United States Patent 11,369,692 (MATERIALS AND METHODS FOR TREATMENT OF DUCHENNE MUSCULAR DYSTROPHY) - sequence listing, part 21

SEQ ID NO: 686173 - DNA, 22 bp, Artificial Sequence
  chemically synthesized
aatgtgtatcacttttgcagca

SEQ ID NO: 686174 - DNA, 22 bp, Artificial Sequence
  chemically synthesized
tttacttgataatgctgcaaaa

SEQ ID NO: 686175 - DNA, 22 bp, Artificial Sequence
  chemically synthesized
ttttacttgataatgctgcaaa

SEQ ID NO: 686176 - DNA, 22 bp, Artificial Sequence
  chemically synthesized
ggatttttttacttgataatgc

SEQ ID NO: 686177 - DNA, 22 bp, Artificial Sequence
  chemically synthesized
aggatttttttacttgataatg

SEQ ID NO: 686178 - DNA, 22 bp, Artificial Sequence
  chemically synthesized
gatttaggatttttttacttga

SEQ ID NO: 686179 - DNA, 22 bp, Artificial Sequence
  chemically synthesized
ttgcagcattatcaagtaaaaa

SEQ ID NO: 686180 - DNA, 22 bp, Artificial Sequence
  chemically synthesized
tgcagcattatcaagtaaaaaa

SEQ ID NO: 686181 - DNA, 22 bp, Artificial Sequence
  chemically synthesized
gcagcattatcaagtaaaaaaa

SEQ ID NO: 686182 - DNA, 22 bp, Artificial Sequence
  chemically synthesized
cagcattatcaagtaaaaaaat

SEQ ID NO: 686183 - DNA, 22 bp, Artificial Sequence
  chemically synthesized
caatggttggatttaggatttt

SEQ ID NO: 686184 - DNA, 22 bp, Artificial Sequence
  chemically synthesized
acaatggttggatttaggattt

SEQ ID NO: 686185 - DNA, 22 bp, Artificial Sequence
  chemically synthesized
tcaagtaaaaaaatcctaaatc

SEQ ID NO: 686186 - DNA, 22 bp, Artificial Sequence
  chemically synthesized
acttacaatggttggatttagg

SEQ ID NO: 686187 - DNA, 22 bp, Artificial Sequence
  chemically synthesized
aatccaaccattgtaagtcagg

SEQ ID NO: 686188 - DNA, 22 bp, Artificial Sequence
  chemically synthesized
tcaatcaaacatagatgatccc

SEQ ID NO: 686189 - DNA, 22 bp, Artificial Sequence
  chemically synthesized
taagtcagggatcatctatgtt

SEQ ID NO: 686190 - DNA, 22 bp, Artificial Sequence
  chemically synthesized
gggcctgtcaatcaaacataga

SEQ ID NO: 686191 - DNA, 22 bp, Artificial Sequence
  chemically synthesized
ctggggcctgtcaatcaaacat

SEQ ID NO: 686192 - DNA, 22 bp, Artificial Sequence
  chemically synthesized
gctggggcctgtcaatcaaaca

SEQ ID NO: 686193 - DNA, 22 bp, Artificial Sequence
  chemically synthesized
cggatgcttgctggggcctgtc

SEQ ID NO: 686194 - DNA, 22 bp, Artificial Sequence
  chemically synthesized
gcggatgcttgctggggcctgt

SEQ ID NO: 686195 - DNA, 22 bp, Artificial Sequence
  chemically synthesized
tgtttgattgacaggccccagc

SEQ ID NO: 686196 - DNA, 22 bp, Artificial Sequence
  chemically synthesized
atttgcggatgcttgctggggc

SEQ ID NO: 686197 - DNA, 22 bp, Artificial Sequence
  chemically synthesized
gattgacaggccccagcaagca

SEQ ID NO: 686198 - DNA, 22 bp, Artificial Sequence
  chemically synthesized
ctcatttgcggatgcttgctgg

SEQ ID NO: 686199 - DNA, 22 bp, Artificial Sequence
  chemically synthesized
attgacaggccccagcaagcat

SEQ ID NO: 686200 - DNA, 22 bp, Artificial Sequence
  chemically synthesized
cctcatttgcggatgcttgctg

SEQ ID NO: 686201 - DNA, 22 bp, Artificial Sequence
  chemically synthesized
tcctcatttgcggatgcttgct

SEQ ID NO: 686202 - DNA, 22 bp, Artificial Sequence
  chemically synthesized
tttcctcatttgcggatgcttg

SEQ ID NO: 686203 - DNA, 22 bp, Artificial Sequence
  chemically synthesized
acaggccccagcaagcatccgc

SEQ ID NO: 686204 - DNA, 22 bp, Artificial Sequence
  chemically synthesized
ttctttcctcatttgcggatgc

SEQ ID NO: 686205 - DNA, 22 bp, Artificial Sequence
  chemically synthesized
tattctttcctcatttgcggat

SEQ ID NO: 686206 - DNA, 22 bp, Artificial Sequence
  chemically synthesized
tctattctttcctcatttgcgg

SEQ ID NO: 686207 - DNA, 22 bp, Artificial Sequence
  chemically synthesized
tctctattctttcctcatttgc

SEQ ID NO: 686208 - DNA, 22 bp, Artificial Sequence
  chemically synthesized
ctctctctattctttcctcatt

SEQ ID NO: 686209 - DNA, 22 bp, Artificial Sequence
  chemically synthesized
tcctctctctattctttcctca

SEQ ID NO: 686210 - DNA, 22 bp, Artificial Sequence
  chemically synthesized
ctcctctctctattctttcctc

SEQ ID NO: 686211 - DNA, 22 bp, Artificial Sequence
  chemically synthesized
tctcctctctctattctttcct

SEQ ID NO: 686212 - DNA, 22 bp, Artificial Sequence
  chemically synthesized
tttctcctctctctattctttc

SEQ ID NO: 686213 - DNA, 22 bp, Artificial Sequence
  chemically synthesized
ctttctcctctctctattcttt

SEQ ID NO: 686214 - DNA, 22 bp, Artificial Sequence
  chemically synthesized
tctttctcctctctctattctt

SEQ ID NO: 686215 - DNA, 22 bp, Artificial Sequence
  chemically synthesized
gtactttctttctcctctctct

SEQ ID NO: 686216 - DNA, 22 bp, Artificial Sequence
  chemically synthesized
atctagtactttctttctcctc

SEQ ID NO: 686217 - DNA, 22 bp, Artificial Sequence
  chemically synthesized
catctagtactttctttctcct

SEQ ID NO: 686218 - DNA, 22 bp, Artificial Sequence
  chemically synthesized
tcttcatctagtactttctttc

SEQ ID NO: 686219 - DNA, 22 bp, Artificial Sequence
  chemically synthesized
gtcttcatctagtactttcttt

SEQ ID NO: 686220 - DNA, 22 bp, Artificial Sequence
  chemically synthesized
tgtcttcatctagtactttctt

SEQ ID NO: 686221 - DNA, 22 bp, Artificial Sequence
  chemically synthesized
tttgtcttcatctagtactttc

SEQ ID NO: 686222 - DNA, 22 bp, Artificial Sequence
  chemically synthesized
tcaccaaggattctttgtcttc

SEQ ID NO: 686223 - DNA, 22 bp, Artificial Sequence
  chemically synthesized
gatgaagacaaagaatccttgg

SEQ ID NO: 686224 - DNA, 22 bp, Artificial Sequence
  chemically synthesized
aagatcctatcaccaaggattc

SEQ ID NO: 686225 - DNA, 22 bp, Artificial Sequence
  chemically synthesized
tctgaagatcctatcaccaagg

SEQ ID NO: 686226 - DNA, 22 bp, Artificial Sequence
  chemically synthesized
tgtctgaagatcctatcaccaa

SEQ ID NO: 686227 - DNA, 22 bp, Artificial Sequence
  chemically synthesized
tctgtctgaagatcctatcacc

SEQ ID NO: 686228 - DNA, 22 bp, Artificial Sequence
  chemically synthesized
gagcctctctgtctgaagatcc

SEQ ID NO: 686229 - DNA, 22 bp, Artificial Sequence
  chemically synthesized
ggtgataggatcttcagacaga

SEQ ID NO: 686230 - DNA, 22 bp, Artificial Sequence
  chemically synthesized
gtgataggatcttcagacagag

SEQ ID NO: 686231 - DNA, 22 bp, Artificial Sequence
  chemically synthesized
aagtccctagagcctctctgtc

SEQ ID NO: 686232 - DNA, 22 bp, Artificial Sequence
  chemically synthesized
caagtccctagagcctctctgt

SEQ ID NO: 686233 - DNA, 22 bp, Artificial Sequence
  chemically synthesized
caggtttcaagtccctagagcc

SEQ ID NO: 686234 - DNA, 22 bp, Artificial Sequence
  chemically synthesized
ccaggtttcaagtccctagagc

SEQ ID NO: 686235 - DNA, 22 bp, Artificial Sequence
  chemically synthesized
cagacagagaggctctagggac

SEQ ID NO: 686236 - DNA, 22 bp, Artificial Sequence
  chemically synthesized
agacagagaggctctagggact

SEQ ID NO: 686237 - DNA, 22 bp, Artificial Sequence
  chemically synthesized
aacttccaggtttcaagtccct

SEQ ID NO: 686238 - DNA, 22 bp, Artificial Sequence
  chemically synthesized
tgctgaacttccaggtttcaag

SEQ ID NO: 686239 - DNA, 22 bp, Artificial Sequence
  chemically synthesized
tagggacttgaaacctggaagt

SEQ ID NO: 686240 - DNA, 22 bp, Artificial Sequence
  chemically synthesized
gggacttgaaacctggaagttc

SEQ ID NO: 686241 - DNA, 22 bp, Artificial Sequence
  chemically synthesized
aatgcctatgctgaacttccag

SEQ ID NO: 686242 - DNA, 22 bp, Artificial Sequence
  chemically synthesized
gaaacctggaagttcagcatag

SEQ ID NO: 686243 - DNA, 22 bp, Artificial Sequence
  chemically synthesized
aaacctggaagttcagcatagg

SEQ ID NO: 686244 - DNA, 22 bp, Artificial Sequence
  chemically synthesized
aacatatactaaatgcctatgc

SEQ ID NO: 686245 - DNA, 22 bp, Artificial Sequence
  chemically synthesized
gaagttcagcataggcatttag

SEQ ID NO: 686246 - DNA, 22 bp, Artificial Sequence
  chemically synthesized
aggctcaacatatactaaatgc

SEQ ID NO: 686247 - DNA, 22 bp, Artificial Sequence
  chemically synthesized
cctaaggctcaacatatactaa

SEQ ID NO: 686248 - DNA, 22 bp, Artificial Sequence
  chemically synthesized
agcataggcatttagtatatgt

SEQ ID NO: 686249 - DNA, 22 bp, Artificial Sequence
  chemically synthesized
ataaatgagttccctaaggctc

SEQ ID NO: 686250 - DNA, 22 bp, Artificial Sequence
  chemically synthesized
agtatatgttgagccttaggga

SEQ ID NO: 686251 - DNA, 22 bp, Artificial Sequence
  chemically synthesized
gtatatgttgagccttagggaa

SEQ ID NO: 686252 - DNA, 22 bp, Artificial Sequence
  chemically synthesized
agccttagggaactcatttatc

SEQ ID NO: 686253 - DNA, 22 bp, Artificial Sequence
  chemically synthesized
agggaactcatttatcaatttg

SEQ ID NO: 686254 - DNA, 22 bp, Artificial Sequence
  chemically synthesized
gggaactcatttatcaatttga

SEQ ID NO: 686255 - DNA, 22 bp, Artificial Sequence
  chemically synthesized
atttatcaatttgatatcactc

SEQ ID NO: 686256 - DNA, 22 bp, Artificial Sequence
  chemically synthesized
atcaatttgatatcactccttt

SEQ ID NO: 686257 - DNA, 22 bp, Artificial Sequence
  chemically synthesized
tcaatttgatatcactcctttg

SEQ ID NO: 686258 - DNA, 22 bp, Artificial Sequence
  chemically synthesized
accatggcagtgatacaaagga

SEQ ID NO: 686259 - DNA, 22 bp, Artificial Sequence
  chemically synthesized
gatatcactcctttgtatcact

SEQ ID NO: 686260 - DNA, 22 bp, Artificial Sequence
  chemically synthesized
atatcactcctttgtatcactg

SEQ ID NO: 686261 - DNA, 22 bp, Artificial Sequence
  chemically synthesized
atcattcaccatggcagtgata

SEQ ID NO: 686262 - DNA, 22 bp, Artificial Sequence
  chemically synthesized
tgatcattcaccatggcagtga

SEQ ID NO: 686263 - DNA, 22 bp, Artificial Sequence
  chemically synthesized
ctgatcattcaccatggcagtg

SEQ ID NO: 686264 - DNA, 22 bp, Artificial Sequence
  chemically synthesized
tctgatcattcaccatggcagt

SEQ ID NO: 686265 - DNA, 22 bp, Artificial Sequence
  chemically synthesized
ctttgtatcactgccatggtga

SEQ ID NO: 686266 - DNA, 22 bp, Artificial Sequence
  chemically synthesized
ctttctgatcattcaccatggc

SEQ ID NO: 686267 - DNA, 22 bp, Artificial Sequence
  chemically synthesized
cctttctgatcattcaccatgg

SEQ ID NO: 686268 - DNA, 22 bp, Artificial Sequence
  chemically synthesized
tgtatcactgccatggtgaatg

SEQ ID NO: 686269 - DNA, 22 bp, Artificial Sequence
  chemically synthesized
gtatcactgccatggtgaatga

SEQ ID NO: 686270 - DNA, 22 bp, Artificial Sequence
  chemically synthesized
tatcactgccatggtgaatgat

SEQ ID NO: 686271 - DNA, 22 bp, Artificial Sequence
  chemically synthesized
tgtttcctttctgatcattcac

SEQ ID NO: 686272 - DNA, 22 bp, Artificial Sequence
  chemically synthesized
gtgtttcctttctgatcattca

SEQ ID NO: 686273 - DNA, 22 bp, Artificial Sequence
  chemically synthesized
ccatggtgaatgatcagaaagg

SEQ ID NO: 686274 - DNA, 22 bp, Artificial Sequence
  chemically synthesized
aagaaggagtttgtgtttcctt

SEQ ID NO: 686275 - DNA, 22 bp, Artificial Sequence
  chemically synthesized
aaagaaggagtttgtgtttcct

SEQ ID NO: 686276 - DNA, 22 bp, Artificial Sequence
  chemically synthesized
ttaaagaaggagtttgtgtttc

SEQ ID NO: 686277 - DNA, 22 bp, Artificial Sequence
  chemically synthesized
cagttcttaaagaaggagtttg

SEQ ID NO: 686278 - DNA, 22 bp, Artificial Sequence
  chemically synthesized
ttgcagttcttaaagaaggagt

SEQ ID NO: 686279 - DNA, 22 bp, Artificial Sequence
  chemically synthesized
gttattgcagttcttaaagaag

SEQ ID NO: 686280 - DNA, 22 bp, Artificial Sequence
  chemically synthesized
cttctttaagaactgcaataac

SEQ ID NO: 686281 - DNA, 22 bp, Artificial Sequence
  chemically synthesized
ctttaagaactgcaataacgaa

SEQ ID NO: 686282 - DNA, 22 bp, Artificial Sequence
  chemically synthesized
tttaagaactgcaataacgaac

SEQ ID NO: 686283 - DNA, 22 bp, Artificial Sequence
  chemically synthesized
taagaactgcaataacgaactg

SEQ ID NO: 686284 - DNA, 22 bp, Artificial Sequence
  chemically synthesized
aagaactgcaataacgaactgt

SEQ ID NO: 686285 - DNA, 22 bp, Artificial Sequence
  chemically synthesized
agaactgcaataacgaactgtt

SEQ ID NO: 686286 - DNA, 22 bp, Artificial Sequence
  chemically synthesized
caataacgaactgtttcttctt

SEQ ID NO: 686287 - DNA, 22 bp, Artificial Sequence
  chemically synthesized
tttcttcttcttcttcttcttc

SEQ ID NO: 686288 - DNA, 22 bp, Artificial Sequence
  chemically synthesized
cttcttcttcttcttcttcttc

SEQ ID NO: 686289 - DNA, 22 bp, Artificial Sequence
  chemically synthesized
ttcttcttcttcttcttcttct

SEQ ID NO: 686290 - DNA, 22 bp, Artificial Sequence
  chemically synthesized
cttcttcttcttcttcttcttc

SEQ ID NO: 686291 - DNA, 22 bp, Artificial Sequence
  chemically synthesized
ttcttcttcttcttcttcttct

SEQ ID NO: 686292 - DNA, 22 bp, Artificial Sequence
  chemically synthesized
cttcttcttcttcttcttcttc

SEQ ID NO: 686293 - DNA, 22 bp, Artificial Sequence
  chemically synthesized
ttcttcttcttcttcttcttct

SEQ ID NO: 686294 - DNA, 22 bp, Artificial Sequence
  chemically synthesized
cttcttcttcttcttcttcttc

SEQ ID NO: 686295 - DNA, 22 bp, Artificial Sequence
  chemically synthesized
ttcttcttcttcttcttcttct

SEQ ID NO: 686296 - DNA, 22 bp, Artificial Sequence
  chemically synthesized
cttcttcttcttcttcttcttc

SEQ ID NO: 686297 - DNA, 22 bp, Artificial Sequence
  chemically synthesized
ttcttcttcttcttcttcttct

SEQ ID NO: 686298 - DNA, 22 bp, Artificial Sequence
  chemically synthesized
cttcttcttcttcttcttcttc

SEQ ID NO: 686299 - DNA, 22 bp, Artificial Sequence
  chemically synthesized
ttcttcttcttcttcttcttct

SEQ ID NO: 686300 - DNA, 22 bp, Artificial Sequence
  chemically synthesized
cttcttcttcttcttcttcttc

SEQ ID NO: 686301 - DNA, 22 bp, Artificial Sequence
  chemically synthesized
ttcttcttcttcttcttcttct

SEQ ID NO: 686302 - DNA, 22 bp, Artificial Sequence
  chemically synthesized
cttcttcttcttcttcttcttc

SEQ ID NO: 686303 - DNA, 22 bp, Artificial Sequence
  chemically synthesized
ttcttcttcttcttcttcttct

SEQ ID NO: 686304 - DNA, 22 bp, Artificial Sequence
  chemically synthesized
ccaaaaaaaagaagaagaagaa

SEQ ID NO: 686305 - DNA, 22 bp, Artificial Sequence
  chemically synthesized
cttcttcttcttcttcttcttc

SEQ ID NO: 686306 - DNA, 22 bp, Artificial Sequence
  chemically synthesized
tgccaaaaaaaagaagaagaag

SEQ ID NO: 686307 - DNA, 22 bp, Artificial Sequence
  chemically synthesized
ttcttcttcttcttcttcttct

SEQ ID NO: 686308 - DNA, 22 bp, Artificial Sequence
  chemically synthesized
cttcttcttcttcttcttcttt

SEQ ID NO: 686309 - DNA, 22 bp, Artificial Sequence
  chemically synthesized
ttcttcttcttcttcttctttt

SEQ ID NO: 686310 - DNA, 22 bp, Artificial Sequence
  chemically synthesized
cttcttcttcttcttctttttt

SEQ ID NO: 686311 - DNA, 22 bp, Artificial Sequence
  chemically synthesized
ttcttcttcttcttcttttttt

SEQ ID NO: 686312 - DNA, 22 bp, Artificial Sequence
  chemically synthesized
cttcttcttcttcttttttttg

SEQ ID NO: 686313 - DNA, 22 bp, Artificial Sequence
  chemically synthesized
ttcttcttcttcttttttttgg

SEQ ID NO: 686314 - DNA, 22 bp, Artificial Sequence
  chemically synthesized
cttcttcttcttttttttggca

SEQ ID NO: 686315 - DNA, 22 bp, Artificial Sequence
  chemically synthesized
ttcttcttcttttttttggcag

SEQ ID NO: 686316 - DNA, 22 bp, Artificial Sequence
  chemically synthesized
cttcttcttttttttggcagag

SEQ ID NO: 686317 - DNA, 22 bp, Artificial Sequence
  chemically synthesized
ttcttcttttttttggcagagg

SEQ ID NO: 686318 - DNA, 22 bp, Artificial Sequence
  chemically synthesized
cttcttttttttggcagaggtg

SEQ ID NO: 686319 - DNA, 22 bp, Artificial Sequence
  chemically synthesized
ttcttttttttggcagaggtgg

SEQ ID NO: 686320 - DNA, 22 bp, Artificial Sequence
  chemically synthesized
cttttttttggcagaggtgggg

SEQ ID NO: 686321 - DNA, 22 bp, Artificial Sequence
  chemically synthesized
ttttttttggcagaggtggggt

SEQ ID NO: 686322 - DNA, 22 bp, Artificial Sequence
  chemically synthesized
ttttttggcagaggtggggtgt

SEQ ID NO: 686323 - DNA, 22 bp, Artificial Sequence
  chemically synthesized
tttttggcagaggtggggtgtc

SEQ ID NO: 686324 - DNA, 22 bp, Artificial Sequence
  chemically synthesized
ttttggcagaggtggggtgtct

SEQ ID NO: 686325 - DNA, 22 bp, Artificial Sequence
  chemically synthesized
gtcaaggtagcgagacacccca

SEQ ID NO: 686326 - DNA, 22 bp, Artificial Sequence
  chemically synthesized
tttggcagaggtggggtgtctc

SEQ ID NO: 686327 - DNA, 22 bp, Artificial Sequence
  chemically synthesized
ttggcagaggtggggtgtctcg

SEQ ID NO: 686328 - DNA, 22 bp, Artificial Sequence
  chemically synthesized
tggcagaggtggggtgtctcgc

SEQ ID NO: 686329 - DNA, 22 bp, Artificial Sequence
  chemically synthesized
ggcagaggtggggtgtctcgct

SEQ ID NO: 686330 - DNA, 22 bp, Artificial Sequence
  chemically synthesized
cctagtcaaggtagcgagacac

SEQ ID NO: 686331 - DNA, 22 bp, Artificial Sequence
  chemically synthesized
gcagaggtggggtgtctcgcta

SEQ ID NO: 686332 - DNA, 22 bp, Artificial Sequence
  chemically synthesized
aagacctgcctagtcaaggtag

SEQ ID NO: 686333 - DNA, 22 bp, Artificial Sequence
  chemically synthesized
gctaccttgactaggcaggtct

SEQ ID NO: 686334 - DNA, 22 bp, Artificial Sequence
  chemically synthesized
aggccagcagttcaagacctgc

SEQ ID NO: 686335 - DNA, 22 bp, Artificial Sequence
  chemically synthesized
gaggccagcagttcaagacctg

SEQ ID NO: 686336 - DNA, 22 bp, Artificial Sequence
  chemically synthesized
ccttgactaggcaggtcttgaa

SEQ ID NO: 686337 - DNA, 22 bp, Artificial Sequence
  chemically synthesized
cttgaggccagcagttcaagac

SEQ ID NO: 686338 - DNA, 22 bp, Artificial Sequence
  chemically synthesized
gactaggcaggtcttgaactgc

SEQ ID NO: 686339 - DNA, 22 bp, Artificial Sequence
  chemically synthesized
actaggcaggtcttgaactgct

SEQ ID NO: 686340 - DNA, 22 bp, Artificial Sequence
  chemically synthesized
ggcaggtcttgaactgctggcc

SEQ ID NO: 686341 - DNA, 22 bp, Artificial Sequence
  chemically synthesized
aggtgggagcattgcttgaggc

SEQ ID NO: 686342 - DNA, 22 bp, Artificial Sequence
  chemically synthesized
gaactgctggcctcaagcaatg

SEQ ID NO: 686343 - DNA, 22 bp, Artificial Sequence
  chemically synthesized
aactgctggcctcaagcaatgc

SEQ ID NO: 686344 - DNA, 22 bp, Artificial Sequence
  chemically synthesized
ggaggctgaggtgggagcattg

SEQ ID NO: 686345 - DNA, 22 bp, Artificial Sequence
  chemically synthesized
ctggcctcaagcaatgctccca

SEQ ID NO: 686346 - DNA, 22 bp, Artificial Sequence
  chemically synthesized
gggaggctgaggtgggagcatt

SEQ ID NO: 686347 - DNA, 22 bp, Artificial Sequence
  chemically synthesized
tgggaggctgaggtgggagcat

SEQ ID NO: 686348 - DNA, 22 bp, Artificial Sequence
  chemically synthesized
gcctcaagcaatgctcccacct

SEQ ID NO: 686349 - DNA, 22 bp, Artificial Sequence
  chemically synthesized
aagcaatgctcccacctcagcc

SEQ ID NO: 686350 - DNA, 22 bp, Artificial Sequence
  chemically synthesized
tccgaacactttgggaggctga

SEQ ID NO: 686351 - DNA, 22 bp, Artificial Sequence
  chemically synthesized
ccacctcagcctcccaaagtgt

SEQ ID NO: 686352 - DNA, 22 bp, Artificial Sequence
  chemically synthesized
atgccggttatccgaacacttt

SEQ ID NO: 686353 - DNA, 22 bp, Artificial Sequence
  chemically synthesized
agcctcccaaagtgttcggata

SEQ ID NO: 686354 - DNA, 22 bp, Artificial Sequence
  chemically synthesized
ccaaagtgttcggataaccggc

SEQ ID NO: 686355 - DNA, 22 bp, Artificial Sequence
  chemically synthesized
gccagaggaggtggctaatgcc

SEQ ID NO: 686356 - DNA, 22 bp, Artificial Sequence
  chemically synthesized
ggccagaggaggtggctaatgc

SEQ ID NO: 686357 - DNA, 22 bp, Artificial Sequence
  chemically synthesized
ttggccagaggaggtggctaat

SEQ ID NO: 686358 - DNA, 22 bp, Artificial Sequence
  chemically synthesized
ggataaccggcattagccacct

SEQ ID NO: 686359 - DNA, 22 bp, Artificial Sequence
  chemically synthesized
gccacctcctctggccaagaac

SEQ ID NO: 686360 - DNA, 22 bp, Artificial Sequence
  chemically synthesized
atcaaaagaaacagttcttggc

SEQ ID NO: 686361 - DNA, 22 bp, Artificial Sequence
  chemically synthesized
aatcaaaagaaacagttcttgg

SEQ ID NO: 686362 - DNA, 22 bp, Artificial Sequence
  chemically synthesized
ctctggccaagaactgtttctt

SEQ ID NO: 686363 - DNA, 22 bp, Artificial Sequence
  chemically synthesized
tggccaagaactgtttcttttg

SEQ ID NO: 686364 - DNA, 22 bp, Artificial Sequence
  chemically synthesized
gccaagaactgtttcttttgat

SEQ ID NO: 686365 - DNA, 22 bp, Artificial Sequence
  chemically synthesized
gagtaggaagaacaaaatttaa

SEQ ID NO: 686366 - DNA, 22 bp, Artificial Sequence
  chemically synthesized
tttcttttgattaaattttgtt

SEQ ID NO: 686367 - DNA, 22 bp, Artificial Sequence
  chemically synthesized
cttttgattaaattttgttctt

SEQ ID NO: 686368 - DNA, 22 bp, Artificial Sequence
  chemically synthesized
ttttgattaaattttgttcttc

SEQ ID NO: 686369 - DNA, 22 bp, Artificial Sequence
  chemically synthesized
ttgattaaattttgttcttcct

SEQ ID NO: 686370 - DNA, 22 bp, Artificial Sequence
  chemically synthesized
tgattaaattttgttcttccta

SEQ ID NO: 686371 - DNA, 22 bp, Artificial Sequence
  chemically synthesized
gattaaattttgttcttcctac

SEQ ID NO: 686372 - DNA, 22 bp, Artificial Sequence
  chemically synthesized
aggaaagttggagtaggaagaa

SEQ ID NO: 686373 - DNA, 22 bp, Artificial Sequence
  chemically synthesized
attaaattttgttcttcctact

SEQ ID NO: 686374 - DNA, 22 bp, Artificial Sequence
  chemically synthesized
aaggaaagttggagtaggaaga

SEQ ID NO: 686375 - DNA, 22 bp, Artificial Sequence
  chemically synthesized
taaggaaagttggagtaggaag

SEQ ID NO: 686376 - DNA, 22 bp, Artificial Sequence
  chemically synthesized
aattttgttcttcctactccaa

SEQ ID NO: 686377 - DNA, 22 bp, Artificial Sequence
  chemically synthesized
tctttaaggaaagttggagtag

SEQ ID NO: 686378 - DNA, 22 bp, Artificial Sequence
  chemically synthesized
tgttcttcctactccaactttc

SEQ ID NO: 686379 - DNA, 22 bp, Artificial Sequence
  chemically synthesized
gttcttcctactccaactttcc

SEQ ID NO: 686380 - DNA, 22 bp, Artificial Sequence
  chemically synthesized
ttcttcctactccaactttcct

SEQ ID NO: 686381 - DNA, 22 bp, Artificial Sequence
  chemically synthesized
ttcctactccaactttccttaa

SEQ ID NO: 686382 - DNA, 22 bp, Artificial Sequence
  chemically synthesized
cctactccaactttccttaaag

SEQ ID NO: 686383 - DNA, 22 bp, Artificial Sequence
  chemically synthesized
aggaagcattatctttaaggaa

SEQ ID NO: 686384 - DNA, 22 bp, Artificial Sequence
  chemically synthesized
ctactccaactttccttaaaga

SEQ ID NO: 686385 - DNA, 22 bp, Artificial Sequence
  chemically synthesized
aaggaagcattatctttaagga

SEQ ID NO: 686386 - DNA, 22 bp, Artificial Sequence
  chemically synthesized
taaggaagcattatctttaagg

SEQ ID NO: 686387 - DNA, 22 bp, Artificial Sequence
  chemically synthesized
ctccaactttccttaaagataa

SEQ ID NO: 686388 - DNA, 22 bp, Artificial Sequence
  chemically synthesized
tctttaaggaagcattatcttt

SEQ ID NO: 686389 - DNA, 22 bp, Artificial Sequence
  chemically synthesized
caactttccttaaagataatgc

SEQ ID NO: 686390 - DNA, 22 bp, Artificial Sequence
  chemically synthesized
atctttaaggaagcattatctt

SEQ ID NO: 686391 - DNA, 22 bp, Artificial Sequence
  chemically synthesized
gatttatctttaaggaagcatt

SEQ ID NO: 686392 - DNA, 22 bp, Artificial Sequence
  chemically synthesized
tccttaaagataatgcttcctt

SEQ ID NO: 686393 - DNA, 22 bp, Artificial Sequence
  chemically synthesized
ccttaaagataatgcttcctta

SEQ ID NO: 686394 - DNA, 22 bp, Artificial Sequence
  chemically synthesized
cttaaagataatgcttccttaa

SEQ ID NO: 686395 - DNA, 22 bp, Artificial Sequence
  chemically synthesized
aaagataatgcttccttaaaga

SEQ ID NO: 686396 - DNA, 22 bp, Artificial Sequence
  chemically synthesized
aagataatgcttccttaaagat

SEQ ID NO: 686397 - DNA, 22 bp, Artificial Sequence
  chemically synthesized
agccattagatttatctttaag

SEQ ID NO: 686398 - DNA, 22 bp, Artificial Sequence
  chemically synthesized
aagccattagatttatctttaa

SEQ ID NO: 686399 - DNA, 22 bp, Artificial Sequence
  chemically synthesized
ccttaaagataaatctaatggc

SEQ ID NO: 686400 - DNA, 22 bp, Artificial Sequence
  chemically synthesized
cttaaagataaatctaatggct

SEQ ID NO: 686401 - DNA, 22 bp, Artificial Sequence
  chemically synthesized
aaagataaatctaatggcttaa

SEQ ID NO: 686402 - DNA, 22 bp, Artificial Sequence
  chemically synthesized
aagataaatctaatggcttaaa

SEQ ID NO: 686403 - DNA, 22 bp, Artificial Sequence
  chemically synthesized
atggcttaaacacacacacaca

SEQ ID NO: 686404 - DNA, 22 bp, Artificial Sequence
  chemically synthesized
aaacacacacacacacacacac

SEQ ID NO: 686405 - DNA, 22 bp, Artificial Sequence
  chemically synthesized
aacacacacacacacacacaca

SEQ ID NO: 686406 - DNA, 22 bp, Artificial Sequence
  chemically synthesized
cgtgtgtgggtgtgggtgtgtg

SEQ ID NO: 686407 - DNA, 22 bp, Artificial Sequence
  chemically synthesized
gcgtgtgtgggtgtgggtgtgt

SEQ ID NO: 686408 - DNA, 22 bp, Artificial Sequence
  chemically synthesized
tgcgtgtgtgggtgtgggtgtg

SEQ ID NO: 686409 - DNA, 22 bp, Artificial Sequence
  chemically synthesized
ttttttatcactctcctcctgt

SEQ ID NO: 686410 - DNA, 22 bp, Artificial Sequence
  chemically synthesized
ttttatcactctcctcctgtcc

SEQ ID NO: 686411 - DNA, 22 bp, Artificial Sequence
  chemically synthesized
tttatcactctcctcctgtccc

SEQ ID NO: 686412 - DNA, 22 bp, Artificial Sequence
  chemically synthesized
ttatcactctcctcctgtccct

SEQ ID NO: 686413 - DNA, 22 bp, Artificial Sequence
  chemically synthesized
tatcactctcctcctgtccctc

SEQ ID NO: 686414 - DNA, 22 bp, Artificial Sequence
  chemically synthesized
atcactctcctcctgtccctct

SEQ ID NO: 686415 - DNA, 22 bp, Artificial Sequence
  chemically synthesized
tcactctcctcctgtccctctt

SEQ ID NO: 686416 - DNA, 22 bp, Artificial Sequence
  chemically synthesized
caaagcaaggtgtaagagggac

SEQ ID NO: 686417 - DNA, 22 bp, Artificial Sequence
  chemically synthesized
tcctcctgtccctcttacacct

SEQ ID NO: 686418 - DNA, 22 bp, Artificial Sequence
  chemically synthesized
ctcctgtccctcttacaccttg

SEQ ID NO: 686419 - DNA, 22 bp, Artificial Sequence
  chemically synthesized
ctgtccctcttacaccttgctt

SEQ ID NO: 686420 - DNA, 22 bp, Artificial Sequence
  chemically synthesized
tccctcttacaccttgctttgg

SEQ ID NO: 686421 - DNA, 22 bp, Artificial Sequence
  chemically synthesized
ttacaccttgctttggaactga

SEQ ID NO: 686422 - DNA, 22 bp, Artificial Sequence
  chemically synthesized
acaccttgctttggaactgact

SEQ ID NO: 686423 - DNA, 22 bp, Artificial Sequence
  chemically synthesized
caccttgctttggaactgactg

SEQ ID NO: 686424 - DNA, 22 bp, Artificial Sequence
  chemically synthesized
gagatgcaaggcaccagtcagt

SEQ ID NO: 686425 - DNA, 22 bp, Artificial Sequence
  chemically synthesized
gctttggaactgactggtgcct

SEQ ID NO: 686426 - DNA, 22 bp, Artificial Sequence
  chemically synthesized
ctttggaactgactggtgcctt

SEQ ID NO: 686427 - DNA, 22 bp, Artificial Sequence
  chemically synthesized
tggaactgactggtgccttgca

SEQ ID NO: 686428 - DNA, 22 bp, Artificial Sequence
  chemically synthesized
ggaactgactggtgccttgcat

SEQ ID NO: 686429 - DNA, 22 bp, Artificial Sequence
  chemically synthesized
gaactgactggtgccttgcatc

SEQ ID NO: 686430 - DNA, 22 bp, Artificial Sequence
  chemically synthesized
actggtgccttgcatctccagt

SEQ ID NO: 686431 - DNA, 22 bp, Artificial Sequence
  chemically synthesized
gtgccttgcatctccagtcatt

SEQ ID NO: 686432 - DNA, 22 bp, Artificial Sequence
  chemically synthesized
cacgatgtgtgataaatgactg

SEQ ID NO: 686433 - DNA, 22 bp, Artificial Sequence
  chemically synthesized
gcatctccagtcatttatcaca

SEQ ID NO: 686434 - DNA, 22 bp, Artificial Sequence
  chemically synthesized
catctccagtcatttatcacac

SEQ ID NO: 686435 - DNA, 22 bp, Artificial Sequence
  chemically synthesized
ggtctacacgatgtgtgataaa

SEQ ID NO: 686436 - DNA, 22 bp, Artificial Sequence
  chemically synthesized
cagtcatttatcacacatcgtg

SEQ ID NO: 686437 - DNA, 22 bp, Artificial Sequence
  chemically synthesized
atatcgaaaatctcggtctaca

SEQ ID NO: 686438 - DNA, 22 bp, Artificial Sequence
  chemically synthesized
atcacacatcgtgtagaccgag

SEQ ID NO: 686439 - DNA, 22 bp, Artificial Sequence
  chemically synthesized
aatatcgaaaatctcggtctac

SEQ ID NO: 686440 - DNA, 22 bp, Artificial Sequence
  chemically synthesized
tcacacatcgtgtagaccgaga

SEQ ID NO: 686441 - DNA, 22 bp, Artificial Sequence
  chemically synthesized
taatatcgaaaatctcggtcta

SEQ ID NO: 686442 - DNA, 22 bp, Artificial Sequence
  chemically synthesized
aatgttttaatatcgaaaatct

SEQ ID NO: 686443 - DNA, 22 bp, Artificial Sequence
  chemically synthesized
gcagactgaatgttttaatatc

SEQ ID NO: 686444 - DNA, 22 bp, Artificial Sequence
  chemically synthesized
cgtacattggcagactgaatgt

SEQ ID NO: 686445 - DNA, 22 bp, Artificial Sequence
  chemically synthesized
tcgatattaaaacattcagtct

SEQ ID NO: 686446 - DNA, 22 bp, Artificial Sequence
  chemically synthesized
cgatattaaaacattcagtctg

SEQ ID NO: 686447 - DNA, 22 bp, Artificial Sequence
  chemically synthesized
gatattaaaacattcagtctgc

SEQ ID NO: 686448 - DNA, 22 bp, Artificial Sequence
  chemically synthesized
ctacgtacattggcagactgaa

SEQ ID NO: 686449 - DNA, 22 bp, Artificial Sequence
  chemically synthesized
cctacgtacattggcagactga

SEQ ID NO: 686450 - DNA, 22 bp, Artificial Sequence
  chemically synthesized
aaacattcagtctgccaatgta

SEQ ID NO: 686451 - DNA, 22 bp, Artificial Sequence
  chemically synthesized
agggtgcttcctacgtacattg

SEQ ID NO: 686452 - DNA, 22 bp, Artificial Sequence
  chemically synthesized
agtctgccaatgtacgtaggaa

SEQ ID NO: 686453 - DNA, 22 bp, Artificial Sequence
  chemically synthesized
aagacattgagggtgcttccta

SEQ ID NO: 686454 - DNA, 22 bp, Artificial Sequence
  chemically synthesized
aaagacattgagggtgcttcct

SEQ ID NO: 686455 - DNA, 22 bp, Artificial Sequence
  chemically synthesized
ccaatgtacgtaggaagcaccc

SEQ ID NO: 686456 - DNA, 22 bp, Artificial Sequence
  chemically synthesized
taaagacattgagggtgcttcc

SEQ ID NO: 686457 - DNA, 22 bp, Artificial Sequence
  chemically synthesized
agaatagcattttaaagacatt

SEQ ID NO: 686458 - DNA, 22 bp, Artificial Sequence
  chemically synthesized
cagaatagcattttaaagacat

SEQ ID NO: 686459 - DNA, 22 bp, Artificial Sequence
  chemically synthesized
aatgtttcagaatagcatttta

SEQ ID NO: 686460 - DNA, 22 bp, Artificial Sequence
  chemically synthesized
aaatgtttcagaatagcatttt

SEQ ID NO: 686461 - DNA, 22 bp, Artificial Sequence
  chemically synthesized
taaatgtttcagaatagcattt

SEQ ID NO: 686462 - DNA, 22 bp, Artificial Sequence
  chemically synthesized
aatgtctttaaaatgctattct

SEQ ID NO: 686463 - DNA, 22 bp, Artificial Sequence
  chemically synthesized
tttaaatgtttcagaatagcat

SEQ ID NO: 686464 - DNA, 22 bp, Artificial Sequence
  chemically synthesized
taaaatgctattctgaaacatt

SEQ ID NO: 686465 - DNA, 22 bp, Artificial Sequence
  chemically synthesized
aaaatgctattctgaaacattt

SEQ ID NO: 686466 - DNA, 22 bp, Artificial Sequence
  chemically synthesized
aaatgctattctgaaacattta

SEQ ID NO: 686467 - DNA, 22 bp, Artificial Sequence
  chemically synthesized
cagatggccctctttaaatgtt

SEQ ID NO: 686468 - DNA, 22 bp, Artificial Sequence
  chemically synthesized
ttgcagatggccctctttaaat

SEQ ID NO: 686469 - DNA, 22 bp, Artificial Sequence
  chemically synthesized
attgcagatggccctctttaaa

SEQ ID NO: 686470 - DNA, 22 bp, Artificial Sequence
  chemically synthesized
ttctgaaacatttaaagagggc

SEQ ID NO: 686471 - DNA, 22 bp, Artificial Sequence
  chemically synthesized
ttattgcagatggccctcttta

SEQ ID NO: 686472 - DNA, 22 bp, Artificial Sequence
  chemically synthesized
tgaaacatttaaagagggccat

SEQ ID NO: 686473 - DNA, 22 bp, Artificial Sequence
  chemically synthesized
aaacatttaaagagggccatct

SEQ ID NO: 686474 - DNA, 22 bp, Artificial Sequence
  chemically synthesized
atgatcattcttattgcagatg

SEQ ID NO: 686475 - DNA, 22 bp, Artificial Sequence
  chemically synthesized
aaagagggccatctgcaataag

SEQ ID NO: 686476 - DNA, 22 bp, Artificial Sequence
  chemically synthesized
aagagggccatctgcaataaga

SEQ ID NO: 686477 - DNA, 22 bp, Artificial Sequence
  chemically synthesized
tcatcatctaatgatcattctt

SEQ ID NO: 686478 - DNA, 22 bp, Artificial Sequence
  chemically synthesized
atcatcatctaatgatcattct

SEQ ID NO: 686479 - DNA, 22 bp, Artificial Sequence
  chemically synthesized
tttatcatcatctaatgatcat

SEQ ID NO: 686480 - DNA, 22 bp, Artificial Sequence
  chemically synthesized
caataagaatgatcattagatg

SEQ ID NO: 686481 - DNA, 22 bp, Artificial Sequence
  chemically synthesized
tgacccagtactgtttatcatc

SEQ ID NO: 686482 - DNA, 22 bp, Artificial Sequence
  chemically synthesized
catctgtgacccagtactgttt

SEQ ID NO: 686483 - DNA, 22 bp, Artificial Sequence
  chemically synthesized
tccatctgtgacccagtactgt

SEQ ID NO: 686484 - DNA, 22 bp, Artificial Sequence
  chemically synthesized
gatgatgataaacagtactggg

SEQ ID NO: 686485 - DNA, 22 bp, Artificial Sequence
  chemically synthesized
ctccatctgtgacccagtactg

SEQ ID NO: 686486 - DNA, 22 bp, Artificial Sequence
  chemically synthesized
tctccatctgtgacccagtact

SEQ ID NO: 686487 - DNA, 22 bp, Artificial Sequence
  chemically synthesized
ctttctccatctgtgacccagt

SEQ ID NO: 686488 - DNA, 22 bp, Artificial Sequence
  chemically synthesized
ttactttctccatctgtgaccc

SEQ ID NO: 686489 - DNA, 22 bp, Artificial Sequence
  chemically synthesized
aaatactattactttctccatc

SEQ ID NO: 686490 - DNA, 22 bp, Artificial Sequence
  chemically synthesized
tcaaatactattactttctcca

SEQ ID NO: 686491 - DNA, 22 bp, Artificial Sequence
  chemically synthesized
ggtcacagatggagaaagtaat

SEQ ID NO: 686492 - DNA, 22 bp, Artificial Sequence
  chemically synthesized
acatgaaaatggctctcaaata

SEQ ID NO: 686493 - DNA, 22 bp, Artificial Sequence
  chemically synthesized
taacattaacatgaaaatggct

SEQ ID NO: 686494 - DNA, 22 bp, Artificial Sequence
  chemically synthesized
gagagccattttcatgttaatg

SEQ ID NO: 686495 - DNA, 22 bp, Artificial Sequence
  chemically synthesized
agagccattttcatgttaatgt

SEQ ID NO: 686496 - DNA, 22 bp, Artificial Sequence
  chemically synthesized
atatgtaatctataacattaac

SEQ ID NO: 686497 - DNA, 22 bp, Artificial Sequence
  chemically synthesized
aatatgtaatctataacattaa

SEQ ID NO: 686498 - DNA, 22 bp, Artificial Sequence
  chemically synthesized
taatatgtaatctataacatta

SEQ ID NO: 686499 - DNA, 22 bp, Artificial Sequence
  chemically synthesized
tttaatatgtaatctataacat

SEQ ID NO: 686500 - DNA, 22 bp, Artificial Sequence
  chemically synthesized
ctttaatatgtaatctataaca

SEQ ID NO: 686501 - DNA, 22 bp, Artificial Sequence
  chemically synthesized
tcatgttaatgttatagattac

SEQ ID NO: 686502 - DNA, 22 bp, Artificial Sequence
  chemically synthesized
catgttaatgttatagattaca

SEQ ID NO: 686503 - DNA, 22 bp, Artificial Sequence
  chemically synthesized
atgttaatgttatagattacat

SEQ ID NO: 686504 - DNA, 22 bp, Artificial Sequence
  chemically synthesized
gcacatttctttaatatgtaat

SEQ ID NO: 686505 - DNA, 22 bp, Artificial Sequence
  chemically synthesized
atgttatagattacatattaaa

SEQ ID NO: 686506 - DNA, 22 bp, Artificial Sequence
  chemically synthesized
ctggcacatttctttaatatgt

SEQ ID NO: 686507 - DNA, 22 bp, Artificial Sequence
  chemically synthesized
attactggcacatttctttaat

SEQ ID NO: 686508 - DNA, 22 bp, Artificial Sequence
  chemically synthesized
cattactggcacatttctttaa

SEQ ID NO: 686509 - DNA, 22 bp, Artificial Sequence
  chemically synthesized
tagattacatattaaagaaatg

SEQ ID NO: 686510 - DNA, 22 bp, Artificial Sequence
  chemically synthesized
cttcattactggcacatttctt

SEQ ID NO: 686511 - DNA, 22 bp, Artificial Sequence
  chemically synthesized
gcttcattactggcacatttct

SEQ ID NO: 686512 - DNA, 22 bp, Artificial Sequence
  chemically synthesized
tttgcttcattactggcacatt

SEQ ID NO: 686513 - DNA, 22 bp, Artificial Sequence
  chemically synthesized
catattaaagaaatgtgccagt

SEQ ID NO: 686514 - DNA, 22 bp, Artificial Sequence
  chemically synthesized
ttgtttgcttcattactggcac

SEQ ID NO: 686515 - DNA, 22 bp, Artificial Sequence
  chemically synthesized
gttgtttgcttcattactggca

SEQ ID NO: 686516 - DNA, 22 bp, Artificial Sequence
  chemically synthesized
tgttgtttgcttcattactggc

SEQ ID NO: 686517 - DNA, 22 bp, Artificial Sequence
  chemically synthesized
tttgttgtttgcttcattactg

SEQ ID NO: 686518 - DNA, 22 bp, Artificial Sequence
  chemically synthesized
aagaaatgtgccagtaatgaag

SEQ ID NO: 686519 - DNA, 22 bp, Artificial Sequence
  chemically synthesized
caatggccctctttgttgtttg

SEQ ID NO: 686520 - DNA, 22 bp, Artificial Sequence
  chemically synthesized
tccaatggccctctttgttgtt

SEQ ID NO: 686521 - DNA, 22 bp, Artificial Sequence
  chemically synthesized
ctccaatggccctctttgttgt

SEQ ID NO: 686522 - DNA, 22 bp, Artificial Sequence
  chemically synthesized
ttctccaatggccctctttgtt

SEQ ID NO: 686523 - DNA, 22 bp, Artificial Sequence
  chemically synthesized
ttcttctccaatggccctcttt

SEQ ID NO: 686524 - DNA, 22 bp, Artificial Sequence
  chemically synthesized
aatagcataactgttcttctcc

SEQ ID NO: 686525 - DNA, 22 bp, Artificial Sequence
  chemically synthesized
caatagcataactgttcttctc

SEQ ID NO: 686526 - DNA, 22 bp, Artificial Sequence
  chemically synthesized
tcaatagcataactgttcttct

SEQ ID NO: 686527 - DNA, 22 bp, Artificial Sequence
  chemically synthesized
ctttcaatagcataactgttct

SEQ ID NO: 686528 - DNA, 22 bp, Artificial Sequence
  chemically synthesized
gagaagaacagttatgctattg

SEQ ID NO: 686529 - DNA, 22 bp, Artificial Sequence
  chemically synthesized
tatcattgctttcaatagcata

SEQ ID NO: 686530 - DNA, 22 bp, Artificial Sequence
  chemically synthesized
ttatatcattgctttcaatagc

SEQ ID NO: 686531 - DNA, 22 bp, Artificial Sequence
  chemically synthesized
attatatcattgctttcaatag

SEQ ID NO: 686532 - DNA, 22 bp, Artificial Sequence
  chemically synthesized
cttattatatcattgctttcaa

SEQ ID NO: 686533 - DNA, 22 bp, Artificial Sequence
  chemically synthesized
tgcttattatatcattgctttc

SEQ ID NO: 686534 - DNA, 22 bp, Artificial Sequence
  chemically synthesized
tgctattgaaagcaatgatata

SEQ ID NO: 686535 - DNA, 22 bp, Artificial Sequence
  chemically synthesized
gggccattctgcttattatatc

SEQ ID NO: 686536 - DNA, 22 bp, Artificial Sequence
  chemically synthesized
ttgaaagcaatgatataataag

SEQ ID NO: 686537 - DNA, 22 bp, Artificial Sequence
  chemically synthesized
ggggccattctgcttattatat

SEQ ID NO: 686538 - DNA, 22 bp, Artificial Sequence
  chemically synthesized
aaagcaatgatataataagcag

SEQ ID NO: 686539 - DNA, 22 bp, Artificial Sequence
  chemically synthesized
aaaacagatggcttggggccat

SEQ ID NO: 686540 - DNA, 22 bp, Artificial Sequence
  chemically synthesized
aaaaacagatggcttggggcca

SEQ ID NO: 686541 - DNA, 22 bp, Artificial Sequence
  chemically synthesized
taaaaacagatggcttggggcc

SEQ ID NO: 686542 - DNA, 22 bp, Artificial Sequence
  chemically synthesized
aatatggtaagctttaaaaaca

SEQ ID NO: 686543 - DNA, 22 bp, Artificial Sequence
  chemically synthesized
acagcctaaatatggtaagctt

SEQ ID NO: 686544 - DNA, 22 bp, Artificial Sequence
  chemically synthesized
tttttaaagcttaccatattta

SEQ ID NO: 686545 - DNA, 22 bp, Artificial Sequence
  chemically synthesized
ttaaagcttaccatatttaggc

SEQ ID NO: 686546 - DNA, 22 bp, Artificial Sequence
  chemically synthesized
taaagcttaccatatttaggct

SEQ ID NO: 686547 - DNA, 22 bp, Artificial Sequence
  chemically synthesized
aaagcttaccatatttaggctg

SEQ ID NO: 686548 - DNA, 22 bp, Artificial Sequence
  chemically synthesized
aagcttaccatatttaggctgt

SEQ ID NO: 686549 - DNA, 22 bp, Artificial Sequence
  chemically synthesized
accatatttaggctgttaggac

SEQ ID NO: 686550 - DNA, 22 bp, Artificial Sequence
  chemically synthesized
ccatatttaggctgttaggacc

SEQ ID NO: 686551 - DNA, 22 bp, Artificial Sequence
  chemically synthesized
catggacagtggaatggtccta

SEQ ID NO: 686552 - DNA, 22 bp, Artificial Sequence
  chemically synthesized
aggctgttaggaccattccact

SEQ ID NO: 686553 - DNA, 22 bp, Artificial Sequence
  chemically synthesized
ggctgttaggaccattccactg

SEQ ID NO: 686554 - DNA, 22 bp, Artificial Sequence
  chemically synthesized
ttaggaccattccactgtccat

SEQ ID NO: 686555 - DNA, 22 bp, Artificial Sequence
  chemically synthesized
agaatggcacctccatggacag

SEQ ID NO: 686556 - DNA, 22 bp, Artificial Sequence
  chemically synthesized
ggaccattccactgtccatgga

SEQ ID NO: 686557 - DNA, 22 bp, Artificial Sequence
  chemically synthesized
tctcagaatggcacctccatgg

SEQ ID NO: 686558 - DNA, 22 bp, Artificial Sequence
  chemically synthesized
ttatctcagaatggcacctcca

SEQ ID NO: 686559 - DNA, 22 bp, Artificial Sequence
  chemically synthesized
cactgtccatggaggtgccatt

SEQ ID NO: 686560 - DNA, 22 bp, Artificial Sequence
  chemically synthesized
cctgttatctcagaatggcacc

SEQ ID NO: 686561 - DNA, 22 bp, Artificial Sequence
  chemically synthesized
ccctgttatctcagaatggcac

SEQ ID NO: 686562 - DNA, 22 bp, Artificial Sequence
  chemically synthesized
tccatggaggtgccattctgag

SEQ ID NO: 686563 - DNA, 22 bp, Artificial Sequence
  chemically synthesized
cccacttccctgttatctcaga

SEQ ID NO: 686564 - DNA, 22 bp, Artificial Sequence
  chemically synthesized
gcccacttccctgttatctcag

SEQ ID NO: 686565 - DNA, 22 bp, Artificial Sequence
  chemically synthesized
tgcccacttccctgttatctca

SEQ ID NO: 686566 - DNA, 22 bp, Artificial Sequence
  chemically synthesized
gttttgcccacttccctgttat

SEQ ID NO: 686567 - DNA, 22 bp, Artificial Sequence
  chemically synthesized
tattagttttgcccacttccct

SEQ ID NO: 686568 - DNA, 22 bp, Artificial Sequence
  chemically synthesized
gtattagttttgcccacttccc

SEQ ID NO: 686569 - DNA, 22 bp, Artificial Sequence
  chemically synthesized
tgagataacagggaagtgggca

SEQ ID NO: 686570 - DNA, 22 bp, Artificial Sequence
  chemically synthesized
agataacagggaagtgggcaaa

SEQ ID NO: 686571 - DNA, 22 bp, Artificial Sequence
  chemically synthesized
atttgtattagttttgcccact

SEQ ID NO: 686572 - DNA, 22 bp, Artificial Sequence
  chemically synthesized
aatttgtattagttttgcccac

SEQ ID NO: 686573 - DNA, 22 bp, Artificial Sequence
  chemically synthesized
acaatggtttaatttgtattag

SEQ ID NO: 686574 - DNA, 22 bp, Artificial Sequence
  chemically synthesized
ctgacaatggtttaatttgtat

SEQ ID NO: 686575 - DNA, 22 bp, Artificial Sequence
  chemically synthesized
atacaaattaaaccattgtcag

SEQ ID NO: 686576 - DNA, 22 bp, Artificial Sequence
  chemically synthesized
tgataaaaattactgacaatgg

SEQ ID NO: 686577 - DNA, 22 bp, Artificial Sequence
  chemically synthesized
atgataaaaattactgacaatg

SEQ ID NO: 686578 - DNA, 22 bp, Artificial Sequence
  chemically synthesized
aaccattgtcagtaatttttat

SEQ ID NO: 686579 - DNA, 22 bp, Artificial Sequence
  chemically synthesized
tcagtaatttttatcataaatt

SEQ ID NO: 686580 - DNA, 22 bp, Artificial Sequence
  chemically synthesized
tagagggaaaaatcaatttatg

SEQ ID NO: 686581 - DNA, 22 bp, Artificial Sequence
  chemically synthesized
gtagagggaaaaatcaatttat

SEQ ID NO: 686582 - DNA, 22 bp, Artificial Sequence
  chemically synthesized
ttatcataaattgatttttccc

SEQ ID NO: 686583 - DNA, 22 bp, Artificial Sequence
  chemically synthesized
tatcataaattgatttttccct

SEQ ID NO: 686584 - DNA, 22 bp, Artificial Sequence
  chemically synthesized
atcataaattgatttttccctc

SEQ ID NO: 686585 - DNA, 22 bp, Artificial Sequence
  chemically synthesized
gatatgtttgtagagggaaaaa

SEQ ID NO: 686586 - DNA, 22 bp, Artificial Sequence
  chemically synthesized
tcataaattgatttttccctct

SEQ ID NO: 686587 - DNA, 22 bp, Artificial Sequence
  chemically synthesized
ggagcattagatatgtttgtag

SEQ ID NO: 686588 - DNA, 22 bp, Artificial Sequence
  chemically synthesized
gggagcattagatatgtttgta

SEQ ID NO: 686589 - DNA, 22 bp, Artificial Sequence
  chemically synthesized
atttttccctctacaaacatat

SEQ ID NO: 686590 - DNA, 22 bp, Artificial Sequence
  chemically synthesized
ttccctctacaaacatatctaa

SEQ ID NO: 686591 - DNA, 22 bp, Artificial Sequence
  chemically synthesized
tccctctacaaacatatctaat

SEQ ID NO: 686592 - DNA, 22 bp, Artificial Sequence
  chemically synthesized
ccctctacaaacatatctaatg

SEQ ID NO: 686593 - DNA, 22 bp, Artificial Sequence
  chemically synthesized
cctctacaaacatatctaatgc

SEQ ID NO: 686594 - DNA, 22 bp, Artificial Sequence
  chemically synthesized
tacaaacatatctaatgctccc

SEQ ID NO: 686595 - DNA, 22 bp, Artificial Sequence
  chemically synthesized
aatagtcagatttgggagcatt

SEQ ID NO: 686596 - DNA, 22 bp, Artificial Sequence
  chemically synthesized
caaacatatctaatgctcccaa

SEQ ID NO: 686597 - DNA, 22 bp, Artificial Sequence
  chemically synthesized
aaatagtcagatttgggagcat

SEQ ID NO: 686598 - DNA, 22 bp, Artificial Sequence
  chemically synthesized
taaatagtcagatttgggagca

SEQ ID NO: 686599 - DNA, 22 bp, Artificial Sequence
  chemically synthesized
ttaaatagtcagatttgggagc

SEQ ID NO: 686600 - DNA, 22 bp, Artificial Sequence
  chemically synthesized
tttaaatagtcagatttgggag

SEQ ID NO: 686601 - DNA, 22 bp, Artificial Sequence
  chemically synthesized
ttttaaatagtcagatttggga

SEQ ID NO: 686602 - DNA, 22 bp, Artificial Sequence
  chemically synthesized
atgctcccaaatctgactattt

SEQ ID NO: 686603 - DNA, 22 bp, Artificial Sequence
  chemically synthesized
agaaacatttttttaaatagtc

SEQ ID NO: 686604 - DNA, 22 bp, Artificial Sequence
  chemically synthesized
ccaaatctgactatttaaaaaa

SEQ ID NO: 686605 - DNA, 22 bp, Artificial Sequence
  chemically synthesized
aggactaagaaacattttttta

SEQ ID NO: 686606 - DNA, 22 bp, Artificial Sequence
  chemically synthesized
actatttaaaaaaatgtttctt

SEQ ID NO: 686607 - DNA, 22 bp, Artificial Sequence
  chemically synthesized
tttaaaaaaatgtttcttagtc

SEQ ID NO: 686608 - DNA, 22 bp, Artificial Sequence
  chemically synthesized
aaaaaaatgtttcttagtcctt

SEQ ID NO: 686609 - DNA, 22 bp, Artificial Sequence
  chemically synthesized
aaaaaatgtttcttagtcctta

SEQ ID NO: 686610 - DNA, 22 bp, Artificial Sequence
  chemically synthesized
tgatatgcatacattaaggact

SEQ ID NO: 686611 - DNA, 22 bp, Artificial Sequence
  chemically synthesized
agagttgtgatatgcatacatt

SEQ ID NO: 686612 - DNA, 22 bp, Artificial Sequence
  chemically synthesized
cagagttgtgatatgcatacat

SEQ ID NO: 686613 - DNA, 22 bp, Artificial Sequence
  chemically synthesized
cttagtccttaatgtatgcata

SEQ ID NO: 686614 - DNA, 22 bp, Artificial Sequence
  chemically synthesized
ttagtccttaatgtatgcatat

SEQ ID NO: 686615 - DNA, 22 bp, Artificial Sequence
  chemically synthesized
agtccttaatgtatgcatatca

SEQ ID NO: 686616 - DNA, 22 bp, Artificial Sequence
  chemically synthesized
gtccttaatgtatgcatatcac

SEQ ID NO: 686617 - DNA, 22 bp, Artificial Sequence
  chemically synthesized
gtgtcttcagagttgtgatatg

SEQ ID NO: 686618 - DNA, 22 bp, Artificial Sequence
  chemically synthesized
tagtgtcttcagagttgtgata

SEQ ID NO: 686619 - DNA, 22 bp, Artificial Sequence
  chemically synthesized
ctagtgtcttcagagttgtgat

SEQ ID NO: 686620 - DNA, 22 bp, Artificial Sequence
  chemically synthesized
aatgtatgcatatcacaactct

SEQ ID NO: 686621 - DNA, 22 bp, Artificial Sequence
  chemically synthesized
atgtatgcatatcacaactctg

SEQ ID NO: 686622 - DNA, 22 bp, Artificial Sequence
  chemically synthesized
tacttctagtgtcttcagagtt

SEQ ID NO: 686623 - DNA, 22 bp, Artificial Sequence
  chemically synthesized
tagtctatacttctagtgtctt

SEQ ID NO: 686624 - DNA, 22 bp, Artificial Sequence
  chemically synthesized
tgaaccctatagtctatacttc

SEQ ID NO: 686625 - DNA, 22 bp, Artificial Sequence
  chemically synthesized
tgaagacactagaagtatagac

SEQ ID NO: 686626 - DNA, 22 bp, Artificial Sequence
  chemically synthesized
aagacactagaagtatagacta

SEQ ID NO: 686627 - DNA, 22 bp, Artificial Sequence
  chemically synthesized
agactgtgaaccctatagtcta

SEQ ID NO: 686628 - DNA, 22 bp, Artificial Sequence
  chemically synthesized
aagactgtgaaccctatagtct

SEQ ID NO: 686629 - DNA, 22 bp, Artificial Sequence
  chemically synthesized
taagactgtgaaccctatagtc

SEQ ID NO: 686630 - DNA, 22 bp, Artificial Sequence
  chemically synthesized
gaagtatagactatagggttca

SEQ ID NO: 686631 - DNA, 22 bp, Artificial Sequence
  chemically synthesized
attttaagactgtgaaccctat

SEQ ID NO: 686632 - DNA, 22 bp, Artificial Sequence
  chemically synthesized
aaatcctcattttaagactgtg

SEQ ID NO: 686633 - DNA, 22 bp, Artificial Sequence
  chemically synthesized
tagggttcacagtcttaaaatg

SEQ ID NO: 686634 - DNA, 22 bp, Artificial Sequence
  chemically synthesized
acagtcttaaaatgaggatttt

SEQ ID NO: 686635 - DNA, 22 bp, Artificial Sequence
  chemically synthesized
atgaaaatcaatatctaaaatc

SEQ ID NO: 686636 - DNA, 22 bp, Artificial Sequence
  chemically synthesized
aaaatgaggattttagatattg

SEQ ID NO: 686637 - DNA, 22 bp, Artificial Sequence
  chemically synthesized
aaatgaggattttagatattga

SEQ ID NO: 686638 - DNA, 22 bp, Artificial Sequence
  chemically synthesized
gaggagagcgttaatgaaaatc

SEQ ID NO: 686639 - DNA, 22 bp, Artificial Sequence
  chemically synthesized
agaggagagcgttaatgaaaat

SEQ ID NO: 686640 - DNA, 22 bp, Artificial Sequence
  chemically synthesized
tagaggagagcgttaatgaaaa

SEQ ID NO: 686641 - DNA, 22 bp, Artificial Sequence
  chemically synthesized
tagatattgattttcattaacg

SEQ ID NO: 686642 - DNA, 22 bp, Artificial Sequence
  chemically synthesized
agatattgattttcattaacgc

SEQ ID NO: 686643 - DNA, 22 bp, Artificial Sequence
  chemically synthesized
ttttagaggagagcgttaatga

SEQ ID NO: 686644 - DNA, 22 bp, Artificial Sequence
  chemically synthesized
gatattgattttcattaacgct

SEQ ID NO: 686645 - DNA, 22 bp, Artificial Sequence
  chemically synthesized
aaactattttagaggagagcgt

SEQ ID NO: 686646 - DNA, 22 bp, Artificial Sequence
  chemically synthesized
attttcattaacgctctcctct

SEQ ID NO: 686647 - DNA, 22 bp, Artificial Sequence
  chemically synthesized
tcattaacgctctcctctaaaa

SEQ ID NO: 686648 - DNA, 22 bp, Artificial Sequence
  chemically synthesized
cattaacgctctcctctaaaat

SEQ ID NO: 686649 - DNA, 22 bp, Artificial Sequence
  chemically synthesized
attaacgctctcctctaaaata

SEQ ID NO: 686650 - DNA, 22 bp, Artificial Sequence
  chemically synthesized
acgctctcctctaaaatagttt

SEQ ID NO: 686651 - DNA, 22 bp, Artificial Sequence
  chemically synthesized
gaagcacaaaagactgaaacta

SEQ ID NO: 686652 - DNA, 22 bp, Artificial Sequence
  chemically synthesized
ggaagcacaaaagactgaaact

SEQ ID NO: 686653 - DNA, 22 bp, Artificial Sequence
  chemically synthesized
tcctctaaaatagtttcagtct

SEQ ID NO: 686654 - DNA, 22 bp, Artificial Sequence
  chemically synthesized
tggaagcacaaaagactgaaac

SEQ ID NO: 686655 - DNA, 22 bp, Artificial Sequence
  chemically synthesized
ctctaaaatagtttcagtcttt

SEQ ID NO: 686656 - DNA, 22 bp, Artificial Sequence
  chemically synthesized
attttggaagcacaaaagactg

SEQ ID NO: 686657 - DNA, 22 bp, Artificial Sequence
  chemically synthesized
taaaatagtttcagtcttttgt

SEQ ID NO: 686658 - DNA, 22 bp, Artificial Sequence
  chemically synthesized
taattttggaagcacaaaagac

SEQ ID NO: 686659 - DNA, 22 bp, Artificial Sequence
  chemically synthesized
aaatagtttcagtcttttgtgc

SEQ ID NO: 686660 - DNA, 22 bp, Artificial Sequence
  chemically synthesized
cagtcttttgtgcttccaaaat

SEQ ID NO: 686661 - DNA, 22 bp, Artificial Sequence
  chemically synthesized
agtcttttgtgcttccaaaatt

SEQ ID NO: 686662 - DNA, 22 bp, Artificial Sequence
  chemically synthesized
aggataaagttctaattttgga

SEQ ID NO: 686663 - DNA, 22 bp, Artificial Sequence
  chemically synthesized
ttgtgcttccaaaattagaact

SEQ ID NO: 686664 - DNA, 22 bp, Artificial Sequence
  chemically synthesized
tgtgcttccaaaattagaactt

SEQ ID NO: 686665 - DNA, 22 bp, Artificial Sequence
  chemically synthesized
gtgcttccaaaattagaacttt

SEQ ID NO: 686666 - DNA, 22 bp, Artificial Sequence
  chemically synthesized
tgcttccaaaattagaacttta

SEQ ID NO: 686667 - DNA, 22 bp, Artificial Sequence
  chemically synthesized
caaaacctaaggataaagttct

SEQ ID NO: 686668 - DNA, 22 bp, Artificial Sequence
  chemically synthesized
ccaaaattagaactttatcctt

SEQ ID NO: 686669 - DNA, 22 bp, Artificial Sequence
  chemically synthesized
caaaattagaactttatcctta

SEQ ID NO: 686670 - DNA, 22 bp, Artificial Sequence
  chemically synthesized
gaactttatccttaggttttgc

SEQ ID NO: 686671 - DNA, 22 bp, Artificial Sequence
  chemically synthesized
caagatccaaattgcaaaacct

SEQ ID NO: 686672 - DNA, 22 bp, Artificial Sequence
  chemically synthesized
acaagatccaaattgcaaaacc

SEQ ID NO: 686673 - DNA, 22 bp, Artificial Sequence
  chemically synthesized
cttacaagatccaaattgcaaa

SEQ ID NO: 686674 - DNA, 22 bp, Artificial Sequence
  chemically synthesized
tatccttaggttttgcaatttg

SEQ ID NO: 686675 - DNA, 22 bp, Artificial Sequence
  chemically synthesized
atccttaggttttgcaatttgg

SEQ ID NO: 686676 - DNA, 22 bp, Artificial Sequence
  chemically synthesized
tccttaggttttgcaatttgga

SEQ ID NO: 686677 - DNA, 22 bp, Artificial Sequence
  chemically synthesized
tctccttacaagatccaaattg

SEQ ID NO: 686678 - DNA, 22 bp, Artificial Sequence
  chemically synthesized
atctccttacaagatccaaatt

SEQ ID NO: 686679 - DNA, 22 bp, Artificial Sequence
  chemically synthesized
tatctccttacaagatccaaat

SEQ ID NO: 686680 - DNA, 22 bp, Artificial Sequence
  chemically synthesized
aggttttgcaatttggatcttg

SEQ ID NO: 686681 - DNA, 22 bp, Artificial Sequence
  chemically synthesized
tttatctccttacaagatccaa

SEQ ID NO: 686682 - DNA, 22 bp, Artificial Sequence
  chemically synthesized
ggttttgcaatttggatcttgt

SEQ ID NO: 686683 - DNA, 22 bp, Artificial Sequence
  chemically synthesized
cctctttatctccttacaagat

SEQ ID NO: 686684 - DNA, 22 bp, Artificial Sequence
  chemically synthesized
ccctctttatctccttacaaga

SEQ ID NO: 686685 - DNA, 22 bp, Artificial Sequence
  chemically synthesized
tgcaatttggatcttgtaagga

SEQ ID NO: 686686 - DNA, 22 bp, Artificial Sequence
  chemically synthesized
gcaatttggatcttgtaaggag

SEQ ID NO: 686687 - DNA, 22 bp, Artificial Sequence
  chemically synthesized
ttccctctttatctccttacaa

SEQ ID NO: 686688 - DNA, 22 bp, Artificial Sequence
  chemically synthesized
caatttggatcttgtaaggaga

SEQ ID NO: 686689 - DNA, 22 bp, Artificial Sequence
  chemically synthesized
cttccctctttatctccttaca

SEQ ID NO: 686690 - DNA, 22 bp, Artificial Sequence
  chemically synthesized
tcttccctctttatctccttac

SEQ ID NO: 686691 - DNA, 22 bp, Artificial Sequence
  chemically synthesized
ttcttccctctttatctcctta

SEQ ID NO: 686692 - DNA, 22 bp, Artificial Sequence
  chemically synthesized
tttcttccctctttatctcctt

SEQ ID NO: 686693 - DNA, 22 bp, Artificial Sequence
  chemically synthesized
ttttcttccctctttatctcct

SEQ ID NO: 686694 - DNA, 22 bp, Artificial Sequence
  chemically synthesized
tttttcttccctctttatctcc

SEQ ID NO: 686695 - DNA, 22 bp, Artificial Sequence
  chemically synthesized
ggatcttgtaaggagataaaga

SEQ ID NO: 686696 - DNA, 22 bp, Artificial Sequence
  chemically synthesized
gatcttgtaaggagataaagag

SEQ ID NO: 686697 - DNA, 22 bp, Artificial Sequence
  chemically synthesized
gtaaggagataaagagggaaga

SEQ ID NO: 686698 - DNA, 22 bp, Artificial Sequence
  chemically synthesized
taaggagataaagagggaagaa

SEQ ID NO: 686699 - DNA, 22 bp, Artificial Sequence
  chemically synthesized
aatcacaaactttttttcttcc

SEQ ID NO: 686700 - DNA, 22 bp, Artificial Sequence
  chemically synthesized
cacccctgaatcacaaactttt

SEQ ID NO: 686701 - DNA, 22 bp, Artificial Sequence
  chemically synthesized
ttacacccctgaatcacaaact

SEQ ID NO: 686702 - DNA, 22 bp, Artificial Sequence
  chemically synthesized
attacacccctgaatcacaaac

SEQ ID NO: 686703 - DNA, 22 bp, Artificial Sequence
  chemically synthesized
gagtttattacacccctgaatc

SEQ ID NO: 686704 - DNA, 22 bp, Artificial Sequence
  chemically synthesized
gtgattcaggggtgtaataaac

SEQ ID NO: 686705 - DNA, 22 bp, Artificial Sequence
  chemically synthesized
tgattcaggggtgtaataaact

SEQ ID NO: 686706 - DNA, 22 bp, Artificial Sequence
  chemically synthesized
atgatatgccagctggagttta

SEQ ID NO: 686707 - DNA, 22 bp, Artificial Sequence
  chemically synthesized
aggggtgtaataaactccagct

SEQ ID NO: 686708 - DNA, 22 bp, Artificial Sequence
  chemically synthesized
ggctcatgatatgccagctgga

SEQ ID NO: 686709 - DNA, 22 bp, Artificial Sequence
  chemically synthesized
acataactaggctcatgatatg

SEQ ID NO: 686710 - DNA, 22 bp, Artificial Sequence
  chemically synthesized
gacataactaggctcatgatat

SEQ ID NO: 686711 - DNA, 22 bp, Artificial Sequence
  chemically synthesized
tgacataactaggctcatgata

SEQ ID NO: 686712 - DNA, 22 bp, Artificial Sequence
  chemically synthesized
cagctggcatatcatgagccta

SEQ ID NO: 686713 - DNA, 22 bp, Artificial Sequence
  chemically synthesized
ttttgacataactaggctcatg

SEQ ID NO: 686714 - DNA, 22 bp, Artificial Sequence
  chemically synthesized
attttgacataactaggctcat

SEQ ID NO: 686715 - DNA, 22 bp, Artificial Sequence
  chemically synthesized
tttattttgacataactaggct

SEQ ID NO: 686716 - DNA, 22 bp, Artificial Sequence
  chemically synthesized
atttattttgacataactaggc

SEQ ID NO: 686717 - DNA, 22 bp, Artificial Sequence
  chemically synthesized
gcatatcatgagcctagttatg

SEQ ID NO: 686718 - DNA, 22 bp, Artificial Sequence
  chemically synthesized
atcatttatttattttgacata

SEQ ID NO: 686719 - DNA, 22 bp, Artificial Sequence
  chemically synthesized
gatcatttatttattttgacat

SEQ ID NO: 686720 - DNA, 22 bp, Artificial Sequence
  chemically synthesized
tgatcatttatttattttgaca

SEQ ID NO: 686721 - DNA, 22 bp, Artificial Sequence
  chemically synthesized
ttgatcatttatttattttgac

SEQ ID NO: 686722 - DNA, 22 bp, Artificial Sequence
  chemically synthesized
gttatgtcaaaataaataaatg

SEQ ID NO: 686723 - DNA, 22 bp, Artificial Sequence
  chemically synthesized
ataagatttttgatcatttatt

SEQ ID NO: 686724 - DNA, 22 bp, Artificial Sequence
  chemically synthesized
aataagatttttgatcatttat

SEQ ID NO: 686725 - DNA, 22 bp, Artificial Sequence
  chemically synthesized
tgtcaaaataaataaatgatca

SEQ ID NO: 686726 - DNA, 22 bp, Artificial Sequence
  chemically synthesized
taataagatttttgatcattta

SEQ ID NO: 686727 - DNA, 22 bp, Artificial Sequence
  chemically synthesized
ttaataagatttttgatcattt

SEQ ID NO: 686728 - DNA, 22 bp, Artificial Sequence
  chemically synthesized
tttaataagatttttgatcatt

SEQ ID NO: 686729 - DNA, 22 bp, Artificial Sequence
  chemically synthesized
ttttttaataagatttttgatc

SEQ ID NO: 686730 - DNA, 22 bp, Artificial Sequence
  chemically synthesized
gttttttaataagatttttgat

SEQ ID NO: 686731 - DNA, 22 bp, Artificial Sequence
  chemically synthesized
tgttttttaataagatttttga

SEQ ID NO: 686732 - DNA, 22 bp, Artificial Sequence
  chemically synthesized
ttgttttttaataagatttttg

SEQ ID NO: 686733 - DNA, 22 bp, Artificial Sequence
  chemically synthesized
cagtatgtttttgttttttaat

SEQ ID NO: 686734 - DNA, 22 bp, Artificial Sequence
  chemically synthesized
caaagttccagtatgtttttgt

SEQ ID NO: 686735 - DNA, 22 bp, Artificial Sequence
  chemically synthesized
ccaaagttccagtatgtttttg

SEQ ID NO: 686736 - DNA, 22 bp, Artificial Sequence
  chemically synthesized
tccaaagttccagtatgttttt

SEQ ID NO: 686737 - DNA, 22 bp, Artificial Sequence
  chemically synthesized
attaaaaaacaaaaacatactg

SEQ ID NO: 686738 - DNA, 22 bp, Artificial Sequence
  chemically synthesized
ttaaaaaacaaaaacatactgg

SEQ ID NO: 686739 - DNA, 22 bp, Artificial Sequence
  chemically synthesized
ttttccaaagttccagtatgtt

SEQ ID NO: 686740 - DNA, 22 bp, Artificial Sequence
  chemically synthesized
attttccaaagttccagtatgt

SEQ ID NO: 686741 - DNA, 22 bp, Artificial Sequence
  chemically synthesized
aaaaacaaaaacatactggaac

SEQ ID NO: 686742 - DNA, 22 bp, Artificial Sequence
  chemically synthesized
aatttattttccaaagttccag

SEQ ID NO: 686743 - DNA, 22 bp, Artificial Sequence
  chemically synthesized
cctaaatttattttccaaagtt

SEQ ID NO: 686744 - DNA, 22 bp, Artificial Sequence
  chemically synthesized
acctaaatttattttccaaagt

SEQ ID NO: 686745 - DNA, 22 bp, Artificial Sequence
  chemically synthesized
tacctaaatttattttccaaag

SEQ ID NO: 686746 - DNA, 22 bp, Artificial Sequence
  chemically synthesized
ttttacctaaatttattttcca

SEQ ID NO: 686747 - DNA, 22 bp, Artificial Sequence
  chemically synthesized
gttttacctaaatttattttcc

SEQ ID NO: 686748 - DNA, 22 bp, Artificial Sequence
  chemically synthesized
acttgttttacctaaatttatt

SEQ ID NO: 686749 - DNA, 22 bp, Artificial Sequence
  chemically synthesized
gaactttggaaaataaatttag

SEQ ID NO: 686750 - DNA, 22 bp, Artificial Sequence
  chemically synthesized
cacttgttttacctaaatttat

SEQ ID NO: 686751 - DNA, 22 bp, Artificial Sequence
  chemically synthesized
atttcacttgttttacctaaat

SEQ ID NO: 686752 - DNA, 22 bp, Artificial Sequence
  chemically synthesized
catttcacttgttttacctaaa

SEQ ID NO: 686753 - DNA, 22 bp, Artificial Sequence
  chemically synthesized
tggaaaataaatttaggtaaaa

SEQ ID NO: 686754 - DNA, 22 bp, Artificial Sequence
  chemically synthesized
tcatttcacttgttttacctaa

SEQ ID NO: 686755 - DNA, 22 bp, Artificial Sequence
  chemically synthesized
ggaaaataaatttaggtaaaac

SEQ ID NO: 686756 - DNA, 22 bp, Artificial Sequence
  chemically synthesized
gaaaataaatttaggtaaaaca

SEQ ID NO: 686757 - DNA, 22 bp, Artificial Sequence
  chemically synthesized
ttttcatttcacttgttttacc

SEQ ID NO: 686758 - DNA, 22 bp, Artificial Sequence
  chemically synthesized
ctattttcatttcacttgtttt

SEQ ID NO: 686759 - DNA, 22 bp, Artificial Sequence
  chemically synthesized
cctattttcatttcacttgttt

SEQ ID NO: 686760 - DNA, 22 bp, Artificial Sequence
  chemically synthesized
ttcctattttcatttcacttgt

SEQ ID NO: 686761 - DNA, 22 bp, Artificial Sequence
  chemically synthesized
aggtaaaacaagtgaaatgaaa

SEQ ID NO: 686762 - DNA, 22 bp, Artificial Sequence
  chemically synthesized
ggtaaaacaagtgaaatgaaaa

SEQ ID NO: 686763 - DNA, 22 bp, Artificial Sequence
  chemically synthesized
atattcttcctattttcatttc

SEQ ID NO: 686764 - DNA, 22 bp, Artificial Sequence
  chemically synthesized
aatattaatattcttcctattt

SEQ ID NO: 686765 - DNA, 22 bp, Artificial Sequence
  chemically synthesized
tgaatattaatattcttcctat

SEQ ID NO: 686766 - DNA, 22 bp, Artificial Sequence
  chemically synthesized
ctgaatattaatattcttccta

SEQ ID NO: 686767 - DNA, 22 bp, Artificial Sequence
  chemically synthesized
atacataatcaatcagcttctg

SEQ ID NO: 686768 - DNA, 22 bp, Artificial Sequence
  chemically synthesized
gctaatacataatcaatcagct

SEQ ID NO: 686769 - DNA, 22 bp, Artificial Sequence
  chemically synthesized
atattcagaagctgattgatta

SEQ ID NO: 686770 - DNA, 22 bp, Artificial Sequence
  chemically synthesized
atctggctaatacataatcaat

SEQ ID NO: 686771 - DNA, 22 bp, Artificial Sequence
  chemically synthesized
gatctggctaatacataatcaa

SEQ ID NO: 686772 - DNA, 22 bp, Artificial Sequence
  chemically synthesized
tgatctggctaatacataatca

SEQ ID NO: 686773 - DNA, 22 bp, Artificial Sequence
  chemically synthesized
agaagctgattgattatgtatt

SEQ ID NO: 686774 - DNA, 22 bp, Artificial Sequence
  chemically synthesized
attgattatgtattagccagat

SEQ ID NO: 686775 - DNA, 22 bp, Artificial Sequence
  chemically synthesized
attatgtattagccagatcaaa

SEQ ID NO: 686776 - DNA, 22 bp, Artificial Sequence
  chemically synthesized
tcacccagaggctttgatctgg

SEQ ID NO: 686777 - DNA, 22 bp, Artificial Sequence
  chemically synthesized
tgtattagccagatcaaagcct

SEQ ID NO: 686778 - DNA, 22 bp, Artificial Sequence
  chemically synthesized
attatcacccagaggctttgat

SEQ ID NO: 686779 - DNA, 22 bp, Artificial Sequence
  chemically synthesized
gccagatcaaagcctctgggtg

SEQ ID NO: 686780 - DNA, 22 bp, Artificial Sequence
  chemically synthesized
agtggctcattatcacccagag

SEQ ID NO: 686781 - DNA, 22 bp, Artificial Sequence
  chemically synthesized
ttcagtggctcattatcaccca

SEQ ID NO: 686782 - DNA, 22 bp, Artificial Sequence
  chemically synthesized
tgggtgataatgagccactgaa

SEQ ID NO: 686783 - DNA, 22 bp, Artificial Sequence
  chemically synthesized
ggtgataatgagccactgaaca

SEQ ID NO: 686784 - DNA, 22 bp, Artificial Sequence
  chemically synthesized
aacaggacaggtggtaatccct

SEQ ID NO: 686785 - DNA, 22 bp, Artificial Sequence
  chemically synthesized
gttgaacaggacaggtggtaat

SEQ ID NO: 686786 - DNA, 22 bp, Artificial Sequence
  chemically synthesized
ctagttgaacaggacaggtggt

SEQ ID NO: 686787 - DNA, 22 bp, Artificial Sequence
  chemically synthesized
aacagggattaccacctgtcct

SEQ ID NO: 686788 - DNA, 22 bp, Artificial Sequence
  chemically synthesized
ccacctgtcctgttcaactagc

SEQ ID NO: 686789 - DNA, 22 bp, Artificial Sequence
  chemically synthesized
gtaagtccagctgctagttgaa

SEQ ID NO: 686790 - DNA, 22 bp, Artificial Sequence
  chemically synthesized
ggtaagtccagctgctagttga

SEQ ID NO: 686791 - DNA, 22 bp, Artificial Sequence
  chemically synthesized
ttggtaagtccagctgctagtt

SEQ ID NO: 686792 - DNA, 22 bp, Artificial Sequence
  chemically synthesized
ttcttggtaagtccagctgcta

SEQ ID NO: 686793 - DNA, 22 bp, Artificial Sequence
  chemically synthesized
tcctgttcaactagcagctgga

SEQ ID NO: 686794 - DNA, 22 bp, Artificial Sequence
  chemically synthesized
ttcaactagcagctggacttac

SEQ ID NO: 686795 - DNA, 22 bp, Artificial Sequence
  chemically synthesized
tccagctgttcttggtaagtcc

SEQ ID NO: 686796 - DNA, 22 bp, Artificial Sequence
  chemically synthesized
aactagcagctggacttaccaa

SEQ ID NO: 686797 - DNA, 22 bp, Artificial Sequence
  chemically synthesized
gtccagctgttcttggtaagtc

SEQ ID NO: 686798 - DNA, 22 bp, Artificial Sequence
  chemically synthesized
ttgtccagctgttcttggtaag

SEQ ID NO: 686799 - DNA, 22 bp, Artificial Sequence
  chemically synthesized
gcagctggacttaccaagaaca

SEQ ID NO: 686800 - DNA, 22 bp, Artificial Sequence
  chemically synthesized
gacttaccaagaacagctggac

SEQ ID NO: 686801 - DNA, 22 bp, Artificial Sequence
  chemically synthesized
tataagtgttcttgtccagctg

SEQ ID NO: 686802 - DNA, 22 bp, Artificial Sequence
  chemically synthesized
atataagtgttcttgtccagct

SEQ ID NO: 686803 - DNA, 22 bp, Artificial Sequence
  chemically synthesized
tatataagtgttcttgtccagc

SEQ ID NO: 686804 - DNA, 22 bp, Artificial Sequence
  chemically synthesized
accaagaacagctggacaagaa

SEQ ID NO: 686805 - DNA, 22 bp, Artificial Sequence
  chemically synthesized
ccaagaacagctggacaagaac

SEQ ID NO: 686806 - DNA, 22 bp, Artificial Sequence
  chemically synthesized
attttatataagtgttcttgtc

SEQ ID NO: 686807 - DNA, 22 bp, Artificial Sequence
  chemically synthesized
aaggctaattttatataagtgt

SEQ ID NO: 686808 - DNA, 22 bp, Artificial Sequence
  chemically synthesized
taaaggctaattttatataagt

SEQ ID NO: 686809 - DNA, 22 bp, Artificial Sequence
  chemically synthesized
ctaaaggctaattttatataag

SEQ ID NO: 686810 - DNA, 22 bp, Artificial Sequence
  chemically synthesized
gacaagaacacttatataaaat

SEQ ID NO: 686811 - DNA, 22 bp, Artificial Sequence
  chemically synthesized
tgcttctaaaggctaattttat

SEQ ID NO: 686812 - DNA, 22 bp, Artificial Sequence
  chemically synthesized
atgcttctaaaggctaatttta

SEQ ID NO: 686813 - DNA, 22 bp, Artificial Sequence
  chemically synthesized
gcttatgcttctaaaggctaat

SEQ ID NO: 686814 - DNA, 22 bp, Artificial Sequence
  chemically synthesized
agcttatgcttctaaaggctaa

SEQ ID NO: 686815 - DNA, 22 bp, Artificial Sequence
  chemically synthesized
atataaaattagcctttagaag

SEQ ID NO: 686816 - DNA, 22 bp, Artificial Sequence
  chemically synthesized
tataaaattagcctttagaagc

SEQ ID NO: 686817 - DNA, 22 bp, Artificial Sequence
  chemically synthesized
gcctttagaagcataagctaag

SEQ ID NO: 686818 - DNA, 22 bp, Artificial Sequence
  chemically synthesized
tagaagcataagctaagttttt

SEQ ID NO: 686819 - DNA, 22 bp, Artificial Sequence
  chemically synthesized
agaagcaggtgaaaaaacttag

SEQ ID NO: 686820 - DNA, 22 bp, Artificial Sequence
  chemically synthesized
agaagcataagctaagtttttt

SEQ ID NO: 686821 - DNA, 22 bp, Artificial Sequence
  chemically synthesized
gaagcataagctaagttttttc

SEQ ID NO: 686822 - DNA, 22 bp, Artificial Sequence
  chemically synthesized
agttttttcacctgcttctcag

SEQ ID NO: 686823 - DNA, 22 bp, Artificial Sequence
  chemically synthesized
tttcacctgcttctcagatcgg

SEQ ID NO: 686824 - DNA, 22 bp, Artificial Sequence
  chemically synthesized
ttcacctgcttctcagatcggc

SEQ ID NO: 686825 - DNA, 22 bp, Artificial Sequence
  chemically synthesized
tcacctgcttctcagatcggca

SEQ ID NO: 686826 - DNA, 22 bp, Artificial Sequence
  chemically synthesized
cacctgcttctcagatcggcat

SEQ ID NO: 686827 - DNA, 22 bp, Artificial Sequence
  chemically synthesized
acctgcttctcagatcggcatc

SEQ ID NO: 686828 - DNA, 22 bp, Artificial Sequence
  chemically synthesized
gcatgagtgataaagatgccga

SEQ ID NO: 686829 - DNA, 22 bp, Artificial Sequence
  chemically synthesized
tggcatgagtgataaagatgcc

SEQ ID NO: 686830 - DNA, 22 bp, Artificial Sequence
  chemically synthesized
cttctcagatcggcatctttat

SEQ ID NO: 686831 - DNA, 22 bp, Artificial Sequence
  chemically synthesized
ctggcatgagtgataaagatgc

SEQ ID NO: 686832 - DNA, 22 bp, Artificial Sequence
  chemically synthesized
ctcagatcggcatctttatcac

SEQ ID NO: 686833 - DNA, 22 bp, Artificial Sequence
  chemically synthesized
cttctggcatgagtgataaaga

SEQ ID NO: 686834 - DNA, 22 bp, Artificial Sequence
  chemically synthesized
tcagatcggcatctttatcact

SEQ ID NO: 686835 - DNA, 22 bp, Artificial Sequence
  chemically synthesized
acttctggcatgagtgataaag

SEQ ID NO: 686836 - DNA, 22 bp, Artificial Sequence
  chemically synthesized
tacttctggcatgagtgataaa

SEQ ID NO: 686837 - DNA, 22 bp, Artificial Sequence
  chemically synthesized
agatcggcatctttatcactca

SEQ ID NO: 686838 - DNA, 22 bp, Artificial Sequence
  chemically synthesized
ttacttctggcatgagtgataa

SEQ ID NO: 686839 - DNA, 22 bp, Artificial Sequence
  chemically synthesized
tttacttctggcatgagtgata

SEQ ID NO: 686840 - DNA, 22 bp, Artificial Sequence
  chemically synthesized
tatcactcatgccagaagtaaa

SEQ ID NO: 686841 - DNA, 22 bp, Artificial Sequence
  chemically synthesized
atcactcatgccagaagtaaaa

SEQ ID NO: 686842 - DNA, 22 bp, Artificial Sequence
  chemically synthesized
tcactcatgccagaagtaaaaa

SEQ ID NO: 686843 - DNA, 22 bp, Artificial Sequence
  chemically synthesized
atgccagaagtaaaaagctttt

SEQ ID NO: 686844 - DNA, 22 bp, Artificial Sequence
  chemically synthesized
aaggcaaaaacagcatcaaaat

SEQ ID NO: 686845 - DNA, 22 bp, Artificial Sequence
  chemically synthesized
ctgaaggcaaaaacagcatcaa

SEQ ID NO: 686846 - DNA, 22 bp, Artificial Sequence
  chemically synthesized
cctgaaggcaaaaacagcatca

SEQ ID NO: 686847 - DNA, 22 bp, Artificial Sequence
  chemically synthesized
tcctgaaggcaaaaacagcatc

SEQ ID NO: 686848 - DNA, 22 bp, Artificial Sequence
  chemically synthesized
ttcatattttgatgctgttttt

SEQ ID NO: 686849 - DNA, 22 bp, Artificial Sequence
  chemically synthesized
tcatattttgatgctgtttttg

SEQ ID NO: 686850 - DNA, 22 bp, Artificial Sequence
  chemically synthesized
catattttgatgctgtttttgc

SEQ ID NO: 686851 - DNA, 22 bp, Artificial Sequence
  chemically synthesized
atattttgatgctgtttttgcc

SEQ ID NO: 686852 - DNA, 22 bp, Artificial Sequence
  chemically synthesized
tgctttcctgaaggcaaaaaca

SEQ ID NO: 686853 - DNA, 22 bp, Artificial Sequence
  chemically synthesized
tgatgctgtttttgccttcagg

SEQ ID NO: 686854 - DNA, 22 bp, Artificial Sequence
  chemically synthesized
gatgctgtttttgccttcagga

SEQ ID NO: 686855 - DNA, 22 bp, Artificial Sequence
  chemically synthesized
aaagctgtgctttcctgaaggc

SEQ ID NO: 686856 - DNA, 22 bp, Artificial Sequence
  chemically synthesized
atgctgtttttgccttcaggaa

SEQ ID NO: 686857 - DNA, 22 bp, Artificial Sequence
  chemically synthesized
gtgttcaaagctgtgctttcct

SEQ ID NO: 686858 - DNA, 22 bp, Artificial Sequence
  chemically synthesized
tttttgccttcaggaaagcaca

SEQ ID NO: 686859 - DNA, 22 bp, Artificial Sequence
  chemically synthesized
ttgccttcaggaaagcacagct

SEQ ID NO: 686860 - DNA, 22 bp, Artificial Sequence
  chemically synthesized
tgccttcaggaaagcacagctt

SEQ ID NO: 686861 - DNA, 22 bp, Artificial Sequence
  chemically synthesized
gccttcaggaaagcacagcttt

SEQ ID NO: 686862 - DNA, 22 bp, Artificial Sequence
  chemically synthesized
ccttcaggaaagcacagctttg

SEQ ID NO: 686863 - DNA, 22 bp, Artificial Sequence
  chemically synthesized
ggaatattggtgttcaaagctg

SEQ ID NO: 686864 - DNA, 22 bp, Artificial Sequence
  chemically synthesized
caggaaagcacagctttgaaca

SEQ ID NO: 686865 - DNA, 22 bp, Artificial Sequence
  chemically synthesized
aggaaagcacagctttgaacac

SEQ ID NO: 686866 - DNA, 22 bp, Artificial Sequence
  chemically synthesized
gtagcaagcggctgggaatatt

SEQ ID NO: 686867 - DNA, 22 bp, Artificial Sequence
  chemically synthesized
ggtagcaagcggctgggaatat

SEQ ID NO: 686868 - DNA, 22 bp, Artificial Sequence
  chemically synthesized
tgaacaccaatattcccagccg

SEQ ID NO: 686869 - DNA, 22 bp, Artificial Sequence
  chemically synthesized
cttggtagcaagcggctgggaa

SEQ ID NO: 686870 - DNA, 22 bp, Artificial Sequence
  chemically synthesized
gaacaccaatattcccagccgc

SEQ ID NO: 686871 - DNA, 22 bp, Artificial Sequence
  chemically synthesized
aacaccaatattcccagccgct

SEQ ID NO: 686872 - DNA, 22 bp, Artificial Sequence
  chemically synthesized
cattacttggtagcaagcggct

SEQ ID NO: 686873 - DNA, 22 bp, Artificial Sequence
  chemically synthesized
ccagccgcttgctaccaagtaa

SEQ ID NO: 686874 - DNA, 22 bp, Artificial Sequence
  chemically synthesized
gaagacaacctccattacttgg

SEQ ID NO: 686875 - DNA, 22 bp, Artificial Sequence
  chemically synthesized
ggtctagaagacaacctccatt

SEQ ID NO: 686876 - DNA, 22 bp, Artificial Sequence
  chemically synthesized
gctaccaagtaatggaggttgt

SEQ ID NO: 686877 - DNA, 22 bp, Artificial Sequence
  chemically synthesized
ctaccaagtaatggaggttgtc

SEQ ID NO: 686878 - DNA, 22 bp, Artificial Sequence
  chemically synthesized
ttaggtctagaagacaacctcc

SEQ ID NO: 686879 - DNA, 22 bp, Artificial Sequence
  chemically synthesized
attaggtctagaagacaacctc

SEQ ID NO: 686880 - DNA, 22 bp, Artificial Sequence
  chemically synthesized
ccaagtaatggaggttgtcttc

SEQ ID NO: 686881 - DNA, 22 bp, Artificial Sequence
  chemically synthesized
gcttattaggtctagaagacaa

SEQ ID NO: 686882 - DNA, 22 bp, Artificial Sequence
  chemically synthesized
agcttattaggtctagaagaca

SEQ ID NO: 686883 - DNA, 22 bp, Artificial Sequence
  chemically synthesized
acatcttagcttattaggtcta

SEQ ID NO: 686884 - DNA, 22 bp, Artificial Sequence
  chemically synthesized
tcttctagacctaataagctaa

SEQ ID NO: 686885 - DNA, 22 bp, Artificial Sequence
  chemically synthesized
ctagacctaataagctaagatg

SEQ ID NO: 686886 - DNA, 22 bp, Artificial Sequence
  chemically synthesized
tagacctaataagctaagatgt

SEQ ID NO: 686887 - DNA, 22 bp, Artificial Sequence
  chemically synthesized
gacctaataagctaagatgtca

SEQ ID NO: 686888 - DNA, 22 bp, Artificial Sequence
  chemically synthesized
ataagctaagatgtcagatgca

SEQ ID NO: 686889 - DNA, 22 bp, Artificial Sequence
  chemically synthesized
agatgtcagatgcacttggttt

SEQ ID NO: 686890 - DNA, 22 bp, Artificial Sequence
  chemically synthesized
ggtttttcctgtcactggctca

SEQ ID NO: 686891 - DNA, 22 bp, Artificial Sequence
  chemically synthesized
gtttttcctgtcactggctcat

SEQ ID NO: 686892 - DNA, 22 bp, Artificial Sequence
  chemically synthesized
ttcctgtcactggctcatcttg

SEQ ID NO: 686893 - DNA, 22 bp, Artificial Sequence
  chemically synthesized
aacataagagcacaagatgagc

SEQ ID NO: 686894 - DNA, 22 bp, Artificial Sequence
  chemically synthesized
tcctgtcactggctcatcttgt

SEQ ID NO: 686895 - DNA, 22 bp, Artificial Sequence
  chemically synthesized
aaacataagagcacaagatgag

SEQ ID NO: 686896 - DNA, 22 bp, Artificial Sequence
  chemically synthesized
cctgtcactggctcatcttgtg

SEQ ID NO: 686897 - DNA, 22 bp, Artificial Sequence
  chemically synthesized
ctgtcactggctcatcttgtgc

SEQ ID NO: 686898 - DNA, 22 bp, Artificial Sequence
  chemically synthesized
tcactggctcatcttgtgctct

SEQ ID NO: 686899 - DNA, 22 bp, Artificial Sequence
  chemically synthesized
tagtggcttaaacataagagca

SEQ ID NO: 686900 - DNA, 22 bp, Artificial Sequence
  chemically synthesized
gtagtggcttaaacataagagc

SEQ ID NO: 686901 - DNA, 22 bp, Artificial Sequence
  chemically synthesized
gctcatcttgtgctcttatgtt

SEQ ID NO: 686902 - DNA, 22 bp, Artificial Sequence
  chemically synthesized
atcttgtgctcttatgtttaag

SEQ ID NO: 686903 - DNA, 22 bp, Artificial Sequence
  chemically synthesized
aaagaatttgtagtggcttaaa

SEQ ID NO: 686904 - DNA, 22 bp, Artificial Sequence
  chemically synthesized
gtgctcttatgtttaagccact

SEQ ID NO: 686905 - DNA, 22 bp, Artificial Sequence
  chemically synthesized
gaaagaatttgtagtggcttaa

SEQ ID NO: 686906 - DNA, 22 bp, Artificial Sequence
  chemically synthesized
tgctcttatgtttaagccacta

SEQ ID NO: 686907 - DNA, 22 bp, Artificial Sequence
  chemically synthesized
tgaaagaatttgtagtggctta

SEQ ID NO: 686908 - DNA, 22 bp, Artificial Sequence
  chemically synthesized
ttgaaagaatttgtagtggctt

SEQ ID NO: 686909 - DNA, 22 bp, Artificial Sequence
  chemically synthesized
ttttgaaagaatttgtagtggc

SEQ ID NO: 686910 - DNA, 22 bp, Artificial Sequence
  chemically synthesized
cttttgaaagaatttgtagtgg

SEQ ID NO: 686911 - DNA, 22 bp, Artificial Sequence
  chemically synthesized
ttatgtttaagccactacaaat

SEQ ID NO: 686912 - DNA, 22 bp, Artificial Sequence
  chemically synthesized
tcttttgaaagaatttgtagtg

SEQ ID NO: 686913 - DNA, 22 bp, Artificial Sequence
  chemically synthesized
atgtttaagccactacaaattc

SEQ ID NO: 686914 - DNA, 22 bp, Artificial Sequence
  chemically synthesized
tgtttaagccactacaaattct

SEQ ID NO: 686915 - DNA, 22 bp, Artificial Sequence
  chemically synthesized
ctttcttttgaaagaatttgta

SEQ ID NO: 686916 - DNA, 22 bp, Artificial Sequence
  chemically synthesized
tactttcttttgaaagaatttg

SEQ ID NO: 686917 - DNA, 22 bp, Artificial Sequence
  chemically synthesized
ctactttcttttgaaagaattt

SEQ ID NO: 686918 - DNA, 22 bp, Artificial Sequence
  chemically synthesized
aagccactacaaattctttcaa

SEQ ID NO: 686919 - DNA, 22 bp, Artificial Sequence
  chemically synthesized
agccactacaaattctttcaaa

SEQ ID NO: 686920 - DNA, 22 bp, Artificial Sequence
  chemically synthesized
tatttctactttcttttgaaag

SEQ ID NO: 686921 - DNA, 22 bp, Artificial Sequence
  chemically synthesized
atatttctactttcttttgaaa

SEQ ID NO: 686922 - DNA, 22 bp, Artificial Sequence
  chemically synthesized
caaattctttcaaaagaaagta

SEQ ID NO: 686923 - DNA, 22 bp, Artificial Sequence
  chemically synthesized
taatttatatttctactttctt

SEQ ID NO: 686924 - DNA, 22 bp, Artificial Sequence
  chemically synthesized
ataatttatatttctactttct

SEQ ID NO: 686925 - DNA, 22 bp, Artificial Sequence
  chemically synthesized
tataatttatatttctactttc

SEQ ID NO: 686926 - DNA, 22 bp, Artificial Sequence
  chemically synthesized
tttataatttatatttctactt

SEQ ID NO: 686927 - DNA, 22 bp, Artificial Sequence
  chemically synthesized
ctttataatttatatttctact

SEQ ID NO: 686928 - DNA, 22 bp, Artificial Sequence
  chemically synthesized
tttcaaaagaaagtagaaatat

SEQ ID NO: 686929 - DNA, 22 bp, Artificial Sequence
  chemically synthesized
tctttataatttatatttctac

SEQ ID NO: 686930 - DNA, 22 bp, Artificial Sequence
  chemically synthesized
tcaaaagaaagtagaaatataa

SEQ ID NO: 686931 - DNA, 22 bp, Artificial Sequence
  chemically synthesized
caaaagaaagtagaaatataaa

SEQ ID NO: 686932 - DNA, 22 bp, Artificial Sequence
  chemically synthesized
aaaagaaagtagaaatataaat

SEQ ID NO: 686933 - DNA, 22 bp, Artificial Sequence
  chemically synthesized
aaatctttctttataatttata

SEQ ID NO: 686934 - DNA, 22 bp, Artificial Sequence
  chemically synthesized
taaagaaagattttaatgtcat

SEQ ID NO: 686935 - DNA, 22 bp, Artificial Sequence
  chemically synthesized
gtgagtaagaatataggaataa

SEQ ID NO: 686936 - DNA, 22 bp, Artificial Sequence
  chemically synthesized
taatgtcatttattcctatatt

SEQ ID NO: 686937 - DNA, 22 bp, Artificial Sequence
  chemically synthesized
aatgtcatttattcctatattc

SEQ ID NO: 686938 - DNA, 22 bp, Artificial Sequence
  chemically synthesized
atgtcatttattcctatattct

SEQ ID NO: 686939 - DNA, 22 bp, Artificial Sequence
  chemically synthesized
attcctatattcttactcacga

SEQ ID NO: 686940 - DNA, 22 bp, Artificial Sequence
  chemically synthesized
ttcctatattcttactcacgaa

SEQ ID NO: 686941 - DNA, 22 bp, Artificial Sequence
  chemically synthesized
aataaaatgaagattcgtgagt

SEQ ID NO: 686942 - DNA, 22 bp, Artificial Sequence
  chemically synthesized
caataaaatgaagattcgtgag

SEQ ID NO: 686943 - DNA, 22 bp, Artificial Sequence
  chemically synthesized
ctatattcttactcacgaatct

SEQ ID NO: 686944 - DNA, 22 bp, Artificial Sequence
  chemically synthesized
tattcttactcacgaatcttca

SEQ ID NO: 686945 - DNA, 22 bp, Artificial Sequence
  chemically synthesized
ttactcacgaatcttcatttta

SEQ ID NO: 686946 - DNA, 22 bp, Artificial Sequence
  chemically synthesized
aataggtttcaataaaatgaag

SEQ ID NO: 686947 - DNA, 22 bp, Artificial Sequence
  chemically synthesized
aaataggtttcaataaaatgaa

SEQ ID NO: 686948 - DNA, 22 bp, Artificial Sequence
  chemically synthesized
actcacgaatcttcattttatt

SEQ ID NO: 686949 - DNA, 22 bp, Artificial Sequence
  chemically synthesized
taaataggtttcaataaaatga

SEQ ID NO: 686950 - DNA, 22 bp, Artificial Sequence
  chemically synthesized
ctcacgaatcttcattttattg

SEQ ID NO: 686951 - DNA, 22 bp, Artificial Sequence
  chemically synthesized
acgaatcttcattttattgaaa

SEQ ID NO: 686952 - DNA, 22 bp, Artificial Sequence
  chemically synthesized
tcattttaaataggtttcaata

SEQ ID NO: 686953 - DNA, 22 bp, Artificial Sequence
  chemically synthesized
cattttattgaaacctatttaa

SEQ ID NO: 686954 - DNA, 22 bp, Artificial Sequence
  chemically synthesized
attttattgaaacctatttaaa

SEQ ID NO: 686955 - DNA, 22 bp, Artificial Sequence
  chemically synthesized
tattgaaacctatttaaaatga

SEQ ID NO: 686956 - DNA, 22 bp, Artificial Sequence
  chemically synthesized
attgaaacctatttaaaatgac

SEQ ID NO: 686957 - DNA, 22 bp, Artificial Sequence
  chemically synthesized
ttgaaacctatttaaaatgaca

SEQ ID NO: 686958 - DNA, 22 bp, Artificial Sequence
  chemically synthesized
aaacctatttaaaatgacaata

SEQ ID NO: 686959 - DNA, 22 bp, Artificial Sequence
  chemically synthesized
ccaagtgtgcatatatattgtc

SEQ ID NO: 686960 - DNA, 22 bp, Artificial Sequence
  chemically synthesized
cccaagtgtgcatatatattgt

SEQ ID NO: 686961 - DNA, 22 bp, Artificial Sequence
  chemically synthesized
tttaaaatgacaatatatatgc

SEQ ID NO: 686962 - DNA, 22 bp, Artificial Sequence
  chemically synthesized
aaaatgacaatatatatgcaca

SEQ ID NO: 686963 - DNA, 22 bp, Artificial Sequence
  chemically synthesized
aaatgacaatatatatgcacac

SEQ ID NO: 686964 - DNA, 22 bp, Artificial Sequence
  chemically synthesized
ataaacttcccaagtgtgcata

SEQ ID NO: 686965 - DNA, 22 bp, Artificial Sequence
  chemically synthesized
tctgataaacttcccaagtgtg

SEQ ID NO: 686966 - DNA, 22 bp, Artificial Sequence
  chemically synthesized
tatcaaaattatctgataaact

SEQ ID NO: 686967 - DNA, 22 bp, Artificial Sequence
  chemically synthesized
atatcaaaattatctgataaac

SEQ ID NO: 686968 - DNA, 22 bp, Artificial Sequence
  chemically synthesized
gggaagtttatcagataatttt

SEQ ID NO: 686969 - DNA, 22 bp, Artificial Sequence
  chemically synthesized
tcgtcttatatcaaaattatct

SEQ ID NO: 686970 - DNA, 22 bp, Artificial Sequence
  chemically synthesized
ggaagtttatcagataattttg

SEQ ID NO: 686971 - DNA, 22 bp, Artificial Sequence
  chemically synthesized
acctatcgtcttatatcaaaat

SEQ ID NO: 686972 - DNA, 22 bp, Artificial Sequence
  chemically synthesized
aacctatcgtcttatatcaaaa

SEQ ID NO: 686973 - DNA, 22 bp, Artificial Sequence
  chemically synthesized
taacctatcgtcttatatcaaa

SEQ ID NO: 686974 - DNA, 22 bp, Artificial Sequence
  chemically synthesized
ttaacctatcgtcttatatcaa

SEQ ID NO: 686975 - DNA, 22 bp, Artificial Sequence
  chemically synthesized
atcagataattttgatataaga

SEQ ID NO: 686976 - DNA, 22 bp, Artificial Sequence
  chemically synthesized
tcagataattttgatataagac

SEQ ID NO: 686977 - DNA, 22 bp, Artificial Sequence
  chemically synthesized
tttttaacctatcgtcttatat

SEQ ID NO: 686978 - DNA, 22 bp, Artificial Sequence
  chemically synthesized
atttttaacctatcgtcttata

SEQ ID NO: 686979 - DNA, 22 bp, Artificial Sequence
  chemically synthesized
tgatataagacgataggttaaa

SEQ ID NO: 686980 - DNA, 22 bp, Artificial Sequence
  chemically synthesized
gatataagacgataggttaaaa

SEQ ID NO: 686981 - DNA, 22 bp, Artificial Sequence
  chemically synthesized
atataagacgataggttaaaaa

SEQ ID NO: 686982 - DNA, 22 bp, Artificial Sequence
  chemically synthesized
tcatatgccttatttttaacct

SEQ ID NO: 686983 - DNA, 22 bp, Artificial Sequence
  chemically synthesized
aaaataaggcatatgacaatct

SEQ ID NO: 686984 - DNA, 22 bp, Artificial Sequence
  chemically synthesized
agagcaccaaataaagattgtc

SEQ ID NO: 686985 - DNA, 22 bp, Artificial Sequence
  chemically synthesized
atacaattcagagcaccaaata

SEQ ID NO: 686986 - DNA, 22 bp, Artificial Sequence
  chemically synthesized
aatacaattcagagcaccaaat

SEQ ID NO: 686987 - DNA, 22 bp, Artificial Sequence
  chemically synthesized
taatacaattcagagcaccaaa

SEQ ID NO: 686988 - DNA, 22 bp, Artificial Sequence
  chemically synthesized
gtgactttaatacaattcagag

SEQ ID NO: 686989 - DNA, 22 bp, Artificial Sequence
  chemically synthesized
tatttggtgctctgaattgtat

SEQ ID NO: 686990 - DNA, 22 bp, Artificial Sequence
  chemically synthesized
atttggtgctctgaattgtatt

SEQ ID NO: 686991 - DNA, 22 bp, Artificial Sequence
  chemically synthesized
tttggtgctctgaattgtatta

SEQ ID NO: 686992 - DNA, 22 bp, Artificial Sequence
  chemically synthesized
ggtgctctgaattgtattaaag

SEQ ID NO: 686993 - DNA, 22 bp, Artificial Sequence
  chemically synthesized
gtgctctgaattgtattaaagt

SEQ ID NO: 686994 - DNA, 22 bp, Artificial Sequence
  chemically synthesized
aaacagactggtgactttaata

SEQ ID NO: 686995 - DNA, 22 bp, Artificial Sequence
  chemically synthesized
aaaacagactggtgactttaat

SEQ ID NO: 686996 - DNA, 22 bp, Artificial Sequence
  chemically synthesized
ttaaaacagactggtgacttta

SEQ ID NO: 686997 - DNA, 22 bp, Artificial Sequence
  chemically synthesized
tgaattgtattaaagtcaccag

SEQ ID NO: 686998 - DNA, 22 bp, Artificial Sequence
  chemically synthesized
aattgtattaaagtcaccagtc

SEQ ID NO: 686999 - DNA, 22 bp, Artificial Sequence
  chemically synthesized
tattaaagtcaccagtctgttt

SEQ ID NO: 687000 - DNA, 22 bp, Artificial Sequence
  chemically synthesized
catgataactcttaaaacagac

SEQ ID NO: 687001 - DNA, 22 bp, Artificial Sequence
  chemically synthesized
aagtcaccagtctgttttaaga

SEQ ID NO: 687002 - DNA, 22 bp, Artificial Sequence
  chemically synthesized
ttccatgataactcttaaaaca

SEQ ID NO: 687003 - DNA, 22 bp, Artificial Sequence
  chemically synthesized
gttccatgataactcttaaaac

SEQ ID NO: 687004 - DNA, 22 bp, Artificial Sequence
  chemically synthesized
acttgttccatgataactctta

SEQ ID NO: 687005 - DNA, 22 bp, Artificial Sequence
  chemically synthesized
attcacttgttccatgataact

SEQ ID NO: 687006 - DNA, 22 bp, Artificial Sequence
  chemically synthesized
ctcattcacttgttccatgata

SEQ ID NO: 687007 - DNA, 22 bp, Artificial Sequence
  chemically synthesized
actcattcacttgttccatgat

SEQ ID NO: 687008 - DNA, 22 bp, Artificial Sequence
  chemically synthesized
ttttaagagttatcatggaaca

SEQ ID NO: 687009 - DNA, 22 bp, Artificial Sequence
  chemically synthesized
taagagttatcatggaacaagt

SEQ ID NO: 687010 - DNA, 22 bp, Artificial Sequence
  chemically synthesized
aagagttatcatggaacaagtg

SEQ ID NO: 687011 - DNA, 22 bp, Artificial Sequence
  chemically synthesized
tatttactcattcacttgttcc

SEQ ID NO: 687012 - DNA, 22 bp, Artificial Sequence
  chemically synthesized
agagttatcatggaacaagtga

SEQ ID NO: 687013 - DNA, 22 bp, Artificial Sequence
  chemically synthesized
ttatatttactcattcacttgt

SEQ ID NO: 687014 - DNA, 22 bp, Artificial Sequence
  chemically synthesized
tcatggaacaagtgaatgagta

SEQ ID NO: 687015 - DNA, 22 bp, Artificial Sequence
  chemically synthesized
agaaggaaggaagtagactatt

SEQ ID NO: 687016 - DNA, 22 bp, Artificial Sequence
  chemically synthesized
gagaaggaaggaagtagactat

SEQ ID NO: 687017 - DNA, 22 bp, Artificial Sequence
  chemically synthesized
tgagaaggaaggaagtagacta

SEQ ID NO: 687018 - DNA, 22 bp, Artificial Sequence
  chemically synthesized
tggaccaaccacactttgagaa

SEQ ID NO: 687019 - DNA, 22 bp, Artificial Sequence
  chemically synthesized
cttccttccttctcaaagtgtg

SEQ ID NO: 687020 - DNA, 22 bp, Artificial Sequence
  chemically synthesized
atctgtggaccaaccacacttt

SEQ ID NO: 687021 - DNA, 22 bp, Artificial Sequence
  chemically synthesized
ccttccttctcaaagtgtggtt

SEQ ID NO: 687022 - DNA, 22 bp, Artificial Sequence
  chemically synthesized
cttccttctcaaagtgtggttg

SEQ ID NO: 687023 - DNA, 22 bp, Artificial Sequence
  chemically synthesized
ctaatctgtggaccaaccacac

SEQ ID NO: 687024 - DNA, 22 bp, Artificial Sequence
  chemically synthesized
ccttctcaaagtgtggttggtc

SEQ ID NO: 687025 - DNA, 22 bp, Artificial Sequence
  chemically synthesized
cttctcaaagtgtggttggtcc

SEQ ID NO: 687026 - DNA, 22 bp, Artificial Sequence
  chemically synthesized
ctcaaagtgtggttggtccaca

SEQ ID NO: 687027 - DNA, 22 bp, Artificial Sequence
  chemically synthesized
atgctgctaatctgtggaccaa

SEQ ID NO: 687028 - DNA, 22 bp, Artificial Sequence
  chemically synthesized
tcaaagtgtggttggtccacag

SEQ ID NO: 687029 - DNA, 22 bp, Artificial Sequence
  chemically synthesized
aaagtgtggttggtccacagat

SEQ ID NO: 687030 - DNA, 22 bp, Artificial Sequence
  chemically synthesized
acaggtgatgctaatgctgcta

SEQ ID NO: 687031 - DNA, 22 bp, Artificial Sequence
  chemically synthesized
gtccacagattagcagcattag

SEQ ID NO: 687032 - DNA, 22 bp, Artificial Sequence
  chemically synthesized
taacaggtgatgctaatgctgc

SEQ ID NO: 687033 - DNA, 22 bp, Artificial Sequence
  chemically synthesized
ctaacaggtgatgctaatgctg

SEQ ID NO: 687034 - DNA, 22 bp, Artificial Sequence
  chemically synthesized
catttctaacaggtgatgctaa

SEQ ID NO: 687035 - DNA, 22 bp, Artificial Sequence
  chemically synthesized
tgcatttctaacaggtgatgct

SEQ ID NO: 687036 - DNA, 22 bp, Artificial Sequence
  chemically synthesized
gcagcattagcatcacctgtta

SEQ ID NO: 687037 - DNA, 22 bp, Artificial Sequence
  chemically synthesized
gcatcacctgttagaaatgcag

SEQ ID NO: 687038 - DNA, 22 bp, Artificial Sequence
  chemically synthesized
aaatgagacatgatgttctgca

SEQ ID NO: 687039 - DNA, 22 bp, Artificial Sequence
  chemically synthesized
ttagaaatgcagaacatcatgt

SEQ ID NO: 687040 - DNA, 22 bp, Artificial Sequence
  chemically synthesized
gaaatgcagaacatcatgtctc

SEQ ID NO: 687041 - DNA, 22 bp, Artificial Sequence
  chemically synthesized
tgagccagtgggtctaaaatga

SEQ ID NO: 687042 - DNA, 22 bp, Artificial Sequence
  chemically synthesized
aaatccagattatgagccagtg

SEQ ID NO: 687043 - DNA, 22 bp, Artificial Sequence
  chemically synthesized
attttagacccactggctcata

SEQ ID NO: 687044 - DNA, 22 bp, Artificial Sequence
  chemically synthesized
ttaaaatccagattatgagcca

SEQ ID NO: 687045 - DNA, 22 bp, Artificial Sequence
  chemically synthesized
gttaaaatccagattatgagcc

SEQ ID NO: 687046 - DNA, 22 bp, Artificial Sequence
  chemically synthesized
tagacccactggctcataatct

SEQ ID NO: 687047 - DNA, 22 bp, Artificial Sequence
  chemically synthesized
agacccactggctcataatctg

SEQ ID NO: 687048 - DNA, 22 bp, Artificial Sequence
  chemically synthesized
gacccactggctcataatctgg

SEQ ID NO: 687049 - DNA, 22 bp, Artificial Sequence
  chemically synthesized
ggaatcttgttaaaatccagat

SEQ ID NO: 687050 - DNA, 22 bp, Artificial Sequence
  chemically synthesized
tctgggaatcttgttaaaatcc

SEQ ID NO: 687051 - DNA, 22 bp, Artificial Sequence
  chemically synthesized
gctcataatctggattttaaca

SEQ ID NO: 687052 - DNA, 22 bp, Artificial Sequence
  chemically synthesized
ataatctggattttaacaagat

SEQ ID NO: 687053 - DNA, 22 bp, Artificial Sequence
  chemically synthesized
gattttaacaagattcccagac

SEQ ID NO: 687054 - DNA, 22 bp, Artificial Sequence
  chemically synthesized
atgtgcatacaaattgtctggg

SEQ ID NO: 687055 - DNA, 22 bp, Artificial Sequence
  chemically synthesized
aatgtgcatacaaattgtctgg

SEQ ID NO: 687056 - DNA, 22 bp, Artificial Sequence
  chemically synthesized
taacaagattcccagacaattt

SEQ ID NO: 687057 - DNA, 22 bp, Artificial Sequence
  chemically synthesized
taatgtgcatacaaattgtctg

SEQ ID NO: 687058 - DNA, 22 bp, Artificial Sequence
  chemically synthesized
aacaagattcccagacaatttg

SEQ ID NO: 687059 - DNA, 22 bp, Artificial Sequence
  chemically synthesized
acaagattcccagacaatttgt

SEQ ID NO: 687060 - DNA, 22 bp, Artificial Sequence
  chemically synthesized
aaattttaatgtgcatacaaat

SEQ ID NO: 687061 - DNA, 22 bp, Artificial Sequence
  chemically synthesized
tcaaattttaatgtgcatacaa

SEQ ID NO: 687062 - DNA, 22 bp, Artificial Sequence
  chemically synthesized
ctcaaattttaatgtgcataca

SEQ ID NO: 687063 - DNA, 22 bp, Artificial Sequence
  chemically synthesized
ccagacaatttgtatgcacatt

SEQ ID NO: 687064 - DNA, 22 bp, Artificial Sequence
  chemically synthesized
cttctcaaattttaatgtgcat

SEQ ID NO: 687065 - DNA, 22 bp, Artificial Sequence
  chemically synthesized
gtatgcacattaaaatttgaga

SEQ ID NO: 687066 - DNA, 22 bp, Artificial Sequence
  chemically synthesized
tatgcacattaaaatttgagaa

SEQ ID NO: 687067 - DNA, 22 bp, Artificial Sequence
  chemically synthesized
acaggaacattgcttctcaaat

SEQ ID NO: 687068 - DNA, 22 bp, Artificial Sequence
  chemically synthesized
agctcacaggaacattgcttct

SEQ ID NO: 687069 - DNA, 22 bp, Artificial Sequence
  chemically synthesized
attaagctcacaggaacattgc

SEQ ID NO: 687070 - DNA, 22 bp, Artificial Sequence
  chemically synthesized
aaatttgagaagcaatgttcct

SEQ ID NO: 687071 - DNA, 22 bp, Artificial Sequence
  chemically synthesized
gagaagcaatgttcctgtgagc

SEQ ID NO: 687072 - DNA, 22 bp, Artificial Sequence
  chemically synthesized
agaagcaatgttcctgtgagct

SEQ ID NO: 687073 - DNA, 22 bp, Artificial Sequence
  chemically synthesized
ctgtgagcttaatcagatcctc

SEQ ID NO: 687074 - DNA, 22 bp, Artificial Sequence
  chemically synthesized
tgagcttaatcagatcctctct

SEQ ID NO: 687075 - DNA, 22 bp, Artificial Sequence
  chemically synthesized
aatcagatcctctctttctttc

SEQ ID NO: 687076 - DNA, 22 bp, Artificial Sequence
  chemically synthesized
atcagatcctctctttctttct

SEQ ID NO: 687077 - DNA, 22 bp, Artificial Sequence
  chemically synthesized
tctttctttctacacgtttttt

SEQ ID NO: 687078 - DNA, 22 bp, Artificial Sequence
  chemically synthesized
aaaaaaaagaaagaaaaaacgt

SEQ ID NO: 687079 - DNA, 22 bp, Artificial Sequence
  chemically synthesized
tttctttctacacgttttttct

SEQ ID NO: 687080 - DNA, 22 bp, Artificial Sequence
  chemically synthesized
tctttctacacgttttttcttt

SEQ ID NO: 687081 - DNA, 22 bp, Artificial Sequence
  chemically synthesized
ctttctacacgttttttctttc

SEQ ID NO: 687082 - DNA, 22 bp, Artificial Sequence
  chemically synthesized
tctcaaaaaaaagaaagaaaaa

SEQ ID NO: 687083 - DNA, 22 bp, Artificial Sequence
  chemically synthesized
tttctacacgttttttctttct

SEQ ID NO: 687084 - DNA, 22 bp, Artificial Sequence
  chemically synthesized
tgtctcaaaaaaaagaaagaaa

SEQ ID NO: 687085 - DNA, 22 bp, Artificial Sequence
  chemically synthesized
tctacacgttttttctttcttt

SEQ ID NO: 687086 - DNA, 22 bp, Artificial Sequence
  chemically synthesized
ctacacgttttttctttctttt

SEQ ID NO: 687087 - DNA, 22 bp, Artificial Sequence
  chemically synthesized
tacacgttttttctttcttttt

SEQ ID NO: 687088 - DNA, 22 bp, Artificial Sequence
  chemically synthesized
cacgttttttctttcttttttt

SEQ ID NO: 687089 - DNA, 22 bp, Artificial Sequence
  chemically synthesized
tttctttcttttttttgagaca

SEQ ID NO: 687090 - DNA, 22 bp, Artificial Sequence
  chemically synthesized
ttctttcttttttttgagacag

SEQ ID NO: 687091 - DNA, 22 bp, Artificial Sequence
  chemically synthesized
tctttcttttttttgagacaga

SEQ ID NO: 687092 - DNA, 22 bp, Artificial Sequence
  chemically synthesized
ctttcttttttttgagacagag

SEQ ID NO: 687093 - DNA, 22 bp, Artificial Sequence
  chemically synthesized
tttcttttttttgagacagagt

SEQ ID NO: 687094 - DNA, 22 bp, Artificial Sequence
  chemically synthesized
tcttttttttgagacagagtct

SEQ ID NO: 687095 - DNA, 22 bp, Artificial Sequence
  chemically synthesized
ggtaacagagtgagactctgtc

SEQ ID NO: 687096 - DNA, 22 bp, Artificial Sequence
  chemically synthesized
cttttttttgagacagagtctc

SEQ ID NO: 687097 - DNA, 22 bp, Artificial Sequence
  chemically synthesized
ttttttttgagacagagtctca

SEQ ID NO: 687098 - DNA, 22 bp, Artificial Sequence
  chemically synthesized
ttttttgagacagagtctcact

SEQ ID NO: 687099 - DNA, 22 bp, Artificial Sequence
  chemically synthesized
tttttgagacagagtctcactc

SEQ ID NO: 687100 - DNA, 22 bp, Artificial Sequence
  chemically synthesized
ttttgagacagagtctcactct

SEQ ID NO: 687101 - DNA, 22 bp, Artificial Sequence
  chemically synthesized
tttgagacagagtctcactctg

SEQ ID NO: 687102 - DNA, 22 bp, Artificial Sequence
  chemically synthesized
ttgagacagagtctcactctgt

SEQ ID NO: 687103 - DNA, 22 bp, Artificial Sequence
  chemically synthesized
tgagacagagtctcactctgtt

SEQ ID NO: 687104 - DNA, 22 bp, Artificial Sequence
  chemically synthesized
gtaagcctcggtaacagagtga

SEQ ID NO: 687105 - DNA, 22 bp, Artificial Sequence
  chemically synthesized
gagacagagtctcactctgtta

SEQ ID NO: 687106 - DNA, 22 bp, Artificial Sequence
  chemically synthesized
ggtaagcctcggtaacagagtg

SEQ ID NO: 687107 - DNA, 22 bp, Artificial Sequence
  chemically synthesized
agacagagtctcactctgttac

SEQ ID NO: 687108 - DNA, 22 bp, Artificial Sequence
  chemically synthesized
tggtaagcctcggtaacagagt

SEQ ID NO: 687109 - DNA, 22 bp, Artificial Sequence
  chemically synthesized
cagctttggtaagcctcggtaa

SEQ ID NO: 687110 - DNA, 22 bp, Artificial Sequence
  chemically synthesized
cactccagctttggtaagcctc

SEQ ID NO: 687111 - DNA, 22 bp, Artificial Sequence
  chemically synthesized
actctgttaccgaggcttacca

SEQ ID NO: 687112 - DNA, 22 bp, Artificial Sequence
  chemically synthesized
tgttaccgaggcttaccaaagc

SEQ ID NO: 687113 - DNA, 22 bp, Artificial Sequence
  chemically synthesized
ttaccgaggcttaccaaagctg

SEQ ID NO: 687114 - DNA, 22 bp, Artificial Sequence
  chemically synthesized
ccgaggcttaccaaagctggag

SEQ ID NO: 687115 - DNA, 22 bp, Artificial Sequence
  chemically synthesized
accaaagctggagtgcagcggc

SEQ ID NO: 687116 - DNA, 22 bp, Artificial Sequence
  chemically synthesized
ccaaagctggagtgcagcggcg

SEQ ID NO: 687117 - DNA, 22 bp, Artificial Sequence
  chemically synthesized
cagtgagccgagatcacgccgc

SEQ ID NO: 687118 - DNA, 22 bp, Artificial Sequence
  chemically synthesized
gagtgcagcggcgtgatctcgg

SEQ ID NO: 687119 - DNA, 22 bp, Artificial Sequence
  chemically synthesized
aacatgggaggcggaggttgca

SEQ ID NO: 687120 - DNA, 22 bp, Artificial Sequence
  chemically synthesized
gaacatgggaggcggaggttgc

SEQ ID NO: 687121 - DNA, 22 bp, Artificial Sequence
  chemically synthesized
ggctcactgcaacctccgcctc

SEQ ID NO: 687122 - DNA, 22 bp, Artificial Sequence
  chemically synthesized
actgcaacctccgcctcccatg

SEQ ID NO: 687123 - DNA, 22 bp, Artificial Sequence
  chemically synthesized
tgagaatcacttgaacatggga

SEQ ID NO: 687124 - DNA, 22 bp, Artificial Sequence
  chemically synthesized
caacctccgcctcccatgttca

SEQ ID NO: 687125 - DNA, 22 bp, Artificial Sequence
  chemically synthesized
agttatgagaatcacttgaaca

SEQ ID NO: 687126 - DNA, 22 bp, Artificial Sequence
  chemically synthesized
cgcctcccatgttcaagtgatt

SEQ ID NO: 687127 - DNA, 22 bp, Artificial Sequence
  chemically synthesized
ccatgttcaagtgattctcata

SEQ ID NO: 687128 - DNA, 22 bp, Artificial Sequence
  chemically synthesized
taatcccaggctgagttatgag

SEQ ID NO: 687129 - DNA, 22 bp, Artificial Sequence
  chemically synthesized
aagtgattctcataactcagcc

SEQ ID NO: 687130 - DNA, 22 bp, Artificial Sequence
  chemically synthesized
taatcccagctgtaatcccagg

SEQ ID NO: 687131 - DNA, 22 bp, Artificial Sequence
  chemically synthesized
tcataactcagcctgggattac

SEQ ID NO: 687132 - DNA, 22 bp, Artificial Sequence
  chemically synthesized
ataactcagcctgggattacag

SEQ ID NO: 687133 - DNA, 22 bp, Artificial Sequence
  chemically synthesized
agcctgggattacagctgggat

SEQ ID NO: 687134 - DNA, 22 bp, Artificial Sequence
  chemically synthesized
ggattacagctgggattacagg

SEQ ID NO: 687135 - DNA, 22 bp, Artificial Sequence
  chemically synthesized
cagctgggattacaggcatgtg

SEQ ID NO: 687136 - DNA, 22 bp, Artificial Sequence
  chemically synthesized
gccgggcatggcggcacatgcc

SEQ ID NO: 687137 - DNA, 22 bp, Artificial Sequence
  chemically synthesized
agccgggcatggcggcacatgc

SEQ ID NO: 687138 - DNA, 22 bp, Artificial Sequence
  chemically synthesized
ggattacaggcatgtgccgcca

SEQ ID NO: 687139 - DNA, 22 bp, Artificial Sequence
  chemically synthesized
caggcatgtgccgccatgcccg

SEQ ID NO: 687140 - DNA, 22 bp, Artificial Sequence
  chemically synthesized
aaaatacaaaacttagccgggc

SEQ ID NO: 687141 - DNA, 22 bp, Artificial Sequence
  chemically synthesized
ctaaaaatacaaaacttagccg

SEQ ID NO: 687142 - DNA, 22 bp, Artificial Sequence
  chemically synthesized
tactaaaaatacaaaacttagc

SEQ ID NO: 687143 - DNA, 22 bp, Artificial Sequence
  chemically synthesized
tctctactaaaaatacaaaact

SEQ ID NO: 687144 - DNA, 22 bp, Artificial Sequence
  chemically synthesized
agttttgtatttttagtagaga

SEQ ID NO: 687145 - DNA, 22 bp, Artificial Sequence
  chemically synthesized
tgtatttttagtagagacaggt

SEQ ID NO: 687146 - DNA, 22 bp, Artificial Sequence
  chemically synthesized
gtatttttagtagagacaggtt

SEQ ID NO: 687147 - DNA, 22 bp, Artificial Sequence
  chemically synthesized
tatttttagtagagacaggttt

SEQ ID NO: 687148 - DNA, 22 bp, Artificial Sequence
  chemically synthesized
gccaacatggcgaaacctgtct

SEQ ID NO: 687149 - DNA, 22 bp, Artificial Sequence
  chemically synthesized
ttagtagagacaggtttcgcca

SEQ ID NO: 687150 - DNA, 22 bp, Artificial Sequence
  chemically synthesized
tagtagagacaggtttcgccat

SEQ ID NO: 687151 - DNA, 22 bp, Artificial Sequence
  chemically synthesized
agtagagacaggtttcgccatg

SEQ ID NO: 687152 - DNA, 22 bp, Artificial Sequence
  chemically synthesized
gtagagacaggtttcgccatgt

SEQ ID NO: 687153 - DNA, 22 bp, Artificial Sequence
  chemically synthesized
gaccagcctggccaacatggcg

SEQ ID NO: 687154 - DNA, 22 bp, Artificial Sequence
  chemically synthesized
agaccagcctggccaacatggc

SEQ ID NO: 687155 - DNA, 22 bp, Artificial Sequence
  chemically synthesized
cgccatgttggccaggctggtc

SEQ ID NO: 687156 - DNA, 22 bp, Artificial Sequence
  chemically synthesized
gccatgttggccaggctggtct

SEQ ID NO: 687157 - DNA, 22 bp, Artificial Sequence
  chemically synthesized
atcccaggaggtttagaccagc

SEQ ID NO: 687158 - DNA, 22 bp, Artificial Sequence
  chemically synthesized
aatcccaggaggtttagaccag

SEQ ID NO: 687159 - DNA, 22 bp, Artificial Sequence
  chemically synthesized
gccaggctggtctaaacctcct

SEQ ID NO: 687160 - DNA, 22 bp, Artificial Sequence
  chemically synthesized
gtctaaacctcctgggattaag

SEQ ID NO: 687161 - DNA, 22 bp, Artificial Sequence
  chemically synthesized
aacctcctgggattaagcgatc

SEQ ID NO: 687162 - DNA, 22 bp, Artificial Sequence
  chemically synthesized
ggaggccgaggagggcagatcg

SEQ ID NO: 687163 - DNA, 22 bp, Artificial Sequence
  chemically synthesized
ctgggattaagcgatctgccct

SEQ ID NO: 687164 - DNA, 22 bp, Artificial Sequence
  chemically synthesized
gggaggccgaggagggcagatc

SEQ ID NO: 687165 - DNA, 22 bp, Artificial Sequence
  chemically synthesized
tgggaggccgaggagggcagat

SEQ ID NO: 687166 - DNA, 22 bp, Artificial Sequence
  chemically synthesized
ggattaagcgatctgccctcct

SEQ ID NO: 687167 - DNA, 22 bp, Artificial Sequence
  chemically synthesized
agcgatctgccctcctcggcct

SEQ ID NO: 687168 - DNA, 22 bp, Artificial Sequence
  chemically synthesized
taatcccaacaggctttgggag

SEQ ID NO: 687169 - DNA, 22 bp, Artificial Sequence
  chemically synthesized
ccctcctcggcctcccaaagcc

SEQ ID NO: 687170 - DNA, 22 bp, Artificial Sequence
  chemically synthesized
ctcggcctcccaaagcctgttg

SEQ ID NO: 687171 - DNA, 22 bp, Artificial Sequence
  chemically synthesized
agcctgtaatcccaacaggctt

SEQ ID NO: 687172 - DNA, 22 bp, Artificial Sequence
  chemically synthesized
aagcctgtaatcccaacaggct

SEQ ID NO: 687173 - DNA, 22 bp, Artificial Sequence
  chemically synthesized
ggcctcccaaagcctgttggga

SEQ ID NO: 687174 - DNA, 22 bp, Artificial Sequence
  chemically synthesized
ccaaagcctgttgggattacag

SEQ ID NO: 687175 - DNA, 22 bp, Artificial Sequence
  chemically synthesized
ttgggattacaggcttaagcca

SEQ ID NO: 687176 - DNA, 22 bp, Artificial Sequence
  chemically synthesized
ggattacaggcttaagccacca

SEQ ID NO: 687177 - DNA, 22 bp, Artificial Sequence
  chemically synthesized
caggcttaagccaccatgcctg

SEQ ID NO: 687178 - DNA, 22 bp, Artificial Sequence
  chemically synthesized
aagccaccatgcctgtccctgt

SEQ ID NO: 687179 - DNA, 22 bp, Artificial Sequence
  chemically synthesized
agccaccatgcctgtccctgtt

SEQ ID NO: 687180 - DNA, 22 bp, Artificial Sequence
  chemically synthesized
caatacaaagtggagaaacagg

SEQ ID NO: 687181 - DNA, 22 bp, Artificial Sequence
  chemically synthesized
tccctgtttctccactttgtat

SEQ ID NO: 687182 - DNA, 22 bp, Artificial Sequence
  chemically synthesized
aaataaaagcattccaatacaa

SEQ ID NO: 687183 - DNA, 22 bp, Artificial Sequence
  chemically synthesized
tttctccactttgtattggaat

SEQ ID NO: 687184 - DNA, 22 bp, Artificial Sequence
  chemically synthesized
ctccactttgtattggaatgct

SEQ ID NO: 687185 - DNA, 22 bp, Artificial Sequence
  chemically synthesized
tccactttgtattggaatgctt

SEQ ID NO: 687186 - DNA, 22 bp, Artificial Sequence
  chemically synthesized
cactttgtattggaatgctttt

SEQ ID NO: 687187 - DNA, 22 bp, Artificial Sequence
  chemically synthesized
tgtattggaatgcttttatttg

SEQ ID NO: 687188 - DNA, 22 bp, Artificial Sequence
  chemically synthesized
aaacatcatattcaaataaaag

SEQ ID NO: 687189 - DNA, 22 bp, Artificial Sequence
  chemically synthesized
gtattggaatgcttttatttga

SEQ ID NO: 687190 - DNA, 22 bp, Artificial Sequence
  chemically synthesized
tattggaatgcttttatttgaa

SEQ ID NO: 687191 - DNA, 22 bp, Artificial Sequence
  chemically synthesized
tactaaaacatcatattcaaat

SEQ ID NO: 687192 - DNA, 22 bp, Artificial Sequence
  chemically synthesized
gtactaaaacatcatattcaaa

SEQ ID NO: 687193 - DNA, 22 bp, Artificial Sequence
  chemically synthesized
gaatgcttttatttgaatatga

SEQ ID NO: 687194 - DNA, 22 bp, Artificial Sequence
  chemically synthesized
tggtttgtactaaaacatcata

SEQ ID NO: 687195 - DNA, 22 bp, Artificial Sequence
  chemically synthesized
ttatttgaatatgatgttttag

SEQ ID NO: 687196 - DNA, 22 bp, Artificial Sequence
  chemically synthesized
tatttgaatatgatgttttagt

SEQ ID NO: 687197 - DNA, 22 bp, Artificial Sequence
  chemically synthesized
atttgaatatgatgttttagta

SEQ ID NO: 687198 - DNA, 22 bp, Artificial Sequence
  chemically synthesized
ggctgtggtttgtactaaaaca

SEQ ID NO: 687199 - DNA, 22 bp, Artificial Sequence
  chemically synthesized
tttgaatatgatgttttagtac

SEQ ID NO: 687200 - DNA, 22 bp, Artificial Sequence
  chemically synthesized
ctaggctgtggtttgtactaaa

SEQ ID NO: 687201 - DNA, 22 bp, Artificial Sequence
  chemically synthesized
gaatatgatgttttagtacaaa

SEQ ID NO: 687202 - DNA, 22 bp, Artificial Sequence
  chemically synthesized
aatatgatgttttagtacaaac

SEQ ID NO: 687203 - DNA, 22 bp, Artificial Sequence
  chemically synthesized
aaacccaggcctcctaggctgt

SEQ ID NO: 687204 - DNA, 22 bp, Artificial Sequence
  chemically synthesized
tagtacaaaccacagcctagga

SEQ ID NO: 687205 - DNA, 22 bp, Artificial Sequence
  chemically synthesized
aaaacccaggcctcctaggctg

SEQ ID NO: 687206 - DNA, 22 bp, Artificial Sequence
  chemically synthesized
agtacaaaccacagcctaggag

SEQ ID NO: 687207 - DNA, 22 bp, Artificial Sequence
  chemically synthesized
taaaacccaggcctcctaggct

SEQ ID NO: 687208 - DNA, 22 bp, Artificial Sequence
  chemically synthesized
gtacaaaccacagcctaggagg

SEQ ID NO: 687209 - DNA, 22 bp, Artificial Sequence
  chemically synthesized
ctttaaaacccaggcctcctag

SEQ ID NO: 687210 - DNA, 22 bp, Artificial Sequence
  chemically synthesized
gttactttaaaacccaggcctc

SEQ ID NO: 687211 - DNA, 22 bp, Artificial Sequence
  chemically synthesized
ggaggcctgggttttaaagtaa

SEQ ID NO: 687212 - DNA, 22 bp, Artificial Sequence
  chemically synthesized
ggttttaaagtaactaatattg

SEQ ID NO: 687213 - DNA, 22 bp, Artificial Sequence
  chemically synthesized
taaagtaactaatattgatggc

SEQ ID NO: 687214 - DNA, 22 bp, Artificial Sequence
  chemically synthesized
aaagtaactaatattgatggct

SEQ ID NO: 687215 - DNA, 22 bp, Artificial Sequence
  chemically synthesized
aagtaactaatattgatggcta

SEQ ID NO: 687216 - DNA, 22 bp, Artificial Sequence
  chemically synthesized
tacatagcaggcatagtagcca

SEQ ID NO: 687217 - DNA, 22 bp, Artificial Sequence
  chemically synthesized
atacatagcaggcatagtagcc

SEQ ID NO: 687218 - DNA, 22 bp, Artificial Sequence
  chemically synthesized
atattgatggctactatgcctg

SEQ ID NO: 687219 - DNA, 22 bp, Artificial Sequence
  chemically synthesized
cacttatacatagcaggcatag

SEQ ID NO: 687220 - DNA, 22 bp, Artificial Sequence
  chemically synthesized
atggctactatgcctgctatgt

SEQ ID NO: 687221 - DNA, 22 bp, Artificial Sequence
  chemically synthesized
tgtacgttacacttatacatag

SEQ ID NO: 687222 - DNA, 22 bp, Artificial Sequence
  chemically synthesized
ctatgcctgctatgtataagtg

SEQ ID NO: 687223 - DNA, 22 bp, Artificial Sequence
  chemically synthesized
tgcctgctatgtataagtgtaa

SEQ ID NO: 687224 - DNA, 22 bp, Artificial Sequence
  chemically synthesized
aacctgtgtacgttacacttat

SEQ ID NO: 687225 - DNA, 22 bp, Artificial Sequence
  chemically synthesized
tgttcaacctgtgtacgttaca

SEQ ID NO: 687226 - DNA, 22 bp, Artificial Sequence
  chemically synthesized
ctatgtataagtgtaacgtaca

SEQ ID NO: 687227 - DNA, 22 bp, Artificial Sequence
  chemically synthesized
atgttcaacctgtgtacgttac

SEQ ID NO: 687228 - DNA, 22 bp, Artificial Sequence
  chemically synthesized
tatgttcaacctgtgtacgtta

SEQ ID NO: 687229 - DNA, 22 bp, Artificial Sequence
  chemically synthesized
tgtataagtgtaacgtacacag

SEQ ID NO: 687230 - DNA, 22 bp, Artificial Sequence
  chemically synthesized
tttatgttcaacctgtgtacgt

SEQ ID NO: 687231 - DNA, 22 bp, Artificial Sequence
  chemically synthesized
ctctttatgttcaacctgtgta

SEQ ID NO: 687232 - DNA, 22 bp, Artificial Sequence
  chemically synthesized
tgtgaaacctcctctttatgtt

SEQ ID NO: 687233 - DNA, 22 bp, Artificial Sequence
  chemically synthesized
atgtgaaacctcctctttatgt

SEQ ID NO: 687234 - DNA, 22 bp, Artificial Sequence
  chemically synthesized
ttatgtgaaacctcctctttat

SEQ ID NO: 687235 - DNA, 22 bp, Artificial Sequence
  chemically synthesized
taatattcttatgtgaaacctc

SEQ ID NO: 687236 - DNA, 22 bp, Artificial Sequence
  chemically synthesized
aacataaagaggaggtttcaca

SEQ ID NO: 687237 - DNA, 22 bp, Artificial Sequence
  chemically synthesized
ctataatattcttatgtgaaac

SEQ ID NO: 687238 - DNA, 22 bp, Artificial Sequence
  chemically synthesized
aggtcacgatacctcctataat

SEQ ID NO: 687239 - DNA, 22 bp, Artificial Sequence
  chemically synthesized
cacataagaatattataggagg

SEQ ID NO: 687240 - DNA, 22 bp, Artificial Sequence
  chemically synthesized
acataagaatattataggaggt

SEQ ID NO: 687241 - DNA, 22 bp, Artificial Sequence
  chemically synthesized
taaggtcacgatacctcctata

SEQ ID NO: 687242 - DNA, 22 bp, Artificial Sequence
  chemically synthesized
taggaggtatcgtgaccttaga

SEQ ID NO: 687243 - DNA, 22 bp, Artificial Sequence
  chemically synthesized
tacagatgtacagatgttctaa

SEQ ID NO: 687244 - DNA, 22 bp, Artificial Sequence
  chemically synthesized
cattatacagatgtacagatgt

SEQ ID NO: 687245 - DNA, 22 bp, Artificial Sequence
  chemically synthesized
agaacatctgtacatctgtata

SEQ ID NO: 687246 - DNA, 22 bp, Artificial Sequence
  chemically synthesized
gaacatctgtacatctgtataa

SEQ ID NO: 687247 - DNA, 22 bp, Artificial Sequence
  chemically synthesized
atgaaagaaataggttccatta

SEQ ID NO: 687248 - DNA, 22 bp, Artificial Sequence
  chemically synthesized
tacatctgtataatggaaccta

SEQ ID NO: 687249 - DNA, 22 bp, Artificial Sequence
  chemically synthesized
gggtctaatgaaagaaataggt

SEQ ID NO: 687250 - DNA, 22 bp, Artificial Sequence
  chemically synthesized
tataatggaacctatttctttc

SEQ ID NO: 687251 - DNA, 22 bp, Artificial Sequence
  chemically synthesized
agattggggtctaatgaaagaa

SEQ ID NO: 687252 - DNA, 22 bp, Artificial Sequence
  chemically synthesized
cagattggggtctaatgaaaga

SEQ ID NO: 687253 - DNA, 22 bp, Artificial Sequence
  chemically synthesized
tcagattggggtctaatgaaag

SEQ ID NO: 687254 - DNA, 22 bp, Artificial Sequence
  chemically synthesized
tttctttcattagaccccaatc

SEQ ID NO: 687255 - DNA, 22 bp, Artificial Sequence
  chemically synthesized
ctttcattagaccccaatctga

SEQ ID NO: 687256 - DNA, 22 bp, Artificial Sequence
  chemically synthesized
tttcattagaccccaatctgaa

SEQ ID NO: 687257 - DNA, 22 bp, Artificial Sequence
  chemically synthesized
tcattagaccccaatctgaaaa

SEQ ID NO: 687258 - DNA, 22 bp, Artificial Sequence
  chemically synthesized
cattagaccccaatctgaaaat

SEQ ID NO: 687259 - DNA, 22 bp, Artificial Sequence
  chemically synthesized
gcagacagagaaattttcagat

SEQ ID NO: 687260 - DNA, 22 bp, Artificial Sequence
  chemically synthesized
attagaccccaatctgaaaatt

SEQ ID NO: 687261 - DNA, 22 bp, Artificial Sequence
  chemically synthesized
ggcagacagagaaattttcaga

SEQ ID NO: 687262 - DNA, 22 bp, Artificial Sequence
  chemically synthesized
tggcagacagagaaattttcag

SEQ ID NO: 687263 - DNA, 22 bp, Artificial Sequence
  chemically synthesized
ttggcagacagagaaattttca

SEQ ID NO: 687264 - DNA, 22 bp, Artificial Sequence
  chemically synthesized
gaccccaatctgaaaatttctc

SEQ ID NO: 687265 - DNA, 22 bp, Artificial Sequence
  chemically synthesized
ttttggcagacagagaaatttt

SEQ ID NO: 687266 - DNA, 22 bp, Artificial Sequence
  chemically synthesized
cttttggcagacagagaaattt

SEQ ID NO: 687267 - DNA, 22 bp, Artificial Sequence
  chemically synthesized
tttcttttggcagacagagaaa

SEQ ID NO: 687268 - DNA, 22 bp, Artificial Sequence
  chemically synthesized
tgtttcttttggcagacagaga

SEQ ID NO: 687269 - DNA, 22 bp, Artificial Sequence
  chemically synthesized
tctgtttcttttggcagacaga

SEQ ID NO: 687270 - DNA, 22 bp, Artificial Sequence
  chemically synthesized
aaaatttctctgtctgccaaaa

SEQ ID NO: 687271 - DNA, 22 bp, Artificial Sequence
  chemically synthesized
ctctgtctgccaaaagaaacag

SEQ ID NO: 687272 - DNA, 22 bp, Artificial Sequence
  chemically synthesized
tctgtctgccaaaagaaacaga

SEQ ID NO: 687273 - DNA, 22 bp, Artificial Sequence
  chemically synthesized
tgtctgccaaaagaaacagaga

SEQ ID NO: 687274 - DNA, 22 bp, Artificial Sequence
  chemically synthesized
tctgccaaaagaaacagagaat

SEQ ID NO: 687275 - DNA, 22 bp, Artificial Sequence
  chemically synthesized
tgggagtagaaggattctctgt

SEQ ID NO: 687276 - DNA, 22 bp, Artificial Sequence
  chemically synthesized
ccaaaagaaacagagaatcctt

SEQ ID NO: 687277 - DNA, 22 bp, Artificial Sequence
  chemically synthesized
cgttgtgggagtagaaggattc

SEQ ID NO: 687278 - DNA, 22 bp, Artificial Sequence
  chemically synthesized
gcgttgtgggagtagaaggatt

SEQ ID NO: 687279 - DNA, 22 bp, Artificial Sequence
  chemically synthesized
ttgcgttgtgggagtagaagga

SEQ ID NO: 687280 - DNA, 22 bp, Artificial Sequence
  chemically synthesized
tcttgcgttgtgggagtagaag

SEQ ID NO: 687281 - DNA, 22 bp, Artificial Sequence
  chemically synthesized
ctctcttgcgttgtgggagtag

SEQ ID NO: 687282 - DNA, 22 bp, Artificial Sequence
  chemically synthesized
cctctcttgcgttgtgggagta

SEQ ID NO: 687283 - DNA, 22 bp, Artificial Sequence
  chemically synthesized
tcctctcttgcgttgtgggagt

SEQ ID NO: 687284 - DNA, 22 bp, Artificial Sequence
  chemically synthesized
ttcctctcttgcgttgtgggag

SEQ ID NO: 687285 - DNA, 22 bp, Artificial Sequence
  chemically synthesized
ttttcctctcttgcgttgtggg

SEQ ID NO: 687286 - DNA, 22 bp, Artificial Sequence
  chemically synthesized
cttttcctctcttgcgttgtgg

SEQ ID NO: 687287 - DNA, 22 bp, Artificial Sequence
  chemically synthesized
tcttttcctctcttgcgttgtg

SEQ ID NO: 687288 - DNA, 22 bp, Artificial Sequence
  chemically synthesized
ttcttttcctctcttgcgttgt

SEQ ID NO: 687289 - DNA, 22 bp, Artificial Sequence
  chemically synthesized
ctactcccacaacgcaagagag

SEQ ID NO: 687290 - DNA, 22 bp, Artificial Sequence
  chemically synthesized
tactcccacaacgcaagagagg

SEQ ID NO: 687291 - DNA, 22 bp, Artificial Sequence
  chemically synthesized
ctcccacaacgcaagagaggaa

SEQ ID NO: 687292 - DNA, 22 bp, Artificial Sequence
  chemically synthesized
ccacaacgcaagagaggaaaag

SEQ ID NO: 687293 - DNA, 22 bp, Artificial Sequence
  chemically synthesized
gaatgtgtttttcttttcctct

SEQ ID NO: 687294 - DNA, 22 bp, Artificial Sequence
  chemically synthesized
agaatgtgtttttcttttcctc

SEQ ID NO: 687295 - DNA, 22 bp, Artificial Sequence
  chemically synthesized
ccacttagaatgtgtttttctt

SEQ ID NO: 687296 - DNA, 22 bp, Artificial Sequence
  chemically synthesized
gccacttagaatgtgtttttct

SEQ ID NO: 687297 - DNA, 22 bp, Artificial Sequence
  chemically synthesized
cttgccacttagaatgtgtttt

SEQ ID NO: 687298 - DNA, 22 bp, Artificial Sequence
  chemically synthesized
ccagttacttgccacttagaat

SEQ ID NO: 687299 - DNA, 22 bp, Artificial Sequence
  chemically synthesized
ctgccagttacttgccacttag

SEQ ID NO: 687300 - DNA, 22 bp, Artificial Sequence
  chemically synthesized
taagtggcaagtaactggcagc

SEQ ID NO: 687301 - DNA, 22 bp, Artificial Sequence
  chemically synthesized
tacaaagtgcctgctgccagtt

SEQ ID NO: 687302 - DNA, 22 bp, Artificial Sequence
  chemically synthesized
atacaaagtgcctgctgccagt

SEQ ID NO: 687303 - DNA, 22 bp, Artificial Sequence
  chemically synthesized
agtggcaagtaactggcagcag

SEQ ID NO: 687304 - DNA, 22 bp, Artificial Sequence
  chemically synthesized
gtatttatacaaagtgcctgct

SEQ ID NO: 687305 - DNA, 22 bp, Artificial Sequence
  chemically synthesized
ggtatttatacaaagtgcctgc

SEQ ID NO: 687306 - DNA, 22 bp, Artificial Sequence
  chemically synthesized
tggtatttatacaaagtgcctg

SEQ ID NO: 687307 - DNA, 22 bp, Artificial Sequence
  chemically synthesized
ttggtatttatacaaagtgcct

SEQ ID NO: 687308 - DNA, 22 bp, Artificial Sequence
  chemically synthesized
cttttggtatttatacaaagtg

SEQ ID NO: 687309 - DNA, 22 bp, Artificial Sequence
  chemically synthesized
gcagcaggcactttgtataaat

SEQ ID NO: 687310 - DNA, 22 bp, Artificial Sequence
  chemically synthesized
acgcgtgctacttttggtattt

SEQ ID NO: 687311 - DNA, 22 bp, Artificial Sequence
  chemically synthesized
tgtataaataccaaaagtagca

SEQ ID NO: 687312 - DNA, 22 bp, Artificial Sequence
  chemically synthesized
gtataaataccaaaagtagcac

SEQ ID NO: 687313 - DNA, 22 bp, Artificial Sequence
  chemically synthesized
tataaataccaaaagtagcacg

SEQ ID NO: 687314 - DNA, 22 bp, Artificial Sequence
  chemically synthesized
aaataaggagtcgtcatcaatg

SEQ ID NO: 687315 - DNA, 22 bp, Artificial Sequence
  chemically synthesized
gaaataaggagtcgtcatcaat

SEQ ID NO: 687316 - DNA, 22 bp, Artificial Sequence
  chemically synthesized
gcacattgatgacgactcctta

SEQ ID NO: 687317 - DNA, 22 bp, Artificial Sequence
  chemically synthesized
caagtgcaggtttgaaataagg

SEQ ID NO: 687318 - DNA, 22 bp, Artificial Sequence
  chemically synthesized
atgacgactccttatttcaaac

SEQ ID NO: 687319 - DNA, 22 bp, Artificial Sequence
  chemically synthesized
ttccaagtgcaggtttgaaata

SEQ ID NO: 687320 - DNA, 22 bp, Artificial Sequence
  chemically synthesized
cagttgttccaagtgcaggttt

SEQ ID NO: 687321 - DNA, 22 bp, Artificial Sequence
  chemically synthesized
cttatttcaaacctgcacttgg

SEQ ID NO: 687322 - DNA, 22 bp, Artificial Sequence
  chemically synthesized
tctgcagttgttccaagtgcag

SEQ ID NO: 687323 - DNA, 22 bp, Artificial Sequence
  chemically synthesized
tatctgcagttgttccaagtgc

SEQ ID NO: 687324 - DNA, 22 bp, Artificial Sequence
  chemically synthesized
atttcaaacctgcacttggaac

SEQ ID NO: 687325 - DNA, 22 bp, Artificial Sequence
  chemically synthesized
tttcaaacctgcacttggaaca

SEQ ID NO: 687326 - DNA, 22 bp, Artificial Sequence
  chemically synthesized
caaacctgcacttggaacaact

SEQ ID NO: 687327 - DNA, 22 bp, Artificial Sequence
  chemically synthesized
gtctctatctgcagttgttcca

SEQ ID NO: 687328 - DNA, 22 bp, Artificial Sequence
  chemically synthesized
aaacctgcacttggaacaactg

SEQ ID NO: 687329 - DNA, 22 bp, Artificial Sequence
  chemically synthesized
ttagtctctatctgcagttgtt

SEQ ID NO: 687330 - DNA, 22 bp, Artificial Sequence
  chemically synthesized
cacttggaacaactgcagatag

SEQ ID NO: 687331 - DNA, 22 bp, Artificial Sequence
  chemically synthesized
ggaacaactgcagatagagact

SEQ ID NO: 687332 - DNA, 22 bp, Artificial Sequence
  chemically synthesized
acaagaattattagtctctatc

SEQ ID NO: 687333 - DNA, 22 bp, Artificial Sequence
  chemically synthesized
gaacaactgcagatagagacta

SEQ ID NO: 687334 - DNA, 22 bp, Artificial Sequence
  chemically synthesized
cagatagagactaataattctt

SEQ ID NO: 687335 - DNA, 22 bp, Artificial Sequence
  chemically synthesized
atacacattgacaagaattatt

SEQ ID NO: 687336 - DNA, 22 bp, Artificial Sequence
  chemically synthesized
aatacacattgacaagaattat

SEQ ID NO: 687337 - DNA, 22 bp, Artificial Sequence
  chemically synthesized
taatacacattgacaagaatta

SEQ ID NO: 687338 - DNA, 22 bp, Artificial Sequence
  chemically synthesized
ttaatacacattgacaagaatt

SEQ ID NO: 687339 - DNA, 22 bp, Artificial Sequence
  chemically synthesized
tcagagcttttaatacacattg

SEQ ID NO: 687340 - DNA, 22 bp, Artificial Sequence
  chemically synthesized
ataattcttgtcaatgtgtatt

SEQ ID NO: 687341 - DNA, 22 bp, Artificial Sequence
  chemically synthesized
ctgtcagagcttttaatacaca

SEQ ID NO: 687342 - DNA, 22 bp, Artificial Sequence
  chemically synthesized
tcctgtcagagcttttaataca

SEQ ID NO: 687343 - DNA, 22 bp, Artificial Sequence
  chemically synthesized
ctcctgtcagagcttttaatac

SEQ ID NO: 687344 - DNA, 22 bp, Artificial Sequence
  chemically synthesized
tctcctgtcagagcttttaata

SEQ ID NO: 687345 - DNA, 22 bp, Artificial Sequence
  chemically synthesized
ttgtcaatgtgtattaaaagct

SEQ ID NO: 687346 - DNA, 22 bp, Artificial Sequence
  chemically synthesized
gtcaatgtgtattaaaagctct

SEQ ID NO: 687347 - DNA, 22 bp, Artificial Sequence
  chemically synthesized
ttttctcctgtcagagctttta

SEQ ID NO: 687348 - DNA, 22 bp, Artificial Sequence
  chemically synthesized
tcaatgtgtattaaaagctctg

SEQ ID NO: 687349 - DNA, 22 bp, Artificial Sequence
  chemically synthesized
cacaagttgttttctcctgtca

SEQ ID NO: 687350 - DNA, 22 bp, Artificial Sequence
  chemically synthesized
aaagctctgacaggagaaaaca

SEQ ID NO: 687351 - DNA, 22 bp, Artificial Sequence
  chemically synthesized
agctgcacaagttgttttctcc

SEQ ID NO: 687352 - DNA, 22 bp, Artificial Sequence
  chemically synthesized
gagctgcacaagttgttttctc

SEQ ID NO: 687353 - DNA, 22 bp, Artificial Sequence
  chemically synthesized
tgacaggagaaaacaacttgtg

SEQ ID NO: 687354 - DNA, 22 bp, Artificial Sequence
  chemically synthesized
aatcttgagctgcacaagttgt

SEQ ID NO: 687355 - DNA, 22 bp, Artificial Sequence
  chemically synthesized
caatcttgagctgcacaagttg

SEQ ID NO: 687356 - DNA, 22 bp, Artificial Sequence
  chemically synthesized
acaggagaaaacaacttgtgca

SEQ ID NO: 687357 - DNA, 22 bp, Artificial Sequence
  chemically synthesized
tcaatcttgagctgcacaagtt

SEQ ID NO: 687358 - DNA, 22 bp, Artificial Sequence
  chemically synthesized
tttcaatcttgagctgcacaag

SEQ ID NO: 687359 - DNA, 22 bp, Artificial Sequence
  chemically synthesized
ctttcaatcttgagctgcacaa

SEQ ID NO: 687360 - DNA, 22 bp, Artificial Sequence
  chemically synthesized
tctttcaatcttgagctgcaca

SEQ ID NO: 687361 - DNA, 22 bp, Artificial Sequence
  chemically synthesized
tgctttctttcaatcttgagct

SEQ ID NO: 687362 - DNA, 22 bp, Artificial Sequence
  chemically synthesized
attgtgctttctttcaatcttg

SEQ ID NO: 687363 - DNA, 22 bp, Artificial Sequence
  chemically synthesized
ctcattgtgctttctttcaatc

SEQ ID NO: 687364 - DNA, 22 bp, Artificial Sequence
  chemically synthesized
gtgcagctcaagattgaaagaa

SEQ ID NO: 687365 - DNA, 22 bp, Artificial Sequence
  chemically synthesized
tgcagctcaagattgaaagaaa

SEQ ID NO: 687366 - DNA, 22 bp, Artificial Sequence
  chemically synthesized
aatctcctcattgtgctttctt

SEQ ID NO: 687367 - DNA, 22 bp, Artificial Sequence
  chemically synthesized
aagattgaaagaaagcacaatg

SEQ ID NO: 687368 - DNA, 22 bp, Artificial Sequence
  chemically synthesized
attgaatctcctcattgtgctt

SEQ ID NO: 687369 - DNA, 22 bp, Artificial Sequence
  chemically synthesized
aattgaatctcctcattgtgct

SEQ ID NO: 687370 - DNA, 22 bp, Artificial Sequence
  chemically synthesized
taattgaatctcctcattgtgc

SEQ ID NO: 687371 - DNA, 22 bp, Artificial Sequence
  chemically synthesized
aaagaaagcacaatgaggagat

SEQ ID NO: 687372 - DNA, 22 bp, Artificial Sequence
  chemically synthesized
ccatcatccagttttaattgaa

SEQ ID NO: 687373 - DNA, 22 bp, Artificial Sequence
  chemically synthesized
tcccatcatccagttttaattg

SEQ ID NO: 687374 - DNA, 22 bp, Artificial Sequence
  chemically synthesized
ctcccatcatccagttttaatt

SEQ ID NO: 687375 - DNA, 22 bp, Artificial Sequence
  chemically synthesized
ttctcccatcatccagttttaa

SEQ ID NO: 687376 - DNA, 22 bp, Artificial Sequence
  chemically synthesized
cttctcccatcatccagtttta

SEQ ID NO: 687377 - DNA, 22 bp, Artificial Sequence
  chemically synthesized
tcttctcccatcatccagtttt

SEQ ID NO: 687378 - DNA, 22 bp, Artificial Sequence
  chemically synthesized
tgctttcttctcccatcatcca

SEQ ID NO: 687379 - DNA, 22 bp, Artificial Sequence
  chemically synthesized
aattaaaactggatgatgggag

SEQ ID NO: 687380 - DNA, 22 bp, Artificial Sequence
  chemically synthesized
tagattatgctttcttctccca

SEQ ID NO: 687381 - DNA, 22 bp, Artificial Sequence
  chemically synthesized
aaactggatgatgggagaagaa

SEQ ID NO: 687382 - DNA, 22 bp, Artificial Sequence
  chemically synthesized
ctatagattatgctttcttctc

SEQ ID NO: 687383 - DNA, 22 bp, Artificial Sequence
  chemically synthesized
gatgatgggagaagaaagcata

SEQ ID NO: 687384 - DNA, 22 bp, Artificial Sequence
  chemically synthesized
tcctcctatagattatgctttc

SEQ ID NO: 687385 - DNA, 22 bp, Artificial Sequence
  chemically synthesized
tacctgtcctcctatagattat

SEQ ID NO: 687386 - DNA, 22 bp, Artificial Sequence
  chemically synthesized
atacctgtcctcctatagatta

SEQ ID NO: 687387 - DNA, 22 bp, Artificial Sequence
  chemically synthesized
taggaggacaggtataaatcct

SEQ ID NO: 687388 - DNA, 22 bp, Artificial Sequence
  chemically synthesized
gacaaatcagaaaaagaggatt

SEQ ID NO: 687389 - DNA, 22 bp, Artificial Sequence
  chemically synthesized
gtagagactggacaaatcagaa

SEQ ID NO: 687390 - DNA, 22 bp, Artificial Sequence
  chemically synthesized
agtagagactggacaaatcaga

SEQ ID NO: 687391 - DNA, 22 bp, Artificial Sequence
  chemically synthesized
tagtagagactggacaaatcag

SEQ ID NO: 687392 - DNA, 22 bp, Artificial Sequence
  chemically synthesized
ttagtagagactggacaaatca

SEQ ID NO: 687393 - DNA, 22 bp, Artificial Sequence
  chemically synthesized
ttttagtagagactggacaaat

SEQ ID NO: 687394 - DNA, 22 bp, Artificial Sequence
  chemically synthesized
tttttctgatttgtccagtctc

SEQ ID NO: 687395 - DNA, 22 bp, Artificial Sequence
  chemically synthesized
tttctgatttgtccagtctcta

SEQ ID NO: 687396 - DNA, 22 bp, Artificial Sequence
  chemically synthesized
aatctcttttagtagagactgg

SEQ ID NO: 687397 - DNA, 22 bp, Artificial Sequence
  chemically synthesized
ttctgatttgtccagtctctac

SEQ ID NO: 687398 - DNA, 22 bp, Artificial Sequence
  chemically synthesized
caatctcttttagtagagactg

SEQ ID NO: 687399 - DNA, 22 bp, Artificial Sequence
  chemically synthesized
tctgatttgtccagtctctact

SEQ ID NO: 687400 - DNA, 22 bp, Artificial Sequence
  chemically synthesized
tcaatctcttttagtagagact

SEQ ID NO: 687401 - DNA, 22 bp, Artificial Sequence
  chemically synthesized
ctgatttgtccagtctctacta

SEQ ID NO: 687402 - DNA, 22 bp, Artificial Sequence
  chemically synthesized
tgatttgtccagtctctactaa

SEQ ID NO: 687403 - DNA, 22 bp, Artificial Sequence
  chemically synthesized
atttgtccagtctctactaaaa

SEQ ID NO: 687404 - DNA, 22 bp, Artificial Sequence
  chemically synthesized
gtccagtctctactaaaagaga

SEQ ID NO: 687405 - DNA, 22 bp, Artificial Sequence
  chemically synthesized
tccagtctctactaaaagagat

SEQ ID NO: 687406 - DNA, 22 bp, Artificial Sequence
  chemically synthesized
atatcagctttcaatctctttt

SEQ ID NO: 687407 - DNA, 22 bp, Artificial Sequence
  chemically synthesized
tgatatcagctttcaatctctt

SEQ ID NO: 687408 - DNA, 22 bp, Artificial Sequence
  chemically synthesized
tactaaaagagattgaaagctg

SEQ ID NO: 687409 - DNA, 22 bp, Artificial Sequence
  chemically synthesized
ctaaaagagattgaaagctgat

SEQ ID NO: 687410 - DNA, 22 bp, Artificial Sequence
  chemically synthesized
aaagagattgaaagctgatatc

SEQ ID NO: 687411 - DNA, 22 bp, Artificial Sequence
  chemically synthesized
gcatggcaaaggattctgatat

SEQ ID NO: 687412 - DNA, 22 bp, Artificial Sequence
  chemically synthesized
aaagctgatatcagaatccttt

SEQ ID NO: 687413 - DNA, 22 bp, Artificial Sequence
  chemically synthesized
taactagcatggcaaaggattc

SEQ ID NO: 687414 - DNA, 22 bp, Artificial Sequence
  chemically synthesized
atatcagaatcctttgccatgc

SEQ ID NO: 687415 - DNA, 22 bp, Artificial Sequence
  chemically synthesized
aataaataaatgcctataacta

SEQ ID NO: 687416 - DNA, 22 bp, Artificial Sequence
  chemically synthesized
tgccatgctagttataggcatt

SEQ ID NO: 687417 - DNA, 22 bp, Artificial Sequence
  chemically synthesized
gccatgctagttataggcattt

SEQ ID NO: 687418 - DNA, 22 bp, Artificial Sequence
  chemically synthesized
ccatgctagttataggcattta

SEQ ID NO: 687419 - DNA, 22 bp, Artificial Sequence
  chemically synthesized
gttataggcatttatttattta

SEQ ID NO: 687420 - DNA, 22 bp, Artificial Sequence
  chemically synthesized
taggcatttatttatttaggta

SEQ ID NO: 687421 - DNA, 22 bp, Artificial Sequence
  chemically synthesized
aaaaatgtaaataaatacctaa

SEQ ID NO: 687422 - DNA, 22 bp, Artificial Sequence
  chemically synthesized
atttatttaggtatttatttac

SEQ ID NO: 687423 - DNA, 22 bp, Artificial Sequence
  chemically synthesized
tttatttaggtatttatttaca

SEQ ID NO: 687424 - DNA, 22 bp, Artificial Sequence
  chemically synthesized
atttaggtatttatttacattt

SEQ ID NO: 687425 - DNA, 22 bp, Artificial Sequence
  chemically synthesized
tttaggtatttatttacatttt

SEQ ID NO: 687426 - DNA, 22 bp, Artificial Sequence
  chemically synthesized
aggtatttatttacatttttta

SEQ ID NO: 687427 - DNA, 22 bp, Artificial Sequence
  chemically synthesized
ggtatttatttacattttttaa

SEQ ID NO: 687428 - DNA, 22 bp, Artificial Sequence
  chemically synthesized
tacataaaagcatataattaaa

SEQ ID NO: 687429 - DNA, 22 bp, Artificial Sequence
  chemically synthesized
atttacattttttaattatatg

SEQ ID NO: 687430 - DNA, 22 bp, Artificial Sequence
  chemically synthesized
tttacattttttaattatatgc

SEQ ID NO: 687431 - DNA, 22 bp, Artificial Sequence
  chemically synthesized
acattttttaattatatgcttt

SEQ ID NO: 687432 - DNA, 22 bp, Artificial Sequence
  chemically synthesized
cattttttaattatatgctttt

SEQ ID NO: 687433 - DNA, 22 bp, Artificial Sequence
  chemically synthesized
aagcatgattatacataaaagc

SEQ ID NO: 687434 - DNA, 22 bp, Artificial Sequence
  chemically synthesized
tttaattatatgcttttatgta

SEQ ID NO: 687435 - DNA, 22 bp, Artificial Sequence
  chemically synthesized
ttaattatatgcttttatgtat

SEQ ID NO: 687436 - DNA, 22 bp, Artificial Sequence
  chemically synthesized
taattatatgcttttatgtata

SEQ ID NO: 687437 - DNA, 22 bp, Artificial Sequence
  chemically synthesized
aattatatgcttttatgtataa

SEQ ID NO: 687438 - DNA, 22 bp, Artificial Sequence
  chemically synthesized
attatatgcttttatgtataat

SEQ ID NO: 687439 - DNA, 22 bp, Artificial Sequence
  chemically synthesized
tatgcttttatgtataatcatg

SEQ ID NO: 687440 - DNA, 22 bp, Artificial Sequence
  chemically synthesized
tacacgtaattgaagcatgatt

SEQ ID NO: 687441 - DNA, 22 bp, Artificial Sequence
  chemically synthesized
ctgtacacgtaattgaagcatg

SEQ ID NO: 687442 - DNA, 22 bp, Artificial Sequence
  chemically synthesized
ttatgtataatcatgcttcaat

SEQ ID NO: 687443 - DNA, 22 bp, Artificial Sequence
  chemically synthesized
gctgtacacgtaattgaagcat

SEQ ID NO: 687444 - DNA, 22 bp, Artificial Sequence
  chemically synthesized
tatgtataatcatgcttcaatt

SEQ ID NO: 687445 - DNA, 22 bp, Artificial Sequence
  chemically synthesized
atgtataatcatgcttcaatta

SEQ ID NO: 687446 - DNA, 22 bp, Artificial Sequence
  chemically synthesized
tgtataatcatgcttcaattac

SEQ ID NO: 687447 - DNA, 22 bp, Artificial Sequence
  chemically synthesized
ccatttgctgtacacgtaattg

SEQ ID NO: 687448 - DNA, 22 bp, Artificial Sequence
  chemically synthesized
accatttgctgtacacgtaatt

SEQ ID NO: 687449 - DNA, 22 bp, Artificial Sequence
  chemically synthesized
caattacgtgtacagcaaatgg

SEQ ID NO: 687450 - DNA, 22 bp, Artificial Sequence
  chemically synthesized
aattacgtgtacagcaaatggt

SEQ ID NO: 687451 - DNA, 22 bp, Artificial Sequence
  chemically synthesized
cgtgtacagcaaatggtaaata

SEQ ID NO: 687452 - DNA, 22 bp, Artificial Sequence
  chemically synthesized
tataaatgagaaatatttacca

SEQ ID NO: 687453 - DNA, 22 bp, Artificial Sequence
  chemically synthesized
atgttatataaatgagaaatat

SEQ ID NO: 687454 - DNA, 22 bp, Artificial Sequence
  chemically synthesized
acctcatgttatataaatgaga

SEQ ID NO: 687455 - DNA, 22 bp, Artificial Sequence
  chemically synthesized
ggaatgactgacctcatgttat

SEQ ID NO: 687456 - DNA, 22 bp, Artificial Sequence
  chemically synthesized
ctcatttatataacatgaggtc

SEQ ID NO: 687457 - DNA, 22 bp, Artificial Sequence
  chemically synthesized
tcatttatataacatgaggtca

SEQ ID NO: 687458 - DNA, 22 bp, Artificial Sequence
  chemically synthesized
attaggaatgactgacctcatg

SEQ ID NO: 687459 - DNA, 22 bp, Artificial Sequence
  chemically synthesized
atttatataacatgaggtcagt

SEQ ID NO: 687460 - DNA, 22 bp, Artificial Sequence
  chemically synthesized
atataacatgaggtcagtcatt

SEQ ID NO: 687461 - DNA, 22 bp, Artificial Sequence
  chemically synthesized
tataacatgaggtcagtcattc

SEQ ID NO: 687462 - DNA, 22 bp, Artificial Sequence
  chemically synthesized
aggcaccagaaaagattcatta

SEQ ID NO: 687463 - DNA, 22 bp, Artificial Sequence
  chemically synthesized
aaggcaccagaaaagattcatt

SEQ ID NO: 687464 - DNA, 22 bp, Artificial Sequence
  chemically synthesized
taaggcaccagaaaagattcat

SEQ ID NO: 687465 - DNA, 22 bp, Artificial Sequence
  chemically synthesized
ggaggttttaaggcaccagaaa

SEQ ID NO: 687466 - DNA, 22 bp, Artificial Sequence
  chemically synthesized
ctaatgaatcttttctggtgcc

SEQ ID NO: 687467 - DNA, 22 bp, Artificial Sequence
  chemically synthesized
atgaatcttttctggtgcctta

SEQ ID NO: 687468 - DNA, 22 bp, Artificial Sequence
  chemically synthesized
attgggaggttttaaggcacca

SEQ ID NO: 687469 - DNA, 22 bp, Artificial Sequence
  chemically synthesized
aattgggaggttttaaggcacc

SEQ ID NO: 687470 - DNA, 22 bp, Artificial Sequence
  chemically synthesized
taattgggaggttttaaggcac

SEQ ID NO: 687471 - DNA, 22 bp, Artificial Sequence
  chemically synthesized
ttctggtgccttaaaacctccc

SEQ ID NO: 687472 - DNA, 22 bp, Artificial Sequence
  chemically synthesized
tctggtgccttaaaacctccca

SEQ ID NO: 687473 - DNA, 22 bp, Artificial Sequence
  chemically synthesized
ctggtgccttaaaacctcccaa

SEQ ID NO: 687474 - DNA, 22 bp, Artificial Sequence
  chemically synthesized
tggtgccttaaaacctcccaat

SEQ ID NO: 687475 - DNA, 22 bp, Artificial Sequence
  chemically synthesized
aaggagtctttaattgggaggt

SEQ ID NO: 687476 - DNA, 22 bp, Artificial Sequence
  chemically synthesized
gaaggagtctttaattgggagg

SEQ ID NO: 687477 - DNA, 22 bp, Artificial Sequence
  chemically synthesized
gtgccttaaaacctcccaatta

SEQ ID NO: 687478 - DNA, 22 bp, Artificial Sequence
  chemically synthesized
aaaacctcccaattaaagactc

SEQ ID NO: 687479 - DNA, 22 bp, Artificial Sequence
  chemically synthesized
gagtatttgaaggagtctttaa

SEQ ID NO: 687480 - DNA, 22 bp, Artificial Sequence
  chemically synthesized
aaacctcccaattaaagactcc

SEQ ID NO: 687481 - DNA, 22 bp, Artificial Sequence
  chemically synthesized
actggagtatttgaaggagtct

SEQ ID NO: 687482 - DNA, 22 bp, Artificial Sequence
  chemically synthesized
gactggagtatttgaaggagtc

SEQ ID NO: 687483 - DNA, 22 bp, Artificial Sequence
  chemically synthesized
tgactggagtatttgaaggagt

SEQ ID NO: 687484 - DNA, 22 bp, Artificial Sequence
  chemically synthesized
ccaattaaagactccttcaaat

SEQ ID NO: 687485 - DNA, 22 bp, Artificial Sequence
  chemically synthesized
gtgtctttgactggagtatttg

SEQ ID NO: 687486 - DNA, 22 bp, Artificial Sequence
  chemically synthesized
aagactccttcaaatactccag

SEQ ID NO: 687487 - DNA, 22 bp, Artificial Sequence
  chemically synthesized
attggtgtctttgactggagta

SEQ ID NO: 687488 - DNA, 22 bp, Artificial Sequence
  chemically synthesized
aattggtgtctttgactggagt

SEQ ID NO: 687489 - DNA, 22 bp, Artificial Sequence
  chemically synthesized
cttcaaatactccagtcaaaga

SEQ ID NO: 687490 - DNA, 22 bp, Artificial Sequence
  chemically synthesized
caaatactccagtcaaagacac

SEQ ID NO: 687491 - DNA, 22 bp, Artificial Sequence
  chemically synthesized
aaatactccagtcaaagacacc

SEQ ID NO: 687492 - DNA, 22 bp, Artificial Sequence
  chemically synthesized
agaggaatccttaattggtgtc

SEQ ID NO: 687493 - DNA, 22 bp, Artificial Sequence
  chemically synthesized
ttaagaggaatccttaattggt

SEQ ID NO: 687494 - DNA, 22 bp, Artificial Sequence
  chemically synthesized
cagtcaaagacaccaattaagg

SEQ ID NO: 687495 - DNA, 22 bp, Artificial Sequence
  chemically synthesized
tctattaagaggaatccttaat

SEQ ID NO: 687496 - DNA, 22 bp, Artificial Sequence
  chemically synthesized
atctattaagaggaatccttaa

SEQ ID NO: 687497 - DNA, 22 bp, Artificial Sequence
  chemically synthesized
gatatttatctattaagaggaa

SEQ ID NO: 687498 - DNA, 22 bp, Artificial Sequence
  chemically synthesized
ggatatttatctattaagagga

SEQ ID NO: 687499 - DNA, 22 bp, Artificial Sequence
  chemically synthesized
gtttggatatttatctattaag

SEQ ID NO: 687500 - DNA, 22 bp, Artificial Sequence
  chemically synthesized
aggattcctcttaatagataaa

SEQ ID NO: 687501 - DNA, 22 bp, Artificial Sequence
  chemically synthesized
ctcttaatagataaatatccaa

SEQ ID NO: 687502 - DNA, 22 bp, Artificial Sequence
  chemically synthesized
aggacagcctggtttggatatt

SEQ ID NO: 687503 - DNA, 22 bp, Artificial Sequence
  chemically synthesized
gaggacagcctggtttggatat

SEQ ID NO: 687504 - DNA, 22 bp, Artificial Sequence
  chemically synthesized
ttaatagataaatatccaaacc

SEQ ID NO: 687505 - DNA, 22 bp, Artificial Sequence
  chemically synthesized
tgaggacagcctggtttggata

SEQ ID NO: 687506 - DNA, 22 bp, Artificial Sequence
  chemically synthesized
aatagataaatatccaaaccag

SEQ ID NO: 687507 - DNA, 22 bp, Artificial Sequence
  chemically synthesized
atagataaatatccaaaccagg

SEQ ID NO: 687508 - DNA, 22 bp, Artificial Sequence
  chemically synthesized
tcattttgaggacagcctggtt

SEQ ID NO: 687509 - DNA, 22 bp, Artificial Sequence
  chemically synthesized
gttatcattttgaggacagcct

SEQ ID NO: 687510 - DNA, 22 bp, Artificial Sequence
  chemically synthesized
acactggttatcattttgagga

SEQ ID NO: 687511 - DNA, 22 bp, Artificial Sequence
  chemically synthesized
gacactggttatcattttgagg

SEQ ID NO: 687512 - DNA, 22 bp, Artificial Sequence
  chemically synthesized
gaatcttgacactggttatcat

SEQ ID NO: 687513 - DNA, 22 bp, Artificial Sequence
  chemically synthesized
tcctcaaaatgataaccagtgt

SEQ ID NO: 687514 - DNA, 22 bp, Artificial Sequence
  chemically synthesized
aacactggaatcttgacactgg

SEQ ID NO: 687515 - DNA, 22 bp, Artificial Sequence
  chemically synthesized
gaacactggaatcttgacactg

SEQ ID NO: 687516 - DNA, 22 bp, Artificial Sequence
  chemically synthesized
aaaatgataaccagtgtcaaga

SEQ ID NO: 687517 - DNA, 22 bp, Artificial Sequence
  chemically synthesized
tgaacactggaatcttgacact

SEQ ID NO: 687518 - DNA, 22 bp, Artificial Sequence
  chemically synthesized
ttgaacactggaatcttgacac

SEQ ID NO: 687519 - DNA, 22 bp, Artificial Sequence
  chemically synthesized
tttgaacactggaatcttgaca

SEQ ID NO: 687520 - DNA, 22 bp, Artificial Sequence
  chemically synthesized
ttttgaacactggaatcttgac

SEQ ID NO: 687521 - DNA, 22 bp, Artificial Sequence
  chemically synthesized
tcttttttgaacactggaatct

SEQ ID NO: 687522 - DNA, 22 bp, Artificial Sequence
  chemically synthesized
atctgtcttttttgaacactgg

SEQ ID NO: 687523 - DNA, 22 bp, Artificial Sequence
  chemically synthesized
ctgatctgtcttttttgaacac

SEQ ID NO: 687524 - DNA, 22 bp, Artificial Sequence
  chemically synthesized
actgatctgtcttttttgaaca

SEQ ID NO: 687525 - DNA, 22 bp, Artificial Sequence
  chemically synthesized
cttactgatctgtcttttttga

SEQ ID NO: 687526 - DNA, 22 bp, Artificial Sequence
  chemically synthesized
cagtgttcaaaaaagacagatc

SEQ ID NO: 687527 - DNA, 22 bp, Artificial Sequence
  chemically synthesized
ggagactgcttactgatctgtc

SEQ ID NO: 687528 - DNA, 22 bp, Artificial Sequence
  chemically synthesized
gggagactgcttactgatctgt

SEQ ID NO: 687529 - DNA, 22 bp, Artificial Sequence
  chemically synthesized
gcttgggagactgcttactgat

SEQ ID NO: 687530 - DNA, 22 bp, Artificial Sequence
  chemically synthesized
aaaaaagacagatcagtaagca

SEQ ID NO: 687531 - DNA, 22 bp, Artificial Sequence
  chemically synthesized
gcacacagtcaattggcttggg

SEQ ID NO: 687532 - DNA, 22 bp, Artificial Sequence
  chemically synthesized
ccaagccaattgactgtgtgcc

SEQ ID NO: 687533 - DNA, 22 bp, Artificial Sequence
  chemically synthesized
aaccaagggtggaattggcaca

SEQ ID NO: 687534 - DNA, 22 bp, Artificial Sequence
  chemically synthesized
caaccaagggtggaattggcac

SEQ ID NO: 687535 - DNA, 22 bp, Artificial Sequence
  chemically synthesized
ccttcaaccaagggtggaattg

SEQ ID NO: 687536 - DNA, 22 bp, Artificial Sequence
  chemically synthesized
tcccttcaaccaagggtggaat

SEQ ID NO: 687537 - DNA, 22 bp, Artificial Sequence
  chemically synthesized
actgtgtgccaattccaccctt

SEQ ID NO: 687538 - DNA, 22 bp, Artificial Sequence
  chemically synthesized
tctcccttcaaccaagggtgga

SEQ ID NO: 687539 - DNA, 22 bp, Artificial Sequence
  chemically synthesized
ctctcccttcaaccaagggtgg

SEQ ID NO: 687540 - DNA, 22 bp, Artificial Sequence
  chemically synthesized
tctctcccttcaaccaagggtg

SEQ ID NO: 687541 - DNA, 22 bp, Artificial Sequence
  chemically synthesized
tgtgccaattccacccttggtt

SEQ ID NO: 687542 - DNA, 22 bp, Artificial Sequence
  chemically synthesized
cacccttggttgaagggagaga

SEQ ID NO: 687543 - DNA, 22 bp, Artificial Sequence
  chemically synthesized
aagcaatcattttctctccctt

SEQ ID NO: 687544 - DNA, 22 bp, Artificial Sequence
  chemically synthesized
tgaagcaatcattttctctccc

SEQ ID NO: 687545 - DNA, 22 bp, Artificial Sequence
  chemically synthesized
ctctgaagcaatcattttctct

SEQ ID NO: 687546 - DNA, 22 bp, Artificial Sequence
  chemically synthesized
ggttgaagggagagaaaatgat

SEQ ID NO: 687547 - DNA, 22 bp, Artificial Sequence
  chemically synthesized
tgctctgaagcaatcattttct

SEQ ID NO: 687548 - DNA, 22 bp, Artificial Sequence
  chemically synthesized
gttgaagggagagaaaatgatt

SEQ ID NO: 687549 - DNA, 22 bp, Artificial Sequence
  chemically synthesized
ctgctctgaagcaatcattttc

SEQ ID NO: 687550 - DNA, 22 bp, Artificial Sequence
  chemically synthesized
cttctgctctgaagcaatcatt

SEQ ID NO: 687551 - DNA, 22 bp, Artificial Sequence
  chemically synthesized
aagggagagaaaatgattgctt

SEQ ID NO: 687552 - DNA, 22 bp, Artificial Sequence
  chemically synthesized
caccgttgcttctgctctgaag

SEQ ID NO: 687553 - DNA, 22 bp, Artificial Sequence
  chemically synthesized
ccaccgttgcttctgctctgaa

SEQ ID NO: 687554 - DNA, 22 bp, Artificial Sequence
  chemically synthesized
cttccaccgttgcttctgctct

SEQ ID NO: 687555 - DNA, 22 bp, Artificial Sequence
  chemically synthesized
tgcttccaccgttgcttctgct

SEQ ID NO: 687556 - DNA, 22 bp, Artificial Sequence
  chemically synthesized
ctgcttccaccgttgcttctgc

SEQ ID NO: 687557 - DNA, 22 bp, Artificial Sequence
  chemically synthesized
ttctgcttccaccgttgcttct

SEQ ID NO: 687558 - DNA, 22 bp, Artificial Sequence
  chemically synthesized
cttctgcttccaccgttgcttc

SEQ ID NO: 687559 - DNA, 22 bp, Artificial Sequence
  chemically synthesized
cttcagagcagaagcaacggtg

SEQ ID NO: 687560 - DNA, 22 bp, Artificial Sequence
  chemically synthesized
tttcttctgcttccaccgttgc

SEQ ID NO: 687561 - DNA, 22 bp, Artificial Sequence
  chemically synthesized
cagagcagaagcaacggtggaa

SEQ ID NO: 687562 - DNA, 22 bp, Artificial Sequence
  chemically synthesized
agagcagaagcaacggtggaag

SEQ ID NO: 687563 - DNA, 22 bp, Artificial Sequence
  chemically synthesized
tctgtttcttctgcttccaccg

SEQ ID NO: 687564 - DNA, 22 bp, Artificial Sequence
  chemically synthesized
gtctgtttcttctgcttccacc

SEQ ID NO: 687565 - DNA, 22 bp, Artificial Sequence
  chemically synthesized
tgtctgtttcttctgcttccac

SEQ ID NO: 687566 - DNA, 22 bp, Artificial Sequence
  chemically synthesized
ttgtctgtttcttctgcttcca

SEQ ID NO: 687567 - DNA, 22 bp, Artificial Sequence
  chemically synthesized
tttgtctgtttcttctgcttcc

SEQ ID NO: 687568 - DNA, 22 bp, Artificial Sequence
  chemically synthesized
ttttgtctgtttcttctgcttc

SEQ ID NO: 687569 - DNA, 22 bp, Artificial Sequence
  chemically synthesized
tttttgtctgtttcttctgctt

SEQ ID NO: 687570 - DNA, 22 bp, Artificial Sequence
  chemically synthesized
ttttttgtctgtttcttctgct

SEQ ID NO: 687571 - DNA, 22 bp, Artificial Sequence
  chemically synthesized
tttttttgtctgtttcttctgc

SEQ ID NO: 687572 - DNA, 22 bp, Artificial Sequence
  chemically synthesized
ccgcccccactttttttttgtc

SEQ ID NO: 687573 - DNA, 22 bp, Artificial Sequence
  chemically synthesized
tcccgcccccactttttttttg

SEQ ID NO: 687574 - DNA, 22 bp, Artificial Sequence
  chemically synthesized
ctctcccgcccccacttttttt

SEQ ID NO: 687575 - DNA, 22 bp, Artificial Sequence
  chemically synthesized
tcctctcccgcccccacttttt

SEQ ID NO: 687576 - DNA, 22 bp, Artificial Sequence
  chemically synthesized
tctcctctcccgcccccacttt

SEQ ID NO: 687577 - DNA, 22 bp, Artificial Sequence
  chemically synthesized
accctctctcctctcccgcccc

SEQ ID NO: 687578 - DNA, 22 bp, Artificial Sequence
  chemically synthesized
aaccctctctcctctcccgccc

SEQ ID NO: 687579 - DNA, 22 bp, Artificial Sequence
  chemically synthesized
catcttaaccctctctcctctc

SEQ ID NO: 687580 - DNA, 22 bp, Artificial Sequence
  chemically synthesized
tcccattgcatcttaaccctct

SEQ ID NO: 687581 - DNA, 22 bp, Artificial Sequence
  chemically synthesized
ctgtcccattgcatcttaaccc

SEQ ID NO: 687582 - DNA, 22 bp, Artificial Sequence
  chemically synthesized
actgtcccattgcatcttaacc

SEQ ID NO: 687583 - DNA, 22 bp, Artificial Sequence
  chemically synthesized
cacaacatcttactgtcccatt

SEQ ID NO: 687584 - DNA, 22 bp, Artificial Sequence
  chemically synthesized
ctccacaacatcttactgtccc

SEQ ID NO: 687585 - DNA, 22 bp, Artificial Sequence
  chemically synthesized
agatgcaatgggacagtaagat

SEQ ID NO: 687586 - DNA, 22 bp, Artificial Sequence
  chemically synthesized
acactactccacaacatcttac

SEQ ID NO: 687587 - DNA, 22 bp, Artificial Sequence
  chemically synthesized
cgggttcacactactccacaac

SEQ ID NO: 687588 - DNA, 22 bp, Artificial Sequence
  chemically synthesized
ccgggttcacactactccacaa

SEQ ID NO: 687589 - DNA, 22 bp, Artificial Sequence
  chemically synthesized
atttccgggttcacactactcc

SEQ ID NO: 687590 - DNA, 22 bp, Artificial Sequence
  chemically synthesized
ccaattgatttccgggttcaca

SEQ ID NO: 687591 - DNA, 22 bp, Artificial Sequence
  chemically synthesized
cccaattgatttccgggttcac

SEQ ID NO: 687592 - DNA, 22 bp, Artificial Sequence
  chemically synthesized
tggagtagtgtgaacccggaaa

SEQ ID NO: 687593 - DNA, 22 bp, Artificial Sequence
  chemically synthesized
tttcccaattgatttccgggtt

SEQ ID NO: 687594 - DNA, 22 bp, Artificial Sequence
  chemically synthesized
tatttcccaattgatttccggg

SEQ ID NO: 687595 - DNA, 22 bp, Artificial Sequence
  chemically synthesized
atgttctatttcccaattgatt

SEQ ID NO: 687596 - DNA, 22 bp, Artificial Sequence
  chemically synthesized
gatgttctatttcccaattgat

SEQ ID NO: 687597 - DNA, 22 bp, Artificial Sequence
  chemically synthesized
tgatgttctatttcccaattga

SEQ ID NO: 687598 - DNA, 22 bp, Artificial Sequence
  chemically synthesized
ttgatgttctatttcccaattg

SEQ ID NO: 687599 - DNA, 22 bp, Artificial Sequence
  chemically synthesized
ttttgatgttctatttcccaat

SEQ ID NO: 687600 - DNA, 22 bp, Artificial Sequence
  chemically synthesized
gcgtgttcttttgatgttctat

SEQ ID NO: 687601 - DNA, 22 bp, Artificial Sequence
  chemically synthesized
ggaaatagaacatcaaaagaac

SEQ ID NO: 687602 - DNA, 22 bp, Artificial Sequence
  chemically synthesized
gagaggagcaaacaaaaaccca

SEQ ID NO: 687603 - DNA, 22 bp, Artificial Sequence
  chemically synthesized
agagaggagcaaacaaaaaccc

SEQ ID NO: 687604 - DNA, 22 bp, Artificial Sequence
  chemically synthesized
tagagaggagcaaacaaaaacc

SEQ ID NO: 687605 - DNA, 22 bp, Artificial Sequence
  chemically synthesized
tttagagaggagcaaacaaaaa

SEQ ID NO: 687606 - DNA, 22 bp, Artificial Sequence
  chemically synthesized
ctttagagaggagcaaacaaaa

SEQ ID NO: 687607 - DNA, 22 bp, Artificial Sequence
  chemically synthesized
tctttagagaggagcaaacaaa

SEQ ID NO: 687608 - DNA, 22 bp, Artificial Sequence
  chemically synthesized
ttctttagagaggagcaaacaa

SEQ ID NO: 687609 - DNA, 22 bp, Artificial Sequence
  chemically synthesized
tttctttagagaggagcaaaca

SEQ ID NO: 687610 - DNA, 22 bp, Artificial Sequence
  chemically synthesized
ttgggtttttgtttgctcctct

SEQ ID NO: 687611 - DNA, 22 bp, Artificial Sequence
  chemically synthesized
tgggtttttgtttgctcctctc

SEQ ID NO: 687612 - DNA, 22 bp, Artificial Sequence
  chemically synthesized
gggtttttgtttgctcctctct

SEQ ID NO: 687613 - DNA, 22 bp, Artificial Sequence
  chemically synthesized
ggtttttgtttgctcctctcta

SEQ ID NO: 687614 - DNA, 22 bp, Artificial Sequence
  chemically synthesized
ttgtttgctcctctctaaagaa

SEQ ID NO: 687615 - DNA, 22 bp, Artificial Sequence
  chemically synthesized
tgtttgctcctctctaaagaaa

SEQ ID NO: 687616 - DNA, 22 bp, Artificial Sequence
  chemically synthesized
gtttgctcctctctaaagaaaa

SEQ ID NO: 687617 - DNA, 22 bp, Artificial Sequence
  chemically synthesized
tttgctcctctctaaagaaaaa

SEQ ID NO: 687618 - DNA, 22 bp, Artificial Sequence
  chemically synthesized
aggtagacagaattttttcttt

SEQ ID NO: 687619 - DNA, 22 bp, Artificial Sequence
  chemically synthesized
gctcctctctaaagaaaaaatt

SEQ ID NO: 687620 - DNA, 22 bp, Artificial Sequence
  chemically synthesized
ctcctctctaaagaaaaaattc

SEQ ID NO: 687621 - DNA, 22 bp, Artificial Sequence
  chemically synthesized
tctaaggtagacagaatttttt

SEQ ID NO: 687622 - DNA, 22 bp, Artificial Sequence
  chemically synthesized
gtctaaggtagacagaattttt

SEQ ID NO: 687623 - DNA, 22 bp, Artificial Sequence
  chemically synthesized
ctctctaaagaaaaaattctgt

SEQ ID NO: 687624 - DNA, 22 bp, Artificial Sequence
  chemically synthesized
tctaaagaaaaaattctgtcta

SEQ ID NO: 687625 - DNA, 22 bp, Artificial Sequence
  chemically synthesized
taaagaaaaaattctgtctacc

SEQ ID NO: 687626 - DNA, 22 bp, Artificial Sequence
  chemically synthesized
aagaaaaaattctgtctacctt

SEQ ID NO: 687627 - DNA, 22 bp, Artificial Sequence
  chemically synthesized
gtgaagtgcttgtctaaggtag

SEQ ID NO: 687628 - DNA, 22 bp, Artificial Sequence
  chemically synthesized
actggtgaagtgcttgtctaag

SEQ ID NO: 687629 - DNA, 22 bp, Artificial Sequence
  chemically synthesized
aactggtgaagtgcttgtctaa

SEQ ID NO: 687630 - DNA, 22 bp, Artificial Sequence
  chemically synthesized
tgtctaccttagacaagcactt

SEQ ID NO: 687631 - DNA, 22 bp, Artificial Sequence
  chemically synthesized
tctaccttagacaagcacttca

SEQ ID NO: 687632 - DNA, 22 bp, Artificial Sequence
  chemically synthesized
ccttagacaagcacttcaccag

SEQ ID NO: 687633 - DNA, 22 bp, Artificial Sequence
  chemically synthesized
ccacagacttaactggtgaagt

SEQ ID NO: 687634 - DNA, 22 bp, Artificial Sequence
  chemically synthesized
cccacagacttaactggtgaag

SEQ ID NO: 687635 - DNA, 22 bp, Artificial Sequence
  chemically synthesized
agacaagcacttcaccagttaa

SEQ ID NO: 687636 - DNA, 22 bp, Artificial Sequence
  chemically synthesized
gacaagcacttcaccagttaag

SEQ ID NO: 687637 - DNA, 22 bp, Artificial Sequence
  chemically synthesized
agtagatgcttcccacagactt

SEQ ID NO: 687638 - DNA, 22 bp, Artificial Sequence
  chemically synthesized
caccagttaagtctgtgggaag

SEQ ID NO: 687639 - DNA, 22 bp, Artificial Sequence
  chemically synthesized
accagttaagtctgtgggaagc

SEQ ID NO: 687640 - DNA, 22 bp, Artificial Sequence
  chemically synthesized
ccctaagtagatgcttcccaca

SEQ ID NO: 687641 - DNA, 22 bp, Artificial Sequence
  chemically synthesized
cctgccctaagtagatgcttcc

SEQ ID NO: 687642 - DNA, 22 bp, Artificial Sequence
  chemically synthesized
agtctgtgggaagcatctactt

SEQ ID NO: 687643 - DNA, 22 bp, Artificial Sequence
  chemically synthesized
gcctacctgccctaagtagatg

SEQ ID NO: 687644 - DNA, 22 bp, Artificial Sequence
  chemically synthesized
tgggaagcatctacttagggca

SEQ ID NO: 687645 - DNA, 22 bp, Artificial Sequence
  chemically synthesized
aagataccaattggcctacctg

SEQ ID NO: 687646 - DNA, 22 bp, Artificial Sequence
  chemically synthesized
cttagggcaggtaggccaattg

SEQ ID NO: 687647 - DNA, 22 bp, Artificial Sequence
  chemically synthesized
agggcaggtaggccaattggta

SEQ ID NO: 687648 - DNA, 22 bp, Artificial Sequence
  chemically synthesized
gggcaggtaggccaattggtat

SEQ ID NO: 687649 - DNA, 22 bp, Artificial Sequence
  chemically synthesized
aaaaagattgaagataccaatt

SEQ ID NO: 687650 - DNA, 22 bp, Artificial Sequence
  chemically synthesized
gaaaaagattgaagataccaat

SEQ ID NO: 687651 - DNA, 22 bp, Artificial Sequence
  chemically synthesized
tgaaaaagattgaagataccaa

SEQ ID NO: 687652 - DNA, 22 bp, Artificial Sequence
  chemically synthesized
agcctttgaaaaagattgaaga

SEQ ID NO: 687653 - DNA, 22 bp, Artificial Sequence
  chemically synthesized
aagcctttgaaaaagattgaag

SEQ ID NO: 687654 - DNA, 22 bp, Artificial Sequence
  chemically synthesized
aatttaagcctttgaaaaagat

SEQ ID NO: 687655 - DNA, 22 bp, Artificial Sequence
  chemically synthesized
gtatcttcaatctttttcaaag

SEQ ID NO: 687656 - DNA, 22 bp, Artificial Sequence
  chemically synthesized
caatctttttcaaaggcttaaa

SEQ ID NO: 687657 - DNA, 22 bp, Artificial Sequence
  chemically synthesized
gatgtgcctaaatttaagcctt

SEQ ID NO: 687658 - DNA, 22 bp, Artificial Sequence
  chemically synthesized
aatctttttcaaaggcttaaat

SEQ ID NO: 687659 - DNA, 22 bp, Artificial Sequence
  chemically synthesized
ctggatgtgcctaaatttaagc

SEQ ID NO: 687660 - DNA, 22 bp, Artificial Sequence
  chemically synthesized
ctcctggatgtgcctaaattta

SEQ ID NO: 687661 - DNA, 22 bp, Artificial Sequence
  chemically synthesized
tttcaaaggcttaaatttaggc

SEQ ID NO: 687662 - DNA, 22 bp, Artificial Sequence
  chemically synthesized
actcctggatgtgcctaaattt

SEQ ID NO: 687663 - DNA, 22 bp, Artificial Sequence
  chemically synthesized
ttcaaaggcttaaatttaggca

SEQ ID NO: 687664 - DNA, 22 bp, Artificial Sequence
  chemically synthesized
tcaaaggcttaaatttaggcac

SEQ ID NO: 687665 - DNA, 22 bp, Artificial Sequence
  chemically synthesized
ttactcctggatgtgcctaaat

SEQ ID NO: 687666 - DNA, 22 bp, Artificial Sequence
  chemically synthesized
caaaggcttaaatttaggcaca

SEQ ID NO: 687667 - DNA, 22 bp, Artificial Sequence
  chemically synthesized
cttactcctggatgtgcctaaa

SEQ ID NO: 687668 - DNA, 22 bp, Artificial Sequence
  chemically synthesized
aaaggcttaaatttaggcacat

SEQ ID NO: 687669 - DNA, 22 bp, Artificial Sequence
  chemically synthesized
tcttactcctggatgtgcctaa

SEQ ID NO: 687670 - DNA, 22 bp, Artificial Sequence
  chemically synthesized
aaatttaggcacatccaggagt

SEQ ID NO: 687671 - DNA, 22 bp, Artificial Sequence
  chemically synthesized
aatttaggcacatccaggagta

SEQ ID NO: 687672 - DNA, 22 bp, Artificial Sequence
  chemically synthesized
aggcacatccaggagtaagaaa

SEQ ID NO: 687673 - DNA, 22 bp, Artificial Sequence
  chemically synthesized
ggcacatccaggagtaagaaag

SEQ ID NO: 687674 - DNA, 22 bp, Artificial Sequence
  chemically synthesized
cacgtagtgaagggaaggactt

SEQ ID NO: 687675 - DNA, 22 bp, Artificial Sequence
  chemically synthesized
gcacgtagtgaagggaaggact

SEQ ID NO: 687676 - DNA, 22 bp, Artificial Sequence
  chemically synthesized
tcttgcacgtagtgaagggaag

SEQ ID NO: 687677 - DNA, 22 bp, Artificial Sequence
  chemically synthesized
atcttgcacgtagtgaagggaa

SEQ ID NO: 687678 - DNA, 22 bp, Artificial Sequence
  chemically synthesized
tatcttgcacgtagtgaaggga

SEQ ID NO: 687679 - DNA, 22 bp, Artificial Sequence
  chemically synthesized
accagctttatcttgcacgtag

SEQ ID NO: 687680 - DNA, 22 bp, Artificial Sequence
  chemically synthesized
cccttcactacgtgcaagataa

SEQ ID NO: 687681 - DNA, 22 bp, Artificial Sequence
  chemically synthesized
ccttcactacgtgcaagataaa

SEQ ID NO: 687682 - DNA, 22 bp, Artificial Sequence
  chemically synthesized
aacgattgaccagctttatctt

SEQ ID NO: 687683 - DNA, 22 bp, Artificial Sequence
  chemically synthesized
cactacgtgcaagataaagctg

SEQ ID NO: 687684 - DNA, 22 bp, Artificial Sequence
  chemically synthesized
actacgtgcaagataaagctgg

SEQ ID NO: 687685 - DNA, 22 bp, Artificial Sequence
  chemically synthesized
gggctcaacgattgaccagctt

SEQ ID NO: 687686 - DNA, 22 bp, Artificial Sequence
  chemically synthesized
cgtgcaagataaagctggtcaa

SEQ ID NO: 687687 - DNA, 22 bp, Artificial Sequence
  chemically synthesized
gtcagctggggctcaacgattg

SEQ ID NO: 687688 - DNA, 22 bp, Artificial Sequence
  chemically synthesized
agtcagctggggctcaacgatt

SEQ ID NO: 687689 - DNA, 22 bp, Artificial Sequence
  chemically synthesized
gtcaatcgttgagccccagctg

SEQ ID NO: 687690 - DNA, 22 bp, Artificial Sequence
  chemically synthesized
acataaaatttagtcagctggg

SEQ ID NO: 687691 - DNA, 22 bp, Artificial Sequence
  chemically synthesized
cctgacataaaatttagtcagc

SEQ ID NO: 687692 - DNA, 22 bp, Artificial Sequence
  chemically synthesized
acctgacataaaatttagtcag

SEQ ID NO: 687693 - DNA, 22 bp, Artificial Sequence
  chemically synthesized
tacctgacataaaatttagtca

SEQ ID NO: 687694 - DNA, 22 bp, Artificial Sequence
  chemically synthesized
agccccagctgactaaatttta

SEQ ID NO: 687695 - DNA, 22 bp, Artificial Sequence
  chemically synthesized
ctttacctgacataaaatttag

SEQ ID NO: 687696 - DNA, 22 bp, Artificial Sequence
  chemically synthesized
cctttacctgacataaaattta

SEQ ID NO: 687697 - DNA, 22 bp, Artificial Sequence
  chemically synthesized
cttcctttacctgacataaaat

SEQ ID NO: 687698 - DNA, 22 bp, Artificial Sequence
  chemically synthesized
actaaattttatgtcaggtaaa

SEQ ID NO: 687699 - DNA, 22 bp, Artificial Sequence
  chemically synthesized
aattttatgtcaggtaaaggaa

SEQ ID NO: 687700 - DNA, 22 bp, Artificial Sequence
  chemically synthesized
tatgtcaggtaaaggaagcaat

SEQ ID NO: 687701 - DNA, 22 bp, Artificial Sequence
  chemically synthesized
atgtcaggtaaaggaagcaatg

SEQ ID NO: 687702 - DNA, 22 bp, Artificial Sequence
  chemically synthesized
tgtcaggtaaaggaagcaatgt

SEQ ID NO: 687703 - DNA, 22 bp, Artificial Sequence
  chemically synthesized
tcgggaacatacccacattgct

SEQ ID NO: 687704 - DNA, 22 bp, Artificial Sequence
  chemically synthesized
ataaattgtcgggaacataccc

SEQ ID NO: 687705 - DNA, 22 bp, Artificial Sequence
  chemically synthesized
tctgataaattgtcgggaacat

SEQ ID NO: 687706 - DNA, 22 bp, Artificial Sequence
  chemically synthesized
gttatctgataaattgtcggga

SEQ ID NO: 687707 - DNA, 22 bp, Artificial Sequence
  chemically synthesized
ggttatctgataaattgtcggg

SEQ ID NO: 687708 - DNA, 22 bp, Artificial Sequence
  chemically synthesized
tacttggttatctgataaattg

SEQ ID NO: 687709 - DNA, 22 bp, Artificial Sequence
  chemically synthesized
ccgacaatttatcagataacca

SEQ ID NO: 687710 - DNA, 22 bp, Artificial Sequence
  chemically synthesized
atgggattgtacttggttatct

SEQ ID NO: 687711 - DNA, 22 bp, Artificial Sequence
  chemically synthesized
aatgggattgtacttggttatc

SEQ ID NO: 687712 - DNA, 22 bp, Artificial Sequence
  chemically synthesized
tcttaatgggattgtacttggt

SEQ ID NO: 687713 - DNA, 22 bp, Artificial Sequence
  chemically synthesized
atcagataaccaagtacaatcc

SEQ ID NO: 687714 - DNA, 22 bp, Artificial Sequence
  chemically synthesized
tcagataaccaagtacaatccc

SEQ ID NO: 687715 - DNA, 22 bp, Artificial Sequence
  chemically synthesized
tagccgttatcttaatgggatt

SEQ ID NO: 687716 - DNA, 22 bp, Artificial Sequence
  chemically synthesized
aaggactatagccgttatctta

SEQ ID NO: 687717 - DNA, 22 bp, Artificial Sequence
  chemically synthesized
aattcaaggactatagccgtta

SEQ ID NO: 687718 - DNA, 22 bp, Artificial Sequence
  chemically synthesized
caattcaaggactatagccgtt

SEQ ID NO: 687719 - DNA, 22 bp, Artificial Sequence
  chemically synthesized
agataacggctatagtccttga

SEQ ID NO: 687720 - DNA, 22 bp, Artificial Sequence
  chemically synthesized
taagtcttcaattcaaggacta

SEQ ID NO: 687721 - DNA, 22 bp, Artificial Sequence
  chemically synthesized
catggccctataagtcttcaat

SEQ ID NO: 687722 - DNA, 22 bp, Artificial Sequence
  chemically synthesized
tagtccttgaattgaagactta

SEQ ID NO: 687723 - DNA, 22 bp, Artificial Sequence
  chemically synthesized
tacatggccctataagtcttca

SEQ ID NO: 687724 - DNA, 22 bp, Artificial Sequence
  chemically synthesized
gaattgaagacttatagggcca

SEQ ID NO: 687725 - DNA, 22 bp, Artificial Sequence
  chemically synthesized
aattgaagacttatagggccat

SEQ ID NO: 687726 - DNA, 22 bp, Artificial Sequence
  chemically synthesized
aagacttatagggccatgtaga

SEQ ID NO: 687727 - DNA, 22 bp, Artificial Sequence
  chemically synthesized
gacaaaagccacctctacatgg

SEQ ID NO: 687728 - DNA, 22 bp, Artificial Sequence
  chemically synthesized
agacaaaagccacctctacatg

SEQ ID NO: 687729 - DNA, 22 bp, Artificial Sequence
  chemically synthesized
tagacaaaagccacctctacat

SEQ ID NO: 687730 - DNA, 22 bp, Artificial Sequence
  chemically synthesized
ttagacaaaagccacctctaca

SEQ ID NO: 687731 - DNA, 22 bp, Artificial Sequence
  chemically synthesized
tttagacaaaagccacctctac

SEQ ID NO: 687732 - DNA, 22 bp, Artificial Sequence
  chemically synthesized
atagggccatgtagaggtggct

SEQ ID NO: 687733 - DNA, 22 bp, Artificial Sequence
  chemically synthesized
tagggccatgtagaggtggctt

SEQ ID NO: 687734 - DNA, 22 bp, Artificial Sequence
  chemically synthesized
tcctttttagacaaaagccacc

SEQ ID NO: 687735 - DNA, 22 bp, Artificial Sequence
  chemically synthesized
gtcctttttagacaaaagccac

SEQ ID NO: 687736 - DNA, 22 bp, Artificial Sequence
  chemically synthesized
tgtcctttttagacaaaagcca

SEQ ID NO: 687737 - DNA, 22 bp, Artificial Sequence
  chemically synthesized
ctttgtcctttttagacaaaag

SEQ ID NO: 687738 - DNA, 22 bp, Artificial Sequence
  chemically synthesized
agttcctttgtcctttttagac

SEQ ID NO: 687739 - DNA, 22 bp, Artificial Sequence
  chemically synthesized
ttcagttcctttgtccttttta

SEQ ID NO: 687740 - DNA, 22 bp, Artificial Sequence
  chemically synthesized
ttgtctaaaaaggacaaaggaa

SEQ ID NO: 687741 - DNA, 22 bp, Artificial Sequence
  chemically synthesized
tgtctaaaaaggacaaaggaac

SEQ ID NO: 687742 - DNA, 22 bp, Artificial Sequence
  chemically synthesized
gtctaaaaaggacaaaggaact

SEQ ID NO: 687743 - DNA, 22 bp, Artificial Sequence
  chemically synthesized
accacattattcagttcctttg

SEQ ID NO: 687744 - DNA, 22 bp, Artificial Sequence
  chemically synthesized
tctaaaaaggacaaaggaactg

SEQ ID NO: 687745 - DNA, 22 bp, Artificial Sequence
  chemically synthesized
aaaaggacaaaggaactgaata

SEQ ID NO: 687746 - DNA, 22 bp, Artificial Sequence
  chemically synthesized
tggcagagaactgaccacatta

SEQ ID NO: 687747 - DNA, 22 bp, Artificial Sequence
  chemically synthesized
tgtggcagagaactgaccacat

SEQ ID NO: 687748 - DNA, 22 bp, Artificial Sequence
  chemically synthesized
atgtctctgtggcagagaactg

SEQ ID NO: 687749 - DNA, 22 bp, Artificial Sequence
  chemically synthesized
aataatgtggtcagttctctgc

SEQ ID NO: 687750 - DNA, 22 bp, Artificial Sequence
  chemically synthesized
catgtctctgtggcagagaact

SEQ ID NO: 687751 - DNA, 22 bp, Artificial Sequence
  chemically synthesized
gtcttcatgtctctgtggcaga

SEQ ID NO: 687752 - DNA, 22 bp, Artificial Sequence
  chemically synthesized
gttcgtcttcatgtctctgtgg

SEQ ID NO: 687753 - DNA, 22 bp, Artificial Sequence
  chemically synthesized
ggttcgtcttcatgtctctgtg

SEQ ID NO: 687754 - DNA, 22 bp, Artificial Sequence
  chemically synthesized
ttggttcgtcttcatgtctctg

SEQ ID NO: 687755 - DNA, 22 bp, Artificial Sequence
  chemically synthesized
tctgccacagagacatgaagac

SEQ ID NO: 687756 - DNA, 22 bp, Artificial Sequence
  chemically synthesized
tgccacagagacatgaagacga

SEQ ID NO: 687757 - DNA, 22 bp, Artificial Sequence
  chemically synthesized
ccacagagacatgaagacgaac

SEQ ID NO: 687758 - DNA, 22 bp, Artificial Sequence
  chemically synthesized
acaaaatgagcaaacacacata

SEQ ID NO: 687759 - DNA, 22 bp, Artificial Sequence
  chemically synthesized
tgacaaaatgagcaaacacaca

SEQ ID NO: 687760 - DNA, 22 bp, Artificial Sequence
  chemically synthesized
ctgacaaaatgagcaaacacac

SEQ ID NO: 687761 - DNA, 22 bp, Artificial Sequence
  chemically synthesized
tttctgacaaaatgagcaaaca

SEQ ID NO: 687762 - DNA, 22 bp, Artificial Sequence
  chemically synthesized
ttgtttctgacaaaatgagcaa

SEQ ID NO: 687763 - DNA, 22 bp, Artificial Sequence
  chemically synthesized
tatgtgtgtttgctcattttgt

SEQ ID NO: 687764 - DNA, 22 bp, Artificial Sequence
  chemically synthesized
atgtgtgtttgctcattttgtc

SEQ ID NO: 687765 - DNA, 22 bp, Artificial Sequence
  chemically synthesized
tgtgtgtttgctcattttgtca

SEQ ID NO: 687766 - DNA, 22 bp, Artificial Sequence
  chemically synthesized
agtcacctgttgtttctgacaa

SEQ ID NO: 687767 - DNA, 22 bp, Artificial Sequence
  chemically synthesized
gctcattttgtcagaaacaaca

SEQ ID NO: 687768 - DNA, 22 bp, Artificial Sequence
  chemically synthesized
ctcattttgtcagaaacaacag

SEQ ID NO: 687769 - DNA, 22 bp, Artificial Sequence
  chemically synthesized
tgtaattaagtcacctgttgtt

SEQ ID NO: 687770 - DNA, 22 bp, Artificial Sequence
  chemically synthesized
attttgtcagaaacaacaggtg

SEQ ID NO: 687771 - DNA, 22 bp, Artificial Sequence
  chemically synthesized
tgtcagaaacaacaggtgactt

SEQ ID NO: 687772 - DNA, 22 bp, Artificial Sequence
  chemically synthesized
gtcagaaacaacaggtgactta

SEQ ID NO: 687773 - DNA, 22 bp, Artificial Sequence
  chemically synthesized
tcagaaacaacaggtgacttaa

SEQ ID NO: 687774 - DNA, 22 bp, Artificial Sequence
  chemically synthesized
aagtctatgtaattaagtcacc

SEQ ID NO: 687775 - DNA, 22 bp, Artificial Sequence
  chemically synthesized
aactgaagtctatgtaattaag

SEQ ID NO: 687776 - DNA, 22 bp, Artificial Sequence
  chemically synthesized
gaactgaagtctatgtaattaa

SEQ ID NO: 687777 - DNA, 22 bp, Artificial Sequence
  chemically synthesized
tgaactgaagtctatgtaatta

SEQ ID NO: 687778 - DNA, 22 bp, Artificial Sequence
  chemically synthesized
gcattttgaactgaagtctatg

SEQ ID NO: 687779 - DNA, 22 bp, Artificial Sequence
  chemically synthesized
agcattttgaactgaagtctat

SEQ ID NO: 687780 - DNA, 22 bp, Artificial Sequence
  chemically synthesized
ttagcattttgaactgaagtct

SEQ ID NO: 687781 - DNA, 22 bp, Artificial Sequence
  chemically synthesized
ttcttagcattttgaactgaag

SEQ ID NO: 687782 - DNA, 22 bp, Artificial Sequence
  chemically synthesized
aattacatagacttcagttcaa

SEQ ID NO: 687783 - DNA, 22 bp, Artificial Sequence
  chemically synthesized
attacatagacttcagttcaaa

SEQ ID NO: 687784 - DNA, 22 bp, Artificial Sequence
  chemically synthesized
catagacttcagttcaaaatgc

SEQ ID NO: 687785 - DNA, 22 bp, Artificial Sequence
  chemically synthesized
tcagttattcttagcattttga

SEQ ID NO: 687786 - DNA, 22 bp, Artificial Sequence
  chemically synthesized
tcagttgtcagttattcttagc

SEQ ID NO: 687787 - DNA, 22 bp, Artificial Sequence
  chemically synthesized
cagttcaaaatgctaagaataa

SEQ ID NO: 687788 - DNA, 22 bp, Artificial Sequence
  chemically synthesized
agttcaaaatgctaagaataac

SEQ ID NO: 687789 - DNA, 22 bp, Artificial Sequence
  chemically synthesized
aaaatgctaagaataactgaca

SEQ ID NO: 687790 - DNA, 22 bp, Artificial Sequence
  chemically synthesized
caaagttgtcagttgtcagtta

SEQ ID NO: 687791 - DNA, 22 bp, Artificial Sequence
  chemically synthesized
tcctccaaagttgtcagttgtc

SEQ ID NO: 687792 - DNA, 22 bp, Artificial Sequence
  chemically synthesized
agaataactgacaactgacaac

SEQ ID NO: 687793 - DNA, 22 bp, Artificial Sequence
  chemically synthesized
gtaggaatctgtcctccaaagt

SEQ ID NO: 687794 - DNA, 22 bp, Artificial Sequence
  chemically synthesized
ggtaggaatctgtcctccaaag

SEQ ID NO: 687795 - DNA, 22 bp, Artificial Sequence
  chemically synthesized
acaactgacaactttggaggac

SEQ ID NO: 687796 - DNA, 22 bp, Artificial Sequence
  chemically synthesized
tggtaggaatctgtcctccaaa

SEQ ID NO: 687797 - DNA, 22 bp, Artificial Sequence
  chemically synthesized
ctttggtaggaatctgtcctcc

SEQ ID NO: 687798 - DNA, 22 bp, Artificial Sequence
  chemically synthesized
acaactttggaggacagattcc

SEQ ID NO: 687799 - DNA, 22 bp, Artificial Sequence
  chemically synthesized
atgtgattactttggtaggaat

SEQ ID NO: 687800 - DNA, 22 bp, Artificial Sequence
  chemically synthesized
tggaggacagattcctaccaaa

SEQ ID NO: 687801 - DNA, 22 bp, Artificial Sequence
  chemically synthesized
ggaggacagattcctaccaaag

SEQ ID NO: 687802 - DNA, 22 bp, Artificial Sequence
  chemically synthesized
gaggacagattcctaccaaagt

SEQ ID NO: 687803 - DNA, 22 bp, Artificial Sequence
  chemically synthesized
agagcagcactaatgtgattac

SEQ ID NO: 687804 - DNA, 22 bp, Artificial Sequence
  chemically synthesized
ctaccaaagtaatcacattagt

SEQ ID NO: 687805 - DNA, 22 bp, Artificial Sequence
  chemically synthesized
ccaaagtaatcacattagtgct

SEQ ID NO: 687806 - DNA, 22 bp, Artificial Sequence
  chemically synthesized
aatgactgagagcagcactaat

SEQ ID NO: 687807 - DNA, 22 bp, Artificial Sequence
  chemically synthesized
attgaatgactgagagcagcac

SEQ ID NO: 687808 - DNA, 22 bp, Artificial Sequence
  chemically synthesized
gtgctgctctcagtcattcaat

SEQ ID NO: 687809 - DNA, 22 bp, Artificial Sequence
  chemically synthesized
aaaatcataaactaattgaatg

SEQ ID NO: 687810 - DNA, 22 bp, Artificial Sequence
  chemically synthesized
ttgaaaatcataaactaattga

SEQ ID NO: 687811 - DNA, 22 bp, Artificial Sequence
  chemically synthesized
ctctcagtcattcaattagttt

SEQ ID NO: 687812 - DNA, 22 bp, Artificial Sequence
  chemically synthesized
attgaaaatcataaactaattg

SEQ ID NO: 687813 - DNA, 22 bp, Artificial Sequence
  chemically synthesized
tcagtcattcaattagtttatg

SEQ ID NO: 687814 - DNA, 22 bp, Artificial Sequence
  chemically synthesized
atttattgaaaatcataaacta

SEQ ID NO: 687815 - DNA, 22 bp, Artificial Sequence
  chemically synthesized
agtcattcaattagtttatgat

SEQ ID NO: 687816 - DNA, 22 bp, Artificial Sequence
  chemically synthesized
ttcatttattgaaaatcataaa

SEQ ID NO: 687817 - DNA, 22 bp, Artificial Sequence
  chemically synthesized
aattagtttatgattttcaata

SEQ ID NO: 687818 - DNA, 22 bp, Artificial Sequence
  chemically synthesized
tatgattattcatttattgaaa

SEQ ID NO: 687819 - DNA, 22 bp, Artificial Sequence
  chemically synthesized
gtttatgattttcaataaatga

SEQ ID NO: 687820 - DNA, 22 bp, Artificial Sequence
  chemically synthesized
ttatatgattattcatttattg

SEQ ID NO: 687821 - DNA, 22 bp, Artificial Sequence
  chemically synthesized
tattatatgattattcatttat

SEQ ID NO: 687822 - DNA, 22 bp, Artificial Sequence
  chemically synthesized
atgattttcaataaatgaataa

SEQ ID NO: 687823 - DNA, 22 bp, Artificial Sequence
  chemically synthesized
tgattttcaataaatgaataat

SEQ ID NO: 687824 - DNA, 22 bp, Artificial Sequence
  chemically synthesized
ttctattatatgattattcatt

SEQ ID NO: 687825 - DNA, 22 bp, Artificial Sequence
  chemically synthesized
gattattctattatatgattat

SEQ ID NO: 687826 - DNA, 22 bp, Artificial Sequence
  chemically synthesized
tcaataaatgaataatcatata

SEQ ID NO: 687827 - DNA, 22 bp, Artificial Sequence
  chemically synthesized
ggattattctattatatgatta

SEQ ID NO: 687828 - DNA, 22 bp, Artificial Sequence
  chemically synthesized
caataaatgaataatcatataa

SEQ ID NO: 687829 - DNA, 22 bp, Artificial Sequence
  chemically synthesized
tggattattctattatatgatt

SEQ ID NO: 687830 - DNA, 22 bp, Artificial Sequence
  chemically synthesized
aataaatgaataatcatataat

SEQ ID NO: 687831 - DNA, 22 bp, Artificial Sequence
  chemically synthesized
aaaataagattttggattattc

SEQ ID NO: 687832 - DNA, 22 bp, Artificial Sequence
  chemically synthesized
tatatacaaaaaacctaaaaat

SEQ ID NO: 687833 - DNA, 22 bp, Artificial Sequence
  chemically synthesized
gttatatatacaaaaaacctaa

SEQ ID NO: 687834 - DNA, 22 bp, Artificial Sequence
  chemically synthesized
atactagttatatatacaaaaa

SEQ ID NO: 687835 - DNA, 22 bp, Artificial Sequence
  chemically synthesized
atttttaggttttttgtatata

SEQ ID NO: 687836 - DNA, 22 bp, Artificial Sequence
  chemically synthesized
tttttaggttttttgtatatat

SEQ ID NO: 687837 - DNA, 22 bp, Artificial Sequence
  chemically synthesized
ttaggttttttgtatatataac

SEQ ID NO: 687838 - DNA, 22 bp, Artificial Sequence
  chemically synthesized
taggttttttgtatatataact

SEQ ID NO: 687839 - DNA, 22 bp, Artificial Sequence
  chemically synthesized
aggttttttgtatatataacta

SEQ ID NO: 687840 - DNA, 22 bp, Artificial Sequence
  chemically synthesized
ggttttttgtatatataactag

SEQ ID NO: 687841 - DNA, 22 bp, Artificial Sequence
  chemically synthesized
acagagagggttaatactagtt

SEQ ID NO: 687842 - DNA, 22 bp, Artificial Sequence
  chemically synthesized
tttgtatatataactagtatta

SEQ ID NO: 687843 - DNA, 22 bp, Artificial Sequence
  chemically synthesized
ttgtatatataactagtattaa

SEQ ID NO: 687844 - DNA, 22 bp, Artificial Sequence
  chemically synthesized
tgtatatataactagtattaac

SEQ ID NO: 687845 - DNA, 22 bp, Artificial Sequence
  chemically synthesized
gtatatataactagtattaacc

SEQ ID NO: 687846 - DNA, 22 bp, Artificial Sequence
  chemically synthesized
tatatataactagtattaaccc

SEQ ID NO: 687847 - DNA, 22 bp, Artificial Sequence
  chemically synthesized
gtattaaccctctctgtcaaca

SEQ ID NO: 687848 - DNA, 22 bp, Artificial Sequence
  chemically synthesized
aggaaagcaaaaatgttgacag

SEQ ID NO: 687849 - DNA, 22 bp, Artificial Sequence
  chemically synthesized
aaggaaagcaaaaatgttgaca

SEQ ID NO: 687850 - DNA, 22 bp, Artificial Sequence
  chemically synthesized
taaggaaagcaaaaatgttgac

SEQ ID NO: 687851 - DNA, 22 bp, Artificial Sequence
  chemically synthesized
tttaaggaaagcaaaaatgttg

SEQ ID NO: 687852 - DNA, 22 bp, Artificial Sequence
  chemically synthesized
accctctctgtcaacatttttg

SEQ ID NO: 687853 - DNA, 22 bp, Artificial Sequence
  chemically synthesized
ctttaaggaaagcaaaaatgtt

SEQ ID NO: 687854 - DNA, 22 bp, Artificial Sequence
  chemically synthesized
tatttctttaaggaaagcaaaa

SEQ ID NO: 687855 - DNA, 22 bp, Artificial Sequence
  chemically synthesized
tctgtcaacatttttgctttcc

SEQ ID NO: 687856 - DNA, 22 bp, Artificial Sequence
  chemically synthesized
atatttctttaaggaaagcaaa

SEQ ID NO: 687857 - DNA, 22 bp, Artificial Sequence
  chemically synthesized
tgtcaacatttttgctttcctt

SEQ ID NO: 687858 - DNA, 22 bp, Artificial Sequence
  chemically synthesized
ttatatttctttaaggaaagca

SEQ ID NO: 687859 - DNA, 22 bp, Artificial Sequence
  chemically synthesized
tcaacatttttgctttccttaa

SEQ ID NO: 687860 - DNA, 22 bp, Artificial Sequence
  chemically synthesized
tgttcttatatttctttaagga

SEQ ID NO: 687861 - DNA, 22 bp, Artificial Sequence
  chemically synthesized
atgttcttatatttctttaagg

SEQ ID NO: 687862 - DNA, 22 bp, Artificial Sequence
  chemically synthesized
tatgttcttatatttctttaag

SEQ ID NO: 687863 - DNA, 22 bp, Artificial Sequence
  chemically synthesized
ttgctttccttaaagaaatata

SEQ ID NO: 687864 - DNA, 22 bp, Artificial Sequence
  chemically synthesized
tgctttccttaaagaaatataa

SEQ ID NO: 687865 - DNA, 22 bp, Artificial Sequence
  chemically synthesized
gctttccttaaagaaatataag

SEQ ID NO: 687866 - DNA, 22 bp, Artificial Sequence
  chemically synthesized
aaattttatgttcttatatttc

SEQ ID NO: 687867 - DNA, 22 bp, Artificial Sequence
  chemically synthesized
ctttccttaaagaaatataaga

SEQ ID NO: 687868 - DNA, 22 bp, Artificial Sequence
  chemically synthesized
tccttaaagaaatataagaaca

SEQ ID NO: 687869 - DNA, 22 bp, Artificial Sequence
  chemically synthesized
ccttaaagaaatataagaacat

SEQ ID NO: 687870 - DNA, 22 bp, Artificial Sequence
  chemically synthesized
gactaaaattttatgttcttat

SEQ ID NO: 687871 - DNA, 22 bp, Artificial Sequence
  chemically synthesized
cttaaagaaatataagaacata

SEQ ID NO: 687872 - DNA, 22 bp, Artificial Sequence
  chemically synthesized
aaagaaatataagaacataaaa

SEQ ID NO: 687873 - DNA, 22 bp, Artificial Sequence
  chemically synthesized
aagaaatataagaacataaaat

SEQ ID NO: 687874 - DNA, 22 bp, Artificial Sequence
  chemically synthesized
cagatgtgagccgccacaccta

SEQ ID NO: 687875 - DNA, 22 bp, Artificial Sequence
  chemically synthesized
tagtctaggtgtggcggctcac

SEQ ID NO: 687876 - DNA, 22 bp, Artificial Sequence
  chemically synthesized
agtctaggtgtggcggctcaca

SEQ ID NO: 687877 - DNA, 22 bp, Artificial Sequence
  chemically synthesized
gtctaggtgtggcggctcacat

SEQ ID NO: 687878 - DNA, 22 bp, Artificial Sequence
  chemically synthesized
ggtgtggcggctcacatctgta

SEQ ID NO: 687879 - DNA, 22 bp, Artificial Sequence
  chemically synthesized
ccaacgtgccaggattacagat

SEQ ID NO: 687880 - DNA, 22 bp, Artificial Sequence
  chemically synthesized
gacctcccaacgtgccaggatt

SEQ ID NO: 687881 - DNA, 22 bp, Artificial Sequence
  chemically synthesized
acatctgtaatcctggcacgtt

SEQ ID NO: 687882 - DNA, 22 bp, Artificial Sequence
  chemically synthesized
taatcctggcacgttgggaggt

SEQ ID NO: 687883 - DNA, 22 bp, Artificial Sequence
  chemically synthesized
gatgatccacccgcctcgacct

SEQ ID NO: 687884 - DNA, 22 bp, Artificial Sequence
  chemically synthesized
agatgatccacccgcctcgacc

SEQ ID NO: 687885 - DNA, 22 bp, Artificial Sequence
  chemically synthesized
gcacgttgggaggtcgaggcgg

SEQ ID NO: 687886 - DNA, 22 bp, Artificial Sequence
  chemically synthesized
gccttagatgatccacccgcct

SEQ ID NO: 687887 - DNA, 22 bp, Artificial Sequence
  chemically synthesized
ctggccttagatgatccacccg

SEQ ID NO: 687888 - DNA, 22 bp, Artificial Sequence
  chemically synthesized
ggaggtcgaggcgggtggatca

SEQ ID NO: 687889 - DNA, 22 bp, Artificial Sequence
  chemically synthesized
aaactcctggccttagatgatc

SEQ ID NO: 687890 - DNA, 22 bp, Artificial Sequence
  chemically synthesized
gtctcaaactcctggccttaga

SEQ ID NO: 687891 - DNA, 22 bp, Artificial Sequence
  chemically synthesized
gccaggttggtctcaaactcct

SEQ ID NO: 687892 - DNA, 22 bp, Artificial Sequence
  chemically synthesized
aggccaggagtttgagaccaac

SEQ ID NO: 687893 - DNA, 22 bp, Artificial Sequence
  chemically synthesized
accatgttggccaggttggtct

SEQ ID NO: 687894 - DNA, 22 bp, Artificial Sequence
  chemically synthesized
caccatgttggccaggttggtc

SEQ ID NO: 687895 - DNA, 22 bp, Artificial Sequence
  chemically synthesized
gagaccaacctggccaacatgg

SEQ ID NO: 687896 - DNA, 22 bp, Artificial Sequence
  chemically synthesized
agaccaacctggccaacatggt

SEQ ID NO: 687897 - DNA, 22 bp, Artificial Sequence
  chemically synthesized
tagagatagagtttcaccatgt

SEQ ID NO: 687898 - DNA, 22 bp, Artificial Sequence
  chemically synthesized
atagagatagagtttcaccatg

SEQ ID NO: 687899 - DNA, 22 bp, Artificial Sequence
  chemically synthesized
tatagagatagagtttcaccat

SEQ ID NO: 687900 - DNA, 22 bp, Artificial Sequence
  chemically synthesized
ttatagagatagagtttcacca

SEQ ID NO: 687901 - DNA, 22 bp, Artificial Sequence
  chemically synthesized
gccaacatggtgaaactctatc

SEQ ID NO: 687902 - DNA, 22 bp, Artificial Sequence
  chemically synthesized
tatttttatagagatagagttt

SEQ ID NO: 687903 - DNA, 22 bp, Artificial Sequence
  chemically synthesized
gtatttttatagagatagagtt

SEQ ID NO: 687904 - DNA, 22 bp, Artificial Sequence
  chemically synthesized
tgtatttttatagagatagagt

SEQ ID NO: 687905 - DNA, 22 bp, Artificial Sequence
  chemically synthesized
ttgtatttttatagagatagag

SEQ ID NO: 687906 - DNA, 22 bp, Artificial Sequence
  chemically synthesized
atttttgtatttttatagagat

SEQ ID NO: 687907 - DNA, 22 bp, Artificial Sequence
  chemically synthesized
tatctctataaaaatacaaaaa

SEQ ID NO: 687908 - DNA, 22 bp, Artificial Sequence
  chemically synthesized
tctctataaaaatacaaaaatt

SEQ ID NO: 687909 - DNA, 22 bp, Artificial Sequence
  chemically synthesized
tataaaaatacaaaaattagct

SEQ ID NO: 687910 - DNA, 22 bp, Artificial Sequence
  chemically synthesized
taaaaatacaaaaattagctgg

SEQ ID NO: 687911 - DNA, 22 bp, Artificial Sequence
  chemically synthesized
caggcacccgccatcatgccca

SEQ ID NO: 687912 - DNA, 22 bp, Artificial Sequence
  chemically synthesized
ggattacaggcacccgccatca

SEQ ID NO: 687913 - DNA, 22 bp, Artificial Sequence
  chemically synthesized
gctgggcatgatggcgggtgcc

SEQ ID NO: 687914 - DNA, 22 bp, Artificial Sequence
  chemically synthesized
ggcatgatggcgggtgcctgta

SEQ ID NO: 687915 - DNA, 22 bp, Artificial Sequence
  chemically synthesized
gagtggctgggattacaggcac

SEQ ID NO: 687916 - DNA, 22 bp, Artificial Sequence
  chemically synthesized
tcgagtggctgggattacaggc

SEQ ID NO: 687917 - DNA, 22 bp, Artificial Sequence
  chemically synthesized
agcctctcgagtggctgggatt

SEQ ID NO: 687918 - DNA, 22 bp, Artificial Sequence
  chemically synthesized
ccgcctcagcctctcgagtggc

SEQ ID NO: 687919 - DNA, 22 bp, Artificial Sequence
  chemically synthesized
tcccgcctcagcctctcgagtg

SEQ ID NO: 687920 - DNA, 22 bp, Artificial Sequence
  chemically synthesized
taatcccagccactcgagaggc

SEQ ID NO: 687921 - DNA, 22 bp, Artificial Sequence
  chemically synthesized
aagtgattctcccgcctcagcc

SEQ ID NO: 687922 - DNA, 22 bp, Artificial Sequence
  chemically synthesized
ggttcaagtgattctcccgcct

SEQ ID NO: 687923 - DNA, 22 bp, Artificial Sequence
  chemically synthesized
gagaggctgaggcgggagaatc

SEQ ID NO: 687924 - DNA, 22 bp, Artificial Sequence
  chemically synthesized
ctgggttcaagtgattctcccg

SEQ ID NO: 687925 - DNA, 22 bp, Artificial Sequence
  chemically synthesized
cacctgctgggttcaagtgatt

SEQ ID NO: 687926 - DNA, 22 bp, Artificial Sequence
  chemically synthesized
aggcgggagaatcacttgaacc

SEQ ID NO: 687927 - DNA, 22 bp, Artificial Sequence
  chemically synthesized
caacctccacctgctgggttca

SEQ ID NO: 687928 - DNA, 22 bp, Artificial Sequence
  chemically synthesized
gaacccagcaggtggaggttgc

SEQ ID NO: 687929 - DNA, 22 bp, Artificial Sequence
  chemically synthesized
aacccagcaggtggaggttgca

SEQ ID NO: 687930 - DNA, 22 bp, Artificial Sequence
  chemically synthesized
gagtgcagtggactgcaacctc

SEQ ID NO: 687931 - DNA, 22 bp, Artificial Sequence
  chemically synthesized
tcacccaggctggagtgcagtg

SEQ ID NO: 687932 - DNA, 22 bp, Artificial Sequence
  chemically synthesized
tgtcacccaggctggagtgcag

SEQ ID NO: 687933 - DNA, 22 bp, Artificial Sequence
  chemically synthesized
ctctgtcacccaggctggagtg

SEQ ID NO: 687934 - DNA, 22 bp, Artificial Sequence
  chemically synthesized
gctctgtcacccaggctggagt

SEQ ID NO: 687935 - DNA, 22 bp, Artificial Sequence
  chemically synthesized
cagtccactgcactccagcctg

SEQ ID NO: 687936 - DNA, 22 bp, Artificial Sequence
  chemically synthesized
tgctctgtcacccaggctggag

SEQ ID NO: 687937 - DNA, 22 bp, Artificial Sequence
  chemically synthesized
ttgctctgtcacccaggctgga

SEQ ID NO: 687938 - DNA, 22 bp, Artificial Sequence
  chemically synthesized
tttgctctgtcacccaggctgg

SEQ ID NO: 687939 - DNA, 22 bp, Artificial Sequence
  chemically synthesized
ttttgctctgtcacccaggctg

SEQ ID NO: 687940 - DNA, 22 bp, Artificial Sequence
  chemically synthesized
tttttgctctgtcacccaggct

SEQ ID NO: 687941 - DNA, 22 bp, Artificial Sequence
  chemically synthesized
ttttttgctctgtcacccaggc

SEQ ID NO: 687942 - DNA, 22 bp, Artificial Sequence
  chemically synthesized
tttttttgctctgtcacccagg

SEQ ID NO: 687943 - DNA, 22 bp, Artificial Sequence
  chemically synthesized
ttttttttgctctgtcacccag

SEQ ID NO: 687944 - DNA, 22 bp, Artificial Sequence
  chemically synthesized
tttttttttgctctgtcaccca

SEQ ID NO: 687945 - DNA, 22 bp, Artificial Sequence
  chemically synthesized
ttttttttttgctctgtcaccc

SEQ ID NO: 687946 - DNA, 22 bp, Artificial Sequence
  chemically synthesized
cactccagcctgggtgacagag

SEQ ID NO: 687947 - DNA, 22 bp, Artificial Sequence
  chemically synthesized
tttttttttttgctctgtcacc

SEQ ID NO: 687948 - DNA, 22 bp, Artificial Sequence
  chemically synthesized
ttttttttttttttgctctgtc

SEQ ID NO: 687949 - DNA, 22 bp, Artificial Sequence
  chemically synthesized
attttttttttttttgctctgt

SEQ ID NO: 687950 - DNA, 22 bp, Artificial Sequence
  chemically synthesized
cagcctgggtgacagagcaaaa

SEQ ID NO: 687951 - DNA, 22 bp, Artificial Sequence
  chemically synthesized
tattttttttttttttgctctg

SEQ ID NO: 687952 - DNA, 22 bp, Artificial Sequence
  chemically synthesized
ttattttttttttttttgctct

SEQ ID NO: 687953 - DNA, 22 bp, Artificial Sequence
  chemically synthesized
tttattttttttttttttgctc

SEQ ID NO: 687954 - DNA, 22 bp, Artificial Sequence
  chemically synthesized
ttttttattttttttttttttg

SEQ ID NO: 687955 - DNA, 22 bp, Artificial Sequence
  chemically synthesized
attttttatttttttttttttt

SEQ ID NO: 687956 - DNA, 22 bp, Artificial Sequence
  chemically synthesized
ggtgacagagcaaaaaaaaaaa

SEQ ID NO: 687957 - DNA, 22 bp, Artificial Sequence
  chemically synthesized
tattttttattttttttttttt

SEQ ID NO: 687958 - DNA, 22 bp, Artificial Sequence
  chemically synthesized
ttttattttttatttttttttt

SEQ ID NO: 687959 - DNA, 22 bp, Artificial Sequence
  chemically synthesized
attttattttttattttttttt

SEQ ID NO: 687960 - DNA, 22 bp, Artificial Sequence
  chemically synthesized
tattttattttttatttttttt

SEQ ID NO: 687961 - DNA, 22 bp, Artificial Sequence
  chemically synthesized
agatggattttattttattttt

SEQ ID NO: 687962 - DNA, 22 bp, Artificial Sequence
  chemically synthesized
gagatggattttattttatttt

SEQ ID NO: 687963 - DNA, 22 bp, Artificial Sequence
  chemically synthesized
tgagatggattttattttattt

SEQ ID NO: 687964 - DNA, 22 bp, Artificial Sequence
  chemically synthesized
ttgagatggattttattttatt

SEQ ID NO: 687965 - DNA, 22 bp, Artificial Sequence
  chemically synthesized
tttgagatggattttattttat

SEQ ID NO: 687966 - DNA, 22 bp, Artificial Sequence
  chemically synthesized
ttttgagatggattttatttta

SEQ ID NO: 687967 - DNA, 22 bp, Artificial Sequence
  chemically synthesized
tttttgagatggattttatttt

SEQ ID NO: 687968 - DNA, 22 bp, Artificial Sequence
  chemically synthesized
ttttttgagatggattttattt

SEQ ID NO: 687969 - DNA, 22 bp, Artificial Sequence
  chemically synthesized
tttttttgagatggattttatt

SEQ ID NO: 687970 - DNA, 22 bp, Artificial Sequence
  chemically synthesized
ttttttttgagatggattttat

SEQ ID NO: 687971 - DNA, 22 bp, Artificial Sequence
  chemically synthesized
tttttttttgagatggatttta

SEQ ID NO: 687972 - DNA, 22 bp, Artificial Sequence
  chemically synthesized
ttttttttttgagatggatttt

SEQ ID NO: 687973 - DNA, 22 bp, Artificial Sequence
  chemically synthesized
atttttttttttttgagatgga

SEQ ID NO: 687974 - DNA, 22 bp, Artificial Sequence
  chemically synthesized
gatttttttttttttgagatgg

SEQ ID NO: 687975 - DNA, 22 bp, Artificial Sequence
  chemically synthesized
tgatttttttttttttgagatg

SEQ ID NO: 687976 - DNA, 22 bp, Artificial Sequence
  chemically synthesized
aattttgatttttttttttttg

SEQ ID NO: 687977 - DNA, 22 bp, Artificial Sequence
  chemically synthesized
aaaaaaaaaaaaatcaaaattt

SEQ ID NO: 687978 - DNA, 22 bp, Artificial Sequence
  chemically synthesized
taatggtatatcagagtgttaa

SEQ ID NO: 687979 - DNA, 22 bp, Artificial Sequence
  chemically synthesized
caataaataattataatggtat

SEQ ID NO: 687980 - DNA, 22 bp, Artificial Sequence
  chemically synthesized
aacactctgatataccattata

SEQ ID NO: 687981 - DNA, 22 bp, Artificial Sequence
  chemically synthesized
acactctgatataccattataa

SEQ ID NO: 687982 - DNA, 22 bp, Artificial Sequence
  chemically synthesized
tcaattacaataaataattata

SEQ ID NO: 687983 - DNA, 22 bp, Artificial Sequence
  chemically synthesized
tgatataccattataattattt

SEQ ID NO: 687984 - DNA, 22 bp, Artificial Sequence
  chemically synthesized
atataccattataattatttat

SEQ ID NO: 687985 - DNA, 22 bp, Artificial Sequence
  chemically synthesized
cgttgtcaattacaataaataa

SEQ ID NO: 687986 - DNA, 22 bp, Artificial Sequence
  chemically synthesized
gcgttgtcaattacaataaata

SEQ ID NO: 687987 - DNA, 22 bp, Artificial Sequence
  chemically synthesized
tatttgcgttgtcaattacaat

SEQ ID NO: 687988 - DNA, 22 bp, Artificial Sequence
  chemically synthesized
taattatttattgtaattgaca

SEQ ID NO: 687989 - DNA, 22 bp, Artificial Sequence
  chemically synthesized
tttattgtaattgacaacgcaa

SEQ ID NO: 687990 - DNA, 22 bp, Artificial Sequence
  chemically synthesized
attgtaattgacaacgcaaata

SEQ ID NO: 687991 - DNA, 22 bp, Artificial Sequence
  chemically synthesized
ttgtaattgacaacgcaaatac

SEQ ID NO: 687992 - DNA, 22 bp, Artificial Sequence
  chemically synthesized
taattgacaacgcaaatacaat

SEQ ID NO: 687993 - DNA, 22 bp, Artificial Sequence
  chemically synthesized
acaacgcaaatacaattttgct

SEQ ID NO: 687994 - DNA, 22 bp, Artificial Sequence
  chemically synthesized
caacgaacagaacaaccaaata

SEQ ID NO: 687995 - DNA, 22 bp, Artificial Sequence
  chemically synthesized
acaacgaacagaacaaccaaat

SEQ ID NO: 687996 - DNA, 22 bp, Artificial Sequence
  chemically synthesized
catttacaacgaacagaacaac

SEQ ID NO: 687997 - DNA, 22 bp, Artificial Sequence
  chemically synthesized
tgcttatttggttgttctgttc

SEQ ID NO: 687998 - DNA, 22 bp, Artificial Sequence
  chemically synthesized
gcttatttggttgttctgttcg

SEQ ID NO: 687999 - DNA, 22 bp, Artificial Sequence
  chemically synthesized
cttatttggttgttctgttcgt

SEQ ID NO: 688000 - DNA, 22 bp, Artificial Sequence
  chemically synthesized
tactccatttacaacgaacaga

SEQ ID NO: 688001 - DNA, 22 bp, Artificial Sequence
  chemically synthesized
gtactccatttacaacgaacag

SEQ ID NO: 688002 - DNA, 22 bp, Artificial Sequence
  chemically synthesized
atttggttgttctgttcgttgt

SEQ ID NO: 688003 - DNA, 22 bp, Artificial Sequence
  chemically synthesized
tttggttgttctgttcgttgta

SEQ ID NO: 688004 - DNA, 22 bp, Artificial Sequence
  chemically synthesized
ggttgttctgttcgttgtaaat

SEQ ID NO: 688005 - DNA, 22 bp, Artificial Sequence
  chemically synthesized
gttgttctgttcgttgtaaatg

SEQ ID NO: 688006 - DNA, 22 bp, Artificial Sequence
  chemically synthesized
gaatttgtactccatttacaac

SEQ ID NO: 688007 - DNA, 22 bp, Artificial Sequence
  chemically synthesized
ttctgttcgttgtaaatggagt

SEQ ID NO: 688008 - DNA, 22 bp, Artificial Sequence
  chemically synthesized
tgttcgttgtaaatggagtaca

SEQ ID NO: 688009 - DNA, 22 bp, Artificial Sequence
  chemically synthesized
ttcgttgtaaatggagtacaaa

SEQ ID NO: 688010 - DNA, 22 bp, Artificial Sequence
  chemically synthesized
acaaaaattagaatttgtactc

SEQ ID NO: 688011 - DNA, 22 bp, Artificial Sequence
  chemically synthesized
gttgtaaatggagtacaaattc

SEQ ID NO: 688012 - DNA, 22 bp, Artificial Sequence
  chemically synthesized
taaatggagtacaaattctaat

SEQ ID NO: 688013 - DNA, 22 bp, Artificial Sequence
  chemically synthesized
gagctaacaaaaattagaattt

SEQ ID NO: 688014 - DNA, 22 bp, Artificial Sequence
  chemically synthesized
agagctaacaaaaattagaatt

SEQ ID NO: 688015 - DNA, 22 bp, Artificial Sequence
  chemically synthesized
atttagagctaacaaaaattag

SEQ ID NO: 688016 - DNA, 22 bp, Artificial Sequence
  chemically synthesized
gatttagagctaacaaaaatta

SEQ ID NO: 688017 - DNA, 22 bp, Artificial Sequence
  chemically synthesized
aaatttgatttagagctaacaa

SEQ ID NO: 688018 - DNA, 22 bp, Artificial Sequence
  chemically synthesized
aaaatttgatttagagctaaca

SEQ ID NO: 688019 - DNA, 22 bp, Artificial Sequence
  chemically synthesized
taaaatttgatttagagctaac

SEQ ID NO: 688020 - DNA, 22 bp, Artificial Sequence
  chemically synthesized
ttaaaatttgatttagagctaa

SEQ ID NO: 688021 - DNA, 22 bp, Artificial Sequence
  chemically synthesized
taatttttgttagctctaaatc

SEQ ID NO: 688022 - DNA, 22 bp, Artificial Sequence
  chemically synthesized
cttttaaaatttgatttagagc

SEQ ID NO: 688023 - DNA, 22 bp, Artificial Sequence
  chemically synthesized
acttttaaaatttgatttagag

SEQ ID NO: 688024 - DNA, 22 bp, Artificial Sequence
  chemically synthesized
atttttgttagctctaaatcaa

SEQ ID NO: 688025 - DNA, 22 bp, Artificial Sequence
  chemically synthesized
tttacttttaaaatttgattta

SEQ ID NO: 688026 - DNA, 22 bp, Artificial Sequence
  chemically synthesized
ttgttagctctaaatcaaattt

SEQ ID NO: 688027 - DNA, 22 bp, Artificial Sequence
  chemically synthesized
tgtttacttttaaaatttgatt

SEQ ID NO: 688028 - DNA, 22 bp, Artificial Sequence
  chemically synthesized
tgttagctctaaatcaaatttt

SEQ ID NO: 688029 - DNA, 22 bp, Artificial Sequence
  chemically synthesized
gttagctctaaatcaaatttta

SEQ ID NO: 688030 - DNA, 22 bp, Artificial Sequence
  chemically synthesized
ttagctctaaatcaaattttaa

SEQ ID NO: 688031 - DNA, 22 bp, Artificial Sequence
  chemically synthesized
gctctaaatcaaattttaaaag

SEQ ID NO: 688032 - DNA, 22 bp, Artificial Sequence
  chemically synthesized
aacattctgtttacttttaaaa

SEQ ID NO: 688033 - DNA, 22 bp, Artificial Sequence
  chemically synthesized
aaacattctgtttacttttaaa

SEQ ID NO: 688034 - DNA, 22 bp, Artificial Sequence
  chemically synthesized
taaacattctgtttacttttaa

SEQ ID NO: 688035 - DNA, 22 bp, Artificial Sequence
  chemically synthesized
taaatcaaattttaaaagtaaa

SEQ ID NO: 688036 - DNA, 22 bp, Artificial Sequence
  chemically synthesized
aatcaaattttaaaagtaaaca

SEQ ID NO: 688037 - DNA, 22 bp, Artificial Sequence
  chemically synthesized
taaaagtaaacagaatgtttaa

SEQ ID NO: 688038 - DNA, 22 bp, Artificial Sequence
  chemically synthesized
aaaagtaaacagaatgtttaaa

SEQ ID NO: 688039 - DNA, 22 bp, Artificial Sequence
  chemically synthesized
aaagtaaacagaatgtttaaag

SEQ ID NO: 688040 - DNA, 22 bp, Artificial Sequence
  chemically synthesized
agcaaataaaacataactttaa

SEQ ID NO: 688041 - DNA, 22 bp, Artificial Sequence
  chemically synthesized
tgttaagcaaataaaacataac

SEQ ID NO: 688042 - DNA, 22 bp, Artificial Sequence
  chemically synthesized
agtgttatgttaagcaaataaa

SEQ ID NO: 688043 - DNA, 22 bp, Artificial Sequence
  chemically synthesized
aagtgttatgttaagcaaataa

SEQ ID NO: 688044 - DNA, 22 bp, Artificial Sequence
  chemically synthesized
aaagttatgttttatttgctta

SEQ ID NO: 688045 - DNA, 22 bp, Artificial Sequence
  chemically synthesized
taagtgttatgttaagcaaata

SEQ ID NO: 688046 - DNA, 22 bp, Artificial Sequence
  chemically synthesized
aagttatgttttatttgcttaa

SEQ ID NO: 688047 - DNA, 22 bp, Artificial Sequence
  chemically synthesized
ttttaagtgttatgttaagcaa

SEQ ID NO: 688048 - DNA, 22 bp, Artificial Sequence
  chemically synthesized
gttttaagtgttatgttaagca

SEQ ID NO: 688049 - DNA, 22 bp, Artificial Sequence
  chemically synthesized
tgttttatttgcttaacataac

SEQ ID NO: 688050 - DNA, 22 bp, Artificial Sequence
  chemically synthesized
atcttgttttaagtgttatgtt

SEQ ID NO: 688051 - DNA, 22 bp, Artificial Sequence
  chemically synthesized
tatttgcttaacataacactta

SEQ ID NO: 688052 - DNA, 22 bp, Artificial Sequence
  chemically synthesized
ttcatcttgttttaagtgttat

SEQ ID NO: 688053 - DNA, 22 bp, Artificial Sequence
  chemically synthesized
atttgcttaacataacacttaa

SEQ ID NO: 688054 - DNA, 22 bp, Artificial Sequence
  chemically synthesized
tttgcttaacataacacttaaa

SEQ ID NO: 688055 - DNA, 22 bp, Artificial Sequence
  chemically synthesized
ctgttcatcttgttttaagtgt

SEQ ID NO: 688056 - DNA, 22 bp, Artificial Sequence
  chemically synthesized
gctgttcatcttgttttaagtg

SEQ ID NO: 688057 - DNA, 22 bp, Artificial Sequence
  chemically synthesized
gcttaacataacacttaaaaca

SEQ ID NO: 688058 - DNA, 22 bp, Artificial Sequence
  chemically synthesized
tgctgttcatcttgttttaagt

SEQ ID NO: 688059 - DNA, 22 bp, Artificial Sequence
  chemically synthesized
cttaacataacacttaaaacaa

SEQ ID NO: 688060 - DNA, 22 bp, Artificial Sequence
  chemically synthesized
aacataacacttaaaacaagat

SEQ ID NO: 688061 - DNA, 22 bp, Artificial Sequence
  chemically synthesized
acataacacttaaaacaagatg

SEQ ID NO: 688062 - DNA, 22 bp, Artificial Sequence
  chemically synthesized
tattttgctgttcatcttgttt

SEQ ID NO: 688063 - DNA, 22 bp, Artificial Sequence
  chemically synthesized
atattttgctgttcatcttgtt

SEQ ID NO: 688064 - DNA, 22 bp, Artificial Sequence
  chemically synthesized
gtcttatattttgctgttcatc

SEQ ID NO: 688065 - DNA, 22 bp, Artificial Sequence
  chemically synthesized
aaaacaagatgaacagcaaaat

SEQ ID NO: 688066 - DNA, 22 bp, Artificial Sequence
  chemically synthesized
aaacaagatgaacagcaaaata

SEQ ID NO: 688067 - DNA, 22 bp, Artificial Sequence
  chemically synthesized
aggcctggtcttatattttgct

SEQ ID NO: 688068 - DNA, 22 bp, Artificial Sequence
  chemically synthesized
agtggattcaggcctggtctta

SEQ ID NO: 688069 - DNA, 22 bp, Artificial Sequence
  chemically synthesized
atagaggagacagctcagtgga

SEQ ID NO: 688070 - DNA, 22 bp, Artificial Sequence
  chemically synthesized
tgaagttcatagaggagacagc

SEQ ID NO: 688071 - DNA, 22 bp, Artificial Sequence
  chemically synthesized
atgaagttcatagaggagacag

SEQ ID NO: 688072 - DNA, 22 bp, Artificial Sequence
  chemically synthesized
aatccactgagctgtctcctct

SEQ ID NO: 688073 - DNA, 22 bp, Artificial Sequence
  chemically synthesized
agctgtctcctctatgaacttc

SEQ ID NO: 688074 - DNA, 22 bp, Artificial Sequence
  chemically synthesized
tgtaagatgccttatgaagttc

SEQ ID NO: 688075 - DNA, 22 bp, Artificial Sequence
  chemically synthesized
tctcctctatgaacttcataag

SEQ ID NO: 688076 - DNA, 22 bp, Artificial Sequence
  chemically synthesized
tatgtaagatgccttatgaagt

SEQ ID NO: 688077 - DNA, 22 bp, Artificial Sequence
  chemically synthesized
ctctatgtaagatgccttatga

SEQ ID NO: 688078 - DNA, 22 bp, Artificial Sequence
  chemically synthesized
ctctatgaacttcataaggcat

SEQ ID NO: 688079 - DNA, 22 bp, Artificial Sequence
  chemically synthesized
actctatgtaagatgccttatg

SEQ ID NO: 688080 - DNA, 22 bp, Artificial Sequence
  chemically synthesized
tatgaacttcataaggcatctt

SEQ ID NO: 688081 - DNA, 22 bp, Artificial Sequence
  chemically synthesized
cttactctatgtaagatgcctt

SEQ ID NO: 688082 - DNA, 22 bp, Artificial Sequence
  chemically synthesized
tgaacttcataaggcatcttac

SEQ ID NO: 688083 - DNA, 22 bp, Artificial Sequence
  chemically synthesized
tctgcttactctatgtaagatg

SEQ ID NO: 688084 - DNA, 22 bp, Artificial Sequence
  chemically synthesized
cataaggcatcttacatagagt

SEQ ID NO: 688085 - DNA, 22 bp, Artificial Sequence
  chemically synthesized
ataaggcatcttacatagagta

SEQ ID NO: 688086 - DNA, 22 bp, Artificial Sequence
  chemically synthesized
gaagtctgtctgcttactctat

SEQ ID NO: 688087 - DNA, 22 bp, Artificial Sequence
  chemically synthesized
taagtctggaagtctgtctgct

SEQ ID NO: 688088 - DNA, 22 bp, Artificial Sequence
  chemically synthesized
acatagagtaagcagacagact

SEQ ID NO: 688089 - DNA, 22 bp, Artificial Sequence
  chemically synthesized
catagagtaagcagacagactt

SEQ ID NO: 688090 - DNA, 22 bp, Artificial Sequence
  chemically synthesized
actgtaagtctggaagtctgtc

SEQ ID NO: 688091 - DNA, 22 bp, Artificial Sequence
  chemically synthesized
taactgtaagtctggaagtctg

SEQ ID NO: 688092 - DNA, 22 bp, Artificial Sequence
  chemically synthesized
ctaactgtaagtctggaagtct

SEQ ID NO: 688093 - DNA, 22 bp, Artificial Sequence
  chemically synthesized
tctaactgtaagtctggaagtc

SEQ ID NO: 688094 - DNA, 22 bp, Artificial Sequence
  chemically synthesized
aaaccagcattttctaactgta

SEQ ID NO: 688095 - DNA, 22 bp, Artificial Sequence
  chemically synthesized
ccagacttacagttagaaaatg

SEQ ID NO: 688096 - DNA, 22 bp, Artificial Sequence
  chemically synthesized
cagacttacagttagaaaatgc

SEQ ID NO: 688097 - DNA, 22 bp, Artificial Sequence
  chemically synthesized
gagcccaggttcaaaccagcat

SEQ ID NO: 688098 - DNA, 22 bp, Artificial Sequence
  chemically synthesized
acagttagaaaatgctggtttg

SEQ ID NO: 688099 - DNA, 22 bp, Artificial Sequence
  chemically synthesized
cagttagaaaatgctggtttga

SEQ ID NO: 688100 - DNA, 22 bp, Artificial Sequence
  chemically synthesized
gaaaatgctggtttgaacctgg

SEQ ID NO: 688101 - DNA, 22 bp, Artificial Sequence
  chemically synthesized
gtttgaacctgggctctaacac

SEQ ID NO: 688102 - DNA, 22 bp, Artificial Sequence
  chemically synthesized
ccccagtatcacagtgttagag

SEQ ID NO: 688103 - DNA, 22 bp, Artificial Sequence
  chemically synthesized
cccccagtatcacagtgttaga

SEQ ID NO: 688104 - DNA, 22 bp, Artificial Sequence
  chemically synthesized
tcccccagtatcacagtgttag

SEQ ID NO: 688105 - DNA, 22 bp, Artificial Sequence
  chemically synthesized
gaacctgggctctaacactgtg

SEQ ID NO: 688106 - DNA, 22 bp, Artificial Sequence
  chemically synthesized
ttcccccagtatcacagtgtta

SEQ ID NO: 688107 - DNA, 22 bp, Artificial Sequence
  chemically synthesized
aacctgggctctaacactgtga

SEQ ID NO: 688108 - DNA, 22 bp, Artificial Sequence
  chemically synthesized
tttcccccagtatcacagtgtt

SEQ ID NO: 688109 - DNA, 22 bp, Artificial Sequence
  chemically synthesized
ttttcccccagtatcacagtgt

SEQ ID NO: 688110 - DNA, 22 bp, Artificial Sequence
  chemically synthesized
tttttcccccagtatcacagtg

SEQ ID NO: 688111 - DNA, 22 bp, Artificial Sequence
  chemically synthesized
ggctctaacactgtgatactgg

SEQ ID NO: 688112 - DNA, 22 bp, Artificial Sequence
  chemically synthesized
tgtgattttttttcccccagta

SEQ ID NO: 688113 - DNA, 22 bp, Artificial Sequence
  chemically synthesized
taacactgtgatactgggggaa

SEQ ID NO: 688114 - DNA, 22 bp, Artificial Sequence
  chemically synthesized
acactgtgatactgggggaaaa

SEQ ID NO: 688115 - DNA, 22 bp, Artificial Sequence
  chemically synthesized
tgatactgggggaaaaaaaatc

SEQ ID NO: 688116 - DNA, 22 bp, Artificial Sequence
  chemically synthesized
aatacattatgtgatttttttt

SEQ ID NO: 688117 - DNA, 22 bp, Artificial Sequence
  chemically synthesized
caatacattatgtgattttttt

SEQ ID NO: 688118 - DNA, 22 bp, Artificial Sequence
  chemically synthesized
tttcaatacattatgtgatttt

SEQ ID NO: 688119 - DNA, 22 bp, Artificial Sequence
  chemically synthesized
ttatttcaatacattatgtgat

SEQ ID NO: 688120 - DNA, 22 bp, Artificial Sequence
  chemically synthesized
ggggaaaaaaaatcacataatg

SEQ ID NO: 688121 - DNA, 22 bp, Artificial Sequence
  chemically synthesized
attatttcaatacattatgtga

SEQ ID NO: 688122 - DNA, 22 bp, Artificial Sequence
  chemically synthesized
tagtcaacaatacttattattt

SEQ ID NO: 688123 - DNA, 22 bp, Artificial Sequence
  chemically synthesized
atagtcaacaatacttattatt

SEQ ID NO: 688124 - DNA, 22 bp, Artificial Sequence
  chemically synthesized
tatagtcaacaatacttattat

SEQ ID NO: 688125 - DNA, 22 bp, Artificial Sequence
  chemically synthesized
cattttatagtcaacaatactt

SEQ ID NO: 688126 - DNA, 22 bp, Artificial Sequence
  chemically synthesized
ccattttatagtcaacaatact

SEQ ID NO: 688127 - DNA, 22 bp, Artificial Sequence
  chemically synthesized
aaataataagtattgttgacta

SEQ ID NO: 688128 - DNA, 22 bp, Artificial Sequence
  chemically synthesized
ttgactataaaatggaaatcta

SEQ ID NO: 688129 - DNA, 22 bp, Artificial Sequence
  chemically synthesized
actataaaatggaaatctatcc

SEQ ID NO: 688130 - DNA, 22 bp, Artificial Sequence
  chemically synthesized
taaaatggaaatctatcctaca

SEQ ID NO: 688131 - DNA, 22 bp, Artificial Sequence
  chemically synthesized
aaagaatatcgtaaaatatgta

SEQ ID NO: 688132 - DNA, 22 bp, Artificial Sequence
  chemically synthesized
aaaagaatatcgtaaaatatgt

SEQ ID NO: 688133 - DNA, 22 bp, Artificial Sequence
  chemically synthesized
taaaagaatatcgtaaaatatg

SEQ ID NO: 688134 - DNA, 22 bp, Artificial Sequence
  chemically synthesized
attttaaaagaatatcgtaaaa

SEQ ID NO: 688135 - DNA, 22 bp, Artificial Sequence
  chemically synthesized
aattttaaaagaatatcgtaaa

SEQ ID NO: 688136 - DNA, 22 bp, Artificial Sequence
  chemically synthesized
tcctacatattttacgatattc

SEQ ID NO: 688137 - DNA, 22 bp, Artificial Sequence
  chemically synthesized
atttaattttaaaagaatatcg

SEQ ID NO: 688138 - DNA, 22 bp, Artificial Sequence
  chemically synthesized
catttaattttaaaagaatatc

SEQ ID NO: 688139 - DNA, 22 bp, Artificial Sequence
  chemically synthesized
catattttacgatattctttta

SEQ ID NO: 688140 - DNA, 22 bp, Artificial Sequence
  chemically synthesized
cttcatttaattttaaaagaat

SEQ ID NO: 688141 - DNA, 22 bp, Artificial Sequence
  chemically synthesized
tacgatattcttttaaaattaa

SEQ ID NO: 688142 - DNA, 22 bp, Artificial Sequence
  chemically synthesized
acgatattcttttaaaattaaa

SEQ ID NO: 688143 - DNA, 22 bp, Artificial Sequence
  chemically synthesized
cgatattcttttaaaattaaat

SEQ ID NO: 688144 - DNA, 22 bp, Artificial Sequence
  chemically synthesized
catatattacttcatttaattt

SEQ ID NO: 688145 - DNA, 22 bp, Artificial Sequence
  chemically synthesized
ttttaaaattaaatgaagtaat

SEQ ID NO: 688146 - DNA, 22 bp, Artificial Sequence
  chemically synthesized
ttaaaattaaatgaagtaatat

SEQ ID NO: 688147 - DNA, 22 bp, Artificial Sequence
  chemically synthesized
taaaattaaatgaagtaatata

SEQ ID NO: 688148 - DNA, 22 bp, Artificial Sequence
  chemically synthesized
cataaagttgcatatattactt

SEQ ID NO: 688149 - DNA, 22 bp, Artificial Sequence
  chemically synthesized
aaaattaaatgaagtaatatat

SEQ ID NO: 688150 - DNA, 22 bp, Artificial Sequence
  chemically synthesized
acataaagttgcatatattact

SEQ ID NO: 688151 - DNA, 22 bp, Artificial Sequence
  chemically synthesized
aaattaaatgaagtaatatatg

SEQ ID NO: 688152 - DNA, 22 bp, Artificial Sequence
  chemically synthesized
cttacataaagttgcatatatt

SEQ ID NO: 688153 - DNA, 22 bp, Artificial Sequence
  chemically synthesized
aatgaagtaatatatgcaactt

SEQ ID NO: 688154 - DNA, 22 bp, Artificial Sequence
  chemically synthesized
taaagtacctacttacataaag

SEQ ID NO: 688155 - DNA, 22 bp, Artificial Sequence
  chemically synthesized
ataaagtacctacttacataaa

SEQ ID NO: 688156 - DNA, 22 bp, Artificial Sequence
  chemically synthesized
gtttataaagtacctacttaca

SEQ ID NO: 688157 - DNA, 22 bp, Artificial Sequence
  chemically synthesized
tagtttataaagtacctactta

SEQ ID NO: 688158 - DNA, 22 bp, Artificial Sequence
  chemically synthesized
ctagtttataaagtacctactt

SEQ ID NO: 688159 - DNA, 22 bp, Artificial Sequence
  chemically synthesized
tctagtttataaagtacctact

SEQ ID NO: 688160 - DNA, 22 bp, Artificial Sequence
  chemically synthesized
attttctagtttataaagtacc

SEQ ID NO: 688161 - DNA, 22 bp, Artificial Sequence
  chemically synthesized
aattttctagtttataaagtac

SEQ ID NO: 688162 - DNA, 22 bp, Artificial Sequence
  chemically synthesized
tatgtaagtaggtactttataa

SEQ ID NO: 688163 - DNA, 22 bp, Artificial Sequence
  chemically synthesized
atgtaagtaggtactttataaa

SEQ ID NO: 688164 - DNA, 22 bp, Artificial Sequence
  chemically synthesized
tgtaagtaggtactttataaac

SEQ ID NO: 688165 - DNA, 22 bp, Artificial Sequence
  chemically synthesized
tttaattttctagtttataaag

SEQ ID NO: 688166 - DNA, 22 bp, Artificial Sequence
  chemically synthesized
gcagttatttaattttctagtt

SEQ ID NO: 688167 - DNA, 22 bp, Artificial Sequence
  chemically synthesized
tataaactagaaaattaaataa

SEQ ID NO: 688168 - DNA, 22 bp, Artificial Sequence
  chemically synthesized
ataaactagaaaattaaataac

SEQ ID NO: 688169 - DNA, 22 bp, Artificial Sequence
  chemically synthesized
taaactagaaaattaaataact

SEQ ID NO: 688170 - DNA, 22 bp, Artificial Sequence
  chemically synthesized
aaaaataaattagcagttattt

SEQ ID NO: 688171 - DNA, 22 bp, Artificial Sequence
  chemically synthesized
gaaaattaaataactgctaatt

SEQ ID NO: 688172 - DNA, 22 bp, Artificial Sequence
  chemically synthesized
aactaaaaaataaattagcagt

SEQ ID NO: 688173 - DNA, 22 bp, Artificial Sequence
  chemically synthesized
ctaaactaaaaaataaattagc

SEQ ID NO: 688174 - DNA, 22 bp, Artificial Sequence
  chemically synthesized
actaaactaaaaaataaattag

SEQ ID NO: 688175 - DNA, 22 bp, Artificial Sequence
  chemically synthesized
tactaaactaaaaaataaatta

SEQ ID NO: 688176 - DNA, 22 bp, Artificial Sequence
  chemically synthesized
aataactgctaatttatttttt

SEQ ID NO: 688177 - DNA, 22 bp, Artificial Sequence
  chemically synthesized
tagactttactaaactaaaaaa

SEQ ID NO: 688178 - DNA, 22 bp, Artificial Sequence
  chemically synthesized
gtagactttactaaactaaaaa

SEQ ID NO: 688179 - DNA, 22 bp, Artificial Sequence
  chemically synthesized
tgtagactttactaaactaaaa

SEQ ID NO: 688180 - DNA, 22 bp, Artificial Sequence
  chemically synthesized
ttgtagactttactaaactaaa

SEQ ID NO: 688181 - DNA, 22 bp, Artificial Sequence
  chemically synthesized
ctaatttattttttagtttagt

SEQ ID NO: 688182 - DNA, 22 bp, Artificial Sequence
  chemically synthesized
atttattttttagtttagtaaa

SEQ ID NO: 688183 - DNA, 22 bp, Artificial Sequence
  chemically synthesized
attttttagtttagtaaagtct

SEQ ID NO: 688184 - DNA, 22 bp, Artificial Sequence
  chemically synthesized
ttttttagtttagtaaagtcta

SEQ ID NO: 688185 - DNA, 22 bp, Artificial Sequence
  chemically synthesized
agtgatgtttttgtagacttta

SEQ ID NO: 688186 - DNA, 22 bp, Artificial Sequence
  chemically synthesized
tttagtttagtaaagtctacaa

SEQ ID NO: 688187 - DNA, 22 bp, Artificial Sequence
  chemically synthesized
ttagtttagtaaagtctacaaa

SEQ ID NO: 688188 - DNA, 22 bp, Artificial Sequence
  chemically synthesized
tagtttagtaaagtctacaaaa

SEQ ID NO: 688189 - DNA, 22 bp, Artificial Sequence
  chemically synthesized
agtttagtaaagtctacaaaaa

SEQ ID NO: 688190 - DNA, 22 bp, Artificial Sequence
  chemically synthesized
gtttagtaaagtctacaaaaac

SEQ ID NO: 688191 - DNA, 22 bp, Artificial Sequence
  chemically synthesized
agtaaagtctacaaaaacatca

SEQ ID NO: 688192 - DNA, 22 bp, Artificial Sequence
  chemically synthesized
gtaaagtctacaaaaacatcac

SEQ ID NO: 688193 - DNA, 22 bp, Artificial Sequence
  chemically synthesized
atatatagttaagtgatgtttt

SEQ ID NO: 688194 - DNA, 22 bp, Artificial Sequence
  chemically synthesized
gatatatagttaagtgatgttt

SEQ ID NO: 688195 - DNA, 22 bp, Artificial Sequence
  chemically synthesized
tatttgatatatagttaagtga

SEQ ID NO: 688196 - DNA, 22 bp, Artificial Sequence
  chemically synthesized
caaaaacatcacttaactatat

SEQ ID NO: 688197 - DNA, 22 bp, Artificial Sequence
  chemically synthesized
agtgactatatttgatatatag

SEQ ID NO: 688198 - DNA, 22 bp, Artificial Sequence
  chemically synthesized
aactatatatcaaatatagtca

SEQ ID NO: 688199 - DNA, 22 bp, Artificial Sequence
  chemically synthesized
actatatatcaaatatagtcac

SEQ ID NO: 688200 - DNA, 22 bp, Artificial Sequence
  chemically synthesized
tatatcaaatatagtcacttag

SEQ ID NO: 688201 - DNA, 22 bp, Artificial Sequence
  chemically synthesized
aggttattattctgtttattat

SEQ ID NO: 688202 - DNA, 22 bp, Artificial Sequence
  chemically synthesized
ggttattattctgtttattatt

SEQ ID NO: 688203 - DNA, 22 bp, Artificial Sequence
  chemically synthesized
ttattctgtttattattattat

SEQ ID NO: 688204 - DNA, 22 bp, Artificial Sequence
  chemically synthesized
ttctgtttattattattattat

SEQ ID NO: 688205 - DNA, 22 bp, Artificial Sequence
  chemically synthesized
tgtttattattattattattat

SEQ ID NO: 688206 - DNA, 22 bp, Artificial Sequence
  chemically synthesized
tttattattattattattatta

SEQ ID NO: 688207 - DNA, 22 bp, Artificial Sequence
  chemically synthesized
attattattattattattatta

SEQ ID NO: 688208 - DNA, 22 bp, Artificial Sequence
  chemically synthesized
ttattattattattattattat

SEQ ID NO: 688209 - DNA, 22 bp, Artificial Sequence
  chemically synthesized
aaataataataataataataat

SEQ ID NO: 688210 - DNA, 22 bp, Artificial Sequence
  chemically synthesized
ttattattattattattattat

SEQ ID NO: 688211 - DNA, 22 bp, Artificial Sequence
  chemically synthesized
ttattattattattattattat

SEQ ID NO: 688212 - DNA, 22 bp, Artificial Sequence
  chemically synthesized
tctcaaataataataataataa

SEQ ID NO: 688213 - DNA, 22 bp, Artificial Sequence
  chemically synthesized
tgtctcaaataataataataat

SEQ ID NO: 688214 - DNA, 22 bp, Artificial Sequence
  chemically synthesized
ttattattattattattattat

SEQ ID NO: 688215 - DNA, 22 bp, Artificial Sequence
  chemically synthesized
ttattattattattattattat

SEQ ID NO: 688216 - DNA, 22 bp, Artificial Sequence
  chemically synthesized
ttattattattattattatttg

SEQ ID NO: 688217 - DNA, 22 bp, Artificial Sequence
  chemically synthesized
ttattattattattatttgaga

SEQ ID NO: 688218 - DNA, 22 bp, Artificial Sequence
  chemically synthesized
ttattattattatttgagacag

SEQ ID NO: 688219 - DNA, 22 bp, Artificial Sequence
  chemically synthesized
ttattattatttgagacagagt

SEQ ID NO: 688220 - DNA, 22 bp, Artificial Sequence
  chemically synthesized
ggcgacagagtgagactctgtc

SEQ ID NO: 688221 - DNA, 22 bp, Artificial Sequence
  chemically synthesized
ttattatttgagacagagtctc

SEQ ID NO: 688222 - DNA, 22 bp, Artificial Sequence
  chemically synthesized
ttatttgagacagagtctcact

SEQ ID NO: 688223 - DNA, 22 bp, Artificial Sequence
  chemically synthesized
tttgagacagagtctcactctg

SEQ ID NO: 688224 - DNA, 22 bp, Artificial Sequence
  chemically synthesized
cagcctgggcgacagagtgaga

SEQ ID NO: 688225 - DNA, 22 bp, Artificial Sequence
  chemically synthesized
gagacagagtctcactctgtcg

SEQ ID NO: 688226 - DNA, 22 bp, Artificial Sequence
  chemically synthesized
agacagagtctcactctgtcgc

SEQ ID NO: 688227 - DNA, 22 bp, Artificial Sequence
  chemically synthesized
cactccagcctgggcgacagag

SEQ ID NO: 688228 - DNA, 22 bp, Artificial Sequence
  chemically synthesized
actctgtcgcccaggctggagt

SEQ ID NO: 688229 - DNA, 22 bp, Artificial Sequence
  chemically synthesized
tgtcgcccaggctggagtgcag

SEQ ID NO: 688230 - DNA, 22 bp, Artificial Sequence
  chemically synthesized
tcgcccaggctggagtgcagtg

SEQ ID NO: 688231 - DNA, 22 bp, Artificial Sequence
  chemically synthesized
cagtgagcagagatcatgccac

SEQ ID NO: 688232 - DNA, 22 bp, Artificial Sequence
  chemically synthesized
gagtgcagtggcatgatctctg

SEQ ID NO: 688233 - DNA, 22 bp, Artificial Sequence
  chemically synthesized
aacccaggaggcggaggttgca

SEQ ID NO: 688234 - DNA, 22 bp, Artificial Sequence
  chemically synthesized
gaacccaggaggcggaggttgc

SEQ ID NO: 688235 - DNA, 22 bp, Artificial Sequence
  chemically synthesized
cttgaacccaggaggcggaggt

SEQ ID NO: 688236 - DNA, 22 bp, Artificial Sequence
  chemically synthesized
tgctcactgcaacctccgcctc

SEQ ID NO: 688237 - DNA, 22 bp, Artificial Sequence
  chemically synthesized
ctcactgcaacctccgcctcct

SEQ ID NO: 688238 - DNA, 22 bp, Artificial Sequence
  chemically synthesized
actgcaacctccgcctcctggg

SEQ ID NO: 688239 - DNA, 22 bp, Artificial Sequence
  chemically synthesized
caacctccgcctcctgggttca

SEQ ID NO: 688240 - DNA, 22 bp, Artificial Sequence
  chemically synthesized
aggcatgagaattgcttgaacc

SEQ ID NO: 688241 - DNA, 22 bp, Artificial Sequence
  chemically synthesized
cgcctcctgggttcaagcaatt

SEQ ID NO: 688242 - DNA, 22 bp, Artificial Sequence
  chemically synthesized
ctgggttcaagcaattctcatg

SEQ ID NO: 688243 - DNA, 22 bp, Artificial Sequence
  chemically synthesized
gggaggctgaggcatgagaatt

SEQ ID NO: 688244 - DNA, 22 bp, Artificial Sequence
  chemically synthesized
ggttcaagcaattctcatgcct

SEQ ID NO: 688245 - DNA, 22 bp, Artificial Sequence
  chemically synthesized
ctcgggaggctgaggcatgaga

SEQ ID NO: 688246 - DNA, 22 bp, Artificial Sequence
  chemically synthesized
aagcaattctcatgcctcagcc

SEQ ID NO: 688247 - DNA, 22 bp, Artificial Sequence
  chemically synthesized
taatcccagctactcgggaggc

SEQ ID NO: 688248 - DNA, 22 bp, Artificial Sequence
  chemically synthesized
tcatgcctcagcctcccgagta

SEQ ID NO: 688249 - DNA, 22 bp, Artificial Sequence
  chemically synthesized
atgcctcagcctcccgagtagc

SEQ ID NO: 688250 - DNA, 22 bp, Artificial Sequence
  chemically synthesized
agcctcccgagtagctgggatt

SEQ ID NO: 688251 - DNA, 22 bp, Artificial Sequence
  chemically synthesized
ccgagtagctgggattacaggt

SEQ ID NO: 688252 - DNA, 22 bp, Artificial Sequence
  chemically synthesized
ggattacaggtgcacgccacca

SEQ ID NO: 688253 - DNA, 22 bp, Artificial Sequence
  chemically synthesized
caggtgcacgccaccatgcctg

SEQ ID NO: 688254 - DNA, 22 bp, Artificial Sequence
  chemically synthesized
aaaatataaaaatcagccaggc

SEQ ID NO: 688255 - DNA, 22 bp, Artificial Sequence
  chemically synthesized
ctaaaaatataaaaatcagcca

SEQ ID NO: 688256 - DNA, 22 bp, Artificial Sequence
  chemically synthesized
tactaaaaatataaaaatcagc

SEQ ID NO: 688257 - DNA, 22 bp, Artificial Sequence
  chemically synthesized
aaccccatctctactaaaaata

SEQ ID NO: 688258 - DNA, 22 bp, Artificial Sequence
  chemically synthesized
gctgatttttatatttttagta

SEQ ID NO: 688259 - DNA, 22 bp, Artificial Sequence
  chemically synthesized
atttttatatttttagtagaga

SEQ ID NO: 688260 - DNA, 22 bp, Artificial Sequence
  chemically synthesized
ttatatttttagtagagatggg

SEQ ID NO: 688261 - DNA, 22 bp, Artificial Sequence
  chemically synthesized
tatatttttagtagagatgggg

SEQ ID NO: 688262 - DNA, 22 bp, Artificial Sequence
  chemically synthesized
atatttttagtagagatggggt

SEQ ID NO: 688263 - DNA, 22 bp, Artificial Sequence
  chemically synthesized
tatttttagtagagatggggtt

SEQ ID NO: 688264 - DNA, 22 bp, Artificial Sequence
  chemically synthesized
gccaacatggctaaaccccatc

SEQ ID NO: 688265 - DNA, 22 bp, Artificial Sequence
  chemically synthesized
ttagtagagatggggtttagcc

SEQ ID NO: 688266 - DNA, 22 bp, Artificial Sequence
  chemically synthesized
tagtagagatggggtttagcca

SEQ ID NO: 688267 - DNA, 22 bp, Artificial Sequence
  chemically synthesized
agtagagatggggtttagccat

SEQ ID NO: 688268 - DNA, 22 bp, Artificial Sequence
  chemically synthesized
gtagagatggggtttagccatg

SEQ ID NO: 688269 - DNA, 22 bp, Artificial Sequence
  chemically synthesized
aagaccagcctggccaacatgg

SEQ ID NO: 688270 - DNA, 22 bp, Artificial Sequence
  chemically synthesized
agccatgttggccaggctggtc

SEQ ID NO: 688271 - DNA, 22 bp, Artificial Sequence
  chemically synthesized
gccatgttggccaggctggtct

SEQ ID NO: 688272 - DNA, 22 bp, Artificial Sequence
  chemically synthesized
atgccaggagttcaagaccagc

SEQ ID NO: 688273 - DNA, 22 bp, Artificial Sequence
  chemically synthesized
gatgccaggagttcaagaccag

SEQ ID NO: 688274 - DNA, 22 bp, Artificial Sequence
  chemically synthesized
cttgatgccaggagttcaagac

SEQ ID NO: 688275 - DNA, 22 bp, Artificial Sequence
  chemically synthesized
gccaggctggtcttgaactcct

SEQ ID NO: 688276 - DNA, 22 bp, Artificial Sequence
  chemically synthesized
gtcttgaactcctggcatcaag

SEQ ID NO: 688277 - DNA, 22 bp, Artificial Sequence
  chemically synthesized
gaactcctggcatcaagcaatc

SEQ ID NO: 688278 - DNA, 22 bp, Artificial Sequence
  chemically synthesized
aactcctggcatcaagcaatct

SEQ ID NO: 688279 - DNA, 22 bp, Artificial Sequence
  chemically synthesized
ggaggccgaggcgggtagattg

SEQ ID NO: 688280 - DNA, 22 bp, Artificial Sequence
  chemically synthesized
ctggcatcaagcaatctacccg

SEQ ID NO: 688281 - DNA, 22 bp, Artificial Sequence
  chemically synthesized
gggaggccgaggcgggtagatt

SEQ ID NO: 688282 - DNA, 22 bp, Artificial Sequence
  chemically synthesized
tgggaggccgaggcgggtagat

SEQ ID NO: 688283 - DNA, 22 bp, Artificial Sequence
  chemically synthesized
gcatcaagcaatctacccgcct

SEQ ID NO: 688284 - DNA, 22 bp, Artificial Sequence
  chemically synthesized
gcactttgggaggccgaggcgg

SEQ ID NO: 688285 - DNA, 22 bp, Artificial Sequence
  chemically synthesized
tagtcctagcactttgggaggc

SEQ ID NO: 688286 - DNA, 22 bp, Artificial Sequence
  chemically synthesized
cccgcctcggcctcccaaagtg

SEQ ID NO: 688287 - DNA, 22 bp, Artificial Sequence
  chemically synthesized
atgcctgtagtcctagcacttt

SEQ ID NO: 688288 - DNA, 22 bp, Artificial Sequence
  chemically synthesized
ggcctcccaaagtgctaggact

SEQ ID NO: 688289 - DNA, 22 bp, Artificial Sequence
  chemically synthesized
ccaaagtgctaggactacaggc

SEQ ID NO: 688290 - DNA, 22 bp, Artificial Sequence
  chemically synthesized
ggcatggtggctcatgcctgta

SEQ ID NO: 688291 - DNA, 22 bp, Artificial Sequence
  chemically synthesized
ggactacaggcatgagccacca

SEQ ID NO: 688292 - DNA, 22 bp, Artificial Sequence
  chemically synthesized
caggcatgagccaccatgccca

SEQ ID NO: 688293 - DNA, 22 bp, Artificial Sequence
  chemically synthesized
aaataataaaataatagtaaat

SEQ ID NO: 688294 - DNA, 22 bp, Artificial Sequence
  chemically synthesized
aaaataataaaataatagtaaa

SEQ ID NO: 688295 - DNA, 22 bp, Artificial Sequence
  chemically synthesized
taaaataataaaataatagtaa

SEQ ID NO: 688296 - DNA, 22 bp, Artificial Sequence
  chemically synthesized
ttaaaataataaaataatagta

SEQ ID NO: 688297 - DNA, 22 bp, Artificial Sequence
  chemically synthesized
ggatttttaaaataataaaata

SEQ ID NO: 688298 - DNA, 22 bp, Artificial Sequence
  chemically synthesized
atttactattattttattattt

SEQ ID NO: 688299 - DNA, 22 bp, Artificial Sequence
  chemically synthesized
tttactattattttattatttt

SEQ ID NO: 688300 - DNA, 22 bp, Artificial Sequence
  chemically synthesized
actattattttattattttaaa

SEQ ID NO: 688301 - DNA, 22 bp, Artificial Sequence
  chemically synthesized
ctattattttattattttaaaa

SEQ ID NO: 688302 - DNA, 22 bp, Artificial Sequence
  chemically synthesized
aggaaattaggatttttaaaat

SEQ ID NO: 688303 - DNA, 22 bp, Artificial Sequence
  chemically synthesized
ttattttattattttaaaaatc

SEQ ID NO: 688304 - DNA, 22 bp, Artificial Sequence
  chemically synthesized
ttttattattttaaaaatccta

SEQ ID NO: 688305 - DNA, 22 bp, Artificial Sequence
  chemically synthesized
tattattttaaaaatcctaatt

SEQ ID NO: 688306 - DNA, 22 bp, Artificial Sequence
  chemically synthesized
attattttaaaaatcctaattt

SEQ ID NO: 688307 - DNA, 22 bp, Artificial Sequence
  chemically synthesized
ttattttaaaaatcctaatttc

SEQ ID NO: 688308 - DNA, 22 bp, Artificial Sequence
  chemically synthesized
caggaaaaattcaggaaattag

SEQ ID NO: 688309 - DNA, 22 bp, Artificial Sequence
  chemically synthesized
ttttaaaaatcctaatttcctg

SEQ ID NO: 688310 - DNA, 22 bp, Artificial Sequence
  chemically synthesized
ccaggaaaaattcaggaaatta

SEQ ID NO: 688311 - DNA, 22 bp, Artificial Sequence
  chemically synthesized
taaaaatcctaatttcctgaat

SEQ ID NO: 688312 - DNA, 22 bp, Artificial Sequence
  chemically synthesized
aaaaatcctaatttcctgaatt

SEQ ID NO: 688313 - DNA, 22 bp, Artificial Sequence
  chemically synthesized
aaaatcctaatttcctgaattt

SEQ ID NO: 688314 - DNA, 22 bp, Artificial Sequence
  chemically synthesized
catttccaggaaaaattcagga

SEQ ID NO: 688315 - DNA, 22 bp, Artificial Sequence
  chemically synthesized
tctgcatttccaggaaaaattc

SEQ ID NO: 688316 - DNA, 22 bp, Artificial Sequence
  chemically synthesized
atctgcatttccaggaaaaatt

SEQ ID NO: 688317 - DNA, 22 bp, Artificial Sequence
  chemically synthesized
cttatctgcatttccaggaaaa

SEQ ID NO: 688318 - DNA, 22 bp, Artificial Sequence
  chemically synthesized
atttcctgaatttttcctggaa

SEQ ID NO: 688319 - DNA, 22 bp, Artificial Sequence
  chemically synthesized
cctacttatctgcatttccagg

SEQ ID NO: 688320 - DNA, 22 bp, Artificial Sequence
  chemically synthesized
cctgaatttttcctggaaatgc

SEQ ID NO: 688321 - DNA, 22 bp, Artificial Sequence
  chemically synthesized
ctgaatttttcctggaaatgca

SEQ ID NO: 688322 - DNA, 22 bp, Artificial Sequence
  chemically synthesized
aatttttcctggaaatgcagat

SEQ ID NO: 688323 - DNA, 22 bp, Artificial Sequence
  chemically synthesized
ttcctggaaatgcagataagta

SEQ ID NO: 688324 - DNA, 22 bp, Artificial Sequence
  chemically synthesized
tcctggaaatgcagataagtag

SEQ ID NO: 688325 - DNA, 22 bp, Artificial Sequence
  chemically synthesized
cctggaaatgcagataagtagg

SEQ ID NO: 688326 - DNA, 22 bp, Artificial Sequence
  chemically synthesized
ctggaaatgcagataagtaggt

SEQ ID NO: 688327 - DNA, 22 bp, Artificial Sequence
  chemically synthesized
gaaatgcagataagtaggtaat

SEQ ID NO: 688328 - DNA, 22 bp, Artificial Sequence
  chemically synthesized
ccatcaccaaatgcattaccta

SEQ ID NO: 688329 - DNA, 22 bp, Artificial Sequence
  chemically synthesized
atactaccatcaccaaatgcat

SEQ ID NO: 688330 - DNA, 22 bp, Artificial Sequence
  chemically synthesized
ttaatactaccatcaccaaatg

SEQ ID NO: 688331 - DNA, 22 bp, Artificial Sequence
  chemically synthesized
ctattaatactaccatcaccaa

SEQ ID NO: 688332 - DNA, 22 bp, Artificial Sequence
  chemically synthesized
attactattaatactaccatca

SEQ ID NO: 688333 - DNA, 22 bp, Artificial Sequence
  chemically synthesized
gctcattactattaatactacc

SEQ ID NO: 688334 - DNA, 22 bp, Artificial Sequence
  chemically synthesized
ggtgatggtagtattaatagta

SEQ ID NO: 688335 - DNA, 22 bp, Artificial Sequence
  chemically synthesized
gtgatggtagtattaatagtaa

SEQ ID NO: 688336 - DNA, 22 bp, Artificial Sequence
  chemically synthesized
aggatgaggtattagctcatta

SEQ ID NO: 688337 - DNA, 22 bp, Artificial Sequence
  chemically synthesized
caggatgaggtattagctcatt

SEQ ID NO: 688338 - DNA, 22 bp, Artificial Sequence
  chemically synthesized
tcaggatgaggtattagctcat

SEQ ID NO: 688339 - DNA, 22 bp, Artificial Sequence
  chemically synthesized
ttttcaggatgaggtattagct

SEQ ID NO: 688340 - DNA, 22 bp, Artificial Sequence
  chemically synthesized
atagtaatgagctaatacctca

SEQ ID NO: 688341 - DNA, 22 bp, Artificial Sequence
  chemically synthesized
agctattttcaggatgaggtat

SEQ ID NO: 688342 - DNA, 22 bp, Artificial Sequence
  chemically synthesized
gagctattttcaggatgaggta

SEQ ID NO: 688343 - DNA, 22 bp, Artificial Sequence
  chemically synthesized
tgagctattttcaggatgaggt

SEQ ID NO: 688344 - DNA, 22 bp, Artificial Sequence
  chemically synthesized
atacctcatcctgaaaatagct

SEQ ID NO: 688345 - DNA, 22 bp, Artificial Sequence
  chemically synthesized
aggtaatctttgagctattttc

SEQ ID NO: 688346 - DNA, 22 bp, Artificial Sequence
  chemically synthesized
aaggtaatctttgagctatttt

SEQ ID NO: 688347 - DNA, 22 bp, Artificial Sequence
  chemically synthesized
atcctgaaaatagctcaaagat

SEQ ID NO: 688348 - DNA, 22 bp, Artificial Sequence
  chemically synthesized
aaaatagctcaaagattacctt

SEQ ID NO: 688349 - DNA, 22 bp, Artificial Sequence
  chemically synthesized
gggagtcaatatgtacttaagg

SEQ ID NO: 688350 - DNA, 22 bp, Artificial Sequence
  chemically synthesized
agggagtcaatatgtacttaag

SEQ ID NO: 688351 - DNA, 22 bp, Artificial Sequence
  chemically synthesized
aaagattaccttaagtacatat

SEQ ID NO: 688352 - DNA, 22 bp, Artificial Sequence
  chemically synthesized
acatatttagggagtcaatatg

SEQ ID NO: 688353 - DNA, 22 bp, Artificial Sequence
  chemically synthesized
ccttaagtacatattgactccc

SEQ ID NO: 688354 - DNA, 22 bp, Artificial Sequence
  chemically synthesized
ttcacatatttagggagtcaat

SEQ ID NO: 688355 - DNA, 22 bp, Artificial Sequence
  chemically synthesized
ttattcacatatttagggagtc

SEQ ID NO: 688356 - DNA, 22 bp, Artificial Sequence
  chemically synthesized
aagtacatattgactccctaaa

SEQ ID NO: 688357 - DNA, 22 bp, Artificial Sequence
  chemically synthesized
gttattcacatatttagggagt

SEQ ID NO: 688358 - DNA, 22 bp, Artificial Sequence
  chemically synthesized
agtacatattgactccctaaat

SEQ ID NO: 688359 - DNA, 22 bp, Artificial Sequence
  chemically synthesized
tatttgttattcacatatttag

SEQ ID NO: 688360 - DNA, 22 bp, Artificial Sequence
  chemically synthesized
actccctaaatatgtgaataac

SEQ ID NO: 688361 - DNA, 22 bp, Artificial Sequence
  chemically synthesized
cctaaatatgtgaataacaaat

SEQ ID NO: 688362 - DNA, 22 bp, Artificial Sequence
  chemically synthesized
tgtgacaattatatttgttatt

SEQ ID NO: 688363 - DNA, 22 bp, Artificial Sequence
  chemically synthesized
atgtgacaattatatttgttat

SEQ ID NO: 688364 - DNA, 22 bp, Artificial Sequence
  chemically synthesized
aatatgtgaataacaaatataa

SEQ ID NO: 688365 - DNA, 22 bp, Artificial Sequence
  chemically synthesized
tatttatgtgacaattatattt

SEQ ID NO: 688366 - DNA, 22 bp, Artificial Sequence
  chemically synthesized
cataattgtatttatgtgacaa

SEQ ID NO: 688367 - DNA, 22 bp, Artificial Sequence
  chemically synthesized
acatgattgcataattgtattt

SEQ ID NO: 688368 - DNA, 22 bp, Artificial Sequence
  chemically synthesized
gttgacatgattgcataattgt

SEQ ID NO: 688369 - DNA, 22 bp, Artificial Sequence
  chemically synthesized
agttgacatgattgcataattg

SEQ ID NO: 688370 - DNA, 22 bp, Artificial Sequence
  chemically synthesized
tcacataaatacaattatgcaa

SEQ ID NO: 688371 - DNA, 22 bp, Artificial Sequence
  chemically synthesized
tatttagttgacatgattgcat

SEQ ID NO: 688372 - DNA, 22 bp, Artificial Sequence
  chemically synthesized
caaattgtatttagttgacatg

SEQ ID NO: 688373 - DNA, 22 bp, Artificial Sequence
  chemically synthesized
gcaaattgtatttagttgacat

SEQ ID NO: 688374 - DNA, 22 bp, Artificial Sequence
  chemically synthesized
tgcaatcatgtcaactaaatac

SEQ ID NO: 688375 - DNA, 22 bp, Artificial Sequence
  chemically synthesized
aacaatcaaaatatttgcaaat

SEQ ID NO: 688376 - DNA, 22 bp, Artificial Sequence
  chemically synthesized
aaacaatcaaaatatttgcaaa

SEQ ID NO: 688377 - DNA, 22 bp, Artificial Sequence
  chemically synthesized
aatacaatttgcaaatattttg

SEQ ID NO: 688378 - DNA, 22 bp, Artificial Sequence
  chemically synthesized
aaaatacaaccttaaacaatca

SEQ ID NO: 688379 - DNA, 22 bp, Artificial Sequence
  chemically synthesized
gcaaatattttgattgtttaag

SEQ ID NO: 688380 - DNA, 22 bp, Artificial Sequence
  chemically synthesized
caaatattttgattgtttaagg

SEQ ID NO: 688381 - DNA, 22 bp, Artificial Sequence
  chemically synthesized
tgattgtttaaggttgtatttt

SEQ ID NO: 688382 - DNA, 22 bp, Artificial Sequence
  chemically synthesized
aatagtacactgaaaatacaac

SEQ ID NO: 688383 - DNA, 22 bp, Artificial Sequence
  chemically synthesized
gattgtttaaggttgtattttc

SEQ ID NO: 688384 - DNA, 22 bp, Artificial Sequence
  chemically synthesized
attgtttaaggttgtattttca

SEQ ID NO: 688385 - DNA, 22 bp, Artificial Sequence
  chemically synthesized
ttaaatagtacactgaaaatac

SEQ ID NO: 688386 - DNA, 22 bp, Artificial Sequence
  chemically synthesized
tttaaggttgtattttcagtgt

SEQ ID NO: 688387 - DNA, 22 bp, Artificial Sequence
  chemically synthesized
aaggttgtattttcagtgtact

SEQ ID NO: 688388 - DNA, 22 bp, Artificial Sequence
  chemically synthesized
aggttgtattttcagtgtacta

SEQ ID NO: 688389 - DNA, 22 bp, Artificial Sequence
  chemically synthesized
tattttcagtgtactatttaac

SEQ ID NO: 688390 - DNA, 22 bp, Artificial Sequence
  chemically synthesized
tcagtgtactatttaacagtta

SEQ ID NO: 688391 - DNA, 22 bp, Artificial Sequence
  chemically synthesized
ataagatatgtataactgttaa

SEQ ID NO: 688392 - DNA, 22 bp, Artificial Sequence
  chemically synthesized
cagtgtactatttaacagttat

SEQ ID NO: 688393 - DNA, 22 bp, Artificial Sequence
  chemically synthesized
agtgtactatttaacagttata

SEQ ID NO: 688394 - DNA, 22 bp, Artificial Sequence
  chemically synthesized
tagactaataagatatgtataa

SEQ ID NO: 688395 - DNA, 22 bp, Artificial Sequence
  chemically synthesized
gtagactaataagatatgtata

SEQ ID NO: 688396 - DNA, 22 bp, Artificial Sequence
  chemically synthesized
tttaacagttatacatatctta

SEQ ID NO: 688397 - DNA, 22 bp, Artificial Sequence
  chemically synthesized
aacagttatacatatcttatta

SEQ ID NO: 688398 - DNA, 22 bp, Artificial Sequence
  chemically synthesized
acagttatacatatcttattag

SEQ ID NO: 688399 - DNA, 22 bp, Artificial Sequence
  chemically synthesized
aagtcttgtagactaataagat

SEQ ID NO: 688400 - DNA, 22 bp, Artificial Sequence
  chemically synthesized
tacatatcttattagtctacaa

SEQ ID NO: 688401 - DNA, 22 bp, Artificial Sequence
  chemically synthesized
tagtctaaagtcttgtagacta

SEQ ID NO: 688402 - DNA, 22 bp, Artificial Sequence
  chemically synthesized
gtagtctaaagtcttgtagact

SEQ ID NO: 688403 - DNA, 22 bp, Artificial Sequence
  chemically synthesized
tccttgtagtctaaagtcttgt

SEQ ID NO: 688404 - DNA, 22 bp, Artificial Sequence
  chemically synthesized
ctgtccttgtagtctaaagtct

SEQ ID NO: 688405 - DNA, 22 bp, Artificial Sequence
  chemically synthesized
attagtctacaagactttagac

SEQ ID NO: 688406 - DNA, 22 bp, Artificial Sequence
  chemically synthesized
ttagtctacaagactttagact

SEQ ID NO: 688407 - DNA, 22 bp, Artificial Sequence
  chemically synthesized
gtctacaagactttagactaca

SEQ ID NO: 688408 - DNA, 22 bp, Artificial Sequence
  chemically synthesized
caagactttagactacaaggac

SEQ ID NO: 688409 - DNA, 22 bp, Artificial Sequence
  chemically synthesized
tagactacaaggacagtagtct

SEQ ID NO: 688410 - DNA, 22 bp, Artificial Sequence
  chemically synthesized
agactacaaggacagtagtctt

SEQ ID NO: 688411 - DNA, 22 bp, Artificial Sequence
  chemically synthesized
gactacaaggacagtagtcttc

SEQ ID NO: 688412 - DNA, 22 bp, Artificial Sequence
  chemically synthesized
ggcaggtagggaccatgaagac

SEQ ID NO: 688413 - DNA, 22 bp, Artificial Sequence
  chemically synthesized
caaggacagtagtcttcatggt

SEQ ID NO: 688414 - DNA, 22 bp, Artificial Sequence
  chemically synthesized
ccatactaggcaggtagggacc

SEQ ID NO: 688415 - DNA, 22 bp, Artificial Sequence
  chemically synthesized
catggtccctacctgcctagta

SEQ ID NO: 688416 - DNA, 22 bp, Artificial Sequence
  chemically synthesized
atggtccctacctgcctagtat

SEQ ID NO: 688417 - DNA, 22 bp, Artificial Sequence
  chemically synthesized
agcaaataatcatagctgccat

SEQ ID NO: 688418 - DNA, 22 bp, Artificial Sequence
  chemically synthesized
cctgcctagtatggcagctatg

SEQ ID NO: 688419 - DNA, 22 bp, Artificial Sequence
  chemically synthesized
attcagcaaataatcatagctg

SEQ ID NO: 688420 - DNA, 22 bp, Artificial Sequence
  chemically synthesized
cctagtatggcagctatgatta

SEQ ID NO: 688421 - DNA, 22 bp, Artificial Sequence
  chemically synthesized
ttcattcagcaaataatcatag

SEQ ID NO: 688422 - DNA, 22 bp, Artificial Sequence
  chemically synthesized
attcattcagcaaataatcata

SEQ ID NO: 688423 - DNA, 22 bp, Artificial Sequence
  chemically synthesized
tattcattcagcaaataatcat

SEQ ID NO: 688424 - DNA, 22 bp, Artificial Sequence
  chemically synthesized
gtatggcagctatgattatttg

SEQ ID NO: 688425 - DNA, 22 bp, Artificial Sequence
  chemically synthesized
ttattcattcagcaaataatca

SEQ ID NO: 688426 - DNA, 22 bp, Artificial Sequence
  chemically synthesized
tttttattcattcagcaaataa

SEQ ID NO: 688427 - DNA, 22 bp, Artificial Sequence
  chemically synthesized
gagtattatttttattcattca

SEQ ID NO: 688428 - DNA, 22 bp, Artificial Sequence
  chemically synthesized
tgattatttgctgaatgaataa

SEQ ID NO: 688429 - DNA, 22 bp, Artificial Sequence
  chemically synthesized
agagtattatttttattcattc

SEQ ID NO: 688430 - DNA, 22 bp, Artificial Sequence
  chemically synthesized
tagagtattatttttattcatt

SEQ ID NO: 688431 - DNA, 22 bp, Artificial Sequence
  chemically synthesized
ttagagtattatttttattcat

SEQ ID NO: 688432 - DNA, 22 bp, Artificial Sequence
  chemically synthesized
tttagagtattatttttattca

SEQ ID NO: 688433 - DNA, 22 bp, Artificial Sequence
  chemically synthesized
tttgctgaatgaataaaaataa

SEQ ID NO: 688434 - DNA, 22 bp, Artificial Sequence
  chemically synthesized
gctgaatgaataaaaataatac

SEQ ID NO: 688435 - DNA, 22 bp, Artificial Sequence
  chemically synthesized
ctgaatgaataaaaataatact

SEQ ID NO: 688436 - DNA, 22 bp, Artificial Sequence
  chemically synthesized
aatgaataaaaataatactcta

SEQ ID NO: 688437 - DNA, 22 bp, Artificial Sequence
  chemically synthesized
atatgaacacactttttagagt

SEQ ID NO: 688438 - DNA, 22 bp, Artificial Sequence
  chemically synthesized
ttcatatgaacacactttttag

SEQ ID NO: 688439 - DNA, 22 bp, Artificial Sequence
  chemically synthesized
taaaaagtgtgttcatatgaat

SEQ ID NO: 688440 - DNA, 22 bp, Artificial Sequence
  chemically synthesized
aaaagtgtgttcatatgaataa

SEQ ID NO: 688441 - DNA, 22 bp, Artificial Sequence
  chemically synthesized
atatgaataatttttcattcat

SEQ ID NO: 688442 - DNA, 22 bp, Artificial Sequence
  chemically synthesized
ggatagaggcatcatgaatgaa

SEQ ID NO: 688443 - DNA, 22 bp, Artificial Sequence
  chemically synthesized
aggatagaggcatcatgaatga

SEQ ID NO: 688444 - DNA, 22 bp, Artificial Sequence
  chemically synthesized
ttcattcatgatgcctctatcc

SEQ ID NO: 688445 - DNA, 22 bp, Artificial Sequence
  chemically synthesized
tcattcatgatgcctctatcct

SEQ ID NO: 688446 - DNA, 22 bp, Artificial Sequence
  chemically synthesized
cattcatgatgcctctatccta

SEQ ID NO: 688447 - DNA, 22 bp, Artificial Sequence
  chemically synthesized
attcatgatgcctctatcctaa

SEQ ID NO: 688448 - DNA, 22 bp, Artificial Sequence
  chemically synthesized
tatataagatgcttaggataga

SEQ ID NO: 688449 - DNA, 22 bp, Artificial Sequence
  chemically synthesized
atgatgcctctatcctaagcat

SEQ ID NO: 688450 - DNA, 22 bp, Artificial Sequence
  chemically synthesized
agatcctatatataagatgctt

SEQ ID NO: 688451 - DNA, 22 bp, Artificial Sequence
  chemically synthesized
tatcctaagcatcttatatata

SEQ ID NO: 688452 - DNA, 22 bp, Artificial Sequence
  chemically synthesized
tggattaagatcctatatataa

SEQ ID NO: 688453 - DNA, 22 bp, Artificial Sequence
  chemically synthesized
tcctaagcatcttatatatagg

SEQ ID NO: 688454 - DNA, 22 bp, Artificial Sequence
  chemically synthesized
ctgtggattaagatcctatata

SEQ ID NO: 688455 - DNA, 22 bp, Artificial Sequence
  chemically synthesized
agcatcttatatataggatctt

SEQ ID NO: 688456 - DNA, 22 bp, Artificial Sequence
  chemically synthesized
agattgctgtggattaagatcc

SEQ ID NO: 688457 - DNA, 22 bp, Artificial Sequence
  chemically synthesized
atatataggatcttaatccaca

SEQ ID NO: 688458 - DNA, 22 bp, Artificial Sequence
  chemically synthesized
tatataggatcttaatccacag

SEQ ID NO: 688459 - DNA, 22 bp, Artificial Sequence
  chemically synthesized
cagggaattcagattgctgtgg

SEQ ID NO: 688460 - DNA, 22 bp, Artificial Sequence
  chemically synthesized
gcagggaattcagattgctgtg

SEQ ID NO: 688461 - DNA, 22 bp, Artificial Sequence
  chemically synthesized
tgcagggaattcagattgctgt

SEQ ID NO: 688462 - DNA, 22 bp, Artificial Sequence
  chemically synthesized
ttgcagggaattcagattgctg

SEQ ID NO: 688463 - DNA, 22 bp, Artificial Sequence
  chemically synthesized
atttttgcagggaattcagatt

SEQ ID NO: 688464 - DNA, 22 bp, Artificial Sequence
  chemically synthesized
aatttttgcagggaattcagat

SEQ ID NO: 688465 - DNA, 22 bp, Artificial Sequence
  chemically synthesized
aatccacagcaatctgaattcc

SEQ ID NO: 688466 - DNA, 22 bp, Artificial Sequence
  chemically synthesized
taatttttgcagggaattcaga

SEQ ID NO: 688467 - DNA, 22 bp, Artificial Sequence
  chemically synthesized
atccacagcaatctgaattccc

SEQ ID NO: 688468 - DNA, 22 bp, Artificial Sequence
  chemically synthesized
ttaatttttgcagggaattcag

SEQ ID NO: 688469 - DNA, 22 bp, Artificial Sequence
  chemically synthesized
ttttaatttttgcagggaattc

SEQ ID NO: 688470 - DNA, 22 bp, Artificial Sequence
  chemically synthesized
cttttaatttttgcagggaatt

SEQ ID NO: 688471 - DNA, 22 bp, Artificial Sequence
  chemically synthesized
aattccctgcaaaaattaaaag

SEQ ID NO: 688472 - DNA, 22 bp, Artificial Sequence
  chemically synthesized
cctgcaaaaattaaaagaagtc

SEQ ID NO: 688473 - DNA, 22 bp, Artificial Sequence
  chemically synthesized
caaaaattaaaagaagtctgat

SEQ ID NO: 688474 - DNA, 22 bp, Artificial Sequence
  chemically synthesized
tatagagtgaaggaatatcaga

SEQ ID NO: 688475 - DNA, 22 bp, Artificial Sequence
  chemically synthesized
aaagaagtctgatattccttca

SEQ ID NO: 688476 - DNA, 22 bp, Artificial Sequence
  chemically synthesized
aaggttatatagagtgaaggaa

SEQ ID NO: 688477 - DNA, 22 bp, Artificial Sequence
  chemically synthesized
caaggttatatagagtgaagga

SEQ ID NO: 688478 - DNA, 22 bp, Artificial Sequence
  chemically synthesized
tcaaggttatatagagtgaagg

SEQ ID NO: 688479 - DNA, 22 bp, Artificial Sequence
  chemically synthesized
ttcaaggttatatagagtgaag

SEQ ID NO: 688480 - DNA, 22 bp, Artificial Sequence
  chemically synthesized
ttttcaaggttatatagagtga

SEQ ID NO: 688481 - DNA, 22 bp, Artificial Sequence
  chemically synthesized
cttttcaaggttatatagagtg

SEQ ID NO: 688482 - DNA, 22 bp, Artificial Sequence
  chemically synthesized
atattccttcactctatataac

SEQ ID NO: 688483 - DNA, 22 bp, Artificial Sequence
  chemically synthesized
tttcttttcaaggttatataga

SEQ ID NO: 688484 - DNA, 22 bp, Artificial Sequence
  chemically synthesized
gtttcttttcaaggttatatag

SEQ ID NO: 688485 - DNA, 22 bp, Artificial Sequence
  chemically synthesized
ccttgtttcttttcaaggttat

SEQ ID NO: 688486 - DNA, 22 bp, Artificial Sequence
  chemically synthesized
cttcactctatataaccttgaa

SEQ ID NO: 688487 - DNA, 22 bp, Artificial Sequence
  chemically synthesized
gccttgtttcttttcaaggtta

SEQ ID NO: 688488 - DNA, 22 bp, Artificial Sequence
  chemically synthesized
tgccttgtttcttttcaaggtt

SEQ ID NO: 688489 - DNA, 22 bp, Artificial Sequence
  chemically synthesized
ttgccttgtttcttttcaaggt

SEQ ID NO: 688490 - DNA, 22 bp, Artificial Sequence
  chemically synthesized
cactctatataaccttgaaaag

SEQ ID NO: 688491 - DNA, 22 bp, Artificial Sequence
  chemically synthesized
actctatataaccttgaaaaga

SEQ ID NO: 688492 - DNA, 22 bp, Artificial Sequence
  chemically synthesized
cttttgccttgtttcttttcaa

SEQ ID NO: 688493 - DNA, 22 bp, Artificial Sequence
  chemically synthesized
gcttttgccttgtttcttttca

SEQ ID NO: 688494 - DNA, 22 bp, Artificial Sequence
  chemically synthesized
tatataaccttgaaaagaaaca

SEQ ID NO: 688495 - DNA, 22 bp, Artificial Sequence
  chemically synthesized
tttgcttttgccttgtttcttt

SEQ ID NO: 688496 - DNA, 22 bp, Artificial Sequence
  chemically synthesized
tataaccttgaaaagaaacaag

SEQ ID NO: 688497 - DNA, 22 bp, Artificial Sequence
  chemically synthesized
gtttgcttttgccttgtttctt

SEQ ID NO: 688498 - DNA, 22 bp, Artificial Sequence
  chemically synthesized
tttgtttgcttttgccttgttt

SEQ ID NO: 688499 - DNA, 22 bp, Artificial Sequence
  chemically synthesized
gtttgtttgcttttgccttgtt

SEQ ID NO: 688500 - DNA, 22 bp, Artificial Sequence
  chemically synthesized
tttgtttgtttgcttttgcctt

SEQ ID NO: 688501 - DNA, 22 bp, Artificial Sequence
  chemically synthesized
gtttgtttgtttgcttttgcct

SEQ ID NO: 688502 - DNA, 22 bp, Artificial Sequence
  chemically synthesized
gaaaagaaacaaggcaaaagca

SEQ ID NO: 688503 - DNA, 22 bp, Artificial Sequence
  chemically synthesized
aaaagaaacaaggcaaaagcaa

SEQ ID NO: 688504 - DNA, 22 bp, Artificial Sequence
  chemically synthesized
tttgtttgtttgtttgcttttg

SEQ ID NO: 688505 - DNA, 22 bp, Artificial Sequence
  chemically synthesized
gtttgtttgtttgtttgctttt

SEQ ID NO: 688506 - DNA, 22 bp, Artificial Sequence
  chemically synthesized
tgtttgtttgtttgtttgcttt

SEQ ID NO: 688507 - DNA, 22 bp, Artificial Sequence
  chemically synthesized
ttgtttgtttgtttgtttgctt

SEQ ID NO: 688508 - DNA, 22 bp, Artificial Sequence
  chemically synthesized
tttgtttgtttgtttgtttgct

SEQ ID NO: 688509 - DNA, 22 bp, Artificial Sequence
  chemically synthesized
gattttttgtttgtttgtttgt

SEQ ID NO: 688510 - DNA, 22 bp, Artificial Sequence
  chemically synthesized
ctggattttttgtttgtttgtt

SEQ ID NO: 688511 - DNA, 22 bp, Artificial Sequence
  chemically synthesized
aagttactggattttttgtttg

SEQ ID NO: 688512 - DNA, 22 bp, Artificial Sequence
  chemically synthesized
caagttactggattttttgttt

SEQ ID NO: 688513 - DNA, 22 bp, Artificial Sequence
  chemically synthesized
atttcaagttactggatttttt

SEQ ID NO: 688514 - DNA, 22 bp, Artificial Sequence
  chemically synthesized
gtagtctcatttcaagttactg

SEQ ID NO: 688515 - DNA, 22 bp, Artificial Sequence
  chemically synthesized
aagcaaacctggtagtctcatt

SEQ ID NO: 688516 - DNA, 22 bp, Artificial Sequence
  chemically synthesized
cctaaagcaaacctggtagtct

SEQ ID NO: 688517 - DNA, 22 bp, Artificial Sequence
  chemically synthesized
gcctaaagcaaacctggtagtc

SEQ ID NO: 688518 - DNA, 22 bp, Artificial Sequence
  chemically synthesized
ccttgcctaaagcaaacctggt

SEQ ID NO: 688519 - DNA, 22 bp, Artificial Sequence
  chemically synthesized
gaaatgagactaccaggtttgc

SEQ ID NO: 688520 - DNA, 22 bp, Artificial Sequence
  chemically synthesized
aaatgagactaccaggtttgct

SEQ ID NO: 688521 - DNA, 22 bp, Artificial Sequence
  chemically synthesized
atagcctaccttgcctaaagca

SEQ ID NO: 688522 - DNA, 22 bp, Artificial Sequence
  chemically synthesized
gttcatagcctaccttgcctaa

SEQ ID NO: 688523 - DNA, 22 bp, Artificial Sequence
  chemically synthesized
ccaggtttgctttaggcaaggt

SEQ ID NO: 688524 - DNA, 22 bp, Artificial Sequence
  chemically synthesized
agttcatagcctaccttgccta

SEQ ID NO: 688525 - DNA, 22 bp, Artificial Sequence
  chemically synthesized
cttagttcatagcctaccttgc

SEQ ID NO: 688526 - DNA, 22 bp, Artificial Sequence
  chemically synthesized
gctttaggcaaggtaggctatg

SEQ ID NO: 688527 - DNA, 22 bp, Artificial Sequence
  chemically synthesized
ctttaggcaaggtaggctatga

SEQ ID NO: 688528 - DNA, 22 bp, Artificial Sequence
  chemically synthesized
aaattgcttagttcatagccta

SEQ ID NO: 688529 - DNA, 22 bp, Artificial Sequence
  chemically synthesized
aaaattgcttagttcatagcct

SEQ ID NO: 688530 - DNA, 22 bp, Artificial Sequence
  chemically synthesized
taaaattgcttagttcatagcc

SEQ ID NO: 688531 - DNA, 22 bp, Artificial Sequence
  chemically synthesized
taggcaaggtaggctatgaact

SEQ ID NO: 688532 - DNA, 22 bp, Artificial Sequence
  chemically synthesized
aggcaaggtaggctatgaacta

SEQ ID NO: 688533 - DNA, 22 bp, Artificial Sequence
  chemically synthesized
ggcaaggtaggctatgaactaa

SEQ ID NO: 688534 - DNA, 22 bp, Artificial Sequence
  chemically synthesized
caagctttaaaattgcttagtt

SEQ ID NO: 688535 - DNA, 22 bp, Artificial Sequence
  chemically synthesized
actccaagctttaaaattgctt

SEQ ID NO: 688536 - DNA, 22 bp, Artificial Sequence
  chemically synthesized
tcctcactccaagctttaaaat

SEQ ID NO: 688537 - DNA, 22 bp, Artificial Sequence
  chemically synthesized
tgaactaagcaattttaaagct

SEQ ID NO: 688538 - DNA, 22 bp, Artificial Sequence
  chemically synthesized
aattgtcctcactccaagcttt

SEQ ID NO: 688539 - DNA, 22 bp, Artificial Sequence
  chemically synthesized
aaattgtcctcactccaagctt

SEQ ID NO: 688540 - DNA, 22 bp, Artificial Sequence
  chemically synthesized
agcaattttaaagcttggagtg

SEQ ID NO: 688541 - DNA, 22 bp, Artificial Sequence
  chemically synthesized
acttaaattgtcctcactccaa

SEQ ID NO: 688542 - DNA, 22 bp, Artificial Sequence
  chemically synthesized
gacttaaattgtcctcactcca

SEQ ID NO: 688543 - DNA, 22 bp, Artificial Sequence
  chemically synthesized
atttgacttaaattgtcctcac

SEQ ID NO: 688544 - DNA, 22 bp, Artificial Sequence
  chemically synthesized
taaagcttggagtgaggacaat

SEQ ID NO: 688545 - DNA, 22 bp, Artificial Sequence
  chemically synthesized
aaagcttggagtgaggacaatt

SEQ ID NO: 688546 - DNA, 22 bp, Artificial Sequence
  chemically synthesized
aagcttggagtgaggacaattt

SEQ ID NO: 688547 - DNA, 22 bp, Artificial Sequence
  chemically synthesized
ggagtgaggacaatttaagtca

SEQ ID NO: 688548 - DNA, 22 bp, Artificial Sequence
  chemically synthesized
gagtgaggacaatttaagtcaa

SEQ ID NO: 688549 - DNA, 22 bp, Artificial Sequence
  chemically synthesized
caaaaaactgatttgacttaaa

SEQ ID NO: 688550 - DNA, 22 bp, Artificial Sequence
  chemically synthesized
tggacattccaaaaaactgatt

SEQ ID NO: 688551 - DNA, 22 bp, Artificial Sequence
  chemically synthesized
gtggacattccaaaaaactgat

SEQ ID NO: 688552 - DNA, 22 bp, Artificial Sequence
  chemically synthesized
aagtcaaatcagttttttggaa

SEQ ID NO: 688553 - DNA, 22 bp, Artificial Sequence
  chemically synthesized
agtcaaatcagttttttggaat

SEQ ID NO: 688554 - DNA, 22 bp, Artificial Sequence
  chemically synthesized
gtgtcttgtggacattccaaaa

SEQ ID NO: 688555 - DNA, 22 bp, Artificial Sequence
  chemically synthesized
agtgtcttgtggacattccaaa

SEQ ID NO: 688556 - DNA, 22 bp, Artificial Sequence
  chemically synthesized
atgatatacttagtgtcttgtg

SEQ ID NO: 688557 - DNA, 22 bp, Artificial Sequence
  chemically synthesized
tttggaatgtccacaagacact

SEQ ID NO: 688558 - DNA, 22 bp, Artificial Sequence
  chemically synthesized
catgatatacttagtgtcttgt

SEQ ID NO: 688559 - DNA, 22 bp, Artificial Sequence
  chemically synthesized
ttggaatgtccacaagacacta

SEQ ID NO: 688560 - DNA, 22 bp, Artificial Sequence
  chemically synthesized
tcatgatatacttagtgtcttg

SEQ ID NO: 688561 - DNA, 22 bp, Artificial Sequence
  chemically synthesized
tggaatgtccacaagacactaa

SEQ ID NO: 688562 - DNA, 22 bp, Artificial Sequence
  chemically synthesized
ggaatgtccacaagacactaag

SEQ ID NO: 688563 - DNA, 22 bp, Artificial Sequence
  chemically synthesized
gaatgtccacaagacactaagt

SEQ ID NO: 688564 - DNA, 22 bp, Artificial Sequence
  chemically synthesized
ttttcatgatatacttagtgtc

SEQ ID NO: 688565 - DNA, 22 bp, Artificial Sequence
  chemically synthesized
aatgttattttcatgatatact

SEQ ID NO: 688566 - DNA, 22 bp, Artificial Sequence
  chemically synthesized
aaatgttattttcatgatatac

SEQ ID NO: 688567 - DNA, 22 bp, Artificial Sequence
  chemically synthesized
cttaaatgttattttcatgata

SEQ ID NO: 688568 - DNA, 22 bp, Artificial Sequence
  chemically synthesized
ccttaaatgttattttcatgat

SEQ ID NO: 688569 - DNA, 22 bp, Artificial Sequence
  chemically synthesized
tccttaaatgttattttcatga

SEQ ID NO: 688570 - DNA, 22 bp, Artificial Sequence
  chemically synthesized
ttccttaaatgttattttcatg

SEQ ID NO: 688571 - DNA, 22 bp, Artificial Sequence
  chemically synthesized
tttttccttaaatgttattttc

SEQ ID NO: 688572 - DNA, 22 bp, Artificial Sequence
  chemically synthesized
atttttccttaaatgttatttt

SEQ ID NO: 688573 - DNA, 22 bp, Artificial Sequence
  chemically synthesized
agtatatcatgaaaataacatt

SEQ ID NO: 688574 - DNA, 22 bp, Artificial Sequence
  chemically synthesized
tgtacttatttttccttaaatg

SEQ ID NO: 688575 - DNA, 22 bp, Artificial Sequence
  chemically synthesized
gtgtacttatttttccttaaat

SEQ ID NO: 688576 - DNA, 22 bp, Artificial Sequence
  chemically synthesized
atgtttgtgtacttatttttcc

SEQ ID NO: 688577 - DNA, 22 bp, Artificial Sequence
  chemically synthesized
tcatgtttgtgtacttattttt

SEQ ID NO: 688578 - DNA, 22 bp, Artificial Sequence
  chemically synthesized
ctctcatgtttgtgtacttatt

SEQ ID NO: 688579 - DNA, 22 bp, Artificial Sequence
  chemically synthesized
actctcatgtttgtgtacttat

SEQ ID NO: 688580 - DNA, 22 bp, Artificial Sequence
  chemically synthesized
aaggaaaaataagtacacaaac

SEQ ID NO: 688581 - DNA, 22 bp, Artificial Sequence
  chemically synthesized
atttactctcatgtttgtgtac

SEQ ID NO: 688582 - DNA, 22 bp, Artificial Sequence
  chemically synthesized
aggaaaaataagtacacaaaca

SEQ ID NO: 688583 - DNA, 22 bp, Artificial Sequence
  chemically synthesized
catttactctcatgtttgtgta

SEQ ID NO: 688584 - DNA, 22 bp, Artificial Sequence
  chemically synthesized
tcatttactctcatgtttgtgt

SEQ ID NO: 688585 - DNA, 22 bp, Artificial Sequence
  chemically synthesized
gaatattttcatttactctcat

SEQ ID NO: 688586 - DNA, 22 bp, Artificial Sequence
  chemically synthesized
caaataactagaatattttcat

SEQ ID NO: 688587 - DNA, 22 bp, Artificial Sequence
  chemically synthesized
agacatccaagtctgcaaataa

SEQ ID NO: 688588 - DNA, 22 bp, Artificial Sequence
  chemically synthesized
aagacatccaagtctgcaaata

SEQ ID NO: 688589 - DNA, 22 bp, Artificial Sequence
  chemically synthesized
taagacatccaagtctgcaaat

SEQ ID NO: 688590 - DNA, 22 bp, Artificial Sequence
  chemically synthesized
gattttaagacatccaagtctg

SEQ ID NO: 688591 - DNA, 22 bp, Artificial Sequence
  chemically synthesized
agattttaagacatccaagtct

SEQ ID NO: 688592 - DNA, 22 bp, Artificial Sequence
  chemically synthesized
tagttatttgcagacttggatg

SEQ ID NO: 688593 - DNA, 22 bp, Artificial Sequence
  chemically synthesized
gttatttgcagacttggatgtc

SEQ ID NO: 688594 - DNA, 22 bp, Artificial Sequence
  chemically synthesized
tttgcagacttggatgtcttaa

SEQ ID NO: 688595 - DNA, 22 bp, Artificial Sequence
  chemically synthesized
aaaaagtttagattttaagaca

SEQ ID NO: 688596 - DNA, 22 bp, Artificial Sequence
  chemically synthesized
gcagacttggatgtcttaaaat

SEQ ID NO: 688597 - DNA, 22 bp, Artificial Sequence
  chemically synthesized
cagacttggatgtcttaaaatc

SEQ ID NO: 688598 - DNA, 22 bp, Artificial Sequence
  chemically synthesized
ccatattaaaaaagtttagatt

SEQ ID NO: 688599 - DNA, 22 bp, Artificial Sequence
  chemically synthesized
ggatgtcttaaaatctaaactt

SEQ ID NO: 688600 - DNA, 22 bp, Artificial Sequence
  chemically synthesized
accatattaaaaaagtttagat

SEQ ID NO: 688601 - DNA, 22 bp, Artificial Sequence
  chemically synthesized
gatgtcttaaaatctaaacttt

SEQ ID NO: 688602 - DNA, 22 bp, Artificial Sequence
  chemically synthesized
atttaccatattaaaaaagttt

SEQ ID NO: 688603 - DNA, 22 bp, Artificial Sequence
  chemically synthesized
aatttaccatattaaaaaagtt

SEQ ID NO: 688604 - DNA, 22 bp, Artificial Sequence
  chemically synthesized
aaaatctaaacttttttaatat

SEQ ID NO: 688605 - DNA, 22 bp, Artificial Sequence
  chemically synthesized
aaatctaaacttttttaatatg

SEQ ID NO: 688606 - DNA, 22 bp, Artificial Sequence
  chemically synthesized
tcatttaatttaccatattaaa

SEQ ID NO: 688607 - DNA, 22 bp, Artificial Sequence
  chemically synthesized
gtcatttaatttaccatattaa

SEQ ID NO: 688608 - DNA, 22 bp, Artificial Sequence
  chemically synthesized
aacttttttaatatggtaaatt

SEQ ID NO: 688609 - DNA, 22 bp, Artificial Sequence
  chemically synthesized
ttttaatatggtaaattaaatg

SEQ ID NO: 688610 - DNA, 22 bp, Artificial Sequence
  chemically synthesized
tttaatatggtaaattaaatga

SEQ ID NO: 688611 - DNA, 22 bp, Artificial Sequence
  chemically synthesized
aatatgaatttgtcatttaatt

SEQ ID NO: 688612 - DNA, 22 bp, Artificial Sequence
  chemically synthesized
ttaatatggtaaattaaatgac

SEQ ID NO: 688613 - DNA, 22 bp, Artificial Sequence
  chemically synthesized
aaatatgaatttgtcatttaat

SEQ ID NO: 688614 - DNA, 22 bp, Artificial Sequence
  chemically synthesized
taatatggtaaattaaatgaca

SEQ ID NO: 688615 - DNA, 22 bp, Artificial Sequence
  chemically synthesized
aatatggtaaattaaatgacaa

SEQ ID NO: 688616 - DNA, 22 bp, Artificial Sequence
  chemically synthesized
atatggtaaattaaatgacaaa

SEQ ID NO: 688617 - DNA, 22 bp, Artificial Sequence
  chemically synthesized
cacttaaatatgaatttgtcat

SEQ ID NO: 688618 - DNA, 22 bp, Artificial Sequence
  chemically synthesized
acacttaaatatgaatttgtca

SEQ ID NO: 688619 - DNA, 22 bp, Artificial Sequence
  chemically synthesized
atttacacttaaatatgaattt

SEQ ID NO: 688620 - DNA, 22 bp, Artificial Sequence
  chemically synthesized
aatttacacttaaatatgaatt

SEQ ID NO: 688621 - DNA, 22 bp, Artificial Sequence
  chemically synthesized
tttaatttacacttaaatatga

SEQ ID NO: 688622 - DNA, 22 bp, Artificial Sequence
  chemically synthesized
atttaatttacacttaaatatg

SEQ ID NO: 688623 - DNA, 22 bp, Artificial Sequence
  chemically synthesized
aatgacaaattcatatttaagt

SEQ ID NO: 688624 - DNA, 22 bp, Artificial Sequence
  chemically synthesized
acatttatttaatttacactta

SEQ ID NO: 688625 - DNA, 22 bp, Artificial Sequence
  chemically synthesized
tagttgacatttatttaattta

SEQ ID NO: 688626 - DNA, 22 bp, Artificial Sequence
  chemically synthesized
atatttaagtgtaaattaaata

SEQ ID NO: 688627 - DNA, 22 bp, Artificial Sequence
  chemically synthesized
atagttgacatttatttaattt

SEQ ID NO: 688628 - DNA, 22 bp, Artificial Sequence
  chemically synthesized
atttatagttgacatttattta

SEQ ID NO: 688629 - DNA, 22 bp, Artificial Sequence
  chemically synthesized
aagtgtaaattaaataaatgtc

SEQ ID NO: 688630 - DNA, 22 bp, Artificial Sequence
  chemically synthesized
agtgtaaattaaataaatgtca

SEQ ID NO: 688631 - DNA, 22 bp, Artificial Sequence
  chemically synthesized
aataaatgtcaactataaatga

SEQ ID NO: 688632 - DNA, 22 bp, Artificial Sequence
  chemically synthesized
aaataatataattcatttatag

SEQ ID NO: 688633 - DNA, 22 bp, Artificial Sequence
  chemically synthesized
caaataatataattcatttata

SEQ ID NO: 688634 - DNA, 22 bp, Artificial Sequence
  chemically synthesized
tcaaataatataattcatttat

SEQ ID NO: 688635 - DNA, 22 bp, Artificial Sequence
  chemically synthesized
cattttcaaataatataattca

SEQ ID NO: 688636 - DNA, 22 bp, Artificial Sequence
  chemically synthesized
taaatgaattatattatttgaa

SEQ ID NO: 688637 - DNA, 22 bp, Artificial Sequence
  chemically synthesized
tattatttgaaaatggaattat

SEQ ID NO: 688638 - DNA, 22 bp, Artificial Sequence
  chemically synthesized
tttgaaaatggaattatatctg

SEQ ID NO: 688639 - DNA, 22 bp, Artificial Sequence
  chemically synthesized
gaaaatggaattatatctgtgc

SEQ ID NO: 688640 - DNA, 22 bp, Artificial Sequence
  chemically synthesized
aaaatggaattatatctgtgct

SEQ ID NO: 688641 - DNA, 22 bp, Artificial Sequence
  chemically synthesized
atgaaaagcgtaatagcacaga

SEQ ID NO: 688642 - DNA, 22 bp, Artificial Sequence
  chemically synthesized
aactaatgaaaagcgtaatagc

SEQ ID NO: 688643 - DNA, 22 bp, Artificial Sequence
  chemically synthesized
caactaatgaaaagcgtaatag

SEQ ID NO: 688644 - DNA, 22 bp, Artificial Sequence
  chemically synthesized
tcaactaatgaaaagcgtaata

SEQ ID NO: 688645 - DNA, 22 bp, Artificial Sequence
  chemically synthesized
tatctgtgctattacgcttttc

SEQ ID NO: 688646 - DNA, 22 bp, Artificial Sequence
  chemically synthesized
tactttcaactaatgaaaagcg

SEQ ID NO: 688647 - DNA, 22 bp, Artificial Sequence
  chemically synthesized
gtactttcaactaatgaaaagc

SEQ ID NO: 688648 - DNA, 22 bp, Artificial Sequence
  chemically synthesized
tgctattacgcttttcattagt

SEQ ID NO: 688649 - DNA, 22 bp, Artificial Sequence
  chemically synthesized
caacttgtactttcaactaatg

SEQ ID NO: 688650 - DNA, 22 bp, Artificial Sequence
  chemically synthesized
gcaacttgtactttcaactaat

SEQ ID NO: 688651 - DNA, 22 bp, Artificial Sequence
  chemically synthesized
ttacgcttttcattagttgaaa

SEQ ID NO: 688652 - DNA, 22 bp, Artificial Sequence
  chemically synthesized
cgcttttcattagttgaaagta

SEQ ID NO: 688653 - DNA, 22 bp, Artificial Sequence
  chemically synthesized
gtttgcaacttgtactttcaac

SEQ ID NO: 688654 - DNA, 22 bp, Artificial Sequence
  chemically synthesized
ctagtttgcaacttgtactttc

SEQ ID NO: 688655 - DNA, 22 bp, Artificial Sequence
  chemically synthesized
ttcattagttgaaagtacaagt

SEQ ID NO: 688656 - DNA, 22 bp, Artificial Sequence
  chemically synthesized
tcattagttgaaagtacaagtt

SEQ ID NO: 688657 - DNA, 22 bp, Artificial Sequence
  chemically synthesized
cattagttgaaagtacaagttg

SEQ ID NO: 688658 - DNA, 22 bp, Artificial Sequence
  chemically synthesized
attagttgaaagtacaagttgc

SEQ ID NO: 688659 - DNA, 22 bp, Artificial Sequence
  chemically synthesized
gttgaaagtacaagttgcaaac

SEQ ID NO: 688660 - DNA, 22 bp, Artificial Sequence
  chemically synthesized
gcccaaagtctgctagtttgca

SEQ ID NO: 688661 - DNA, 22 bp, Artificial Sequence
  chemically synthesized
aaagtacaagttgcaaactagc

SEQ ID NO: 688662 - DNA, 22 bp, Artificial Sequence
  chemically synthesized
agcccaaagtctgctagtttgc

SEQ ID NO: 688663 - DNA, 22 bp, Artificial Sequence
  chemically synthesized
caaactagcagactttgggcta

SEQ ID NO: 688664 - DNA, 22 bp, Artificial Sequence
  chemically synthesized
tgcatgccaaatttagcccaaa

SEQ ID NO: 688665 - DNA, 22 bp, Artificial Sequence
  chemically synthesized
gtgcatgccaaatttagcccaa

SEQ ID NO: 688666 - DNA, 22 bp, Artificial Sequence
  chemically synthesized
gcagactttgggctaaatttgg

SEQ ID NO: 688667 - DNA, 22 bp, Artificial Sequence
  chemically synthesized
atcaaaacatttgtgcatgcca

SEQ ID NO: 688668 - DNA, 22 bp, Artificial Sequence
  chemically synthesized
tgggctaaatttggcatgcaca

SEQ ID NO: 688669 - DNA, 22 bp, Artificial Sequence
  chemically synthesized
gggctaaatttggcatgcacaa

SEQ ID NO: 688670 - DNA, 22 bp, Artificial Sequence
  chemically synthesized
ggctaaatttggcatgcacaaa

SEQ ID NO: 688671 - DNA, 22 bp, Artificial Sequence
  chemically synthesized
aatttggcatgcacaaatgttt

SEQ ID NO: 688672 - DNA, 22 bp, Artificial Sequence
  chemically synthesized
tgtgggctaatcaaaacatttg

SEQ ID NO: 688673 - DNA, 22 bp, Artificial Sequence
  chemically synthesized
ggcatgcacaaatgttttgatt

SEQ ID NO: 688674 - DNA, 22 bp, Artificial Sequence
  chemically synthesized
gcatgcacaaatgttttgatta

SEQ ID NO: 688675 - DNA, 22 bp, Artificial Sequence
  chemically synthesized
aaaaaaaaaaaactgtgtgggc

SEQ ID NO: 688676 - DNA, 22 bp, Artificial Sequence
  chemically synthesized
tgattagcccacacagtttttt

SEQ ID NO: 688677 - DNA, 22 bp, Artificial Sequence
  chemically synthesized
agattaaaaaaaaaaaaactgt

SEQ ID NO: 688678 - DNA, 22 bp, Artificial Sequence
  chemically synthesized
gattagcccacacagttttttt

SEQ ID NO: 688679 - DNA, 22 bp, Artificial Sequence
  chemically synthesized
attagcccacacagtttttttt

SEQ ID NO: 688680 - DNA, 22 bp, Artificial Sequence
  chemically synthesized
gcccacacagtttttttttttt

SEQ ID NO: 688681 - DNA, 22 bp, Artificial Sequence
  chemically synthesized
agtaattcagattaaaaaaaaa

SEQ ID NO: 688682 - DNA, 22 bp, Artificial Sequence
  chemically synthesized
aatgttgagtaattcagattaa

SEQ ID NO: 688683 - DNA, 22 bp, Artificial Sequence
  chemically synthesized
aaatgttgagtaattcagatta

SEQ ID NO: 688684 - DNA, 22 bp, Artificial Sequence
  chemically synthesized
ttttttttttaatctgaattac

SEQ ID NO: 688685 - DNA, 22 bp, Artificial Sequence
  chemically synthesized
tttttttttaatctgaattact

SEQ ID NO: 688686 - DNA, 22 bp, Artificial Sequence
  chemically synthesized
ttttttttaatctgaattactc

SEQ ID NO: 688687 - DNA, 22 bp, Artificial Sequence
  chemically synthesized
tttttttaatctgaattactca

SEQ ID NO: 688688 - DNA, 22 bp, Artificial Sequence
  chemically synthesized
ttttttaatctgaattactcaa

SEQ ID NO: 688689 - DNA, 22 bp, Artificial Sequence
  chemically synthesized
aatatttaaatgttgagtaatt

SEQ ID NO: 688690 - DNA, 22 bp, Artificial Sequence
  chemically synthesized
tttttaatctgaattactcaac

SEQ ID NO: 688691 - DNA, 22 bp, Artificial Sequence
  chemically synthesized
ttttaatctgaattactcaaca

SEQ ID NO: 688692 - DNA, 22 bp, Artificial Sequence
  chemically synthesized
tgaatatttaaatgttgagtaa

SEQ ID NO: 688693 - DNA, 22 bp, Artificial Sequence
  chemically synthesized
tttaatctgaattactcaacat

SEQ ID NO: 688694 - DNA, 22 bp, Artificial Sequence
  chemically synthesized
ttaatctgaattactcaacatt

SEQ ID NO: 688695 - DNA, 22 bp, Artificial Sequence
  chemically synthesized
taatctgaattactcaacattt

SEQ ID NO: 688696 - DNA, 22 bp, Artificial Sequence
  chemically synthesized
aatctgaattactcaacattta

SEQ ID NO: 688697 - DNA, 22 bp, Artificial Sequence
  chemically synthesized
atctgaattactcaacatttaa

SEQ ID NO: 688698 - DNA, 22 bp, Artificial Sequence
  chemically synthesized
aattactcaacatttaaatatt

SEQ ID NO: 688699 - DNA, 22 bp, Artificial Sequence
  chemically synthesized
taaaatatctctgaatatttaa

SEQ ID NO: 688700 - DNA, 22 bp, Artificial Sequence
  chemically synthesized
tgtaaaatatctctgaatattt

SEQ ID NO: 688701 - DNA, 22 bp, Artificial Sequence
  chemically synthesized
ctcaacatttaaatattcagag

SEQ ID NO: 688702 - DNA, 22 bp, Artificial Sequence
  chemically synthesized
ttctgtaaaatatctctgaata

SEQ ID NO: 688703 - DNA, 22 bp, Artificial Sequence
  chemically synthesized
aacatttaaatattcagagata

SEQ ID NO: 688704 - DNA, 22 bp, Artificial Sequence
  chemically synthesized
gattattctgtaaaatatctct

SEQ ID NO: 688705 - DNA, 22 bp, Artificial Sequence
  chemically synthesized
aaatattcagagatattttaca

SEQ ID NO: 688706 - DNA, 22 bp, Artificial Sequence
  chemically synthesized
aatattcagagatattttacag

SEQ ID NO: 688707 - DNA, 22 bp, Artificial Sequence
  chemically synthesized
agagatattttacagaataatc

SEQ ID NO: 688708 - DNA, 22 bp, Artificial Sequence
  chemically synthesized
aatgagaagtcagaaggttgga

SEQ ID NO: 688709 - DNA, 22 bp, Artificial Sequence
  chemically synthesized
aaatgagaagtcagaaggttgg

SEQ ID NO: 688710 - DNA, 22 bp, Artificial Sequence
  chemically synthesized
tacagaataatccaaccttctg

SEQ ID NO: 688711 - DNA, 22 bp, Artificial Sequence
  chemically synthesized
taaatgagaagtcagaaggttg

SEQ ID NO: 688712 - DNA, 22 bp, Artificial Sequence
  chemically synthesized
acagaataatccaaccttctga

SEQ ID NO: 688713 - DNA, 22 bp, Artificial Sequence
  chemically synthesized
ttaaatgagaagtcagaaggtt

SEQ ID NO: 688714 - DNA, 22 bp, Artificial Sequence
  chemically synthesized
cagaataatccaaccttctgac

SEQ ID NO: 688715 - DNA, 22 bp, Artificial Sequence
  chemically synthesized
cttttaaatgagaagtcagaag

SEQ ID NO: 688716 - DNA, 22 bp, Artificial Sequence
  chemically synthesized
ctgacttctcatttaaaaggaa

SEQ ID NO: 688717 - DNA, 22 bp, Artificial Sequence
  chemically synthesized
tgacttctcatttaaaaggaat

SEQ ID NO: 688718 - DNA, 22 bp, Artificial Sequence
  chemically synthesized
acttctcatttaaaaggaatga

SEQ ID NO: 688719 - DNA, 22 bp, Artificial Sequence
  chemically synthesized
ctcatttaaaaggaatgatttg

SEQ ID NO: 688720 - DNA, 22 bp, Artificial Sequence
  chemically synthesized
tcatttaaaaggaatgatttgt

SEQ ID NO: 688721 - DNA, 22 bp, Artificial Sequence
  chemically synthesized
atttaaaaggaatgatttgtcc

SEQ ID NO: 688722 - DNA, 22 bp, Artificial Sequence
  chemically synthesized
aaaaggaatgatttgtccatgc

SEQ ID NO: 688723 - DNA, 22 bp, Artificial Sequence
  chemically synthesized
aaaggaatgatttgtccatgct

SEQ ID NO: 688724 - DNA, 22 bp, Artificial Sequence
  chemically synthesized
tcatgcaagaataggagcccag

SEQ ID NO: 688725 - DNA, 22 bp, Artificial Sequence
  chemically synthesized
ttgtcatgcaagaataggagcc

SEQ ID NO: 688726 - DNA, 22 bp, Artificial Sequence
  chemically synthesized
gtccatgctgggctcctattct

SEQ ID NO: 688727 - DNA, 22 bp, Artificial Sequence
  chemically synthesized
tccatgctgggctcctattctt

SEQ ID NO: 688728 - DNA, 22 bp, Artificial Sequence
  chemically synthesized
cggaaagttattgtcatgcaag

SEQ ID NO: 688729 - DNA, 22 bp, Artificial Sequence
  chemically synthesized
ggctcctattcttgcatgacaa

SEQ ID NO: 688730 - DNA, 22 bp, Artificial Sequence
  chemically synthesized
ctattcttgcatgacaataact

SEQ ID NO: 688731 - DNA, 22 bp, Artificial Sequence
  chemically synthesized
ttcttgcatgacaataactttc

SEQ ID NO: 688732 - DNA, 22 bp, Artificial Sequence
  chemically synthesized
ttgcatgacaataactttccgg

SEQ ID NO: 688733 - DNA, 22 bp, Artificial Sequence
  chemically synthesized
tagaatggtggctccggaaagt

SEQ ID NO: 688734 - DNA, 22 bp, Artificial Sequence
  chemically synthesized
gcatgacaataactttccggag

SEQ ID NO: 688735 - DNA, 22 bp, Artificial Sequence
  chemically synthesized
catgacaataactttccggagc

SEQ ID NO: 688736 - DNA, 22 bp, Artificial Sequence
  chemically synthesized
tccggagccaccattctataac

SEQ ID NO: 688737 - DNA, 22 bp, Artificial Sequence
  chemically synthesized
ccggagccaccattctataacg

SEQ ID NO: 688738 - DNA, 22 bp, Artificial Sequence
  chemically synthesized
cggagccaccattctataacgg

SEQ ID NO: 688739 - DNA, 22 bp, Artificial Sequence
  chemically synthesized
tagaatacatgtgccgttatag

SEQ ID NO: 688740 - DNA, 22 bp, Artificial Sequence
  chemically synthesized
gtagggactatagaatacatgt

SEQ ID NO: 688741 - DNA, 22 bp, Artificial Sequence
  chemically synthesized
tataacggcacatgtattctat

SEQ ID NO: 688742 - DNA, 22 bp, Artificial Sequence
  chemically synthesized
taacggcacatgtattctatag

SEQ ID NO: 688743 - DNA, 22 bp, Artificial Sequence
  chemically synthesized
atgggagctggtagggactata

SEQ ID NO: 688744 - DNA, 22 bp, Artificial Sequence
  chemically synthesized
tatagtccctaccagctcccat

SEQ ID NO: 688745 - DNA, 22 bp, Artificial Sequence
  chemically synthesized
tagtccctaccagctcccatta

SEQ ID NO: 688746 - DNA, 22 bp, Artificial Sequence
  chemically synthesized
gcgaagcgtaagttaatgggag

SEQ ID NO: 688747 - DNA, 22 bp, Artificial Sequence
  chemically synthesized
ccagctcccattaacttacgct

SEQ ID NO: 688748 - DNA, 22 bp, Artificial Sequence
  chemically synthesized
ggcaaggctagcgaagcgtaag

SEQ ID NO: 688749 - DNA, 22 bp, Artificial Sequence
  chemically synthesized
ccattaacttacgcttcgctag

SEQ ID NO: 688750 - DNA, 22 bp, Artificial Sequence
  chemically synthesized
taactgggcaaggctagcgaag

SEQ ID NO: 688751 - DNA, 22 bp, Artificial Sequence
  chemically synthesized
ctgtaactgggcaaggctagcg

SEQ ID NO: 688752 - DNA, 22 bp, Artificial Sequence
  chemically synthesized
acttacgcttcgctagccttgc

SEQ ID NO: 688753 - DNA, 22 bp, Artificial Sequence
  chemically synthesized
ctactgtaactgggcaaggcta

SEQ ID NO: 688754 - DNA, 22 bp, Artificial Sequence
  chemically synthesized
acgcttcgctagccttgcccag

SEQ ID NO: 688755 - DNA, 22 bp, Artificial Sequence
  chemically synthesized
cgcttcgctagccttgcccagt

SEQ ID NO: 688756 - DNA, 22 bp, Artificial Sequence
  chemically synthesized
gcctgctactgtaactgggcaa

SEQ ID NO: 688757 - DNA, 22 bp, Artificial Sequence
  chemically synthesized
cgctagccttgcccagttacag

SEQ ID NO: 688758 - DNA, 22 bp, Artificial Sequence
  chemically synthesized
gctagccttgcccagttacagt

SEQ ID NO: 688759 - DNA, 22 bp, Artificial Sequence
  chemically synthesized
gccttgcccagttacagtagca

SEQ ID NO: 688760 - DNA, 22 bp, Artificial Sequence
  chemically synthesized
gcccagttacagtagcaggcta

SEQ ID NO: 688761 - DNA, 22 bp, Artificial Sequence
  chemically synthesized
cccagttacagtagcaggctag

SEQ ID NO: 688762 - DNA, 22 bp, Artificial Sequence
  chemically synthesized
aaatgccaacagaggggctagc

SEQ ID NO: 688763 - DNA, 22 bp, Artificial Sequence
  chemically synthesized
cagtagcaggctagcccctctg

SEQ ID NO: 688764 - DNA, 22 bp, Artificial Sequence
  chemically synthesized
caaactgaaatgccaacagagg

SEQ ID NO: 688765 - DNA, 22 bp, Artificial Sequence
  chemically synthesized
gcccctctgttggcatttcagt

SEQ ID NO: 688766 - DNA, 22 bp, Artificial Sequence
  chemically synthesized
aaccagaggttgcaaactgaaa

SEQ ID NO: 688767 - DNA, 22 bp, Artificial Sequence
  chemically synthesized
tgttggcatttcagtttgcaac

SEQ ID NO: 688768 - DNA, 22 bp, Artificial Sequence
  chemically synthesized
gtctaaaccagaggttgcaaac

SEQ ID NO: 688769 - DNA, 22 bp, Artificial Sequence
  chemically synthesized
ttggcatttcagtttgcaacct

SEQ ID NO: 688770 - DNA, 22 bp, Artificial Sequence
  chemically synthesized
ctggtctaaaccagaggttgca

SEQ ID NO: 688771 - DNA, 22 bp, Artificial Sequence
  chemically synthesized
gcatttcagtttgcaacctctg

SEQ ID NO: 688772 - DNA, 22 bp, Artificial Sequence
  chemically synthesized
gctggtctaaaccagaggttgc

SEQ ID NO: 688773 - DNA, 22 bp, Artificial Sequence
  chemically synthesized
tgctggtctaaaccagaggttg

SEQ ID NO: 688774 - DNA, 22 bp, Artificial Sequence
  chemically synthesized
cagtttgcaacctctggtttag

SEQ ID NO: 688775 - DNA, 22 bp, Artificial Sequence
  chemically synthesized
agtttgcaacctctggtttaga

SEQ ID NO: 688776 - DNA, 22 bp, Artificial Sequence
  chemically synthesized
gcaacctctggtttagaccagc

SEQ ID NO: 688777 - DNA, 22 bp, Artificial Sequence
  chemically synthesized
tggtcagcctttgctggtctaa

SEQ ID NO: 688778 - DNA, 22 bp, Artificial Sequence
  chemically synthesized
caacctctggtttagaccagca

SEQ ID NO: 688779 - DNA, 22 bp, Artificial Sequence
  chemically synthesized
ctatggtcagcctttgctggtc

SEQ ID NO: 688780 - DNA, 22 bp, Artificial Sequence
  chemically synthesized
tggtttagaccagcaaaggctg

SEQ ID NO: 688781 - DNA, 22 bp, Artificial Sequence
  chemically synthesized
agattgctatggtcagcctttg

SEQ ID NO: 688782 - DNA, 22 bp, Artificial Sequence
  chemically synthesized
gtttagaccagcaaaggctgac

SEQ ID NO: 688783 - DNA, 22 bp, Artificial Sequence
  chemically synthesized
taagattgctatggtcagcctt

SEQ ID NO: 688784 - DNA, 22 bp, Artificial Sequence
  chemically synthesized
agaccagcaaaggctgaccata

SEQ ID NO: 688785 - DNA, 22 bp, Artificial Sequence
  chemically synthesized
gaccagcaaaggctgaccatag

SEQ ID NO: 688786 - DNA, 22 bp, Artificial Sequence
  chemically synthesized
agatactctaagattgctatgg

SEQ ID NO: 688787 - DNA, 22 bp, Artificial Sequence
  chemically synthesized
aagcacactaagatactctaag

SEQ ID NO: 688788 - DNA, 22 bp, Artificial Sequence
  chemically synthesized
accatagcaatcttagagtatc

SEQ ID NO: 688789 - DNA, 22 bp, Artificial Sequence
  chemically synthesized
aaagcacactaagatactctaa

SEQ ID NO: 688790 - DNA, 22 bp, Artificial Sequence
  chemically synthesized
acttaaagcacactaagatact

SEQ ID NO: 688791 - DNA, 22 bp, Artificial Sequence
  chemically synthesized
agagtatcttagtgtgctttaa

SEQ ID NO: 688792 - DNA, 22 bp, Artificial Sequence
  chemically synthesized
gagtatcttagtgtgctttaag

SEQ ID NO: 688793 - DNA, 22 bp, Artificial Sequence
  chemically synthesized
tcagtgtcagttgacttaaagc

SEQ ID NO: 688794 - DNA, 22 bp, Artificial Sequence
  chemically synthesized
gtcagtgtcagttgacttaaag

SEQ ID NO: 688795 - DNA, 22 bp, Artificial Sequence
  chemically synthesized
tgtcagtgtcagttgacttaaa

SEQ ID NO: 688796 - DNA, 22 bp, Artificial Sequence
  chemically synthesized
ttgtcagtgtcagttgacttaa

SEQ ID NO: 688797 - DNA, 22 bp, Artificial Sequence
  chemically synthesized
ttttgtcagtgtcagttgactt

SEQ ID NO: 688798 - DNA, 22 bp, Artificial Sequence
  chemically synthesized
cttttgtcagtgtcagttgact

SEQ ID NO: 688799 - DNA, 22 bp, Artificial Sequence
  chemically synthesized
agtgtgctttaagtcaactgac

SEQ ID NO: 688800 - DNA, 22 bp, Artificial Sequence
  chemically synthesized
gtgtgctttaagtcaactgaca

SEQ ID NO: 688801 - DNA, 22 bp, Artificial Sequence
  chemically synthesized
ttcttttgtcagtgtcagttga

SEQ ID NO: 688802 - DNA, 22 bp, Artificial Sequence
  chemically synthesized
cttcttttgtcagtgtcagttg

SEQ ID NO: 688803 - DNA, 22 bp, Artificial Sequence
  chemically synthesized
tttcttcttttgtcagtgtcag

SEQ ID NO: 688804 - DNA, 22 bp, Artificial Sequence
  chemically synthesized
tatttcttcttttgtcagtgtc

SEQ ID NO: 688805 - DNA, 22 bp, Artificial Sequence
  chemically synthesized
ctatttcttcttttgtcagtgt

SEQ ID NO: 688806 - DNA, 22 bp, Artificial Sequence
  chemically synthesized
taagtcaactgacactgacaaa

SEQ ID NO: 688807 - DNA, 22 bp, Artificial Sequence
  chemically synthesized
tctatttcttcttttgtcagtg

SEQ ID NO: 688808 - DNA, 22 bp, Artificial Sequence
  chemically synthesized
aagtcaactgacactgacaaaa

SEQ ID NO: 688809 - DNA, 22 bp, Artificial Sequence
  chemically synthesized
agtcaactgacactgacaaaag

SEQ ID NO: 688810 - DNA, 22 bp, Artificial Sequence
  chemically synthesized
caattttctatttcttcttttg

SEQ ID NO: 688811 - DNA, 22 bp, Artificial Sequence
  chemically synthesized
ttccaattttctatttcttctt

SEQ ID NO: 688812 - DNA, 22 bp, Artificial Sequence
  chemically synthesized
acactgacaaaagaagaaatag

SEQ ID NO: 688813 - DNA, 22 bp, Artificial Sequence
  chemically synthesized
acaaaagaagaaatagaaaatt

SEQ ID NO: 688814 - DNA, 22 bp, Artificial Sequence
  chemically synthesized
aatagtacagggctattccaat

SEQ ID NO: 688815 - DNA, 22 bp, Artificial Sequence
  chemically synthesized
aaatagtacagggctattccaa

SEQ ID NO: 688816 - DNA, 22 bp, Artificial Sequence
  chemically synthesized
ttaaatagtacagggctattcc

SEQ ID NO: 688817 - DNA, 22 bp, Artificial Sequence
  chemically synthesized
cttaaatagtacagggctattc

SEQ ID NO: 688818 - DNA, 22 bp, Artificial Sequence
  chemically synthesized
tttcttaaatagtacagggcta

SEQ ID NO: 688819 - DNA, 22 bp, Artificial Sequence
  chemically synthesized
atttcttaaatagtacagggct

SEQ ID NO: 688820 - DNA, 22 bp, Artificial Sequence
  chemically synthesized
gaatagccctgtactatttaag

SEQ ID NO: 688821 - DNA, 22 bp, Artificial Sequence
  chemically synthesized
cagtgtttatttcttaaatagt

SEQ ID NO: 688822 - DNA, 22 bp, Artificial Sequence
  chemically synthesized
taattacagtgtttatttctta

SEQ ID NO: 688823 - DNA, 22 bp, Artificial Sequence
  chemically synthesized
ataattacagtgtttatttctt

SEQ ID NO: 688824 - DNA, 22 bp, Artificial Sequence
  chemically synthesized
tactatttaagaaataaacact

SEQ ID NO: 688825 - DNA, 22 bp, Artificial Sequence
  chemically synthesized
tttaagaaataaacactgtaat

SEQ ID NO: 688826 - DNA, 22 bp, Artificial Sequence
  chemically synthesized
aagaaataaacactgtaattat

SEQ ID NO: 688827 - DNA, 22 bp, Artificial Sequence
  chemically synthesized
gtgggaaaatttataattacag

SEQ ID NO: 688828 - DNA, 22 bp, Artificial Sequence
  chemically synthesized
agaaataaacactgtaattata

SEQ ID NO: 688829 - DNA, 22 bp, Artificial Sequence
  chemically synthesized
ctagtgggaaaatttataatta

SEQ ID NO: 688830 - DNA, 22 bp, Artificial Sequence
  chemically synthesized
cctagtgggaaaatttataatt

SEQ ID NO: 688831 - DNA, 22 bp, Artificial Sequence
  chemically synthesized
tcctagtgggaaaatttataat

SEQ ID NO: 688832 - DNA, 22 bp, Artificial Sequence
  chemically synthesized
gaattttcctagtgggaaaatt

SEQ ID NO: 688833 - DNA, 22 bp, Artificial Sequence
  chemically synthesized
ggaattttcctagtgggaaaat

SEQ ID NO: 688834 - DNA, 22 bp, Artificial Sequence
  chemically synthesized
taattataaattttcccactag

SEQ ID NO: 688835 - DNA, 22 bp, Artificial Sequence
  chemically synthesized
gccttggaattttcctagtggg

SEQ ID NO: 688836 - DNA, 22 bp, Artificial Sequence
  chemically synthesized
ggccttggaattttcctagtgg

SEQ ID NO: 688837 - DNA, 22 bp, Artificial Sequence
  chemically synthesized
taaattttcccactaggaaaat

SEQ ID NO: 688838 - DNA, 22 bp, Artificial Sequence
  chemically synthesized
tcccactaggaaaattccaagg

SEQ ID NO: 688839 - DNA, 22 bp, Artificial Sequence
  chemically synthesized
cccactaggaaaattccaaggc

SEQ ID NO: 688840 - DNA, 22 bp, Artificial Sequence
  chemically synthesized
ccactaggaaaattccaaggcc

SEQ ID NO: 688841 - DNA, 22 bp, Artificial Sequence
  chemically synthesized
ccagtgatatgatttggccttg

SEQ ID NO: 688842 - DNA, 22 bp, Artificial Sequence
  chemically synthesized
tgccagtgatatgatttggcct

SEQ ID NO: 688843 - DNA, 22 bp, Artificial Sequence
  chemically synthesized
ggaaaattccaaggccaaatca

SEQ ID NO: 688844 - DNA, 22 bp, Artificial Sequence
  chemically synthesized
ctgccagtgatatgatttggcc

SEQ ID NO: 688845 - DNA, 22 bp, Artificial Sequence
  chemically synthesized
gtatttctgccagtgatatgat

SEQ ID NO: 688846 - DNA, 22 bp, Artificial Sequence
  chemically synthesized
caaggccaaatcatatcactgg

SEQ ID NO: 688847 - DNA, 22 bp, Artificial Sequence
  chemically synthesized
agattggtatttctgccagtga

SEQ ID NO: 688848 - DNA, 22 bp, Artificial Sequence
  chemically synthesized
aagattggtatttctgccagtg

SEQ ID NO: 688849 - DNA, 22 bp, Artificial Sequence
  chemically synthesized
taagattggtatttctgccagt

SEQ ID NO: 688850 - DNA, 22 bp, Artificial Sequence
  chemically synthesized
tttaagattggtatttctgcca

SEQ ID NO: 688851 - DNA, 22 bp, Artificial Sequence
  chemically synthesized
ctttaagattggtatttctgcc

SEQ ID NO: 688852 - DNA, 22 bp, Artificial Sequence
  chemically synthesized
gaagagtttctttaagattggt

SEQ ID NO: 688853 - DNA, 22 bp, Artificial Sequence
  chemically synthesized
tggaagagtttctttaagattg

SEQ ID NO: 688854 - DNA, 22 bp, Artificial Sequence
  chemically synthesized
gcagaaataccaatcttaaaga

SEQ ID NO: 688855 - DNA, 22 bp, Artificial Sequence
  chemically synthesized
gtctctggaagagtttctttaa

SEQ ID NO: 688856 - DNA, 22 bp, Artificial Sequence
  chemically synthesized
tagtctctggaagagtttcttt

SEQ ID NO: 688857 - DNA, 22 bp, Artificial Sequence
  chemically synthesized
ctagtctctggaagagtttctt

SEQ ID NO: 688858 - DNA, 22 bp, Artificial Sequence
  chemically synthesized
ttctagtctctggaagagtttc

SEQ ID NO: 688859 - DNA, 22 bp, Artificial Sequence
  chemically synthesized
cctcttctagtctctggaagag

SEQ ID NO: 688860 - DNA, 22 bp, Artificial Sequence
  chemically synthesized
aaagaaactcttccagagacta

SEQ ID NO: 688861 - DNA, 22 bp, Artificial Sequence
  chemically synthesized
aagaaactcttccagagactag

SEQ ID NO: 688862 - DNA, 22 bp, Artificial Sequence
  chemically synthesized
ttccagagactagaagaggcaa

SEQ ID NO: 688863 - DNA, 22 bp, Artificial Sequence
  chemically synthesized
ccagagactagaagaggcaatg

SEQ ID NO: 688864 - DNA, 22 bp, Artificial Sequence
  chemically synthesized
cagagactagaagaggcaatgc

SEQ ID NO: 688865 - DNA, 22 bp, Artificial Sequence
  chemically synthesized
ataaaggcaagtagggaagcat

SEQ ID NO: 688866 - DNA, 22 bp, Artificial Sequence
  chemically synthesized
cataaaggcaagtagggaagca

SEQ ID NO: 688867 - DNA, 22 bp, Artificial Sequence
  chemically synthesized
gaagaggcaatgcttccctact

SEQ ID NO: 688868 - DNA, 22 bp, Artificial Sequence
  chemically synthesized
gtttcataaaggcaagtaggga

SEQ ID NO: 688869 - DNA, 22 bp, Artificial Sequence
  chemically synthesized
tggtttcataaaggcaagtagg

SEQ ID NO: 688870 - DNA, 22 bp, Artificial Sequence
  chemically synthesized
ttctggtttcataaaggcaagt

SEQ ID NO: 688871 - DNA, 22 bp, Artificial Sequence
  chemically synthesized
ccctacttgcctttatgaaacc

SEQ ID NO: 688872 - DNA, 22 bp, Artificial Sequence
  chemically synthesized
cctacttgcctttatgaaacca

SEQ ID NO: 688873 - DNA, 22 bp, Artificial Sequence
  chemically synthesized
gtatgtggattattctggtttc

SEQ ID NO: 688874 - DNA, 22 bp, Artificial Sequence
  chemically synthesized
cttgcctttatgaaaccagaat

SEQ ID NO: 688875 - DNA, 22 bp, Artificial Sequence
  chemically synthesized
ggtatgtggattattctggttt

SEQ ID NO: 688876 - DNA, 22 bp, Artificial Sequence
  chemically synthesized
gcctttatgaaaccagaataat

SEQ ID NO: 688877 - DNA, 22 bp, Artificial Sequence
  chemically synthesized
cctttatgaaaccagaataatc

SEQ ID NO: 688878 - DNA, 22 bp, Artificial Sequence
  chemically synthesized
tatgaaaccagaataatccaca

SEQ ID NO: 688879 - DNA, 22 bp, Artificial Sequence
  chemically synthesized
atgaaaccagaataatccacat

SEQ ID NO: 688880 - DNA, 22 bp, Artificial Sequence
  chemically synthesized
tcaaggtttggtatgtggatta

SEQ ID NO: 688881 - DNA, 22 bp, Artificial Sequence
  chemically synthesized
tgaaaccagaataatccacata

SEQ ID NO: 688882 - DNA, 22 bp, Artificial Sequence
  chemically synthesized
gtcaaggtttggtatgtggatt

SEQ ID NO: 688883 - DNA, 22 bp, Artificial Sequence
  chemically synthesized
ttgtcaaggtttggtatgtgga

SEQ ID NO: 688884 - DNA, 22 bp, Artificial Sequence
  chemically synthesized
ccattcttgtcaaggtttggta

SEQ ID NO: 688885 - DNA, 22 bp, Artificial Sequence
  chemically synthesized
gtctgccattcttgtcaaggtt

SEQ ID NO: 688886 - DNA, 22 bp, Artificial Sequence
  chemically synthesized
tattggtctgccattcttgtca

SEQ ID NO: 688887 - DNA, 22 bp, Artificial Sequence
  chemically synthesized
gttatattggtctgccattctt

SEQ ID NO: 688888 - DNA, 22 bp, Artificial Sequence
  chemically synthesized
ttagttatattggtctgccatt

SEQ ID NO: 688889 - DNA, 22 bp, Artificial Sequence
  chemically synthesized
attagttatattggtctgccat

SEQ ID NO: 688890 - DNA, 22 bp, Artificial Sequence
  chemically synthesized
gacaagaatggcagaccaatat

SEQ ID NO: 688891 - DNA, 22 bp, Artificial Sequence
  chemically synthesized
tgtttattagttatattggtct

SEQ ID NO: 688892 - DNA, 22 bp, Artificial Sequence
  chemically synthesized
acaagaatggcagaccaatata

SEQ ID NO: 688893 - DNA, 22 bp, Artificial Sequence
  chemically synthesized
catctgtgtttattagttatat

SEQ ID NO: 688894 - DNA, 22 bp, Artificial Sequence
  chemically synthesized
ttgcatctgtgtttattagtta

SEQ ID NO: 688895 - DNA, 22 bp, Artificial Sequence
  chemically synthesized
gagttattgcatctgtgtttat

SEQ ID NO: 688896 - DNA, 22 bp, Artificial Sequence
  chemically synthesized
agagttattgcatctgtgttta

SEQ ID NO: 688897 - DNA, 22 bp, Artificial Sequence
  chemically synthesized
tagagttattgcatctgtgttt

SEQ ID NO: 688898 - DNA, 22 bp, Artificial Sequence
  chemically synthesized
ctttagagttattgcatctgtg

SEQ ID NO: 688899 - DNA, 22 bp, Artificial Sequence
  chemically synthesized
cctttagagttattgcatctgt

SEQ ID NO: 688900 - DNA, 22 bp, Artificial Sequence
  chemically synthesized
ataaacacagatgcaataactc

SEQ ID NO: 688901 - DNA, 22 bp, Artificial Sequence
  chemically synthesized
atagtatttcctttagagttat

SEQ ID NO: 688902 - DNA, 22 bp, Artificial Sequence
  chemically synthesized
gatagtatttcctttagagtta

SEQ ID NO: 688903 - DNA, 22 bp, Artificial Sequence
  chemically synthesized
atttgatagtatttcctttaga

SEQ ID NO: 688904 - DNA, 22 bp, Artificial Sequence
  chemically synthesized
gaattcatttgatagtatttcc

SEQ ID NO: 688905 - DNA, 22 bp, Artificial Sequence
  chemically synthesized
agaattcatttgatagtatttc

SEQ ID NO: 688906 - DNA, 22 bp, Artificial Sequence
  chemically synthesized
atttagaattcatttgatagta

SEQ ID NO: 688907 - DNA, 22 bp, Artificial Sequence
  chemically synthesized
taaaggaaatactatcaaatga

SEQ ID NO: 688908 - DNA, 22 bp, Artificial Sequence
  chemically synthesized
aaggaaatactatcaaatgaat

SEQ ID NO: 688909 - DNA, 22 bp, Artificial Sequence
  chemically synthesized
aacattcatttagaattcattt

SEQ ID NO: 688910 - DNA, 22 bp, Artificial Sequence
  chemically synthesized
atgctaaacattcatttagaat

SEQ ID NO: 688911 - DNA, 22 bp, Artificial Sequence
  chemically synthesized
gatgctaaacattcatttagaa

SEQ ID NO: 688912 - DNA, 22 bp, Artificial Sequence
  chemically synthesized
tcaaatgaattctaaatgaatg

SEQ ID NO: 688913 - DNA, 22 bp, Artificial Sequence
  chemically synthesized
gcccagtacttgatgctaaaca

SEQ ID NO: 688914 - DNA, 22 bp, Artificial Sequence
  chemically synthesized
taaatgaatgtttagcatcaag

SEQ ID NO: 688915 - DNA, 22 bp, Artificial Sequence
  chemically synthesized
gttggcccagtacttgatgcta

SEQ ID NO: 688916 - DNA, 22 bp, Artificial Sequence
  chemically synthesized
aatgaatgtttagcatcaagta

SEQ ID NO: 688917 - DNA, 22 bp, Artificial Sequence
  chemically synthesized
agcatcaagtactgggccaact

SEQ ID NO: 688918 - DNA, 22 bp, Artificial Sequence
  chemically synthesized
gcatcaagtactgggccaacta

SEQ ID NO: 688919 - DNA, 22 bp, Artificial Sequence
  chemically synthesized
ataatatggatatctagttggc

SEQ ID NO: 688920 - DNA, 22 bp, Artificial Sequence
  chemically synthesized
cataatatggatatctagttgg

SEQ ID NO: 688921 - DNA, 22 bp, Artificial Sequence
  chemically synthesized
tcataatatggatatctagttg

SEQ ID NO: 688922 - DNA, 22 bp, Artificial Sequence
  chemically synthesized
ttcataatatggatatctagtt

SEQ ID NO: 688923 - DNA, 22 bp, Artificial Sequence
  chemically synthesized
tttttcataatatggatatcta

SEQ ID NO: 688924 - DNA, 22 bp, Artificial Sequence
  chemically synthesized
atttttcataatatggatatct

SEQ ID NO: 688925 - DNA, 22 bp, Artificial Sequence
  chemically synthesized
tatttttcataatatggatatc

SEQ ID NO: 688926 - DNA, 22 bp, Artificial Sequence
  chemically synthesized
ggccaactagatatccatatta

SEQ ID NO: 688927 - DNA, 22 bp, Artificial Sequence
  chemically synthesized
agttttatttttcataatatgg

SEQ ID NO: 688928 - DNA, 22 bp, Artificial Sequence
  chemically synthesized
gatatccatattatgaaaaata

SEQ ID NO: 688929 - DNA, 22 bp, Artificial Sequence
  chemically synthesized
tgaaaaataaaactcaatctct

SEQ ID NO: 688930 - DNA, 22 bp, Artificial Sequence
  chemically synthesized
tgtaatatgtgagatagagatt

SEQ ID NO: 688931 - DNA, 22 bp, Artificial Sequence
  chemically synthesized
gtgtaatatgtgagatagagat

SEQ ID NO: 688932 - DNA, 22 bp, Artificial Sequence
  chemically synthesized
tgtgtaatatgtgagatagaga

SEQ ID NO: 688933 - DNA, 22 bp, Artificial Sequence
  chemically synthesized
ttgtgtaatatgtgagatagag

SEQ ID NO: 688934 - DNA, 22 bp, Artificial Sequence
  chemically synthesized
accttttgtgtaatatgtgaga

SEQ ID NO: 688935 - DNA, 22 bp, Artificial Sequence
  chemically synthesized
aatctctatctcacatattaca

SEQ ID NO: 688936 - DNA, 22 bp, Artificial Sequence
  chemically synthesized
gaattgaccttttgtgtaatat

SEQ ID NO: 688937 - DNA, 22 bp, Artificial Sequence
  chemically synthesized
tatctcacatattacacaaaag

SEQ ID NO: 688938 - DNA, 22 bp, Artificial Sequence
  chemically synthesized
tctcacatattacacaaaaggt

SEQ ID NO: 688939 - DNA, 22 bp, Artificial Sequence
  chemically synthesized
acatattacacaaaaggtcaat

SEQ ID NO: 688940 - DNA, 22 bp, Artificial Sequence
  chemically synthesized
gatatatagtacacctggaatt

SEQ ID NO: 688941 - DNA, 22 bp, Artificial Sequence
  chemically synthesized
cacaaaaggtcaattccaggtg

SEQ ID NO: 688942 - DNA, 22 bp, Artificial Sequence
  chemically synthesized
agatatatagtacacctggaat

SEQ ID NO: 688943 - DNA, 22 bp, Artificial Sequence
  chemically synthesized
catttagatatatagtacacct

SEQ ID NO: 688944 - DNA, 22 bp, Artificial Sequence
  chemically synthesized
ccatttagatatatagtacacc

SEQ ID NO: 688945 - DNA, 22 bp, Artificial Sequence
  chemically synthesized
tccatttagatatatagtacac

SEQ ID NO: 688946 - DNA, 22 bp, Artificial Sequence
  chemically synthesized
ttccatttagatatatagtaca

SEQ ID NO: 688947 - DNA, 22 bp, Artificial Sequence
  chemically synthesized
acttttccatttagatatatag

SEQ ID NO: 688948 - DNA, 22 bp, Artificial Sequence
  chemically synthesized
aacttttccatttagatatata

SEQ ID NO: 688949 - DNA, 22 bp, Artificial Sequence
  chemically synthesized
taacttttccatttagatatat

SEQ ID NO: 688950 - DNA, 22 bp, Artificial Sequence
  chemically synthesized
ttaacttttccatttagatata

SEQ ID NO: 688951 - DNA, 22 bp, Artificial Sequence
  chemically synthesized
caggtgtactatatatctaaat

SEQ ID NO: 688952 - DNA, 22 bp, Artificial Sequence
  chemically synthesized
tttaacttttccatttagatat

SEQ ID NO: 688953 - DNA, 22 bp, Artificial Sequence
  chemically synthesized
ttttttaacttttccatttaga

SEQ ID NO: 688954 - DNA, 22 bp, Artificial Sequence
  chemically synthesized
ctattttttaacttttccattt

SEQ ID NO: 688955 - DNA, 22 bp, Artificial Sequence
  chemically synthesized
actattttttaacttttccatt

SEQ ID NO: 688956 - DNA, 22 bp, Artificial Sequence
  chemically synthesized
tatatctaaatggaaaagttaa

SEQ ID NO: 688957 - DNA, 22 bp, Artificial Sequence
  chemically synthesized
gaaacttactattttttaactt

SEQ ID NO: 688958 - DNA, 22 bp, Artificial Sequence
  chemically synthesized
tagaaacttactattttttaac

SEQ ID NO: 688959 - DNA, 22 bp, Artificial Sequence
  chemically synthesized
ctagaaacttactattttttaa

SEQ ID NO: 688960 - DNA, 22 bp, Artificial Sequence
  chemically synthesized
aatggaaaagttaaaaaatagt

SEQ ID NO: 688961 - DNA, 22 bp, Artificial Sequence
  chemically synthesized
tcttctagaaacttactatttt

SEQ ID NO: 688962 - DNA, 22 bp, Artificial Sequence
  chemically synthesized
ttatcttctagaaacttactat

SEQ ID NO: 688963 - DNA, 22 bp, Artificial Sequence
  chemically synthesized
attatcttctagaaacttacta

SEQ ID NO: 688964 - DNA, 22 bp, Artificial Sequence
  chemically synthesized
tattatcttctagaaacttact

SEQ ID NO: 688965 - DNA, 22 bp, Artificial Sequence
  chemically synthesized
ttattatcttctagaaacttac

SEQ ID NO: 688966 - DNA, 22 bp, Artificial Sequence
  chemically synthesized
ttttattatcttctagaaactt

SEQ ID NO: 688967 - DNA, 22 bp, Artificial Sequence
  chemically synthesized
aaaaatagtaagtttctagaag

SEQ ID NO: 688968 - DNA, 22 bp, Artificial Sequence
  chemically synthesized
ctagaagataataaaagaggat

SEQ ID NO: 688969 - DNA, 22 bp, Artificial Sequence
  chemically synthesized
tagaagataataaaagaggata

SEQ ID NO: 688970 - DNA, 22 bp, Artificial Sequence
  chemically synthesized
gaagataataaaagaggataca

SEQ ID NO: 688971 - DNA, 22 bp, Artificial Sequence
  chemically synthesized
atacaagataatgaatgtatcc

SEQ ID NO: 688972 - DNA, 22 bp, Artificial Sequence
  chemically synthesized
ctaatacaagataatgaatgta

SEQ ID NO: 688973 - DNA, 22 bp, Artificial Sequence
  chemically synthesized
cctaatacaagataatgaatgt

SEQ ID NO: 688974 - DNA, 22 bp, Artificial Sequence
  chemically synthesized
tcctaatacaagataatgaatg

SEQ ID NO: 688975 - DNA, 22 bp, Artificial Sequence
  chemically synthesized
agaaatctttcctaatacaaga

SEQ ID NO: 688976 - DNA, 22 bp, Artificial Sequence
  chemically synthesized
aagaaatctttcctaatacaag

SEQ ID NO: 688977 - DNA, 22 bp, Artificial Sequence
  chemically synthesized
taagaaatctttcctaatacaa

SEQ ID NO: 688978 - DNA, 22 bp, Artificial Sequence
  chemically synthesized
tttaagaaatctttcctaatac

SEQ ID NO: 688979 - DNA, 22 bp, Artificial Sequence
  chemically synthesized
attatcttgtattaggaaagat

SEQ ID NO: 688980 - DNA, 22 bp, Artificial Sequence
  chemically synthesized
tgtcctctttaagaaatctttc

SEQ ID NO: 688981 - DNA, 22 bp, Artificial Sequence
  chemically synthesized
tcttgtattaggaaagatttct

SEQ ID NO: 688982 - DNA, 22 bp, Artificial Sequence
  chemically synthesized
gtgtcctctttaagaaatcttt

SEQ ID NO: 688983 - DNA, 22 bp, Artificial Sequence
  chemically synthesized
tgtgtcctctttaagaaatctt

SEQ ID NO: 688984 - DNA, 22 bp, Artificial Sequence
  chemically synthesized
ttgtgtcctctttaagaaatct

SEQ ID NO: 688985 - DNA, 22 bp, Artificial Sequence
  chemically synthesized
gtattaggaaagatttcttaaa

SEQ ID NO: 688986 - DNA, 22 bp, Artificial Sequence
  chemically synthesized
ttttgtgtcctctttaagaaat

SEQ ID NO: 688987 - DNA, 22 bp, Artificial Sequence
  chemically synthesized
tattaggaaagatttcttaaag

SEQ ID NO: 688988 - DNA, 22 bp, Artificial Sequence
  chemically synthesized
attcttttgtgtcctctttaag

SEQ ID NO: 688989 - DNA, 22 bp, Artificial Sequence
  chemically synthesized
ggaaagatttcttaaagaggac

SEQ ID NO: 688990 - DNA, 22 bp, Artificial Sequence
  chemically synthesized
gggttaattcttttgtgtcctc

SEQ ID NO: 688991 - DNA, 22 bp, Artificial Sequence
  chemically synthesized
agggttaattcttttgtgtcct

SEQ ID NO: 688992 - DNA, 22 bp, Artificial Sequence
  chemically synthesized
cttagggttaattcttttgtgt

SEQ ID NO: 688993 - DNA, 22 bp, Artificial Sequence
  chemically synthesized
ccttagggttaattcttttgtg

SEQ ID NO: 688994 - DNA, 22 bp, Artificial Sequence
  chemically synthesized
cttaaagaggacacaaaagaat

SEQ ID NO: 688995 - DNA, 22 bp, Artificial Sequence
  chemically synthesized
tccttagggttaattcttttgt

SEQ ID NO: 688996 - DNA, 22 bp, Artificial Sequence
  chemically synthesized
ttaaagaggacacaaaagaatt

SEQ ID NO: 688997 - DNA, 22 bp, Artificial Sequence
  chemically synthesized
ttccttagggttaattcttttg

SEQ ID NO: 688998 - DNA, 22 bp, Artificial Sequence
  chemically synthesized
aaagaggacacaaaagaattaa

SEQ ID NO: 688999 - DNA, 22 bp, Artificial Sequence
  chemically synthesized
aagaggacacaaaagaattaac

SEQ ID NO: 689000 - DNA, 22 bp, Artificial Sequence
  chemically synthesized
atatagtccaatatgtaaattt

SEQ ID NO: 689001 - DNA, 22 bp, Artificial Sequence
  chemically synthesized
accctaaggaaaaatttacata

SEQ ID NO: 689002 - DNA, 22 bp, Artificial Sequence
  chemically synthesized
aatatagtccaatatgtaaatt

SEQ ID NO: 689003 - DNA, 22 bp, Artificial Sequence
  chemically synthesized
taatatagtccaatatgtaaat

SEQ ID NO: 689004 - DNA, 22 bp, Artificial Sequence
  chemically synthesized
actttaatatagtccaatatgt

SEQ ID NO: 689005 - DNA, 22 bp, Artificial Sequence
  chemically synthesized
aggaaaaatttacatattggac

SEQ ID NO: 689006 - DNA, 22 bp, Artificial Sequence
  chemically synthesized
aactttaatatagtccaatatg

SEQ ID NO: 689007 - DNA, 22 bp, Artificial Sequence
  chemically synthesized
ttaactttaatatagtccaata

SEQ ID NO: 689008 - DNA, 22 bp, Artificial Sequence
  chemically synthesized
atagttcttaactttaatatag

SEQ ID NO: 689009 - DNA, 22 bp, Artificial Sequence
  chemically synthesized
acatattggactatattaaagt

SEQ ID NO: 689010 - DNA, 22 bp, Artificial Sequence
  chemically synthesized
catattggactatattaaagtt

SEQ ID NO: 689011 - DNA, 22 bp, Artificial Sequence
  chemically synthesized
attgatagttcttaactttaat

SEQ ID NO: 689012 - DNA, 22 bp, Artificial Sequence
  chemically synthesized
gattgatagttcttaactttaa

SEQ ID NO: 689013 - DNA, 22 bp, Artificial Sequence
  chemically synthesized
tgattgatagttcttaacttta

SEQ ID NO: 689014 - DNA, 22 bp, Artificial Sequence
  chemically synthesized
ttgattgatagttcttaacttt

SEQ ID NO: 689015 - DNA, 22 bp, Artificial Sequence
  chemically synthesized
tttgattgatagttcttaactt

SEQ ID NO: 689016 - DNA, 22 bp, Artificial Sequence
  chemically synthesized
ttttgattgatagttcttaact

SEQ ID NO: 689017 - DNA, 22 bp, Artificial Sequence
  chemically synthesized
gactatattaaagttaagaact

SEQ ID NO: 689018 - DNA, 22 bp, Artificial Sequence
  chemically synthesized
tttttttgattgatagttctta

SEQ ID NO: 689019 - DNA, 22 bp, Artificial Sequence
  chemically synthesized
tattaaagttaagaactatcaa

SEQ ID NO: 689020 - DNA, 22 bp, Artificial Sequence
  chemically synthesized
aattgtttttttgattgatagt

SEQ ID NO: 689021 - DNA, 22 bp, Artificial Sequence
  chemically synthesized
aagttaagaactatcaatcaaa

SEQ ID NO: 689022 - DNA, 22 bp, Artificial Sequence
  chemically synthesized
attaaattgtttttttgattga

SEQ ID NO: 689023 - DNA, 22 bp, Artificial Sequence
  chemically synthesized
aattaaattgtttttttgattg

SEQ ID NO: 689024 - DNA, 22 bp, Artificial Sequence
  chemically synthesized
taattaaattgtttttttgatt

SEQ ID NO: 689025 - DNA, 22 bp, Artificial Sequence
  chemically synthesized
ttaattaaattgtttttttgat

SEQ ID NO: 689026 - DNA, 22 bp, Artificial Sequence
  chemically synthesized
agaactatcaatcaaaaaaaca

SEQ ID NO: 689027 - DNA, 22 bp, Artificial Sequence
  chemically synthesized
cttttaattaaattgttttttt

SEQ ID NO: 689028 - DNA, 22 bp, Artificial Sequence
  chemically synthesized
ccttttaattaaattgtttttt

SEQ ID NO: 689029 - DNA, 22 bp, Artificial Sequence
  chemically synthesized
tccttttaattaaattgttttt

SEQ ID NO: 689030 - DNA, 22 bp, Artificial Sequence
  chemically synthesized
tcaatcaaaaaaacaatttaat

SEQ ID NO: 689031 - DNA, 22 bp, Artificial Sequence
  chemically synthesized
tagctttccttttaattaaatt

SEQ ID NO: 689032 - DNA, 22 bp, Artificial Sequence
  chemically synthesized
atagctttccttttaattaaat

SEQ ID NO: 689033 - DNA, 22 bp, Artificial Sequence
  chemically synthesized
tatagctttccttttaattaaa

SEQ ID NO: 689034 - DNA, 22 bp, Artificial Sequence
  chemically synthesized
ccattttatagctttcctttta

SEQ ID NO: 689035 - DNA, 22 bp, Artificial Sequence
  chemically synthesized
tcccattttatagctttccttt

SEQ ID NO: 689036 - DNA, 22 bp, Artificial Sequence
  chemically synthesized
ctcccattttatagctttcctt

SEQ ID NO: 689037 - DNA, 22 bp, Artificial Sequence
  chemically synthesized
aattaaaaggaaagctataaaa

SEQ ID NO: 689038 - DNA, 22 bp, Artificial Sequence
  chemically synthesized
attaaaaggaaagctataaaat

SEQ ID NO: 689039 - DNA, 22 bp, Artificial Sequence
  chemically synthesized
caaatatcttctcccattttat

SEQ ID NO: 689040 - DNA, 22 bp, Artificial Sequence
  chemically synthesized
aaaggaaagctataaaatggga

SEQ ID NO: 689041 - DNA, 22 bp, Artificial Sequence
  chemically synthesized
tatgtgttgcaaatatcttctc

SEQ ID NO: 689042 - DNA, 22 bp, Artificial Sequence
  chemically synthesized
taaaatgggagaagatatttgc

SEQ ID NO: 689043 - DNA, 22 bp, Artificial Sequence
  chemically synthesized
taaattgtatgtgttgcaaata

SEQ ID NO: 689044 - DNA, 22 bp, Artificial Sequence
  chemically synthesized
gtaaattgtatgtgttgcaaat

SEQ ID NO: 689045 - DNA, 22 bp, Artificial Sequence
  chemically synthesized
tgtaaattgtatgtgttgcaaa

SEQ ID NO: 689046 - DNA, 22 bp, Artificial Sequence
  chemically synthesized
tagccctttgtaaattgtatgt

SEQ ID NO: 689047 - DNA, 22 bp, Artificial Sequence
  chemically synthesized
gtagccctttgtaaattgtatg

SEQ ID NO: 689048 - DNA, 22 bp, Artificial Sequence
  chemically synthesized
gtttgtagccctttgtaaattg

SEQ ID NO: 689049 - DNA, 22 bp, Artificial Sequence
  chemically synthesized
gcaacacatacaatttacaaag

SEQ ID NO: 689050 - DNA, 22 bp, Artificial Sequence
  chemically synthesized
tagtttgtagccctttgtaaat

SEQ ID NO: 689051 - DNA, 22 bp, Artificial Sequence
  chemically synthesized
caacacatacaatttacaaagg

SEQ ID NO: 689052 - DNA, 22 bp, Artificial Sequence
  chemically synthesized
catattctagtttgtagccctt

SEQ ID NO: 689053 - DNA, 22 bp, Artificial Sequence
  chemically synthesized
acatattctagtttgtagccct

SEQ ID NO: 689054 - DNA, 22 bp, Artificial Sequence
  chemically synthesized
tacatattctagtttgtagccc

SEQ ID NO: 689055 - DNA, 22 bp, Artificial Sequence
  chemically synthesized
ttacatattctagtttgtagcc

SEQ ID NO: 689056 - DNA, 22 bp, Artificial Sequence
  chemically synthesized
tttacatattctagtttgtagc

SEQ ID NO: 689057 - DNA, 22 bp, Artificial Sequence
  chemically synthesized
ttttacatattctagtttgtag

SEQ ID NO: 689058 - DNA, 22 bp, Artificial Sequence
  chemically synthesized
tttttacatattctagtttgta

SEQ ID NO: 689059 - DNA, 22 bp, Artificial Sequence
  chemically synthesized
acaaagggctacaaactagaat

SEQ ID NO: 689060 - DNA, 22 bp, Artificial Sequence
  chemically synthesized
caaagggctacaaactagaata

SEQ ID NO: 689061 - DNA, 22 bp, Artificial Sequence
  chemically synthesized
taggagttttttttacatattc

SEQ ID NO: 689062 - DNA, 22 bp, Artificial Sequence
  chemically synthesized
caaactagaatatgtaaaaaaa

SEQ ID NO: 689063 - DNA, 22 bp, Artificial Sequence
  chemically synthesized
atctgtaggagttttttttaca

SEQ ID NO: 689064 - DNA, 22 bp, Artificial Sequence
  chemically synthesized
ttgatctgtaggagtttttttt

SEQ ID NO: 689065 - DNA, 22 bp, Artificial Sequence
  chemically synthesized
attgatctgtaggagttttttt

SEQ ID NO: 689066 - DNA, 22 bp, Artificial Sequence
  chemically synthesized
ttattgatctgtaggagttttt

SEQ ID NO: 689067 - DNA, 22 bp, Artificial Sequence
  chemically synthesized
gaatatgtaaaaaaaactccta

SEQ ID NO: 689068 - DNA, 22 bp, Artificial Sequence
  chemically synthesized
cttattgatctgtaggagtttt

SEQ ID NO: 689069 - DNA, 22 bp, Artificial Sequence
  chemically synthesized
tcttattgatctgtaggagttt

SEQ ID NO: 689070 - DNA, 22 bp, Artificial Sequence
  chemically synthesized
ttcttattgatctgtaggagtt

SEQ ID NO: 689071 - DNA, 22 bp, Artificial Sequence
  chemically synthesized
tttcttattgatctgtaggagt

SEQ ID NO: 689072 - DNA, 22 bp, Artificial Sequence
  chemically synthesized
tttttcttattgatctgtagga

SEQ ID NO: 689073 - DNA, 22 bp, Artificial Sequence
  chemically synthesized
ctttttcttattgatctgtagg

SEQ ID NO: 689074 - DNA, 22 bp, Artificial Sequence
  chemically synthesized
atccttctttttcttattgatc

SEQ ID NO: 689075 - DNA, 22 bp, Artificial Sequence
  chemically synthesized
attcatccttctttttcttatt

SEQ ID NO: 689076 - DNA, 22 bp, Artificial Sequence
  chemically synthesized
ctacagatcaataagaaaaaga

SEQ ID NO: 689077 - DNA, 22 bp, Artificial Sequence
  chemically synthesized
ttgattcatccttctttttctt

SEQ ID NO: 689078 - DNA, 22 bp, Artificial Sequence
  chemically synthesized
attgattcatccttctttttct

SEQ ID NO: 689079 - DNA, 22 bp, Artificial Sequence
  chemically synthesized
tattgattcatccttctttttc

SEQ ID NO: 689080 - DNA, 22 bp, Artificial Sequence
  chemically synthesized
cagatcaataagaaaaagaagg

SEQ ID NO: 689081 - DNA, 22 bp, Artificial Sequence
  chemically synthesized
ttattgattcatccttcttttt

SEQ ID NO: 689082 - DNA, 22 bp, Artificial Sequence
  chemically synthesized
tttattgattcatccttctttt

SEQ ID NO: 689083 - DNA, 22 bp, Artificial Sequence
  chemically synthesized
ttttattgattcatccttcttt

SEQ ID NO: 689084 - DNA, 22 bp, Artificial Sequence
  chemically synthesized
tttttattgattcatccttctt

SEQ ID NO: 689085 - DNA, 22 bp, Artificial Sequence
  chemically synthesized
ttttttttattgattcatcctt

SEQ ID NO: 689086 - DNA, 22 bp, Artificial Sequence
  chemically synthesized
cctattttttttattgattcat

SEQ ID NO: 689087 - DNA, 22 bp, Artificial Sequence
  chemically synthesized
gcctattttttttattgattca

SEQ ID NO: 689088 - DNA, 22 bp, Artificial Sequence
  chemically synthesized
ttgcctattttttttattgatt

SEQ ID NO: 689089 - DNA, 22 bp, Artificial Sequence
  chemically synthesized
agtctcttgcctatttttttta

SEQ ID NO: 689090 - DNA, 22 bp, Artificial Sequence
  chemically synthesized
ttcagtctcttgcctatttttt

SEQ ID NO: 689091 - DNA, 22 bp, Artificial Sequence
  chemically synthesized
tgtgaagtatctattcagtctc

SEQ ID NO: 689092 - DNA, 22 bp, Artificial Sequence
  chemically synthesized
ttgtgtgaagtatctattcagt

SEQ ID NO: 689093 - DNA, 22 bp, Artificial Sequence
  chemically synthesized
gatatcctgttgtgtgaagtat

SEQ ID NO: 689094 - DNA, 22 bp, Artificial Sequence
  chemically synthesized
ggatatcctgttgtgtgaagta

SEQ ID NO: 689095 - DNA, 22 bp, Artificial Sequence
  chemically synthesized
tggatatcctgttgtgtgaagt

SEQ ID NO: 689096 - DNA, 22 bp, Artificial Sequence
  chemically synthesized
aatagatacttcacacaacagg

SEQ ID NO: 689097 - DNA, 22 bp, Artificial Sequence
  chemically synthesized
accattttggatatcctgttgt

SEQ ID NO: 689098 - DNA, 22 bp, Artificial Sequence
  chemically synthesized
ttgaccattttggatatcctgt

SEQ ID NO: 689099 - DNA, 22 bp, Artificial Sequence
  chemically synthesized
attgaccattttggatatcctg

SEQ ID NO: 689100 - DNA, 22 bp, Artificial Sequence
  chemically synthesized
cacacaacaggatatccaaaat

SEQ ID NO: 689101 - DNA, 22 bp, Artificial Sequence
  chemically synthesized
acacaacaggatatccaaaatg

SEQ ID NO: 689102 - DNA, 22 bp, Artificial Sequence
  chemically synthesized
cgtgtatttattgaccattttg

SEQ ID NO: 689103 - DNA, 22 bp, Artificial Sequence
  chemically synthesized
acgtgtatttattgaccatttt

SEQ ID NO: 689104 - DNA, 22 bp, Artificial Sequence
  chemically synthesized
tacgtgtatttattgaccattt

SEQ ID NO: 689105 - DNA, 22 bp, Artificial Sequence
  chemically synthesized
ttacgtgtatttattgaccatt

SEQ ID NO: 689106 - DNA, 22 bp, Artificial Sequence
  chemically synthesized
aatatttttacgtgtatttatt

SEQ ID NO: 689107 - DNA, 22 bp, Artificial Sequence
  chemically synthesized
tgaggttgaatatttttacgtg

SEQ ID NO: 689108 - DNA, 22 bp, Artificial Sequence
  chemically synthesized
atgaggttgaatatttttacgt

SEQ ID NO: 689109 - DNA, 22 bp, Artificial Sequence
  chemically synthesized
cttatgaggttgaatattttta

SEQ ID NO: 689110 - DNA, 22 bp, Artificial Sequence
  chemically synthesized
attacttatgaggttgaatatt

SEQ ID NO: 689111 - DNA, 22 bp, Artificial Sequence
  chemically synthesized
tctgattacttatgaggttgaa

SEQ ID NO: 689112 - DNA, 22 bp, Artificial Sequence
  chemically synthesized
caattgtctgattacttatgag

SEQ ID NO: 689113 - DNA, 22 bp, Artificial Sequence
  chemically synthesized
gcaattgtctgattacttatga

SEQ ID NO: 689114 - DNA, 22 bp, Artificial Sequence
  chemically synthesized
atttgcaattgtctgattactt

SEQ ID NO: 689115 - DNA, 22 bp, Artificial Sequence
  chemically synthesized
aatttgcaattgtctgattact

SEQ ID NO: 689116 - DNA, 22 bp, Artificial Sequence
  chemically synthesized
taatttgcaattgtctgattac

SEQ ID NO: 689117 - DNA, 22 bp, Artificial Sequence
  chemically synthesized
aacctcataagtaatcagacaa

SEQ ID NO: 689118 - DNA, 22 bp, Artificial Sequence
  chemically synthesized
ttttaatttgcaattgtctgat

SEQ ID NO: 689119 - DNA, 22 bp, Artificial Sequence
  chemically synthesized
ttattttaatttgcaattgtct

SEQ ID NO: 689120 - DNA, 22 bp, Artificial Sequence
  chemically synthesized
ataagtaatcagacaattgcaa

SEQ ID NO: 689121 - DNA, 22 bp, Artificial Sequence
  chemically synthesized
attgttattttaatttgcaatt

SEQ ID NO: 689122 - DNA, 22 bp, Artificial Sequence
  chemically synthesized
caaattaaaataacaatgagat

SEQ ID NO: 689123 - DNA, 22 bp, Artificial Sequence
  chemically synthesized
aaataacaatgagattctactc

SEQ ID NO: 689124 - DNA, 22 bp, Artificial Sequence
  chemically synthesized
cagtgagtgtgtgagtagaatc

SEQ ID NO: 689125 - DNA, 22 bp, Artificial Sequence
  chemically synthesized
gccattgcagtgagtgtgtgag

SEQ ID NO: 689126 - DNA, 22 bp, Artificial Sequence
  chemically synthesized
cgccattgcagtgagtgtgtga

SEQ ID NO: 689127 - DNA, 22 bp, Artificial Sequence
  chemically synthesized
tcgccattgcagtgagtgtgtg

SEQ ID NO: 689128 - DNA, 22 bp, Artificial Sequence
  chemically synthesized
aaattttcgccattgcagtgag

SEQ ID NO: 689129 - DNA, 22 bp, Artificial Sequence
  chemically synthesized
aaaattttcgccattgcagtga

SEQ ID NO: 689130 - DNA, 22 bp, Artificial Sequence
  chemically synthesized
tactcacacactcactgcaatg

SEQ ID NO: 689131 - DNA, 22 bp, Artificial Sequence
  chemically synthesized
taaaattttcgccattgcagtg

SEQ ID NO: 689132 - DNA, 22 bp, Artificial Sequence
  chemically synthesized
ctcacacactcactgcaatggc

SEQ ID NO: 689133 - DNA, 22 bp, Artificial Sequence
  chemically synthesized
acacactcactgcaatggcgaa

SEQ ID NO: 689134 - DNA, 22 bp, Artificial Sequence
  chemically synthesized
gtctttaaaattttcgccattg

SEQ ID NO: 689135 - DNA, 22 bp, Artificial Sequence
  chemically synthesized
ttagtctttaaaattttcgcca

SEQ ID NO: 689136 - DNA, 22 bp, Artificial Sequence
  chemically synthesized
gttagtctttaaaattttcgcc

SEQ ID NO: 689137 - DNA, 22 bp, Artificial Sequence
  chemically synthesized
actgcaatggcgaaaattttaa

SEQ ID NO: 689138 - DNA, 22 bp, Artificial Sequence
  chemically synthesized
atacttgttagtctttaaaatt

SEQ ID NO: 689139 - DNA, 22 bp, Artificial Sequence
  chemically synthesized
gatacttgttagtctttaaaat

SEQ ID NO: 689140 - DNA, 22 bp, Artificial Sequence
  chemically synthesized
caatggcgaaaattttaaagac

SEQ ID NO: 689141 - DNA, 22 bp, Artificial Sequence
  chemically synthesized
aacaatacttgatacttgttag

SEQ ID NO: 689142 - DNA, 22 bp, Artificial Sequence
  chemically synthesized
taaagactaacaagtatcaagt

SEQ ID NO: 689143 - DNA, 22 bp, Artificial Sequence
  chemically synthesized
aaagactaacaagtatcaagta

SEQ ID NO: 689144 - DNA, 22 bp, Artificial Sequence
  chemically synthesized
aagactaacaagtatcaagtat

SEQ ID NO: 689145 - DNA, 22 bp, Artificial Sequence
  chemically synthesized
cacatctcaacaatacttgata

SEQ ID NO: 689146 - DNA, 22 bp, Artificial Sequence
  chemically synthesized
acaagtatcaagtattgttgag

SEQ ID NO: 689147 - DNA, 22 bp, Artificial Sequence
  chemically synthesized
gtagctccacatctcaacaata

SEQ ID NO: 689148 - DNA, 22 bp, Artificial Sequence
  chemically synthesized
tagtagctccacatctcaacaa

SEQ ID NO: 689149 - DNA, 22 bp, Artificial Sequence
  chemically synthesized
ttgagatgtggagctactagaa

SEQ ID NO: 689150 - DNA, 22 bp, Artificial Sequence
  chemically synthesized
gcagtatatgaaagttctagta

SEQ ID NO: 689151 - DNA, 22 bp, Artificial Sequence
  chemically synthesized
agatgtggagctactagaactt

SEQ ID NO: 689152 - DNA, 22 bp, Artificial Sequence
  chemically synthesized
caccatcattagcagtatatga

SEQ ID NO: 689153 - DNA, 22 bp, Artificial Sequence
  chemically synthesized
acaccatcattagcagtatatg

SEQ ID NO: 689154 - DNA, 22 bp, Artificial Sequence
  chemically synthesized
ctagaactttcatatactgcta

SEQ ID NO: 689155 - DNA, 22 bp, Artificial Sequence
  chemically synthesized
gaactttcatatactgctaatg

SEQ ID NO: 689156 - DNA, 22 bp, Artificial Sequence
  chemically synthesized
taccagtttacaccatcattag

SEQ ID NO: 689157 - DNA, 22 bp, Artificial Sequence
  chemically synthesized
tcatatactgctaatgatggtg

SEQ ID NO: 689158 - DNA, 22 bp, Artificial Sequence
  chemically synthesized
catatactgctaatgatggtgt

SEQ ID NO: 689159 - DNA, 22 bp, Artificial Sequence
  chemically synthesized
atatactgctaatgatggtgta

SEQ ID NO: 689160 - DNA, 22 bp, Artificial Sequence
  chemically synthesized
caaagtggttgtaccagtttac

SEQ ID NO: 689161 - DNA, 22 bp, Artificial Sequence
  chemically synthesized
ctaatgatggtgtaaactggta

SEQ ID NO: 689162 - DNA, 22 bp, Artificial Sequence
  chemically synthesized
ccaaagtggttgtaccagttta

SEQ ID NO: 689163 - DNA, 22 bp, Artificial Sequence
  chemically synthesized
tccaaagtggttgtaccagttt

SEQ ID NO: 689164 - DNA, 22 bp, Artificial Sequence
  chemically synthesized
atgatggtgtaaactggtacaa

SEQ ID NO: 689165 - DNA, 22 bp, Artificial Sequence
  chemically synthesized
gttttccaaagtggttgtacca

SEQ ID NO: 689166 - DNA, 22 bp, Artificial Sequence
  chemically synthesized
ctggttttccaaagtggttgta

SEQ ID NO: 689167 - DNA, 22 bp, Artificial Sequence
  chemically synthesized
gtagatactcctggttttccaa

SEQ ID NO: 689168 - DNA, 22 bp, Artificial Sequence
  chemically synthesized
gtacaaccactttggaaaacca

SEQ ID NO: 689169 - DNA, 22 bp, Artificial Sequence
  chemically synthesized
agtagatactcctggttttcca

SEQ ID NO: 689170 - DNA, 22 bp, Artificial Sequence
  chemically synthesized
tagtagatactcctggttttcc

SEQ ID NO: 689171 - DNA, 22 bp, Artificial Sequence
  chemically synthesized
agctttagtagatactcctggt

SEQ ID NO: 689172 - DNA, 22 bp, Artificial Sequence
  chemically synthesized
tggaaaaccaggagtatctact

SEQ ID NO: 689173 - DNA, 22 bp, Artificial Sequence
  chemically synthesized
ggaaaaccaggagtatctacta

SEQ ID NO: 689174 - DNA, 22 bp, Artificial Sequence
  chemically synthesized
gaaaaccaggagtatctactaa

SEQ ID NO: 689175 - DNA, 22 bp, Artificial Sequence
  chemically synthesized
agggtaggcatatgctgagctt

SEQ ID NO: 689176 - DNA, 22 bp, Artificial Sequence
  chemically synthesized
tgttgagggtaggcatatgctg

SEQ ID NO: 689177 - DNA, 22 bp, Artificial Sequence
  chemically synthesized
ctaaagctcagcatatgcctac

SEQ ID NO: 689178 - DNA, 22 bp, Artificial Sequence
  chemically synthesized
cctatgttgagggtaggcatat

SEQ ID NO: 689179 - DNA, 22 bp, Artificial Sequence
  chemically synthesized
aagctcagcatatgcctaccct

SEQ ID NO: 689180 - DNA, 22 bp, Artificial Sequence
  chemically synthesized
agcatatgcctaccctcaacat

SEQ ID NO: 689181 - DNA, 22 bp, Artificial Sequence
  chemically synthesized
cagtaaaattgcctatgttgag

SEQ ID NO: 689182 - DNA, 22 bp, Artificial Sequence
  chemically synthesized
gcagtaaaattgcctatgttga

SEQ ID NO: 689183 - DNA, 22 bp, Artificial Sequence
  chemically synthesized
tgcagtaaaattgcctatgttg

SEQ ID NO: 689184 - DNA, 22 bp, Artificial Sequence
  chemically synthesized
ccctcaacataggcaattttac

SEQ ID NO: 689185 - DNA, 22 bp, Artificial Sequence
  chemically synthesized
gtatatactttgcagtaaaatt

SEQ ID NO: 689186 - DNA, 22 bp, Artificial Sequence
  chemically synthesized
ggtatatactttgcagtaaaat

SEQ ID NO: 689187 - DNA, 22 bp, Artificial Sequence
  chemically synthesized
aacataggcaattttactgcaa

SEQ ID NO: 689188 - DNA, 22 bp, Artificial Sequence
  chemically synthesized
tgtttggtatatactttgcagt

SEQ ID NO: 689189 - DNA, 22 bp, Artificial Sequence
  chemically synthesized
tactgcaaagtatataccaaac

SEQ ID NO: 689190 - DNA, 22 bp, Artificial Sequence
  chemically synthesized
actgcaaagtatataccaaaca

SEQ ID NO: 689191 - DNA, 22 bp, Artificial Sequence
  chemically synthesized
ctgcaaagtatataccaaacac

SEQ ID NO: 689192 - DNA, 22 bp, Artificial Sequence
  chemically synthesized
caaagtatataccaaacacagt

SEQ ID NO: 689193 - DNA, 22 bp, Artificial Sequence
  chemically synthesized
gcacacacgtgtgtacaactgt

SEQ ID NO: 689194 - DNA, 22 bp, Artificial Sequence
  chemically synthesized
ggcacacacgtgtgtacaactg

SEQ ID NO: 689195 - DNA, 22 bp, Artificial Sequence
  chemically synthesized
tggcacacacgtgtgtacaact

SEQ ID NO: 689196 - DNA, 22 bp, Artificial Sequence
  chemically synthesized
ttggcacacacgtgtgtacaac

SEQ ID NO: 689197 - DNA, 22 bp, Artificial Sequence
  chemically synthesized
tttggcacacacgtgtgtacaa

SEQ ID NO: 689198 - DNA, 22 bp, Artificial Sequence
  chemically synthesized
atgcgttttttggcacacacgt

SEQ ID NO: 689199 - DNA, 22 bp, Artificial Sequence
  chemically synthesized
aatgcgttttttggcacacacg

SEQ ID NO: 689200 - DNA, 22 bp, Artificial Sequence
  chemically synthesized
taatgcgttttttggcacacac

SEQ ID NO: 689201 - DNA, 22 bp, Artificial Sequence
  chemically synthesized
tttaatgcgttttttggcacac

SEQ ID NO: 689202 - DNA, 22 bp, Artificial Sequence
  chemically synthesized
tacacacgtgtgtgccaaaaaa

SEQ ID NO: 689203 - DNA, 22 bp, Artificial Sequence
  chemically synthesized
tgaacattctttaatgcgtttt

SEQ ID NO: 689204 - DNA, 22 bp, Artificial Sequence
  chemically synthesized
ctatgaacattctttaatgcgt

SEQ ID NO: 689205 - DNA, 22 bp, Artificial Sequence
  chemically synthesized
tgaataaggcctcctatgaaca

SEQ ID NO: 689206 - DNA, 22 bp, Artificial Sequence
  chemically synthesized
aagaatgttcataggaggcctt

SEQ ID NO: 689207 - DNA, 22 bp, Artificial Sequence
  chemically synthesized
aagacattatgaataaggcctc

SEQ ID NO: 689208 - DNA, 22 bp, Artificial Sequence
  chemically synthesized
gaagacattatgaataaggcct

SEQ ID NO: 689209 - DNA, 22 bp, Artificial Sequence
  chemically synthesized
cagtttgaagacattatgaata

SEQ ID NO: 689210 - DNA, 22 bp, Artificial Sequence
  chemically synthesized
ataggaggccttattcataatg

SEQ ID NO: 689211 - DNA, 22 bp, Artificial Sequence
  chemically synthesized
ccagtttgaagacattatgaat

SEQ ID NO: 689212 - DNA, 22 bp, Artificial Sequence
  chemically synthesized
tccagtttgaagacattatgaa

SEQ ID NO: 689213 - DNA, 22 bp, Artificial Sequence
  chemically synthesized
tttccagtttgaagacattatg

SEQ ID NO: 689214 - DNA, 22 bp, Artificial Sequence
  chemically synthesized
gttctttccagtttgaagacat

SEQ ID NO: 689215 - DNA, 22 bp, Artificial Sequence
  chemically synthesized
ggttctttccagtttgaagaca

SEQ ID NO: 689216 - DNA, 22 bp, Artificial Sequence
  chemically synthesized
tggttctttccagtttgaagac

SEQ ID NO: 689217 - DNA, 22 bp, Artificial Sequence
  chemically synthesized
attcataatgtcttcaaactgg

SEQ ID NO: 689218 - DNA, 22 bp, Artificial Sequence
  chemically synthesized
ttcataatgtcttcaaactgga

SEQ ID NO: 689219 - DNA, 22 bp, Artificial Sequence
  chemically synthesized
ataatgtcttcaaactggaaag

SEQ ID NO: 689220 - DNA, 22 bp, Artificial Sequence
  chemically synthesized
gggaacattttggttctttcca

SEQ ID NO: 689221 - DNA, 22 bp, Artificial Sequence
  chemically synthesized
ttggggaacattttggttcttt

SEQ ID NO: 689222 - DNA, 22 bp, Artificial Sequence
  chemically synthesized
ttgttggggaacattttggttc

SEQ ID NO: 689223 - DNA, 22 bp, Artificial Sequence
  chemically synthesized
caaactggaaagaaccaaaatg

SEQ ID NO: 689224 - DNA, 22 bp, Artificial Sequence
  chemically synthesized
aaactggaaagaaccaaaatgt

SEQ ID NO: 689225 - DNA, 22 bp, Artificial Sequence
  chemically synthesized
tattgttggggaacattttggt

SEQ ID NO: 689226 - DNA, 22 bp, Artificial Sequence
  chemically synthesized
gaaagaaccaaaatgttcccca

SEQ ID NO: 689227 - DNA, 22 bp, Artificial Sequence
  chemically synthesized
tccattctattgttggggaaca

SEQ ID NO: 689228 - DNA, 22 bp, Artificial Sequence
  chemically synthesized
atccattctattgttggggaac

SEQ ID NO: 689229 - DNA, 22 bp, Artificial Sequence
  chemically synthesized
taatttatccattctattgttg

SEQ ID NO: 689230 - DNA, 22 bp, Artificial Sequence
  chemically synthesized
cccaacaatagaatggataaat

SEQ ID NO: 689231 - DNA, 22 bp, Artificial Sequence
  chemically synthesized
aaatgtatactataatttatcc

SEQ ID NO: 689232 - DNA, 22 bp, Artificial Sequence
  chemically synthesized
aaaatgtatactataatttatc

SEQ ID NO: 689233 - DNA, 22 bp, Artificial Sequence
  chemically synthesized
atatcccatttaaaatgtatac

SEQ ID NO: 689234 - DNA, 22 bp, Artificial Sequence
  chemically synthesized
gatatcccatttaaaatgtata

SEQ ID NO: 689235 - DNA, 22 bp, Artificial Sequence
  chemically synthesized
caatttgatatcccatttaaaa

SEQ ID NO: 689236 - DNA, 22 bp, Artificial Sequence
  chemically synthesized
tagtatacattttaaatgggat

SEQ ID NO: 689237 - DNA, 22 bp, Artificial Sequence
  chemically synthesized
attgcaatttgatatcccattt

SEQ ID NO: 689238 - DNA, 22 bp, Artificial Sequence
  chemically synthesized
cattgcaatttgatatcccatt

SEQ ID NO: 689239 - DNA, 22 bp, Artificial Sequence
  chemically synthesized
tcattgcaatttgatatcccat

SEQ ID NO: 689240 - DNA, 22 bp, Artificial Sequence
  chemically synthesized
taaatgggatatcaaattgcaa

SEQ ID NO: 689241 - DNA, 22 bp, Artificial Sequence
  chemically synthesized
aaatgggatatcaaattgcaat

SEQ ID NO: 689242 - DNA, 22 bp, Artificial Sequence
  chemically synthesized
tcatacattttcattgcaattt

SEQ ID NO: 689243 - DNA, 22 bp, Artificial Sequence
  chemically synthesized
aatgggatatcaaattgcaatg

SEQ ID NO: 689244 - DNA, 22 bp, Artificial Sequence
  chemically synthesized
catgaatctgtcatacattttc

SEQ ID NO: 689245 - DNA, 22 bp, Artificial Sequence
  chemically synthesized
ttgcatgaatctgtcatacatt

SEQ ID NO: 689246 - DNA, 22 bp, Artificial Sequence
  chemically synthesized
caatgaaaatgtatgacagatt

SEQ ID NO: 689247 - DNA, 22 bp, Artificial Sequence
  chemically synthesized
atgttgttgcatgaatctgtca

SEQ ID NO: 689248 - DNA, 22 bp, Artificial Sequence
  chemically synthesized
actcatgttgttgcatgaatct

SEQ ID NO: 689249 - DNA, 22 bp, Artificial Sequence
  chemically synthesized
tgagattaactcatgttgttgc

SEQ ID NO: 689250 - DNA, 22 bp, Artificial Sequence
  chemically synthesized
atgagattaactcatgttgttg

SEQ ID NO: 689251 - DNA, 22 bp, Artificial Sequence
  chemically synthesized
tgtttatgagattaactcatgt

SEQ ID NO: 689252 - DNA, 22 bp, Artificial Sequence
  chemically synthesized
atgcaacaacatgagttaatct

SEQ ID NO: 689253 - DNA, 22 bp, Artificial Sequence
  chemically synthesized
aacattgtgtttatgagattaa

SEQ ID NO: 689254 - DNA, 22 bp, Artificial Sequence
  chemically synthesized
ggactcaacattgtgtttatga

SEQ ID NO: 689255 - DNA, 22 bp, Artificial Sequence
  chemically synthesized
tatctaggactcaacattgtgt

SEQ ID NO: 689256 - DNA, 22 bp, Artificial Sequence
  chemically synthesized
gtatctaggactcaacattgtg

SEQ ID NO: 689257 - DNA, 22 bp, Artificial Sequence
  chemically synthesized
tgtatctaggactcaacattgt

SEQ ID NO: 689258 - DNA, 22 bp, Artificial Sequence
  chemically synthesized
atctcataaacacaatgttgag

SEQ ID NO: 689259 - DNA, 22 bp, Artificial Sequence
  chemically synthesized
ttgtatctaggactcaacattg

SEQ ID NO: 689260 - DNA, 22 bp, Artificial Sequence
  chemically synthesized
ataaacacaatgttgagtccta

SEQ ID NO: 689261 - DNA, 22 bp, Artificial Sequence
  chemically synthesized
tacagtatataaccttttgtat

SEQ ID NO: 689262 - DNA, 22 bp, Artificial Sequence
  chemically synthesized
agtcctagatacaaaaggttat

SEQ ID NO: 689263 - DNA, 22 bp, Artificial Sequence
  chemically synthesized
gatacaaaaggttatatactgt

SEQ ID NO: 689264 - DNA, 22 bp, Artificial Sequence
  chemically synthesized
taaaaatggaattgtacagtat

SEQ ID NO: 689265 - DNA, 22 bp, Artificial Sequence
  chemically synthesized
tataaaaatggaattgtacagt

SEQ ID NO: 689266 - DNA, 22 bp, Artificial Sequence
  chemically synthesized
aactctataaaaatggaattgt

SEQ ID NO: 689267 - DNA, 22 bp, Artificial Sequence
  chemically synthesized
gaactctataaaaatggaattg

SEQ ID NO: 689268 - DNA, 22 bp, Artificial Sequence
  chemically synthesized
tatactgtacaattccattttt

SEQ ID NO: 689269 - DNA, 22 bp, Artificial Sequence
  chemically synthesized
tttgaactctataaaaatggaa

SEQ ID NO: 689270 - DNA, 22 bp, Artificial Sequence
  chemically synthesized
atttgaactctataaaaatgga

SEQ ID NO: 689271 - DNA, 22 bp, Artificial Sequence
  chemically synthesized
tttatttgaactctataaaaat

SEQ ID NO: 689272 - DNA, 22 bp, Artificial Sequence
  chemically synthesized
tacaattccatttttatagagt

SEQ ID NO: 689273 - DNA, 22 bp, Artificial Sequence
  chemically synthesized
cctgtttatttgaactctataa

SEQ ID NO: 689274 - DNA, 22 bp, Artificial Sequence
  chemically synthesized
gcctgtttatttgaactctata

SEQ ID NO: 689275 - DNA, 22 bp, Artificial Sequence
  chemically synthesized
tgcctgtttatttgaactctat

SEQ ID NO: 689276 - DNA, 22 bp, Artificial Sequence
  chemically synthesized
catttttatagagttcaaataa

SEQ ID NO: 689277 - DNA, 22 bp, Artificial Sequence
  chemically synthesized
agttttgcctgtttatttgaac

SEQ ID NO: 689278 - DNA, 22 bp, Artificial Sequence
  chemically synthesized
ttatagagttcaaataaacagg

SEQ ID NO: 689279 - DNA, 22 bp, Artificial Sequence
  chemically synthesized
tatagagttcaaataaacaggc

SEQ ID NO: 689280 - DNA, 22 bp, Artificial Sequence
  chemically synthesized
tggttgagttttgcctgtttat

SEQ ID NO: 689281 - DNA, 22 bp, Artificial Sequence
  chemically synthesized
atagagttcaaataaacaggca

SEQ ID NO: 689282 - DNA, 22 bp, Artificial Sequence
  chemically synthesized
tagagttcaaataaacaggcaa

SEQ ID NO: 689283 - DNA, 22 bp, Artificial Sequence
  chemically synthesized
taacactatggttgagttttgc

SEQ ID NO: 689284 - DNA, 22 bp, Artificial Sequence
  chemically synthesized
ataacactatggttgagttttg

SEQ ID NO: 689285 - DNA, 22 bp, Artificial Sequence
  chemically synthesized
aaataaacaggcaaaactcaac

SEQ ID NO: 689286 - DNA, 22 bp, Artificial Sequence
  chemically synthesized
ccttataacactatggttgagt

SEQ ID NO: 689287 - DNA, 22 bp, Artificial Sequence
  chemically synthesized
tgccttataacactatggttga

SEQ ID NO: 689288 - DNA, 22 bp, Artificial Sequence
  chemically synthesized
ctctgccttataacactatggt

SEQ ID NO: 689289 - DNA, 22 bp, Artificial Sequence
  chemically synthesized
ctactctgccttataacactat

SEQ ID NO: 689290 - DNA, 22 bp, Artificial Sequence
  chemically synthesized
aaccatagtgttataaggcaga

SEQ ID NO: 689291 - DNA, 22 bp, Artificial Sequence
  chemically synthesized
aaggtaactgctactctgcctt

SEQ ID NO: 689292 - DNA, 22 bp, Artificial Sequence
  chemically synthesized
aaaggtaactgctactctgcct

SEQ ID NO: 689293 - DNA, 22 bp, Artificial Sequence
  chemically synthesized
atcttaaaggtaactgctactc

SEQ ID NO: 689294 - DNA, 22 bp, Artificial Sequence
  chemically synthesized
cctcatcttaaaggtaactgct

SEQ ID NO: 689295 - DNA, 22 bp, Artificial Sequence
  chemically synthesized
taaggcagagtagcagttacct

SEQ ID NO: 689296 - DNA, 22 bp, Artificial Sequence
  chemically synthesized
ctccctcatcttaaaggtaact

SEQ ID NO: 689297 - DNA, 22 bp, Artificial Sequence
  chemically synthesized
ttcctccctcatcttaaaggta

SEQ ID NO: 689298 - DNA, 22 bp, Artificial Sequence
  chemically synthesized
ccaatcactattcctccctcat

SEQ ID NO: 689299 - DNA, 22 bp, Artificial Sequence
  chemically synthesized
tcccaatcactattcctccctc

SEQ ID NO: 689300 - DNA, 22 bp, Artificial Sequence
  chemically synthesized
cctttaagatgagggaggaata

SEQ ID NO: 689301 - DNA, 22 bp, Artificial Sequence
  chemically synthesized
cctctcccaatcactattcctc

SEQ ID NO: 689302 - DNA, 22 bp, Artificial Sequence
  chemically synthesized
taagatgagggaggaatagtga

SEQ ID NO: 689303 - DNA, 22 bp, Artificial Sequence
  chemically synthesized
aagatgagggaggaatagtgat

SEQ ID NO: 689304 - DNA, 22 bp, Artificial Sequence
  chemically synthesized
agatgagggaggaatagtgatt

SEQ ID NO: 689305 - DNA, 22 bp, Artificial Sequence
  chemically synthesized
acccacattccctctcccaatc

SEQ ID NO: 689306 - DNA, 22 bp, Artificial Sequence
  chemically synthesized
cctcacccacattccctctccc

SEQ ID NO: 689307 - DNA, 22 bp, Artificial Sequence
  chemically synthesized
ggagagggaatgtgggtgaggt

SEQ ID NO: 689308 - DNA, 22 bp, Artificial Sequence
  chemically synthesized
agaaatcaccaccctacctcac

SEQ ID NO: 689309 - DNA, 22 bp, Artificial Sequence
  chemically synthesized
cctcagaaatcaccaccctacc

SEQ ID NO: 689310 - DNA, 22 bp, Artificial Sequence
  chemically synthesized
aggagaaacatagaatataacc

SEQ ID NO: 689311 - DNA, 22 bp, Artificial Sequence
  chemically synthesized
gaggagaaacatagaatataac

SEQ ID NO: 689312 - DNA, 22 bp, Artificial Sequence
  chemically synthesized
ctgaggtagtggttatattcta

SEQ ID NO: 689313 - DNA, 22 bp, Artificial Sequence
  chemically synthesized
tgaggtagtggttatattctat

SEQ ID NO: 689314 - DNA, 22 bp, Artificial Sequence
  chemically synthesized
aggtagtggttatattctatgt

SEQ ID NO: 689315 - DNA, 22 bp, Artificial Sequence
  chemically synthesized
aaaatgaaaagcttgaggagaa

SEQ ID NO: 689316 - DNA, 22 bp, Artificial Sequence
  chemically synthesized
caaaatgaaaagcttgaggaga

SEQ ID NO: 689317 - DNA, 22 bp, Artificial Sequence
  chemically synthesized
tattctatgtttctcctcaagc

SEQ ID NO: 689318 - DNA, 22 bp, Artificial Sequence
  chemically synthesized
tcaaaatgaaaagcttgaggag

SEQ ID NO: 689319 - DNA, 22 bp, Artificial Sequence
  chemically synthesized
tatgtttctcctcaagcttttc

SEQ ID NO: 689320 - DNA, 22 bp, Artificial Sequence
  chemically synthesized
aaattttcaaaatgaaaagctt

SEQ ID NO: 689321 - DNA, 22 bp, Artificial Sequence
  chemically synthesized
tgtttctcctcaagcttttcat

SEQ ID NO: 689322 - DNA, 22 bp, Artificial Sequence
  chemically synthesized
aaaattttcaaaatgaaaagct

SEQ ID NO: 689323 - DNA, 22 bp, Artificial Sequence
  chemically synthesized
gtttaaaattttcaaaatgaaa

SEQ ID NO: 689324 - DNA, 22 bp, Artificial Sequence
  chemically synthesized
ctcctcaagcttttcattttga

SEQ ID NO: 689325 - DNA, 22 bp, Artificial Sequence
  chemically synthesized
tcctcaagcttttcattttgaa

SEQ ID NO: 689326 - DNA, 22 bp, Artificial Sequence
  chemically synthesized
ctcaagcttttcattttgaaaa

SEQ ID NO: 689327 - DNA, 22 bp, Artificial Sequence
  chemically synthesized
aattggtttaaaattttcaaaa

SEQ ID NO: 689328 - DNA, 22 bp, Artificial Sequence
  chemically synthesized
caattggtttaaaattttcaaa

SEQ ID NO: 689329 - DNA, 22 bp, Artificial Sequence
  chemically synthesized
aagcttttcattttgaaaattt

SEQ ID NO: 689330 - DNA, 22 bp, Artificial Sequence
  chemically synthesized
acatttcaattggtttaaaatt

SEQ ID NO: 689331 - DNA, 22 bp, Artificial Sequence
  chemically synthesized
ttcattttgaaaattttaaacc

SEQ ID NO: 689332 - DNA, 22 bp, Artificial Sequence
  chemically synthesized
aacatttcaattggtttaaaat

SEQ ID NO: 689333 - DNA, 22 bp, Artificial Sequence
  chemically synthesized
tcattttgaaaattttaaacca

SEQ ID NO: 689334 - DNA, 22 bp, Artificial Sequence
  chemically synthesized
taacatttcaattggtttaaaa

SEQ ID NO: 689335 - DNA, 22 bp, Artificial Sequence
  chemically synthesized
cattttgaaaattttaaaccaa

SEQ ID NO: 689336 - DNA, 22 bp, Artificial Sequence
  chemically synthesized
ttaacatttcaattggtttaaa

SEQ ID NO: 689337 - DNA, 22 bp, Artificial Sequence
  chemically synthesized
attttgaaaattttaaaccaat

SEQ ID NO: 689338 - DNA, 22 bp, Artificial Sequence
  chemically synthesized
ttttaacatttcaattggttta

SEQ ID NO: 689339 - DNA, 22 bp, Artificial Sequence
  chemically synthesized
tgaaaattttaaaccaattgaa

SEQ ID NO: 689340 - DNA, 22 bp, Artificial Sequence
  chemically synthesized
gaaaattttaaaccaattgaaa

SEQ ID NO: 689341 - DNA, 22 bp, Artificial Sequence
  chemically synthesized
aaaattttaaaccaattgaaat

SEQ ID NO: 689342 - DNA, 22 bp, Artificial Sequence
  chemically synthesized
tgggtgttcttttaacatttca

SEQ ID NO: 689343 - DNA, 22 bp, Artificial Sequence
  chemically synthesized
atgggtgttcttttaacatttc

SEQ ID NO: 689344 - DNA, 22 bp, Artificial Sequence
  chemically synthesized
taaaccaattgaaatgttaaaa

SEQ ID NO: 689345 - DNA, 22 bp, Artificial Sequence
  chemically synthesized
aaaccaattgaaatgttaaaag

SEQ ID NO: 689346 - DNA, 22 bp, Artificial Sequence
  chemically synthesized
aaccaattgaaatgttaaaaga

SEQ ID NO: 689347 - DNA, 22 bp, Artificial Sequence
  chemically synthesized
agtgaatggtttatgggtgttc

SEQ ID NO: 689348 - DNA, 22 bp, Artificial Sequence
  chemically synthesized
aaatgttaaaagaacacccata

SEQ ID NO: 689349 - DNA, 22 bp, Artificial Sequence
  chemically synthesized
aaagaacacccataaaccattc

SEQ ID NO: 689350 - DNA, 22 bp, Artificial Sequence
  chemically synthesized
gggagtctaagtgaatggttta

SEQ ID NO: 689351 - DNA, 22 bp, Artificial Sequence
  chemically synthesized
acagttggggagtctaagtgaa

SEQ ID NO: 689352 - DNA, 22 bp, Artificial Sequence
  chemically synthesized
tgttaacagttggggagtctaa

SEQ ID NO: 689353 - DNA, 22 bp, Artificial Sequence
  chemically synthesized
acttagactccccaactgttaa

SEQ ID NO: 689354 - DNA, 22 bp, Artificial Sequence
  chemically synthesized
agactccccaactgttaacata

SEQ ID NO: 689355 - DNA, 22 bp, Artificial Sequence
  chemically synthesized
gactccccaactgttaacataa

SEQ ID NO: 689356 - DNA, 22 bp, Artificial Sequence
  chemically synthesized
cccaactgttaacataatattc

SEQ ID NO: 689357 - DNA, 22 bp, Artificial Sequence
  chemically synthesized
ttaacataatattcgctttctc

SEQ ID NO: 689358 - DNA, 22 bp, Artificial Sequence
  chemically synthesized
acataatattcgctttctctct

SEQ ID NO: 689359 - DNA, 22 bp, Artificial Sequence
  chemically synthesized
ggggagtggtgagagagagaga

SEQ ID NO: 689360 - DNA, 22 bp, Artificial Sequence
  chemically synthesized
gctttctctctctctctctcac

SEQ ID NO: 689361 - DNA, 22 bp, Artificial Sequence
  chemically synthesized
tctctctctctctctcaccact

SEQ ID NO: 689362 - DNA, 22 bp, Artificial Sequence
  chemically synthesized
ctctctctctctctcaccactc

SEQ ID NO: 689363 - DNA, 22 bp, Artificial Sequence
  chemically synthesized
tctctctctctctcaccactcc

SEQ ID NO: 689364 - DNA, 22 bp, Artificial Sequence
  chemically synthesized
tctctctctctcaccactcccc

SEQ ID NO: 689365 - DNA, 22 bp, Artificial Sequence
  chemically synthesized
tctctctctcaccactccccca

SEQ ID NO: 689366 - DNA, 22 bp, Artificial Sequence
  chemically synthesized
tctctctcaccactcccccaac

SEQ ID NO: 689367 - DNA, 22 bp, Artificial Sequence
  chemically synthesized
tctctcaccactcccccaaccc

SEQ ID NO: 689368 - DNA, 22 bp, Artificial Sequence
  chemically synthesized
tctcaccactcccccaacccgg

SEQ ID NO: 689369 - DNA, 22 bp, Artificial Sequence
  chemically synthesized
tcaccactcccccaacccggtg

SEQ ID NO: 689370 - DNA, 22 bp, Artificial Sequence
  chemically synthesized
accactcccccaacccggtgtg

SEQ ID NO: 689371 - DNA, 22 bp, Artificial Sequence
  chemically synthesized
ccccaacccggtgtgtgtgtgt

SEQ ID NO: 689372 - DNA, 22 bp, Artificial Sequence
  chemically synthesized
cacacacacacacacacacaca

SEQ ID NO: 689373 - DNA, 22 bp, Artificial Sequence
  chemically synthesized
aaccagactacacacacacaca

SEQ ID NO: 689374 - DNA, 22 bp, Artificial Sequence
  chemically synthesized
gtttagtgtgtgtgtgtgtgtg

SEQ ID NO: 689375 - DNA, 22 bp, Artificial Sequence
  chemically synthesized
agtgtgtgtgtgtgtgtgtgtg

SEQ ID NO: 689376 - DNA, 22 bp, Artificial Sequence
  chemically synthesized
gtgtgtgtgtgtgtgtgtgtgt

SEQ ID NO: 689377 - DNA, 22 bp, Artificial Sequence
  chemically synthesized
cacacacacacacacacacaca

SEQ ID NO: 689378 - DNA, 22 bp, Artificial Sequence
  chemically synthesized
aaccagattacacacacacaca

SEQ ID NO: 689379 - DNA, 22 bp, Artificial Sequence
  chemically synthesized
tcagtagccctaaaccagatta

SEQ ID NO: 689380 - DNA, 22 bp, Artificial Sequence
  chemically synthesized
gtttagggctactgataatgtt

SEQ ID NO: 689381 - DNA, 22 bp, Artificial Sequence
  chemically synthesized
ggacagtaaataaaacattatc

SEQ ID NO: 689382 - DNA, 22 bp, Artificial Sequence
  chemically synthesized
agggctactgataatgttttat

SEQ ID NO: 689383 - DNA, 22 bp, Artificial Sequence
  chemically synthesized
gggctactgataatgttttatt

SEQ ID NO: 689384 - DNA, 22 bp, Artificial Sequence
  chemically synthesized
gccatctaggacagtaaataaa

SEQ ID NO: 689385 - DNA, 22 bp, Artificial Sequence
  chemically synthesized
ctgataatgttttatttactgt

SEQ ID NO: 689386 - DNA, 22 bp, Artificial Sequence
  chemically synthesized
ataatgttttatttactgtcct

SEQ ID NO: 689387 - DNA, 22 bp, Artificial Sequence
  chemically synthesized
tgttcgccatctaggacagtaa

SEQ ID NO: 689388 - DNA, 22 bp, Artificial Sequence
  chemically synthesized
tatttactgtcctagatggcga

SEQ ID NO: 689389 - DNA, 22 bp, Artificial Sequence
  chemically synthesized
atttactgtcctagatggcgaa

SEQ ID NO: 689390 - DNA, 22 bp, Artificial Sequence
  chemically synthesized
tttactgtcctagatggcgaac

SEQ ID NO: 689391 - DNA, 22 bp, Artificial Sequence
  chemically synthesized
actgtcctagatggcgaacata

SEQ ID NO: 689392 - DNA, 22 bp, Artificial Sequence
  chemically synthesized
ctgtcctagatggcgaacatag

SEQ ID NO: 689393 - DNA, 22 bp, Artificial Sequence
  chemically synthesized
tcctagatggcgaacataggtg

SEQ ID NO: 689394 - DNA, 22 bp, Artificial Sequence
  chemically synthesized
tcacaaaatgaatacacctatg

SEQ ID NO: 689395 - DNA, 22 bp, Artificial Sequence
  chemically synthesized
gatggcgaacataggtgtattc

SEQ ID NO: 689396 - DNA, 22 bp, Artificial Sequence
  chemically synthesized
aatgcaattatcacaaaatgaa

SEQ ID NO: 689397 - DNA, 22 bp, Artificial Sequence
  chemically synthesized
agctcaatgcaattatcacaaa

SEQ ID NO: 689398 - DNA, 22 bp, Artificial Sequence
  chemically synthesized
attttgtgataattgcattgag

SEQ ID NO: 689399 - DNA, 22 bp, Artificial Sequence
  chemically synthesized
tgtgataattgcattgagctga

SEQ ID NO: 689400 - DNA, 22 bp, Artificial Sequence
  chemically synthesized
gtgataattgcattgagctgaa

SEQ ID NO: 689401 - DNA, 22 bp, Artificial Sequence
  chemically synthesized
tgataattgcattgagctgaac

SEQ ID NO: 689402 - DNA, 22 bp, Artificial Sequence
  chemically synthesized
cattgagctgaacatgtttcat

SEQ ID NO: 689403 - DNA, 22 bp, Artificial Sequence
  chemically synthesized
agaaagtatacagatgaaacat

SEQ ID NO: 689404 - DNA, 22 bp, Artificial Sequence
  chemically synthesized
agctgaacatgtttcatctgta

SEQ ID NO: 689405 - DNA, 22 bp, Artificial Sequence
  chemically synthesized
aacatgtttcatctgtatactt

SEQ ID NO: 689406 - DNA, 22 bp, Artificial Sequence
  chemically synthesized
aagaatgacccacattcagaaa

SEQ ID NO: 689407 - DNA, 22 bp, Artificial Sequence
  chemically synthesized
catctgtatactttctgaatgt

SEQ ID NO: 689408 - DNA, 22 bp, Artificial Sequence
  chemically synthesized
gaagaatgacccacattcagaa

SEQ ID NO: 689409 - DNA, 22 bp, Artificial Sequence
  chemically synthesized
atctgtatactttctgaatgtg

SEQ ID NO: 689410 - DNA, 22 bp, Artificial Sequence
  chemically synthesized
cttgaagaatgacccacattca

SEQ ID NO: 689411 - DNA, 22 bp, Artificial Sequence
  chemically synthesized
gcttgaagaatgacccacattc

SEQ ID NO: 689412 - DNA, 22 bp, Artificial Sequence
  chemically synthesized
tgcttgaagaatgacccacatt

SEQ ID NO: 689413 - DNA, 22 bp, Artificial Sequence
  chemically synthesized
tatactttctgaatgtgggtca

SEQ ID NO: 689414 - DNA, 22 bp, Artificial Sequence
  chemically synthesized
ttgcttgaagaatgacccacat

SEQ ID NO: 689415 - DNA, 22 bp, Artificial Sequence
  chemically synthesized
tttgcttgaagaatgacccaca

SEQ ID NO: 689416 - DNA, 22 bp, Artificial Sequence
  chemically synthesized
ttttgcttgaagaatgacccac

SEQ ID NO: 689417 - DNA, 22 bp, Artificial Sequence
  chemically synthesized
tttttgcttgaagaatgaccca

SEQ ID NO: 689418 - DNA, 22 bp, Artificial Sequence
  chemically synthesized
ttttttgcttgaagaatgaccc

SEQ ID NO: 689419 - DNA, 22 bp, Artificial Sequence
  chemically synthesized
ttttttttgcttgaagaatgac

SEQ ID NO: 689420 - DNA, 22 bp, Artificial Sequence
  chemically synthesized
tctgaatgtgggtcattcttca

SEQ ID NO: 689421 - DNA, 22 bp, Artificial Sequence
  chemically synthesized
ctgaatgtgggtcattcttcaa

SEQ ID NO: 689422 - DNA, 22 bp, Artificial Sequence
  chemically synthesized
tgaatgtgggtcattcttcaag

SEQ ID NO: 689423 - DNA, 22 bp, Artificial Sequence
  chemically synthesized
aatgtgggtcattcttcaagca

SEQ ID NO: 689424 - DNA, 22 bp, Artificial Sequence
  chemically synthesized
aatctcttttttttgcttgaag

SEQ ID NO: 689425 - DNA, 22 bp, Artificial Sequence
  chemically synthesized
attgaatctcttttttttgctt

SEQ ID NO: 689426 - DNA, 22 bp, Artificial Sequence
  chemically synthesized
ttcaagcaaaaaaaagagattc

SEQ ID NO: 689427 - DNA, 22 bp, Artificial Sequence
  chemically synthesized
caagcaaaaaaaagagattcaa

SEQ ID NO: 689428 - DNA, 22 bp, Artificial Sequence
  chemically synthesized
aagcaaaaaaaagagattcaat

SEQ ID NO: 689429 - DNA, 22 bp, Artificial Sequence
  chemically synthesized
aaaaaataagttgattgaatct

SEQ ID NO: 689430 - DNA, 22 bp, Artificial Sequence
  chemically synthesized
caaaaaataagttgattgaatc

SEQ ID NO: 689431 - DNA, 22 bp, Artificial Sequence
  chemically synthesized
tcaaaaaataagttgattgaat

SEQ ID NO: 689432 - DNA, 22 bp, Artificial Sequence
  chemically synthesized
gagggcgttttcaaaaaataag

SEQ ID NO: 689433 - DNA, 22 bp, Artificial Sequence
  chemically synthesized
cgagggcgttttcaaaaaataa

SEQ ID NO: 689434 - DNA, 22 bp, Artificial Sequence
  chemically synthesized
tcgagggcgttttcaaaaaata

SEQ ID NO: 689435 - DNA, 22 bp, Artificial Sequence
  chemically synthesized
ttttcgagggcgttttcaaaaa

SEQ ID NO: 689436 - DNA, 22 bp, Artificial Sequence
  chemically synthesized
aatcaacttattttttgaaaac

SEQ ID NO: 689437 - DNA, 22 bp, Artificial Sequence
  chemically synthesized
aatgcattgttttcgagggcgt

SEQ ID NO: 689438 - DNA, 22 bp, Artificial Sequence
  chemically synthesized
attttttgaaaacgccctcgaa

SEQ ID NO: 689439 - DNA, 22 bp, Artificial Sequence
  chemically synthesized
ttttttgaaaacgccctcgaaa

SEQ ID NO: 689440 - DNA, 22 bp, Artificial Sequence
  chemically synthesized
tttgaaaacgccctcgaaaaca

SEQ ID NO: 689441 - DNA, 22 bp, Artificial Sequence
  chemically synthesized
tattgaatgcattgttttcgag

SEQ ID NO: 689442 - DNA, 22 bp, Artificial Sequence
  chemically synthesized
ttgaaaacgccctcgaaaacaa

SEQ ID NO: 689443 - DNA, 22 bp, Artificial Sequence
  chemically synthesized
tgaaaacgccctcgaaaacaat

SEQ ID NO: 689444 - DNA, 22 bp, Artificial Sequence
  chemically synthesized
gaaaacgccctcgaaaacaatg

SEQ ID NO: 689445 - DNA, 22 bp, Artificial Sequence
  chemically synthesized
aaaacgccctcgaaaacaatgc

SEQ ID NO: 689446 - DNA, 22 bp, Artificial Sequence
  chemically synthesized
agtaatgtgttgtattgaatgc

SEQ ID NO: 689447 - DNA, 22 bp, Artificial Sequence
  chemically synthesized
cagtaatgtgttgtattgaatg

SEQ ID NO: 689448 - DNA, 22 bp, Artificial Sequence
  chemically synthesized
gaaaacaatgcattcaatacaa

SEQ ID NO: 689449 - DNA, 22 bp, Artificial Sequence
  chemically synthesized
cccatagtatttcagtaatgtg

SEQ ID NO: 689450 - DNA, 22 bp, Artificial Sequence
  chemically synthesized
aatacaacacattactgaaata

SEQ ID NO: 689451 - DNA, 22 bp, Artificial Sequence
  chemically synthesized
ctgaaatactatgggtaatgat

SEQ ID NO: 689452 - DNA, 22 bp, Artificial Sequence
  chemically synthesized
aaatactatgggtaatgatttt

SEQ ID NO: 689453 - DNA, 22 bp, Artificial Sequence
  chemically synthesized
aacagcaacaacaaaaaatcat

SEQ ID NO: 689454 - DNA, 22 bp, Artificial Sequence
  chemically synthesized
tctaaacagcaacaacaaaaaa

SEQ ID NO: 689455 - DNA, 22 bp, Artificial Sequence
  chemically synthesized
tgggtaatgattttttgttgtt

SEQ ID NO: 689456 - DNA, 22 bp, Artificial Sequence
  chemically synthesized
acgctgtctaaacagcaacaac

SEQ ID NO: 689457 - DNA, 22 bp, Artificial Sequence
  chemically synthesized
cctaacgctgtctaaacagcaa

SEQ ID NO: 689458 - DNA, 22 bp, Artificial Sequence
  chemically synthesized
ccctaacgctgtctaaacagca

SEQ ID NO: 689459 - DNA, 22 bp, Artificial Sequence
  chemically synthesized
tccctaacgctgtctaaacagc

SEQ ID NO: 689460 - DNA, 22 bp, Artificial Sequence
  chemically synthesized
ttccctaacgctgtctaaacag

SEQ ID NO: 689461 - DNA, 22 bp, Artificial Sequence
  chemically synthesized
tttgttgttgctgtttagacag

SEQ ID NO: 689462 - DNA, 22 bp, Artificial Sequence
  chemically synthesized
ttgttgttgctgtttagacagc

SEQ ID NO: 689463 - DNA, 22 bp, Artificial Sequence
  chemically synthesized
tgttgttgctgtttagacagcg

SEQ ID NO: 689464 - DNA, 22 bp, Artificial Sequence
  chemically synthesized
gttgttgctgtttagacagcgt

SEQ ID NO: 689465 - DNA, 22 bp, Artificial Sequence
  chemically synthesized
ttgttgctgtttagacagcgtt

SEQ ID NO: 689466 - DNA, 22 bp, Artificial Sequence
  chemically synthesized
ttgctgtttagacagcgttagg

SEQ ID NO: 689467 - DNA, 22 bp, Artificial Sequence
  chemically synthesized
ctgtttagacagcgttagggaa

SEQ ID NO: 689468 - DNA, 22 bp, Artificial Sequence
  chemically synthesized
tttagacagcgttagggaaaaa

SEQ ID NO: 689469 - DNA, 22 bp, Artificial Sequence
  chemically synthesized
agacagcgttagggaaaaacta

SEQ ID NO: 689470 - DNA, 22 bp, Artificial Sequence
  chemically synthesized
gacagcgttagggaaaaactac

SEQ ID NO: 689471 - DNA, 22 bp, Artificial Sequence
  chemically synthesized
gggaaaaactacaccatatttt

SEQ ID NO: 689472 - DNA, 22 bp, Artificial Sequence
  chemically synthesized
aataaatagatcagaaaatatg

SEQ ID NO: 689473 - DNA, 22 bp, Artificial Sequence
  chemically synthesized
ttcaataaatagatcagaaaat

SEQ ID NO: 689474 - DNA, 22 bp, Artificial Sequence
  chemically synthesized
gttcaataaatagatcagaaaa

SEQ ID NO: 689475 - DNA, 22 bp, Artificial Sequence
  chemically synthesized
caccatattttctgatctattt

SEQ ID NO: 689476 - DNA, 22 bp, Artificial Sequence
  chemically synthesized
aggtatccttgttcaataaata

SEQ ID NO: 689477 - DNA, 22 bp, Artificial Sequence
  chemically synthesized
tctgatctatttattgaacaag

SEQ ID NO: 689478 - DNA, 22 bp, Artificial Sequence
  chemically synthesized
ctgatctatttattgaacaagg

SEQ ID NO: 689479 - DNA, 22 bp, Artificial Sequence
  chemically synthesized
tgatctatttattgaacaagga

SEQ ID NO: 689480 - DNA, 22 bp, Artificial Sequence
  chemically synthesized
ccacattgaggtatccttgttc

SEQ ID NO: 689481 - DNA, 22 bp, Artificial Sequence
  chemically synthesized
atctatttattgaacaaggata

SEQ ID NO: 689482 - DNA, 22 bp, Artificial Sequence
  chemically synthesized
actgccacattgaggtatcctt

SEQ ID NO: 689483 - DNA, 22 bp, Artificial Sequence
  chemically synthesized
tttattgaacaaggatacctca

SEQ ID NO: 689484 - DNA, 22 bp, Artificial Sequence
  chemically synthesized
attgaacaaggatacctcaatg

SEQ ID NO: 689485 - DNA, 22 bp, Artificial Sequence
  chemically synthesized
ttgaacaaggatacctcaatgt

SEQ ID NO: 689486 - DNA, 22 bp, Artificial Sequence
  chemically synthesized
aacaaggatacctcaatgtggc

SEQ ID NO: 689487 - DNA, 22 bp, Artificial Sequence
  chemically synthesized
acccaagcctcactgccacatt

SEQ ID NO: 689488 - DNA, 22 bp, Artificial Sequence
  chemically synthesized
aacccaagcctcactgccacat

SEQ ID NO: 689489 - DNA, 22 bp, Artificial Sequence
  chemically synthesized
taacccaagcctcactgccaca

SEQ ID NO: 689490 - DNA, 22 bp, Artificial Sequence
  chemically synthesized
aatgtggcagtgaggcttgggt

SEQ ID NO: 689491 - DNA, 22 bp, Artificial Sequence
  chemically synthesized
tgacataacaattttaacccaa

SEQ ID NO: 689492 - DNA, 22 bp, Artificial Sequence
  chemically synthesized
gggttaaaattgttatgtcaca

SEQ ID NO: 689493 - DNA, 22 bp, Artificial Sequence
  chemically synthesized
ggttaaaattgttatgtcacag

SEQ ID NO: 689494 - DNA, 22 bp, Artificial Sequence
  chemically synthesized
aaattgttatgtcacagcctca

SEQ ID NO: 689495 - DNA, 22 bp, Artificial Sequence
  chemically synthesized
ttatgtcacagcctcacctgct

SEQ ID NO: 689496 - DNA, 22 bp, Artificial Sequence
  chemically synthesized
cggaaaacaaccagcaggtgag

SEQ ID NO: 689497 - DNA, 22 bp, Artificial Sequence
  chemically synthesized
tgtcacagcctcacctgctggt

SEQ ID NO: 689498 - DNA, 22 bp, Artificial Sequence
  chemically synthesized
acctgctggttgttttccgtag

SEQ ID NO: 689499 - DNA, 22 bp, Artificial Sequence
  chemically synthesized
ctggttgttttccgtagccata

SEQ ID NO: 689500 - DNA, 22 bp, Artificial Sequence
  chemically synthesized
gttgttttccgtagccatactc

SEQ ID NO: 689501 - DNA, 22 bp, Artificial Sequence
  chemically synthesized
ttttccgtagccatactctaca

SEQ ID NO: 689502 - DNA, 22 bp, Artificial Sequence
  chemically synthesized
tccgtagccatactctacactt

SEQ ID NO: 689503 - DNA, 22 bp, Artificial Sequence
  chemically synthesized
ccgtagccatactctacacttg

SEQ ID NO: 689504 - DNA, 22 bp, Artificial Sequence
  chemically synthesized
cgtagccatactctacacttgc

SEQ ID NO: 689505 - DNA, 22 bp, Artificial Sequence
  chemically synthesized
catataatacagaagcaagtgt

SEQ ID NO: 689506 - DNA, 22 bp, Artificial Sequence
  chemically synthesized
tctccatataatacagaagcaa

SEQ ID NO: 689507 - DNA, 22 bp, Artificial Sequence
  chemically synthesized
atctccatataatacagaagca

SEQ ID NO: 689508 - DNA, 22 bp, Artificial Sequence
  chemically synthesized
ttatctccatataatacagaag

SEQ ID NO: 689509 - DNA, 22 bp, Artificial Sequence
  chemically synthesized
cttatctccatataatacagaa

SEQ ID NO: 689510 - DNA, 22 bp, Artificial Sequence
  chemically synthesized
tacacttgcttctgtattatat

SEQ ID NO: 689511 - DNA, 22 bp, Artificial Sequence
  chemically synthesized
cacttgcttctgtattatatgg

SEQ ID NO: 689512 - DNA, 22 bp, Artificial Sequence
  chemically synthesized
gcttctgtattatatggagata

SEQ ID NO: 689513 - DNA, 22 bp, Artificial Sequence
  chemically synthesized
cttctgtattatatggagataa

SEQ ID NO: 689514 - DNA, 22 bp, Artificial Sequence
  chemically synthesized
ctgtattatatggagataagaa

SEQ ID NO: 689515 - DNA, 22 bp, Artificial Sequence
  chemically synthesized
tgtattatatggagataagaaa

SEQ ID NO: 689516 - DNA, 22 bp, Artificial Sequence
  chemically synthesized
tattatatggagataagaaatc

SEQ ID NO: 689517 - DNA, 22 bp, Artificial Sequence
  chemically synthesized
tatggagataagaaatctcccc

SEQ ID NO: 689518 - DNA, 22 bp, Artificial Sequence
  chemically synthesized
aaagcagcaagtatggggagat

SEQ ID NO: 689519 - DNA, 22 bp, Artificial Sequence
  chemically synthesized
aaaagcagcaagtatggggaga

SEQ ID NO: 689520 - DNA, 22 bp, Artificial Sequence
  chemically synthesized
taaaagcagcaagtatggggag

SEQ ID NO: 689521 - DNA, 22 bp, Artificial Sequence
  chemically synthesized
aaaacattttaaaagcagcaag

SEQ ID NO: 689522 - DNA, 22 bp, Artificial Sequence
  chemically synthesized
aaaaacattttaaaagcagcaa

SEQ ID NO: 689523 - DNA, 22 bp, Artificial Sequence
  chemically synthesized
tcttaaaaacattttaaaagca

SEQ ID NO: 689524 - DNA, 22 bp, Artificial Sequence
  chemically synthesized
cccatacttgctgcttttaaaa

SEQ ID NO: 689525 - DNA, 22 bp, Artificial Sequence
  chemically synthesized
gtcttaaaaacattttaaaagc

SEQ ID NO: 689526 - DNA, 22 bp, Artificial Sequence
  chemically synthesized
gctgcttttaaaatgtttttaa

SEQ ID NO: 689527 - DNA, 22 bp, Artificial Sequence
  chemically synthesized
aacaaccttgtcttaaaaacat

SEQ ID NO: 689528 - DNA, 22 bp, Artificial Sequence
  chemically synthesized
ctgcttttaaaatgtttttaag

SEQ ID NO: 689529 - DNA, 22 bp, Artificial Sequence
  chemically synthesized
cttttaaaatgtttttaagaca

SEQ ID NO: 689530 - DNA, 22 bp, Artificial Sequence
  chemically synthesized
ttaaaatgtttttaagacaagg

SEQ ID NO: 689531 - DNA, 22 bp, Artificial Sequence
  chemically synthesized
tgccctgaacaaccttgtctta

SEQ ID NO: 689532 - DNA, 22 bp, Artificial Sequence
  chemically synthesized
taaaatgtttttaagacaaggt

SEQ ID NO: 689533 - DNA, 22 bp, Artificial Sequence
  chemically synthesized
aaaatgtttttaagacaaggtt

SEQ ID NO: 689534 - DNA, 22 bp, Artificial Sequence
  chemically synthesized
tgtgccctgaacaaccttgtct

SEQ ID NO: 689535 - DNA, 22 bp, Artificial Sequence
  chemically synthesized
aaatgtttttaagacaaggttg

SEQ ID NO: 689536 - DNA, 22 bp, Artificial Sequence
  chemically synthesized
attctgtgccctgaacaacctt

SEQ ID NO: 689537 - DNA, 22 bp, Artificial Sequence
  chemically synthesized
ttaagacaaggttgttcagggc

SEQ ID NO: 689538 - DNA, 22 bp, Artificial Sequence
  chemically synthesized
taagacaaggttgttcagggca

SEQ ID NO: 689539 - DNA, 22 bp, Artificial Sequence
  chemically synthesized
tgtctcattctgtgccctgaac

SEQ ID NO: 689540 - DNA, 22 bp, Artificial Sequence
  chemically synthesized
aagacaaggttgttcagggcac

SEQ ID NO: 689541 - DNA, 22 bp, Artificial Sequence
  chemically synthesized
agacaaggttgttcagggcaca

SEQ ID NO: 689542 - DNA, 22 bp, Artificial Sequence
  chemically synthesized
tgtgtctcattctgtgccctga

SEQ ID NO: 689543 - DNA, 22 bp, Artificial Sequence
  chemically synthesized
ttcagggcacagaatgagacac

SEQ ID NO: 689544 - DNA, 22 bp, Artificial Sequence
  chemically synthesized
agggcacagaatgagacacaga

SEQ ID NO: 689545 - DNA, 22 bp, Artificial Sequence
  chemically synthesized
gcagtaacccccatagccccgc

SEQ ID NO: 689546 - DNA, 22 bp, Artificial Sequence
  chemically synthesized
cactggcagtaacccccatagc

SEQ ID NO: 689547 - DNA, 22 bp, Artificial Sequence
  chemically synthesized
ccctgcactggcagtaaccccc

SEQ ID NO: 689548 - DNA, 22 bp, Artificial Sequence
  chemically synthesized
atatctaccctgcactggcagt

SEQ ID NO: 689549 - DNA, 22 bp, Artificial Sequence
  chemically synthesized
aatatctaccctgcactggcag

SEQ ID NO: 689550 - DNA, 22 bp, Artificial Sequence
  chemically synthesized
tgggggttactgccagtgcagg

SEQ ID NO: 689551 - DNA, 22 bp, Artificial Sequence
  chemically synthesized
ctgccagtgcagggtagatatt

SEQ ID NO: 689552 - DNA, 22 bp, Artificial Sequence
  chemically synthesized
ataggacaatttaatatctacc

SEQ ID NO: 689553 - DNA, 22 bp, Artificial Sequence
  chemically synthesized
ccagtgcagggtagatattaaa

SEQ ID NO: 689554 - DNA, 22 bp, Artificial Sequence
  chemically synthesized
actgataggacaatttaatatc

SEQ ID NO: 689555 - DNA, 22 bp, Artificial Sequence
  chemically synthesized
gtcgattaactgataggacaat

SEQ ID NO: 689556 - DNA, 22 bp, Artificial Sequence
  chemically synthesized
agtcgattaactgataggacaa

SEQ ID NO: 689557 - DNA, 22 bp, Artificial Sequence
  chemically synthesized
cttagtcgattaactgatagga

SEQ ID NO: 689558 - DNA, 22 bp, Artificial Sequence
  chemically synthesized
acttagtcgattaactgatagg

SEQ ID NO: 689559 - DNA, 22 bp, Artificial Sequence
  chemically synthesized
tacttagtcgattaactgatag

SEQ ID NO: 689560 - DNA, 22 bp, Artificial Sequence
  chemically synthesized
aattgtcctatcagttaatcga

SEQ ID NO: 689561 - DNA, 22 bp, Artificial Sequence
  chemically synthesized
tgttttacttagtcgattaact

SEQ ID NO: 689562 - DNA, 22 bp, Artificial Sequence
  chemically synthesized
tcctatcagttaatcgactaag

SEQ ID NO: 689563 - DNA, 22 bp, Artificial Sequence
  chemically synthesized
tcagttaatcgactaagtaaaa

SEQ ID NO: 689564 - DNA, 22 bp, Artificial Sequence
  chemically synthesized
atcgactaagtaaaacacagtt

SEQ ID NO: 689565 - DNA, 22 bp, Artificial Sequence
  chemically synthesized
gcagggggagtcagaactgtgt

SEQ ID NO: 689566 - DNA, 22 bp, Artificial Sequence
  chemically synthesized
ggcagggggagtcagaactgtg

SEQ ID NO: 689567 - DNA, 22 bp, Artificial Sequence
  chemically synthesized
tttggcagggggagtcagaact

SEQ ID NO: 689568 - DNA, 22 bp, Artificial Sequence
  chemically synthesized
gtttggcagggggagtcagaac

SEQ ID NO: 689569 - DNA, 22 bp, Artificial Sequence
  chemically synthesized
agtaaaacacagttctgactcc

SEQ ID NO: 689570 - DNA, 22 bp, Artificial Sequence
  chemically synthesized
accatttgtttggcagggggag

SEQ ID NO: 689571 - DNA, 22 bp, Artificial Sequence
  chemically synthesized
aaccatttgtttggcaggggga

SEQ ID NO: 689572 - DNA, 22 bp, Artificial Sequence
  chemically synthesized
gtttaaccatttgtttggcagg

SEQ ID NO: 689573 - DNA, 22 bp, Artificial Sequence
  chemically synthesized
ctcgtttaaccatttgtttggc

SEQ ID NO: 689574 - DNA, 22 bp, Artificial Sequence
  chemically synthesized
tgactccccctgccaaacaaat

SEQ ID NO: 689575 - DNA, 22 bp, Artificial Sequence
  chemically synthesized
gctcgtttaaccatttgtttgg

SEQ ID NO: 689576 - DNA, 22 bp, Artificial Sequence
  chemically synthesized
actccccctgccaaacaaatgg

SEQ ID NO: 689577 - DNA, 22 bp, Artificial Sequence
  chemically synthesized
gcttgctcgtttaaccatttgt

SEQ ID NO: 689578 - DNA, 22 bp, Artificial Sequence
  chemically synthesized
agcttgctcgtttaaccatttg

SEQ ID NO: 689579 - DNA, 22 bp, Artificial Sequence
  chemically synthesized
cccctgccaaacaaatggttaa

SEQ ID NO: 689580 - DNA, 22 bp, Artificial Sequence
  chemically synthesized
tagcttgctcgtttaaccattt

SEQ ID NO: 689581 - DNA, 22 bp, Artificial Sequence
  chemically synthesized
tttagcttgctcgtttaaccat

SEQ ID NO: 689582 - DNA, 22 bp, Artificial Sequence
  chemically synthesized
ctttagcttgctcgtttaacca

SEQ ID NO: 689583 - DNA, 22 bp, Artificial Sequence
  chemically synthesized
tctttagcttgctcgtttaacc

SEQ ID NO: 689584 - DNA, 22 bp, Artificial Sequence
  chemically synthesized
ccaaacaaatggttaaacgagc

SEQ ID NO: 689585 - DNA, 22 bp, Artificial Sequence
  chemically synthesized
tgtcctttctttagcttgctcg

SEQ ID NO: 689586 - DNA, 22 bp, Artificial Sequence
  chemically synthesized
ttatgtcctttctttagcttgc

SEQ ID NO: 689587 - DNA, 22 bp, Artificial Sequence
  chemically synthesized
gcctattatgtcctttctttag

SEQ ID NO: 689588 - DNA, 22 bp, Artificial Sequence
  chemically synthesized
aacgagcaagctaaagaaagga

SEQ ID NO: 689589 - DNA, 22 bp, Artificial Sequence
  chemically synthesized
aagaaaggacataataggccag

SEQ ID NO: 689590 - DNA, 22 bp, Artificial Sequence
  chemically synthesized
caggcgtgagccaccacacctg

SEQ ID NO: 689591 - DNA, 22 bp, Artificial Sequence
  chemically synthesized
ggattacaggcgtgagccacca

SEQ ID NO: 689592 - DNA, 22 bp, Artificial Sequence
  chemically synthesized
gcatcccaaagtgctgggatta

SEQ ID NO: 689593 - DNA, 22 bp, Artificial Sequence
  chemically synthesized
ggcatcccaaagtgctgggatt

SEQ ID NO: 689594 - DNA, 22 bp, Artificial Sequence
  chemically synthesized
acgcctgtaatcccagcacttt

SEQ ID NO: 689595 - DNA, 22 bp, Artificial Sequence
  chemically synthesized
ccttggcatcccaaagtgctgg

SEQ ID NO: 689596 - DNA, 22 bp, Artificial Sequence
  chemically synthesized
ctgccttggcatcccaaagtgc

SEQ ID NO: 689597 - DNA, 22 bp, Artificial Sequence
  chemically synthesized
taatcccagcactttgggatgc

SEQ ID NO: 689598 - DNA, 22 bp, Artificial Sequence
  chemically synthesized
aagcgatcctcctgccttggca

SEQ ID NO: 689599 - DNA, 22 bp, Artificial Sequence
  chemically synthesized
gctcaagcgatcctcctgcctt

SEQ ID NO: 689600 - DNA, 22 bp, Artificial Sequence
  chemically synthesized
ggctcaagcgatcctcctgcct

SEQ ID NO: 689601 - DNA, 22 bp, Artificial Sequence
  chemically synthesized
tgggatgccaaggcaggaggat

SEQ ID NO: 689602 - DNA, 22 bp, Artificial Sequence
  chemically synthesized
gggatgccaaggcaggaggatc

SEQ ID NO: 689603 - DNA, 22 bp, Artificial Sequence
  chemically synthesized
cttggctcaagcgatcctcctg

SEQ ID NO: 689604 - DNA, 22 bp, Artificial Sequence
  chemically synthesized
ggatgccaaggcaggaggatcg

SEQ ID NO: 689605 - DNA, 22 bp, Artificial Sequence
  chemically synthesized
gaactccttggctcaagcgatc

SEQ ID NO: 689606 - DNA, 22 bp, Artificial Sequence
  chemically synthesized
acctcgaactccttggctcaag

SEQ ID NO: 689607 - DNA, 22 bp, Artificial Sequence
  chemically synthesized
cccaggctgacctcgaactcct

SEQ ID NO: 689608 - DNA, 22 bp, Artificial Sequence
  chemically synthesized
gagccaaggagttcgaggtcag

SEQ ID NO: 689609 - DNA, 22 bp, Artificial Sequence
  chemically synthesized
agccaaggagttcgaggtcagc

SEQ ID NO: 689610 - DNA, 22 bp, Artificial Sequence
  chemically synthesized
accatgttgcccaggctgacct

SEQ ID NO: 689611 - DNA, 22 bp, Artificial Sequence
  chemically synthesized
gaggtcagcctgggcaacatgg

SEQ ID NO: 689612 - DNA, 22 bp, Artificial Sequence
  chemically synthesized
ggcaacatggtgagactacccc

SEQ ID NO: 689613 - DNA, 22 bp, Artificial Sequence
  chemically synthesized
gtagagatggcagcagggggta

SEQ ID NO: 689614 - DNA, 22 bp, Artificial Sequence
  chemically synthesized
cgtagagatggcagcagggggt

SEQ ID NO: 689615 - DNA, 22 bp, Artificial Sequence
  chemically synthesized
tcgtagagatggcagcaggggg

SEQ ID NO: 689616 - DNA, 22 bp, Artificial Sequence
  chemically synthesized
ttcgtagagatggcagcagggg

SEQ ID NO: 689617 - DNA, 22 bp, Artificial Sequence
  chemically synthesized
ttttcgtagagatggcagcagg

SEQ ID NO: 689618 - DNA, 22 bp, Artificial Sequence
  chemically synthesized
cttttcgtagagatggcagcag

SEQ ID NO: 689619 - DNA, 22 bp, Artificial Sequence
  chemically synthesized
tcttttcgtagagatggcagca

SEQ ID NO: 689620 - DNA, 22 bp, Artificial Sequence
  chemically synthesized
tattttcttttcgtagagatgg

SEQ ID NO: 689621 - DNA, 22 bp, Artificial Sequence
  chemically synthesized
gtattttcttttcgtagagatg

SEQ ID NO: 689622 - DNA, 22 bp, Artificial Sequence
  chemically synthesized
ccccctgctgccatctctacga

SEQ ID NO: 689623 - DNA, 22 bp, Artificial Sequence
  chemically synthesized
tgtattttcttttcgtagagat

SEQ ID NO: 689624 - DNA, 22 bp, Artificial Sequence
  chemically synthesized
ttgtattttcttttcgtagaga

SEQ ID NO: 689625 - DNA, 22 bp, Artificial Sequence
  chemically synthesized
tttgtattttcttttcgtagag

SEQ ID NO: 689626 - DNA, 22 bp, Artificial Sequence
  chemically synthesized
ttttgtattttcttttcgtaga

SEQ ID NO: 689627 - DNA, 22 bp, Artificial Sequence
  chemically synthesized
tttttgtattttcttttcgtag

SEQ ID NO: 689628 - DNA, 22 bp, Artificial Sequence
  chemically synthesized
ttttttgtattttcttttcgta

SEQ ID NO: 689629 - DNA, 22 bp, Artificial Sequence
  chemically synthesized
ctgccatctctacgaaaagaaa

SEQ ID NO: 689630 - DNA, 22 bp, Artificial Sequence
  chemically synthesized
cttttttttgtattttcttttc

SEQ ID NO: 689631 - DNA, 22 bp, Artificial Sequence
  chemically synthesized
ccttttttttgtattttctttt

SEQ ID NO: 689632 - DNA, 22 bp, Artificial Sequence
  chemically synthesized
ccatctctacgaaaagaaaata

SEQ ID NO: 689633 - DNA, 22 bp, Artificial Sequence
  chemically synthesized
tccttttttttgtattttcttt

SEQ ID NO: 689634 - DNA, 22 bp, Artificial Sequence
  chemically synthesized
tacgaaaagaaaatacaaaaaa

SEQ ID NO: 689635 - DNA, 22 bp, Artificial Sequence
  chemically synthesized
tgtgctttccttttttttgtat

SEQ ID NO: 689636 - DNA, 22 bp, Artificial Sequence
  chemically synthesized
cgaaaagaaaatacaaaaaaaa

SEQ ID NO: 689637 - DNA, 22 bp, Artificial Sequence
  chemically synthesized
gaaaatattatgtgctttcctt

SEQ ID NO: 689638 - DNA, 22 bp, Artificial Sequence
  chemically synthesized
ggaaaatattatgtgctttcct

SEQ ID NO: 689639 - DNA, 22 bp, Artificial Sequence
  chemically synthesized
tggaaaatattatgtgctttcc

SEQ ID NO: 689640 - DNA, 22 bp, Artificial Sequence
  chemically synthesized
agctttggaaaatattatgtgc

SEQ ID NO: 689641 - DNA, 22 bp, Artificial Sequence
  chemically synthesized
tctaagctttggaaaatattat

SEQ ID NO: 689642 - DNA, 22 bp, Artificial Sequence
  chemically synthesized
atctaagctttggaaaatatta

SEQ ID NO: 689643 - DNA, 22 bp, Artificial Sequence
  chemically synthesized
tatctaagctttggaaaatatt

SEQ ID NO: 689644 - DNA, 22 bp, Artificial Sequence
  chemically synthesized
ttatctaagctttggaaaatat

SEQ ID NO: 689645 - DNA, 22 bp, Artificial Sequence
  chemically synthesized
tttatctaagctttggaaaata

SEQ ID NO: 689646 - DNA, 22 bp, Artificial Sequence
  chemically synthesized
ctttttatctaagctttggaaa

SEQ ID NO: 689647 - DNA, 22 bp, Artificial Sequence
  chemically synthesized
tcctactttttatctaagcttt

SEQ ID NO: 689648 - DNA, 22 bp, Artificial Sequence
  chemically synthesized
tccaaagcttagataaaaagta

SEQ ID NO: 689649 - DNA, 22 bp, Artificial Sequence
  chemically synthesized
ccaaagcttagataaaaagtag

SEQ ID NO: 689650 - DNA, 22 bp, Artificial Sequence
  chemically synthesized
aggtcatctatcctacttttta

SEQ ID NO: 689651 - DNA, 22 bp, Artificial Sequence
  chemically synthesized
caaagcttagataaaaagtagg

SEQ ID NO: 689652 - DNA, 22 bp, Artificial Sequence
  chemically synthesized
atcctcaggtcatctatcctac

SEQ ID NO: 689653 - DNA, 22 bp, Artificial Sequence
  chemically synthesized
catcctcaggtcatctatccta

SEQ ID NO: 689654 - DNA, 22 bp, Artificial Sequence
  chemically synthesized
tcatcctcaggtcatctatcct

SEQ ID NO: 689655 - DNA, 22 bp, Artificial Sequence
  chemically synthesized
agataaaaagtaggatagatga

SEQ ID NO: 689656 - DNA, 22 bp, Artificial Sequence
  chemically synthesized
ttcatcctcaggtcatctatcc

SEQ ID NO: 689657 - DNA, 22 bp, Artificial Sequence
  chemically synthesized
gataaaaagtaggatagatgac

SEQ ID NO: 689658 - DNA, 22 bp, Artificial Sequence
  chemically synthesized
tttcatcctcaggtcatctatc

SEQ ID NO: 689659 - DNA, 22 bp, Artificial Sequence
  chemically synthesized
tttttcatcctcaggtcatcta

SEQ ID NO: 689660 - DNA, 22 bp, Artificial Sequence
  chemically synthesized
ctttttcatcctcaggtcatct

SEQ ID NO: 689661 - DNA, 22 bp, Artificial Sequence
  chemically synthesized
tgtttctttttcatcctcaggt

SEQ ID NO: 689662 - DNA, 22 bp, Artificial Sequence
  chemically synthesized
taattatgtttctttttcatcc

SEQ ID NO: 689663 - DNA, 22 bp, Artificial Sequence
  chemically synthesized
tataattatgtttctttttcat

SEQ ID NO: 689664 - DNA, 22 bp, Artificial Sequence
  chemically synthesized
ctataattatgtttctttttca

SEQ ID NO: 689665 - DNA, 22 bp, Artificial Sequence
  chemically synthesized
aggatgaaaaagaaacataatt

SEQ ID NO: 689666 - DNA, 22 bp, Artificial Sequence
  chemically synthesized
gtaaacaacacaaaggaaaaac

SEQ ID NO: 689667 - DNA, 22 bp, Artificial Sequence
  chemically synthesized
ttggtaaacaacacaaaggaaa

SEQ ID NO: 689668 - DNA, 22 bp, Artificial Sequence
  chemically synthesized
tgttggtaaacaacacaaagga

SEQ ID NO: 689669 - DNA, 22 bp, Artificial Sequence
  chemically synthesized
ctgttggtaaacaacacaaagg

SEQ ID NO: 689670 - DNA, 22 bp, Artificial Sequence
  chemically synthesized
tagaagtttttcctttgtgttg

SEQ ID NO: 689671 - DNA, 22 bp, Artificial Sequence
  chemically synthesized
atttctgttggtaaacaacaca

SEQ ID NO: 689672 - DNA, 22 bp, Artificial Sequence
  chemically synthesized
attcatttctgttggtaaacaa

SEQ ID NO: 689673 - DNA, 22 bp, Artificial Sequence
  chemically synthesized
ttcctttgtgttgtttaccaac

SEQ ID NO: 689674 - DNA, 22 bp, Artificial Sequence
  chemically synthesized
tcctttgtgttgtttaccaaca

SEQ ID NO: 689675 - DNA, 22 bp, Artificial Sequence
  chemically synthesized
ttaattcatttctgttggtaaa

SEQ ID NO: 689676 - DNA, 22 bp, Artificial Sequence
  chemically synthesized
cctttgtgttgtttaccaacag

SEQ ID NO: 689677 - DNA, 22 bp, Artificial Sequence
  chemically synthesized
ctttgtgttgtttaccaacaga

SEQ ID NO: 689678 - DNA, 22 bp, Artificial Sequence
  chemically synthesized
tgtgttgtttaccaacagaaat

SEQ ID NO: 689679 - DNA, 22 bp, Artificial Sequence
  chemically synthesized
gtgttgtttaccaacagaaatg

SEQ ID NO: 689680 - DNA, 22 bp, Artificial Sequence
  chemically synthesized
tgttgtttaccaacagaaatga

SEQ ID NO: 689681 - DNA, 22 bp, Artificial Sequence
  chemically synthesized
tgccgtattgttaattcatttc

SEQ ID NO: 689682 - DNA, 22 bp, Artificial Sequence
  chemically synthesized
tttaccaacagaaatgaattaa

SEQ ID NO: 689683 - DNA, 22 bp, Artificial Sequence
  chemically synthesized
ttgtgccgtattgttaattcat

SEQ ID NO: 689684 - DNA, 22 bp, Artificial Sequence
  chemically synthesized
accaacagaaatgaattaacaa

SEQ ID NO: 689685 - DNA, 22 bp, Artificial Sequence
  chemically synthesized
tgttgtgccgtattgttaattc

SEQ ID NO: 689686 - DNA, 22 bp, Artificial Sequence
  chemically synthesized
ccaacagaaatgaattaacaat

SEQ ID NO: 689687 - DNA, 22 bp, Artificial Sequence
  chemically synthesized
ttctgttgtgccgtattgttaa

SEQ ID NO: 689688 - DNA, 22 bp, Artificial Sequence
  chemically synthesized
gttctgttgtgccgtattgtta

SEQ ID NO: 689689 - DNA, 22 bp, Artificial Sequence
  chemically synthesized
tgtgtttgttctgttgtgccgt

SEQ ID NO: 689690 - DNA, 22 bp, Artificial Sequence
  chemically synthesized
agctgtgtgtttgttctgttgt

SEQ ID NO: 689691 - DNA, 22 bp, Artificial Sequence
  chemically synthesized
acaatacggcacaacagaacaa

SEQ ID NO: 689692 - DNA, 22 bp, Artificial Sequence
  chemically synthesized
tctaagctgtgtgtttgttctg

SEQ ID NO: 689693 - DNA, 22 bp, Artificial Sequence
  chemically synthesized
gtctaagctgtgtgtttgttct

SEQ ID NO: 689694 - DNA, 22 bp, Artificial Sequence
  chemically synthesized
tgtctaagctgtgtgtttgttc

SEQ ID NO: 689695 - DNA, 22 bp, Artificial Sequence
  chemically synthesized
ttgtctaagctgtgtgtttgtt

SEQ ID NO: 689696 - DNA, 22 bp, Artificial Sequence
  chemically synthesized
cttttgtctaagctgtgtgttt

SEQ ID NO: 689697 - DNA, 22 bp, Artificial Sequence
  chemically synthesized
agttgcttttgtctaagctgtg

SEQ ID NO: 689698 - DNA, 22 bp, Artificial Sequence
  chemically synthesized
ggactaagttgcttttgtctaa

SEQ ID NO: 689699 - DNA, 22 bp, Artificial Sequence
  chemically synthesized
gaatctgggactaagttgcttt

SEQ ID NO: 689700 - DNA, 22 bp, Artificial Sequence
  chemically synthesized
agacaaaagcaacttagtccca

SEQ ID NO: 689701 - DNA, 22 bp, Artificial Sequence
  chemically synthesized
tggactagaatctgggactaag

SEQ ID NO: 689702 - DNA, 22 bp, Artificial Sequence
  chemically synthesized
gacaaaagcaacttagtcccag

SEQ ID NO: 689703 - DNA, 22 bp, Artificial Sequence
  chemically synthesized
ctatggactagaatctgggact

SEQ ID NO: 689704 - DNA, 22 bp, Artificial Sequence
  chemically synthesized
gctatggactagaatctgggac

SEQ ID NO: 689705 - DNA, 22 bp, Artificial Sequence
  chemically synthesized
gatcatttgctatggactagaa

SEQ ID NO: 689706 - DNA, 22 bp, Artificial Sequence
  chemically synthesized
agatcatttgctatggactaga

SEQ ID NO: 689707 - DNA, 22 bp, Artificial Sequence
  chemically synthesized
agtcccagattctagtccatag

SEQ ID NO: 689708 - DNA, 22 bp, Artificial Sequence
  chemically synthesized
gtcccagattctagtccatagc

SEQ ID NO: 689709 - DNA, 22 bp, Artificial Sequence
  chemically synthesized
tcttagatcatttgctatggac

SEQ ID NO: 689710 - DNA, 22 bp, Artificial Sequence
  chemically synthesized
gatctatcttagatcatttgct

SEQ ID NO: 689711 - DNA, 22 bp, Artificial Sequence
  chemically synthesized
tagtccatagcaaatgatctaa

SEQ ID NO: 689712 - DNA, 22 bp, Artificial Sequence
  chemically synthesized
gtccatagcaaatgatctaaga

SEQ ID NO: 689713 - DNA, 22 bp, Artificial Sequence
  chemically synthesized
agatgtctggatctatcttaga

SEQ ID NO: 689714 - DNA, 22 bp, Artificial Sequence
  chemically synthesized
gagatgtctggatctatcttag

SEQ ID NO: 689715 - DNA, 22 bp, Artificial Sequence
  chemically synthesized
tgagatgtctggatctatctta

SEQ ID NO: 689716 - DNA, 22 bp, Artificial Sequence
  chemically synthesized
aggctttgagatgtctggatct

SEQ ID NO: 689717 - DNA, 22 bp, Artificial Sequence
  chemically synthesized
gaaactgaggctttgagatgtc

SEQ ID NO: 689718 - DNA, 22 bp, Artificial Sequence
  chemically synthesized
agatagatccagacatctcaaa

SEQ ID NO: 689719 - DNA, 22 bp, Artificial Sequence
  chemically synthesized
ggaaactgaggctttgagatgt

SEQ ID NO: 689720 - DNA, 22 bp, Artificial Sequence
  chemically synthesized
ccacagacttggaaactgaggc

SEQ ID NO: 689721 - DNA, 22 bp, Artificial Sequence
  chemically synthesized
ttcccacagacttggaaactga

SEQ ID NO: 689722 - DNA, 22 bp, Artificial Sequence
  chemically synthesized
attcccacagacttggaaactg

SEQ ID NO: 689723 - DNA, 22 bp, Artificial Sequence
  chemically synthesized
ttattcccacagacttggaaac

SEQ ID NO: 689724 - DNA, 22 bp, Artificial Sequence
  chemically synthesized
aaagcctcagtttccaagtctg

SEQ ID NO: 689725 - DNA, 22 bp, Artificial Sequence
  chemically synthesized
ttcttattcccacagacttgga

SEQ ID NO: 689726 - DNA, 22 bp, Artificial Sequence
  chemically synthesized
agtttccaagtctgtgggaata

SEQ ID NO: 689727 - DNA, 22 bp, Artificial Sequence
  chemically synthesized
ccaagtctgtgggaataagaat

SEQ ID NO: 689728 - DNA, 22 bp, Artificial Sequence
  chemically synthesized
caagtctgtgggaataagaata

SEQ ID NO: 689729 - DNA, 22 bp, Artificial Sequence
  chemically synthesized
agtatcatatatgattattctt

SEQ ID NO: 689730 - DNA, 22 bp, Artificial Sequence
  chemically synthesized
gagtatcatatatgattattct

SEQ ID NO: 689731 - DNA, 22 bp, Artificial Sequence
  chemically synthesized
tgggaataagaataatcatata

SEQ ID NO: 689732 - DNA, 22 bp, Artificial Sequence
  chemically synthesized
caatatcccatggaatgtttga

SEQ ID NO: 689733 - DNA, 22 bp, Artificial Sequence
  chemically synthesized
acaatatcccatggaatgtttg

SEQ ID NO: 689734 - DNA, 22 bp, Artificial Sequence
  chemically synthesized
ttacaatatcccatggaatgtt

SEQ ID NO: 689735 - DNA, 22 bp, Artificial Sequence
  chemically synthesized
attcttacaatatcccatggaa

SEQ ID NO: 689736 - DNA, 22 bp, Artificial Sequence
  chemically synthesized
gattcttacaatatcccatgga

SEQ ID NO: 689737 - DNA, 22 bp, Artificial Sequence
  chemically synthesized
aaacattccatgggatattgta

SEQ ID NO: 689738 - DNA, 22 bp, Artificial Sequence
  chemically synthesized
tcacacttgattcttacaatat

SEQ ID NO: 689739 - DNA, 22 bp, Artificial Sequence
  chemically synthesized
ttatcacacttgattcttacaa

SEQ ID NO: 689740 - DNA, 22 bp, Artificial Sequence
  chemically synthesized
tattatcacacttgattcttac

SEQ ID NO: 689741 - DNA, 22 bp, Artificial Sequence
  chemically synthesized
catgggatattgtaagaatcaa

SEQ ID NO: 689742 - DNA, 22 bp, Artificial Sequence
  chemically synthesized
acctctattatcacacttgatt

SEQ ID NO: 689743 - DNA, 22 bp, Artificial Sequence
  chemically synthesized
cacctctattatcacacttgat

SEQ ID NO: 689744 - DNA, 22 bp, Artificial Sequence
  chemically synthesized
tcacctctattatcacacttga

SEQ ID NO: 689745 - DNA, 22 bp, Artificial Sequence
  chemically synthesized
taagaatcaagtgtgataatag

SEQ ID NO: 689746 - DNA, 22 bp, Artificial Sequence
  chemically synthesized
tcgaacactttcacctctatta

SEQ ID NO: 689747 - DNA, 22 bp, Artificial Sequence
  chemically synthesized
atcgaacactttcacctctatt

SEQ ID NO: 689748 - DNA, 22 bp, Artificial Sequence
  chemically synthesized
tatcgaacactttcacctctat

SEQ ID NO: 689749 - DNA, 22 bp, Artificial Sequence
  chemically synthesized
tatagcactttatcgaacactt

SEQ ID NO: 689750 - DNA, 22 bp, Artificial Sequence
  chemically synthesized
gtatagcactttatcgaacact

SEQ ID NO: 689751 - DNA, 22 bp, Artificial Sequence
  chemically synthesized
gataaagtgctatacaaacaca

SEQ ID NO: 689752 - DNA, 22 bp, Artificial Sequence
  chemically synthesized
tagatagccccatgtgtttgta

SEQ ID NO: 689753 - DNA, 22 bp, Artificial Sequence
  chemically synthesized
atagatagccccatgtgtttgt

SEQ ID NO: 689754 - DNA, 22 bp, Artificial Sequence
  chemically synthesized
tacaaacacatggggctatcta

SEQ ID NO: 689755 - DNA, 22 bp, Artificial Sequence
  chemically synthesized
aggtagataacttatagatagc

SEQ ID NO: 689756 - DNA, 22 bp, Artificial Sequence
  chemically synthesized
tctataagttatctacctgaat

SEQ ID NO: 689757 - DNA, 22 bp, Artificial Sequence
  chemically synthesized
gggtagaggatatattcaggta

SEQ ID NO: 689758 - DNA, 22 bp, Artificial Sequence
  chemically synthesized
taagttatctacctgaatatat

SEQ ID NO: 689759 - DNA, 22 bp, Artificial Sequence
  chemically synthesized
tctacctgaatatatcctctac

SEQ ID NO: 689760 - DNA, 22 bp, Artificial Sequence
  chemically synthesized
cctgaatatatcctctacccga

SEQ ID NO: 689761 - DNA, 22 bp, Artificial Sequence
  chemically synthesized
atgccatggatgttcgggtaga

SEQ ID NO: 689762 - DNA, 22 bp, Artificial Sequence
  chemically synthesized
taatgccatggatgttcgggta

SEQ ID NO: 689763 - DNA, 22 bp, Artificial Sequence
  chemically synthesized
aatatatcctctacccgaacat

SEQ ID NO: 689764 - DNA, 22 bp, Artificial Sequence
  chemically synthesized
ctaatgccatggatgttcgggt

SEQ ID NO: 689765 - DNA, 22 bp, Artificial Sequence
  chemically synthesized
tctaatgccatggatgttcggg

SEQ ID NO: 689766 - DNA, 22 bp, Artificial Sequence
  chemically synthesized
tacccgaacatccatggcatta

SEQ ID NO: 689767 - DNA, 22 bp, Artificial Sequence
  chemically synthesized
cccgaacatccatggcattaga

SEQ ID NO: 689768 - DNA, 22 bp, Artificial Sequence
  chemically synthesized
atcccatggtctttctaatgcc

SEQ ID NO: 689769 - DNA, 22 bp, Artificial Sequence
  chemically synthesized
atacctgatcccatggtctttc

SEQ ID NO: 689770 - DNA, 22 bp, Artificial Sequence
  chemically synthesized
tgatacctgatcccatggtctt

SEQ ID NO: 689771 - DNA, 22 bp, Artificial Sequence
  chemically synthesized
ctgatacctgatcccatggtct

SEQ ID NO: 689772 - DNA, 22 bp, Artificial Sequence
  chemically synthesized
gaaagaccatgggatcaggtat

SEQ ID NO: 689773 - DNA, 22 bp, Artificial Sequence
  chemically synthesized
gaaaaccagatcttctgatacc

SEQ ID NO: 689774 - DNA, 22 bp, Artificial Sequence
  chemically synthesized
gtctagaaaaccagatcttctg

SEQ ID NO: 689775 - DNA, 22 bp, Artificial Sequence
  chemically synthesized
aactggtctagaaaaccagatc

SEQ ID NO: 689776 - DNA, 22 bp, Artificial Sequence
  chemically synthesized
gtaacatggctaaactggtcta

SEQ ID NO: 689777 - DNA, 22 bp, Artificial Sequence
  chemically synthesized
agtaacatggctaaactggtct

SEQ ID NO: 689778 - DNA, 22 bp, Artificial Sequence
  chemically synthesized
tagtaacatggctaaactggtc

SEQ ID NO: 689779 - DNA, 22 bp, Artificial Sequence
  chemically synthesized
gttttctagaccagtttagcca

SEQ ID NO: 689780 - DNA, 22 bp, Artificial Sequence
  chemically synthesized
tctagaccagtttagccatgtt

SEQ ID NO: 689781 - DNA, 22 bp, Artificial Sequence
  chemically synthesized
ctagaccagtttagccatgtta

SEQ ID NO: 689782 - DNA, 22 bp, Artificial Sequence
  chemically synthesized
tagaccagtttagccatgttac

SEQ ID NO: 689783 - DNA, 22 bp, Artificial Sequence
  chemically synthesized
gaccagtttagccatgttacta

SEQ ID NO: 689784 - DNA, 22 bp, Artificial Sequence
  chemically synthesized
agccatgttactaaaattactt

SEQ ID NO: 689785 - DNA, 22 bp, Artificial Sequence
  chemically synthesized
gccatgttactaaaattacttt

SEQ ID NO: 689786 - DNA, 22 bp, Artificial Sequence
  chemically synthesized
ctaaaattactttccccttttg

SEQ ID NO: 689787 - DNA, 22 bp, Artificial Sequence
  chemically synthesized
aaattactttccccttttggac

SEQ ID NO: 689788 - DNA, 22 bp, Artificial Sequence
  chemically synthesized
cagataggaaaatggaagtcca

SEQ ID NO: 689789 - DNA, 22 bp, Artificial Sequence
  chemically synthesized
ctttccccttttggacttccat

SEQ ID NO: 689790 - DNA, 22 bp, Artificial Sequence
  chemically synthesized
acagataggaaaatggaagtcc

SEQ ID NO: 689791 - DNA, 22 bp, Artificial Sequence
  chemically synthesized
tccccttttggacttccatttt

SEQ ID NO: 689792 - DNA, 22 bp, Artificial Sequence
  chemically synthesized
ccccttttggacttccattttc

SEQ ID NO: 689793 - DNA, 22 bp, Artificial Sequence
  chemically synthesized
cccttttggacttccattttcc

SEQ ID NO: 689794 - DNA, 22 bp, Artificial Sequence
  chemically synthesized
atcttacagataggaaaatgga

SEQ ID NO: 689795 - DNA, 22 bp, Artificial Sequence
  chemically synthesized
catcttacagataggaaaatgg

SEQ ID NO: 689796 - DNA, 22 bp, Artificial Sequence
  chemically synthesized
ttcatcttacagataggaaaat

SEQ ID NO: 689797 - DNA, 22 bp, Artificial Sequence
  chemically synthesized
ttggacttccattttcctatct

SEQ ID NO: 689798 - DNA, 22 bp, Artificial Sequence
  chemically synthesized
tggacttccattttcctatctg

SEQ ID NO: 689799 - DNA, 22 bp, Artificial Sequence
  chemically synthesized
ggacttccattttcctatctgt

SEQ ID NO: 689800 - DNA, 22 bp, Artificial Sequence
  chemically synthesized
gacttccattttcctatctgta

SEQ ID NO: 689801 - DNA, 22 bp, Artificial Sequence
  chemically synthesized
ccattttcctatctgtaagatg

SEQ ID NO: 689802 - DNA, 22 bp, Artificial Sequence
  chemically synthesized
cattttcctatctgtaagatga

SEQ ID NO: 689803 - DNA, 22 bp, Artificial Sequence
  chemically synthesized
tcctatctgtaagatgaagagt

SEQ ID NO: 689804 - DNA, 22 bp, Artificial Sequence
  chemically synthesized
cctatctgtaagatgaagagtt

SEQ ID NO: 689805 - DNA, 22 bp, Artificial Sequence
  chemically synthesized
ctatctgtaagatgaagagttt

SEQ ID NO: 689806 - DNA, 22 bp, Artificial Sequence
  chemically synthesized
tctgtaagatgaagagtttggg

SEQ ID NO: 689807 - DNA, 22 bp, Artificial Sequence
  chemically synthesized
taagatgaagagtttgggttgg

SEQ ID NO: 689808 - DNA, 22 bp, Artificial Sequence
  chemically synthesized
gggttggattatctttgacatt

SEQ ID NO: 689809 - DNA, 22 bp, Artificial Sequence
  chemically synthesized
ggttggattatctttgacattc

SEQ ID NO: 689810 - DNA, 22 bp, Artificial Sequence
  chemically synthesized
gattatctttgacattctttct

SEQ ID NO: 689811 - DNA, 22 bp, Artificial Sequence
  chemically synthesized
tgaaatgtaagaggaagaaaga

SEQ ID NO: 689812 - DNA, 22 bp, Artificial Sequence
  chemically synthesized
tctttgacattctttcttcctc

SEQ ID NO: 689813 - DNA, 22 bp, Artificial Sequence
  chemically synthesized
tgacattctttcttcctcttac

SEQ ID NO: 689814 - DNA, 22 bp, Artificial Sequence
  chemically synthesized
gacattctttcttcctcttaca

SEQ ID NO: 689815 - DNA, 22 bp, Artificial Sequence
  chemically synthesized
acattctttcttcctcttacat

SEQ ID NO: 689816 - DNA, 22 bp, Artificial Sequence
  chemically synthesized
tttcttcctcttacatttcaca

SEQ ID NO: 689817 - DNA, 22 bp, Artificial Sequence
  chemically synthesized
tcttcctcttacatttcacaat

SEQ ID NO: 689818 - DNA, 22 bp, Artificial Sequence
  chemically synthesized
cttcctcttacatttcacaatt

SEQ ID NO: 689819 - DNA, 22 bp, Artificial Sequence
  chemically synthesized
ttcctcttacatttcacaattt

SEQ ID NO: 689820 - DNA, 22 bp, Artificial Sequence
  chemically synthesized
cctcttacatttcacaatttta

SEQ ID NO: 689821 - DNA, 22 bp, Artificial Sequence
  chemically synthesized
ctcttacatttcacaattttat

SEQ ID NO: 689822 - DNA, 22 bp, Artificial Sequence
  chemically synthesized
aaatgtgaggagataaaattgt

SEQ ID NO: 689823 - DNA, 22 bp, Artificial Sequence
  chemically synthesized
ttacatttcacaattttatctc

SEQ ID NO: 689824 - DNA, 22 bp, Artificial Sequence
  chemically synthesized
ctcaaatgtgaggagataaaat

SEQ ID NO: 689825 - DNA, 22 bp, Artificial Sequence
  chemically synthesized
actcaaatgtgaggagataaaa

SEQ ID NO: 689826 - DNA, 22 bp, Artificial Sequence
  chemically synthesized
acatttcacaattttatctcct

SEQ ID NO: 689827 - DNA, 22 bp, Artificial Sequence
  chemically synthesized
catttcacaattttatctcctc

SEQ ID NO: 689828 - DNA, 22 bp, Artificial Sequence
  chemically synthesized
cacaattttatctcctcacatt

SEQ ID NO: 689829 - DNA, 22 bp, Artificial Sequence
  chemically synthesized
acaattttatctcctcacattt

SEQ ID NO: 689830 - DNA, 22 bp, Artificial Sequence
  chemically synthesized
cagaagtacgtttactcaaatg

SEQ ID NO: 689831 - DNA, 22 bp, Artificial Sequence
  chemically synthesized
tatctcctcacatttgagtaaa

SEQ ID NO: 689832 - DNA, 22 bp, Artificial Sequence
  chemically synthesized
atctcctcacatttgagtaaac

SEQ ID NO: 689833 - DNA, 22 bp, Artificial Sequence
  chemically synthesized
tctcctcacatttgagtaaacg

SEQ ID NO: 689834 - DNA, 22 bp, Artificial Sequence
  chemically synthesized
gactgcagaagtacgtttactc

SEQ ID NO: 689835 - DNA, 22 bp, Artificial Sequence
  chemically synthesized
ctcacatttgagtaaacgtact

SEQ ID NO: 689836 - DNA, 22 bp, Artificial Sequence
  chemically synthesized
attagactgcagaagtacgttt

SEQ ID NO: 689837 - DNA, 22 bp, Artificial Sequence
  chemically synthesized
acatttgagtaaacgtacttct

SEQ ID NO: 689838 - DNA, 22 bp, Artificial Sequence
  chemically synthesized
gagtaaacgtacttctgcagtc

SEQ ID NO: 689839 - DNA, 22 bp, Artificial Sequence
  chemically synthesized
agtaaacgtacttctgcagtct

SEQ ID NO: 689840 - DNA, 22 bp, Artificial Sequence
  chemically synthesized
agtcagctaattagactgcaga

SEQ ID NO: 689841 - DNA, 22 bp, Artificial Sequence
  chemically synthesized
ctgcagtctaattagctgactg

SEQ ID NO: 689842 - DNA, 22 bp, Artificial Sequence
  chemically synthesized
tgcagtctaattagctgactga

SEQ ID NO: 689843 - DNA, 22 bp, Artificial Sequence
  chemically synthesized
cagtctaattagctgactgaat

SEQ ID NO: 689844 - DNA, 22 bp, Artificial Sequence
  chemically synthesized
taacgggtcatcagtattcagt

SEQ ID NO: 689845 - DNA, 22 bp, Artificial Sequence
  chemically synthesized
tataacgggtcatcagtattca

SEQ ID NO: 689846 - DNA, 22 bp, Artificial Sequence
  chemically synthesized
attagctgactgaatactgatg

SEQ ID NO: 689847 - DNA, 22 bp, Artificial Sequence
  chemically synthesized
gctgactgaatactgatgaccc

SEQ ID NO: 689848 - DNA, 22 bp, Artificial Sequence
  chemically synthesized
actgaatactgatgacccgtta

SEQ ID NO: 689849 - DNA, 22 bp, Artificial Sequence
  chemically synthesized
aaagcacacctctataacgggt

SEQ ID NO: 689850 - DNA, 22 bp, Artificial Sequence
  chemically synthesized
aatactgatgacccgttataga

SEQ ID NO: 689851 - DNA, 22 bp, Artificial Sequence
  chemically synthesized
tgaaagcacacctctataacgg

SEQ ID NO: 689852 - DNA, 22 bp, Artificial Sequence
  chemically synthesized
tctctgaaagcacacctctata

SEQ ID NO: 689853 - DNA, 22 bp, Artificial Sequence
  chemically synthesized
atctctgaaagcacacctctat

SEQ ID NO: 689854 - DNA, 22 bp, Artificial Sequence
  chemically synthesized
atgacccgttatagaggtgtgc

SEQ ID NO: 689855 - DNA, 22 bp, Artificial Sequence
  chemically synthesized
acttatctctgaaagcacacct

SEQ ID NO: 689856 - DNA, 22 bp, Artificial Sequence
  chemically synthesized
aacttatctctgaaagcacacc

SEQ ID NO: 689857 - DNA, 22 bp, Artificial Sequence
  chemically synthesized
taacttatctctgaaagcacac

SEQ ID NO: 689858 - DNA, 22 bp, Artificial Sequence
  chemically synthesized
tcctttaacttatctctgaaag

SEQ ID NO: 689859 - DNA, 22 bp, Artificial Sequence
  chemically synthesized
gtcctttaacttatctctgaaa

SEQ ID NO: 689860 - DNA, 22 bp, Artificial Sequence
  chemically synthesized
tagaggtgtgctttcagagata

SEQ ID NO: 689861 - DNA, 22 bp, Artificial Sequence
  chemically synthesized
caagcttgtcctttaacttatc

SEQ ID NO: 689862 - DNA, 22 bp, Artificial Sequence
  chemically synthesized
agattacaagcttgtcctttaa

SEQ ID NO: 689863 - DNA, 22 bp, Artificial Sequence
  chemically synthesized
tcagagataagttaaaggacaa

SEQ ID NO: 689864 - DNA, 22 bp, Artificial Sequence
  chemically synthesized
cagagataagttaaaggacaag

SEQ ID NO: 689865 - DNA, 22 bp, Artificial Sequence
  chemically synthesized
agagataagttaaaggacaagc

SEQ ID NO: 689866 - DNA, 22 bp, Artificial Sequence
  chemically synthesized
ccctaagattacaagcttgtcc

SEQ ID NO: 689867 - DNA, 22 bp, Artificial Sequence
  chemically synthesized
ttaccctaagattacaagcttg

SEQ ID NO: 689868 - DNA, 22 bp, Artificial Sequence
  chemically synthesized
aaggacaagcttgtaatcttag

SEQ ID NO: 689869 - DNA, 22 bp, Artificial Sequence
  chemically synthesized
ccaaaactgttaccctaagatt

SEQ ID NO: 689870 - DNA, 22 bp, Artificial Sequence
  chemically synthesized
tcccaaaactgttaccctaaga

SEQ ID NO: 689871 - DNA, 22 bp, Artificial Sequence
  chemically synthesized
ctcccaaaactgttaccctaag

SEQ ID NO: 689872 - DNA, 22 bp, Artificial Sequence
  chemically synthesized
cttctcccaaaactgttaccct

SEQ ID NO: 689873 - DNA, 22 bp, Artificial Sequence
  chemically synthesized
gtaatcttagggtaacagtttt

SEQ ID NO: 689874 - DNA, 22 bp, Artificial Sequence
  chemically synthesized
taatcttagggtaacagttttg

SEQ ID NO: 689875 - DNA, 22 bp, Artificial Sequence
  chemically synthesized
agggtaacagttttgggagaag

SEQ ID NO: 689876 - DNA, 22 bp, Artificial Sequence
  chemically synthesized
gggtaacagttttgggagaagg

SEQ ID NO: 689877 - DNA, 22 bp, Artificial Sequence
  chemically synthesized
agggaatggatctccttctccc

SEQ ID NO: 689878 - DNA, 22 bp, Artificial Sequence
  chemically synthesized
aagggaatggatctccttctcc

SEQ ID NO: 689879 - DNA, 22 bp, Artificial Sequence
  chemically synthesized
tcatttaagggaatggatctcc

SEQ ID NO: 689880 - DNA, 22 bp, Artificial Sequence
  chemically synthesized
tgggagaaggagatccattccc

SEQ ID NO: 689881 - DNA, 22 bp, Artificial Sequence
  chemically synthesized
gggagaaggagatccattccct

SEQ ID NO: 689882 - DNA, 22 bp, Artificial Sequence
  chemically synthesized
ggagaaggagatccattccctt

SEQ ID NO: 689883 - DNA, 22 bp, Artificial Sequence
  chemically synthesized
ccattatcatttaagggaatgg

SEQ ID NO: 689884 - DNA, 22 bp, Artificial Sequence
  chemically synthesized
tgccattatcatttaagggaat

SEQ ID NO: 689885 - DNA, 22 bp, Artificial Sequence
  chemically synthesized
ctgccattatcatttaagggaa

SEQ ID NO: 689886 - DNA, 22 bp, Artificial Sequence
  chemically synthesized
gtggtcatttctgccattatca

SEQ ID NO: 689887 - DNA, 22 bp, Artificial Sequence
  chemically synthesized
agtggtcatttctgccattatc

SEQ ID NO: 689888 - DNA, 22 bp, Artificial Sequence
  chemically synthesized
tagtggtcatttctgccattat

SEQ ID NO: 689889 - DNA, 22 bp, Artificial Sequence
  chemically synthesized
ccttaaatgataatggcagaaa

SEQ ID NO: 689890 - DNA, 22 bp, Artificial Sequence
  chemically synthesized
ctttagtggtcatttctgccat

SEQ ID NO: 689891 - DNA, 22 bp, Artificial Sequence
  chemically synthesized
cctttagtggtcatttctgcca

SEQ ID NO: 689892 - DNA, 22 bp, Artificial Sequence
  chemically synthesized
aaatgataatggcagaaatgac

SEQ ID NO: 689893 - DNA, 22 bp, Artificial Sequence
  chemically synthesized
aatgataatggcagaaatgacc

SEQ ID NO: 689894 - DNA, 22 bp, Artificial Sequence
  chemically synthesized
ccttcctttagtggtcatttct

SEQ ID NO: 689895 - DNA, 22 bp, Artificial Sequence
  chemically synthesized
gccttcctttagtggtcatttc

SEQ ID NO: 689896 - DNA, 22 bp, Artificial Sequence
  chemically synthesized
ttgccttcctttagtggtcatt

SEQ ID NO: 689897 - DNA, 22 bp, Artificial Sequence
  chemically synthesized
cttgccttcctttagtggtcat

SEQ ID NO: 689898 - DNA, 22 bp, Artificial Sequence
  chemically synthesized
aaggaaggcaagaagtatctgg

SEQ ID NO: 689899 - DNA, 22 bp, Artificial Sequence
  chemically synthesized
agaatgccataaaccagatact

SEQ ID NO: 689900 - DNA, 22 bp, Artificial Sequence
  chemically synthesized
gggaaatagattcagaatgcca

SEQ ID NO: 689901 - DNA, 22 bp, Artificial Sequence
  chemically synthesized
ggggaaatagattcagaatgcc

SEQ ID NO: 689902 - DNA, 22 bp, Artificial Sequence
  chemically synthesized
catttggggaaatagattcaga

SEQ ID NO: 689903 - DNA, 22 bp, Artificial Sequence
  chemically synthesized
gtttatggcattctgaatctat

SEQ ID NO: 689904 - DNA, 22 bp, Artificial Sequence
  chemically synthesized
ccatttggggaaatagattcag

SEQ ID NO: 689905 - DNA, 22 bp, Artificial Sequence
  chemically synthesized
atggcattctgaatctatttcc

SEQ ID NO: 689906 - DNA, 22 bp, Artificial Sequence
  chemically synthesized
atttccatttggggaaatagat

SEQ ID NO: 689907 - DNA, 22 bp, Artificial Sequence
  chemically synthesized
tggcattctgaatctatttccc

SEQ ID NO: 689908 - DNA, 22 bp, Artificial Sequence
  chemically synthesized
catctgatttccatttggggaa

SEQ ID NO: 689909 - DNA, 22 bp, Artificial Sequence
  chemically synthesized
acatctgatttccatttgggga

SEQ ID NO: 689910 - DNA, 22 bp, Artificial Sequence
  chemically synthesized
tacatctgatttccatttgggg

SEQ ID NO: 689911 - DNA, 22 bp, Artificial Sequence
  chemically synthesized
tgaatctatttccccaaatgga

SEQ ID NO: 689912 - DNA, 22 bp, Artificial Sequence
  chemically synthesized
aatctatttccccaaatggaaa

SEQ ID NO: 689913 - DNA, 22 bp, Artificial Sequence
  chemically synthesized
tttccccaaatggaaatcagat

SEQ ID NO: 689914 - DNA, 22 bp, Artificial Sequence
  chemically synthesized
ccccaaatggaaatcagatgta

SEQ ID NO: 689915 - DNA, 22 bp, Artificial Sequence
  chemically synthesized
cccaaatggaaatcagatgtaa

SEQ ID NO: 689916 - DNA, 22 bp, Artificial Sequence
  chemically synthesized
agcacaagaattttacatctga

SEQ ID NO: 689917 - DNA, 22 bp, Artificial Sequence
  chemically synthesized
tgagcacaagaattttacatct

SEQ ID NO: 689918 - DNA, 22 bp, Artificial Sequence
  chemically synthesized
cgtctctgagcacaagaatttt

SEQ ID NO: 689919 - DNA, 22 bp, Artificial Sequence
  chemically synthesized
aatcaacactacgtctctgagc

SEQ ID NO: 689920 - DNA, 22 bp, Artificial Sequence
  chemically synthesized
caatcaacactacgtctctgag

SEQ ID NO: 689921 - DNA, 22 bp, Artificial Sequence
  chemically synthesized
ttcaatcaacactacgtctctg

SEQ ID NO: 689922 - DNA, 22 bp, Artificial Sequence
  chemically synthesized
ttgtgctcagagacgtagtgtt

SEQ ID NO: 689923 - DNA, 22 bp, Artificial Sequence
  chemically synthesized
cactcttcaatcaacactacgt

SEQ ID NO: 689924 - DNA, 22 bp, Artificial Sequence
  chemically synthesized
gtgctcagagacgtagtgttga

SEQ ID NO: 689925 - DNA, 22 bp, Artificial Sequence
  chemically synthesized
tgctcagagacgtagtgttgat

SEQ ID NO: 689926 - DNA, 22 bp, Artificial Sequence
  chemically synthesized
agagacgtagtgttgattgaag

SEQ ID NO: 689927 - DNA, 22 bp, Artificial Sequence
  chemically synthesized
agagaatcacgtggatctgcac

SEQ ID NO: 689928 - DNA, 22 bp, Artificial Sequence
  chemically synthesized
attgaagagtgcagatccacgt

SEQ ID NO: 689929 - DNA, 22 bp, Artificial Sequence
  chemically synthesized
aagagtgcagatccacgtgatt

SEQ ID NO: 689930 - DNA, 22 bp, Artificial Sequence
  chemically synthesized
aaacacacatgaatatgacact

SEQ ID NO: 689931 - DNA, 22 bp, Artificial Sequence
  chemically synthesized
ctgaaacacacatgaatatgac

SEQ ID NO: 689932 - DNA, 22 bp, Artificial Sequence
  chemically synthesized
tcttagtgtcatattcatgtgt

SEQ ID NO: 689933 - DNA, 22 bp, Artificial Sequence
  chemically synthesized
cactactgaaacacacatgaat

SEQ ID NO: 689934 - DNA, 22 bp, Artificial Sequence
  chemically synthesized
acactactgaaacacacatgaa

SEQ ID NO: 689935 - DNA, 22 bp, Artificial Sequence
  chemically synthesized
ttagtgtcatattcatgtgtgt

SEQ ID NO: 689936 - DNA, 22 bp, Artificial Sequence
  chemically synthesized
agtgtcatattcatgtgtgttt

SEQ ID NO: 689937 - DNA, 22 bp, Artificial Sequence
  chemically synthesized
gtgtcatattcatgtgtgtttc

SEQ ID NO: 689938 - DNA, 22 bp, Artificial Sequence
  chemically synthesized
cgagtttacactactgaaacac

SEQ ID NO: 689939 - DNA, 22 bp, Artificial Sequence
  chemically synthesized
aattccgagtttacactactga

SEQ ID NO: 689940 - DNA, 22 bp, Artificial Sequence
  chemically synthesized
atgtgtgtttcagtagtgtaaa

SEQ ID NO: 689941 - DNA, 22 bp, Artificial Sequence
  chemically synthesized
ttcaattccgagtttacactac

SEQ ID NO: 689942 - DNA, 22 bp, Artificial Sequence
  chemically synthesized
cagtagtgtaaactcggaattg

SEQ ID NO: 689943 - DNA, 22 bp, Artificial Sequence
  chemically synthesized
agtagtgtaaactcggaattga

SEQ ID NO: 689944 - DNA, 22 bp, Artificial Sequence
  chemically synthesized
caaacacaggcaactattcaat

SEQ ID NO: 689945 - DNA, 22 bp, Artificial Sequence
  chemically synthesized
acaaacacaggcaactattcaa

SEQ ID NO: 689946 - DNA, 22 bp, Artificial Sequence
  chemically synthesized
ttacaaacacaggcaactattc

SEQ ID NO: 689947 - DNA, 22 bp, Artificial Sequence
  chemically synthesized
ggaattgaatagttgcctgtgt

SEQ ID NO: 689948 - DNA, 22 bp, Artificial Sequence
  chemically synthesized
caatgtctcttacaaacacagg

SEQ ID NO: 689949 - DNA, 22 bp, Artificial Sequence
  chemically synthesized
aatagttgcctgtgtttgtaag

SEQ ID NO: 689950 - DNA, 22 bp, Artificial Sequence
  chemically synthesized
cctgtgtttgtaagagacattg

SEQ ID NO: 689951 - DNA, 22 bp, Artificial Sequence
  chemically synthesized
tgtttgtaagagacattgtagg

SEQ ID NO: 689952 - DNA, 22 bp, Artificial Sequence
  chemically synthesized
gtaagagacattgtaggtttgc

SEQ ID NO: 689953 - DNA, 22 bp, Artificial Sequence
  chemically synthesized
taagagacattgtaggtttgct

SEQ ID NO: 689954 - DNA, 22 bp, Artificial Sequence
  chemically synthesized
aaaagaaaaaataaaaataaaa

SEQ ID NO: 689955 - DNA, 22 bp, Artificial Sequence
  chemically synthesized
taggtttgcttttttattttta

SEQ ID NO: 689956 - DNA, 22 bp, Artificial Sequence
  chemically synthesized
catctcaaaagaaaaaataaaa

SEQ ID NO: 689957 - DNA, 22 bp, Artificial Sequence
  chemically synthesized
gcttttttatttttattttttc

SEQ ID NO: 689958 - DNA, 22 bp, Artificial Sequence
  chemically synthesized
cttttttatttttattttttct

SEQ ID NO: 689959 - DNA, 22 bp, Artificial Sequence
  chemically synthesized
ttttatttttattttttctttt

SEQ ID NO: 689960 - DNA, 22 bp, Artificial Sequence
  chemically synthesized
tttatttttattttttcttttg

SEQ ID NO: 689961 - DNA, 22 bp, Artificial Sequence
  chemically synthesized
ttatttttattttttcttttga

SEQ ID NO: 689962 - DNA, 22 bp, Artificial Sequence
  chemically synthesized
tatttttattttttcttttgag

SEQ ID NO: 689963 - DNA, 22 bp, Artificial Sequence
  chemically synthesized
atttttattttttcttttgaga

SEQ ID NO: 689964 - DNA, 22 bp, Artificial Sequence
  chemically synthesized
tttttattttttcttttgagat

SEQ ID NO: 689965 - DNA, 22 bp, Artificial Sequence
  chemically synthesized
ttattttttcttttgagatgga

SEQ ID NO: 689966 - DNA, 22 bp, Artificial Sequence
  chemically synthesized
tattttttcttttgagatggag

SEQ ID NO: 689967 - DNA, 22 bp, Artificial Sequence
  chemically synthesized
attttttcttttgagatggagt

SEQ ID NO: 689968 - DNA, 22 bp, Artificial Sequence
  chemically synthesized
ttttttcttttgagatggagtc

SEQ ID NO: 689969 - DNA, 22 bp, Artificial Sequence
  chemically synthesized
ggcaacagagtgagactccatc

SEQ ID NO: 689970 - DNA, 22 bp, Artificial Sequence
  chemically synthesized
tttcttttgagatggagtctca

SEQ ID NO: 689971 - DNA, 22 bp, Artificial Sequence
  chemically synthesized
ttcttttgagatggagtctcac

SEQ ID NO: 689972 - DNA, 22 bp, Artificial Sequence
  chemically synthesized
tcttttgagatggagtctcact

SEQ ID NO: 689973 - DNA, 22 bp, Artificial Sequence
  chemically synthesized
cttttgagatggagtctcactc

SEQ ID NO: 689974 - DNA, 22 bp, Artificial Sequence
  chemically synthesized
ttttgagatggagtctcactct

SEQ ID NO: 689975 - DNA, 22 bp, Artificial Sequence
  chemically synthesized
cagcctgggcaacagagtgaga

SEQ ID NO: 689976 - DNA, 22 bp, Artificial Sequence
  chemically synthesized
ttgagatggagtctcactctgt

SEQ ID NO: 689977 - DNA, 22 bp, Artificial Sequence
  chemically synthesized
tgagatggagtctcactctgtt

SEQ ID NO: 689978 - DNA, 22 bp, Artificial Sequence
  chemically synthesized
gagatggagtctcactctgttg

SEQ ID NO: 689979 - DNA, 22 bp, Artificial Sequence
  chemically synthesized
agatggagtctcactctgttgc

SEQ ID NO: 689980 - DNA, 22 bp, Artificial Sequence
  chemically synthesized
cactacagcctgggcaacagag

SEQ ID NO: 689981 - DNA, 22 bp, Artificial Sequence
  chemically synthesized
ctgcactacagcctgggcaaca

SEQ ID NO: 689982 - DNA, 22 bp, Artificial Sequence
  chemically synthesized
actctgttgcccaggctgtagt

SEQ ID NO: 689983 - DNA, 22 bp, Artificial Sequence
  chemically synthesized
tgttgcccaggctgtagtgcag

SEQ ID NO: 689984 - DNA, 22 bp, Artificial Sequence
  chemically synthesized
ttgcccaggctgtagtgcagta

SEQ ID NO: 689985 - DNA, 22 bp, Artificial Sequence
  chemically synthesized
cccaggctgtagtgcagtagcg

SEQ ID NO: 689986 - DNA, 22 bp, Artificial Sequence
  chemically synthesized
cagtgagccgagatcgcgctac

SEQ ID NO: 689987 - DNA, 22 bp, Artificial Sequence
  chemically synthesized
gcagtgagccgagatcgcgcta

SEQ ID NO: 689988 - DNA, 22 bp, Artificial Sequence
  chemically synthesized
tagtgcagtagcgcgatctcgg

SEQ ID NO: 689989 - DNA, 22 bp, Artificial Sequence
  chemically synthesized
gagcttgcagtgagccgagatc

SEQ ID NO: 689990 - DNA, 22 bp, Artificial Sequence
  chemically synthesized
ggctcactgcaagctccagccc

SEQ ID NO: 689991 - DNA, 22 bp, Artificial Sequence
  chemically synthesized
actgcaagctccagccccgggt

SEQ ID NO: 689992 - DNA, 22 bp, Artificial Sequence
  chemically synthesized
caagctccagccccgggttcac

SEQ ID NO: 689993 - DNA, 22 bp, Artificial Sequence
  chemically synthesized
aggcaggagaatggcgtgaacc

SEQ ID NO: 689994 - DNA, 22 bp, Artificial Sequence
  chemically synthesized
cagccccgggttcacgccattc

SEQ ID NO: 689995 - DNA, 22 bp, Artificial Sequence
  chemically synthesized
gggaggctgaggcaggagaatg

SEQ ID NO: 689996 - DNA, 22 bp, Artificial Sequence
  chemically synthesized
acgccattctcctgcctcagcc

SEQ ID NO: 689997 - DNA, 22 bp, Artificial Sequence
  chemically synthesized
tagtcccagatactcgggaggc

SEQ ID NO: 689998 - DNA, 22 bp, Artificial Sequence
  chemically synthesized
tcctgcctcagcctcccgagta

SEQ ID NO: 689999 - DNA, 22 bp, Artificial Sequence
  chemically synthesized
ctgcctcagcctcccgagtatc

SEQ ID NO: 690000 - DNA, 22 bp, Artificial Sequence
  chemically synthesized
cctcagcctcccgagtatctgg

SEQ ID NO: 690001 - DNA, 22 bp, Artificial Sequence
  chemically synthesized
agcctcccgagtatctgggact

SEQ ID NO: 690002 - DNA, 22 bp, Artificial Sequence
  chemically synthesized
ccgagtatctgggactacaggc

SEQ ID NO: 690003 - DNA, 22 bp, Artificial Sequence
  chemically synthesized
gccaggtgtggtggtggacgcc

SEQ ID NO: 690004 - DNA, 22 bp, Artificial Sequence
  chemically synthesized
ggactacaggcgtccaccacca

SEQ ID NO: 690005 - DNA, 22 bp, Artificial Sequence
  chemically synthesized
caggcgtccaccaccacacctg

SEQ ID NO: 690006 - DNA, 22 bp, Artificial Sequence
  chemically synthesized
aaaatacaaaaaattagccagg

SEQ ID NO: 690007 - DNA, 22 bp, Artificial Sequence
  chemically synthesized
ctaaaaatacaaaaaattagcc

SEQ ID NO: 690008 - DNA, 22 bp, Artificial Sequence
  chemically synthesized
tactaaaaatacaaaaaattag

SEQ ID NO: 690009 - DNA, 22 bp, Artificial Sequence
  chemically synthesized
gctaattttttgtatttttagt

SEQ ID NO: 690010 - DNA, 22 bp, Artificial Sequence
  chemically synthesized
attttttgtatttttagtagag

SEQ ID NO: 690011 - DNA, 22 bp, Artificial Sequence
  chemically synthesized
tttgtatttttagtagagactg

SEQ ID NO: 690012 - DNA, 22 bp, Artificial Sequence
  chemically synthesized
ttgtatttttagtagagactgg

SEQ ID NO: 690013 - DNA, 22 bp, Artificial Sequence
  chemically synthesized
acacggtgaaacccagtctcta

SEQ ID NO: 690014 - DNA, 22 bp, Artificial Sequence
  chemically synthesized
tgtatttttagtagagactggg

SEQ ID NO: 690015 - DNA, 22 bp, Artificial Sequence
  chemically synthesized
gtatttttagtagagactgggt

SEQ ID NO: 690016 - DNA, 22 bp, Artificial Sequence
  chemically synthesized
tatttttagtagagactgggtt

SEQ ID NO: 690017 - DNA, 22 bp, Artificial Sequence
  chemically synthesized
gctaacacggtgaaacccagtc

SEQ ID NO: 690018 - DNA, 22 bp, Artificial Sequence
  chemically synthesized
ttagtagagactgggtttcacc

SEQ ID NO: 690019 - DNA, 22 bp, Artificial Sequence
  chemically synthesized
tagtagagactgggtttcaccg

SEQ ID NO: 690020 - DNA, 22 bp, Artificial Sequence
  chemically synthesized
agtagagactgggtttcaccgt

SEQ ID NO: 690021 - DNA, 22 bp, Artificial Sequence
  chemically synthesized
gtagagactgggtttcaccgtg

SEQ ID NO: 690022 - DNA, 22 bp, Artificial Sequence
  chemically synthesized
ggtttcaccgtgttagccagga

SEQ ID NO: 690023 - DNA, 22 bp, Artificial Sequence
  chemically synthesized
caccgtgttagccaggatgatc

SEQ ID NO: 690024 - DNA, 22 bp, Artificial Sequence
  chemically synthesized
accgtgttagccaggatgatct

SEQ ID NO: 690025 - DNA, 22 bp, Artificial Sequence
  chemically synthesized
gccaggatgatctcgatctccc

SEQ ID NO: 690026 - DNA, 22 bp, Artificial Sequence
  chemically synthesized
gatctcccgaccttgtgatccg

SEQ ID NO: 690027 - DNA, 22 bp, Artificial Sequence
  chemically synthesized
tgaggccgaggtgggcggatca

SEQ ID NO: 690028 - DNA, 22 bp, Artificial Sequence
  chemically synthesized
gtgaggccgaggtgggcggatc

SEQ ID NO: 690029 - DNA, 22 bp, Artificial Sequence
  chemically synthesized
tgtgaggccgaggtgggcggat

SEQ ID NO: 690030 - DNA, 22 bp, Artificial Sequence
  chemically synthesized
ccgaccttgtgatccgcccacc

SEQ ID NO: 690031 - DNA, 22 bp, Artificial Sequence
  chemically synthesized
gtgatccgcccacctcggcctc

SEQ ID NO: 690032 - DNA, 22 bp, Artificial Sequence
  chemically synthesized
tgatccgcccacctcggcctca

SEQ ID NO: 690033 - DNA, 22 bp, Artificial Sequence
  chemically synthesized
taatcccagcactttgtgaggc

SEQ ID NO: 690034 - DNA, 22 bp, Artificial Sequence
  chemically synthesized
acacctgtaatcccagcacttt

SEQ ID NO: 690035 - DNA, 22 bp, Artificial Sequence
  chemically synthesized
ggcctcacaaagtgctgggatt

SEQ ID NO: 690036 - DNA, 22 bp, Artificial Sequence
  chemically synthesized
acaaagtgctgggattacaggt

SEQ ID NO: 690037 - DNA, 22 bp, Artificial Sequence
  chemically synthesized
cggccgggcgcggtggctcaca

SEQ ID NO: 690038 - DNA, 22 bp, Artificial Sequence
  chemically synthesized
ggattacaggtgtgagccaccg

SEQ ID NO: 690039 - DNA, 22 bp, Artificial Sequence
  chemically synthesized
caggtgtgagccaccgcgcccg

SEQ ID NO: 690040 - DNA, 22 bp, Artificial Sequence
  chemically synthesized
aaagcaaacctacggccgggcg

SEQ ID NO: 690041 - DNA, 22 bp, Artificial Sequence
  chemically synthesized
aaagtatattaaaagcaaacct

SEQ ID NO: 690042 - DNA, 22 bp, Artificial Sequence
  chemically synthesized
tgaaagtatattaaaagcaaac

SEQ ID NO: 690043 - DNA, 22 bp, Artificial Sequence
  chemically synthesized
acacacacattctgaaagtata

SEQ ID NO: 690044 - DNA, 22 bp, Artificial Sequence
  chemically synthesized
gcttttaatatactttcagaat

SEQ ID NO: 690045 - DNA, 22 bp, Artificial Sequence
  chemically synthesized
cttttaatatactttcagaatg

SEQ ID NO: 690046 - DNA, 22 bp, Artificial Sequence
  chemically synthesized
ttaatatactttcagaatgtgt

SEQ ID NO: 690047 - DNA, 22 bp, Artificial Sequence
  chemically synthesized
taatatactttcagaatgtgtg

SEQ ID NO: 690048 - DNA, 22 bp, Artificial Sequence
  chemically synthesized
aatatactttcagaatgtgtgt

SEQ ID NO: 690049 - DNA, 22 bp, Artificial Sequence
  chemically synthesized
atatactttcagaatgtgtgtg

SEQ ID NO: 690050 - DNA, 22 bp, Artificial Sequence
  chemically synthesized
tatgaaaaaaaaatgctaacac

SEQ ID NO: 690051 - DNA, 22 bp, Artificial Sequence
  chemically synthesized
tcagaatgtgtgtgttagcatt

SEQ ID NO: 690052 - DNA, 22 bp, Artificial Sequence
  chemically synthesized
cagaatgtgtgtgttagcattt

SEQ ID NO: 690053 - DNA, 22 bp, Artificial Sequence
  chemically synthesized
agaatgtgtgtgttagcatttt

SEQ ID NO: 690054 - DNA, 22 bp, Artificial Sequence
  chemically synthesized
ttatatgaaaaaaaaatgctaa

SEQ ID NO: 690055 - DNA, 22 bp, Artificial Sequence
  chemically synthesized
gcatttttttttcatataacag

SEQ ID NO: 690056 - DNA, 22 bp, Artificial Sequence
  chemically synthesized
aatgtcaataaagctgttatat

SEQ ID NO: 690057 - DNA, 22 bp, Artificial Sequence
  chemically synthesized
ttttttcatataacagctttat

SEQ ID NO: 690058 - DNA, 22 bp, Artificial Sequence
  chemically synthesized
tttttcatataacagctttatt

SEQ ID NO: 690059 - DNA, 22 bp, Artificial Sequence
  chemically synthesized
ttttcatataacagctttattg

SEQ ID NO: 690060 - DNA, 22 bp, Artificial Sequence
  chemically synthesized
tttcatataacagctttattga

SEQ ID NO: 690061 - DNA, 22 bp, Artificial Sequence
  chemically synthesized
ttcatataacagctttattgac

SEQ ID NO: 690062 - DNA, 22 bp, Artificial Sequence
  chemically synthesized
tcatataacagctttattgaca

SEQ ID NO: 690063 - DNA, 22 bp, Artificial Sequence
  chemically synthesized
catataacagctttattgacat

SEQ ID NO: 690064 - DNA, 22 bp, Artificial Sequence
  chemically synthesized
atataacagctttattgacatt

SEQ ID NO: 690065 - DNA, 22 bp, Artificial Sequence
  chemically synthesized
tattgacatttagtatacatac

SEQ ID NO: 690066 - DNA, 22 bp, Artificial Sequence
  chemically synthesized
attgacatttagtatacatacc

SEQ ID NO: 690067 - DNA, 22 bp, Artificial Sequence
  chemically synthesized
ttgacatttagtatacatacca

SEQ ID NO: 690068 - DNA, 22 bp, Artificial Sequence
  chemically synthesized
acatttagtatacataccatac

SEQ ID NO: 690069 - DNA, 22 bp, Artificial Sequence
  chemically synthesized
aatgggcgaatcgtatggtatg

SEQ ID NO: 690070 - DNA, 22 bp, Artificial Sequence
  chemically synthesized
aaatgggcgaatcgtatggtat

SEQ ID NO: 690071 - DNA, 22 bp, Artificial Sequence
  chemically synthesized
agtatacataccatacgattcg

SEQ ID NO: 690072 - DNA, 22 bp, Artificial Sequence
  chemically synthesized
gtatacataccatacgattcgc

SEQ ID NO: 690073 - DNA, 22 bp, Artificial Sequence
  chemically synthesized
tacaccttaaatgggcgaatcg

SEQ ID NO: 690074 - DNA, 22 bp, Artificial Sequence
  chemically synthesized
aattgtacaccttaaatgggcg

SEQ ID NO: 690075 - DNA, 22 bp, Artificial Sequence
  chemically synthesized
gcccatttaaggtgtacaattc

SEQ ID NO: 690076 - DNA, 22 bp, Artificial Sequence
  chemically synthesized
aaggtgtacaattcaatatttt

SEQ ID NO: 690077 - DNA, 22 bp, Artificial Sequence
  chemically synthesized
aggtgtacaattcaatattttt

SEQ ID NO: 690078 - DNA, 22 bp, Artificial Sequence
  chemically synthesized
aacaaacaaacaaacaaaaata

SEQ ID NO: 690079 - DNA, 22 bp, Artificial Sequence
  chemically synthesized
aatatttttgtttgtttgtttg

SEQ ID NO: 690080 - DNA, 22 bp, Artificial Sequence
  chemically synthesized
ttgtttgtttgtttgttgagac

SEQ ID NO: 690081 - DNA, 22 bp, Artificial Sequence
  chemically synthesized
tgtttgtttgtttgttgagact

SEQ ID NO: 690082 - DNA, 22 bp, Artificial Sequence
  chemically synthesized
ggtgacagagcgagtctcaaca

SEQ ID NO: 690083 - DNA, 22 bp, Artificial Sequence
  chemically synthesized
gtttgtttgtttgttgagactc

SEQ ID NO: 690084 - DNA, 22 bp, Artificial Sequence
  chemically synthesized
tttgtttgtttgttgagactcg

SEQ ID NO: 690085 - DNA, 22 bp, Artificial Sequence
  chemically synthesized
gtttgtttgttgagactcgctc

SEQ ID NO: 690086 - DNA, 22 bp, Artificial Sequence
  chemically synthesized
gcctgggtgacagagcgagtct

SEQ ID NO: 690087 - DNA, 22 bp, Artificial Sequence
  chemically synthesized
tttgtttgttgagactcgctct

SEQ ID NO: 690088 - DNA, 22 bp, Artificial Sequence
  chemically synthesized
tagcctgggtgacagagcgagt

SEQ ID NO: 690089 - DNA, 22 bp, Artificial Sequence
  chemically synthesized
gtttgttgagactcgctctgtc

SEQ ID NO: 690090 - DNA, 22 bp, Artificial Sequence
  chemically synthesized
tttgttgagactcgctctgtca

SEQ ID NO: 690091 - DNA, 22 bp, Artificial Sequence
  chemically synthesized
cactctagcctgggtgacagag

SEQ ID NO: 690092 - DNA, 22 bp, Artificial Sequence
  chemically synthesized
gttgagactcgctctgtcaccc

SEQ ID NO: 690093 - DNA, 22 bp, Artificial Sequence
  chemically synthesized
ttgagactcgctctgtcaccca

SEQ ID NO: 690094 - DNA, 22 bp, Artificial Sequence
  chemically synthesized
agactcgctctgtcacccaggc

SEQ ID NO: 690095 - DNA, 22 bp, Artificial Sequence
  chemically synthesized
gctctgtcacccaggctagagt

SEQ ID NO: 690096 - DNA, 22 bp, Artificial Sequence
  chemically synthesized
tgtcacccaggctagagtgcaa

SEQ ID NO: 690097 - DNA, 22 bp, Artificial Sequence
  chemically synthesized
tcacccaggctagagtgcaatg

SEQ ID NO: 690098 - DNA, 22 bp, Artificial Sequence
  chemically synthesized
cagtgagccaagatcatgccat

SEQ ID NO: 690099 - DNA, 22 bp, Artificial Sequence
  chemically synthesized
gagtgcaatggcatgatcttgg

SEQ ID NO: 690100 - DNA, 22 bp, Artificial Sequence
  chemically synthesized
ggaggtggaggttgcagtgagc

SEQ ID NO: 690101 - DNA, 22 bp, Artificial Sequence
  chemically synthesized
gggaggtggaggttgcagtgag

SEQ ID NO: 690102 - DNA, 22 bp, Artificial Sequence
  chemically synthesized
gacttgggaggtggaggttgca

SEQ ID NO: 690103 - DNA, 22 bp, Artificial Sequence
  chemically synthesized
ggacttgggaggtggaggttgc

SEQ ID NO: 690104 - DNA, 22 bp, Artificial Sequence
  chemically synthesized
ggctcactgcaacctccacctc

SEQ ID NO: 690105 - DNA, 22 bp, Artificial Sequence
  chemically synthesized
gctcactgcaacctccacctcc

SEQ ID NO: 690106 - DNA, 22 bp, Artificial Sequence
  chemically synthesized
actgcaacctccacctcccaag

SEQ ID NO: 690107 - DNA, 22 bp, Artificial Sequence
  chemically synthesized
caacctccacctcccaagtcca

SEQ ID NO: 690108 - DNA, 22 bp, Artificial Sequence
  chemically synthesized
aggcaggagaatcgcttggact

SEQ ID NO: 690109 - DNA, 22 bp, Artificial Sequence
  chemically synthesized
cacctcccaagtccaagcgatt

SEQ ID NO: 690110 - DNA, 22 bp, Artificial Sequence
  chemically synthesized
ggaggctgaggcaggagaatcg

SEQ ID NO: 690111 - DNA, 22 bp, Artificial Sequence
  chemically synthesized
ccaagtccaagcgattctcctg

SEQ ID NO: 690112 - DNA, 22 bp, Artificial Sequence
  chemically synthesized
gggaggctgaggcaggagaatc

SEQ ID NO: 690113 - DNA, 22 bp, Artificial Sequence
  chemically synthesized
cttgggaggctgaggcaggaga

SEQ ID NO: 690114 - DNA, 22 bp, Artificial Sequence
  chemically synthesized
taatcccagctacttgggaggc

SEQ ID NO: 690115 - DNA, 22 bp, Artificial Sequence
  chemically synthesized
gtaatcccagctacttgggagg

SEQ ID NO: 690116 - DNA, 22 bp, Artificial Sequence
  chemically synthesized
tcctgcctcagcctcccaagta

SEQ ID NO: 690117 - DNA, 22 bp, Artificial Sequence
  chemically synthesized
ctgcctcagcctcccaagtagc

SEQ ID NO: 690118 - DNA, 22 bp, Artificial Sequence
  chemically synthesized
cctcagcctcccaagtagctgg

SEQ ID NO: 690119 - DNA, 22 bp, Artificial Sequence
  chemically synthesized
agcctcccaagtagctgggatt

SEQ ID NO: 690120 - DNA, 22 bp, Artificial Sequence
  chemically synthesized
atagcgagcgcttgtaatccca

SEQ ID NO: 690121 - DNA, 22 bp, Artificial Sequence
  chemically synthesized
ccaagtagctgggattacaagc

SEQ ID NO: 690122 - DNA, 22 bp, Artificial Sequence
  chemically synthesized
gccaggcgttcatagcgagcgc

SEQ ID NO: 690123 - DNA, 22 bp, Artificial Sequence
  chemically synthesized
ggattacaagcgctcgctatga

SEQ ID NO: 690124 - DNA, 22 bp, Artificial Sequence
  chemically synthesized
caagcgctcgctatgaacgcct

SEQ ID NO: 690125 - DNA, 22 bp, Artificial Sequence
  chemically synthesized
aaaatacaaacattagccaggc

SEQ ID NO: 690126 - DNA, 22 bp, Artificial Sequence
  chemically synthesized
gctatgaacgcctggctaatgt

SEQ ID NO: 690127 - DNA, 22 bp, Artificial Sequence
  chemically synthesized
ctaaaaatacaaacattagcca

SEQ ID NO: 690128 - DNA, 22 bp, Artificial Sequence
  chemically synthesized
tactaaaaatacaaacattagc

SEQ ID NO: 690129 - DNA, 22 bp, Artificial Sequence
  chemically synthesized
tgaacgcctggctaatgtttgt

SEQ ID NO: 690130 - DNA, 22 bp, Artificial Sequence
  chemically synthesized
gctaatgtttgtatttttagta

SEQ ID NO: 690131 - DNA, 22 bp, Artificial Sequence
  chemically synthesized
atgtttgtatttttagtagaga

SEQ ID NO: 690132 - DNA, 22 bp, Artificial Sequence
  chemically synthesized
gtatttttagtagagatggggt

SEQ ID NO: 690133 - DNA, 22 bp, Artificial Sequence
  chemically synthesized
tatttttagtagagatggggtt

SEQ ID NO: 690134 - DNA, 22 bp, Artificial Sequence
  chemically synthesized
accaacatggtgaaaccccatc

SEQ ID NO: 690135 - DNA, 22 bp, Artificial Sequence
  chemically synthesized
ttagtagagatggggtttcacc

SEQ ID NO: 690136 - DNA, 22 bp, Artificial Sequence
  chemically synthesized
tagtagagatggggtttcacca

SEQ ID NO: 690137 - DNA, 22 bp, Artificial Sequence
  chemically synthesized
agtagagatggggtttcaccat

SEQ ID NO: 690138 - DNA, 22 bp, Artificial Sequence
  chemically synthesized
gtagagatggggtttcaccatg

SEQ ID NO: 690139 - DNA, 22 bp, Artificial Sequence
  chemically synthesized
gagaccagcctgaccaacatgg

SEQ ID NO: 690140 - DNA, 22 bp, Artificial Sequence
  chemically synthesized
caccatgttggtcaggctggtc

SEQ ID NO: 690141 - DNA, 22 bp, Artificial Sequence
  chemically synthesized
accatgttggtcaggctggtct

SEQ ID NO: 690142 - DNA, 22 bp, Artificial Sequence
  chemically synthesized
atgtcaggagttcgagaccagc

SEQ ID NO: 690143 - DNA, 22 bp, Artificial Sequence
  chemically synthesized
gatgtcaggagttcgagaccag

SEQ ID NO: 690144 - DNA, 22 bp, Artificial Sequence
  chemically synthesized
gtcaggctggtctcgaactcct

SEQ ID NO: 690145 - DNA, 22 bp, Artificial Sequence
  chemically synthesized
gtctcgaactcctgacatcaag

SEQ ID NO: 690146 - DNA, 22 bp, Artificial Sequence
  chemically synthesized
gaactcctgacatcaagtgatc

SEQ ID NO: 690147 - DNA, 22 bp, Artificial Sequence
  chemically synthesized
ggaggccaaggcgggcagatca

SEQ ID NO: 690148 - DNA, 22 bp, Artificial Sequence
  chemically synthesized
ctgacatcaagtgatctgcccg

SEQ ID NO: 690149 - DNA, 22 bp, Artificial Sequence
  chemically synthesized
gggaggccaaggcgggcagatc

SEQ ID NO: 690150 - DNA, 22 bp, Artificial Sequence
  chemically synthesized
tgggaggccaaggcgggcagat

SEQ ID NO: 690151 - DNA, 22 bp, Artificial Sequence
  chemically synthesized
acatcaagtgatctgcccgcct

SEQ ID NO: 690152 - DNA, 22 bp, Artificial Sequence
  chemically synthesized
taatgcaagcactttgggaggc

SEQ ID NO: 690153 - DNA, 22 bp, Artificial Sequence
  chemically synthesized
cccgccttggcctcccaaagtg

SEQ ID NO: 690154 - DNA, 22 bp, Artificial Sequence
  chemically synthesized
cgcctgtaatgcaagcactttg

SEQ ID NO: 690155 - DNA, 22 bp, Artificial Sequence
  chemically synthesized
ggcctcccaaagtgcttgcatt

SEQ ID NO: 690156 - DNA, 22 bp, Artificial Sequence
  chemically synthesized
gcctcccaaagtgcttgcatta

SEQ ID NO: 690157 - DNA, 22 bp, Artificial Sequence
  chemically synthesized
ccaaagtgcttgcattacaggc

SEQ ID NO: 690158 - DNA, 22 bp, Artificial Sequence
  chemically synthesized
gcattacaggcgtagccaccac

SEQ ID NO: 690159 - DNA, 22 bp, Artificial Sequence
  chemically synthesized
cattacaggcgtagccaccaca

SEQ ID NO: 690160 - DNA, 22 bp, Artificial Sequence
  chemically synthesized
agtcaaggccgggtgtggtggc

SEQ ID NO: 690161 - DNA, 22 bp, Artificial Sequence
  chemically synthesized
caggcgtagccaccacacccgg

SEQ ID NO: 690162 - DNA, 22 bp, Artificial Sequence
  chemically synthesized
catatatcaccaatacaaagta

SEQ ID NO: 690163 - DNA, 22 bp, Artificial Sequence
  chemically synthesized
gacttagtactttgtattggtg

SEQ ID NO: 690164 - DNA, 22 bp, Artificial Sequence
  chemically synthesized
acttagtactttgtattggtga

SEQ ID NO: 690165 - DNA, 22 bp, Artificial Sequence
  chemically synthesized
agtactttgtattggtgatata

SEQ ID NO: 690166 - DNA, 22 bp, Artificial Sequence
  chemically synthesized
aaatcaattccatatatcacca

SEQ ID NO: 690167 - DNA, 22 bp, Artificial Sequence
  chemically synthesized
gtactttgtattggtgatatat

SEQ ID NO: 690168 - DNA, 22 bp, Artificial Sequence
  chemically synthesized
tgtattggtgatatatggaatt

SEQ ID NO: 690169 - DNA, 22 bp, Artificial Sequence
  chemically synthesized
gtattggtgatatatggaattg

SEQ ID NO: 690170 - DNA, 22 bp, Artificial Sequence
  chemically synthesized
tattggtgatatatggaattga

SEQ ID NO: 690171 - DNA, 22 bp, Artificial Sequence
  chemically synthesized
gtgatatatggaattgatttca

SEQ ID NO: 690172 - DNA, 22 bp, Artificial Sequence
  chemically synthesized
gaatggcaaaaaatgttgaaat

SEQ ID NO: 690173 - DNA, 22 bp, Artificial Sequence
  chemically synthesized
accctagaatggcaaaaaatgt

SEQ ID NO: 690174 - DNA, 22 bp, Artificial Sequence
  chemically synthesized
caccctagaatggcaaaaaatg

SEQ ID NO: 690175 - DNA, 22 bp, Artificial Sequence
  chemically synthesized
tcaccctagaatggcaaaaaat

SEQ ID NO: 690176 - DNA, 22 bp, Artificial Sequence
  chemically synthesized
atttcaacattttttgccattc

SEQ ID NO: 690177 - DNA, 22 bp, Artificial Sequence
  chemically synthesized
caacattttttgccattctagg

SEQ ID NO: 690178 - DNA, 22 bp, Artificial Sequence
  chemically synthesized
tagcactttcaccctagaatgg

SEQ ID NO: 690179 - DNA, 22 bp, Artificial Sequence
  chemically synthesized
aacattttttgccattctaggg

SEQ ID NO: 690180 - DNA, 22 bp, Artificial Sequence
  chemically synthesized
ttgtagcactttcaccctagaa

SEQ ID NO: 690181 - DNA, 22 bp, Artificial Sequence
  chemically synthesized
attgtagcactttcaccctaga

SEQ ID NO: 690182 - DNA, 22 bp, Artificial Sequence
  chemically synthesized
tttgccattctagggtgaaagt

SEQ ID NO: 690183 - DNA, 22 bp, Artificial Sequence
  chemically synthesized
atttattgtagcactttcaccc

SEQ ID NO: 690184 - DNA, 22 bp, Artificial Sequence
  chemically synthesized
ttgccattctagggtgaaagtg

SEQ ID NO: 690185 - DNA, 22 bp, Artificial Sequence
  chemically synthesized
aatttattgtagcactttcacc

SEQ ID NO: 690186 - DNA, 22 bp, Artificial Sequence
  chemically synthesized
tgccattctagggtgaaagtgc

SEQ ID NO: 690187 - DNA, 22 bp, Artificial Sequence
  chemically synthesized
taatttattgtagcactttcac

SEQ ID NO: 690188 - DNA, 22 bp, Artificial Sequence
  chemically synthesized
gccattctagggtgaaagtgct

SEQ ID NO: 690189 - DNA, 22 bp, Artificial Sequence
  chemically synthesized
ccattctagggtgaaagtgcta

SEQ ID NO: 690190 - DNA, 22 bp, Artificial Sequence
  chemically synthesized
tagggtgaaagtgctacaataa

SEQ ID NO: 690191 - DNA, 22 bp, Artificial Sequence
  chemically synthesized
gggtgaaagtgctacaataaat

SEQ ID NO: 690192 - DNA, 22 bp, Artificial Sequence
  chemically synthesized
gtataaggttttaatttattgt

SEQ ID NO: 690193 - DNA, 22 bp, Artificial Sequence
  chemically synthesized
gctggtataaggttttaattta

SEQ ID NO: 690194 - DNA, 22 bp, Artificial Sequence
  chemically synthesized
ggctggtataaggttttaattt

SEQ ID NO: 690195 - DNA, 22 bp, Artificial Sequence
  chemically synthesized
tggctggtataaggttttaatt

SEQ ID NO: 690196 - DNA, 22 bp, Artificial Sequence
  chemically synthesized
tttggctggtataaggttttaa

SEQ ID NO: 690197 - DNA, 22 bp, Artificial Sequence
  chemically synthesized
ctttggctggtataaggtttta

SEQ ID NO: 690198 - DNA, 22 bp, Artificial Sequence
  chemically synthesized
ttctttggctggtataaggttt

SEQ ID NO: 690199 - DNA, 22 bp, Artificial Sequence
  chemically synthesized
caataaattaaaaccttatacc

SEQ ID NO: 690200 - DNA, 22 bp, Artificial Sequence
  chemically synthesized
cctcttctttggctggtataag

SEQ ID NO: 690201 - DNA, 22 bp, Artificial Sequence
  chemically synthesized
agagctgcctcttctttggctg

SEQ ID NO: 690202 - DNA, 22 bp, Artificial Sequence
  chemically synthesized
aaaccttataccagccaaagaa

SEQ ID NO: 690203 - DNA, 22 bp, Artificial Sequence
  chemically synthesized
acaattgagagctgcctcttct

SEQ ID NO: 690204 - DNA, 22 bp, Artificial Sequence
  chemically synthesized
ataccagccaaagaagaggcag

SEQ ID NO: 690205 - DNA, 22 bp, Artificial Sequence
  chemically synthesized
taccagccaaagaagaggcagc

SEQ ID NO: 690206 - DNA, 22 bp, Artificial Sequence
  chemically synthesized
aacattcacaattgagagctgc

SEQ ID NO: 690207 - DNA, 22 bp, Artificial Sequence
  chemically synthesized
tcaacattcacaattgagagct

SEQ ID NO: 690208 - DNA, 22 bp, Artificial Sequence
  chemically synthesized
taagtatattctcaacattcac

SEQ ID NO: 690209 - DNA, 22 bp, Artificial Sequence
  chemically synthesized
gtaagtatattctcaacattca

SEQ ID NO: 690210 - DNA, 22 bp, Artificial Sequence
  chemically synthesized
ttgtaagtatattctcaacatt

SEQ ID NO: 690211 - DNA, 22 bp, Artificial Sequence
  chemically synthesized
cttgtaagtatattctcaacat

SEQ ID NO: 690212 - DNA, 22 bp, Artificial Sequence
  chemically synthesized
tcttgtaagtatattctcaaca

SEQ ID NO: 690213 - DNA, 22 bp, Artificial Sequence
  chemically synthesized
tcaattgtgaatgttgagaata

SEQ ID NO: 690214 - DNA, 22 bp, Artificial Sequence
  chemically synthesized
ttcttgtaagtatattctcaac

SEQ ID NO: 690215 - DNA, 22 bp, Artificial Sequence
  chemically synthesized
aattgtgaatgttgagaatata

SEQ ID NO: 690216 - DNA, 22 bp, Artificial Sequence
  chemically synthesized
aatttttcttgtaagtatattc

SEQ ID NO: 690217 - DNA, 22 bp, Artificial Sequence
  chemically synthesized
tgaatgttgagaatatacttac

SEQ ID NO: 690218 - DNA, 22 bp, Artificial Sequence
  chemically synthesized
agaatatacttacaagaaaaat

SEQ ID NO: 690219 - DNA, 22 bp, Artificial Sequence
  chemically synthesized
catcaccaaagttaaatttttc

SEQ ID NO: 690220 - DNA, 22 bp, Artificial Sequence
  chemically synthesized
ttacatcaccaaagttaaattt

SEQ ID NO: 690221 - DNA, 22 bp, Artificial Sequence
  chemically synthesized
acaagaaaaatttaactttggt

SEQ ID NO: 690222 - DNA, 22 bp, Artificial Sequence
  chemically synthesized
caagaaaaatttaactttggtg

SEQ ID NO: 690223 - DNA, 22 bp, Artificial Sequence
  chemically synthesized
aactttggtgatgtaatagctt

SEQ ID NO: 690224 - DNA, 22 bp, Artificial Sequence
  chemically synthesized
actttggtgatgtaatagcttc

SEQ ID NO: 690225 - DNA, 22 bp, Artificial Sequence
  chemically synthesized
ggtaatgcaaatgaagctatta

SEQ ID NO: 690226 - DNA, 22 bp, Artificial Sequence
  chemically synthesized
aggtaatgcaaatgaagctatt

SEQ ID NO: 690227 - DNA, 22 bp, Artificial Sequence
  chemically synthesized
taggtaatgcaaatgaagctat

SEQ ID NO: 690228 - DNA, 22 bp, Artificial Sequence
  chemically synthesized
tggtgatgtaatagcttcattt

SEQ ID NO: 690229 - DNA, 22 bp, Artificial Sequence
  chemically synthesized
ggtgatgtaatagcttcatttg

SEQ ID NO: 690230 - DNA, 22 bp, Artificial Sequence
  chemically synthesized
gtgatgtaatagcttcatttgc

SEQ ID NO: 690231 - DNA, 22 bp, Artificial Sequence
  chemically synthesized
aagctttaggtaatgcaaatga

SEQ ID NO: 690232 - DNA, 22 bp, Artificial Sequence
  chemically synthesized
caagctttaggtaatgcaaatg

SEQ ID NO: 690233 - DNA, 22 bp, Artificial Sequence
  chemically synthesized
acttcaagctttaggtaatgca

SEQ ID NO: 690234 - DNA, 22 bp, Artificial Sequence
  chemically synthesized
gacttcaagctttaggtaatgc

SEQ ID NO: 690235 - DNA, 22 bp, Artificial Sequence
  chemically synthesized
tgacttcaagctttaggtaatg

SEQ ID NO: 690236 - DNA, 22 bp, Artificial Sequence
  chemically synthesized
ttgacttcaagctttaggtaat

SEQ ID NO: 690237 - DNA, 22 bp, Artificial Sequence
  chemically synthesized
gcttttgacttcaagctttagg

SEQ ID NO: 690238 - DNA, 22 bp, Artificial Sequence
  chemically synthesized
catttgcattacctaaagcttg

SEQ ID NO: 690239 - DNA, 22 bp, Artificial Sequence
  chemically synthesized
agcttttgacttcaagctttag

SEQ ID NO: 690240 - DNA, 22 bp, Artificial Sequence
  chemically synthesized
atttgcattacctaaagcttga

SEQ ID NO: 690241 - DNA, 22 bp, Artificial Sequence
  chemically synthesized
tagcttttgacttcaagcttta

SEQ ID NO: 690242 - DNA, 22 bp, Artificial Sequence
  chemically synthesized
gcattacctaaagcttgaagtc

SEQ ID NO: 690243 - DNA, 22 bp, Artificial Sequence
  chemically synthesized
cattacctaaagcttgaagtca

SEQ ID NO: 690244 - DNA, 22 bp, Artificial Sequence
  chemically synthesized
atactttagcttttgacttcaa

SEQ ID NO: 690245 - DNA, 22 bp, Artificial Sequence
  chemically synthesized
aatactttagcttttgacttca

SEQ ID NO: 690246 - DNA, 22 bp, Artificial Sequence
  chemically synthesized
cctaaagcttgaagtcaaaagc

SEQ ID NO: 690247 - DNA, 22 bp, Artificial Sequence
  chemically synthesized
aagcttgaagtcaaaagctaaa

SEQ ID NO: 690248 - DNA, 22 bp, Artificial Sequence
  chemically synthesized
tacgcttaatactttagctttt

SEQ ID NO: 690249 - DNA, 22 bp, Artificial Sequence
  chemically synthesized
tgtacgcttaatactttagctt

SEQ ID NO: 690250 - DNA, 22 bp, Artificial Sequence
  chemically synthesized
ctgtacgcttaatactttagct

SEQ ID NO: 690251 - DNA, 22 bp, Artificial Sequence
  chemically synthesized
gaagtcaaaagctaaagtatta

SEQ ID NO: 690252 - DNA, 22 bp, Artificial Sequence
  chemically synthesized
aagtcaaaagctaaagtattaa

SEQ ID NO: 690253 - DNA, 22 bp, Artificial Sequence
  chemically synthesized
atagagtccatgcttctgtacg

SEQ ID NO: 690254 - DNA, 22 bp, Artificial Sequence
  chemically synthesized
catagagtccatgcttctgtac

SEQ ID NO: 690255 - DNA, 22 bp, Artificial Sequence
  chemically synthesized
aagtattaagcgtacagaagca

SEQ ID NO: 690256 - DNA, 22 bp, Artificial Sequence
  chemically synthesized
tcatagagtccatgcttctgta

SEQ ID NO: 690257 - DNA, 22 bp, Artificial Sequence
  chemically synthesized
tttcatagagtccatgcttctg

SEQ ID NO: 690258 - DNA, 22 bp, Artificial Sequence
  chemically synthesized
ctttcatagagtccatgcttct

SEQ ID NO: 690259 - DNA, 22 bp, Artificial Sequence
  chemically synthesized
tttctttcatagagtccatgct

SEQ ID NO: 690260 - DNA, 22 bp, Artificial Sequence
  chemically synthesized
agcgtacagaagcatggactct

SEQ ID NO: 690261 - DNA, 22 bp, Artificial Sequence
  chemically synthesized
gattgtttctttcatagagtcc

SEQ ID NO: 690262 - DNA, 22 bp, Artificial Sequence
  chemically synthesized
ggattgtttctttcatagagtc

SEQ ID NO: 690263 - DNA, 22 bp, Artificial Sequence
  chemically synthesized
tggattgtttctttcatagagt

SEQ ID NO: 690264 - DNA, 22 bp, Artificial Sequence
  chemically synthesized
ttggattgtttctttcatagag

SEQ ID NO: 690265 - DNA, 22 bp, Artificial Sequence
  chemically synthesized
tttggattgtttctttcataga

SEQ ID NO: 690266 - DNA, 22 bp, Artificial Sequence
  chemically synthesized
tatgaaagaaacaatccaaaaa

SEQ ID NO: 690267 - DNA, 22 bp, Artificial Sequence
  chemically synthesized
tgaaagaaacaatccaaaaagt

SEQ ID NO: 690268 - DNA, 22 bp, Artificial Sequence
  chemically synthesized
taaaaaaaaaaaaaaaaaaaag

SEQ ID NO: 690269 - DNA, 22 bp, Artificial Sequence
  chemically synthesized
ccattgtaaaaaaaaaaaaaaa

SEQ ID NO: 690270 - DNA, 22 bp, Artificial Sequence
  chemically synthesized
atgtctcccattgtaaaaaaaa

SEQ ID NO: 690271 - DNA, 22 bp, Artificial Sequence
  chemically synthesized
aatgtctcccattgtaaaaaaa

SEQ ID NO: 690272 - DNA, 22 bp, Artificial Sequence
  chemically synthesized
ttttttttttttttttttacaa

SEQ ID NO: 690273 - DNA, 22 bp, Artificial Sequence
  chemically synthesized
tttttttttttttttttacaat

SEQ ID NO: 690274 - DNA, 22 bp, Artificial Sequence
  chemically synthesized
ttaatgtctcccattgtaaaaa

SEQ ID NO: 690275 - DNA, 22 bp, Artificial Sequence
  chemically synthesized
ttttttttttttttttacaatg

SEQ ID NO: 690276 - DNA, 22 bp, Artificial Sequence
  chemically synthesized
tttttttttttttttacaatgg

SEQ ID NO: 690277 - DNA, 22 bp, Artificial Sequence
  chemically synthesized
ttttttttttttttacaatggg

SEQ ID NO: 690278 - DNA, 22 bp, Artificial Sequence
  chemically synthesized
tttttttttttttacaatggga

SEQ ID NO: 690279 - DNA, 22 bp, Artificial Sequence
  chemically synthesized
ttttttttttttacaatgggag

SEQ ID NO: 690280 - DNA, 22 bp, Artificial Sequence
  chemically synthesized
tttttttttttacaatgggaga

SEQ ID NO: 690281 - DNA, 22 bp, Artificial Sequence
  chemically synthesized
ttttttttttacaatgggagac

SEQ ID NO: 690282 - DNA, 22 bp, Artificial Sequence
  chemically synthesized
tttttttttacaatgggagaca

SEQ ID NO: 690283 - DNA, 22 bp, Artificial Sequence
  chemically synthesized
ttttttttacaatgggagacat

SEQ ID NO: 690284 - DNA, 22 bp, Artificial Sequence
  chemically synthesized
ccaaagttcttaatgtctccca

SEQ ID NO: 690285 - DNA, 22 bp, Artificial Sequence
  chemically synthesized
tttttttacaatgggagacatt

SEQ ID NO: 690286 - DNA, 22 bp, Artificial Sequence
  chemically synthesized
ttttttacaatgggagacatta

SEQ ID NO: 690287 - DNA, 22 bp, Artificial Sequence
  chemically synthesized
tttttacaatgggagacattaa

SEQ ID NO: 690288 - DNA, 22 bp, Artificial Sequence
  chemically synthesized
ttttacaatgggagacattaag

SEQ ID NO: 690289 - DNA, 22 bp, Artificial Sequence
  chemically synthesized
gttaccaaagttcttaatgtct

SEQ ID NO: 690290 - DNA, 22 bp, Artificial Sequence
  chemically synthesized
tttacaatgggagacattaaga

SEQ ID NO: 690291 - DNA, 22 bp, Artificial Sequence
  chemically synthesized
ttacaatgggagacattaagaa

SEQ ID NO: 690292 - DNA, 22 bp, Artificial Sequence
  chemically synthesized
tacaatgggagacattaagaac

SEQ ID NO: 690293 - DNA, 22 bp, Artificial Sequence
  chemically synthesized
acaatgggagacattaagaact

SEQ ID NO: 690294 - DNA, 22 bp, Artificial Sequence
  chemically synthesized
caatgggagacattaagaactt

SEQ ID NO: 690295 - DNA, 22 bp, Artificial Sequence
  chemically synthesized
aagagttagttaccaaagttct

SEQ ID NO: 690296 - DNA, 22 bp, Artificial Sequence
  chemically synthesized
agaactttggtaactaactctt

SEQ ID NO: 690297 - DNA, 22 bp, Artificial Sequence
  chemically synthesized
tcatcagggacatattgaagag

SEQ ID NO: 690298 - DNA, 22 bp, Artificial Sequence
  chemically synthesized
tggtaactaactcttcaatatg

SEQ ID NO: 690299 - DNA, 22 bp, Artificial Sequence
  chemically synthesized
ggtaactaactcttcaatatgt

SEQ ID NO: 690300 - DNA, 22 bp, Artificial Sequence
  chemically synthesized
gtaactaactcttcaatatgtc

SEQ ID NO: 690301 - DNA, 22 bp, Artificial Sequence
  chemically synthesized
gtctgtcatcagggacatattg

SEQ ID NO: 690302 - DNA, 22 bp, Artificial Sequence
  chemically synthesized
ggtctgtcatcagggacatatt

SEQ ID NO: 690303 - DNA, 22 bp, Artificial Sequence
  chemically synthesized
actcttcaatatgtccctgatg

SEQ ID NO: 690304 - DNA, 22 bp, Artificial Sequence
  chemically synthesized
ttcaatatgtccctgatgacag

SEQ ID NO: 690305 - DNA, 22 bp, Artificial Sequence
  chemically synthesized
caatatgtccctgatgacagac

SEQ ID NO: 690306 - DNA, 22 bp, Artificial Sequence
  chemically synthesized
aatatgtccctgatgacagacc

SEQ ID NO: 690307 - DNA, 22 bp, Artificial Sequence
  chemically synthesized
gtcataaatccttggtctgtca

SEQ ID NO: 690308 - DNA, 22 bp, Artificial Sequence
  chemically synthesized
tggtcataaatccttggtctgt

SEQ ID NO: 690309 - DNA, 22 bp, Artificial Sequence
  chemically synthesized
ctggtcataaatccttggtctg

SEQ ID NO: 690310 - DNA, 22 bp, Artificial Sequence
  chemically synthesized
ttctggtcataaatccttggtc

SEQ ID NO: 690311 - DNA, 22 bp, Artificial Sequence
  chemically synthesized
cttctggtcataaatccttggt

SEQ ID NO: 690312 - DNA, 22 bp, Artificial Sequence
  chemically synthesized
atgacagaccaaggatttatga

SEQ ID NO: 690313 - DNA, 22 bp, Artificial Sequence
  chemically synthesized
atagcttcttctggtcataaat

SEQ ID NO: 690314 - DNA, 22 bp, Artificial Sequence
  chemically synthesized
aatagcttcttctggtcataaa

SEQ ID NO: 690315 - DNA, 22 bp, Artificial Sequence
  chemically synthesized
ttaatagcttcttctggtcata

SEQ ID NO: 690316 - DNA, 22 bp, Artificial Sequence
  chemically synthesized
cttaatagcttcttctggtcat

SEQ ID NO: 690317 - DNA, 22 bp, Artificial Sequence
  chemically synthesized
tcttaatagcttcttctggtca

SEQ ID NO: 690318 - DNA, 22 bp, Artificial Sequence
  chemically synthesized
aggaagattttcttaatagctt

SEQ ID NO: 690319 - DNA, 22 bp, Artificial Sequence
  chemically synthesized
atgaccagaagaagctattaag

SEQ ID NO: 690320 - DNA, 22 bp, Artificial Sequence
  chemically synthesized
tgaccagaagaagctattaaga

SEQ ID NO: 690321 - DNA, 22 bp, Artificial Sequence
  chemically synthesized
acacctcaggaagattttctta

SEQ ID NO: 690322 - DNA, 22 bp, Artificial Sequence
  chemically synthesized
aacacctcaggaagattttctt

SEQ ID NO: 690323 - DNA, 22 bp, Artificial Sequence
  chemically synthesized
aatgtttaacacctcaggaaga

SEQ ID NO: 690324 - DNA, 22 bp, Artificial Sequence
  chemically synthesized
ttaagaaaatcttcctgaggtg

SEQ ID NO: 690325 - DNA, 22 bp, Artificial Sequence
  chemically synthesized
agaaaatcttcctgaggtgtta

SEQ ID NO: 690326 - DNA, 22 bp, Artificial Sequence
  chemically synthesized
cctgaggtgttaaacattgaac

SEQ ID NO: 690327 - DNA, 22 bp, Artificial Sequence
  chemically synthesized
ctgaggtgttaaacattgaaca

SEQ ID NO: 690328 - DNA, 22 bp, Artificial Sequence
  chemically synthesized
atgaataatccatgttcaatgt

SEQ ID NO: 690329 - DNA, 22 bp, Artificial Sequence
  chemically synthesized
catgaataatccatgttcaatg

SEQ ID NO: 690330 - DNA, 22 bp, Artificial Sequence
  chemically synthesized
tcatgaataatccatgttcaat

SEQ ID NO: 690331 - DNA, 22 bp, Artificial Sequence
  chemically synthesized
aggtgttaaacattgaacatgg

SEQ ID NO: 690332 - DNA, 22 bp, Artificial Sequence
  chemically synthesized
ttcatgaataatccatgttcaa

SEQ ID NO: 690333 - DNA, 22 bp, Artificial Sequence
  chemically synthesized
tcttttcatgaataatccatgt

SEQ ID NO: 690334 - DNA, 22 bp, Artificial Sequence
  chemically synthesized
ctatcttttcatgaataatcca

SEQ ID NO: 690335 - DNA, 22 bp, Artificial Sequence
  chemically synthesized
aacattgaacatggattattca

SEQ ID NO: 690336 - DNA, 22 bp, Artificial Sequence
  chemically synthesized
cctatcttttcatgaataatcc

SEQ ID NO: 690337 - DNA, 22 bp, Artificial Sequence
  chemically synthesized
aacatggattattcatgaaaag

SEQ ID NO: 690338 - DNA, 22 bp, Artificial Sequence
  chemically synthesized
agaaaagagatttcctatcttt

SEQ ID NO: 690339 - DNA, 22 bp, Artificial Sequence
  chemically synthesized
attcagaaaagagatttcctat

SEQ ID NO: 690340 - DNA, 22 bp, Artificial Sequence
  chemically synthesized
ttcatgaaaagataggaaatct

SEQ ID NO: 690341 - DNA, 22 bp, Artificial Sequence
  chemically synthesized
tgattcagaaaagagatttcct

SEQ ID NO: 690342 - DNA, 22 bp, Artificial Sequence
  chemically synthesized
ctgattcagaaaagagatttcc

SEQ ID NO: 690343 - DNA, 22 bp, Artificial Sequence
  chemically synthesized
atgaaaagataggaaatctctt

SEQ ID NO: 690344 - DNA, 22 bp, Artificial Sequence
  chemically synthesized
ttctgattcagaaaagagattt

SEQ ID NO: 690345 - DNA, 22 bp, Artificial Sequence
  chemically synthesized
tcttctgattcagaaaagagat

SEQ ID NO: 690346 - DNA, 22 bp, Artificial Sequence
  chemically synthesized
ctctcttctgattcagaaaaga

SEQ ID NO: 690347 - DNA, 22 bp, Artificial Sequence
  chemically synthesized
ttttctgaatcagaagagagta

SEQ ID NO: 690348 - DNA, 22 bp, Artificial Sequence
  chemically synthesized
ttctgaatcagaagagagtaga

SEQ ID NO: 690349 - DNA, 22 bp, Artificial Sequence
  chemically synthesized
tctgaatcagaagagagtagat

SEQ ID NO: 690350 - DNA, 22 bp, Artificial Sequence
  chemically synthesized
ctgaatcagaagagagtagatt

SEQ ID NO: 690351 - DNA, 22 bp, Artificial Sequence
  chemically synthesized
cagatcaacaagaatctactct

SEQ ID NO: 690352 - DNA, 22 bp, Artificial Sequence
  chemically synthesized
tgaatcagaagagagtagattc

SEQ ID NO: 690353 - DNA, 22 bp, Artificial Sequence
  chemically synthesized
aatcagaagagagtagattctt

SEQ ID NO: 690354 - DNA, 22 bp, Artificial Sequence
  chemically synthesized
ttgttgatctggagtggtttcc

SEQ ID NO: 690355 - DNA, 22 bp, Artificial Sequence
  chemically synthesized
gttgatctggagtggtttccat

SEQ ID NO: 690356 - DNA, 22 bp, Artificial Sequence
  chemically synthesized
ttgatctggagtggtttccatt

SEQ ID NO: 690357 - DNA, 22 bp, Artificial Sequence
  chemically synthesized
ccatggcagaagtaaatggaaa

SEQ ID NO: 690358 - DNA, 22 bp, Artificial Sequence
  chemically synthesized
atctggagtggtttccatttac

SEQ ID NO: 690359 - DNA, 22 bp, Artificial Sequence
  chemically synthesized
ttcccatggcagaagtaaatgg

SEQ ID NO: 690360 - DNA, 22 bp, Artificial Sequence
  chemically synthesized
attcccatggcagaagtaaatg

SEQ ID NO: 690361 - DNA, 22 bp, Artificial Sequence
  chemically synthesized
gagtggtttccatttacttctg

SEQ ID NO: 690362 - DNA, 22 bp, Artificial Sequence
  chemically synthesized
agtttattcccatggcagaagt

SEQ ID NO: 690363 - DNA, 22 bp, Artificial Sequence
  chemically synthesized
ccatttacttctgccatgggaa

SEQ ID NO: 690364 - DNA, 22 bp, Artificial Sequence
  chemically synthesized
catttacttctgccatgggaat

SEQ ID NO: 690365 - DNA, 22 bp, Artificial Sequence
  chemically synthesized
acttctgccatgggaataaact

SEQ ID NO: 690366 - DNA, 22 bp, Artificial Sequence
  chemically synthesized
cttctgccatgggaataaactg

SEQ ID NO: 690367 - DNA, 22 bp, Artificial Sequence
  chemically synthesized
tagagcaatcattcagtttatt

SEQ ID NO: 690368 - DNA, 22 bp, Artificial Sequence
  chemically synthesized
ctgccatgggaataaactgaat

SEQ ID NO: 690369 - DNA, 22 bp, Artificial Sequence
  chemically synthesized
tgccatgggaataaactgaatg

SEQ ID NO: 690370 - DNA, 22 bp, Artificial Sequence
  chemically synthesized
ccatgggaataaactgaatgat

SEQ ID NO: 690371 - DNA, 22 bp, Artificial Sequence
  chemically synthesized
aattatagagcaatcattcagt

SEQ ID NO: 690372 - DNA, 22 bp, Artificial Sequence
  chemically synthesized
ttcaattatagagcaatcattc

SEQ ID NO: 690373 - DNA, 22 bp, Artificial Sequence
  chemically synthesized
aaagactattcaattatagagc

SEQ ID NO: 690374 - DNA, 22 bp, Artificial Sequence
  chemically synthesized
aaaagactattcaattatagag

SEQ ID NO: 690375 - DNA, 22 bp, Artificial Sequence
  chemically synthesized
aatgattgctctataattgaat

SEQ ID NO: 690376 - DNA, 22 bp, Artificial Sequence
  chemically synthesized
ctctataattgaatagtctttt

SEQ ID NO: 690377 - DNA, 22 bp, Artificial Sequence
  chemically synthesized
tagagtatggtttaaaagacta

SEQ ID NO: 690378 - DNA, 22 bp, Artificial Sequence
  chemically synthesized
atagagtatggtttaaaagact

SEQ ID NO: 690379 - DNA, 22 bp, Artificial Sequence
  chemically synthesized
tataattgaatagtcttttaaa

SEQ ID NO: 690380 - DNA, 22 bp, Artificial Sequence
  chemically synthesized
taattgaatagtcttttaaacc

SEQ ID NO: 690381 - DNA, 22 bp, Artificial Sequence
  chemically synthesized
tagaatttatagagtatggttt

SEQ ID NO: 690382 - DNA, 22 bp, Artificial Sequence
  chemically synthesized
aatagtcttttaaaccatactc

SEQ ID NO: 690383 - DNA, 22 bp, Artificial Sequence
  chemically synthesized
ttaaaccatactctataaattc

SEQ ID NO: 690384 - DNA, 22 bp, Artificial Sequence
  chemically synthesized
taaaccatactctataaattct

SEQ ID NO: 690385 - DNA, 22 bp, Artificial Sequence
  chemically synthesized
taagatagttatagaatttata

SEQ ID NO: 690386 - DNA, 22 bp, Artificial Sequence
  chemically synthesized
aaaccatactctataaattcta

SEQ ID NO: 690387 - DNA, 22 bp, Artificial Sequence
  chemically synthesized
ataagatagttatagaatttat

SEQ ID NO: 690388 - DNA, 22 bp, Artificial Sequence
  chemically synthesized
aaccatactctataaattctat

SEQ ID NO: 690389 - DNA, 22 bp, Artificial Sequence
  chemically synthesized
tataaattctataactatctta

SEQ ID NO: 690390 - DNA, 22 bp, Artificial Sequence
  chemically synthesized
gataccatacttataagatagt

SEQ ID NO: 690391 - DNA, 22 bp, Artificial Sequence
  chemically synthesized
taaattctataactatcttata

SEQ ID NO: 690392 - DNA, 22 bp, Artificial Sequence
  chemically synthesized
agataccatacttataagatag

SEQ ID NO: 690393 - DNA, 22 bp, Artificial Sequence
  chemically synthesized
tagataccatacttataagata

SEQ ID NO: 690394 - DNA, 22 bp, Artificial Sequence
  chemically synthesized
ttagataccatacttataagat

SEQ ID NO: 690395 - DNA, 22 bp, Artificial Sequence
  chemically synthesized
tttttagataccatacttataa

SEQ ID NO: 690396 - DNA, 22 bp, Artificial Sequence
  chemically synthesized
atttttagataccatacttata

SEQ ID NO: 690397 - DNA, 22 bp, Artificial Sequence
  chemically synthesized
tataactatcttataagtatgg

SEQ ID NO: 690398 - DNA, 22 bp, Artificial Sequence
  chemically synthesized
taactatcttataagtatggta

SEQ ID NO: 690399 - DNA, 22 bp, Artificial Sequence
  chemically synthesized
tcagtcttatttttagatacca

SEQ ID NO: 690400 - DNA, 22 bp, Artificial Sequence
  chemically synthesized
tcttataagtatggtatctaaa

SEQ ID NO: 690401 - DNA, 22 bp, Artificial Sequence
  chemically synthesized
ataagtatggtatctaaaaata

SEQ ID NO: 690402 - DNA, 22 bp, Artificial Sequence
  chemically synthesized
taagtatggtatctaaaaataa

SEQ ID NO: 690403 - DNA, 22 bp, Artificial Sequence
  chemically synthesized
aagctatcagtcttatttttag

SEQ ID NO: 690404 - DNA, 22 bp, Artificial Sequence
  chemically synthesized
tgagtcctcaagctatcagtct

SEQ ID NO: 690405 - DNA, 22 bp, Artificial Sequence
  chemically synthesized
aaaataagactgatagcttgag

SEQ ID NO: 690406 - DNA, 22 bp, Artificial Sequence
  chemically synthesized
acaactatgagtcctcaagcta

SEQ ID NO: 690407 - DNA, 22 bp, Artificial Sequence
  chemically synthesized
cacaactatgagtcctcaagct

SEQ ID NO: 690408 - DNA, 22 bp, Artificial Sequence
  chemically synthesized
tcacaactatgagtcctcaagc

SEQ ID NO: 690409 - DNA, 22 bp, Artificial Sequence
  chemically synthesized
ttcacaactatgagtcctcaag

SEQ ID NO: 690410 - DNA, 22 bp, Artificial Sequence
  chemically synthesized
atagcttgaggactcatagttg

SEQ ID NO: 690411 - DNA, 22 bp, Artificial Sequence
  chemically synthesized
aatagtttttcacaactatgag

SEQ ID NO: 690412 - DNA, 22 bp, Artificial Sequence
  chemically synthesized
caatagtttttcacaactatga

SEQ ID NO: 690413 - DNA, 22 bp, Artificial Sequence
  chemically synthesized
tcaatagtttttcacaactatg

SEQ ID NO: 690414 - DNA, 22 bp, Artificial Sequence
  chemically synthesized
gaggactcatagttgtgaaaaa

SEQ ID NO: 690415 - DNA, 22 bp, Artificial Sequence
  chemically synthesized
aggactcatagttgtgaaaaac

SEQ ID NO: 690416 - DNA, 22 bp, Artificial Sequence
  chemically synthesized
aatgatactttcaatagttttt

SEQ ID NO: 690417 - DNA, 22 bp, Artificial Sequence
  chemically synthesized
caatgatactttcaatagtttt

SEQ ID NO: 690418 - DNA, 22 bp, Artificial Sequence
  chemically synthesized
tcaatgatactttcaatagttt

SEQ ID NO: 690419 - DNA, 22 bp, Artificial Sequence
  chemically synthesized
atagttgtgaaaaactattgaa

SEQ ID NO: 690420 - DNA, 22 bp, Artificial Sequence
  chemically synthesized
ttcaatgatactttcaatagtt

SEQ ID NO: 690421 - DNA, 22 bp, Artificial Sequence
  chemically synthesized
agccttttcaatgatactttca

SEQ ID NO: 690422 - DNA, 22 bp, Artificial Sequence
  chemically synthesized
tgaaaaactattgaaagtatca

SEQ ID NO: 690423 - DNA, 22 bp, Artificial Sequence
  chemically synthesized
ttgaaagtatcattgaaaaggc

SEQ ID NO: 690424 - DNA, 22 bp, Artificial Sequence
  chemically synthesized
aaagtatcattgaaaaggctca

SEQ ID NO: 690425 - DNA, 22 bp, Artificial Sequence
  chemically synthesized
aaaatagaaaacgttgagcctt

SEQ ID NO: 690426 - DNA, 22 bp, Artificial Sequence
  chemically synthesized
gaaaatagaaaacgttgagcct

SEQ ID NO: 690427 - DNA, 22 bp, Artificial Sequence
  chemically synthesized
tgaaaatagaaaacgttgagcc

SEQ ID NO: 690428 - DNA, 22 bp, Artificial Sequence
  chemically synthesized
ttgaaaatagaaaacgttgagc

SEQ ID NO: 690429 - DNA, 22 bp, Artificial Sequence
  chemically synthesized
tttgaaaatagaaaacgttgag

SEQ ID NO: 690430 - DNA, 22 bp, Artificial Sequence
  chemically synthesized
gctttttgaaaatagaaaacgt

SEQ ID NO: 690431 - DNA, 22 bp, Artificial Sequence
  chemically synthesized
aaaaggctcaacgttttctatt

SEQ ID NO: 690432 - DNA, 22 bp, Artificial Sequence
  chemically synthesized
ccattagctttttgaaaataga

SEQ ID NO: 690433 - DNA, 22 bp, Artificial Sequence
  chemically synthesized
accattagctttttgaaaatag

SEQ ID NO: 690434 - DNA, 22 bp, Artificial Sequence
  chemically synthesized
aacgttttctattttcaaaaag

SEQ ID NO: 690435 - DNA, 22 bp, Artificial Sequence
  chemically synthesized
tctattttcaaaaagctaatgg

SEQ ID NO: 690436 - DNA, 22 bp, Artificial Sequence
  chemically synthesized
aaaaatagcttaccattagctt

SEQ ID NO: 690437 - DNA, 22 bp, Artificial Sequence
  chemically synthesized
ctattttcaaaaagctaatggt

SEQ ID NO: 690438 - DNA, 22 bp, Artificial Sequence
  chemically synthesized
tattttcaaaaagctaatggta

SEQ ID NO: 690439 - DNA, 22 bp, Artificial Sequence
  chemically synthesized
ttttcaaaaagctaatggtaag

SEQ ID NO: 690440 - DNA, 22 bp, Artificial Sequence
  chemically synthesized
gattaaaaaatagcttaccatt

SEQ ID NO: 690441 - DNA, 22 bp, Artificial Sequence
  chemically synthesized
tcaaaaagctaatggtaagcta

SEQ ID NO: 690442 - DNA, 22 bp, Artificial Sequence
  chemically synthesized
caaaaagctaatggtaagctat

SEQ ID NO: 690443 - DNA, 22 bp, Artificial Sequence
  chemically synthesized
aaaaagctaatggtaagctatt

SEQ ID NO: 690444 - DNA, 22 bp, Artificial Sequence
  chemically synthesized
atggtaagctattttttaatcc

SEQ ID NO: 690445 - DNA, 22 bp, Artificial Sequence
  chemically synthesized
aaaccatcatccattggattaa

SEQ ID NO: 690446 - DNA, 22 bp, Artificial Sequence
  chemically synthesized
ctgaaaccatcatccattggat

SEQ ID NO: 690447 - DNA, 22 bp, Artificial Sequence
  chemically synthesized
actgaaaccatcatccattgga

SEQ ID NO: 690448 - DNA, 22 bp, Artificial Sequence
  chemically synthesized
tactgaaaccatcatccattgg

SEQ ID NO: 690449 - DNA, 22 bp, Artificial Sequence
  chemically synthesized
ttttttaatccaatggatgatg

SEQ ID NO: 690450 - DNA, 22 bp, Artificial Sequence
  chemically synthesized
cctttactgaaaccatcatcca

SEQ ID NO: 690451 - DNA, 22 bp, Artificial Sequence
  chemically synthesized
tttaatccaatggatgatggtt

SEQ ID NO: 690452 - DNA, 22 bp, Artificial Sequence
  chemically synthesized
ttaatccaatggatgatggttt

SEQ ID NO: 690453 - DNA, 22 bp, Artificial Sequence
  chemically synthesized
taatccaatggatgatggtttc

SEQ ID NO: 690454 - DNA, 22 bp, Artificial Sequence
  chemically synthesized
aatccaatggatgatggtttca

SEQ ID NO: 690455 - DNA, 22 bp, Artificial Sequence
  chemically synthesized
atccaatggatgatggtttcag

SEQ ID NO: 690456 - DNA, 22 bp, Artificial Sequence
  chemically synthesized
tgacaaaattgcctttactgaa

SEQ ID NO: 690457 - DNA, 22 bp, Artificial Sequence
  chemically synthesized
gtgacaaaattgcctttactga

SEQ ID NO: 690458 - DNA, 22 bp, Artificial Sequence
  chemically synthesized
tgtgacaaaattgcctttactg

SEQ ID NO: 690459 - DNA, 22 bp, Artificial Sequence
  chemically synthesized
cagtaaaggcaattttgtcaca

SEQ ID NO: 690460 - DNA, 22 bp, Artificial Sequence
  chemically synthesized
agtaaaggcaattttgtcacaa

SEQ ID NO: 690461 - DNA, 22 bp, Artificial Sequence
  chemically synthesized
ccataaaaatctttgtgacaaa

SEQ ID NO: 690462 - DNA, 22 bp, Artificial Sequence
  chemically synthesized
cagattcccataaaaatctttg

SEQ ID NO: 690463 - DNA, 22 bp, Artificial Sequence
  chemically synthesized
tgtcacaaagatttttatggga

SEQ ID NO: 690464 - DNA, 22 bp, Artificial Sequence
  chemically synthesized
catactgcagattcccataaaa

SEQ ID NO: 690465 - DNA, 22 bp, Artificial Sequence
  chemically synthesized
gtcacaaagatttttatgggaa

SEQ ID NO: 690466 - DNA, 22 bp, Artificial Sequence
  chemically synthesized
tcacaaagatttttatgggaat

SEQ ID NO: 690467 - DNA, 22 bp, Artificial Sequence
  chemically synthesized
tacatactgcagattcccataa

SEQ ID NO: 690468 - DNA, 22 bp, Artificial Sequence
  chemically synthesized
ctacatactgcagattcccata

SEQ ID NO: 690469 - DNA, 22 bp, Artificial Sequence
  chemically synthesized
tctacatactgcagattcccat

SEQ ID NO: 690470 - DNA, 22 bp, Artificial Sequence
  chemically synthesized
ttatgggaatctgcagtatgta

SEQ ID NO: 690471 - DNA, 22 bp, Artificial Sequence
  chemically synthesized
tatgggaatctgcagtatgtag

SEQ ID NO: 690472 - DNA, 22 bp, Artificial Sequence
  chemically synthesized
aggagaatctttctacatactg

SEQ ID NO: 690473 - DNA, 22 bp, Artificial Sequence
  chemically synthesized
atgggaatctgcagtatgtaga

SEQ ID NO: 690474 - DNA, 22 bp, Artificial Sequence
  chemically synthesized
tgggaatctgcagtatgtagaa

SEQ ID NO: 690475 - DNA, 22 bp, Artificial Sequence
  chemically synthesized
ctcaggagaatctttctacata

SEQ ID NO: 690476 - DNA, 22 bp, Artificial Sequence
  chemically synthesized
cctcaggagaatctttctacat

SEQ ID NO: 690477 - DNA, 22 bp, Artificial Sequence
  chemically synthesized
cagtatgtagaaagattctcct

SEQ ID NO: 690478 - DNA, 22 bp, Artificial Sequence
  chemically synthesized
taaagggagcagtaagcacgtt

SEQ ID NO: 690479 - DNA, 22 bp, Artificial Sequence
  chemically synthesized
tcctgaggaaacgtgcttactg

SEQ ID NO: 690480 - DNA, 22 bp, Artificial Sequence
  chemically synthesized
ctgtaaagggagcagtaagcac

SEQ ID NO: 690481 - DNA, 22 bp, Artificial Sequence
  chemically synthesized
ctgaggaaacgtgcttactgct

SEQ ID NO: 690482 - DNA, 22 bp, Artificial Sequence
  chemically synthesized
aggaaacgtgcttactgctccc

SEQ ID NO: 690483 - DNA, 22 bp, Artificial Sequence
  chemically synthesized
acctactgtaaagggagcagta

SEQ ID NO: 690484 - DNA, 22 bp, Artificial Sequence
  chemically synthesized
gacctactgtaaagggagcagt

SEQ ID NO: 690485 - DNA, 22 bp, Artificial Sequence
  chemically synthesized
ttgacctactgtaaagggagca

SEQ ID NO: 690486 - DNA, 22 bp, Artificial Sequence
  chemically synthesized
actgctccctttacagtaggtc

SEQ ID NO: 690487 - DNA, 22 bp, Artificial Sequence
  chemically synthesized
ctgctccctttacagtaggtca

SEQ ID NO: 690488 - DNA, 22 bp, Artificial Sequence
  chemically synthesized
ctccctttacagtaggtcaaga

SEQ ID NO: 690489 - DNA, 22 bp, Artificial Sequence
  chemically synthesized
gaaatcagagactcttgaccta

SEQ ID NO: 690490 - DNA, 22 bp, Artificial Sequence
  chemically synthesized
cctttacagtaggtcaagagtc

SEQ ID NO: 690491 - DNA, 22 bp, Artificial Sequence
  chemically synthesized
tgctagaaatcagagactcttg

SEQ ID NO: 690492 - DNA, 22 bp, Artificial Sequence
  chemically synthesized
tacagtaggtcaagagtctctg

SEQ ID NO: 690493 - DNA, 22 bp, Artificial Sequence
  chemically synthesized
tgtgctagaaatcagagactct

SEQ ID NO: 690494 - DNA, 22 bp, Artificial Sequence
  chemically synthesized
acagtaggtcaagagtctctga

SEQ ID NO: 690495 - DNA, 22 bp, Artificial Sequence
  chemically synthesized
cagtaggtcaagagtctctgat

SEQ ID NO: 690496 - DNA, 22 bp, Artificial Sequence
  chemically synthesized
gaaaatagttctgtgctagaaa

SEQ ID NO: 690497 - DNA, 22 bp, Artificial Sequence
  chemically synthesized
tgatttctagcacagaactatt

SEQ ID NO: 690498 - DNA, 22 bp, Artificial Sequence
  chemically synthesized
atttctagcacagaactatttt

SEQ ID NO: 690499 - DNA, 22 bp, Artificial Sequence
  chemically synthesized
aaagatgcctagaaaatagttc

SEQ ID NO: 690500 - DNA, 22 bp, Artificial Sequence
  chemically synthesized
aaaagatgcctagaaaatagtt

SEQ ID NO: 690501 - DNA, 22 bp, Artificial Sequence
  chemically synthesized
taaaagatgcctagaaaatagt

SEQ ID NO: 690502 - DNA, 22 bp, Artificial Sequence
  chemically synthesized
ctagcacagaactattttctag

SEQ ID NO: 690503 - DNA, 22 bp, Artificial Sequence
  chemically synthesized
tagcacagaactattttctagg

SEQ ID NO: 690504 - DNA, 22 bp, Artificial Sequence
  chemically synthesized
gcacagaactattttctaggca

SEQ ID NO: 690505 - DNA, 22 bp, Artificial Sequence
  chemically synthesized
ggtagggttttaaaagatgcct

SEQ ID NO: 690506 - DNA, 22 bp, Artificial Sequence
  chemically synthesized
aggtagggttttaaaagatgcc

SEQ ID NO: 690507 - DNA, 22 bp, Artificial Sequence
  chemically synthesized
taggtagggttttaaaagatgc

SEQ ID NO: 690508 - DNA, 22 bp, Artificial Sequence
  chemically synthesized
ttttctaggcatcttttaaaac

SEQ ID NO: 690509 - DNA, 22 bp, Artificial Sequence
  chemically synthesized
cctttaggtagggttttaaaag

SEQ ID NO: 690510 - DNA, 22 bp, Artificial Sequence
  chemically synthesized
tctaggcatcttttaaaaccct

SEQ ID NO: 690511 - DNA, 22 bp, Artificial Sequence
  chemically synthesized
ctaggcatcttttaaaacccta

SEQ ID NO: 690512 - DNA, 22 bp, Artificial Sequence
  chemically synthesized
taggcatcttttaaaaccctac

SEQ ID NO: 690513 - DNA, 22 bp, Artificial Sequence
  chemically synthesized
atctgcctttaggtagggtttt

SEQ ID NO: 690514 - DNA, 22 bp, Artificial Sequence
  chemically synthesized
ggcatcttttaaaaccctacct

SEQ ID NO: 690515 - DNA, 22 bp, Artificial Sequence
  chemically synthesized
ttaaaaccctacctaaaggcag

SEQ ID NO: 690516 - DNA, 22 bp, Artificial Sequence
  chemically synthesized
gggcccactcatctgcctttag

SEQ ID NO: 690517 - DNA, 22 bp, Artificial Sequence
  chemically synthesized
taaaaccctacctaaaggcaga

SEQ ID NO: 690518 - DNA, 22 bp, Artificial Sequence
  chemically synthesized
aaaaccctacctaaaggcagat

SEQ ID NO: 690519 - DNA, 22 bp, Artificial Sequence
  chemically synthesized
aaaccctacctaaaggcagatg

SEQ ID NO: 690520 - DNA, 22 bp, Artificial Sequence
  chemically synthesized
taacattagggcccactcatct

SEQ ID NO: 690521 - DNA, 22 bp, Artificial Sequence
  chemically synthesized
gtaacattagggcccactcatc

SEQ ID NO: 690522 - DNA, 22 bp, Artificial Sequence
  chemically synthesized
tgtaacattagggcccactcat

SEQ ID NO: 690523 - DNA, 22 bp, Artificial Sequence
  chemically synthesized
cctaaaggcagatgagtgggcc

SEQ ID NO: 690524 - DNA, 22 bp, Artificial Sequence
  chemically synthesized
tttgtaacattagggcccactc

SEQ ID NO: 690525 - DNA, 22 bp, Artificial Sequence
  chemically synthesized
aaggcagatgagtgggccctaa

SEQ ID NO: 690526 - DNA, 22 bp, Artificial Sequence
  chemically synthesized
agagtagttctttgtaacatta

SEQ ID NO: 690527 - DNA, 22 bp, Artificial Sequence
  chemically synthesized
gctcagagtagttctttgtaac

SEQ ID NO: 690528 - DNA, 22 bp, Artificial Sequence
  chemically synthesized
agctcagagtagttctttgtaa

SEQ ID NO: 690529 - DNA, 22 bp, Artificial Sequence
  chemically synthesized
acttagctcagagtagttcttt

SEQ ID NO: 690530 - DNA, 22 bp, Artificial Sequence
  chemically synthesized
cacttagctcagagtagttctt

SEQ ID NO: 690531 - DNA, 22 bp, Artificial Sequence
  chemically synthesized
tcacttagctcagagtagttct

SEQ ID NO: 690532 - DNA, 22 bp, Artificial Sequence
  chemically synthesized
tttcacttagctcagagtagtt

SEQ ID NO: 690533 - DNA, 22 bp, Artificial Sequence
  chemically synthesized
atgttacaaagaactactctga

SEQ ID NO: 690534 - DNA, 22 bp, Artificial Sequence
  chemically synthesized
taattctttcacttagctcaga

SEQ ID NO: 690535 - DNA, 22 bp, Artificial Sequence
  chemically synthesized
caaagaactactctgagctaag

SEQ ID NO: 690536 - DNA, 22 bp, Artificial Sequence
  chemically synthesized
tccaactgtaattctttcactt

SEQ ID NO: 690537 - DNA, 22 bp, Artificial Sequence
  chemically synthesized
gtccaactgtaattctttcact

SEQ ID NO: 690538 - DNA, 22 bp, Artificial Sequence
  chemically synthesized
ctctgagctaagtgaaagaatt

SEQ ID NO: 690539 - DNA, 22 bp, Artificial Sequence
  chemically synthesized
tgagctaagtgaaagaattaca

SEQ ID NO: 690540 - DNA, 22 bp, Artificial Sequence
  chemically synthesized
ccacttgtccaactgtaattct

SEQ ID NO: 690541 - DNA, 22 bp, Artificial Sequence
  chemically synthesized
agctaagtgaaagaattacagt

SEQ ID NO: 690542 - DNA, 22 bp, Artificial Sequence
  chemically synthesized
ttcccacttgtccaactgtaat

SEQ ID NO: 690543 - DNA, 22 bp, Artificial Sequence
  chemically synthesized
gttcccacttgtccaactgtaa

SEQ ID NO: 690544 - DNA, 22 bp, Artificial Sequence
  chemically synthesized
agtgaaagaattacagttggac

SEQ ID NO: 690545 - DNA, 22 bp, Artificial Sequence
  chemically synthesized
tttgttcccacttgtccaactg

SEQ ID NO: 690546 - DNA, 22 bp, Artificial Sequence
  chemically synthesized
cagttggacaagtgggaacaaa

SEQ ID NO: 690547 - DNA, 22 bp, Artificial Sequence
  chemically synthesized
tgaaccatgttatttgttccca

SEQ ID NO: 690548 - DNA, 22 bp, Artificial Sequence
  chemically synthesized
gacaagtgggaacaaataacat

SEQ ID NO: 690549 - DNA, 22 bp, Artificial Sequence
  chemically synthesized
cagctatgaaccatgttatttg

SEQ ID NO: 690550 - DNA, 22 bp, Artificial Sequence
  chemically synthesized
atgtgagcagtaattgcagcta

SEQ ID NO: 690551 - DNA, 22 bp, Artificial Sequence
  chemically synthesized
atagctgcaattactgctcaca

SEQ ID NO: 690552 - DNA, 22 bp, Artificial Sequence
  chemically synthesized
taagtaaaattcatgtgagcag

SEQ ID NO: 690553 - DNA, 22 bp, Artificial Sequence
  chemically synthesized
caattactgctcacatgaattt

SEQ ID NO: 690554 - DNA, 22 bp, Artificial Sequence
  chemically synthesized
ctgctcacatgaattttactta

SEQ ID NO: 690555 - DNA, 22 bp, Artificial Sequence
  chemically synthesized
ctcacatgaattttacttataa

SEQ ID NO: 690556 - DNA, 22 bp, Artificial Sequence
  chemically synthesized
gcatcaggaatattataagtaa

SEQ ID NO: 690557 - DNA, 22 bp, Artificial Sequence
  chemically synthesized
ggcatcaggaatattataagta

SEQ ID NO: 690558 - DNA, 22 bp, Artificial Sequence
  chemically synthesized
acatgaattttacttataatat

SEQ ID NO: 690559 - DNA, 22 bp, Artificial Sequence
  chemically synthesized
tgacttggcatcaggaatatta

SEQ ID NO: 690560 - DNA, 22 bp, Artificial Sequence
  chemically synthesized
atgacttggcatcaggaatatt

SEQ ID NO: 690561 - DNA, 22 bp, Artificial Sequence
  chemically synthesized
tacttataatattcctgatgcc

SEQ ID NO: 690562 - DNA, 22 bp, Artificial Sequence
  chemically synthesized
acttataatattcctgatgcca

SEQ ID NO: 690563 - DNA, 22 bp, Artificial Sequence
  chemically synthesized
cttataatattcctgatgccaa

SEQ ID NO: 690564 - DNA, 22 bp, Artificial Sequence
  chemically synthesized
agagcatttatgacttggcatc

SEQ ID NO: 690565 - DNA, 22 bp, Artificial Sequence
  chemically synthesized
ataatattcctgatgccaagtc

SEQ ID NO: 690566 - DNA, 22 bp, Artificial Sequence
  chemically synthesized
taatattcctgatgccaagtca

SEQ ID NO: 690567 - DNA, 22 bp, Artificial Sequence
  chemically synthesized
ctgatgccaagtcataaatgct

SEQ ID NO: 690568 - DNA, 22 bp, Artificial Sequence
  chemically synthesized
atgccaagtcataaatgctctc

SEQ ID NO: 690569 - DNA, 22 bp, Artificial Sequence
  chemically synthesized
ccagtcagatgagatgttgaga

SEQ ID NO: 690570 - DNA, 22 bp, Artificial Sequence
  chemically synthesized
taccagtcagatgagatgttga

SEQ ID NO: 690571 - DNA, 22 bp, Artificial Sequence
  chemically synthesized
tcaacatctcatctgactggta

SEQ ID NO: 690572 - DNA, 22 bp, Artificial Sequence
  chemically synthesized
aacatctcatctgactggtaga

SEQ ID NO: 690573 - DNA, 22 bp, Artificial Sequence
  chemically synthesized
atgccagtaagaaagttctacc

SEQ ID NO: 690574 - DNA, 22 bp, Artificial Sequence
  chemically synthesized
atctgactggtagaactttctt

SEQ ID NO: 690575 - DNA, 22 bp, Artificial Sequence
  chemically synthesized
ggaatctcatgccagtaagaaa

SEQ ID NO: 690576 - DNA, 22 bp, Artificial Sequence
  chemically synthesized
actggtagaactttcttactgg

SEQ ID NO: 690577 - DNA, 22 bp, Artificial Sequence
  chemically synthesized
gtagaactttcttactggcatg

SEQ ID NO: 690578 - DNA, 22 bp, Artificial Sequence
  chemically synthesized
tcttactggcatgagattccta

SEQ ID NO: 690579 - DNA, 22 bp, Artificial Sequence
  chemically synthesized
cttactggcatgagattcctag

SEQ ID NO: 690580 - DNA, 22 bp, Artificial Sequence
  chemically synthesized
ttactggcatgagattcctagg

SEQ ID NO: 690581 - DNA, 22 bp, Artificial Sequence
  chemically synthesized
actggcatgagattcctaggat

SEQ ID NO: 690582 - DNA, 22 bp, Artificial Sequence
  chemically synthesized
ctggcatgagattcctaggatt

SEQ ID NO: 690583 - DNA, 22 bp, Artificial Sequence
  chemically synthesized
aaggataacaaaaatcctagga

SEQ ID NO: 690584 - DNA, 22 bp, Artificial Sequence
  chemically synthesized
gcatgagattcctaggattttt

SEQ ID NO: 690585 - DNA, 22 bp, Artificial Sequence
  chemically synthesized
ctaggatttttgttatccttta

SEQ ID NO: 690586 - DNA, 22 bp, Artificial Sequence
  chemically synthesized
ggatttttgttatcctttagct

SEQ ID NO: 690587 - DNA, 22 bp, Artificial Sequence
  chemically synthesized
ttgttatcctttagcttttata

SEQ ID NO: 690588 - DNA, 22 bp, Artificial Sequence
  chemically synthesized
tgttatcctttagcttttatat

SEQ ID NO: 690589 - DNA, 22 bp, Artificial Sequence
  chemically synthesized
gttatcctttagcttttatatt

SEQ ID NO: 690590 - DNA, 22 bp, Artificial Sequence
  chemically synthesized
ttatcctttagcttttatattc

SEQ ID NO: 690591 - DNA, 22 bp, Artificial Sequence
  chemically synthesized
tcctttagcttttatattctac

SEQ ID NO: 690592 - DNA, 22 bp, Artificial Sequence
  chemically synthesized
tagcttttatattctacaccat

SEQ ID NO: 690593 - DNA, 22 bp, Artificial Sequence
  chemically synthesized
agcttttatattctacaccatg

SEQ ID NO: 690594 - DNA, 22 bp, Artificial Sequence
  chemically synthesized
gcttttatattctacaccatgg

SEQ ID NO: 690595 - DNA, 22 bp, Artificial Sequence
  chemically synthesized
gagtggtaccaatccatggtgt

SEQ ID NO: 690596 - DNA, 22 bp, Artificial Sequence
  chemically synthesized
agagtggtaccaatccatggtg

SEQ ID NO: 690597 - DNA, 22 bp, Artificial Sequence
  chemically synthesized
ttatattctacaccatggattg

SEQ ID NO: 690598 - DNA, 22 bp, Artificial Sequence
  chemically synthesized
tatattctacaccatggattgg

SEQ ID NO: 690599 - DNA, 22 bp, Artificial Sequence
  chemically synthesized
atattctacaccatggattggt

SEQ ID NO: 690600 - DNA, 22 bp, Artificial Sequence
  chemically synthesized
tattctacaccatggattggta

SEQ ID NO: 690601 - DNA, 22 bp, Artificial Sequence
  chemically synthesized
atccaatttagagtggtaccaa

SEQ ID NO: 690602 - DNA, 22 bp, Artificial Sequence
  chemically synthesized
tacaccatggattggtaccact

SEQ ID NO: 690603 - DNA, 22 bp, Artificial Sequence
  chemically synthesized
gatccaatttagagtggtacca

SEQ ID NO: 690604 - DNA, 22 bp, Artificial Sequence
  chemically synthesized
caccatggattggtaccactct

SEQ ID NO: 690605 - DNA, 22 bp, Artificial Sequence
  chemically synthesized
caaaatttgatccaatttagag

SEQ ID NO: 690606 - DNA, 22 bp, Artificial Sequence
  chemically synthesized
ttccaaaatttgatccaattta

SEQ ID NO: 690607 - DNA, 22 bp, Artificial Sequence
  chemically synthesized
gtaccactctaaattggatcaa

SEQ ID NO: 690608 - DNA, 22 bp, Artificial Sequence
  chemically synthesized
ttgttccaaaatttgatccaat

SEQ ID NO: 690609 - DNA, 22 bp, Artificial Sequence
  chemically synthesized
atgtctattgttccaaaatttg

SEQ ID NO: 690610 - DNA, 22 bp, Artificial Sequence
  chemically synthesized
gatgtctattgttccaaaattt

SEQ ID NO: 690611 - DNA, 22 bp, Artificial Sequence
  chemically synthesized
taaattggatcaaattttggaa

SEQ ID NO: 690612 - DNA, 22 bp, Artificial Sequence
  chemically synthesized
aattggatcaaattttggaaca

SEQ ID NO: 690613 - DNA, 22 bp, Artificial Sequence
  chemically synthesized
cttgatgtctattgttccaaaa

SEQ ID NO: 690614 - DNA, 22 bp, Artificial Sequence
  chemically synthesized
acttgatgtctattgttccaaa

SEQ ID NO: 690615 - DNA, 22 bp, Artificial Sequence
  chemically synthesized
gatcaaattttggaacaataga

SEQ ID NO: 690616 - DNA, 22 bp, Artificial Sequence
  chemically synthesized
gaaacatcttacttgatgtcta

SEQ ID NO: 690617 - DNA, 22 bp, Artificial Sequence
  chemically synthesized
agaaacatcttacttgatgtct

SEQ ID NO: 690618 - DNA, 22 bp, Artificial Sequence
  chemically synthesized
tggaacaatagacatcaagtaa

SEQ ID NO: 690619 - DNA, 22 bp, Artificial Sequence
  chemically synthesized
tttagaaacatcttacttgatg

SEQ ID NO: 690620 - DNA, 22 bp, Artificial Sequence
  chemically synthesized
ggaacaatagacatcaagtaag

SEQ ID NO: 690621 - DNA, 22 bp, Artificial Sequence
  chemically synthesized
gaacaatagacatcaagtaaga

SEQ ID NO: 690622 - DNA, 22 bp, Artificial Sequence
  chemically synthesized
attgtttagaaacatcttactt

SEQ ID NO: 690623 - DNA, 22 bp, Artificial Sequence
  chemically synthesized
agaatagctaattgtttagaaa

SEQ ID NO: 690624 - DNA, 22 bp, Artificial Sequence
  chemically synthesized
aaatgactaagaatagctaatt

SEQ ID NO: 690625 - DNA, 22 bp, Artificial Sequence
  chemically synthesized
ctaaacaattagctattcttag

SEQ ID NO: 690626 - DNA, 22 bp, Artificial Sequence
  chemically synthesized
taaacaattagctattcttagt

SEQ ID NO: 690627 - DNA, 22 bp, Artificial Sequence
  chemically synthesized
aacaattagctattcttagtca

SEQ ID NO: 690628 - DNA, 22 bp, Artificial Sequence
  chemically synthesized
tgacatagaaattcaaatgact

SEQ ID NO: 690629 - DNA, 22 bp, Artificial Sequence
  chemically synthesized
gctattcttagtcatttgaatt

SEQ ID NO: 690630 - DNA, 22 bp, Artificial Sequence
  chemically synthesized
ttcttagtcatttgaatttcta

SEQ ID NO: 690631 - DNA, 22 bp, Artificial Sequence
  chemically synthesized
ttagtcatttgaatttctatgt

SEQ ID NO: 690632 - DNA, 22 bp, Artificial Sequence
  chemically synthesized
agtcatttgaatttctatgtca

SEQ ID NO: 690633 - DNA, 22 bp, Artificial Sequence
  chemically synthesized
gtcatttgaatttctatgtcat

SEQ ID NO: 690634 - DNA, 22 bp, Artificial Sequence
  chemically synthesized
gaatttctatgtcataacacat

SEQ ID NO: 690635 - DNA, 22 bp, Artificial Sequence
  chemically synthesized
aatttctatgtcataacacatg

SEQ ID NO: 690636 - DNA, 22 bp, Artificial Sequence
  chemically synthesized
taaatgccaaagcatgtgttat

SEQ ID NO: 690637 - DNA, 22 bp, Artificial Sequence
  chemically synthesized
tataaatgccaaagcatgtgtt

SEQ ID NO: 690638 - DNA, 22 bp, Artificial Sequence
  chemically synthesized
ctatgtcataacacatgctttg

SEQ ID NO: 690639 - DNA, 22 bp, Artificial Sequence
  chemically synthesized
ctctataaatgccaaagcatgt

SEQ ID NO: 690640 - DNA, 22 bp, Artificial Sequence
  chemically synthesized
tatgtcataacacatgctttgg

SEQ ID NO: 690641 - DNA, 22 bp, Artificial Sequence
  chemically synthesized
tgtcataacacatgctttggca

SEQ ID NO: 690642 - DNA, 22 bp, Artificial Sequence
  chemically synthesized
agagtaggttactctataaatg

SEQ ID NO: 690643 - DNA, 22 bp, Artificial Sequence
  chemically synthesized
aagagtaggttactctataaat

SEQ ID NO: 690644 - DNA, 22 bp, Artificial Sequence
  chemically synthesized
ttaagagtaggttactctataa

SEQ ID NO: 690645 - DNA, 22 bp, Artificial Sequence
  chemically synthesized
cttaagagtaggttactctata

SEQ ID NO: 690646 - DNA, 22 bp, Artificial Sequence
  chemically synthesized
tcttaagagtaggttactctat

SEQ ID NO: 690647 - DNA, 22 bp, Artificial Sequence
  chemically synthesized
ttcttaagagtaggttactcta

SEQ ID NO: 690648 - DNA, 22 bp, Artificial Sequence
  chemically synthesized
tttcttaagagtaggttactct

SEQ ID NO: 690649 - DNA, 22 bp, Artificial Sequence
  chemically synthesized
tggcatttatagagtaacctac

SEQ ID NO: 690650 - DNA, 22 bp, Artificial Sequence
  chemically synthesized
ggcatttatagagtaacctact

SEQ ID NO: 690651 - DNA, 22 bp, Artificial Sequence
  chemically synthesized
ttttttcttaagagtaggttac

SEQ ID NO: 690652 - DNA, 22 bp, Artificial Sequence
  chemically synthesized
gcatttatagagtaacctactc

SEQ ID NO: 690653 - DNA, 22 bp, Artificial Sequence
  chemically synthesized
atagagtaacctactcttaaga

SEQ ID NO: 690654 - DNA, 22 bp, Artificial Sequence
  chemically synthesized
tagagtaacctactcttaagaa

SEQ ID NO: 690655 - DNA, 22 bp, Artificial Sequence
  chemically synthesized
gaagagattattttttcttaag

SEQ ID NO: 690656 - DNA, 22 bp, Artificial Sequence
  chemically synthesized
agaagagattattttttcttaa

SEQ ID NO: 690657 - DNA, 22 bp, Artificial Sequence
  chemically synthesized
tagaagagattattttttctta

SEQ ID NO: 690658 - DNA, 22 bp, Artificial Sequence
  chemically synthesized
ctcttaagaaaaaataatctct

SEQ ID NO: 690659 - DNA, 22 bp, Artificial Sequence
  chemically synthesized
ttaagaaaaaataatctcttct

SEQ ID NO: 690660 - DNA, 22 bp, Artificial Sequence
  chemically synthesized
aatacgggctttagaagagatt

SEQ ID NO: 690661 - DNA, 22 bp, Artificial Sequence
  chemically synthesized
aagaaaaaataatctcttctaa

SEQ ID NO: 690662 - DNA, 22 bp, Artificial Sequence
  chemically synthesized
agaaaaaataatctcttctaaa

SEQ ID NO: 690663 - DNA, 22 bp, Artificial Sequence
  chemically synthesized
taaaattaaatacgggctttag

SEQ ID NO: 690664 - DNA, 22 bp, Artificial Sequence
  chemically synthesized
ttctaaagcccgtatttaattt

SEQ ID NO: 690665 - DNA, 22 bp, Artificial Sequence
  chemically synthesized
ctaaagcccgtatttaatttta

SEQ ID NO: 690666 - DNA, 22 bp, Artificial Sequence
  chemically synthesized
taaagcccgtatttaattttac

SEQ ID NO: 690667 - DNA, 22 bp, Artificial Sequence
  chemically synthesized
tgtatacacaattgtaaaatta

SEQ ID NO: 690668 - DNA, 22 bp, Artificial Sequence
  chemically synthesized
aagcccgtatttaattttacaa

SEQ ID NO: 690669 - DNA, 22 bp, Artificial Sequence
  chemically synthesized
aattttacaattgtgtatacac

SEQ ID NO: 690670 - DNA, 22 bp, Artificial Sequence
  chemically synthesized
attttacaattgtgtatacaca

SEQ ID NO: 690671 - DNA, 22 bp, Artificial Sequence
  chemically synthesized
tatacatacacaattgtgtata

SEQ ID NO: 690672 - DNA, 22 bp, Artificial Sequence
  chemically synthesized
tacaattgtgtatacacaattg

SEQ ID NO: 690673 - DNA, 22 bp, Artificial Sequence
  chemically synthesized
acaattgtgtatacacaattgt

SEQ ID NO: 690674 - DNA, 22 bp, Artificial Sequence
  chemically synthesized
ctatatacatacacaattgtgt

SEQ ID NO: 690675 - DNA, 22 bp, Artificial Sequence
  chemically synthesized
caattgtgtatacacaattgtg

SEQ ID NO: 690676 - DNA, 22 bp, Artificial Sequence
  chemically synthesized
actatatacatacacaattgtg

SEQ ID NO: 690677 - DNA, 22 bp, Artificial Sequence
  chemically synthesized
tgtatacacaattgtgtatgta

SEQ ID NO: 690678 - DNA, 22 bp, Artificial Sequence
  chemically synthesized
tcagtgaccatgcttactatat

SEQ ID NO: 690679 - DNA, 22 bp, Artificial Sequence
  chemically synthesized
gtcagtgaccatgcttactata

SEQ ID NO: 690680 - DNA, 22 bp, Artificial Sequence
  chemically synthesized
tgtatgtatatagtaagcatgg

SEQ ID NO: 690681 - DNA, 22 bp, Artificial Sequence
  chemically synthesized
gcatttgtcagtgaccatgctt

SEQ ID NO: 690682 - DNA, 22 bp, Artificial Sequence
  chemically synthesized
agacattagcatttgtcagtga

SEQ ID NO: 690683 - DNA, 22 bp, Artificial Sequence
  chemically synthesized
gctgagacattagcatttgtca

SEQ ID NO: 690684 - DNA, 22 bp, Artificial Sequence
  chemically synthesized
cctggctgagacattagcattt

SEQ ID NO: 690685 - DNA, 22 bp, Artificial Sequence
  chemically synthesized
ccctggctgagacattagcatt

SEQ ID NO: 690686 - DNA, 22 bp, Artificial Sequence
  chemically synthesized
acaaatgctaatgtctcagcca

SEQ ID NO: 690687 - DNA, 22 bp, Artificial Sequence
  chemically synthesized
tcaatcaatttccctggctgag

SEQ ID NO: 690688 - DNA, 22 bp, Artificial Sequence
  chemically synthesized
ctgtcaatcaatttccctggct

SEQ ID NO: 690689 - DNA, 22 bp, Artificial Sequence
  chemically synthesized
cctgtcaatcaatttccctggc

SEQ ID NO: 690690 - DNA, 22 bp, Artificial Sequence
  chemically synthesized
atgtctcagccagggaaattga

SEQ ID NO: 690691 - DNA, 22 bp, Artificial Sequence
  chemically synthesized
cagtttcctgtcaatcaatttc

SEQ ID NO: 690692 - DNA, 22 bp, Artificial Sequence
  chemically synthesized
tccagtttcctgtcaatcaatt

SEQ ID NO: 690693 - DNA, 22 bp, Artificial Sequence
  chemically synthesized
ctccagtttcctgtcaatcaat

SEQ ID NO: 690694 - DNA, 22 bp, Artificial Sequence
  chemically synthesized
agccagggaaattgattgacag

SEQ ID NO: 690695 - DNA, 22 bp, Artificial Sequence
  chemically synthesized
ttctccagtttcctgtcaatca

SEQ ID NO: 690696 - DNA, 22 bp, Artificial Sequence
  chemically synthesized
aggggctcttctccagtttcct

SEQ ID NO: 690697 - DNA, 22 bp, Artificial Sequence
  chemically synthesized
caggggctcttctccagtttcc

SEQ ID NO: 690698 - DNA, 22 bp, Artificial Sequence
  chemically synthesized
tcaggggctcttctccagtttc

SEQ ID NO: 690699 - DNA, 22 bp, Artificial Sequence
  chemically synthesized
attgacaggaaactggagaaga

SEQ ID NO: 690700 - DNA, 22 bp, Artificial Sequence
  chemically synthesized
agttttcaggggctcttctcca

SEQ ID NO: 690701 - DNA, 22 bp, Artificial Sequence
  chemically synthesized
gagttttcaggggctcttctcc

SEQ ID NO: 690702 - DNA, 22 bp, Artificial Sequence
  chemically synthesized
acaggaaactggagaagagccc

SEQ ID NO: 690703 - DNA, 22 bp, Artificial Sequence
  chemically synthesized
cagacttgagttttcaggggct

SEQ ID NO: 690704 - DNA, 22 bp, Artificial Sequence
  chemically synthesized
gagaagagcccctgaaaactca

SEQ ID NO: 690705 - DNA, 22 bp, Artificial Sequence
  chemically synthesized
aaaactcaagtctgtaattata

SEQ ID NO: 690706 - DNA, 22 bp, Artificial Sequence
  chemically synthesized
acagatgtagtatataattaca

SEQ ID NO: 690707 - DNA, 22 bp, Artificial Sequence
  chemically synthesized
aagtctgtaattatatactaca

SEQ ID NO: 690708 - DNA, 22 bp, Artificial Sequence
  chemically synthesized
taattatatactacatctgtga

SEQ ID NO: 690709 - DNA, 22 bp, Artificial Sequence
  chemically synthesized
atacaggtagtccactcacaga

SEQ ID NO: 690710 - DNA, 22 bp, Artificial Sequence
  chemically synthesized
tatactacatctgtgagtggac

SEQ ID NO: 690711 - DNA, 22 bp, Artificial Sequence
  chemically synthesized
catctgtgagtggactacctgt

SEQ ID NO: 690712 - DNA, 22 bp, Artificial Sequence
  chemically synthesized
tgagtggactacctgtatcagt

SEQ ID NO: 690713 - DNA, 22 bp, Artificial Sequence
  chemically synthesized
gaagatggtgtataaactgata

SEQ ID NO: 690714 - DNA, 22 bp, Artificial Sequence
  chemically synthesized
ggaagatggtgtataaactgat

SEQ ID NO: 690715 - DNA, 22 bp, Artificial Sequence
  chemically synthesized
ggatttggaagatggtgtataa

SEQ ID NO: 690716 - DNA, 22 bp, Artificial Sequence
  chemically synthesized
cctgtatcagtttatacaccat

SEQ ID NO: 690717 - DNA, 22 bp, Artificial Sequence
  chemically synthesized
gggatttggaagatggtgtata

SEQ ID NO: 690718 - DNA, 22 bp, Artificial Sequence
  chemically synthesized
tgggatttggaagatggtgtat

SEQ ID NO: 690719 - DNA, 22 bp, Artificial Sequence
  chemically synthesized
tatcagtttatacaccatcttc

SEQ ID NO: 690720 - DNA, 22 bp, Artificial Sequence
  chemically synthesized
aactttgggatttggaagatgg

SEQ ID NO: 690721 - DNA, 22 bp, Artificial Sequence
  chemically synthesized
ccactaaactttgggatttgga

SEQ ID NO: 690722 - DNA, 22 bp, Artificial Sequence
  chemically synthesized
atacaccatcttccaaatccca

SEQ ID NO: 690723 - DNA, 22 bp, Artificial Sequence
  chemically synthesized
accactaaactttgggatttgg

SEQ ID NO: 690724 - DNA, 22 bp, Artificial Sequence
  chemically synthesized
tacaccatcttccaaatcccaa

SEQ ID NO: 690725 - DNA, 22 bp, Artificial Sequence
  chemically synthesized
gtttaccactaaactttgggat

SEQ ID NO: 690726 - DNA, 22 bp, Artificial Sequence
  chemically synthesized
agtttaccactaaactttggga

SEQ ID NO: 690727 - DNA, 22 bp, Artificial Sequence
  chemically synthesized
ccaaatcccaaagtttagtggt

SEQ ID NO: 690728 - DNA, 22 bp, Artificial Sequence
  chemically synthesized
caaatcccaaagtttagtggta

SEQ ID NO: 690729 - DNA, 22 bp, Artificial Sequence
  chemically synthesized
agtggtaaactaaaccttgtct

SEQ ID NO: 690730 - DNA, 22 bp, Artificial Sequence
  chemically synthesized
gtggtaaactaaaccttgtctg

SEQ ID NO: 690731 - DNA, 22 bp, Artificial Sequence
  chemically synthesized
gaccatacagggcatcagacaa

SEQ ID NO: 690732 - DNA, 22 bp, Artificial Sequence
  chemically synthesized
agaccatacagggcatcagaca

SEQ ID NO: 690733 - DNA, 22 bp, Artificial Sequence
  chemically synthesized
tagaccatacagggcatcagac

SEQ ID NO: 690734 - DNA, 22 bp, Artificial Sequence
  chemically synthesized
ttagaccatacagggcatcaga

SEQ ID NO: 690735 - DNA, 22 bp, Artificial Sequence
  chemically synthesized
tttagaccatacagggcatcag

SEQ ID NO: 690736 - DNA, 22 bp, Artificial Sequence
  chemically synthesized
ttttagaccatacagggcatca

SEQ ID NO: 690737 - DNA, 22 bp, Artificial Sequence
  chemically synthesized
ttttttagaccatacagggcat

SEQ ID NO: 690738 - DNA, 22 bp, Artificial Sequence
  chemically synthesized
aaccttgtctgatgccctgtat

SEQ ID NO: 690739 - DNA, 22 bp, Artificial Sequence
  chemically synthesized
ctcttttttagaccatacaggg

SEQ ID NO: 690740 - DNA, 22 bp, Artificial Sequence
  chemically synthesized
tcctcttttttagaccatacag

SEQ ID NO: 690741 - DNA, 22 bp, Artificial Sequence
  chemically synthesized
gtctgatgccctgtatggtcta

SEQ ID NO: 690742 - DNA, 22 bp, Artificial Sequence
  chemically synthesized
tctgatgccctgtatggtctaa

SEQ ID NO: 690743 - DNA, 22 bp, Artificial Sequence
  chemically synthesized
atgccctgtatggtctaaaaaa

SEQ ID NO: 690744 - DNA, 22 bp, Artificial Sequence
  chemically synthesized
aacccctctcctcttttttaga

SEQ ID NO: 690745 - DNA, 22 bp, Artificial Sequence
  chemically synthesized
caacccctctcctcttttttag

SEQ ID NO: 690746 - DNA, 22 bp, Artificial Sequence
  chemically synthesized
tcaacccctctcctctttttta

SEQ ID NO: 690747 - DNA, 22 bp, Artificial Sequence
  chemically synthesized
ttcaacccctctcctctttttt

SEQ ID NO: 690748 - DNA, 22 bp, Artificial Sequence
  chemically synthesized
ttttcaacccctctcctctttt

SEQ ID NO: 690749 - DNA, 22 bp, Artificial Sequence
  chemically synthesized
tatggtctaaaaaagaggagag

SEQ ID NO: 690750 - DNA, 22 bp, Artificial Sequence
  chemically synthesized
ctcttttcaacccctctcctct

SEQ ID NO: 690751 - DNA, 22 bp, Artificial Sequence
  chemically synthesized
gctcttttcaacccctctcctc

SEQ ID NO: 690752 - DNA, 22 bp, Artificial Sequence
  chemically synthesized
ttgctcttttcaacccctctcc

SEQ ID NO: 690753 - DNA, 22 bp, Artificial Sequence
  chemically synthesized
cctcttgctcttttcaacccct

SEQ ID NO: 690754 - DNA, 22 bp, Artificial Sequence
  chemically synthesized
aaaaagaggagaggggttgaaa

SEQ ID NO: 690755 - DNA, 22 bp, Artificial Sequence
  chemically synthesized
tacctcttgctcttttcaaccc

SEQ ID NO: 690756 - DNA, 22 bp, Artificial Sequence
  chemically synthesized
ctctacctcttgctcttttcaa

SEQ ID NO: 690757 - DNA, 22 bp, Artificial Sequence
  chemically synthesized
tactctacctcttgctcttttc

SEQ ID NO: 690758 - DNA, 22 bp, Artificial Sequence
  chemically synthesized
catctctactctacctcttgct

SEQ ID NO: 690759 - DNA, 22 bp, Artificial Sequence
  chemically synthesized
agattgcatctctactctacct

SEQ ID NO: 690760 - DNA, 22 bp, Artificial Sequence
  chemically synthesized
aaaagagcaagaggtagagtag

SEQ ID NO: 690761 - DNA, 22 bp, Artificial Sequence
  chemically synthesized
cagattgcatctctactctacc

SEQ ID NO: 690762 - DNA, 22 bp, Artificial Sequence
  chemically synthesized
ggaatagcggtcttcagattgc

SEQ ID NO: 690763 - DNA, 22 bp, Artificial Sequence
  chemically synthesized
tgggaatagcggtcttcagatt

SEQ ID NO: 690764 - DNA, 22 bp, Artificial Sequence
  chemically synthesized
tcactctgggaatagcggtctt

SEQ ID NO: 690765 - DNA, 22 bp, Artificial Sequence
  chemically synthesized
tatcactctgggaatagcggtc

SEQ ID NO: 690766 - DNA, 22 bp, Artificial Sequence
  chemically synthesized
ctctatcactctgggaatagcg

SEQ ID NO: 690767 - DNA, 22 bp, Artificial Sequence
  chemically synthesized
gctctatcactctgggaatagc

SEQ ID NO: 690768 - DNA, 22 bp, Artificial Sequence
  chemically synthesized
aagaccgctattcccagagtga

SEQ ID NO: 690769 - DNA, 22 bp, Artificial Sequence
  chemically synthesized
gtcacttgctctatcactctgg

SEQ ID NO: 690770 - DNA, 22 bp, Artificial Sequence
  chemically synthesized
ctagtcacttgctctatcactc

SEQ ID NO: 690771 - DNA, 22 bp, Artificial Sequence
  chemically synthesized
actactagtcacttgctctatc

SEQ ID NO: 690772 - DNA, 22 bp, Artificial Sequence
  chemically synthesized
ttcccagagtgatagagcaagt

SEQ ID NO: 690773 - DNA, 22 bp, Artificial Sequence
  chemically synthesized
ccagagtgatagagcaagtgac

SEQ ID NO: 690774 - DNA, 22 bp, Artificial Sequence
  chemically synthesized
acattcactactagtcacttgc

SEQ ID NO: 690775 - DNA, 22 bp, Artificial Sequence
  chemically synthesized
gtagtgaatgtgagggacctcc

SEQ ID NO: 690776 - DNA, 22 bp, Artificial Sequence
  chemically synthesized
tatgacagacaaaccacacaaa

SEQ ID NO: 690777 - DNA, 22 bp, Artificial Sequence
  chemically synthesized
atatgacagacaaaccacacaa

SEQ ID NO: 690778 - DNA, 22 bp, Artificial Sequence
  chemically synthesized
aagatttatatgacagacaaac

SEQ ID NO: 690779 - DNA, 22 bp, Artificial Sequence
  chemically synthesized
ctgtttgtgtggtttgtctgtc

SEQ ID NO: 690780 - DNA, 22 bp, Artificial Sequence
  chemically synthesized
caagatttatatgacagacaaa

SEQ ID NO: 690781 - DNA, 22 bp, Artificial Sequence
  chemically synthesized
tttgtgtggtttgtctgtcata

SEQ ID NO: 690782 - DNA, 22 bp, Artificial Sequence
  chemically synthesized
gtgtggtttgtctgtcatataa

SEQ ID NO: 690783 - DNA, 22 bp, Artificial Sequence
  chemically synthesized
tgtggtttgtctgtcatataaa

SEQ ID NO: 690784 - DNA, 22 bp, Artificial Sequence
  chemically synthesized
tgtaagtttcaagatttatatg

SEQ ID NO: 690785 - DNA, 22 bp, Artificial Sequence
  chemically synthesized
gtctgtcatataaatcttgaaa

SEQ ID NO: 690786 - DNA, 22 bp, Artificial Sequence
  chemically synthesized
tctgtcatataaatcttgaaac

SEQ ID NO: 690787 - DNA, 22 bp, Artificial Sequence
  chemically synthesized
taaaaatctatgtaagtttcaa

SEQ ID NO: 690788 - DNA, 22 bp, Artificial Sequence
  chemically synthesized
tcatataaatcttgaaacttac

SEQ ID NO: 690789 - DNA, 22 bp, Artificial Sequence
  chemically synthesized
ataaaaatctatgtaagtttca

SEQ ID NO: 690790 - DNA, 22 bp, Artificial Sequence
  chemically synthesized
ccttataaaaatctatgtaagt

SEQ ID NO: 690791 - DNA, 22 bp, Artificial Sequence
  chemically synthesized
cccttataaaaatctatgtaag

SEQ ID NO: 690792 - DNA, 22 bp, Artificial Sequence
  chemically synthesized
tcccttataaaaatctatgtaa

SEQ ID NO: 690793 - DNA, 22 bp, Artificial Sequence
  chemically synthesized
atgttttcccttataaaaatct

SEQ ID NO: 690794 - DNA, 22 bp, Artificial Sequence
  chemically synthesized
gaaacttacatagatttttata

SEQ ID NO: 690795 - DNA, 22 bp, Artificial Sequence
  chemically synthesized
aaacttacatagatttttataa

SEQ ID NO: 690796 - DNA, 22 bp, Artificial Sequence
  chemically synthesized
acatagatttttataagggaaa

SEQ ID NO: 690797 - DNA, 22 bp, Artificial Sequence
  chemically synthesized
catagatttttataagggaaaa

SEQ ID NO: 690798 - DNA, 22 bp, Artificial Sequence
  chemically synthesized
gatatgctgatgttttccctta

SEQ ID NO: 690799 - DNA, 22 bp, Artificial Sequence
  chemically synthesized
tcgatatgctgatgttttccct

SEQ ID NO: 690800 - DNA, 22 bp, Artificial Sequence
  chemically synthesized
ctcgatatgctgatgttttccc

SEQ ID NO: 690801 - DNA, 22 bp, Artificial Sequence
  chemically synthesized
ttctcgatatgctgatgttttc

SEQ ID NO: 690802 - DNA, 22 bp, Artificial Sequence
  chemically synthesized
cttctcgatatgctgatgtttt

SEQ ID NO: 690803 - DNA, 22 bp, Artificial Sequence
  chemically synthesized
tcttctcgatatgctgatgttt

SEQ ID NO: 690804 - DNA, 22 bp, Artificial Sequence
  chemically synthesized
ttataagggaaaacatcagcat

SEQ ID NO: 690805 - DNA, 22 bp, Artificial Sequence
  chemically synthesized
tataagggaaaacatcagcata

SEQ ID NO: 690806 - DNA, 22 bp, Artificial Sequence
  chemically synthesized
ataagggaaaacatcagcatat

SEQ ID NO: 690807 - DNA, 22 bp, Artificial Sequence
  chemically synthesized
taagggaaaacatcagcatatc

SEQ ID NO: 690808 - DNA, 22 bp, Artificial Sequence
  chemically synthesized
tatctttcttctcgatatgctg

SEQ ID NO: 690809 - DNA, 22 bp, Artificial Sequence
  chemically synthesized
aacattatatctttcttctcga

SEQ ID NO: 690810 - DNA, 22 bp, Artificial Sequence
  chemically synthesized
aaacattatatctttcttctcg

SEQ ID NO: 690811 - DNA, 22 bp, Artificial Sequence
  chemically synthesized
aataaagtccagtggcaatgat

SEQ ID NO: 690812 - DNA, 22 bp, Artificial Sequence
  chemically synthesized
aaggggatcattgccactggac

SEQ ID NO: 690813 - DNA, 22 bp, Artificial Sequence
  chemically synthesized
aggggatcattgccactggact

SEQ ID NO: 690814 - DNA, 22 bp, Artificial Sequence
  chemically synthesized
ccactggactttatttagattt

SEQ ID NO: 690815 - DNA, 22 bp, Artificial Sequence
  chemically synthesized
atagaatgtgcaagccaaaatc

SEQ ID NO: 690816 - DNA, 22 bp, Artificial Sequence
  chemically synthesized
gactttatttagattttggctt

SEQ ID NO: 690817 - DNA, 22 bp, Artificial Sequence
  chemically synthesized
tgatagaatgtgcaagccaaaa

SEQ ID NO: 690818 - DNA, 22 bp, Artificial Sequence
  chemically synthesized
tatttagattttggcttgcaca

SEQ ID NO: 690819 - DNA, 22 bp, Artificial Sequence
  chemically synthesized
attctgatagaatgtgcaagcc

SEQ ID NO: 690820 - DNA, 22 bp, Artificial Sequence
  chemically synthesized
atttagattttggcttgcacat

SEQ ID NO: 690821 - DNA, 22 bp, Artificial Sequence
  chemically synthesized
cattctgatagaatgtgcaagc

SEQ ID NO: 690822 - DNA, 22 bp, Artificial Sequence
  chemically synthesized
tttagattttggcttgcacatt

SEQ ID NO: 690823 - DNA, 22 bp, Artificial Sequence
  chemically synthesized
tcattctgatagaatgtgcaag

SEQ ID NO: 690824 - DNA, 22 bp, Artificial Sequence
  chemically synthesized
ttcattctgatagaatgtgcaa

SEQ ID NO: 690825 - DNA, 22 bp, Artificial Sequence
  chemically synthesized
agattttggcttgcacattcta

SEQ ID NO: 690826 - DNA, 22 bp, Artificial Sequence
  chemically synthesized
gattttggcttgcacattctat

SEQ ID NO: 690827 - DNA, 22 bp, Artificial Sequence
  chemically synthesized
gcttttcattctgatagaatgt

SEQ ID NO: 690828 - DNA, 22 bp, Artificial Sequence
  chemically synthesized
tggcttgcacattctatcagaa

SEQ ID NO: 690829 - DNA, 22 bp, Artificial Sequence
  chemically synthesized
ggcttgcacattctatcagaat

SEQ ID NO: 690830 - DNA, 22 bp, Artificial Sequence
  chemically synthesized
gcttgcacattctatcagaatg

SEQ ID NO: 690831 - DNA, 22 bp, Artificial Sequence
  chemically synthesized
aatgttggcttttcattctgat

SEQ ID NO: 690832 - DNA, 22 bp, Artificial Sequence
  chemically synthesized
caatgttggcttttcattctga

SEQ ID NO: 690833 - DNA, 22 bp, Artificial Sequence
  chemically synthesized
gcacattctatcagaatgaaaa

SEQ ID NO: 690834 - DNA, 22 bp, Artificial Sequence
  chemically synthesized
cacattctatcagaatgaaaag

SEQ ID NO: 690835 - DNA, 22 bp, Artificial Sequence
  chemically synthesized
tatcagaatgaaaagccaacat

SEQ ID NO: 690836 - DNA, 22 bp, Artificial Sequence
  chemically synthesized
tcagaatgaaaagccaacattg

SEQ ID NO: 690837 - DNA, 22 bp, Artificial Sequence
  chemically synthesized
tatgatgaaaagatttcaatgt

SEQ ID NO: 690838 - DNA, 22 bp, Artificial Sequence
  chemically synthesized
atatgatgaaaagatttcaatg

SEQ ID NO: 690839 - DNA, 22 bp, Artificial Sequence
  chemically synthesized
ttatatgatgaaaagatttcaa

SEQ ID NO: 690840 - DNA, 22 bp, Artificial Sequence
  chemically synthesized
tcttatatgatgaaaagatttc

SEQ ID NO: 690841 - DNA, 22 bp, Artificial Sequence
  chemically synthesized
ctcttatatgatgaaaagattt

SEQ ID NO: 690842 - DNA, 22 bp, Artificial Sequence
  chemically synthesized
tctcttatatgatgaaaagatt

SEQ ID NO: 690843 - DNA, 22 bp, Artificial Sequence
  chemically synthesized
ttctcttatatgatgaaaagat

SEQ ID NO: 690844 - DNA, 22 bp, Artificial Sequence
  chemically synthesized
tttctcttatatgatgaaaaga

SEQ ID NO: 690845 - DNA, 22 bp, Artificial Sequence
  chemically synthesized
ctttttctcttatatgatgaaa

SEQ ID NO: 690846 - DNA, 22 bp, Artificial Sequence
  chemically synthesized
cctttttctcttatatgatgaa

SEQ ID NO: 690847 - DNA, 22 bp, Artificial Sequence
  chemically synthesized
tcttcctttttctcttatatga

SEQ ID NO: 690848 - DNA, 22 bp, Artificial Sequence
  chemically synthesized
aaatcttttcatcatataagag

SEQ ID NO: 690849 - DNA, 22 bp, Artificial Sequence
  chemically synthesized
ctatcttcctttttctcttata

SEQ ID NO: 690850 - DNA, 22 bp, Artificial Sequence
  chemically synthesized
ttcatcatataagagaaaaagg

SEQ ID NO: 690851 - DNA, 22 bp, Artificial Sequence
  chemically synthesized
tcatcatataagagaaaaagga

SEQ ID NO: 690852 - DNA, 22 bp, Artificial Sequence
  chemically synthesized
catcatataagagaaaaaggaa

SEQ ID NO: 690853 - DNA, 22 bp, Artificial Sequence
  chemically synthesized
atcatataagagaaaaaggaag

SEQ ID NO: 690854 - DNA, 22 bp, Artificial Sequence
  chemically synthesized
tgataccagcacctactatctt

SEQ ID NO: 690855 - DNA, 22 bp, Artificial Sequence
  chemically synthesized
gtgataccagcacctactatct

SEQ ID NO: 690856 - DNA, 22 bp, Artificial Sequence
  chemically synthesized
gccttgtgataccagcacctac

SEQ ID NO: 690857 - DNA, 22 bp, Artificial Sequence
  chemically synthesized
tagccttgtgataccagcacct

SEQ ID NO: 690858 - DNA, 22 bp, Artificial Sequence
  chemically synthesized
ctagccttgtgataccagcacc

SEQ ID NO: 690859 - DNA, 22 bp, Artificial Sequence
  chemically synthesized
tgaaaaccgcttctagccttgt

SEQ ID NO: 690860 - DNA, 22 bp, Artificial Sequence
  chemically synthesized
ctatgaaaaccgcttctagcct

SEQ ID NO: 690861 - DNA, 22 bp, Artificial Sequence
  chemically synthesized
gtatcacaaggctagaagcggt

SEQ ID NO: 690862 - DNA, 22 bp, Artificial Sequence
  chemically synthesized
actactatgaaaaccgcttcta

SEQ ID NO: 690863 - DNA, 22 bp, Artificial Sequence
  chemically synthesized
atggctgactactatgaaaacc

SEQ ID NO: 690864 - DNA, 22 bp, Artificial Sequence
  chemically synthesized
gaagcggttttcatagtagtca

SEQ ID NO: 690865 - DNA, 22 bp, Artificial Sequence
  chemically synthesized
ataagggaaagattaatggctg

SEQ ID NO: 690866 - DNA, 22 bp, Artificial Sequence
  chemically synthesized
tcatagtagtcagccattaatc

SEQ ID NO: 690867 - DNA, 22 bp, Artificial Sequence
  chemically synthesized
catagtagtcagccattaatct

SEQ ID NO: 690868 - DNA, 22 bp, Artificial Sequence
  chemically synthesized
atagtagtcagccattaatctt

SEQ ID NO: 690869 - DNA, 22 bp, Artificial Sequence
  chemically synthesized
aaactcataagggaaagattaa

SEQ ID NO: 690870 - DNA, 22 bp, Artificial Sequence
  chemically synthesized
ggataactcaaactcataaggg

SEQ ID NO: 690871 - DNA, 22 bp, Artificial Sequence
  chemically synthesized
atctttcccttatgagtttgag

SEQ ID NO: 690872 - DNA, 22 bp, Artificial Sequence
  chemically synthesized
tcccttatgagtttgagttatc

SEQ ID NO: 690873 - DNA, 22 bp, Artificial Sequence
  chemically synthesized
cccttatgagtttgagttatcc

SEQ ID NO: 690874 - DNA, 22 bp, Artificial Sequence
  chemically synthesized
ccttatgagtttgagttatcct

SEQ ID NO: 690875 - DNA, 22 bp, Artificial Sequence
  chemically synthesized
atgagtttgagttatcctaaca

SEQ ID NO: 690876 - DNA, 22 bp, Artificial Sequence
  chemically synthesized
taatatgcacaatgttaggata

SEQ ID NO: 690877 - DNA, 22 bp, Artificial Sequence
  chemically synthesized
tgagtttgagttatcctaacat

SEQ ID NO: 690878 - DNA, 22 bp, Artificial Sequence
  chemically synthesized
ataatatgcacaatgttaggat

SEQ ID NO: 690879 - DNA, 22 bp, Artificial Sequence
  chemically synthesized
tatttataatatgcacaatgtt

SEQ ID NO: 690880 - DNA, 22 bp, Artificial Sequence
  chemically synthesized
gagttatcctaacattgtgcat

SEQ ID NO: 690881 - DNA, 22 bp, Artificial Sequence
  chemically synthesized
agttatcctaacattgtgcata

SEQ ID NO: 690882 - DNA, 22 bp, Artificial Sequence
  chemically synthesized
tcctaacattgtgcatattata

SEQ ID NO: 690883 - DNA, 22 bp, Artificial Sequence
  chemically synthesized
acattgtgcatattataaatac

SEQ ID NO: 690884 - DNA, 22 bp, Artificial Sequence
  chemically synthesized
tgcatattataaatacagacac

SEQ ID NO: 690885 - DNA, 22 bp, Artificial Sequence
  chemically synthesized
taaatacagacacctgcttggc

SEQ ID NO: 690886 - DNA, 22 bp, Artificial Sequence
  chemically synthesized
agaggcagtacaagccaagcag

SEQ ID NO: 690887 - DNA, 22 bp, Artificial Sequence
  chemically synthesized
ttgagaggcagtacaagccaag

SEQ ID NO: 690888 - DNA, 22 bp, Artificial Sequence
  chemically synthesized
gttgagaggcagtacaagccaa

SEQ ID NO: 690889 - DNA, 22 bp, Artificial Sequence
  chemically synthesized
tgttgagaggcagtacaagcca

SEQ ID NO: 690890 - DNA, 22 bp, Artificial Sequence
  chemically synthesized
ccatcactttgttgagaggcag

SEQ ID NO: 690891 - DNA, 22 bp, Artificial Sequence
  chemically synthesized
cttggcttgtactgcctctcaa

SEQ ID NO: 690892 - DNA, 22 bp, Artificial Sequence
  chemically synthesized
ggcttgtactgcctctcaacaa

SEQ ID NO: 690893 - DNA, 22 bp, Artificial Sequence
  chemically synthesized
tctgccatcactttgttgagag

SEQ ID NO: 690894 - DNA, 22 bp, Artificial Sequence
  chemically synthesized
gcttgtactgcctctcaacaaa

SEQ ID NO: 690895 - DNA, 22 bp, Artificial Sequence
  chemically synthesized
tgtctgccatcactttgttgag

SEQ ID NO: 690896 - DNA, 22 bp, Artificial Sequence
  chemically synthesized
ctgtctgccatcactttgttga

SEQ ID NO: 690897 - DNA, 22 bp, Artificial Sequence
  chemically synthesized
tctgtctgccatcactttgttg

SEQ ID NO: 690898 - DNA, 22 bp, Artificial Sequence
  chemically synthesized
gtactgcctctcaacaaagtga

SEQ ID NO: 690899 - DNA, 22 bp, Artificial Sequence
  chemically synthesized
tactgcctctcaacaaagtgat

SEQ ID NO: 690900 - DNA, 22 bp, Artificial Sequence
  chemically synthesized
ggttttctgtctgccatcactt

SEQ ID NO: 690901 - DNA, 22 bp, Artificial Sequence
  chemically synthesized
aggttttctgtctgccatcact

SEQ ID NO: 690902 - DNA, 22 bp, Artificial Sequence
  chemically synthesized
cctctcaacaaagtgatggcag

SEQ ID NO: 690903 - DNA, 22 bp, Artificial Sequence
  chemically synthesized
taggttttctgtctgccatcac

SEQ ID NO: 690904 - DNA, 22 bp, Artificial Sequence
  chemically synthesized
ttaggttttctgtctgccatca

SEQ ID NO: 690905 - DNA, 22 bp, Artificial Sequence
  chemically synthesized
tttaggttttctgtctgccatc

SEQ ID NO: 690906 - DNA, 22 bp, Artificial Sequence
  chemically synthesized
ttttaggttttctgtctgccat

SEQ ID NO: 690907 - DNA, 22 bp, Artificial Sequence
  chemically synthesized
tcaacaaagtgatggcagacag

SEQ ID NO: 690908 - DNA, 22 bp, Artificial Sequence
  chemically synthesized
aacaaagtgatggcagacagaa

SEQ ID NO: 690909 - DNA, 22 bp, Artificial Sequence
  chemically synthesized
gtccagaaaagaacttttttag

SEQ ID NO: 690910 - DNA, 22 bp, Artificial Sequence
  chemically synthesized
atccacagctagtccagaaaag

SEQ ID NO: 690911 - DNA, 22 bp, Artificial Sequence
  chemically synthesized
aaaaagttcttttctggactag

SEQ ID NO: 690912 - DNA, 22 bp, Artificial Sequence
  chemically synthesized
ggcctaatccacagctagtcca

SEQ ID NO: 690913 - DNA, 22 bp, Artificial Sequence
  chemically synthesized
ttttctggactagctgtggatt

SEQ ID NO: 690914 - DNA, 22 bp, Artificial Sequence
  chemically synthesized
ttctggactagctgtggattag

SEQ ID NO: 690915 - DNA, 22 bp, Artificial Sequence
  chemically synthesized
tctggactagctgtggattagg

SEQ ID NO: 690916 - DNA, 22 bp, Artificial Sequence
  chemically synthesized
ctggactagctgtggattaggc

SEQ ID NO: 690917 - DNA, 22 bp, Artificial Sequence
  chemically synthesized
tggactagctgtggattaggcc

SEQ ID NO: 690918 - DNA, 22 bp, Artificial Sequence
  chemically synthesized
gactagctgtggattaggccta

SEQ ID NO: 690919 - DNA, 22 bp, Artificial Sequence
  chemically synthesized
atggcgatccaatctaggccta

SEQ ID NO: 690920 - DNA, 22 bp, Artificial Sequence
  chemically synthesized
taatggcgatccaatctaggcc

SEQ ID NO: 690921 - DNA, 22 bp, Artificial Sequence
  chemically synthesized
gctgtggattaggcctagattg

SEQ ID NO: 690922 - DNA, 22 bp, Artificial Sequence
  chemically synthesized
ctaatggcgatccaatctaggc

SEQ ID NO: 690923 - DNA, 22 bp, Artificial Sequence
  chemically synthesized
tctaatggcgatccaatctagg

SEQ ID NO: 690924 - DNA, 22 bp, Artificial Sequence
  chemically synthesized
ttctaatggcgatccaatctag

SEQ ID NO: 690925 - DNA, 22 bp, Artificial Sequence
  chemically synthesized
tggattaggcctagattggatc

SEQ ID NO: 690926 - DNA, 22 bp, Artificial Sequence
  chemically synthesized
cccacttttctaatggcgatcc

SEQ ID NO: 690927 - DNA, 22 bp, Artificial Sequence
  chemically synthesized
ggcctagattggatcgccatta

SEQ ID NO: 690928 - DNA, 22 bp, Artificial Sequence
  chemically synthesized
gattggatcgccattagaaaag

SEQ ID NO: 690929 - DNA, 22 bp, Artificial Sequence
  chemically synthesized
gatcgccattagaaaagtgggg

SEQ ID NO: 690930 - DNA, 22 bp, Artificial Sequence
  chemically synthesized
gaaaagtggggaatgcatatgc

SEQ ID NO: 690931 - DNA, 22 bp, Artificial Sequence
  chemically synthesized
tatgtatgcacacatgcatatg

SEQ ID NO: 690932 - DNA, 22 bp, Artificial Sequence
  chemically synthesized
gtatgtatgcacacatgcatat

SEQ ID NO: 690933 - DNA, 22 bp, Artificial Sequence
  chemically synthesized
taggcccatagaacttgtatgt

SEQ ID NO: 690934 - DNA, 22 bp, Artificial Sequence
  chemically synthesized
caggactgtaggcccatagaac

SEQ ID NO: 690935 - DNA, 22 bp, Artificial Sequence
  chemically synthesized
agtgtgcactccaggactgtag

SEQ ID NO: 690936 - DNA, 22 bp, Artificial Sequence
  chemically synthesized
tatgggcctacagtcctggagt

SEQ ID NO: 690937 - DNA, 22 bp, Artificial Sequence
  chemically synthesized
tgggcctacagtcctggagtgc

SEQ ID NO: 690938 - DNA, 22 bp, Artificial Sequence
  chemically synthesized
cagtcctggagtgcacactgag

SEQ ID NO: 690939 - DNA, 22 bp, Artificial Sequence
  chemically synthesized
gagtgcacactgagacatgtgg

SEQ ID NO: 690940 - DNA, 22 bp, Artificial Sequence
  chemically synthesized
aaaggcagcaacccccagaagc

SEQ ID NO: 690941 - DNA, 22 bp, Artificial Sequence
  chemically synthesized
agacatgtggcttctgggggtt

SEQ ID NO: 690942 - DNA, 22 bp, Artificial Sequence
  chemically synthesized
tggtattgaaaggcagcaaccc

SEQ ID NO: 690943 - DNA, 22 bp, Artificial Sequence
  chemically synthesized
tgtggtattgaaaggcagcaac

SEQ ID NO: 690944 - DNA, 22 bp, Artificial Sequence
  chemically synthesized
ctgggggttgctgcctttcaat

SEQ ID NO: 690945 - DNA, 22 bp, Artificial Sequence
  chemically synthesized
tgggggttgctgcctttcaata

SEQ ID NO: 690946 - DNA, 22 bp, Artificial Sequence
  chemically synthesized
ggggttgctgcctttcaatacc

SEQ ID NO: 690947 - DNA, 22 bp, Artificial Sequence
  chemically synthesized
taacccagtgattctgtggtat

SEQ ID NO: 690948 - DNA, 22 bp, Artificial Sequence
  chemically synthesized
ctgcctttcaataccacagaat

SEQ ID NO: 690949 - DNA, 22 bp, Artificial Sequence
  chemically synthesized
cctttcaataccacagaatcac

SEQ ID NO: 690950 - DNA, 22 bp, Artificial Sequence
  chemically synthesized
tcaataccacagaatcactggg

SEQ ID NO: 690951 - DNA, 22 bp, Artificial Sequence
  chemically synthesized
caataccacagaatcactgggt

SEQ ID NO: 690952 - DNA, 22 bp, Artificial Sequence
  chemically synthesized
aataccacagaatcactgggtt

SEQ ID NO: 690953 - DNA, 22 bp, Artificial Sequence
  chemically synthesized
agccaatgggctgtaacccagt

SEQ ID NO: 690954 - DNA, 22 bp, Artificial Sequence
  chemically synthesized
ctcagccaatgggctgtaaccc

SEQ ID NO: 690955 - DNA, 22 bp, Artificial Sequence
  chemically synthesized
aactactcagccaatgggctgt

SEQ ID NO: 690956 - DNA, 22 bp, Artificial Sequence
  chemically synthesized
gaactactcagccaatgggctg

SEQ ID NO: 690957 - DNA, 22 bp, Artificial Sequence
  chemically synthesized
ggttacagcccattggctgagt

SEQ ID NO: 690958 - DNA, 22 bp, Artificial Sequence
  chemically synthesized
tagataacttgaactactcagc

SEQ ID NO: 690959 - DNA, 22 bp, Artificial Sequence
  chemically synthesized
cagcccattggctgagtagttc

SEQ ID NO: 690960 - DNA, 22 bp, Artificial Sequence
  chemically synthesized
gctgagtagttcaagttatcta

SEQ ID NO: 690961 - DNA, 22 bp, Artificial Sequence
  chemically synthesized
agtagttcaagttatctataga

SEQ ID NO: 690962 - DNA, 22 bp, Artificial Sequence
  chemically synthesized
tcacataataaatgagtctata

SEQ ID NO: 690963 - DNA, 22 bp, Artificial Sequence
  chemically synthesized
tgtcacataataaatgagtcta

SEQ ID NO: 690964 - DNA, 22 bp, Artificial Sequence
  chemically synthesized
aagttatctatagactcattta

SEQ ID NO: 690965 - DNA, 22 bp, Artificial Sequence
  chemically synthesized
tctatagactcatttattatgt

SEQ ID NO: 690966 - DNA, 22 bp, Artificial Sequence
  chemically synthesized
tcatcagctctgtcacataata

SEQ ID NO: 690967 - DNA, 22 bp, Artificial Sequence
  chemically synthesized
tagactcatttattatgtgaca

SEQ ID NO: 690968 - DNA, 22 bp, Artificial Sequence
  chemically synthesized
tgctatcatcagctctgtcaca

SEQ ID NO: 690969 - DNA, 22 bp, Artificial Sequence
  chemically synthesized
atttattatgtgacagagctga

SEQ ID NO: 690970 - DNA, 22 bp, Artificial Sequence
  chemically synthesized
attatgtgacagagctgatgat

SEQ ID NO: 690971 - DNA, 22 bp, Artificial Sequence
  chemically synthesized
ttatgtgacagagctgatgata

SEQ ID NO: 690972 - DNA, 22 bp, Artificial Sequence
  chemically synthesized
tgtgacagagctgatgatagca

SEQ ID NO: 690973 - DNA, 22 bp, Artificial Sequence
  chemically synthesized
aatcagggatgcatctatgcta

SEQ ID NO: 690974 - DNA, 22 bp, Artificial Sequence
  chemically synthesized
caatcagggatgcatctatgct

SEQ ID NO: 690975 - DNA, 22 bp, Artificial Sequence
  chemically synthesized
tcaatcagggatgcatctatgc

SEQ ID NO: 690976 - DNA, 22 bp, Artificial Sequence
  chemically synthesized
gctttcaatcagggatgcatct

SEQ ID NO: 690977 - DNA, 22 bp, Artificial Sequence
  chemically synthesized
atgatagcatagatgcatccct

SEQ ID NO: 690978 - DNA, 22 bp, Artificial Sequence
  chemically synthesized
tctggctttcaatcagggatgc

SEQ ID NO: 690979 - DNA, 22 bp, Artificial Sequence
  chemically synthesized
attgaaagccagatagatcctt

SEQ ID NO: 690980 - DNA, 22 bp, Artificial Sequence
  chemically synthesized
aaagccagatagatcctttgct

SEQ ID NO: 690981 - DNA, 22 bp, Artificial Sequence
  chemically synthesized
acaaagcaaaatgaagcaaagg

SEQ ID NO: 690982 - DNA, 22 bp, Artificial Sequence
  chemically synthesized
gcccacactaacaaagcaaaat

SEQ ID NO: 690983 - DNA, 22 bp, Artificial Sequence
  chemically synthesized
tgctagcccacactaacaaagc

SEQ ID NO: 690984 - DNA, 22 bp, Artificial Sequence
  chemically synthesized
tgcttcattttgctttgttagt

SEQ ID NO: 690985 - DNA, 22 bp, Artificial Sequence
  chemically synthesized
gcttcattttgctttgttagtg

SEQ ID NO: 690986 - DNA, 22 bp, Artificial Sequence
  chemically synthesized
cttcattttgctttgttagtgt

SEQ ID NO: 690987 - DNA, 22 bp, Artificial Sequence
  chemically synthesized
cattttgctttgttagtgtggg

SEQ ID NO: 690988 - DNA, 22 bp, Artificial Sequence
  chemically synthesized
attttgctttgttagtgtgggc

SEQ ID NO: 690989 - DNA, 22 bp, Artificial Sequence
  chemically synthesized
tgctttgttagtgtgggctagc

SEQ ID NO: 690990 - DNA, 22 bp, Artificial Sequence
  chemically synthesized
gctttgttagtgtgggctagca

SEQ ID NO: 690991 - DNA, 22 bp, Artificial Sequence
  chemically synthesized
aaggcaagcctgtgctagccca

SEQ ID NO: 690992 - DNA, 22 bp, Artificial Sequence
  chemically synthesized
ctttgttagtgtgggctagcac

SEQ ID NO: 690993 - DNA, 22 bp, Artificial Sequence
  chemically synthesized
tgttagtgtgggctagcacagg

SEQ ID NO: 690994 - DNA, 22 bp, Artificial Sequence
  chemically synthesized
gttagtgtgggctagcacaggc

SEQ ID NO: 690995 - DNA, 22 bp, Artificial Sequence
  chemically synthesized
ttagtgtgggctagcacaggct

SEQ ID NO: 690996 - DNA, 22 bp, Artificial Sequence
  chemically synthesized
gtgtgggctagcacaggcttgc

SEQ ID NO: 690997 - DNA, 22 bp, Artificial Sequence
  chemically synthesized
aggtacctaaaggcaagcctgt

SEQ ID NO: 690998 - DNA, 22 bp, Artificial Sequence
  chemically synthesized
cactcaggtacctaaaggcaag

SEQ ID NO: 690999 - DNA, 22 bp, Artificial Sequence
  chemically synthesized
gcacaggcttgcctttaggtac

SEQ ID NO: 691000 - DNA, 22 bp, Artificial Sequence
  chemically synthesized
tacattccactcaggtacctaa

SEQ ID NO: 691001 - DNA, 22 bp, Artificial Sequence
  chemically synthesized
gaagttgtacattccactcagg

SEQ ID NO: 691002 - DNA, 22 bp, Artificial Sequence
  chemically synthesized
gcctttaggtacctgagtggaa

SEQ ID NO: 691003 - DNA, 22 bp, Artificial Sequence
  chemically synthesized
cctttaggtacctgagtggaat

SEQ ID NO: 691004 - DNA, 22 bp, Artificial Sequence
  chemically synthesized
taggtacctgagtggaatgtac

SEQ ID NO: 691005 - DNA, 22 bp, Artificial Sequence
  chemically synthesized
aggtacctgagtggaatgtaca

SEQ ID NO: 691006 - DNA, 22 bp, Artificial Sequence
  chemically synthesized
ggtacctgagtggaatgtacaa

SEQ ID NO: 691007 - DNA, 22 bp, Artificial Sequence
  chemically synthesized
catgtaaggactagaagttgta

SEQ ID NO: 691008 - DNA, 22 bp, Artificial Sequence
  chemically synthesized
agtggaatgtacaacttctagt

SEQ ID NO: 691009 - DNA, 22 bp, Artificial Sequence
  chemically synthesized
cattacatgtaaggactagaag

SEQ ID NO: 691010 - DNA, 22 bp, Artificial Sequence
  chemically synthesized
tccattacatgtaaggactaga

SEQ ID NO: 691011 - DNA, 22 bp, Artificial Sequence
  chemically synthesized
ctccattacatgtaaggactag

SEQ ID NO: 691012 - DNA, 22 bp, Artificial Sequence
  chemically synthesized
ctagtccttacatgtaatggag

SEQ ID NO: 691013 - DNA, 22 bp, Artificial Sequence
  chemically synthesized
tagtccttacatgtaatggaga

SEQ ID NO: 691014 - DNA, 22 bp, Artificial Sequence
  chemically synthesized
gtccttacatgtaatggagaag

SEQ ID NO: 691015 - DNA, 22 bp, Artificial Sequence
  chemically synthesized
acatgtaatggagaagactgct

SEQ ID NO: 691016 - DNA, 22 bp, Artificial Sequence
  chemically synthesized
aagatgaatcatagcagtcttc

SEQ ID NO: 691017 - DNA, 22 bp, Artificial Sequence
  chemically synthesized
catgtaatggagaagactgcta

SEQ ID NO: 691018 - DNA, 22 bp, Artificial Sequence
  chemically synthesized
caagatgaatcatagcagtctt

SEQ ID NO: 691019 - DNA, 22 bp, Artificial Sequence
  chemically synthesized
tcaagatgaatcatagcagtct

SEQ ID NO: 691020 - DNA, 22 bp, Artificial Sequence
  chemically synthesized
ttcaagatgaatcatagcagtc

SEQ ID NO: 691021 - DNA, 22 bp, Artificial Sequence
  chemically synthesized
cttttcaagatgaatcatagca

SEQ ID NO: 691022 - DNA, 22 bp, Artificial Sequence
  chemically synthesized
acttttcaagatgaatcatagc

SEQ ID NO: 691023 - DNA, 22 bp, Artificial Sequence
  chemically synthesized
tacttttcaagatgaatcatag

SEQ ID NO: 691024 - DNA, 22 bp, Artificial Sequence
  chemically synthesized
ctatgattcatcttgaaaagta

SEQ ID NO: 691025 - DNA, 22 bp, Artificial Sequence
  chemically synthesized
tgattcatcttgaaaagtaaaa

SEQ ID NO: 691026 - DNA, 22 bp, Artificial Sequence
  chemically synthesized
atcttgaaaagtaaaatgtaca

SEQ ID NO: 691027 - DNA, 22 bp, Artificial Sequence
  chemically synthesized
gaaaagtaaaatgtacacacat

SEQ ID NO: 691028 - DNA, 22 bp, Artificial Sequence
  chemically synthesized
aaaagtaaaatgtacacacata

SEQ ID NO: 691029 - DNA, 22 bp, Artificial Sequence
  chemically synthesized
gatatagacaggtatgtgtgta

SEQ ID NO: 691030 - DNA, 22 bp, Artificial Sequence
  chemically synthesized
ggatatagacaggtatgtgtgt

SEQ ID NO: 691031 - DNA, 22 bp, Artificial Sequence
  chemically synthesized
cccccaagcttggatatagaca

SEQ ID NO: 691032 - DNA, 22 bp, Artificial Sequence
  chemically synthesized
tctatatccaagcttgggggta

SEQ ID NO: 691033 - DNA, 22 bp, Artificial Sequence
  chemically synthesized
aaacccagaagtgttaccccca

SEQ ID NO: 691034 - DNA, 22 bp, Artificial Sequence
  chemically synthesized
tatccaagcttgggggtaacac

SEQ ID NO: 691035 - DNA, 22 bp, Artificial Sequence
  chemically synthesized
gggggtaacacttctgggtttg

SEQ ID NO: 691036 - DNA, 22 bp, Artificial Sequence
  chemically synthesized
ggggtaacacttctgggtttga

SEQ ID NO: 691037 - DNA, 22 bp, Artificial Sequence
  chemically synthesized
tacaaaaatgtcatagctcaaa

SEQ ID NO: 691038 - DNA, 22 bp, Artificial Sequence
  chemically synthesized
ttatacaaaaatgtcatagctc

SEQ ID NO: 691039 - DNA, 22 bp, Artificial Sequence
  chemically synthesized
attatacaaaaatgtcatagct

SEQ ID NO: 691040 - DNA, 22 bp, Artificial Sequence
  chemically synthesized
ctgggtttgagctatgacattt

SEQ ID NO: 691041 - DNA, 22 bp, Artificial Sequence
  chemically synthesized
tgggtttgagctatgacatttt

SEQ ID NO: 691042 - DNA, 22 bp, Artificial Sequence
  chemically synthesized
atttattatacaaaaatgtcat

SEQ ID NO: 691043 - DNA, 22 bp, Artificial Sequence
  chemically synthesized
catttattatacaaaaatgtca

SEQ ID NO: 691044 - DNA, 22 bp, Artificial Sequence
  chemically synthesized
ggtttgagctatgacatttttg

SEQ ID NO: 691045 - DNA, 22 bp, Artificial Sequence
  chemically synthesized
tcatttattatacaaaaatgtc

SEQ ID NO: 691046 - DNA, 22 bp, Artificial Sequence
  chemically synthesized
attttcatttattatacaaaaa

SEQ ID NO: 691047 - DNA, 22 bp, Artificial Sequence
  chemically synthesized
gagctatgacatttttgtataa

SEQ ID NO: 691048 - DNA, 22 bp, Artificial Sequence
  chemically synthesized
aattttcatttattatacaaaa

SEQ ID NO: 691049 - DNA, 22 bp, Artificial Sequence
  chemically synthesized
agctatgacatttttgtataat

SEQ ID NO: 691050 - DNA, 22 bp, Artificial Sequence
  chemically synthesized
tgacatttttgtataataaatg

SEQ ID NO: 691051 - DNA, 22 bp, Artificial Sequence
  chemically synthesized
aaatgaagtttaattttcattt

SEQ ID NO: 691052 - DNA, 22 bp, Artificial Sequence
  chemically synthesized
ttgtataataaatgaaaattaa

SEQ ID NO: 691053 - DNA, 22 bp, Artificial Sequence
  chemically synthesized
tgtataataaatgaaaattaaa

SEQ ID NO: 691054 - DNA, 22 bp, Artificial Sequence
  chemically synthesized
gtataataaatgaaaattaaac

SEQ ID NO: 691055 - DNA, 22 bp, Artificial Sequence
  chemically synthesized
tataataaatgaaaattaaact

SEQ ID NO: 691056 - DNA, 22 bp, Artificial Sequence
  chemically synthesized
tgaaattcaaatgaagtttaat

SEQ ID NO: 691057 - DNA, 22 bp, Artificial Sequence
  chemically synthesized
aacttcatttgaatttcataat

SEQ ID NO: 691058 - DNA, 22 bp, Artificial Sequence
  chemically synthesized
catttgaatttcataattacct

SEQ ID NO: 691059 - DNA, 22 bp, Artificial Sequence
  chemically synthesized
atttgaatttcataattaccta

SEQ ID NO: 691060 - DNA, 22 bp, Artificial Sequence
  chemically synthesized
aatcacaccagtagtaggtaat

SEQ ID NO: 691061 - DNA, 22 bp, Artificial Sequence
  chemically synthesized
gaatttcataattacctactac

SEQ ID NO: 691062 - DNA, 22 bp, Artificial Sequence
  chemically synthesized
taaatcacaccagtagtaggta

SEQ ID NO: 691063 - DNA, 22 bp, Artificial Sequence
  chemically synthesized
aatttcataattacctactact

SEQ ID NO: 691064 - DNA, 22 bp, Artificial Sequence
  chemically synthesized
ctaaatcacaccagtagtaggt

SEQ ID NO: 691065 - DNA, 22 bp, Artificial Sequence
  chemically synthesized
cttctaaatcacaccagtagta

SEQ ID NO: 691066 - DNA, 22 bp, Artificial Sequence
  chemically synthesized
cataattacctactactggtgt

SEQ ID NO: 691067 - DNA, 22 bp, Artificial Sequence
  chemically synthesized
ataattacctactactggtgtg

SEQ ID NO: 691068 - DNA, 22 bp, Artificial Sequence
  chemically synthesized
ccagctgcttctaaatcacacc

SEQ ID NO: 691069 - DNA, 22 bp, Artificial Sequence
  chemically synthesized
cctactactggtgtgatttaga

SEQ ID NO: 691070 - DNA, 22 bp, Artificial Sequence
  chemically synthesized
acctaccagctgcttctaaatc

SEQ ID NO: 691071 - DNA, 22 bp, Artificial Sequence
  chemically synthesized
ctactggtgtgatttagaagca

SEQ ID NO: 691072 - DNA, 22 bp, Artificial Sequence
  chemically synthesized
ctggtgtgatttagaagcagct

SEQ ID NO: 691073 - DNA, 22 bp, Artificial Sequence
  chemically synthesized
gtgtgatttagaagcagctggt

SEQ ID NO: 691074 - DNA, 22 bp, Artificial Sequence
  chemically synthesized
agaagcagctggtaggtcaata

SEQ ID NO: 691075 - DNA, 22 bp, Artificial Sequence
  chemically synthesized
gaagcagctggtaggtcaatat

SEQ ID NO: 691076 - DNA, 22 bp, Artificial Sequence
  chemically synthesized
aaatgcataaaagagcaccata

SEQ ID NO: 691077 - DNA, 22 bp, Artificial Sequence
  chemically synthesized
gtaggtcaatatggtgctcttt

SEQ ID NO: 691078 - DNA, 22 bp, Artificial Sequence
  chemically synthesized
agtactaaaatgcataaaagag

SEQ ID NO: 691079 - DNA, 22 bp, Artificial Sequence
  chemically synthesized
tcagtactaaaatgcataaaag

SEQ ID NO: 691080 - DNA, 22 bp, Artificial Sequence
  chemically synthesized
ctcagtactaaaatgcataaaa

SEQ ID NO: 691081 - DNA, 22 bp, Artificial Sequence
  chemically synthesized
tctcagtactaaaatgcataaa

SEQ ID NO: 691082 - DNA, 22 bp, Artificial Sequence
  chemically synthesized
ttctcagtactaaaatgcataa

SEQ ID NO: 691083 - DNA, 22 bp, Artificial Sequence
  chemically synthesized
tgtttttctcagtactaaaatg

SEQ ID NO: 691084 - DNA, 22 bp, Artificial Sequence
  chemically synthesized
atgtttttctcagtactaaaat

SEQ ID NO: 691085 - DNA, 22 bp, Artificial Sequence
  chemically synthesized
ttttatgcattttagtactgag

SEQ ID NO: 691086 - DNA, 22 bp, Artificial Sequence
  chemically synthesized
ttatgcattttagtactgagaa

SEQ ID NO: 691087 - DNA, 22 bp, Artificial Sequence
  chemically synthesized
gcacttatgtttttctcagtac

SEQ ID NO: 691088 - DNA, 22 bp, Artificial Sequence
  chemically synthesized
tatgcattttagtactgagaaa

SEQ ID NO: 691089 - DNA, 22 bp, Artificial Sequence
  chemically synthesized
atgcattttagtactgagaaaa

SEQ ID NO: 691090 - DNA, 22 bp, Artificial Sequence
  chemically synthesized
tgcattttagtactgagaaaaa

SEQ ID NO: 691091 - DNA, 22 bp, Artificial Sequence
  chemically synthesized
tagtactgagaaaaacataagt

SEQ ID NO: 691092 - DNA, 22 bp, Artificial Sequence
  chemically synthesized
agtactgagaaaaacataagtg

SEQ ID NO: 691093 - DNA, 22 bp, Artificial Sequence
  chemically synthesized
gtactgagaaaaacataagtgc

SEQ ID NO: 691094 - DNA, 22 bp, Artificial Sequence
  chemically synthesized
aaagtggcatatctagcactta

SEQ ID NO: 691095 - DNA, 22 bp, Artificial Sequence
  chemically synthesized
aaaagtggcatatctagcactt

SEQ ID NO: 691096 - DNA, 22 bp, Artificial Sequence
  chemically synthesized
taaaagtggcatatctagcact

SEQ ID NO: 691097 - DNA, 22 bp, Artificial Sequence
  chemically synthesized
agaaaaacataagtgctagata

SEQ ID NO: 691098 - DNA, 22 bp, Artificial Sequence
  chemically synthesized
ggaaactttaaaagtggcatat

SEQ ID NO: 691099 - DNA, 22 bp, Artificial Sequence
  chemically synthesized
tgggaaactttaaaagtggcat

SEQ ID NO: 691100 - DNA, 22 bp, Artificial Sequence
  chemically synthesized
atattctgggaaactttaaaag

SEQ ID NO: 691101 - DNA, 22 bp, Artificial Sequence
  chemically synthesized
taatattctgggaaactttaaa

SEQ ID NO: 691102 - DNA, 22 bp, Artificial Sequence
  chemically synthesized
gatatgccacttttaaagtttc

SEQ ID NO: 691103 - DNA, 22 bp, Artificial Sequence
  chemically synthesized
aattctaatattctgggaaact

SEQ ID NO: 691104 - DNA, 22 bp, Artificial Sequence
  chemically synthesized
gaattctaatattctgggaaac

SEQ ID NO: 691105 - DNA, 22 bp, Artificial Sequence
  chemically synthesized
ttaaagtttcccagaatattag

SEQ ID NO: 691106 - DNA, 22 bp, Artificial Sequence
  chemically synthesized
taaagtttcccagaatattaga

SEQ ID NO: 691107 - DNA, 22 bp, Artificial Sequence
  chemically synthesized
aaagtttcccagaatattagaa

SEQ ID NO: 691108 - DNA, 22 bp, Artificial Sequence
  chemically synthesized
aagtttcccagaatattagaat

SEQ ID NO: 691109 - DNA, 22 bp, Artificial Sequence
  chemically synthesized
cccagaatattagaattcaaac

SEQ ID NO: 691110 - DNA, 22 bp, Artificial Sequence
  chemically synthesized
ccagaatattagaattcaaaca

SEQ ID NO: 691111 - DNA, 22 bp, Artificial Sequence
  chemically synthesized
gaattcaaacacacacacacac

SEQ ID NO: 691112 - DNA, 22 bp, Artificial Sequence
  chemically synthesized
aaacacacacacacacacacat

SEQ ID NO: 691113 - DNA, 22 bp, Artificial Sequence
  chemically synthesized
tatgtgtgtgtgtgtatgtgtg

SEQ ID NO: 691114 - DNA, 22 bp, Artificial Sequence
  chemically synthesized
tgtatgtgtgtgtgtgtatgtg

SEQ ID NO: 691115 - DNA, 22 bp, Artificial Sequence
  chemically synthesized
ctctgtatgtgtgtgtgtgtat

SEQ ID NO: 691116 - DNA, 22 bp, Artificial Sequence
  chemically synthesized
ttactctgtatgtgtgtgtgtg

SEQ ID NO: 691117 - DNA, 22 bp, Artificial Sequence
  chemically synthesized
ccactattactctgtatgtgtg

SEQ ID NO: 691118 - DNA, 22 bp, Artificial Sequence
  chemically synthesized
gcagtggtattaccactattac

SEQ ID NO: 691119 - DNA, 22 bp, Artificial Sequence
  chemically synthesized
tggcagtggtattaccactatt

SEQ ID NO: 691120 - DNA, 22 bp, Artificial Sequence
  chemically synthesized
agtctctggcagtggtattacc

SEQ ID NO: 691121 - DNA, 22 bp, Artificial Sequence
  chemically synthesized
actgagtctctggcagtggtat

SEQ ID NO: 691122 - DNA, 22 bp, Artificial Sequence
  chemically synthesized
aactgagtctctggcagtggta

SEQ ID NO: 691123 - DNA, 22 bp, Artificial Sequence
  chemically synthesized
tcttaactgagtctctggcagt

SEQ ID NO: 691124 - DNA, 22 bp, Artificial Sequence
  chemically synthesized
ccagagactcagttaagataat

SEQ ID NO: 691125 - DNA, 22 bp, Artificial Sequence
  chemically synthesized
agttaagataatattgttctct

SEQ ID NO: 691126 - DNA, 22 bp, Artificial Sequence
  chemically synthesized
aagaggagtcaaatagagaaca

SEQ ID NO: 691127 - DNA, 22 bp, Artificial Sequence
  chemically synthesized
agataatattgttctctatttg

SEQ ID NO: 691128 - DNA, 22 bp, Artificial Sequence
  chemically synthesized
gacggaattaaagaggagtcaa

SEQ ID NO: 691129 - DNA, 22 bp, Artificial Sequence
  chemically synthesized
agacggaattaaagaggagtca

SEQ ID NO: 691130 - DNA, 22 bp, Artificial Sequence
  chemically synthesized
ttctctatttgactcctcttta

SEQ ID NO: 691131 - DNA, 22 bp, Artificial Sequence
  chemically synthesized
tctatttgactcctctttaatt

SEQ ID NO: 691132 - DNA, 22 bp, Artificial Sequence
  chemically synthesized
atgtttagacggaattaaagag

SEQ ID NO: 691133 - DNA, 22 bp, Artificial Sequence
  chemically synthesized
tatttgactcctctttaattcc

SEQ ID NO: 691134 - DNA, 22 bp, Artificial Sequence
  chemically synthesized
tttgactcctctttaattccgt

SEQ ID NO: 691135 - DNA, 22 bp, Artificial Sequence
  chemically synthesized
attcatgtttagacggaattaa

SEQ ID NO: 691136 - DNA, 22 bp, Artificial Sequence
  chemically synthesized
tcattcatgtttagacggaatt

SEQ ID NO: 691137 - DNA, 22 bp, Artificial Sequence
  chemically synthesized
gactcctctttaattccgtcta

SEQ ID NO: 691138 - DNA, 22 bp, Artificial Sequence
  chemically synthesized
actcctctttaattccgtctaa

SEQ ID NO: 691139 - DNA, 22 bp, Artificial Sequence
  chemically synthesized
ttctcattcatgtttagacgga

SEQ ID NO: 691140 - DNA, 22 bp, Artificial Sequence
  chemically synthesized
ctctttaattccgtctaaacat

SEQ ID NO: 691141 - DNA, 22 bp, Artificial Sequence
  chemically synthesized
tttaattccgtctaaacatgaa

SEQ ID NO: 691142 - DNA, 22 bp, Artificial Sequence
  chemically synthesized
taattccgtctaaacatgaatg

SEQ ID NO: 691143 - DNA, 22 bp, Artificial Sequence
  chemically synthesized
aattccgtctaaacatgaatga

SEQ ID NO: 691144 - DNA, 22 bp, Artificial Sequence
  chemically synthesized
attccgtctaaacatgaatgag

SEQ ID NO: 691145 - DNA, 22 bp, Artificial Sequence
  chemically synthesized
cgtctaaacatgaatgagaata

SEQ ID NO: 691146 - DNA, 22 bp, Artificial Sequence
  chemically synthesized
aacatgaatgagaataatcatt

SEQ ID NO: 691147 - DNA, 22 bp, Artificial Sequence
  chemically synthesized
tagatataggtcaatgattatt

SEQ ID NO: 691148 - DNA, 22 bp, Artificial Sequence
  chemically synthesized
gtcatgttgtagatataggtca

SEQ ID NO: 691149 - DNA, 22 bp, Artificial Sequence
  chemically synthesized
agtcatgttgtagatataggtc

SEQ ID NO: 691150 - DNA, 22 bp, Artificial Sequence
  chemically synthesized
atttagtcatgttgtagatata

SEQ ID NO: 691151 - DNA, 22 bp, Artificial Sequence
  chemically synthesized
gtgaactcatttagtcatgttg

SEQ ID NO: 691152 - DNA, 22 bp, Artificial Sequence
  chemically synthesized
acctatatctacaacatgacta

SEQ ID NO: 691153 - DNA, 22 bp, Artificial Sequence
  chemically synthesized
tggtgaactcatttagtcatgt

SEQ ID NO: 691154 - DNA, 22 bp, Artificial Sequence
  chemically synthesized
tatctacaacatgactaaatga

SEQ ID NO: 691155 - DNA, 22 bp, Artificial Sequence
  chemically synthesized
gatcctctggtgaactcattta

SEQ ID NO: 691156 - DNA, 22 bp, Artificial Sequence
  chemically synthesized
caacatgactaaatgagttcac

SEQ ID NO: 691157 - DNA, 22 bp, Artificial Sequence
  chemically synthesized
ttagatcctctggtgaactcat

SEQ ID NO: 691158 - DNA, 22 bp, Artificial Sequence
  chemically synthesized
tgctgttagatcctctggtgaa

SEQ ID NO: 691159 - DNA, 22 bp, Artificial Sequence
  chemically synthesized
atgctgttagatcctctggtga

SEQ ID NO: 691160 - DNA, 22 bp, Artificial Sequence
  chemically synthesized
aatgagttcaccagaggatcta

SEQ ID NO: 691161 - DNA, 22 bp, Artificial Sequence
  chemically synthesized
accagaggatctaacagcataa

SEQ ID NO: 691162 - DNA, 22 bp, Artificial Sequence
  chemically synthesized
atggaaaatagatttatgctgt

SEQ ID NO: 691163 - DNA, 22 bp, Artificial Sequence
  chemically synthesized
attcatggaaaatagatttatg

SEQ ID NO: 691164 - DNA, 22 bp, Artificial Sequence
  chemically synthesized
aattcatggaaaatagatttat

SEQ ID NO: 691165 - DNA, 22 bp, Artificial Sequence
  chemically synthesized
atttaattcatggaaaatagat

SEQ ID NO: 691166 - DNA, 22 bp, Artificial Sequence
  chemically synthesized
aatttaattcatggaaaataga

SEQ ID NO: 691167 - DNA, 22 bp, Artificial Sequence
  chemically synthesized
taatttaattcatggaaaatag

SEQ ID NO: 691168 - DNA, 22 bp, Artificial Sequence
  chemically synthesized
acagcataaatctattttccat

SEQ ID NO: 691169 - DNA, 22 bp, Artificial Sequence
  chemically synthesized
ttaatttaattcatggaaaata

SEQ ID NO: 691170 - DNA, 22 bp, Artificial Sequence
  chemically synthesized
atgagtttttaatttaattcat

SEQ ID NO: 691171 - DNA, 22 bp, Artificial Sequence
  chemically synthesized
ttttccatgaattaaattaaaa

SEQ ID NO: 691172 - DNA, 22 bp, Artificial Sequence
  chemically synthesized
tccatgaattaaattaaaaact

SEQ ID NO: 691173 - DNA, 22 bp, Artificial Sequence
  chemically synthesized
tgtgtattcatgagtttttaat

SEQ ID NO: 691174 - DNA, 22 bp, Artificial Sequence
  chemically synthesized
ccatgaattaaattaaaaactc

SEQ ID NO: 691175 - DNA, 22 bp, Artificial Sequence
  chemically synthesized
catgaattaaattaaaaactca

SEQ ID NO: 691176 - DNA, 22 bp, Artificial Sequence
  chemically synthesized
aaagtattatgtgtattcatga

SEQ ID NO: 691177 - DNA, 22 bp, Artificial Sequence
  chemically synthesized
aattaaaaactcatgaatacac

SEQ ID NO: 691178 - DNA, 22 bp, Artificial Sequence
  chemically synthesized
aatctaaaagtattatgtgtat

SEQ ID NO: 691179 - DNA, 22 bp, Artificial Sequence
  chemically synthesized
aaaactcatgaatacacataat

SEQ ID NO: 691180 - DNA, 22 bp, Artificial Sequence
  chemically synthesized
gttcaatctaaaagtattatgt

SEQ ID NO: 691181 - DNA, 22 bp, Artificial Sequence
  chemically synthesized
ggttcaatctaaaagtattatg

SEQ ID NO: 691182 - DNA, 22 bp, Artificial Sequence
  chemically synthesized
atgaatacacataatactttta

SEQ ID NO: 691183 - DNA, 22 bp, Artificial Sequence
  chemically synthesized
atgaaaatatttggttcaatct

SEQ ID NO: 691184 - DNA, 22 bp, Artificial Sequence
  chemically synthesized
tattcatgaaaatatttggttc

SEQ ID NO: 691185 - DNA, 22 bp, Artificial Sequence
  chemically synthesized
ttagattgaaccaaatattttc

SEQ ID NO: 691186 - DNA, 22 bp, Artificial Sequence
  chemically synthesized
tagattgaaccaaatattttca

SEQ ID NO: 691187 - DNA, 22 bp, Artificial Sequence
  chemically synthesized
agattgaaccaaatattttcat

SEQ ID NO: 691188 - DNA, 22 bp, Artificial Sequence
  chemically synthesized
gattgaaccaaatattttcatg

SEQ ID NO: 691189 - DNA, 22 bp, Artificial Sequence
  chemically synthesized
aaccaaatattttcatgaatac

SEQ ID NO: 691190 - DNA, 22 bp, Artificial Sequence
  chemically synthesized
cgtggatgaagagagtctgtat

SEQ ID NO: 691191 - DNA, 22 bp, Artificial Sequence
  chemically synthesized
ctacgtggatgaagagagtctg

SEQ ID NO: 691192 - DNA, 22 bp, Artificial Sequence
  chemically synthesized
cctacgtggatgaagagagtct

SEQ ID NO: 691193 - DNA, 22 bp, Artificial Sequence
  chemically synthesized
tcatgaatacagactctcttca

SEQ ID NO: 691194 - DNA, 22 bp, Artificial Sequence
  chemically synthesized
catgaatacagactctcttcat

SEQ ID NO: 691195 - DNA, 22 bp, Artificial Sequence
  chemically synthesized
atgaatacagactctcttcatc

SEQ ID NO: 691196 - DNA, 22 bp, Artificial Sequence
  chemically synthesized
accaatagggtttcctacgtgg

SEQ ID NO: 691197 - DNA, 22 bp, Artificial Sequence
  chemically synthesized
ctcaccaatagggtttcctacg

SEQ ID NO: 691198 - DNA, 22 bp, Artificial Sequence
  chemically synthesized
tcttcatccacgtaggaaaccc

SEQ ID NO: 691199 - DNA, 22 bp, Artificial Sequence
  chemically synthesized
ctgctcaccaatagggtttcct

SEQ ID NO: 691200 - DNA, 22 bp, Artificial Sequence
  chemically synthesized
ttcatccacgtaggaaacccta

SEQ ID NO: 691201 - DNA, 22 bp, Artificial Sequence
  chemically synthesized
catccacgtaggaaaccctatt

SEQ ID NO: 691202 - DNA, 22 bp, Artificial Sequence
  chemically synthesized
atccacgtaggaaaccctattg

SEQ ID NO: 691203 - DNA, 22 bp, Artificial Sequence
  chemically synthesized
ccaacctgctgctcaccaatag

SEQ ID NO: 691204 - DNA, 22 bp, Artificial Sequence
  chemically synthesized
attgccaacctgctgctcacca

SEQ ID NO: 691205 - DNA, 22 bp, Artificial Sequence
  chemically synthesized
ctcattgccaacctgctgctca

SEQ ID NO: 691206 - DNA, 22 bp, Artificial Sequence
  chemically synthesized
actcattgccaacctgctgctc

SEQ ID NO: 691207 - DNA, 22 bp, Artificial Sequence
  chemically synthesized
ttggtgagcagcaggttggcaa

SEQ ID NO: 691208 - DNA, 22 bp, Artificial Sequence
  chemically synthesized
gtgagcagcaggttggcaatga

SEQ ID NO: 691209 - DNA, 22 bp, Artificial Sequence
  chemically synthesized
agcagcatttactcattgccaa

SEQ ID NO: 691210 - DNA, 22 bp, Artificial Sequence
  chemically synthesized
ctgagcagcatttactcattgc

SEQ ID NO: 691211 - DNA, 22 bp, Artificial Sequence
  chemically synthesized
acctgctgagcagcatttactc

SEQ ID NO: 691212 - DNA, 22 bp, Artificial Sequence
  chemically synthesized
gcaatgagtaaatgctgctcag

SEQ ID NO: 691213 - DNA, 22 bp, Artificial Sequence
  chemically synthesized
tacacgtctgacctgctgagca

SEQ ID NO: 691214 - DNA, 22 bp, Artificial Sequence
  chemically synthesized
cagctgtacacgtctgacctgc

SEQ ID NO: 691215 - DNA, 22 bp, Artificial Sequence
  chemically synthesized
tccagctgtacacgtctgacct

SEQ ID NO: 691216 - DNA, 22 bp, Artificial Sequence
  chemically synthesized
ctccagctgtacacgtctgacc

SEQ ID NO: 691217 - DNA, 22 bp, Artificial Sequence
  chemically synthesized
tctccagctgtacacgtctgac

SEQ ID NO: 691218 - DNA, 22 bp, Artificial Sequence
  chemically synthesized
ctcagcaggtcagacgtgtaca

SEQ ID NO: 691219 - DNA, 22 bp, Artificial Sequence
  chemically synthesized
agcaggtcagacgtgtacagct

SEQ ID NO: 691220 - DNA, 22 bp, Artificial Sequence
  chemically synthesized
atgatctttctccagctgtaca

SEQ ID NO: 691221 - DNA, 22 bp, Artificial Sequence
  chemically synthesized
catgatctttctccagctgtac

SEQ ID NO: 691222 - DNA, 22 bp, Artificial Sequence
  chemically synthesized
aatttcatgatctttctccagc

SEQ ID NO: 691223 - DNA, 22 bp, Artificial Sequence
  chemically synthesized
gctaaatttcatgatctttctc

SEQ ID NO: 691224 - DNA, 22 bp, Artificial Sequence
  chemically synthesized
gtatactagctaaatttcatga

SEQ ID NO: 691225 - DNA, 22 bp, Artificial Sequence
  chemically synthesized
gagaaagatcatgaaatttagc

SEQ ID NO: 691226 - DNA, 22 bp, Artificial Sequence
  chemically synthesized
cctagtatactagctaaatttc

SEQ ID NO: 691227 - DNA, 22 bp, Artificial Sequence
  chemically synthesized
gcctagtatactagctaaattt

SEQ ID NO: 691228 - DNA, 22 bp, Artificial Sequence
  chemically synthesized
tgcctagtatactagctaaatt

SEQ ID NO: 691229 - DNA, 22 bp, Artificial Sequence
  chemically synthesized
tgttttgcctagtatactagct

SEQ ID NO: 691230 - DNA, 22 bp, Artificial Sequence
  chemically synthesized
gtgttttgcctagtatactagc

SEQ ID NO: 691231 - DNA, 22 bp, Artificial Sequence
  chemically synthesized
cagatttgtgttttgcctagta

SEQ ID NO: 691232 - DNA, 22 bp, Artificial Sequence
  chemically synthesized
ccagatttgtgttttgcctagt

SEQ ID NO: 691233 - DNA, 22 bp, Artificial Sequence
  chemically synthesized
tccagatttgtgttttgcctag

SEQ ID NO: 691234 - DNA, 22 bp, Artificial Sequence
  chemically synthesized
agctagtatactaggcaaaaca

SEQ ID NO: 691235 - DNA, 22 bp, Artificial Sequence
  chemically synthesized
gctagtatactaggcaaaacac

SEQ ID NO: 691236 - DNA, 22 bp, Artificial Sequence
  chemically synthesized
ctttccagatttgtgttttgcc

SEQ ID NO: 691237 - DNA, 22 bp, Artificial Sequence
  chemically synthesized
gtatactaggcaaaacacaaat

SEQ ID NO: 691238 - DNA, 22 bp, Artificial Sequence
  chemically synthesized
ggcaaaacacaaatctggaaag

SEQ ID NO: 691239 - DNA, 22 bp, Artificial Sequence
  chemically synthesized
caatgtggatcatctcctttcc

SEQ ID NO: 691240 - DNA, 22 bp, Artificial Sequence
  chemically synthesized
aaaattgcaatgtggatcatct

SEQ ID NO: 691241 - DNA, 22 bp, Artificial Sequence
  chemically synthesized
aaaaattgcaatgtggatcatc

SEQ ID NO: 691242 - DNA, 22 bp, Artificial Sequence
  chemically synthesized
taaaaattgcaatgtggatcat

SEQ ID NO: 691243 - DNA, 22 bp, Artificial Sequence
  chemically synthesized
ttaaaaattgcaatgtggatca

SEQ ID NO: 691244 - DNA, 22 bp, Artificial Sequence
  chemically synthesized
tttaaaaattgcaatgtggatc

SEQ ID NO: 691245 - DNA, 22 bp, Artificial Sequence
  chemically synthesized
ttttaaaaattgcaatgtggat

SEQ ID NO: 691246 - DNA, 22 bp, Artificial Sequence
  chemically synthesized
gaaaggagatgatccacattgc

SEQ ID NO: 691247 - DNA, 22 bp, Artificial Sequence
  chemically synthesized
tttttaaaaattgcaatgtgga

SEQ ID NO: 691248 - DNA, 22 bp, Artificial Sequence
  chemically synthesized
catagaattttttttaaaaatt

SEQ ID NO: 691249 - DNA, 22 bp, Artificial Sequence
  chemically synthesized
agtctacatagaatttttttta

SEQ ID NO: 691250 - DNA, 22 bp, Artificial Sequence
  chemically synthesized
taagtctacatagaattttttt

SEQ ID NO: 691251 - DNA, 22 bp, Artificial Sequence
  chemically synthesized
caatttttaaaaaaaattctat

SEQ ID NO: 691252 - DNA, 22 bp, Artificial Sequence
  chemically synthesized
gacctctaagtctacatagaat

SEQ ID NO: 691253 - DNA, 22 bp, Artificial Sequence
  chemically synthesized
ttaaaaaaaattctatgtagac

SEQ ID NO: 691254 - DNA, 22 bp, Artificial Sequence
  chemically synthesized
taaaaaaaattctatgtagact

SEQ ID NO: 691255 - DNA, 22 bp, Artificial Sequence
  chemically synthesized
aaaaaaaattctatgtagactt

SEQ ID NO: 691256 - DNA, 22 bp, Artificial Sequence
  chemically synthesized
tactagacctctaagtctacat

SEQ ID NO: 691257 - DNA, 22 bp, Artificial Sequence
  chemically synthesized
aaaaaaattctatgtagactta

SEQ ID NO: 691258 - DNA, 22 bp, Artificial Sequence
  chemically synthesized
tatgtagacttagaggtctagt

SEQ ID NO: 691259 - DNA, 22 bp, Artificial Sequence
  chemically synthesized
tgtagacttagaggtctagtac

SEQ ID NO: 691260 - DNA, 22 bp, Artificial Sequence
  chemically synthesized
tgtgtatgtgtactgtactaga

SEQ ID NO: 691261 - DNA, 22 bp, Artificial Sequence
  chemically synthesized
gtgtgtatgtgtactgtactag

SEQ ID NO: 691262 - DNA, 22 bp, Artificial Sequence
  chemically synthesized
cttgtgtgtatgtgtactgtac

SEQ ID NO: 691263 - DNA, 22 bp, Artificial Sequence
  chemically synthesized
agaggtctagtacagtacacat

SEQ ID NO: 691264 - DNA, 22 bp, Artificial Sequence
  chemically synthesized
gaggtctagtacagtacacata

SEQ ID NO: 691265 - DNA, 22 bp, Artificial Sequence
  chemically synthesized
tgttccttgtgtgtatgtgtac

SEQ ID NO: 691266 - DNA, 22 bp, Artificial Sequence
  chemically synthesized
atgttccttgtgtgtatgtgta

SEQ ID NO: 691267 - DNA, 22 bp, Artificial Sequence
  chemically synthesized
gtacagtacacatacacacaag

SEQ ID NO: 691268 - DNA, 22 bp, Artificial Sequence
  chemically synthesized
agaagatatttatgttccttgt

SEQ ID NO: 691269 - DNA, 22 bp, Artificial Sequence
  chemically synthesized
tcagaagatatttatgttcctt

SEQ ID NO: 691270 - DNA, 22 bp, Artificial Sequence
  chemically synthesized
tctcagaagatatttatgttcc

SEQ ID NO: 691271 - DNA, 22 bp, Artificial Sequence
  chemically synthesized
cagaaactctctcagaagatat

SEQ ID NO: 691272 - DNA, 22 bp, Artificial Sequence
  chemically synthesized
aaaggtaaagcctacagaaact

SEQ ID NO: 691273 - DNA, 22 bp, Artificial Sequence
  chemically synthesized
caaaggtaaagcctacagaaac

SEQ ID NO: 691274 - DNA, 22 bp, Artificial Sequence
  chemically synthesized
ctgagagagtttctgtaggctt

SEQ ID NO: 691275 - DNA, 22 bp, Artificial Sequence
  chemically synthesized
tgagagagtttctgtaggcttt

SEQ ID NO: 691276 - DNA, 22 bp, Artificial Sequence
  chemically synthesized
agagagtttctgtaggctttac

SEQ ID NO: 691277 - DNA, 22 bp, Artificial Sequence
  chemically synthesized
ctgtaggctttacctttgaagt

SEQ ID NO: 691278 - DNA, 22 bp, Artificial Sequence
  chemically synthesized
tgtaggctttacctttgaagtt

SEQ ID NO: 691279 - DNA, 22 bp, Artificial Sequence
  chemically synthesized
taggctttacctttgaagtttt

SEQ ID NO: 691280 - DNA, 22 bp, Artificial Sequence
  chemically synthesized
tacctttgaagtttttttcttt

SEQ ID NO: 691281 - DNA, 22 bp, Artificial Sequence
  chemically synthesized
ccaaaaaaagaaaaagaaaaaa

SEQ ID NO: 691282 - DNA, 22 bp, Artificial Sequence
  chemically synthesized
acctttgaagtttttttctttt

SEQ ID NO: 691283 - DNA, 22 bp, Artificial Sequence
  chemically synthesized
cccaaaaaaagaaaaagaaaaa

SEQ ID NO: 691284 - DNA, 22 bp, Artificial Sequence
  chemically synthesized
cctttgaagtttttttcttttt

SEQ ID NO: 691285 - DNA, 22 bp, Artificial Sequence
  chemically synthesized
tttcccaaaaaaagaaaaagaa

SEQ ID NO: 691286 - DNA, 22 bp, Artificial Sequence
  chemically synthesized
gtttcccaaaaaaagaaaaaga

SEQ ID NO: 691287 - DNA, 22 bp, Artificial Sequence
  chemically synthesized
tgaagtttttttctttttcttt

SEQ ID NO: 691288 - DNA, 22 bp, Artificial Sequence
  chemically synthesized
tgtttcccaaaaaaagaaaaag

SEQ ID NO: 691289 - DNA, 22 bp, Artificial Sequence
  chemically synthesized
gaagtttttttctttttctttt

SEQ ID NO: 691290 - DNA, 22 bp, Artificial Sequence
  chemically synthesized
aagtttttttctttttcttttt

SEQ ID NO: 691291 - DNA, 22 bp, Artificial Sequence
  chemically synthesized
tgttttgtttcccaaaaaaaga

SEQ ID NO: 691292 - DNA, 22 bp, Artificial Sequence
  chemically synthesized
ttttctttttctttttttggga

SEQ ID NO: 691293 - DNA, 22 bp, Artificial Sequence
  chemically synthesized
ttgtgttttgtttcccaaaaaa

SEQ ID NO: 691294 - DNA, 22 bp, Artificial Sequence
  chemically synthesized
tttctttttctttttttgggaa

SEQ ID NO: 691295 - DNA, 22 bp, Artificial Sequence
  chemically synthesized
gttgtgttttgtttcccaaaaa

SEQ ID NO: 691296 - DNA, 22 bp, Artificial Sequence
  chemically synthesized
ttctttttctttttttgggaaa

SEQ ID NO: 691297 - DNA, 22 bp, Artificial Sequence
  chemically synthesized
tgttgtgttttgtttcccaaaa

SEQ ID NO: 691298 - DNA, 22 bp, Artificial Sequence
  chemically synthesized
tctttttctttttttgggaaac

SEQ ID NO: 691299 - DNA, 22 bp, Artificial Sequence
  chemically synthesized
ctttttctttttttgggaaaca

SEQ ID NO: 691300 - DNA, 22 bp, Artificial Sequence
  chemically synthesized
tttttctttttttgggaaacaa

SEQ ID NO: 691301 - DNA, 22 bp, Artificial Sequence
  chemically synthesized
tttctttttttgggaaacaaaa

SEQ ID NO: 691302 - DNA, 22 bp, Artificial Sequence
  chemically synthesized
ttctttttttgggaaacaaaac

SEQ ID NO: 691303 - DNA, 22 bp, Artificial Sequence
  chemically synthesized
tctttttttgggaaacaaaaca

SEQ ID NO: 691304 - DNA, 22 bp, Artificial Sequence
  chemically synthesized
ctttttttgggaaacaaaacac

SEQ ID NO: 691305 - DNA, 22 bp, Artificial Sequence
  chemically synthesized
tttttttgggaaacaaaacaca

SEQ ID NO: 691306 - DNA, 22 bp, Artificial Sequence
  chemically synthesized
tttttgggaaacaaaacacaac

SEQ ID NO: 691307 - DNA, 22 bp, Artificial Sequence
  chemically synthesized
ttttgggaaacaaaacacaaca

SEQ ID NO: 691308 - DNA, 22 bp, Artificial Sequence
  chemically synthesized
tttgggaaacaaaacacaacaa

SEQ ID NO: 691309 - DNA, 22 bp, Artificial Sequence
  chemically synthesized
ttgggaaacaaaacacaacaaa

SEQ ID NO: 691310 - DNA, 22 bp, Artificial Sequence
  chemically synthesized
tgggaaacaaaacacaacaaaa

SEQ ID NO: 691311 - DNA, 22 bp, Artificial Sequence
  chemically synthesized
gggaaacaaaacacaacaaaac

SEQ ID NO: 691312 - DNA, 22 bp, Artificial Sequence
  chemically synthesized
ggaaacaaaacacaacaaaaca

SEQ ID NO: 691313 - DNA, 22 bp, Artificial Sequence
  chemically synthesized
agggcaacaggaggtgttttgt

SEQ ID NO: 691314 - DNA, 22 bp, Artificial Sequence
  chemically synthesized
gcattcagggcaacaggaggtg

SEQ ID NO: 691315 - DNA, 22 bp, Artificial Sequence
  chemically synthesized
catcattagcattcagggcaac

SEQ ID NO: 691316 - DNA, 22 bp, Artificial Sequence
  chemically synthesized
ccatcattagcattcagggcaa

SEQ ID NO: 691317 - DNA, 22 bp, Artificial Sequence
  chemically synthesized
ctgttgccctgaatgctaatga

SEQ ID NO: 691318 - DNA, 22 bp, Artificial Sequence
  chemically synthesized
ttgccctgaatgctaatgatgg

SEQ ID NO: 691319 - DNA, 22 bp, Artificial Sequence
  chemically synthesized
ccctgaatgctaatgatggaag

SEQ ID NO: 691320 - DNA, 22 bp, Artificial Sequence
  chemically synthesized
aatgctaatgatggaagactgt

SEQ ID NO: 691321 - DNA, 22 bp, Artificial Sequence
  chemically synthesized
gcatcaccatagcaacagtctt

SEQ ID NO: 691322 - DNA, 22 bp, Artificial Sequence
  chemically synthesized
atgatggaagactgttgctatg

SEQ ID NO: 691323 - DNA, 22 bp, Artificial Sequence
  chemically synthesized
aaattagcatcaccatagcaac

SEQ ID NO: 691324 - DNA, 22 bp, Artificial Sequence
  chemically synthesized
ttgctatggtgatgctaatttc

SEQ ID NO: 691325 - DNA, 22 bp, Artificial Sequence
  chemically synthesized
ctatggtgatgctaatttcaac

SEQ ID NO: 691326 - DNA, 22 bp, Artificial Sequence
  chemically synthesized
tggtgatgctaatttcaacacc

SEQ ID NO: 691327 - DNA, 22 bp, Artificial Sequence
  chemically synthesized
atgtgaagtccacaggcaacgg

SEQ ID NO: 691328 - DNA, 22 bp, Artificial Sequence
  chemically synthesized
atttcaacaccgttgcctgtgg

SEQ ID NO: 691329 - DNA, 22 bp, Artificial Sequence
  chemically synthesized
caacaccgttgcctgtggactt

SEQ ID NO: 691330 - DNA, 22 bp, Artificial Sequence
  chemically synthesized
aacaccgttgcctgtggacttc

SEQ ID NO: 691331 - DNA, 22 bp, Artificial Sequence
  chemically synthesized
aaacagcgagttcatgtgaagt

SEQ ID NO: 691332 - DNA, 22 bp, Artificial Sequence
  chemically synthesized
cctgtggacttcacatgaactc

SEQ ID NO: 691333 - DNA, 22 bp, Artificial Sequence
  chemically synthesized
tggacttcacatgaactcgctg

SEQ ID NO: 691334 - DNA, 22 bp, Artificial Sequence
  chemically synthesized
cagaagttaaaacagcgagttc

SEQ ID NO: 691335 - DNA, 22 bp, Artificial Sequence
  chemically synthesized
gcagaagttaaaacagcgagtt

SEQ ID NO: 691336 - DNA, 22 bp, Artificial Sequence
  chemically synthesized
cacatgaactcgctgttttaac

SEQ ID NO: 691337 - DNA, 22 bp, Artificial Sequence
  chemically synthesized
acatgaactcgctgttttaact

SEQ ID NO: 691338 - DNA, 22 bp, Artificial Sequence
  chemically synthesized
taaatgacatttgcagaagtta

SEQ ID NO: 691339 - DNA, 22 bp, Artificial Sequence
  chemically synthesized
gtaaatgacatttgcagaagtt

SEQ ID NO: 691340 - DNA, 22 bp, Artificial Sequence
  chemically synthesized
tgtaaatgacatttgcagaagt

SEQ ID NO: 691341 - DNA, 22 bp, Artificial Sequence
  chemically synthesized
gctgttttaacttctgcaaatg

SEQ ID NO: 691342 - DNA, 22 bp, Artificial Sequence
  chemically synthesized
attttgtaaatgacatttgcag

SEQ ID NO: 691343 - DNA, 22 bp, Artificial Sequence
  chemically synthesized
cattttgtaaatgacatttgca

SEQ ID NO: 691344 - DNA, 22 bp, Artificial Sequence
  chemically synthesized
tcattttgtaaatgacatttgc

SEQ ID NO: 691345 - DNA, 22 bp, Artificial Sequence
  chemically synthesized
ttttaacttctgcaaatgtcat

SEQ ID NO: 691346 - DNA, 22 bp, Artificial Sequence
  chemically synthesized
taacttctgcaaatgtcattta

SEQ ID NO: 691347 - DNA, 22 bp, Artificial Sequence
  chemically synthesized
aacttctgcaaatgtcatttac

SEQ ID NO: 691348 - DNA, 22 bp, Artificial Sequence
  chemically synthesized
acttctgcaaatgtcatttaca

SEQ ID NO: 691349 - DNA, 22 bp, Artificial Sequence
  chemically synthesized
atgggttttcattttgtaaatg

SEQ ID NO: 691350 - DNA, 22 bp, Artificial Sequence
  chemically synthesized
ctgcaaatgtcatttacaaaat

SEQ ID NO: 691351 - DNA, 22 bp, Artificial Sequence
  chemically synthesized
tgcaaatgtcatttacaaaatg

SEQ ID NO: 691352 - DNA, 22 bp, Artificial Sequence
  chemically synthesized
caaatgtcatttacaaaatgaa

SEQ ID NO: 691353 - DNA, 22 bp, Artificial Sequence
  chemically synthesized
atcattaatgggttttcatttt

SEQ ID NO: 691354 - DNA, 22 bp, Artificial Sequence
  chemically synthesized
gctaatcattaatgggttttca

SEQ ID NO: 691355 - DNA, 22 bp, Artificial Sequence
  chemically synthesized
acaaaatgaaaacccattaatg

SEQ ID NO: 691356 - DNA, 22 bp, Artificial Sequence
  chemically synthesized
caaaatgaaaacccattaatga

SEQ ID NO: 691357 - DNA, 22 bp, Artificial Sequence
  chemically synthesized
tgccctcgctaatcattaatgg

SEQ ID NO: 691358 - DNA, 22 bp, Artificial Sequence
  chemically synthesized
aagtggaacattgtgccctcgc

SEQ ID NO: 691359 - DNA, 22 bp, Artificial Sequence
  chemically synthesized
attaaagtggaacattgtgccc

SEQ ID NO: 691360 - DNA, 22 bp, Artificial Sequence
  chemically synthesized
atgattagcgagggcacaatgt

SEQ ID NO: 691361 - DNA, 22 bp, Artificial Sequence
  chemically synthesized
taattaaagtggaacattgtgc

SEQ ID NO: 691362 - DNA, 22 bp, Artificial Sequence
  chemically synthesized
ttctaattaaagtggaacattg

SEQ ID NO: 691363 - DNA, 22 bp, Artificial Sequence
  chemically synthesized
gcgagggcacaatgttccactt

SEQ ID NO: 691364 - DNA, 22 bp, Artificial Sequence
  chemically synthesized
ttattctaattaaagtggaaca

SEQ ID NO: 691365 - DNA, 22 bp, Artificial Sequence
  chemically synthesized
attattctaattaaagtggaac

SEQ ID NO: 691366 - DNA, 22 bp, Artificial Sequence
  chemically synthesized
cttattattctaattaaagtgg

SEQ ID NO: 691367 - DNA, 22 bp, Artificial Sequence
  chemically synthesized
cactttaattagaataataagg

SEQ ID NO: 691368 - DNA, 22 bp, Artificial Sequence
  chemically synthesized
tgcatcagcattccttattatt

SEQ ID NO: 691369 - DNA, 22 bp, Artificial Sequence
  chemically synthesized
gtgcatcagcattccttattat

SEQ ID NO: 691370 - DNA, 22 bp, Artificial Sequence
  chemically synthesized
tgtgcatcagcattccttatta

SEQ ID NO: 691371 - DNA, 22 bp, Artificial Sequence
  chemically synthesized
taattagaataataaggaatgc

SEQ ID NO: 691372 - DNA, 22 bp, Artificial Sequence
  chemically synthesized
aattagaataataaggaatgct

SEQ ID NO: 691373 - DNA, 22 bp, Artificial Sequence
  chemically synthesized
attagaataataaggaatgctg

SEQ ID NO: 691374 - DNA, 22 bp, Artificial Sequence
  chemically synthesized
tattttgtgcatcagcattcct

SEQ ID NO: 691375 - DNA, 22 bp, Artificial Sequence
  chemically synthesized
gaataataaggaatgctgatgc

SEQ ID NO: 691376 - DNA, 22 bp, Artificial Sequence
  chemically synthesized
acaaacctgtattttgtgcatc

SEQ ID NO: 691377 - DNA, 22 bp, Artificial Sequence
  chemically synthesized
agtagtgattcacaaacctgta

SEQ ID NO: 691378 - DNA, 22 bp, Artificial Sequence
  chemically synthesized
atgcacaaaatacaggtttgtg

SEQ ID NO: 691379 - DNA, 22 bp, Artificial Sequence
  chemically synthesized
acagtgtaggctcagtagtgat

SEQ ID NO: 691380 - DNA, 22 bp, Artificial Sequence
  chemically synthesized
gacagtgtaggctcagtagtga

SEQ ID NO: 691381 - DNA, 22 bp, Artificial Sequence
  chemically synthesized
tgacagtgtaggctcagtagtg

SEQ ID NO: 691382 - DNA, 22 bp, Artificial Sequence
  chemically synthesized
attttgacagtgtaggctcagt

SEQ ID NO: 691383 - DNA, 22 bp, Artificial Sequence
  chemically synthesized
gtgaatcactactgagcctaca

SEQ ID NO: 691384 - DNA, 22 bp, Artificial Sequence
  chemically synthesized
tgaatcactactgagcctacac

SEQ ID NO: 691385 - DNA, 22 bp, Artificial Sequence
  chemically synthesized
ctgagcctacactgtcaaaatt

SEQ ID NO: 691386 - DNA, 22 bp, Artificial Sequence
  chemically synthesized
atccgtagtaattaattttgac

SEQ ID NO: 691387 - DNA, 22 bp, Artificial Sequence
  chemically synthesized
agcctacactgtcaaaattaat

SEQ ID NO: 691388 - DNA, 22 bp, Artificial Sequence
  chemically synthesized
cactgtcaaaattaattactac

SEQ ID NO: 691389 - DNA, 22 bp, Artificial Sequence
  chemically synthesized
tcaaaattaattactacggatg

SEQ ID NO: 691390 - DNA, 22 bp, Artificial Sequence
  chemically synthesized
attactacggatgaggatttgg

SEQ ID NO: 691391 - DNA, 22 bp, Artificial Sequence
  chemically synthesized
aaaaaagaaaagtaccaaatcc

SEQ ID NO: 691392 - DNA, 22 bp, Artificial Sequence
  chemically synthesized
aaaaaaagaaaagtaccaaatc

SEQ ID NO: 691393 - DNA, 22 bp, Artificial Sequence
  chemically synthesized
ctacggatgaggatttggtact

SEQ ID NO: 691394 - DNA, 22 bp, Artificial Sequence
  chemically synthesized
taaaaaaagaaaagtaccaaat

SEQ ID NO: 691395 - DNA, 22 bp, Artificial Sequence
  chemically synthesized
tttaaaaaaagaaaagtaccaa

SEQ ID NO: 691396 - DNA, 22 bp, Artificial Sequence
  chemically synthesized
cggatgaggatttggtactttt

SEQ ID NO: 691397 - DNA, 22 bp, Artificial Sequence
  chemically synthesized
ctttaaaaaaagaaaagtacca

SEQ ID NO: 691398 - DNA, 22 bp, Artificial Sequence
  chemically synthesized
tctttaaaaaaagaaaagtacc

SEQ ID NO: 691399 - DNA, 22 bp, Artificial Sequence
  chemically synthesized
aagctttctttaaaaaaagaaa

SEQ ID NO: 691400 - DNA, 22 bp, Artificial Sequence
  chemically synthesized
taaagctttctttaaaaaaaga

SEQ ID NO: 691401 - DNA, 22 bp, Artificial Sequence
  chemically synthesized
ctctaaagctttctttaaaaaa

SEQ ID NO: 691402 - DNA, 22 bp, Artificial Sequence
  chemically synthesized
ggtacttttctttttttaaaga

SEQ ID NO: 691403 - DNA, 22 bp, Artificial Sequence
  chemically synthesized
gtacttttctttttttaaagaa

SEQ ID NO: 691404 - DNA, 22 bp, Artificial Sequence
  chemically synthesized
tactctaaagctttctttaaaa

SEQ ID NO: 691405 - DNA, 22 bp, Artificial Sequence
  chemically synthesized
ttctactctaaagctttcttta

SEQ ID NO: 691406 - DNA, 22 bp, Artificial Sequence
  chemically synthesized
ttctttttttaaagaaagcttt

SEQ ID NO: 691407 - DNA, 22 bp, Artificial Sequence
  chemically synthesized
tctttttttaaagaaagcttta

SEQ ID NO: 691408 - DNA, 22 bp, Artificial Sequence
  chemically synthesized
ctttttttaaagaaagctttag

SEQ ID NO: 691409 - DNA, 22 bp, Artificial Sequence
  chemically synthesized
tttttttaaagaaagctttaga

SEQ ID NO: 691410 - DNA, 22 bp, Artificial Sequence
  chemically synthesized
tttttaaagaaagctttagagt

SEQ ID NO: 691411 - DNA, 22 bp, Artificial Sequence
  chemically synthesized
ttttaaagaaagctttagagta

SEQ ID NO: 691412 - DNA, 22 bp, Artificial Sequence
  chemically synthesized
tttaaagaaagctttagagtag

SEQ ID NO: 691413 - DNA, 22 bp, Artificial Sequence
  chemically synthesized
ttaaagaaagctttagagtaga

SEQ ID NO: 691414 - DNA, 22 bp, Artificial Sequence
  chemically synthesized
taaagaaagctttagagtagaa

SEQ ID NO: 691415 - DNA, 22 bp, Artificial Sequence
  chemically synthesized
aaagaaagctttagagtagaac

SEQ ID NO: 691416 - DNA, 22 bp, Artificial Sequence
  chemically synthesized
aagaaagctttagagtagaaca

SEQ ID NO: 691417 - DNA, 22 bp, Artificial Sequence
  chemically synthesized
agtcaaaatacaactgttctac

SEQ ID NO: 691418 - DNA, 22 bp, Artificial Sequence
  chemically synthesized
aagtcaaaatacaactgttcta

SEQ ID NO: 691419 - DNA, 22 bp, Artificial Sequence
  chemically synthesized
taagtcaaaatacaactgttct

SEQ ID NO: 691420 - DNA, 22 bp, Artificial Sequence
  chemically synthesized
ttaagtcaaaatacaactgttc

SEQ ID NO: 691421 - DNA, 22 bp, Artificial Sequence
  chemically synthesized
cttttaagtcaaaatacaactg

SEQ ID NO: 691422 - DNA, 22 bp, Artificial Sequence
  chemically synthesized
tagagtagaacagttgtatttt

SEQ ID NO: 691423 - DNA, 22 bp, Artificial Sequence
  chemically synthesized
agagtagaacagttgtattttg

SEQ ID NO: 691424 - DNA, 22 bp, Artificial Sequence
  chemically synthesized
gagtagaacagttgtattttga

SEQ ID NO: 691425 - DNA, 22 bp, Artificial Sequence
  chemically synthesized
aattccttttaagtcaaaatac

SEQ ID NO: 691426 - DNA, 22 bp, Artificial Sequence
  chemically synthesized
caattccttttaagtcaaaata

SEQ ID NO: 691427 - DNA, 22 bp, Artificial Sequence
  chemically synthesized
tcaattccttttaagtcaaaat

SEQ ID NO: 691428 - DNA, 22 bp, Artificial Sequence
  chemically synthesized
tattttgacttaaaaggaattg

SEQ ID NO: 691429 - DNA, 22 bp, Artificial Sequence
  chemically synthesized
aaagagagagttttcaattcct

SEQ ID NO: 691430 - DNA, 22 bp, Artificial Sequence
  chemically synthesized
aaaagagagagttttcaattcc

SEQ ID NO: 691431 - DNA, 22 bp, Artificial Sequence
  chemically synthesized
tgacttaaaaggaattgaaaac

SEQ ID NO: 691432 - DNA, 22 bp, Artificial Sequence
  chemically synthesized
gacttaaaaggaattgaaaact

SEQ ID NO: 691433 - DNA, 22 bp, Artificial Sequence
  chemically synthesized
acttaaaaggaattgaaaactc

SEQ ID NO: 691434 - DNA, 22 bp, Artificial Sequence
  chemically synthesized
aaatttaaaagagagagttttc

SEQ ID NO: 691435 - DNA, 22 bp, Artificial Sequence
  chemically synthesized
caaatttaaaagagagagtttt

SEQ ID NO: 691436 - DNA, 22 bp, Artificial Sequence
  chemically synthesized
aaaaggaattgaaaactctctc

SEQ ID NO: 691437 - DNA, 22 bp, Artificial Sequence
  chemically synthesized
aaaggaattgaaaactctctct

SEQ ID NO: 691438 - DNA, 22 bp, Artificial Sequence
  chemically synthesized
ccttcaaatttaaaagagagag

SEQ ID NO: 691439 - DNA, 22 bp, Artificial Sequence
  chemically synthesized
accttcaaatttaaaagagaga

SEQ ID NO: 691440 - DNA, 22 bp, Artificial Sequence
  chemically synthesized
taccttcaaatttaaaagagag

SEQ ID NO: 691441 - DNA, 22 bp, Artificial Sequence
  chemically synthesized
ttaccttcaaatttaaaagaga

SEQ ID NO: 691442 - DNA, 22 bp, Artificial Sequence
  chemically synthesized
tttaccttcaaatttaaaagag

SEQ ID NO: 691443 - DNA, 22 bp, Artificial Sequence
  chemically synthesized
ttttaccttcaaatttaaaaga

SEQ ID NO: 691444 - DNA, 22 bp, Artificial Sequence
  chemically synthesized
tttttaccttcaaatttaaaag

SEQ ID NO: 691445 - DNA, 22 bp, Artificial Sequence
  chemically synthesized
ttttttaccttcaaatttaaaa

SEQ ID NO: 691446 - DNA, 22 bp, Artificial Sequence
  chemically synthesized
aaaactctctcttttaaatttg

SEQ ID NO: 691447 - DNA, 22 bp, Artificial Sequence
  chemically synthesized
tttttttaccttcaaatttaaa

SEQ ID NO: 691448 - DNA, 22 bp, Artificial Sequence
  chemically synthesized
tctcttttaaatttgaaggtaa

SEQ ID NO: 691449 - DNA, 22 bp, Artificial Sequence
  chemically synthesized
tcttttaaatttgaaggtaaaa

SEQ ID NO: 691450 - DNA, 22 bp, Artificial Sequence
  chemically synthesized
ttttaaatttgaaggtaaaaaa

SEQ ID NO: 691451 - DNA, 22 bp, Artificial Sequence
  chemically synthesized
ttaaatttgaaggtaaaaaaaa

SEQ ID NO: 691452 - DNA, 22 bp, Artificial Sequence
  chemically synthesized
gggagatgtgctttttttttac

SEQ ID NO: 691453 - DNA, 22 bp, Artificial Sequence
  chemically synthesized
taaatttgaaggtaaaaaaaaa

SEQ ID NO: 691454 - DNA, 22 bp, Artificial Sequence
  chemically synthesized
aaatttgaaggtaaaaaaaaag

SEQ ID NO: 691455 - DNA, 22 bp, Artificial Sequence
  chemically synthesized
aatttgaaggtaaaaaaaaagc

SEQ ID NO: 691456 - DNA, 22 bp, Artificial Sequence
  chemically synthesized
ttagggagatgtgctttttttt

SEQ ID NO: 691457 - DNA, 22 bp, Artificial Sequence
  chemically synthesized
gaaggtaaaaaaaaagcacatc

SEQ ID NO: 691458 - DNA, 22 bp, Artificial Sequence
  chemically synthesized
aaggtaaaaaaaaagcacatct

SEQ ID NO: 691459 - DNA, 22 bp, Artificial Sequence
  chemically synthesized
tgtgtactgttagggagatgtg

SEQ ID NO: 691460 - DNA, 22 bp, Artificial Sequence
  chemically synthesized
atgtgtactgttagggagatgt

SEQ ID NO: 691461 - DNA, 22 bp, Artificial Sequence
  chemically synthesized
tatgtgtactgttagggagatg

SEQ ID NO: 691462 - DNA, 22 bp, Artificial Sequence
  chemically synthesized
ttatgtgtactgttagggagat

SEQ ID NO: 691463 - DNA, 22 bp, Artificial Sequence
  chemically synthesized
gtttttatgtgtactgttaggg

SEQ ID NO: 691464 - DNA, 22 bp, Artificial Sequence
  chemically synthesized
cagttagtttttatgtgtactg

SEQ ID NO: 691465 - DNA, 22 bp, Artificial Sequence
  chemically synthesized
gcagttagtttttatgtgtact

SEQ ID NO: 691466 - DNA, 22 bp, Artificial Sequence
  chemically synthesized
tgcagttagtttttatgtgtac

SEQ ID NO: 691467 - DNA, 22 bp, Artificial Sequence
  chemically synthesized
tttgcagttagtttttatgtgt

SEQ ID NO: 691468 - DNA, 22 bp, Artificial Sequence
  chemically synthesized
cctaacagtacacataaaaact

SEQ ID NO: 691469 - DNA, 22 bp, Artificial Sequence
  chemically synthesized
ctctttgcagttagtttttatg

SEQ ID NO: 691470 - DNA, 22 bp, Artificial Sequence
  chemically synthesized
gctctttgcagttagtttttat

SEQ ID NO: 691471 - DNA, 22 bp, Artificial Sequence
  chemically synthesized
tgctctttgcagttagttttta

SEQ ID NO: 691472 - DNA, 22 bp, Artificial Sequence
  chemically synthesized
acagtacacataaaaactaact

SEQ ID NO: 691473 - DNA, 22 bp, Artificial Sequence
  chemically synthesized
ttttgctctttgcagttagttt

SEQ ID NO: 691474 - DNA, 22 bp, Artificial Sequence
  chemically synthesized
gttttgctctttgcagttagtt

SEQ ID NO: 691475 - DNA, 22 bp, Artificial Sequence
  chemically synthesized
tgttttgctctttgcagttagt

SEQ ID NO: 691476 - DNA, 22 bp, Artificial Sequence
  chemically synthesized
ttgttttgctctttgcagttag

SEQ ID NO: 691477 - DNA, 22 bp, Artificial Sequence
  chemically synthesized
caacttttgttttgctctttgc

SEQ ID NO: 691478 - DNA, 22 bp, Artificial Sequence
  chemically synthesized
ggttccaacttttgttttgctc

SEQ ID NO: 691479 - DNA, 22 bp, Artificial Sequence
  chemically synthesized
actgcaaagagcaaaacaaaag

SEQ ID NO: 691480 - DNA, 22 bp, Artificial Sequence
  chemically synthesized
accctaggttccaacttttgtt

SEQ ID NO: 691481 - DNA, 22 bp, Artificial Sequence
  chemically synthesized
caaagagcaaaacaaaagttgg

SEQ ID NO: 691482 - DNA, 22 bp, Artificial Sequence
  chemically synthesized
agaaatatctgaccctaggttc

SEQ ID NO: 691483 - DNA, 22 bp, Artificial Sequence
  chemically synthesized
ctcagaaatatctgaccctagg

SEQ ID NO: 691484 - DNA, 22 bp, Artificial Sequence
  chemically synthesized
actcagaaatatctgaccctag

SEQ ID NO: 691485 - DNA, 22 bp, Artificial Sequence
  chemically synthesized
ttactcagaaatatctgaccct

SEQ ID NO: 691486 - DNA, 22 bp, Artificial Sequence
  chemically synthesized
agttcttactcagaaatatctg

SEQ ID NO: 691487 - DNA, 22 bp, Artificial Sequence
  chemically synthesized
gaacctagggtcagatatttct

SEQ ID NO: 691488 - DNA, 22 bp, Artificial Sequence
  chemically synthesized
cagttcttactcagaaatatct

SEQ ID NO: 691489 - DNA, 22 bp, Artificial Sequence
  chemically synthesized
ttcagttcttactcagaaatat

SEQ ID NO: 691490 - DNA, 22 bp, Artificial Sequence
  chemically synthesized
cttcagttcttactcagaaata

SEQ ID NO: 691491 - DNA, 22 bp, Artificial Sequence
  chemically synthesized
tcttcagttcttactcagaaat

SEQ ID NO: 691492 - DNA, 22 bp, Artificial Sequence
  chemically synthesized
ttcttcagttcttactcagaaa

SEQ ID NO: 691493 - DNA, 22 bp, Artificial Sequence
  chemically synthesized
gggtcagatatttctgagtaag

SEQ ID NO: 691494 - DNA, 22 bp, Artificial Sequence
  chemically synthesized
acttttcttcagttcttactca

SEQ ID NO: 691495 - DNA, 22 bp, Artificial Sequence
  chemically synthesized
gttgacttttcttcagttctta

SEQ ID NO: 691496 - DNA, 22 bp, Artificial Sequence
  chemically synthesized
ctgagtaagaactgaagaaaag

SEQ ID NO: 691497 - DNA, 22 bp, Artificial Sequence
  chemically synthesized
tgagtaagaactgaagaaaagt

SEQ ID NO: 691498 - DNA, 22 bp, Artificial Sequence
  chemically synthesized
agtaagaactgaagaaaagtca

SEQ ID NO: 691499 - DNA, 22 bp, Artificial Sequence
  chemically synthesized
aacgaacaattagttgactttt

SEQ ID NO: 691500 - DNA, 22 bp, Artificial Sequence
  chemically synthesized
taaacgaacaattagttgactt

SEQ ID NO: 691501 - DNA, 22 bp, Artificial Sequence
  chemically synthesized
ctaaacgaacaattagttgact

SEQ ID NO: 691502 - DNA, 22 bp, Artificial Sequence
  chemically synthesized
tctaaacgaacaattagttgac

SEQ ID NO: 691503 - DNA, 22 bp, Artificial Sequence
  chemically synthesized
ttttctaaacgaacaattagtt

SEQ ID NO: 691504 - DNA, 22 bp, Artificial Sequence
  chemically synthesized
aagaaaagtcaactaattgttc

SEQ ID NO: 691505 - DNA, 22 bp, Artificial Sequence
  chemically synthesized
ccctattttctaaacgaacaat

SEQ ID NO: 691506 - DNA, 22 bp, Artificial Sequence
  chemically synthesized
attgttcgtttagaaaataggg

SEQ ID NO: 691507 - DNA, 22 bp, Artificial Sequence
  chemically synthesized
ttcgtttagaaaatagggtagg

SEQ ID NO: 691508 - DNA, 22 bp, Artificial Sequence
  chemically synthesized
gtttagaaaatagggtaggctg

SEQ ID NO: 691509 - DNA, 22 bp, Artificial Sequence
  chemically synthesized
agaaaatagggtaggctgggtg

SEQ ID NO: 691510 - DNA, 22 bp, Artificial Sequence
  chemically synthesized
gaaaatagggtaggctgggtgt

SEQ ID NO: 691511 - DNA, 22 bp, Artificial Sequence
  chemically synthesized
caggcgtgagccatcacaccca

SEQ ID NO: 691512 - DNA, 22 bp, Artificial Sequence
  chemically synthesized
ggattacaggcgtgagccatca

SEQ ID NO: 691513 - DNA, 22 bp, Artificial Sequence
  chemically synthesized
ggtgtgatggctcacgcctgta

SEQ ID NO: 691514 - DNA, 22 bp, Artificial Sequence
  chemically synthesized
agcgtcccaaagtgctgggatt

SEQ ID NO: 691515 - DNA, 22 bp, Artificial Sequence
  chemically synthesized
acgcctgtaatcccagcacttt

SEQ ID NO: 691516 - DNA, 22 bp, Artificial Sequence
  chemically synthesized
taatcccagcactttgggacgc

SEQ ID NO: 691517 - DNA, 22 bp, Artificial Sequence
  chemically synthesized
atgatccacccacctcagcgtc

SEQ ID NO: 691518 - DNA, 22 bp, Artificial Sequence
  chemically synthesized
acctcatgatccacccacctca

SEQ ID NO: 691519 - DNA, 22 bp, Artificial Sequence
  chemically synthesized
gacctcatgatccacccacctc

SEQ ID NO: 691520 - DNA, 22 bp, Artificial Sequence
  chemically synthesized
ttgacctcatgatccacccacc

SEQ ID NO: 691521 - DNA, 22 bp, Artificial Sequence
  chemically synthesized
tgggacgctgaggtgggtggat

SEQ ID NO: 691522 - DNA, 22 bp, Artificial Sequence
  chemically synthesized
gggacgctgaggtgggtggatc

SEQ ID NO: 691523 - DNA, 22 bp, Artificial Sequence
  chemically synthesized
ggacgctgaggtgggtggatca

SEQ ID NO: 691524 - DNA, 22 bp, Artificial Sequence
  chemically synthesized
atctcttgacctcatgatccac

SEQ ID NO: 691525 - DNA, 22 bp, Artificial Sequence
  chemically synthesized
gatctcttgacctcatgatcca

SEQ ID NO: 691526 - DNA, 22 bp, Artificial Sequence
  chemically synthesized
aggtgggtggatcatgaggtca

SEQ ID NO: 691527 - DNA, 22 bp, Artificial Sequence
  chemically synthesized
gccaggatggtcttgatctctt

SEQ ID NO: 691528 - DNA, 22 bp, Artificial Sequence
  chemically synthesized
ggccaggatggtcttgatctct

SEQ ID NO: 691529 - DNA, 22 bp, Artificial Sequence
  chemically synthesized
accaatttggccaggatggtct

SEQ ID NO: 691530 - DNA, 22 bp, Artificial Sequence
  chemically synthesized
caccaatttggccaggatggtc

SEQ ID NO: 691531 - DNA, 22 bp, Artificial Sequence
  chemically synthesized
gtagagacagggtttcaccaat

SEQ ID NO: 691532 - DNA, 22 bp, Artificial Sequence
  chemically synthesized
agtagagacagggtttcaccaa

SEQ ID NO: 691533 - DNA, 22 bp, Artificial Sequence
  chemically synthesized
tagtagagacagggtttcacca

SEQ ID NO: 691534 - DNA, 22 bp, Artificial Sequence
  chemically synthesized
ttagtagagacagggtttcacc

SEQ ID NO: 691535 - DNA, 22 bp, Artificial Sequence
  chemically synthesized
gccaaattggtgaaaccctgtc

SEQ ID NO: 691536 - DNA, 22 bp, Artificial Sequence
  chemically synthesized
tatttttagtagagacagggtt

SEQ ID NO: 691537 - DNA, 22 bp, Artificial Sequence
  chemically synthesized
gtatttttagtagagacagggt

SEQ ID NO: 691538 - DNA, 22 bp, Artificial Sequence
  chemically synthesized
tgtatttttagtagagacaggg

SEQ ID NO: 691539 - DNA, 22 bp, Artificial Sequence
  chemically synthesized
ttgtatttttagtagagacagg

SEQ ID NO: 691540 - DNA, 22 bp, Artificial Sequence
  chemically synthesized
atttttgtatttttagtagaga

SEQ ID NO: 691541 - DNA, 22 bp, Artificial Sequence
  chemically synthesized
gtgaaaccctgtctctactaaa

SEQ ID NO: 691542 - DNA, 22 bp, Artificial Sequence
  chemically synthesized
tctctactaaaaatacaaaaat

SEQ ID NO: 691543 - DNA, 22 bp, Artificial Sequence
  chemically synthesized
tactaaaaatacaaaaattagc

SEQ ID NO: 691544 - DNA, 22 bp, Artificial Sequence
  chemically synthesized
ctaaaaatacaaaaattagctg

SEQ ID NO: 691545 - DNA, 22 bp, Artificial Sequence
  chemically synthesized
catgccaccatacccagctaat

SEQ ID NO: 691546 - DNA, 22 bp, Artificial Sequence
  chemically synthesized
aaaatacaaaaattagctgggt

SEQ ID NO: 691547 - DNA, 22 bp, Artificial Sequence
  chemically synthesized
cagttgcatgccaccataccca

SEQ ID NO: 691548 - DNA, 22 bp, Artificial Sequence
  chemically synthesized
ggactacagttgcatgccacca

SEQ ID NO: 691549 - DNA, 22 bp, Artificial Sequence
  chemically synthesized
gctgggtatggtggcatgcaac

SEQ ID NO: 691550 - DNA, 22 bp, Artificial Sequence
  chemically synthesized
ggtatggtggcatgcaactgta

SEQ ID NO: 691551 - DNA, 22 bp, Artificial Sequence
  chemically synthesized
ccaagtagctgggactacagtt

SEQ ID NO: 691552 - DNA, 22 bp, Artificial Sequence
  chemically synthesized
agcctcccaagtagctgggact

SEQ ID NO: 691553 - DNA, 22 bp, Artificial Sequence
  chemically synthesized
cctcagcctcccaagtagctgg

SEQ ID NO: 691554 - DNA, 22 bp, Artificial Sequence
  chemically synthesized
ctgcctcagcctcccaagtagc

SEQ ID NO: 691555 - DNA, 22 bp, Artificial Sequence
  chemically synthesized
tcctgcctcagcctcccaagta

SEQ ID NO: 691556 - DNA, 22 bp, Artificial Sequence
  chemically synthesized
tagtcccagctacttgggaggc

SEQ ID NO: 691557 - DNA, 22 bp, Artificial Sequence
  chemically synthesized
aagcgattctcctgcctcagcc

SEQ ID NO: 691558 - DNA, 22 bp, Artificial Sequence
  chemically synthesized
cttgggaggctgaggcaggaga

SEQ ID NO: 691559 - DNA, 22 bp, Artificial Sequence
  chemically synthesized
gggaggctgaggcaggagaatc

SEQ ID NO: 691560 - DNA, 22 bp, Artificial Sequence
  chemically synthesized
ccaggttcaagcgattctcctg

SEQ ID NO: 691561 - DNA, 22 bp, Artificial Sequence
  chemically synthesized
ggaggctgaggcaggagaatcg

SEQ ID NO: 691562 - DNA, 22 bp, Artificial Sequence
  chemically synthesized
cacctcccaggttcaagcgatt

SEQ ID NO: 691563 - DNA, 22 bp, Artificial Sequence
  chemically synthesized
aggcaggagaatcgcttgaacc

SEQ ID NO: 691564 - DNA, 22 bp, Artificial Sequence
  chemically synthesized
caacctccacctcccaggttca

SEQ ID NO: 691565 - DNA, 22 bp, Artificial Sequence
  chemically synthesized
actgcaacctccacctcccagg

SEQ ID NO: 691566 - DNA, 22 bp, Artificial Sequence
  chemically synthesized
ggctcactgcaacctccacctc

SEQ ID NO: 691567 - DNA, 22 bp, Artificial Sequence
  chemically synthesized
gaacctgggaggtggaggttgc

SEQ ID NO: 691568 - DNA, 22 bp, Artificial Sequence
  chemically synthesized
aacctgggaggtggaggttgca

SEQ ID NO: 691569 - DNA, 22 bp, Artificial Sequence
  chemically synthesized
ggaggtggaggttgcagtgagc

SEQ ID NO: 691570 - DNA, 22 bp, Artificial Sequence
  chemically synthesized
gagtgcagtggtgcgatctcgg

SEQ ID NO: 691571 - DNA, 22 bp, Artificial Sequence
  chemically synthesized
cagtgagccgagatcgcaccac

SEQ ID NO: 691572 - DNA, 22 bp, Artificial Sequence
  chemically synthesized
tcaccaggctggagtgcagtgg

SEQ ID NO: 691573 - DNA, 22 bp, Artificial Sequence
  chemically synthesized
tgtcaccaggctggagtgcagt

SEQ ID NO: 691574 - DNA, 22 bp, Artificial Sequence
  chemically synthesized
ctctgtcaccaggctggagtgc

SEQ ID NO: 691575 - DNA, 22 bp, Artificial Sequence
  chemically synthesized
cctctgtcaccaggctggagtg

SEQ ID NO: 691576 - DNA, 22 bp, Artificial Sequence
  chemically synthesized
cactccagcctggtgacagagg

SEQ ID NO: 691577 - DNA, 22 bp, Artificial Sequence
  chemically synthesized
agacggagtcttcctctgtcac

SEQ ID NO: 691578 - DNA, 22 bp, Artificial Sequence
  chemically synthesized
aagacggagtcttcctctgtca

SEQ ID NO: 691579 - DNA, 22 bp, Artificial Sequence
  chemically synthesized
taagacggagtcttcctctgtc

SEQ ID NO: 691580 - DNA, 22 bp, Artificial Sequence
  chemically synthesized
ttaagacggagtcttcctctgt

SEQ ID NO: 691581 - DNA, 22 bp, Artificial Sequence
  chemically synthesized
tttaagacggagtcttcctctg

SEQ ID NO: 691582 - DNA, 22 bp, Artificial Sequence
  chemically synthesized
cagcctggtgacagaggaagac

SEQ ID NO: 691583 - DNA, 22 bp, Artificial Sequence
  chemically synthesized
ttttaagacggagtcttcctct

SEQ ID NO: 691584 - DNA, 22 bp, Artificial Sequence
  chemically synthesized
tttttaagacggagtcttcctc

SEQ ID NO: 691585 - DNA, 22 bp, Artificial Sequence
  chemically synthesized
ttttttaagacggagtcttcct

SEQ ID NO: 691586 - DNA, 22 bp, Artificial Sequence
  chemically synthesized
tttttttaagacggagtcttcc

SEQ ID NO: 691587 - DNA, 22 bp, Artificial Sequence
  chemically synthesized
ttttttttaagacggagtcttc

SEQ ID NO: 691588 - DNA, 22 bp, Artificial Sequence
  chemically synthesized
tttttttttaagacggagtctt

SEQ ID NO: 691589 - DNA, 22 bp, Artificial Sequence
  chemically synthesized
ttttttttttaagacggagtct

SEQ ID NO: 691590 - DNA, 22 bp, Artificial Sequence
  chemically synthesized
gtgacagaggaagactccgtct

SEQ ID NO: 691591 - DNA, 22 bp, Artificial Sequence
  chemically synthesized
tttttttttttaagacggagtc

SEQ ID NO: 691592 - DNA, 22 bp, Artificial Sequence
  chemically synthesized
ttttttttttttaagacggagt

SEQ ID NO: 691593 - DNA, 22 bp, Artificial Sequence
  chemically synthesized
tttttttttttttaagacggag

SEQ ID NO: 691594 - DNA, 22 bp, Artificial Sequence
  chemically synthesized
ttttttttttttttaagacgga

SEQ ID NO: 691595 - DNA, 22 bp, Artificial Sequence
  chemically synthesized
tttttttttttttttaagacgg

SEQ ID NO: 691596 - DNA, 22 bp, Artificial Sequence
  chemically synthesized
ttttttttttttttttaagacg

SEQ ID NO: 691597 - DNA, 22 bp, Artificial Sequence
  chemically synthesized
tttttttttttttttttaagac

SEQ ID NO: 691598 - DNA, 22 bp, Artificial Sequence
  chemically synthesized
ttttttttttttttttttaaga

SEQ ID NO: 691599 - DNA, 22 bp, Artificial Sequence
  chemically synthesized
tttttttttttttttttttaag

SEQ ID NO: 691600 - DNA, 22 bp, Artificial Sequence
  chemically synthesized
ttttttttttttttttttttaa

SEQ ID NO: 691601 - DNA, 22 bp, Artificial Sequence
  chemically synthesized
ttttttttttttttttttttta

SEQ ID NO: 691602 - DNA, 22 bp, Artificial Sequence
  chemically synthesized
tttttttttttttttttttttt

SEQ ID NO: 691603 - DNA, 22 bp, Artificial Sequence
  chemically synthesized
cgtcttaaaaaaaaaaaaaaaa

SEQ ID NO: 691604 - DNA, 22 bp, Artificial Sequence
  chemically synthesized
aaaaaaaaaaaaaaaaaaaaaa

SEQ ID NO: 691605 - DNA, 22 bp, Artificial Sequence
  chemically synthesized
aaaaaaaaaaaaaaaaaaaaaa

SEQ ID NO: 691606 - DNA, 22 bp, Artificial Sequence
  chemically synthesized
tatcatcccccccatccttttt

SEQ ID NO: 691607 - DNA, 22 bp, Artificial Sequence
  chemically synthesized
cctgtatcatcccccccatcct

SEQ ID NO: 691608 - DNA, 22 bp, Artificial Sequence
  chemically synthesized
acctgtatcatcccccccatcc

SEQ ID NO: 691609 - DNA, 22 bp, Artificial Sequence
  chemically synthesized
aaatagcttacctgtatcatcc

SEQ ID NO: 691610 - DNA, 22 bp, Artificial Sequence
  chemically synthesized
aaatattcaaatagcttacctg

SEQ ID NO: 691611 - DNA, 22 bp, Artificial Sequence
  chemically synthesized
gaaatattcaaatagcttacct

SEQ ID NO: 691612 - DNA, 22 bp, Artificial Sequence
  chemically synthesized
tgaaatattcaaatagcttacc

SEQ ID NO: 691613 - DNA, 22 bp, Artificial Sequence
  chemically synthesized
ttgaaatattcaaatagcttac

SEQ ID NO: 691614 - DNA, 22 bp, Artificial Sequence
  chemically synthesized
tttgaaatattcaaatagctta

SEQ ID NO: 691615 - DNA, 22 bp, Artificial Sequence
  chemically synthesized
ttttttgaaatattcaaatagc

SEQ ID NO: 691616 - DNA, 22 bp, Artificial Sequence
  chemically synthesized
agatagttattttttgaaatat

SEQ ID NO: 691617 - DNA, 22 bp, Artificial Sequence
  chemically synthesized
ctcagatagttattttttgaaa

SEQ ID NO: 691618 - DNA, 22 bp, Artificial Sequence
  chemically synthesized
cctcagatagttattttttgaa

SEQ ID NO: 691619 - DNA, 22 bp, Artificial Sequence
  chemically synthesized
tcctcagatagttattttttga

SEQ ID NO: 691620 - DNA, 22 bp, Artificial Sequence
  chemically synthesized
ttcctcagatagttattttttg

SEQ ID NO: 691621 - DNA, 22 bp, Artificial Sequence
  chemically synthesized
tttgaatatttcaaaaaataac

SEQ ID NO: 691622 - DNA, 22 bp, Artificial Sequence
  chemically synthesized
tttcctcagatagttatttttt

SEQ ID NO: 691623 - DNA, 22 bp, Artificial Sequence
  chemically synthesized
gaatatttcaaaaaataactat

SEQ ID NO: 691624 - DNA, 22 bp, Artificial Sequence
  chemically synthesized
aatatttcaaaaaataactatc

SEQ ID NO: 691625 - DNA, 22 bp, Artificial Sequence
  chemically synthesized
caaaaaataactatctgaggaa

SEQ ID NO: 691626 - DNA, 22 bp, Artificial Sequence
  chemically synthesized
aaaaaataactatctgaggaaa

SEQ ID NO: 691627 - DNA, 22 bp, Artificial Sequence
  chemically synthesized
ccatatgcagcactttttcctc

SEQ ID NO: 691628 - DNA, 22 bp, Artificial Sequence
  chemically synthesized
accatatgcagcactttttcct

SEQ ID NO: 691629 - DNA, 22 bp, Artificial Sequence
  chemically synthesized
tctgaggaaaaagtgctgcata

SEQ ID NO: 691630 - DNA, 22 bp, Artificial Sequence
  chemically synthesized
aggaaaaagtgctgcatatggt

SEQ ID NO: 691631 - DNA, 22 bp, Artificial Sequence
  chemically synthesized
atatcaaggtatttaccatatg

SEQ ID NO: 691632 - DNA, 22 bp, Artificial Sequence
  chemically synthesized
catatggtaaataccttgatat

SEQ ID NO: 691633 - DNA, 22 bp, Artificial Sequence
  chemically synthesized
tgtggacacataaatccaaata

SEQ ID NO: 691634 - DNA, 22 bp, Artificial Sequence
  chemically synthesized
gatattagatatatttggattt

SEQ ID NO: 691635 - DNA, 22 bp, Artificial Sequence
  chemically synthesized
gtgtggacacataaatccaaat

SEQ ID NO: 691636 - DNA, 22 bp, Artificial Sequence
  chemically synthesized
atattagatatatttggattta

SEQ ID NO: 691637 - DNA, 22 bp, Artificial Sequence
  chemically synthesized
cttgtgtggacacataaatcca

SEQ ID NO: 691638 - DNA, 22 bp, Artificial Sequence
  chemically synthesized
ccttgtgtggacacataaatcc

SEQ ID NO: 691639 - DNA, 22 bp, Artificial Sequence
  chemically synthesized
gatatatttggatttatgtgtc

SEQ ID NO: 691640 - DNA, 22 bp, Artificial Sequence
  chemically synthesized
tttccttgtgtggacacataaa

SEQ ID NO: 691641 - DNA, 22 bp, Artificial Sequence
  chemically synthesized
tgtttccttgtgtggacacata

SEQ ID NO: 691642 - DNA, 22 bp, Artificial Sequence
  chemically synthesized
tctgtttccttgtgtggacaca

SEQ ID NO: 691643 - DNA, 22 bp, Artificial Sequence
  chemically synthesized
ggatttatgtgtccacacaagg

SEQ ID NO: 691644 - DNA, 22 bp, Artificial Sequence
  chemically synthesized
gatttatgtgtccacacaagga

SEQ ID NO: 691645 - DNA, 22 bp, Artificial Sequence
  chemically synthesized
aatgttctctgtttccttgtgt

SEQ ID NO: 691646 - DNA, 22 bp, Artificial Sequence
  chemically synthesized
aaatgttctctgtttccttgtg

SEQ ID NO: 691647 - DNA, 22 bp, Artificial Sequence
  chemically synthesized
atgtgtccacacaaggaaacag

SEQ ID NO: 691648 - DNA, 22 bp, Artificial Sequence
  chemically synthesized
tttaaatgttctctgtttcctt

SEQ ID NO: 691649 - DNA, 22 bp, Artificial Sequence
  chemically synthesized
tgtgtccacacaaggaaacaga

SEQ ID NO: 691650 - DNA, 22 bp, Artificial Sequence
  chemically synthesized
ccagttgtttaaatgttctctg

SEQ ID NO: 691651 - DNA, 22 bp, Artificial Sequence
  chemically synthesized
tatattcccagttgtttaaatg

SEQ ID NO: 691652 - DNA, 22 bp, Artificial Sequence
  chemically synthesized
gtatattcccagttgtttaaat

SEQ ID NO: 691653 - DNA, 22 bp, Artificial Sequence
  chemically synthesized
ttgtatattcccagttgtttaa

SEQ ID NO: 691654 - DNA, 22 bp, Artificial Sequence
  chemically synthesized
ctcttgtatattcccagttgtt

SEQ ID NO: 691655 - DNA, 22 bp, Artificial Sequence
  chemically synthesized
cctcttgtatattcccagttgt

SEQ ID NO: 691656 - DNA, 22 bp, Artificial Sequence
  chemically synthesized
tttcctcttgtatattcccagt

SEQ ID NO: 691657 - DNA, 22 bp, Artificial Sequence
  chemically synthesized
gtttcctcttgtatattcccag

SEQ ID NO: 691658 - DNA, 22 bp, Artificial Sequence
  chemically synthesized
tgtttcctcttgtatattccca

SEQ ID NO: 691659 - DNA, 22 bp, Artificial Sequence
  chemically synthesized
ttgtttcctcttgtatattccc

SEQ ID NO: 691660 - DNA, 22 bp, Artificial Sequence
  chemically synthesized
tttttgtttcctcttgtatatt

SEQ ID NO: 691661 - DNA, 22 bp, Artificial Sequence
  chemically synthesized
aaacaactgggaatatacaaga

SEQ ID NO: 691662 - DNA, 22 bp, Artificial Sequence
  chemically synthesized
aacaactgggaatatacaagag

SEQ ID NO: 691663 - DNA, 22 bp, Artificial Sequence
  chemically synthesized
ggaatatacaagaggaaacaaa

SEQ ID NO: 691664 - DNA, 22 bp, Artificial Sequence
  chemically synthesized
gagagaatagaattatttttgt

SEQ ID NO: 691665 - DNA, 22 bp, Artificial Sequence
  chemically synthesized
ccattggagagaatagaattat

SEQ ID NO: 691666 - DNA, 22 bp, Artificial Sequence
  chemically synthesized
accattggagagaatagaatta

SEQ ID NO: 691667 - DNA, 22 bp, Artificial Sequence
  chemically synthesized
taccattggagagaatagaatt

SEQ ID NO: 691668 - DNA, 22 bp, Artificial Sequence
  chemically synthesized
ttaccattggagagaatagaat

SEQ ID NO: 691669 - DNA, 22 bp, Artificial Sequence
  chemically synthesized
aatcttttaccattggagagaa

SEQ ID NO: 691670 - DNA, 22 bp, Artificial Sequence
  chemically synthesized
aggtaactcaatcttttaccat

SEQ ID NO: 691671 - DNA, 22 bp, Artificial Sequence
  chemically synthesized
tattctctccaatggtaaaaga

SEQ ID NO: 691672 - DNA, 22 bp, Artificial Sequence
  chemically synthesized
aaggtaactcaatcttttacca

SEQ ID NO: 691673 - DNA, 22 bp, Artificial Sequence
  chemically synthesized
taaggtaactcaatcttttacc

SEQ ID NO: 691674 - DNA, 22 bp, Artificial Sequence
  chemically synthesized
ttctctccaatggtaaaagatt

SEQ ID NO: 691675 - DNA, 22 bp, Artificial Sequence
  chemically synthesized
ttttaaggtaactcaatctttt

SEQ ID NO: 691676 - DNA, 22 bp, Artificial Sequence
  chemically synthesized
tctccaatggtaaaagattgag

SEQ ID NO: 691677 - DNA, 22 bp, Artificial Sequence
  chemically synthesized
attttaaggtaactcaatcttt

SEQ ID NO: 691678 - DNA, 22 bp, Artificial Sequence
  chemically synthesized
tattttaaggtaactcaatctt

SEQ ID NO: 691679 - DNA, 22 bp, Artificial Sequence
  chemically synthesized
tccaatggtaaaagattgagtt

SEQ ID NO: 691680 - DNA, 22 bp, Artificial Sequence
  chemically synthesized
caatggtaaaagattgagttac

SEQ ID NO: 691681 - DNA, 22 bp, Artificial Sequence
  chemically synthesized
agttaccttaaaataaagattt

SEQ ID NO: 691682 - DNA, 22 bp, Artificial Sequence
  chemically synthesized
tgcaggtgaaaaaaaaatcttt

SEQ ID NO: 691683 - DNA, 22 bp, Artificial Sequence
  chemically synthesized
gtgcaggtgaaaaaaaaatctt

SEQ ID NO: 691684 - DNA, 22 bp, Artificial Sequence
  chemically synthesized
ccttaaaataaagatttttttt

SEQ ID NO: 691685 - DNA, 22 bp, Artificial Sequence
  chemically synthesized
aaaataaagatttttttttcac

SEQ ID NO: 691686 - DNA, 22 bp, Artificial Sequence
  chemically synthesized
aaatttgtgcaggtgaaaaaaa

SEQ ID NO: 691687 - DNA, 22 bp, Artificial Sequence
  chemically synthesized
aaataaagatttttttttcacc

SEQ ID NO: 691688 - DNA, 22 bp, Artificial Sequence
  chemically synthesized
aaaatttgtgcaggtgaaaaaa

SEQ ID NO: 691689 - DNA, 22 bp, Artificial Sequence
  chemically synthesized
taaaatttgtgcaggtgaaaaa

SEQ ID NO: 691690 - DNA, 22 bp, Artificial Sequence
  chemically synthesized
ctttaaaatttgtgcaggtgaa

SEQ ID NO: 691691 - DNA, 22 bp, Artificial Sequence
  chemically synthesized
ttttttcacctgcacaaatttt

SEQ ID NO: 691692 - DNA, 22 bp, Artificial Sequence
  chemically synthesized
agatgttgctttaaaatttgtg

SEQ ID NO: 691693 - DNA, 22 bp, Artificial Sequence
  chemically synthesized
tttttcacctgcacaaatttta

SEQ ID NO: 691694 - DNA, 22 bp, Artificial Sequence
  chemically synthesized
cagatgttgctttaaaatttgt

SEQ ID NO: 691695 - DNA, 22 bp, Artificial Sequence
  chemically synthesized
ttttcacctgcacaaattttaa

SEQ ID NO: 691696 - DNA, 22 bp, Artificial Sequence
  chemically synthesized
tttcacctgcacaaattttaaa

SEQ ID NO: 691697 - DNA, 22 bp, Artificial Sequence
  chemically synthesized
ttcacctgcacaaattttaaag

SEQ ID NO: 691698 - DNA, 22 bp, Artificial Sequence
  chemically synthesized
tcacctgcacaaattttaaagc

SEQ ID NO: 691699 - DNA, 22 bp, Artificial Sequence
  chemically synthesized
cacctgcacaaattttaaagca

SEQ ID NO: 691700 - DNA, 22 bp, Artificial Sequence
  chemically synthesized
atcttcagatgttgctttaaaa

SEQ ID NO: 691701 - DNA, 22 bp, Artificial Sequence
  chemically synthesized
acctgcacaaattttaaagcaa

SEQ ID NO: 691702 - DNA, 22 bp, Artificial Sequence
  chemically synthesized
cacaaattttaaagcaacatct

SEQ ID NO: 691703 - DNA, 22 bp, Artificial Sequence
  chemically synthesized
caactcatcttcagatgttgct

SEQ ID NO: 691704 - DNA, 22 bp, Artificial Sequence
  chemically synthesized
ccaactcatcttcagatgttgc

SEQ ID NO: 691705 - DNA, 22 bp, Artificial Sequence
  chemically synthesized
tccaactcatcttcagatgttg

SEQ ID NO: 691706 - DNA, 22 bp, Artificial Sequence
  chemically synthesized
tttccaactcatcttcagatgt

SEQ ID NO: 691707 - DNA, 22 bp, Artificial Sequence
  chemically synthesized
taaagcaacatctgaagatgag

SEQ ID NO: 691708 - DNA, 22 bp, Artificial Sequence
  chemically synthesized
aaagcaacatctgaagatgagt

SEQ ID NO: 691709 - DNA, 22 bp, Artificial Sequence
  chemically synthesized
aagcaacatctgaagatgagtt

SEQ ID NO: 691710 - DNA, 22 bp, Artificial Sequence
  chemically synthesized
aatatggaacatactctttcca

SEQ ID NO: 691711 - DNA, 22 bp, Artificial Sequence
  chemically synthesized
aaatatggaacatactctttcc

SEQ ID NO: 691712 - DNA, 22 bp, Artificial Sequence
  chemically synthesized
aagatgagttggaaagagtatg

SEQ ID NO: 691713 - DNA, 22 bp, Artificial Sequence
  chemically synthesized
gaaagagtatgttccatattta

SEQ ID NO: 691714 - DNA, 22 bp, Artificial Sequence
  chemically synthesized
cagcaaaccatgtggaaacaaa

SEQ ID NO: 691715 - DNA, 22 bp, Artificial Sequence
  chemically synthesized
gcagcaaaccatgtggaaacaa

SEQ ID NO: 691716 - DNA, 22 bp, Artificial Sequence
  chemically synthesized
catatttaaatttgtttccaca

SEQ ID NO: 691717 - DNA, 22 bp, Artificial Sequence
  chemically synthesized
tgcagcaaaccatgtggaaaca

SEQ ID NO: 691718 - DNA, 22 bp, Artificial Sequence
  chemically synthesized
aaatttgtttccacatggtttg

SEQ ID NO: 691719 - DNA, 22 bp, Artificial Sequence
  chemically synthesized
aatttgtttccacatggtttgc

SEQ ID NO: 691720 - DNA, 22 bp, Artificial Sequence
  chemically synthesized
gtttccacatggtttgctgcaa

SEQ ID NO: 691721 - DNA, 22 bp, Artificial Sequence
  chemically synthesized
tttccacatggtttgctgcaaa

SEQ ID NO: 691722 - DNA, 22 bp, Artificial Sequence
  chemically synthesized
ccacatggtttgctgcaaagac

SEQ ID NO: 691723 - DNA, 22 bp, Artificial Sequence
  chemically synthesized
cacatggtttgctgcaaagact

SEQ ID NO: 691724 - DNA, 22 bp, Artificial Sequence
  chemically synthesized
gctgcaaagactgcgtcggttg

SEQ ID NO: 691725 - DNA, 22 bp, Artificial Sequence
  chemically synthesized
ctgcaaagactgcgtcggttga

SEQ ID NO: 691726 - DNA, 22 bp, Artificial Sequence
  chemically synthesized
caaagactgcgtcggttgattt

SEQ ID NO: 691727 - DNA, 22 bp, Artificial Sequence
  chemically synthesized
cgtcggttgattttattttcga

SEQ ID NO: 691728 - DNA, 22 bp, Artificial Sequence
  chemically synthesized
attttattttcgatgctctaca

SEQ ID NO: 691729 - DNA, 22 bp, Artificial Sequence
  chemically synthesized
tattttcgatgctctacatttc

SEQ ID NO: 691730 - DNA, 22 bp, Artificial Sequence
  chemically synthesized
attttcgatgctctacatttcc

SEQ ID NO: 691731 - DNA, 22 bp, Artificial Sequence
  chemically synthesized
ttttcgatgctctacatttcca

SEQ ID NO: 691732 - DNA, 22 bp, Artificial Sequence
  chemically synthesized
tcgatgctctacatttccattc

SEQ ID NO: 691733 - DNA, 22 bp, Artificial Sequence
  chemically synthesized
cgatgctctacatttccattct

SEQ ID NO: 691734 - DNA, 22 bp, Artificial Sequence
  chemically synthesized
gatgctctacatttccattctg

SEQ ID NO: 691735 - DNA, 22 bp, Artificial Sequence
  chemically synthesized
aatagggggtgacccagaatgg

SEQ ID NO: 691736 - DNA, 22 bp, Artificial Sequence
  chemically synthesized
actgaatagggggtgacccaga

SEQ ID NO: 691737 - DNA, 22 bp, Artificial Sequence
  chemically synthesized
tacatttccattctgggtcacc

SEQ ID NO: 691738 - DNA, 22 bp, Artificial Sequence
  chemically synthesized
cactgaatagggggtgacccag

SEQ ID NO: 691739 - DNA, 22 bp, Artificial Sequence
  chemically synthesized
catttccattctgggtcacccc

SEQ ID NO: 691740 - DNA, 22 bp, Artificial Sequence
  chemically synthesized
ccattctgggtcaccccctatt

SEQ ID NO: 691741 - DNA, 22 bp, Artificial Sequence
  chemically synthesized
cattctgggtcaccccctattc

SEQ ID NO: 691742 - DNA, 22 bp, Artificial Sequence
  chemically synthesized
tgggtcaccccctattcagtga

SEQ ID NO: 691743 - DNA, 22 bp, Artificial Sequence
  chemically synthesized
ggtcaccccctattcagtgaaa

SEQ ID NO: 691744 - DNA, 22 bp, Artificial Sequence
  chemically synthesized
caccaatgacataaaatgattt

SEQ ID NO: 691745 - DNA, 22 bp, Artificial Sequence
  chemically synthesized
gctgcaccaatgacataaaatg

SEQ ID NO: 691746 - DNA, 22 bp, Artificial Sequence
  chemically synthesized
ttcagtgaaatcattttatgtc

SEQ ID NO: 691747 - DNA, 22 bp, Artificial Sequence
  chemically synthesized
ttggctgcaccaatgacataaa

SEQ ID NO: 691748 - DNA, 22 bp, Artificial Sequence
  chemically synthesized
agtgaaatcattttatgtcatt

SEQ ID NO: 691749 - DNA, 22 bp, Artificial Sequence
  chemically synthesized
gttggctgcaccaatgacataa

SEQ ID NO: 691750 - DNA, 22 bp, Artificial Sequence
  chemically synthesized
tgttggctgcaccaatgacata

SEQ ID NO: 691751 - DNA, 22 bp, Artificial Sequence
  chemically synthesized
ttgttggctgcaccaatgacat

SEQ ID NO: 691752 - DNA, 22 bp, Artificial Sequence
  chemically synthesized
tttgttggctgcaccaatgaca

SEQ ID NO: 691753 - DNA, 22 bp, Artificial Sequence
  chemically synthesized
tatgtcattggtgcagccaaca

SEQ ID NO: 691754 - DNA, 22 bp, Artificial Sequence
  chemically synthesized
atgtcattggtgcagccaacaa

SEQ ID NO: 691755 - DNA, 22 bp, Artificial Sequence
  chemically synthesized
tgtcattggtgcagccaacaaa

SEQ ID NO: 691756 - DNA, 22 bp, Artificial Sequence
  chemically synthesized
gtgcagccaacaaaaaaccgat

SEQ ID NO: 691757 - DNA, 22 bp, Artificial Sequence
  chemically synthesized
catatccagcaaatacaccatc

SEQ ID NO: 691758 - DNA, 22 bp, Artificial Sequence
  chemically synthesized
ccatatccagcaaatacaccat

SEQ ID NO: 691759 - DNA, 22 bp, Artificial Sequence
  chemically synthesized
caccttccatatccagcaaata

SEQ ID NO: 691760 - DNA, 22 bp, Artificial Sequence
  chemically synthesized
gctggatatggaaggtgcaaca

SEQ ID NO: 691761 - DNA, 22 bp, Artificial Sequence
  chemically synthesized
ctggatatggaaggtgcaacac

SEQ ID NO: 691762 - DNA, 22 bp, Artificial Sequence
  chemically synthesized
gatatggaaggtgcaacacgca

SEQ ID NO: 691763 - DNA, 22 bp, Artificial Sequence
  chemically synthesized
taacatgaaaaatgcgtgttgc

SEQ ID NO: 691764 - DNA, 22 bp, Artificial Sequence
  chemically synthesized
gtaacatgaaaaatgcgtgttg

SEQ ID NO: 691765 - DNA, 22 bp, Artificial Sequence
  chemically synthesized
tgtaacatgaaaaatgcgtgtt

SEQ ID NO: 691766 - DNA, 22 bp, Artificial Sequence
  chemically synthesized
ttgtaacatgaaaaatgcgtgt

SEQ ID NO: 691767 - DNA, 22 bp, Artificial Sequence
  chemically synthesized
taggaagatttttgtaacatga

SEQ ID NO: 691768 - DNA, 22 bp, Artificial Sequence
  chemically synthesized
tgtaggaagatttttgtaacat

SEQ ID NO: 691769 - DNA, 22 bp, Artificial Sequence
  chemically synthesized
ctgtaggaagatttttgtaaca

SEQ ID NO: 691770 - DNA, 22 bp, Artificial Sequence
  chemically synthesized
gaacttctgtaggaagattttt

SEQ ID NO: 691771 - DNA, 22 bp, Artificial Sequence
  chemically synthesized
ggaacttctgtaggaagatttt

SEQ ID NO: 691772 - DNA, 22 bp, Artificial Sequence
  chemically synthesized
ttcatgttacaaaaatcttcct

SEQ ID NO: 691773 - DNA, 22 bp, Artificial Sequence
  chemically synthesized
tcatgttacaaaaatcttccta

SEQ ID NO: 691774 - DNA, 22 bp, Artificial Sequence
  chemically synthesized
catgttacaaaaatcttcctac

SEQ ID NO: 691775 - DNA, 22 bp, Artificial Sequence
  chemically synthesized
atgttacaaaaatcttcctaca

SEQ ID NO: 691776 - DNA, 22 bp, Artificial Sequence
  chemically synthesized
caaaaatcttcctacagaagtt

SEQ ID NO: 691777 - DNA, 22 bp, Artificial Sequence
  chemically synthesized
ccaaatccaacaggtttggaac

SEQ ID NO: 691778 - DNA, 22 bp, Artificial Sequence
  chemically synthesized
gccaaatccaacaggtttggaa

SEQ ID NO: 691779 - DNA, 22 bp, Artificial Sequence
  chemically synthesized
cctacagaagttccaaacctgt

SEQ ID NO: 691780 - DNA, 22 bp, Artificial Sequence
  chemically synthesized
ctacagaagttccaaacctgtt

SEQ ID NO: 691781 - DNA, 22 bp, Artificial Sequence
  chemically synthesized
cagaagttccaaacctgttgga

SEQ ID NO: 691782 - DNA, 22 bp, Artificial Sequence
  chemically synthesized
atcatatcttgccaaatccaac

SEQ ID NO: 691783 - DNA, 22 bp, Artificial Sequence
  chemically synthesized
catcatatcttgccaaatccaa

SEQ ID NO: 691784 - DNA, 22 bp, Artificial Sequence
  chemically synthesized
caaacctgttggatttggcaag

SEQ ID NO: 691785 - DNA, 22 bp, Artificial Sequence
  chemically synthesized
ccttcatcatatcttgccaaat

SEQ ID NO: 691786 - DNA, 22 bp, Artificial Sequence
  chemically synthesized
ttggatttggcaagatatgatg

SEQ ID NO: 691787 - DNA, 22 bp, Artificial Sequence
  chemically synthesized
gtatcatctcccttcatcatat

SEQ ID NO: 691788 - DNA, 22 bp, Artificial Sequence
  chemically synthesized
gatttggcaagatatgatgaag

SEQ ID NO: 691789 - DNA, 22 bp, Artificial Sequence
  chemically synthesized
ggcaagatatgatgaagggaga

SEQ ID NO: 691790 - DNA, 22 bp, Artificial Sequence
  chemically synthesized
gcaagatatgatgaagggagat

SEQ ID NO: 691791 - DNA, 22 bp, Artificial Sequence
  chemically synthesized
tataaagtattggtatcatctc

SEQ ID NO: 691792 - DNA, 22 bp, Artificial Sequence
  chemically synthesized
gaaactatataaagtattggta

SEQ ID NO: 691793 - DNA, 22 bp, Artificial Sequence
  chemically synthesized
tagaaactatataaagtattgg

SEQ ID NO: 691794 - DNA, 22 bp, Artificial Sequence
  chemically synthesized
ctctagaaactatataaagtat

SEQ ID NO: 691795 - DNA, 22 bp, Artificial Sequence
  chemically synthesized
aaggattactctagaaactata

SEQ ID NO: 691796 - DNA, 22 bp, Artificial Sequence
  chemically synthesized
caaggattactctagaaactat

SEQ ID NO: 691797 - DNA, 22 bp, Artificial Sequence
  chemically synthesized
tcaaggattactctagaaacta

SEQ ID NO: 691798 - DNA, 22 bp, Artificial Sequence
  chemically synthesized
tatatagtttctagagtaatcc

SEQ ID NO: 691799 - DNA, 22 bp, Artificial Sequence
  chemically synthesized
atatagtttctagagtaatcct

SEQ ID NO: 691800 - DNA, 22 bp, Artificial Sequence
  chemically synthesized
tatagtttctagagtaatcctt

SEQ ID NO: 691801 - DNA, 22 bp, Artificial Sequence
  chemically synthesized
ctagagtaatccttgaaagact

SEQ ID NO: 691802 - DNA, 22 bp, Artificial Sequence
  chemically synthesized
tagagtaatccttgaaagactt

SEQ ID NO: 691803 - DNA, 22 bp, Artificial Sequence
  chemically synthesized
gagtaatccttgaaagacttgt

SEQ ID NO: 691804 - DNA, 22 bp, Artificial Sequence
  chemically synthesized
aagacccagaatacaagtcttt

SEQ ID NO: 691805 - DNA, 22 bp, Artificial Sequence
  chemically synthesized
actgaagacccagaatacaagt

SEQ ID NO: 691806 - DNA, 22 bp, Artificial Sequence
  chemically synthesized
gactgaagacccagaatacaag

SEQ ID NO: 691807 - DNA, 22 bp, Artificial Sequence
  chemically synthesized
cttgactgaagacccagaatac

SEQ ID NO: 691808 - DNA, 22 bp, Artificial Sequence
  chemically synthesized
gaaagacttgtattctgggtct

SEQ ID NO: 691809 - DNA, 22 bp, Artificial Sequence
  chemically synthesized
aaagacttgtattctgggtctt

SEQ ID NO: 691810 - DNA, 22 bp, Artificial Sequence
  chemically synthesized
taatattacttgactgaagacc

SEQ ID NO: 691811 - DNA, 22 bp, Artificial Sequence
  chemically synthesized
gtattctgggtcttcagtcaag

SEQ ID NO: 691812 - DNA, 22 bp, Artificial Sequence
  chemically synthesized
tattctgggtcttcagtcaagt

SEQ ID NO: 691813 - DNA, 22 bp, Artificial Sequence
  chemically synthesized
cagaccctataatattacttga

SEQ ID NO: 691814 - DNA, 22 bp, Artificial Sequence
  chemically synthesized
tgggtcttcagtcaagtaatat

SEQ ID NO: 691815 - DNA, 22 bp, Artificial Sequence
  chemically synthesized
tacagaccctataatattactt

SEQ ID NO: 691816 - DNA, 22 bp, Artificial Sequence
  chemically synthesized
ggtcttcagtcaagtaatatta

SEQ ID NO: 691817 - DNA, 22 bp, Artificial Sequence
  chemically synthesized
cagtcaagtaatattatagggt

SEQ ID NO: 691818 - DNA, 22 bp, Artificial Sequence
  chemically synthesized
atagttctacagaccctataat

SEQ ID NO: 691819 - DNA, 22 bp, Artificial Sequence
  chemically synthesized
agtcaagtaatattatagggtc

SEQ ID NO: 691820 - DNA, 22 bp, Artificial Sequence
  chemically synthesized
gatagttctacagaccctataa

SEQ ID NO: 691821 - DNA, 22 bp, Artificial Sequence
  chemically synthesized
tagggtctgtagaactatcaaa

SEQ ID NO: 691822 - DNA, 22 bp, Artificial Sequence
  chemically synthesized
aataacacaggtaatttgatag

SEQ ID NO: 691823 - DNA, 22 bp, Artificial Sequence
  chemically synthesized
acctcaataacacaggtaattt

SEQ ID NO: 691824 - DNA, 22 bp, Artificial Sequence
  chemically synthesized
cacctcaataacacaggtaatt

SEQ ID NO: 691825 - DNA, 22 bp, Artificial Sequence
  chemically synthesized
tagaactatcaaattacctgtg

SEQ ID NO: 691826 - DNA, 22 bp, Artificial Sequence
  chemically synthesized
tcacctcaataacacaggtaat

SEQ ID NO: 691827 - DNA, 22 bp, Artificial Sequence
  chemically synthesized
acctttcacctcaataacacag

SEQ ID NO: 691828 - DNA, 22 bp, Artificial Sequence
  chemically synthesized
tcaaattacctgtgttattgag

SEQ ID NO: 691829 - DNA, 22 bp, Artificial Sequence
  chemically synthesized
cctgtgttattgaggtgaaagg

SEQ ID NO: 691830 - DNA, 22 bp, Artificial Sequence
  chemically synthesized
tgttattgaggtgaaaggtgaa

SEQ ID NO: 691831 - DNA, 22 bp, Artificial Sequence
  chemically synthesized
ttgaggtgaaaggtgaatttgt

SEQ ID NO: 691832 - DNA, 22 bp, Artificial Sequence
  chemically synthesized
aggtgaaaggtgaatttgtggt

SEQ ID NO: 691833 - DNA, 22 bp, Artificial Sequence
  chemically synthesized
atatcaggtagacaaataaggc

SEQ ID NO: 691834 - DNA, 22 bp, Artificial Sequence
  chemically synthesized
aatatcaggtagacaaataagg

SEQ ID NO: 691835 - DNA, 22 bp, Artificial Sequence
  chemically synthesized
gcttaatatcaggtagacaaat

SEQ ID NO: 691836 - DNA, 22 bp, Artificial Sequence
  chemically synthesized
gtggtggccttatttgtctacc

SEQ ID NO: 691837 - DNA, 22 bp, Artificial Sequence
  chemically synthesized
ggcttaatatcaggtagacaaa

SEQ ID NO: 691838 - DNA, 22 bp, Artificial Sequence
  chemically synthesized
tggtggccttatttgtctacct

SEQ ID NO: 691839 - DNA, 22 bp, Artificial Sequence
  chemically synthesized
atttgtctacctgatattaagc

SEQ ID NO: 691840 - DNA, 22 bp, Artificial Sequence
  chemically synthesized
tttgtctacctgatattaagcc

SEQ ID NO: 691841 - DNA, 22 bp, Artificial Sequence
  chemically synthesized
gtctacctgatattaagccaag

SEQ ID NO: 691842 - DNA, 22 bp, Artificial Sequence
  chemically synthesized
tctacctgatattaagccaagg

SEQ ID NO: 691843 - DNA, 22 bp, Artificial Sequence
  chemically synthesized
ccaagtgcagtacccttggctt

SEQ ID NO: 691844 - DNA, 22 bp, Artificial Sequence
  chemically synthesized
cccaagtgcagtacccttggct

SEQ ID NO: 691845 - DNA, 22 bp, Artificial Sequence
  chemically synthesized
cctgatattaagccaagggtac

SEQ ID NO: 691846 - DNA, 22 bp, Artificial Sequence
  chemically synthesized
tcttcccaagtgcagtaccctt

SEQ ID NO: 691847 - DNA, 22 bp, Artificial Sequence
  chemically synthesized
atattaagccaagggtactgca

SEQ ID NO: 691848 - DNA, 22 bp, Artificial Sequence
  chemically synthesized
agccaagggtactgcacttggg

SEQ ID NO: 691849 - DNA, 22 bp, Artificial Sequence
  chemically synthesized
acggcagatgtcagctgtcttc

SEQ ID NO: 691850 - DNA, 22 bp, Artificial Sequence
  chemically synthesized
gacggcagatgtcagctgtctt

SEQ ID NO: 691851 - DNA, 22 bp, Artificial Sequence
  chemically synthesized
tgacggcagatgtcagctgtct

SEQ ID NO: 691852 - DNA, 22 bp, Artificial Sequence
  chemically synthesized
ttgacggcagatgtcagctgtc

SEQ ID NO: 691853 - DNA, 22 bp, Artificial Sequence
  chemically synthesized
cacttgggaagacagctgacat

SEQ ID NO: 691854 - DNA, 22 bp, Artificial Sequence
  chemically synthesized
catttttgacggcagatgtcag

SEQ ID NO: 691855 - DNA, 22 bp, Artificial Sequence
  chemically synthesized
acatttttgacggcagatgtca

SEQ ID NO: 691856 - DNA, 22 bp, Artificial Sequence
  chemically synthesized
gggaagacagctgacatctgcc

SEQ ID NO: 691857 - DNA, 22 bp, Artificial Sequence
  chemically synthesized
tacatttttgacggcagatgtc

SEQ ID NO: 691858 - DNA, 22 bp, Artificial Sequence
  chemically synthesized
ggaagacagctgacatctgccg

SEQ ID NO: 691859 - DNA, 22 bp, Artificial Sequence
  chemically synthesized
ctttacatttttgacggcagat

SEQ ID NO: 691860 - DNA, 22 bp, Artificial Sequence
  chemically synthesized
ctactttacatttttgacggca

SEQ ID NO: 691861 - DNA, 22 bp, Artificial Sequence
  chemically synthesized
cctactttacatttttgacggc

SEQ ID NO: 691862 - DNA, 22 bp, Artificial Sequence
  chemically synthesized
acttcctactttacatttttga

SEQ ID NO: 691863 - DNA, 22 bp, Artificial Sequence
  chemically synthesized
acatctgccgtcaaaaatgtaa

SEQ ID NO: 691864 - DNA, 22 bp, Artificial Sequence
  chemically synthesized
taacttcctactttacattttt

SEQ ID NO: 691865 - DNA, 22 bp, Artificial Sequence
  chemically synthesized
ccgtcaaaaatgtaaagtagga

SEQ ID NO: 691866 - DNA, 22 bp, Artificial Sequence
  chemically synthesized
aatacgaagatactctaacttc

SEQ ID NO: 691867 - DNA, 22 bp, Artificial Sequence
  chemically synthesized
aacctaaatacgaagatactct

SEQ ID NO: 691868 - DNA, 22 bp, Artificial Sequence
  chemically synthesized
aaacctaaatacgaagatactc

SEQ ID NO: 691869 - DNA, 22 bp, Artificial Sequence
  chemically synthesized
gagtatcttcgtatttaggttt

SEQ ID NO: 691870 - DNA, 22 bp, Artificial Sequence
  chemically synthesized
agcaatgcaagtttaaacctaa

SEQ ID NO: 691871 - DNA, 22 bp, Artificial Sequence
  chemically synthesized
gagcaatgcaagtttaaaccta

SEQ ID NO: 691872 - DNA, 22 bp, Artificial Sequence
  chemically synthesized
ttgagcaatgcaagtttaaacc

SEQ ID NO: 691873 - DNA, 22 bp, Artificial Sequence
  chemically synthesized
cttgagcaatgcaagtttaaac

SEQ ID NO: 691874 - DNA, 22 bp, Artificial Sequence
  chemically synthesized
tcttgagcaatgcaagtttaaa

SEQ ID NO: 691875 - DNA, 22 bp, Artificial Sequence
  chemically synthesized
ttcttgagcaatgcaagtttaa

SEQ ID NO: 691876 - DNA, 22 bp, Artificial Sequence
  chemically synthesized
cgtatttaggtttaaacttgca

SEQ ID NO: 691877 - DNA, 22 bp, Artificial Sequence
  chemically synthesized
gtatttaggtttaaacttgcat

SEQ ID NO: 691878 - DNA, 22 bp, Artificial Sequence
  chemically synthesized
ccttttcttgagcaatgcaagt

SEQ ID NO: 691879 - DNA, 22 bp, Artificial Sequence
  chemically synthesized
aggtttaaacttgcattgctca

SEQ ID NO: 691880 - DNA, 22 bp, Artificial Sequence
  chemically synthesized
ggtttaaacttgcattgctcaa

SEQ ID NO: 691881 - DNA, 22 bp, Artificial Sequence
  chemically synthesized
tatcctaccttttcttgagcaa

SEQ ID NO: 691882 - DNA, 22 bp, Artificial Sequence
  chemically synthesized
gtatcctaccttttcttgagca

SEQ ID NO: 691883 - DNA, 22 bp, Artificial Sequence
  chemically synthesized
tgtatcctaccttttcttgagc

SEQ ID NO: 691884 - DNA, 22 bp, Artificial Sequence
  chemically synthesized
aaacttgcattgctcaagaaaa

SEQ ID NO: 691885 - DNA, 22 bp, Artificial Sequence
  chemically synthesized
aacttgcattgctcaagaaaag

SEQ ID NO: 691886 - DNA, 22 bp, Artificial Sequence
  chemically synthesized
gcattgctcaagaaaaggtagg

SEQ ID NO: 691887 - DNA, 22 bp, Artificial Sequence
  chemically synthesized
cattgctcaagaaaaggtagga

SEQ ID NO: 691888 - DNA, 22 bp, Artificial Sequence
  chemically synthesized
tataactttgtatcctaccttt

SEQ ID NO: 691889 - DNA, 22 bp, Artificial Sequence
  chemically synthesized
atataactttgtatcctacctt

SEQ ID NO: 691890 - DNA, 22 bp, Artificial Sequence
  chemically synthesized
tttatataactttgtatcctac

SEQ ID NO: 691891 - DNA, 22 bp, Artificial Sequence
  chemically synthesized
ctcaagaaaaggtaggatacaa

SEQ ID NO: 691892 - DNA, 22 bp, Artificial Sequence
  chemically synthesized
aagaaaaggtaggatacaaagt

SEQ ID NO: 691893 - DNA, 22 bp, Artificial Sequence
  chemically synthesized
ataaaatacaaaagatattgtt

SEQ ID NO: 691894 - DNA, 22 bp, Artificial Sequence
  chemically synthesized
ctgataaaatacaaaagatatt

SEQ ID NO: 691895 - DNA, 22 bp, Artificial Sequence
  chemically synthesized
tataaacaatatcttttgtatt

SEQ ID NO: 691896 - DNA, 22 bp, Artificial Sequence
  chemically synthesized
aaatctgctgataaaatacaaa

SEQ ID NO: 691897 - DNA, 22 bp, Artificial Sequence
  chemically synthesized
aaaatctgctgataaaatacaa

SEQ ID NO: 691898 - DNA, 22 bp, Artificial Sequence
  chemically synthesized
taaaatctgctgataaaataca

SEQ ID NO: 691899 - DNA, 22 bp, Artificial Sequence
  chemically synthesized
ttaaaatctgctgataaaatac

SEQ ID NO: 691900 - DNA, 22 bp, Artificial Sequence
  chemically synthesized
tttaaaatctgctgataaaata

SEQ ID NO: 691901 - DNA, 22 bp, Artificial Sequence
  chemically synthesized
cagttttttaaaatctgctgat

SEQ ID NO: 691902 - DNA, 22 bp, Artificial Sequence
  chemically synthesized
ccagttttttaaaatctgctga

SEQ ID NO: 691903 - DNA, 22 bp, Artificial Sequence
  chemically synthesized
ttgtattttatcagcagatttt

SEQ ID NO: 691904 - DNA, 22 bp, Artificial Sequence
  chemically synthesized
ttccagttttttaaaatctgct

SEQ ID NO: 691905 - DNA, 22 bp, Artificial Sequence
  chemically synthesized
tgtattttatcagcagatttta

SEQ ID NO: 691906 - DNA, 22 bp, Artificial Sequence
  chemically synthesized
cttccagttttttaaaatctgc

SEQ ID NO: 691907 - DNA, 22 bp, Artificial Sequence
  chemically synthesized
gtattttatcagcagattttaa

SEQ ID NO: 691908 - DNA, 22 bp, Artificial Sequence
  chemically synthesized
tattttatcagcagattttaaa

SEQ ID NO: 691909 - DNA, 22 bp, Artificial Sequence
  chemically synthesized
tatcagcagattttaaaaaact

SEQ ID NO: 691910 - DNA, 22 bp, Artificial Sequence
  chemically synthesized
atcagcagattttaaaaaactg

SEQ ID NO: 691911 - DNA, 22 bp, Artificial Sequence
  chemically synthesized
tcagcagattttaaaaaactgg

SEQ ID NO: 691912 - DNA, 22 bp, Artificial Sequence
  chemically synthesized
gtaatgtcttcttccagttttt

SEQ ID NO: 691913 - DNA, 22 bp, Artificial Sequence
  chemically synthesized
taaaaaactggaagaagacatt

SEQ ID NO: 691914 - DNA, 22 bp, Artificial Sequence
  chemically synthesized
aaaaaactggaagaagacatta

SEQ ID NO: 691915 - DNA, 22 bp, Artificial Sequence
  chemically synthesized
aaaaactggaagaagacattac

SEQ ID NO: 691916 - DNA, 22 bp, Artificial Sequence
  chemically synthesized
caatgaacatgttggtaatgtc

SEQ ID NO: 691917 - DNA, 22 bp, Artificial Sequence
  chemically synthesized
gaagaagacattaccaacatgt

SEQ ID NO: 691918 - DNA, 22 bp, Artificial Sequence
  chemically synthesized
gacaactgcaatgaacatgttg

SEQ ID NO: 691919 - DNA, 22 bp, Artificial Sequence
  chemically synthesized
ccaacatgttcattgcagttgt

SEQ ID NO: 691920 - DNA, 22 bp, Artificial Sequence
  chemically synthesized
agtgcccatcaccacctagaca

SEQ ID NO: 691921 - DNA, 22 bp, Artificial Sequence
  chemically synthesized
aagtgcccatcaccacctagac

SEQ ID NO: 691922 - DNA, 22 bp, Artificial Sequence
  chemically synthesized
attgcagttgtctaggtggtga

SEQ ID NO: 691923 - DNA, 22 bp, Artificial Sequence
  chemically synthesized
cagttgtctaggtggtgatggg

SEQ ID NO: 691924 - DNA, 22 bp, Artificial Sequence
  chemically synthesized
aaaatatttaagtgcccatcac

SEQ ID NO: 691925 - DNA, 22 bp, Artificial Sequence
  chemically synthesized
tctaggtggtgatgggcactta

SEQ ID NO: 691926 - DNA, 22 bp, Artificial Sequence
  chemically synthesized
ggtggtgatgggcacttaaata

SEQ ID NO: 691927 - DNA, 22 bp, Artificial Sequence
  chemically synthesized
tggaaaacatagaaaaagatta

SEQ ID NO: 691928 - DNA, 22 bp, Artificial Sequence
  chemically synthesized
aaatatttttaatctttttcta

SEQ ID NO: 691929 - DNA, 22 bp, Artificial Sequence
  chemically synthesized
aatatttttaatctttttctat

SEQ ID NO: 691930 - DNA, 22 bp, Artificial Sequence
  chemically synthesized
actgtggaaaacatagaaaaag

SEQ ID NO: 691931 - DNA, 22 bp, Artificial Sequence
  chemically synthesized
ttaatctttttctatgttttcc

SEQ ID NO: 691932 - DNA, 22 bp, Artificial Sequence
  chemically synthesized
taatctttttctatgttttcca

SEQ ID NO: 691933 - DNA, 22 bp, Artificial Sequence
  chemically synthesized
aatctttttctatgttttccac

SEQ ID NO: 691934 - DNA, 22 bp, Artificial Sequence
  chemically synthesized
atctttttctatgttttccaca

SEQ ID NO: 691935 - DNA, 22 bp, Artificial Sequence
  chemically synthesized
tttctatgttttccacagtgaa

SEQ ID NO: 691936 - DNA, 22 bp, Artificial Sequence
  chemically synthesized
ttctatgttttccacagtgaac

SEQ ID NO: 691937 - DNA, 22 bp, Artificial Sequence
  chemically synthesized
tctatgttttccacagtgaaca

SEQ ID NO: 691938 - DNA, 22 bp, Artificial Sequence
  chemically synthesized
ctatgttttccacagtgaacat

SEQ ID NO: 691939 - DNA, 22 bp, Artificial Sequence
  chemically synthesized
tatgttttccacagtgaacatt

SEQ ID NO: 691940 - DNA, 22 bp, Artificial Sequence
  chemically synthesized
tgttttccacagtgaacattta

SEQ ID NO: 691941 - DNA, 22 bp, Artificial Sequence
  chemically synthesized
tccacagtgaacatttattatt

SEQ ID NO: 691942 - DNA, 22 bp, Artificial Sequence
  chemically synthesized
ccacagtgaacatttattattt

SEQ ID NO: 691943 - DNA, 22 bp, Artificial Sequence
  chemically synthesized
cacagtgaacatttattatttt

SEQ ID NO: 691944 - DNA, 22 bp, Artificial Sequence
  chemically synthesized
cgtgtcataacaaaaataataa

SEQ ID NO: 691945 - DNA, 22 bp, Artificial Sequence
  chemically synthesized
ccgtgtcataacaaaaataata

SEQ ID NO: 691946 - DNA, 22 bp, Artificial Sequence
  chemically synthesized
tccgtgtcataacaaaaataat

SEQ ID NO: 691947 - DNA, 22 bp, Artificial Sequence
  chemically synthesized
taagttttccgtgtcataacaa

SEQ ID NO: 691948 - DNA, 22 bp, Artificial Sequence
  chemically synthesized
gtaagttttccgtgtcataaca

SEQ ID NO: 691949 - DNA, 22 bp, Artificial Sequence
  chemically synthesized
attatttttgttatgacacgga

SEQ ID NO: 691950 - DNA, 22 bp, Artificial Sequence
  chemically synthesized
ttatttttgttatgacacggaa

SEQ ID NO: 691951 - DNA, 22 bp, Artificial Sequence
  chemically synthesized
atatttgtaagttttccgtgtc

SEQ ID NO: 691952 - DNA, 22 bp, Artificial Sequence
  chemically synthesized
tttttgttatgacacggaaaac

SEQ ID NO: 691953 - DNA, 22 bp, Artificial Sequence
  chemically synthesized
ttgttatgacacggaaaactta

SEQ ID NO: 691954 - DNA, 22 bp, Artificial Sequence
  chemically synthesized
tgttatgacacggaaaacttac

SEQ ID NO: 691955 - DNA, 22 bp, Artificial Sequence
  chemically synthesized
gttatgacacggaaaacttaca

SEQ ID NO: 691956 - DNA, 22 bp, Artificial Sequence
  chemically synthesized
gaaattaatatttgtaagtttt

SEQ ID NO: 691957 - DNA, 22 bp, Artificial Sequence
  chemically synthesized
ttatgacacggaaaacttacaa

SEQ ID NO: 691958 - DNA, 22 bp, Artificial Sequence
  chemically synthesized
agaaattaatatttgtaagttt

SEQ ID NO: 691959 - DNA, 22 bp, Artificial Sequence
  chemically synthesized
tagaaattaatatttgtaagtt

SEQ ID NO: 691960 - DNA, 22 bp, Artificial Sequence
  chemically synthesized
tgacacggaaaacttacaaata

SEQ ID NO: 691961 - DNA, 22 bp, Artificial Sequence
  chemically synthesized
agcaatacattttagaaattaa

SEQ ID NO: 691962 - DNA, 22 bp, Artificial Sequence
  chemically synthesized
acaaatattaatttctaaaatg

SEQ ID NO: 691963 - DNA, 22 bp, Artificial Sequence
  chemically synthesized
caaatattaatttctaaaatgt

SEQ ID NO: 691964 - DNA, 22 bp, Artificial Sequence
  chemically synthesized
gaagtctgagcaatacatttta

SEQ ID NO: 691965 - DNA, 22 bp, Artificial Sequence
  chemically synthesized
aaactggaagtctgagcaatac

SEQ ID NO: 691966 - DNA, 22 bp, Artificial Sequence
  chemically synthesized
atttctaaaatgtattgctcag

SEQ ID NO: 691967 - DNA, 22 bp, Artificial Sequence
  chemically synthesized
ctaaaatgtattgctcagactt

SEQ ID NO: 691968 - DNA, 22 bp, Artificial Sequence
  chemically synthesized
taaaatgtattgctcagacttc

SEQ ID NO: 691969 - DNA, 22 bp, Artificial Sequence
  chemically synthesized
caagttgaaactggaagtctga

SEQ ID NO: 691970 - DNA, 22 bp, Artificial Sequence
  chemically synthesized
aaatgtattgctcagacttcca

SEQ ID NO: 691971 - DNA, 22 bp, Artificial Sequence
  chemically synthesized
catctccaagttgaaactggaa

SEQ ID NO: 691972 - DNA, 22 bp, Artificial Sequence
  chemically synthesized
ctcagacttccagtttcaactt

SEQ ID NO: 691973 - DNA, 22 bp, Artificial Sequence
  chemically synthesized
catctccatctccaagttgaaa

SEQ ID NO: 691974 - DNA, 22 bp, Artificial Sequence
  chemically synthesized
agacttccagtttcaacttgga

SEQ ID NO: 691975 - DNA, 22 bp, Artificial Sequence
  chemically synthesized
tccatctccatctccaagttga

SEQ ID NO: 691976 - DNA, 22 bp, Artificial Sequence
  chemically synthesized
ccagtttcaacttggagatgga

SEQ ID NO: 691977 - DNA, 22 bp, Artificial Sequence
  chemically synthesized
cagctctccatctccatctcca

SEQ ID NO: 691978 - DNA, 22 bp, Artificial Sequence
  chemically synthesized
cagtttcaacttggagatggag

SEQ ID NO: 691979 - DNA, 22 bp, Artificial Sequence
  chemically synthesized
gcagctctccatctccatctcc

SEQ ID NO: 691980 - DNA, 22 bp, Artificial Sequence
  chemically synthesized
tgcagctctccatctccatctc

SEQ ID NO: 691981 - DNA, 22 bp, Artificial Sequence
  chemically synthesized
tttgcagctctccatctccatc

SEQ ID NO: 691982 - DNA, 22 bp, Artificial Sequence
  chemically synthesized
caacttggagatggagatggag

SEQ ID NO: 691983 - DNA, 22 bp, Artificial Sequence
  chemically synthesized
aacttggagatggagatggaga

SEQ ID NO: 691984 - DNA, 22 bp, Artificial Sequence
  chemically synthesized
ggagatggagatggagagctgc

SEQ ID NO: 691985 - DNA, 22 bp, Artificial Sequence
  chemically synthesized
gagatggagatggagagctgca

SEQ ID NO: 691986 - DNA, 22 bp, Artificial Sequence
  chemically synthesized
caagtatgggagcaacctcttt

SEQ ID NO: 691987 - DNA, 22 bp, Artificial Sequence
  chemically synthesized
ctacaagtatgggagcaacctc

SEQ ID NO: 691988 - DNA, 22 bp, Artificial Sequence
  chemically synthesized
gctacaagtatgggagcaacct

SEQ ID NO: 691989 - DNA, 22 bp, Artificial Sequence
  chemically synthesized
ttgctacaagtatgggagcaac

SEQ ID NO: 691990 - DNA, 22 bp, Artificial Sequence
  chemically synthesized
cttgctacaagtatgggagcaa

SEQ ID NO: 691991 - DNA, 22 bp, Artificial Sequence
  chemically synthesized
tcttgctacaagtatgggagca

SEQ ID NO: 691992 - DNA, 22 bp, Artificial Sequence
  chemically synthesized
caaagaggttgctcccatactt

SEQ ID NO: 691993 - DNA, 22 bp, Artificial Sequence
  chemically synthesized
tccagcagttttcttgctacaa

SEQ ID NO: 691994 - DNA, 22 bp, Artificial Sequence
  chemically synthesized
ctcccatacttgtagcaagaaa

SEQ ID NO: 691995 - DNA, 22 bp, Artificial Sequence
  chemically synthesized
tctgtccagcagttttcttgct

SEQ ID NO: 691996 - DNA, 22 bp, Artificial Sequence
  chemically synthesized
atctgtccagcagttttcttgc

SEQ ID NO: 691997 - DNA, 22 bp, Artificial Sequence
  chemically synthesized
ccatacttgtagcaagaaaact

SEQ ID NO: 691998 - DNA, 22 bp, Artificial Sequence
  chemically synthesized
atttatctgtccagcagttttc

SEQ ID NO: 691999 - DNA, 22 bp, Artificial Sequence
  chemically synthesized
gtagcaagaaaactgctggaca

SEQ ID NO: 692000 - DNA, 22 bp, Artificial Sequence
  chemically synthesized
tagcaagaaaactgctggacag

SEQ ID NO: 692001 - DNA, 22 bp, Artificial Sequence
  chemically synthesized
atgaaaagtcattaatttatct

SEQ ID NO: 692002 - DNA, 22 bp, Artificial Sequence
  chemically synthesized
ctggacagataaattaatgact

SEQ ID NO: 692003 - DNA, 22 bp, Artificial Sequence
  chemically synthesized
atggactgatgaaaagtcatta

SEQ ID NO: 692004 - DNA, 22 bp, Artificial Sequence
  chemically synthesized
gacagataaattaatgactttt

SEQ ID NO: 692005 - DNA, 22 bp, Artificial Sequence
  chemically synthesized
tgatggactgatgaaaagtcat

SEQ ID NO: 692006 - DNA, 22 bp, Artificial Sequence
  chemically synthesized
tctgatggactgatgaaaagtc

SEQ ID NO: 692007 - DNA, 22 bp, Artificial Sequence
  chemically synthesized
ctctgatggactgatgaaaagt

SEQ ID NO: 692008 - DNA, 22 bp, Artificial Sequence
  chemically synthesized
atgacttttcatcagtccatca

SEQ ID NO: 692009 - DNA, 22 bp, Artificial Sequence
  chemically synthesized
taatgtcatttctctgatggac

SEQ ID NO: 692010 - DNA, 22 bp, Artificial Sequence
  chemically synthesized
tataatgtcatttctctgatgg

SEQ ID NO: 692011 - DNA, 22 bp, Artificial Sequence
  chemically synthesized
ttcatcagtccatcagagaaat

SEQ ID NO: 692012 - DNA, 22 bp, Artificial Sequence
  chemically synthesized
ttctataatgtcatttctctga

SEQ ID NO: 692013 - DNA, 22 bp, Artificial Sequence
  chemically synthesized
tcatcagtccatcagagaaatg

SEQ ID NO: 692014 - DNA, 22 bp, Artificial Sequence
  chemically synthesized
catcagtccatcagagaaatga

SEQ ID NO: 692015 - DNA, 22 bp, Artificial Sequence
  chemically synthesized
atcagtccatcagagaaatgac

SEQ ID NO: 692016 - DNA, 22 bp, Artificial Sequence
  chemically synthesized
aggttgttctataatgtcattt

SEQ ID NO: 692017 - DNA, 22 bp, Artificial Sequence
  chemically synthesized
caggttgttctataatgtcatt

SEQ ID NO: 692018 - DNA, 22 bp, Artificial Sequence
  chemically synthesized
cagatttcaggttgttctataa

SEQ ID NO: 692019 - DNA, 22 bp, Artificial Sequence
  chemically synthesized
tccagatttcaggttgttctat

SEQ ID NO: 692020 - DNA, 22 bp, Artificial Sequence
  chemically synthesized
tctccagatttcaggttgttct

SEQ ID NO: 692021 - DNA, 22 bp, Artificial Sequence
  chemically synthesized
tagaacaacctgaaatctggag

SEQ ID NO: 692022 - DNA, 22 bp, Artificial Sequence
  chemically synthesized
aaggccaatctctctccagatt

SEQ ID NO: 692023 - DNA, 22 bp, Artificial Sequence
  chemically synthesized
gctaaaggccaatctctctcca

SEQ ID NO: 692024 - DNA, 22 bp, Artificial Sequence
  chemically synthesized
tggctaaaggccaatctctctc

SEQ ID NO: 692025 - DNA, 22 bp, Artificial Sequence
  chemically synthesized
ctggctaaaggccaatctctct

SEQ ID NO: 692026 - DNA, 22 bp, Artificial Sequence
  chemically synthesized
cttctggctaaaggccaatctc

SEQ ID NO: 692027 - DNA, 22 bp, Artificial Sequence
  chemically synthesized
aaatctggagagagattggcct

SEQ ID NO: 692028 - DNA, 22 bp, Artificial Sequence
  chemically synthesized
gagagagattggcctttagcca

SEQ ID NO: 692029 - DNA, 22 bp, Artificial Sequence
  chemically synthesized
aggcactgcttctggctaaagg

SEQ ID NO: 692030 - DNA, 22 bp, Artificial Sequence
  chemically synthesized
gcctttagccagaagcagtgcc

SEQ ID NO: 692031 - DNA, 22 bp, Artificial Sequence
  chemically synthesized
tagccagaagcagtgcctgagc

SEQ ID NO: 692032 - DNA, 22 bp, Artificial Sequence
  chemically synthesized
agccagaagcagtgcctgagca

SEQ ID NO: 692033 - DNA, 22 bp, Artificial Sequence
  chemically synthesized
cagggatccaaatgctcaggca

SEQ ID NO: 692034 - DNA, 22 bp, Artificial Sequence
  chemically synthesized
gccagaagcagtgcctgagcat

SEQ ID NO: 692035 - DNA, 22 bp, Artificial Sequence
  chemically synthesized
ctccagggatccaaatgctcag

SEQ ID NO: 692036 - DNA, 22 bp, Artificial Sequence
  chemically synthesized
tatggcatctgctccagggatc

SEQ ID NO: 692037 - DNA, 22 bp, Artificial Sequence
  chemically synthesized
atatggcatctgctccagggat

SEQ ID NO: 692038 - DNA, 22 bp, Artificial Sequence
  chemically synthesized
agcatttggatccctggagcag

SEQ ID NO: 692039 - DNA, 22 bp, Artificial Sequence
  chemically synthesized
gtttatatggcatctgctccag

SEQ ID NO: 692040 - DNA, 22 bp, Artificial Sequence
  chemically synthesized
ctagtttatatggcatctgctc

SEQ ID NO: 692041 - DNA, 22 bp, Artificial Sequence
  chemically synthesized
ggatccctggagcagatgccat

SEQ ID NO: 692042 - DNA, 22 bp, Artificial Sequence
  chemically synthesized
gatccctggagcagatgccata

SEQ ID NO: 692043 - DNA, 22 bp, Artificial Sequence
  chemically synthesized
cctactagtttatatggcatct

SEQ ID NO: 692044 - DNA, 22 bp, Artificial Sequence
  chemically synthesized
atctccctactagtttatatgg

SEQ ID NO: 692045 - DNA, 22 bp, Artificial Sequence
  chemically synthesized
aatctccctactagtttatatg

SEQ ID NO: 692046 - DNA, 22 bp, Artificial Sequence
  chemically synthesized
gagcagatgccatataaactag

SEQ ID NO: 692047 - DNA, 22 bp, Artificial Sequence
  chemically synthesized
ccacatgtcccccaacaattta

SEQ ID NO: 692048 - DNA, 22 bp, Artificial Sequence
  chemically synthesized
gtagggagattaaattgttggg

SEQ ID NO: 692049 - DNA, 22 bp, Artificial Sequence
  chemically synthesized
gctcccacatgtcccccaacaa

SEQ ID NO: 692050 - DNA, 22 bp, Artificial Sequence
  chemically synthesized
aggctagctcccacatgtcccc

SEQ ID NO: 692051 - DNA, 22 bp, Artificial Sequence
  chemically synthesized
tcaggctagctcccacatgtcc

SEQ ID NO: 692052 - DNA, 22 bp, Artificial Sequence
  chemically synthesized
aattgttgggggacatgtggga

SEQ ID NO: 692053 - DNA, 22 bp, Artificial Sequence
  chemically synthesized
acactctcaggctagctcccac

SEQ ID NO: 692054 - DNA, 22 bp, Artificial Sequence
  chemically synthesized
ttgggggacatgtgggagctag

SEQ ID NO: 692055 - DNA, 22 bp, Artificial Sequence
  chemically synthesized
cacactctcaggctagctccca

SEQ ID NO: 692056 - DNA, 22 bp, Artificial Sequence
  chemically synthesized
ggggacatgtgggagctagcct

SEQ ID NO: 692057 - DNA, 22 bp, Artificial Sequence
  chemically synthesized
gcctgagagtgtgaagatcctg

SEQ ID NO: 692058 - DNA, 22 bp, Artificial Sequence
  chemically synthesized
tggcagtagcccccaggatctt

SEQ ID NO: 692059 - DNA, 22 bp, Artificial Sequence
  chemically synthesized
agagtgtgaagatcctgggggc

SEQ ID NO: 692060 - DNA, 22 bp, Artificial Sequence
  chemically synthesized
cacctatggcagtagcccccag

SEQ ID NO: 692061 - DNA, 22 bp, Artificial Sequence
  chemically synthesized
ggactccacctatggcagtagc

SEQ ID NO: 692062 - DNA, 22 bp, Artificial Sequence
  chemically synthesized
ggggctactgccataggtggag

SEQ ID NO: 692063 - DNA, 22 bp, Artificial Sequence
  chemically synthesized
caaaaggttgggactccaccta

SEQ ID NO: 692064 - DNA, 22 bp, Artificial Sequence
  chemically synthesized
gcaaaaggttgggactccacct

SEQ ID NO: 692065 - DNA, 22 bp, Artificial Sequence
  chemically synthesized
ctgccataggtggagtcccaac

SEQ ID NO: 692066 - DNA, 22 bp, Artificial Sequence
  chemically synthesized
ccataggtggagtcccaacctt

SEQ ID NO: 692067 - DNA, 22 bp, Artificial Sequence
  chemically synthesized
aaggaagaagcttgcaaaaggt

SEQ ID NO: 692068 - DNA, 22 bp, Artificial Sequence
  chemically synthesized
ctgaaggaagaagcttgcaaaa

SEQ ID NO: 692069 - DNA, 22 bp, Artificial Sequence
  chemically synthesized
ttgcaagcttcttccttcagga

SEQ ID NO: 692070 - DNA, 22 bp, Artificial Sequence
  chemically synthesized
tgcaagcttcttccttcaggaa

SEQ ID NO: 692071 - DNA, 22 bp, Artificial Sequence
  chemically synthesized
gcaagcttcttccttcaggaac

SEQ ID NO: 692072 - DNA, 22 bp, Artificial Sequence
  chemically synthesized
caagcttcttccttcaggaact

SEQ ID NO: 692073 - DNA, 22 bp, Artificial Sequence
  chemically synthesized
tgaaggcaaggtacagttcctg

SEQ ID NO: 692074 - DNA, 22 bp, Artificial Sequence
  chemically synthesized
gtgaaggcaaggtacagttcct

SEQ ID NO: 692075 - DNA, 22 bp, Artificial Sequence
  chemically synthesized
cttgtgaaggcaaggtacagtt

SEQ ID NO: 692076 - DNA, 22 bp, Artificial Sequence
  chemically synthesized
cttccttcaggaactgtacctt

SEQ ID NO: 692077 - DNA, 22 bp, Artificial Sequence
  chemically synthesized
ttccttcaggaactgtaccttg

SEQ ID NO: 692078 - DNA, 22 bp, Artificial Sequence
  chemically synthesized
ccttcaggaactgtaccttgcc

SEQ ID NO: 692079 - DNA, 22 bp, Artificial Sequence
  chemically synthesized
cttcaggaactgtaccttgcct

SEQ ID NO: 692080 - DNA, 22 bp, Artificial Sequence
  chemically synthesized
caggaactgtaccttgccttca

SEQ ID NO: 692081 - DNA, 22 bp, Artificial Sequence
  chemically synthesized
gcatcctccttgtgaaggcaag

SEQ ID NO: 692082 - DNA, 22 bp, Artificial Sequence
  chemically synthesized
aggaactgtaccttgccttcac

SEQ ID NO: 692083 - DNA, 22 bp, Artificial Sequence
  chemically synthesized
cgcatcctccttgtgaaggcaa

SEQ ID NO: 692084 - DNA, 22 bp, Artificial Sequence
  chemically synthesized
ttcgcatcctccttgtgaaggc

SEQ ID NO: 692085 - DNA, 22 bp, Artificial Sequence
  chemically synthesized
taccttgccttcacaaggagga

SEQ ID NO: 692086 - DNA, 22 bp, Artificial Sequence
  chemically synthesized
cagattcttcgcatcctccttg

SEQ ID NO: 692087 - DNA, 22 bp, Artificial Sequence
  chemically synthesized
tccagattcttcgcatcctcct

SEQ ID NO: 692088 - DNA, 22 bp, Artificial Sequence
  chemically synthesized
ctccagattcttcgcatcctcc

SEQ ID NO: 692089 - DNA, 22 bp, Artificial Sequence
  chemically synthesized
tctccagattcttcgcatcctc

SEQ ID NO: 692090 - DNA, 22 bp, Artificial Sequence
  chemically synthesized
gccttcacaaggaggatgcgaa

SEQ ID NO: 692091 - DNA, 22 bp, Artificial Sequence
  chemically synthesized
ccttcacaaggaggatgcgaag

SEQ ID NO: 692092 - DNA, 22 bp, Artificial Sequence
  chemically synthesized
cacaaggaggatgcgaagaatc

SEQ ID NO: 692093 - DNA, 22 bp, Artificial Sequence
  chemically synthesized
acaaggaggatgcgaagaatct

SEQ ID NO: 692094 - DNA, 22 bp, Artificial Sequence
  chemically synthesized
gggaggctttctccagattctt

SEQ ID NO: 692095 - DNA, 22 bp, Artificial Sequence
  chemically synthesized
gagaaagcctccccaacaccct

SEQ ID NO: 692096 - DNA, 22 bp, Artificial Sequence
  chemically synthesized
cccaatcagcaacacagagggt

SEQ ID NO: 692097 - DNA, 22 bp, Artificial Sequence
  chemically synthesized
ccccaatcagcaacacagaggg

SEQ ID NO: 692098 - DNA, 22 bp, Artificial Sequence
  chemically synthesized
cccaacaccctctgtgttgctg

SEQ ID NO: 692099 - DNA, 22 bp, Artificial Sequence
  chemically synthesized
tgacccttccccaatcagcaac

SEQ ID NO: 692100 - DNA, 22 bp, Artificial Sequence
  chemically synthesized
ctgtgacccttccccaatcagc

SEQ ID NO: 692101 - DNA, 22 bp, Artificial Sequence
  chemically synthesized
gctactgtgacccttccccaat

SEQ ID NO: 692102 - DNA, 22 bp, Artificial Sequence
  chemically synthesized
tgtgttgctgattggggaaggg

SEQ ID NO: 692103 - DNA, 22 bp, Artificial Sequence
  chemically synthesized
tgttgctgattggggaagggtc

SEQ ID NO: 692104 - DNA, 22 bp, Artificial Sequence
  chemically synthesized
ctgattggggaagggtcacagt

SEQ ID NO: 692105 - DNA, 22 bp, Artificial Sequence
  chemically synthesized
atggtgactagctactgtgacc

SEQ ID NO: 692106 - DNA, 22 bp, Artificial Sequence
  chemically synthesized
attggggaagggtcacagtagc

SEQ ID NO: 692107 - DNA, 22 bp, Artificial Sequence
  chemically synthesized
gggaagggtcacagtagctagt

SEQ ID NO: 692108 - DNA, 22 bp, Artificial Sequence
  chemically synthesized
aagagaagggtataagcagatt

SEQ ID NO: 692109 - DNA, 22 bp, Artificial Sequence
  chemically synthesized
tgaagagaagggtataagcaga

SEQ ID NO: 692110 - DNA, 22 bp, Artificial Sequence
  chemically synthesized
gtcaccatgaatctgcttatac

SEQ ID NO: 692111 - DNA, 22 bp, Artificial Sequence
  chemically synthesized
ctctgaagagaagggtataagc

SEQ ID NO: 692112 - DNA, 22 bp, Artificial Sequence
  chemically synthesized
cctctgaagagaagggtataag

SEQ ID NO: 692113 - DNA, 22 bp, Artificial Sequence
  chemically synthesized
tcctctgaagagaagggtataa

SEQ ID NO: 692114 - DNA, 22 bp, Artificial Sequence
  chemically synthesized
ttcctctgaagagaagggtata

SEQ ID NO: 692115 - DNA, 22 bp, Artificial Sequence
  chemically synthesized
cttatacccttctcttcagagg

SEQ ID NO: 692116 - DNA, 22 bp, Artificial Sequence
  chemically synthesized
atacccttctcttcagaggaaa

SEQ ID NO: 692117 - DNA, 22 bp, Artificial Sequence
  chemically synthesized
tacccttctcttcagaggaaaa

SEQ ID NO: 692118 - DNA, 22 bp, Artificial Sequence
  chemically synthesized
tagcaatgtgatgtcttttcct

SEQ ID NO: 692119 - DNA, 22 bp, Artificial Sequence
  chemically synthesized
atagcaatgtgatgtcttttcc

SEQ ID NO: 692120 - DNA, 22 bp, Artificial Sequence
  chemically synthesized
tatagcaatgtgatgtcttttc

SEQ ID NO: 692121 - DNA, 22 bp, Artificial Sequence
  chemically synthesized
ctcttcagaggaaaagacatca

SEQ ID NO: 692122 - DNA, 22 bp, Artificial Sequence
  chemically synthesized
tttatagcaatgtgatgtcttt

SEQ ID NO: 692123 - DNA, 22 bp, Artificial Sequence
  chemically synthesized
tcttcagaggaaaagacatcac

SEQ ID NO: 692124 - DNA, 22 bp, Artificial Sequence
  chemically synthesized
ttcagaggaaaagacatcacat

SEQ ID NO: 692125 - DNA, 22 bp, Artificial Sequence
  chemically synthesized
cagaggaaaagacatcacattg

SEQ ID NO: 692126 - DNA, 22 bp, Artificial Sequence
  chemically synthesized
agaggaaaagacatcacattgc

SEQ ID NO: 692127 - DNA, 22 bp, Artificial Sequence
  chemically synthesized
cccagtcacgggtagttcttta

SEQ ID NO: 692128 - DNA, 22 bp, Artificial Sequence
  chemically synthesized
taaactacccagtcacgggtag

SEQ ID NO: 692129 - DNA, 22 bp, Artificial Sequence
  chemically synthesized
ataaactacccagtcacgggta

SEQ ID NO: 692130 - DNA, 22 bp, Artificial Sequence
  chemically synthesized
ctataaagaactacccgtgact

SEQ ID NO: 692131 - DNA, 22 bp, Artificial Sequence
  chemically synthesized
tataaactacccagtcacgggt

SEQ ID NO: 692132 - DNA, 22 bp, Artificial Sequence
  chemically synthesized
taaagaactacccgtgactggg

SEQ ID NO: 692133 - DNA, 22 bp, Artificial Sequence
  chemically synthesized
ctttataaactacccagtcacg

SEQ ID NO: 692134 - DNA, 22 bp, Artificial Sequence
  chemically synthesized
gctttataaactacccagtcac

SEQ ID NO: 692135 - DNA, 22 bp, Artificial Sequence
  chemically synthesized
tgctttataaactacccagtca

SEQ ID NO: 692136 - DNA, 22 bp, Artificial Sequence
  chemically synthesized
tttgctttataaactacccagt

SEQ ID NO: 692137 - DNA, 22 bp, Artificial Sequence
  chemically synthesized
cccgtgactgggtagtttataa

SEQ ID NO: 692138 - DNA, 22 bp, Artificial Sequence
  chemically synthesized
aacctctttgctttataaacta

SEQ ID NO: 692139 - DNA, 22 bp, Artificial Sequence
  chemically synthesized
ggtagtttataaagcaaagagg

SEQ ID NO: 692140 - DNA, 22 bp, Artificial Sequence
  chemically synthesized
tgagtcaattaaacctctttgc

SEQ ID NO: 692141 - DNA, 22 bp, Artificial Sequence
  chemically synthesized
ataaagcaaagaggtttaattg

SEQ ID NO: 692142 - DNA, 22 bp, Artificial Sequence
  chemically synthesized
taaagcaaagaggtttaattga

SEQ ID NO: 692143 - DNA, 22 bp, Artificial Sequence
  chemically synthesized
cagaactgtgagtcaattaaac

SEQ ID NO: 692144 - DNA, 22 bp, Artificial Sequence
  chemically synthesized
tacagcctgcagaactgtgagt

SEQ ID NO: 692145 - DNA, 22 bp, Artificial Sequence
  chemically synthesized
ctatacagcctgcagaactgtg

SEQ ID NO: 692146 - DNA, 22 bp, Artificial Sequence
  chemically synthesized
aattgactcacagttctgcagg

SEQ ID NO: 692147 - DNA, 22 bp, Artificial Sequence
  chemically synthesized
attgactcacagttctgcaggc

SEQ ID NO: 692148 - DNA, 22 bp, Artificial Sequence
  chemically synthesized
actcacagttctgcaggctgta

SEQ ID NO: 692149 - DNA, 22 bp, Artificial Sequence
  chemically synthesized
acagttctgcaggctgtatagg

SEQ ID NO: 692150 - DNA, 22 bp, Artificial Sequence
  chemically synthesized
cccagccatgcctcctatacag

SEQ ID NO: 692151 - DNA, 22 bp, Artificial Sequence
  chemically synthesized
tgcaggctgtataggaggcatg

SEQ ID NO: 692152 - DNA, 22 bp, Artificial Sequence
  chemically synthesized
agggctccccagccatgcctcc

SEQ ID NO: 692153 - DNA, 22 bp, Artificial Sequence
  chemically synthesized
caggctgtataggaggcatggc

SEQ ID NO: 692154 - DNA, 22 bp, Artificial Sequence
  chemically synthesized
ctgagggctccccagccatgcc

SEQ ID NO: 692155 - DNA, 22 bp, Artificial Sequence
  chemically synthesized
cctgagggctccccagccatgc

SEQ ID NO: 692156 - DNA, 22 bp, Artificial Sequence
  chemically synthesized
tataggaggcatggctggggag

SEQ ID NO: 692157 - DNA, 22 bp, Artificial Sequence
  chemically synthesized
agcttcctgagggctccccagc

SEQ ID NO: 692158 - DNA, 22 bp, Artificial Sequence
  chemically synthesized
aagcttcctgagggctccccag

SEQ ID NO: 692159 - DNA, 22 bp, Artificial Sequence
  chemically synthesized
taagcttcctgagggctcccca

SEQ ID NO: 692160 - DNA, 22 bp, Artificial Sequence
  chemically synthesized
ccatgattttaagcttcctgag

SEQ ID NO: 692161 - DNA, 22 bp, Artificial Sequence
  chemically synthesized
tgccatgattttaagcttcctg

SEQ ID NO: 692162 - DNA, 22 bp, Artificial Sequence
  chemically synthesized
ctgccatgattttaagcttcct

SEQ ID NO: 692163 - DNA, 22 bp, Artificial Sequence
  chemically synthesized
gggagccctcaggaagcttaaa

SEQ ID NO: 692164 - DNA, 22 bp, Artificial Sequence
  chemically synthesized
ccttctgccatgattttaagct

SEQ ID NO: 692165 - DNA, 22 bp, Artificial Sequence
  chemically synthesized
gccttctgccatgattttaagc

SEQ ID NO: 692166 - DNA, 22 bp, Artificial Sequence
  chemically synthesized
tgccttctgccatgattttaag

SEQ ID NO: 692167 - DNA, 22 bp, Artificial Sequence
  chemically synthesized
ccctttgccttctgccatgatt

SEQ ID NO: 692168 - DNA, 22 bp, Artificial Sequence
  chemically synthesized
aggaagcttaaaatcatggcag

SEQ ID NO: 692169 - DNA, 22 bp, Artificial Sequence
  chemically synthesized
cccctttgccttctgccatgat

SEQ ID NO: 692170 - DNA, 22 bp, Artificial Sequence
  chemically synthesized
cttcccctttgccttctgccat

SEQ ID NO: 692171 - DNA, 22 bp, Artificial Sequence
  chemically synthesized
gcttcccctttgccttctgcca

SEQ ID NO: 692172 - DNA, 22 bp, Artificial Sequence
  chemically synthesized
aaaatcatggcagaaggcaaag

SEQ ID NO: 692173 - DNA, 22 bp, Artificial Sequence
  chemically synthesized
aaatcatggcagaaggcaaagg

SEQ ID NO: 692174 - DNA, 22 bp, Artificial Sequence
  chemically synthesized
tgtgaagatgtgcttgcttccc

SEQ ID NO: 692175 - DNA, 22 bp, Artificial Sequence
  chemically synthesized
ctgtgtgaagatgtgcttgctt

SEQ ID NO: 692176 - DNA, 22 bp, Artificial Sequence
  chemically synthesized
ctgctgtgtgaagatgtgcttg

SEQ ID NO: 692177 - DNA, 22 bp, Artificial Sequence
  chemically synthesized
tcctgctgctgtgtgaagatgt

SEQ ID NO: 692178 - DNA, 22 bp, Artificial Sequence
  chemically synthesized
tgtctatcctgctgctgtgtga

SEQ ID NO: 692179 - DNA, 22 bp, Artificial Sequence
  chemically synthesized
actgtgtctatcctgctgctgt

SEQ ID NO: 692180 - DNA, 22 bp, Artificial Sequence
  chemically synthesized
cactgtgtctatcctgctgctg

SEQ ID NO: 692181 - DNA, 22 bp, Artificial Sequence
  chemically synthesized
cccttcactgtgtctatcctgc

SEQ ID NO: 692182 - DNA, 22 bp, Artificial Sequence
  chemically synthesized
ccccttcactgtgtctatcctg

SEQ ID NO: 692183 - DNA, 22 bp, Artificial Sequence
  chemically synthesized
tccccttcactgtgtctatcct

SEQ ID NO: 692184 - DNA, 22 bp, Artificial Sequence
  chemically synthesized
cacacagcagcaggatagacac

SEQ ID NO: 692185 - DNA, 22 bp, Artificial Sequence
  chemically synthesized
acacagcagcaggatagacaca

SEQ ID NO: 692186 - DNA, 22 bp, Artificial Sequence
  chemically synthesized
agagtatgtaggactttcccct

SEQ ID NO: 692187 - DNA, 22 bp, Artificial Sequence
  chemically synthesized
gagagtatgtaggactttcccc

SEQ ID NO: 692188 - DNA, 22 bp, Artificial Sequence
  chemically synthesized
tttgagagtatgtaggactttc

SEQ ID NO: 692189 - DNA, 22 bp, Artificial Sequence
  chemically synthesized
gttatttgagagtatgtaggac

SEQ ID NO: 692190 - DNA, 22 bp, Artificial Sequence
  chemically synthesized
aagagatctagttatttgagag

SEQ ID NO: 692191 - DNA, 22 bp, Artificial Sequence
  chemically synthesized
tcaagagatctagttatttgag

SEQ ID NO: 692192 - DNA, 22 bp, Artificial Sequence
  chemically synthesized
catactctcaaataactagatc

SEQ ID NO: 692193 - DNA, 22 bp, Artificial Sequence
  chemically synthesized
tcaaataactagatctcttgag

SEQ ID NO: 692194 - DNA, 22 bp, Artificial Sequence
  chemically synthesized
aaataactagatctcttgagaa

SEQ ID NO: 692195 - DNA, 22 bp, Artificial Sequence
  chemically synthesized
tgatagtgagtgagttctcaag

SEQ ID NO: 692196 - DNA, 22 bp, Artificial Sequence
  chemically synthesized
gtgatagtgagtgagttctcaa

SEQ ID NO: 692197 - DNA, 22 bp, Artificial Sequence
  chemically synthesized
tacttgtgatagtgagtgagtt

SEQ ID NO: 692198 - DNA, 22 bp, Artificial Sequence
  chemically synthesized
gatctcttgagaactcactcac

SEQ ID NO: 692199 - DNA, 22 bp, Artificial Sequence
  chemically synthesized
ctgtacttgtgatagtgagtga

SEQ ID NO: 692200 - DNA, 22 bp, Artificial Sequence
  chemically synthesized
ttgagaactcactcactatcac

SEQ ID NO: 692201 - DNA, 22 bp, Artificial Sequence
  chemically synthesized
cgttgctgtacttgtgatagtg

SEQ ID NO: 692202 - DNA, 22 bp, Artificial Sequence
  chemically synthesized
gagaactcactcactatcacaa

SEQ ID NO: 692203 - DNA, 22 bp, Artificial Sequence
  chemically synthesized
agaactcactcactatcacaag

SEQ ID NO: 692204 - DNA, 22 bp, Artificial Sequence
  chemically synthesized
tccgttgctgtacttgtgatag

SEQ ID NO: 692205 - DNA, 22 bp, Artificial Sequence
  chemically synthesized
ctccgttgctgtacttgtgata

SEQ ID NO: 692206 - DNA, 22 bp, Artificial Sequence
  chemically synthesized
actcactatcacaagtacagca

SEQ ID NO: 692207 - DNA, 22 bp, Artificial Sequence
  chemically synthesized
actatcacaagtacagcaacgg

SEQ ID NO: 692208 - DNA, 22 bp, Artificial Sequence
  chemically synthesized
tcacaagtacagcaacggagaa

SEQ ID NO: 692209 - DNA, 22 bp, Artificial Sequence
  chemically synthesized
atgggaggtgaatgaatcatgg

SEQ ID NO: 692210 - DNA, 22 bp, Artificial Sequence
  chemically synthesized
cccccatgattcattcacctcc

SEQ ID NO: 692211 - DNA, 22 bp, Artificial Sequence
  chemically synthesized
gaggaggggcctgatgggaggt

SEQ ID NO: 692212 - DNA, 22 bp, Artificial Sequence
  chemically synthesized
attcacctcccatcaggcccct

SEQ ID NO: 692213 - DNA, 22 bp, Artificial Sequence
  chemically synthesized
acctcccatcaggcccctcctc

SEQ ID NO: 692214 - DNA, 22 bp, Artificial Sequence
  chemically synthesized
taatccccacatgttggaggag

SEQ ID NO: 692215 - DNA, 22 bp, Artificial Sequence
  chemically synthesized
ccatcaggcccctcctccaaca

SEQ ID NO: 692216 - DNA, 22 bp, Artificial Sequence
  chemically synthesized
ctccaacatgtggggattacaa

SEQ ID NO: 692217 - DNA, 22 bp, Artificial Sequence
  chemically synthesized
caacatgtggggattacaattt

SEQ ID NO: 692218 - DNA, 22 bp, Artificial Sequence
  chemically synthesized
cacccaaatgtcatgtcaaatt

SEQ ID NO: 692219 - DNA, 22 bp, Artificial Sequence
  chemically synthesized
tgtctccacccaaatgtcatgt

SEQ ID NO: 692220 - DNA, 22 bp, Artificial Sequence
  chemically synthesized
tgtgtctccacccaaatgtcat

SEQ ID NO: 692221 - DNA, 22 bp, Artificial Sequence
  chemically synthesized
caatttgacatgacatttgggt

SEQ ID NO: 692222 - DNA, 22 bp, Artificial Sequence
  chemically synthesized
gttctgtgtctccacccaaatg

SEQ ID NO: 692223 - DNA, 22 bp, Artificial Sequence
  chemically synthesized
ggttctgtgtctccacccaaat

SEQ ID NO: 692224 - DNA, 22 bp, Artificial Sequence
  chemically synthesized
gacatgacatttgggtggagac

SEQ ID NO: 692225 - DNA, 22 bp, Artificial Sequence
  chemically synthesized
acatgacatttgggtggagaca

SEQ ID NO: 692226 - DNA, 22 bp, Artificial Sequence
  chemically synthesized
atatggtttggttctgtgtctc

SEQ ID NO: 692227 - DNA, 22 bp, Artificial Sequence
  chemically synthesized
gggtggagacacagaaccaaac

SEQ ID NO: 692228 - DNA, 22 bp, Artificial Sequence
  chemically synthesized
ggtggagacacagaaccaaacc

SEQ ID NO: 692229 - DNA, 22 bp, Artificial Sequence
  chemically synthesized
agtgcctgatatggtttggttc

SEQ ID NO: 692230 - DNA, 22 bp, Artificial Sequence
  chemically synthesized
ctcagtgcctgatatggtttgg

SEQ ID NO: 692231 - DNA, 22 bp, Artificial Sequence
  chemically synthesized
cctcagtgcctgatatggtttg

SEQ ID NO: 692232 - DNA, 22 bp, Artificial Sequence
  chemically synthesized
aaatgcagtggtatttcctcag

SEQ ID NO: 692233 - DNA, 22 bp, Artificial Sequence
  chemically synthesized
ccctaaaatgcagtggtatttc

SEQ ID NO: 692234 - DNA, 22 bp, Artificial Sequence
  chemically synthesized
cccctaaaatgcagtggtattt

SEQ ID NO: 692235 - DNA, 22 bp, Artificial Sequence
  chemically synthesized
ccttcccctaaaatgcagtggt

SEQ ID NO: 692236 - DNA, 22 bp, Artificial Sequence
  chemically synthesized
aggaaataccactgcattttag

SEQ ID NO: 692237 - DNA, 22 bp, Artificial Sequence
  chemically synthesized
gtgttcccttcccctaaaatgc

SEQ ID NO: 692238 - DNA, 22 bp, Artificial Sequence
  chemically synthesized
cattttaggggaagggaacacc

SEQ ID NO: 692239 - DNA, 22 bp, Artificial Sequence
  chemically synthesized
taggggaagggaacaccagatc

SEQ ID NO: 692240 - DNA, 22 bp, Artificial Sequence
  chemically synthesized
aggggaagggaacaccagatct

SEQ ID NO: 692241 - DNA, 22 bp, Artificial Sequence
  chemically synthesized
ggggaagggaacaccagatctc

SEQ ID NO: 692242 - DNA, 22 bp, Artificial Sequence
  chemically synthesized
atctatgtgtggttttgttttg

SEQ ID NO: 692243 - DNA, 22 bp, Artificial Sequence
  chemically synthesized
tgtgtggttttgttttgttctt

SEQ ID NO: 692244 - DNA, 22 bp, Artificial Sequence
  chemically synthesized
tgttttgttctttttttgtttg

SEQ ID NO: 692245 - DNA, 22 bp, Artificial Sequence
  chemically synthesized
gttttgttctttttttgtttgt

SEQ ID NO: 692246 - DNA, 22 bp, Artificial Sequence
  chemically synthesized
ttttgttctttttttgtttgtt

SEQ ID NO: 692247 - DNA, 22 bp, Artificial Sequence
  chemically synthesized
tgttctttttttgtttgttttt

SEQ ID NO: 692248 - DNA, 22 bp, Artificial Sequence
  chemically synthesized
gttctttttttgtttgtttttt

SEQ ID NO: 692249 - DNA, 22 bp, Artificial Sequence
  chemically synthesized
ttctttttttgtttgttttttt

SEQ ID NO: 692250 - DNA, 22 bp, Artificial Sequence
  chemically synthesized
tttttttgtttgtttttttttg

SEQ ID NO: 692251 - DNA, 22 bp, Artificial Sequence
  chemically synthesized
tttttgtttgtttttttttgtt

SEQ ID NO: 692252 - DNA, 22 bp, Artificial Sequence
  chemically synthesized
ttttgtttgtttttttttgttt

SEQ ID NO: 692253 - DNA, 22 bp, Artificial Sequence
  chemically synthesized
tttgtttgtttttttttgtttg

SEQ ID NO: 692254 - DNA, 22 bp, Artificial Sequence
  chemically synthesized
ttgtttgtttttttttgtttgt

SEQ ID NO: 692255 - DNA, 22 bp, Artificial Sequence
  chemically synthesized
tgtttgtttttttttgtttgtt

SEQ ID NO: 692256 - DNA, 22 bp, Artificial Sequence
  chemically synthesized
gtttgtttttttttgtttgttt

SEQ ID NO: 692257 - DNA, 22 bp, Artificial Sequence
  chemically synthesized
tttgtttttttttgtttgtttg

SEQ ID NO: 692258 - DNA, 22 bp, Artificial Sequence
  chemically synthesized
gtttttttttgtttgtttgttg

SEQ ID NO: 692259 - DNA, 22 bp, Artificial Sequence
  chemically synthesized
tttttttttgtttgtttgttgt

SEQ ID NO: 692260 - DNA, 22 bp, Artificial Sequence
  chemically synthesized
aaaaacaacaacaacaacaaac

SEQ ID NO: 692261 - DNA, 22 bp, Artificial Sequence
  chemically synthesized
ttttttgtttgtttgttgttgt

SEQ ID NO: 692262 - DNA, 22 bp, Artificial Sequence
  chemically synthesized
tttttgtttgtttgttgttgtt

SEQ ID NO: 692263 - DNA, 22 bp, Artificial Sequence
  chemically synthesized
ttttgtttgtttgttgttgttg

SEQ ID NO: 692264 - DNA, 22 bp, Artificial Sequence
  chemically synthesized
tttgtttgtttgttgttgttgt

SEQ ID NO: 692265 - DNA, 22 bp, Artificial Sequence
  chemically synthesized
ttgtttgtttgttgttgttgtt

SEQ ID NO: 692266 - DNA, 22 bp, Artificial Sequence
  chemically synthesized
tgtttgtttgttgttgttgttg

SEQ ID NO: 692267 - DNA, 22 bp, Artificial Sequence
  chemically synthesized
gtttgtttgttgttgttgttgt

SEQ ID NO: 692268 - DNA, 22 bp, Artificial Sequence
  chemically synthesized
tttgtttgttgttgttgttgtt

SEQ ID NO: 692269 - DNA, 22 bp, Artificial Sequence
  chemically synthesized
cataaggctgaaaaacaacaac

SEQ ID NO: 692270 - DNA, 22 bp, Artificial Sequence
  chemically synthesized
gtttgttgttgttgttgttttt

SEQ ID NO: 692271 - DNA, 22 bp, Artificial Sequence
  chemically synthesized
tttgttgttgttgttgtttttc

SEQ ID NO: 692272 - DNA, 22 bp, Artificial Sequence
  chemically synthesized
ctgcataaggctgaaaaacaac

SEQ ID NO: 692273 - DNA, 22 bp, Artificial Sequence
  chemically synthesized
tcctgcataaggctgaaaaaca

SEQ ID NO: 692274 - DNA, 22 bp, Artificial Sequence
  chemically synthesized
gttgttgttgttgtttttcagc

SEQ ID NO: 692275 - DNA, 22 bp, Artificial Sequence
  chemically synthesized
ctcctgcataaggctgaaaaac

SEQ ID NO: 692276 - DNA, 22 bp, Artificial Sequence
  chemically synthesized
ttgttgttgttgtttttcagcc

SEQ ID NO: 692277 - DNA, 22 bp, Artificial Sequence
  chemically synthesized
tctcctgcataaggctgaaaaa

SEQ ID NO: 692278 - DNA, 22 bp, Artificial Sequence
  chemically synthesized
ttgttgttgtttttcagcctta

SEQ ID NO: 692279 - DNA, 22 bp, Artificial Sequence
  chemically synthesized
ttgttgtttttcagccttatgc

SEQ ID NO: 692280 - DNA, 22 bp, Artificial Sequence
  chemically synthesized
ttgtttttcagccttatgcagg

SEQ ID NO: 692281 - DNA, 22 bp, Artificial Sequence
  chemically synthesized
tttttcagccttatgcaggaga

SEQ ID NO: 692282 - DNA, 22 bp, Artificial Sequence
  chemically synthesized
ttcagccttatgcaggagaaag

SEQ ID NO: 692283 - DNA, 22 bp, Artificial Sequence
  chemically synthesized
tcagccttatgcaggagaaagg

SEQ ID NO: 692284 - DNA, 22 bp, Artificial Sequence
  chemically synthesized
tggccccaaggccctttctcct

SEQ ID NO: 692285 - DNA, 22 bp, Artificial Sequence
  chemically synthesized
cagccttatgcaggagaaaggg

SEQ ID NO: 692286 - DNA, 22 bp, Artificial Sequence
  chemically synthesized
agccttatgcaggagaaagggc

SEQ ID NO: 692287 - DNA, 22 bp, Artificial Sequence
  chemically synthesized
agtctatggccccaaggccctt

SEQ ID NO: 692288 - DNA, 22 bp, Artificial Sequence
  chemically synthesized
atgcaggagaaagggccttggg

SEQ ID NO: 692289 - DNA, 22 bp, Artificial Sequence
  chemically synthesized
tcagtctatggccccaaggccc

SEQ ID NO: 692290 - DNA, 22 bp, Artificial Sequence
  chemically synthesized
tgcaggagaaagggccttgggg

SEQ ID NO: 692291 - DNA, 22 bp, Artificial Sequence
  chemically synthesized
ggggccatagactgagaacact

SEQ ID NO: 692292 - DNA, 22 bp, Artificial Sequence
  chemically synthesized
gggccatagactgagaacactg

SEQ ID NO: 692293 - DNA, 22 bp, Artificial Sequence
  chemically synthesized
cagtggatatccaccagtgttc

SEQ ID NO: 692294 - DNA, 22 bp, Artificial Sequence
  chemically synthesized
gagctgcagtggatatccacca

SEQ ID NO: 692295 - DNA, 22 bp, Artificial Sequence
  chemically synthesized
ctggagctgcagtggatatcca

SEQ ID NO: 692296 - DNA, 22 bp, Artificial Sequence
  chemically synthesized
cctggagctgcagtggatatcc

SEQ ID NO: 692297 - DNA, 22 bp, Artificial Sequence
  chemically synthesized
agaacactggtggatatccact

SEQ ID NO: 692298 - DNA, 22 bp, Artificial Sequence
  chemically synthesized
ccttcctggagctgcagtggat

SEQ ID NO: 692299 - DNA, 22 bp, Artificial Sequence
  chemically synthesized
gtggatatccactgcagctcca

SEQ ID NO: 692300 - DNA, 22 bp, Artificial Sequence
  chemically synthesized
ccattcccttcctggagctgca

SEQ ID NO: 692301 - DNA, 22 bp, Artificial Sequence
  chemically synthesized
aacctcccattcccttcctgga

SEQ ID NO: 692302 - DNA, 22 bp, Artificial Sequence
  chemically synthesized
caacctcccattcccttcctgg

SEQ ID NO: 692303 - DNA, 22 bp, Artificial Sequence
  chemically synthesized
cagctccaggaagggaatggga

SEQ ID NO: 692304 - DNA, 22 bp, Artificial Sequence
  chemically synthesized
caggaagggaatgggaggttga

SEQ ID NO: 692305 - DNA, 22 bp, Artificial Sequence
  chemically synthesized
cagaggtagagtaacttcaacc

SEQ ID NO: 692306 - DNA, 22 bp, Artificial Sequence
  chemically synthesized
ctccagaggtagagtaacttca

SEQ ID NO: 692307 - DNA, 22 bp, Artificial Sequence
  chemically synthesized
cctccagaggtagagtaacttc

SEQ ID NO: 692308 - DNA, 22 bp, Artificial Sequence
  chemically synthesized
ccttcctccagaggtagagtaa

SEQ ID NO: 692309 - DNA, 22 bp, Artificial Sequence
  chemically synthesized
cccttcctccagaggtagagta

SEQ ID NO: 692310 - DNA, 22 bp, Artificial Sequence
  chemically synthesized
tcccttcctccagaggtagagt

SEQ ID NO: 692311 - DNA, 22 bp, Artificial Sequence
  chemically synthesized
tttcccttcctccagaggtaga

SEQ ID NO: 692312 - DNA, 22 bp, Artificial Sequence
  chemically synthesized
ctttcccttcctccagaggtag

SEQ ID NO: 692313 - DNA, 22 bp, Artificial Sequence
  chemically synthesized
tttctttcccttcctccagagg

SEQ ID NO: 692314 - DNA, 22 bp, Artificial Sequence
  chemically synthesized
aagttactctacctctggagga

SEQ ID NO: 692315 - DNA, 22 bp, Artificial Sequence
  chemically synthesized
caattatttctttcccttcctc

SEQ ID NO: 692316 - DNA, 22 bp, Artificial Sequence
  chemically synthesized
ctctacctctggaggaagggaa

SEQ ID NO: 692317 - DNA, 22 bp, Artificial Sequence
  chemically synthesized
acaattatttctttcccttcct

SEQ ID NO: 692318 - DNA, 22 bp, Artificial Sequence
  chemically synthesized
tacaattatttctttcccttcc

SEQ ID NO: 692319 - DNA, 22 bp, Artificial Sequence
  chemically synthesized
tacctctggaggaagggaaaga

SEQ ID NO: 692320 - DNA, 22 bp, Artificial Sequence
  chemically synthesized
cctctggaggaagggaaagaaa

SEQ ID NO: 692321 - DNA, 22 bp, Artificial Sequence
  chemically synthesized
tggaggaagggaaagaaataat

SEQ ID NO: 692322 - DNA, 22 bp, Artificial Sequence
  chemically synthesized
gaggaagggaaagaaataattg

SEQ ID NO: 692323 - DNA, 22 bp, Artificial Sequence
  chemically synthesized
gggatgtggtctttacaattat

SEQ ID NO: 692324 - DNA, 22 bp, Artificial Sequence
  chemically synthesized
ggggatgtggtctttacaatta

SEQ ID NO: 692325 - DNA, 22 bp, Artificial Sequence
  chemically synthesized
ggtcttggggatgtggtcttta

SEQ ID NO: 692326 - DNA, 22 bp, Artificial Sequence
  chemically synthesized
gcctgggtcttggggatgtggt

SEQ ID NO: 692327 - DNA, 22 bp, Artificial Sequence
  chemically synthesized
taaagaccacatccccaagacc

SEQ ID NO: 692328 - DNA, 22 bp, Artificial Sequence
  chemically synthesized
atacacagttggcctgggtctt

SEQ ID NO: 692329 - DNA, 22 bp, Artificial Sequence
  chemically synthesized
aattaatacacagttggcctgg

SEQ ID NO: 692330 - DNA, 22 bp, Artificial Sequence
  chemically synthesized
gaattaatacacagttggcctg

SEQ ID NO: 692331 - DNA, 22 bp, Artificial Sequence
  chemically synthesized
atgtttgaattaatacacagtt

SEQ ID NO: 692332 - DNA, 22 bp, Artificial Sequence
  chemically synthesized
taatgtttgaattaatacacag

SEQ ID NO: 692333 - DNA, 22 bp, Artificial Sequence
  chemically synthesized
tctaatgtttgaattaatacac

SEQ ID NO: 692334 - DNA, 22 bp, Artificial Sequence
  chemically synthesized
tgtattaattcaaacattagag

SEQ ID NO: 692335 - DNA, 22 bp, Artificial Sequence
  chemically synthesized
attcaaacattagagaatgcct

SEQ ID NO: 692336 - DNA, 22 bp, Artificial Sequence
  chemically synthesized
agtgtcgggcagaggcattctc

SEQ ID NO: 692337 - DNA, 22 bp, Artificial Sequence
  chemically synthesized
aaacattagagaatgcctctgc

SEQ ID NO: 692338 - DNA, 22 bp, Artificial Sequence
  chemically synthesized
gagaatgcctctgcccgacact

SEQ ID NO: 692339 - DNA, 22 bp, Artificial Sequence
  chemically synthesized
gtgtagtggttgagtgtcgggc

SEQ ID NO: 692340 - DNA, 22 bp, Artificial Sequence
  chemically synthesized
ttagtgtagtggttgagtgtcg

SEQ ID NO: 692341 - DNA, 22 bp, Artificial Sequence
  chemically synthesized
gttagtgtagtggttgagtgtc

SEQ ID NO: 692342 - DNA, 22 bp, Artificial Sequence
  chemically synthesized
tgcccgacactcaaccactaca

SEQ ID NO: 692343 - DNA, 22 bp, Artificial Sequence
  chemically synthesized
gaagcttgttagtgtagtggtt

SEQ ID NO: 692344 - DNA, 22 bp, Artificial Sequence
  chemically synthesized
cccgacactcaaccactacact

SEQ ID NO: 692345 - DNA, 22 bp, Artificial Sequence
  chemically synthesized
attggaagcttgttagtgtagt

SEQ ID NO: 692346 - DNA, 22 bp, Artificial Sequence
  chemically synthesized
ctcattggaagcttgttagtgt

SEQ ID NO: 692347 - DNA, 22 bp, Artificial Sequence
  chemically synthesized
cctcattggaagcttgttagtg

SEQ ID NO: 692348 - DNA, 22 bp, Artificial Sequence
  chemically synthesized
tttcctcattggaagcttgtta

SEQ ID NO: 692349 - DNA, 22 bp, Artificial Sequence
  chemically synthesized
aaccactacactaacaagcttc

SEQ ID NO: 692350 - DNA, 22 bp, Artificial Sequence
  chemically synthesized
gtttcctcattggaagcttgtt

SEQ ID NO: 692351 - DNA, 22 bp, Artificial Sequence
  chemically synthesized
tgtttcctcattggaagcttgt

SEQ ID NO: 692352 - DNA, 22 bp, Artificial Sequence
  chemically synthesized
cactaacaagcttccaatgagg

SEQ ID NO: 692353 - DNA, 22 bp, Artificial Sequence
  chemically synthesized
gtaactttgtttcctcattgga

SEQ ID NO: 692354 - DNA, 22 bp, Artificial Sequence
  chemically synthesized
tggtaactttgtttcctcattg

SEQ ID NO: 692355 - DNA, 22 bp, Artificial Sequence
  chemically synthesized
acaagcttccaatgaggaaaca

SEQ ID NO: 692356 - DNA, 22 bp, Artificial Sequence
  chemically synthesized
ctctggtaactttgtttcctca

SEQ ID NO: 692357 - DNA, 22 bp, Artificial Sequence
  chemically synthesized
aaattcctctggtaactttgtt

SEQ ID NO: 692358 - DNA, 22 bp, Artificial Sequence
  chemically synthesized
caaattcctctggtaactttgt

SEQ ID NO: 692359 - DNA, 22 bp, Artificial Sequence
  chemically synthesized
ccaatgaggaaacaaagttacc

SEQ ID NO: 692360 - DNA, 22 bp, Artificial Sequence
  chemically synthesized
caatgaggaaacaaagttacca

SEQ ID NO: 692361 - DNA, 22 bp, Artificial Sequence
  chemically synthesized
tggccaccagagacttcaaatt

SEQ ID NO: 692362 - DNA, 22 bp, Artificial Sequence
  chemically synthesized
ctgtggccaccagagacttcaa

SEQ ID NO: 692363 - DNA, 22 bp, Artificial Sequence
  chemically synthesized
ccagaggaatttgaagtctctg

SEQ ID NO: 692364 - DNA, 22 bp, Artificial Sequence
  chemically synthesized
ctgctgtggccaccagagactt

SEQ ID NO: 692365 - DNA, 22 bp, Artificial Sequence
  chemically synthesized
ttgctgctgtggccaccagaga

SEQ ID NO: 692366 - DNA, 22 bp, Artificial Sequence
  chemically synthesized
gttgctgctgtggccaccagag

SEQ ID NO: 692367 - DNA, 22 bp, Artificial Sequence
  chemically synthesized
tgttgctgctgtggccaccaga

SEQ ID NO: 692368 - DNA, 22 bp, Artificial Sequence
  chemically synthesized
agttttgttgctgctgtggcca

SEQ ID NO: 692369 - DNA, 22 bp, Artificial Sequence
  chemically synthesized
gaagtctctggtggccacagca

SEQ ID NO: 692370 - DNA, 22 bp, Artificial Sequence
  chemically synthesized
aagtctctggtggccacagcag

SEQ ID NO: 692371 - DNA, 22 bp, Artificial Sequence
  chemically synthesized
ttgagttttgttgctgctgtgg

SEQ ID NO: 692372 - DNA, 22 bp, Artificial Sequence
  chemically synthesized
tggtggccacagcagcaacaaa

SEQ ID NO: 692373 - DNA, 22 bp, Artificial Sequence
  chemically synthesized
tcattgttgagttttgttgctg

SEQ ID NO: 692374 - DNA, 22 bp, Artificial Sequence
  chemically synthesized
gtggccacagcagcaacaaaac

SEQ ID NO: 692375 - DNA, 22 bp, Artificial Sequence
  chemically synthesized
gttgtcattgttgagttttgtt

SEQ ID NO: 692376 - DNA, 22 bp, Artificial Sequence
  chemically synthesized
ggttgtcattgttgagttttgt

SEQ ID NO: 692377 - DNA, 22 bp, Artificial Sequence
  chemically synthesized
tggttgtcattgttgagttttg

SEQ ID NO: 692378 - DNA, 22 bp, Artificial Sequence
  chemically synthesized
ctttggttgtcattgttgagtt

SEQ ID NO: 692379 - DNA, 22 bp, Artificial Sequence
  chemically synthesized
gtagttgctttggttgtcattg

SEQ ID NO: 692380 - DNA, 22 bp, Artificial Sequence
  chemically synthesized
atgttggtagttgctttggttg

SEQ ID NO: 692381 - DNA, 22 bp, Artificial Sequence
  chemically synthesized
gatgttggtagttgctttggtt

SEQ ID NO: 692382 - DNA, 22 bp, Artificial Sequence
  chemically synthesized
aacaatgacaaccaaagcaact

SEQ ID NO: 692383 - DNA, 22 bp, Artificial Sequence
  chemically synthesized
tgtttgatgttggtagttgctt

SEQ ID NO: 692384 - DNA, 22 bp, Artificial Sequence
  chemically synthesized
ggctgtgtttgatgttggtagt

SEQ ID NO: 692385 - DNA, 22 bp, Artificial Sequence
  chemically synthesized
ggaattgggctgtgtttgatgt

SEQ ID NO: 692386 - DNA, 22 bp, Artificial Sequence
  chemically synthesized
actgggaattgggctgtgtttg

SEQ ID NO: 692387 - DNA, 22 bp, Artificial Sequence
  chemically synthesized
ccaacatcaaacacagcccaat

SEQ ID NO: 692388 - DNA, 22 bp, Artificial Sequence
  chemically synthesized
atctgactgggaattgggctgt

SEQ ID NO: 692389 - DNA, 22 bp, Artificial Sequence
  chemically synthesized
aatctgactgggaattgggctg

SEQ ID NO: 692390 - DNA, 22 bp, Artificial Sequence
  chemically synthesized
tcttaatctgactgggaattgg

SEQ ID NO: 692391 - DNA, 22 bp, Artificial Sequence
  chemically synthesized
atcttaatctgactgggaattg

SEQ ID NO: 692392 - DNA, 22 bp, Artificial Sequence
  chemically synthesized
acatggtaatttatcttaatct

SEQ ID NO: 692393 - DNA, 22 bp, Artificial Sequence
  chemically synthesized
gacatggtaatttatcttaatc

SEQ ID NO: 692394 - DNA, 22 bp, Artificial Sequence
  chemically synthesized
tgacatggtaatttatcttaat

SEQ ID NO: 692395 - DNA, 22 bp, Artificial Sequence
  chemically synthesized
ccagtcagattaagataaatta

SEQ ID NO: 692396 - DNA, 22 bp, Artificial Sequence
  chemically synthesized
aggtaaataaacctttgacatg

SEQ ID NO: 692397 - DNA, 22 bp, Artificial Sequence
  chemically synthesized
agataaattaccatgtcaaagg

SEQ ID NO: 692398 - DNA, 22 bp, Artificial Sequence
  chemically synthesized
ccatgtcaaaggtttatttacc

SEQ ID NO: 692399 - DNA, 22 bp, Artificial Sequence
  chemically synthesized
gatagcgtaatagatactgagg

SEQ ID NO: 692400 - DNA, 22 bp, Artificial Sequence
  chemically synthesized
agatagcgtaatagatactgag

SEQ ID NO: 692401 - DNA, 22 bp, Artificial Sequence
  chemically synthesized
atttacctcagtatctattacg

SEQ ID NO: 692402 - DNA, 22 bp, Artificial Sequence
  chemically synthesized
tttacctcagtatctattacgc

SEQ ID NO: 692403 - DNA, 22 bp, Artificial Sequence
  chemically synthesized
acctcagtatctattacgctat

SEQ ID NO: 692404 - DNA, 22 bp, Artificial Sequence
  chemically synthesized
cctcagtatctattacgctatc

SEQ ID NO: 692405 - DNA, 22 bp, Artificial Sequence
  chemically synthesized
agtatctattacgctatctaag

SEQ ID NO: 692406 - DNA, 22 bp, Artificial Sequence
  chemically synthesized
aggggtaaaagtcaggcatctt

SEQ ID NO: 692407 - DNA, 22 bp, Artificial Sequence
  chemically synthesized
ttacgctatctaagatgcctga

SEQ ID NO: 692408 - DNA, 22 bp, Artificial Sequence
  chemically synthesized
cgctatctaagatgcctgactt

SEQ ID NO: 692409 - DNA, 22 bp, Artificial Sequence
  chemically synthesized
tatctcaggggtaaaagtcagg

SEQ ID NO: 692410 - DNA, 22 bp, Artificial Sequence
  chemically synthesized
gtatctcaggggtaaaagtcag

SEQ ID NO: 692411 - DNA, 22 bp, Artificial Sequence
  chemically synthesized
tgtatctcaggggtaaaagtca

SEQ ID NO: 692412 - DNA, 22 bp, Artificial Sequence
  chemically synthesized
tctaagatgcctgacttttacc

SEQ ID NO: 692413 - DNA, 22 bp, Artificial Sequence
  chemically synthesized
agatgcctgacttttacccctg

SEQ ID NO: 692414 - DNA, 22 bp, Artificial Sequence
  chemically synthesized
ggcatgctttgtatctcagggg

SEQ ID NO: 692415 - DNA, 22 bp, Artificial Sequence
  chemically synthesized
aggcatgctttgtatctcaggg

SEQ ID NO: 692416 - DNA, 22 bp, Artificial Sequence
  chemically synthesized
cttaggcatgctttgtatctca

SEQ ID NO: 692417 - DNA, 22 bp, Artificial Sequence
  chemically synthesized
acttttacccctgagatacaaa

SEQ ID NO: 692418 - DNA, 22 bp, Artificial Sequence
  chemically synthesized
gcttaggcatgctttgtatctc

SEQ ID NO: 692419 - DNA, 22 bp, Artificial Sequence
  chemically synthesized
ttgcttaggcatgctttgtatc

SEQ ID NO: 692420 - DNA, 22 bp, Artificial Sequence
  chemically synthesized
cttgcttaggcatgctttgtat

SEQ ID NO: 692421 - DNA, 22 bp, Artificial Sequence
  chemically synthesized
ttacccctgagatacaaagcat

SEQ ID NO: 692422 - DNA, 22 bp, Artificial Sequence
  chemically synthesized
tcttgcttaggcatgctttgta

SEQ ID NO: 692423 - DNA, 22 bp, Artificial Sequence
  chemically synthesized
tacccctgagatacaaagcatg

SEQ ID NO: 692424 - DNA, 22 bp, Artificial Sequence
  chemically synthesized
ttcttgcttaggcatgctttgt

SEQ ID NO: 692425 - DNA, 22 bp, Artificial Sequence
  chemically synthesized
acccctgagatacaaagcatgc

SEQ ID NO: 692426 - DNA, 22 bp, Artificial Sequence
  chemically synthesized
cccctgagatacaaagcatgcc

SEQ ID NO: 692427 - DNA, 22 bp, Artificial Sequence
  chemically synthesized
tgatttttcttgcttaggcatg

SEQ ID NO: 692428 - DNA, 22 bp, Artificial Sequence
  chemically synthesized
agatacaaagcatgcctaagca

SEQ ID NO: 692429 - DNA, 22 bp, Artificial Sequence
  chemically synthesized
gactgtgatttttcttgcttag

SEQ ID NO: 692430 - DNA, 22 bp, Artificial Sequence
  chemically synthesized
agactgtgatttttcttgctta

SEQ ID NO: 692431 - DNA, 22 bp, Artificial Sequence
  chemically synthesized
cttagactgtgatttttcttgc

SEQ ID NO: 692432 - DNA, 22 bp, Artificial Sequence
  chemically synthesized
tctccttagactgtgatttttc

SEQ ID NO: 692433 - DNA, 22 bp, Artificial Sequence
  chemically synthesized
gtctccttagactgtgattttt

SEQ ID NO: 692434 - DNA, 22 bp, Artificial Sequence
  chemically synthesized
tgtctccttagactgtgatttt

SEQ ID NO: 692435 - DNA, 22 bp, Artificial Sequence
  chemically synthesized
ctttgtctccttagactgtgat

SEQ ID NO: 692436 - DNA, 22 bp, Artificial Sequence
  chemically synthesized
gctttgtctccttagactgtga

SEQ ID NO: 692437 - DNA, 22 bp, Artificial Sequence
  chemically synthesized
agcaagaaaaatcacagtctaa

SEQ ID NO: 692438 - DNA, 22 bp, Artificial Sequence
  chemically synthesized
ttgctttgtctccttagactgt

SEQ ID NO: 692439 - DNA, 22 bp, Artificial Sequence
  chemically synthesized
attcttgctttgtctccttaga

SEQ ID NO: 692440 - DNA, 22 bp, Artificial Sequence
  chemically synthesized
tgattcttgctttgtctcctta

SEQ ID NO: 692441 - DNA, 22 bp, Artificial Sequence
  chemically synthesized
gttctgattcttgctttgtctc

SEQ ID NO: 692442 - DNA, 22 bp, Artificial Sequence
  chemically synthesized
agtctggttctgattcttgctt

SEQ ID NO: 692443 - DNA, 22 bp, Artificial Sequence
  chemically synthesized
aggagacaaagcaagaatcaga

SEQ ID NO: 692444 - DNA, 22 bp, Artificial Sequence
  chemically synthesized
catatctaagtctggttctgat

SEQ ID NO: 692445 - DNA, 22 bp, Artificial Sequence
  chemically synthesized
ttacatatctaagtctggttct

SEQ ID NO: 692446 - DNA, 22 bp, Artificial Sequence
  chemically synthesized
caacaactgttacatatctaag

SEQ ID NO: 692447 - DNA, 22 bp, Artificial Sequence
  chemically synthesized
atagttccaacaactgttacat

SEQ ID NO: 692448 - DNA, 22 bp, Artificial Sequence
  chemically synthesized
tctgatagttccaacaactgtt

SEQ ID NO: 692449 - DNA, 22 bp, Artificial Sequence
  chemically synthesized
ctgtctgatagttccaacaact

SEQ ID NO: 692450 - DNA, 22 bp, Artificial Sequence
  chemically synthesized
agatatgtaacagttgttggaa

SEQ ID NO: 692451 - DNA, 22 bp, Artificial Sequence
  chemically synthesized
cctgtctgatagttccaacaac

SEQ ID NO: 692452 - DNA, 22 bp, Artificial Sequence
  chemically synthesized
gatatgtaacagttgttggaac

SEQ ID NO: 692453 - DNA, 22 bp, Artificial Sequence
  chemically synthesized
aatttcctgtctgatagttcca

SEQ ID NO: 692454 - DNA, 22 bp, Artificial Sequence
  chemically synthesized
aaatttcctgtctgatagttcc

SEQ ID NO: 692455 - DNA, 22 bp, Artificial Sequence
  chemically synthesized
taaatttcctgtctgatagttc

SEQ ID NO: 692456 - DNA, 22 bp, Artificial Sequence
  chemically synthesized
ttttaaatttcctgtctgatag

SEQ ID NO: 692457 - DNA, 22 bp, Artificial Sequence
  chemically synthesized
ttggaactatcagacaggaaat

SEQ ID NO: 692458 - DNA, 22 bp, Artificial Sequence
  chemically synthesized
tggttattttaaatttcctgtc

SEQ ID NO: 692459 - DNA, 22 bp, Artificial Sequence
  chemically synthesized
gaactatcagacaggaaattta

SEQ ID NO: 692460 - DNA, 22 bp, Artificial Sequence
  chemically synthesized
attatggttattttaaatttcc

SEQ ID NO: 692461 - DNA, 22 bp, Artificial Sequence
  chemically synthesized
tcagacaggaaatttaaaataa

SEQ ID NO: 692462 - DNA, 22 bp, Artificial Sequence
  chemically synthesized
aaatattaattatggttatttt

SEQ ID NO: 692463 - DNA, 22 bp, Artificial Sequence
  chemically synthesized
aaaatattaattatggttattt

SEQ ID NO: 692464 - DNA, 22 bp, Artificial Sequence
  chemically synthesized
taaaatattaattatggttatt

SEQ ID NO: 692465 - DNA, 22 bp, Artificial Sequence
  chemically synthesized
aagagtctttaaaatattaatt

SEQ ID NO: 692466 - DNA, 22 bp, Artificial Sequence
  chemically synthesized
aaaataaccataattaatattt

SEQ ID NO: 692467 - DNA, 22 bp, Artificial Sequence
  chemically synthesized
aaataaccataattaatatttt

SEQ ID NO: 692468 - DNA, 22 bp, Artificial Sequence
  chemically synthesized
cctcaagagtctttaaaatatt

SEQ ID NO: 692469 - DNA, 22 bp, Artificial Sequence
  chemically synthesized
ccctcaagagtctttaaaatat

SEQ ID NO: 692470 - DNA, 22 bp, Artificial Sequence
  chemically synthesized
tccctcaagagtctttaaaata

SEQ ID NO: 692471 - DNA, 22 bp, Artificial Sequence
  chemically synthesized
ttccctcaagagtctttaaaat

SEQ ID NO: 692472 - DNA, 22 bp, Artificial Sequence
  chemically synthesized
ttttccctcaagagtctttaaa

SEQ ID NO: 692473 - DNA, 22 bp, Artificial Sequence
  chemically synthesized
cttttccctcaagagtctttaa

SEQ ID NO: 692474 - DNA, 22 bp, Artificial Sequence
  chemically synthesized
tcttttccctcaagagtcttta

SEQ ID NO: 692475 - DNA, 22 bp, Artificial Sequence
  chemically synthesized
tctttcttttccctcaagagtc

SEQ ID NO: 692476 - DNA, 22 bp, Artificial Sequence
  chemically synthesized
atattttaaagactcttgaggg

SEQ ID NO: 692477 - DNA, 22 bp, Artificial Sequence
  chemically synthesized
catattgtctttcttttccctc

SEQ ID NO: 692478 - DNA, 22 bp, Artificial Sequence
  chemically synthesized
taaagactcttgagggaaaaga

SEQ ID NO: 692479 - DNA, 22 bp, Artificial Sequence
  chemically synthesized
gcatattgtctttcttttccct

SEQ ID NO: 692480 - DNA, 22 bp, Artificial Sequence
  chemically synthesized
aaagactcttgagggaaaagaa

SEQ ID NO: 692481 - DNA, 22 bp, Artificial Sequence
  chemically synthesized
aagactcttgagggaaaagaaa

SEQ ID NO: 692482 - DNA, 22 bp, Artificial Sequence
  chemically synthesized
atcttgcatattgtctttcttt

SEQ ID NO: 692483 - DNA, 22 bp, Artificial Sequence
  chemically synthesized
ttgagggaaaagaaagacaata

SEQ ID NO: 692484 - DNA, 22 bp, Artificial Sequence
  chemically synthesized
tctaatcttgcatattgtcttt

SEQ ID NO: 692485 - DNA, 22 bp, Artificial Sequence
  chemically synthesized
gagggaaaagaaagacaatatg

SEQ ID NO: 692486 - DNA, 22 bp, Artificial Sequence
  chemically synthesized
tatctaatcttgcatattgtct

SEQ ID NO: 692487 - DNA, 22 bp, Artificial Sequence
  chemically synthesized
agggaaaagaaagacaatatgc

SEQ ID NO: 692488 - DNA, 22 bp, Artificial Sequence
  chemically synthesized
ctatctaatcttgcatattgtc

SEQ ID NO: 692489 - DNA, 22 bp, Artificial Sequence
  chemically synthesized
tctatctaatcttgcatattgt

SEQ ID NO: 692490 - DNA, 22 bp, Artificial Sequence
  chemically synthesized
catattttctatctaatcttgc

SEQ ID NO: 692491 - DNA, 22 bp, Artificial Sequence
  chemically synthesized
acatattttctatctaatcttg

SEQ ID NO: 692492 - DNA, 22 bp, Artificial Sequence
  chemically synthesized
atcttacatattttctatctaa

SEQ ID NO: 692493 - DNA, 22 bp, Artificial Sequence
  chemically synthesized
taatcttacatattttctatct

SEQ ID NO: 692494 - DNA, 22 bp, Artificial Sequence
  chemically synthesized
ctaatcttacatattttctatc

SEQ ID NO: 692495 - DNA, 22 bp, Artificial Sequence
  chemically synthesized
tcttctaatcttacatattttc

SEQ ID NO: 692496 - DNA, 22 bp, Artificial Sequence
  chemically synthesized
catattgtcttctaatcttaca

SEQ ID NO: 692497 - DNA, 22 bp, Artificial Sequence
  chemically synthesized
gatagaaaatatgtaagattag

SEQ ID NO: 692498 - DNA, 22 bp, Artificial Sequence
  chemically synthesized
gcatattgtcttctaatcttac

SEQ ID NO: 692499 - DNA, 22 bp, Artificial Sequence
  chemically synthesized
atcttgcatattgtcttctaat

SEQ ID NO: 692500 - DNA, 22 bp, Artificial Sequence
  chemically synthesized
gaagacaatatgcaagattaga

SEQ ID NO: 692501 - DNA, 22 bp, Artificial Sequence
  chemically synthesized
taagagtgaatcaaatctaatc

SEQ ID NO: 692502 - DNA, 22 bp, Artificial Sequence
  chemically synthesized
gaaactataagagtgaatcaaa

SEQ ID NO: 692503 - DNA, 22 bp, Artificial Sequence
  chemically synthesized
gatttgattcactcttatagtt

SEQ ID NO: 692504 - DNA, 22 bp, Artificial Sequence
  chemically synthesized
aaatatagagctggaaactata

SEQ ID NO: 692505 - DNA, 22 bp, Artificial Sequence
  chemically synthesized
gattcactcttatagtttccag

SEQ ID NO: 692506 - DNA, 22 bp, Artificial Sequence
  chemically synthesized
attcactcttatagtttccagc

SEQ ID NO: 692507 - DNA, 22 bp, Artificial Sequence
  chemically synthesized
actcttatagtttccagctcta

SEQ ID NO: 692508 - DNA, 22 bp, Artificial Sequence
  chemically synthesized
aaatatactgaaatatagagct

SEQ ID NO: 692509 - DNA, 22 bp, Artificial Sequence
  chemically synthesized
ttatagtttccagctctatatt

SEQ ID NO: 692510 - DNA, 22 bp, Artificial Sequence
  chemically synthesized
atagtttccagctctatatttc

SEQ ID NO: 692511 - DNA, 22 bp, Artificial Sequence
  chemically synthesized
tagtttccagctctatatttca

SEQ ID NO: 692512 - DNA, 22 bp, Artificial Sequence
  chemically synthesized
tactgaaatatactgaaatata

SEQ ID NO: 692513 - DNA, 22 bp, Artificial Sequence
  chemically synthesized
tatactgaaatatactgaaata

SEQ ID NO: 692514 - DNA, 22 bp, Artificial Sequence
  chemically synthesized
ccagctctatatttcagtatat

SEQ ID NO: 692515 - DNA, 22 bp, Artificial Sequence
  chemically synthesized
cagctctatatttcagtatatt

SEQ ID NO: 692516 - DNA, 22 bp, Artificial Sequence
  chemically synthesized
cagctctatactgaaatatact

SEQ ID NO: 692517 - DNA, 22 bp, Artificial Sequence
  chemically synthesized
ccagctctatactgaaatatac

SEQ ID NO: 692518 - DNA, 22 bp, Artificial Sequence
  chemically synthesized
tatatttcagtatatttcagta

SEQ ID NO: 692519 - DNA, 22 bp, Artificial Sequence
  chemically synthesized
tatttcagtatatttcagtata

SEQ ID NO: 692520 - DNA, 22 bp, Artificial Sequence
  chemically synthesized
tagtttccagctctatactgaa

SEQ ID NO: 692521 - DNA, 22 bp, Artificial Sequence
  chemically synthesized
atagtttccagctctatactga

SEQ ID NO: 692522 - DNA, 22 bp, Artificial Sequence
  chemically synthesized
cagtatatttcagtatagagct

SEQ ID NO: 692523 - DNA, 22 bp, Artificial Sequence
  chemically synthesized
agtatatttcagtatagagctg

SEQ ID NO: 692524 - DNA, 22 bp, Artificial Sequence
  chemically synthesized
acttatagtttccagctctata

SEQ ID NO: 692525 - DNA, 22 bp, Artificial Sequence
  chemically synthesized
attcacttatagtttccagctc

SEQ ID NO: 692526 - DNA, 22 bp, Artificial Sequence
  chemically synthesized
gattcacttatagtttccagct

SEQ ID NO: 692527 - DNA, 22 bp, Artificial Sequence
  chemically synthesized
cagtatagagctggaaactata

SEQ ID NO: 692528 - DNA, 22 bp, Artificial Sequence
  chemically synthesized
agtatagagctggaaactataa

SEQ ID NO: 692529 - DNA, 22 bp, Artificial Sequence
  chemically synthesized
catttgattcacttatagtttc

SEQ ID NO: 692530 - DNA, 22 bp, Artificial Sequence
  chemically synthesized
ccatttgattcacttatagttt

SEQ ID NO: 692531 - DNA, 22 bp, Artificial Sequence
  chemically synthesized
gcatttccatttgattcactta

SEQ ID NO: 692532 - DNA, 22 bp, Artificial Sequence
  chemically synthesized
tagcatttccatttgattcact

SEQ ID NO: 692533 - DNA, 22 bp, Artificial Sequence
  chemically synthesized
ctagcatttccatttgattcac

SEQ ID NO: 692534 - DNA, 22 bp, Artificial Sequence
  chemically synthesized
gaaactataagtgaatcaaatg

SEQ ID NO: 692535 - DNA, 22 bp, Artificial Sequence
  chemically synthesized
atttctagcatttccatttgat

SEQ ID NO: 692536 - DNA, 22 bp, Artificial Sequence
  chemically synthesized
aatttctagcatttccatttga

SEQ ID NO: 692537 - DNA, 22 bp, Artificial Sequence
  chemically synthesized
taatttctagcatttccatttg

SEQ ID NO: 692538 - DNA, 22 bp, Artificial Sequence
  chemically synthesized
ttaatttctagcatttccattt

SEQ ID NO: 692539 - DNA, 22 bp, Artificial Sequence
  chemically synthesized
taagtgaatcaaatggaaatgc

SEQ ID NO: 692540 - DNA, 22 bp, Artificial Sequence
  chemically synthesized
cttttaatttctagcatttcca

SEQ ID NO: 692541 - DNA, 22 bp, Artificial Sequence
  chemically synthesized
ctgcttttaatttctagcattt

SEQ ID NO: 692542 - DNA, 22 bp, Artificial Sequence
  chemically synthesized
ttactgcttttaatttctagca

SEQ ID NO: 692543 - DNA, 22 bp, Artificial Sequence
  chemically synthesized
tgttactgcttttaatttctag

SEQ ID NO: 692544 - DNA, 22 bp, Artificial Sequence
  chemically synthesized
ctgttactgcttttaatttcta

SEQ ID NO: 692545 - DNA, 22 bp, Artificial Sequence
  chemically synthesized
tctgttactgcttttaatttct

SEQ ID NO: 692546 - DNA, 22 bp, Artificial Sequence
  chemically synthesized
ttctgttactgcttttaatttc

SEQ ID NO: 692547 - DNA, 22 bp, Artificial Sequence
  chemically synthesized
ttttctgttactgcttttaatt

SEQ ID NO: 692548 - DNA, 22 bp, Artificial Sequence
  chemically synthesized
cttttctgttactgcttttaat

SEQ ID NO: 692549 - DNA, 22 bp, Artificial Sequence
  chemically synthesized
tcttttctgttactgcttttaa

SEQ ID NO: 692550 - DNA, 22 bp, Artificial Sequence
  chemically synthesized
ttcttttctgttactgctttta

SEQ ID NO: 692551 - DNA, 22 bp, Artificial Sequence
  chemically synthesized
gaaattaaaagcagtaacagaa

SEQ ID NO: 692552 - DNA, 22 bp, Artificial Sequence
  chemically synthesized
aggtatttttcttttctgttac

SEQ ID NO: 692553 - DNA, 22 bp, Artificial Sequence
  chemically synthesized
aaagcagtaacagaaaagaaaa

SEQ ID NO: 692554 - DNA, 22 bp, Artificial Sequence
  chemically synthesized
cagatgagcccatctaaggtat

SEQ ID NO: 692555 - DNA, 22 bp, Artificial Sequence
  chemically synthesized
aatctacagatgagcccatcta

SEQ ID NO: 692556 - DNA, 22 bp, Artificial Sequence
  chemically synthesized
ttgaatctacagatgagcccat

SEQ ID NO: 692557 - DNA, 22 bp, Artificial Sequence
  chemically synthesized
gttgaatctacagatgagccca

SEQ ID NO: 692558 - DNA, 22 bp, Artificial Sequence
  chemically synthesized
tgttgaatctacagatgagccc

SEQ ID NO: 692559 - DNA, 22 bp, Artificial Sequence
  chemically synthesized
tctttgttgaatctacagatga

SEQ ID NO: 692560 - DNA, 22 bp, Artificial Sequence
  chemically synthesized
gtctttgttgaatctacagatg

SEQ ID NO: 692561 - DNA, 22 bp, Artificial Sequence
  chemically synthesized
agatgggctcatctgtagattc

SEQ ID NO: 692562 - DNA, 22 bp, Artificial Sequence
  chemically synthesized
cttgtctttgttgaatctacag

SEQ ID NO: 692563 - DNA, 22 bp, Artificial Sequence
  chemically synthesized
gatgggctcatctgtagattca

SEQ ID NO: 692564 - DNA, 22 bp, Artificial Sequence
  chemically synthesized
ccttgtctttgttgaatctaca

SEQ ID NO: 692565 - DNA, 22 bp, Artificial Sequence
  chemically synthesized
tccttgtctttgttgaatctac

SEQ ID NO: 692566 - DNA, 22 bp, Artificial Sequence
  chemically synthesized
tttccttgtctttgttgaatct

SEQ ID NO: 692567 - DNA, 22 bp, Artificial Sequence
  chemically synthesized
gttctttccttgtctttgttga

SEQ ID NO: 692568 - DNA, 22 bp, Artificial Sequence
  chemically synthesized
atctgtagattcaacaaagaca

SEQ ID NO: 692569 - DNA, 22 bp, Artificial Sequence
  chemically synthesized
actggttctttccttgtctttg

SEQ ID NO: 692570 - DNA, 22 bp, Artificial Sequence
  chemically synthesized
tagattcaacaaagacaaggaa

SEQ ID NO: 692571 - DNA, 22 bp, Artificial Sequence
  chemically synthesized
aagttcactggttctttccttg

SEQ ID NO: 692572 - DNA, 22 bp, Artificial Sequence
  chemically synthesized
aacaaagacaaggaaagaacca

SEQ ID NO: 692573 - DNA, 22 bp, Artificial Sequence
  chemically synthesized
tattcaagttcactggttcttt

SEQ ID NO: 692574 - DNA, 22 bp, Artificial Sequence
  chemically synthesized
ccctatattcaagttcactggt

SEQ ID NO: 692575 - DNA, 22 bp, Artificial Sequence
  chemically synthesized
ttaccctatattcaagttcact

SEQ ID NO: 692576 - DNA, 22 bp, Artificial Sequence
  chemically synthesized
tgttaccctatattcaagttca

SEQ ID NO: 692577 - DNA, 22 bp, Artificial Sequence
  chemically synthesized
ctgttaccctatattcaagttc

SEQ ID NO: 692578 - DNA, 22 bp, Artificial Sequence
  chemically synthesized
tataatttctgttaccctatat

SEQ ID NO: 692579 - DNA, 22 bp, Artificial Sequence
  chemically synthesized
gtataatttctgttaccctata

SEQ ID NO: 692580 - DNA, 22 bp, Artificial Sequence
  chemically synthesized
agtttgtataatttctgttacc

SEQ ID NO: 692581 - DNA, 22 bp, Artificial Sequence
  chemically synthesized
cagtttgtataatttctgttac

SEQ ID NO: 692582 - DNA, 22 bp, Artificial Sequence
  chemically synthesized
tcagtttgtataatttctgtta

SEQ ID NO: 692583 - DNA, 22 bp, Artificial Sequence
  chemically synthesized
ttcagtttgtataatttctgtt

SEQ ID NO: 692584 - DNA, 22 bp, Artificial Sequence
  chemically synthesized
gaatatagggtaacagaaatta

SEQ ID NO: 692585 - DNA, 22 bp, Artificial Sequence
  chemically synthesized
aatatagggtaacagaaattat

SEQ ID NO: 692586 - DNA, 22 bp, Artificial Sequence
  chemically synthesized
cttttcagtttgtataatttct

SEQ ID NO: 692587 - DNA, 22 bp, Artificial Sequence
  chemically synthesized
cccctgcttttcagtttgtata

SEQ ID NO: 692588 - DNA, 22 bp, Artificial Sequence
  chemically synthesized
ccccctgcttttcagtttgtat

SEQ ID NO: 692589 - DNA, 22 bp, Artificial Sequence
  chemically synthesized
tccccctgcttttcagtttgta

SEQ ID NO: 692590 - DNA, 22 bp, Artificial Sequence
  chemically synthesized
ttccccctgcttttcagtttgt

SEQ ID NO: 692591 - DNA, 22 bp, Artificial Sequence
  chemically synthesized
cttttccccctgcttttcagtt

SEQ ID NO: 692592 - DNA, 22 bp, Artificial Sequence
  chemically synthesized
acttttccccctgcttttcagt

SEQ ID NO: 692593 - DNA, 22 bp, Artificial Sequence
  chemically synthesized
tacttttccccctgcttttcag

SEQ ID NO: 692594 - DNA, 22 bp, Artificial Sequence
  chemically synthesized
ttacttttccccctgcttttca

SEQ ID NO: 692595 - DNA, 22 bp, Artificial Sequence
  chemically synthesized
tttacttttccccctgcttttc

SEQ ID NO: 692596 - DNA, 22 bp, Artificial Sequence
  chemically synthesized
ttttacttttccccctgctttt

SEQ ID NO: 692597 - DNA, 22 bp, Artificial Sequence
  chemically synthesized
tttttacttttccccctgcttt

SEQ ID NO: 692598 - DNA, 22 bp, Artificial Sequence
  chemically synthesized
ttttttacttttccccctgctt

SEQ ID NO: 692599 - DNA, 22 bp, Artificial Sequence
  chemically synthesized
tacaaactgaaaagcaggggga

SEQ ID NO: 692600 - DNA, 22 bp, Artificial Sequence
  chemically synthesized
tttttttacttttccccctgct

SEQ ID NO: 692601 - DNA, 22 bp, Artificial Sequence
  chemically synthesized
ttttttttacttttccccctgc

SEQ ID NO: 692602 - DNA, 22 bp, Artificial Sequence
  chemically synthesized
catttttttttttacttttccc

SEQ ID NO: 692603 - DNA, 22 bp, Artificial Sequence
  chemically synthesized
aaaagcagggggaaaagtaaaa

SEQ ID NO: 692604 - DNA, 22 bp, Artificial Sequence
  chemically synthesized
caattgcatttttttttttact

SEQ ID NO: 692605 - DNA, 22 bp, Artificial Sequence
  chemically synthesized
tattgcaattgcattttttttt

SEQ ID NO: 692606 - DNA, 22 bp, Artificial Sequence
  chemically synthesized
gtattgcaattgcatttttttt

SEQ ID NO: 692607 - DNA, 22 bp, Artificial Sequence
  chemically synthesized
tgtttgtattgcaattgcattt

SEQ ID NO: 692608 - DNA, 22 bp, Artificial Sequence
  chemically synthesized
ctgtgtttgtattgcaattgca

SEQ ID NO: 692609 - DNA, 22 bp, Artificial Sequence
  chemically synthesized
aaaacctactgtgtttgtattg

SEQ ID NO: 692610 - DNA, 22 bp, Artificial Sequence
  chemically synthesized
atactgaaaacctactgtgttt

SEQ ID NO: 692611 - DNA, 22 bp, Artificial Sequence
  chemically synthesized
aatactgaaaacctactgtgtt

SEQ ID NO: 692612 - DNA, 22 bp, Artificial Sequence
  chemically synthesized
cttaatactgaaaacctactgt

SEQ ID NO: 692613 - DNA, 22 bp, Artificial Sequence
  chemically synthesized
caatacaaacacagtaggtttt

SEQ ID NO: 692614 - DNA, 22 bp, Artificial Sequence
  chemically synthesized
gagccctacttaatactgaaaa

SEQ ID NO: 692615 - DNA, 22 bp, Artificial Sequence
  chemically synthesized
ctagagccctacttaatactga

SEQ ID NO: 692616 - DNA, 22 bp, Artificial Sequence
  chemically synthesized
cctagagccctacttaatactg

SEQ ID NO: 692617 - DNA, 22 bp, Artificial Sequence
  chemically synthesized
tttcctagagccctacttaata

SEQ ID NO: 692618 - DNA, 22 bp, Artificial Sequence
  chemically synthesized
tcagtattaagtagggctctag

SEQ ID NO: 692619 - DNA, 22 bp, Artificial Sequence
  chemically synthesized
cagtattaagtagggctctagg

SEQ ID NO: 692620 - DNA, 22 bp, Artificial Sequence
  chemically synthesized
agtattaagtagggctctagga

SEQ ID NO: 692621 - DNA, 22 bp, Artificial Sequence
  chemically synthesized
aaaaatagctgtttcctagagc

SEQ ID NO: 692622 - DNA, 22 bp, Artificial Sequence
  chemically synthesized
atctgaaaaatagctgtttcct

SEQ ID NO: 692623 - DNA, 22 bp, Artificial Sequence
  chemically synthesized
agtagggctctaggaaacagct

SEQ ID NO: 692624 - DNA, 22 bp, Artificial Sequence
  chemically synthesized
aatctgaaaaatagctgtttcc

SEQ ID NO: 692625 - DNA, 22 bp, Artificial Sequence
  chemically synthesized
cttaatctgaaaaatagctgtt

SEQ ID NO: 692626 - DNA, 22 bp, Artificial Sequence
  chemically synthesized
ttacttaatctgaaaaatagct

SEQ ID NO: 692627 - DNA, 22 bp, Artificial Sequence
  chemically synthesized
taggaaacagctatttttcaga

SEQ ID NO: 692628 - DNA, 22 bp, Artificial Sequence
  chemically synthesized
ggaaacagctatttttcagatt

SEQ ID NO: 692629 - DNA, 22 bp, Artificial Sequence
  chemically synthesized
caccaaactgttacttaatctg

SEQ ID NO: 692630 - DNA, 22 bp, Artificial Sequence
  chemically synthesized
tttttcagattaagtaacagtt

SEQ ID NO: 692631 - DNA, 22 bp, Artificial Sequence
  chemically synthesized
ttcagattaagtaacagtttgg

SEQ ID NO: 692632 - DNA, 22 bp, Artificial Sequence
  chemically synthesized
tcagattaagtaacagtttggt

SEQ ID NO: 692633 - DNA, 22 bp, Artificial Sequence
  chemically synthesized
cagattaagtaacagtttggtg

SEQ ID NO: 692634 - DNA, 22 bp, Artificial Sequence
  chemically synthesized
agattaagtaacagtttggtgc

SEQ ID NO: 692635 - DNA, 22 bp, Artificial Sequence
  chemically synthesized
atcagcataattgcaccaaact

SEQ ID NO: 692636 - DNA, 22 bp, Artificial Sequence
  chemically synthesized
gatcagcataattgcaccaaac

SEQ ID NO: 692637 - DNA, 22 bp, Artificial Sequence
  chemically synthesized
agtaacagtttggtgcaattat

SEQ ID NO: 692638 - DNA, 22 bp, Artificial Sequence
  chemically synthesized
tgcttgatcagcataattgcac

SEQ ID NO: 692639 - DNA, 22 bp, Artificial Sequence
  chemically synthesized
atgcttgatcagcataattgca

SEQ ID NO: 692640 - DNA, 22 bp, Artificial Sequence
  chemically synthesized
tatgcttgatcagcataattgc

SEQ ID NO: 692641 - DNA, 22 bp, Artificial Sequence
  chemically synthesized
tttatgcttgatcagcataatt

SEQ ID NO: 692642 - DNA, 22 bp, Artificial Sequence
  chemically synthesized
tagttctttatgcttgatcagc

SEQ ID NO: 692643 - DNA, 22 bp, Artificial Sequence
  chemically synthesized
ggtgcaattatgctgatcaagc

SEQ ID NO: 692644 - DNA, 22 bp, Artificial Sequence
  chemically synthesized
atagttctttatgcttgatcag

SEQ ID NO: 692645 - DNA, 22 bp, Artificial Sequence
  chemically synthesized
gtgcaattatgctgatcaagca

SEQ ID NO: 692646 - DNA, 22 bp, Artificial Sequence
  chemically synthesized
atttatagttctttatgcttga

SEQ ID NO: 692647 - DNA, 22 bp, Artificial Sequence
  chemically synthesized
aatttatagttctttatgcttg

SEQ ID NO: 692648 - DNA, 22 bp, Artificial Sequence
  chemically synthesized
taatttatagttctttatgctt

SEQ ID NO: 692649 - DNA, 22 bp, Artificial Sequence
  chemically synthesized
tgctgatcaagcataaagaact

SEQ ID NO: 692650 - DNA, 22 bp, Artificial Sequence
  chemically synthesized
atcaagcataaagaactataaa

SEQ ID NO: 692651 - DNA, 22 bp, Artificial Sequence
  chemically synthesized
agtgaagtctttaatttatagt

SEQ ID NO: 692652 - DNA, 22 bp, Artificial Sequence
  chemically synthesized
gagtgaagtctttaatttatag

SEQ ID NO: 692653 - DNA, 22 bp, Artificial Sequence
  chemically synthesized
tgagtgaagtctttaatttata

SEQ ID NO: 692654 - DNA, 22 bp, Artificial Sequence
  chemically synthesized
tttgagtgaagtctttaattta

SEQ ID NO: 692655 - DNA, 22 bp, Artificial Sequence
  chemically synthesized
ctttgagtgaagtctttaattt

SEQ ID NO: 692656 - DNA, 22 bp, Artificial Sequence
  chemically synthesized
taaattaaagacttcactcaaa

SEQ ID NO: 692657 - DNA, 22 bp, Artificial Sequence
  chemically synthesized
tcagaggtcttctttgagtgaa

SEQ ID NO: 692658 - DNA, 22 bp, Artificial Sequence
  chemically synthesized
gtcagaggtcttctttgagtga

SEQ ID NO: 692659 - DNA, 22 bp, Artificial Sequence
  chemically synthesized
cttgtcagaggtcttctttgag

SEQ ID NO: 692660 - DNA, 22 bp, Artificial Sequence
  chemically synthesized
aagacttcactcaaagaagacc

SEQ ID NO: 692661 - DNA, 22 bp, Artificial Sequence
  chemically synthesized
gttgcttgtcagaggtcttctt

SEQ ID NO: 692662 - DNA, 22 bp, Artificial Sequence
  chemically synthesized
ggttgcttgtcagaggtcttct

SEQ ID NO: 692663 - DNA, 22 bp, Artificial Sequence
  chemically synthesized
cactcaaagaagacctctgaca

SEQ ID NO: 692664 - DNA, 22 bp, Artificial Sequence
  chemically synthesized
actcaaagaagacctctgacaa

SEQ ID NO: 692665 - DNA, 22 bp, Artificial Sequence
  chemically synthesized
tagcaacttggttgcttgtcag

SEQ ID NO: 692666 - DNA, 22 bp, Artificial Sequence
  chemically synthesized
aaagaagacctctgacaagcaa

SEQ ID NO: 692667 - DNA, 22 bp, Artificial Sequence
  chemically synthesized
gtagcaacttggttgcttgtca

SEQ ID NO: 692668 - DNA, 22 bp, Artificial Sequence
  chemically synthesized
tgtagcaacttggttgcttgtc

SEQ ID NO: 692669 - DNA, 22 bp, Artificial Sequence
  chemically synthesized
aatactttgtagcaacttggtt

SEQ ID NO: 692670 - DNA, 22 bp, Artificial Sequence
  chemically synthesized
aaatactttgtagcaacttggt

SEQ ID NO: 692671 - DNA, 22 bp, Artificial Sequence
  chemically synthesized
taaatactttgtagcaacttgg

SEQ ID NO: 692672 - DNA, 22 bp, Artificial Sequence
  chemically synthesized
ttaaatactttgtagcaacttg

SEQ ID NO: 692673 - DNA, 22 bp, Artificial Sequence
  chemically synthesized
tgacaagcaaccaagttgctac

SEQ ID NO: 692674 - DNA, 22 bp, Artificial Sequence
  chemically synthesized
tttaaatactttgtagcaactt

SEQ ID NO: 692675 - DNA, 22 bp, Artificial Sequence
  chemically synthesized
acaagcaaccaagttgctacaa

SEQ ID NO: 692676 - DNA, 22 bp, Artificial Sequence
  chemically synthesized
gctttttaaatactttgtagca

SEQ ID NO: 692677 - DNA, 22 bp, Artificial Sequence
  chemically synthesized
gtcactagctttttaaatactt

SEQ ID NO: 692678 - DNA, 22 bp, Artificial Sequence
  chemically synthesized
gttggtcactagctttttaaat

SEQ ID NO: 692679 - DNA, 22 bp, Artificial Sequence
  chemically synthesized
ctacaaagtatttaaaaagcta

SEQ ID NO: 692680 - DNA, 22 bp, Artificial Sequence
  chemically synthesized
caaagtatttaaaaagctagtg

SEQ ID NO: 692681 - DNA, 22 bp, Artificial Sequence
  chemically synthesized
taaacaactggttggtcactag

SEQ ID NO: 692682 - DNA, 22 bp, Artificial Sequence
  chemically synthesized
aaaaagctagtgaccaaccagt

SEQ ID NO: 692683 - DNA, 22 bp, Artificial Sequence
  chemically synthesized
aaaagctagtgaccaaccagtt

SEQ ID NO: 692684 - DNA, 22 bp, Artificial Sequence
  chemically synthesized
gtgaccaaccagttgtttacag

SEQ ID NO: 692685 - DNA, 22 bp, Artificial Sequence
  chemically synthesized
caaaatatatcactgtaaacaa

SEQ ID NO: 692686 - DNA, 22 bp, Artificial Sequence
  chemically synthesized
aatcaaatattgcaaaatatat

SEQ ID NO: 692687 - DNA, 22 bp, Artificial Sequence
  chemically synthesized
tttacagtgatatattttgcaa

SEQ ID NO: 692688 - DNA, 22 bp, Artificial Sequence
  chemically synthesized
atctaaatcaaatattgcaaaa

SEQ ID NO: 692689 - DNA, 22 bp, Artificial Sequence
  chemically synthesized
acagtgatatattttgcaatat

SEQ ID NO: 692690 - DNA, 22 bp, Artificial Sequence
  chemically synthesized
aatctaaatcaaatattgcaaa

SEQ ID NO: 692691 - DNA, 22 bp, Artificial Sequence
  chemically synthesized
cagtgatatattttgcaatatt

SEQ ID NO: 692692 - DNA, 22 bp, Artificial Sequence
  chemically synthesized
ttaatctaaatcaaatattgca

SEQ ID NO: 692693 - DNA, 22 bp, Artificial Sequence
  chemically synthesized
gaactcttaatctaaatcaaat

SEQ ID NO: 692694 - DNA, 22 bp, Artificial Sequence
  chemically synthesized
ctagaactcttaatctaaatca

SEQ ID NO: 692695 - DNA, 22 bp, Artificial Sequence
  chemically synthesized
cctagaactcttaatctaaatc

SEQ ID NO: 692696 - DNA, 22 bp, Artificial Sequence
  chemically synthesized
tgcaatatttgatttagattaa

SEQ ID NO: 692697 - DNA, 22 bp, Artificial Sequence
  chemically synthesized
gcaatatttgatttagattaag

SEQ ID NO: 692698 - DNA, 22 bp, Artificial Sequence
  chemically synthesized
caatatttgatttagattaaga

SEQ ID NO: 692699 - DNA, 22 bp, Artificial Sequence
  chemically synthesized
tatttcctagaactcttaatct

SEQ ID NO: 692700 - DNA, 22 bp, Artificial Sequence
  chemically synthesized
gtatttcctagaactcttaatc

SEQ ID NO: 692701 - DNA, 22 bp, Artificial Sequence
  chemically synthesized
tgtatttcctagaactcttaat

SEQ ID NO: 692702 - DNA, 22 bp, Artificial Sequence
  chemically synthesized
ttgtatttcctagaactcttaa

SEQ ID NO: 692703 - DNA, 22 bp, Artificial Sequence
  chemically synthesized
tttgtatttcctagaactctta

SEQ ID NO: 692704 - DNA, 22 bp, Artificial Sequence
  chemically synthesized
gatttagattaagagttctagg

SEQ ID NO: 692705 - DNA, 22 bp, Artificial Sequence
  chemically synthesized
atttagattaagagttctagga

SEQ ID NO: 692706 - DNA, 22 bp, Artificial Sequence
  chemically synthesized
agattaagagttctaggaaata

SEQ ID NO: 692707 - DNA, 22 bp, Artificial Sequence
  chemically synthesized
tggatctttttgtatttcctag

SEQ ID NO: 692708 - DNA, 22 bp, Artificial Sequence
  chemically synthesized
gattaagagttctaggaaatac

SEQ ID NO: 692709 - DNA, 22 bp, Artificial Sequence
  chemically synthesized
tactgtggatctttttgtattt

SEQ ID NO: 692710 - DNA, 22 bp, Artificial Sequence
  chemically synthesized
agagttctaggaaatacaaaaa

SEQ ID NO: 692711 - DNA, 22 bp, Artificial Sequence
  chemically synthesized
gtactgtggatctttttgtatt

SEQ ID NO: 692712 - DNA, 22 bp, Artificial Sequence
  chemically synthesized
tgtactgtggatctttttgtat

SEQ ID NO: 692713 - DNA, 22 bp, Artificial Sequence
  chemically synthesized
ttgtactgtggatctttttgta

SEQ ID NO: 692714 - DNA, 22 bp, Artificial Sequence
  chemically synthesized
tttgtactgtggatctttttgt

SEQ ID NO: 692715 - DNA, 22 bp, Artificial Sequence
  chemically synthesized
ttttgtactgtggatctttttg

SEQ ID NO: 692716 - DNA, 22 bp, Artificial Sequence
  chemically synthesized
taggaaatacaaaaagatccac

SEQ ID NO: 692717 - DNA, 22 bp, Artificial Sequence
  chemically synthesized
tttttttgtactgtggatcttt

SEQ ID NO: 692718 - DNA, 22 bp, Artificial Sequence
  chemically synthesized
gtttttttgtactgtggatctt

SEQ ID NO: 692719 - DNA, 22 bp, Artificial Sequence
  chemically synthesized
ggaaatacaaaaagatccacag

SEQ ID NO: 692720 - DNA, 22 bp, Artificial Sequence
  chemically synthesized
gaaggaacacatttgttttttt

SEQ ID NO: 692721 - DNA, 22 bp, Artificial Sequence
  chemically synthesized
agcattagaaggaacacatttg

SEQ ID NO: 692722 - DNA, 22 bp, Artificial Sequence
  chemically synthesized
tgagcattagaaggaacacatt

SEQ ID NO: 692723 - DNA, 22 bp, Artificial Sequence
  chemically synthesized
attctgagcattagaaggaaca

SEQ ID NO: 692724 - DNA, 22 bp, Artificial Sequence
  chemically synthesized
cttctaatgctcagaattaaca

SEQ ID NO: 692725 - DNA, 22 bp, Artificial Sequence
  chemically synthesized
agcaaagataaaatgttaattc

SEQ ID NO: 692726 - DNA, 22 bp, Artificial Sequence
  chemically synthesized
gagcaaagataaaatgttaatt

SEQ ID NO: 692727 - DNA, 22 bp, Artificial Sequence
  chemically synthesized
ctaatgctcagaattaacattt

SEQ ID NO: 692728 - DNA, 22 bp, Artificial Sequence
  chemically synthesized
tgagcaaagataaaatgttaat

SEQ ID NO: 692729 - DNA, 22 bp, Artificial Sequence
  chemically synthesized
taatgctcagaattaacatttt

SEQ ID NO: 692730 - DNA, 22 bp, Artificial Sequence
  chemically synthesized
atgctcagaattaacattttat

SEQ ID NO: 692731 - DNA, 22 bp, Artificial Sequence
  chemically synthesized
agaattaacattttatctttgc

SEQ ID NO: 692732 - DNA, 22 bp, Artificial Sequence
  chemically synthesized
aaaagaagctttgagcaaagat

SEQ ID NO: 692733 - DNA, 22 bp, Artificial Sequence
  chemically synthesized
caaaagaagctttgagcaaaga

SEQ ID NO: 692734 - DNA, 22 bp, Artificial Sequence
  chemically synthesized
tttcaaaagaagctttgagcaa

SEQ ID NO: 692735 - DNA, 22 bp, Artificial Sequence
  chemically synthesized
acattttatctttgctcaaagc

SEQ ID NO: 692736 - DNA, 22 bp, Artificial Sequence
  chemically synthesized
atttcaaaagaagctttgagca

SEQ ID NO: 692737 - DNA, 22 bp, Artificial Sequence
  chemically synthesized
tatttcaaaagaagctttgagc

SEQ ID NO: 692738 - DNA, 22 bp, Artificial Sequence
  chemically synthesized
tatctttgctcaaagcttcttt

SEQ ID NO: 692739 - DNA, 22 bp, Artificial Sequence
  chemically synthesized
atctttgctcaaagcttctttt

SEQ ID NO: 692740 - DNA, 22 bp, Artificial Sequence
  chemically synthesized
tctttgctcaaagcttcttttg

SEQ ID NO: 692741 - DNA, 22 bp, Artificial Sequence
  chemically synthesized
tgctcaaagcttcttttgaaat

SEQ ID NO: 692742 - DNA, 22 bp, Artificial Sequence
  chemically synthesized
gctcaaagcttcttttgaaata

SEQ ID NO: 692743 - DNA, 22 bp, Artificial Sequence
  chemically synthesized
aatggtgtattttatttcaaaa

SEQ ID NO: 692744 - DNA, 22 bp, Artificial Sequence
  chemically synthesized
ctcaaagcttcttttgaaataa

SEQ ID NO: 692745 - DNA, 22 bp, Artificial Sequence
  chemically synthesized
gaatggtgtattttatttcaaa

SEQ ID NO: 692746 - DNA, 22 bp, Artificial Sequence
  chemically synthesized
aaagcttcttttgaaataaaat

SEQ ID NO: 692747 - DNA, 22 bp, Artificial Sequence
  chemically synthesized
atcttgaatggtgtattttatt

SEQ ID NO: 692748 - DNA, 22 bp, Artificial Sequence
  chemically synthesized
catcttgaatggtgtattttat

SEQ ID NO: 692749 - DNA, 22 bp, Artificial Sequence
  chemically synthesized
cttttgaaataaaatacaccat

SEQ ID NO: 692750 - DNA, 22 bp, Artificial Sequence
  chemically synthesized
ttttgaaataaaatacaccatt

SEQ ID NO: 692751 - DNA, 22 bp, Artificial Sequence
  chemically synthesized
ttgaaataaaatacaccattca

SEQ ID NO: 692752 - DNA, 22 bp, Artificial Sequence
  chemically synthesized
tgaaataaaatacaccattcaa

SEQ ID NO: 692753 - DNA, 22 bp, Artificial Sequence
  chemically synthesized
gaaataaaatacaccattcaag

SEQ ID NO: 692754 - DNA, 22 bp, Artificial Sequence
  chemically synthesized
aaataaaatacaccattcaaga

SEQ ID NO: 692755 - DNA, 22 bp, Artificial Sequence
  chemically synthesized
aagatgaaattccgatcctctc

SEQ ID NO: 692756 - DNA, 22 bp, Artificial Sequence
  chemically synthesized
tagtatgggagagggggcatca

SEQ ID NO: 692757 - DNA, 22 bp, Artificial Sequence
  chemically synthesized
cgatcctctctgatgccccctc

SEQ ID NO: 692758 - DNA, 22 bp, Artificial Sequence
  chemically synthesized
gttgtagtatgggagagggggc

SEQ ID NO: 692759 - DNA, 22 bp, Artificial Sequence
  chemically synthesized
tctgatgccccctctcccatac

SEQ ID NO: 692760 - DNA, 22 bp, Artificial Sequence
  chemically synthesized
tgatgccccctctcccatacta

SEQ ID NO: 692761 - DNA, 22 bp, Artificial Sequence
  chemically synthesized
tgatactagttgtagtatggga

SEQ ID NO: 692762 - DNA, 22 bp, Artificial Sequence
  chemically synthesized
atgccccctctcccatactaca

SEQ ID NO: 692763 - DNA, 22 bp, Artificial Sequence
  chemically synthesized
tcccatactacaactagtatca

SEQ ID NO: 692764 - DNA, 22 bp, Artificial Sequence
  chemically synthesized
ccatactacaactagtatcata

SEQ ID NO: 692765 - DNA, 22 bp, Artificial Sequence
  chemically synthesized
gaaagataaacaccaaagttat

SEQ ID NO: 692766 - DNA, 22 bp, Artificial Sequence
  chemically synthesized
caactagtatcataactttggt

SEQ ID NO: 692767 - DNA, 22 bp, Artificial Sequence
  chemically synthesized
gtatcataactttggtgtttat

SEQ ID NO: 692768 - DNA, 22 bp, Artificial Sequence
  chemically synthesized
aaatgaaaagcctggaaagata

SEQ ID NO: 692769 - DNA, 22 bp, Artificial Sequence
  chemically synthesized
tggtgtttatctttccaggctt

SEQ ID NO: 692770 - DNA, 22 bp, Artificial Sequence
  chemically synthesized
aattaaaatgaaaagcctggaa

SEQ ID NO: 692771 - DNA, 22 bp, Artificial Sequence
  chemically synthesized
ggtgtttatctttccaggcttt

SEQ ID NO: 692772 - DNA, 22 bp, Artificial Sequence
  chemically synthesized
gtgtttatctttccaggctttt

SEQ ID NO: 692773 - DNA, 22 bp, Artificial Sequence
  chemically synthesized
aaaattaaattaaaatgaaaag

SEQ ID NO: 692774 - DNA, 22 bp, Artificial Sequence
  chemically synthesized
atctttccaggcttttcatttt

SEQ ID NO: 692775 - DNA, 22 bp, Artificial Sequence
  chemically synthesized
aaaaattaaattaaaatgaaaa

SEQ ID NO: 692776 - DNA, 22 bp, Artificial Sequence
  chemically synthesized
tctttccaggcttttcatttta

SEQ ID NO: 692777 - DNA, 22 bp, Artificial Sequence
  chemically synthesized
taaaaattaaattaaaatgaaa

SEQ ID NO: 692778 - DNA, 22 bp, Artificial Sequence
  chemically synthesized
ttaaaaattaaattaaaatgaa

SEQ ID NO: 692779 - DNA, 22 bp, Artificial Sequence
  chemically synthesized
tccaggcttttcattttaattt

SEQ ID NO: 692780 - DNA, 22 bp, Artificial Sequence
  chemically synthesized
ccaggcttttcattttaattta

SEQ ID NO: 692781 - DNA, 22 bp, Artificial Sequence
  chemically synthesized
atttttaaaaattaaattaaaa

SEQ ID NO: 692782 - DNA, 22 bp, Artificial Sequence
  chemically synthesized
caggcttttcattttaatttaa

SEQ ID NO: 692783 - DNA, 22 bp, Artificial Sequence
  chemically synthesized
ttcattttaatttaatttttaa

SEQ ID NO: 692784 - DNA, 22 bp, Artificial Sequence
  chemically synthesized
tcattttaatttaatttttaaa

SEQ ID NO: 692785 - DNA, 22 bp, Artificial Sequence
  chemically synthesized
cattttaatttaatttttaaaa

SEQ ID NO: 692786 - DNA, 22 bp, Artificial Sequence
  chemically synthesized
attttaatttaatttttaaaaa

SEQ ID NO: 692787 - DNA, 22 bp, Artificial Sequence
  chemically synthesized
taatttaatttttaaaaattag

SEQ ID NO: 692788 - DNA, 22 bp, Artificial Sequence
  chemically synthesized
aatttaatttttaaaaattagt

SEQ ID NO: 692789 - DNA, 22 bp, Artificial Sequence
  chemically synthesized
aaaataaaaaagactaattttt

SEQ ID NO: 692790 - DNA, 22 bp, Artificial Sequence
  chemically synthesized
atttaatttttaaaaattagtc

SEQ ID NO: 692791 - DNA, 22 bp, Artificial Sequence
  chemically synthesized
aatttttaaaaattagtctttt

SEQ ID NO: 692792 - DNA, 22 bp, Artificial Sequence
  chemically synthesized
atttttaaaaattagtcttttt

SEQ ID NO: 692793 - DNA, 22 bp, Artificial Sequence
  chemically synthesized
ttaaaaattagtcttttttatt

SEQ ID NO: 692794 - DNA, 22 bp, Artificial Sequence
  chemically synthesized
taaaaattagtcttttttattt

SEQ ID NO: 692795 - DNA, 22 bp, Artificial Sequence
  chemically synthesized
aaaaattagtcttttttatttt

SEQ ID NO: 692796 - DNA, 22 bp, Artificial Sequence
  chemically synthesized
aaaattagtcttttttattttt

SEQ ID NO: 692797 - DNA, 22 bp, Artificial Sequence
  chemically synthesized
aagtacaggtgcaatactaaaa

SEQ ID NO: 692798 - DNA, 22 bp, Artificial Sequence
  chemically synthesized
gtcttttttatttttagtattg

SEQ ID NO: 692799 - DNA, 22 bp, Artificial Sequence
  chemically synthesized
gaagtacaggtgcaatactaaa

SEQ ID NO: 692800 - DNA, 22 bp, Artificial Sequence
  chemically synthesized
tgaagtacaggtgcaatactaa

SEQ ID NO: 692801 - DNA, 22 bp, Artificial Sequence
  chemically synthesized
ttgaagtacaggtgcaatacta

SEQ ID NO: 692802 - DNA, 22 bp, Artificial Sequence
  chemically synthesized
tttgaagtacaggtgcaatact

SEQ ID NO: 692803 - DNA, 22 bp, Artificial Sequence
  chemically synthesized
ttttatttttagtattgcacct

SEQ ID NO: 692804 - DNA, 22 bp, Artificial Sequence
  chemically synthesized
tttatttttagtattgcacctg

SEQ ID NO: 692805 - DNA, 22 bp, Artificial Sequence
  chemically synthesized
ctttttgaagtacaggtgcaat

SEQ ID NO: 692806 - DNA, 22 bp, Artificial Sequence
  chemically synthesized
ttatttttagtattgcacctgt

SEQ ID NO: 692807 - DNA, 22 bp, Artificial Sequence
  chemically synthesized
gctttttgaagtacaggtgcaa

SEQ ID NO: 692808 - DNA, 22 bp, Artificial Sequence
  chemically synthesized
tatttttagtattgcacctgta

SEQ ID NO: 692809 - DNA, 22 bp, Artificial Sequence
  chemically synthesized
tgctttttgaagtacaggtgca

SEQ ID NO: 692810 - DNA, 22 bp, Artificial Sequence
  chemically synthesized
atttttagtattgcacctgtac

SEQ ID NO: 692811 - DNA, 22 bp, Artificial Sequence
  chemically synthesized
tttttagtattgcacctgtact

SEQ ID NO: 692812 - DNA, 22 bp, Artificial Sequence
  chemically synthesized
ttagtattgcacctgtacttca

SEQ ID NO: 692813 - DNA, 22 bp, Artificial Sequence
  chemically synthesized
tagtattgcacctgtacttcaa

SEQ ID NO: 692814 - DNA, 22 bp, Artificial Sequence
  chemically synthesized
agtattgcacctgtacttcaaa

SEQ ID NO: 692815 - DNA, 22 bp, Artificial Sequence
  chemically synthesized
gtattgcacctgtacttcaaaa

SEQ ID NO: 692816 - DNA, 22 bp, Artificial Sequence
  chemically synthesized
aagtgttttgctttttgaagta

SEQ ID NO: 692817 - DNA, 22 bp, Artificial Sequence
  chemically synthesized
aaagtgttttgctttttgaagt

SEQ ID NO: 692818 - DNA, 22 bp, Artificial Sequence
  chemically synthesized
taaagtgttttgctttttgaag

SEQ ID NO: 692819 - DNA, 22 bp, Artificial Sequence
  chemically synthesized
ttaaagtgttttgctttttgaa

SEQ ID NO: 692820 - DNA, 22 bp, Artificial Sequence
  chemically synthesized
tttaaagtgttttgctttttga

SEQ ID NO: 692821 - DNA, 22 bp, Artificial Sequence
  chemically synthesized
cacctgtacttcaaaaagcaaa

SEQ ID NO: 692822 - DNA, 22 bp, Artificial Sequence
  chemically synthesized
tacttcaaaaagcaaaacactt

SEQ ID NO: 692823 - DNA, 22 bp, Artificial Sequence
  chemically synthesized
gaaggtcactttttaaagtgtt

SEQ ID NO: 692824 - DNA, 22 bp, Artificial Sequence
  chemically synthesized
caaaaagcaaaacactttaaaa

SEQ ID NO: 692825 - DNA, 22 bp, Artificial Sequence
  chemically synthesized
tggaaggtcactttttaaagtg

SEQ ID NO: 692826 - DNA, 22 bp, Artificial Sequence
  chemically synthesized
aaaaagcaaaacactttaaaaa

SEQ ID NO: 692827 - DNA, 22 bp, Artificial Sequence
  chemically synthesized
aattctggaaggtcacttttta

SEQ ID NO: 692828 - DNA, 22 bp, Artificial Sequence
  chemically synthesized
atgctaaattctggaaggtcac

SEQ ID NO: 692829 - DNA, 22 bp, Artificial Sequence
  chemically synthesized
tgatgctaaattctggaaggtc

SEQ ID NO: 692830 - DNA, 22 bp, Artificial Sequence
  chemically synthesized
taaaaagtgaccttccagaatt

SEQ ID NO: 692831 - DNA, 22 bp, Artificial Sequence
  chemically synthesized
aaaaagtgaccttccagaattt

SEQ ID NO: 692832 - DNA, 22 bp, Artificial Sequence
  chemically synthesized
aaaagtgaccttccagaattta

SEQ ID NO: 692833 - DNA, 22 bp, Artificial Sequence
  chemically synthesized
ccagaatttagcatcagaatct

SEQ ID NO: 692834 - DNA, 22 bp, Artificial Sequence
  chemically synthesized
cagaatttagcatcagaatctc

SEQ ID NO: 692835 - DNA, 22 bp, Artificial Sequence
  chemically synthesized
aaaccatgagtgtgaatgagat

SEQ ID NO: 692836 - DNA, 22 bp, Artificial Sequence
  chemically synthesized
agcatcagaatctcattcacac

SEQ ID NO: 692837 - DNA, 22 bp, Artificial Sequence
  chemically synthesized
gcatcagaatctcattcacact

SEQ ID NO: 692838 - DNA, 22 bp, Artificial Sequence
  chemically synthesized
gtaactgaaaccatgagtgtga

SEQ ID NO: 692839 - DNA, 22 bp, Artificial Sequence
  chemically synthesized
attcacactcatggtttcagtt

SEQ ID NO: 692840 - DNA, 22 bp, Artificial Sequence
  chemically synthesized
tatatagctagtaactgaaacc

SEQ ID NO: 692841 - DNA, 22 bp, Artificial Sequence
  chemically synthesized
gtatatagctagtaactgaaac

SEQ ID NO: 692842 - DNA, 22 bp, Artificial Sequence
  chemically synthesized
acactcatggtttcagttacta

SEQ ID NO: 692843 - DNA, 22 bp, Artificial Sequence
  chemically synthesized
cttgtatatagctagtaactga

SEQ ID NO: 692844 - DNA, 22 bp, Artificial Sequence
  chemically synthesized
atggtttcagttactagctata

SEQ ID NO: 692845 - DNA, 22 bp, Artificial Sequence
  chemically synthesized
catattacttgtatatagctag

SEQ ID NO: 692846 - DNA, 22 bp, Artificial Sequence
  chemically synthesized
acatattacttgtatatagcta

SEQ ID NO: 692847 - DNA, 22 bp, Artificial Sequence
  chemically synthesized
atttacatattacttgtatata

SEQ ID NO: 692848 - DNA, 22 bp, Artificial Sequence
  chemically synthesized
cagttactagctatatacaagt

SEQ ID NO: 692849 - DNA, 22 bp, Artificial Sequence
  chemically synthesized
agttactagctatatacaagta

SEQ ID NO: 692850 - DNA, 22 bp, Artificial Sequence
  chemically synthesized
ctagctatatacaagtaatatg

SEQ ID NO: 692851 - DNA, 22 bp, Artificial Sequence
  chemically synthesized
gagtcactaatttacatattac

SEQ ID NO: 692852 - DNA, 22 bp, Artificial Sequence
  chemically synthesized
gctatatacaagtaatatgtaa

SEQ ID NO: 692853 - DNA, 22 bp, Artificial Sequence
  chemically synthesized
tatacaagtaatatgtaaatta

SEQ ID NO: 692854 - DNA, 22 bp, Artificial Sequence
  chemically synthesized
ggttggagtcactaatttacat

SEQ ID NO: 692855 - DNA, 22 bp, Artificial Sequence
  chemically synthesized
gtgactccaacccagatgcgcc

SEQ ID NO: 692856 - DNA, 22 bp, Artificial Sequence
  chemically synthesized
aagaaagaaggaggcgcatctg

SEQ ID NO: 692857 - DNA, 22 bp, Artificial Sequence
  chemically synthesized
caacccagatgcgcctccttct

SEQ ID NO: 692858 - DNA, 22 bp, Artificial Sequence
  chemically synthesized
cttctttctttaggtgcacact

SEQ ID NO: 692859 - DNA, 22 bp, Artificial Sequence
  chemically synthesized
taaatagacagatagtgtgcac

SEQ ID NO: 692860 - DNA, 22 bp, Artificial Sequence
  chemically synthesized
ctttctttaggtgcacactatc

SEQ ID NO: 692861 - DNA, 22 bp, Artificial Sequence
  chemically synthesized
tttctttaggtgcacactatct

SEQ ID NO: 692862 - DNA, 22 bp, Artificial Sequence
  chemically synthesized
tctttaggtgcacactatctgt

SEQ ID NO: 692863 - DNA, 22 bp, Artificial Sequence
  chemically synthesized
ctttaggtgcacactatctgtc

SEQ ID NO: 692864 - DNA, 22 bp, Artificial Sequence
  chemically synthesized
tttaggtgcacactatctgtct

SEQ ID NO: 692865 - DNA, 22 bp, Artificial Sequence
  chemically synthesized
taggtgcacactatctgtctat

SEQ ID NO: 692866 - DNA, 22 bp, Artificial Sequence
  chemically synthesized
aggtgcacactatctgtctatt

SEQ ID NO: 692867 - DNA, 22 bp, Artificial Sequence
  chemically synthesized
ggtgcacactatctgtctattt

SEQ ID NO: 692868 - DNA, 22 bp, Artificial Sequence
  chemically synthesized
gtgacatccaaaaagcactgta

SEQ ID NO: 692869 - DNA, 22 bp, Artificial Sequence
  chemically synthesized
tctgtctatttacagtgctttt

SEQ ID NO: 692870 - DNA, 22 bp, Artificial Sequence
  chemically synthesized
tctatttacagtgctttttgga

SEQ ID NO: 692871 - DNA, 22 bp, Artificial Sequence
  chemically synthesized
aaatgattggtgacatccaaaa

SEQ ID NO: 692872 - DNA, 22 bp, Artificial Sequence
  chemically synthesized
tttacagtgctttttggatgtc

SEQ ID NO: 692873 - DNA, 22 bp, Artificial Sequence
  chemically synthesized
caaatgattggtgacatccaaa

SEQ ID NO: 692874 - DNA, 22 bp, Artificial Sequence
  chemically synthesized
acagtgctttttggatgtcacc

SEQ ID NO: 692875 - DNA, 22 bp, Artificial Sequence
  chemically synthesized
cagtgctttttggatgtcacca

SEQ ID NO: 692876 - DNA, 22 bp, Artificial Sequence
  chemically synthesized
gatttcaaatgattggtgacat

SEQ ID NO: 692877 - DNA, 22 bp, Artificial Sequence
  chemically synthesized
ggatttcaaatgattggtgaca

SEQ ID NO: 692878 - DNA, 22 bp, Artificial Sequence
  chemically synthesized
tttggatgtcaccaatcatttg

SEQ ID NO: 692879 - DNA, 22 bp, Artificial Sequence
  chemically synthesized
ttggatgtcaccaatcatttga

SEQ ID NO: 692880 - DNA, 22 bp, Artificial Sequence
  chemically synthesized
tggatgtcaccaatcatttgaa

SEQ ID NO: 692881 - DNA, 22 bp, Artificial Sequence
  chemically synthesized
ggatgtcaccaatcatttgaaa

SEQ ID NO: 692882 - DNA, 22 bp, Artificial Sequence
  chemically synthesized
taaatgtttggatttcaaatga

SEQ ID NO: 692883 - DNA, 22 bp, Artificial Sequence
  chemically synthesized
gatgtcaccaatcatttgaaat

SEQ ID NO: 692884 - DNA, 22 bp, Artificial Sequence
  chemically synthesized
attgtaaatgtttggatttcaa

SEQ ID NO: 692885 - DNA, 22 bp, Artificial Sequence
  chemically synthesized
gattgtaaatgtttggatttca

SEQ ID NO: 692886 - DNA, 22 bp, Artificial Sequence
  chemically synthesized
gggtggcaatttgattgtaaat

SEQ ID NO: 692887 - DNA, 22 bp, Artificial Sequence
  chemically synthesized
gaaatccaaacatttacaatca

SEQ ID NO: 692888 - DNA, 22 bp, Artificial Sequence
  chemically synthesized
agggtggcaatttgattgtaaa

SEQ ID NO: 692889 - DNA, 22 bp, Artificial Sequence
  chemically synthesized
aaatccaaacatttacaatcaa

SEQ ID NO: 692890 - DNA, 22 bp, Artificial Sequence
  chemically synthesized
acaatcaaattgccaccctaaa

SEQ ID NO: 692891 - DNA, 22 bp, Artificial Sequence
  chemically synthesized
caatcaaattgccaccctaaat

SEQ ID NO: 692892 - DNA, 22 bp, Artificial Sequence
  chemically synthesized
aagaaagatcagatttagggtg

SEQ ID NO: 692893 - DNA, 22 bp, Artificial Sequence
  chemically synthesized
taaagaaagatcagatttaggg

SEQ ID NO: 692894 - DNA, 22 bp, Artificial Sequence
  chemically synthesized
gggaactctaaagaaagatcag

SEQ ID NO: 692895 - DNA, 22 bp, Artificial Sequence
  chemically synthesized
ccaccctaaatctgatctttct

SEQ ID NO: 692896 - DNA, 22 bp, Artificial Sequence
  chemically synthesized
aatctgatctttctttagagtt

SEQ ID NO: 692897 - DNA, 22 bp, Artificial Sequence
  chemically synthesized
cagtgagttagggaactctaaa

SEQ ID NO: 692898 - DNA, 22 bp, Artificial Sequence
  chemically synthesized
acagtgagttagggaactctaa

SEQ ID NO: 692899 - DNA, 22 bp, Artificial Sequence
  chemically synthesized
tacagtgagttagggaactcta

SEQ ID NO: 692900 - DNA, 22 bp, Artificial Sequence
  chemically synthesized
tttacagtgagttagggaactc

SEQ ID NO: 692901 - DNA, 22 bp, Artificial Sequence
  chemically synthesized
atctttctttagagttccctaa

SEQ ID NO: 692902 - DNA, 22 bp, Artificial Sequence
  chemically synthesized
tctttagagttccctaactcac

SEQ ID NO: 692903 - DNA, 22 bp, Artificial Sequence
  chemically synthesized
ctttagagttccctaactcact

SEQ ID NO: 692904 - DNA, 22 bp, Artificial Sequence
  chemically synthesized
gtaattctttacagtgagttag

SEQ ID NO: 692905 - DNA, 22 bp, Artificial Sequence
  chemically synthesized
tttagagttccctaactcactg

SEQ ID NO: 692906 - DNA, 22 bp, Artificial Sequence
  chemically synthesized
tagagttccctaactcactgta

SEQ ID NO: 692907 - DNA, 22 bp, Artificial Sequence
  chemically synthesized
agagttccctaactcactgtaa

SEQ ID NO: 692908 - DNA, 22 bp, Artificial Sequence
  chemically synthesized
gagttccctaactcactgtaaa

SEQ ID NO: 692909 - DNA, 22 bp, Artificial Sequence
  chemically synthesized
cctaactcactgtaaagaatta

SEQ ID NO: 692910 - DNA, 22 bp, Artificial Sequence
  chemically synthesized
actcactgtaaagaattaccaa

SEQ ID NO: 692911 - DNA, 22 bp, Artificial Sequence
  chemically synthesized
ggcaatgcacagttggtaattc

SEQ ID NO: 692912 - DNA, 22 bp, Artificial Sequence
  chemically synthesized
tgggcaatgcacagttggtaat

SEQ ID NO: 692913 - DNA, 22 bp, Artificial Sequence
  chemically synthesized
ctgggcaatgcacagttggtaa

SEQ ID NO: 692914 - DNA, 22 bp, Artificial Sequence
  chemically synthesized
actgtaaagaattaccaactgt

SEQ ID NO: 692915 - DNA, 22 bp, Artificial Sequence
  chemically synthesized
taaagaattaccaactgtgcat

SEQ ID NO: 692916 - DNA, 22 bp, Artificial Sequence
  chemically synthesized
gatttctgggcaatgcacagtt

SEQ ID NO: 692917 - DNA, 22 bp, Artificial Sequence
  chemically synthesized
ccaactgtgcattgcccagaaa

SEQ ID NO: 692918 - DNA, 22 bp, Artificial Sequence
  chemically synthesized
tgcattgcccagaaatctaggt

SEQ ID NO: 692919 - DNA, 22 bp, Artificial Sequence
  chemically synthesized
cccagaaatctaggtgtgattc

SEQ ID NO: 692920 - DNA, 22 bp, Artificial Sequence
  chemically synthesized
ggtgtgattccttgacatgttt

SEQ ID NO: 692921 - DNA, 22 bp, Artificial Sequence
  chemically synthesized
cttgacatgttttgctttctct

SEQ ID NO: 692922 - DNA, 22 bp, Artificial Sequence
  chemically synthesized
gacatgttttgctttctctttg

SEQ ID NO: 692923 - DNA, 22 bp, Artificial Sequence
  chemically synthesized
acatgttttgctttctctttgc

SEQ ID NO: 692924 - DNA, 22 bp, Artificial Sequence
  chemically synthesized
tgctttctctttgcgcccttcc

SEQ ID NO: 692925 - DNA, 22 bp, Artificial Sequence
  chemically synthesized
gctttctctttgcgcccttcct

SEQ ID NO: 692926 - DNA, 22 bp, Artificial Sequence
  chemically synthesized
ctttctctttgcgcccttcctc

SEQ ID NO: 692927 - DNA, 22 bp, Artificial Sequence
  chemically synthesized
tctctttgcgcccttcctccta

SEQ ID NO: 692928 - DNA, 22 bp, Artificial Sequence
  chemically synthesized
ctctttgcgcccttcctcctat

SEQ ID NO: 692929 - DNA, 22 bp, Artificial Sequence
  chemically synthesized
aggatagatatcataggaggaa

SEQ ID NO: 692930 - DNA, 22 bp, Artificial Sequence
  chemically synthesized
tctttgcgcccttcctcctatg

SEQ ID NO: 692931 - DNA, 22 bp, Artificial Sequence
  chemically synthesized
gaggatagatatcataggagga

SEQ ID NO: 692932 - DNA, 22 bp, Artificial Sequence
  chemically synthesized
tttgcgcccttcctcctatgat

SEQ ID NO: 692933 - DNA, 22 bp, Artificial Sequence
  chemically synthesized
tgcgcccttcctcctatgatat

SEQ ID NO: 692934 - DNA, 22 bp, Artificial Sequence
  chemically synthesized
gcgcccttcctcctatgatatc

SEQ ID NO: 692935 - DNA, 22 bp, Artificial Sequence
  chemically synthesized
cgcccttcctcctatgatatct

SEQ ID NO: 692936 - DNA, 22 bp, Artificial Sequence
  chemically synthesized
agatttgaggatagatatcata

SEQ ID NO: 692937 - DNA, 22 bp, Artificial Sequence
  chemically synthesized
aagatttgaggatagatatcat

SEQ ID NO: 692938 - DNA, 22 bp, Artificial Sequence
  chemically synthesized
cctcctatgatatctatcctca

SEQ ID NO: 692939 - DNA, 22 bp, Artificial Sequence
  chemically synthesized
ctcctatgatatctatcctcaa

SEQ ID NO: 692940 - DNA, 22 bp, Artificial Sequence
  chemically synthesized
ctatgatatctatcctcaaatc

SEQ ID NO: 692941 - DNA, 22 bp, Artificial Sequence
  chemically synthesized
tgatatctatcctcaaatctta

SEQ ID NO: 692942 - DNA, 22 bp, Artificial Sequence
  chemically synthesized
ggaggtaaaaatccttaagatt

SEQ ID NO: 692943 - DNA, 22 bp, Artificial Sequence
  chemically synthesized
aggaggtaaaaatccttaagat

SEQ ID NO: 692944 - DNA, 22 bp, Artificial Sequence
  chemically synthesized
taggaggtaaaaatccttaaga

SEQ ID NO: 692945 - DNA, 22 bp, Artificial Sequence
  chemically synthesized
ttaggaggtaaaaatccttaag

SEQ ID NO: 692946 - DNA, 22 bp, Artificial Sequence
  chemically synthesized
tcctcaaatcttaaggattttt

SEQ ID NO: 692947 - DNA, 22 bp, Artificial Sequence
  chemically synthesized
aaatcttaaggatttttacctc

SEQ ID NO: 692948 - DNA, 22 bp, Artificial Sequence
  chemically synthesized
agagatttttaggaggtaaaaa

SEQ ID NO: 692949 - DNA, 22 bp, Artificial Sequence
  chemically synthesized
gagagatttttaggaggtaaaa

SEQ ID NO: 692950 - DNA, 22 bp, Artificial Sequence
  chemically synthesized
aaggatttttacctcctaaaaa

SEQ ID NO: 692951 - DNA, 22 bp, Artificial Sequence
  chemically synthesized
aggatttttacctcctaaaaat

SEQ ID NO: 692952 - DNA, 22 bp, Artificial Sequence
  chemically synthesized
ttacctcctaaaaatctctcaa

SEQ ID NO: 692953 - DNA, 22 bp, Artificial Sequence
  chemically synthesized
tacctcctaaaaatctctcaaa

SEQ ID NO: 692954 - DNA, 22 bp, Artificial Sequence
  chemically synthesized
acctcctaaaaatctctcaaat

SEQ ID NO: 692955 - DNA, 22 bp, Artificial Sequence
  chemically synthesized
cctcctaaaaatctctcaaatc

SEQ ID NO: 692956 - DNA, 22 bp, Artificial Sequence
  chemically synthesized
ctaaaaatctctcaaatctatg

SEQ ID NO: 692957 - DNA, 22 bp, Artificial Sequence
  chemically synthesized
aaaatctctcaaatctatgcct

SEQ ID NO: 692958 - DNA, 22 bp, Artificial Sequence
  chemically synthesized
gatatggtgagaaaggcataga

SEQ ID NO: 692959 - DNA, 22 bp, Artificial Sequence
  chemically synthesized
ggatatggtgagaaaggcatag

SEQ ID NO: 692960 - DNA, 22 bp, Artificial Sequence
  chemically synthesized
tcaaatctatgcctttctcacc

SEQ ID NO: 692961 - DNA, 22 bp, Artificial Sequence
  chemically synthesized
aaatctatgcctttctcaccat

SEQ ID NO: 692962 - DNA, 22 bp, Artificial Sequence
  chemically synthesized
tgcctttctcaccatatccaaa

SEQ ID NO: 692963 - DNA, 22 bp, Artificial Sequence
  chemically synthesized
gaccaagatgatgatagtttgg

SEQ ID NO: 692964 - DNA, 22 bp, Artificial Sequence
  chemically synthesized
tctcaccatatccaaactatca

SEQ ID NO: 692965 - DNA, 22 bp, Artificial Sequence
  chemically synthesized
ggaccaagatgatgatagtttg

SEQ ID NO: 692966 - DNA, 22 bp, Artificial Sequence
  chemically synthesized
ctcaccatatccaaactatcat

SEQ ID NO: 692967 - DNA, 22 bp, Artificial Sequence
  chemically synthesized
tcaccatatccaaactatcatc

SEQ ID NO: 692968 - DNA, 22 bp, Artificial Sequence
  chemically synthesized
accatatccaaactatcatcat

SEQ ID NO: 692969 - DNA, 22 bp, Artificial Sequence
  chemically synthesized
tcatcatcttggtccaaatccc

SEQ ID NO: 692970 - DNA, 22 bp, Artificial Sequence
  chemically synthesized
ggtccaaatcccatcttctctc

SEQ ID NO: 692971 - DNA, 22 bp, Artificial Sequence
  chemically synthesized
gtccaaatcccatcttctctca

SEQ ID NO: 692972 - DNA, 22 bp, Artificial Sequence
  chemically synthesized
atgaaagccaggtgagagaaga

SEQ ID NO: 692973 - DNA, 22 bp, Artificial Sequence
  chemically synthesized
ctgatgaaagccaggtgagaga

SEQ ID NO: 692974 - DNA, 22 bp, Artificial Sequence
  chemically synthesized
aaggttactgatgaaagccagg

SEQ ID NO: 692975 - DNA, 22 bp, Artificial Sequence
  chemically synthesized
gaaggttactgatgaaagccag

SEQ ID NO: 692976 - DNA, 22 bp, Artificial Sequence
  chemically synthesized
ctctcacctggctttcatcagt

SEQ ID NO: 692977 - DNA, 22 bp, Artificial Sequence
  chemically synthesized
tctcacctggctttcatcagta

SEQ ID NO: 692978 - DNA, 22 bp, Artificial Sequence
  chemically synthesized
tcacctggctttcatcagtaac

SEQ ID NO: 692979 - DNA, 22 bp, Artificial Sequence
  chemically synthesized
acctggctttcatcagtaacct

SEQ ID NO: 692980 - DNA, 22 bp, Artificial Sequence
  chemically synthesized
gctttcatcagtaaccttcaaa

SEQ ID NO: 692981 - DNA, 22 bp, Artificial Sequence
  chemically synthesized
tgaatacaaacgtttgaaggtt

SEQ ID NO: 692982 - DNA, 22 bp, Artificial Sequence
  chemically synthesized
tcatcagtaaccttcaaacgtt

SEQ ID NO: 692983 - DNA, 22 bp, Artificial Sequence
  chemically synthesized
catcagtaaccttcaaacgttt

SEQ ID NO: 692984 - DNA, 22 bp, Artificial Sequence
  chemically synthesized
atcagtaaccttcaaacgtttg

SEQ ID NO: 692985 - DNA, 22 bp, Artificial Sequence
  chemically synthesized
gatgaggagcctatgaatacaa

SEQ ID NO: 692986 - DNA, 22 bp, Artificial Sequence
  chemically synthesized
caaacgtttgtattcataggct

SEQ ID NO: 692987 - DNA, 22 bp, Artificial Sequence
  chemically synthesized
aaacgtttgtattcataggctc

SEQ ID NO: 692988 - DNA, 22 bp, Artificial Sequence
  chemically synthesized
gtattcataggctcctcatcca

SEQ ID NO: 692989 - DNA, 22 bp, Artificial Sequence
  chemically synthesized
atgcaaatgaattggatgagga

SEQ ID NO: 692990 - DNA, 22 bp, Artificial Sequence
  chemically synthesized
tattcataggctcctcatccaa

SEQ ID NO: 692991 - DNA, 22 bp, Artificial Sequence
  chemically synthesized
gctgatgcaaatgaattggatg

SEQ ID NO: 692992 - DNA, 22 bp, Artificial Sequence
  chemically synthesized
ataggctcctcatccaattcat

SEQ ID NO: 692993 - DNA, 22 bp, Artificial Sequence
  chemically synthesized
tggctgatgcaaatgaattgga

SEQ ID NO: 692994 - DNA, 22 bp, Artificial Sequence
  chemically synthesized
ctcatccaattcatttgcatca

SEQ ID NO: 692995 - DNA, 22 bp, Artificial Sequence
  chemically synthesized
atccaattcatttgcatcagcc

SEQ ID NO: 692996 - DNA, 22 bp, Artificial Sequence
  chemically synthesized
aaaaagtcctctggctgatgca

SEQ ID NO: 692997 - DNA, 22 bp, Artificial Sequence
  chemically synthesized
atttgcatcagccagaggactt

SEQ ID NO: 692998 - DNA, 22 bp, Artificial Sequence
  chemically synthesized
gcatcagccagaggactttttg

SEQ ID NO: 692999 - DNA, 22 bp, Artificial Sequence
  chemically synthesized
catcagccagaggactttttga

SEQ ID NO: 693000 - DNA, 22 bp, Artificial Sequence
  chemically synthesized
gaggaggtgaggagaaaactca

SEQ ID NO: 693001 - DNA, 22 bp, Artificial Sequence
  chemically synthesized
gggctggaggaggtgaggagaa

SEQ ID NO: 693002 - DNA, 22 bp, Artificial Sequence
  chemically synthesized
tttgagttttctcctcacctcc

SEQ ID NO: 693003 - DNA, 22 bp, Artificial Sequence
  chemically synthesized
ttgagttttctcctcacctcct

SEQ ID NO: 693004 - DNA, 22 bp, Artificial Sequence
  chemically synthesized
tgagttttctcctcacctcctc

SEQ ID NO: 693005 - DNA, 22 bp, Artificial Sequence
  chemically synthesized
gagttttctcctcacctcctcc

SEQ ID NO: 693006 - DNA, 22 bp, Artificial Sequence
  chemically synthesized
agttttctcctcacctcctcca

SEQ ID NO: 693007 - DNA, 22 bp, Artificial Sequence
  chemically synthesized
tctcctcacctcctccagccct

SEQ ID NO: 693008 - DNA, 22 bp, Artificial Sequence
  chemically synthesized
ctcctcacctcctccagcccta

SEQ ID NO: 693009 - DNA, 22 bp, Artificial Sequence
  chemically synthesized
tcctcacctcctccagccctag

SEQ ID NO: 693010 - DNA, 22 bp, Artificial Sequence
  chemically synthesized
ctcacctcctccagccctagtc

SEQ ID NO: 693011 - DNA, 22 bp, Artificial Sequence
  chemically synthesized
aaaggacagcatgactagggct

SEQ ID NO: 693012 - DNA, 22 bp, Artificial Sequence
  chemically synthesized
acctcctccagccctagtcatg

SEQ ID NO: 693013 - DNA, 22 bp, Artificial Sequence
  chemically synthesized
ctccagccctagtcatgctgtc

SEQ ID NO: 693014 - DNA, 22 bp, Artificial Sequence
  chemically synthesized
cagccctagtcatgctgtcctt

SEQ ID NO: 693015 - DNA, 22 bp, Artificial Sequence
  chemically synthesized
tcaatacaagggattaaaagga

SEQ ID NO: 693016 - DNA, 22 bp, Artificial Sequence
  chemically synthesized
gtcaatacaagggattaaaagg

SEQ ID NO: 693017 - DNA, 22 bp, Artificial Sequence
  chemically synthesized
gtcatgctgtccttttaatccc

SEQ ID NO: 693018 - DNA, 22 bp, Artificial Sequence
  chemically synthesized
tccttttaatcccttgtattga

SEQ ID NO: 693019 - DNA, 22 bp, Artificial Sequence
  chemically synthesized
gcaggagggaacttgtcaatac

SEQ ID NO: 693020 - DNA, 22 bp, Artificial Sequence
  chemically synthesized
agcaggagggaacttgtcaata

SEQ ID NO: 693021 - DNA, 22 bp, Artificial Sequence
  chemically synthesized
ttaatcccttgtattgacaagt

SEQ ID NO: 693022 - DNA, 22 bp, Artificial Sequence
  chemically synthesized
taatcccttgtattgacaagtt

SEQ ID NO: 693023 - DNA, 22 bp, Artificial Sequence
  chemically synthesized
aatcccttgtattgacaagttc

SEQ ID NO: 693024 - DNA, 22 bp, Artificial Sequence
  chemically synthesized
atcccttgtattgacaagttcc

SEQ ID NO: 693025 - DNA, 22 bp, Artificial Sequence
  chemically synthesized
gtattgacaagttccctcctgc

SEQ ID NO: 693026 - DNA, 22 bp, Artificial Sequence
  chemically synthesized
tattgacaagttccctcctgct

SEQ ID NO: 693027 - DNA, 22 bp, Artificial Sequence
  chemically synthesized
acaagttccctcctgctaaatt

SEQ ID NO: 693028 - DNA, 22 bp, Artificial Sequence
  chemically synthesized
cctcctgctaaattgccttgac

SEQ ID NO: 693029 - DNA, 22 bp, Artificial Sequence
  chemically synthesized
ctgctaaattgccttgacacat

SEQ ID NO: 693030 - DNA, 22 bp, Artificial Sequence
  chemically synthesized
ctaaattgccttgacacatgac

SEQ ID NO: 693031 - DNA, 22 bp, Artificial Sequence
  chemically synthesized
aattgccttgacacatgactct

SEQ ID NO: 693032 - DNA, 22 bp, Artificial Sequence
  chemically synthesized
acacaaaaagagagagagagtc

SEQ ID NO: 693033 - DNA, 22 bp, Artificial Sequence
  chemically synthesized
ccttgacacatgactctctctc

SEQ ID NO: 693034 - DNA, 22 bp, Artificial Sequence
  chemically synthesized
gacacatgactctctctctctt

SEQ ID NO: 693035 - DNA, 22 bp, Artificial Sequence
  chemically synthesized
acacatgactctctctctcttt

SEQ ID NO: 693036 - DNA, 22 bp, Artificial Sequence
  chemically synthesized
tctctctctttttgtgttaata

SEQ ID NO: 693037 - DNA, 22 bp, Artificial Sequence
  chemically synthesized
agaatgaatacatattaacaca

SEQ ID NO: 693038 - DNA, 22 bp, Artificial Sequence
  chemically synthesized
tctctctttttgtgttaatatg

SEQ ID NO: 693039 - DNA, 22 bp, Artificial Sequence
  chemically synthesized
tctctttttgtgttaatatgta

SEQ ID NO: 693040 - DNA, 22 bp, Artificial Sequence
  chemically synthesized
tctttttgtgttaatatgtatt

SEQ ID NO: 693041 - DNA, 22 bp, Artificial Sequence
  chemically synthesized
tttttgtgttaatatgtattca

SEQ ID NO: 693042 - DNA, 22 bp, Artificial Sequence
  chemically synthesized
tttgtgttaatatgtattcatt

SEQ ID NO: 693043 - DNA, 22 bp, Artificial Sequence
  chemically synthesized
ttgtgttaatatgtattcattc

SEQ ID NO: 693044 - DNA, 22 bp, Artificial Sequence
  chemically synthesized
tgtgttaatatgtattcattct

SEQ ID NO: 693045 - DNA, 22 bp, Artificial Sequence
  chemically synthesized
gtgttaatatgtattcattctt

SEQ ID NO: 693046 - DNA, 22 bp, Artificial Sequence
  chemically synthesized
tgttaatatgtattcattctta

SEQ ID NO: 693047 - DNA, 22 bp, Artificial Sequence
  chemically synthesized
atatgtattcattcttagtgtc

SEQ ID NO: 693048 - DNA, 22 bp, Artificial Sequence
  chemically synthesized
attcttagtgtcatttccatta

SEQ ID NO: 693049 - DNA, 22 bp, Artificial Sequence
  chemically synthesized
ttagtgtcatttccattatcta

SEQ ID NO: 693050 - DNA, 22 bp, Artificial Sequence
  chemically synthesized
agtgtcatttccattatctatt

SEQ ID NO: 693051 - DNA, 22 bp, Artificial Sequence
  chemically synthesized
gtgtcatttccattatctattc

SEQ ID NO: 693052 - DNA, 22 bp, Artificial Sequence
  chemically synthesized
caaagtatagccagggaataga

SEQ ID NO: 693053 - DNA, 22 bp, Artificial Sequence
  chemically synthesized
ccattatctattccctggctat

SEQ ID NO: 693054 - DNA, 22 bp, Artificial Sequence
  chemically synthesized
cattatctattccctggctata

SEQ ID NO: 693055 - DNA, 22 bp, Artificial Sequence
  chemically synthesized
tctattccctggctatactttg

SEQ ID NO: 693056 - DNA, 22 bp, Artificial Sequence
  chemically synthesized
ttccctggctatactttggagg

SEQ ID NO: 693057 - DNA, 22 bp, Artificial Sequence
  chemically synthesized
cctggctatactttggaggtat

SEQ ID NO: 693058 - DNA, 22 bp, Artificial Sequence
  chemically synthesized
gctatactttggaggtatcatg

SEQ ID NO: 693059 - DNA, 22 bp, Artificial Sequence
  chemically synthesized
gtgagcaacatgcatgatacct

SEQ ID NO: 693060 - DNA, 22 bp, Artificial Sequence
  chemically synthesized
ggtgagcaacatgcatgatacc

SEQ ID NO: 693061 - DNA, 22 bp, Artificial Sequence
  chemically synthesized
tactttggaggtatcatgcatg

SEQ ID NO: 693062 - DNA, 22 bp, Artificial Sequence
  chemically synthesized
tggaggtatcatgcatgttgct

SEQ ID NO: 693063 - DNA, 22 bp, Artificial Sequence
  chemically synthesized
ggaggtatcatgcatgttgctc

SEQ ID NO: 693064 - DNA, 22 bp, Artificial Sequence
  chemically synthesized
gaggtatcatgcatgttgctca

SEQ ID NO: 693065 - DNA, 22 bp, Artificial Sequence
  chemically synthesized
gatgtaaagggtacatttggtg

SEQ ID NO: 693066 - DNA, 22 bp, Artificial Sequence
  chemically synthesized
ctagatgtaaagggtacatttg

SEQ ID NO: 693067 - DNA, 22 bp, Artificial Sequence
  chemically synthesized
ctcaccaaatgtaccctttaca

SEQ ID NO: 693068 - DNA, 22 bp, Artificial Sequence
  chemically synthesized
accaaatgtaccctttacatct

SEQ ID NO: 693069 - DNA, 22 bp, Artificial Sequence
  chemically synthesized
tacatctagcaatgtatctggt

SEQ ID NO: 693070 - DNA, 22 bp, Artificial Sequence
  chemically synthesized
acatctagcaatgtatctggtg

SEQ ID NO: 693071 - DNA, 22 bp, Artificial Sequence
  chemically synthesized
tcagaatatgtgcaccagatac

SEQ ID NO: 693072 - DNA, 22 bp, Artificial Sequence
  chemically synthesized
catctagcaatgtatctggtgc

SEQ ID NO: 693073 - DNA, 22 bp, Artificial Sequence
  chemically synthesized
atcagaatatgtgcaccagata

SEQ ID NO: 693074 - DNA, 22 bp, Artificial Sequence
  chemically synthesized
tttatcagaatatgtgcaccag

SEQ ID NO: 693075 - DNA, 22 bp, Artificial Sequence
  chemically synthesized
atttatcagaatatgtgcacca

SEQ ID NO: 693076 - DNA, 22 bp, Artificial Sequence
  chemically synthesized
gcaatgtatctggtgcacatat

SEQ ID NO: 693077 - DNA, 22 bp, Artificial Sequence
  chemically synthesized
tcaatagatgtttatttatcag

SEQ ID NO: 693078 - DNA, 22 bp, Artificial Sequence
  chemically synthesized
gtgcacatattctgataaataa

SEQ ID NO: 693079 - DNA, 22 bp, Artificial Sequence
  chemically synthesized
gtcaatagatgtttatttatca

SEQ ID NO: 693080 - DNA, 22 bp, Artificial Sequence
  chemically synthesized
atttgtcaatagatgtttattt

SEQ ID NO: 693081 - DNA, 22 bp, Artificial Sequence
  chemically synthesized
attcatttgtcaatagatgttt

SEQ ID NO: 693082 - DNA, 22 bp, Artificial Sequence
  chemically synthesized
tgataaataaacatctattgac

SEQ ID NO: 693083 - DNA, 22 bp, Artificial Sequence
  chemically synthesized
attgattcatttgtcaatagat

SEQ ID NO: 693084 - DNA, 22 bp, Artificial Sequence
  chemically synthesized
ataaataaacatctattgacaa

SEQ ID NO: 693085 - DNA, 22 bp, Artificial Sequence
  chemically synthesized
attcattgattcatttgtcaat

SEQ ID NO: 693086 - DNA, 22 bp, Artificial Sequence
  chemically synthesized
attcattcattgattcatttgt

SEQ ID NO: 693087 - DNA, 22 bp, Artificial Sequence
  chemically synthesized
actgattcattcattgattcat

SEQ ID NO: 693088 - DNA, 22 bp, Artificial Sequence
  chemically synthesized
gactgattcattcattgattca

SEQ ID NO: 693089 - DNA, 22 bp, Artificial Sequence
  chemically synthesized
ttgactgattcattcattgatt

SEQ ID NO: 693090 - DNA, 22 bp, Artificial Sequence
  chemically synthesized
ttgacaaatgaatcaatgaatg

SEQ ID NO: 693091 - DNA, 22 bp, Artificial Sequence
  chemically synthesized
acaaatgaatcaatgaatgaat

SEQ ID NO: 693092 - DNA, 22 bp, Artificial Sequence
  chemically synthesized
aagatatactcttgactgattc

SEQ ID NO: 693093 - DNA, 22 bp, Artificial Sequence
  chemically synthesized
tctaaagatatactcttgactg

SEQ ID NO: 693094 - DNA, 22 bp, Artificial Sequence
  chemically synthesized
atctaaagatatactcttgact

SEQ ID NO: 693095 - DNA, 22 bp, Artificial Sequence
  chemically synthesized
agaaaaacatttatctaaagat

SEQ ID NO: 693096 - DNA, 22 bp, Artificial Sequence
  chemically synthesized
cctaagaaaaacatttatctaa

SEQ ID NO: 693097 - DNA, 22 bp, Artificial Sequence
  chemically synthesized
acctaagaaaaacatttatcta

SEQ ID NO: 693098 - DNA, 22 bp, Artificial Sequence
  chemically synthesized
cttacctaagaaaaacatttat

SEQ ID NO: 693099 - DNA, 22 bp, Artificial Sequence
  chemically synthesized
tccttacctaagaaaaacattt

SEQ ID NO: 693100 - DNA, 22 bp, Artificial Sequence
  chemically synthesized
attctccttacctaagaaaaac

SEQ ID NO: 693101 - DNA, 22 bp, Artificial Sequence
  chemically synthesized
gattctccttacctaagaaaaa

SEQ ID NO: 693102 - DNA, 22 bp, Artificial Sequence
  chemically synthesized
tagataaatgtttttcttaggt

SEQ ID NO: 693103 - DNA, 22 bp, Artificial Sequence
  chemically synthesized
agataaatgtttttcttaggta

SEQ ID NO: 693104 - DNA, 22 bp, Artificial Sequence
  chemically synthesized
gataaatgtttttcttaggtaa

SEQ ID NO: 693105 - DNA, 22 bp, Artificial Sequence
  chemically synthesized
aatggtttgattctccttacct

SEQ ID NO: 693106 - DNA, 22 bp, Artificial Sequence
  chemically synthesized
aaatggtttgattctccttacc

SEQ ID NO: 693107 - DNA, 22 bp, Artificial Sequence
  chemically synthesized
ttcttaggtaaggagaatcaaa

SEQ ID NO: 693108 - DNA, 22 bp, Artificial Sequence
  chemically synthesized
tcttaggtaaggagaatcaaac

SEQ ID NO: 693109 - DNA, 22 bp, Artificial Sequence
  chemically synthesized
cttaggtaaggagaatcaaacc

SEQ ID NO: 693110 - DNA, 22 bp, Artificial Sequence
  chemically synthesized
atgcacttaaatggtttgattc

SEQ ID NO: 693111 - DNA, 22 bp, Artificial Sequence
  chemically synthesized
ttaggtaaggagaatcaaacca

SEQ ID NO: 693112 - DNA, 22 bp, Artificial Sequence
  chemically synthesized
taatgcacttaaatggtttgat

SEQ ID NO: 693113 - DNA, 22 bp, Artificial Sequence
  chemically synthesized
aggtaaggagaatcaaaccatt

SEQ ID NO: 693114 - DNA, 22 bp, Artificial Sequence
  chemically synthesized
ggtaaggagaatcaaaccattt

SEQ ID NO: 693115 - DNA, 22 bp, Artificial Sequence
  chemically synthesized
attctaatgcacttaaatggtt

SEQ ID NO: 693116 - DNA, 22 bp, Artificial Sequence
  chemically synthesized
aattctaatgcacttaaatggt

SEQ ID NO: 693117 - DNA, 22 bp, Artificial Sequence
  chemically synthesized
taattctaatgcacttaaatgg

SEQ ID NO: 693118 - DNA, 22 bp, Artificial Sequence
  chemically synthesized
ttaattctaatgcacttaaatg

SEQ ID NO: 693119 - DNA, 22 bp, Artificial Sequence
  chemically synthesized
tttaattctaatgcacttaaat

SEQ ID NO: 693120 - DNA, 22 bp, Artificial Sequence
  chemically synthesized
aaatgctttttaattctaatgc

SEQ ID NO: 693121 - DNA, 22 bp, Artificial Sequence
  chemically synthesized
aagtgcattagaattaaaaagc

SEQ ID NO: 693122 - DNA, 22 bp, Artificial Sequence
  chemically synthesized
agtgcattagaattaaaaagca

SEQ ID NO: 693123 - DNA, 22 bp, Artificial Sequence
  chemically synthesized
acaaatgctaaaatgcttttta

SEQ ID NO: 693124 - DNA, 22 bp, Artificial Sequence
  chemically synthesized
tcacaaatgctaaaatgctttt

SEQ ID NO: 693125 - DNA, 22 bp, Artificial Sequence
  chemically synthesized
ctcacaaatgctaaaatgcttt

SEQ ID NO: 693126 - DNA, 22 bp, Artificial Sequence
  chemically synthesized
gaattaaaaagcattttagcat

SEQ ID NO: 693127 - DNA, 22 bp, Artificial Sequence
  chemically synthesized
agaatttctcacaaatgctaaa

SEQ ID NO: 693128 - DNA, 22 bp, Artificial Sequence
  chemically synthesized
cagaatttctcacaaatgctaa

SEQ ID NO: 693129 - DNA, 22 bp, Artificial Sequence
  chemically synthesized
tcagaatttctcacaaatgcta

SEQ ID NO: 693130 - DNA, 22 bp, Artificial Sequence
  chemically synthesized
aaaagcattttagcatttgtga

SEQ ID NO: 693131 - DNA, 22 bp, Artificial Sequence
  chemically synthesized
ctttcagaatttctcacaaatg

SEQ ID NO: 693132 - DNA, 22 bp, Artificial Sequence
  chemically synthesized
ctgctttcagaatttctcacaa

SEQ ID NO: 693133 - DNA, 22 bp, Artificial Sequence
  chemically synthesized
ttactgctttcagaatttctca

SEQ ID NO: 693134 - DNA, 22 bp, Artificial Sequence
  chemically synthesized
gttactgctttcagaatttctc

SEQ ID NO: 693135 - DNA, 22 bp, Artificial Sequence
  chemically synthesized
tagcatttgtgagaaattctga

SEQ ID NO: 693136 - DNA, 22 bp, Artificial Sequence
  chemically synthesized
agcatttgtgagaaattctgaa

SEQ ID NO: 693137 - DNA, 22 bp, Artificial Sequence
  chemically synthesized
cttgttactgctttcagaattt

SEQ ID NO: 693138 - DNA, 22 bp, Artificial Sequence
  chemically synthesized
gcatttgtgagaaattctgaaa

SEQ ID NO: 693139 - DNA, 22 bp, Artificial Sequence
  chemically synthesized
ctacttgttactgctttcagaa

SEQ ID NO: 693140 - DNA, 22 bp, Artificial Sequence
  chemically synthesized
gtgagaaattctgaaagcagta

SEQ ID NO: 693141 - DNA, 22 bp, Artificial Sequence
  chemically synthesized
tgagaaattctgaaagcagtaa

SEQ ID NO: 693142 - DNA, 22 bp, Artificial Sequence
  chemically synthesized
tgaaagcagtaacaagtagcag

SEQ ID NO: 693143 - DNA, 22 bp, Artificial Sequence
  chemically synthesized
taaaagtagaaactgctacttg

SEQ ID NO: 693144 - DNA, 22 bp, Artificial Sequence
  chemically synthesized
gtaaaagtagaaactgctactt

SEQ ID NO: 693145 - DNA, 22 bp, Artificial Sequence
  chemically synthesized
aaagcagtaacaagtagcagtt

SEQ ID NO: 693146 - DNA, 22 bp, Artificial Sequence
  chemically synthesized
tatttgtaaaagtagaaactgc

SEQ ID NO: 693147 - DNA, 22 bp, Artificial Sequence
  chemically synthesized
agttatatttgtaaaagtagaa

SEQ ID NO: 693148 - DNA, 22 bp, Artificial Sequence
  chemically synthesized
acctcagttatatttgtaaaag

SEQ ID NO: 693149 - DNA, 22 bp, Artificial Sequence
  chemically synthesized
aacctcagttatatttgtaaaa

SEQ ID NO: 693150 - DNA, 22 bp, Artificial Sequence
  chemically synthesized
tttaacctcagttatatttgta

SEQ ID NO: 693151 - DNA, 22 bp, Artificial Sequence
  chemically synthesized
gtttaacctcagttatatttgt

SEQ ID NO: 693152 - DNA, 22 bp, Artificial Sequence
  chemically synthesized
tgtttaacctcagttatatttg

SEQ ID NO: 693153 - DNA, 22 bp, Artificial Sequence
  chemically synthesized
ctacttttacaaatataactga

SEQ ID NO: 693154 - DNA, 22 bp, Artificial Sequence
  chemically synthesized
tacttttacaaatataactgag

SEQ ID NO: 693155 - DNA, 22 bp, Artificial Sequence
  chemically synthesized
cttttacaaatataactgaggt

SEQ ID NO: 693156 - DNA, 22 bp, Artificial Sequence
  chemically synthesized
ttacaaatataactgaggttaa

SEQ ID NO: 693157 - DNA, 22 bp, Artificial Sequence
  chemically synthesized
ggtatattttgtttaacctcag

SEQ ID NO: 693158 - DNA, 22 bp, Artificial Sequence
  chemically synthesized
tacaaatataactgaggttaaa

SEQ ID NO: 693159 - DNA, 22 bp, Artificial Sequence
  chemically synthesized
acaaatataactgaggttaaac

SEQ ID NO: 693160 - DNA, 22 bp, Artificial Sequence
  chemically synthesized
caaatataactgaggttaaaca

SEQ ID NO: 693161 - DNA, 22 bp, Artificial Sequence
  chemically synthesized
ctgggtatattttgtttaacct

SEQ ID NO: 693162 - DNA, 22 bp, Artificial Sequence
  chemically synthesized
actgggtatattttgtttaacc

SEQ ID NO: 693163 - DNA, 22 bp, Artificial Sequence
  chemically synthesized
tactgggtatattttgtttaac

SEQ ID NO: 693164 - DNA, 22 bp, Artificial Sequence
  chemically synthesized
ttactgggtatattttgtttaa

SEQ ID NO: 693165 - DNA, 22 bp, Artificial Sequence
  chemically synthesized
tttactgggtatattttgttta

SEQ ID NO: 693166 - DNA, 22 bp, Artificial Sequence
  chemically synthesized
ttttttactgggtatattttgt

SEQ ID NO: 693167 - DNA, 22 bp, Artificial Sequence
  chemically synthesized
aggttaaacaaaatatacccag

SEQ ID NO: 693168 - DNA, 22 bp, Artificial Sequence
  chemically synthesized
aacaaaatatacccagtaaaaa

SEQ ID NO: 693169 - DNA, 22 bp, Artificial Sequence
  chemically synthesized
gtaagaagttattttttactgg

SEQ ID NO: 693170 - DNA, 22 bp, Artificial Sequence
  chemically synthesized
gccaagttagtaagaagttatt

SEQ ID NO: 693171 - DNA, 22 bp, Artificial Sequence
  chemically synthesized
acccataattagccaagttagt

SEQ ID NO: 693172 - DNA, 22 bp, Artificial Sequence
  chemically synthesized
cacccataattagccaagttag

SEQ ID NO: 693173 - DNA, 22 bp, Artificial Sequence
  chemically synthesized
cttactaacttggctaattatg

SEQ ID NO: 693174 - DNA, 22 bp, Artificial Sequence
  chemically synthesized
ttactaacttggctaattatgg

SEQ ID NO: 693175 - DNA, 22 bp, Artificial Sequence
  chemically synthesized
actaacttggctaattatgggt

SEQ ID NO: 693176 - DNA, 22 bp, Artificial Sequence
  chemically synthesized
ctaacttggctaattatgggtg

SEQ ID NO: 693177 - DNA, 22 bp, Artificial Sequence
  chemically synthesized
acttggctaattatgggtgaaa

SEQ ID NO: 693178 - DNA, 22 bp, Artificial Sequence
  chemically synthesized
ggctaattatgggtgaaattgg

SEQ ID NO: 693179 - DNA, 22 bp, Artificial Sequence
  chemically synthesized
gctaattatgggtgaaattggt

SEQ ID NO: 693180 - DNA, 22 bp, Artificial Sequence
  chemically synthesized
tcacagcataaatgaccaattt

SEQ ID NO: 693181 - DNA, 22 bp, Artificial Sequence
  chemically synthesized
attatgggtgaaattggtcatt

SEQ ID NO: 693182 - DNA, 22 bp, Artificial Sequence
  chemically synthesized
tgggtgaaattggtcatttatg

SEQ ID NO: 693183 - DNA, 22 bp, Artificial Sequence
  chemically synthesized
atcattgtcacagcataaatga

SEQ ID NO: 693184 - DNA, 22 bp, Artificial Sequence
  chemically synthesized
tgatcattgtcacagcataaat

SEQ ID NO: 693185 - DNA, 22 bp, Artificial Sequence
  chemically synthesized
gtcatttatgctgtgacaatga

SEQ ID NO: 693186 - DNA, 22 bp, Artificial Sequence
  chemically synthesized
caagggtgtctctgatcattgt

SEQ ID NO: 693187 - DNA, 22 bp, Artificial Sequence
  chemically synthesized
ccaagggtgtctctgatcattg

SEQ ID NO: 693188 - DNA, 22 bp, Artificial Sequence
  chemically synthesized
atgctgtgacaatgatcagaga

SEQ ID NO: 693189 - DNA, 22 bp, Artificial Sequence
  chemically synthesized
tgctgtgacaatgatcagagac

SEQ ID NO: 693190 - DNA, 22 bp, Artificial Sequence
  chemically synthesized
tgacaatgatcagagacaccct

SEQ ID NO: 693191 - DNA, 22 bp, Artificial Sequence
  chemically synthesized
aagaagcatagtttccaagggt

SEQ ID NO: 693192 - DNA, 22 bp, Artificial Sequence
  chemically synthesized
aaagaagcatagtttccaaggg

SEQ ID NO: 693193 - DNA, 22 bp, Artificial Sequence
  chemically synthesized
cttaaagaagcatagtttccaa

SEQ ID NO: 693194 - DNA, 22 bp, Artificial Sequence
  chemically synthesized
ttccttaaagaagcatagtttc

SEQ ID NO: 693195 - DNA, 22 bp, Artificial Sequence
  chemically synthesized
ggaaactatgcttctttaagga

SEQ ID NO: 693196 - DNA, 22 bp, Artificial Sequence
  chemically synthesized
gaaactatgcttctttaaggaa

SEQ ID NO: 693197 - DNA, 22 bp, Artificial Sequence
  chemically synthesized
taaaatggcatcattattcctt

SEQ ID NO: 693198 - DNA, 22 bp, Artificial Sequence
  chemically synthesized
tgcttctttaaggaataatgat

SEQ ID NO: 693199 - DNA, 22 bp, Artificial Sequence
  chemically synthesized
ctttaaggaataatgatgccat

SEQ ID NO: 693200 - DNA, 22 bp, Artificial Sequence
  chemically synthesized
tttaaggaataatgatgccatt

SEQ ID NO: 693201 - DNA, 22 bp, Artificial Sequence
  chemically synthesized
taaggaataatgatgccatttt

SEQ ID NO: 693202 - DNA, 22 bp, Artificial Sequence
  chemically synthesized
aaggaataatgatgccatttta

SEQ ID NO: 693203 - DNA, 22 bp, Artificial Sequence
  chemically synthesized
aggaataatgatgccattttat

SEQ ID NO: 693204 - DNA, 22 bp, Artificial Sequence
  chemically synthesized
aaatgaaagcataaaactataa

SEQ ID NO: 693205 - DNA, 22 bp, Artificial Sequence
  chemically synthesized
aaatgctaaaatgaaagcataa

SEQ ID NO: 693206 - DNA, 22 bp, Artificial Sequence
  chemically synthesized
tcaaatgctaaaatgaaagcat

SEQ ID NO: 693207 - DNA, 22 bp, Artificial Sequence
  chemically synthesized
tatagttttatgctttcatttt

SEQ ID NO: 693208 - DNA, 22 bp, Artificial Sequence
  chemically synthesized
ttctcaaatgctaaaatgaaag

SEQ ID NO: 693209 - DNA, 22 bp, Artificial Sequence
  chemically synthesized
atagttttatgctttcatttta

SEQ ID NO: 693210 - DNA, 22 bp, Artificial Sequence
  chemically synthesized
tagttttatgctttcattttag

SEQ ID NO: 693211 - DNA, 22 bp, Artificial Sequence
  chemically synthesized
tgaactgttctcaaatgctaaa

SEQ ID NO: 693212 - DNA, 22 bp, Artificial Sequence
  chemically synthesized
tatgctttcattttagcatttg

SEQ ID NO: 693213 - DNA, 22 bp, Artificial Sequence
  chemically synthesized
gtgaactgttctcaaatgctaa

SEQ ID NO: 693214 - DNA, 22 bp, Artificial Sequence
  chemically synthesized
atgctttcattttagcatttga

SEQ ID NO: 693215 - DNA, 22 bp, Artificial Sequence
  chemically synthesized
tgctttcattttagcatttgag

SEQ ID NO: 693216 - DNA, 22 bp, Artificial Sequence
  chemically synthesized
tcattttagcatttgagaacag

SEQ ID NO: 693217 - DNA, 22 bp, Artificial Sequence
  chemically synthesized
cattttagcatttgagaacagt

SEQ ID NO: 693218 - DNA, 22 bp, Artificial Sequence
  chemically synthesized
gtgtgtttgtgaactgttctca

SEQ ID NO: 693219 - DNA, 22 bp, Artificial Sequence
  chemically synthesized
attttagcatttgagaacagtt

SEQ ID NO: 693220 - DNA, 22 bp, Artificial Sequence
  chemically synthesized
attagtgtgtttgtgaactgtt

SEQ ID NO: 693221 - DNA, 22 bp, Artificial Sequence
  chemically synthesized
tagcatttgagaacagttcaca

SEQ ID NO: 693222 - DNA, 22 bp, Artificial Sequence
  chemically synthesized
agcatttgagaacagttcacaa

SEQ ID NO: 693223 - DNA, 22 bp, Artificial Sequence
  chemically synthesized
gcatttgagaacagttcacaaa

SEQ ID NO: 693224 - DNA, 22 bp, Artificial Sequence
  chemically synthesized
gagaacagttcacaaacacact

SEQ ID NO: 693225 - DNA, 22 bp, Artificial Sequence
  chemically synthesized
cagagattaattagtgtgtttg

SEQ ID NO: 693226 - DNA, 22 bp, Artificial Sequence
  chemically synthesized
agaacagttcacaaacacacta

SEQ ID NO: 693227 - DNA, 22 bp, Artificial Sequence
  chemically synthesized
acaaacacactaattaatctct

SEQ ID NO: 693228 - DNA, 22 bp, Artificial Sequence
  chemically synthesized
attaatctctgcaatgatattg

SEQ ID NO: 693229 - DNA, 22 bp, Artificial Sequence
  chemically synthesized
taatataggagtacaatatcat

SEQ ID NO: 693230 - DNA, 22 bp, Artificial Sequence
  chemically synthesized
atctctgcaatgatattgtact

SEQ ID NO: 693231 - DNA, 22 bp, Artificial Sequence
  chemically synthesized
gcctgtaatataggagtacaat

SEQ ID NO: 693232 - DNA, 22 bp, Artificial Sequence
  chemically synthesized
tgcaatgatattgtactcctat

SEQ ID NO: 693233 - DNA, 22 bp, Artificial Sequence
  chemically synthesized
caatgatattgtactcctatat

SEQ ID NO: 693234 - DNA, 22 bp, Artificial Sequence
  chemically synthesized
aattggcctgtaatataggagt

SEQ ID NO: 693235 - DNA, 22 bp, Artificial Sequence
  chemically synthesized
gaattggcctgtaatataggag

SEQ ID NO: 693236 - DNA, 22 bp, Artificial Sequence
  chemically synthesized
ttgaattggcctgtaatatagg

SEQ ID NO: 693237 - DNA, 22 bp, Artificial Sequence
  chemically synthesized
cttgaattggcctgtaatatag

SEQ ID NO: 693238 - DNA, 22 bp, Artificial Sequence
  chemically synthesized
tcttgaattggcctgtaatata

SEQ ID NO: 693239 - DNA, 22 bp, Artificial Sequence
  chemically synthesized
ctttcttgaattggcctgtaat

SEQ ID NO: 693240 - DNA, 22 bp, Artificial Sequence
  chemically synthesized
actttcttgaattggcctgtaa

SEQ ID NO: 693241 - DNA, 22 bp, Artificial Sequence
  chemically synthesized
tactcctatattacaggccaat

SEQ ID NO: 693242 - DNA, 22 bp, Artificial Sequence
  chemically synthesized
ctatattacaggccaattcaag

SEQ ID NO: 693243 - DNA, 22 bp, Artificial Sequence
  chemically synthesized
tgtgatttactttcttgaattg

SEQ ID NO: 693244 - DNA, 22 bp, Artificial Sequence
  chemically synthesized
tattacaggccaattcaagaaa

SEQ ID NO: 693245 - DNA, 22 bp, Artificial Sequence
  chemically synthesized
caggccaattcaagaaagtaaa

SEQ ID NO: 693246 - DNA, 22 bp, Artificial Sequence
  chemically synthesized
aaatctgtgtgatttactttct

SEQ ID NO: 693247 - DNA, 22 bp, Artificial Sequence
  chemically synthesized
gaaatctgtgtgatttactttc

SEQ ID NO: 693248 - DNA, 22 bp, Artificial Sequence
  chemically synthesized
tgaaatctgtgtgatttacttt

SEQ ID NO: 693249 - DNA, 22 bp, Artificial Sequence
  chemically synthesized
ttgaaatctgtgtgatttactt

SEQ ID NO: 693250 - DNA, 22 bp, Artificial Sequence
  chemically synthesized
tgcttttgaaatctgtgtgatt

SEQ ID NO: 693251 - DNA, 22 bp, Artificial Sequence
  chemically synthesized
aagaaagtaaatcacacagatt

SEQ ID NO: 693252 - DNA, 22 bp, Artificial Sequence
  chemically synthesized
ctatgcttttgaaatctgtgtg

SEQ ID NO: 693253 - DNA, 22 bp, Artificial Sequence
  chemically synthesized
cctatgcttttgaaatctgtgt

SEQ ID NO: 693254 - DNA, 22 bp, Artificial Sequence
  chemically synthesized
tcctatgcttttgaaatctgtg

SEQ ID NO: 693255 - DNA, 22 bp, Artificial Sequence
  chemically synthesized
ttcctatgcttttgaaatctgt

SEQ ID NO: 693256 - DNA, 22 bp, Artificial Sequence
  chemically synthesized
aaaatttttcctatgcttttga

SEQ ID NO: 693257 - DNA, 22 bp, Artificial Sequence
  chemically synthesized
ggcatctaaaaatttttcctat

SEQ ID NO: 693258 - DNA, 22 bp, Artificial Sequence
  chemically synthesized
aggcatctaaaaatttttccta

SEQ ID NO: 693259 - DNA, 22 bp, Artificial Sequence
  chemically synthesized
ttaggcatctaaaaatttttcc

SEQ ID NO: 693260 - DNA, 22 bp, Artificial Sequence
  chemically synthesized
caaaagcataggaaaaattttt

SEQ ID NO: 693261 - DNA, 22 bp, Artificial Sequence
  chemically synthesized
aaaagcataggaaaaattttta

SEQ ID NO: 693262 - DNA, 22 bp, Artificial Sequence
  chemically synthesized
ttagatgcctaagaatatactc

SEQ ID NO: 693263 - DNA, 22 bp, Artificial Sequence
  chemically synthesized
tagatgcctaagaatatactct

SEQ ID NO: 693264 - DNA, 22 bp, Artificial Sequence
  chemically synthesized
agatgcctaagaatatactctt

SEQ ID NO: 693265 - DNA, 22 bp, Artificial Sequence
  chemically synthesized
gatgcctaagaatatactcttt

SEQ ID NO: 693266 - DNA, 22 bp, Artificial Sequence
  chemically synthesized
agaatatactctttacctcctg

SEQ ID NO: 693267 - DNA, 22 bp, Artificial Sequence
  chemically synthesized
taaagacatatataacaaggta

SEQ ID NO: 693268 - DNA, 22 bp, Artificial Sequence
  chemically synthesized
tttacctcctgtaccttgttat

SEQ ID NO: 693269 - DNA, 22 bp, Artificial Sequence
  chemically synthesized
tacctcctgtaccttgttatat

SEQ ID NO: 693270 - DNA, 22 bp, Artificial Sequence
  chemically synthesized
acctcctgtaccttgttatata

SEQ ID NO: 693271 - DNA, 22 bp, Artificial Sequence
  chemically synthesized
cctcctgtaccttgttatatat

SEQ ID NO: 693272 - DNA, 22 bp, Artificial Sequence
  chemically synthesized
agactataaagacatatataac

SEQ ID NO: 693273 - DNA, 22 bp, Artificial Sequence
  chemically synthesized
ctgtaccttgttatatatgtct

SEQ ID NO: 693274 - DNA, 22 bp, Artificial Sequence
  chemically synthesized
tctaagactataaagacatata

SEQ ID NO: 693275 - DNA, 22 bp, Artificial Sequence
  chemically synthesized
taccttgttatatatgtcttta

SEQ ID NO: 693276 - DNA, 22 bp, Artificial Sequence
  chemically synthesized
gttatatatgtctttatagtct

SEQ ID NO: 693277 - DNA, 22 bp, Artificial Sequence
  chemically synthesized
aagatctatctaagactataaa

SEQ ID NO: 693278 - DNA, 22 bp, Artificial Sequence
  chemically synthesized
ttatatatgtctttatagtctt

SEQ ID NO: 693279 - DNA, 22 bp, Artificial Sequence
  chemically synthesized
ttaaagatctatctaagactat

SEQ ID NO: 693280 - DNA, 22 bp, Artificial Sequence
  chemically synthesized
tatatgtctttatagtcttaga

SEQ ID NO: 693281 - DNA, 22 bp, Artificial Sequence
  chemically synthesized
attaaagatctatctaagacta

SEQ ID NO: 693282 - DNA, 22 bp, Artificial Sequence
  chemically synthesized
tattaaagatctatctaagact

SEQ ID NO: 693283 - DNA, 22 bp, Artificial Sequence
  chemically synthesized
tttattaaagatctatctaaga

SEQ ID NO: 693284 - DNA, 22 bp, Artificial Sequence
  chemically synthesized
aattctttattaaagatctatc

SEQ ID NO: 693285 - DNA, 22 bp, Artificial Sequence
  chemically synthesized
caattctttattaaagatctat

SEQ ID NO: 693286 - DNA, 22 bp, Artificial Sequence
  chemically synthesized
tatagtcttagatagatcttta

SEQ ID NO: 693287 - DNA, 22 bp, Artificial Sequence
  chemically synthesized
atagtcttagatagatctttaa

SEQ ID NO: 693288 - DNA, 22 bp, Artificial Sequence
  chemically synthesized
tagtcttagatagatctttaat

SEQ ID NO: 693289 - DNA, 22 bp, Artificial Sequence
  chemically synthesized
tttcaattctttattaaagatc

SEQ ID NO: 693290 - DNA, 22 bp, Artificial Sequence
  chemically synthesized
tgtttcaattctttattaaaga

SEQ ID NO: 693291 - DNA, 22 bp, Artificial Sequence
  chemically synthesized
ctgtttcaattctttattaaag

SEQ ID NO: 693292 - DNA, 22 bp, Artificial Sequence
  chemically synthesized
tttctgtttcaattctttatta

SEQ ID NO: 693293 - DNA, 22 bp, Artificial Sequence
  chemically synthesized
agatagatctttaataaagaat

SEQ ID NO: 693294 - DNA, 22 bp, Artificial Sequence
  chemically synthesized
gatagatctttaataaagaatt

SEQ ID NO: 693295 - DNA, 22 bp, Artificial Sequence
  chemically synthesized
tgtttctgtttcaattctttat

SEQ ID NO: 693296 - DNA, 22 bp, Artificial Sequence
  chemically synthesized
taataaagaattgaaacagaaa

SEQ ID NO: 693297 - DNA, 22 bp, Artificial Sequence
  chemically synthesized
aataaagaattgaaacagaaac

SEQ ID NO: 693298 - DNA, 22 bp, Artificial Sequence
  chemically synthesized
ataaagaattgaaacagaaaca

SEQ ID NO: 693299 - DNA, 22 bp, Artificial Sequence
  chemically synthesized
aaataaggatctctgtttctgt

SEQ ID NO: 693300 - DNA, 22 bp, Artificial Sequence
  chemically synthesized
aaacagaaacagagatccttat

SEQ ID NO: 693301 - DNA, 22 bp, Artificial Sequence
  chemically synthesized
cataaaggagctaaaataagga

SEQ ID NO: 693302 - DNA, 22 bp, Artificial Sequence
  chemically synthesized
acataaaggagctaaaataagg

SEQ ID NO: 693303 - DNA, 22 bp, Artificial Sequence
  chemically synthesized
attttagctcctttatgtaaat

SEQ ID NO: 693304 - DNA, 22 bp, Artificial Sequence
  chemically synthesized
ttttagctcctttatgtaaatc

SEQ ID NO: 693305 - DNA, 22 bp, Artificial Sequence
  chemically synthesized
tagctcctttatgtaaatcata

SEQ ID NO: 693306 - DNA, 22 bp, Artificial Sequence
  chemically synthesized
agctcctttatgtaaatcatat

SEQ ID NO: 693307 - DNA, 22 bp, Artificial Sequence
  chemically synthesized
gctcctttatgtaaatcatatg

SEQ ID NO: 693308 - DNA, 22 bp, Artificial Sequence
  chemically synthesized
agtcataaatatgcatatgatt

SEQ ID NO: 693309 - DNA, 22 bp, Artificial Sequence
  chemically synthesized
ctttatgtaaatcatatgcata

SEQ ID NO: 693310 - DNA, 22 bp, Artificial Sequence
  chemically synthesized
tatgtaaatcatatgcatattt

SEQ ID NO: 693311 - DNA, 22 bp, Artificial Sequence
  chemically synthesized
atgtaaatcatatgcatattta

SEQ ID NO: 693312 - DNA, 22 bp, Artificial Sequence
  chemically synthesized
tgtaaatcatatgcatatttat

SEQ ID NO: 693313 - DNA, 22 bp, Artificial Sequence
  chemically synthesized
acaaaataaaggaactaagtca

SEQ ID NO: 693314 - DNA, 22 bp, Artificial Sequence
  chemically synthesized
atgacttagttcctttattttg

SEQ ID NO: 693315 - DNA, 22 bp, Artificial Sequence
  chemically synthesized
tgacttagttcctttattttgt

SEQ ID NO: 693316 - DNA, 22 bp, Artificial Sequence
  chemically synthesized
agttcctttattttgtgagcat

SEQ ID NO: 693317 - DNA, 22 bp, Artificial Sequence
  chemically synthesized
gttcctttattttgtgagcatt

SEQ ID NO: 693318 - DNA, 22 bp, Artificial Sequence
  chemically synthesized
ctttattttgtgagcattttat

SEQ ID NO: 693319 - DNA, 22 bp, Artificial Sequence
  chemically synthesized
tatatatatatatataaaatgc

SEQ ID NO: 693320 - DNA, 22 bp, Artificial Sequence
  chemically synthesized
tattttgtgagcattttatata

SEQ ID NO: 693321 - DNA, 22 bp, Artificial Sequence
  chemically synthesized
attttgtgagcattttatatat

SEQ ID NO: 693322 - DNA, 22 bp, Artificial Sequence
  chemically synthesized
ttttgtgagcattttatatata

SEQ ID NO: 693323 - DNA, 22 bp, Artificial Sequence
  chemically synthesized
tattatatatatatatatataa

SEQ ID NO: 693324 - DNA, 22 bp, Artificial Sequence
  chemically synthesized
atattatatatatatatatata

SEQ ID NO: 693325 - DNA, 22 bp, Artificial Sequence
  chemically synthesized
tgtgagcattttatatatatat

SEQ ID NO: 693326 - DNA, 22 bp, Artificial Sequence
  chemically synthesized
tatattatatatatatatatat

SEQ ID NO: 693327 - DNA, 22 bp, Artificial Sequence
  chemically synthesized
gtgagcattttatatatatata

SEQ ID NO: 693328 - DNA, 22 bp, Artificial Sequence
  chemically synthesized
tgagcattttatatatatatat

SEQ ID NO: 693329 - DNA, 22 bp, Artificial Sequence
  chemically synthesized
tattttatattatatatatata

SEQ ID NO: 693330 - DNA, 22 bp, Artificial Sequence
  chemically synthesized
atattttatattatatatatat

SEQ ID NO: 693331 - DNA, 22 bp, Artificial Sequence
  chemically synthesized
tatattttatattatatatata

SEQ ID NO: 693332 - DNA, 22 bp, Artificial Sequence
  chemically synthesized
tatatatatatatatataatat

SEQ ID NO: 693333 - DNA, 22 bp, Artificial Sequence
  chemically synthesized
atatatatatatatataatata

SEQ ID NO: 693334 - DNA, 22 bp, Artificial Sequence
  chemically synthesized
tatatatatatatataatataa

SEQ ID NO: 693335 - DNA, 22 bp, Artificial Sequence
  chemically synthesized
taaattttatattttatattat

SEQ ID NO: 693336 - DNA, 22 bp, Artificial Sequence
  chemically synthesized
ttgtaaattttatattttatat

SEQ ID NO: 693337 - DNA, 22 bp, Artificial Sequence
  chemically synthesized
taccagctattgtaaattttat

SEQ ID NO: 693338 - DNA, 22 bp, Artificial Sequence
  chemically synthesized
ttgtaccagctattgtaaattt

SEQ ID NO: 693339 - DNA, 22 bp, Artificial Sequence
  chemically synthesized
ggggctattgtaccagctattg

SEQ ID NO: 693340 - DNA, 22 bp, Artificial Sequence
  chemically synthesized
ttgggggctattgtaccagcta

SEQ ID NO: 693341 - DNA, 22 bp, Artificial Sequence
  chemically synthesized
attgggggctattgtaccagct

SEQ ID NO: 693342 - DNA, 22 bp, Artificial Sequence
  chemically synthesized
tatttattgggggctattgtac

SEQ ID NO: 693343 - DNA, 22 bp, Artificial Sequence
  chemically synthesized
acaatagctggtacaatagccc

SEQ ID NO: 693344 - DNA, 22 bp, Artificial Sequence
  chemically synthesized
caatagctggtacaatagcccc

SEQ ID NO: 693345 - DNA, 22 bp, Artificial Sequence
  chemically synthesized
agcaaactatatttattggggg

SEQ ID NO: 693346 - DNA, 22 bp, Artificial Sequence
  chemically synthesized
gtacaatagcccccaataaata

SEQ ID NO: 693347 - DNA, 22 bp, Artificial Sequence
  chemically synthesized
attaagcaaactatatttattg

SEQ ID NO: 693348 - DNA, 22 bp, Artificial Sequence
  chemically synthesized
cattaattaagcaaactatatt

SEQ ID NO: 693349 - DNA, 22 bp, Artificial Sequence
  chemically synthesized
attacattaattaagcaaacta

SEQ ID NO: 693350 - DNA, 22 bp, Artificial Sequence
  chemically synthesized
atgaattcattacattaattaa

SEQ ID NO: 693351 - DNA, 22 bp, Artificial Sequence
  chemically synthesized
gcttaattaatgtaatgaattc

SEQ ID NO: 693352 - DNA, 22 bp, Artificial Sequence
  chemically synthesized
cttaattaatgtaatgaattca

SEQ ID NO: 693353 - DNA, 22 bp, Artificial Sequence
  chemically synthesized
aattaatgtaatgaattcatta

SEQ ID NO: 693354 - DNA, 22 bp, Artificial Sequence
  chemically synthesized
attaatgtaatgaattcattaa

SEQ ID NO: 693355 - DNA, 22 bp, Artificial Sequence
  chemically synthesized
caaaaggcaaatgtattaatga

SEQ ID NO: 693356 - DNA, 22 bp, Artificial Sequence
  chemically synthesized
atgtaatgaattcattaataca

SEQ ID NO: 693357 - DNA, 22 bp, Artificial Sequence
  chemically synthesized
gcaaaaggcaaatgtattaatg

SEQ ID NO: 693358 - DNA, 22 bp, Artificial Sequence
  chemically synthesized
tgcaaaaggcaaatgtattaat

SEQ ID NO: 693359 - DNA, 22 bp, Artificial Sequence
  chemically synthesized
ttttgcaaaaggcaaatgtatt

SEQ ID NO: 693360 - DNA, 22 bp, Artificial Sequence
  chemically synthesized
tgttttgcaaaaggcaaatgta

SEQ ID NO: 693361 - DNA, 22 bp, Artificial Sequence
  chemically synthesized
ctgttttgcaaaaggcaaatgt

SEQ ID NO: 693362 - DNA, 22 bp, Artificial Sequence
  chemically synthesized
gtttctgttttgcaaaaggcaa

SEQ ID NO: 693363 - DNA, 22 bp, Artificial Sequence
  chemically synthesized
attaatacatttgccttttgca

SEQ ID NO: 693364 - DNA, 22 bp, Artificial Sequence
  chemically synthesized
atacatttgccttttgcaaaac

SEQ ID NO: 693365 - DNA, 22 bp, Artificial Sequence
  chemically synthesized
gccttttgcaaaacagaaacta

SEQ ID NO: 693366 - DNA, 22 bp, Artificial Sequence
  chemically synthesized
acaatatcgagctagtttctgt

SEQ ID NO: 693367 - DNA, 22 bp, Artificial Sequence
  chemically synthesized
ccttttgcaaaacagaaactag

SEQ ID NO: 693368 - DNA, 22 bp, Artificial Sequence
  chemically synthesized
cacaatatcgagctagtttctg

SEQ ID NO: 693369 - DNA, 22 bp, Artificial Sequence
  chemically synthesized
ttgcaaaacagaaactagctcg

SEQ ID NO: 693370 - DNA, 22 bp, Artificial Sequence
  chemically synthesized
tgcaaaacagaaactagctcga

SEQ ID NO: 693371 - DNA, 22 bp, Artificial Sequence
  chemically synthesized
gcaaaacagaaactagctcgat

SEQ ID NO: 693372 - DNA, 22 bp, Artificial Sequence
  chemically synthesized
ggacttcacaatatcgagctag

SEQ ID NO: 693373 - DNA, 22 bp, Artificial Sequence
  chemically synthesized
caaaacagaaactagctcgata

SEQ ID NO: 693374 - DNA, 22 bp, Artificial Sequence
  chemically synthesized
gctcgatattgtgaagtcccag

SEQ ID NO: 693375 - DNA, 22 bp, Artificial Sequence
  chemically synthesized
gatattgtgaagtcccagggtt

SEQ ID NO: 693376 - DNA, 22 bp, Artificial Sequence
  chemically synthesized
ggatgagggaggaaaccctggg

SEQ ID NO: 693377 - DNA, 22 bp, Artificial Sequence
  chemically synthesized
tgaagtcccagggtttcctccc

SEQ ID NO: 693378 - DNA, 22 bp, Artificial Sequence
  chemically synthesized
cctccctcatcccaatatgatg

SEQ ID NO: 693379 - DNA, 22 bp, Artificial Sequence
  chemically synthesized
ctccctcatcccaatatgatgg

SEQ ID NO: 693380 - DNA, 22 bp, Artificial Sequence
  chemically synthesized
cctcatcccaatatgatggcat

SEQ ID NO: 693381 - DNA, 22 bp, Artificial Sequence
  chemically synthesized
gagtcatggggtgggatgccat

SEQ ID NO: 693382 - DNA, 22 bp, Artificial Sequence
  chemically synthesized
atcccaatatgatggcatccca

SEQ ID NO: 693383 - DNA, 22 bp, Artificial Sequence
  chemically synthesized
agagtcatggggtgggatgcca

SEQ ID NO: 693384 - DNA, 22 bp, Artificial Sequence
  chemically synthesized
ttagagtcatggggtgggatgc

SEQ ID NO: 693385 - DNA, 22 bp, Artificial Sequence
  chemically synthesized
cttagagtcatggggtgggatg

SEQ ID NO: 693386 - DNA, 22 bp, Artificial Sequence
  chemically synthesized
taatcatcaatatatacatcct

SEQ ID NO: 693387 - DNA, 22 bp, Artificial Sequence
  chemically synthesized
gtaatcatcaatatatacatcc

SEQ ID NO: 693388 - DNA, 22 bp, Artificial Sequence
  chemically synthesized
tgtaatcatcaatatatacatc

SEQ ID NO: 693389 - DNA, 22 bp, Artificial Sequence
  chemically synthesized
ttgtaatcatcaatatatacat

SEQ ID NO: 693390 - DNA, 22 bp, Artificial Sequence
  chemically synthesized
taagaaggatgtatatattgat

SEQ ID NO: 693391 - DNA, 22 bp, Artificial Sequence
  chemically synthesized
acttttgtaatcatcaatatat

SEQ ID NO: 693392 - DNA, 22 bp, Artificial Sequence
  chemically synthesized
aacttttgtaatcatcaatata

SEQ ID NO: 693393 - DNA, 22 bp, Artificial Sequence
  chemically synthesized
agaaggatgtatatattgatga

SEQ ID NO: 693394 - DNA, 22 bp, Artificial Sequence
  chemically synthesized
taacttttgtaatcatcaatat

SEQ ID NO: 693395 - DNA, 22 bp, Artificial Sequence
  chemically synthesized
atgattacaaaagttaaagctc

SEQ ID NO: 693396 - DNA, 22 bp, Artificial Sequence
  chemically synthesized
caaaagttaaagctcttgtcct

SEQ ID NO: 693397 - DNA, 22 bp, Artificial Sequence
  chemically synthesized
ggggaagacgtcaggacaagag

SEQ ID NO: 693398 - DNA, 22 bp, Artificial Sequence
  chemically synthesized
aagctaggggaagacgtcagga

SEQ ID NO: 693399 - DNA, 22 bp, Artificial Sequence
  chemically synthesized
aagctcttgtcctgacgtcttc

SEQ ID NO: 693400 - DNA, 22 bp, Artificial Sequence
  chemically synthesized
gatctgaagctaggggaagacg

SEQ ID NO: 693401 - DNA, 22 bp, Artificial Sequence
  chemically synthesized
ggatctgaagctaggggaagac

SEQ ID NO: 693402 - DNA, 22 bp, Artificial Sequence
  chemically synthesized
ttgtcctgacgtcttcccctag

SEQ ID NO: 693403 - DNA, 22 bp, Artificial Sequence
  chemically synthesized
gtcctgacgtcttcccctagct

SEQ ID NO: 693404 - DNA, 22 bp, Artificial Sequence
  chemically synthesized
tcctgacgtcttcccctagctt

SEQ ID NO: 693405 - DNA, 22 bp, Artificial Sequence
  chemically synthesized
aaaatttggatctgaagctagg

SEQ ID NO: 693406 - DNA, 22 bp, Artificial Sequence
  chemically synthesized
acgtcttcccctagcttcagat

SEQ ID NO: 693407 - DNA, 22 bp, Artificial Sequence
  chemically synthesized
tgcagttcaaaatttggatctg

SEQ ID NO: 693408 - DNA, 22 bp, Artificial Sequence
  chemically synthesized
cccctagcttcagatccaaatt

SEQ ID NO: 693409 - DNA, 22 bp, Artificial Sequence
  chemically synthesized
ccctagcttcagatccaaattt

SEQ ID NO: 693410 - DNA, 22 bp, Artificial Sequence
  chemically synthesized
gctgtgcagttcaaaatttgga

SEQ ID NO: 693411 - DNA, 22 bp, Artificial Sequence
  chemically synthesized
gcttcagatccaaattttgaac

SEQ ID NO: 693412 - DNA, 22 bp, Artificial Sequence
  chemically synthesized
cagatccaaattttgaactgca

SEQ ID NO: 693413 - DNA, 22 bp, Artificial Sequence
  chemically synthesized
ggtatctagctgtgcagttcaa

SEQ ID NO: 693414 - DNA, 22 bp, Artificial Sequence
  chemically synthesized
agatccaaattttgaactgcac

SEQ ID NO: 693415 - DNA, 22 bp, Artificial Sequence
  chemically synthesized
ttgggtatctagctgtgcagtt

SEQ ID NO: 693416 - DNA, 22 bp, Artificial Sequence
  chemically synthesized
attgggtatctagctgtgcagt

SEQ ID NO: 693417 - DNA, 22 bp, Artificial Sequence
  chemically synthesized
aggtacttattgggtatctagc

SEQ ID NO: 693418 - DNA, 22 bp, Artificial Sequence
  chemically synthesized
tgaactgcacagctagataccc

SEQ ID NO: 693419 - DNA, 22 bp, Artificial Sequence
  chemically synthesized
gaggtacttattgggtatctag

SEQ ID NO: 693420 - DNA, 22 bp, Artificial Sequence
  chemically synthesized
gaactgcacagctagataccca

SEQ ID NO: 693421 - DNA, 22 bp, Artificial Sequence
  chemically synthesized
aactgcacagctagatacccaa

SEQ ID NO: 693422 - DNA, 22 bp, Artificial Sequence
  chemically synthesized
agtttgaggtacttattgggta

SEQ ID NO: 693423 - DNA, 22 bp, Artificial Sequence
  chemically synthesized
aagtttgaggtacttattgggt

SEQ ID NO: 693424 - DNA, 22 bp, Artificial Sequence
  chemically synthesized
cacagctagatacccaataagt

SEQ ID NO: 693425 - DNA, 22 bp, Artificial Sequence
  chemically synthesized
gatacccaataagtacctcaaa

SEQ ID NO: 693426 - DNA, 22 bp, Artificial Sequence
  chemically synthesized
gacatgtttaagtttgaggtac

SEQ ID NO: 693427 - DNA, 22 bp, Artificial Sequence
  chemically synthesized
agacatgtttaagtttgaggta

SEQ ID NO: 693428 - DNA, 22 bp, Artificial Sequence
  chemically synthesized
ggtttagacatgtttaagtttg

SEQ ID NO: 693429 - DNA, 22 bp, Artificial Sequence
  chemically synthesized
cctgggtttagacatgtttaag

SEQ ID NO: 693430 - DNA, 22 bp, Artificial Sequence
  chemically synthesized
gagctgcctgggtttagacatg

SEQ ID NO: 693431 - DNA, 22 bp, Artificial Sequence
  chemically synthesized
aaacttaaacatgtctaaaccc

SEQ ID NO: 693432 - DNA, 22 bp, Artificial Sequence
  chemically synthesized
aaacatgtctaaacccaggcag

SEQ ID NO: 693433 - DNA, 22 bp, Artificial Sequence
  chemically synthesized
aacatgtctaaacccaggcagc

SEQ ID NO: 693434 - DNA, 22 bp, Artificial Sequence
  chemically synthesized
cgtgtagaaaccctagagctgc

SEQ ID NO: 693435 - DNA, 22 bp, Artificial Sequence
  chemically synthesized
ccgtgtagaaaccctagagctg

SEQ ID NO: 693436 - DNA, 22 bp, Artificial Sequence
  chemically synthesized
ttccgtgtagaaaccctagagc

SEQ ID NO: 693437 - DNA, 22 bp, Artificial Sequence
  chemically synthesized
aacccaggcagctctagggttt

SEQ ID NO: 693438 - DNA, 22 bp, Artificial Sequence
  chemically synthesized
ctcttccgtgtagaaaccctag

SEQ ID NO: 693439 - DNA, 22 bp, Artificial Sequence
  chemically synthesized
gatagctactcttccgtgtaga

SEQ ID NO: 693440 - DNA, 22 bp, Artificial Sequence
  chemically synthesized
tagggtttctacacggaagagt

SEQ ID NO: 693441 - DNA, 22 bp, Artificial Sequence
  chemically synthesized
gggtttctacacggaagagtag

SEQ ID NO: 693442 - DNA, 22 bp, Artificial Sequence
  chemically synthesized
tcaactagatagctactcttcc

SEQ ID NO: 693443 - DNA, 22 bp, Artificial Sequence
  chemically synthesized
gtcaactagatagctactcttc

SEQ ID NO: 693444 - DNA, 22 bp, Artificial Sequence
  chemically synthesized
cttgtcaactagatagctactc

SEQ ID NO: 693445 - DNA, 22 bp, Artificial Sequence
  chemically synthesized
ctacacggaagagtagctatct

SEQ ID NO: 693446 - DNA, 22 bp, Artificial Sequence
  chemically synthesized
tacacggaagagtagctatcta

SEQ ID NO: 693447 - DNA, 22 bp, Artificial Sequence
  chemically synthesized
cacggaagagtagctatctagt

SEQ ID NO: 693448 - DNA, 22 bp, Artificial Sequence
  chemically synthesized
aacaaaaaaaaattgcttgtca

SEQ ID NO: 693449 - DNA, 22 bp, Artificial Sequence
  chemically synthesized
atctaaacaaaaaaaaattgct

SEQ ID NO: 693450 - DNA, 22 bp, Artificial Sequence
  chemically synthesized
tctagttgacaagcaatttttt

SEQ ID NO: 693451 - DNA, 22 bp, Artificial Sequence
  chemically synthesized
aatctaaacaaaaaaaaattgc

SEQ ID NO: 693452 - DNA, 22 bp, Artificial Sequence
  chemically synthesized
gttgacaagcaatttttttttg

SEQ ID NO: 693453 - DNA, 22 bp, Artificial Sequence
  chemically synthesized
acaagcaatttttttttgttta

SEQ ID NO: 693454 - DNA, 22 bp, Artificial Sequence
  chemically synthesized
ttttttgtttagattaaatgtt

SEQ ID NO: 693455 - DNA, 22 bp, Artificial Sequence
  chemically synthesized
tttttgtttagattaaatgttt

SEQ ID NO: 693456 - DNA, 22 bp, Artificial Sequence
  chemically synthesized
ttttgtttagattaaatgtttt

SEQ ID NO: 693457 - DNA, 22 bp, Artificial Sequence
  chemically synthesized
tttgtttagattaaatgttttc

SEQ ID NO: 693458 - DNA, 22 bp, Artificial Sequence
  chemically synthesized
cagcaacaacaggaaaacattt

SEQ ID NO: 693459 - DNA, 22 bp, Artificial Sequence
  chemically synthesized
ttgtttagattaaatgttttcc

SEQ ID NO: 693460 - DNA, 22 bp, Artificial Sequence
  chemically synthesized
ccagcaacaacaggaaaacatt

SEQ ID NO: 693461 - DNA, 22 bp, Artificial Sequence
  chemically synthesized
tgtttagattaaatgttttcct

SEQ ID NO: 693462 - DNA, 22 bp, Artificial Sequence
  chemically synthesized
gtttagattaaatgttttcctg

SEQ ID NO: 693463 - DNA, 22 bp, Artificial Sequence
  chemically synthesized
tttagattaaatgttttcctgt

SEQ ID NO: 693464 - DNA, 22 bp, Artificial Sequence
  chemically synthesized
cttccagcaacaacaggaaaac

SEQ ID NO: 693465 - DNA, 22 bp, Artificial Sequence
  chemically synthesized
gcttccagcaacaacaggaaaa

SEQ ID NO: 693466 - DNA, 22 bp, Artificial Sequence
  chemically synthesized
tgcttccagcaacaacaggaaa

SEQ ID NO: 693467 - DNA, 22 bp, Artificial Sequence
  chemically synthesized
agattaaatgttttcctgttgt

SEQ ID NO: 693468 - DNA, 22 bp, Artificial Sequence
  chemically synthesized
gattaaatgttttcctgttgtt

SEQ ID NO: 693469 - DNA, 22 bp, Artificial Sequence
  chemically synthesized
aatgttttcctgttgttgctgg

SEQ ID NO: 693470 - DNA, 22 bp, Artificial Sequence
  chemically synthesized
gccatactttgcttccagcaac

SEQ ID NO: 693471 - DNA, 22 bp, Artificial Sequence
  chemically synthesized
tcctgttgttgctggaagcaaa

SEQ ID NO: 693472 - DNA, 22 bp, Artificial Sequence
  chemically synthesized
cctgttgttgctggaagcaaag

SEQ ID NO: 693473 - DNA, 22 bp, Artificial Sequence
  chemically synthesized
ctgttgttgctggaagcaaagt

SEQ ID NO: 693474 - DNA, 22 bp, Artificial Sequence
  chemically synthesized
cccattagccatactttgcttc

SEQ ID NO: 693475 - DNA, 22 bp, Artificial Sequence
  chemically synthesized
ttgttgctggaagcaaagtatg

SEQ ID NO: 693476 - DNA, 22 bp, Artificial Sequence
  chemically synthesized
ttgctggaagcaaagtatggct

SEQ ID NO: 693477 - DNA, 22 bp, Artificial Sequence
  chemically synthesized
ctggaagcaaagtatggctaat

SEQ ID NO: 693478 - DNA, 22 bp, Artificial Sequence
  chemically synthesized
gaagcaaagtatggctaatggg

SEQ ID NO: 693479 - DNA, 22 bp, Artificial Sequence
  chemically synthesized
caataatacctgcccattagcc

SEQ ID NO: 693480 - DNA, 22 bp, Artificial Sequence
  chemically synthesized
tgctccaataatacctgcccat

SEQ ID NO: 693481 - DNA, 22 bp, Artificial Sequence
  chemically synthesized
tgtgctccaataatacctgccc

SEQ ID NO: 693482 - DNA, 22 bp, Artificial Sequence
  chemically synthesized
ctgtgctccaataatacctgcc

SEQ ID NO: 693483 - DNA, 22 bp, Artificial Sequence
  chemically synthesized
aagagcttctgtgctccaataa

SEQ ID NO: 693484 - DNA, 22 bp, Artificial Sequence
  chemically synthesized
atgggcaggtattattggagca

SEQ ID NO: 693485 - DNA, 22 bp, Artificial Sequence
  chemically synthesized
gaagagcttctgtgctccaata

SEQ ID NO: 693486 - DNA, 22 bp, Artificial Sequence
  chemically synthesized
aagggtggcttgaagagcttct

SEQ ID NO: 693487 - DNA, 22 bp, Artificial Sequence
  chemically synthesized
aaagggtggcttgaagagcttc

SEQ ID NO: 693488 - DNA, 22 bp, Artificial Sequence
  chemically synthesized
ttggagcacagaagctcttcaa

SEQ ID NO: 693489 - DNA, 22 bp, Artificial Sequence
  chemically synthesized
gagcacagaagctcttcaagcc

SEQ ID NO: 693490 - DNA, 22 bp, Artificial Sequence
  chemically synthesized
aagagatgtcttaaagggtggc

SEQ ID NO: 693491 - DNA, 22 bp, Artificial Sequence
  chemically synthesized
aaagagatgtcttaaagggtgg

SEQ ID NO: 693492 - DNA, 22 bp, Artificial Sequence
  chemically synthesized
taaagagatgtcttaaagggtg

SEQ ID NO: 693493 - DNA, 22 bp, Artificial Sequence
  chemically synthesized
ttaaagagatgtcttaaagggt

SEQ ID NO: 693494 - DNA, 22 bp, Artificial Sequence
  chemically synthesized
tttaaagagatgtcttaaaggg

SEQ ID NO: 693495 - DNA, 22 bp, Artificial Sequence
  chemically synthesized
ttcaagccaccctttaagacat

SEQ ID NO: 693496 - DNA, 22 bp, Artificial Sequence
  chemically synthesized
caagccaccctttaagacatct

SEQ ID NO: 693497 - DNA, 22 bp, Artificial Sequence
  chemically synthesized
aagccaccctttaagacatctc

SEQ ID NO: 693498 - DNA, 22 bp, Artificial Sequence
  chemically synthesized
taagacatctctttaaaaaatt

SEQ ID NO: 693499 - DNA, 22 bp, Artificial Sequence
  chemically synthesized
aagacatctctttaaaaaatta

SEQ ID NO: 693500 - DNA, 22 bp, Artificial Sequence
  chemically synthesized
agacatctctttaaaaaattat

SEQ ID NO: 693501 - DNA, 22 bp, Artificial Sequence
  chemically synthesized
caaataaatgaaataaataatt

SEQ ID NO: 693502 - DNA, 22 bp, Artificial Sequence
  chemically synthesized
tttaaaaaattatttatttcat

SEQ ID NO: 693503 - DNA, 22 bp, Artificial Sequence
  chemically synthesized
taaaaaattatttatttcattt

SEQ ID NO: 693504 - DNA, 22 bp, Artificial Sequence
  chemically synthesized
tcaattacaaataaatgaaata

SEQ ID NO: 693505 - DNA, 22 bp, Artificial Sequence
  chemically synthesized
aaaaaattatttatttcattta

SEQ ID NO: 693506 - DNA, 22 bp, Artificial Sequence
  chemically synthesized
gtcaattacaaataaatgaaat

SEQ ID NO: 693507 - DNA, 22 bp, Artificial Sequence
  chemically synthesized
aaaaattatttatttcatttat

SEQ ID NO: 693508 - DNA, 22 bp, Artificial Sequence
  chemically synthesized
tttgtcaattacaaataaatga

SEQ ID NO: 693509 - DNA, 22 bp, Artificial Sequence
  chemically synthesized
ttatttgtcaattacaaataaa

SEQ ID NO: 693510 - DNA, 22 bp, Artificial Sequence
  chemically synthesized
tttatttcatttatttgtaatt

SEQ ID NO: 693511 - DNA, 22 bp, Artificial Sequence
  chemically synthesized
atttcatttatttgtaattgac

SEQ ID NO: 693512 - DNA, 22 bp, Artificial Sequence
  chemically synthesized
tttcatttatttgtaattgaca

SEQ ID NO: 693513 - DNA, 22 bp, Artificial Sequence
  chemically synthesized
catttatttgtaattgacaaat

SEQ ID NO: 693514 - DNA, 22 bp, Artificial Sequence
  chemically synthesized
atttatttgtaattgacaaata

SEQ ID NO: 693515 - DNA, 22 bp, Artificial Sequence
  chemically synthesized
atttgtaattgacaaataatag

SEQ ID NO: 693516 - DNA, 22 bp, Artificial Sequence
  chemically synthesized
tttgtaattgacaaataatagt

SEQ ID NO: 693517 - DNA, 22 bp, Artificial Sequence
  chemically synthesized
gtaattgacaaataatagtttg

SEQ ID NO: 693518 - DNA, 22 bp, Artificial Sequence
  chemically synthesized
taattgacaaataatagtttgt

SEQ ID NO: 693519 - DNA, 22 bp, Artificial Sequence
  chemically synthesized
acaaataatagtttgtatattt

SEQ ID NO: 693520 - DNA, 22 bp, Artificial Sequence
  chemically synthesized
gtatatttatgggatacgatgt

SEQ ID NO: 693521 - DNA, 22 bp, Artificial Sequence
  chemically synthesized
tatatttatgggatacgatgtg

SEQ ID NO: 693522 - DNA, 22 bp, Artificial Sequence
  chemically synthesized
atgggatacgatgtgatgtttt

SEQ ID NO: 693523 - DNA, 22 bp, Artificial Sequence
  chemically synthesized
tgggatacgatgtgatgttttg

SEQ ID NO: 693524 - DNA, 22 bp, Artificial Sequence
  chemically synthesized
caatatataccaagatcaaaac

SEQ ID NO: 693525 - DNA, 22 bp, Artificial Sequence
  chemically synthesized
tacaatatataccaagatcaaa

SEQ ID NO: 693526 - DNA, 22 bp, Artificial Sequence
  chemically synthesized
ctacaatatataccaagatcaa

SEQ ID NO: 693527 - DNA, 22 bp, Artificial Sequence
  chemically synthesized
tctacaatatataccaagatca

SEQ ID NO: 693528 - DNA, 22 bp, Artificial Sequence
  chemically synthesized
tttctacaatatataccaagat

SEQ ID NO: 693529 - DNA, 22 bp, Artificial Sequence
  chemically synthesized
atcaactctttctacaatatat

SEQ ID NO: 693530 - DNA, 22 bp, Artificial Sequence
  chemically synthesized
gatcaactctttctacaatata

SEQ ID NO: 693531 - DNA, 22 bp, Artificial Sequence
  chemically synthesized
tgatcttggtatatattgtaga

SEQ ID NO: 693532 - DNA, 22 bp, Artificial Sequence
  chemically synthesized
gatcttggtatatattgtagaa

SEQ ID NO: 693533 - DNA, 22 bp, Artificial Sequence
  chemically synthesized
atcttggtatatattgtagaaa

SEQ ID NO: 693534 - DNA, 22 bp, Artificial Sequence
  chemically synthesized
gcttgatcaactctttctacaa

SEQ ID NO: 693535 - DNA, 22 bp, Artificial Sequence
  chemically synthesized
ggtatatattgtagaaagagtt

SEQ ID NO: 693536 - DNA, 22 bp, Artificial Sequence
  chemically synthesized
attagcttgatcaactctttct

SEQ ID NO: 693537 - DNA, 22 bp, Artificial Sequence
  chemically synthesized
gtatatattgtagaaagagttg

SEQ ID NO: 693538 - DNA, 22 bp, Artificial Sequence
  chemically synthesized
tagaaagagttgatcaagctaa

SEQ ID NO: 693539 - DNA, 22 bp, Artificial Sequence
  chemically synthesized
gtgaggtaatggatacgttaat

SEQ ID NO: 693540 - DNA, 22 bp, Artificial Sequence
  chemically synthesized
atcaagctaattaacgtatcca

SEQ ID NO: 693541 - DNA, 22 bp, Artificial Sequence
  chemically synthesized
attaacgtatccattacctcac

SEQ ID NO: 693542 - DNA, 22 bp, Artificial Sequence
  chemically synthesized
acgtatccattacctcaccaac

SEQ ID NO: 693543 - DNA, 22 bp, Artificial Sequence
  chemically synthesized
accgcaaaaaataaatgatatg

SEQ ID NO: 693544 - DNA, 22 bp, Artificial Sequence
  chemically synthesized
tcaccgcaaaaaataaatgata

SEQ ID NO: 693545 - DNA, 22 bp, Artificial Sequence
  chemically synthesized
cctcaccaacatatcatttatt

SEQ ID NO: 693546 - DNA, 22 bp, Artificial Sequence
  chemically synthesized
accaacatatcatttatttttt

SEQ ID NO: 693547 - DNA, 22 bp, Artificial Sequence
  chemically synthesized
atgttctcaccgcaaaaaataa

SEQ ID NO: 693548 - DNA, 22 bp, Artificial Sequence
  chemically synthesized
aatgttctcaccgcaaaaaata

SEQ ID NO: 693549 - DNA, 22 bp, Artificial Sequence
  chemically synthesized
taatgttctcaccgcaaaaaat

SEQ ID NO: 693550 - DNA, 22 bp, Artificial Sequence
  chemically synthesized
ttaatgttctcaccgcaaaaaa

SEQ ID NO: 693551 - DNA, 22 bp, Artificial Sequence
  chemically synthesized
attttttgcggtgagaacatta

SEQ ID NO: 693552 - DNA, 22 bp, Artificial Sequence
  chemically synthesized
ttttttgcggtgagaacattaa

SEQ ID NO: 693553 - DNA, 22 bp, Artificial Sequence
  chemically synthesized
aaagaatagatttttaatgttc

SEQ ID NO: 693554 - DNA, 22 bp, Artificial Sequence
  chemically synthesized
tttgcggtgagaacattaaaaa

SEQ ID NO: 693555 - DNA, 22 bp, Artificial Sequence
  chemically synthesized
ttgcggtgagaacattaaaaat

SEQ ID NO: 693556 - DNA, 22 bp, Artificial Sequence
  chemically synthesized
ctaaaagaatagatttttaatg

SEQ ID NO: 693557 - DNA, 22 bp, Artificial Sequence
  chemically synthesized
tgcggtgagaacattaaaaatc

SEQ ID NO: 693558 - DNA, 22 bp, Artificial Sequence
  chemically synthesized
gcggtgagaacattaaaaatct

SEQ ID NO: 693559 - DNA, 22 bp, Artificial Sequence
  chemically synthesized
cggtgagaacattaaaaatcta

SEQ ID NO: 693560 - DNA, 22 bp, Artificial Sequence
  chemically synthesized
aaaattgctaaaagaatagatt

SEQ ID NO: 693561 - DNA, 22 bp, Artificial Sequence
  chemically synthesized
caaaattgctaaaagaatagat

SEQ ID NO: 693562 - DNA, 22 bp, Artificial Sequence
  chemically synthesized
atatatttcaaaattgctaaaa

SEQ ID NO: 693563 - DNA, 22 bp, Artificial Sequence
  chemically synthesized
aaaatctattcttttagcaatt

SEQ ID NO: 693564 - DNA, 22 bp, Artificial Sequence
  chemically synthesized
ttcttttagcaattttgaaata

SEQ ID NO: 693565 - DNA, 22 bp, Artificial Sequence
  chemically synthesized
ttttagcaattttgaaatatat

SEQ ID NO: 693566 - DNA, 22 bp, Artificial Sequence
  chemically synthesized
ataataatgtctcatatatttc

SEQ ID NO: 693567 - DNA, 22 bp, Artificial Sequence
  chemically synthesized
ttagcaattttgaaatatatga

SEQ ID NO: 693568 - DNA, 22 bp, Artificial Sequence
  chemically synthesized
tagcaattttgaaatatatgag

SEQ ID NO: 693569 - DNA, 22 bp, Artificial Sequence
  chemically synthesized
agcaattttgaaatatatgaga

SEQ ID NO: 693570 - DNA, 22 bp, Artificial Sequence
  chemically synthesized
gcaattttgaaatatatgagac

SEQ ID NO: 693571 - DNA, 22 bp, Artificial Sequence
  chemically synthesized
tgaaatatatgagacattatta

SEQ ID NO: 693572 - DNA, 22 bp, Artificial Sequence
  chemically synthesized
gaaatatatgagacattattat

SEQ ID NO: 693573 - DNA, 22 bp, Artificial Sequence
  chemically synthesized
aaatatatgagacattattatt

SEQ ID NO: 693574 - DNA, 22 bp, Artificial Sequence
  chemically synthesized
cagtacatggtaaccatggcta

SEQ ID NO: 693575 - DNA, 22 bp, Artificial Sequence
  chemically synthesized
cattgcagtacatggtaaccat

SEQ ID NO: 693576 - DNA, 22 bp, Artificial Sequence
  chemically synthesized
ttattagccatggttaccatgt

SEQ ID NO: 693577 - DNA, 22 bp, Artificial Sequence
  chemically synthesized
ttagccatggttaccatgtact

SEQ ID NO: 693578 - DNA, 22 bp, Artificial Sequence
  chemically synthesized
gtgttccattgcagtacatggt

SEQ ID NO: 693579 - DNA, 22 bp, Artificial Sequence
  chemically synthesized
agtgttccattgcagtacatgg

SEQ ID NO: 693580 - DNA, 22 bp, Artificial Sequence
  chemically synthesized
tagtgttccattgcagtacatg

SEQ ID NO: 693581 - DNA, 22 bp, Artificial Sequence
  chemically synthesized
gccatggttaccatgtactgca

SEQ ID NO: 693582 - DNA, 22 bp, Artificial Sequence
  chemically synthesized
ccatgtactgcaatggaacact

SEQ ID NO: 693583 - DNA, 22 bp, Artificial Sequence
  chemically synthesized
gtagggaaaatcaagttttagt

SEQ ID NO: 693584 - DNA, 22 bp, Artificial Sequence
  chemically synthesized
ggtagggaaaatcaagttttag

SEQ ID NO: 693585 - DNA, 22 bp, Artificial Sequence
  chemically synthesized
caatggaacactaaaacttgat

SEQ ID NO: 693586 - DNA, 22 bp, Artificial Sequence
  chemically synthesized
aaacttgattttccctaccaaa

SEQ ID NO: 693587 - DNA, 22 bp, Artificial Sequence
  chemically synthesized
aagaggaacaaatttggtaggg

SEQ ID NO: 693588 - DNA, 22 bp, Artificial Sequence
  chemically synthesized
aaagaggaacaaatttggtagg

SEQ ID NO: 693589 - DNA, 22 bp, Artificial Sequence
  chemically synthesized
gattttccctaccaaatttgtt

SEQ ID NO: 693590 - DNA, 22 bp, Artificial Sequence
  chemically synthesized
attttccctaccaaatttgttc

SEQ ID NO: 693591 - DNA, 22 bp, Artificial Sequence
  chemically synthesized
tccctaccaaatttgttcctct

SEQ ID NO: 693592 - DNA, 22 bp, Artificial Sequence
  chemically synthesized
ccctaccaaatttgttcctctt

SEQ ID NO: 693593 - DNA, 22 bp, Artificial Sequence
  chemically synthesized
cctaccaaatttgttcctcttt

SEQ ID NO: 693594 - DNA, 22 bp, Artificial Sequence
  chemically synthesized
ccaaatttgttcctctttaagt

SEQ ID NO: 693595 - DNA, 22 bp, Artificial Sequence
  chemically synthesized
agcaggaacaggtacttaaaga

SEQ ID NO: 693596 - DNA, 22 bp, Artificial Sequence
  chemically synthesized
cagcaggaacaggtacttaaag

SEQ ID NO: 693597 - DNA, 22 bp, Artificial Sequence
  chemically synthesized
tcagcaggaacaggtacttaaa

SEQ ID NO: 693598 - DNA, 22 bp, Artificial Sequence
  chemically synthesized
gttcctctttaagtacctgttc

SEQ ID NO: 693599 - DNA, 22 bp, Artificial Sequence
  chemically synthesized
ggctttcagcaggaacaggtac

SEQ ID NO: 693600 - DNA, 22 bp, Artificial Sequence
  chemically synthesized
ttcctctttaagtacctgttcc

SEQ ID NO: 693601 - DNA, 22 bp, Artificial Sequence
  chemically synthesized
ctcggctttcagcaggaacagg

SEQ ID NO: 693602 - DNA, 22 bp, Artificial Sequence
  chemically synthesized
ctctttaagtacctgttcctgc

SEQ ID NO: 693603 - DNA, 22 bp, Artificial Sequence
  chemically synthesized
tttaagtacctgttcctgctga

SEQ ID NO: 693604 - DNA, 22 bp, Artificial Sequence
  chemically synthesized
taagtacctgttcctgctgaaa

SEQ ID NO: 693605 - DNA, 22 bp, Artificial Sequence
  chemically synthesized
aagtacctgttcctgctgaaag

SEQ ID NO: 693606 - DNA, 22 bp, Artificial Sequence
  chemically synthesized
agtacctgttcctgctgaaagc

SEQ ID NO: 693607 - DNA, 22 bp, Artificial Sequence
  chemically synthesized
ttcctgctgaaagccgaggaga

SEQ ID NO: 693608 - DNA, 22 bp, Artificial Sequence
  chemically synthesized
ctgctgaaagccgaggagacac

SEQ ID NO: 693609 - DNA, 22 bp, Artificial Sequence
  chemically synthesized
ctgaaagccgaggagacacctg

SEQ ID NO: 693610 - DNA, 22 bp, Artificial Sequence
  chemically synthesized
aaagccgaggagacacctggat

SEQ ID NO: 693611 - DNA, 22 bp, Artificial Sequence
  chemically synthesized
gaggtcaggagggacagaaaga

SEQ ID NO: 693612 - DNA, 22 bp, Artificial Sequence
  chemically synthesized
gattgccctctttctgtccctc

SEQ ID NO: 693613 - DNA, 22 bp, Artificial Sequence
  chemically synthesized
atgcattggaggtcaggaggga

SEQ ID NO: 693614 - DNA, 22 bp, Artificial Sequence
  chemically synthesized
ccctctttctgtccctcctgac

SEQ ID NO: 693615 - DNA, 22 bp, Artificial Sequence
  chemically synthesized
ctgatgcattggaggtcaggag

SEQ ID NO: 693616 - DNA, 22 bp, Artificial Sequence
  chemically synthesized
gctgatgcattggaggtcagga

SEQ ID NO: 693617 - DNA, 22 bp, Artificial Sequence
  chemically synthesized
tttctgtccctcctgacctcca

SEQ ID NO: 693618 - DNA, 22 bp, Artificial Sequence
  chemically synthesized
tctgtccctcctgacctccaat

SEQ ID NO: 693619 - DNA, 22 bp, Artificial Sequence
  chemically synthesized
ctgtccctcctgacctccaatg

SEQ ID NO: 693620 - DNA, 22 bp, Artificial Sequence
  chemically synthesized
tgtccctcctgacctccaatgc

SEQ ID NO: 693621 - DNA, 22 bp, Artificial Sequence
  chemically synthesized
tccctcctgacctccaatgcat

SEQ ID NO: 693622 - DNA, 22 bp, Artificial Sequence
  chemically synthesized
ctgacctccaatgcatcagcaa

SEQ ID NO: 693623 - DNA, 22 bp, Artificial Sequence
  chemically synthesized
acctccaatgcatcagcaagac

SEQ ID NO: 693624 - DNA, 22 bp, Artificial Sequence
  chemically synthesized
gaaacaatcacaggtcttgctg

SEQ ID NO: 693625 - DNA, 22 bp, Artificial Sequence
  chemically synthesized
agaaacaatcacaggtcttgct

SEQ ID NO: 693626 - DNA, 22 bp, Artificial Sequence
  chemically synthesized
caatgcatcagcaagacctgtg

SEQ ID NO: 693627 - DNA, 22 bp, Artificial Sequence
  chemically synthesized
gaatcagggaatatggtttaga

SEQ ID NO: 693628 - DNA, 22 bp, Artificial Sequence
  chemically synthesized
tgattgtttctaaaccatattc

SEQ ID NO: 693629 - DNA, 22 bp, Artificial Sequence
  chemically synthesized
tttctaaaccatattccctgat

SEQ ID NO: 693630 - DNA, 22 bp, Artificial Sequence
  chemically synthesized
ctaaaccatattccctgattcc

SEQ ID NO: 693631 - DNA, 22 bp, Artificial Sequence
  chemically synthesized
taaaccatattccctgattcca

SEQ ID NO: 693632 - DNA, 22 bp, Artificial Sequence
  chemically synthesized
aaccatattccctgattccaac

SEQ ID NO: 693633 - DNA, 22 bp, Artificial Sequence
  chemically synthesized
cctgattccaaccacctcttgt

SEQ ID NO: 693634 - DNA, 22 bp, Artificial Sequence
  chemically synthesized
attccaaccacctcttgtgatc

SEQ ID NO: 693635 - DNA, 22 bp, Artificial Sequence
  chemically synthesized
caaccacctcttgtgatctcca

SEQ ID NO: 693636 - DNA, 22 bp, Artificial Sequence
  chemically synthesized
gataaaggtagcagtggagatc

SEQ ID NO: 693637 - DNA, 22 bp, Artificial Sequence
  chemically synthesized
ttgtgatctccactgctacctt

SEQ ID NO: 693638 - DNA, 22 bp, Artificial Sequence
  chemically synthesized
gtgatctccactgctaccttta

SEQ ID NO: 693639 - DNA, 22 bp, Artificial Sequence
  chemically synthesized
tgatctccactgctacctttat

SEQ ID NO: 693640 - DNA, 22 bp, Artificial Sequence
  chemically synthesized
gataagatctagataaaggtag

SEQ ID NO: 693641 - DNA, 22 bp, Artificial Sequence
  chemically synthesized
gtgttagataagatctagataa

SEQ ID NO: 693642 - DNA, 22 bp, Artificial Sequence
  chemically synthesized
cactgctacctttatctagatc

SEQ ID NO: 693643 - DNA, 22 bp, Artificial Sequence
  chemically synthesized
ctacctttatctagatcttatc

SEQ ID NO: 693644 - DNA, 22 bp, Artificial Sequence
  chemically synthesized
cctttatctagatcttatctaa

SEQ ID NO: 693645 - DNA, 22 bp, Artificial Sequence
  chemically synthesized
tatctagatcttatctaacacc

SEQ ID NO: 693646 - DNA, 22 bp, Artificial Sequence
  chemically synthesized
atctagatcttatctaacacca

SEQ ID NO: 693647 - DNA, 22 bp, Artificial Sequence
  chemically synthesized
tctagatcttatctaacaccag

SEQ ID NO: 693648 - DNA, 22 bp, Artificial Sequence
  chemically synthesized
gatcttatctaacaccagtgct

SEQ ID NO: 693649 - DNA, 22 bp, Artificial Sequence
  chemically synthesized
atctaacaccagtgcttcccac

SEQ ID NO: 693650 - DNA, 22 bp, Artificial Sequence
  chemically synthesized
tctaacaccagtgcttcccaca

SEQ ID NO: 693651 - DNA, 22 bp, Artificial Sequence
  chemically synthesized
acaccagtgcttcccacactac

SEQ ID NO: 693652 - DNA, 22 bp, Artificial Sequence
  chemically synthesized
cccacactactatctggtctcc

SEQ ID NO: 693653 - DNA, 22 bp, Artificial Sequence
  chemically synthesized
ccacactactatctggtctccc

SEQ ID NO: 693654 - DNA, 22 bp, Artificial Sequence
  chemically synthesized
ctatctggtctccctgcttcca

SEQ ID NO: 693655 - DNA, 22 bp, Artificial Sequence
  chemically synthesized
tctggtctccctgcttccactc

SEQ ID NO: 693656 - DNA, 22 bp, Artificial Sequence
  chemically synthesized
gtctccctgcttccactctggc

SEQ ID NO: 693657 - DNA, 22 bp, Artificial Sequence
  chemically synthesized
cctgcttccactctggctcttc

SEQ ID NO: 693658 - DNA, 22 bp, Artificial Sequence
  chemically synthesized
ggggtgaggaaatatgaagagc

SEQ ID NO: 693659 - DNA, 22 bp, Artificial Sequence
  chemically synthesized
cttccactctggctcttcatat

SEQ ID NO: 693660 - DNA, 22 bp, Artificial Sequence
  chemically synthesized
ccactctggctcttcatatttc

SEQ ID NO: 693661 - DNA, 22 bp, Artificial Sequence
  chemically synthesized
cactctggctcttcatatttcc

SEQ ID NO: 693662 - DNA, 22 bp, Artificial Sequence
  chemically synthesized
tggctcttcatatttcctcacc

SEQ ID NO: 693663 - DNA, 22 bp, Artificial Sequence
  chemically synthesized
gctcttcatatttcctcacccc

SEQ ID NO: 693664 - DNA, 22 bp, Artificial Sequence
  chemically synthesized
ttcatatttcctcacccctaac

SEQ ID NO: 693665 - DNA, 22 bp, Artificial Sequence
  chemically synthesized
gtggaacacgtgagttaggggt

SEQ ID NO: 693666 - DNA, 22 bp, Artificial Sequence
  chemically synthesized
catatttcctcacccctaactc

SEQ ID NO: 693667 - DNA, 22 bp, Artificial Sequence
  chemically synthesized
ggtggaacacgtgagttagggg

SEQ ID NO: 693668 - DNA, 22 bp, Artificial Sequence
  chemically synthesized
atatttcctcacccctaactca

SEQ ID NO: 693669 - DNA, 22 bp, Artificial Sequence
  chemically synthesized
cctcacccctaactcacgtgtt

SEQ ID NO: 693670 - DNA, 22 bp, Artificial Sequence
  chemically synthesized
ctcacccctaactcacgtgttc

SEQ ID NO: 693671 - DNA, 22 bp, Artificial Sequence
  chemically synthesized
acccctaactcacgtgttccac

SEQ ID NO: 693672 - DNA, 22 bp, Artificial Sequence
  chemically synthesized
tgtggagaatgcatttggtgga

SEQ ID NO: 693673 - DNA, 22 bp, Artificial Sequence
  chemically synthesized
actcacgtgttccaccaaatgc

SEQ ID NO: 693674 - DNA, 22 bp, Artificial Sequence
  chemically synthesized
ctgtgtggagaatgcatttggt

SEQ ID NO: 693675 - DNA, 22 bp, Artificial Sequence
  chemically synthesized
acgtgttccaccaaatgcattc

SEQ ID NO: 693676 - DNA, 22 bp, Artificial Sequence
  chemically synthesized
gctgctgtgtggagaatgcatt

SEQ ID NO: 693677 - DNA, 22 bp, Artificial Sequence
  chemically synthesized
caccaaatgcattctccacaca

SEQ ID NO: 693678 - DNA, 22 bp, Artificial Sequence
  chemically synthesized
gcaagacataattggctgctgt

SEQ ID NO: 693679 - DNA, 22 bp, Artificial Sequence
  chemically synthesized
gattggcaagacataattggct

SEQ ID NO: 693680 - DNA, 22 bp, Artificial Sequence
  chemically synthesized
tccacacagcagccaattatgt

SEQ ID NO: 693681 - DNA, 22 bp, Artificial Sequence
  chemically synthesized
cacacagcagccaattatgtct

SEQ ID NO: 693682 - DNA, 22 bp, Artificial Sequence
  chemically synthesized
aaagtagactagattggcaaga

SEQ ID NO: 693683 - DNA, 22 bp, Artificial Sequence
  chemically synthesized
gaaagtagactagattggcaag

SEQ ID NO: 693684 - DNA, 22 bp, Artificial Sequence
  chemically synthesized
tgtcttgccaatctagtctact

SEQ ID NO: 693685 - DNA, 22 bp, Artificial Sequence
  chemically synthesized
taatgcagtttgaaagtagact

SEQ ID NO: 693686 - DNA, 22 bp, Artificial Sequence
  chemically synthesized
ttataatgcagtttgaaagtag

SEQ ID NO: 693687 - DNA, 22 bp, Artificial Sequence
  chemically synthesized
gccaatctagtctactttcaaa

SEQ ID NO: 693688 - DNA, 22 bp, Artificial Sequence
  chemically synthesized
gttataatgcagtttgaaagta

SEQ ID NO: 693689 - DNA, 22 bp, Artificial Sequence
  chemically synthesized
ccaatctagtctactttcaaac

SEQ ID NO: 693690 - DNA, 22 bp, Artificial Sequence
  chemically synthesized
tgttataatgcagtttgaaagt

SEQ ID NO: 693691 - DNA, 22 bp, Artificial Sequence
  chemically synthesized
gtgctttgttataatgcagttt

SEQ ID NO: 693692 - DNA, 22 bp, Artificial Sequence
  chemically synthesized
gtctactttcaaactgcattat

SEQ ID NO: 693693 - DNA, 22 bp, Artificial Sequence
  chemically synthesized
ctggtgctttgttataatgcag

SEQ ID NO: 693694 - DNA, 22 bp, Artificial Sequence
  chemically synthesized
gctggtgctttgttataatgca

SEQ ID NO: 693695 - DNA, 22 bp, Artificial Sequence
  chemically synthesized
tgctggtgctttgttataatgc

SEQ ID NO: 693696 - DNA, 22 bp, Artificial Sequence
  chemically synthesized
ttgctggtgctttgttataatg

SEQ ID NO: 693697 - DNA, 22 bp, Artificial Sequence
  chemically synthesized
ctttcaaactgcattataacaa

SEQ ID NO: 693698 - DNA, 22 bp, Artificial Sequence
  chemically synthesized
tttgctggtgctttgttataat

SEQ ID NO: 693699 - DNA, 22 bp, Artificial Sequence
  chemically synthesized
tcaaactgcattataacaaagc

SEQ ID NO: 693700 - DNA, 22 bp, Artificial Sequence
  chemically synthesized
caaactgcattataacaaagca

SEQ ID NO: 693701 - DNA, 22 bp, Artificial Sequence
  chemically synthesized
gttttttgctggtgctttgtta

SEQ ID NO: 693702 - DNA, 22 bp, Artificial Sequence
  chemically synthesized
aaactgcattataacaaagcac

SEQ ID NO: 693703 - DNA, 22 bp, Artificial Sequence
  chemically synthesized
ggttttttgctggtgctttgtt

SEQ ID NO: 693704 - DNA, 22 bp, Artificial Sequence
  chemically synthesized
cattataacaaagcaccagcaa

SEQ ID NO: 693705 - DNA, 22 bp, Artificial Sequence
  chemically synthesized
gaggtgtttggttttttgctgg

SEQ ID NO: 693706 - DNA, 22 bp, Artificial Sequence
  chemically synthesized
taacaaagcaccagcaaaaaac

SEQ ID NO: 693707 - DNA, 22 bp, Artificial Sequence
  chemically synthesized
ttggaggtgtttggttttttgc

SEQ ID NO: 693708 - DNA, 22 bp, Artificial Sequence
  chemically synthesized
gttggaggtgtttggttttttg

SEQ ID NO: 693709 - DNA, 22 bp, Artificial Sequence
  chemically synthesized
ggtgaagtttgttggaggtgtt

SEQ ID NO: 693710 - DNA, 22 bp, Artificial Sequence
  chemically synthesized
tcaaagcctaggtgaagtttgt

SEQ ID NO: 693711 - DNA, 22 bp, Artificial Sequence
  chemically synthesized
atcaaagcctaggtgaagtttg

SEQ ID NO: 693712 - DNA, 22 bp, Artificial Sequence
  chemically synthesized
tatcaaagcctaggtgaagttt

SEQ ID NO: 693713 - DNA, 22 bp, Artificial Sequence
  chemically synthesized
acctttatcaaagcctaggtga

SEQ ID NO: 693714 - DNA, 22 bp, Artificial Sequence
  chemically synthesized
gacctttatcaaagcctaggtg

SEQ ID NO: 693715 - DNA, 22 bp, Artificial Sequence
  chemically synthesized
caacaaacttcacctaggcttt

SEQ ID NO: 693716 - DNA, 22 bp, Artificial Sequence
  chemically synthesized
cacctaggctttgataaaggtc

SEQ ID NO: 693717 - DNA, 22 bp, Artificial Sequence
  chemically synthesized
acctaggctttgataaaggtca

SEQ ID NO: 693718 - DNA, 22 bp, Artificial Sequence
  chemically synthesized
aaatgcaaaccttgacctttat

SEQ ID NO: 693719 - DNA, 22 bp, Artificial Sequence
  chemically synthesized
gaaatgcaaaccttgaccttta

SEQ ID NO: 693720 - DNA, 22 bp, Artificial Sequence
  chemically synthesized
tgaaatgcaaaccttgaccttt

SEQ ID NO: 693721 - DNA, 22 bp, Artificial Sequence
  chemically synthesized
ttgaaatgcaaaccttgacctt

SEQ ID NO: 693722 - DNA, 22 bp, Artificial Sequence
  chemically synthesized
ggctttgataaaggtcaaggtt

SEQ ID NO: 693723 - DNA, 22 bp, Artificial Sequence
  chemically synthesized
tgataaaggtcaaggtttgcat

SEQ ID NO: 693724 - DNA, 22 bp, Artificial Sequence
  chemically synthesized
gataaaggtcaaggtttgcatt

SEQ ID NO: 693725 - DNA, 22 bp, Artificial Sequence
  chemically synthesized
ataaaggtcaaggtttgcattt

SEQ ID NO: 693726 - DNA, 22 bp, Artificial Sequence
  chemically synthesized
caaagaggaaaatttttgaaat

SEQ ID NO: 693727 - DNA, 22 bp, Artificial Sequence
  chemically synthesized
caactccaaagaggaaaatttt

SEQ ID NO: 693728 - DNA, 22 bp, Artificial Sequence
  chemically synthesized
tgcaactccaaagaggaaaatt

SEQ ID NO: 693729 - DNA, 22 bp, Artificial Sequence
  chemically synthesized
ctgcaactccaaagaggaaaat

SEQ ID NO: 693730 - DNA, 22 bp, Artificial Sequence
  chemically synthesized
gcatttcaaaaattttcctctt

SEQ ID NO: 693731 - DNA, 22 bp, Artificial Sequence
  chemically synthesized
tctgcaactccaaagaggaaaa

SEQ ID NO: 693732 - DNA, 22 bp, Artificial Sequence
  chemically synthesized
catttcaaaaattttcctcttt

SEQ ID NO: 693733 - DNA, 22 bp, Artificial Sequence
  chemically synthesized
ttctgcaactccaaagaggaaa

SEQ ID NO: 693734 - DNA, 22 bp, Artificial Sequence
  chemically synthesized
ttttctgcaactccaaagagga

SEQ ID NO: 693735 - DNA, 22 bp, Artificial Sequence
  chemically synthesized
cttttctgcaactccaaagagg

SEQ ID NO: 693736 - DNA, 22 bp, Artificial Sequence
  chemically synthesized
caaaaattttcctctttggagt

SEQ ID NO: 693737 - DNA, 22 bp, Artificial Sequence
  chemically synthesized
aaaaattttcctctttggagtt

SEQ ID NO: 693738 - DNA, 22 bp, Artificial Sequence
  chemically synthesized
aatatttcttttctgcaactcc

SEQ ID NO: 693739 - DNA, 22 bp, Artificial Sequence
  chemically synthesized
tcctctttggagttgcagaaaa

SEQ ID NO: 693740 - DNA, 22 bp, Artificial Sequence
  chemically synthesized
cctctttggagttgcagaaaag

SEQ ID NO: 693741 - DNA, 22 bp, Artificial Sequence
  chemically synthesized
ctctttggagttgcagaaaaga

SEQ ID NO: 693742 - DNA, 22 bp, Artificial Sequence
  chemically synthesized
agccctgaatatttcttttctg

SEQ ID NO: 693743 - DNA, 22 bp, Artificial Sequence
  chemically synthesized
tttggagttgcagaaaagaaat

SEQ ID NO: 693744 - DNA, 22 bp, Artificial Sequence
  chemically synthesized
tggagttgcagaaaagaaatat

SEQ ID NO: 693745 - DNA, 22 bp, Artificial Sequence
  chemically synthesized
ggagttgcagaaaagaaatatt

SEQ ID NO: 693746 - DNA, 22 bp, Artificial Sequence
  chemically synthesized
gagttgcagaaaagaaatattc

SEQ ID NO: 693747 - DNA, 22 bp, Artificial Sequence
  chemically synthesized
aaattcagccctgaatatttct

SEQ ID NO: 693748 - DNA, 22 bp, Artificial Sequence
  chemically synthesized
ctgaaattcagccctgaatatt

SEQ ID NO: 693749 - DNA, 22 bp, Artificial Sequence
  chemically synthesized
cagaaaagaaatattcagggct

SEQ ID NO: 693750 - DNA, 22 bp, Artificial Sequence
  chemically synthesized
ataagaaggttgctgaaattca

SEQ ID NO: 693751 - DNA, 22 bp, Artificial Sequence
  chemically synthesized
agggctgaatttcagcaacctt

SEQ ID NO: 693752 - DNA, 22 bp, Artificial Sequence
  chemically synthesized
taaatactaataagaaggttgc

SEQ ID NO: 693753 - DNA, 22 bp, Artificial Sequence
  chemically synthesized
gtaaatactaataagaaggttg

SEQ ID NO: 693754 - DNA, 22 bp, Artificial Sequence
  chemically synthesized
aatttcagcaaccttcttatta

SEQ ID NO: 693755 - DNA, 22 bp, Artificial Sequence
  chemically synthesized
gtttgtaaatactaataagaag

SEQ ID NO: 693756 - DNA, 22 bp, Artificial Sequence
  chemically synthesized
cagcaaccttcttattagtatt

SEQ ID NO: 693757 - DNA, 22 bp, Artificial Sequence
  chemically synthesized
agcaaccttcttattagtattt

SEQ ID NO: 693758 - DNA, 22 bp, Artificial Sequence
  chemically synthesized
gccaagtataactagtttgtaa

SEQ ID NO: 693759 - DNA, 22 bp, Artificial Sequence
  chemically synthesized
cttattagtatttacaaactag

SEQ ID NO: 693760 - DNA, 22 bp, Artificial Sequence
  chemically synthesized
ttattagtatttacaaactagt

SEQ ID NO: 693761 - DNA, 22 bp, Artificial Sequence
  chemically synthesized
attagtatttacaaactagtta

SEQ ID NO: 693762 - DNA, 22 bp, Artificial Sequence
  chemically synthesized
ttagtatttacaaactagttat

SEQ ID NO: 693763 - DNA, 22 bp, Artificial Sequence
  chemically synthesized
caaattagccaagtataactag

SEQ ID NO: 693764 - DNA, 22 bp, Artificial Sequence
  chemically synthesized
gtatttacaaactagttatact

SEQ ID NO: 693765 - DNA, 22 bp, Artificial Sequence
  chemically synthesized
acaaactagttatacttggcta

SEQ ID NO: 693766 - DNA, 22 bp, Artificial Sequence
  chemically synthesized
caaactagttatacttggctaa

SEQ ID NO: 693767 - DNA, 22 bp, Artificial Sequence
  chemically synthesized
aatggtgttacaaattagccaa

SEQ ID NO: 693768 - DNA, 22 bp, Artificial Sequence
  chemically synthesized
caatggtgttacaaattagcca

SEQ ID NO: 693769 - DNA, 22 bp, Artificial Sequence
  chemically synthesized
tcaatggtgttacaaattagcc

SEQ ID NO: 693770 - DNA, 22 bp, Artificial Sequence
  chemically synthesized
gttatacttggctaatttgtaa

SEQ ID NO: 693771 - DNA, 22 bp, Artificial Sequence
  chemically synthesized
actttcaatggtgttacaaatt

SEQ ID NO: 693772 - DNA, 22 bp, Artificial Sequence
  chemically synthesized
tacttggctaatttgtaacacc

SEQ ID NO: 693773 - DNA, 22 bp, Artificial Sequence
  chemically synthesized
ggctaatttgtaacaccattga

SEQ ID NO: 693774 - DNA, 22 bp, Artificial Sequence
  chemically synthesized
gctaatttgtaacaccattgaa

SEQ ID NO: 693775 - DNA, 22 bp, Artificial Sequence
  chemically synthesized
ccaaacctcactttcaatggtg

SEQ ID NO: 693776 - DNA, 22 bp, Artificial Sequence
  chemically synthesized
ttgccaaacctcactttcaatg

SEQ ID NO: 693777 - DNA, 22 bp, Artificial Sequence
  chemically synthesized
atttgtaacaccattgaaagtg

SEQ ID NO: 693778 - DNA, 22 bp, Artificial Sequence
  chemically synthesized
attgccaaacctcactttcaat

SEQ ID NO: 693779 - DNA, 22 bp, Artificial Sequence
  chemically synthesized
gtaacaccattgaaagtgaggt

SEQ ID NO: 693780 - DNA, 22 bp, Artificial Sequence
  chemically synthesized
taacaccattgaaagtgaggtt

SEQ ID NO: 693781 - DNA, 22 bp, Artificial Sequence
  chemically synthesized
aaagtgaggtttggcaataagt

SEQ ID NO: 693782 - DNA, 22 bp, Artificial Sequence
  chemically synthesized
acaatgtaaagtacacttattg

SEQ ID NO: 693783 - DNA, 22 bp, Artificial Sequence
  chemically synthesized
atgttcacaatgtaaagtacac

SEQ ID NO: 693784 - DNA, 22 bp, Artificial Sequence
  chemically synthesized
aatgttcacaatgtaaagtaca

SEQ ID NO: 693785 - DNA, 22 bp, Artificial Sequence
  chemically synthesized
taatgttcacaatgtaaagtac

SEQ ID NO: 693786 - DNA, 22 bp, Artificial Sequence
  chemically synthesized
ttaatgttcacaatgtaaagta

SEQ ID NO: 693787 - DNA, 22 bp, Artificial Sequence
  chemically synthesized
ggcaataagtgtactttacatt

SEQ ID NO: 693788 - DNA, 22 bp, Artificial Sequence
  chemically synthesized
gcaataagtgtactttacattg

SEQ ID NO: 693789 - DNA, 22 bp, Artificial Sequence
  chemically synthesized
tttttaatgttcacaatgtaaa

SEQ ID NO: 693790 - DNA, 22 bp, Artificial Sequence
  chemically synthesized
gtttttaatgttcacaatgtaa

SEQ ID NO: 693791 - DNA, 22 bp, Artificial Sequence
  chemically synthesized
tttgtttttaatgttcacaatg

SEQ ID NO: 693792 - DNA, 22 bp, Artificial Sequence
  chemically synthesized
gtttgtttttaatgttcacaat

SEQ ID NO: 693793 - DNA, 22 bp, Artificial Sequence
  chemically synthesized
tacattgtgaacattaaaaaca

SEQ ID NO: 693794 - DNA, 22 bp, Artificial Sequence
  chemically synthesized
acattgtgaacattaaaaacaa

SEQ ID NO: 693795 - DNA, 22 bp, Artificial Sequence
  chemically synthesized
cattgtgaacattaaaaacaaa

SEQ ID NO: 693796 - DNA, 22 bp, Artificial Sequence
  chemically synthesized
tgaacattaaaaacaaacaaga

SEQ ID NO: 693797 - DNA, 22 bp, Artificial Sequence
  chemically synthesized
ccagacaatatgtcttgtttgt

SEQ ID NO: 693798 - DNA, 22 bp, Artificial Sequence
  chemically synthesized
gccagacaatatgtcttgtttg

SEQ ID NO: 693799 - DNA, 22 bp, Artificial Sequence
  chemically synthesized
tgccagacaatatgtcttgttt

SEQ ID NO: 693800 - DNA, 22 bp, Artificial Sequence
  chemically synthesized
aaaacaaacaagacatattgtc

SEQ ID NO: 693801 - DNA, 22 bp, Artificial Sequence
  chemically synthesized
tctggcaaaatattttttgctg

SEQ ID NO: 693802 - DNA, 22 bp, Artificial Sequence
  chemically synthesized
aaacaacaacaacaacagcaaa

SEQ ID NO: 693803 - DNA, 22 bp, Artificial Sequence
  chemically synthesized
gcaaaatattttttgctgttgt

SEQ ID NO: 693804 - DNA, 22 bp, Artificial Sequence
  chemically synthesized
caaacaacaacaacaacagcaa

SEQ ID NO: 693805 - DNA, 22 bp, Artificial Sequence
  chemically synthesized
tttgctgttgttgttgttgttt

SEQ ID NO: 693806 - DNA, 22 bp, Artificial Sequence
  chemically synthesized
ttgctgttgttgttgttgtttg

SEQ ID NO: 693807 - DNA, 22 bp, Artificial Sequence
  chemically synthesized
tgctgttgttgttgttgtttga

SEQ ID NO: 693808 - DNA, 22 bp, Artificial Sequence
  chemically synthesized
gctgttgttgttgttgtttgaa

SEQ ID NO: 693809 - DNA, 22 bp, Artificial Sequence
  chemically synthesized
ctgttgttgttgttgtttgaaa

SEQ ID NO: 693810 - DNA, 22 bp, Artificial Sequence
  chemically synthesized
aaatatatacaatttcaaacaa

SEQ ID NO: 693811 - DNA, 22 bp, Artificial Sequence
  chemically synthesized
ttgttgttgttgtttgaaattg

SEQ ID NO: 693812 - DNA, 22 bp, Artificial Sequence
  chemically synthesized
ttgttgttgtttgaaattgtat

SEQ ID NO: 693813 - DNA, 22 bp, Artificial Sequence
  chemically synthesized
ttgttgtttgaaattgtatata

SEQ ID NO: 693814 - DNA, 22 bp, Artificial Sequence
  chemically synthesized
aggtagttcaaatatatacaat

SEQ ID NO: 693815 - DNA, 22 bp, Artificial Sequence
  chemically synthesized
aaggtagttcaaatatatacaa

SEQ ID NO: 693816 - DNA, 22 bp, Artificial Sequence
  chemically synthesized
taaggtagttcaaatatataca

SEQ ID NO: 693817 - DNA, 22 bp, Artificial Sequence
  chemically synthesized
ttgtttgaaattgtatatattt

SEQ ID NO: 693818 - DNA, 22 bp, Artificial Sequence
  chemically synthesized
ttaaggtagttcaaatatatac

SEQ ID NO: 693819 - DNA, 22 bp, Artificial Sequence
  chemically synthesized
tttgaaattgtatatatttgaa

SEQ ID NO: 693820 - DNA, 22 bp, Artificial Sequence
  chemically synthesized
tcttttaaggtagttcaaatat

SEQ ID NO: 693821 - DNA, 22 bp, Artificial Sequence
  chemically synthesized
gaaattgtatatatttgaacta

SEQ ID NO: 693822 - DNA, 22 bp, Artificial Sequence
  chemically synthesized
aaattgtatatatttgaactac

SEQ ID NO: 693823 - DNA, 22 bp, Artificial Sequence
  chemically synthesized
attatcttttaaggtagttcaa

SEQ ID NO: 693824 - DNA, 22 bp, Artificial Sequence
  chemically synthesized
tgattatcttttaaggtagttc

SEQ ID NO: 693825 - DNA, 22 bp, Artificial Sequence
  chemically synthesized
tatatatttgaactaccttaaa

SEQ ID NO: 693826 - DNA, 22 bp, Artificial Sequence
  chemically synthesized
ctctgattatcttttaaggtag

SEQ ID NO: 693827 - DNA, 22 bp, Artificial Sequence
  chemically synthesized
cctctgattatcttttaaggta

SEQ ID NO: 693828 - DNA, 22 bp, Artificial Sequence
  chemically synthesized
ggacttcctctgattatctttt

SEQ ID NO: 693829 - DNA, 22 bp, Artificial Sequence
  chemically synthesized
gaactaccttaaaagataatca

SEQ ID NO: 693830 - DNA, 22 bp, Artificial Sequence
  chemically synthesized
aactaccttaaaagataatcag

SEQ ID NO: 693831 - DNA, 22 bp, Artificial Sequence
  chemically synthesized
cctgggacttcctctgattatc

SEQ ID NO: 693832 - DNA, 22 bp, Artificial Sequence
  chemically synthesized
ccttaaaagataatcagaggaa

SEQ ID NO: 693833 - DNA, 22 bp, Artificial Sequence
  chemically synthesized
aaaagataatcagaggaagtcc

SEQ ID NO: 693834 - DNA, 22 bp, Artificial Sequence
  chemically synthesized
aaagataatcagaggaagtccc

SEQ ID NO: 693835 - DNA, 22 bp, Artificial Sequence
  chemically synthesized
aatgtccagctacctgggactt

SEQ ID NO: 693836 - DNA, 22 bp, Artificial Sequence
  chemically synthesized
aaatgtccagctacctgggact

SEQ ID NO: 693837 - DNA, 22 bp, Artificial Sequence
  chemically synthesized
taaatgtccagctacctgggac

SEQ ID NO: 693838 - DNA, 22 bp, Artificial Sequence
  chemically synthesized
ttaaatgtccagctacctggga

SEQ ID NO: 693839 - DNA, 22 bp, Artificial Sequence
  chemically synthesized
aaagaaaaaagacaaactttta

SEQ ID NO: 693840 - DNA, 22 bp, Artificial Sequence
  chemically synthesized
caaagaaaaaagacaaactttt

SEQ ID NO: 693841 - DNA, 22 bp, Artificial Sequence
  chemically synthesized
tcaaagaaaaaagacaaacttt

SEQ ID NO: 693842 - DNA, 22 bp, Artificial Sequence
  chemically synthesized
ttttcaaagaaaaaagacaaac

SEQ ID NO: 693843 - DNA, 22 bp, Artificial Sequence
  chemically synthesized
gacatttaaaagtttgtctttt

SEQ ID NO: 693844 - DNA, 22 bp, Artificial Sequence
  chemically synthesized
aaaagtttgtcttttttctttg

SEQ ID NO: 693845 - DNA, 22 bp, Artificial Sequence
  chemically synthesized
atgtattattttcaaagaaaaa

SEQ ID NO: 693846 - DNA, 22 bp, Artificial Sequence
  chemically synthesized
aaagtttgtcttttttctttga

SEQ ID NO: 693847 - DNA, 22 bp, Artificial Sequence
  chemically synthesized
catgtattattttcaaagaaaa

SEQ ID NO: 693848 - DNA, 22 bp, Artificial Sequence
  chemically synthesized
gtcttttttctttgaaaataat

SEQ ID NO: 693849 - DNA, 22 bp, Artificial Sequence
  chemically synthesized
caagtttcatgtattattttca

SEQ ID NO: 693850 - DNA, 22 bp, Artificial Sequence
  chemically synthesized
tcttttttctttgaaaataata

SEQ ID NO: 693851 - DNA, 22 bp, Artificial Sequence
  chemically synthesized
ccaagtttcatgtattattttc

SEQ ID NO: 693852 - DNA, 22 bp, Artificial Sequence
  chemically synthesized
ttttctttgaaaataatacatg

SEQ ID NO: 693853 - DNA, 22 bp, Artificial Sequence
  chemically synthesized
tttctttgaaaataatacatga

SEQ ID NO: 693854 - DNA, 22 bp, Artificial Sequence
  chemically synthesized
ttctttgaaaataatacatgaa

SEQ ID NO: 693855 - DNA, 22 bp, Artificial Sequence
  chemically synthesized
tctttgaaaataatacatgaaa

SEQ ID NO: 693856 - DNA, 22 bp, Artificial Sequence
  chemically synthesized
ccaatttccaagtttcatgtat

SEQ ID NO: 693857 - DNA, 22 bp, Artificial Sequence
  chemically synthesized
ctttgaaaataatacatgaaac

SEQ ID NO: 693858 - DNA, 22 bp, Artificial Sequence
  chemically synthesized
cccaatttccaagtttcatgta

SEQ ID NO: 693859 - DNA, 22 bp, Artificial Sequence
  chemically synthesized
tttgaaaataatacatgaaact

SEQ ID NO: 693860 - DNA, 22 bp, Artificial Sequence
  chemically synthesized
tcccaatttccaagtttcatgt

SEQ ID NO: 693861 - DNA, 22 bp, Artificial Sequence
  chemically synthesized
tgaaaataatacatgaaacttg

SEQ ID NO: 693862 - DNA, 22 bp, Artificial Sequence
  chemically synthesized
gaaaataatacatgaaacttgg

SEQ ID NO: 693863 - DNA, 22 bp, Artificial Sequence
  chemically synthesized
aaaataatacatgaaacttgga

SEQ ID NO: 693864 - DNA, 22 bp, Artificial Sequence
  chemically synthesized
tagtaaatatgttttcccaatt

SEQ ID NO: 693865 - DNA, 22 bp, Artificial Sequence
  chemically synthesized
aatattatagtaaatatgtttt

SEQ ID NO: 693866 - DNA, 22 bp, Artificial Sequence
  chemically synthesized
gaatattatagtaaatatgttt

SEQ ID NO: 693867 - DNA, 22 bp, Artificial Sequence
  chemically synthesized
ggaaattgggaaaacatattta

SEQ ID NO: 693868 - DNA, 22 bp, Artificial Sequence
  chemically synthesized
gaaattgggaaaacatatttac

SEQ ID NO: 693869 - DNA, 22 bp, Artificial Sequence
  chemically synthesized
acttgaatattatagtaaatat

SEQ ID NO: 693870 - DNA, 22 bp, Artificial Sequence
  chemically synthesized
gacttgaatattatagtaaata

SEQ ID NO: 693871 - DNA, 22 bp, Artificial Sequence
  chemically synthesized
tgacttgaatattatagtaaat

SEQ ID NO: 693872 - DNA, 22 bp, Artificial Sequence
  chemically synthesized
tttgacttgaatattatagtaa

SEQ ID NO: 693873 - DNA, 22 bp, Artificial Sequence
  chemically synthesized
ggaaaacatatttactataata

SEQ ID NO: 693874 - DNA, 22 bp, Artificial Sequence
  chemically synthesized
cattctttgacttgaatattat

SEQ ID NO: 693875 - DNA, 22 bp, Artificial Sequence
  chemically synthesized
tccattctttgacttgaatatt

SEQ ID NO: 693876 - DNA, 22 bp, Artificial Sequence
  chemically synthesized
actataatattcaagtcaaaga

SEQ ID NO: 693877 - DNA, 22 bp, Artificial Sequence
  chemically synthesized
ctataatattcaagtcaaagaa

SEQ ID NO: 693878 - DNA, 22 bp, Artificial Sequence
  chemically synthesized
ggcaattctccattctttgact

SEQ ID NO: 693879 - DNA, 22 bp, Artificial Sequence
  chemically synthesized
taatattcaagtcaaagaatgg

SEQ ID NO: 693880 - DNA, 22 bp, Artificial Sequence
  chemically synthesized
attgggcaattctccattcttt

SEQ ID NO: 693881 - DNA, 22 bp, Artificial Sequence
  chemically synthesized
aagtcaaagaatggagaattgc

SEQ ID NO: 693882 - DNA, 22 bp, Artificial Sequence
  chemically synthesized
tataaaccctaattgggcaatt

SEQ ID NO: 693883 - DNA, 22 bp, Artificial Sequence
  chemically synthesized
atataaaccctaattgggcaat

SEQ ID NO: 693884 - DNA, 22 bp, Artificial Sequence
  chemically synthesized
tatataaaccctaattgggcaa

SEQ ID NO: 693885 - DNA, 22 bp, Artificial Sequence
  chemically synthesized
attttatataaaccctaattgg

SEQ ID NO: 693886 - DNA, 22 bp, Artificial Sequence
  chemically synthesized
aaaactaattttatataaaccc

SEQ ID NO: 693887 - DNA, 22 bp, Artificial Sequence
  chemically synthesized
gaaaactaattttatataaacc

SEQ ID NO: 693888 - DNA, 22 bp, Artificial Sequence
  chemically synthesized
cccaattagggtttatataaaa

SEQ ID NO: 693889 - DNA, 22 bp, Artificial Sequence
  chemically synthesized
aatttgaaaactaattttatat

SEQ ID NO: 693890 - DNA, 22 bp, Artificial Sequence
  chemically synthesized
aaatttgaaaactaattttata

SEQ ID NO: 693891 - DNA, 22 bp, Artificial Sequence
  chemically synthesized
taaatttgaaaactaattttat

SEQ ID NO: 693892 - DNA, 22 bp, Artificial Sequence
  chemically synthesized
ttaaatttgaaaactaatttta

SEQ ID NO: 693893 - DNA, 22 bp, Artificial Sequence
  chemically synthesized
tttaaatttgaaaactaatttt

SEQ ID NO: 693894 - DNA, 22 bp, Artificial Sequence
  chemically synthesized
ttttaaatttgaaaactaattt

SEQ ID NO: 693895 - DNA, 22 bp, Artificial Sequence
  chemically synthesized
gggtttatataaaattagtttt

SEQ ID NO: 693896 - DNA, 22 bp, Artificial Sequence
  chemically synthesized
tttttaaatttgaaaactaatt

SEQ ID NO: 693897 - DNA, 22 bp, Artificial Sequence
  chemically synthesized
ttttttaaatttgaaaactaat

SEQ ID NO: 693898 - DNA, 22 bp, Artificial Sequence
  chemically synthesized
atataaaattagttttcaaatt

SEQ ID NO: 693899 - DNA, 22 bp, Artificial Sequence
  chemically synthesized
gatttttttttaaatttgaaaa

SEQ ID NO: 693900 - DNA, 22 bp, Artificial Sequence
  chemically synthesized
tataaaattagttttcaaattt

SEQ ID NO: 693901 - DNA, 22 bp, Artificial Sequence
  chemically synthesized
gtctggatttttttttaaattt

SEQ ID NO: 693902 - DNA, 22 bp, Artificial Sequence
  chemically synthesized
agtctggatttttttttaaatt

SEQ ID NO: 693903 - DNA, 22 bp, Artificial Sequence
  chemically synthesized
gttttcaaatttaaaaaaaaat

SEQ ID NO: 693904 - DNA, 22 bp, Artificial Sequence
  chemically synthesized
tcaaatttaaaaaaaaatccag

SEQ ID NO: 693905 - DNA, 22 bp, Artificial Sequence
  chemically synthesized
caaatttaaaaaaaaatccaga

SEQ ID NO: 693906 - DNA, 22 bp, Artificial Sequence
  chemically synthesized
aaatttaaaaaaaaatccagac

SEQ ID NO: 693907 - DNA, 22 bp, Artificial Sequence
  chemically synthesized
taaagatataatttagtctgga

SEQ ID NO: 693908 - DNA, 22 bp, Artificial Sequence
  chemically synthesized
aaaaaaaaatccagactaaatt

SEQ ID NO: 693909 - DNA, 22 bp, Artificial Sequence
  chemically synthesized
aaaaaaaatccagactaaatta

SEQ ID NO: 693910 - DNA, 22 bp, Artificial Sequence
  chemically synthesized
tacattataaagatataattta

SEQ ID NO: 693911 - DNA, 22 bp, Artificial Sequence
  chemically synthesized
agggttatacattataaagata

SEQ ID NO: 693912 - DNA, 22 bp, Artificial Sequence
  chemically synthesized
aagggttatacattataaagat

SEQ ID NO: 693913 - DNA, 22 bp, Artificial Sequence
  chemically synthesized
ttaagggttatacattataaag

SEQ ID NO: 693914 - DNA, 22 bp, Artificial Sequence
  chemically synthesized
aattatatctttataatgtata

SEQ ID NO: 693915 - DNA, 22 bp, Artificial Sequence
  chemically synthesized
tatctttataatgtataaccct

SEQ ID NO: 693916 - DNA, 22 bp, Artificial Sequence
  chemically synthesized
tataatgtataacccttaagag

SEQ ID NO: 693917 - DNA, 22 bp, Artificial Sequence
  chemically synthesized
ataatgtataacccttaagagt

SEQ ID NO: 693918 - DNA, 22 bp, Artificial Sequence
  chemically synthesized
taatgtataacccttaagagtt

SEQ ID NO: 693919 - DNA, 22 bp, Artificial Sequence
  chemically synthesized
tgaaccaaccagaagatatata

SEQ ID NO: 693920 - DNA, 22 bp, Artificial Sequence
  chemically synthesized
atgaaccaaccagaagatatat

SEQ ID NO: 693921 - DNA, 22 bp, Artificial Sequence
  chemically synthesized
aagagttgtttatatatcttct

SEQ ID NO: 693922 - DNA, 22 bp, Artificial Sequence
  chemically synthesized
agagttgtttatatatcttctg

SEQ ID NO: 693923 - DNA, 22 bp, Artificial Sequence
  chemically synthesized
cgcttatgaaccaaccagaaga

SEQ ID NO: 693924 - DNA, 22 bp, Artificial Sequence
  chemically synthesized
ccgcttatgaaccaaccagaag

SEQ ID NO: 693925 - DNA, 22 bp, Artificial Sequence
  chemically synthesized
ttccgcttatgaaccaaccaga

SEQ ID NO: 693926 - DNA, 22 bp, Artificial Sequence
  chemically synthesized
tttatatatcttctggttggtt

SEQ ID NO: 693927 - DNA, 22 bp, Artificial Sequence
  chemically synthesized
atatatcttctggttggttcat

SEQ ID NO: 693928 - DNA, 22 bp, Artificial Sequence
  chemically synthesized
tatatcttctggttggttcata

SEQ ID NO: 693929 - DNA, 22 bp, Artificial Sequence
  chemically synthesized
ctggttggttcataagcggaag

SEQ ID NO: 693930 - DNA, 22 bp, Artificial Sequence
  chemically synthesized
tggttggttcataagcggaaga

SEQ ID NO: 693931 - DNA, 22 bp, Artificial Sequence
  chemically synthesized
gttggttcataagcggaagagc

SEQ ID NO: 693932 - DNA, 22 bp, Artificial Sequence
  chemically synthesized
aacagtgcagcagctcttccgc

SEQ ID NO: 693933 - DNA, 22 bp, Artificial Sequence
  chemically synthesized
gttcataagcggaagagctgct

SEQ ID NO: 693934 - DNA, 22 bp, Artificial Sequence
  chemically synthesized
ataagcggaagagctgctgcac

SEQ ID NO: 693935 - DNA, 22 bp, Artificial Sequence
  chemically synthesized
ctgcactgttcagtatcatttc

SEQ ID NO: 693936 - DNA, 22 bp, Artificial Sequence
  chemically synthesized
agtgaaatatggggaaatgata

SEQ ID NO: 693937 - DNA, 22 bp, Artificial Sequence
  chemically synthesized
cactgttcagtatcatttcccc

SEQ ID NO: 693938 - DNA, 22 bp, Artificial Sequence
  chemically synthesized
tcagtgaaatatggggaaatga

SEQ ID NO: 693939 - DNA, 22 bp, Artificial Sequence
  chemically synthesized
ctcagtgaaatatggggaaatg

SEQ ID NO: 693940 - DNA, 22 bp, Artificial Sequence
  chemically synthesized
ttcagtatcatttccccatatt

SEQ ID NO: 693941 - DNA, 22 bp, Artificial Sequence
  chemically synthesized
atttctcagtgaaatatgggga

SEQ ID NO: 693942 - DNA, 22 bp, Artificial Sequence
  chemically synthesized
catttctcagtgaaatatgggg

SEQ ID NO: 693943 - DNA, 22 bp, Artificial Sequence
  chemically synthesized
agtatcatttccccatatttca

SEQ ID NO: 693944 - DNA, 22 bp, Artificial Sequence
  chemically synthesized
aacttcatttctcagtgaaata

SEQ ID NO: 693945 - DNA, 22 bp, Artificial Sequence
  chemically synthesized
tgaacttcatttctcagtgaaa

SEQ ID NO: 693946 - DNA, 22 bp, Artificial Sequence
  chemically synthesized
tctgaacttcatttctcagtga

SEQ ID NO: 693947 - DNA, 22 bp, Artificial Sequence
  chemically synthesized
ccccatatttcactgagaaatg

SEQ ID NO: 693948 - DNA, 22 bp, Artificial Sequence
  chemically synthesized
ctctctgaacttcatttctcag

SEQ ID NO: 693949 - DNA, 22 bp, Artificial Sequence
  chemically synthesized
cccatatttcactgagaaatga

SEQ ID NO: 693950 - DNA, 22 bp, Artificial Sequence
  chemically synthesized
attactctctgaacttcatttc

SEQ ID NO: 693951 - DNA, 22 bp, Artificial Sequence
  chemically synthesized
cattactctctgaacttcattt

SEQ ID NO: 693952 - DNA, 22 bp, Artificial Sequence
  chemically synthesized
cactgagaaatgaagttcagag

SEQ ID NO: 693953 - DNA, 22 bp, Artificial Sequence
  chemically synthesized
actgagaaatgaagttcagaga

SEQ ID NO: 693954 - DNA, 22 bp, Artificial Sequence
  chemically synthesized
cataatttcattactctctgaa

SEQ ID NO: 693955 - DNA, 22 bp, Artificial Sequence
  chemically synthesized
acataatttcattactctctga

SEQ ID NO: 693956 - DNA, 22 bp, Artificial Sequence
  chemically synthesized
agaaatgaagttcagagagtaa

SEQ ID NO: 693957 - DNA, 22 bp, Artificial Sequence
  chemically synthesized
agagagtaatgaaattatgtaa

SEQ ID NO: 693958 - DNA, 22 bp, Artificial Sequence
  chemically synthesized
taaaataatatgtatgccctta

SEQ ID NO: 693959 - DNA, 22 bp, Artificial Sequence
  chemically synthesized
tagatgttataaaataatatgt

SEQ ID NO: 693960 - DNA, 22 bp, Artificial Sequence
  chemically synthesized
tgtaagggcatacatattattt

SEQ ID NO: 693961 - DNA, 22 bp, Artificial Sequence
  chemically synthesized
tatagatgttataaaataatat

SEQ ID NO: 693962 - DNA, 22 bp, Artificial Sequence
  chemically synthesized
ttttataacatctatagaattt

SEQ ID NO: 693963 - DNA, 22 bp, Artificial Sequence
  chemically synthesized
tataacatctatagaatttaca

SEQ ID NO: 693964 - DNA, 22 bp, Artificial Sequence
  chemically synthesized
ataacatctatagaatttacat

SEQ ID NO: 693965 - DNA, 22 bp, Artificial Sequence
  chemically synthesized
taacatctatagaatttacatc

SEQ ID NO: 693966 - DNA, 22 bp, Artificial Sequence
  chemically synthesized
ggcatgagagtccaaagatgta

SEQ ID NO: 693967 - DNA, 22 bp, Artificial Sequence
  chemically synthesized
aggcatgagagtccaaagatgt

SEQ ID NO: 693968 - DNA, 22 bp, Artificial Sequence
  chemically synthesized
tagaatttacatctttggactc

SEQ ID NO: 693969 - DNA, 22 bp, Artificial Sequence
  chemically synthesized
aatttaggcatgagagtccaaa

SEQ ID NO: 693970 - DNA, 22 bp, Artificial Sequence
  chemically synthesized
acatctttggactctcatgcct

SEQ ID NO: 693971 - DNA, 22 bp, Artificial Sequence
  chemically synthesized
catctttggactctcatgccta

SEQ ID NO: 693972 - DNA, 22 bp, Artificial Sequence
  chemically synthesized
tggactctcatgcctaaattta

SEQ ID NO: 693973 - DNA, 22 bp, Artificial Sequence
  chemically synthesized
ggactctcatgcctaaatttaa

SEQ ID NO: 693974 - DNA, 22 bp, Artificial Sequence
  chemically synthesized
gactctcatgcctaaatttaat

SEQ ID NO: 693975 - DNA, 22 bp, Artificial Sequence
  chemically synthesized
tcatgcctaaatttaatttcct

SEQ ID NO: 693976 - DNA, 22 bp, Artificial Sequence
  chemically synthesized
atgcctaaatttaatttcctat

SEQ ID NO: 693977 - DNA, 22 bp, Artificial Sequence
  chemically synthesized
aatttaatttcctattggttta

SEQ ID NO: 693978 - DNA, 22 bp, Artificial Sequence
  chemically synthesized
aatttcctattggtttattatt

SEQ ID NO: 693979 - DNA, 22 bp, Artificial Sequence
  chemically synthesized
atttcctattggtttattattt

SEQ ID NO: 693980 - DNA, 22 bp, Artificial Sequence
  chemically synthesized
cctattggtttattatttcatc

SEQ ID NO: 693981 - DNA, 22 bp, Artificial Sequence
  chemically synthesized
ctattggtttattatttcatct

SEQ ID NO: 693982 - DNA, 22 bp, Artificial Sequence
  chemically synthesized
ttggtttattatttcatctccg

SEQ ID NO: 693983 - DNA, 22 bp, Artificial Sequence
  chemically synthesized
gtttattatttcatctccgcct

SEQ ID NO: 693984 - DNA, 22 bp, Artificial Sequence
  chemically synthesized
attatttcatctccgcctgact

SEQ ID NO: 693985 - DNA, 22 bp, Artificial Sequence
  chemically synthesized
ttatttcatctccgcctgactt

SEQ ID NO: 693986 - DNA, 22 bp, Artificial Sequence
  chemically synthesized
tttcatctccgcctgacttctg

SEQ ID NO: 693987 - DNA, 22 bp, Artificial Sequence
  chemically synthesized
ggatataaaacacagaagtcag

SEQ ID NO: 693988 - DNA, 22 bp, Artificial Sequence
  chemically synthesized
gggatataaaacacagaagtca

SEQ ID NO: 693989 - DNA, 22 bp, Artificial Sequence
  chemically synthesized
catctccgcctgacttctgtgt

SEQ ID NO: 693990 - DNA, 22 bp, Artificial Sequence
  chemically synthesized
atctccgcctgacttctgtgtt

SEQ ID NO: 693991 - DNA, 22 bp, Artificial Sequence
  chemically synthesized
atttgggatataaaacacagaa

SEQ ID NO: 693992 - DNA, 22 bp, Artificial Sequence
  chemically synthesized
aatttgggatataaaacacaga

SEQ ID NO: 693993 - DNA, 22 bp, Artificial Sequence
  chemically synthesized
cgcctgacttctgtgttttata

SEQ ID NO: 693994 - DNA, 22 bp, Artificial Sequence
  chemically synthesized
acttctgtgttttatatcccaa

SEQ ID NO: 693995 - DNA, 22 bp, Artificial Sequence
  chemically synthesized
tgggaaatttaatttgggatat

SEQ ID NO: 693996 - DNA, 22 bp, Artificial Sequence
  chemically synthesized
ctgtgttttatatcccaaatta

SEQ ID NO: 693997 - DNA, 22 bp, Artificial Sequence
  chemically synthesized
tgtgttttatatcccaaattaa

SEQ ID NO: 693998 - DNA, 22 bp, Artificial Sequence
  chemically synthesized
tgttttatatcccaaattaaat

SEQ ID NO: 693999 - DNA, 22 bp, Artificial Sequence
  chemically synthesized
aggaaatctgtgggaaatttaa

SEQ ID NO: 694000 - DNA, 22 bp, Artificial Sequence
  chemically synthesized
tatatcccaaattaaatttccc

SEQ ID NO: 694001 - DNA, 22 bp, Artificial Sequence
  chemically synthesized
atatcccaaattaaatttccca

SEQ ID NO: 694002 - DNA, 22 bp, Artificial Sequence
  chemically synthesized
tatcccaaattaaatttcccac

SEQ ID NO: 694003 - DNA, 22 bp, Artificial Sequence
  chemically synthesized
aatttcccacagatttccttag

SEQ ID NO: 694004 - DNA, 22 bp, Artificial Sequence
  chemically synthesized
tagagtaataatatacctaagg

SEQ ID NO: 694005 - DNA, 22 bp, Artificial Sequence
  chemically synthesized
cccacagatttccttaggtata

SEQ ID NO: 694006 - DNA, 22 bp, Artificial Sequence
  chemically synthesized
atagagtaataatatacctaag

SEQ ID NO: 694007 - DNA, 22 bp, Artificial Sequence
  chemically synthesized
ccacagatttccttaggtatat

SEQ ID NO: 694008 - DNA, 22 bp, Artificial Sequence
  chemically synthesized
tatagagtaataatatacctaa

SEQ ID NO: 694009 - DNA, 22 bp, Artificial Sequence
  chemically synthesized
ccattttatagagtaataatat

SEQ ID NO: 694010 - DNA, 22 bp, Artificial Sequence
  chemically synthesized
ttgccattttatagagtaataa

SEQ ID NO: 694011 - DNA, 22 bp, Artificial Sequence
  chemically synthesized
ccttaggtatattattactcta

SEQ ID NO: 694012 - DNA, 22 bp, Artificial Sequence
  chemically synthesized
cttaggtatattattactctat

SEQ ID NO: 694013 - DNA, 22 bp, Artificial Sequence
  chemically synthesized
aggtatattattactctataaa

SEQ ID NO: 694014 - DNA, 22 bp, Artificial Sequence
  chemically synthesized
ggtatattattactctataaaa

SEQ ID NO: 694015 - DNA, 22 bp, Artificial Sequence
  chemically synthesized
tagtgaacagattattgccatt

SEQ ID NO: 694016 - DNA, 22 bp, Artificial Sequence
  chemically synthesized
ttactctataaaatggcaataa

SEQ ID NO: 694017 - DNA, 22 bp, Artificial Sequence
  chemically synthesized
ctctataaaatggcaataatct

SEQ ID NO: 694018 - DNA, 22 bp, Artificial Sequence
  chemically synthesized
gctatagtgaacagattattgc

SEQ ID NO: 694019 - DNA, 22 bp, Artificial Sequence
  chemically synthesized
tataaaatggcaataatctgtt

SEQ ID NO: 694020 - DNA, 22 bp, Artificial Sequence
  chemically synthesized
taaaatggcaataatctgttca

SEQ ID NO: 694021 - DNA, 22 bp, Artificial Sequence
  chemically synthesized
agcaatagtgttggctatagtg

SEQ ID NO: 694022 - DNA, 22 bp, Artificial Sequence
  chemically synthesized
ttcactatagccaacactattg

SEQ ID NO: 694023 - DNA, 22 bp, Artificial Sequence
  chemically synthesized
caaagatgattaagcaatagtg

SEQ ID NO: 694024 - DNA, 22 bp, Artificial Sequence
  chemically synthesized
actatagccaacactattgctt

SEQ ID NO: 694025 - DNA, 22 bp, Artificial Sequence
  chemically synthesized
tagccaacactattgcttaatc

SEQ ID NO: 694026 - DNA, 22 bp, Artificial Sequence
  chemically synthesized
ttgcttaatcatctttgtaatt

SEQ ID NO: 694027 - DNA, 22 bp, Artificial Sequence
  chemically synthesized
cttaatcatctttgtaattatt

SEQ ID NO: 694028 - DNA, 22 bp, Artificial Sequence
  chemically synthesized
aatcatctttgtaattatttta

SEQ ID NO: 694029 - DNA, 22 bp, Artificial Sequence
  chemically synthesized
atcatctttgtaattattttat

SEQ ID NO: 694030 - DNA, 22 bp, Artificial Sequence
  chemically synthesized
tgtaattattttatcatttctc

SEQ ID NO: 694031 - DNA, 22 bp, Artificial Sequence
  chemically synthesized
gtaattattttatcatttctct

SEQ ID NO: 694032 - DNA, 22 bp, Artificial Sequence
  chemically synthesized
taattattttatcatttctcta

SEQ ID NO: 694033 - DNA, 22 bp, Artificial Sequence
  chemically synthesized
caaaacaaaaaatagagaaatg

SEQ ID NO: 694034 - DNA, 22 bp, Artificial Sequence
  chemically synthesized
ttttatcatttctctatttttt

SEQ ID NO: 694035 - DNA, 22 bp, Artificial Sequence
  chemically synthesized
tatcatttctctattttttgtt

SEQ ID NO: 694036 - DNA, 22 bp, Artificial Sequence
  chemically synthesized
atcatttctctattttttgttt

SEQ ID NO: 694037 - DNA, 22 bp, Artificial Sequence
  chemically synthesized
tcatttctctattttttgtttt

SEQ ID NO: 694038 - DNA, 22 bp, Artificial Sequence
  chemically synthesized
aatatgtgtattacaaaacaaa

SEQ ID NO: 694039 - DNA, 22 bp, Artificial Sequence
  chemically synthesized
ctaaatatgtgtattacaaaac

SEQ ID NO: 694040 - DNA, 22 bp, Artificial Sequence
  chemically synthesized
ctctattttttgttttgtaata

SEQ ID NO: 694041 - DNA, 22 bp, Artificial Sequence
  chemically synthesized
cctaaatatgtgtattacaaaa

SEQ ID NO: 694042 - DNA, 22 bp, Artificial Sequence
  chemically synthesized
tctattttttgttttgtaatac

SEQ ID NO: 694043 - DNA, 22 bp, Artificial Sequence
  chemically synthesized
tcctaaatatgtgtattacaaa

SEQ ID NO: 694044 - DNA, 22 bp, Artificial Sequence
  chemically synthesized
tattttttgttttgtaatacac

SEQ ID NO: 694045 - DNA, 22 bp, Artificial Sequence
  chemically synthesized
ttttttgttttgtaatacacat

SEQ ID NO: 694046 - DNA, 22 bp, Artificial Sequence
  chemically synthesized
tcctttcctaaatatgtgtatt

SEQ ID NO: 694047 - DNA, 22 bp, Artificial Sequence
  chemically synthesized
gtcctttcctaaatatgtgtat

SEQ ID NO: 694048 - DNA, 22 bp, Artificial Sequence
  chemically synthesized
tttgttttgtaatacacatatt

SEQ ID NO: 694049 - DNA, 22 bp, Artificial Sequence
  chemically synthesized
ttgttttgtaatacacatattt

SEQ ID NO: 694050 - DNA, 22 bp, Artificial Sequence
  chemically synthesized
tgttttgtaatacacatattta

SEQ ID NO: 694051 - DNA, 22 bp, Artificial Sequence
  chemically synthesized
cttgtcctttcctaaatatgtg

SEQ ID NO: 694052 - DNA, 22 bp, Artificial Sequence
  chemically synthesized
gttttgtaatacacatatttag

SEQ ID NO: 694053 - DNA, 22 bp, Artificial Sequence
  chemically synthesized
acttgtcctttcctaaatatgt

SEQ ID NO: 694054 - DNA, 22 bp, Artificial Sequence
  chemically synthesized
ttttgtaatacacatatttagg

SEQ ID NO: 694055 - DNA, 22 bp, Artificial Sequence
  chemically synthesized
tgtaatacacatatttaggaaa

SEQ ID NO: 694056 - DNA, 22 bp, Artificial Sequence
  chemically synthesized
gtttacttgtcctttcctaaat

SEQ ID NO: 694057 - DNA, 22 bp, Artificial Sequence
  chemically synthesized
gtaatacacatatttaggaaag

SEQ ID NO: 694058 - DNA, 22 bp, Artificial Sequence
  chemically synthesized
ggtttacttgtcctttcctaaa

SEQ ID NO: 694059 - DNA, 22 bp, Artificial Sequence
  chemically synthesized
taatacacatatttaggaaagg

SEQ ID NO: 694060 - DNA, 22 bp, Artificial Sequence
  chemically synthesized
ggaatttggtttacttgtcctt

SEQ ID NO: 694061 - DNA, 22 bp, Artificial Sequence
  chemically synthesized
aggaatttggtttacttgtcct

SEQ ID NO: 694062 - DNA, 22 bp, Artificial Sequence
  chemically synthesized
aggaaaggacaagtaaaccaaa

SEQ ID NO: 694063 - DNA, 22 bp, Artificial Sequence
  chemically synthesized
tcaatttaggaatttggtttac

SEQ ID NO: 694064 - DNA, 22 bp, Artificial Sequence
  chemically synthesized
ggaaaggacaagtaaaccaaat

SEQ ID NO: 694065 - DNA, 22 bp, Artificial Sequence
  chemically synthesized
gtcaatttaggaatttggttta

SEQ ID NO: 694066 - DNA, 22 bp, Artificial Sequence
  chemically synthesized
tgtcaatttaggaatttggttt

SEQ ID NO: 694067 - DNA, 22 bp, Artificial Sequence
  chemically synthesized
tacgtagtactttgtcaattta

SEQ ID NO: 694068 - DNA, 22 bp, Artificial Sequence
  chemically synthesized
atacgtagtactttgtcaattt

SEQ ID NO: 694069 - DNA, 22 bp, Artificial Sequence
  chemically synthesized
atttatacgtagtactttgtca

SEQ ID NO: 694070 - DNA, 22 bp, Artificial Sequence
  chemically synthesized
aatttatacgtagtactttgtc

SEQ ID NO: 694071 - DNA, 22 bp, Artificial Sequence
  chemically synthesized
tttaatttatacgtagtacttt

SEQ ID NO: 694072 - DNA, 22 bp, Artificial Sequence
  chemically synthesized
ctaaattgacaaagtactacgt

SEQ ID NO: 694073 - DNA, 22 bp, Artificial Sequence
  chemically synthesized
tgtttaatttatacgtagtact

SEQ ID NO: 694074 - DNA, 22 bp, Artificial Sequence
  chemically synthesized
ctgtttaatttatacgtagtac

SEQ ID NO: 694075 - DNA, 22 bp, Artificial Sequence
  chemically synthesized
aattgacaaagtactacgtata

SEQ ID NO: 694076 - DNA, 22 bp, Artificial Sequence
  chemically synthesized
acaaagtactacgtataaatta

SEQ ID NO: 694077 - DNA, 22 bp, Artificial Sequence
  chemically synthesized
taccaacttctgtttaatttat

SEQ ID NO: 694078 - DNA, 22 bp, Artificial Sequence
  chemically synthesized
actgtaccaacttctgtttaat

SEQ ID NO: 694079 - DNA, 22 bp, Artificial Sequence
  chemically synthesized
gactgtaccaacttctgtttaa

SEQ ID NO: 694080 - DNA, 22 bp, Artificial Sequence
  chemically synthesized
cgtataaattaaacagaagttg

SEQ ID NO: 694081 - DNA, 22 bp, Artificial Sequence
  chemically synthesized
atgcttgactgtaccaacttct

SEQ ID NO: 694082 - DNA, 22 bp, Artificial Sequence
  chemically synthesized
agagattcatgcttgactgtac

SEQ ID NO: 694083 - DNA, 22 bp, Artificial Sequence
  chemically synthesized
aacagaagttggtacagtcaag

SEQ ID NO: 694084 - DNA, 22 bp, Artificial Sequence
  chemically synthesized
ttcagagattcatgcttgactg

SEQ ID NO: 694085 - DNA, 22 bp, Artificial Sequence
  chemically synthesized
attcagagattcatgcttgact

SEQ ID NO: 694086 - DNA, 22 bp, Artificial Sequence
  chemically synthesized
tattcagagattcatgcttgac

SEQ ID NO: 694087 - DNA, 22 bp, Artificial Sequence
  chemically synthesized
gtacagtcaagcatgaatctct

SEQ ID NO: 694088 - DNA, 22 bp, Artificial Sequence
  chemically synthesized
gtggctttattcagagattcat

SEQ ID NO: 694089 - DNA, 22 bp, Artificial Sequence
  chemically synthesized
aaagttggtggctttattcaga

SEQ ID NO: 694090 - DNA, 22 bp, Artificial Sequence
  chemically synthesized
tcaaagttggtggctttattca

SEQ ID NO: 694091 - DNA, 22 bp, Artificial Sequence
  chemically synthesized
ctcaaagttggtggctttattc

SEQ ID NO: 694092 - DNA, 22 bp, Artificial Sequence
  chemically synthesized
gaaacacttctcaaagttggtg

SEQ ID NO: 694093 - DNA, 22 bp, Artificial Sequence
  chemically synthesized
tgaataaagccaccaactttga

SEQ ID NO: 694094 - DNA, 22 bp, Artificial Sequence
  chemically synthesized
ttggaaacacttctcaaagttg

SEQ ID NO: 694095 - DNA, 22 bp, Artificial Sequence
  chemically synthesized
aataaagccaccaactttgaga

SEQ ID NO: 694096 - DNA, 22 bp, Artificial Sequence
  chemically synthesized
aggttgttggaaacacttctca

SEQ ID NO: 694097 - DNA, 22 bp, Artificial Sequence
  chemically synthesized
gaggttgttggaaacacttctc

SEQ ID NO: 694098 - DNA, 22 bp, Artificial Sequence
  chemically synthesized
tgagaagtgtttccaacaacct

SEQ ID NO: 694099 - DNA, 22 bp, Artificial Sequence
  chemically synthesized
gagaagtgtttccaacaacctc

SEQ ID NO: 694100 - DNA, 22 bp, Artificial Sequence
  chemically synthesized
agaagtgtttccaacaacctca

SEQ ID NO: 694101 - DNA, 22 bp, Artificial Sequence
  chemically synthesized
ccaacaacctcaagtacttttt

SEQ ID NO: 694102 - DNA, 22 bp, Artificial Sequence
  chemically synthesized
caacaacctcaagtactttttt

SEQ ID NO: 694103 - DNA, 22 bp, Artificial Sequence
  chemically synthesized
taaagagtggagtgaagaaaaa

SEQ ID NO: 694104 - DNA, 22 bp, Artificial Sequence
  chemically synthesized
ataaagagtggagtgaagaaaa

SEQ ID NO: 694105 - DNA, 22 bp, Artificial Sequence
  chemically synthesized
tataaagagtggagtgaagaaa

SEQ ID NO: 694106 - DNA, 22 bp, Artificial Sequence
  chemically synthesized
aagtactttttttcttcactcc

SEQ ID NO: 694107 - DNA, 22 bp, Artificial Sequence
  chemically synthesized
tttttcttcactccactcttta

SEQ ID NO: 694108 - DNA, 22 bp, Artificial Sequence
  chemically synthesized
ttttcttcactccactctttat

SEQ ID NO: 694109 - DNA, 22 bp, Artificial Sequence
  chemically synthesized
tcaccaagttttataaagagtg

SEQ ID NO: 694110 - DNA, 22 bp, Artificial Sequence
  chemically synthesized
tttcttcactccactctttata

SEQ ID NO: 694111 - DNA, 22 bp, Artificial Sequence
  chemically synthesized
atcaccaagttttataaagagt

SEQ ID NO: 694112 - DNA, 22 bp, Artificial Sequence
  chemically synthesized
ttcttcactccactctttataa

SEQ ID NO: 694113 - DNA, 22 bp, Artificial Sequence
  chemically synthesized
tatcaccaagttttataaagag

SEQ ID NO: 694114 - DNA, 22 bp, Artificial Sequence
  chemically synthesized
tcttcactccactctttataaa

SEQ ID NO: 694115 - DNA, 22 bp, Artificial Sequence
  chemically synthesized
cttcactccactctttataaaa

SEQ ID NO: 694116 - DNA, 22 bp, Artificial Sequence
  chemically synthesized
ttcactccactctttataaaac

SEQ ID NO: 694117 - DNA, 22 bp, Artificial Sequence
  chemically synthesized
cactccactctttataaaactt

SEQ ID NO: 694118 - DNA, 22 bp, Artificial Sequence
  chemically synthesized
actccactctttataaaacttg

SEQ ID NO: 694119 - DNA, 22 bp, Artificial Sequence
  chemically synthesized
cactctttataaaacttggtga

SEQ ID NO: 694120 - DNA, 22 bp, Artificial Sequence
  chemically synthesized
tttataaaacttggtgataaag

SEQ ID NO: 694121 - DNA, 22 bp, Artificial Sequence
  chemically synthesized
catcgtgaacacctttatcacc

SEQ ID NO: 694122 - DNA, 22 bp, Artificial Sequence
  chemically synthesized
tataaaacttggtgataaaggt

SEQ ID NO: 694123 - DNA, 22 bp, Artificial Sequence
  chemically synthesized
ataaaacttggtgataaaggtg

SEQ ID NO: 694124 - DNA, 22 bp, Artificial Sequence
  chemically synthesized
taaaacttggtgataaaggtgt

SEQ ID NO: 694125 - DNA, 22 bp, Artificial Sequence
  chemically synthesized
gttccatcgtgaacacctttat

SEQ ID NO: 694126 - DNA, 22 bp, Artificial Sequence
  chemically synthesized
agttccatcgtgaacaccttta

SEQ ID NO: 694127 - DNA, 22 bp, Artificial Sequence
  chemically synthesized
tagttccatcgtgaacaccttt

SEQ ID NO: 694128 - DNA, 22 bp, Artificial Sequence
  chemically synthesized
ttagttccatcgtgaacacctt

SEQ ID NO: 694129 - DNA, 22 bp, Artificial Sequence
  chemically synthesized
ggtgataaaggtgttcacgatg

SEQ ID NO: 694130 - DNA, 22 bp, Artificial Sequence
  chemically synthesized
gtgataaaggtgttcacgatgg

SEQ ID NO: 694131 - DNA, 22 bp, Artificial Sequence
  chemically synthesized
atccaaataacttttagttcca

SEQ ID NO: 694132 - DNA, 22 bp, Artificial Sequence
  chemically synthesized
aatccaaataacttttagttcc

SEQ ID NO: 694133 - DNA, 22 bp, Artificial Sequence
  chemically synthesized
taatccaaataacttttagttc

SEQ ID NO: 694134 - DNA, 22 bp, Artificial Sequence
  chemically synthesized
acgatggaactaaaagttattt

SEQ ID NO: 694135 - DNA, 22 bp, Artificial Sequence
  chemically synthesized
aaagttatttggattaaaatat

SEQ ID NO: 694136 - DNA, 22 bp, Artificial Sequence
  chemically synthesized
tttggattaaaatattgctggt

SEQ ID NO: 694137 - DNA, 22 bp, Artificial Sequence
  chemically synthesized
ggattaaaatattgctggtctg

SEQ ID NO: 694138 - DNA, 22 bp, Artificial Sequence
  chemically synthesized
gattaaaatattgctggtctgg

SEQ ID NO: 694139 - DNA, 22 bp, Artificial Sequence
  chemically synthesized
gggaagcatgaatcccagacca

SEQ ID NO: 694140 - DNA, 22 bp, Artificial Sequence
  chemically synthesized
ggggaagcatgaatcccagacc

SEQ ID NO: 694141 - DNA, 22 bp, Artificial Sequence
  chemically synthesized
aaatattgctggtctgggattc

SEQ ID NO: 694142 - DNA, 22 bp, Artificial Sequence
  chemically synthesized
cttggggaagcatgaatcccag

SEQ ID NO: 694143 - DNA, 22 bp, Artificial Sequence
  chemically synthesized
ctggtctgggattcatgcttcc

SEQ ID NO: 694144 - DNA, 22 bp, Artificial Sequence
  chemically synthesized
gtctgggattcatgcttcccca

SEQ ID NO: 694145 - DNA, 22 bp, Artificial Sequence
  chemically synthesized
gcaaatcaatattgcttgggga

SEQ ID NO: 694146 - DNA, 22 bp, Artificial Sequence
  chemically synthesized
ggattcatgcttccccaagcaa

SEQ ID NO: 694147 - DNA, 22 bp, Artificial Sequence
  chemically synthesized
atgcttccccaagcaatattga

SEQ ID NO: 694148 - DNA, 22 bp, Artificial Sequence
  chemically synthesized
ccccaagcaatattgatttgct

SEQ ID NO: 694149 - DNA, 22 bp, Artificial Sequence
  chemically synthesized
cccaagcaatattgatttgcta

SEQ ID NO: 694150 - DNA, 22 bp, Artificial Sequence
  chemically synthesized
aataagaacagaaaaaaatccc

SEQ ID NO: 694151 - DNA, 22 bp, Artificial Sequence
  chemically synthesized
atttgctaggggatttttttct

SEQ ID NO: 694152 - DNA, 22 bp, Artificial Sequence
  chemically synthesized
gctaggggatttttttctgttc

SEQ ID NO: 694153 - DNA, 22 bp, Artificial Sequence
  chemically synthesized
ctaggggatttttttctgttct

SEQ ID NO: 694154 - DNA, 22 bp, Artificial Sequence
  chemically synthesized
aaaagactgaataagaacagaa

SEQ ID NO: 694155 - DNA, 22 bp, Artificial Sequence
  chemically synthesized
ggggatttttttctgttcttat

SEQ ID NO: 694156 - DNA, 22 bp, Artificial Sequence
  chemically synthesized
aattaaaaagactgaataagaa

SEQ ID NO: 694157 - DNA, 22 bp, Artificial Sequence
  chemically synthesized
aaattaaaaagactgaataaga

SEQ ID NO: 694158 - DNA, 22 bp, Artificial Sequence
  chemically synthesized
taaattaaaaagactgaataag

SEQ ID NO: 694159 - DNA, 22 bp, Artificial Sequence
  chemically synthesized
ttttctgttcttattcagtctt

SEQ ID NO: 694160 - DNA, 22 bp, Artificial Sequence
  chemically synthesized
tttctgttcttattcagtcttt

SEQ ID NO: 694161 - DNA, 22 bp, Artificial Sequence
  chemically synthesized
ttctgttcttattcagtctttt

SEQ ID NO: 694162 - DNA, 22 bp, Artificial Sequence
  chemically synthesized
tctgttcttattcagtcttttt

SEQ ID NO: 694163 - DNA, 22 bp, Artificial Sequence
  chemically synthesized
ctgttcttattcagtcttttta

SEQ ID NO: 694164 - DNA, 22 bp, Artificial Sequence
  chemically synthesized
tgttcttattcagtctttttaa

SEQ ID NO: 694165 - DNA, 22 bp, Artificial Sequence
  chemically synthesized
ttcttattcagtctttttaatt

SEQ ID NO: 694166 - DNA, 22 bp, Artificial Sequence
  chemically synthesized
ttattcagtctttttaatttaa

SEQ ID NO: 694167 - DNA, 22 bp, Artificial Sequence
  chemically synthesized
attcagtctttttaatttaaaa

SEQ ID NO: 694168 - DNA, 22 bp, Artificial Sequence
  chemically synthesized
ttcagtctttttaatttaaaat

SEQ ID NO: 694169 - DNA, 22 bp, Artificial Sequence
  chemically synthesized
agtctttttaatttaaaatatt

SEQ ID NO: 694170 - DNA, 22 bp, Artificial Sequence
  chemically synthesized
tttaatttaaaatattttatat

SEQ ID NO: 694171 - DNA, 22 bp, Artificial Sequence
  chemically synthesized
ttaatttaaaatattttatatt

SEQ ID NO: 694172 - DNA, 22 bp, Artificial Sequence
  chemically synthesized
taatttaaaatattttatattt

SEQ ID NO: 694173 - DNA, 22 bp, Artificial Sequence
  chemically synthesized
aatttaaaatattttatattta

SEQ ID NO: 694174 - DNA, 22 bp, Artificial Sequence
  chemically synthesized
atttaaaatattttatatttat

SEQ ID NO: 694175 - DNA, 22 bp, Artificial Sequence
  chemically synthesized
aaaatattttatatttatgttg

SEQ ID NO: 694176 - DNA, 22 bp, Artificial Sequence
  chemically synthesized
aaatattttatatttatgttgc

SEQ ID NO: 694177 - DNA, 22 bp, Artificial Sequence
  chemically synthesized
tatatttatgttgctttttttc

SEQ ID NO: 694178 - DNA, 22 bp, Artificial Sequence
  chemically synthesized
agtaaaacatcagaaaaaaagc

SEQ ID NO: 694179 - DNA, 22 bp, Artificial Sequence
  chemically synthesized
atatttatgttgctttttttct

SEQ ID NO: 694180 - DNA, 22 bp, Artificial Sequence
  chemically synthesized
tatttatgttgctttttttctg

SEQ ID NO: 694181 - DNA, 22 bp, Artificial Sequence
  chemically synthesized
attcagtaaaacatcagaaaaa

SEQ ID NO: 694182 - DNA, 22 bp, Artificial Sequence
  chemically synthesized
atgttgctttttttctgatgtt

SEQ ID NO: 694183 - DNA, 22 bp, Artificial Sequence
  chemically synthesized
tgttgctttttttctgatgttt

SEQ ID NO: 694184 - DNA, 22 bp, Artificial Sequence
  chemically synthesized
tagaattaattcagtaaaacat

SEQ ID NO: 694185 - DNA, 22 bp, Artificial Sequence
  chemically synthesized
ctttttttctgatgttttactg

SEQ ID NO: 694186 - DNA, 22 bp, Artificial Sequence
  chemically synthesized
tttttctgatgttttactgaat

SEQ ID NO: 694187 - DNA, 22 bp, Artificial Sequence
  chemically synthesized
ttttctgatgttttactgaatt

SEQ ID NO: 694188 - DNA, 22 bp, Artificial Sequence
  chemically synthesized
tttctgatgttttactgaatta

SEQ ID NO: 694189 - DNA, 22 bp, Artificial Sequence
  chemically synthesized
ttctgatgttttactgaattaa

SEQ ID NO: 694190 - DNA, 22 bp, Artificial Sequence
  chemically synthesized
gaaactatagaattaattcagt

SEQ ID NO: 694191 - DNA, 22 bp, Artificial Sequence
  chemically synthesized
tctgatgttttactgaattaat

SEQ ID NO: 694192 - DNA, 22 bp, Artificial Sequence
  chemically synthesized
ctgatgttttactgaattaatt

SEQ ID NO: 694193 - DNA, 22 bp, Artificial Sequence
  chemically synthesized
tgatgttttactgaattaattc

SEQ ID NO: 694194 - DNA, 22 bp, Artificial Sequence
  chemically synthesized
atgttttactgaattaattcta

SEQ ID NO: 694195 - DNA, 22 bp, Artificial Sequence
  chemically synthesized
ccgtggcctggaaactatagaa

SEQ ID NO: 694196 - DNA, 22 bp, Artificial Sequence
  chemically synthesized
tactgaattaattctatagttt

SEQ ID NO: 694197 - DNA, 22 bp, Artificial Sequence
  chemically synthesized
actgaattaattctatagtttc

SEQ ID NO: 694198 - DNA, 22 bp, Artificial Sequence
  chemically synthesized
ctgaattaattctatagtttcc

SEQ ID NO: 694199 - DNA, 22 bp, Artificial Sequence
  chemically synthesized
aattaattctatagtttccagg

SEQ ID NO: 694200 - DNA, 22 bp, Artificial Sequence
  chemically synthesized
cagtagttgccgtggcctggaa

SEQ ID NO: 694201 - DNA, 22 bp, Artificial Sequence
  chemically synthesized
acagtagttgccgtggcctgga

SEQ ID NO: 694202 - DNA, 22 bp, Artificial Sequence
  chemically synthesized
attctatagtttccaggccacg

SEQ ID NO: 694203 - DNA, 22 bp, Artificial Sequence
  chemically synthesized
tatagtttccaggccacggcaa

SEQ ID NO: 694204 - DNA, 22 bp, Artificial Sequence
  chemically synthesized
tagtttccaggccacggcaact

SEQ ID NO: 694205 - DNA, 22 bp, Artificial Sequence
  chemically synthesized
ccaggccacggcaactactgta

SEQ ID NO: 694206 - DNA, 22 bp, Artificial Sequence
  chemically synthesized
caggccacggcaactactgtaa

SEQ ID NO: 694207 - DNA, 22 bp, Artificial Sequence
  chemically synthesized
acagtatgggccatacccttac

SEQ ID NO: 694208 - DNA, 22 bp, Artificial Sequence
  chemically synthesized
ctgtaagggtatggcccatact

SEQ ID NO: 694209 - DNA, 22 bp, Artificial Sequence
  chemically synthesized
taagggtatggcccatactgtc

SEQ ID NO: 694210 - DNA, 22 bp, Artificial Sequence
  chemically synthesized
aataatataatctgacagtatg

SEQ ID NO: 694211 - DNA, 22 bp, Artificial Sequence
  chemically synthesized
tcagattatattattcagtgtt

SEQ ID NO: 694212 - DNA, 22 bp, Artificial Sequence
  chemically synthesized
agatgagcagaggaacactgaa

SEQ ID NO: 694213 - DNA, 22 bp, Artificial Sequence
  chemically synthesized
tattattcagtgttcctctgct

SEQ ID NO: 694214 - DNA, 22 bp, Artificial Sequence
  chemically synthesized
aaggatctgagatgagcagagg

SEQ ID NO: 694215 - DNA, 22 bp, Artificial Sequence
  chemically synthesized
tgaaggatctgagatgagcaga

SEQ ID NO: 694216 - DNA, 22 bp, Artificial Sequence
  chemically synthesized
ttcagtgttcctctgctcatct

SEQ ID NO: 694217 - DNA, 22 bp, Artificial Sequence
  chemically synthesized
agtgttcctctgctcatctcag

SEQ ID NO: 694218 - DNA, 22 bp, Artificial Sequence
  chemically synthesized
ctctgctcatctcagatccttc

SEQ ID NO: 694219 - DNA, 22 bp, Artificial Sequence
  chemically synthesized
tgctcatctcagatccttcaga

SEQ ID NO: 694220 - DNA, 22 bp, Artificial Sequence
  chemically synthesized
ctcatctcagatccttcagagg

SEQ ID NO: 694221 - DNA, 22 bp, Artificial Sequence
  chemically synthesized
atctcagatccttcagaggctg

SEQ ID NO: 694222 - DNA, 22 bp, Artificial Sequence
  chemically synthesized
agatccttcagaggctgctatt

SEQ ID NO: 694223 - DNA, 22 bp, Artificial Sequence
  chemically synthesized
cagaggctgctatttttacacg

SEQ ID NO: 694224 - DNA, 22 bp, Artificial Sequence
  chemically synthesized
agaggctgctatttttacacgt

SEQ ID NO: 694225 - DNA, 22 bp, Artificial Sequence
  chemically synthesized
atgtgtaatagaacgtgtaaaa

SEQ ID NO: 694226 - DNA, 22 bp, Artificial Sequence
  chemically synthesized
ctatttttacacgttctattac

SEQ ID NO: 694227 - DNA, 22 bp, Artificial Sequence
  chemically synthesized
aaagtcctgatgtgtaatagaa

SEQ ID NO: 694228 - DNA, 22 bp, Artificial Sequence
  chemically synthesized
tttttacacgttctattacaca

SEQ ID NO: 694229 - DNA, 22 bp, Artificial Sequence
  chemically synthesized
ttacacgttctattacacatca

SEQ ID NO: 694230 - DNA, 22 bp, Artificial Sequence
  chemically synthesized
tacacgttctattacacatcag

SEQ ID NO: 694231 - DNA, 22 bp, Artificial Sequence
  chemically synthesized
acacgttctattacacatcagg

SEQ ID NO: 694232 - DNA, 22 bp, Artificial Sequence
  chemically synthesized
aaacctaaaagtcctgatgtgt

SEQ ID NO: 694233 - DNA, 22 bp, Artificial Sequence
  chemically synthesized
cacgttctattacacatcagga

SEQ ID NO: 694234 - DNA, 22 bp, Artificial Sequence
  chemically synthesized
aaattaaaacctaaaagtcctg

SEQ ID NO: 694235 - DNA, 22 bp, Artificial Sequence
  chemically synthesized
aaaattaaaacctaaaagtcct

SEQ ID NO: 694236 - DNA, 22 bp, Artificial Sequence
  chemically synthesized
tattacacatcaggacttttag

SEQ ID NO: 694237 - DNA, 22 bp, Artificial Sequence
  chemically synthesized
taaaattaaaacctaaaagtcc

SEQ ID NO: 694238 - DNA, 22 bp, Artificial Sequence
  chemically synthesized
ttacacatcaggacttttaggt

SEQ ID NO: 694239 - DNA, 22 bp, Artificial Sequence
  chemically synthesized
tttaaaattaaaacctaaaagt

SEQ ID NO: 694240 - DNA, 22 bp, Artificial Sequence
  chemically synthesized
ctttaaaattaaaacctaaaag

SEQ ID NO: 694241 - DNA, 22 bp, Artificial Sequence
  chemically synthesized
cacatcaggacttttaggtttt

SEQ ID NO: 694242 - DNA, 22 bp, Artificial Sequence
  chemically synthesized
ttaggttttaattttaaagaag

SEQ ID NO: 694243 - DNA, 22 bp, Artificial Sequence
  chemically synthesized
aaatgtggaacacttctttaaa

SEQ ID NO: 694244 - DNA, 22 bp, Artificial Sequence
  chemically synthesized
taggttttaattttaaagaagt

SEQ ID NO: 694245 - DNA, 22 bp, Artificial Sequence
  chemically synthesized
aggttttaattttaaagaagtg

SEQ ID NO: 694246 - DNA, 22 bp, Artificial Sequence
  chemically synthesized
ggttttaattttaaagaagtgt

SEQ ID NO: 694247 - DNA, 22 bp, Artificial Sequence
  chemically synthesized
taattttaaagaagtgttccac

SEQ ID NO: 694248 - DNA, 22 bp, Artificial Sequence
  chemically synthesized
aattttaaagaagtgttccaca

SEQ ID NO: 694249 - DNA, 22 bp, Artificial Sequence
  chemically synthesized
attttaaagaagtgttccacat

SEQ ID NO: 694250 - DNA, 22 bp, Artificial Sequence
  chemically synthesized
taaagaagtgttccacatttga

SEQ ID NO: 694251 - DNA, 22 bp, Artificial Sequence
  chemically synthesized
aaagaagtgttccacatttgag

SEQ ID NO: 694252 - DNA, 22 bp, Artificial Sequence
  chemically synthesized
aagaagtgttccacatttgagc

SEQ ID NO: 694253 - DNA, 22 bp, Artificial Sequence
  chemically synthesized
agggtatatcagagggctcaaa

SEQ ID NO: 694254 - DNA, 22 bp, Artificial Sequence
  chemically synthesized
taactcagggtatatcagaggg

SEQ ID NO: 694255 - DNA, 22 bp, Artificial Sequence
  chemically synthesized
cacatttgagccctctgatata

SEQ ID NO: 694256 - DNA, 22 bp, Artificial Sequence
  chemically synthesized
taactataactcagggtatatc

SEQ ID NO: 694257 - DNA, 22 bp, Artificial Sequence
  chemically synthesized
gagccctctgatataccctgag

SEQ ID NO: 694258 - DNA, 22 bp, Artificial Sequence
  chemically synthesized
agccctctgatataccctgagt

SEQ ID NO: 694259 - DNA, 22 bp, Artificial Sequence
  chemically synthesized
taactgtaactataactcaggg

SEQ ID NO: 694260 - DNA, 22 bp, Artificial Sequence
  chemically synthesized
tgatataccctgagttatagtt

SEQ ID NO: 694261 - DNA, 22 bp, Artificial Sequence
  chemically synthesized
taactgtaactgtaactataac

SEQ ID NO: 694262 - DNA, 22 bp, Artificial Sequence
  chemically synthesized
atataccctgagttatagttac

SEQ ID NO: 694263 - DNA, 22 bp, Artificial Sequence
  chemically synthesized
actgtaactgtaactgtaacta

SEQ ID NO: 694264 - DNA, 22 bp, Artificial Sequence
  chemically synthesized
tctgactgtaactgtaactgta

SEQ ID NO: 694265 - DNA, 22 bp, Artificial Sequence
  chemically synthesized
agttatagttacagttacagtt

SEQ ID NO: 694266 - DNA, 22 bp, Artificial Sequence
  chemically synthesized
tagttacagttacagttacagt

SEQ ID NO: 694267 - DNA, 22 bp, Artificial Sequence
  chemically synthesized
agaagttatctgactgtaactg

SEQ ID NO: 694268 - DNA, 22 bp, Artificial Sequence
  chemically synthesized
tgagaagttatctgactgtaac

SEQ ID NO: 694269 - DNA, 22 bp, Artificial Sequence
  chemically synthesized
ctgagaagttatctgactgtaa

SEQ ID NO: 694270 - DNA, 22 bp, Artificial Sequence
  chemically synthesized
tctgagaagttatctgactgta

SEQ ID NO: 694271 - DNA, 22 bp, Artificial Sequence
  chemically synthesized
ttctgagaagttatctgactgt

SEQ ID NO: 694272 - DNA, 22 bp, Artificial Sequence
  chemically synthesized
cagttacagttacagtcagata

SEQ ID NO: 694273 - DNA, 22 bp, Artificial Sequence
  chemically synthesized
tttctgagaagttatctgactg

SEQ ID NO: 694274 - DNA, 22 bp, Artificial Sequence
  chemically synthesized
cagttacagtcagataacttct

SEQ ID NO: 694275 - DNA, 22 bp, Artificial Sequence
  chemically synthesized
caaagtcattttttctgagaag

SEQ ID NO: 694276 - DNA, 22 bp, Artificial Sequence
  chemically synthesized
cagtcagataacttctcagaaa

SEQ ID NO: 694277 - DNA, 22 bp, Artificial Sequence
  chemically synthesized
aaactacaaagtcattttttct

SEQ ID NO: 694278 - DNA, 22 bp, Artificial Sequence
  chemically synthesized
ctcagaaaaaatgactttgtag

SEQ ID NO: 694279 - DNA, 22 bp, Artificial Sequence
  chemically synthesized
tcagaaaaaatgactttgtagt

SEQ ID NO: 694280 - DNA, 22 bp, Artificial Sequence
  chemically synthesized
agaaaaaatgactttgtagttt

SEQ ID NO: 694281 - DNA, 22 bp, Artificial Sequence
  chemically synthesized
tgtagtttgaacatgttttctc

SEQ ID NO: 694282 - DNA, 22 bp, Artificial Sequence
  chemically synthesized
gtagtttgaacatgttttctcc

SEQ ID NO: 694283 - DNA, 22 bp, Artificial Sequence
  chemically synthesized
acatggagggatggagaaaaca

SEQ ID NO: 694284 - DNA, 22 bp, Artificial Sequence
  chemically synthesized
tagtttgaacatgttttctcca

SEQ ID NO: 694285 - DNA, 22 bp, Artificial Sequence
  chemically synthesized
gaacatgttttctccatccctc

SEQ ID NO: 694286 - DNA, 22 bp, Artificial Sequence
  chemically synthesized
aacatgttttctccatccctcc

SEQ ID NO: 694287 - DNA, 22 bp, Artificial Sequence
  chemically synthesized
gaaaaaattaacatggagggat

SEQ ID NO: 694288 - DNA, 22 bp, Artificial Sequence
  chemically synthesized
tctccatccctccatgttaatt

SEQ ID NO: 694289 - DNA, 22 bp, Artificial Sequence
  chemically synthesized
tgaactggaaaaaattaacatg

SEQ ID NO: 694290 - DNA, 22 bp, Artificial Sequence
  chemically synthesized
ctccatccctccatgttaattt

SEQ ID NO: 694291 - DNA, 22 bp, Artificial Sequence
  chemically synthesized
gtgaactggaaaaaattaacat

SEQ ID NO: 694292 - DNA, 22 bp, Artificial Sequence
  chemically synthesized
tccatccctccatgttaatttt

SEQ ID NO: 694293 - DNA, 22 bp, Artificial Sequence
  chemically synthesized
catccctccatgttaatttttt

SEQ ID NO: 694294 - DNA, 22 bp, Artificial Sequence
  chemically synthesized
acttgtgaactggaaaaaatta

SEQ ID NO: 694295 - DNA, 22 bp, Artificial Sequence
  chemically synthesized
cacttgtgaactggaaaaaatt

SEQ ID NO: 694296 - DNA, 22 bp, Artificial Sequence
  chemically synthesized
tcacttgtgaactggaaaaaat

SEQ ID NO: 694297 - DNA, 22 bp, Artificial Sequence
  chemically synthesized
ttttcacttgtgaactggaaaa

SEQ ID NO: 694298 - DNA, 22 bp, Artificial Sequence
  chemically synthesized
gttttcacttgtgaactggaaa

SEQ ID NO: 694299 - DNA, 22 bp, Artificial Sequence
  chemically synthesized
catgttaattttttccagttca

SEQ ID NO: 694300 - DNA, 22 bp, Artificial Sequence
  chemically synthesized
atcttgttttcacttgtgaact

SEQ ID NO: 694301 - DNA, 22 bp, Artificial Sequence
  chemically synthesized
attttttccagttcacaagtga

SEQ ID NO: 694302 - DNA, 22 bp, Artificial Sequence
  chemically synthesized
tttccagttcacaagtgaaaac

SEQ ID NO: 694303 - DNA, 22 bp, Artificial Sequence
  chemically synthesized
ttccagttcacaagtgaaaaca

SEQ ID NO: 694304 - DNA, 22 bp, Artificial Sequence
  chemically synthesized
tccagttcacaagtgaaaacaa

SEQ ID NO: 694305 - DNA, 22 bp, Artificial Sequence
  chemically synthesized
ccagttcacaagtgaaaacaag

SEQ ID NO: 694306 - DNA, 22 bp, Artificial Sequence
  chemically synthesized
cagttcacaagtgaaaacaaga

SEQ ID NO: 694307 - DNA, 22 bp, Artificial Sequence
  chemically synthesized
agagcatactaatcttgttttc

SEQ ID NO: 694308 - DNA, 22 bp, Artificial Sequence
  chemically synthesized
acaagtgaaaacaagattagta

SEQ ID NO: 694309 - DNA, 22 bp, Artificial Sequence
  chemically synthesized
gtagattcagagcatactaatc

SEQ ID NO: 694310 - DNA, 22 bp, Artificial Sequence
  chemically synthesized
actggtagattcagagcatact

SEQ ID NO: 694311 - DNA, 22 bp, Artificial Sequence
  chemically synthesized
gtatgctctgaatctaccagtc

SEQ ID NO: 694312 - DNA, 22 bp, Artificial Sequence
  chemically synthesized
tgaatctaccagtcagtatgtt

SEQ ID NO: 694313 - DNA, 22 bp, Artificial Sequence
  chemically synthesized
aggtggaagatgaaacatactg

SEQ ID NO: 694314 - DNA, 22 bp, Artificial Sequence
  chemically synthesized
aatctaccagtcagtatgtttc

SEQ ID NO: 694315 - DNA, 22 bp, Artificial Sequence
  chemically synthesized
ccagtcagtatgtttcatcttc

SEQ ID NO: 694316 - DNA, 22 bp, Artificial Sequence
  chemically synthesized
aatgttgaggtggaagatgaaa

SEQ ID NO: 694317 - DNA, 22 bp, Artificial Sequence
  chemically synthesized
catcttccacctcaacattgaa

SEQ ID NO: 694318 - DNA, 22 bp, Artificial Sequence
  chemically synthesized
atcttccacctcaacattgaac

SEQ ID NO: 694319 - DNA, 22 bp, Artificial Sequence
  chemically synthesized
ccacctcaacattgaactgctt

SEQ ID NO: 694320 - DNA, 22 bp, Artificial Sequence
  chemically synthesized
cacctcaacattgaactgcttc

SEQ ID NO: 694321 - DNA, 22 bp, Artificial Sequence
  chemically synthesized
aacattgaactgcttcctttca

SEQ ID NO: 694322 - DNA, 22 bp, Artificial Sequence
  chemically synthesized
aaaagatgtataaggtgaaagg

SEQ ID NO: 694323 - DNA, 22 bp, Artificial Sequence
  chemically synthesized
aaaaagatgtataaggtgaaag

SEQ ID NO: 694324 - DNA, 22 bp, Artificial Sequence
  chemically synthesized
aactgcttcctttcaccttata

SEQ ID NO: 694325 - DNA, 22 bp, Artificial Sequence
  chemically synthesized
tttaaaaagatgtataaggtga

SEQ ID NO: 694326 - DNA, 22 bp, Artificial Sequence
  chemically synthesized
cttcctttcaccttatacatct

SEQ ID NO: 694327 - DNA, 22 bp, Artificial Sequence
  chemically synthesized
cctttcaccttatacatctttt

SEQ ID NO: 694328 - DNA, 22 bp, Artificial Sequence
  chemically synthesized
ctttcaccttatacatcttttt

SEQ ID NO: 694329 - DNA, 22 bp, Artificial Sequence
  chemically synthesized
aatgtattgtttaaaaagatgt

SEQ ID NO: 694330 - DNA, 22 bp, Artificial Sequence
  chemically synthesized
gaatgtattgtttaaaaagatg

SEQ ID NO: 694331 - DNA, 22 bp, Artificial Sequence
  chemically synthesized
tcaccttatacatctttttaaa

SEQ ID NO: 694332 - DNA, 22 bp, Artificial Sequence
  chemically synthesized
caccttatacatctttttaaac

SEQ ID NO: 694333 - DNA, 22 bp, Artificial Sequence
  chemically synthesized
accttatacatctttttaaaca

SEQ ID NO: 694334 - DNA, 22 bp, Artificial Sequence
  chemically synthesized
atacatctttttaaacaataca

SEQ ID NO: 694335 - DNA, 22 bp, Artificial Sequence
  chemically synthesized
caagtccttgaatgtattgttt

SEQ ID NO: 694336 - DNA, 22 bp, Artificial Sequence
  chemically synthesized
tacatctttttaaacaatacat

SEQ ID NO: 694337 - DNA, 22 bp, Artificial Sequence
  chemically synthesized
tattccaagtccttgaatgtat

SEQ ID NO: 694338 - DNA, 22 bp, Artificial Sequence
  chemically synthesized
tttaaacaatacattcaaggac

SEQ ID NO: 694339 - DNA, 22 bp, Artificial Sequence
  chemically synthesized
ttaaacaatacattcaaggact

SEQ ID NO: 694340 - DNA, 22 bp, Artificial Sequence
  chemically synthesized
taaacaatacattcaaggactt

SEQ ID NO: 694341 - DNA, 22 bp, Artificial Sequence
  chemically synthesized
aaacaatacattcaaggacttg

SEQ ID NO: 694342 - DNA, 22 bp, Artificial Sequence
  chemically synthesized
ccaattatattccaagtccttg

SEQ ID NO: 694343 - DNA, 22 bp, Artificial Sequence
  chemically synthesized
aacaatacattcaaggacttgg

SEQ ID NO: 694344 - DNA, 22 bp, Artificial Sequence
  chemically synthesized
aaggacttggaatataattggc

SEQ ID NO: 694345 - DNA, 22 bp, Artificial Sequence
  chemically synthesized
atcatcaacaaaattgccaatt

SEQ ID NO: 694346 - DNA, 22 bp, Artificial Sequence
  chemically synthesized
attcatcatcaacaaaattgcc

SEQ ID NO: 694347 - DNA, 22 bp, Artificial Sequence
  chemically synthesized
ggaatataattggcaattttgt

SEQ ID NO: 694348 - DNA, 22 bp, Artificial Sequence
  chemically synthesized
gaatataattggcaattttgtt

SEQ ID NO: 694349 - DNA, 22 bp, Artificial Sequence
  chemically synthesized
agcctcattcatcatcaacaaa

SEQ ID NO: 694350 - DNA, 22 bp, Artificial Sequence
  chemically synthesized
ctcagcctcattcatcatcaac

SEQ ID NO: 694351 - DNA, 22 bp, Artificial Sequence
  chemically synthesized
gcaattttgttgatgatgaatg

SEQ ID NO: 694352 - DNA, 22 bp, Artificial Sequence
  chemically synthesized
tattgctcagcctcattcatca

SEQ ID NO: 694353 - DNA, 22 bp, Artificial Sequence
  chemically synthesized
tgttgatgatgaatgaggctga

SEQ ID NO: 694354 - DNA, 22 bp, Artificial Sequence
  chemically synthesized
gttgatgatgaatgaggctgag

SEQ ID NO: 694355 - DNA, 22 bp, Artificial Sequence
  chemically synthesized
ttgatgatgaatgaggctgagc

SEQ ID NO: 694356 - DNA, 22 bp, Artificial Sequence
  chemically synthesized
atgatgaatgaggctgagcaat

SEQ ID NO: 694357 - DNA, 22 bp, Artificial Sequence
  chemically synthesized
tagagtagcaaaaggcatcatt

SEQ ID NO: 694358 - DNA, 22 bp, Artificial Sequence
  chemically synthesized
agcaatataatgatgccttttg

SEQ ID NO: 694359 - DNA, 22 bp, Artificial Sequence
  chemically synthesized
aaagcactatagagtagcaaaa

SEQ ID NO: 694360 - DNA, 22 bp, Artificial Sequence
  chemically synthesized
ctgaaagcactatagagtagca

SEQ ID NO: 694361 - DNA, 22 bp, Artificial Sequence
  chemically synthesized
actgaaagcactatagagtagc

SEQ ID NO: 694362 - DNA, 22 bp, Artificial Sequence
  chemically synthesized
tactgaaagcactatagagtag

SEQ ID NO: 694363 - DNA, 22 bp, Artificial Sequence
  chemically synthesized
ttactgaaagcactatagagta

SEQ ID NO: 694364 - DNA, 22 bp, Artificial Sequence
  chemically synthesized
tttactgaaagcactatagagt

SEQ ID NO: 694365 - DNA, 22 bp, Artificial Sequence
  chemically synthesized
tttttactgaaagcactataga

SEQ ID NO: 694366 - DNA, 22 bp, Artificial Sequence
  chemically synthesized
ctttttactgaaagcactatag

SEQ ID NO: 694367 - DNA, 22 bp, Artificial Sequence
  chemically synthesized
ttgctactctatagtgctttca

SEQ ID NO: 694368 - DNA, 22 bp, Artificial Sequence
  chemically synthesized
tgctactctatagtgctttcag

SEQ ID NO: 694369 - DNA, 22 bp, Artificial Sequence
  chemically synthesized
gctactctatagtgctttcagt

SEQ ID NO: 694370 - DNA, 22 bp, Artificial Sequence
  chemically synthesized
ctactctatagtgctttcagta

SEQ ID NO: 694371 - DNA, 22 bp, Artificial Sequence
  chemically synthesized
aagccatttctttttactgaaa

SEQ ID NO: 694372 - DNA, 22 bp, Artificial Sequence
  chemically synthesized
ctctatagtgctttcagtaaaa

SEQ ID NO: 694373 - DNA, 22 bp, Artificial Sequence
  chemically synthesized
tatagtgctttcagtaaaaaga

SEQ ID NO: 694374 - DNA, 22 bp, Artificial Sequence
  chemically synthesized
tagtgctttcagtaaaaagaaa

SEQ ID NO: 694375 - DNA, 22 bp, Artificial Sequence
  chemically synthesized
gtcctcaagccatttcttttta

SEQ ID NO: 694376 - DNA, 22 bp, Artificial Sequence
  chemically synthesized
agtcctcaagccatttcttttt

SEQ ID NO: 694377 - DNA, 22 bp, Artificial Sequence
  chemically synthesized
ttagtcctcaagccatttcttt

SEQ ID NO: 694378 - DNA, 22 bp, Artificial Sequence
  chemically synthesized
tcagtaaaaagaaatggcttga

SEQ ID NO: 694379 - DNA, 22 bp, Artificial Sequence
  chemically synthesized
cagtaaaaagaaatggcttgag

SEQ ID NO: 694380 - DNA, 22 bp, Artificial Sequence
  chemically synthesized
agtaaaaagaaatggcttgagg

SEQ ID NO: 694381 - DNA, 22 bp, Artificial Sequence
  chemically synthesized
atatactcttagtcctcaagcc

SEQ ID NO: 694382 - DNA, 22 bp, Artificial Sequence
  chemically synthesized
catatactcttagtcctcaagc

SEQ ID NO: 694383 - DNA, 22 bp, Artificial Sequence
  chemically synthesized
atatttcatatactcttagtcc

SEQ ID NO: 694384 - DNA, 22 bp, Artificial Sequence
  chemically synthesized
actcatatttcatatactctta

SEQ ID NO: 694385 - DNA, 22 bp, Artificial Sequence
  chemically synthesized
tcactcatatttcatatactct

SEQ ID NO: 694386 - DNA, 22 bp, Artificial Sequence
  chemically synthesized
tctcactcatatttcatatact

SEQ ID NO: 694387 - DNA, 22 bp, Artificial Sequence
  chemically synthesized
ctctcactcatatttcatatac

SEQ ID NO: 694388 - DNA, 22 bp, Artificial Sequence
  chemically synthesized
gaggactaagagtatatgaaat

SEQ ID NO: 694389 - DNA, 22 bp, Artificial Sequence
  chemically synthesized
tctctcactcatatttcatata

SEQ ID NO: 694390 - DNA, 22 bp, Artificial Sequence
  chemically synthesized
aggactaagagtatatgaaata

SEQ ID NO: 694391 - DNA, 22 bp, Artificial Sequence
  chemically synthesized
ttctctcactcatatttcatat

SEQ ID NO: 694392 - DNA, 22 bp, Artificial Sequence
  chemically synthesized
tttctctcactcatatttcata

SEQ ID NO: 694393 - DNA, 22 bp, Artificial Sequence
  chemically synthesized
agagtatatgaaatatgagtga

SEQ ID NO: 694394 - DNA, 22 bp, Artificial Sequence
  chemically synthesized
gagctttttctctcactcatat

SEQ ID NO: 694395 - DNA, 22 bp, Artificial Sequence
  chemically synthesized
agagctttttctctcactcata

SEQ ID NO: 694396 - DNA, 22 bp, Artificial Sequence
  chemically synthesized
tcaaggaccttagagctttttc

SEQ ID NO: 694397 - DNA, 22 bp, Artificial Sequence
  chemically synthesized
ttatcaaggaccttagagcttt

SEQ ID NO: 694398 - DNA, 22 bp, Artificial Sequence
  chemically synthesized
attatcaaggaccttagagctt

SEQ ID NO: 694399 - DNA, 22 bp, Artificial Sequence
  chemically synthesized
tattatcaaggaccttagagct

SEQ ID NO: 694400 - DNA, 22 bp, Artificial Sequence
  chemically synthesized
aaggtgctttattatcaaggac

SEQ ID NO: 694401 - DNA, 22 bp, Artificial Sequence
  chemically synthesized
aaaggtgctttattatcaagga

SEQ ID NO: 694402 - DNA, 22 bp, Artificial Sequence
  chemically synthesized
taaaggtgctttattatcaagg

SEQ ID NO: 694403 - DNA, 22 bp, Artificial Sequence
  chemically synthesized
taaggtccttgataataaagca

SEQ ID NO: 694404 - DNA, 22 bp, Artificial Sequence
  chemically synthesized
aggtccttgataataaagcacc

SEQ ID NO: 694405 - DNA, 22 bp, Artificial Sequence
  chemically synthesized
atgatatcgttttaaaggtgct

SEQ ID NO: 694406 - DNA, 22 bp, Artificial Sequence
  chemically synthesized
gataataaagcacctttaaaac

SEQ ID NO: 694407 - DNA, 22 bp, Artificial Sequence
  chemically synthesized
ataataaagcacctttaaaacg

SEQ ID NO: 694408 - DNA, 22 bp, Artificial Sequence
  chemically synthesized
taaaacgatatcatgagatgat

SEQ ID NO: 694409 - DNA, 22 bp, Artificial Sequence
  chemically synthesized
gtagggagaaacatcatctcat

SEQ ID NO: 694410 - DNA, 22 bp, Artificial Sequence
  chemically synthesized
aaaacgatatcatgagatgatg

SEQ ID NO: 694411 - DNA, 22 bp, Artificial Sequence
  chemically synthesized
ggtagggagaaacatcatctca

SEQ ID NO: 694412 - DNA, 22 bp, Artificial Sequence
  chemically synthesized
aaacgatatcatgagatgatgt

SEQ ID NO: 694413 - DNA, 22 bp, Artificial Sequence
  chemically synthesized
tggtagggagaaacatcatctc

SEQ ID NO: 694414 - DNA, 22 bp, Artificial Sequence
  chemically synthesized
ttggtagggagaaacatcatct

SEQ ID NO: 694415 - DNA, 22 bp, Artificial Sequence
  chemically synthesized
tttggtagggagaaacatcatc

SEQ ID NO: 694416 - DNA, 22 bp, Artificial Sequence
  chemically synthesized
ttttggtagggagaaacatcat

SEQ ID NO: 694417 - DNA, 22 bp, Artificial Sequence
  chemically synthesized
gggtttttttggtagggagaaa

SEQ ID NO: 694418 - DNA, 22 bp, Artificial Sequence
  chemically synthesized
ggggtttttttggtagggagaa

SEQ ID NO: 694419 - DNA, 22 bp, Artificial Sequence
  chemically synthesized
tggggtttttttggtagggaga

SEQ ID NO: 694420 - DNA, 22 bp, Artificial Sequence
  chemically synthesized
ttggggtttttttggtagggag

SEQ ID NO: 694421 - DNA, 22 bp, Artificial Sequence
  chemically synthesized
tttggggtttttttggtaggga

SEQ ID NO: 694422 - DNA, 22 bp, Artificial Sequence
  chemically synthesized
ctccctaccaaaaaaaccccaa

SEQ ID NO: 694423 - DNA, 22 bp, Artificial Sequence
  chemically synthesized
acacatagttttttggggtttt

SEQ ID NO: 694424 - DNA, 22 bp, Artificial Sequence
  chemically synthesized
tccctaccaaaaaaaccccaaa

SEQ ID NO: 694425 - DNA, 22 bp, Artificial Sequence
  chemically synthesized
cacacatagttttttggggttt

SEQ ID NO: 694426 - DNA, 22 bp, Artificial Sequence
  chemically synthesized
tcacacatagttttttggggtt

SEQ ID NO: 694427 - DNA, 22 bp, Artificial Sequence
  chemically synthesized
cctaccaaaaaaaccccaaaaa

SEQ ID NO: 694428 - DNA, 22 bp, Artificial Sequence
  chemically synthesized
ttcacacatagttttttggggt

SEQ ID NO: 694429 - DNA, 22 bp, Artificial Sequence
  chemically synthesized
tttcacacatagttttttgggg

SEQ ID NO: 694430 - DNA, 22 bp, Artificial Sequence
  chemically synthesized
ttttcacacatagttttttggg

SEQ ID NO: 694431 - DNA, 22 bp, Artificial Sequence
  chemically synthesized
tttttcacacatagttttttgg

SEQ ID NO: 694432 - DNA, 22 bp, Artificial Sequence
  chemically synthesized
ccaaaaaaaccccaaaaaacta

SEQ ID NO: 694433 - DNA, 22 bp, Artificial Sequence
  chemically synthesized
ttttttcacacatagttttttg

SEQ ID NO: 694434 - DNA, 22 bp, Artificial Sequence
  chemically synthesized
atacaagagagccgattttttt

SEQ ID NO: 694435 - DNA, 22 bp, Artificial Sequence
  chemically synthesized
tgtgtgaaaaaaaaatcggctc

SEQ ID NO: 694436 - DNA, 22 bp, Artificial Sequence
  chemically synthesized
catgaatgcccgatgttgatac

SEQ ID NO: 694437 - DNA, 22 bp, Artificial Sequence
  chemically synthesized
attgcatgaatgcccgatgttg

SEQ ID NO: 694438 - DNA, 22 bp, Artificial Sequence
  chemically synthesized
aattgcatgaatgcccgatgtt

SEQ ID NO: 694439 - DNA, 22 bp, Artificial Sequence
  chemically synthesized
taattgcatgaatgcccgatgt

SEQ ID NO: 694440 - DNA, 22 bp, Artificial Sequence
  chemically synthesized
tcttgtatcaacatcgggcatt

SEQ ID NO: 694441 - DNA, 22 bp, Artificial Sequence
  chemically synthesized
ttgtatcaacatcgggcattca

SEQ ID NO: 694442 - DNA, 22 bp, Artificial Sequence
  chemically synthesized
gtatcaacatcgggcattcatg

SEQ ID NO: 694443 - DNA, 22 bp, Artificial Sequence
  chemically synthesized
tatcaacatcgggcattcatgc

SEQ ID NO: 694444 - DNA, 22 bp, Artificial Sequence
  chemically synthesized
ccagacacatacaaaagatttt

SEQ ID NO: 694445 - DNA, 22 bp, Artificial Sequence
  chemically synthesized
atgcaattaaaatcttttgtat

SEQ ID NO: 694446 - DNA, 22 bp, Artificial Sequence
  chemically synthesized
gatatcattaccagacacatac

SEQ ID NO: 694447 - DNA, 22 bp, Artificial Sequence
  chemically synthesized
aaatcttttgtatgtgtctggt

SEQ ID NO: 694448 - DNA, 22 bp, Artificial Sequence
  chemically synthesized
aatattagatatcattaccaga

SEQ ID NO: 694449 - DNA, 22 bp, Artificial Sequence
  chemically synthesized
ttgtatgtgtctggtaatgata

SEQ ID NO: 694450 - DNA, 22 bp, Artificial Sequence
  chemically synthesized
ttaaatattagatatcattacc

SEQ ID NO: 694451 - DNA, 22 bp, Artificial Sequence
  chemically synthesized
tgtatgtgtctggtaatgatat

SEQ ID NO: 694452 - DNA, 22 bp, Artificial Sequence
  chemically synthesized
gtatgtgtctggtaatgatatc

SEQ ID NO: 694453 - DNA, 22 bp, Artificial Sequence
  chemically synthesized
tgttaaatattagatatcatta

SEQ ID NO: 694454 - DNA, 22 bp, Artificial Sequence
  chemically synthesized
tatgtgtctggtaatgatatct

SEQ ID NO: 694455 - DNA, 22 bp, Artificial Sequence
  chemically synthesized
tctgttaaatattagatatcat

SEQ ID NO: 694456 - DNA, 22 bp, Artificial Sequence
  chemically synthesized
ctctgttaaatattagatatca

SEQ ID NO: 694457 - DNA, 22 bp, Artificial Sequence
  chemically synthesized
tctctgttaaatattagatatc

SEQ ID NO: 694458 - DNA, 22 bp, Artificial Sequence
  chemically synthesized
cctttctctgttaaatattaga

SEQ ID NO: 694459 - DNA, 22 bp, Artificial Sequence
  chemically synthesized
gcctttctctgttaaatattag

SEQ ID NO: 694460 - DNA, 22 bp, Artificial Sequence
  chemically synthesized
tgcctttctctgttaaatatta

SEQ ID NO: 694461 - DNA, 22 bp, Artificial Sequence
  chemically synthesized
gtaatgatatctaatatttaac

SEQ ID NO: 694462 - DNA, 22 bp, Artificial Sequence
  chemically synthesized
ttgcctttctctgttaaatatt

SEQ ID NO: 694463 - DNA, 22 bp, Artificial Sequence
  chemically synthesized
aaccagtttttgcctttctctg

SEQ ID NO: 694464 - DNA, 22 bp, Artificial Sequence
  chemically synthesized
atatttaacagagaaaggcaaa

SEQ ID NO: 694465 - DNA, 22 bp, Artificial Sequence
  chemically synthesized
tactcaaccagtttttgccttt

SEQ ID NO: 694466 - DNA, 22 bp, Artificial Sequence
  chemically synthesized
aacagagaaaggcaaaaactgg

SEQ ID NO: 694467 - DNA, 22 bp, Artificial Sequence
  chemically synthesized
agttatactcaaccagtttttg

SEQ ID NO: 694468 - DNA, 22 bp, Artificial Sequence
  chemically synthesized
acagagaaaggcaaaaactggt

SEQ ID NO: 694469 - DNA, 22 bp, Artificial Sequence
  chemically synthesized
gaattcagttatactcaaccag

SEQ ID NO: 694470 - DNA, 22 bp, Artificial Sequence
  chemically synthesized
agaattcagttatactcaacca

SEQ ID NO: 694471 - DNA, 22 bp, Artificial Sequence
  chemically synthesized
aagtttagaattcagttatact

SEQ ID NO: 694472 - DNA, 22 bp, Artificial Sequence
  chemically synthesized
caagtttagaattcagttatac

SEQ ID NO: 694473 - DNA, 22 bp, Artificial Sequence
  chemically synthesized
gttgagtataactgaattctaa

SEQ ID NO: 694474 - DNA, 22 bp, Artificial Sequence
  chemically synthesized
agtataactgaattctaaactt

SEQ ID NO: 694475 - DNA, 22 bp, Artificial Sequence
  chemically synthesized
aattctaaacttgaagtctttt

SEQ ID NO: 694476 - DNA, 22 bp, Artificial Sequence
  chemically synthesized
taaacttgaagtcttttcttcc

SEQ ID NO: 694477 - DNA, 22 bp, Artificial Sequence
  chemically synthesized
aacttgaagtcttttcttccct

SEQ ID NO: 694478 - DNA, 22 bp, Artificial Sequence
  chemically synthesized
cagtggtatccagtagggaaga

SEQ ID NO: 694479 - DNA, 22 bp, Artificial Sequence
  chemically synthesized
gaagtcttttcttccctactgg

SEQ ID NO: 694480 - DNA, 22 bp, Artificial Sequence
  chemically synthesized
aagtcttttcttccctactgga

SEQ ID NO: 694481 - DNA, 22 bp, Artificial Sequence
  chemically synthesized
ttcttccctactggataccact

SEQ ID NO: 694482 - DNA, 22 bp, Artificial Sequence
  chemically synthesized
aggcagagctgcagtggtatcc

SEQ ID NO: 694483 - DNA, 22 bp, Artificial Sequence
  chemically synthesized
tcttccctactggataccactg

SEQ ID NO: 694484 - DNA, 22 bp, Artificial Sequence
  chemically synthesized
cttccctactggataccactgc

SEQ ID NO: 694485 - DNA, 22 bp, Artificial Sequence
  chemically synthesized
ttccctactggataccactgca

SEQ ID NO: 694486 - DNA, 22 bp, Artificial Sequence
  chemically synthesized
ccctactggataccactgcagc

SEQ ID NO: 694487 - DNA, 22 bp, Artificial Sequence
  chemically synthesized
cctactggataccactgcagct

SEQ ID NO: 694488 - DNA, 22 bp, Artificial Sequence
  chemically synthesized
ctggataccactgcagctctgc

SEQ ID NO: 694489 - DNA, 22 bp, Artificial Sequence
  chemically synthesized
agacatacattgaggcagagct

SEQ ID NO: 694490 - DNA, 22 bp, Artificial Sequence
  chemically synthesized
gataccactgcagctctgcctc

SEQ ID NO: 694491 - DNA, 22 bp, Artificial Sequence
  chemically synthesized
cagctctgcctcaatgtatgtc

SEQ ID NO: 694492 - DNA, 22 bp, Artificial Sequence
  chemically synthesized
tgcctcaatgtatgtcttagga

SEQ ID NO: 694493 - DNA, 22 bp, Artificial Sequence
  chemically synthesized
cctcaatgtatgtcttaggatt

SEQ ID NO: 694494 - DNA, 22 bp, Artificial Sequence
  chemically synthesized
aatgtatgtcttaggatttacc

SEQ ID NO: 694495 - DNA, 22 bp, Artificial Sequence
  chemically synthesized
gagtaaggtaagtggtaaatcc

SEQ ID NO: 694496 - DNA, 22 bp, Artificial Sequence
  chemically synthesized
aaaaaagttggagtaaggtaag

SEQ ID NO: 694497 - DNA, 22 bp, Artificial Sequence
  chemically synthesized
aggatttaccacttaccttact

SEQ ID NO: 694498 - DNA, 22 bp, Artificial Sequence
  chemically synthesized
gaaaaaagttggagtaaggtaa

SEQ ID NO: 694499 - DNA, 22 bp, Artificial Sequence
  chemically synthesized
ggatttaccacttaccttactc

SEQ ID NO: 694500 - DNA, 22 bp, Artificial Sequence
  chemically synthesized
accacttaccttactccaactt

SEQ ID NO: 694501 - DNA, 22 bp, Artificial Sequence
  chemically synthesized
ccacttaccttactccaacttt

SEQ ID NO: 694502 - DNA, 22 bp, Artificial Sequence
  chemically synthesized
atagatcttgaaaaaagttgga

SEQ ID NO: 694503 - DNA, 22 bp, Artificial Sequence
  chemically synthesized
aatagatcttgaaaaaagttgg

SEQ ID NO: 694504 - DNA, 22 bp, Artificial Sequence
  chemically synthesized
accttactccaacttttttcaa

SEQ ID NO: 694505 - DNA, 22 bp, Artificial Sequence
  chemically synthesized
tcttaatagatcttgaaaaaag

SEQ ID NO: 694506 - DNA, 22 bp, Artificial Sequence
  chemically synthesized
ccttactccaacttttttcaag

SEQ ID NO: 694507 - DNA, 22 bp, Artificial Sequence
  chemically synthesized
actccaacttttttcaagatct

SEQ ID NO: 694508 - DNA, 22 bp, Artificial Sequence
  chemically synthesized
ctccaacttttttcaagatcta

SEQ ID NO: 694509 - DNA, 22 bp, Artificial Sequence
  chemically synthesized
caacttttttcaagatctatta

SEQ ID NO: 694510 - DNA, 22 bp, Artificial Sequence
  chemically synthesized
gggaccactgtcttaatagatc

SEQ ID NO: 694511 - DNA, 22 bp, Artificial Sequence
  chemically synthesized
ttttcaagatctattaagacag

SEQ ID NO: 694512 - DNA, 22 bp, Artificial Sequence
  chemically synthesized
tttcaagatctattaagacagt

SEQ ID NO: 694513 - DNA, 22 bp, Artificial Sequence
  chemically synthesized
ttcaagatctattaagacagtg

SEQ ID NO: 694514 - DNA, 22 bp, Artificial Sequence
  chemically synthesized
tcaagatctattaagacagtgg

SEQ ID NO: 694515 - DNA, 22 bp, Artificial Sequence
  chemically synthesized
caagatctattaagacagtggt

SEQ ID NO: 694516 - DNA, 22 bp, Artificial Sequence
  chemically synthesized
aagatctattaagacagtggtc

SEQ ID NO: 694517 - DNA, 22 bp, Artificial Sequence
  chemically synthesized
gtgccaaaaaggctggggacca

SEQ ID NO: 694518 - DNA, 22 bp, Artificial Sequence
  chemically synthesized
ttaagacagtggtccccagcct

SEQ ID NO: 694519 - DNA, 22 bp, Artificial Sequence
  chemically synthesized
agacagtggtccccagcctttt

SEQ ID NO: 694520 - DNA, 22 bp, Artificial Sequence
  chemically synthesized
atgcctggtgccaaaaaggctg

SEQ ID NO: 694521 - DNA, 22 bp, Artificial Sequence
  chemically synthesized
cagaaaactcatgcctggtgcc

SEQ ID NO: 694522 - DNA, 22 bp, Artificial Sequence
  chemically synthesized
ccagaaaactcatgcctggtgc

SEQ ID NO: 694523 - DNA, 22 bp, Artificial Sequence
  chemically synthesized
tcttccagaaaactcatgcctg

SEQ ID NO: 694524 - DNA, 22 bp, Artificial Sequence
  chemically synthesized
tttggcaccaggcatgagtttt

SEQ ID NO: 694525 - DNA, 22 bp, Artificial Sequence
  chemically synthesized
ttggcaccaggcatgagttttc

SEQ ID NO: 694526 - DNA, 22 bp, Artificial Sequence
  chemically synthesized
tggcaccaggcatgagttttct

SEQ ID NO: 694527 - DNA, 22 bp, Artificial Sequence
  chemically synthesized
ggcaccaggcatgagttttctg

SEQ ID NO: 694528 - DNA, 22 bp, Artificial Sequence
  chemically synthesized
gcaccaggcatgagttttctgg

SEQ ID NO: 694529 - DNA, 22 bp, Artificial Sequence
  chemically synthesized
tggaaaaattgtcttccagaaa

SEQ ID NO: 694530 - DNA, 22 bp, Artificial Sequence
  chemically synthesized
ccagtctgtggaaaaattgtct

SEQ ID NO: 694531 - DNA, 22 bp, Artificial Sequence
  chemically synthesized
cctcccagtctgtggaaaaatt

SEQ ID NO: 694532 - DNA, 22 bp, Artificial Sequence
  chemically synthesized
tctggaagacaatttttccaca

SEQ ID NO: 694533 - DNA, 22 bp, Artificial Sequence
  chemically synthesized
ctggaagacaatttttccacag

SEQ ID NO: 694534 - DNA, 22 bp, Artificial Sequence
  chemically synthesized
tggaagacaatttttccacaga

SEQ ID NO: 694535 - DNA, 22 bp, Artificial Sequence
  chemically synthesized
gaagacaatttttccacagact

SEQ ID NO: 694536 - DNA, 22 bp, Artificial Sequence
  chemically synthesized
ttccacagactgggaggcaggg

SEQ ID NO: 694537 - DNA, 22 bp, Artificial Sequence
  chemically synthesized
tccacagactgggaggcagggg

SEQ ID NO: 694538 - DNA, 22 bp, Artificial Sequence
  chemically synthesized
ccacagactgggaggcaggggc

SEQ ID NO: 694539 - DNA, 22 bp, Artificial Sequence
  chemically synthesized
cacagactgggaggcaggggcg

SEQ ID NO: 694540 - DNA, 22 bp, Artificial Sequence
  chemically synthesized
gaaaccatacccccgcccctgc

SEQ ID NO: 694541 - DNA, 22 bp, Artificial Sequence
  chemically synthesized
atctcgaaaccatacccccgcc

SEQ ID NO: 694542 - DNA, 22 bp, Artificial Sequence
  chemically synthesized
catctcgaaaccatacccccgc

SEQ ID NO: 694543 - DNA, 22 bp, Artificial Sequence
  chemically synthesized
ggaggcaggggcgggggtatgg

SEQ ID NO: 694544 - DNA, 22 bp, Artificial Sequence
  chemically synthesized
aggtggaacggtttcatctcga

SEQ ID NO: 694545 - DNA, 22 bp, Artificial Sequence
  chemically synthesized
atgatctgaggtggaacggttt

SEQ ID NO: 694546 - DNA, 22 bp, Artificial Sequence
  chemically synthesized
cgagatgaaaccgttccacctc

SEQ ID NO: 694547 - DNA, 22 bp, Artificial Sequence
  chemically synthesized
gagatgaaaccgttccacctca

SEQ ID NO: 694548 - DNA, 22 bp, Artificial Sequence
  chemically synthesized
atgcctgatgatctgaggtgga

SEQ ID NO: 694549 - DNA, 22 bp, Artificial Sequence
  chemically synthesized
tgagaaactaatgcctgatgat

SEQ ID NO: 694550 - DNA, 22 bp, Artificial Sequence
  chemically synthesized
atgagaaactaatgcctgatga

SEQ ID NO: 694551 - DNA, 22 bp, Artificial Sequence
  chemically synthesized
tatgagaaactaatgcctgatg

SEQ ID NO: 694552 - DNA, 22 bp, Artificial Sequence
  chemically synthesized
cacctcagatcatcaggcatta

SEQ ID NO: 694553 - DNA, 22 bp, Artificial Sequence
  chemically synthesized
tttatgagaaactaatgcctga

SEQ ID NO: 694554 - DNA, 22 bp, Artificial Sequence
  chemically synthesized
agatcatcaggcattagtttct

SEQ ID NO: 694555 - DNA, 22 bp, Artificial Sequence
  chemically synthesized
tgacctctttatgagaaactaa

SEQ ID NO: 694556 - DNA, 22 bp, Artificial Sequence
  chemically synthesized
ggttgtgacctctttatgagaa

SEQ ID NO: 694557 - DNA, 22 bp, Artificial Sequence
  chemically synthesized
gtttctcataaagaggtcacaa

SEQ ID NO: 694558 - DNA, 22 bp, Artificial Sequence
  chemically synthesized
ctcataaagaggtcacaaccta

SEQ ID NO: 694559 - DNA, 22 bp, Artificial Sequence
  chemically synthesized
tcataaagaggtcacaacctag

SEQ ID NO: 694560 - DNA, 22 bp, Artificial Sequence
  chemically synthesized
ataaagaggtcacaacctagat

SEQ ID NO: 694561 - DNA, 22 bp, Artificial Sequence
  chemically synthesized
tgtatgcgagggatctaggttg

SEQ ID NO: 694562 - DNA, 22 bp, Artificial Sequence
  chemically synthesized
tgaactatgtatgcgagggatc

SEQ ID NO: 694563 - DNA, 22 bp, Artificial Sequence
  chemically synthesized
ttgtgaactatgtatgcgaggg

SEQ ID NO: 694564 - DNA, 22 bp, Artificial Sequence
  chemically synthesized
gatccctcgcatacatagttca

SEQ ID NO: 694565 - DNA, 22 bp, Artificial Sequence
  chemically synthesized
gcatacatagttcacaataggg

SEQ ID NO: 694566 - DNA, 22 bp, Artificial Sequence
  chemically synthesized
tcgtaggtgcacaagccctatt

SEQ ID NO: 694567 - DNA, 22 bp, Artificial Sequence
  chemically synthesized
gattatcgtaggtgcacaagcc

SEQ ID NO: 694568 - DNA, 22 bp, Artificial Sequence
  chemically synthesized
acaatagggcttgtgcacctac

SEQ ID NO: 694569 - DNA, 22 bp, Artificial Sequence
  chemically synthesized
gtgcacctacgataatctaatg

SEQ ID NO: 694570 - DNA, 22 bp, Artificial Sequence
  chemically synthesized
tgcacctacgataatctaatgc

SEQ ID NO: 694571 - DNA, 22 bp, Artificial Sequence
  chemically synthesized
tcagatcagtcgtggcattaga

SEQ ID NO: 694572 - DNA, 22 bp, Artificial Sequence
  chemically synthesized
ctgtcagatcagtcgtggcatt

SEQ ID NO: 694573 - DNA, 22 bp, Artificial Sequence
  chemically synthesized
cgataatctaatgccacgactg

SEQ ID NO: 694574 - DNA, 22 bp, Artificial Sequence
  chemically synthesized
cctcctgtcagatcagtcgtgg

SEQ ID NO: 694575 - DNA, 22 bp, Artificial Sequence
  chemically synthesized
tgcctcctgtcagatcagtcgt

SEQ ID NO: 694576 - DNA, 22 bp, Artificial Sequence
  chemically synthesized
agctctgcctcctgtcagatca

SEQ ID NO: 694577 - DNA, 22 bp, Artificial Sequence
  chemically synthesized
atgccacgactgatctgacagg

SEQ ID NO: 694578 - DNA, 22 bp, Artificial Sequence
  chemically synthesized
cctgagctctgcctcctgtcag

SEQ ID NO: 694579 - DNA, 22 bp, Artificial Sequence
  chemically synthesized
ctgcctgagctctgcctcctgt

SEQ ID NO: 694580 - DNA, 22 bp, Artificial Sequence
  chemically synthesized
atctgacaggaggcagagctca

SEQ ID NO: 694581 - DNA, 22 bp, Artificial Sequence
  chemically synthesized
acaggaggcagagctcaggcag

SEQ ID NO: 694582 - DNA, 22 bp, Artificial Sequence
  chemically synthesized
aggcagtaatgttcacttgctc

SEQ ID NO: 694583 - DNA, 22 bp, Artificial Sequence
  chemically synthesized
gaacagcaggaggtgagtggtg

SEQ ID NO: 694584 - DNA, 22 bp, Artificial Sequence
  chemically synthesized
acttgctcaccactcacctcct

SEQ ID NO: 694585 - DNA, 22 bp, Artificial Sequence
  chemically synthesized
gctcaccactcacctcctgctg

SEQ ID NO: 694586 - DNA, 22 bp, Artificial Sequence
  chemically synthesized
ctcaccactcacctcctgctgt

SEQ ID NO: 694587 - DNA, 22 bp, Artificial Sequence
  chemically synthesized
gaccatggactggaacagcagg

SEQ ID NO: 694588 - DNA, 22 bp, Artificial Sequence
  chemically synthesized
accactcacctcctgctgttcc

SEQ ID NO: 694589 - DNA, 22 bp, Artificial Sequence
  chemically synthesized
tggaccatggactggaacagca

SEQ ID NO: 694590 - DNA, 22 bp, Artificial Sequence
  chemically synthesized
acctctggaccatggactggaa

SEQ ID NO: 694591 - DNA, 22 bp, Artificial Sequence
  chemically synthesized
acctcctgctgttccagtccat

SEQ ID NO: 694592 - DNA, 22 bp, Artificial Sequence
  chemically synthesized
ctgctgttccagtccatggtcc

SEQ ID NO: 694593 - DNA, 22 bp, Artificial Sequence
  chemically synthesized
ctgttccagtccatggtccaga

SEQ ID NO: 694594 - DNA, 22 bp, Artificial Sequence
  chemically synthesized
ttccagtccatggtccagaggt

SEQ ID NO: 694595 - DNA, 22 bp, Artificial Sequence
  chemically synthesized
cagtccatggtccagaggttag

SEQ ID NO: 694596 - DNA, 22 bp, Artificial Sequence
  chemically synthesized
atagagggatccctaacctctg

SEQ ID NO: 694597 - DNA, 22 bp, Artificial Sequence
  chemically synthesized
aatagagggatccctaacctct

SEQ ID NO: 694598 - DNA, 22 bp, Artificial Sequence
  chemically synthesized
tgtcttaatagagggatcccta

SEQ ID NO: 694599 - DNA, 22 bp, Artificial Sequence
  chemically synthesized
gggatccctctattaagacata

SEQ ID NO: 694600 - DNA, 22 bp, Artificial Sequence
  chemically synthesized
agtgaatgcatgtaagcctatg

SEQ ID NO: 694601 - DNA, 22 bp, Artificial Sequence
  chemically synthesized
ttcagtgaatgcatgtaagcct

SEQ ID NO: 694602 - DNA, 22 bp, Artificial Sequence
  chemically synthesized
tattaagacataggcttacatg

SEQ ID NO: 694603 - DNA, 22 bp, Artificial Sequence
  chemically synthesized
ttaagacataggcttacatgca

SEQ ID NO: 694604 - DNA, 22 bp, Artificial Sequence
  chemically synthesized
agacataggcttacatgcattc

SEQ ID NO: 694605 - DNA, 22 bp, Artificial Sequence
  chemically synthesized
aggagccagcattgttcagtga

SEQ ID NO: 694606 - DNA, 22 bp, Artificial Sequence
  chemically synthesized
caggagccagcattgttcagtg

SEQ ID NO: 694607 - DNA, 22 bp, Artificial Sequence
  chemically synthesized
ttcaggagccagcattgttcag

SEQ ID NO: 694608 - DNA, 22 bp, Artificial Sequence
  chemically synthesized
acatgcattcactgaacaatgc

SEQ ID NO: 694609 - DNA, 22 bp, Artificial Sequence
  chemically synthesized
cttcaggagccagcattgttca

SEQ ID NO: 694610 - DNA, 22 bp, Artificial Sequence
  chemically synthesized
catgcattcactgaacaatgct

SEQ ID NO: 694611 - DNA, 22 bp, Artificial Sequence
  chemically synthesized
tcttcaggagccagcattgttc

SEQ ID NO: 694612 - DNA, 22 bp, Artificial Sequence
  chemically synthesized
ccaagctttcttcaggagccag

SEQ ID NO: 694613 - DNA, 22 bp, Artificial Sequence
  chemically synthesized
actgaacaatgctggctcctga

SEQ ID NO: 694614 - DNA, 22 bp, Artificial Sequence
  chemically synthesized
aacaatgctggctcctgaagaa

SEQ ID NO: 694615 - DNA, 22 bp, Artificial Sequence
  chemically synthesized
tcaaaactcccaagctttcttc

SEQ ID NO: 694616 - DNA, 22 bp, Artificial Sequence
  chemically synthesized
tatcaaaactcccaagctttct

SEQ ID NO: 694617 - DNA, 22 bp, Artificial Sequence
  chemically synthesized
ctatcaaaactcccaagctttc

SEQ ID NO: 694618 - DNA, 22 bp, Artificial Sequence
  chemically synthesized
ttctatcaaaactcccaagctt

SEQ ID NO: 694619 - DNA, 22 bp, Artificial Sequence
  chemically synthesized
gctcctgaagaaagcttgggag

SEQ ID NO: 694620 - DNA, 22 bp, Artificial Sequence
  chemically synthesized
ctgaagaaagcttgggagtttt

SEQ ID NO: 694621 - DNA, 22 bp, Artificial Sequence
  chemically synthesized
aagaaagcttgggagttttgat

SEQ ID NO: 694622 - DNA, 22 bp, Artificial Sequence
  chemically synthesized
aaatcctcttctatcaaaactc

SEQ ID NO: 694623 - DNA, 22 bp, Artificial Sequence
  chemically synthesized
aaaatcctcttctatcaaaact

SEQ ID NO: 694624 - DNA, 22 bp, Artificial Sequence
  chemically synthesized
gggagttttgatagaagaggat

SEQ ID NO: 694625 - DNA, 22 bp, Artificial Sequence
  chemically synthesized
ggagttttgatagaagaggatt

SEQ ID NO: 694626 - DNA, 22 bp, Artificial Sequence
  chemically synthesized
ggaaaacaccttaaaatcctct

SEQ ID NO: 694627 - DNA, 22 bp, Artificial Sequence
  chemically synthesized
aggaaaacaccttaaaatcctc

SEQ ID NO: 694628 - DNA, 22 bp, Artificial Sequence
  chemically synthesized
tgatagaagaggattttaaggt

SEQ ID NO: 694629 - DNA, 22 bp, Artificial Sequence
  chemically synthesized
gatagaagaggattttaaggtg

SEQ ID NO: 694630 - DNA, 22 bp, Artificial Sequence
  chemically synthesized
atagaagaggattttaaggtgt

SEQ ID NO: 694631 - DNA, 22 bp, Artificial Sequence
  chemically synthesized
tgagaatatcttaggaaaacac

SEQ ID NO: 694632 - DNA, 22 bp, Artificial Sequence
  chemically synthesized
ttgtgagaatatcttaggaaaa

SEQ ID NO: 694633 - DNA, 22 bp, Artificial Sequence
  chemically synthesized
taaggtgttttcctaagatatt

SEQ ID NO: 694634 - DNA, 22 bp, Artificial Sequence
  chemically synthesized
aaggtgttttcctaagatattc

SEQ ID NO: 694635 - DNA, 22 bp, Artificial Sequence
  chemically synthesized
aggtgttttcctaagatattct

SEQ ID NO: 694636 - DNA, 22 bp, Artificial Sequence
  chemically synthesized
ccaaaactgttgtgagaatatc

SEQ ID NO: 694637 - DNA, 22 bp, Artificial Sequence
  chemically synthesized
ttaccaaaactgttgtgagaat

SEQ ID NO: 694638 - DNA, 22 bp, Artificial Sequence
  chemically synthesized
tcctaagatattctcacaacag

SEQ ID NO: 694639 - DNA, 22 bp, Artificial Sequence
  chemically synthesized
ctattaccaaaactgttgtgag

SEQ ID NO: 694640 - DNA, 22 bp, Artificial Sequence
  chemically synthesized
cctaagatattctcacaacagt

SEQ ID NO: 694641 - DNA, 22 bp, Artificial Sequence
  chemically synthesized
ctaagatattctcacaacagtt

SEQ ID NO: 694642 - DNA, 22 bp, Artificial Sequence
  chemically synthesized
agatattctcacaacagttttg

SEQ ID NO: 694643 - DNA, 22 bp, Artificial Sequence
  chemically synthesized
agtagctcctattaccaaaact

SEQ ID NO: 694644 - DNA, 22 bp, Artificial Sequence
  chemically synthesized
cagtagctcctattaccaaaac

SEQ ID NO: 694645 - DNA, 22 bp, Artificial Sequence
  chemically synthesized
cttcagtagctcctattaccaa

SEQ ID NO: 694646 - DNA, 22 bp, Artificial Sequence
  chemically synthesized
tcacaacagttttggtaatagg

SEQ ID NO: 694647 - DNA, 22 bp, Artificial Sequence
  chemically synthesized
acaacagttttggtaataggag

SEQ ID NO: 694648 - DNA, 22 bp, Artificial Sequence
  chemically synthesized
tggtaataggagctactgaagg

SEQ ID NO: 694649 - DNA, 22 bp, Artificial Sequence
  chemically synthesized
agtgaatatattccttcagtag

SEQ ID NO: 694650 - DNA, 22 bp, Artificial Sequence
  chemically synthesized
ggtaataggagctactgaagga

SEQ ID NO: 694651 - DNA, 22 bp, Artificial Sequence
  chemically synthesized
aagtgaatatattccttcagta

SEQ ID NO: 694652 - DNA, 22 bp, Artificial Sequence
  chemically synthesized
gtaataggagctactgaaggaa

SEQ ID NO: 694653 - DNA, 22 bp, Artificial Sequence
  chemically synthesized
taagtgaatatattccttcagt

SEQ ID NO: 694654 - DNA, 22 bp, Artificial Sequence
  chemically synthesized
ctgaaggaatatattcacttaa

SEQ ID NO: 694655 - DNA, 22 bp, Artificial Sequence
  chemically synthesized
aagaaagcatctttaagtgaat

SEQ ID NO: 694656 - DNA, 22 bp, Artificial Sequence
  chemically synthesized
gaagaaagcatctttaagtgaa

SEQ ID NO: 694657 - DNA, 22 bp, Artificial Sequence
  chemically synthesized
tgaagaaagcatctttaagtga

SEQ ID NO: 694658 - DNA, 22 bp, Artificial Sequence
  chemically synthesized
aaggaatatattcacttaaaga

SEQ ID NO: 694659 - DNA, 22 bp, Artificial Sequence
  chemically synthesized
ttttgaagaaagcatctttaag

SEQ ID NO: 694660 - DNA, 22 bp, Artificial Sequence
  chemically synthesized
ctgttttgaagaaagcatcttt

SEQ ID NO: 694661 - DNA, 22 bp, Artificial Sequence
  chemically synthesized
aaagttactgttttgaagaaag

SEQ ID NO: 694662 - DNA, 22 bp, Artificial Sequence
  chemically synthesized
acttaaagatgctttcttcaaa

SEQ ID NO: 694663 - DNA, 22 bp, Artificial Sequence
  chemically synthesized
gaaagttactgttttgaagaaa

SEQ ID NO: 694664 - DNA, 22 bp, Artificial Sequence
  chemically synthesized
tgaaagttactgttttgaagaa

SEQ ID NO: 694665 - DNA, 22 bp, Artificial Sequence
  chemically synthesized
aaagatgctttcttcaaaacag

SEQ ID NO: 694666 - DNA, 22 bp, Artificial Sequence
  chemically synthesized
aagatgctttcttcaaaacagt

SEQ ID NO: 694667 - DNA, 22 bp, Artificial Sequence
  chemically synthesized
taaatctttgaaagttactgtt

SEQ ID NO: 694668 - DNA, 22 bp, Artificial Sequence
  chemically synthesized
tcttcaaaacagtaactttcaa

SEQ ID NO: 694669 - DNA, 22 bp, Artificial Sequence
  chemically synthesized
cttcaaaacagtaactttcaaa

SEQ ID NO: 694670 - DNA, 22 bp, Artificial Sequence
  chemically synthesized
ttcaaaacagtaactttcaaag

SEQ ID NO: 694671 - DNA, 22 bp, Artificial Sequence
  chemically synthesized
taaactataaatctttgaaagt

SEQ ID NO: 694672 - DNA, 22 bp, Artificial Sequence
  chemically synthesized
caaaacagtaactttcaaagat

SEQ ID NO: 694673 - DNA, 22 bp, Artificial Sequence
  chemically synthesized
aaaacagtaactttcaaagatt

SEQ ID NO: 694674 - DNA, 22 bp, Artificial Sequence
  chemically synthesized
tgctataaactataaatctttg

SEQ ID NO: 694675 - DNA, 22 bp, Artificial Sequence
  chemically synthesized
gattatgctataaactataaat

SEQ ID NO: 694676 - DNA, 22 bp, Artificial Sequence
  chemically synthesized
gctagattatgctataaactat

SEQ ID NO: 694677 - DNA, 22 bp, Artificial Sequence
  chemically synthesized
tcaaagatttatagtttatagc

SEQ ID NO: 694678 - DNA, 22 bp, Artificial Sequence
  chemically synthesized
caaagatttatagtttatagca

SEQ ID NO: 694679 - DNA, 22 bp, Artificial Sequence
  chemically synthesized
aaagatttatagtttatagcat

SEQ ID NO: 694680 - DNA, 22 bp, Artificial Sequence
  chemically synthesized
cctggctagattatgctataaa

SEQ ID NO: 694681 - DNA, 22 bp, Artificial Sequence
  chemically synthesized
attgcctggctagattatgcta

SEQ ID NO: 694682 - DNA, 22 bp, Artificial Sequence
  chemically synthesized
atagtttatagcataatctagc

SEQ ID NO: 694683 - DNA, 22 bp, Artificial Sequence
  chemically synthesized
tagtttatagcataatctagcc

SEQ ID NO: 694684 - DNA, 22 bp, Artificial Sequence
  chemically synthesized
atggggttgattgcctggctag

SEQ ID NO: 694685 - DNA, 22 bp, Artificial Sequence
  chemically synthesized
atagcataatctagccaggcaa

SEQ ID NO: 694686 - DNA, 22 bp, Artificial Sequence
  chemically synthesized
tagcataatctagccaggcaat

SEQ ID NO: 694687 - DNA, 22 bp, Artificial Sequence
  chemically synthesized
agtgttgatggggttgattgcc

SEQ ID NO: 694688 - DNA, 22 bp, Artificial Sequence
  chemically synthesized
gccaggcaatcaaccccatcaa

SEQ ID NO: 694689 - DNA, 22 bp, Artificial Sequence
  chemically synthesized
agagcagatggggttgagtgtt

SEQ ID NO: 694690 - DNA, 22 bp, Artificial Sequence
  chemically synthesized
ttgagagcagatggggttgagt

SEQ ID NO: 694691 - DNA, 22 bp, Artificial Sequence
  chemically synthesized
gttgagagcagatggggttgag

SEQ ID NO: 694692 - DNA, 22 bp, Artificial Sequence
  chemically synthesized
agtttgttgagagcagatgggg

SEQ ID NO: 694693 - DNA, 22 bp, Artificial Sequence
  chemically synthesized
cagtttgttgagagcagatggg

SEQ ID NO: 694694 - DNA, 22 bp, Artificial Sequence
  chemically synthesized
tatatttcagtttgttgagagc

SEQ ID NO: 694695 - DNA, 22 bp, Artificial Sequence
  chemically synthesized
gtatatttcagtttgttgagag

SEQ ID NO: 694696 - DNA, 22 bp, Artificial Sequence
  chemically synthesized
aaccccatctgctctcaacaaa

SEQ ID NO: 694697 - DNA, 22 bp, Artificial Sequence
  chemically synthesized
tgtatatttcagtttgttgaga

SEQ ID NO: 694698 - DNA, 22 bp, Artificial Sequence
  chemically synthesized
ttttgtatatttcagtttgttg

SEQ ID NO: 694699 - DNA, 22 bp, Artificial Sequence
  chemically synthesized
attttgtatatttcagtttgtt

SEQ ID NO: 694700 - DNA, 22 bp, Artificial Sequence
  chemically synthesized
ctctcaacaaactgaaatatac

SEQ ID NO: 694701 - DNA, 22 bp, Artificial Sequence
  chemically synthesized
tcaacaaactgaaatatacaaa

SEQ ID NO: 694702 - DNA, 22 bp, Artificial Sequence
  chemically synthesized
gcagtccatttattttgtatat

SEQ ID NO: 694703 - DNA, 22 bp, Artificial Sequence
  chemically synthesized
aacaaactgaaatatacaaaat

SEQ ID NO: 694704 - DNA, 22 bp, Artificial Sequence
  chemically synthesized
agcagtccatttattttgtata

SEQ ID NO: 694705 - DNA, 22 bp, Artificial Sequence
  chemically synthesized
tagcagtccatttattttgtat

SEQ ID NO: 694706 - DNA, 22 bp, Artificial Sequence
  chemically synthesized
ttagcagtccatttattttgta

SEQ ID NO: 694707 - DNA, 22 bp, Artificial Sequence
  chemically synthesized
tttagcagtccatttattttgt

SEQ ID NO: 694708 - DNA, 22 bp, Artificial Sequence
  chemically synthesized
aaatatacaaaataaatggact

SEQ ID NO: 694709 - DNA, 22 bp, Artificial Sequence
  chemically synthesized
gaagcgattttttagcagtcca

SEQ ID NO: 694710 - DNA, 22 bp, Artificial Sequence
  chemically synthesized
ggaagcgattttttagcagtcc

SEQ ID NO: 694711 - DNA, 22 bp, Artificial Sequence
  chemically synthesized
catttggaagcgattttttagc

SEQ ID NO: 694712 - DNA, 22 bp, Artificial Sequence
  chemically synthesized
aattacatttggaagcgatttt

SEQ ID NO: 694713 - DNA, 22 bp, Artificial Sequence
  chemically synthesized
ttaaattacatttggaagcgat

SEQ ID NO: 694714 - DNA, 22 bp, Artificial Sequence
  chemically synthesized
attaaattacatttggaagcga

SEQ ID NO: 694715 - DNA, 22 bp, Artificial Sequence
  chemically synthesized
ctaaaaaatcgcttccaaatgt

SEQ ID NO: 694716 - DNA, 22 bp, Artificial Sequence
  chemically synthesized
cagtttattaaattacatttgg

SEQ ID NO: 694717 - DNA, 22 bp, Artificial Sequence
  chemically synthesized
aaaaatcgcttccaaatgtaat

SEQ ID NO: 694718 - DNA, 22 bp, Artificial Sequence
  chemically synthesized
gtgttacagtttattaaattac

SEQ ID NO: 694719 - DNA, 22 bp, Artificial Sequence
  chemically synthesized
ccaaatgtaatttaataaactg

SEQ ID NO: 694720 - DNA, 22 bp, Artificial Sequence
  chemically synthesized
caaatgtaatttaataaactgt

SEQ ID NO: 694721 - DNA, 22 bp, Artificial Sequence
  chemically synthesized
gatagccccactggtgttacag

SEQ ID NO: 694722 - DNA, 22 bp, Artificial Sequence
  chemically synthesized
tagatagccccactggtgttac

SEQ ID NO: 694723 - DNA, 22 bp, Artificial Sequence
  chemically synthesized
aataaactgtaacaccagtggg

SEQ ID NO: 694724 - DNA, 22 bp, Artificial Sequence
  chemically synthesized
ataaactgtaacaccagtgggg

SEQ ID NO: 694725 - DNA, 22 bp, Artificial Sequence
  chemically synthesized
aattctagatagccccactggt

SEQ ID NO: 694726 - DNA, 22 bp, Artificial Sequence
  chemically synthesized
aaattctagatagccccactgg

SEQ ID NO: 694727 - DNA, 22 bp, Artificial Sequence
  chemically synthesized
taaattctagatagccccactg

SEQ ID NO: 694728 - DNA, 22 bp, Artificial Sequence
  chemically synthesized
ttaaattctagatagccccact

SEQ ID NO: 694729 - DNA, 22 bp, Artificial Sequence
  chemically synthesized
tttaaattctagatagccccac

SEQ ID NO: 694730 - DNA, 22 bp, Artificial Sequence
  chemically synthesized
ttttaaattctagatagcccca

SEQ ID NO: 694731 - DNA, 22 bp, Artificial Sequence
  chemically synthesized
taacaccagtggggctatctag

SEQ ID NO: 694732 - DNA, 22 bp, Artificial Sequence
  chemically synthesized
tttttttaaattctagatagcc

SEQ ID NO: 694733 - DNA, 22 bp, Artificial Sequence
  chemically synthesized
catgttatttttttaaattcta

SEQ ID NO: 694734 - DNA, 22 bp, Artificial Sequence
  chemically synthesized
tctagaatttaaaaaaataaca

SEQ ID NO: 694735 - DNA, 22 bp, Artificial Sequence
  chemically synthesized
gaatttaaaaaaataacatgga

SEQ ID NO: 694736 - DNA, 22 bp, Artificial Sequence
  chemically synthesized
aaaaaaataacatggaacttct

SEQ ID NO: 694737 - DNA, 22 bp, Artificial Sequence
  chemically synthesized
aaaaaataacatggaacttctt

SEQ ID NO: 694738 - DNA, 22 bp, Artificial Sequence
  chemically synthesized
aaaaatagacaataacagataa

SEQ ID NO: 694739 - DNA, 22 bp, Artificial Sequence
  chemically synthesized
aaaaaatagacaataacagata

SEQ ID NO: 694740 - DNA, 22 bp, Artificial Sequence
  chemically synthesized
taaaaaatagacaataacagat

SEQ ID NO: 694741 - DNA, 22 bp, Artificial Sequence
  chemically synthesized
ttaaaaaatagacaataacaga

SEQ ID NO: 694742 - DNA, 22 bp, Artificial Sequence
  chemically synthesized
ctttatctgttattgtctattt

SEQ ID NO: 694743 - DNA, 22 bp, Artificial Sequence
  chemically synthesized
tttatctgttattgtctatttt

SEQ ID NO: 694744 - DNA, 22 bp, Artificial Sequence
  chemically synthesized
tatctgttattgtctatttttt

SEQ ID NO: 694745 - DNA, 22 bp, Artificial Sequence
  chemically synthesized
atctgttattgtctatttttta

SEQ ID NO: 694746 - DNA, 22 bp, Artificial Sequence
  chemically synthesized
tctgttattgtctattttttaa

SEQ ID NO: 694747 - DNA, 22 bp, Artificial Sequence
  chemically synthesized
ttattgtctattttttaaaaat

SEQ ID NO: 694748 - DNA, 22 bp, Artificial Sequence
  chemically synthesized
ttgtctattttttaaaaattat

SEQ ID NO: 694749 - DNA, 22 bp, Artificial Sequence
  chemically synthesized
tctattttttaaaaattattta

SEQ ID NO: 694750 - DNA, 22 bp, Artificial Sequence
  chemically synthesized
ttttttaaaaattatttattta

SEQ ID NO: 694751 - DNA, 22 bp, Artificial Sequence
  chemically synthesized
gaaataaataaataaataaata

SEQ ID NO: 694752 - DNA, 22 bp, Artificial Sequence
  chemically synthesized
tttaaaaattatttatttattt

SEQ ID NO: 694753 - DNA, 22 bp, Artificial Sequence
  chemically synthesized
ttaaaaattatttatttattta

SEQ ID NO: 694754 - DNA, 22 bp, Artificial Sequence
  chemically synthesized
taaaaattatttatttatttat

SEQ ID NO: 694755 - DNA, 22 bp, Artificial Sequence
  chemically synthesized
aaaaattatttatttatttatt

SEQ ID NO: 694756 - DNA, 22 bp, Artificial Sequence
  chemically synthesized
catctagaaataaataaataaa

SEQ ID NO: 694757 - DNA, 22 bp, Artificial Sequence
  chemically synthesized
aaaattatttatttatttattt

SEQ ID NO: 694758 - DNA, 22 bp, Artificial Sequence
  chemically synthesized
tttatttatttatttatttcta

SEQ ID NO: 694759 - DNA, 22 bp, Artificial Sequence
  chemically synthesized
atttatttatttatttctagat

SEQ ID NO: 694760 - DNA, 22 bp, Artificial Sequence
  chemically synthesized
tttatttatttatttctagatg

SEQ ID NO: 694761 - DNA, 22 bp, Artificial Sequence
  chemically synthesized
atttatttatttctagatggag

SEQ ID NO: 694762 - DNA, 22 bp, Artificial Sequence
  chemically synthesized
tttatttatttctagatggagt

SEQ ID NO: 694763 - DNA, 22 bp, Artificial Sequence
  chemically synthesized
agcaatatagcaagactccatc

SEQ ID NO: 694764 - DNA, 22 bp, Artificial Sequence
  chemically synthesized
atttatttctagatggagtctt

SEQ ID NO: 694765 - DNA, 22 bp, Artificial Sequence
  chemically synthesized
tttatttctagatggagtcttg

SEQ ID NO: 694766 - DNA, 22 bp, Artificial Sequence
  chemically synthesized
atttctagatggagtcttgcta

SEQ ID NO: 694767 - DNA, 22 bp, Artificial Sequence
  chemically synthesized
tttctagatggagtcttgctat

SEQ ID NO: 694768 - DNA, 22 bp, Artificial Sequence
  chemically synthesized
ctagatggagtcttgctatatt

SEQ ID NO: 694769 - DNA, 22 bp, Artificial Sequence
  chemically synthesized
tagatggagtcttgctatattg

SEQ ID NO: 694770 - DNA, 22 bp, Artificial Sequence
  chemically synthesized
agaccaggctgagcaatatagc

SEQ ID NO: 694771 - DNA, 22 bp, Artificial Sequence
  chemically synthesized
gatggagtcttgctatattgct

SEQ ID NO: 694772 - DNA, 22 bp, Artificial Sequence
  chemically synthesized
gagaccaggctgagcaatatag

SEQ ID NO: 694773 - DNA, 22 bp, Artificial Sequence
  chemically synthesized
gctatattgctcagcctggtct

SEQ ID NO: 694774 - DNA, 22 bp, Artificial Sequence
  chemically synthesized
ctatattgctcagcctggtctc

SEQ ID NO: 694775 - DNA, 22 bp, Artificial Sequence
  chemically synthesized
agtccaggagtttgagaccagg

SEQ ID NO: 694776 - DNA, 22 bp, Artificial Sequence
  chemically synthesized
gagtccaggagtttgagaccag

SEQ ID NO: 694777 - DNA, 22 bp, Artificial Sequence
  chemically synthesized
tattgctcagcctggtctcaaa

SEQ ID NO: 694778 - DNA, 22 bp, Artificial Sequence
  chemically synthesized
ctcagcctggtctcaaactcct

SEQ ID NO: 694779 - DNA, 22 bp, Artificial Sequence
  chemically synthesized
agcctggtctcaaactcctgga

SEQ ID NO: 694780 - DNA, 22 bp, Artificial Sequence
  chemically synthesized
gtctcaaactcctggactcaag

SEQ ID NO: 694781 - DNA, 22 bp, Artificial Sequence
  chemically synthesized
aaactcctggactcaagtgatc

SEQ ID NO: 694782 - DNA, 22 bp, Artificial Sequence
  chemically synthesized
ggaagccgaagcaggaagatca

SEQ ID NO: 694783 - DNA, 22 bp, Artificial Sequence
  chemically synthesized
ctggactcaagtgatcttcctg

SEQ ID NO: 694784 - DNA, 22 bp, Artificial Sequence
  chemically synthesized
gggaagccgaagcaggaagatc

SEQ ID NO: 694785 - DNA, 22 bp, Artificial Sequence
  chemically synthesized
tgggaagccgaagcaggaagat

SEQ ID NO: 694786 - DNA, 22 bp, Artificial Sequence
  chemically synthesized
gactcaagtgatcttcctgctt

SEQ ID NO: 694787 - DNA, 22 bp, Artificial Sequence
  chemically synthesized
aagtgatcttcctgcttcggct

SEQ ID NO: 694788 - DNA, 22 bp, Artificial Sequence
  chemically synthesized
cagtcccaacactttgggaagc

SEQ ID NO: 694789 - DNA, 22 bp, Artificial Sequence
  chemically synthesized
cctgcttcggcttcccaaagtg

SEQ ID NO: 694790 - DNA, 22 bp, Artificial Sequence
  chemically synthesized
ctgcttcggcttcccaaagtgt

SEQ ID NO: 694791 - DNA, 22 bp, Artificial Sequence
  chemically synthesized
tgcctgcagtcccaacactttg

SEQ ID NO: 694792 - DNA, 22 bp, Artificial Sequence
  chemically synthesized
cttcggcttcccaaagtgttgg

SEQ ID NO: 694793 - DNA, 22 bp, Artificial Sequence
  chemically synthesized
atgcctgcagtcccaacacttt

SEQ ID NO: 694794 - DNA, 22 bp, Artificial Sequence
  chemically synthesized
cggcttcccaaagtgttgggac

SEQ ID NO: 694795 - DNA, 22 bp, Artificial Sequence
  chemically synthesized
ggcttcccaaagtgttgggact

SEQ ID NO: 694796 - DNA, 22 bp, Artificial Sequence
  chemically synthesized
cccaaagtgttgggactgcagg

SEQ ID NO: 694797 - DNA, 22 bp, Artificial Sequence
  chemically synthesized
ccaaagtgttgggactgcaggc

SEQ ID NO: 694798 - DNA, 22 bp, Artificial Sequence
  chemically synthesized
ggactgcaggcataagctgctg

SEQ ID NO: 694799 - DNA, 22 bp, Artificial Sequence
  chemically synthesized
caggcataagctgctgtgccgt

SEQ ID NO: 694800 - DNA, 22 bp, Artificial Sequence
  chemically synthesized
ctgtgccgtgccatctattttt

SEQ ID NO: 694801 - DNA, 22 bp, Artificial Sequence
  chemically synthesized
tgccgtgccatctatttttttg

SEQ ID NO: 694802 - DNA, 22 bp, Artificial Sequence
  chemically synthesized
caaagaaaaaaaaaatcacaca

SEQ ID NO: 694803 - DNA, 22 bp, Artificial Sequence
  chemically synthesized
tttttttgtgtgtgattttttt

SEQ ID NO: 694804 - DNA, 22 bp, Artificial Sequence
  chemically synthesized
catctccaaagaaaaaaaaaat

SEQ ID NO: 694805 - DNA, 22 bp, Artificial Sequence
  chemically synthesized
ttttgtgtgtgatttttttttt

SEQ ID NO: 694806 - DNA, 22 bp, Artificial Sequence
  chemically synthesized
tttgtgtgtgattttttttttc

SEQ ID NO: 694807 - DNA, 22 bp, Artificial Sequence
  chemically synthesized
ttgtgtgtgattttttttttct

SEQ ID NO: 694808 - DNA, 22 bp, Artificial Sequence
  chemically synthesized
tgtgtgtgattttttttttctt

SEQ ID NO: 694809 - DNA, 22 bp, Artificial Sequence
  chemically synthesized
gtgtgtgattttttttttcttt

SEQ ID NO: 694810 - DNA, 22 bp, Artificial Sequence
  chemically synthesized
tgtgtgattttttttttctttg

SEQ ID NO: 694811 - DNA, 22 bp, Artificial Sequence
  chemically synthesized
agactccatctccaaagaaaaa

SEQ ID NO: 694812 - DNA, 22 bp, Artificial Sequence
  chemically synthesized
tttttttctttggagatggagt

SEQ ID NO: 694813 - DNA, 22 bp, Artificial Sequence
  chemically synthesized
ttttttctttggagatggagtc

SEQ ID NO: 694814 - DNA, 22 bp, Artificial Sequence
  chemically synthesized
tttttctttggagatggagtct

SEQ ID NO: 694815 - DNA, 22 bp, Artificial Sequence
  chemically synthesized
ttttctttggagatggagtctc

SEQ ID NO: 694816 - DNA, 22 bp, Artificial Sequence
  chemically synthesized
tttctttggagatggagtctca

SEQ ID NO: 694817 - DNA, 22 bp, Artificial Sequence
  chemically synthesized
ttctttggagatggagtctcaa

SEQ ID NO: 694818 - DNA, 22 bp, Artificial Sequence
  chemically synthesized
tctttggagatggagtctcaac

SEQ ID NO: 694819 - DNA, 22 bp, Artificial Sequence
  chemically synthesized
ctttggagatggagtctcaact

SEQ ID NO: 694820 - DNA, 22 bp, Artificial Sequence
  chemically synthesized
tttggagatggagtctcaactc

SEQ ID NO: 694821 - DNA, 22 bp, Artificial Sequence
  chemically synthesized
agccagggcgacagagttgaga

SEQ ID NO: 694822 - DNA, 22 bp, Artificial Sequence
  chemically synthesized
tggagatggagtctcaactctg

SEQ ID NO: 694823 - DNA, 22 bp, Artificial Sequence
  chemically synthesized
cagccagggcgacagagttgag

SEQ ID NO: 694824 - DNA, 22 bp, Artificial Sequence
  chemically synthesized
ggagatggagtctcaactctgt

SEQ ID NO: 694825 - DNA, 22 bp, Artificial Sequence
  chemically synthesized
gagatggagtctcaactctgtc

SEQ ID NO: 694826 - DNA, 22 bp, Artificial Sequence
  chemically synthesized
cacttcagccagggcgacagag

SEQ ID NO: 694827 - DNA, 22 bp, Artificial Sequence
  chemically synthesized
aactctgtcgccctggctgaag

SEQ ID NO: 694828 - DNA, 22 bp, Artificial Sequence
  chemically synthesized
tgtcgccctggctgaagtgcaa

SEQ ID NO: 694829 - DNA, 22 bp, Artificial Sequence
  chemically synthesized
tcgccctggctgaagtgcaatg

SEQ ID NO: 694830 - DNA, 22 bp, Artificial Sequence
  chemically synthesized
cagtgagccgagatcgcaccat

SEQ ID NO: 694831 - DNA, 22 bp, Artificial Sequence
  chemically synthesized
gctgaagtgcaatggtgcgatc

SEQ ID NO: 694832 - DNA, 22 bp, Artificial Sequence
  chemically synthesized
aagtgcaatggtgcgatctcgg

SEQ ID NO: 694833 - DNA, 22 bp, Artificial Sequence
  chemically synthesized
gaggcagaggttgcagtgagcc

SEQ ID NO: 694834 - DNA, 22 bp, Artificial Sequence
  chemically synthesized
aaccctggaggcagaggttgca

SEQ ID NO: 694835 - DNA, 22 bp, Artificial Sequence
  chemically synthesized
gaaccctggaggcagaggttgc

SEQ ID NO: 694836 - DNA, 22 bp, Artificial Sequence
  chemically synthesized
ggctcactgcaacctctgcctc

SEQ ID NO: 694837 - DNA, 22 bp, Artificial Sequence
  chemically synthesized
actgcaacctctgcctccaggg

SEQ ID NO: 694838 - DNA, 22 bp, Artificial Sequence
  chemically synthesized
caacctctgcctccagggttca

SEQ ID NO: 694839 - DNA, 22 bp, Artificial Sequence
  chemically synthesized
aggcaggagaatcacttgaacc

SEQ ID NO: 694840 - DNA, 22 bp, Artificial Sequence
  chemically synthesized
tgcctccagggttcaagtgatt

SEQ ID NO: 694841 - DNA, 22 bp, Artificial Sequence
  chemically synthesized
cctccagggttcaagtgattct

SEQ ID NO: 694842 - DNA, 22 bp, Artificial Sequence
  chemically synthesized
cagggttcaagtgattctcctg

SEQ ID NO: 694843 - DNA, 22 bp, Artificial Sequence
  chemically synthesized
aggaggctgaggcaggagaatc

SEQ ID NO: 694844 - DNA, 22 bp, Artificial Sequence
  chemically synthesized
ctcaggaggctgaggcaggaga

SEQ ID NO: 694845 - DNA, 22 bp, Artificial Sequence
  chemically synthesized
aagtgattctcctgcctcagcc

SEQ ID NO: 694846 - DNA, 22 bp, Artificial Sequence
  chemically synthesized
taatccccactactcaggaggc

SEQ ID NO: 694847 - DNA, 22 bp, Artificial Sequence
  chemically synthesized
tcctgcctcagcctcctgagta

SEQ ID NO: 694848 - DNA, 22 bp, Artificial Sequence
  chemically synthesized
ctgcctcagcctcctgagtagt

SEQ ID NO: 694849 - DNA, 22 bp, Artificial Sequence
  chemically synthesized
cctcagcctcctgagtagtggg

SEQ ID NO: 694850 - DNA, 22 bp, Artificial Sequence
  chemically synthesized
agcctcctgagtagtggggatt

SEQ ID NO: 694851 - DNA, 22 bp, Artificial Sequence
  chemically synthesized
ctgagtagtggggattacaggc

SEQ ID NO: 694852 - DNA, 22 bp, Artificial Sequence
  chemically synthesized
gtgtggtggcagatgcctgtaa

SEQ ID NO: 694853 - DNA, 22 bp, Artificial Sequence
  chemically synthesized
agtagtggggattacaggcatc

SEQ ID NO: 694854 - DNA, 22 bp, Artificial Sequence
  chemically synthesized
gtctggtgtggtggcagatgcc

SEQ ID NO: 694855 - DNA, 22 bp, Artificial Sequence
  chemically synthesized
caggcatctgccaccacaccag

SEQ ID NO: 694856 - DNA, 22 bp, Artificial Sequence
  chemically synthesized
aaaatacaaaaattagtctggt

SEQ ID NO: 694857 - DNA, 22 bp, Artificial Sequence
  chemically synthesized
ctaaaaatacaaaaattagtct

SEQ ID NO: 694858 - DNA, 22 bp, Artificial Sequence
  chemically synthesized
ccaccacaccagactaattttt

SEQ ID NO: 694859 - DNA, 22 bp, Artificial Sequence
  chemically synthesized
tactaaaaatacaaaaattagt

SEQ ID NO: 694860 - DNA, 22 bp, Artificial Sequence
  chemically synthesized
atttttgtatttttagtagaga

SEQ ID NO: 694861 - DNA, 22 bp, Artificial Sequence
  chemically synthesized
ttgtatttttagtagagacggg

SEQ ID NO: 694862 - DNA, 22 bp, Artificial Sequence
  chemically synthesized
tgtatttttagtagagacgggg

SEQ ID NO: 694863 - DNA, 22 bp, Artificial Sequence
  chemically synthesized
gtatttttagtagagacggggt

SEQ ID NO: 694864 - DNA, 22 bp, Artificial Sequence
  chemically synthesized
tatttttagtagagacggggtt

SEQ ID NO: 694865 - DNA, 22 bp, Artificial Sequence
  chemically synthesized
tccaagatggtgaaccccgtct

SEQ ID NO: 694866 - DNA, 22 bp, Artificial Sequence
  chemically synthesized
ttagtagagacggggttcacca

SEQ ID NO: 694867 - DNA, 22 bp, Artificial Sequence
  chemically synthesized
tagtagagacggggttcaccat

SEQ ID NO: 694868 - DNA, 22 bp, Artificial Sequence
  chemically synthesized
agtagagacggggttcaccatc

SEQ ID NO: 694869 - DNA, 22 bp, Artificial Sequence
  chemically synthesized
gtagagacggggttcaccatct

SEQ ID NO: 694870 - DNA, 22 bp, Artificial Sequence
  chemically synthesized
aagaccagcctgtccaagatgg

SEQ ID NO: 694871 - DNA, 22 bp, Artificial Sequence
  chemically synthesized
accatcttggacaggctggtct

SEQ ID NO: 694872 - DNA, 22 bp, Artificial Sequence
  chemically synthesized
aggtcaggagttcaagaccagc

SEQ ID NO: 694873 - DNA, 22 bp, Artificial Sequence
  chemically synthesized
ggacaggctggtcttgaactcc

SEQ ID NO: 694874 - DNA, 22 bp, Artificial Sequence
  chemically synthesized
gacaggctggtcttgaactcct

SEQ ID NO: 694875 - DNA, 22 bp, Artificial Sequence
  chemically synthesized
gtcttgaactcctgacctcagg

SEQ ID NO: 694876 - DNA, 22 bp, Artificial Sequence
  chemically synthesized
aggtgggcaaatcacctgaggt

SEQ ID NO: 694877 - DNA, 22 bp, Artificial Sequence
  chemically synthesized
gaactcctgacctcaggtgatt

SEQ ID NO: 694878 - DNA, 22 bp, Artificial Sequence
  chemically synthesized
aactcctgacctcaggtgattt

SEQ ID NO: 694879 - DNA, 22 bp, Artificial Sequence
  chemically synthesized
ggaggctgaggtgggcaaatca

SEQ ID NO: 694880 - DNA, 22 bp, Artificial Sequence
  chemically synthesized
ctgacctcaggtgatttgccca

SEQ ID NO: 694881 - DNA, 22 bp, Artificial Sequence
  chemically synthesized
gggaggctgaggtgggcaaatc

SEQ ID NO: 694882 - DNA, 22 bp, Artificial Sequence
  chemically synthesized
tgggaggctgaggtgggcaaat

SEQ ID NO: 694883 - DNA, 22 bp, Artificial Sequence
  chemically synthesized
acctcaggtgatttgcccacct

SEQ ID NO: 694884 - DNA, 22 bp, Artificial Sequence
  chemically synthesized
gcactttgggaggctgaggtgg

SEQ ID NO: 694885 - DNA, 22 bp, Artificial Sequence
  chemically synthesized
aggtgatttgcccacctcagcc

SEQ ID NO: 694886 - DNA, 22 bp, Artificial Sequence
  chemically synthesized
taatcctagcactttgggaggc

SEQ ID NO: 694887 - DNA, 22 bp, Artificial Sequence
  chemically synthesized
gcccacctcagcctcccaaagt

SEQ ID NO: 694888 - DNA, 22 bp, Artificial Sequence
  chemically synthesized
cccacctcagcctcccaaagtg

SEQ ID NO: 694889 - DNA, 22 bp, Artificial Sequence
  chemically synthesized
acacctgtaatcctagcacttt

SEQ ID NO: 694890 - DNA, 22 bp, Artificial Sequence
  chemically synthesized
agcctcccaaagtgctaggatt

SEQ ID NO: 694891 - DNA, 22 bp, Artificial Sequence
  chemically synthesized
ccaaagtgctaggattacaggt

SEQ ID NO: 694892 - DNA, 22 bp, Artificial Sequence
  chemically synthesized
ggattacaggtgtgagccacca

SEQ ID NO: 694893 - DNA, 22 bp, Artificial Sequence
  chemically synthesized
caggtgtgagccaccacgcctg

SEQ ID NO: 694894 - DNA, 22 bp, Artificial Sequence
  chemically synthesized
aagaaaaatagatggcagtcca

SEQ ID NO: 694895 - DNA, 22 bp, Artificial Sequence
  chemically synthesized
aaagaaaaatagatggcagtcc

SEQ ID NO: 694896 - DNA, 22 bp, Artificial Sequence
  chemically synthesized
tttaaagaaaaatagatggcag

SEQ ID NO: 694897 - DNA, 22 bp, Artificial Sequence
  chemically synthesized
atttaaagaaaaatagatggca

SEQ ID NO: 694898 - DNA, 22 bp, Artificial Sequence
  chemically synthesized
gactgccatctatttttcttta

SEQ ID NO: 694899 - DNA, 22 bp, Artificial Sequence
  chemically synthesized
ccatctatttttctttaaataa

SEQ ID NO: 694900 - DNA, 22 bp, Artificial Sequence
  chemically synthesized
tgatcccaataggtatgcttat

SEQ ID NO: 694901 - DNA, 22 bp, Artificial Sequence
  chemically synthesized
tttttctttaaataagcatacc

SEQ ID NO: 694902 - DNA, 22 bp, Artificial Sequence
  chemically synthesized
ttctttaaataagcatacctat

SEQ ID NO: 694903 - DNA, 22 bp, Artificial Sequence
  chemically synthesized
tctttaaataagcatacctatt

SEQ ID NO: 694904 - DNA, 22 bp, Artificial Sequence
  chemically synthesized
agctatgatcccaataggtatg

SEQ ID NO: 694905 - DNA, 22 bp, Artificial Sequence
  chemically synthesized
ctttaaataagcatacctattg

SEQ ID NO: 694906 - DNA, 22 bp, Artificial Sequence
  chemically synthesized
tttaaataagcatacctattgg

SEQ ID NO: 694907 - DNA, 22 bp, Artificial Sequence
  chemically synthesized
taaataagcatacctattggga

SEQ ID NO: 694908 - DNA, 22 bp, Artificial Sequence
  chemically synthesized
aaataagcatacctattgggat

SEQ ID NO: 694909 - DNA, 22 bp, Artificial Sequence
  chemically synthesized
aataagcatacctattgggatc

SEQ ID NO: 694910 - DNA, 22 bp, Artificial Sequence
  chemically synthesized
gaagctgagctatgatcccaat

SEQ ID NO: 694911 - DNA, 22 bp, Artificial Sequence
  chemically synthesized
agcactggaagctgagctatga

SEQ ID NO: 694912 - DNA, 22 bp, Artificial Sequence
  chemically synthesized
ttgggatcatagctcagcttcc

SEQ ID NO: 694913 - DNA, 22 bp, Artificial Sequence
  chemically synthesized
atgattaagcactggaagctga

SEQ ID NO: 694914 - DNA, 22 bp, Artificial Sequence
  chemically synthesized
gatgattaagcactggaagctg

SEQ ID NO: 694915 - DNA, 22 bp, Artificial Sequence
  chemically synthesized
ggatcatagctcagcttccagt

SEQ ID NO: 694916 - DNA, 22 bp, Artificial Sequence
  chemically synthesized
tgatgattaagcactggaagct

SEQ ID NO: 694917 - DNA, 22 bp, Artificial Sequence
  chemically synthesized
attttgatgattaagcactgga

SEQ ID NO: 694918 - DNA, 22 bp, Artificial Sequence
  chemically synthesized
gattttgatgattaagcactgg

SEQ ID NO: 694919 - DNA, 22 bp, Artificial Sequence
  chemically synthesized
tgattttgatgattaagcactg

SEQ ID NO: 694920 - DNA, 22 bp, Artificial Sequence
  chemically synthesized
ttttgattttgatgattaagca

SEQ ID NO: 694921 - DNA, 22 bp, Artificial Sequence
  chemically synthesized
gttttgattttgatgattaagc

SEQ ID NO: 694922 - DNA, 22 bp, Artificial Sequence
  chemically synthesized
agcttccagtgcttaatcatca

SEQ ID NO: 694923 - DNA, 22 bp, Artificial Sequence
  chemically synthesized
ccagtgcttaatcatcaaaatc

SEQ ID NO: 694924 - DNA, 22 bp, Artificial Sequence
  chemically synthesized
atcatttgttttgattttgatg

SEQ ID NO: 694925 - DNA, 22 bp, Artificial Sequence
  chemically synthesized
cagtgcttaatcatcaaaatca

SEQ ID NO: 694926 - DNA, 22 bp, Artificial Sequence
  chemically synthesized
gatcatttgttttgattttgat

SEQ ID NO: 694927 - DNA, 22 bp, Artificial Sequence
  chemically synthesized
aatcatcaaaatcaaaacaaat

SEQ ID NO: 694928 - DNA, 22 bp, Artificial Sequence
  chemically synthesized
atcatcaaaatcaaaacaaatg

SEQ ID NO: 694929 - DNA, 22 bp, Artificial Sequence
  chemically synthesized
acatgtaaaaataataataaat

SEQ ID NO: 694930 - DNA, 22 bp, Artificial Sequence
  chemically synthesized
tatatctcacatgtaaaaataa

SEQ ID NO: 694931 - DNA, 22 bp, Artificial Sequence
  chemically synthesized
attattatttttacatgtgaga

SEQ ID NO: 694932 - DNA, 22 bp, Artificial Sequence
  chemically synthesized
ttattatttttacatgtgagat

SEQ ID NO: 694933 - DNA, 22 bp, Artificial Sequence
  chemically synthesized
gcatgtattatatatctcacat

SEQ ID NO: 694934 - DNA, 22 bp, Artificial Sequence
  chemically synthesized
ttatttttacatgtgagatata

SEQ ID NO: 694935 - DNA, 22 bp, Artificial Sequence
  chemically synthesized
tttttacatgtgagatatataa

SEQ ID NO: 694936 - DNA, 22 bp, Artificial Sequence
  chemically synthesized
ttacatgtgagatatataatac

SEQ ID NO: 694937 - DNA, 22 bp, Artificial Sequence
  chemically synthesized
tacatgtgagatatataataca

SEQ ID NO: 694938 - DNA, 22 bp, Artificial Sequence
  chemically synthesized
acatgtgagatatataatacat

SEQ ID NO: 694939 - DNA, 22 bp, Artificial Sequence
  chemically synthesized
catgtgagatatataatacatg

SEQ ID NO: 694940 - DNA, 22 bp, Artificial Sequence
  chemically synthesized
catcatccctagcatgtattat

SEQ ID NO: 694941 - DNA, 22 bp, Artificial Sequence
  chemically synthesized
gcatcatccctagcatgtatta

SEQ ID NO: 694942 - DNA, 22 bp, Artificial Sequence
  chemically synthesized
tgcatcatccctagcatgtatt

SEQ ID NO: 694943 - DNA, 22 bp, Artificial Sequence
  chemically synthesized
tgcatctttgcatcatccctag

SEQ ID NO: 694944 - DNA, 22 bp, Artificial Sequence
  chemically synthesized
atgcatctttgcatcatcccta

SEQ ID NO: 694945 - DNA, 22 bp, Artificial Sequence
  chemically synthesized
tgccttatgcatctttgcatca

SEQ ID NO: 694946 - DNA, 22 bp, Artificial Sequence
  chemically synthesized
gtgccttatgcatctttgcatc

SEQ ID NO: 694947 - DNA, 22 bp, Artificial Sequence
  chemically synthesized
gggatgatgcaaagatgcataa

SEQ ID NO: 694948 - DNA, 22 bp, Artificial Sequence
  chemically synthesized
acaacgcttgtgccttatgcat

SEQ ID NO: 694949 - DNA, 22 bp, Artificial Sequence
  chemically synthesized
tgacaacgcttgtgccttatgc

SEQ ID NO: 694950 - DNA, 22 bp, Artificial Sequence
  chemically synthesized
tctgacaacgcttgtgccttat

SEQ ID NO: 694951 - DNA, 22 bp, Artificial Sequence
  chemically synthesized
taaactctctgacaacgcttgt

SEQ ID NO: 694952 - DNA, 22 bp, Artificial Sequence
  chemically synthesized
agctgtaaactctctgacaacg

SEQ ID NO: 694953 - DNA, 22 bp, Artificial Sequence
  chemically synthesized
agttcagctgtaaactctctga

SEQ ID NO: 694954 - DNA, 22 bp, Artificial Sequence
  chemically synthesized
ctcagttcagctgtaaactctc

SEQ ID NO: 694955 - DNA, 22 bp, Artificial Sequence
  chemically synthesized
tctcctcagttcagctgtaaac

SEQ ID NO: 694956 - DNA, 22 bp, Artificial Sequence
  chemically synthesized
gtctcctcagttcagctgtaaa

SEQ ID NO: 694957 - DNA, 22 bp, Artificial Sequence
  chemically synthesized
tcagagagtttacagctgaact

SEQ ID NO: 694958 - DNA, 22 bp, Artificial Sequence
  chemically synthesized
agatcccttgtctcctcagttc

SEQ ID NO: 694959 - DNA, 22 bp, Artificial Sequence
  chemically synthesized
cagatcccttgtctcctcagtt

SEQ ID NO: 694960 - DNA, 22 bp, Artificial Sequence
  chemically synthesized
tcagatcccttgtctcctcagt

SEQ ID NO: 694961 - DNA, 22 bp, Artificial Sequence
  chemically synthesized
acagctgaactgaggagacaag

SEQ ID NO: 694962 - DNA, 22 bp, Artificial Sequence
  chemically synthesized
attttcagatcccttgtctcct

SEQ ID NO: 694963 - DNA, 22 bp, Artificial Sequence
  chemically synthesized
cagctgaactgaggagacaagg

SEQ ID NO: 694964 - DNA, 22 bp, Artificial Sequence
  chemically synthesized
ttaattttcagatcccttgtct

SEQ ID NO: 694965 - DNA, 22 bp, Artificial Sequence
  chemically synthesized
gttaattttcagatcccttgtc

SEQ ID NO: 694966 - DNA, 22 bp, Artificial Sequence
  chemically synthesized
tgttaattttcagatcccttgt

SEQ ID NO: 694967 - DNA, 22 bp, Artificial Sequence
  chemically synthesized
aactgaggagacaagggatctg

SEQ ID NO: 694968 - DNA, 22 bp, Artificial Sequence
  chemically synthesized
aggagacaagggatctgaaaat

SEQ ID NO: 694969 - DNA, 22 bp, Artificial Sequence
  chemically synthesized
aaatattttgttaattttcaga

SEQ ID NO: 694970 - DNA, 22 bp, Artificial Sequence
  chemically synthesized
gaaatattttgttaattttcag

SEQ ID NO: 694971 - DNA, 22 bp, Artificial Sequence
  chemically synthesized
ttgaaatattttgttaattttc

SEQ ID NO: 694972 - DNA, 22 bp, Artificial Sequence
  chemically synthesized
actcttgaaatattttgttaat

SEQ ID NO: 694973 - DNA, 22 bp, Artificial Sequence
  chemically synthesized
aactcttgaaatattttgttaa

SEQ ID NO: 694974 - DNA, 22 bp, Artificial Sequence
  chemically synthesized
tttaactcttgaaatattttgt

SEQ ID NO: 694975 - DNA, 22 bp, Artificial Sequence
  chemically synthesized
gtttaactcttgaaatattttg

SEQ ID NO: 694976 - DNA, 22 bp, Artificial Sequence
  chemically synthesized
ttgtttaactcttgaaatattt

SEQ ID NO: 694977 - DNA, 22 bp, Artificial Sequence
  chemically synthesized
cttgtttaactcttgaaatatt

SEQ ID NO: 694978 - DNA, 22 bp, Artificial Sequence
  chemically synthesized
aaaattaacaaaatatttcaag

SEQ ID NO: 694979 - DNA, 22 bp, Artificial Sequence
  chemically synthesized
tcttgtttaactcttgaaatat

SEQ ID NO: 694980 - DNA, 22 bp, Artificial Sequence
  chemically synthesized
tttcttgtttaactcttgaaat

SEQ ID NO: 694981 - DNA, 22 bp, Artificial Sequence
  chemically synthesized
ctttcttgtttaactcttgaaa

SEQ ID NO: 694982 - DNA, 22 bp, Artificial Sequence
  chemically synthesized
tctttcttgtttaactcttgaa

SEQ ID NO: 694983 - DNA, 22 bp, Artificial Sequence
  chemically synthesized
acaaaatatttcaagagttaaa

SEQ ID NO: 694984 - DNA, 22 bp, Artificial Sequence
  chemically synthesized
agaccccaagttttctttcttg

SEQ ID NO: 694985 - DNA, 22 bp, Artificial Sequence
  chemically synthesized
caagagttaaacaagaaagaaa

SEQ ID NO: 694986 - DNA, 22 bp, Artificial Sequence
  chemically synthesized
aagagttaaacaagaaagaaaa

SEQ ID NO: 694987 - DNA, 22 bp, Artificial Sequence
  chemically synthesized
aacaagaaagaaaacttggggt

SEQ ID NO: 694988 - DNA, 22 bp, Artificial Sequence
  chemically synthesized
taacgtcccagctaagacccca

SEQ ID NO: 694989 - DNA, 22 bp, Artificial Sequence
  chemically synthesized
tataacgtcccagctaagaccc

SEQ ID NO: 694990 - DNA, 22 bp, Artificial Sequence
  chemically synthesized
ggggtcttagctgggacgttat

SEQ ID NO: 694991 - DNA, 22 bp, Artificial Sequence
  chemically synthesized
gggtcttagctgggacgttata

SEQ ID NO: 694992 - DNA, 22 bp, Artificial Sequence
  chemically synthesized
gaaatagcaagagcctctataa

SEQ ID NO: 694993 - DNA, 22 bp, Artificial Sequence
  chemically synthesized
agctgggacgttatagaggctc

SEQ ID NO: 694994 - DNA, 22 bp, Artificial Sequence
  chemically synthesized
gctgggacgttatagaggctct

SEQ ID NO: 694995 - DNA, 22 bp, Artificial Sequence
  chemically synthesized
ggacgttatagaggctcttgct

SEQ ID NO: 694996 - DNA, 22 bp, Artificial Sequence
  chemically synthesized
agcagatcctagaaatagcaag

SEQ ID NO: 694997 - DNA, 22 bp, Artificial Sequence
  chemically synthesized
aagcagatcctagaaatagcaa

SEQ ID NO: 694998 - DNA, 22 bp, Artificial Sequence
  chemically synthesized
taagcagatcctagaaatagca

SEQ ID NO: 694999 - DNA, 22 bp, Artificial Sequence
  chemically synthesized
tagaggctcttgctatttctag

SEQ ID NO: 695000 - DNA, 22 bp, Artificial Sequence
  chemically synthesized
ttttaagcagatcctagaaata

SEQ ID NO: 695001 - DNA, 22 bp, Artificial Sequence
  chemically synthesized
attttaagcagatcctagaaat

SEQ ID NO: 695002 - DNA, 22 bp, Artificial Sequence
  chemically synthesized
accttattttaagcagatccta

SEQ ID NO: 695003 - DNA, 22 bp, Artificial Sequence
  chemically synthesized
aaccttattttaagcagatcct

SEQ ID NO: 695004 - DNA, 22 bp, Artificial Sequence
  chemically synthesized
ttgctatttctaggatctgctt

SEQ ID NO: 695005 - DNA, 22 bp, Artificial Sequence
  chemically synthesized
taaccttattttaagcagatcc

SEQ ID NO: 695006 - DNA, 22 bp, Artificial Sequence
  chemically synthesized
ttaaccttattttaagcagatc

SEQ ID NO: 695007 - DNA, 22 bp, Artificial Sequence
  chemically synthesized
gctatttctaggatctgcttaa

SEQ ID NO: 695008 - DNA, 22 bp, Artificial Sequence
  chemically synthesized
ctatttctaggatctgcttaaa

SEQ ID NO: 695009 - DNA, 22 bp, Artificial Sequence
  chemically synthesized
atttttaaccttattttaagca

SEQ ID NO: 695010 - DNA, 22 bp, Artificial Sequence
  chemically synthesized
tttctaggatctgcttaaaata

SEQ ID NO: 695011 - DNA, 22 bp, Artificial Sequence
  chemically synthesized
ctaggatctgcttaaaataagg

SEQ ID NO: 695012 - DNA, 22 bp, Artificial Sequence
  chemically synthesized
taggatctgcttaaaataaggt

SEQ ID NO: 695013 - DNA, 22 bp, Artificial Sequence
  chemically synthesized
ggatctgcttaaaataaggtta

SEQ ID NO: 695014 - DNA, 22 bp, Artificial Sequence
  chemically synthesized
cttaaaataaggttaaaaatta

SEQ ID NO: 695015 - DNA, 22 bp, Artificial Sequence
  chemically synthesized
tataagtaataattaattttta

SEQ ID NO: 695016 - DNA, 22 bp, Artificial Sequence
  chemically synthesized
aaaataaggttaaaaattaatt

SEQ ID NO: 695017 - DNA, 22 bp, Artificial Sequence
  chemically synthesized
aaataaggttaaaaattaatta

SEQ ID NO: 695018 - DNA, 22 bp, Artificial Sequence
  chemically synthesized
aaattatataagtaataattaa

SEQ ID NO: 695019 - DNA, 22 bp, Artificial Sequence
  chemically synthesized
aaaattatataagtaataatta

SEQ ID NO: 695020 - DNA, 22 bp, Artificial Sequence
  chemically synthesized
taaaattatataagtaataatt

SEQ ID NO: 695021 - DNA, 22 bp, Artificial Sequence
  chemically synthesized
cctttaaaattatataagtaat

SEQ ID NO: 695022 - DNA, 22 bp, Artificial Sequence
  chemically synthesized
aaaattaattattacttatata

SEQ ID NO: 695023 - DNA, 22 bp, Artificial Sequence
  chemically synthesized
attattacttatataattttaa

SEQ ID NO: 695024 - DNA, 22 bp, Artificial Sequence
  chemically synthesized
tacatgtctacctttaaaatta

SEQ ID NO: 695025 - DNA, 22 bp, Artificial Sequence
  chemically synthesized
ttacttatataattttaaaggt

SEQ ID NO: 695026 - DNA, 22 bp, Artificial Sequence
  chemically synthesized
cttatataattttaaaggtaga

SEQ ID NO: 695027 - DNA, 22 bp, Artificial Sequence
  chemically synthesized
atataattttaaaggtagacat

SEQ ID NO: 695028 - DNA, 22 bp, Artificial Sequence
  chemically synthesized
tataattttaaaggtagacatg

SEQ ID NO: 695029 - DNA, 22 bp, Artificial Sequence
  chemically synthesized
taaaggtagacatgtataactg

SEQ ID NO: 695030 - DNA, 22 bp, Artificial Sequence
  chemically synthesized
aaaggtagacatgtataactgt

SEQ ID NO: 695031 - DNA, 22 bp, Artificial Sequence
  chemically synthesized
ggaagtgatataacagttatac

SEQ ID NO: 695032 - DNA, 22 bp, Artificial Sequence
  chemically synthesized
aaggtagacatgtataactgtt

SEQ ID NO: 695033 - DNA, 22 bp, Artificial Sequence
  chemically synthesized
ttatatcacttcctagtcctga

SEQ ID NO: 695034 - DNA, 22 bp, Artificial Sequence
  chemically synthesized
agaaaaggccagggtcaggact

SEQ ID NO: 695035 - DNA, 22 bp, Artificial Sequence
  chemically synthesized
tatcacttcctagtcctgaccc

SEQ ID NO: 695036 - DNA, 22 bp, Artificial Sequence
  chemically synthesized
cctagtcctgaccctggccttt

SEQ ID NO: 695037 - DNA, 22 bp, Artificial Sequence
  chemically synthesized
ctagtcctgaccctggcctttt

SEQ ID NO: 695038 - DNA, 22 bp, Artificial Sequence
  chemically synthesized
gtcctgaccctggccttttctt

SEQ ID NO: 695039 - DNA, 22 bp, Artificial Sequence
  chemically synthesized
ggaaatcacaagtctaagaaaa

SEQ ID NO: 695040 - DNA, 22 bp, Artificial Sequence
  chemically synthesized
aggaaatcacaagtctaagaaa

SEQ ID NO: 695041 - DNA, 22 bp, Artificial Sequence
  chemically synthesized
taggaaatcacaagtctaagaa

SEQ ID NO: 695042 - DNA, 22 bp, Artificial Sequence
  chemically synthesized
accctggccttttcttagactt

SEQ ID NO: 695043 - DNA, 22 bp, Artificial Sequence
  chemically synthesized
gccttttcttagacttgtgatt

SEQ ID NO: 695044 - DNA, 22 bp, Artificial Sequence
  chemically synthesized
tcccaagttttaggaaatcaca

SEQ ID NO: 695045 - DNA, 22 bp, Artificial Sequence
  chemically synthesized
gtcccaagttttaggaaatcac

SEQ ID NO: 695046 - DNA, 22 bp, Artificial Sequence
  chemically synthesized
ttcttagacttgtgatttccta

SEQ ID NO: 695047 - DNA, 22 bp, Artificial Sequence
  chemically synthesized
tcttagacttgtgatttcctaa

SEQ ID NO: 695048 - DNA, 22 bp, Artificial Sequence
  chemically synthesized
cttagacttgtgatttcctaaa

SEQ ID NO: 695049 - DNA, 22 bp, Artificial Sequence
  chemically synthesized
ttagacttgtgatttcctaaaa

SEQ ID NO: 695050 - DNA, 22 bp, Artificial Sequence
  chemically synthesized
agacttgtgatttcctaaaact

SEQ ID NO: 695051 - DNA, 22 bp, Artificial Sequence
  chemically synthesized
gacttgtgatttcctaaaactt

SEQ ID NO: 695052 - DNA, 22 bp, Artificial Sequence
  chemically synthesized
acatcttgtcccaagttttagg

SEQ ID NO: 695053 - DNA, 22 bp, Artificial Sequence
  chemically synthesized
aacatcttgtcccaagttttag

SEQ ID NO: 695054 - DNA, 22 bp, Artificial Sequence
  chemically synthesized
cttaacatcttgtcccaagttt

SEQ ID NO: 695055 - DNA, 22 bp, Artificial Sequence
  chemically synthesized
gtgatttcctaaaacttgggac

SEQ ID NO: 695056 - DNA, 22 bp, Artificial Sequence
  chemically synthesized
ccttaacatcttgtcccaagtt

SEQ ID NO: 695057 - DNA, 22 bp, Artificial Sequence
  chemically synthesized
tgatttcctaaaacttgggaca

SEQ ID NO: 695058 - DNA, 22 bp, Artificial Sequence
  chemically synthesized
tccttaacatcttgtcccaagt

SEQ ID NO: 695059 - DNA, 22 bp, Artificial Sequence
  chemically synthesized
ttccttaacatcttgtcccaag

SEQ ID NO: 695060 - DNA, 22 bp, Artificial Sequence
  chemically synthesized
cctaaaacttgggacaagatgt

SEQ ID NO: 695061 - DNA, 22 bp, Artificial Sequence
  chemically synthesized
ctaaaacttgggacaagatgtt

SEQ ID NO: 695062 - DNA, 22 bp, Artificial Sequence
  chemically synthesized
catatttttccttaacatcttg

SEQ ID NO: 695063 - DNA, 22 bp, Artificial Sequence
  chemically synthesized
aaacttgggacaagatgttaag

SEQ ID NO: 695064 - DNA, 22 bp, Artificial Sequence
  chemically synthesized
gggacaagatgttaaggaaaaa

SEQ ID NO: 695065 - DNA, 22 bp, Artificial Sequence
  chemically synthesized
ggacaagatgttaaggaaaaat

SEQ ID NO: 695066 - DNA, 22 bp, Artificial Sequence
  chemically synthesized
aggaaaaatatgtaggcccgct

SEQ ID NO: 695067 - DNA, 22 bp, Artificial Sequence
  chemically synthesized
ccatgagcaagaggggaaaaaa

SEQ ID NO: 695068 - DNA, 22 bp, Artificial Sequence
  chemically synthesized
gccatgagcaagaggggaaaaa

SEQ ID NO: 695069 - DNA, 22 bp, Artificial Sequence
  chemically synthesized
tgccatgagcaagaggggaaaa

SEQ ID NO: 695070 - DNA, 22 bp, Artificial Sequence
  chemically synthesized
atcctcctttttttcccctctt

SEQ ID NO: 695071 - DNA, 22 bp, Artificial Sequence
  chemically synthesized
tctttgccatgagcaagagggg

SEQ ID NO: 695072 - DNA, 22 bp, Artificial Sequence
  chemically synthesized
ctttttttcccctcttgctcat

SEQ ID NO: 695073 - DNA, 22 bp, Artificial Sequence
  chemically synthesized
tttttcccctcttgctcatggc

SEQ ID NO: 695074 - DNA, 22 bp, Artificial Sequence
  chemically synthesized
aaaattatctttgccatgagca

SEQ ID NO: 695075 - DNA, 22 bp, Artificial Sequence
  chemically synthesized
ttttcccctcttgctcatggca

SEQ ID NO: 695076 - DNA, 22 bp, Artificial Sequence
  chemically synthesized
aaaaattatctttgccatgagc

SEQ ID NO: 695077 - DNA, 22 bp, Artificial Sequence
  chemically synthesized
tttcccctcttgctcatggcaa

SEQ ID NO: 695078 - DNA, 22 bp, Artificial Sequence
  chemically synthesized
ttcccctcttgctcatggcaaa

SEQ ID NO: 695079 - DNA, 22 bp, Artificial Sequence
  chemically synthesized
tcccctcttgctcatggcaaag

SEQ ID NO: 695080 - DNA, 22 bp, Artificial Sequence
  chemically synthesized
cccctcttgctcatggcaaaga

SEQ ID NO: 695081 - DNA, 22 bp, Artificial Sequence
  chemically synthesized
gtttaaaaattatctttgccat

SEQ ID NO: 695082 - DNA, 22 bp, Artificial Sequence
  chemically synthesized
ccctcttgctcatggcaaagat

SEQ ID NO: 695083 - DNA, 22 bp, Artificial Sequence
  chemically synthesized
agtttaaaaattatctttgcca

SEQ ID NO: 695084 - DNA, 22 bp, Artificial Sequence
  chemically synthesized
tagtttaaaaattatctttgcc

SEQ ID NO: 695085 - DNA, 22 bp, Artificial Sequence
  chemically synthesized
ttttagtttaaaaattatcttt

SEQ ID NO: 695086 - DNA, 22 bp, Artificial Sequence
  chemically synthesized
ttgctcatggcaaagataattt

SEQ ID NO: 695087 - DNA, 22 bp, Artificial Sequence
  chemically synthesized
attttagtttaaaaattatctt

SEQ ID NO: 695088 - DNA, 22 bp, Artificial Sequence
  chemically synthesized
gctcatggcaaagataattttt

SEQ ID NO: 695089 - DNA, 22 bp, Artificial Sequence
  chemically synthesized
ctcatggcaaagataattttta

SEQ ID NO: 695090 - DNA, 22 bp, Artificial Sequence
  chemically synthesized
tgtttattttagtttaaaaatt

SEQ ID NO: 695091 - DNA, 22 bp, Artificial Sequence
  chemically synthesized
atggcaaagataatttttaaac

SEQ ID NO: 695092 - DNA, 22 bp, Artificial Sequence
  chemically synthesized
gtgtttattttagtttaaaaat

SEQ ID NO: 695093 - DNA, 22 bp, Artificial Sequence
  chemically synthesized
cacaatttgtgtttattttagt

SEQ ID NO: 695094 - DNA, 22 bp, Artificial Sequence
  chemically synthesized
acacaatttgtgtttattttag

SEQ ID NO: 695095 - DNA, 22 bp, Artificial Sequence
  chemically synthesized
tacttacacaatttgtgtttat

SEQ ID NO: 695096 - DNA, 22 bp, Artificial Sequence
  chemically synthesized
ttaaactaaaataaacacaaat

SEQ ID NO: 695097 - DNA, 22 bp, Artificial Sequence
  chemically synthesized
taaactaaaataaacacaaatt

SEQ ID NO: 695098 - DNA, 22 bp, Artificial Sequence
  chemically synthesized
aaactaaaataaacacaaattg

SEQ ID NO: 695099 - DNA, 22 bp, Artificial Sequence
  chemically synthesized
aactaaaataaacacaaattgt

SEQ ID NO: 695100 - DNA, 22 bp, Artificial Sequence
  chemically synthesized
aaataaacacaaattgtgtaag

SEQ ID NO: 695101 - DNA, 22 bp, Artificial Sequence
  chemically synthesized
atgtgagatccaaatgttatac

SEQ ID NO: 695102 - DNA, 22 bp, Artificial Sequence
  chemically synthesized
tgtaagtataacatttggatct

SEQ ID NO: 695103 - DNA, 22 bp, Artificial Sequence
  chemically synthesized
tgtgagtctgatgtgagatcca

SEQ ID NO: 695104 - DNA, 22 bp, Artificial Sequence
  chemically synthesized
gtgtgagtctgatgtgagatcc

SEQ ID NO: 695105 - DNA, 22 bp, Artificial Sequence
  chemically synthesized
agatttgtgtgagtctgatgtg

SEQ ID NO: 695106 - DNA, 22 bp, Artificial Sequence
  chemically synthesized
ggatctcacatcagactcacac

SEQ ID NO: 695107 - DNA, 22 bp, Artificial Sequence
  chemically synthesized
gatctcacatcagactcacaca

SEQ ID NO: 695108 - DNA, 22 bp, Artificial Sequence
  chemically synthesized
gataagaatctgagatttgtgt

SEQ ID NO: 695109 - DNA, 22 bp, Artificial Sequence
  chemically synthesized
acatcagactcacacaaatctc

SEQ ID NO: 695110 - DNA, 22 bp, Artificial Sequence
  chemically synthesized
gtactagataagaatctgagat

SEQ ID NO: 695111 - DNA, 22 bp, Artificial Sequence
  chemically synthesized
acacaaatctcagattcttatc

SEQ ID NO: 695112 - DNA, 22 bp, Artificial Sequence
  chemically synthesized
ataaagattggtactagataag

SEQ ID NO: 695113 - DNA, 22 bp, Artificial Sequence
  chemically synthesized
agattcttatctagtaccaatc

SEQ ID NO: 695114 - DNA, 22 bp, Artificial Sequence
  chemically synthesized
agtcattaataaagattggtac

SEQ ID NO: 695115 - DNA, 22 bp, Artificial Sequence
  chemically synthesized
cagtcattaataaagattggta

SEQ ID NO: 695116 - DNA, 22 bp, Artificial Sequence
  chemically synthesized
tcagtcattaataaagattggt

SEQ ID NO: 695117 - DNA, 22 bp, Artificial Sequence
  chemically synthesized
tttcagtcattaataaagattg

SEQ ID NO: 695118 - DNA, 22 bp, Artificial Sequence
  chemically synthesized
ttatctagtaccaatctttatt

SEQ ID NO: 695119 - DNA, 22 bp, Artificial Sequence
  chemically synthesized
atctagtaccaatctttattaa

SEQ ID NO: 695120 - DNA, 22 bp, Artificial Sequence
  chemically synthesized
tctagtaccaatctttattaat

SEQ ID NO: 695121 - DNA, 22 bp, Artificial Sequence
  chemically synthesized
taattctttcagtcattaataa

SEQ ID NO: 695122 - DNA, 22 bp, Artificial Sequence
  chemically synthesized
gtaccaatctttattaatgact

SEQ ID NO: 695123 - DNA, 22 bp, Artificial Sequence
  chemically synthesized
cctataattctttcagtcatta

SEQ ID NO: 695124 - DNA, 22 bp, Artificial Sequence
  chemically synthesized
ccctataattctttcagtcatt

SEQ ID NO: 695125 - DNA, 22 bp, Artificial Sequence
  chemically synthesized
tattaatgactgaaagaattat

SEQ ID NO: 695126 - DNA, 22 bp, Artificial Sequence
  chemically synthesized
attaatgactgaaagaattata

SEQ ID NO: 695127 - DNA, 22 bp, Artificial Sequence
  chemically synthesized
ttaatgactgaaagaattatag

SEQ ID NO: 695128 - DNA, 22 bp, Artificial Sequence
  chemically synthesized
tgcccagcacttccctataatt

SEQ ID NO: 695129 - DNA, 22 bp, Artificial Sequence
  chemically synthesized
atgactgaaagaattataggga

SEQ ID NO: 695130 - DNA, 22 bp, Artificial Sequence
  chemically synthesized
tctgtgcccagcacttccctat

SEQ ID NO: 695131 - DNA, 22 bp, Artificial Sequence
  chemically synthesized
tatctgtgcccagcacttccct

SEQ ID NO: 695132 - DNA, 22 bp, Artificial Sequence
  chemically synthesized
aaagaattatagggaagtgctg

SEQ ID NO: 695133 - DNA, 22 bp, Artificial Sequence
  chemically synthesized
tagggaagtgctgggcacagat

SEQ ID NO: 695134 - DNA, 22 bp, Artificial Sequence
  chemically synthesized
cccagggaaataatgttctatc

SEQ ID NO: 695135 - DNA, 22 bp, Artificial Sequence
  chemically synthesized
ggcacagatagaacattatttc

SEQ ID NO: 695136 - DNA, 22 bp, Artificial Sequence
  chemically synthesized
aggttccccagggaaataatgt

SEQ ID NO: 695137 - DNA, 22 bp, Artificial Sequence
  chemically synthesized
caggttccccagggaaataatg

SEQ ID NO: 695138 - DNA, 22 bp, Artificial Sequence
  chemically synthesized
tttcaggttccccagggaaata

SEQ ID NO: 695139 - DNA, 22 bp, Artificial Sequence
  chemically synthesized
tttccctggggaacctgaaata

SEQ ID NO: 695140 - DNA, 22 bp, Artificial Sequence
  chemically synthesized
ccctggggaacctgaaataatc

SEQ ID NO: 695141 - DNA, 22 bp, Artificial Sequence
  chemically synthesized
cctggggaacctgaaataatca

SEQ ID NO: 695142 - DNA, 22 bp, Artificial Sequence
  chemically synthesized
gaaacgcatgtgtgattatttc

SEQ ID NO: 695143 - DNA, 22 bp, Artificial Sequence
  chemically synthesized
ggaaacgcatgtgtgattattt

SEQ ID NO: 695144 - DNA, 22 bp, Artificial Sequence
  chemically synthesized
tggaaacgcatgtgtgattatt

SEQ ID NO: 695145 - DNA, 22 bp, Artificial Sequence
  chemically synthesized
gggaacctgaaataatcacaca

SEQ ID NO: 695146 - DNA, 22 bp, Artificial Sequence
  chemically synthesized
aaataatcacacatgcgtttcc

SEQ ID NO: 695147 - DNA, 22 bp, Artificial Sequence
  chemically synthesized
ccaaaacatccatgttatttcc

SEQ ID NO: 695148 - DNA, 22 bp, Artificial Sequence
  chemically synthesized
caaaacatccatgttatttccc

SEQ ID NO: 695149 - DNA, 22 bp, Artificial Sequence
  chemically synthesized
atatgaaaccaaagcacatcat

SEQ ID NO: 695150 - DNA, 22 bp, Artificial Sequence
  chemically synthesized
tttcccattatgatgtgctttg

SEQ ID NO: 695151 - DNA, 22 bp, Artificial Sequence
  chemically synthesized
ttaatatgaaaccaaagcacat

SEQ ID NO: 695152 - DNA, 22 bp, Artificial Sequence
  chemically synthesized
cccattatgatgtgctttggtt

SEQ ID NO: 695153 - DNA, 22 bp, Artificial Sequence
  chemically synthesized
ccattatgatgtgctttggttt

SEQ ID NO: 695154 - DNA, 22 bp, Artificial Sequence
  chemically synthesized
tgatgtgctttggtttcatatt

SEQ ID NO: 695155 - DNA, 22 bp, Artificial Sequence
  chemically synthesized
aaaacgtatctgttaatatgaa

SEQ ID NO: 695156 - DNA, 22 bp, Artificial Sequence
  chemically synthesized
aaaaacgtatctgttaatatga

SEQ ID NO: 695157 - DNA, 22 bp, Artificial Sequence
  chemically synthesized
taaaaacgtatctgttaatatg

SEQ ID NO: 695158 - DNA, 22 bp, Artificial Sequence
  chemically synthesized
ttaaaaacgtatctgttaatat

SEQ ID NO: 695159 - DNA, 22 bp, Artificial Sequence
  chemically synthesized
tggtttcatattaacagatacg

SEQ ID NO: 695160 - DNA, 22 bp, Artificial Sequence
  chemically synthesized
ggtttcatattaacagatacgt

SEQ ID NO: 695161 - DNA, 22 bp, Artificial Sequence
  chemically synthesized
gtttcatattaacagatacgtt

SEQ ID NO: 695162 - DNA, 22 bp, Artificial Sequence
  chemically synthesized
tgtaaatttttaaaaacgtatc

SEQ ID NO: 695163 - DNA, 22 bp, Artificial Sequence
  chemically synthesized
catattaacagatacgttttta

SEQ ID NO: 695164 - DNA, 22 bp, Artificial Sequence
  chemically synthesized
tgtgtaaatttttaaaaacgta

SEQ ID NO: 695165 - DNA, 22 bp, Artificial Sequence
  chemically synthesized
atattaacagatacgtttttaa

SEQ ID NO: 695166 - DNA, 22 bp, Artificial Sequence
  chemically synthesized
ctgtgtaaatttttaaaaacgt

SEQ ID NO: 695167 - DNA, 22 bp, Artificial Sequence
  chemically synthesized
acagatacgtttttaaaaattt

SEQ ID NO: 695168 - DNA, 22 bp, Artificial Sequence
  chemically synthesized
aatgtttctgtgtaaattttta

SEQ ID NO: 695169 - DNA, 22 bp, Artificial Sequence
  chemically synthesized
caatgtttctgtgtaaattttt

SEQ ID NO: 695170 - DNA, 22 bp, Artificial Sequence
  chemically synthesized
tcaatgtttctgtgtaaatttt

SEQ ID NO: 695171 - DNA, 22 bp, Artificial Sequence
  chemically synthesized
ctttcaatgtttctgtgtaaat

SEQ ID NO: 695172 - DNA, 22 bp, Artificial Sequence
  chemically synthesized
cctttcaatgtttctgtgtaaa

SEQ ID NO: 695173 - DNA, 22 bp, Artificial Sequence
  chemically synthesized
ttaaaaatttacacagaaacat

SEQ ID NO: 695174 - DNA, 22 bp, Artificial Sequence
  chemically synthesized
taaaaatttacacagaaacatt

SEQ ID NO: 695175 - DNA, 22 bp, Artificial Sequence
  chemically synthesized
aaaaatttacacagaaacattg

SEQ ID NO: 695176 - DNA, 22 bp, Artificial Sequence
  chemically synthesized
aaaatttacacagaaacattga

SEQ ID NO: 695177 - DNA, 22 bp, Artificial Sequence
  chemically synthesized
aaatgatttcctttcaatgttt

SEQ ID NO: 695178 - DNA, 22 bp, Artificial Sequence
  chemically synthesized
acacagaaacattgaaaggaaa

SEQ ID NO: 695179 - DNA, 22 bp, Artificial Sequence
  chemically synthesized
agactgaaatgatttcctttca

SEQ ID NO: 695180 - DNA, 22 bp, Artificial Sequence
  chemically synthesized
cacagaaacattgaaaggaaat

SEQ ID NO: 695181 - DNA, 22 bp, Artificial Sequence
  chemically synthesized
gagactgaaatgatttcctttc

SEQ ID NO: 695182 - DNA, 22 bp, Artificial Sequence
  chemically synthesized
tgagactgaaatgatttccttt

SEQ ID NO: 695183 - DNA, 22 bp, Artificial Sequence
  chemically synthesized
ttgagactgaaatgatttcctt

SEQ ID NO: 695184 - DNA, 22 bp, Artificial Sequence
  chemically synthesized
aaaggaaatcatttcagtctca

SEQ ID NO: 695185 - DNA, 22 bp, Artificial Sequence
  chemically synthesized
taaaatggaaaacttttgagac

SEQ ID NO: 695186 - DNA, 22 bp, Artificial Sequence
  chemically synthesized
acagattataaaatggaaaact

SEQ ID NO: 695187 - DNA, 22 bp, Artificial Sequence
  chemically synthesized
cagtctcaaaagttttccattt

SEQ ID NO: 695188 - DNA, 22 bp, Artificial Sequence
  chemically synthesized
agtctcaaaagttttccatttt

SEQ ID NO: 695189 - DNA, 22 bp, Artificial Sequence
  chemically synthesized
taattgacagattataaaatgg

SEQ ID NO: 695190 - DNA, 22 bp, Artificial Sequence
  chemically synthesized
gtaattgacagattataaaatg

SEQ ID NO: 695191 - DNA, 22 bp, Artificial Sequence
  chemically synthesized
tgtaattgacagattataaaat

SEQ ID NO: 695192 - DNA, 22 bp, Artificial Sequence
  chemically synthesized
aaaagttttccattttataatc

SEQ ID NO: 695193 - DNA, 22 bp, Artificial Sequence
  chemically synthesized
ttgtaattgacagattataaaa

SEQ ID NO: 695194 - DNA, 22 bp, Artificial Sequence
  chemically synthesized
tttttgtaattgacagattata

SEQ ID NO: 695195 - DNA, 22 bp, Artificial Sequence
  chemically synthesized
tatttttgtaattgacagatta

SEQ ID NO: 695196 - DNA, 22 bp, Artificial Sequence
  chemically synthesized
ctatttttgtaattgacagatt

SEQ ID NO: 695197 - DNA, 22 bp, Artificial Sequence
  chemically synthesized
tctatttttgtaattgacagat

SEQ ID NO: 695198 - DNA, 22 bp, Artificial Sequence
  chemically synthesized
tccattttataatctgtcaatt

SEQ ID NO: 695199 - DNA, 22 bp, Artificial Sequence
  chemically synthesized
ttctatttttgtaattgacaga

SEQ ID NO: 695200 - DNA, 22 bp, Artificial Sequence
  chemically synthesized
ccattttataatctgtcaatta

SEQ ID NO: 695201 - DNA, 22 bp, Artificial Sequence
  chemically synthesized
cattttataatctgtcaattac

SEQ ID NO: 695202 - DNA, 22 bp, Artificial Sequence
  chemically synthesized
tataatctgtcaattacaaaaa

SEQ ID NO: 695203 - DNA, 22 bp, Artificial Sequence
  chemically synthesized
ataatctgtcaattacaaaaat

SEQ ID NO: 695204 - DNA, 22 bp, Artificial Sequence
  chemically synthesized
taatctgtcaattacaaaaata

SEQ ID NO: 695205 - DNA, 22 bp, Artificial Sequence
  chemically synthesized
catgaacgtttttctatttttg

SEQ ID NO: 695206 - DNA, 22 bp, Artificial Sequence
  chemically synthesized
tcaattacaaaaatagaaaaac

SEQ ID NO: 695207 - DNA, 22 bp, Artificial Sequence
  chemically synthesized
caaaaatagaaaaacgttcatg

SEQ ID NO: 695208 - DNA, 22 bp, Artificial Sequence
  chemically synthesized
gagaatagggcatagctacatg

SEQ ID NO: 695209 - DNA, 22 bp, Artificial Sequence
  chemically synthesized
gctggagaatagggcatagcta

SEQ ID NO: 695210 - DNA, 22 bp, Artificial Sequence
  chemically synthesized
atgtagctatgccctattctcc

SEQ ID NO: 695211 - DNA, 22 bp, Artificial Sequence
  chemically synthesized
tgagtcgtggctggctggagaa

SEQ ID NO: 695212 - DNA, 22 bp, Artificial Sequence
  chemically synthesized
atgagtcgtggctggctggaga

SEQ ID NO: 695213 - DNA, 22 bp, Artificial Sequence
  chemically synthesized
tgccctattctccagccagcca

SEQ ID NO: 695214 - DNA, 22 bp, Artificial Sequence
  chemically synthesized
gatttatgagtcgtggctggct

SEQ ID NO: 695215 - DNA, 22 bp, Artificial Sequence
  chemically synthesized
ggatttatgagtcgtggctggc

SEQ ID NO: 695216 - DNA, 22 bp, Artificial Sequence
  chemically synthesized
ttctccagccagccacgactca

SEQ ID NO: 695217 - DNA, 22 bp, Artificial Sequence
  chemically synthesized
tccagccagccacgactcataa

SEQ ID NO: 695218 - DNA, 22 bp, Artificial Sequence
  chemically synthesized
gaatgtttggatttatgagtcg

SEQ ID NO: 695219 - DNA, 22 bp, Artificial Sequence
  chemically synthesized
cagccagccacgactcataaat

SEQ ID NO: 695220 - DNA, 22 bp, Artificial Sequence
  chemically synthesized
taaataaacctggaatgtttgg

SEQ ID NO: 695221 - DNA, 22 bp, Artificial Sequence
  chemically synthesized
ttgtaaataaacctggaatgtt

SEQ ID NO: 695222 - DNA, 22 bp, Artificial Sequence
  chemically synthesized
attgtaaataaacctggaatgt

SEQ ID NO: 695223 - DNA, 22 bp, Artificial Sequence
  chemically synthesized
ataaatccaaacattccaggtt

SEQ ID NO: 695224 - DNA, 22 bp, Artificial Sequence
  chemically synthesized
gatagcttattgtaaataaacc

SEQ ID NO: 695225 - DNA, 22 bp, Artificial Sequence
  chemically synthesized
gctagatagcttattgtaaata

SEQ ID NO: 695226 - DNA, 22 bp, Artificial Sequence
  chemically synthesized
gcctggctagatagcttattgt

SEQ ID NO: 695227 - DNA, 22 bp, Artificial Sequence
  chemically synthesized
caggtttatttacaataagcta

SEQ ID NO: 695228 - DNA, 22 bp, Artificial Sequence
  chemically synthesized
atttacaataagctatctagcc

SEQ ID NO: 695229 - DNA, 22 bp, Artificial Sequence
  chemically synthesized
tttacaataagctatctagcca

SEQ ID NO: 695230 - DNA, 22 bp, Artificial Sequence
  chemically synthesized
acaataagctatctagccaggc

SEQ ID NO: 695231 - DNA, 22 bp, Artificial Sequence
  chemically synthesized
caataagctatctagccaggcc

SEQ ID NO: 695232 - DNA, 22 bp, Artificial Sequence
  chemically synthesized
gtagggtatacctggcctggct

SEQ ID NO: 695233 - DNA, 22 bp, Artificial Sequence
  chemically synthesized
agtagggtatacctggcctggc

SEQ ID NO: 695234 - DNA, 22 bp, Artificial Sequence
  chemically synthesized
tagtagggtatacctggcctgg

SEQ ID NO: 695235 - DNA, 22 bp, Artificial Sequence
  chemically synthesized
tctagccaggccaggtataccc

SEQ ID NO: 695236 - DNA, 22 bp, Artificial Sequence
  chemically synthesized
gccaggccaggtataccctact

SEQ ID NO: 695237 - DNA, 22 bp, Artificial Sequence
  chemically synthesized
taaaatgattttagtagggtat

SEQ ID NO: 695238 - DNA, 22 bp, Artificial Sequence
  chemically synthesized
tctataaaatgattttagtagg

SEQ ID NO: 695239 - DNA, 22 bp, Artificial Sequence
  chemically synthesized
caaatccctatctataaaatga

SEQ ID NO: 695240 - DNA, 22 bp, Artificial Sequence
  chemically synthesized
ctaaaatcattttatagatagg

SEQ ID NO: 695241 - DNA, 22 bp, Artificial Sequence
  chemically synthesized
aaatcattttatagatagggat

SEQ ID NO: 695242 - DNA, 22 bp, Artificial Sequence
  chemically synthesized
gaggaaagatacctgcaaatcc

SEQ ID NO: 695243 - DNA, 22 bp, Artificial Sequence
  chemically synthesized
tatagatagggatttgcaggta

SEQ ID NO: 695244 - DNA, 22 bp, Artificial Sequence
  chemically synthesized
atagatagggatttgcaggtat

SEQ ID NO: 695245 - DNA, 22 bp, Artificial Sequence
  chemically synthesized
actagaggaaagatacctgcaa

SEQ ID NO: 695246 - DNA, 22 bp, Artificial Sequence
  chemically synthesized
tagatagggatttgcaggtatc

SEQ ID NO: 695247 - DNA, 22 bp, Artificial Sequence
  chemically synthesized
atagtggttaactagaggaaag

SEQ ID NO: 695248 - DNA, 22 bp, Artificial Sequence
  chemically synthesized
ttaatagtggttaactagagga

SEQ ID NO: 695249 - DNA, 22 bp, Artificial Sequence
  chemically synthesized
gcaggtatctttcctctagtta

SEQ ID NO: 695250 - DNA, 22 bp, Artificial Sequence
  chemically synthesized
gttaatagtggttaactagagg

SEQ ID NO: 695251 - DNA, 22 bp, Artificial Sequence
  chemically synthesized
caggtatctttcctctagttaa

SEQ ID NO: 695252 - DNA, 22 bp, Artificial Sequence
  chemically synthesized
tcttgttaatagtggttaacta

SEQ ID NO: 695253 - DNA, 22 bp, Artificial Sequence
  chemically synthesized
atcttgttaatagtggttaact

SEQ ID NO: 695254 - DNA, 22 bp, Artificial Sequence
  chemically synthesized
tttatcttgttaatagtggtta

SEQ ID NO: 695255 - DNA, 22 bp, Artificial Sequence
  chemically synthesized
gtttatcttgttaatagtggtt

SEQ ID NO: 695256 - DNA, 22 bp, Artificial Sequence
  chemically synthesized
tcctctagttaaccactattaa

SEQ ID NO: 695257 - DNA, 22 bp, Artificial Sequence
  chemically synthesized
ttgtttatcttgttaatagtgg

SEQ ID NO: 695258 - DNA, 22 bp, Artificial Sequence
  chemically synthesized
cctctagttaaccactattaac

SEQ ID NO: 695259 - DNA, 22 bp, Artificial Sequence
  chemically synthesized
cttgtttatcttgttaatagtg

SEQ ID NO: 695260 - DNA, 22 bp, Artificial Sequence
  chemically synthesized
ctctagttaaccactattaaca

SEQ ID NO: 695261 - DNA, 22 bp, Artificial Sequence
  chemically synthesized
tagttaaccactattaacaaga

SEQ ID NO: 695262 - DNA, 22 bp, Artificial Sequence
  chemically synthesized
gttaaccactattaacaagata

SEQ ID NO: 695263 - DNA, 22 bp, Artificial Sequence
  chemically synthesized
ccagaccttcttgtttatcttg

SEQ ID NO: 695264 - DNA, 22 bp, Artificial Sequence
  chemically synthesized
accactattaacaagataaaca

SEQ ID NO: 695265 - DNA, 22 bp, Artificial Sequence
  chemically synthesized
ttaacaagataaacaagaaggt

SEQ ID NO: 695266 - DNA, 22 bp, Artificial Sequence
  chemically synthesized
atgacctcccagaccttcttgt

SEQ ID NO: 695267 - DNA, 22 bp, Artificial Sequence
  chemically synthesized
acaagataaacaagaaggtctg

SEQ ID NO: 695268 - DNA, 22 bp, Artificial Sequence
  chemically synthesized
ataaacatgttaatgacctccc

SEQ ID NO: 695269 - DNA, 22 bp, Artificial Sequence
  chemically synthesized
cataaacatgttaatgacctcc

SEQ ID NO: 695270 - DNA, 22 bp, Artificial Sequence
  chemically synthesized
atagaccacttcataaacatgt

SEQ ID NO: 695271 - DNA, 22 bp, Artificial Sequence
  chemically synthesized
ggaggtcattaacatgtttatg

SEQ ID NO: 695272 - DNA, 22 bp, Artificial Sequence
  chemically synthesized
aatagaccacttcataaacatg

SEQ ID NO: 695273 - DNA, 22 bp, Artificial Sequence
  chemically synthesized
acatgtttatgaagtggtctat

SEQ ID NO: 695274 - DNA, 22 bp, Artificial Sequence
  chemically synthesized
atgaagtggtctattaaggtca

SEQ ID NO: 695275 - DNA, 22 bp, Artificial Sequence
  chemically synthesized
tgaagtggtctattaaggtcat

SEQ ID NO: 695276 - DNA, 22 bp, Artificial Sequence
  chemically synthesized
ggggatgtgaagggaataaatg

SEQ ID NO: 695277 - DNA, 22 bp, Artificial Sequence
  chemically synthesized
cctgggggatgtgaagggaata

SEQ ID NO: 695278 - DNA, 22 bp, Artificial Sequence
  chemically synthesized
ttaaggtcatttattcccttca

SEQ ID NO: 695279 - DNA, 22 bp, Artificial Sequence
  chemically synthesized
ttccctgggggatgtgaaggga

SEQ ID NO: 695280 - DNA, 22 bp, Artificial Sequence
  chemically synthesized
aggtcatttattcccttcacat

SEQ ID NO: 695281 - DNA, 22 bp, Artificial Sequence
  chemically synthesized
attccctgggggatgtgaaggg

SEQ ID NO: 695282 - DNA, 22 bp, Artificial Sequence
  chemically synthesized
tgacttattccctgggggatgt

SEQ ID NO: 695283 - DNA, 22 bp, Artificial Sequence
  chemically synthesized
attcccttcacatcccccaggg

SEQ ID NO: 695284 - DNA, 22 bp, Artificial Sequence
  chemically synthesized
ttcccttcacatcccccaggga

SEQ ID NO: 695285 - DNA, 22 bp, Artificial Sequence
  chemically synthesized
ccttcacatcccccagggaata

SEQ ID NO: 695286 - DNA, 22 bp, Artificial Sequence
  chemically synthesized
cacatcccccagggaataagtc

SEQ ID NO: 695287 - DNA, 22 bp, Artificial Sequence
  chemically synthesized
acatcccccagggaataagtca

SEQ ID NO: 695288 - DNA, 22 bp, Artificial Sequence
  chemically synthesized
acagcaggtctgtgacttattc

SEQ ID NO: 695289 - DNA, 22 bp, Artificial Sequence
  chemically synthesized
aagagaataaagggtattaaca

SEQ ID NO: 695290 - DNA, 22 bp, Artificial Sequence
  chemically synthesized
ctgttaataccctttattctct

SEQ ID NO: 695291 - DNA, 22 bp, Artificial Sequence
  chemically synthesized
ttaataccctttattctcttta

SEQ ID NO: 695292 - DNA, 22 bp, Artificial Sequence
  chemically synthesized
ataccctttattctctttagtt

SEQ ID NO: 695293 - DNA, 22 bp, Artificial Sequence
  chemically synthesized
tattctctttagtttcctcttc

SEQ ID NO: 695294 - DNA, 22 bp, Artificial Sequence
  chemically synthesized
attctctttagtttcctcttcg

SEQ ID NO: 695295 - DNA, 22 bp, Artificial Sequence
  chemically synthesized
ttctctttagtttcctcttcgt

SEQ ID NO: 695296 - DNA, 22 bp, Artificial Sequence
  chemically synthesized
tctttagtttcctcttcgttgt

SEQ ID NO: 695297 - DNA, 22 bp, Artificial Sequence
  chemically synthesized
tttagtttcctcttcgttgtcc

SEQ ID NO: 695298 - DNA, 22 bp, Artificial Sequence
  chemically synthesized
tagtttcctcttcgttgtcctc

SEQ ID NO: 695299 - DNA, 22 bp, Artificial Sequence
  chemically synthesized
agtttcctcttcgttgtcctct

SEQ ID NO: 695300 - DNA, 22 bp, Artificial Sequence
  chemically synthesized
gtttcctcttcgttgtcctctc

SEQ ID NO: 695301 - DNA, 22 bp, Artificial Sequence
  chemically synthesized
cctcttcgttgtcctctctctc

SEQ ID NO: 695302 - DNA, 22 bp, Artificial Sequence
  chemically synthesized
ctcttcgttgtcctctctctct

SEQ ID NO: 695303 - DNA, 22 bp, Artificial Sequence
  chemically synthesized
ttcgttgtcctctctctctctc

SEQ ID NO: 695304 - DNA, 22 bp, Artificial Sequence
  chemically synthesized
cgttgtcctctctctctctctc

SEQ ID NO: 695305 - DNA, 22 bp, Artificial Sequence
  chemically synthesized
gttgtcctctctctctctctct

SEQ ID NO: 695306 - DNA, 22 bp, Artificial Sequence
  chemically synthesized
tcctctctctctctctctctct

SEQ ID NO: 695307 - DNA, 22 bp, Artificial Sequence
  chemically synthesized
tctctctctctctctctctctc

SEQ ID NO: 695308 - DNA, 22 bp, Artificial Sequence
  chemically synthesized
tctctctctctctctctctctc

SEQ ID NO: 695309 - DNA, 22 bp, Artificial Sequence
  chemically synthesized
tctctctctctctctctctctc

SEQ ID NO: 695310 - DNA, 22 bp, Artificial Sequence
  chemically synthesized
tctctctctctctctctctcca

SEQ ID NO: 695311 - DNA, 22 bp, Artificial Sequence
  chemically synthesized
tctctctctctctctctccata

SEQ ID NO: 695312 - DNA, 22 bp, Artificial Sequence
  chemically synthesized
tctctctctctctctccatata

SEQ ID NO: 695313 - DNA, 22 bp, Artificial Sequence
  chemically synthesized
tctctctctctctccatatata

SEQ ID NO: 695314 - DNA, 22 bp, Artificial Sequence
  chemically synthesized
tctctctctctccatatatata

SEQ ID NO: 695315 - DNA, 22 bp, Artificial Sequence
  chemically synthesized
tctctctctccatatatatata

SEQ ID NO: 695316 - DNA, 22 bp, Artificial Sequence
  chemically synthesized
tctctctccatatatatatata

SEQ ID NO: 695317 - DNA, 22 bp, Artificial Sequence
  chemically synthesized
tctctccatatatatatatata

SEQ ID NO: 695318 - DNA, 22 bp, Artificial Sequence
  chemically synthesized
tctccatatatatatatatata

SEQ ID NO: 695319 - DNA, 22 bp, Artificial Sequence
  chemically synthesized
tccatatatatatatatatata

SEQ ID NO: 695320 - DNA, 22 bp, Artificial Sequence
  chemically synthesized
catatatatatatatatatatg

SEQ ID NO: 695321 - DNA, 22 bp, Artificial Sequence
  chemically synthesized
tatgtacacatacatacataca

SEQ ID NO: 695322 - DNA, 22 bp, Artificial Sequence
  chemically synthesized
atatatctatatgtacacatac

SEQ ID NO: 695323 - DNA, 22 bp, Artificial Sequence
  chemically synthesized
tgtatgtatgtatgtgtacata

SEQ ID NO: 695324 - DNA, 22 bp, Artificial Sequence
  chemically synthesized
ctcatatatctatatgtacaca

SEQ ID NO: 695325 - DNA, 22 bp, Artificial Sequence
  chemically synthesized
actcatatatctatatgtacac

SEQ ID NO: 695326 - DNA, 22 bp, Artificial Sequence
  chemically synthesized
tactcatatatctatatgtaca

SEQ ID NO: 695327 - DNA, 22 bp, Artificial Sequence
  chemically synthesized
tgtacattttactcatatatct

SEQ ID NO: 695328 - DNA, 22 bp, Artificial Sequence
  chemically synthesized
gtgtacattttactcatatatc

SEQ ID NO: 695329 - DNA, 22 bp, Artificial Sequence
  chemically synthesized
aaagtaatttgtgtacatttta

SEQ ID NO: 695330 - DNA, 22 bp, Artificial Sequence
  chemically synthesized
tgcatccaattaaaagtaattt

SEQ ID NO: 695331 - DNA, 22 bp, Artificial Sequence
  chemically synthesized
atgcatccaattaaaagtaatt

SEQ ID NO: 695332 - DNA, 22 bp, Artificial Sequence
  chemically synthesized
tatgcatccaattaaaagtaat

SEQ ID NO: 695333 - DNA, 22 bp, Artificial Sequence
  chemically synthesized
cttttaattggatgcataaaga

SEQ ID NO: 695334 - DNA, 22 bp, Artificial Sequence
  chemically synthesized
aaggtggaaatatctttatgca

SEQ ID NO: 695335 - DNA, 22 bp, Artificial Sequence
  chemically synthesized
ttaattggatgcataaagatat

SEQ ID NO: 695336 - DNA, 22 bp, Artificial Sequence
  chemically synthesized
taattggatgcataaagatatt

SEQ ID NO: 695337 - DNA, 22 bp, Artificial Sequence
  chemically synthesized
aattggatgcataaagatattt

SEQ ID NO: 695338 - DNA, 22 bp, Artificial Sequence
  chemically synthesized
attggatgcataaagatatttc

SEQ ID NO: 695339 - DNA, 22 bp, Artificial Sequence
  chemically synthesized
gatgcataaagatatttccacc

SEQ ID NO: 695340 - DNA, 22 bp, Artificial Sequence
  chemically synthesized
agcaggcacagcaaaagttcaa

SEQ ID NO: 695341 - DNA, 22 bp, Artificial Sequence
  chemically synthesized
ccaccttgaacttttgctgtgc

SEQ ID NO: 695342 - DNA, 22 bp, Artificial Sequence
  chemically synthesized
caccttgaacttttgctgtgcc

SEQ ID NO: 695343 - DNA, 22 bp, Artificial Sequence
  chemically synthesized
gaacttttgctgtgcctgctca

SEQ ID NO: 695344 - DNA, 22 bp, Artificial Sequence
  chemically synthesized
aacttttgctgtgcctgctcag

SEQ ID NO: 695345 - DNA, 22 bp, Artificial Sequence
  chemically synthesized
gatagagcaggaggggctgagc

SEQ ID NO: 695346 - DNA, 22 bp, Artificial Sequence
  chemically synthesized
ttgctgtgcctgctcagcccct

SEQ ID NO: 695347 - DNA, 22 bp, Artificial Sequence
  chemically synthesized
tgctgtgcctgctcagcccctc

SEQ ID NO: 695348 - DNA, 22 bp, Artificial Sequence
  chemically synthesized
gctgtgcctgctcagcccctcc

SEQ ID NO: 695349 - DNA, 22 bp, Artificial Sequence
  chemically synthesized
ctgtgcctgctcagcccctcct

SEQ ID NO: 695350 - DNA, 22 bp, Artificial Sequence
  chemically synthesized
tgcctgctcagcccctcctgct

SEQ ID NO: 695351 - DNA, 22 bp, Artificial Sequence
  chemically synthesized
ctcagcccctcctgctctatct

SEQ ID NO: 695352 - DNA, 22 bp, Artificial Sequence
  chemically synthesized
agcccctcctgctctatctagg

SEQ ID NO: 695353 - DNA, 22 bp, Artificial Sequence
  chemically synthesized
ctgctctatctaggattcattc

SEQ ID NO: 695354 - DNA, 22 bp, Artificial Sequence
  chemically synthesized
ctctatctaggattcattcttt

SEQ ID NO: 695355 - DNA, 22 bp, Artificial Sequence
  chemically synthesized
tatctaggattcattcttttct

SEQ ID NO: 695356 - DNA, 22 bp, Artificial Sequence
  chemically synthesized
tctaggattcattcttttctat

SEQ ID NO: 695357 - DNA, 22 bp, Artificial Sequence
  chemically synthesized
ggattcattcttttctattatt

SEQ ID NO: 695358 - DNA, 22 bp, Artificial Sequence
  chemically synthesized
ccaaaaaaaaaaatcaaataat

SEQ ID NO: 695359 - DNA, 22 bp, Artificial Sequence
  chemically synthesized
attcttttctattatttgattt

SEQ ID NO: 695360 - DNA, 22 bp, Artificial Sequence
  chemically synthesized
tgccaaaaaaaaaaatcaaata

SEQ ID NO: 695361 - DNA, 22 bp, Artificial Sequence
  chemically synthesized
ctgccaaaaaaaaaaatcaaat

SEQ ID NO: 695362 - DNA, 22 bp, Artificial Sequence
  chemically synthesized
tctgccaaaaaaaaaaatcaaa

SEQ ID NO: 695363 - DNA, 22 bp, Artificial Sequence
  chemically synthesized
ttctgccaaaaaaaaaaatcaa

SEQ ID NO: 695364 - DNA, 22 bp, Artificial Sequence
  chemically synthesized
ttttctattatttgattttttt

SEQ ID NO: 695365 - DNA, 22 bp, Artificial Sequence
  chemically synthesized
ttctattatttgattttttttt

SEQ ID NO: 695366 - DNA, 22 bp, Artificial Sequence
  chemically synthesized
tctattatttgatttttttttt

SEQ ID NO: 695367 - DNA, 22 bp, Artificial Sequence
  chemically synthesized
ctattatttgattttttttttt

SEQ ID NO: 695368 - DNA, 22 bp, Artificial Sequence
  chemically synthesized
tattatttgatttttttttttg

SEQ ID NO: 695369 - DNA, 22 bp, Artificial Sequence
  chemically synthesized
ttatttgatttttttttttggc

SEQ ID NO: 695370 - DNA, 22 bp, Artificial Sequence
  chemically synthesized
caagaacttttctgccaaaaaa

SEQ ID NO: 695371 - DNA, 22 bp, Artificial Sequence
  chemically synthesized
tttgatttttttttttggcaga

SEQ ID NO: 695372 - DNA, 22 bp, Artificial Sequence
  chemically synthesized
gatttttttttttggcagaaaa

SEQ ID NO: 695373 - DNA, 22 bp, Artificial Sequence
  chemically synthesized
atttttttttttggcagaaaag

SEQ ID NO: 695374 - DNA, 22 bp, Artificial Sequence
  chemically synthesized
ttttttttggcagaaaagttct

SEQ ID NO: 695375 - DNA, 22 bp, Artificial Sequence
  chemically synthesized
tttttttggcagaaaagttctt

SEQ ID NO: 695376 - DNA, 22 bp, Artificial Sequence
  chemically synthesized
tatcaatactacaagaactttt

SEQ ID NO: 695377 - DNA, 22 bp, Artificial Sequence
  chemically synthesized
ttttttggcagaaaagttcttg

SEQ ID NO: 695378 - DNA, 22 bp, Artificial Sequence
  chemically synthesized
atatcaatactacaagaacttt

SEQ ID NO: 695379 - DNA, 22 bp, Artificial Sequence
  chemically synthesized
tttttggcagaaaagttcttgt

SEQ ID NO: 695380 - DNA, 22 bp, Artificial Sequence
  chemically synthesized
ttttggcagaaaagttcttgta

SEQ ID NO: 695381 - DNA, 22 bp, Artificial Sequence
  chemically synthesized
tttggcagaaaagttcttgtag

SEQ ID NO: 695382 - DNA, 22 bp, Artificial Sequence
  chemically synthesized
cttatatcaatactacaagaac

SEQ ID NO: 695383 - DNA, 22 bp, Artificial Sequence
  chemically synthesized
ttggcagaaaagttcttgtagt

SEQ ID NO: 695384 - DNA, 22 bp, Artificial Sequence
  chemically synthesized
acttatatcaatactacaagaa

SEQ ID NO: 695385 - DNA, 22 bp, Artificial Sequence
  chemically synthesized
tggcagaaaagttcttgtagta

SEQ ID NO: 695386 - DNA, 22 bp, Artificial Sequence
  chemically synthesized
ggcagaaaagttcttgtagtat

SEQ ID NO: 695387 - DNA, 22 bp, Artificial Sequence
  chemically synthesized
ttacttatatcaatactacaag

SEQ ID NO: 695388 - DNA, 22 bp, Artificial Sequence
  chemically synthesized
gcagaaaagttcttgtagtatt

SEQ ID NO: 695389 - DNA, 22 bp, Artificial Sequence
  chemically synthesized
gctcttacttatatcaatacta

SEQ ID NO: 695390 - DNA, 22 bp, Artificial Sequence
  chemically synthesized
tcgctcttacttatatcaatac

SEQ ID NO: 695391 - DNA, 22 bp, Artificial Sequence
  chemically synthesized
ctcgctcttacttatatcaata

SEQ ID NO: 695392 - DNA, 22 bp, Artificial Sequence
  chemically synthesized
tctcgctcttacttatatcaat

SEQ ID NO: 695393 - DNA, 22 bp, Artificial Sequence
  chemically synthesized
ttctcgctcttacttatatcaa

SEQ ID NO: 695394 - DNA, 22 bp, Artificial Sequence
  chemically synthesized
tttctcgctcttacttatatca

SEQ ID NO: 695395 - DNA, 22 bp, Artificial Sequence
  chemically synthesized
ttgtagtattgatataagtaag

SEQ ID NO: 695396 - DNA, 22 bp, Artificial Sequence
  chemically synthesized
ttttttctcgctcttacttata

SEQ ID NO: 695397 - DNA, 22 bp, Artificial Sequence
  chemically synthesized
gtagtattgatataagtaagag

SEQ ID NO: 695398 - DNA, 22 bp, Artificial Sequence
  chemically synthesized
tagtattgatataagtaagagc

SEQ ID NO: 695399 - DNA, 22 bp, Artificial Sequence
  chemically synthesized
attgttttttctcgctcttact

SEQ ID NO: 695400 - DNA, 22 bp, Artificial Sequence
  chemically synthesized
gattaattgttttttctcgctc

SEQ ID NO: 695401 - DNA, 22 bp, Artificial Sequence
  chemically synthesized
atataagtaagagcgagaaaaa

SEQ ID NO: 695402 - DNA, 22 bp, Artificial Sequence
  chemically synthesized
tcaaataaaggctagattaatt

SEQ ID NO: 695403 - DNA, 22 bp, Artificial Sequence
  chemically synthesized
atcaaataaaggctagattaat

SEQ ID NO: 695404 - DNA, 22 bp, Artificial Sequence
  chemically synthesized
tatcaaataaaggctagattaa

SEQ ID NO: 695405 - DNA, 22 bp, Artificial Sequence
  chemically synthesized
atctagcctttatttgataaag

SEQ ID NO: 695406 - DNA, 22 bp, Artificial Sequence
  chemically synthesized
gcctttatttgataaagcactt

SEQ ID NO: 695407 - DNA, 22 bp, Artificial Sequence
  chemically synthesized
atatgtaaatacaagtgcttta

SEQ ID NO: 695408 - DNA, 22 bp, Artificial Sequence
  chemically synthesized
tatttgataaagcacttgtatt

SEQ ID NO: 695409 - DNA, 22 bp, Artificial Sequence
  chemically synthesized
tgttaatatgtaaatacaagtg

SEQ ID NO: 695410 - DNA, 22 bp, Artificial Sequence
  chemically synthesized
atttgataaagcacttgtattt

SEQ ID NO: 695411 - DNA, 22 bp, Artificial Sequence
  chemically synthesized
tttgataaagcacttgtattta

SEQ ID NO: 695412 - DNA, 22 bp, Artificial Sequence
  chemically synthesized
gataaagcacttgtatttacat

SEQ ID NO: 695413 - DNA, 22 bp, Artificial Sequence
  chemically synthesized
ataaagcacttgtatttacata

SEQ ID NO: 695414 - DNA, 22 bp, Artificial Sequence
  chemically synthesized
gtatttacatattaacacaggg

SEQ ID NO: 695415 - DNA, 22 bp, Artificial Sequence
  chemically synthesized
tatttacatattaacacagggt

SEQ ID NO: 695416 - DNA, 22 bp, Artificial Sequence
  chemically synthesized
tccgaaaaatgtaggcaccctg

SEQ ID NO: 695417 - DNA, 22 bp, Artificial Sequence
  chemically synthesized
acatattaacacagggtgccta

SEQ ID NO: 695418 - DNA, 22 bp, Artificial Sequence
  chemically synthesized
catattaacacagggtgcctac

SEQ ID NO: 695419 - DNA, 22 bp, Artificial Sequence
  chemically synthesized
tatccgaaaaatgtaggcaccc

SEQ ID NO: 695420 - DNA, 22 bp, Artificial Sequence
  chemically synthesized
acacagggtgcctacatttttc

SEQ ID NO: 695421 - DNA, 22 bp, Artificial Sequence
  chemically synthesized
catttttcggatagagattttt

SEQ ID NO: 695422 - DNA, 22 bp, Artificial Sequence
  chemically synthesized
ttcggatagagatttttctttt

SEQ ID NO: 695423 - DNA, 22 bp, Artificial Sequence
  chemically synthesized
tcggatagagatttttcttttc

SEQ ID NO: 695424 - DNA, 22 bp, Artificial Sequence
  chemically synthesized
cggatagagatttttcttttct

SEQ ID NO: 695425 - DNA, 22 bp, Artificial Sequence
  chemically synthesized
ggatagagatttttcttttctt

SEQ ID NO: 695426 - DNA, 22 bp, Artificial Sequence
  chemically synthesized
ggaataaaaaaaaaagaagaaa

SEQ ID NO: 695427 - DNA, 22 bp, Artificial Sequence
  chemically synthesized
taggaataaaaaaaaaagaaga

SEQ ID NO: 695428 - DNA, 22 bp, Artificial Sequence
  chemically synthesized
ttcttttctttcttcttttttt

SEQ ID NO: 695429 - DNA, 22 bp, Artificial Sequence
  chemically synthesized
tcttttctttcttctttttttt

SEQ ID NO: 695430 - DNA, 22 bp, Artificial Sequence
  chemically synthesized
cttttctttcttcttttttttt

SEQ ID NO: 695431 - DNA, 22 bp, Artificial Sequence
  chemically synthesized
tctctaggaataaaaaaaaaag

SEQ ID NO: 695432 - DNA, 22 bp, Artificial Sequence
  chemically synthesized
ttttctttcttctttttttttt

SEQ ID NO: 695433 - DNA, 22 bp, Artificial Sequence
  chemically synthesized
tgtctctaggaataaaaaaaaa

SEQ ID NO: 695434 - DNA, 22 bp, Artificial Sequence
  chemically synthesized
ttctttcttcttttttttttat

SEQ ID NO: 695435 - DNA, 22 bp, Artificial Sequence
  chemically synthesized
tctttcttcttttttttttatt

SEQ ID NO: 695436 - DNA, 22 bp, Artificial Sequence
  chemically synthesized
ctttcttcttttttttttattc

SEQ ID NO: 695437 - DNA, 22 bp, Artificial Sequence
  chemically synthesized
tttcttcttttttttttattcc

SEQ ID NO: 695438 - DNA, 22 bp, Artificial Sequence
  chemically synthesized
tcttcttttttttttattccta

SEQ ID NO: 695439 - DNA, 22 bp, Artificial Sequence
  chemically synthesized
cttcttttttttttattcctag

SEQ ID NO: 695440 - DNA, 22 bp, Artificial Sequence
  chemically synthesized
ttcttttttttttattcctaga

SEQ ID NO: 695441 - DNA, 22 bp, Artificial Sequence
  chemically synthesized
cttttttttttattcctagaga

SEQ ID NO: 695442 - DNA, 22 bp, Artificial Sequence
  chemically synthesized
ttttttttttattcctagagac

SEQ ID NO: 695443 - DNA, 22 bp, Artificial Sequence
  chemically synthesized
ttttttttattcctagagacag

SEQ ID NO: 695444 - DNA, 22 bp, Artificial Sequence
  chemically synthesized
tttttttattcctagagacaga

SEQ ID NO: 695445 - DNA, 22 bp, Artificial Sequence
  chemically synthesized
ttttttattcctagagacagag

SEQ ID NO: 695446 - DNA, 22 bp, Artificial Sequence
  chemically synthesized
tttttattcctagagacagagt

SEQ ID NO: 695447 - DNA, 22 bp, Artificial Sequence
  chemically synthesized
ttttattcctagagacagagtc

SEQ ID NO: 695448 - DNA, 22 bp, Artificial Sequence
  chemically synthesized
tttattcctagagacagagtct

SEQ ID NO: 695449 - DNA, 22 bp, Artificial Sequence
  chemically synthesized
ggcaacacagcaagactctgtc

SEQ ID NO: 695450 - DNA, 22 bp, Artificial Sequence
  chemically synthesized
ttattcctagagacagagtctt

SEQ ID NO: 695451 - DNA, 22 bp, Artificial Sequence
  chemically synthesized
gggcaacacagcaagactctgt

SEQ ID NO: 695452 - DNA, 22 bp, Artificial Sequence
  chemically synthesized
tattcctagagacagagtcttg

SEQ ID NO: 695453 - DNA, 22 bp, Artificial Sequence
  chemically synthesized
attcctagagacagagtcttgc

SEQ ID NO: 695454 - DNA, 22 bp, Artificial Sequence
  chemically synthesized
ttcctagagacagagtcttgct

SEQ ID NO: 695455 - DNA, 22 bp, Artificial Sequence
  chemically synthesized
ctagagacagagtcttgctgtg

SEQ ID NO: 695456 - DNA, 22 bp, Artificial Sequence
  chemically synthesized
cagcttgggcaacacagcaaga

SEQ ID NO: 695457 - DNA, 22 bp, Artificial Sequence
  chemically synthesized
gagacagagtcttgctgtgttg

SEQ ID NO: 695458 - DNA, 22 bp, Artificial Sequence
  chemically synthesized
cactccagcttgggcaacacag

SEQ ID NO: 695459 - DNA, 22 bp, Artificial Sequence
  chemically synthesized
tgccactgcactccagcttggg

SEQ ID NO: 695460 - DNA, 22 bp, Artificial Sequence
  chemically synthesized
gtgccactgcactccagcttgg

SEQ ID NO: 695461 - DNA, 22 bp, Artificial Sequence
  chemically synthesized
gctgtgttgcccaagctggagt

SEQ ID NO: 695462 - DNA, 22 bp, Artificial Sequence
  chemically synthesized
ctgtgttgcccaagctggagtg

SEQ ID NO: 695463 - DNA, 22 bp, Artificial Sequence
  chemically synthesized
tgttgcccaagctggagtgcag

SEQ ID NO: 695464 - DNA, 22 bp, Artificial Sequence
  chemically synthesized
cccaagctggagtgcagtggca

SEQ ID NO: 695465 - DNA, 22 bp, Artificial Sequence
  chemically synthesized
tagtgaaccgtgtttgtgccac

SEQ ID NO: 695466 - DNA, 22 bp, Artificial Sequence
  chemically synthesized
gagtgcagtggcacaaacacgg

SEQ ID NO: 695467 - DNA, 22 bp, Artificial Sequence
  chemically synthesized
aggctatagtgaaccgtgtttg

SEQ ID NO: 695468 - DNA, 22 bp, Artificial Sequence
  chemically synthesized
agcccagggggccgaaagttga

SEQ ID NO: 695469 - DNA, 22 bp, Artificial Sequence
  chemically synthesized
gagcccagggggccgaaagttg

SEQ ID NO: 695470 - DNA, 22 bp, Artificial Sequence
  chemically synthesized
actatagcctcaactttcggcc

SEQ ID NO: 695471 - DNA, 22 bp, Artificial Sequence
  chemically synthesized
cttgagcccagggggccgaaag

SEQ ID NO: 695472 - DNA, 22 bp, Artificial Sequence
  chemically synthesized
tagcctcaactttcggccccct

SEQ ID NO: 695473 - DNA, 22 bp, Artificial Sequence
  chemically synthesized
aactttcggccccctgggctca

SEQ ID NO: 695474 - DNA, 22 bp, Artificial Sequence
  chemically synthesized
aggcaggaggattgcttgagcc

SEQ ID NO: 695475 - DNA, 22 bp, Artificial Sequence
  chemically synthesized
tcggccccctgggctcaagcaa

SEQ ID NO: 695476 - DNA, 22 bp, Artificial Sequence
  chemically synthesized
cggccccctgggctcaagcaat

SEQ ID NO: 695477 - DNA, 22 bp, Artificial Sequence
  chemically synthesized
ggccccctgggctcaagcaatc

SEQ ID NO: 695478 - DNA, 22 bp, Artificial Sequence
  chemically synthesized
ggctcaagcaatcctcctgcct

SEQ ID NO: 695479 - DNA, 22 bp, Artificial Sequence
  chemically synthesized
aagcaatcctcctgcctcagca

SEQ ID NO: 695480 - DNA, 22 bp, Artificial Sequence
  chemically synthesized
tggtcccaggcacacaggatgc

SEQ ID NO: 695481 - DNA, 22 bp, Artificial Sequence
  chemically synthesized
gtggtcccaggcacacaggatg

SEQ ID NO: 695482 - DNA, 22 bp, Artificial Sequence
  chemically synthesized
ctgcctcagcatcctgtgtgcc

SEQ ID NO: 695483 - DNA, 22 bp, Artificial Sequence
  chemically synthesized
cctcagcatcctgtgtgcctgg

SEQ ID NO: 695484 - DNA, 22 bp, Artificial Sequence
  chemically synthesized
agcatcctgtgtgcctgggacc

SEQ ID NO: 695485 - DNA, 22 bp, Artificial Sequence
  chemically synthesized
gcatggtggcatgtgcttgtgg

SEQ ID NO: 695486 - DNA, 22 bp, Artificial Sequence
  chemically synthesized
tgtgcctgggaccacaagcaca

SEQ ID NO: 695487 - DNA, 22 bp, Artificial Sequence
  chemically synthesized
ggcatggtggcatgtgcttgtg

SEQ ID NO: 695488 - DNA, 22 bp, Artificial Sequence
  chemically synthesized
ggaccacaagcacatgccacca

SEQ ID NO: 695489 - DNA, 22 bp, Artificial Sequence
  chemically synthesized
caaaaaaaaaaaaaaaaaaatc

SEQ ID NO: 695490 - DNA, 22 bp, Artificial Sequence
  chemically synthesized
tacaaaaaaaaaaaaaaaaaaa

SEQ ID NO: 695491 - DNA, 22 bp, Artificial Sequence
  chemically synthesized
gtctctacaaaaaaaaaaaaaa

SEQ ID NO: 695492 - DNA, 22 bp, Artificial Sequence
  chemically synthesized
ttttttttttttttttgtagag

SEQ ID NO: 695493 - DNA, 22 bp, Artificial Sequence
  chemically synthesized
tttttttttttttttgtagaga

SEQ ID NO: 695494 - DNA, 22 bp, Artificial Sequence
  chemically synthesized
ttttttttttttttgtagagac

SEQ ID NO: 695495 - DNA, 22 bp, Artificial Sequence
  chemically synthesized
tttttttttttttgtagagacc

SEQ ID NO: 695496 - DNA, 22 bp, Artificial Sequence
  chemically synthesized
ttttttttttttgtagagacca

SEQ ID NO: 695497 - DNA, 22 bp, Artificial Sequence
  chemically synthesized
tttttttttttgtagagaccag

SEQ ID NO: 695498 - DNA, 22 bp, Artificial Sequence
  chemically synthesized
ttttttttttgtagagaccagg

SEQ ID NO: 695499 - DNA, 22 bp, Artificial Sequence
  chemically synthesized
tttttttttgtagagaccaggt

SEQ ID NO: 695500 - DNA, 22 bp, Artificial Sequence
  chemically synthesized
ttttttttgtagagaccaggta

SEQ ID NO: 695501 - DNA, 22 bp, Artificial Sequence
  chemically synthesized
tttttttgtagagaccaggtat

SEQ ID NO: 695502 - DNA, 22 bp, Artificial Sequence
  chemically synthesized
agcaacaaaatgatacctggtc

SEQ ID NO: 695503 - DNA, 22 bp, Artificial Sequence
  chemically synthesized
ttttttgtagagaccaggtatc

SEQ ID NO: 695504 - DNA, 22 bp, Artificial Sequence
  chemically synthesized
tttttgtagagaccaggtatca

SEQ ID NO: 695505 - DNA, 22 bp, Artificial Sequence
  chemically synthesized
ttttgtagagaccaggtatcat

SEQ ID NO: 695506 - DNA, 22 bp, Artificial Sequence
  chemically synthesized
tttgtagagaccaggtatcatt

SEQ ID NO: 695507 - DNA, 22 bp, Artificial Sequence
  chemically synthesized
ttgtagagaccaggtatcattt

SEQ ID NO: 695508 - DNA, 22 bp, Artificial Sequence
  chemically synthesized
tgtagagaccaggtatcatttt

SEQ ID NO: 695509 - DNA, 22 bp, Artificial Sequence
  chemically synthesized
gtagagaccaggtatcattttg

SEQ ID NO: 695510 - DNA, 22 bp, Artificial Sequence
  chemically synthesized
tagagaccaggtatcattttgt

SEQ ID NO: 695511 - DNA, 22 bp, Artificial Sequence
  chemically synthesized
gaagccagcctgagcaacaaaa

SEQ ID NO: 695512 - DNA, 22 bp, Artificial Sequence
  chemically synthesized
agcccaggagttcgaagccagc

SEQ ID NO: 695513 - DNA, 22 bp, Artificial Sequence
  chemically synthesized
aagcccaggagttcgaagccag

SEQ ID NO: 695514 - DNA, 22 bp, Artificial Sequence
  chemically synthesized
tgttgctcaggctggcttcgaa

SEQ ID NO: 695515 - DNA, 22 bp, Artificial Sequence
  chemically synthesized
gttgctcaggctggcttcgaac

SEQ ID NO: 695516 - DNA, 22 bp, Artificial Sequence
  chemically synthesized
ttgctcaggctggcttcgaact

SEQ ID NO: 695517 - DNA, 22 bp, Artificial Sequence
  chemically synthesized
ctcaggctggcttcgaactcct

SEQ ID NO: 695518 - DNA, 22 bp, Artificial Sequence
  chemically synthesized
aggctggcttcgaactcctggg

SEQ ID NO: 695519 - DNA, 22 bp, Artificial Sequence
  chemically synthesized
gcttcgaactcctgggcttaag

SEQ ID NO: 695520 - DNA, 22 bp, Artificial Sequence
  chemically synthesized
cgaactcctgggcttaagtgtt

SEQ ID NO: 695521 - DNA, 22 bp, Artificial Sequence
  chemically synthesized
gaactcctgggcttaagtgttc

SEQ ID NO: 695522 - DNA, 22 bp, Artificial Sequence
  chemically synthesized
gggggtcaaagcagaaggaaca

SEQ ID NO: 695523 - DNA, 22 bp, Artificial Sequence
  chemically synthesized
ctgggcttaagtgttccttctg

SEQ ID NO: 695524 - DNA, 22 bp, Artificial Sequence
  chemically synthesized
ggggggtcaaagcagaaggaac

SEQ ID NO: 695525 - DNA, 22 bp, Artificial Sequence
  chemically synthesized
tggggggtcaaagcagaaggaa

SEQ ID NO: 695526 - DNA, 22 bp, Artificial Sequence
  chemically synthesized
ggcttaagtgttccttctgctt

SEQ ID NO: 695527 - DNA, 22 bp, Artificial Sequence
  chemically synthesized
aagtgttccttctgctttgacc

SEQ ID NO: 695528 - DNA, 22 bp, Artificial Sequence
  chemically synthesized
agtgttccttctgctttgaccc

SEQ ID NO: 695529 - DNA, 22 bp, Artificial Sequence
  chemically synthesized
cttctgctttgaccccccaaag

SEQ ID NO: 695530 - DNA, 22 bp, Artificial Sequence
  chemically synthesized
ctgctttgaccccccaaagtgc

SEQ ID NO: 695531 - DNA, 22 bp, Artificial Sequence
  chemically synthesized
tgctttgaccccccaaagtgct

SEQ ID NO: 695532 - DNA, 22 bp, Artificial Sequence
  chemically synthesized
ctttgaccccccaaagtgctgg

SEQ ID NO: 695533 - DNA, 22 bp, Artificial Sequence
  chemically synthesized
aagcgtgtaatcccagcacttt

SEQ ID NO: 695534 - DNA, 22 bp, Artificial Sequence
  chemically synthesized
tgaccccccaaagtgctgggat

SEQ ID NO: 695535 - DNA, 22 bp, Artificial Sequence
  chemically synthesized
gaccccccaaagtgctgggatt

SEQ ID NO: 695536 - DNA, 22 bp, Artificial Sequence
  chemically synthesized
accccccaaagtgctgggatta

SEQ ID NO: 695537 - DNA, 22 bp, Artificial Sequence
  chemically synthesized
ggcacagtgtctcaagcgtgta

SEQ ID NO: 695538 - DNA, 22 bp, Artificial Sequence
  chemically synthesized
ggattacacgcttgagacactg

SEQ ID NO: 695539 - DNA, 22 bp, Artificial Sequence
  chemically synthesized
aatatagctgggcacagtgtct

SEQ ID NO: 695540 - DNA, 22 bp, Artificial Sequence
  chemically synthesized
cacgcttgagacactgtgccca

SEQ ID NO: 695541 - DNA, 22 bp, Artificial Sequence
  chemically synthesized
tctgaatatagctgggcacagt

SEQ ID NO: 695542 - DNA, 22 bp, Artificial Sequence
  chemically synthesized
tgtctgaatatagctgggcaca

SEQ ID NO: 695543 - DNA, 22 bp, Artificial Sequence
  chemically synthesized
gagacactgtgcccagctatat

SEQ ID NO: 695544 - DNA, 22 bp, Artificial Sequence
  chemically synthesized
agacactgtgcccagctatatt

SEQ ID NO: 695545 - DNA, 22 bp, Artificial Sequence
  chemically synthesized
agaaaaatctctgtctgaatat

SEQ ID NO: 695546 - DNA, 22 bp, Artificial Sequence
  chemically synthesized
tgcccagctatattcagacaga

SEQ ID NO: 695547 - DNA, 22 bp, Artificial Sequence
  chemically synthesized
aagattaagaaaaatctctgtc

SEQ ID NO: 695548 - DNA, 22 bp, Artificial Sequence
  chemically synthesized
tgaagattaagaaaaatctctg

SEQ ID NO: 695549 - DNA, 22 bp, Artificial Sequence
  chemically synthesized
ctgaagattaagaaaaatctct

SEQ ID NO: 695550 - DNA, 22 bp, Artificial Sequence
  chemically synthesized
tctgaagattaagaaaaatctc

SEQ ID NO: 695551 - DNA, 22 bp, Artificial Sequence
  chemically synthesized
tattcagacagagatttttctt

SEQ ID NO: 695552 - DNA, 22 bp, Artificial Sequence
  chemically synthesized
tgttttctgaagattaagaaaa

SEQ ID NO: 695553 - DNA, 22 bp, Artificial Sequence
  chemically synthesized
atgttttctgaagattaagaaa

SEQ ID NO: 695554 - DNA, 22 bp, Artificial Sequence
  chemically synthesized
agacagagatttttcttaatct

SEQ ID NO: 695555 - DNA, 22 bp, Artificial Sequence
  chemically synthesized
ttcttaatcttcagaaaacata

SEQ ID NO: 695556 - DNA, 22 bp, Artificial Sequence
  chemically synthesized
tcttaatcttcagaaaacataa

SEQ ID NO: 695557 - DNA, 22 bp, Artificial Sequence
  chemically synthesized
cttaatcttcagaaaacataag

SEQ ID NO: 695558 - DNA, 22 bp, Artificial Sequence
  chemically synthesized
ttaatcttcagaaaacataagc

SEQ ID NO: 695559 - DNA, 22 bp, Artificial Sequence
  chemically synthesized
aagataaataatggcttatgtt

SEQ ID NO: 695560 - DNA, 22 bp, Artificial Sequence
  chemically synthesized
aatcttcagaaaacataagcca

SEQ ID NO: 695561 - DNA, 22 bp, Artificial Sequence
  chemically synthesized
gaagataaataatggcttatgt

SEQ ID NO: 695562 - DNA, 22 bp, Artificial Sequence
  chemically synthesized
atcttcagaaaacataagccat

SEQ ID NO: 695563 - DNA, 22 bp, Artificial Sequence
  chemically synthesized
tgaagataaataatggcttatg

SEQ ID NO: 695564 - DNA, 22 bp, Artificial Sequence
  chemically synthesized
ttgaagataaataatggcttat

SEQ ID NO: 695565 - DNA, 22 bp, Artificial Sequence
  chemically synthesized
cagaaaacataagccattattt

SEQ ID NO: 695566 - DNA, 22 bp, Artificial Sequence
  chemically synthesized
agaaaacataagccattattta

SEQ ID NO: 695567 - DNA, 22 bp, Artificial Sequence
  chemically synthesized
atatgtttttgaagataaataa

SEQ ID NO: 695568 - DNA, 22 bp, Artificial Sequence
  chemically synthesized
ggcaattaatatgtttttgaag

SEQ ID NO: 695569 - DNA, 22 bp, Artificial Sequence
  chemically synthesized
tttatcttcaaaaacatattaa

SEQ ID NO: 695570 - DNA, 22 bp, Artificial Sequence
  chemically synthesized
atcttcaaaaacatattaattg

SEQ ID NO: 695571 - DNA, 22 bp, Artificial Sequence
  chemically synthesized
tcttcaaaaacatattaattgc

SEQ ID NO: 695572 - DNA, 22 bp, Artificial Sequence
  chemically synthesized
caaaagcaatctgggcaattaa

SEQ ID NO: 695573 - DNA, 22 bp, Artificial Sequence
  chemically synthesized
caaaaacatattaattgcccag

SEQ ID NO: 695574 - DNA, 22 bp, Artificial Sequence
  chemically synthesized
aaaaacatattaattgcccaga

SEQ ID NO: 695575 - DNA, 22 bp, Artificial Sequence
  chemically synthesized
aaaattacaaaagcaatctggg

SEQ ID NO: 695576 - DNA, 22 bp, Artificial Sequence
  chemically synthesized
attgcccagattgcttttgtaa

SEQ ID NO: 695577 - DNA, 22 bp, Artificial Sequence
  chemically synthesized
ataatgactcaaaattacaaaa

SEQ ID NO: 695578 - DNA, 22 bp, Artificial Sequence
  chemically synthesized
cccagattgcttttgtaatttt

SEQ ID NO: 695579 - DNA, 22 bp, Artificial Sequence
  chemically synthesized
tcataatgactcaaaattacaa

SEQ ID NO: 695580 - DNA, 22 bp, Artificial Sequence
  chemically synthesized
ctcataatgactcaaaattaca

SEQ ID NO: 695581 - DNA, 22 bp, Artificial Sequence
  chemically synthesized
tctcataatgactcaaaattac

SEQ ID NO: 695582 - DNA, 22 bp, Artificial Sequence
  chemically synthesized
ttctcataatgactcaaaatta

SEQ ID NO: 695583 - DNA, 22 bp, Artificial Sequence
  chemically synthesized
tttctcataatgactcaaaatt

SEQ ID NO: 695584 - DNA, 22 bp, Artificial Sequence
  chemically synthesized
cttttgtaattttgagtcatta

SEQ ID NO: 695585 - DNA, 22 bp, Artificial Sequence
  chemically synthesized
atactttttctcataatgactc

SEQ ID NO: 695586 - DNA, 22 bp, Artificial Sequence
  chemically synthesized
ttgtaattttgagtcattatga

SEQ ID NO: 695587 - DNA, 22 bp, Artificial Sequence
  chemically synthesized
tcatactttttctcataatgac

SEQ ID NO: 695588 - DNA, 22 bp, Artificial Sequence
  chemically synthesized
tgtaattttgagtcattatgag

SEQ ID NO: 695589 - DNA, 22 bp, Artificial Sequence
  chemically synthesized
ctcatactttttctcataatga

SEQ ID NO: 695590 - DNA, 22 bp, Artificial Sequence
  chemically synthesized
gtaattttgagtcattatgaga

SEQ ID NO: 695591 - DNA, 22 bp, Artificial Sequence
  chemically synthesized
taattttgagtcattatgagaa

SEQ ID NO: 695592 - DNA, 22 bp, Artificial Sequence
  chemically synthesized
tgagtcattatgagaaaaagta

SEQ ID NO: 695593 - DNA, 22 bp, Artificial Sequence
  chemically synthesized
gagtcattatgagaaaaagtat

SEQ ID NO: 695594 - DNA, 22 bp, Artificial Sequence
  chemically synthesized
agtcattatgagaaaaagtatg

SEQ ID NO: 695595 - DNA, 22 bp, Artificial Sequence
  chemically synthesized
tgagaaaaagtatgagaaatac

SEQ ID NO: 695596 - DNA, 22 bp, Artificial Sequence
  chemically synthesized
catggtgcaaaagaagtatttc

SEQ ID NO: 695597 - DNA, 22 bp, Artificial Sequence
  chemically synthesized
taactacatggtgcaaaagaag

SEQ ID NO: 695598 - DNA, 22 bp, Artificial Sequence
  chemically synthesized
tcattataactacatggtgcaa

SEQ ID NO: 695599 - DNA, 22 bp, Artificial Sequence
  chemically synthesized
atcattataactacatggtgca

SEQ ID NO: 695600 - DNA, 22 bp, Artificial Sequence
  chemically synthesized
tatcattataactacatggtgc

SEQ ID NO: 695601 - DNA, 22 bp, Artificial Sequence
  chemically synthesized
ttatcattataactacatggtg

SEQ ID NO: 695602 - DNA, 22 bp, Artificial Sequence
  chemically synthesized
tttatcattataactacatggt

SEQ ID NO: 695603 - DNA, 22 bp, Artificial Sequence
  chemically synthesized
ttttttatcattataactacat

SEQ ID NO: 695604 - DNA, 22 bp, Artificial Sequence
  chemically synthesized
attttttatcattataactaca

SEQ ID NO: 695605 - DNA, 22 bp, Artificial Sequence
  chemically synthesized
cttttgcaccatgtagttataa

SEQ ID NO: 695606 - DNA, 22 bp, Artificial Sequence
  chemically synthesized
tattttttatcattataactac

SEQ ID NO: 695607 - DNA, 22 bp, Artificial Sequence
  chemically synthesized
ttttgcaccatgtagttataat

SEQ ID NO: 695608 - DNA, 22 bp, Artificial Sequence
  chemically synthesized
ttgcaccatgtagttataatga

SEQ ID NO: 695609 - DNA, 22 bp, Artificial Sequence
  chemically synthesized
tgcaccatgtagttataatgat

SEQ ID NO: 695610 - DNA, 22 bp, Artificial Sequence
  chemically synthesized
gcaccatgtagttataatgata

SEQ ID NO: 695611 - DNA, 22 bp, Artificial Sequence
  chemically synthesized
gtctttattttttatcattata

SEQ ID NO: 695612 - DNA, 22 bp, Artificial Sequence
  chemically synthesized
caccatgtagttataatgataa

SEQ ID NO: 695613 - DNA, 22 bp, Artificial Sequence
  chemically synthesized
agtctttattttttatcattat

SEQ ID NO: 695614 - DNA, 22 bp, Artificial Sequence
  chemically synthesized
tagtctttattttttatcatta

SEQ ID NO: 695615 - DNA, 22 bp, Artificial Sequence
  chemically synthesized
tttagtctttattttttatcat

SEQ ID NO: 695616 - DNA, 22 bp, Artificial Sequence
  chemically synthesized
taatgataaaaaataaagacta

SEQ ID NO: 695617 - DNA, 22 bp, Artificial Sequence
  chemically synthesized
cagagtgatattctttagtctt

SEQ ID NO: 695618 - DNA, 22 bp, Artificial Sequence
  chemically synthesized
ttgcagagtgatattctttagt

SEQ ID NO: 695619 - DNA, 22 bp, Artificial Sequence
  chemically synthesized
attattgcagagtgatattctt

SEQ ID NO: 695620 - DNA, 22 bp, Artificial Sequence
  chemically synthesized
aagaatatcactctgcaataat

SEQ ID NO: 695621 - DNA, 22 bp, Artificial Sequence
  chemically synthesized
cagaatgatattcattattgca

SEQ ID NO: 695622 - DNA, 22 bp, Artificial Sequence
  chemically synthesized
ttgcagaatgatattcattatt

SEQ ID NO: 695623 - DNA, 22 bp, Artificial Sequence
  chemically synthesized
attgcagaatgatattcattat

SEQ ID NO: 695624 - DNA, 22 bp, Artificial Sequence
  chemically synthesized
ttattgcagaatgatattcatt

SEQ ID NO: 695625 - DNA, 22 bp, Artificial Sequence
  chemically synthesized
ttcttattgcagaatgatattc

SEQ ID NO: 695626 - DNA, 22 bp, Artificial Sequence
  chemically synthesized
attcttattgcagaatgatatt

SEQ ID NO: 695627 - DNA, 22 bp, Artificial Sequence
  chemically synthesized
tattcttattgcagaatgatat

SEQ ID NO: 695628 - DNA, 22 bp, Artificial Sequence
  chemically synthesized
tgcaataatgaatatcattctg

SEQ ID NO: 695629 - DNA, 22 bp, Artificial Sequence
  chemically synthesized
caataatgaatatcattctgca

SEQ ID NO: 695630 - DNA, 22 bp, Artificial Sequence
  chemically synthesized
cagaatgatactttattcttat

SEQ ID NO: 695631 - DNA, 22 bp, Artificial Sequence
  chemically synthesized
ttgcagaatgatactttattct

SEQ ID NO: 695632 - DNA, 22 bp, Artificial Sequence
  chemically synthesized
attgcagaatgatactttattc

SEQ ID NO: 695633 - DNA, 22 bp, Artificial Sequence
  chemically synthesized
tgcaataagaataaagtatcat

SEQ ID NO: 695634 - DNA, 22 bp, Artificial Sequence
  chemically synthesized
atcttattgcagaatgatactt

SEQ ID NO: 695635 - DNA, 22 bp, Artificial Sequence
  chemically synthesized
caataagaataaagtatcattc

SEQ ID NO: 695636 - DNA, 22 bp, Artificial Sequence
  chemically synthesized
catcttattgcagaatgatact

SEQ ID NO: 695637 - DNA, 22 bp, Artificial Sequence
  chemically synthesized
catgcagaacatttcatcttat

SEQ ID NO: 695638 - DNA, 22 bp, Artificial Sequence
  chemically synthesized
tgcaataagatgaaatgttctg

SEQ ID NO: 695639 - DNA, 22 bp, Artificial Sequence
  chemically synthesized
caataagatgaaatgttctgca

SEQ ID NO: 695640 - DNA, 22 bp, Artificial Sequence
  chemically synthesized
cccatgtattacatgcagaaca

SEQ ID NO: 695641 - DNA, 22 bp, Artificial Sequence
  chemically synthesized
agtctgcccatgtattacatgc

SEQ ID NO: 695642 - DNA, 22 bp, Artificial Sequence
  chemically synthesized
tgcatgtaatacatgggcagac

SEQ ID NO: 695643 - DNA, 22 bp, Artificial Sequence
  chemically synthesized
ggggaatactgagtctgcccat

SEQ ID NO: 695644 - DNA, 22 bp, Artificial Sequence
  chemically synthesized
catgtaatacatgggcagactc

SEQ ID NO: 695645 - DNA, 22 bp, Artificial Sequence
  chemically synthesized
agctgggggaatactgagtctg

SEQ ID NO: 695646 - DNA, 22 bp, Artificial Sequence
  chemically synthesized
gagctgggggaatactgagtct

SEQ ID NO: 695647 - DNA, 22 bp, Artificial Sequence
  chemically synthesized
ccaagccttgagctgggggaat

SEQ ID NO: 695648 - DNA, 22 bp, Artificial Sequence
  chemically synthesized
tcccaagccttgagctggggga

SEQ ID NO: 695649 - DNA, 22 bp, Artificial Sequence
  chemically synthesized
ctcccaagccttgagctggggg

SEQ ID NO: 695650 - DNA, 22 bp, Artificial Sequence
  chemically synthesized
agtattcccccagctcaaggct

SEQ ID NO: 695651 - DNA, 22 bp, Artificial Sequence
  chemically synthesized
ccccagctcaaggcttgggaga

SEQ ID NO: 695652 - DNA, 22 bp, Artificial Sequence
  chemically synthesized
taagtcacaatttctcccaagc

SEQ ID NO: 695653 - DNA, 22 bp, Artificial Sequence
  chemically synthesized
tggctataagtcacaatttctc

SEQ ID NO: 695654 - DNA, 22 bp, Artificial Sequence
  chemically synthesized
aaggcttgggagaaattgtgac

SEQ ID NO: 695655 - DNA, 22 bp, Artificial Sequence
  chemically synthesized
gggagaaattgtgacttatagc

SEQ ID NO: 695656 - DNA, 22 bp, Artificial Sequence
  chemically synthesized
ggagaaattgtgacttatagcc

SEQ ID NO: 695657 - DNA, 22 bp, Artificial Sequence
  chemically synthesized
ggcaaatatatatggtctgtgg

SEQ ID NO: 695658 - DNA, 22 bp, Artificial Sequence
  chemically synthesized
tgacttatagccacagaccata

SEQ ID NO: 695659 - DNA, 22 bp, Artificial Sequence
  chemically synthesized
ctaggcaaatatatatggtctg

SEQ ID NO: 695660 - DNA, 22 bp, Artificial Sequence
  chemically synthesized
actaggcaaatatatatggtct

SEQ ID NO: 695661 - DNA, 22 bp, Artificial Sequence
  chemically synthesized
tactaggcaaatatatatggtc

SEQ ID NO: 695662 - DNA, 22 bp, Artificial Sequence
  chemically synthesized
atagccacagaccatatatatt

SEQ ID NO: 695663 - DNA, 22 bp, Artificial Sequence
  chemically synthesized
tagccacagaccatatatattt

SEQ ID NO: 695664 - DNA, 22 bp, Artificial Sequence
  chemically synthesized
gctttactaggcaaatatatat

SEQ ID NO: 695665 - DNA, 22 bp, Artificial Sequence
  chemically synthesized
tagctttactaggcaaatatat

SEQ ID NO: 695666 - DNA, 22 bp, Artificial Sequence
  chemically synthesized
tggttctagctttactaggcaa

SEQ ID NO: 695667 - DNA, 22 bp, Artificial Sequence
  chemically synthesized
agccagaggcctatggttctag

SEQ ID NO: 695668 - DNA, 22 bp, Artificial Sequence
  chemically synthesized
gcctagtaaagctagaaccata

SEQ ID NO: 695669 - DNA, 22 bp, Artificial Sequence
  chemically synthesized
aagccagaggcctatggttcta

SEQ ID NO: 695670 - DNA, 22 bp, Artificial Sequence
  chemically synthesized
cctagtaaagctagaaccatag

SEQ ID NO: 695671 - DNA, 22 bp, Artificial Sequence
  chemically synthesized
ccttaagccagaggcctatggt

SEQ ID NO: 695672 - DNA, 22 bp, Artificial Sequence
  chemically synthesized
gtaaagctagaaccataggcct

SEQ ID NO: 695673 - DNA, 22 bp, Artificial Sequence
  chemically synthesized
cccttaagccagaggcctatgg

SEQ ID NO: 695674 - DNA, 22 bp, Artificial Sequence
  chemically synthesized
atccttcccttaagccagaggc

SEQ ID NO: 695675 - DNA, 22 bp, Artificial Sequence
  chemically synthesized
gaaccataggcctctggcttaa

SEQ ID NO: 695676 - DNA, 22 bp, Artificial Sequence
  chemically synthesized
cagaacagatcgtctcatcctt

SEQ ID NO: 695677 - DNA, 22 bp, Artificial Sequence
  chemically synthesized
tggcttaagggaaggatgagac

SEQ ID NO: 695678 - DNA, 22 bp, Artificial Sequence
  chemically synthesized
gcttaagggaaggatgagacga

SEQ ID NO: 695679 - DNA, 22 bp, Artificial Sequence
  chemically synthesized
aagggaaggatgagacgatctg

SEQ ID NO: 695680 - DNA, 22 bp, Artificial Sequence
  chemically synthesized
agggaaggatgagacgatctgt

SEQ ID NO: 695681 - DNA, 22 bp, Artificial Sequence
  chemically synthesized
acaccaccccccgccccccatt

SEQ ID NO: 695682 - DNA, 22 bp, Artificial Sequence
  chemically synthesized
gacaccaccccccgccccccat

SEQ ID NO: 695683 - DNA, 22 bp, Artificial Sequence
  chemically synthesized
tgacaccaccccccgcccccca

SEQ ID NO: 695684 - DNA, 22 bp, Artificial Sequence
  chemically synthesized
ttctggaatggggggcgggggg

SEQ ID NO: 695685 - DNA, 22 bp, Artificial Sequence
  chemically synthesized
attttgacaccaccccccgccc

SEQ ID NO: 695686 - DNA, 22 bp, Artificial Sequence
  chemically synthesized
gattttgacaccaccccccgcc

SEQ ID NO: 695687 - DNA, 22 bp, Artificial Sequence
  chemically synthesized
tggaatggggggcggggggtgg

SEQ ID NO: 695688 - DNA, 22 bp, Artificial Sequence
  chemically synthesized
gaatggggggcggggggtggtg

SEQ ID NO: 695689 - DNA, 22 bp, Artificial Sequence
  chemically synthesized
tgcatgtccttgattttgacac

SEQ ID NO: 695690 - DNA, 22 bp, Artificial Sequence
  chemically synthesized
gtgcatgtccttgattttgaca

SEQ ID NO: 695691 - DNA, 22 bp, Artificial Sequence
  chemically synthesized
caacatttgtgcatgtccttga

SEQ ID NO: 695692 - DNA, 22 bp, Artificial Sequence
  chemically synthesized
gcaacatttgtgcatgtccttg

SEQ ID NO: 695693 - DNA, 22 bp, Artificial Sequence
  chemically synthesized
tgcaacatttgtgcatgtcctt

SEQ ID NO: 695694 - DNA, 22 bp, Artificial Sequence
  chemically synthesized
caggagcctttgcaacatttgt

SEQ ID NO: 695695 - DNA, 22 bp, Artificial Sequence
  chemically synthesized
tgcaggagcctttgcaacattt

SEQ ID NO: 695696 - DNA, 22 bp, Artificial Sequence
  chemically synthesized
gatggacaagaagtgctctgca

SEQ ID NO: 695697 - DNA, 22 bp, Artificial Sequence
  chemically synthesized
agatggacaagaagtgctctgc

SEQ ID NO: 695698 - DNA, 22 bp, Artificial Sequence
  chemically synthesized
caaaggctcctgcagagcactt

SEQ ID NO: 695699 - DNA, 22 bp, Artificial Sequence
  chemically synthesized
ctgcagagcacttcttgtccat

SEQ ID NO: 695700 - DNA, 22 bp, Artificial Sequence
  chemically synthesized
cagagcacttcttgtccatcta

SEQ ID NO: 695701 - DNA, 22 bp, Artificial Sequence
  chemically synthesized
aaaggtagcgcgtggtcaattt

SEQ ID NO: 695702 - DNA, 22 bp, Artificial Sequence
  chemically synthesized
cttgtccatctaaattgaccac

SEQ ID NO: 695703 - DNA, 22 bp, Artificial Sequence
  chemically synthesized
ttgtccatctaaattgaccacg

SEQ ID NO: 695704 - DNA, 22 bp, Artificial Sequence
  chemically synthesized
tgaaaggtagcgcgtggtcaat

SEQ ID NO: 695705 - DNA, 22 bp, Artificial Sequence
  chemically synthesized
ctgaaaggtagcgcgtggtcaa

SEQ ID NO: 695706 - DNA, 22 bp, Artificial Sequence
  chemically synthesized
gtccatctaaattgaccacgcg

SEQ ID NO: 695707 - DNA, 22 bp, Artificial Sequence
  chemically synthesized
tctgaaaggtagcgcgtggtca

SEQ ID NO: 695708 - DNA, 22 bp, Artificial Sequence
  chemically synthesized
tccatctaaattgaccacgcgc

SEQ ID NO: 695709 - DNA, 22 bp, Artificial Sequence
  chemically synthesized
taagtctttctgaaaggtagcg

SEQ ID NO: 695710 - DNA, 22 bp, Artificial Sequence
  chemically synthesized
aattgaccacgcgctacctttc

SEQ ID NO: 695711 - DNA, 22 bp, Artificial Sequence
  chemically synthesized
aattgtaagtctttctgaaagg

SEQ ID NO: 695712 - DNA, 22 bp, Artificial Sequence
  chemically synthesized
accacgcgctacctttcagaaa

SEQ ID NO: 695713 - DNA, 22 bp, Artificial Sequence
  chemically synthesized
ataccctcaattgtaagtcttt

SEQ ID NO: 695714 - DNA, 22 bp, Artificial Sequence
  chemically synthesized
cataccctcaattgtaagtctt

SEQ ID NO: 695715 - DNA, 22 bp, Artificial Sequence
  chemically synthesized
ttcataccctcaattgtaagtc

SEQ ID NO: 695716 - DNA, 22 bp, Artificial Sequence
  chemically synthesized
cctttcagaaagacttacaatt

SEQ ID NO: 695717 - DNA, 22 bp, Artificial Sequence
  chemically synthesized
tcttcataccctcaattgtaag

SEQ ID NO: 695718 - DNA, 22 bp, Artificial Sequence
  chemically synthesized
ctcttcataccctcaattgtaa

SEQ ID NO: 695719 - DNA, 22 bp, Artificial Sequence
  chemically synthesized
tcagaaagacttacaattgagg

SEQ ID NO: 695720 - DNA, 22 bp, Artificial Sequence
  chemically synthesized
cagaaagacttacaattgaggg

SEQ ID NO: 695721 - DNA, 22 bp, Artificial Sequence
  chemically synthesized
agaaagacttacaattgagggt

SEQ ID NO: 695722 - DNA, 22 bp, Artificial Sequence
  chemically synthesized
acaattgagggtatgaagagaa

SEQ ID NO: 695723 - DNA, 22 bp, Artificial Sequence
  chemically synthesized
caattgagggtatgaagagaaa

SEQ ID NO: 695724 - DNA, 22 bp, Artificial Sequence
  chemically synthesized
agggtatgaagagaaacacatt

SEQ ID NO: 695725 - DNA, 22 bp, Artificial Sequence
  chemically synthesized
ataaatgtcatggaatgtgttt

SEQ ID NO: 695726 - DNA, 22 bp, Artificial Sequence
  chemically synthesized
aataaatgtcatggaatgtgtt

SEQ ID NO: 695727 - DNA, 22 bp, Artificial Sequence
  chemically synthesized
catgacatttattaagtatggt

SEQ ID NO: 695728 - DNA, 22 bp, Artificial Sequence
  chemically synthesized
agatagagagtatggccaagac

SEQ ID NO: 695729 - DNA, 22 bp, Artificial Sequence
  chemically synthesized
attaagtatggtcttggccata

SEQ ID NO: 695730 - DNA, 22 bp, Artificial Sequence
  chemically synthesized
ttaagtatggtcttggccatac

SEQ ID NO: 695731 - DNA, 22 bp, Artificial Sequence
  chemically synthesized
cctaagatagagagtatggcca

SEQ ID NO: 695732 - DNA, 22 bp, Artificial Sequence
  chemically synthesized
ccctaagatagagagtatggcc

SEQ ID NO: 695733 - DNA, 22 bp, Artificial Sequence
  chemically synthesized
agtatggtcttggccatactct

SEQ ID NO: 695734 - DNA, 22 bp, Artificial Sequence
  chemically synthesized
catcagggcttccctaagatag

SEQ ID NO: 695735 - DNA, 22 bp, Artificial Sequence
  chemically synthesized
ggccatactctctatcttaggg

SEQ ID NO: 695736 - DNA, 22 bp, Artificial Sequence
  chemically synthesized
gccatactctctatcttaggga

SEQ ID NO: 695737 - DNA, 22 bp, Artificial Sequence
  chemically synthesized
caccacctccatcagggcttcc

SEQ ID NO: 695738 - DNA, 22 bp, Artificial Sequence
  chemically synthesized
tctatcttagggaagccctgat

SEQ ID NO: 695739 - DNA, 22 bp, Artificial Sequence
  chemically synthesized
tatcttagggaagccctgatgg

SEQ ID NO: 695740 - DNA, 22 bp, Artificial Sequence
  chemically synthesized
tcttagggaagccctgatggag

SEQ ID NO: 695741 - DNA, 22 bp, Artificial Sequence
  chemically synthesized
agggaagccctgatggaggtgg

SEQ ID NO: 695742 - DNA, 22 bp, Artificial Sequence
  chemically synthesized
agtcatattccaccacctccat

SEQ ID NO: 695743 - DNA, 22 bp, Artificial Sequence
  chemically synthesized
gggaagccctgatggaggtggt

SEQ ID NO: 695744 - DNA, 22 bp, Artificial Sequence
  chemically synthesized
taagtcatattccaccacctcc

SEQ ID NO: 695745 - DNA, 22 bp, Artificial Sequence
  chemically synthesized
ctaagtcatattccaccacctc

SEQ ID NO: 695746 - DNA, 22 bp, Artificial Sequence
  chemically synthesized
atggaggtggtggaatatgact

SEQ ID NO: 695747 - DNA, 22 bp, Artificial Sequence
  chemically synthesized
agaaatcctttgcttttctgct

SEQ ID NO: 695748 - DNA, 22 bp, Artificial Sequence
  chemically synthesized
gaaatcctttgcttttctgctc

SEQ ID NO: 695749 - DNA, 22 bp, Artificial Sequence
  chemically synthesized
tgcttttctgctccattggtct

SEQ ID NO: 695750 - DNA, 22 bp, Artificial Sequence
  chemically synthesized
gcttttctgctccattggtcta

SEQ ID NO: 695751 - DNA, 22 bp, Artificial Sequence
  chemically synthesized
cttttctgctccattggtctat

SEQ ID NO: 695752 - DNA, 22 bp, Artificial Sequence
  chemically synthesized
ttctgctccattggtctatatg

SEQ ID NO: 695753 - DNA, 22 bp, Artificial Sequence
  chemically synthesized
tctgctccattggtctatatgt

SEQ ID NO: 695754 - DNA, 22 bp, Artificial Sequence
  chemically synthesized
gtaccaaaacagacatatagac

SEQ ID NO: 695755 - DNA, 22 bp, Artificial Sequence
  chemically synthesized
ctgctccattggtctatatgtc

SEQ ID NO: 695756 - DNA, 22 bp, Artificial Sequence
  chemically synthesized
tgctccattggtctatatgtct

SEQ ID NO: 695757 - DNA, 22 bp, Artificial Sequence
  chemically synthesized
ctccattggtctatatgtctgt

SEQ ID NO: 695758 - DNA, 22 bp, Artificial Sequence
  chemically synthesized
cattggtctatatgtctgtttt

SEQ ID NO: 695759 - DNA, 22 bp, Artificial Sequence
  chemically synthesized
gtctatatgtctgttttggtac

SEQ ID NO: 695760 - DNA, 22 bp, Artificial Sequence
  chemically synthesized
tatgtctgttttggtaccagta

SEQ ID NO: 695761 - DNA, 22 bp, Artificial Sequence
  chemically synthesized
ttttggtaccagtaccatgctg

SEQ ID NO: 695762 - DNA, 22 bp, Artificial Sequence
  chemically synthesized
cagtaaccaaaacagcatggta

SEQ ID NO: 695763 - DNA, 22 bp, Artificial Sequence
  chemically synthesized
tggtaccagtaccatgctgttt

SEQ ID NO: 695764 - DNA, 22 bp, Artificial Sequence
  chemically synthesized
ggtaccagtaccatgctgtttt

SEQ ID NO: 695765 - DNA, 22 bp, Artificial Sequence
  chemically synthesized
gtaccagtaccatgctgttttg

SEQ ID NO: 695766 - DNA, 22 bp, Artificial Sequence
  chemically synthesized
caaggctacagtaaccaaaaca

SEQ ID NO: 695767 - DNA, 22 bp, Artificial Sequence
  chemically synthesized
tactacaaggctacagtaacca

SEQ ID NO: 695768 - DNA, 22 bp, Artificial Sequence
  chemically synthesized
aaactatactacaaggctacag

SEQ ID NO: 695769 - DNA, 22 bp, Artificial Sequence
  chemically synthesized
ttttggttactgtagccttgta

SEQ ID NO: 695770 - DNA, 22 bp, Artificial Sequence
  chemically synthesized
aattcaaactatactacaaggc

SEQ ID NO: 695771 - DNA, 22 bp, Artificial Sequence
  chemically synthesized
tggttactgtagccttgtagta

SEQ ID NO: 695772 - DNA, 22 bp, Artificial Sequence
  chemically synthesized
ggttactgtagccttgtagtat

SEQ ID NO: 695773 - DNA, 22 bp, Artificial Sequence
  chemically synthesized
gttactgtagccttgtagtata

SEQ ID NO: 695774 - DNA, 22 bp, Artificial Sequence
  chemically synthesized
ctgtagccttgtagtatagttt

SEQ ID NO: 695775 - DNA, 22 bp, Artificial Sequence
  chemically synthesized
tagccttgtagtatagtttgaa

SEQ ID NO: 695776 - DNA, 22 bp, Artificial Sequence
  chemically synthesized
gtagtatagtttgaattcaggt

SEQ ID NO: 695777 - DNA, 22 bp, Artificial Sequence
  chemically synthesized
tagtatagtttgaattcaggtg

SEQ ID NO: 695778 - DNA, 22 bp, Artificial Sequence
  chemically synthesized
gaggcatcacaccacctgaatt

SEQ ID NO: 695779 - DNA, 22 bp, Artificial Sequence
  chemically synthesized
gaattcaggtggtgtgatgcct

SEQ ID NO: 695780 - DNA, 22 bp, Artificial Sequence
  chemically synthesized
aattcaggtggtgtgatgcctc

SEQ ID NO: 695781 - DNA, 22 bp, Artificial Sequence
  chemically synthesized
aggtggtgtgatgcctctagct

SEQ ID NO: 695782 - DNA, 22 bp, Artificial Sequence
  chemically synthesized
agcaaaaagaacaaagctagag

SEQ ID NO: 695783 - DNA, 22 bp, Artificial Sequence
  chemically synthesized
taagcaaaaagaacaaagctag

SEQ ID NO: 695784 - DNA, 22 bp, Artificial Sequence
  chemically synthesized
tagctttgttctttttgcttag

SEQ ID NO: 695785 - DNA, 22 bp, Artificial Sequence
  chemically synthesized
gctttgttctttttgcttagaa

SEQ ID NO: 695786 - DNA, 22 bp, Artificial Sequence
  chemically synthesized
tgttctttttgcttagaattgt

SEQ ID NO: 695787 - DNA, 22 bp, Artificial Sequence
  chemically synthesized
gttctttttgcttagaattgtc

SEQ ID NO: 695788 - DNA, 22 bp, Artificial Sequence
  chemically synthesized
ttctttttgcttagaattgtct

SEQ ID NO: 695789 - DNA, 22 bp, Artificial Sequence
  chemically synthesized
tttttgcttagaattgtcttgg

SEQ ID NO: 695790 - DNA, 22 bp, Artificial Sequence
  chemically synthesized
tttgcttagaattgtcttggct

SEQ ID NO: 695791 - DNA, 22 bp, Artificial Sequence
  chemically synthesized
ttgcttagaattgtcttggcta

SEQ ID NO: 695792 - DNA, 22 bp, Artificial Sequence
  chemically synthesized
tgcttagaattgtcttggctat

SEQ ID NO: 695793 - DNA, 22 bp, Artificial Sequence
  chemically synthesized
gcttagaattgtcttggctata

SEQ ID NO: 695794 - DNA, 22 bp, Artificial Sequence
  chemically synthesized
cttagaattgtcttggctatac

SEQ ID NO: 695795 - DNA, 22 bp, Artificial Sequence
  chemically synthesized
agaattgtcttggctatacggg

SEQ ID NO: 695796 - DNA, 22 bp, Artificial Sequence
  chemically synthesized
gaattgtcttggctatacgggg

SEQ ID NO: 695797 - DNA, 22 bp, Artificial Sequence
  chemically synthesized
tcttggctatacggggtcttct

SEQ ID NO: 695798 - DNA, 22 bp, Artificial Sequence
  chemically synthesized
atgtggaatcaaagaagacccc

SEQ ID NO: 695799 - DNA, 22 bp, Artificial Sequence
  chemically synthesized
catgtggaatcaaagaagaccc

SEQ ID NO: 695800 - DNA, 22 bp, Artificial Sequence
  chemically synthesized
ggctatacggggtcttctttga

SEQ ID NO: 695801 - DNA, 22 bp, Artificial Sequence
  chemically synthesized
gctatacggggtcttctttgat

SEQ ID NO: 695802 - DNA, 22 bp, Artificial Sequence
  chemically synthesized
aatttcatgtggaatcaaagaa

SEQ ID NO: 695803 - DNA, 22 bp, Artificial Sequence
  chemically synthesized
aaatttcatgtggaatcaaaga

SEQ ID NO: 695804 - DNA, 22 bp, Artificial Sequence
  chemically synthesized
taaatttcatgtggaatcaaag

SEQ ID NO: 695805 - DNA, 22 bp, Artificial Sequence
  chemically synthesized
tacggggtcttctttgattcca

SEQ ID NO: 695806 - DNA, 22 bp, Artificial Sequence
  chemically synthesized
ttttaaatttcatgtggaatca

SEQ ID NO: 695807 - DNA, 22 bp, Artificial Sequence
  chemically synthesized
ctttgattccacatgaaattta

SEQ ID NO: 695808 - DNA, 22 bp, Artificial Sequence
  chemically synthesized
tttgattccacatgaaatttaa

SEQ ID NO: 695809 - DNA, 22 bp, Artificial Sequence
  chemically synthesized
tgattccacatgaaatttaaaa

SEQ ID NO: 695810 - DNA, 22 bp, Artificial Sequence
  chemically synthesized
aaaaaaaaactgttttaaattt

SEQ ID NO: 695811 - DNA, 22 bp, Artificial Sequence
  chemically synthesized
gattccacatgaaatttaaaac

SEQ ID NO: 695812 - DNA, 22 bp, Artificial Sequence
  chemically synthesized
attccacatgaaatttaaaaca

SEQ ID NO: 695813 - DNA, 22 bp, Artificial Sequence
  chemically synthesized
cacatgaaatttaaaacagttt

SEQ ID NO: 695814 - DNA, 22 bp, Artificial Sequence
  chemically synthesized
acagaattaaaaaaaaaactgt

SEQ ID NO: 695815 - DNA, 22 bp, Artificial Sequence
  chemically synthesized
cacagaattaaaaaaaaaactg

SEQ ID NO: 695816 - DNA, 22 bp, Artificial Sequence
  chemically synthesized
ttcacagaattaaaaaaaaaac

SEQ ID NO: 695817 - DNA, 22 bp, Artificial Sequence
  chemically synthesized
cttcacagaattaaaaaaaaaa

SEQ ID NO: 695818 - DNA, 22 bp, Artificial Sequence
  chemically synthesized
aaaacagttttttttttaattc

SEQ ID NO: 695819 - DNA, 22 bp, Artificial Sequence
  chemically synthesized
aaacagttttttttttaattct

SEQ ID NO: 695820 - DNA, 22 bp, Artificial Sequence
  chemically synthesized
ccatgaccttcttcacagaatt

SEQ ID NO: 695821 - DNA, 22 bp, Artificial Sequence
  chemically synthesized
tttttttaattctgtgaagaag

SEQ ID NO: 695822 - DNA, 22 bp, Artificial Sequence
  chemically synthesized
ttttttaattctgtgaagaagg

SEQ ID NO: 695823 - DNA, 22 bp, Artificial Sequence
  chemically synthesized
tttttaattctgtgaagaaggt

SEQ ID NO: 695824 - DNA, 22 bp, Artificial Sequence
  chemically synthesized
ttttaattctgtgaagaaggtc

SEQ ID NO: 695825 - DNA, 22 bp, Artificial Sequence
  chemically synthesized
tttaattctgtgaagaaggtca

SEQ ID NO: 695826 - DNA, 22 bp, Artificial Sequence
  chemically synthesized
ttaattctgtgaagaaggtcat

SEQ ID NO: 695827 - DNA, 22 bp, Artificial Sequence
  chemically synthesized
taattctgtgaagaaggtcatg

SEQ ID NO: 695828 - DNA, 22 bp, Artificial Sequence
  chemically synthesized
ccatcaaactaccatgaccttc

SEQ ID NO: 695829 - DNA, 22 bp, Artificial Sequence
  chemically synthesized
aattctgtgaagaaggtcatgg

SEQ ID NO: 695830 - DNA, 22 bp, Artificial Sequence
  chemically synthesized
attctgtgaagaaggtcatggt

SEQ ID NO: 695831 - DNA, 22 bp, Artificial Sequence
  chemically synthesized
ttcccatcaaactaccatgacc

SEQ ID NO: 695832 - DNA, 22 bp, Artificial Sequence
  chemically synthesized
tgtgaagaaggtcatggtagtt

SEQ ID NO: 695833 - DNA, 22 bp, Artificial Sequence
  chemically synthesized
tgaagaaggtcatggtagtttg

SEQ ID NO: 695834 - DNA, 22 bp, Artificial Sequence
  chemically synthesized
aatgctattcccatcaaactac

SEQ ID NO: 695835 - DNA, 22 bp, Artificial Sequence
  chemically synthesized
tagattcaatgctattcccatc

SEQ ID NO: 695836 - DNA, 22 bp, Artificial Sequence
  chemically synthesized
atagattcaatgctattcccat

SEQ ID NO: 695837 - DNA, 22 bp, Artificial Sequence
  chemically synthesized
gatgggaatagcattgaatcta

SEQ ID NO: 695838 - DNA, 22 bp, Artificial Sequence
  chemically synthesized
atgggaatagcattgaatctat

SEQ ID NO: 695839 - DNA, 22 bp, Artificial Sequence
  chemically synthesized
cccaaagtaatttatagattca

SEQ ID NO: 695840 - DNA, 22 bp, Artificial Sequence
  chemically synthesized
tactgcccaaagtaatttatag

SEQ ID NO: 695841 - DNA, 22 bp, Artificial Sequence
  chemically synthesized
aatctataaattactttgggca

SEQ ID NO: 695842 - DNA, 22 bp, Artificial Sequence
  chemically synthesized
taaattactttgggcagtataa

SEQ ID NO: 695843 - DNA, 22 bp, Artificial Sequence
  chemically synthesized
ctttgggcagtataaccatttt

SEQ ID NO: 695844 - DNA, 22 bp, Artificial Sequence
  chemically synthesized
tgggcagtataaccattttcac

SEQ ID NO: 695845 - DNA, 22 bp, Artificial Sequence
  chemically synthesized
gggcagtataaccattttcacg

SEQ ID NO: 695846 - DNA, 22 bp, Artificial Sequence
  chemically synthesized
ggcagtataaccattttcacga

SEQ ID NO: 695847 - DNA, 22 bp, Artificial Sequence
  chemically synthesized
atggataggaagaatcaatatc

SEQ ID NO: 695848 - DNA, 22 bp, Artificial Sequence
  chemically synthesized
catggataggaagaatcaatat

SEQ ID NO: 695849 - DNA, 22 bp, Artificial Sequence
  chemically synthesized
tcatggataggaagaatcaata

SEQ ID NO: 695850 - DNA, 22 bp, Artificial Sequence
  chemically synthesized
tcacgatattgattcttcctat

SEQ ID NO: 695851 - DNA, 22 bp, Artificial Sequence
  chemically synthesized
cacgatattgattcttcctatc

SEQ ID NO: 695852 - DNA, 22 bp, Artificial Sequence
  chemically synthesized
aggtctttcatggataggaaga

SEQ ID NO: 695853 - DNA, 22 bp, Artificial Sequence
  chemically synthesized
acgatattgattcttcctatcc

SEQ ID NO: 695854 - DNA, 22 bp, Artificial Sequence
  chemically synthesized
tgaggtctttcatggataggaa

SEQ ID NO: 695855 - DNA, 22 bp, Artificial Sequence
  chemically synthesized
ctgaggtctttcatggatagga

SEQ ID NO: 695856 - DNA, 22 bp, Artificial Sequence
  chemically synthesized
tttctgaggtctttcatggata

SEQ ID NO: 695857 - DNA, 22 bp, Artificial Sequence
  chemically synthesized
attcttcctatccatgaaagac

SEQ ID NO: 695858 - DNA, 22 bp, Artificial Sequence
  chemically synthesized
ttcctatccatgaaagacctca

SEQ ID NO: 695859 - DNA, 22 bp, Artificial Sequence
  chemically synthesized
cctatccatgaaagacctcaga

SEQ ID NO: 695860 - DNA, 22 bp, Artificial Sequence
  chemically synthesized
ctatccatgaaagacctcagaa

SEQ ID NO: 695861 - DNA, 22 bp, Artificial Sequence
  chemically synthesized
tccatgaaagacctcagaaata

SEQ ID NO: 695862 - DNA, 22 bp, Artificial Sequence
  chemically synthesized
tagatgtgtggtattatttctg

SEQ ID NO: 695863 - DNA, 22 bp, Artificial Sequence
  chemically synthesized
gtagatgtgtggtattatttct

SEQ ID NO: 695864 - DNA, 22 bp, Artificial Sequence
  chemically synthesized
agaaataataccacacatctac

SEQ ID NO: 695865 - DNA, 22 bp, Artificial Sequence
  chemically synthesized
tcaaagatcagatgtttgtaga

SEQ ID NO: 695866 - DNA, 22 bp, Artificial Sequence
  chemically synthesized
atcaaagatcagatgtttgtag

SEQ ID NO: 695867 - DNA, 22 bp, Artificial Sequence
  chemically synthesized
tcaggtttatcaaagatcagat

SEQ ID NO: 695868 - DNA, 22 bp, Artificial Sequence
  chemically synthesized
gtcaggtttatcaaagatcaga

SEQ ID NO: 695869 - DNA, 22 bp, Artificial Sequence
  chemically synthesized
tgtcaggtttatcaaagatcag

SEQ ID NO: 695870 - DNA, 22 bp, Artificial Sequence
  chemically synthesized
ttgtcaggtttatcaaagatca

SEQ ID NO: 695871 - DNA, 22 bp, Artificial Sequence
  chemically synthesized
tttttgtcaggtttatcaaaga

SEQ ID NO: 695872 - DNA, 22 bp, Artificial Sequence
  chemically synthesized
caaacatctgatctttgataaa

SEQ ID NO: 695873 - DNA, 22 bp, Artificial Sequence
  chemically synthesized
gtttttgtcaggtttatcaaag

SEQ ID NO: 695874 - DNA, 22 bp, Artificial Sequence
  chemically synthesized
cttgtttttgtcaggtttatca

SEQ ID NO: 695875 - DNA, 22 bp, Artificial Sequence
  chemically synthesized
atctttgataaacctgacaaaa

SEQ ID NO: 695876 - DNA, 22 bp, Artificial Sequence
  chemically synthesized
cccattgcttgtttttgtcagg

SEQ ID NO: 695877 - DNA, 22 bp, Artificial Sequence
  chemically synthesized
ccccattgcttgtttttgtcag

SEQ ID NO: 695878 - DNA, 22 bp, Artificial Sequence
  chemically synthesized
tccccattgcttgtttttgtca

SEQ ID NO: 695879 - DNA, 22 bp, Artificial Sequence
  chemically synthesized
tgataaacctgacaaaaacaag

SEQ ID NO: 695880 - DNA, 22 bp, Artificial Sequence
  chemically synthesized
gataaacctgacaaaaacaagc

SEQ ID NO: 695881 - DNA, 22 bp, Artificial Sequence
  chemically synthesized
ataaacctgacaaaaacaagca

SEQ ID NO: 695882 - DNA, 22 bp, Artificial Sequence
  chemically synthesized
acaaaaacaagcaatggggaaa

SEQ ID NO: 695883 - DNA, 22 bp, Artificial Sequence
  chemically synthesized
aataggagatcctttccccatt

SEQ ID NO: 695884 - DNA, 22 bp, Artificial Sequence
  chemically synthesized
ctgaataggagatcctttcccc

SEQ ID NO: 695885 - DNA, 22 bp, Artificial Sequence
  chemically synthesized
actgaataggagatcctttccc

SEQ ID NO: 695886 - DNA, 22 bp, Artificial Sequence
  chemically synthesized
ccagcaccgtttactgaatagg

SEQ ID NO: 695887 - DNA, 22 bp, Artificial Sequence
  chemically synthesized
cccagcaccgtttactgaatag

SEQ ID NO: 695888 - DNA, 22 bp, Artificial Sequence
  chemically synthesized
tcccagcaccgtttactgaata

SEQ ID NO: 695889 - DNA, 22 bp, Artificial Sequence
  chemically synthesized
gagagttttcccagcaccgttt

SEQ ID NO: 695890 - DNA, 22 bp, Artificial Sequence
  chemically synthesized
ctattcagtaaacggtgctggg

SEQ ID NO: 695891 - DNA, 22 bp, Artificial Sequence
  chemically synthesized
ttcagtaaacggtgctgggaaa

SEQ ID NO: 695892 - DNA, 22 bp, Artificial Sequence
  chemically synthesized
agtaaacggtgctgggaaaact

SEQ ID NO: 695893 - DNA, 22 bp, Artificial Sequence
  chemically synthesized
catatggctagagagttttccc

SEQ ID NO: 695894 - DNA, 22 bp, Artificial Sequence
  chemically synthesized
tgcatatggctagagagttttc

SEQ ID NO: 695895 - DNA, 22 bp, Artificial Sequence
  chemically synthesized
ctgcatatggctagagagtttt

SEQ ID NO: 695896 - DNA, 22 bp, Artificial Sequence
  chemically synthesized
tctgcatatggctagagagttt

SEQ ID NO: 695897 - DNA, 22 bp, Artificial Sequence
  chemically synthesized
ttttctgcatatggctagagag

SEQ ID NO: 695898 - DNA, 22 bp, Artificial Sequence
  chemically synthesized
tgttttctgcatatggctagag

SEQ ID NO: 695899 - DNA, 22 bp, Artificial Sequence
  chemically synthesized
ctgttttctgcatatggctaga

SEQ ID NO: 695900 - DNA, 22 bp, Artificial Sequence
  chemically synthesized
ggaaaactctctagccatatgc

SEQ ID NO: 695901 - DNA, 22 bp, Artificial Sequence
  chemically synthesized
tctagccatatgcagaaaacag

SEQ ID NO: 695902 - DNA, 22 bp, Artificial Sequence
  chemically synthesized
tagccatatgcagaaaacagaa

SEQ ID NO: 695903 - DNA, 22 bp, Artificial Sequence
  chemically synthesized
gccatatgcagaaaacagaaac

SEQ ID NO: 695904 - DNA, 22 bp, Artificial Sequence
  chemically synthesized
taagggaggggtccagtttctg

SEQ ID NO: 695905 - DNA, 22 bp, Artificial Sequence
  chemically synthesized
tgtaagctgtaagggaggggtc

SEQ ID NO: 695906 - DNA, 22 bp, Artificial Sequence
  chemically synthesized
gtgtaagctgtaagggaggggt

SEQ ID NO: 695907 - DNA, 22 bp, Artificial Sequence
  chemically synthesized
tgtgtaagctgtaagggagggg

SEQ ID NO: 695908 - DNA, 22 bp, Artificial Sequence
  chemically synthesized
ttgtgtaagctgtaagggaggg

SEQ ID NO: 695909 - DNA, 22 bp, Artificial Sequence
  chemically synthesized
atttttgtgtaagctgtaaggg

SEQ ID NO: 695910 - DNA, 22 bp, Artificial Sequence
  chemically synthesized
gacccctcccttacagcttaca

SEQ ID NO: 695911 - DNA, 22 bp, Artificial Sequence
  chemically synthesized
agttaatttttgtgtaagctgt

SEQ ID NO: 695912 - DNA, 22 bp, Artificial Sequence
  chemically synthesized
gagttaatttttgtgtaagctg

SEQ ID NO: 695913 - DNA, 22 bp, Artificial Sequence
  chemically synthesized
ccttacagcttacacaaaaatt

SEQ ID NO: 695914 - DNA, 22 bp, Artificial Sequence
  chemically synthesized
atccatcttgagttaatttttg

SEQ ID NO: 695915 - DNA, 22 bp, Artificial Sequence
  chemically synthesized
aatccatcttgagttaattttt

SEQ ID NO: 695916 - DNA, 22 bp, Artificial Sequence
  chemically synthesized
acagcttacacaaaaattaact

SEQ ID NO: 695917 - DNA, 22 bp, Artificial Sequence
  chemically synthesized
taatccatcttgagttaatttt

SEQ ID NO: 695918 - DNA, 22 bp, Artificial Sequence
  chemically synthesized
cagcttacacaaaaattaactc

SEQ ID NO: 695919 - DNA, 22 bp, Artificial Sequence
  chemically synthesized
agtctttaatccatcttgagtt

SEQ ID NO: 695920 - DNA, 22 bp, Artificial Sequence
  chemically synthesized
acacaaaaattaactcaagatg

SEQ ID NO: 695921 - DNA, 22 bp, Artificial Sequence
  chemically synthesized
aagtctttaatccatcttgagt

SEQ ID NO: 695922 - DNA, 22 bp, Artificial Sequence
  chemically synthesized
cacaaaaattaactcaagatgg

SEQ ID NO: 695923 - DNA, 22 bp, Artificial Sequence
  chemically synthesized
catttaagtctttaatccatct

SEQ ID NO: 695924 - DNA, 22 bp, Artificial Sequence
  chemically synthesized
acatttaagtctttaatccatc

SEQ ID NO: 695925 - DNA, 22 bp, Artificial Sequence
  chemically synthesized
tacatttaagtctttaatccat

SEQ ID NO: 695926 - DNA, 22 bp, Artificial Sequence
  chemically synthesized
actcaagatggattaaagactt

SEQ ID NO: 695927 - DNA, 22 bp, Artificial Sequence
  chemically synthesized
gggttttacatttaagtcttta

SEQ ID NO: 695928 - DNA, 22 bp, Artificial Sequence
  chemically synthesized
ggggttttacatttaagtcttt

SEQ ID NO: 695929 - DNA, 22 bp, Artificial Sequence
  chemically synthesized
aagatggattaaagacttaaat

SEQ ID NO: 695930 - DNA, 22 bp, Artificial Sequence
  chemically synthesized
ggatttggggttttacatttaa

SEQ ID NO: 695931 - DNA, 22 bp, Artificial Sequence
  chemically synthesized
aggatttggggttttacattta

SEQ ID NO: 695932 - DNA, 22 bp, Artificial Sequence
  chemically synthesized
taggatttggggttttacattt

SEQ ID NO: 695933 - DNA, 22 bp, Artificial Sequence
  chemically synthesized
ttaggatttggggttttacatt

SEQ ID NO: 695934 - DNA, 22 bp, Artificial Sequence
  chemically synthesized
aagacttaaatgtaaaacccca

SEQ ID NO: 695935 - DNA, 22 bp, Artificial Sequence
  chemically synthesized
gggtttttaggatttggggttt

SEQ ID NO: 695936 - DNA, 22 bp, Artificial Sequence
  chemically synthesized
tagggtttttaggatttggggt

SEQ ID NO: 695937 - DNA, 22 bp, Artificial Sequence
  chemically synthesized
ctagggtttttaggatttgggg

SEQ ID NO: 695938 - DNA, 22 bp, Artificial Sequence
  chemically synthesized
aaatgtaaaaccccaaatccta

SEQ ID NO: 695939 - DNA, 22 bp, Artificial Sequence
  chemically synthesized
aatgtaaaaccccaaatcctaa

SEQ ID NO: 695940 - DNA, 22 bp, Artificial Sequence
  chemically synthesized
cttctagggtttttaggatttg

SEQ ID NO: 695941 - DNA, 22 bp, Artificial Sequence
  chemically synthesized
ccttctagggtttttaggattt

SEQ ID NO: 695942 - DNA, 22 bp, Artificial Sequence
  chemically synthesized
ggtttccttctagggtttttag

SEQ ID NO: 695943 - DNA, 22 bp, Artificial Sequence
  chemically synthesized
cctaggtttccttctagggttt

SEQ ID NO: 695944 - DNA, 22 bp, Artificial Sequence
  chemically synthesized
aatggtattgcctaggtttcct

SEQ ID NO: 695945 - DNA, 22 bp, Artificial Sequence
  chemically synthesized
aaaaccctagaaggaaacctag

SEQ ID NO: 695946 - DNA, 22 bp, Artificial Sequence
  chemically synthesized
aaatggtattgcctaggtttcc

SEQ ID NO: 695947 - DNA, 22 bp, Artificial Sequence
  chemically synthesized
tgtcttaaatggtattgcctag

SEQ ID NO: 695948 - DNA, 22 bp, Artificial Sequence
  chemically synthesized
gaaggaaacctaggcaatacca

SEQ ID NO: 695949 - DNA, 22 bp, Artificial Sequence
  chemically synthesized
cccatgcctatgtcttaaatgg

SEQ ID NO: 695950 - DNA, 22 bp, Artificial Sequence
  chemically synthesized
gcccatgcctatgtcttaaatg

SEQ ID NO: 695951 - DNA, 22 bp, Artificial Sequence
  chemically synthesized
tgcccatgcctatgtcttaaat

SEQ ID NO: 695952 - DNA, 22 bp, Artificial Sequence
  chemically synthesized
ggcaataccatttaagacatag

SEQ ID NO: 695953 - DNA, 22 bp, Artificial Sequence
  chemically synthesized
tcatgaagtctttgcccatgcc

SEQ ID NO: 695954 - DNA, 22 bp, Artificial Sequence
  chemically synthesized
gtcatgaagtctttgcccatgc

SEQ ID NO: 695955 - DNA, 22 bp, Artificial Sequence
  chemically synthesized
tgtcatgaagtctttgcccatg

SEQ ID NO: 695956 - DNA, 22 bp, Artificial Sequence
  chemically synthesized
ttgtcatgaagtctttgcccat

SEQ ID NO: 695957 - DNA, 22 bp, Artificial Sequence
  chemically synthesized
aagacataggcatgggcaaaga

SEQ ID NO: 695958 - DNA, 22 bp, Artificial Sequence
  chemically synthesized
agacataggcatgggcaaagac

SEQ ID NO: 695959 - DNA, 22 bp, Artificial Sequence
  chemically synthesized
gcgtttttgtcatgaagtcttt

SEQ ID NO: 695960 - DNA, 22 bp, Artificial Sequence
  chemically synthesized
ggcgtttttgtcatgaagtctt

SEQ ID NO: 695961 - DNA, 22 bp, Artificial Sequence
  chemically synthesized
tggcgtttttgtcatgaagtct

SEQ ID NO: 695962 - DNA, 22 bp, Artificial Sequence
  chemically synthesized
ttggcgtttttgtcatgaagtc

SEQ ID NO: 695963 - DNA, 22 bp, Artificial Sequence
  chemically synthesized
cttttggcgtttttgtcatgaa

SEQ ID NO: 695964 - DNA, 22 bp, Artificial Sequence
  chemically synthesized
cagttgcttttggcgtttttgt

SEQ ID NO: 695965 - DNA, 22 bp, Artificial Sequence
  chemically synthesized
ttgcagttgcttttggcgtttt

SEQ ID NO: 695966 - DNA, 22 bp, Artificial Sequence
  chemically synthesized
gttgcagttgcttttggcgttt

SEQ ID NO: 695967 - DNA, 22 bp, Artificial Sequence
  chemically synthesized
tgttgcagttgcttttggcgtt

SEQ ID NO: 695968 - DNA, 22 bp, Artificial Sequence
  chemically synthesized
ttgttgcagttgcttttggcgt

SEQ ID NO: 695969 - DNA, 22 bp, Artificial Sequence
  chemically synthesized
catgacaaaaacgccaaaagca

SEQ ID NO: 695970 - DNA, 22 bp, Artificial Sequence
  chemically synthesized
atgacaaaaacgccaaaagcaa

SEQ ID NO: 695971 - DNA, 22 bp, Artificial Sequence
  chemically synthesized
tcttttgttgcagttgcttttg

SEQ ID NO: 695972 - DNA, 22 bp, Artificial Sequence
  chemically synthesized
gtcttttgttgcagttgctttt

SEQ ID NO: 695973 - DNA, 22 bp, Artificial Sequence
  chemically synthesized
tgtcttttgttgcagttgcttt

SEQ ID NO: 695974 - DNA, 22 bp, Artificial Sequence
  chemically synthesized
aattttgtcttttgttgcagtt

SEQ ID NO: 695975 - DNA, 22 bp, Artificial Sequence
  chemically synthesized
tcaattttgtcttttgttgcag

SEQ ID NO: 695976 - DNA, 22 bp, Artificial Sequence
  chemically synthesized
ctcaattttgtcttttgttgca

SEQ ID NO: 695977 - DNA, 22 bp, Artificial Sequence
  chemically synthesized
catttctcaattttgtcttttg

SEQ ID NO: 695978 - DNA, 22 bp, Artificial Sequence
  chemically synthesized
gattccatttctcaattttgtc

SEQ ID NO: 695979 - DNA, 22 bp, Artificial Sequence
  chemically synthesized
caacaaaagacaaaattgagaa

SEQ ID NO: 695980 - DNA, 22 bp, Artificial Sequence
  chemically synthesized
attagattccatttctcaattt

SEQ ID NO: 695981 - DNA, 22 bp, Artificial Sequence
  chemically synthesized
aattagattccatttctcaatt

SEQ ID NO: 695982 - DNA, 22 bp, Artificial Sequence
  chemically synthesized
gtttaattagattccatttctc

SEQ ID NO: 695983 - DNA, 22 bp, Artificial Sequence
  chemically synthesized
agtttaattagattccatttct

SEQ ID NO: 695984 - DNA, 22 bp, Artificial Sequence
  chemically synthesized
tagtttaattagattccatttc

SEQ ID NO: 695985 - DNA, 22 bp, Artificial Sequence
  chemically synthesized
tttagtttaattagattccatt

SEQ ID NO: 695986 - DNA, 22 bp, Artificial Sequence
  chemically synthesized
agaaatggaatctaattaaact

SEQ ID NO: 695987 - DNA, 22 bp, Artificial Sequence
  chemically synthesized
tgcagaagctctttagtttaat

SEQ ID NO: 695988 - DNA, 22 bp, Artificial Sequence
  chemically synthesized
ctgtgcagaagctctttagttt

SEQ ID NO: 695989 - DNA, 22 bp, Artificial Sequence
  chemically synthesized
gctgtgcagaagctctttagtt

SEQ ID NO: 695990 - DNA, 22 bp, Artificial Sequence
  chemically synthesized
tgctgtgcagaagctctttagt

SEQ ID NO: 695991 - DNA, 22 bp, Artificial Sequence
  chemically synthesized
ttgctgtgcagaagctctttag

SEQ ID NO: 695992 - DNA, 22 bp, Artificial Sequence
  chemically synthesized
ttttgctgtgcagaagctcttt

SEQ ID NO: 695993 - DNA, 22 bp, Artificial Sequence
  chemically synthesized
cttttgctgtgcagaagctctt

SEQ ID NO: 695994 - DNA, 22 bp, Artificial Sequence
  chemically synthesized
attaaactaaagagcttctgca

SEQ ID NO: 695995 - DNA, 22 bp, Artificial Sequence
  chemically synthesized
aactaaagagcttctgcacagc

SEQ ID NO: 695996 - DNA, 22 bp, Artificial Sequence
  chemically synthesized
atgatagtttcttttgctgtgc

SEQ ID NO: 695997 - DNA, 22 bp, Artificial Sequence
  chemically synthesized
gatgatagtttcttttgctgtg

SEQ ID NO: 695998 - DNA, 22 bp, Artificial Sequence
  chemically synthesized
aagagcttctgcacagcaaaag

SEQ ID NO: 695999 - DNA, 22 bp, Artificial Sequence
  chemically synthesized
tgatgatagtttcttttgctgt

SEQ ID NO: 696000 - DNA, 22 bp, Artificial Sequence
  chemically synthesized
actttgatgatagtttcttttg

SEQ ID NO: 696001 - DNA, 22 bp, Artificial Sequence
  chemically synthesized
ttcactttgatgatagtttctt

SEQ ID NO: 696002 - DNA, 22 bp, Artificial Sequence
  chemically synthesized
ctgcacagcaaaagaaactatc

SEQ ID NO: 696003 - DNA, 22 bp, Artificial Sequence
  chemically synthesized
tgcacagcaaaagaaactatca

SEQ ID NO: 696004 - DNA, 22 bp, Artificial Sequence
  chemically synthesized
cacagcaaaagaaactatcatc

SEQ ID NO: 696005 - DNA, 22 bp, Artificial Sequence
  chemically synthesized
cctattcactttgatgatagtt

SEQ ID NO: 696006 - DNA, 22 bp, Artificial Sequence
  chemically synthesized
taggttgcctattcactttgat

SEQ ID NO: 696007 - DNA, 22 bp, Artificial Sequence
  chemically synthesized
tgtaggttgcctattcactttg

SEQ ID NO: 696008 - DNA, 22 bp, Artificial Sequence
  chemically synthesized
ccattctgtaggttgcctattc

SEQ ID NO: 696009 - DNA, 22 bp, Artificial Sequence
  chemically synthesized
cccattctgtaggttgcctatt

SEQ ID NO: 696010 - DNA, 22 bp, Artificial Sequence
  chemically synthesized
tcatcaaagtgaataggcaacc

SEQ ID NO: 696011 - DNA, 22 bp, Artificial Sequence
  chemically synthesized
tcccattctgtaggttgcctat

SEQ ID NO: 696012 - DNA, 22 bp, Artificial Sequence
  chemically synthesized
aaaaaatgttttcccattctgt

SEQ ID NO: 696013 - DNA, 22 bp, Artificial Sequence
  chemically synthesized
cagaatgggaaaacattttttc

SEQ ID NO: 696014 - DNA, 22 bp, Artificial Sequence
  chemically synthesized
tcagatgggtagattgaaaaaa

SEQ ID NO: 696015 - DNA, 22 bp, Artificial Sequence
  chemically synthesized
gtcagatgggtagattgaaaaa

SEQ ID NO: 696016 - DNA, 22 bp, Artificial Sequence
  chemically synthesized
tgtcagatgggtagattgaaaa

SEQ ID NO: 696017 - DNA, 22 bp, Artificial Sequence
  chemically synthesized
gacctttgtcagatgggtagat

SEQ ID NO: 696018 - DNA, 22 bp, Artificial Sequence
  chemically synthesized
tttcaatctacccatctgacaa

SEQ ID NO: 696019 - DNA, 22 bp, Artificial Sequence
  chemically synthesized
gatattagacctttgtcagatg

SEQ ID NO: 696020 - DNA, 22 bp, Artificial Sequence
  chemically synthesized
ttcaatctacccatctgacaaa

SEQ ID NO: 696021 - DNA, 22 bp, Artificial Sequence
  chemically synthesized
tcaatctacccatctgacaaag

SEQ ID NO: 696022 - DNA, 22 bp, Artificial Sequence
  chemically synthesized
tggatattagacctttgtcaga

SEQ ID NO: 696023 - DNA, 22 bp, Artificial Sequence
  chemically synthesized
caatctacccatctgacaaagg

SEQ ID NO: 696024 - DNA, 22 bp, Artificial Sequence
  chemically synthesized
aatctacccatctgacaaaggt

SEQ ID NO: 696025 - DNA, 22 bp, Artificial Sequence
  chemically synthesized
taaattctggatattagacctt

SEQ ID NO: 696026 - DNA, 22 bp, Artificial Sequence
  chemically synthesized
cccatctgacaaaggtctaata

SEQ ID NO: 696027 - DNA, 22 bp, Artificial Sequence
  chemically synthesized
gtaaattctggatattagacct

SEQ ID NO: 696028 - DNA, 22 bp, Artificial Sequence
  chemically synthesized
cttgtaaattctggatattaga

SEQ ID NO: 696029 - DNA, 22 bp, Artificial Sequence
  chemically synthesized
acaaaggtctaatatccagaat

SEQ ID NO: 696030 - DNA, 22 bp, Artificial Sequence
  chemically synthesized
agttccttgtaaattctggata

SEQ ID NO: 696031 - DNA, 22 bp, Artificial Sequence
  chemically synthesized
aagttccttgtaaattctggat

SEQ ID NO: 696032 - DNA, 22 bp, Artificial Sequence
  chemically synthesized
atatccagaatttacaaggaac

SEQ ID NO: 696033 - DNA, 22 bp, Artificial Sequence
  chemically synthesized
tgaatatgtttaagttccttgt

SEQ ID NO: 696034 - DNA, 22 bp, Artificial Sequence
  chemically synthesized
gtgaatatgtttaagttccttg

SEQ ID NO: 696035 - DNA, 22 bp, Artificial Sequence
  chemically synthesized
ttgtgaatatgtttaagttcct

SEQ ID NO: 696036 - DNA, 22 bp, Artificial Sequence
  chemically synthesized
cttgtgaatatgtttaagttcc

SEQ ID NO: 696037 - DNA, 22 bp, Artificial Sequence
  chemically synthesized
tcttgtgaatatgtttaagttc

SEQ ID NO: 696038 - DNA, 22 bp, Artificial Sequence
  chemically synthesized
ttcttgtgaatatgtttaagtt

SEQ ID NO: 696039 - DNA, 22 bp, Artificial Sequence
  chemically synthesized
tttcttgtgaatatgtttaagt

SEQ ID NO: 696040 - DNA, 22 bp, Artificial Sequence
  chemically synthesized
tctttttcttgtgaatatgttt

SEQ ID NO: 696041 - DNA, 22 bp, Artificial Sequence
  chemically synthesized
acaaggaacttaaacatattca

SEQ ID NO: 696042 - DNA, 22 bp, Artificial Sequence
  chemically synthesized
gtctttttcttgtgaatatgtt

SEQ ID NO: 696043 - DNA, 22 bp, Artificial Sequence
  chemically synthesized
caaggaacttaaacatattcac

SEQ ID NO: 696044 - DNA, 22 bp, Artificial Sequence
  chemically synthesized
tttgtctttttcttgtgaatat

SEQ ID NO: 696045 - DNA, 22 bp, Artificial Sequence
  chemically synthesized
aaacatattcacaagaaaaaga

SEQ ID NO: 696046 - DNA, 22 bp, Artificial Sequence
  chemically synthesized
aacatattcacaagaaaaagac

SEQ ID NO: 696047 - DNA, 22 bp, Artificial Sequence
  chemically synthesized
atagggttgtttgtctttttct

SEQ ID NO: 696048 - DNA, 22 bp, Artificial Sequence
  chemically synthesized
gatagggttgtttgtctttttc

SEQ ID NO: 696049 - DNA, 22 bp, Artificial Sequence
  chemically synthesized
tgatagggttgtttgtcttttt

SEQ ID NO: 696050 - DNA, 22 bp, Artificial Sequence
  chemically synthesized
ttgatagggttgtttgtctttt

SEQ ID NO: 696051 - DNA, 22 bp, Artificial Sequence
  chemically synthesized
tttgatagggttgtttgtcttt

SEQ ID NO: 696052 - DNA, 22 bp, Artificial Sequence
  chemically synthesized
acaagaaaaagacaaacaaccc

SEQ ID NO: 696053 - DNA, 22 bp, Artificial Sequence
  chemically synthesized
cccactttttgatagggttgtt

SEQ ID NO: 696054 - DNA, 22 bp, Artificial Sequence
  chemically synthesized
gcccactttttgatagggttgt

SEQ ID NO: 696055 - DNA, 22 bp, Artificial Sequence
  chemically synthesized
tgcccactttttgatagggttg

SEQ ID NO: 696056 - DNA, 22 bp, Artificial Sequence
  chemically synthesized
atatcctttgcccactttttga

SEQ ID NO: 696057 - DNA, 22 bp, Artificial Sequence
  chemically synthesized
ttcatatcctttgcccactttt

SEQ ID NO: 696058 - DNA, 22 bp, Artificial Sequence
  chemically synthesized
tcaaaaagtgggcaaaggatat

SEQ ID NO: 696059 - DNA, 22 bp, Artificial Sequence
  chemically synthesized
agaagtgtctgttcatatcctt

SEQ ID NO: 696060 - DNA, 22 bp, Artificial Sequence
  chemically synthesized
gagaagtgtctgttcatatcct

SEQ ID NO: 696061 - DNA, 22 bp, Artificial Sequence
  chemically synthesized
tgagaagtgtctgttcatatcc

SEQ ID NO: 696062 - DNA, 22 bp, Artificial Sequence
  chemically synthesized
ttgagaagtgtctgttcatatc

SEQ ID NO: 696063 - DNA, 22 bp, Artificial Sequence
  chemically synthesized
ttttgagaagtgtctgttcata

SEQ ID NO: 696064 - DNA, 22 bp, Artificial Sequence
  chemically synthesized
cttttgagaagtgtctgttcat

SEQ ID NO: 696065 - DNA, 22 bp, Artificial Sequence
  chemically synthesized
gccatgtaaatgtcttcttttg

SEQ ID NO: 696066 - DNA, 22 bp, Artificial Sequence
  chemically synthesized
ttggccatgtaaatgtcttctt

SEQ ID NO: 696067 - DNA, 22 bp, Artificial Sequence
  chemically synthesized
gttggccatgtaaatgtcttct

SEQ ID NO: 696068 - DNA, 22 bp, Artificial Sequence
  chemically synthesized
ctcaaaagaagacatttacatg

SEQ ID NO: 696069 - DNA, 22 bp, Artificial Sequence
  chemically synthesized
tcaaaagaagacatttacatgg

SEQ ID NO: 696070 - DNA, 22 bp, Artificial Sequence
  chemically synthesized
atatgtttgttggccatgtaaa

SEQ ID NO: 696071 - DNA, 22 bp, Artificial Sequence
  chemically synthesized
aaaagaagacatttacatggcc

SEQ ID NO: 696072 - DNA, 22 bp, Artificial Sequence
  chemically synthesized
catatgtttgttggccatgtaa

SEQ ID NO: 696073 - DNA, 22 bp, Artificial Sequence
  chemically synthesized
tcatatgtttgttggccatgta

SEQ ID NO: 696074 - DNA, 22 bp, Artificial Sequence
  chemically synthesized
ttcatatgtttgttggccatgt

SEQ ID NO: 696075 - DNA, 22 bp, Artificial Sequence
  chemically synthesized
tttcatatgtttgttggccatg

SEQ ID NO: 696076 - DNA, 22 bp, Artificial Sequence
  chemically synthesized
ttttcatatgtttgttggccat

SEQ ID NO: 696077 - DNA, 22 bp, Artificial Sequence
  chemically synthesized
tttttcatatgtttgttggcca

SEQ ID NO: 696078 - DNA, 22 bp, Artificial Sequence
  chemically synthesized
agctttttttcatatgtttgtt

SEQ ID NO: 696079 - DNA, 22 bp, Artificial Sequence
  chemically synthesized
acatggccaacaaacatatgaa

SEQ ID NO: 696080 - DNA, 22 bp, Artificial Sequence
  chemically synthesized
catggccaacaaacatatgaaa

SEQ ID NO: 696081 - DNA, 22 bp, Artificial Sequence
  chemically synthesized
atgatcagtgatgttgagcttt

SEQ ID NO: 696082 - DNA, 22 bp, Artificial Sequence
  chemically synthesized
tgatgatcagtgatgttgagct

SEQ ID NO: 696083 - DNA, 22 bp, Artificial Sequence
  chemically synthesized
tctgatgatcagtgatgttgag

SEQ ID NO: 696084 - DNA, 22 bp, Artificial Sequence
  chemically synthesized
ctctgatgatcagtgatgttga

SEQ ID NO: 696085 - DNA, 22 bp, Artificial Sequence
  chemically synthesized
catttctctgatgatcagtgat

SEQ ID NO: 696086 - DNA, 22 bp, Artificial Sequence
  chemically synthesized
gcatttctctgatgatcagtga

SEQ ID NO: 696087 - DNA, 22 bp, Artificial Sequence
  chemically synthesized
atttgcatttctctgatgatca

SEQ ID NO: 696088 - DNA, 22 bp, Artificial Sequence
  chemically synthesized
catttgcatttctctgatgatc

SEQ ID NO: 696089 - DNA, 22 bp, Artificial Sequence
  chemically synthesized
tcatttgcatttctctgatgat

SEQ ID NO: 696090 - DNA, 22 bp, Artificial Sequence
  chemically synthesized
aacatcactgatcatcagagaa

SEQ ID NO: 696091 - DNA, 22 bp, Artificial Sequence
  chemically synthesized
tggttttcatttgcatttctct

SEQ ID NO: 696092 - DNA, 22 bp, Artificial Sequence
  chemically synthesized
attgtggttttcatttgcattt

SEQ ID NO: 696093 - DNA, 22 bp, Artificial Sequence
  chemically synthesized
atcatcagagaaatgcaaatga

SEQ ID NO: 696094 - DNA, 22 bp, Artificial Sequence
  chemically synthesized
gtgtgagatggtatctcattgt

SEQ ID NO: 696095 - DNA, 22 bp, Artificial Sequence
  chemically synthesized
actggtgtgagatggtatctca

SEQ ID NO: 696096 - DNA, 22 bp, Artificial Sequence
  chemically synthesized
tgactggtgtgagatggtatct

SEQ ID NO: 696097 - DNA, 22 bp, Artificial Sequence
  chemically synthesized
ataatcaccattctgactggtg

SEQ ID NO: 696098 - DNA, 22 bp, Artificial Sequence
  chemically synthesized
aataatcaccattctgactggt

SEQ ID NO: 696099 - DNA, 22 bp, Artificial Sequence
  chemically synthesized
taataatcaccattctgactgg

SEQ ID NO: 696100 - DNA, 22 bp, Artificial Sequence
  chemically synthesized
ttaataatcaccattctgactg

SEQ ID NO: 696101 - DNA, 22 bp, Artificial Sequence
  chemically synthesized
tttaataatcaccattctgact

SEQ ID NO: 696102 - DNA, 22 bp, Artificial Sequence
  chemically synthesized
actttttaataatcaccattct

SEQ ID NO: 696103 - DNA, 22 bp, Artificial Sequence
  chemically synthesized
acaccagtcagaatggtgatta

SEQ ID NO: 696104 - DNA, 22 bp, Artificial Sequence
  chemically synthesized
ctgactttttaataatcaccat

SEQ ID NO: 696105 - DNA, 22 bp, Artificial Sequence
  chemically synthesized
cctgactttttaataatcacca

SEQ ID NO: 696106 - DNA, 22 bp, Artificial Sequence
  chemically synthesized
tttcctgactttttaataatca

SEQ ID NO: 696107 - DNA, 22 bp, Artificial Sequence
  chemically synthesized
ttgtttcctgactttttaataa

SEQ ID NO: 696108 - DNA, 22 bp, Artificial Sequence
  chemically synthesized
gccagcatctgttgtttcctga

SEQ ID NO: 696109 - DNA, 22 bp, Artificial Sequence
  chemically synthesized
ttaaaaagtcaggaaacaacag

SEQ ID NO: 696110 - DNA, 22 bp, Artificial Sequence
  chemically synthesized
aaaagtcaggaaacaacagatg

SEQ ID NO: 696111 - DNA, 22 bp, Artificial Sequence
  chemically synthesized
cacagcctagccagcatctgtt

SEQ ID NO: 696112 - DNA, 22 bp, Artificial Sequence
  chemically synthesized
tccacagcctagccagcatctg

SEQ ID NO: 696113 - DNA, 22 bp, Artificial Sequence
  chemically synthesized
ctccacagcctagccagcatct

SEQ ID NO: 696114 - DNA, 22 bp, Artificial Sequence
  chemically synthesized
ccatttctccacagcctagcca

SEQ ID NO: 696115 - DNA, 22 bp, Artificial Sequence
  chemically synthesized
aaaagcgttcccatttctccac

SEQ ID NO: 696116 - DNA, 22 bp, Artificial Sequence
  chemically synthesized
gctaggctgtggagaaatggga

SEQ ID NO: 696117 - DNA, 22 bp, Artificial Sequence
  chemically synthesized
ggctgtggagaaatgggaacgc

SEQ ID NO: 696118 - DNA, 22 bp, Artificial Sequence
  chemically synthesized
tggagaaatgggaacgcttttg

SEQ ID NO: 696119 - DNA, 22 bp, Artificial Sequence
  chemically synthesized
ccatcaacagttcaaaagcgtt

SEQ ID NO: 696120 - DNA, 22 bp, Artificial Sequence
  chemically synthesized
cattcccatcaacagttcaaaa

SEQ ID NO: 696121 - DNA, 22 bp, Artificial Sequence
  chemically synthesized
acattcccatcaacagttcaaa

SEQ ID NO: 696122 - DNA, 22 bp, Artificial Sequence
  chemically synthesized
atttacattcccatcaacagtt

SEQ ID NO: 696123 - DNA, 22 bp, Artificial Sequence
  chemically synthesized
aactaatttacattcccatcaa

SEQ ID NO: 696124 - DNA, 22 bp, Artificial Sequence
  chemically synthesized
ttgaactgttgatgggaatgta

SEQ ID NO: 696125 - DNA, 22 bp, Artificial Sequence
  chemically synthesized
tgaactgttgatgggaatgtaa

SEQ ID NO: 696126 - DNA, 22 bp, Artificial Sequence
  chemically synthesized
gaactgttgatgggaatgtaaa

SEQ ID NO: 696127 - DNA, 22 bp, Artificial Sequence
  chemically synthesized
aactgttgatgggaatgtaaat

SEQ ID NO: 696128 - DNA, 22 bp, Artificial Sequence
  chemically synthesized
cacaatggttgaactaatttac

SEQ ID NO: 696129 - DNA, 22 bp, Artificial Sequence
  chemically synthesized
ttgatgggaatgtaaattagtt

SEQ ID NO: 696130 - DNA, 22 bp, Artificial Sequence
  chemically synthesized
ccacaatggttgaactaattta

SEQ ID NO: 696131 - DNA, 22 bp, Artificial Sequence
  chemically synthesized
tccacaatggttgaactaattt

SEQ ID NO: 696132 - DNA, 22 bp, Artificial Sequence
  chemically synthesized
atgggaatgtaaattagttcaa

SEQ ID NO: 696133 - DNA, 22 bp, Artificial Sequence
  chemically synthesized
ttttccacaatggttgaactaa

SEQ ID NO: 696134 - DNA, 22 bp, Artificial Sequence
  chemically synthesized
ccatactgttttccacaatggt

SEQ ID NO: 696135 - DNA, 22 bp, Artificial Sequence
  chemically synthesized
gttcaaccattgtggaaaacag

SEQ ID NO: 696136 - DNA, 22 bp, Artificial Sequence
  chemically synthesized
aggaattgccatactgttttcc

SEQ ID NO: 696137 - DNA, 22 bp, Artificial Sequence
  chemically synthesized
gaggaattgccatactgttttc

SEQ ID NO: 696138 - DNA, 22 bp, Artificial Sequence
  chemically synthesized
aaccattgtggaaaacagtatg

SEQ ID NO: 696139 - DNA, 22 bp, Artificial Sequence
  chemically synthesized
gatccttgaggaattgccatac

SEQ ID NO: 696140 - DNA, 22 bp, Artificial Sequence
  chemically synthesized
tagatccttgaggaattgccat

SEQ ID NO: 696141 - DNA, 22 bp, Artificial Sequence
  chemically synthesized
tggaaaacagtatggcaattcc

SEQ ID NO: 696142 - DNA, 22 bp, Artificial Sequence
  chemically synthesized
gttctagatccttgaggaattg

SEQ ID NO: 696143 - DNA, 22 bp, Artificial Sequence
  chemically synthesized
tggttctagatccttgaggaat

SEQ ID NO: 696144 - DNA, 22 bp, Artificial Sequence
  chemically synthesized
ctggttctagatccttgaggaa

SEQ ID NO: 696145 - DNA, 22 bp, Artificial Sequence
  chemically synthesized
ctcaaggatctagaaccagaaa

SEQ ID NO: 696146 - DNA, 22 bp, Artificial Sequence
  chemically synthesized
ggccaaatggtatttctggttc

SEQ ID NO: 696147 - DNA, 22 bp, Artificial Sequence
  chemically synthesized
aaggatctagaaccagaaatac

SEQ ID NO: 696148 - DNA, 22 bp, Artificial Sequence
  chemically synthesized
gaaccagaaataccatttggcc

SEQ ID NO: 696149 - DNA, 22 bp, Artificial Sequence
  chemically synthesized
ggtgtatacccagtaatgggat

SEQ ID NO: 696150 - DNA, 22 bp, Artificial Sequence
  chemically synthesized
gggtgtatacccagtaatggga

SEQ ID NO: 696151 - DNA, 22 bp, Artificial Sequence
  chemically synthesized
tgggtgtatacccagtaatggg

SEQ ID NO: 696152 - DNA, 22 bp, Artificial Sequence
  chemically synthesized
ggcccagccatcccattactgg

SEQ ID NO: 696153 - DNA, 22 bp, Artificial Sequence
  chemically synthesized
gcccagccatcccattactggg

SEQ ID NO: 696154 - DNA, 22 bp, Artificial Sequence
  chemically synthesized
ctttgggtgtatacccagtaat

SEQ ID NO: 696155 - DNA, 22 bp, Artificial Sequence
  chemically synthesized
tattcctttgggtgtataccca

SEQ ID NO: 696156 - DNA, 22 bp, Artificial Sequence
  chemically synthesized
atattcctttgggtgtataccc

SEQ ID NO: 696157 - DNA, 22 bp, Artificial Sequence
  chemically synthesized
ctgggtatacacccaaaggaat

SEQ ID NO: 696158 - DNA, 22 bp, Artificial Sequence
  chemically synthesized
ggtatacacccaaaggaatata

SEQ ID NO: 696159 - DNA, 22 bp, Artificial Sequence
  chemically synthesized
tagtagaatgatttatattcct

SEQ ID NO: 696160 - DNA, 22 bp, Artificial Sequence
  chemically synthesized
atagtagaatgatttatattcc

SEQ ID NO: 696161 - DNA, 22 bp, Artificial Sequence
  chemically synthesized
tatagtagaatgatttatattc

SEQ ID NO: 696162 - DNA, 22 bp, Artificial Sequence
  chemically synthesized
tactataaagacacatgcatat

SEQ ID NO: 696163 - DNA, 22 bp, Artificial Sequence
  chemically synthesized
caataaacatacatatgcatgt

SEQ ID NO: 696164 - DNA, 22 bp, Artificial Sequence
  chemically synthesized
ctataaagacacatgcatatgt

SEQ ID NO: 696165 - DNA, 22 bp, Artificial Sequence
  chemically synthesized
taaagacacatgcatatgtatg

SEQ ID NO: 696166 - DNA, 22 bp, Artificial Sequence
  chemically synthesized
taaatagtgctgcaataaacat

SEQ ID NO: 696167 - DNA, 22 bp, Artificial Sequence
  chemically synthesized
ttgtaaatagtgctgcaataaa

SEQ ID NO: 696168 - DNA, 22 bp, Artificial Sequence
  chemically synthesized
ctattgtaaatagtgctgcaat

SEQ ID NO: 696169 - DNA, 22 bp, Artificial Sequence
  chemically synthesized
gctattgtaaatagtgctgcaa

SEQ ID NO: 696170 - DNA, 22 bp, Artificial Sequence
  chemically synthesized
tgctattgtaaatagtgctgca

SEQ ID NO: 696171 - DNA, 22 bp, Artificial Sequence
  chemically synthesized
catgtctttgctattgtaaata

SEQ ID NO: 696172 - DNA, 22 bp, Artificial Sequence
  chemically synthesized
attgcagcactatttacaatag

SEQ ID NO: 696173 - DNA, 22 bp, Artificial Sequence
  chemically synthesized
ttgcagcactatttacaatagc

SEQ ID NO: 696174 - DNA, 22 bp, Artificial Sequence
  chemically synthesized
gttccatgtctttgctattgta

SEQ ID NO: 696175 - DNA, 22 bp, Artificial Sequence
  chemically synthesized
cagcactatttacaatagcaaa

SEQ ID NO: 696176 - DNA, 22 bp, Artificial Sequence
  chemically synthesized
ggttggttccatgtctttgcta

SEQ ID NO: 696177 - DNA, 22 bp, Artificial Sequence
  chemically synthesized
gggttggttccatgtctttgct

SEQ ID NO: 696178 - DNA, 22 bp, Artificial Sequence
  chemically synthesized
tttacaatagcaaagacatgga

SEQ ID NO: 696179 - DNA, 22 bp, Artificial Sequence
  chemically synthesized
acaatagcaaagacatggaacc

SEQ ID NO: 696180 - DNA, 22 bp, Artificial Sequence
  chemically synthesized
caatagcaaagacatggaacca

SEQ ID NO: 696181 - DNA, 22 bp, Artificial Sequence
  chemically synthesized
atgggcatttgggttggttcca

SEQ ID NO: 696182 - DNA, 22 bp, Artificial Sequence
  chemically synthesized
tcattgatgggcatttgggttg

SEQ ID NO: 696183 - DNA, 22 bp, Artificial Sequence
  chemically synthesized
tccagtctatcattgatgggca

SEQ ID NO: 696184 - DNA, 22 bp, Artificial Sequence
  chemically synthesized
atccagtctatcattgatgggc

SEQ ID NO: 696185 - DNA, 22 bp, Artificial Sequence
  chemically synthesized
tatccagtctatcattgatggg

SEQ ID NO: 696186 - DNA, 22 bp, Artificial Sequence
  chemically synthesized
tttatccagtctatcattgatg

SEQ ID NO: 696187 - DNA, 22 bp, Artificial Sequence
  chemically synthesized
ctttatccagtctatcattgat

SEQ ID NO: 696188 - DNA, 22 bp, Artificial Sequence
  chemically synthesized
tctttatccagtctatcattga

SEQ ID NO: 696189 - DNA, 22 bp, Artificial Sequence
  chemically synthesized
tatgtaccacattttctttatc

SEQ ID NO: 696190 - DNA, 22 bp, Artificial Sequence
  chemically synthesized
atatgtaccacattttctttat

SEQ ID NO: 696191 - DNA, 22 bp, Artificial Sequence
  chemically synthesized
catggtttatatgtaccacatt

SEQ ID NO: 696192 - DNA, 22 bp, Artificial Sequence
  chemically synthesized
gataaagaaaatgtggtacata

SEQ ID NO: 696193 - DNA, 22 bp, Artificial Sequence
  chemically synthesized
cgtagtattccatggtttatat

SEQ ID NO: 696194 - DNA, 22 bp, Artificial Sequence
  chemically synthesized
tggctgcgtagtattccatggt

SEQ ID NO: 696195 - DNA, 22 bp, Artificial Sequence
  chemically synthesized
atggctgcgtagtattccatgg

SEQ ID NO: 696196 - DNA, 22 bp, Artificial Sequence
  chemically synthesized
tatggctgcgtagtattccatg

SEQ ID NO: 696197 - DNA, 22 bp, Artificial Sequence
  chemically synthesized
ttatggctgcgtagtattccat

SEQ ID NO: 696198 - DNA, 22 bp, Artificial Sequence
  chemically synthesized
tttatggctgcgtagtattcca

SEQ ID NO: 696199 - DNA, 22 bp, Artificial Sequence
  chemically synthesized
ctttttatggctgcgtagtatt

SEQ ID NO: 696200 - DNA, 22 bp, Artificial Sequence
  chemically synthesized
attcctttttatggctgcgtag

SEQ ID NO: 696201 - DNA, 22 bp, Artificial Sequence
  chemically synthesized
cgcagccataaaaaggaatgag

SEQ ID NO: 696202 - DNA, 22 bp, Artificial Sequence
  chemically synthesized
caaaggacgtgatctcattcct

SEQ ID NO: 696203 - DNA, 22 bp, Artificial Sequence
  chemically synthesized
atgtccctgcaaaggacgtgat

SEQ ID NO: 696204 - DNA, 22 bp, Artificial Sequence
  chemically synthesized
catgtccctgcaaaggacgtga

SEQ ID NO: 696205 - DNA, 22 bp, Artificial Sequence
  chemically synthesized
cagtttcatgtccctgcaaagg

SEQ ID NO: 696206 - DNA, 22 bp, Artificial Sequence
  chemically synthesized
ccagtttcatgtccctgcaaag

SEQ ID NO: 696207 - DNA, 22 bp, Artificial Sequence
  chemically synthesized
aggatgatggcttccagtttca

SEQ ID NO: 696208 - DNA, 22 bp, Artificial Sequence
  chemically synthesized
tgcagggacatgaaactggaag

SEQ ID NO: 696209 - DNA, 22 bp, Artificial Sequence
  chemically synthesized
gcagggacatgaaactggaagc

SEQ ID NO: 696210 - DNA, 22 bp, Artificial Sequence
  chemically synthesized
ctgaggatgatggcttccagtt

SEQ ID NO: 696211 - DNA, 22 bp, Artificial Sequence
  chemically synthesized
cagggacatgaaactggaagcc

SEQ ID NO: 696212 - DNA, 22 bp, Artificial Sequence
  chemically synthesized
gctgaggatgatggcttccagt

SEQ ID NO: 696213 - DNA, 22 bp, Artificial Sequence
  chemically synthesized
gtttgctgaggatgatggcttc

SEQ ID NO: 696214 - DNA, 22 bp, Artificial Sequence
  chemically synthesized
tgttagtttgctgaggatgatg

SEQ ID NO: 696215 - DNA, 22 bp, Artificial Sequence
  chemically synthesized
ctgtgttagtttgctgaggatg

SEQ ID NO: 696216 - DNA, 22 bp, Artificial Sequence
  chemically synthesized
ttcctgtgttagtttgctgagg

SEQ ID NO: 696217 - DNA, 22 bp, Artificial Sequence
  chemically synthesized
gaagccatcatcctcagcaaac

SEQ ID NO: 696218 - DNA, 22 bp, Artificial Sequence
  chemically synthesized
tgttcctgtgttagtttgctga

SEQ ID NO: 696219 - DNA, 22 bp, Artificial Sequence
  chemically synthesized
ctgttcctgtgttagtttgctg

SEQ ID NO: 696220 - DNA, 22 bp, Artificial Sequence
  chemically synthesized
tctgttcctgtgttagtttgct

SEQ ID NO: 696221 - DNA, 22 bp, Artificial Sequence
  chemically synthesized
gttttctgttcctgtgttagtt

SEQ ID NO: 696222 - DNA, 22 bp, Artificial Sequence
  chemically synthesized
ggttttctgttcctgtgttagt

SEQ ID NO: 696223 - DNA, 22 bp, Artificial Sequence
  chemically synthesized
agcaaactaacacaggaacaga

SEQ ID NO: 696224 - DNA, 22 bp, Artificial Sequence
  chemically synthesized
acacaggaacagaaaaccaaac

SEQ ID NO: 696225 - DNA, 22 bp, Artificial Sequence
  chemically synthesized
tgagtgagaacatgcagcgttt

SEQ ID NO: 696226 - DNA, 22 bp, Artificial Sequence
  chemically synthesized
gtgagtgagaacatgcagcgtt

SEQ ID NO: 696227 - DNA, 22 bp, Artificial Sequence
  chemically synthesized
acttgtgagtgagaacatgcag

SEQ ID NO: 696228 - DNA, 22 bp, Artificial Sequence
  chemically synthesized
tcacttgtgagtgagaacatgc

SEQ ID NO: 696229 - DNA, 22 bp, Artificial Sequence
  chemically synthesized
aactctcacttgtgagtgagaa

SEQ ID NO: 696230 - DNA, 22 bp, Artificial Sequence
  chemically synthesized
atgttcaactctcacttgtgag

SEQ ID NO: 696231 - DNA, 22 bp, Artificial Sequence
  chemically synthesized
aatgttcaactctcacttgtga

SEQ ID NO: 696232 - DNA, 22 bp, Artificial Sequence
  chemically synthesized
catgttctcactcacaagtgag

SEQ ID NO: 696233 - DNA, 22 bp, Artificial Sequence
  chemically synthesized
ttaatgttcaactctcacttgt

SEQ ID NO: 696234 - DNA, 22 bp, Artificial Sequence
  chemically synthesized
tcactcacaagtgagagttgaa

SEQ ID NO: 696235 - DNA, 22 bp, Artificial Sequence
  chemically synthesized
actcacaagtgagagttgaaca

SEQ ID NO: 696236 - DNA, 22 bp, Artificial Sequence
  chemically synthesized
acaagtgagagttgaacattaa

SEQ ID NO: 696237 - DNA, 22 bp, Artificial Sequence
  chemically synthesized
tgtccatgtgttcttaatgttc

SEQ ID NO: 696238 - DNA, 22 bp, Artificial Sequence
  chemically synthesized
tgtgtccatgtgttcttaatgt

SEQ ID NO: 696239 - DNA, 22 bp, Artificial Sequence
  chemically synthesized
tctgtgtccatgtgttcttaat

SEQ ID NO: 696240 - DNA, 22 bp, Artificial Sequence
  chemically synthesized
cctctctgtgtccatgtgttct

SEQ ID NO: 696241 - DNA, 22 bp, Artificial Sequence
  chemically synthesized
ccctctctgtgtccatgtgttc

SEQ ID NO: 696242 - DNA, 22 bp, Artificial Sequence
  chemically synthesized
tttccctctctgtgtccatgtg

SEQ ID NO: 696243 - DNA, 22 bp, Artificial Sequence
  chemically synthesized
aacattaagaacacatggacac

SEQ ID NO: 696244 - DNA, 22 bp, Artificial Sequence
  chemically synthesized
agaacacatggacacagagagg

SEQ ID NO: 696245 - DNA, 22 bp, Artificial Sequence
  chemically synthesized
gtgtgcattgtttccctctctg

SEQ ID NO: 696246 - DNA, 22 bp, Artificial Sequence
  chemically synthesized
aacccccaaaccccaacaggcc

SEQ ID NO: 696247 - DNA, 22 bp, Artificial Sequence
  chemically synthesized
caacccccaaaccccaacaggc

SEQ ID NO: 696248 - DNA, 22 bp, Artificial Sequence
  chemically synthesized
ccttcaacccccaaaccccaac

SEQ ID NO: 696249 - DNA, 22 bp, Artificial Sequence
  chemically synthesized
cctcccttcaacccccaaaccc

SEQ ID NO: 696250 - DNA, 22 bp, Artificial Sequence
  chemically synthesized
agttccctcccttcaaccccca

SEQ ID NO: 696251 - DNA, 22 bp, Artificial Sequence
  chemically synthesized
ttggggtttgggggttgaaggg

SEQ ID NO: 696252 - DNA, 22 bp, Artificial Sequence
  chemically synthesized
gggtttgggggttgaagggagg

SEQ ID NO: 696253 - DNA, 22 bp, Artificial Sequence
  chemically synthesized
gggggttgaagggagggaactt

SEQ ID NO: 696254 - DNA, 22 bp, Artificial Sequence
  chemically synthesized
ggggttgaagggagggaactta

SEQ ID NO: 696255 - DNA, 22 bp, Artificial Sequence
  chemically synthesized
atgacccatcgtctaagttccc

SEQ ID NO: 696256 - DNA, 22 bp, Artificial Sequence
  chemically synthesized
aagggagggaacttagacgatg

SEQ ID NO: 696257 - DNA, 22 bp, Artificial Sequence
  chemically synthesized
cacctaatgacccatcgtctaa

SEQ ID NO: 696258 - DNA, 22 bp, Artificial Sequence
  chemically synthesized
ctgcacctaatgacccatcgtc

SEQ ID NO: 696259 - DNA, 22 bp, Artificial Sequence
  chemically synthesized
agacgatgggtcattaggtgca

SEQ ID NO: 696260 - DNA, 22 bp, Artificial Sequence
  chemically synthesized
gacgatgggtcattaggtgcag

SEQ ID NO: 696261 - DNA, 22 bp, Artificial Sequence
  chemically synthesized
ggtgcagcagaccaccatggca

SEQ ID NO: 696262 - DNA, 22 bp, Artificial Sequence
  chemically synthesized
cataggtatatgtatgccatgg

SEQ ID NO: 696263 - DNA, 22 bp, Artificial Sequence
  chemically synthesized
ttacataggtatatgtatgcca

SEQ ID NO: 696264 - DNA, 22 bp, Artificial Sequence
  chemically synthesized
gttacataggtatatgtatgcc

SEQ ID NO: 696265 - DNA, 22 bp, Artificial Sequence
  chemically synthesized
tgtaacaaacctgcacgttctg

SEQ ID NO: 696266 - DNA, 22 bp, Artificial Sequence
  chemically synthesized
cacgttctgcacatgtatctcg

SEQ ID NO: 696267 - DNA, 22 bp, Artificial Sequence
  chemically synthesized
tgcacatgtatctcggtttttt

SEQ ID NO: 696268 - DNA, 22 bp, Artificial Sequence
  chemically synthesized
cacatgtatctcggttttttgg

SEQ ID NO: 696269 - DNA, 22 bp, Artificial Sequence
  chemically synthesized
aaaaaaaaaaacacaccaaaaa

SEQ ID NO: 696270 - DNA, 22 bp, Artificial Sequence
  chemically synthesized
taaaaaaaaaaaacacaccaaa

SEQ ID NO: 696271 - DNA, 22 bp, Artificial Sequence
  chemically synthesized
ctaaaaaaaaaaaacacaccaa

SEQ ID NO: 696272 - DNA, 22 bp, Artificial Sequence
  chemically synthesized
ttctaaaaaaaaaaaacacacc

SEQ ID NO: 696273 - DNA, 22 bp, Artificial Sequence
  chemically synthesized
cttctaaaaaaaaaaaacacac

SEQ ID NO: 696274 - DNA, 22 bp, Artificial Sequence
  chemically synthesized
tcttctaaaaaaaaaaaacaca

SEQ ID NO: 696275 - DNA, 22 bp, Artificial Sequence
  chemically synthesized
ttcttctaaaaaaaaaaaacac

SEQ ID NO: 696276 - DNA, 22 bp, Artificial Sequence
  chemically synthesized
ggttttttggtgtgtttttttt

SEQ ID NO: 696277 - DNA, 22 bp, Artificial Sequence
  chemically synthesized
tttcttctaaaaaaaaaaaaca

SEQ ID NO: 696278 - DNA, 22 bp, Artificial Sequence
  chemically synthesized
ttttcttctaaaaaaaaaaaac

SEQ ID NO: 696279 - DNA, 22 bp, Artificial Sequence
  chemically synthesized
tttttcttctaaaaaaaaaaaa

SEQ ID NO: 696280 - DNA, 22 bp, Artificial Sequence
  chemically synthesized
tttttttcttctaaaaaaaaaa

SEQ ID NO: 696281 - DNA, 22 bp, Artificial Sequence
  chemically synthesized
tttggtgtgtttttttttttta

SEQ ID NO: 696282 - DNA, 22 bp, Artificial Sequence
  chemically synthesized
ctttttttcttctaaaaaaaaa

SEQ ID NO: 696283 - DNA, 22 bp, Artificial Sequence
  chemically synthesized
ttggtgtgttttttttttttag

SEQ ID NO: 696284 - DNA, 22 bp, Artificial Sequence
  chemically synthesized
tctttttttcttctaaaaaaaa

SEQ ID NO: 696285 - DNA, 22 bp, Artificial Sequence
  chemically synthesized
tggtgtgttttttttttttaga

SEQ ID NO: 696286 - DNA, 22 bp, Artificial Sequence
  chemically synthesized
ttctttttttcttctaaaaaaa

SEQ ID NO: 696287 - DNA, 22 bp, Artificial Sequence
  chemically synthesized
ggtgtgttttttttttttagaa

SEQ ID NO: 696288 - DNA, 22 bp, Artificial Sequence
  chemically synthesized
tttctttttttcttctaaaaaa

SEQ ID NO: 696289 - DNA, 22 bp, Artificial Sequence
  chemically synthesized
gtgtgttttttttttttagaag

SEQ ID NO: 696290 - DNA, 22 bp, Artificial Sequence
  chemically synthesized
ttttctttttttcttctaaaaa

SEQ ID NO: 696291 - DNA, 22 bp, Artificial Sequence
  chemically synthesized
ttttttctttttttcttctaaa

SEQ ID NO: 696292 - DNA, 22 bp, Artificial Sequence
  chemically synthesized
cttttttctttttttcttctaa

SEQ ID NO: 696293 - DNA, 22 bp, Artificial Sequence
  chemically synthesized
tttttttttagaagaaaaaaag

SEQ ID NO: 696294 - DNA, 22 bp, Artificial Sequence
  chemically synthesized
ttttttttagaagaaaaaaaga

SEQ ID NO: 696295 - DNA, 22 bp, Artificial Sequence
  chemically synthesized
tttttttagaagaaaaaaagaa

SEQ ID NO: 696296 - DNA, 22 bp, Artificial Sequence
  chemically synthesized
cccccttcttttttcttttttt

SEQ ID NO: 696297 - DNA, 22 bp, Artificial Sequence
  chemically synthesized
ttttttagaagaaaaaaagaaa

SEQ ID NO: 696298 - DNA, 22 bp, Artificial Sequence
  chemically synthesized
tttttagaagaaaaaaagaaaa

SEQ ID NO: 696299 - DNA, 22 bp, Artificial Sequence
  chemically synthesized
ttttagaagaaaaaaagaaaaa

SEQ ID NO: 696300 - DNA, 22 bp, Artificial Sequence
  chemically synthesized
tttagaagaaaaaaagaaaaaa

SEQ ID NO: 696301 - DNA, 22 bp, Artificial Sequence
  chemically synthesized
ttagaagaaaaaaagaaaaaag

SEQ ID NO: 696302 - DNA, 22 bp, Artificial Sequence
  chemically synthesized
tagaagaaaaaaagaaaaaaga

SEQ ID NO: 696303 - DNA, 22 bp, Artificial Sequence
  chemically synthesized
agaagaaaaaaagaaaaaagaa

SEQ ID NO: 696304 - DNA, 22 bp, Artificial Sequence
  chemically synthesized
gaagaaaaaaagaaaaaagaag

SEQ ID NO: 696305 - DNA, 22 bp, Artificial Sequence
  chemically synthesized
aaatgagatctccccccttctt

SEQ ID NO: 696306 - DNA, 22 bp, Artificial Sequence
  chemically synthesized
aatcaattaaaatgagatctcc

SEQ ID NO: 696307 - DNA, 22 bp, Artificial Sequence
  chemically synthesized
gtctaaatcaattaaaatgaga

SEQ ID NO: 696308 - DNA, 22 bp, Artificial Sequence
  chemically synthesized
tggtctaaatcaattaaaatga

SEQ ID NO: 696309 - DNA, 22 bp, Artificial Sequence
  chemically synthesized
attctggtctaaatcaattaaa

SEQ ID NO: 696310 - DNA, 22 bp, Artificial Sequence
  chemically synthesized
gattctggtctaaatcaattaa

SEQ ID NO: 696311 - DNA, 22 bp, Artificial Sequence
  chemically synthesized
aaatgtttgattctggtctaaa

SEQ ID NO: 696312 - DNA, 22 bp, Artificial Sequence
  chemically synthesized
attttaattgatttagaccaga

SEQ ID NO: 696313 - DNA, 22 bp, Artificial Sequence
  chemically synthesized
aaaatgtttgattctggtctaa

SEQ ID NO: 696314 - DNA, 22 bp, Artificial Sequence
  chemically synthesized
taaaatgtttgattctggtcta

SEQ ID NO: 696315 - DNA, 22 bp, Artificial Sequence
  chemically synthesized
ttaaaatgtttgattctggtct

SEQ ID NO: 696316 - DNA, 22 bp, Artificial Sequence
  chemically synthesized
taattgatttagaccagaatca

SEQ ID NO: 696317 - DNA, 22 bp, Artificial Sequence
  chemically synthesized
aattgatttagaccagaatcaa

SEQ ID NO: 696318 - DNA, 22 bp, Artificial Sequence
  chemically synthesized
attgatttagaccagaatcaaa

SEQ ID NO: 696319 - DNA, 22 bp, Artificial Sequence
  chemically synthesized
atttttaaaatgtttgattctg

SEQ ID NO: 696320 - DNA, 22 bp, Artificial Sequence
  chemically synthesized
aatttttaaaatgtttgattct

SEQ ID NO: 696321 - DNA, 22 bp, Artificial Sequence
  chemically synthesized
taatttttaaaatgtttgattc

SEQ ID NO: 696322 - DNA, 22 bp, Artificial Sequence
  chemically synthesized
ttaatttttaaaatgtttgatt

SEQ ID NO: 696323 - DNA, 22 bp, Artificial Sequence
  chemically synthesized
atttagaccagaatcaaacatt

SEQ ID NO: 696324 - DNA, 22 bp, Artificial Sequence
  chemically synthesized
tttaatttttaaaatgtttgat

SEQ ID NO: 696325 - DNA, 22 bp, Artificial Sequence
  chemically synthesized
ttttaatttttaaaatgtttga

SEQ ID NO: 696326 - DNA, 22 bp, Artificial Sequence
  chemically synthesized
tttttaatttttaaaatgtttg

SEQ ID NO: 696327 - DNA, 22 bp, Artificial Sequence
  chemically synthesized
ttttttaatttttaaaatgttt

SEQ ID NO: 696328 - DNA, 22 bp, Artificial Sequence
  chemically synthesized
agaccagaatcaaacattttaa

SEQ ID NO: 696329 - DNA, 22 bp, Artificial Sequence
  chemically synthesized
tttttttaatttttaaaatgtt

SEQ ID NO: 696330 - DNA, 22 bp, Artificial Sequence
  chemically synthesized
gaccagaatcaaacattttaaa

SEQ ID NO: 696331 - DNA, 22 bp, Artificial Sequence
  chemically synthesized
ttttttttaatttttaaaatgt

SEQ ID NO: 696332 - DNA, 22 bp, Artificial Sequence
  chemically synthesized
tttttttttaatttttaaaatg

SEQ ID NO: 696333 - DNA, 22 bp, Artificial Sequence
  chemically synthesized
ttttttttttaatttttaaaat

SEQ ID NO: 696334 - DNA, 22 bp, Artificial Sequence
  chemically synthesized
tttttttttttaatttttaaaa

SEQ ID NO: 696335 - DNA, 22 bp, Artificial Sequence
  chemically synthesized
ttttttttttttaatttttaaa

SEQ ID NO: 696336 - DNA, 22 bp, Artificial Sequence
  chemically synthesized
ttttttttttttttaattttta

SEQ ID NO: 696337 - DNA, 22 bp, Artificial Sequence
  chemically synthesized
cttttttttttttttaattttt

SEQ ID NO: 696338 - DNA, 22 bp, Artificial Sequence
  chemically synthesized
taaaaattaaaaaaaaaaaaaa

SEQ ID NO: 696339 - DNA, 22 bp, Artificial Sequence
  chemically synthesized
aaaaattaaaaaaaaaaaaaag

SEQ ID NO: 696340 - DNA, 22 bp, Artificial Sequence
  chemically synthesized
aaaattaaaaaaaaaaaaaaga

SEQ ID NO: 696341 - DNA, 22 bp, Artificial Sequence
  chemically synthesized
agaaaacaaagtatttcttttt

SEQ ID NO: 696342 - DNA, 22 bp, Artificial Sequence
  chemically synthesized
aaaaaaaaaaaaagaaatactt

SEQ ID NO: 696343 - DNA, 22 bp, Artificial Sequence
  chemically synthesized
caggctgagaaaacaaagtatt

SEQ ID NO: 696344 - DNA, 22 bp, Artificial Sequence
  chemically synthesized
cctgcaggctgagaaaacaaag

SEQ ID NO: 696345 - DNA, 22 bp, Artificial Sequence
  chemically synthesized
cctccctgcaggctgagaaaac

SEQ ID NO: 696346 - DNA, 22 bp, Artificial Sequence
  chemically synthesized
tacctccctgcaggctgagaaa

SEQ ID NO: 696347 - DNA, 22 bp, Artificial Sequence
  chemically synthesized
ctacctccctgcaggctgagaa

SEQ ID NO: 696348 - DNA, 22 bp, Artificial Sequence
  chemically synthesized
ttctacctccctgcaggctgag

SEQ ID NO: 696349 - DNA, 22 bp, Artificial Sequence
  chemically synthesized
tgttttctcagcctgcagggag

SEQ ID NO: 696350 - DNA, 22 bp, Artificial Sequence
  chemically synthesized
gttttctcagcctgcagggagg

SEQ ID NO: 696351 - DNA, 22 bp, Artificial Sequence
  chemically synthesized
ttttctcagcctgcagggaggt

SEQ ID NO: 696352 - DNA, 22 bp, Artificial Sequence
  chemically synthesized
tctcagcctgcagggaggtaga

SEQ ID NO: 696353 - DNA, 22 bp, Artificial Sequence
  chemically synthesized
ctcagcctgcagggaggtagaa

SEQ ID NO: 696354 - DNA, 22 bp, Artificial Sequence
  chemically synthesized
atgtaagcactcttctacctcc

SEQ ID NO: 696355 - DNA, 22 bp, Artificial Sequence
  chemically synthesized
tcagcctgcagggaggtagaag

SEQ ID NO: 696356 - DNA, 22 bp, Artificial Sequence
  chemically synthesized
agcctgcagggaggtagaagag

SEQ ID NO: 696357 - DNA, 22 bp, Artificial Sequence
  chemically synthesized
cagggaggtagaagagtgctta

SEQ ID NO: 696358 - DNA, 22 bp, Artificial Sequence
  chemically synthesized
gccagccctgatgtaagcactc

SEQ ID NO: 696359 - DNA, 22 bp, Artificial Sequence
  chemically synthesized
ggccagccctgatgtaagcact

SEQ ID NO: 696360 - DNA, 22 bp, Artificial Sequence
  chemically synthesized
acatcagggctggccaagtttt

SEQ ID NO: 696361 - DNA, 22 bp, Artificial Sequence
  chemically synthesized
catcagggctggccaagttttt

SEQ ID NO: 696362 - DNA, 22 bp, Artificial Sequence
  chemically synthesized
gccaagtttttgtttcattttg

SEQ ID NO: 696363 - DNA, 22 bp, Artificial Sequence
  chemically synthesized
ttgtttcattttgttttttgtt

SEQ ID NO: 696364 - DNA, 22 bp, Artificial Sequence
  chemically synthesized
tgtttcattttgttttttgttc

SEQ ID NO: 696365 - DNA, 22 bp, Artificial Sequence
  chemically synthesized
ggcaataaaggggaacaaaaaa

SEQ ID NO: 696366 - DNA, 22 bp, Artificial Sequence
  chemically synthesized
gtttcattttgttttttgttcc

SEQ ID NO: 696367 - DNA, 22 bp, Artificial Sequence
  chemically synthesized
gggcaataaaggggaacaaaaa

SEQ ID NO: 696368 - DNA, 22 bp, Artificial Sequence
  chemically synthesized
tttcattttgttttttgttccc

SEQ ID NO: 696369 - DNA, 22 bp, Artificial Sequence
  chemically synthesized
tgggcaataaaggggaacaaaa

SEQ ID NO: 696370 - DNA, 22 bp, Artificial Sequence
  chemically synthesized
cattttgttttttgttcccctt

SEQ ID NO: 696371 - DNA, 22 bp, Artificial Sequence
  chemically synthesized
ctttgggcaataaaggggaaca

SEQ ID NO: 696372 - DNA, 22 bp, Artificial Sequence
  chemically synthesized
attttgttttttgttccccttt

SEQ ID NO: 696373 - DNA, 22 bp, Artificial Sequence
  chemically synthesized
ctgctttgggcaataaagggga

SEQ ID NO: 696374 - DNA, 22 bp, Artificial Sequence
  chemically synthesized
gctgctttgggcaataaagggg

SEQ ID NO: 696375 - DNA, 22 bp, Artificial Sequence
  chemically synthesized
tgttttttgttcccctttattg

SEQ ID NO: 696376 - DNA, 22 bp, Artificial Sequence
  chemically synthesized
tgctgctttgggcaataaaggg

SEQ ID NO: 696377 - DNA, 22 bp, Artificial Sequence
  chemically synthesized
gttttttgttcccctttattgc

SEQ ID NO: 696378 - DNA, 22 bp, Artificial Sequence
  chemically synthesized
ttttttgttcccctttattgcc

SEQ ID NO: 696379 - DNA, 22 bp, Artificial Sequence
  chemically synthesized
tttgctgctttgggcaataaag

SEQ ID NO: 696380 - DNA, 22 bp, Artificial Sequence
  chemically synthesized
tttgttcccctttattgcccaa

SEQ ID NO: 696381 - DNA, 22 bp, Artificial Sequence
  chemically synthesized
ctctttgctgctttgggcaata

SEQ ID NO: 696382 - DNA, 22 bp, Artificial Sequence
  chemically synthesized
ttgttcccctttattgcccaaa

SEQ ID NO: 696383 - DNA, 22 bp, Artificial Sequence
  chemically synthesized
tgttcccctttattgcccaaag

SEQ ID NO: 696384 - DNA, 22 bp, Artificial Sequence
  chemically synthesized
gttcccctttattgcccaaagc

SEQ ID NO: 696385 - DNA, 22 bp, Artificial Sequence
  chemically synthesized
ttcccctttattgcccaaagca

SEQ ID NO: 696386 - DNA, 22 bp, Artificial Sequence
  chemically synthesized
agttactctttgctgctttggg

SEQ ID NO: 696387 - DNA, 22 bp, Artificial Sequence
  chemically synthesized
ccctttattgcccaaagcagca

SEQ ID NO: 696388 - DNA, 22 bp, Artificial Sequence
  chemically synthesized
tattgcccaaagcagcaaagag

SEQ ID NO: 696389 - DNA, 22 bp, Artificial Sequence
  chemically synthesized
attgcccaaagcagcaaagagt

SEQ ID NO: 696390 - DNA, 22 bp, Artificial Sequence
  chemically synthesized
ttgcccaaagcagcaaagagta

SEQ ID NO: 696391 - DNA, 22 bp, Artificial Sequence
  chemically synthesized
cagagacctaagttactctttg

SEQ ID NO: 696392 - DNA, 22 bp, Artificial Sequence
  chemically synthesized
cccaaagcagcaaagagtaact

SEQ ID NO: 696393 - DNA, 22 bp, Artificial Sequence
  chemically synthesized
gcaatcaagttgcagagaccta

SEQ ID NO: 696394 - DNA, 22 bp, Artificial Sequence
  chemically synthesized
cgcaatcaagttgcagagacct

SEQ ID NO: 696395 - DNA, 22 bp, Artificial Sequence
  chemically synthesized
gcgtatcttcgcaatcaagttg

SEQ ID NO: 696396 - DNA, 22 bp, Artificial Sequence
  chemically synthesized
ggcgtatcttcgcaatcaagtt

SEQ ID NO: 696397 - DNA, 22 bp, Artificial Sequence
  chemically synthesized
aggtctctgcaacttgattgcg

SEQ ID NO: 696398 - DNA, 22 bp, Artificial Sequence
  chemically synthesized
ggtctctgcaacttgattgcga

SEQ ID NO: 696399 - DNA, 22 bp, Artificial Sequence
  chemically synthesized
cttggcgtatcttcgcaatcaa

SEQ ID NO: 696400 - DNA, 22 bp, Artificial Sequence
  chemically synthesized
ccttggcgtatcttcgcaatca

SEQ ID NO: 696401 - DNA, 22 bp, Artificial Sequence
  chemically synthesized
tccttggcgtatcttcgcaatc

SEQ ID NO: 696402 - DNA, 22 bp, Artificial Sequence
  chemically synthesized
tgcaacttgattgcgaagatac

SEQ ID NO: 696403 - DNA, 22 bp, Artificial Sequence
  chemically synthesized
caacttgattgcgaagatacgc

SEQ ID NO: 696404 - DNA, 22 bp, Artificial Sequence
  chemically synthesized
ggtggattttccttggcgtatc

SEQ ID NO: 696405 - DNA, 22 bp, Artificial Sequence
  chemically synthesized
gattgcgaagatacgccaagga

SEQ ID NO: 696406 - DNA, 22 bp, Artificial Sequence
  chemically synthesized
ttaggtggattttccttggcgt

SEQ ID NO: 696407 - DNA, 22 bp, Artificial Sequence
  chemically synthesized
attgcgaagatacgccaaggaa

SEQ ID NO: 696408 - DNA, 22 bp, Artificial Sequence
  chemically synthesized
cgaagatacgccaaggaaaatc

SEQ ID NO: 696409 - DNA, 22 bp, Artificial Sequence
  chemically synthesized
cactgttaggtggattttcctt

SEQ ID NO: 696410 - DNA, 22 bp, Artificial Sequence
  chemically synthesized
cctgcactgttaggtggatttt

SEQ ID NO: 696411 - DNA, 22 bp, Artificial Sequence
  chemically synthesized
ccctgcactgttaggtggattt

SEQ ID NO: 696412 - DNA, 22 bp, Artificial Sequence
  chemically synthesized
gtagtccttccctgcactgtta

SEQ ID NO: 696413 - DNA, 22 bp, Artificial Sequence
  chemically synthesized
tagtagtccttccctgcactgt

SEQ ID NO: 696414 - DNA, 22 bp, Artificial Sequence
  chemically synthesized
ctctagtagtccttccctgcac

SEQ ID NO: 696415 - DNA, 22 bp, Artificial Sequence
  chemically synthesized
acagtgcagggaaggactacta

SEQ ID NO: 696416 - DNA, 22 bp, Artificial Sequence
  chemically synthesized
ggcatcaccaaaactactctag

SEQ ID NO: 696417 - DNA, 22 bp, Artificial Sequence
  chemically synthesized
gggcatcaccaaaactactcta

SEQ ID NO: 696418 - DNA, 22 bp, Artificial Sequence
  chemically synthesized
ccatcttgggcatcaccaaaac

SEQ ID NO: 696419 - DNA, 22 bp, Artificial Sequence
  chemically synthesized
ctagagtagttttggtgatgcc

SEQ ID NO: 696420 - DNA, 22 bp, Artificial Sequence
  chemically synthesized
gagtagttttggtgatgcccaa

SEQ ID NO: 696421 - DNA, 22 bp, Artificial Sequence
  chemically synthesized
tgaggctgccatcttgggcatc

SEQ ID NO: 696422 - DNA, 22 bp, Artificial Sequence
  chemically synthesized
tggtgatgcccaagatggcagc

SEQ ID NO: 696423 - DNA, 22 bp, Artificial Sequence
  chemically synthesized
ggtgatgcccaagatggcagcc

SEQ ID NO: 696424 - DNA, 22 bp, Artificial Sequence
  chemically synthesized
gtgatgcccaagatggcagcct

SEQ ID NO: 696425 - DNA, 22 bp, Artificial Sequence
  chemically synthesized
tataaccaaatgtggccaatcc

SEQ ID NO: 696426 - DNA, 22 bp, Artificial Sequence
  chemically synthesized
gtataaccaaatgtggccaatc

SEQ ID NO: 696427 - DNA, 22 bp, Artificial Sequence
  chemically synthesized
acagtggtggattggccacatt

SEQ ID NO: 696428 - DNA, 22 bp, Artificial Sequence
  chemically synthesized
gccatttgtataaccaaatgtg

SEQ ID NO: 696429 - DNA, 22 bp, Artificial Sequence
  chemically synthesized
aaaactggccatttgtataacc

SEQ ID NO: 696430 - DNA, 22 bp, Artificial Sequence
  chemically synthesized
gccacatttggttatacaaatg

SEQ ID NO: 696431 - DNA, 22 bp, Artificial Sequence
  chemically synthesized
attgaaaactggccatttgtat

SEQ ID NO: 696432 - DNA, 22 bp, Artificial Sequence
  chemically synthesized
gattgaaaactggccatttgta

SEQ ID NO: 696433 - DNA, 22 bp, Artificial Sequence
  chemically synthesized
tgattgaaaactggccatttgt

SEQ ID NO: 696434 - DNA, 22 bp, Artificial Sequence
  chemically synthesized
ttgattgaaaactggccatttg

SEQ ID NO: 696435 - DNA, 22 bp, Artificial Sequence
  chemically synthesized
ggttatacaaatggccagtttt

SEQ ID NO: 696436 - DNA, 22 bp, Artificial Sequence
  chemically synthesized
gttatacaaatggccagttttc

SEQ ID NO: 696437 - DNA, 22 bp, Artificial Sequence
  chemically synthesized
atgtttttgattgaaaactggc

SEQ ID NO: 696438 - DNA, 22 bp, Artificial Sequence
  chemically synthesized
taatgtttttgattgaaaactg

SEQ ID NO: 696439 - DNA, 22 bp, Artificial Sequence
  chemically synthesized
ctaatgtttttgattgaaaact

SEQ ID NO: 696440 - DNA, 22 bp, Artificial Sequence
  chemically synthesized
tacaaatggccagttttcaatc

SEQ ID NO: 696441 - DNA, 22 bp, Artificial Sequence
  chemically synthesized
tctaatgtttttgattgaaaac

SEQ ID NO: 696442 - DNA, 22 bp, Artificial Sequence
  chemically synthesized
aactttctaatgtttttgattg

SEQ ID NO: 696443 - DNA, 22 bp, Artificial Sequence
  chemically synthesized
caactttctaatgtttttgatt

SEQ ID NO: 696444 - DNA, 22 bp, Artificial Sequence
  chemically synthesized
tttcaactttctaatgtttttg

SEQ ID NO: 696445 - DNA, 22 bp, Artificial Sequence
  chemically synthesized
gctgtttcaactttctaatgtt

SEQ ID NO: 696446 - DNA, 22 bp, Artificial Sequence
  chemically synthesized
tagctgtttcaactttctaatg

SEQ ID NO: 696447 - DNA, 22 bp, Artificial Sequence
  chemically synthesized
tcaatcaaaaacattagaaagt

SEQ ID NO: 696448 - DNA, 22 bp, Artificial Sequence
  chemically synthesized
ctagctgtttcaactttctaat

SEQ ID NO: 696449 - DNA, 22 bp, Artificial Sequence
  chemically synthesized
caatcaaaaacattagaaagtt

SEQ ID NO: 696450 - DNA, 22 bp, Artificial Sequence
  chemically synthesized
aatcaaaaacattagaaagttg

SEQ ID NO: 696451 - DNA, 22 bp, Artificial Sequence
  chemically synthesized
cttctagctgtttcaactttct

SEQ ID NO: 696452 - DNA, 22 bp, Artificial Sequence
  chemically synthesized
ttgcttctagctgtttcaactt

SEQ ID NO: 696453 - DNA, 22 bp, Artificial Sequence
  chemically synthesized
agctattgcttctagctgtttc

SEQ ID NO: 696454 - DNA, 22 bp, Artificial Sequence
  chemically synthesized
gaaagttgaaacagctagaagc

SEQ ID NO: 696455 - DNA, 22 bp, Artificial Sequence
  chemically synthesized
aaacagctagaagcaatagctg

SEQ ID NO: 696456 - DNA, 22 bp, Artificial Sequence
  chemically synthesized
gaagcaatagctgagatgatga

SEQ ID NO: 696457 - DNA, 22 bp, Artificial Sequence
  chemically synthesized
agatgatgatgattattttatt

SEQ ID NO: 696458 - DNA, 22 bp, Artificial Sequence
  chemically synthesized
tacgaataaaaataaataaatc

SEQ ID NO: 696459 - DNA, 22 bp, Artificial Sequence
  chemically synthesized
atacgaataaaaataaataaat

SEQ ID NO: 696460 - DNA, 22 bp, Artificial Sequence
  chemically synthesized
ttttatttgatttatttatttt

SEQ ID NO: 696461 - DNA, 22 bp, Artificial Sequence
  chemically synthesized
tatttgatttatttatttttat

SEQ ID NO: 696462 - DNA, 22 bp, Artificial Sequence
  chemically synthesized
atttgatttatttatttttatt

SEQ ID NO: 696463 - DNA, 22 bp, Artificial Sequence
  chemically synthesized
tttgatttatttatttttattc

SEQ ID NO: 696464 - DNA, 22 bp, Artificial Sequence
  chemically synthesized
agaaatttatacgaataaaaat

SEQ ID NO: 696465 - DNA, 22 bp, Artificial Sequence
  chemically synthesized
gatttatttatttttattcgta

SEQ ID NO: 696466 - DNA, 22 bp, Artificial Sequence
  chemically synthesized
atttatttatttttattcgtat

SEQ ID NO: 696467 - DNA, 22 bp, Artificial Sequence
  chemically synthesized
tacctcagaaatttatacgaat

SEQ ID NO: 696468 - DNA, 22 bp, Artificial Sequence
  chemically synthesized
gtacctcagaaatttatacgaa

SEQ ID NO: 696469 - DNA, 22 bp, Artificial Sequence
  chemically synthesized
atttatttttattcgtataaat

SEQ ID NO: 696470 - DNA, 22 bp, Artificial Sequence
  chemically synthesized
tttatttttattcgtataaatt

SEQ ID NO: 696471 - DNA, 22 bp, Artificial Sequence
  chemically synthesized
atttttattcgtataaatttct

SEQ ID NO: 696472 - DNA, 22 bp, Artificial Sequence
  chemically synthesized
cacttgtacctcagaaatttat

SEQ ID NO: 696473 - DNA, 22 bp, Artificial Sequence
  chemically synthesized
tttttattcgtataaatttctg

SEQ ID NO: 696474 - DNA, 22 bp, Artificial Sequence
  chemically synthesized
ttattcgtataaatttctgagg

SEQ ID NO: 696475 - DNA, 22 bp, Artificial Sequence
  chemically synthesized
tattcgtataaatttctgaggt

SEQ ID NO: 696476 - DNA, 22 bp, Artificial Sequence
  chemically synthesized
attcgtataaatttctgaggta

SEQ ID NO: 696477 - DNA, 22 bp, Artificial Sequence
  chemically synthesized
ttcgtataaatttctgaggtac

SEQ ID NO: 696478 - DNA, 22 bp, Artificial Sequence
  chemically synthesized
gtataaatttctgaggtacaag

SEQ ID NO: 696479 - DNA, 22 bp, Artificial Sequence
  chemically synthesized
taacaaaactgcacttgtacct

SEQ ID NO: 696480 - DNA, 22 bp, Artificial Sequence
  chemically synthesized
ctgaggtacaagtgcagttttg

SEQ ID NO: 696481 - DNA, 22 bp, Artificial Sequence
  chemically synthesized
tgaggtacaagtgcagttttgt

SEQ ID NO: 696482 - DNA, 22 bp, Artificial Sequence
  chemically synthesized
aggtacaagtgcagttttgtta

SEQ ID NO: 696483 - DNA, 22 bp, Artificial Sequence
  chemically synthesized
tgcaatacatccctgtaacaaa

SEQ ID NO: 696484 - DNA, 22 bp, Artificial Sequence
  chemically synthesized
accactatgcaatacatccctg

SEQ ID NO: 696485 - DNA, 22 bp, Artificial Sequence
  chemically synthesized
tgttacagggatgtattgcata

SEQ ID NO: 696486 - DNA, 22 bp, Artificial Sequence
  chemically synthesized
gttacagggatgtattgcatag

SEQ ID NO: 696487 - DNA, 22 bp, Artificial Sequence
  chemically synthesized
ttacagggatgtattgcatagt

SEQ ID NO: 696488 - DNA, 22 bp, Artificial Sequence
  chemically synthesized
cagggatgtattgcatagtggt

SEQ ID NO: 696489 - DNA, 22 bp, Artificial Sequence
  chemically synthesized
aaagcccaggttcaccactatg

SEQ ID NO: 696490 - DNA, 22 bp, Artificial Sequence
  chemically synthesized
catagtggtgaacctgggcttt

SEQ ID NO: 696491 - DNA, 22 bp, Artificial Sequence
  chemically synthesized
gtgatggatacactaaaagccc

SEQ ID NO: 696492 - DNA, 22 bp, Artificial Sequence
  chemically synthesized
ggtgatggatacactaaaagcc

SEQ ID NO: 696493 - DNA, 22 bp, Artificial Sequence
  chemically synthesized
tggtgatggatacactaaaagc

SEQ ID NO: 696494 - DNA, 22 bp, Artificial Sequence
  chemically synthesized
ctttggtgatggatacactaaa

SEQ ID NO: 696495 - DNA, 22 bp, Artificial Sequence
  chemically synthesized
ggcttttagtgtatccatcacc

SEQ ID NO: 696496 - DNA, 22 bp, Artificial Sequence
  chemically synthesized
ttagtgtatccatcaccaaagt

SEQ ID NO: 696497 - DNA, 22 bp, Artificial Sequence
  chemically synthesized
tagtgtatccatcaccaaagta

SEQ ID NO: 696498 - DNA, 22 bp, Artificial Sequence
  chemically synthesized
agtgtatccatcaccaaagtag

SEQ ID NO: 696499 - DNA, 22 bp, Artificial Sequence
  chemically synthesized
gtgtatccatcaccaaagtagt

SEQ ID NO: 696500 - DNA, 22 bp, Artificial Sequence
  chemically synthesized
atgggtacaaggtgcactactt

SEQ ID NO: 696501 - DNA, 22 bp, Artificial Sequence
  chemically synthesized
aatgggtacaaggtgcactact

SEQ ID NO: 696502 - DNA, 22 bp, Artificial Sequence
  chemically synthesized
cttaatgggtacaaggtgcact

SEQ ID NO: 696503 - DNA, 22 bp, Artificial Sequence
  chemically synthesized
gtacccattaagtaatgtctca

SEQ ID NO: 696504 - DNA, 22 bp, Artificial Sequence
  chemically synthesized
tacccattaagtaatgtctcat

SEQ ID NO: 696505 - DNA, 22 bp, Artificial Sequence
  chemically synthesized
ggtgaggggtggataatgagac

SEQ ID NO: 696506 - DNA, 22 bp, Artificial Sequence
  chemically synthesized
agtaatgtctcattatccaccc

SEQ ID NO: 696507 - DNA, 22 bp, Artificial Sequence
  chemically synthesized
attatccacccctcacccagca

SEQ ID NO: 696508 - DNA, 22 bp, Artificial Sequence
  chemically synthesized
agaagggcagaatgctgggtga

SEQ ID NO: 696509 - DNA, 22 bp, Artificial Sequence
  chemically synthesized
tccacccctcacccagcattct

SEQ ID NO: 696510 - DNA, 22 bp, Artificial Sequence
  chemically synthesized
gagattcagaagggcagaatgc

SEQ ID NO: 696511 - DNA, 22 bp, Artificial Sequence
  chemically synthesized
acccagcattctgcccttctga

SEQ ID NO: 696512 - DNA, 22 bp, Artificial Sequence
  chemically synthesized
tgcccttctgaatctccaatgt

SEQ ID NO: 696513 - DNA, 22 bp, Artificial Sequence
  chemically synthesized
cccttctgaatctccaatgtct

SEQ ID NO: 696514 - DNA, 22 bp, Artificial Sequence
  chemically synthesized
ctgaatctccaatgtctatcct

SEQ ID NO: 696515 - DNA, 22 bp, Artificial Sequence
  chemically synthesized
tgaatctccaatgtctatcctt

SEQ ID NO: 696516 - DNA, 22 bp, Artificial Sequence
  chemically synthesized
aatctccaatgtctatccttct

SEQ ID NO: 696517 - DNA, 22 bp, Artificial Sequence
  chemically synthesized
aaatcatcatgataagaaggat

SEQ ID NO: 696518 - DNA, 22 bp, Artificial Sequence
  chemically synthesized
aaaatcatcatgataagaagga

SEQ ID NO: 696519 - DNA, 22 bp, Artificial Sequence
  chemically synthesized
caatgtctatccttcttatcat

SEQ ID NO: 696520 - DNA, 22 bp, Artificial Sequence
  chemically synthesized
atacttaaaatcatcatgataa

SEQ ID NO: 696521 - DNA, 22 bp, Artificial Sequence
  chemically synthesized
tccttcttatcatgatgatttt

SEQ ID NO: 696522 - DNA, 22 bp, Artificial Sequence
  chemically synthesized
cttatcatgatgattttaagta

SEQ ID NO: 696523 - DNA, 22 bp, Artificial Sequence
  chemically synthesized
ttatcatgatgattttaagtat

SEQ ID NO: 696524 - DNA, 22 bp, Artificial Sequence
  chemically synthesized
atcatgatgattttaagtatca

SEQ ID NO: 696525 - DNA, 22 bp, Artificial Sequence
  chemically synthesized
tcatgatgattttaagtatcaa

SEQ ID NO: 696526 - DNA, 22 bp, Artificial Sequence
  chemically synthesized
ataaaggggaggggggagaatt

SEQ ID NO: 696527 - DNA, 22 bp, Artificial Sequence
  chemically synthesized
taataaaggggaggggggagaa

SEQ ID NO: 696528 - DNA, 22 bp, Artificial Sequence
  chemically synthesized
taagtatcaattctcccccctc

SEQ ID NO: 696529 - DNA, 22 bp, Artificial Sequence
  chemically synthesized
aagtatcaattctcccccctcc

SEQ ID NO: 696530 - DNA, 22 bp, Artificial Sequence
  chemically synthesized
agtatcaattctcccccctccc

SEQ ID NO: 696531 - DNA, 22 bp, Artificial Sequence
  chemically synthesized
tccaagtcattctaataaaggg

SEQ ID NO: 696532 - DNA, 22 bp, Artificial Sequence
  chemically synthesized
atccaagtcattctaataaagg

SEQ ID NO: 696533 - DNA, 22 bp, Artificial Sequence
  chemically synthesized
tcccccctcccctttattagaa

SEQ ID NO: 696534 - DNA, 22 bp, Artificial Sequence
  chemically synthesized
ccccctcccctttattagaatg

SEQ ID NO: 696535 - DNA, 22 bp, Artificial Sequence
  chemically synthesized
gaggcttatccaagtcattcta

SEQ ID NO: 696536 - DNA, 22 bp, Artificial Sequence
  chemically synthesized
ccctttattagaatgacttgga

SEQ ID NO: 696537 - DNA, 22 bp, Artificial Sequence
  chemically synthesized
tattagaatgacttggataagc

SEQ ID NO: 696538 - DNA, 22 bp, Artificial Sequence
  chemically synthesized
attagaatgacttggataagcc

SEQ ID NO: 696539 - DNA, 22 bp, Artificial Sequence
  chemically synthesized
aaaaaagttggaggcttatcca

SEQ ID NO: 696540 - DNA, 22 bp, Artificial Sequence
  chemically synthesized
ttagaatgacttggataagcct

SEQ ID NO: 696541 - DNA, 22 bp, Artificial Sequence
  chemically synthesized
gaatgacttggataagcctcca

SEQ ID NO: 696542 - DNA, 22 bp, Artificial Sequence
  chemically synthesized
agattcaaaaaagttggaggct

SEQ ID NO: 696543 - DNA, 22 bp, Artificial Sequence
  chemically synthesized
ggataagcctccaacttttttg

SEQ ID NO: 696544 - DNA, 22 bp, Artificial Sequence
  chemically synthesized
gataagcctccaacttttttga

SEQ ID NO: 696545 - DNA, 22 bp, Artificial Sequence
  chemically synthesized
caacttttttgaatctcagctg

SEQ ID NO: 696546 - DNA, 22 bp, Artificial Sequence
  chemically synthesized
ttttgaatctcagctgtttctt

SEQ ID NO: 696547 - DNA, 22 bp, Artificial Sequence
  chemically synthesized
tttgaatctcagctgtttcttc

SEQ ID NO: 696548 - DNA, 22 bp, Artificial Sequence
  chemically synthesized
ttgaatctcagctgtttcttcc

SEQ ID NO: 696549 - DNA, 22 bp, Artificial Sequence
  chemically synthesized
tgaatctcagctgtttcttcct

SEQ ID NO: 696550 - DNA, 22 bp, Artificial Sequence
  chemically synthesized
aaaaaaaaaaaaaggaagaaac

SEQ ID NO: 696551 - DNA, 22 bp, Artificial Sequence
  chemically synthesized
gaatctcagctgtttcttcctt

SEQ ID NO: 696552 - DNA, 22 bp, Artificial Sequence
  chemically synthesized
aatctcagctgtttcttccttt

SEQ ID NO: 696553 - DNA, 22 bp, Artificial Sequence
  chemically synthesized
agctgtttcttccttttttttt

SEQ ID NO: 696554 - DNA, 22 bp, Artificial Sequence
  chemically synthesized
tttcttcctttttttttttttt

SEQ ID NO: 696555 - DNA, 22 bp, Artificial Sequence
  chemically synthesized
cttccttttttttttttttaac

SEQ ID NO: 696556 - DNA, 22 bp, Artificial Sequence
  chemically synthesized
ttccttttttttttttttaact

SEQ ID NO: 696557 - DNA, 22 bp, Artificial Sequence
  chemically synthesized
ccttttttttttttttaacttt

SEQ ID NO: 696558 - DNA, 22 bp, Artificial Sequence
  chemically synthesized
cttttttttttttttaactttt

SEQ ID NO: 696559 - DNA, 22 bp, Artificial Sequence
  chemically synthesized
ttttttttttttaacttttatt

SEQ ID NO: 696560 - DNA, 22 bp, Artificial Sequence
  chemically synthesized
tttttttttttaacttttattt

SEQ ID NO: 696561 - DNA, 22 bp, Artificial Sequence
  chemically synthesized
ttttttttttaacttttattta

SEQ ID NO: 696562 - DNA, 22 bp, Artificial Sequence
  chemically synthesized
aaaataaataaataaataaaag

SEQ ID NO: 696563 - DNA, 22 bp, Artificial Sequence
  chemically synthesized
tttttttttaacttttatttat

SEQ ID NO: 696564 - DNA, 22 bp, Artificial Sequence
  chemically synthesized
ttttttttaacttttatttatt

SEQ ID NO: 696565 - DNA, 22 bp, Artificial Sequence
  chemically synthesized
tttttttaacttttatttattt

SEQ ID NO: 696566 - DNA, 22 bp, Artificial Sequence
  chemically synthesized
ttttttaacttttatttattta

SEQ ID NO: 696567 - DNA, 22 bp, Artificial Sequence
  chemically synthesized
tttttaacttttatttatttat

SEQ ID NO: 696568 - DNA, 22 bp, Artificial Sequence
  chemically synthesized
ttttaacttttatttatttatt

SEQ ID NO: 696569 - DNA, 22 bp, Artificial Sequence
  chemically synthesized
tttaacttttatttatttattt

SEQ ID NO: 696570 - DNA, 22 bp, Artificial Sequence
  chemically synthesized
ttaacttttatttatttattta

SEQ ID NO: 696571 - DNA, 22 bp, Artificial Sequence
  chemically synthesized
taacttttatttatttatttat

SEQ ID NO: 696572 - DNA, 22 bp, Artificial Sequence
  chemically synthesized
aacttttatttatttatttatt

SEQ ID NO: 696573 - DNA, 22 bp, Artificial Sequence
  chemically synthesized
acttttatttatttatttattt

SEQ ID NO: 696574 - DNA, 22 bp, Artificial Sequence
  chemically synthesized
ttatttatttatttattttgag

SEQ ID NO: 696575 - DNA, 22 bp, Artificial Sequence
  chemically synthesized
tatttatttatttattttgaga

SEQ ID NO: 696576 - DNA, 22 bp, Artificial Sequence
  chemically synthesized
atttatttatttattttgagat

SEQ ID NO: 696577 - DNA, 22 bp, Artificial Sequence
  chemically synthesized
tttatttatttattttgagatg

SEQ ID NO: 696578 - DNA, 22 bp, Artificial Sequence
  chemically synthesized
atttatttattttgagatgggg

SEQ ID NO: 696579 - DNA, 22 bp, Artificial Sequence
  chemically synthesized
tttatttattttgagatggggt

SEQ ID NO: 696580 - DNA, 22 bp, Artificial Sequence
  chemically synthesized
ggtgacagagtgagaccccatc

SEQ ID NO: 696581 - DNA, 22 bp, Artificial Sequence
  chemically synthesized
atttattttgagatggggtctc

SEQ ID NO: 696582 - DNA, 22 bp, Artificial Sequence
  chemically synthesized
tttattttgagatggggtctca

SEQ ID NO: 696583 - DNA, 22 bp, Artificial Sequence
  chemically synthesized
attttgagatggggtctcactc

SEQ ID NO: 696584 - DNA, 22 bp, Artificial Sequence
  chemically synthesized
ttttgagatggggtctcactct

SEQ ID NO: 696585 - DNA, 22 bp, Artificial Sequence
  chemically synthesized
cagcctgggtgacagagtgaga

SEQ ID NO: 696586 - DNA, 22 bp, Artificial Sequence
  chemically synthesized
tgagatggggtctcactctgtc

SEQ ID NO: 696587 - DNA, 22 bp, Artificial Sequence
  chemically synthesized
gagatggggtctcactctgtca

SEQ ID NO: 696588 - DNA, 22 bp, Artificial Sequence
  chemically synthesized
agatggggtctcactctgtcac

SEQ ID NO: 696589 - DNA, 22 bp, Artificial Sequence
  chemically synthesized
cactccagcctgggtgacagag

SEQ ID NO: 696590 - DNA, 22 bp, Artificial Sequence
  chemically synthesized
actctgtcacccaggctggagt

SEQ ID NO: 696591 - DNA, 22 bp, Artificial Sequence
  chemically synthesized
tgtcacccaggctggagtgcag

SEQ ID NO: 696592 - DNA, 22 bp, Artificial Sequence
  chemically synthesized
tcacccaggctggagtgcagtg

SEQ ID NO: 696593 - DNA, 22 bp, Artificial Sequence
  chemically synthesized
cagtgagccgagatcacaccac

SEQ ID NO: 696594 - DNA, 22 bp, Artificial Sequence
  chemically synthesized
gagtgcagtggtgtgatctcgg

SEQ ID NO: 696595 - DNA, 22 bp, Artificial Sequence
  chemically synthesized
aaccagggaggcggaggttgca

SEQ ID NO: 696596 - DNA, 22 bp, Artificial Sequence
  chemically synthesized
gaaccagggaggcggaggttgc

SEQ ID NO: 696597 - DNA, 22 bp, Artificial Sequence
  chemically synthesized
ggctcactgcaacctccgcctc

SEQ ID NO: 696598 - DNA, 22 bp, Artificial Sequence
  chemically synthesized
actgcaacctccgcctccctgg

SEQ ID NO: 696599 - DNA, 22 bp, Artificial Sequence
  chemically synthesized
caacctccgcctccctggttca

SEQ ID NO: 696600 - DNA, 22 bp, Artificial Sequence
  chemically synthesized
gggcaggggaatcccttgaacc

SEQ ID NO: 696601 - DNA, 22 bp, Artificial Sequence
  chemically synthesized
cgcctccctggttcaagggatt

SEQ ID NO: 696602 - DNA, 22 bp, Artificial Sequence
  chemically synthesized
cctggttcaagggattcccctg

SEQ ID NO: 696603 - DNA, 22 bp, Artificial Sequence
  chemically synthesized
aggaggctggggcaggggaatc

SEQ ID NO: 696604 - DNA, 22 bp, Artificial Sequence
  chemically synthesized
ctcaggaggctggggcagggga

SEQ ID NO: 696605 - DNA, 22 bp, Artificial Sequence
  chemically synthesized
gttcaagggattcccctgcccc

SEQ ID NO: 696606 - DNA, 22 bp, Artificial Sequence
  chemically synthesized
aagggattcccctgccccagcc

SEQ ID NO: 696607 - DNA, 22 bp, Artificial Sequence
  chemically synthesized
tggtcccagctactcaggaggc

SEQ ID NO: 696608 - DNA, 22 bp, Artificial Sequence
  chemically synthesized
ccctgccccagcctcctgagta

SEQ ID NO: 696609 - DNA, 22 bp, Artificial Sequence
  chemically synthesized
ccccagcctcctgagtagctgg

SEQ ID NO: 696610 - DNA, 22 bp, Artificial Sequence
  chemically synthesized
ctgagtagctgggaccacaggt

SEQ ID NO: 696611 - DNA, 22 bp, Artificial Sequence
  chemically synthesized
agtagctgggaccacaggtgca

SEQ ID NO: 696612 - DNA, 22 bp, Artificial Sequence
  chemically synthesized
aatgtagtggcatgcacctgtg

SEQ ID NO: 696613 - DNA, 22 bp, Artificial Sequence
  chemically synthesized
ggaccacaggtgcatgccacta

SEQ ID NO: 696614 - DNA, 22 bp, Artificial Sequence
  chemically synthesized
ccaaagatacaaaacagtagct

SEQ ID NO: 696615 - DNA, 22 bp, Artificial Sequence
  chemically synthesized
taccaaagatacaaaacagtag

SEQ ID NO: 696616 - DNA, 22 bp, Artificial Sequence
  chemically synthesized
cattcagctactgttttgtatc

SEQ ID NO: 696617 - DNA, 22 bp, Artificial Sequence
  chemically synthesized
agctactgttttgtatctttgg

SEQ ID NO: 696618 - DNA, 22 bp, Artificial Sequence
  chemically synthesized
ctgttttgtatctttggtagag

SEQ ID NO: 696619 - DNA, 22 bp, Artificial Sequence
  chemically synthesized
ttttgtatctttggtagagatg

SEQ ID NO: 696620 - DNA, 22 bp, Artificial Sequence
  chemically synthesized
tgtatctttggtagagatgggg

SEQ ID NO: 696621 - DNA, 22 bp, Artificial Sequence
  chemically synthesized
gtatctttggtagagatggggt

SEQ ID NO: 696622 - DNA, 22 bp, Artificial Sequence
  chemically synthesized
tatctttggtagagatggggtt

SEQ ID NO: 696623 - DNA, 22 bp, Artificial Sequence
  chemically synthesized
ggcaacatggcgaaaccccatc

SEQ ID NO: 696624 - DNA, 22 bp, Artificial Sequence
  chemically synthesized
tggtagagatggggtttcgcca

SEQ ID NO: 696625 - DNA, 22 bp, Artificial Sequence
  chemically synthesized
ggtagagatggggtttcgccat

SEQ ID NO: 696626 - DNA, 22 bp, Artificial Sequence
  chemically synthesized
gtagagatggggtttcgccatg

SEQ ID NO: 696627 - DNA, 22 bp, Artificial Sequence
  chemically synthesized
aagaccagcctgggcaacatgg

SEQ ID NO: 696628 - DNA, 22 bp, Artificial Sequence
  chemically synthesized
agcagttcaagaccagcctggg

SEQ ID NO: 696629 - DNA, 22 bp, Artificial Sequence
  chemically synthesized
cgccatgttgcccaggctggtc

SEQ ID NO: 696630 - DNA, 22 bp, Artificial Sequence
  chemically synthesized
gccatgttgcccaggctggtct

SEQ ID NO: 696631 - DNA, 22 bp, Artificial Sequence
  chemically synthesized
agctcagcagttcaagaccagc

SEQ ID NO: 696632 - DNA, 22 bp, Artificial Sequence
  chemically synthesized
gagctcagcagttcaagaccag

SEQ ID NO: 696633 - DNA, 22 bp, Artificial Sequence
  chemically synthesized
cccaggctggtcttgaactgct

SEQ ID NO: 696634 - DNA, 22 bp, Artificial Sequence
  chemically synthesized
gtcttgaactgctgagctcaag

SEQ ID NO: 696635 - DNA, 22 bp, Artificial Sequence
  chemically synthesized
gaactgctgagctcaagtgatc

SEQ ID NO: 696636 - DNA, 22 bp, Artificial Sequence
  chemically synthesized
aactgctgagctcaagtgatcc

SEQ ID NO: 696637 - DNA, 22 bp, Artificial Sequence
  chemically synthesized
gcaggccaaggtgggtggatca

SEQ ID NO: 696638 - DNA, 22 bp, Artificial Sequence
  chemically synthesized
ctgagctcaagtgatccaccca

SEQ ID NO: 696639 - DNA, 22 bp, Artificial Sequence
  chemically synthesized
ggcaggccaaggtgggtggatc

SEQ ID NO: 696640 - DNA, 22 bp, Artificial Sequence
  chemically synthesized
tggcaggccaaggtgggtggat

SEQ ID NO: 696641 - DNA, 22 bp, Artificial Sequence
  chemically synthesized
agctcaagtgatccacccacct

SEQ ID NO: 696642 - DNA, 22 bp, Artificial Sequence
  chemically synthesized
aagtgatccacccaccttggcc

SEQ ID NO: 696643 - DNA, 22 bp, Artificial Sequence
  chemically synthesized
taatcccagcactttggcaggc

SEQ ID NO: 696644 - DNA, 22 bp, Artificial Sequence
  chemically synthesized
atgcctgtaatcccagcacttt

SEQ ID NO: 696645 - DNA, 22 bp, Artificial Sequence
  chemically synthesized
ggcctgccaaagtgctgggatt

SEQ ID NO: 696646 - DNA, 22 bp, Artificial Sequence
  chemically synthesized
gcctgccaaagtgctgggatta

SEQ ID NO: 696647 - DNA, 22 bp, Artificial Sequence
  chemically synthesized
ccaaagtgctgggattacaggc

SEQ ID NO: 696648 - DNA, 22 bp, Artificial Sequence
  chemically synthesized
tcagtcgggcgtggtggctcat

SEQ ID NO: 696649 - DNA, 22 bp, Artificial Sequence
  chemically synthesized
ggattacaggcatgagccacca

SEQ ID NO: 696650 - DNA, 22 bp, Artificial Sequence
  chemically synthesized
caggcatgagccaccacgcccg

SEQ ID NO: 696651 - DNA, 22 bp, Artificial Sequence
  chemically synthesized
tccaataaagaaaaaaacggct

SEQ ID NO: 696652 - DNA, 22 bp, Artificial Sequence
  chemically synthesized
ttatccaataaagaaaaaaacg

SEQ ID NO: 696653 - DNA, 22 bp, Artificial Sequence
  chemically synthesized
attatccaataaagaaaaaaac

SEQ ID NO: 696654 - DNA, 22 bp, Artificial Sequence
  chemically synthesized
cacttattatccaataaagaaa

SEQ ID NO: 696655 - DNA, 22 bp, Artificial Sequence
  chemically synthesized
atagccgtttttttctttattg

SEQ ID NO: 696656 - DNA, 22 bp, Artificial Sequence
  chemically synthesized
taacactccacttattatccaa

SEQ ID NO: 696657 - DNA, 22 bp, Artificial Sequence
  chemically synthesized
gtaacactccacttattatcca

SEQ ID NO: 696658 - DNA, 22 bp, Artificial Sequence
  chemically synthesized
ttttctttattggataataagt

SEQ ID NO: 696659 - DNA, 22 bp, Artificial Sequence
  chemically synthesized
tttctttattggataataagtg

SEQ ID NO: 696660 - DNA, 22 bp, Artificial Sequence
  chemically synthesized
ttctttattggataataagtgg

SEQ ID NO: 696661 - DNA, 22 bp, Artificial Sequence
  chemically synthesized
tctttattggataataagtgga

SEQ ID NO: 696662 - DNA, 22 bp, Artificial Sequence
  chemically synthesized
ctttattggataataagtggag

SEQ ID NO: 696663 - DNA, 22 bp, Artificial Sequence
  chemically synthesized
atccttgtaacactccacttat

SEQ ID NO: 696664 - DNA, 22 bp, Artificial Sequence
  chemically synthesized
tttattggataataagtggagt

SEQ ID NO: 696665 - DNA, 22 bp, Artificial Sequence
  chemically synthesized
aatccttgtaacactccactta

SEQ ID NO: 696666 - DNA, 22 bp, Artificial Sequence
  chemically synthesized
tattggataataagtggagtgt

SEQ ID NO: 696667 - DNA, 22 bp, Artificial Sequence
  chemically synthesized
attggataataagtggagtgtt

SEQ ID NO: 696668 - DNA, 22 bp, Artificial Sequence
  chemically synthesized
ttggataataagtggagtgtta

SEQ ID NO: 696669 - DNA, 22 bp, Artificial Sequence
  chemically synthesized
ccatttaatccttgtaacactc

SEQ ID NO: 696670 - DNA, 22 bp, Artificial Sequence
  chemically synthesized
gataataagtggagtgttacaa

SEQ ID NO: 696671 - DNA, 22 bp, Artificial Sequence
  chemically synthesized
cccatttaatccttgtaacact

SEQ ID NO: 696672 - DNA, 22 bp, Artificial Sequence
  chemically synthesized
tatcttcccatttaatccttgt

SEQ ID NO: 696673 - DNA, 22 bp, Artificial Sequence
  chemically synthesized
atctgtatcttcccatttaatc

SEQ ID NO: 696674 - DNA, 22 bp, Artificial Sequence
  chemically synthesized
catctgtatcttcccatttaat

SEQ ID NO: 696675 - DNA, 22 bp, Artificial Sequence
  chemically synthesized
caaggattaaatgggaagatac

SEQ ID NO: 696676 - DNA, 22 bp, Artificial Sequence
  chemically synthesized
aatgacaaagtgtttcatctgt

SEQ ID NO: 696677 - DNA, 22 bp, Artificial Sequence
  chemically synthesized
aatgggaagatacagatgaaac

SEQ ID NO: 696678 - DNA, 22 bp, Artificial Sequence
  chemically synthesized
tgtgctaaatgacaaagtgttt

SEQ ID NO: 696679 - DNA, 22 bp, Artificial Sequence
  chemically synthesized
ctatgtgctaaatgacaaagtg

SEQ ID NO: 696680 - DNA, 22 bp, Artificial Sequence
  chemically synthesized
atgtgtgcctactatgtgctaa

SEQ ID NO: 696681 - DNA, 22 bp, Artificial Sequence
  chemically synthesized
aatgtgtgcctactatgtgcta

SEQ ID NO: 696682 - DNA, 22 bp, Artificial Sequence
  chemically synthesized
tgtcatttagcacatagtaggc

SEQ ID NO: 696683 - DNA, 22 bp, Artificial Sequence
  chemically synthesized
gtcatttagcacatagtaggca

SEQ ID NO: 696684 - DNA, 22 bp, Artificial Sequence
  chemically synthesized
tcatttagcacatagtaggcac

SEQ ID NO: 696685 - DNA, 22 bp, Artificial Sequence
  chemically synthesized
agcacatagtaggcacacatta

SEQ ID NO: 696686 - DNA, 22 bp, Artificial Sequence
  chemically synthesized
gcacatagtaggcacacattaa

SEQ ID NO: 696687 - DNA, 22 bp, Artificial Sequence
  chemically synthesized
gacaggaagaaaagcaaagttt

SEQ ID NO: 696688 - DNA, 22 bp, Artificial Sequence
  chemically synthesized
ctagacaggaagaaaagcaaag

SEQ ID NO: 696689 - DNA, 22 bp, Artificial Sequence
  chemically synthesized
aactttgcttttcttcctgtct

SEQ ID NO: 696690 - DNA, 22 bp, Artificial Sequence
  chemically synthesized
tgcttttcttcctgtctagcag

SEQ ID NO: 696691 - DNA, 22 bp, Artificial Sequence
  chemically synthesized
gcttttcttcctgtctagcaga

SEQ ID NO: 696692 - DNA, 22 bp, Artificial Sequence
  chemically synthesized
cttttcttcctgtctagcagat

SEQ ID NO: 696693 - DNA, 22 bp, Artificial Sequence
  chemically synthesized
ttcttcctgtctagcagattac

SEQ ID NO: 696694 - DNA, 22 bp, Artificial Sequence
  chemically synthesized
tcttcctgtctagcagattaca

SEQ ID NO: 696695 - DNA, 22 bp, Artificial Sequence
  chemically synthesized
cttcctgtctagcagattacat

SEQ ID NO: 696696 - DNA, 22 bp, Artificial Sequence
  chemically synthesized
atagataagtccatgtaatctg

SEQ ID NO: 696697 - DNA, 22 bp, Artificial Sequence
  chemically synthesized
ttcctgtctagcagattacatg

SEQ ID NO: 696698 - DNA, 22 bp, Artificial Sequence
  chemically synthesized
cctgtctagcagattacatgga

SEQ ID NO: 696699 - DNA, 22 bp, Artificial Sequence
  chemically synthesized
ctgtctagcagattacatggac

SEQ ID NO: 696700 - DNA, 22 bp, Artificial Sequence
  chemically synthesized
tctagcagattacatggactta

SEQ ID NO: 696701 - DNA, 22 bp, Artificial Sequence
  chemically synthesized
gcagattacatggacttatcta

SEQ ID NO: 696702 - DNA, 22 bp, Artificial Sequence
  chemically synthesized
taaacagtgtgtctcatagata

SEQ ID NO: 696703 - DNA, 22 bp, Artificial Sequence
  chemically synthesized
tgtaaacagtgtgtctcataga

SEQ ID NO: 696704 - DNA, 22 bp, Artificial Sequence
  chemically synthesized
ctgtaaacagtgtgtctcatag

SEQ ID NO: 696705 - DNA, 22 bp, Artificial Sequence
  chemically synthesized
catggacttatctatgagacac

SEQ ID NO: 696706 - DNA, 22 bp, Artificial Sequence
  chemically synthesized
tctgtaaacagtgtgtctcata

SEQ ID NO: 696707 - DNA, 22 bp, Artificial Sequence
  chemically synthesized
atgagttttctgtaaacagtgt

SEQ ID NO: 696708 - DNA, 22 bp, Artificial Sequence
  chemically synthesized
atctatgagacacactgtttac

SEQ ID NO: 696709 - DNA, 22 bp, Artificial Sequence
  chemically synthesized
tctatgagacacactgtttaca

SEQ ID NO: 696710 - DNA, 22 bp, Artificial Sequence
  chemically synthesized
ttcatgagttttctgtaaacag

SEQ ID NO: 696711 - DNA, 22 bp, Artificial Sequence
  chemically synthesized
gttcatgagttttctgtaaaca

SEQ ID NO: 696712 - DNA, 22 bp, Artificial Sequence
  chemically synthesized
tgagacacactgtttacagaaa

SEQ ID NO: 696713 - DNA, 22 bp, Artificial Sequence
  chemically synthesized
ttgttcatgagttttctgtaaa

SEQ ID NO: 696714 - DNA, 22 bp, Artificial Sequence
  chemically synthesized
cttgttcatgagttttctgtaa

SEQ ID NO: 696715 - DNA, 22 bp, Artificial Sequence
  chemically synthesized
tttcttgttcatgagttttctg

SEQ ID NO: 696716 - DNA, 22 bp, Artificial Sequence
  chemically synthesized
gtcactatttcttgttcatgag

SEQ ID NO: 696717 - DNA, 22 bp, Artificial Sequence
  chemically synthesized
tttacagaaaactcatgaacaa

SEQ ID NO: 696718 - DNA, 22 bp, Artificial Sequence
  chemically synthesized
ggtcactatttcttgttcatga

SEQ ID NO: 696719 - DNA, 22 bp, Artificial Sequence
  chemically synthesized
tggtcactatttcttgttcatg

SEQ ID NO: 696720 - DNA, 22 bp, Artificial Sequence
  chemically synthesized
ttggtcactatttcttgttcat

SEQ ID NO: 696721 - DNA, 22 bp, Artificial Sequence
  chemically synthesized
acagaaaactcatgaacaagaa

SEQ ID NO: 696722 - DNA, 22 bp, Artificial Sequence
  chemically synthesized
cagaaaactcatgaacaagaaa

SEQ ID NO: 696723 - DNA, 22 bp, Artificial Sequence
  chemically synthesized
cttttggtcactatttcttgtt

SEQ ID NO: 696724 - DNA, 22 bp, Artificial Sequence
  chemically synthesized
ccttttggtcactatttcttgt

SEQ ID NO: 696725 - DNA, 22 bp, Artificial Sequence
  chemically synthesized
tccttttggtcactatttcttg

SEQ ID NO: 696726 - DNA, 22 bp, Artificial Sequence
  chemically synthesized
tttccttttggtcactatttct

SEQ ID NO: 696727 - DNA, 22 bp, Artificial Sequence
  chemically synthesized
ctttccttttggtcactatttc

SEQ ID NO: 696728 - DNA, 22 bp, Artificial Sequence
  chemically synthesized
tctttccttttggtcactattt

SEQ ID NO: 696729 - DNA, 22 bp, Artificial Sequence
  chemically synthesized
atgaacaagaaatagtgaccaa

SEQ ID NO: 696730 - DNA, 22 bp, Artificial Sequence
  chemically synthesized
ttttctttccttttggtcacta

SEQ ID NO: 696731 - DNA, 22 bp, Artificial Sequence
  chemically synthesized
ttgttttctttccttttggtca

SEQ ID NO: 696732 - DNA, 22 bp, Artificial Sequence
  chemically synthesized
gttgttttctttccttttggtc

SEQ ID NO: 696733 - DNA, 22 bp, Artificial Sequence
  chemically synthesized
tgttgttttctttccttttggt

SEQ ID NO: 696734 - DNA, 22 bp, Artificial Sequence
  chemically synthesized
gaaggaatcgttttgttgtttt

SEQ ID NO: 696735 - DNA, 22 bp, Artificial Sequence
  chemically synthesized
agaaggaatcgttttgttgttt

SEQ ID NO: 696736 - DNA, 22 bp, Artificial Sequence
  chemically synthesized
tagaaggaatcgttttgttgtt

SEQ ID NO: 696737 - DNA, 22 bp, Artificial Sequence
  chemically synthesized
ctttagaaggaatcgttttgtt

SEQ ID NO: 696738 - DNA, 22 bp, Artificial Sequence
  chemically synthesized
ttgctttagaaggaatcgtttt

SEQ ID NO: 696739 - DNA, 22 bp, Artificial Sequence
  chemically synthesized
gttgctttagaaggaatcgttt

SEQ ID NO: 696740 - DNA, 22 bp, Artificial Sequence
  chemically synthesized
tgttgctttagaaggaatcgtt

SEQ ID NO: 696741 - DNA, 22 bp, Artificial Sequence
  chemically synthesized
tttgttgctttagaaggaatcg

SEQ ID NO: 696742 - DNA, 22 bp, Artificial Sequence
  chemically synthesized
ctttgttgctttagaaggaatc

SEQ ID NO: 696743 - DNA, 22 bp, Artificial Sequence
  chemically synthesized
cttctttgttgctttagaagga

SEQ ID NO: 696744 - DNA, 22 bp, Artificial Sequence
  chemically synthesized
gcttctttgttgctttagaagg

SEQ ID NO: 696745 - DNA, 22 bp, Artificial Sequence
  chemically synthesized
acttgcttctttgttgctttag

SEQ ID NO: 696746 - DNA, 22 bp, Artificial Sequence
  chemically synthesized
aacttgcttctttgttgcttta

SEQ ID NO: 696747 - DNA, 22 bp, Artificial Sequence
  chemically synthesized
taacttgcttctttgttgcttt

SEQ ID NO: 696748 - DNA, 22 bp, Artificial Sequence
  chemically synthesized
ttaacttgcttctttgttgctt

SEQ ID NO: 696749 - DNA, 22 bp, Artificial Sequence
  chemically synthesized
cttctaaagcaacaaagaagca

SEQ ID NO: 696750 - DNA, 22 bp, Artificial Sequence
  chemically synthesized
ctaaagcaacaaagaagcaagt

SEQ ID NO: 696751 - DNA, 22 bp, Artificial Sequence
  chemically synthesized
taaagcaacaaagaagcaagtt

SEQ ID NO: 696752 - DNA, 22 bp, Artificial Sequence
  chemically synthesized
aagcaacaaagaagcaagttaa

SEQ ID NO: 696753 - DNA, 22 bp, Artificial Sequence
  chemically synthesized
catgtcagatggtcagtgcaat

SEQ ID NO: 696754 - DNA, 22 bp, Artificial Sequence
  chemically synthesized
aaaattacacattgcactgacc

SEQ ID NO: 696755 - DNA, 22 bp, Artificial Sequence
  chemically synthesized
cacattgcactgaccatctgac

SEQ ID NO: 696756 - DNA, 22 bp, Artificial Sequence
  chemically synthesized
cactgaccatctgacatgcaat

SEQ ID NO: 696757 - DNA, 22 bp, Artificial Sequence
  chemically synthesized
gtccccaaagccattgcatgtc

SEQ ID NO: 696758 - DNA, 22 bp, Artificial Sequence
  chemically synthesized
ggtccccaaagccattgcatgt

SEQ ID NO: 696759 - DNA, 22 bp, Artificial Sequence
  chemically synthesized
accatctgacatgcaatggctt

SEQ ID NO: 696760 - DNA, 22 bp, Artificial Sequence
  chemically synthesized
acatgcaatggctttggggacc

SEQ ID NO: 696761 - DNA, 22 bp, Artificial Sequence
  chemically synthesized
tccacatccatcttggtcccca

SEQ ID NO: 696762 - DNA, 22 bp, Artificial Sequence
  chemically synthesized
atccacatccatcttggtcccc

SEQ ID NO: 696763 - DNA, 22 bp, Artificial Sequence
  chemically synthesized
agcttatccacatccatcttgg

SEQ ID NO: 696764 - DNA, 22 bp, Artificial Sequence
  chemically synthesized
tcagcttatccacatccatctt

SEQ ID NO: 696765 - DNA, 22 bp, Artificial Sequence
  chemically synthesized
ctcagcttatccacatccatct

SEQ ID NO: 696766 - DNA, 22 bp, Artificial Sequence
  chemically synthesized
tctcagcttatccacatccatc

SEQ ID NO: 696767 - DNA, 22 bp, Artificial Sequence
  chemically synthesized
tggggaccaagatggatgtgga

SEQ ID NO: 696768 - DNA, 22 bp, Artificial Sequence
  chemically synthesized
tttctcagcttatccacatcca

SEQ ID NO: 696769 - DNA, 22 bp, Artificial Sequence
  chemically synthesized
ggggaccaagatggatgtggat

SEQ ID NO: 696770 - DNA, 22 bp, Artificial Sequence
  chemically synthesized
ctttctcagcttatccacatcc

SEQ ID NO: 696771 - DNA, 22 bp, Artificial Sequence
  chemically synthesized
gggaccaagatggatgtggata

SEQ ID NO: 696772 - DNA, 22 bp, Artificial Sequence
  chemically synthesized
tctttctcagcttatccacatc

SEQ ID NO: 696773 - DNA, 22 bp, Artificial Sequence
  chemically synthesized
ttctttctcagcttatccacat

SEQ ID NO: 696774 - DNA, 22 bp, Artificial Sequence
  chemically synthesized
tttttctttctcagcttatcca

SEQ ID NO: 696775 - DNA, 22 bp, Artificial Sequence
  chemically synthesized
tgtttttctttctcagcttatc

SEQ ID NO: 696776 - DNA, 22 bp, Artificial Sequence
  chemically synthesized
ctgtttttctttctcagcttat

SEQ ID NO: 696777 - DNA, 22 bp, Artificial Sequence
  chemically synthesized
tctgtttttctttctcagctta

SEQ ID NO: 696778 - DNA, 22 bp, Artificial Sequence
  chemically synthesized
ttctgtttttctttctcagctt

SEQ ID NO: 696779 - DNA, 22 bp, Artificial Sequence
  chemically synthesized
tttctgtttttctttctcagct

SEQ ID NO: 696780 - DNA, 22 bp, Artificial Sequence
  chemically synthesized
ttttctgtttttctttctcagc

SEQ ID NO: 696781 - DNA, 22 bp, Artificial Sequence
  chemically synthesized
cttttttctgtttttctttctc

SEQ ID NO: 696782 - DNA, 22 bp, Artificial Sequence
  chemically synthesized
aactgcttttttctgtttttct

SEQ ID NO: 696783 - DNA, 22 bp, Artificial Sequence
  chemically synthesized
tcaactgcttttttctgttttt

SEQ ID NO: 696784 - DNA, 22 bp, Artificial Sequence
  chemically synthesized
agaaagaaaaacagaaaaaagc

SEQ ID NO: 696785 - DNA, 22 bp, Artificial Sequence
  chemically synthesized
aaactctcaactgcttttttct

SEQ ID NO: 696786 - DNA, 22 bp, Artificial Sequence
  chemically synthesized
ctgaaactctcaactgcttttt

SEQ ID NO: 696787 - DNA, 22 bp, Artificial Sequence
  chemically synthesized
cctgaaactctcaactgctttt

SEQ ID NO: 696788 - DNA, 22 bp, Artificial Sequence
  chemically synthesized
ttcctgaaactctcaactgctt

SEQ ID NO: 696789 - DNA, 22 bp, Artificial Sequence
  chemically synthesized
ctcttcctgaaactctcaactg

SEQ ID NO: 696790 - DNA, 22 bp, Artificial Sequence
  chemically synthesized
gctgctcttcctgaaactctca

SEQ ID NO: 696791 - DNA, 22 bp, Artificial Sequence
  chemically synthesized
aaaagcctcgctgctcttcctg

SEQ ID NO: 696792 - DNA, 22 bp, Artificial Sequence
  chemically synthesized
agagtttcaggaagagcagcga

SEQ ID NO: 696793 - DNA, 22 bp, Artificial Sequence
  chemically synthesized
caggaagagcagcgaggctttt

SEQ ID NO: 696794 - DNA, 22 bp, Artificial Sequence
  chemically synthesized
aggaagagcagcgaggcttttc

SEQ ID NO: 696795 - DNA, 22 bp, Artificial Sequence
  chemically synthesized
gggggatgaaactgaaaagcct

SEQ ID NO: 696796 - DNA, 22 bp, Artificial Sequence
  chemically synthesized
ctggggggatgaaactgaaaag

SEQ ID NO: 696797 - DNA, 22 bp, Artificial Sequence
  chemically synthesized
actcctggggggatgaaactga

SEQ ID NO: 696798 - DNA, 22 bp, Artificial Sequence
  chemically synthesized
ttcagtttcatccccccaggag

SEQ ID NO: 696799 - DNA, 22 bp, Artificial Sequence
  chemically synthesized
tgataccattaactcctggggg

SEQ ID NO: 696800 - DNA, 22 bp, Artificial Sequence
  chemically synthesized
tcagtttcatccccccaggagt

SEQ ID NO: 696801 - DNA, 22 bp, Artificial Sequence
  chemically synthesized
cagtttcatccccccaggagtt

SEQ ID NO: 696802 - DNA, 22 bp, Artificial Sequence
  chemically synthesized
tgtgataccattaactcctggg

SEQ ID NO: 696803 - DNA, 22 bp, Artificial Sequence
  chemically synthesized
agtttcatccccccaggagtta

SEQ ID NO: 696804 - DNA, 22 bp, Artificial Sequence
  chemically synthesized
ctgtgataccattaactcctgg

SEQ ID NO: 696805 - DNA, 22 bp, Artificial Sequence
  chemically synthesized
tctgtgataccattaactcctg

SEQ ID NO: 696806 - DNA, 22 bp, Artificial Sequence
  chemically synthesized
catccccccaggagttaatggt

SEQ ID NO: 696807 - DNA, 22 bp, Artificial Sequence
  chemically synthesized
atccccccaggagttaatggta

SEQ ID NO: 696808 - DNA, 22 bp, Artificial Sequence
  chemically synthesized
ggcaaatgatcacgttttctgt

SEQ ID NO: 696809 - DNA, 22 bp, Artificial Sequence
  chemically synthesized
atggtatcacagaaaacgtgat

SEQ ID NO: 696810 - DNA, 22 bp, Artificial Sequence
  chemically synthesized
tcggcattcggcaaatgatcac

SEQ ID NO: 696811 - DNA, 22 bp, Artificial Sequence
  chemically synthesized
actgtcggcattcggcaaatga

SEQ ID NO: 696812 - DNA, 22 bp, Artificial Sequence
  chemically synthesized
gctcactgtcggcattcggcaa

SEQ ID NO: 696813 - DNA, 22 bp, Artificial Sequence
  chemically synthesized
agctcactgtcggcattcggca

SEQ ID NO: 696814 - DNA, 22 bp, Artificial Sequence
  chemically synthesized
gatgagacttagctcactgtcg

SEQ ID NO: 696815 - DNA, 22 bp, Artificial Sequence
  chemically synthesized
gccgaatgccgacagtgagcta

SEQ ID NO: 696816 - DNA, 22 bp, Artificial Sequence
  chemically synthesized
ccgaatgccgacagtgagctaa

SEQ ID NO: 696817 - DNA, 22 bp, Artificial Sequence
  chemically synthesized
agagcaggtcctagatgagact

SEQ ID NO: 696818 - DNA, 22 bp, Artificial Sequence
  chemically synthesized
taagagcaggtcctagatgaga

SEQ ID NO: 696819 - DNA, 22 bp, Artificial Sequence
  chemically synthesized
ctaagagcaggtcctagatgag

SEQ ID NO: 696820 - DNA, 22 bp, Artificial Sequence
  chemically synthesized
gaaagcttctaagagcaggtcc

SEQ ID NO: 696821 - DNA, 22 bp, Artificial Sequence
  chemically synthesized
agtctcatctaggacctgctct

SEQ ID NO: 696822 - DNA, 22 bp, Artificial Sequence
  chemically synthesized
tggaaagcttctaagagcaggt

SEQ ID NO: 696823 - DNA, 22 bp, Artificial Sequence
  chemically synthesized
actctggaaagcttctaagagc

SEQ ID NO: 696824 - DNA, 22 bp, Artificial Sequence
  chemically synthesized
atctaggacctgctcttagaag

SEQ ID NO: 696825 - DNA, 22 bp, Artificial Sequence
  chemically synthesized
ggacctgctcttagaagctttc

SEQ ID NO: 696826 - DNA, 22 bp, Artificial Sequence
  chemically synthesized
gatattgactctggaaagcttc

SEQ ID NO: 696827 - DNA, 22 bp, Artificial Sequence
  chemically synthesized
tggatattgactctggaaagct

SEQ ID NO: 696828 - DNA, 22 bp, Artificial Sequence
  chemically synthesized
ctcttagaagctttccagagtc

SEQ ID NO: 696829 - DNA, 22 bp, Artificial Sequence
  chemically synthesized
ttagaagctttccagagtcaat

SEQ ID NO: 696830 - DNA, 22 bp, Artificial Sequence
  chemically synthesized
agaagctttccagagtcaatat

SEQ ID NO: 696831 - DNA, 22 bp, Artificial Sequence
  chemically synthesized
gaagctttccagagtcaatatc

SEQ ID NO: 696832 - DNA, 22 bp, Artificial Sequence
  chemically synthesized
tccagagtcaatatccagagat

SEQ ID NO: 696833 - DNA, 22 bp, Artificial Sequence
  chemically synthesized
ccagagtcaatatccagagata

SEQ ID NO: 696834 - DNA, 22 bp, Artificial Sequence
  chemically synthesized
cagagtcaatatccagagatac

SEQ ID NO: 696835 - DNA, 22 bp, Artificial Sequence
  chemically synthesized
tacaagatagaaaaacagtatc

SEQ ID NO: 696836 - DNA, 22 bp, Artificial Sequence
  chemically synthesized
aaccgttgtacaagatagaaaa

SEQ ID NO: 696837 - DNA, 22 bp, Artificial Sequence
  chemically synthesized
aaaccgttgtacaagatagaaa

SEQ ID NO: 696838 - DNA, 22 bp, Artificial Sequence
  chemically synthesized
taaaccgttgtacaagatagaa

SEQ ID NO: 696839 - DNA, 22 bp, Artificial Sequence
  chemically synthesized
ttaaaccgttgtacaagataga

SEQ ID NO: 696840 - DNA, 22 bp, Artificial Sequence
  chemically synthesized
tttaaaccgttgtacaagatag

SEQ ID NO: 696841 - DNA, 22 bp, Artificial Sequence
  chemically synthesized
tttttctatcttgtacaacggt

SEQ ID NO: 696842 - DNA, 22 bp, Artificial Sequence
  chemically synthesized
caaattttttaaaccgttgtac

SEQ ID NO: 696843 - DNA, 22 bp, Artificial Sequence
  chemically synthesized
ttctatcttgtacaacggttta

SEQ ID NO: 696844 - DNA, 22 bp, Artificial Sequence
  chemically synthesized
tctatcttgtacaacggtttaa

SEQ ID NO: 696845 - DNA, 22 bp, Artificial Sequence
  chemically synthesized
ctatcttgtacaacggtttaaa

SEQ ID NO: 696846 - DNA, 22 bp, Artificial Sequence
  chemically synthesized
tatcttgtacaacggtttaaaa

SEQ ID NO: 696847 - DNA, 22 bp, Artificial Sequence
  chemically synthesized
tcttgtacaacggtttaaaaaa

SEQ ID NO: 696848 - DNA, 22 bp, Artificial Sequence
  chemically synthesized
tcacgttgcaaattttttaaac

SEQ ID NO: 696849 - DNA, 22 bp, Artificial Sequence
  chemically synthesized
gtacaacggtttaaaaaatttg

SEQ ID NO: 696850 - DNA, 22 bp, Artificial Sequence
  chemically synthesized
tacaacggtttaaaaaatttgc

SEQ ID NO: 696851 - DNA, 22 bp, Artificial Sequence
  chemically synthesized
tataaatcagtgctgtcacgtt

SEQ ID NO: 696852 - DNA, 22 bp, Artificial Sequence
  chemically synthesized
aaaaaatttgcaacgtgacagc

SEQ ID NO: 696853 - DNA, 22 bp, Artificial Sequence
  chemically synthesized
aaaaatttgcaacgtgacagca

SEQ ID NO: 696854 - DNA, 22 bp, Artificial Sequence
  chemically synthesized
gcaacgtgacagcactgattta

SEQ ID NO: 696855 - DNA, 22 bp, Artificial Sequence
  chemically synthesized
caacgtgacagcactgatttat

SEQ ID NO: 696856 - DNA, 22 bp, Artificial Sequence
  chemically synthesized
tgagtgcattgtataaatcagt

SEQ ID NO: 696857 - DNA, 22 bp, Artificial Sequence
  chemically synthesized
aagaaatagactgtgagtgcat

SEQ ID NO: 696858 - DNA, 22 bp, Artificial Sequence
  chemically synthesized
aaagaaatagactgtgagtgca

SEQ ID NO: 696859 - DNA, 22 bp, Artificial Sequence
  chemically synthesized
taaagaaatagactgtgagtgc

SEQ ID NO: 696860 - DNA, 22 bp, Artificial Sequence
  chemically synthesized
atttatacaatgcactcacagt

SEQ ID NO: 696861 - DNA, 22 bp, Artificial Sequence
  chemically synthesized
ttaaagaaatagactgtgagtg

SEQ ID NO: 696862 - DNA, 22 bp, Artificial Sequence
  chemically synthesized
tttaaagaaatagactgtgagt

SEQ ID NO: 696863 - DNA, 22 bp, Artificial Sequence
  chemically synthesized
ttttaaagaaatagactgtgag

SEQ ID NO: 696864 - DNA, 22 bp, Artificial Sequence
  chemically synthesized
atacaatgcactcacagtctat

SEQ ID NO: 696865 - DNA, 22 bp, Artificial Sequence
  chemically synthesized
ttttttaaagaaatagactgtg

SEQ ID NO: 696866 - DNA, 22 bp, Artificial Sequence
  chemically synthesized
tacaatgcactcacagtctatt

SEQ ID NO: 696867 - DNA, 22 bp, Artificial Sequence
  chemically synthesized
tgtatgtattcttttttaaaga

SEQ ID NO: 696868 - DNA, 22 bp, Artificial Sequence
  chemically synthesized
acagtctatttctttaaaaaag

SEQ ID NO: 696869 - DNA, 22 bp, Artificial Sequence
  chemically synthesized
tgtgtatgtattcttttttaaa

SEQ ID NO: 696870 - DNA, 22 bp, Artificial Sequence
  chemically synthesized
tctgtgtatgtattctttttta

SEQ ID NO: 696871 - DNA, 22 bp, Artificial Sequence
  chemically synthesized
tctctgtgtatgtattcttttt

SEQ ID NO: 696872 - DNA, 22 bp, Artificial Sequence
  chemically synthesized
tctctctgtgtatgtattcttt

SEQ ID NO: 696873 - DNA, 22 bp, Artificial Sequence
  chemically synthesized
tttctttaaaaaagaatacata

SEQ ID NO: 696874 - DNA, 22 bp, Artificial Sequence
  chemically synthesized
tctctctctgtgtatgtattct

SEQ ID NO: 696875 - DNA, 22 bp, Artificial Sequence
  chemically synthesized
tctctctctctgtgtatgtatt

SEQ ID NO: 696876 - DNA, 22 bp, Artificial Sequence
  chemically synthesized
ctttaaaaaagaatacatacac

SEQ ID NO: 696877 - DNA, 22 bp, Artificial Sequence
  chemically synthesized
tttaaaaaagaatacatacaca

SEQ ID NO: 696878 - DNA, 22 bp, Artificial Sequence
  chemically synthesized
tctctctctctctgtgtatgta

SEQ ID NO: 696879 - DNA, 22 bp, Artificial Sequence
  chemically synthesized
taaaaaagaatacatacacaga

SEQ ID NO: 696880 - DNA, 22 bp, Artificial Sequence
  chemically synthesized
tctctctctctctctgtgtatg

SEQ ID NO: 696881 - DNA, 22 bp, Artificial Sequence
  chemically synthesized
aaaaaagaatacatacacagag

SEQ ID NO: 696882 - DNA, 22 bp, Artificial Sequence
  chemically synthesized
aaaaagaatacatacacagaga

SEQ ID NO: 696883 - DNA, 22 bp, Artificial Sequence
  chemically synthesized
tctctctctctctctctgtgta

SEQ ID NO: 696884 - DNA, 22 bp, Artificial Sequence
  chemically synthesized
tctctctctctctctctctgtg

SEQ ID NO: 696885 - DNA, 22 bp, Artificial Sequence
  chemically synthesized
tctctctctctctctctctctg

SEQ ID NO: 696886 - DNA, 22 bp, Artificial Sequence
  chemically synthesized
tctctctctctctctctctctc

SEQ ID NO: 696887 - DNA, 22 bp, Artificial Sequence
  chemically synthesized
tctctctctctctctctctctc

SEQ ID NO: 696888 - DNA, 22 bp, Artificial Sequence
  chemically synthesized
tctctctctctctctctctctc

SEQ ID NO: 696889 - DNA, 22 bp, Artificial Sequence
  chemically synthesized
tctctctctctctctctctctc

SEQ ID NO: 696890 - DNA, 22 bp, Artificial Sequence
  chemically synthesized
tctctctctctctctctctctc

SEQ ID NO: 696891 - DNA, 22 bp, Artificial Sequence
  chemically synthesized
tctctctctctctctctctctc

SEQ ID NO: 696892 - DNA, 22 bp, Artificial Sequence
  chemically synthesized
tctctctctctctctctctctc

SEQ ID NO: 696893 - DNA, 22 bp, Artificial Sequence
  chemically synthesized
acacggtaaaacactctctctc

SEQ ID NO: 696894 - DNA, 22 bp, Artificial Sequence
  chemically synthesized
aggaaaaatgttaacacggtaa

SEQ ID NO: 696895 - DNA, 22 bp, Artificial Sequence
  chemically synthesized
caggaaaaatgttaacacggta

SEQ ID NO: 696896 - DNA, 22 bp, Artificial Sequence
  chemically synthesized
ttcaggaaaaatgttaacacgg

SEQ ID NO: 696897 - DNA, 22 bp, Artificial Sequence
  chemically synthesized
cttcaggaaaaatgttaacacg

SEQ ID NO: 696898 - DNA, 22 bp, Artificial Sequence
  chemically synthesized
tcttcaggaaaaatgttaacac

SEQ ID NO: 696899 - DNA, 22 bp, Artificial Sequence
  chemically synthesized
aatactttcttcaggaaaaatg

SEQ ID NO: 696900 - DNA, 22 bp, Artificial Sequence
  chemically synthesized
taccgtgttaacatttttcctg

SEQ ID NO: 696901 - DNA, 22 bp, Artificial Sequence
  chemically synthesized
accgtgttaacatttttcctga

SEQ ID NO: 696902 - DNA, 22 bp, Artificial Sequence
  chemically synthesized
ccgtgttaacatttttcctgaa

SEQ ID NO: 696903 - DNA, 22 bp, Artificial Sequence
  chemically synthesized
acatttttcctgaagaaagtat

SEQ ID NO: 696904 - DNA, 22 bp, Artificial Sequence
  chemically synthesized
ttcctgaagaaagtatttaata

SEQ ID NO: 696905 - DNA, 22 bp, Artificial Sequence
  chemically synthesized
tcctgaagaaagtatttaatac

SEQ ID NO: 696906 - DNA, 22 bp, Artificial Sequence
  chemically synthesized
cctgaagaaagtatttaatacc

SEQ ID NO: 696907 - DNA, 22 bp, Artificial Sequence
  chemically synthesized
ctgaagaaagtatttaataccc

SEQ ID NO: 696908 - DNA, 22 bp, Artificial Sequence
  chemically synthesized
aagaaagtatttaataccctct

SEQ ID NO: 696909 - DNA, 22 bp, Artificial Sequence
  chemically synthesized
aataccctctccctacccccta

SEQ ID NO: 696910 - DNA, 22 bp, Artificial Sequence
  chemically synthesized
ataccctctccctaccccctac

SEQ ID NO: 696911 - DNA, 22 bp, Artificial Sequence
  chemically synthesized
caggggatagggtgggggagta

SEQ ID NO: 696912 - DNA, 22 bp, Artificial Sequence
  chemically synthesized
tccctaccccctactcccccac

SEQ ID NO: 696913 - DNA, 22 bp, Artificial Sequence
  chemically synthesized
ccaggggatagggtgggggagt

SEQ ID NO: 696914 - DNA, 22 bp, Artificial Sequence
  chemically synthesized
cctaccccctactcccccaccc

SEQ ID NO: 696915 - DNA, 22 bp, Artificial Sequence
  chemically synthesized
cttccaggggatagggtggggg

SEQ ID NO: 696916 - DNA, 22 bp, Artificial Sequence
  chemically synthesized
ccttccaggggatagggtgggg

SEQ ID NO: 696917 - DNA, 22 bp, Artificial Sequence
  chemically synthesized
ccccctactcccccaccctatc

SEQ ID NO: 696918 - DNA, 22 bp, Artificial Sequence
  chemically synthesized
cttccttccaggggatagggtg

SEQ ID NO: 696919 - DNA, 22 bp, Artificial Sequence
  chemically synthesized
ccctccttccttccaggggata

SEQ ID NO: 696920 - DNA, 22 bp, Artificial Sequence
  chemically synthesized
ctcccccaccctatcccctgga

SEQ ID NO: 696921 - DNA, 22 bp, Artificial Sequence
  chemically synthesized
cccctccttccttccaggggat

SEQ ID NO: 696922 - DNA, 22 bp, Artificial Sequence
  chemically synthesized
ccccaccctatcccctggaagg

SEQ ID NO: 696923 - DNA, 22 bp, Artificial Sequence
  chemically synthesized
agtcttcccctccttccttcca

SEQ ID NO: 696924 - DNA, 22 bp, Artificial Sequence
  chemically synthesized
tcccctggaaggaaggagggga

SEQ ID NO: 696925 - DNA, 22 bp, Artificial Sequence
  chemically synthesized
caaatcccattcagtcttcccc

SEQ ID NO: 696926 - DNA, 22 bp, Artificial Sequence
  chemically synthesized
gaaggaaggaggggaagactga

SEQ ID NO: 696927 - DNA, 22 bp, Artificial Sequence
  chemically synthesized
agtgggaaaactccaaatccca

SEQ ID NO: 696928 - DNA, 22 bp, Artificial Sequence
  chemically synthesized
tcagtgggaaaactccaaatcc

SEQ ID NO: 696929 - DNA, 22 bp, Artificial Sequence
  chemically synthesized
ctcagtgggaaaactccaaatc

SEQ ID NO: 696930 - DNA, 22 bp, Artificial Sequence
  chemically synthesized
tctcagtgggaaaactccaaat

SEQ ID NO: 696931 - DNA, 22 bp, Artificial Sequence
  chemically synthesized
aatgggatttggagttttccca

SEQ ID NO: 696932 - DNA, 22 bp, Artificial Sequence
  chemically synthesized
cagaaaatgcccctttctcagt

SEQ ID NO: 696933 - DNA, 22 bp, Artificial Sequence
  chemically synthesized
ggagttttcccactgagaaagg

SEQ ID NO: 696934 - DNA, 22 bp, Artificial Sequence
  chemically synthesized
gagttttcccactgagaaaggg

SEQ ID NO: 696935 - DNA, 22 bp, Artificial Sequence
  chemically synthesized
gttgcagaaaatgcccctttct

SEQ ID NO: 696936 - DNA, 22 bp, Artificial Sequence
  chemically synthesized
tcccactgagaaaggggcattt

SEQ ID NO: 696937 - DNA, 22 bp, Artificial Sequence
  chemically synthesized
cccactgagaaaggggcatttt

SEQ ID NO: 696938 - DNA, 22 bp, Artificial Sequence
  chemically synthesized
acctggttgcagaaaatgcccc

SEQ ID NO: 696939 - DNA, 22 bp, Artificial Sequence
  chemically synthesized
ccactgagaaaggggcattttc

SEQ ID NO: 696940 - DNA, 22 bp, Artificial Sequence
  chemically synthesized
agaaaggggcattttctgcaac

SEQ ID NO: 696941 - DNA, 22 bp, Artificial Sequence
  chemically synthesized
aacactgacctggttgcagaaa

SEQ ID NO: 696942 - DNA, 22 bp, Artificial Sequence
  chemically synthesized
gaacactgacctggttgcagaa

SEQ ID NO: 696943 - DNA, 22 bp, Artificial Sequence
  chemically synthesized
tgaacactgacctggttgcaga

SEQ ID NO: 696944 - DNA, 22 bp, Artificial Sequence
  chemically synthesized
gtcctttgaacactgacctggt

SEQ ID NO: 696945 - DNA, 22 bp, Artificial Sequence
  chemically synthesized
tctgcaaccaggtcagtgttca

SEQ ID NO: 696946 - DNA, 22 bp, Artificial Sequence
  chemically synthesized
ctgcaaccaggtcagtgttcaa

SEQ ID NO: 696947 - DNA, 22 bp, Artificial Sequence
  chemically synthesized
tgcaaccaggtcagtgttcaaa

SEQ ID NO: 696948 - DNA, 22 bp, Artificial Sequence
  chemically synthesized
gagcattagtcctttgaacact

SEQ ID NO: 696949 - DNA, 22 bp, Artificial Sequence
  chemically synthesized
agagcattagtcctttgaacac

SEQ ID NO: 696950 - DNA, 22 bp, Artificial Sequence
  chemically synthesized
caaccaggtcagtgttcaaagg

SEQ ID NO: 696951 - DNA, 22 bp, Artificial Sequence
  chemically synthesized
cttagagcattagtcctttgaa

SEQ ID NO: 696952 - DNA, 22 bp, Artificial Sequence
  chemically synthesized
ccttagagcattagtcctttga

SEQ ID NO: 696953 - DNA, 22 bp, Artificial Sequence
  chemically synthesized
ggataatttccttagagcatta

SEQ ID NO: 696954 - DNA, 22 bp, Artificial Sequence
  chemically synthesized
gggataatttccttagagcatt

SEQ ID NO: 696955 - DNA, 22 bp, Artificial Sequence
  chemically synthesized
tgggataatttccttagagcat

SEQ ID NO: 696956 - DNA, 22 bp, Artificial Sequence
  chemically synthesized
tttgggataatttccttagagc

SEQ ID NO: 696957 - DNA, 22 bp, Artificial Sequence
  chemically synthesized
aaaggactaatgctctaaggaa

SEQ ID NO: 696958 - DNA, 22 bp, Artificial Sequence
  chemically synthesized
ctttgggataatttccttagag

SEQ ID NO: 696959 - DNA, 22 bp, Artificial Sequence
  chemically synthesized
ttctttgggataatttccttag

SEQ ID NO: 696960 - DNA, 22 bp, Artificial Sequence
  chemically synthesized
tcttctttgggataatttcctt

SEQ ID NO: 696961 - DNA, 22 bp, Artificial Sequence
  chemically synthesized
tctcttctttgggataatttcc

SEQ ID NO: 696962 - DNA, 22 bp, Artificial Sequence
  chemically synthesized
atgctctaaggaaattatccca

SEQ ID NO: 696963 - DNA, 22 bp, Artificial Sequence
  chemically synthesized
cctctctcttctttgggataat

SEQ ID NO: 696964 - DNA, 22 bp, Artificial Sequence
  chemically synthesized
taaggaaattatcccaaagaag

SEQ ID NO: 696965 - DNA, 22 bp, Artificial Sequence
  chemically synthesized
aactgcctctctcttctttggg

SEQ ID NO: 696966 - DNA, 22 bp, Artificial Sequence
  chemically synthesized
aggaaattatcccaaagaagag

SEQ ID NO: 696967 - DNA, 22 bp, Artificial Sequence
  chemically synthesized
ataaccctgaactgcctctctc

SEQ ID NO: 696968 - DNA, 22 bp, Artificial Sequence
  chemically synthesized
aataaccctgaactgcctctct

SEQ ID NO: 696969 - DNA, 22 bp, Artificial Sequence
  chemically synthesized
tcccaaagaagagagaggcagt

SEQ ID NO: 696970 - DNA, 22 bp, Artificial Sequence
  chemically synthesized
aaataacttaataaccctgaac

SEQ ID NO: 696971 - DNA, 22 bp, Artificial Sequence
  chemically synthesized
aaaataacttaataaccctgaa

SEQ ID NO: 696972 - DNA, 22 bp, Artificial Sequence
  chemically synthesized
taaaataacttaataaccctga

SEQ ID NO: 696973 - DNA, 22 bp, Artificial Sequence
  chemically synthesized
agggttattaagttattttaaa

SEQ ID NO: 696974 - DNA, 22 bp, Artificial Sequence
  chemically synthesized
ttaagttattttaaaacattgc

SEQ ID NO: 696975 - DNA, 22 bp, Artificial Sequence
  chemically synthesized
agttattttaaaacattgcctg

SEQ ID NO: 696976 - DNA, 22 bp, Artificial Sequence
  chemically synthesized
ttttaaaacattgcctgggctg

SEQ ID NO: 696977 - DNA, 22 bp, Artificial Sequence
  chemically synthesized
taaaacattgcctgggctgttg

SEQ ID NO: 696978 - DNA, 22 bp, Artificial Sequence
  chemically synthesized
aaaacattgcctgggctgttgc

SEQ ID NO: 696979 - DNA, 22 bp, Artificial Sequence
  chemically synthesized
aaacattgcctgggctgttgct

SEQ ID NO: 696980 - DNA, 22 bp, Artificial Sequence
  chemically synthesized
acaaaggtcagcagcaacagcc

SEQ ID NO: 696981 - DNA, 22 bp, Artificial Sequence
  chemically synthesized
cacaaaggtcagcagcaacagc

SEQ ID NO: 696982 - DNA, 22 bp, Artificial Sequence
  chemically synthesized
ccttcacaaaggtcagcagcaa

SEQ ID NO: 696983 - DNA, 22 bp, Artificial Sequence
  chemically synthesized
cctgggctgttgctgctgacct

SEQ ID NO: 696984 - DNA, 22 bp, Artificial Sequence
  chemically synthesized
ttcccttcacaaaggtcagcag

SEQ ID NO: 696985 - DNA, 22 bp, Artificial Sequence
  chemically synthesized
ggctgttgctgctgacctttgt

SEQ ID NO: 696986 - DNA, 22 bp, Artificial Sequence
  chemically synthesized
ttgctgctgacctttgtgaagg

SEQ ID NO: 696987 - DNA, 22 bp, Artificial Sequence
  chemically synthesized
ctgctgacctttgtgaagggaa

SEQ ID NO: 696988 - DNA, 22 bp, Artificial Sequence
  chemically synthesized
ctgacctttgtgaagggaacag

SEQ ID NO: 696989 - DNA, 22 bp, Artificial Sequence
  chemically synthesized
ggaagcagcatcctgttccctt

SEQ ID NO: 696990 - DNA, 22 bp, Artificial Sequence
  chemically synthesized
acctttgtgaagggaacaggat

SEQ ID NO: 696991 - DNA, 22 bp, Artificial Sequence
  chemically synthesized
ccctgggaagcagcatcctgtt

SEQ ID NO: 696992 - DNA, 22 bp, Artificial Sequence
  chemically synthesized
tgtgaagggaacaggatgctgc

SEQ ID NO: 696993 - DNA, 22 bp, Artificial Sequence
  chemically synthesized
ttcccctgggaagcagcatcct

SEQ ID NO: 696994 - DNA, 22 bp, Artificial Sequence
  chemically synthesized
gtgaagggaacaggatgctgct

SEQ ID NO: 696995 - DNA, 22 bp, Artificial Sequence
  chemically synthesized
tgaagggaacaggatgctgctt

SEQ ID NO: 696996 - DNA, 22 bp, Artificial Sequence
  chemically synthesized
tgttcccctgggaagcagcatc

SEQ ID NO: 696997 - DNA, 22 bp, Artificial Sequence
  chemically synthesized
ttctgttcccctgggaagcagc

SEQ ID NO: 696998 - DNA, 22 bp, Artificial Sequence
  chemically synthesized
attctgttcccctgggaagcag

SEQ ID NO: 696999 - DNA, 22 bp, Artificial Sequence
  chemically synthesized
ttattctgttcccctgggaagc

SEQ ID NO: 697000 - DNA, 22 bp, Artificial Sequence
  chemically synthesized
cttattctgttcccctgggaag

SEQ ID NO: 697001 - DNA, 22 bp, Artificial Sequence
  chemically synthesized
cttcttattctgttcccctggg

SEQ ID NO: 697002 - DNA, 22 bp, Artificial Sequence
  chemically synthesized
attgcttcttattctgttcccc

SEQ ID NO: 697003 - DNA, 22 bp, Artificial Sequence
  chemically synthesized
taattgcttcttattctgttcc

SEQ ID NO: 697004 - DNA, 22 bp, Artificial Sequence
  chemically synthesized
tctaattgcttcttattctgtt

SEQ ID NO: 697005 - DNA, 22 bp, Artificial Sequence
  chemically synthesized
cttcccaggggaacagaataag

SEQ ID NO: 697006 - DNA, 22 bp, Artificial Sequence
  chemically synthesized
ctctaattgcttcttattctgt

SEQ ID NO: 697007 - DNA, 22 bp, Artificial Sequence
  chemically synthesized
cccaggggaacagaataagaag

SEQ ID NO: 697008 - DNA, 22 bp, Artificial Sequence
  chemically synthesized
ccaggggaacagaataagaagc

SEQ ID NO: 697009 - DNA, 22 bp, Artificial Sequence
  chemically synthesized
ggcttctctaattgcttcttat

SEQ ID NO: 697010 - DNA, 22 bp, Artificial Sequence
  chemically synthesized
ctaggcttctctaattgcttct

SEQ ID NO: 697011 - DNA, 22 bp, Artificial Sequence
  chemically synthesized
tcctaggcttctctaattgctt

SEQ ID NO: 697012 - DNA, 22 bp, Artificial Sequence
  chemically synthesized
ccgggcctctcctaggcttctc

SEQ ID NO: 697013 - DNA, 22 bp, Artificial Sequence
  chemically synthesized
ccaaacattcccgggcctctcc

SEQ ID NO: 697014 - DNA, 22 bp, Artificial Sequence
  chemically synthesized
gagaagcctaggagaggcccgg

SEQ ID NO: 697015 - DNA, 22 bp, Artificial Sequence
  chemically synthesized
ggagaggcccgggaatgtttgg

SEQ ID NO: 697016 - DNA, 22 bp, Artificial Sequence
  chemically synthesized
gggtatgtgtgaattcccaaac

SEQ ID NO: 697017 - DNA, 22 bp, Artificial Sequence
  chemically synthesized
ggggtatgtgtgaattcccaaa

SEQ ID NO: 697018 - DNA, 22 bp, Artificial Sequence
  chemically synthesized
ccacgtaatttggggtatgtgt

SEQ ID NO: 697019 - DNA, 22 bp, Artificial Sequence
  chemically synthesized
gggaattcacacataccccaaa

SEQ ID NO: 697020 - DNA, 22 bp, Artificial Sequence
  chemically synthesized
ggaattcacacataccccaaat

SEQ ID NO: 697021 - DNA, 22 bp, Artificial Sequence
  chemically synthesized
gcgttcccacgtaatttggggt

SEQ ID NO: 697022 - DNA, 22 bp, Artificial Sequence
  chemically synthesized
agcgttcccacgtaatttgggg

SEQ ID NO: 697023 - DNA, 22 bp, Artificial Sequence
  chemically synthesized
ttagcgttcccacgtaatttgg

SEQ ID NO: 697024 - DNA, 22 bp, Artificial Sequence
  chemically synthesized
acacataccccaaattacgtgg

SEQ ID NO: 697025 - DNA, 22 bp, Artificial Sequence
  chemically synthesized
attcttagcgttcccacgtaat

SEQ ID NO: 697026 - DNA, 22 bp, Artificial Sequence
  chemically synthesized
cattcttagcgttcccacgtaa

SEQ ID NO: 697027 - DNA, 22 bp, Artificial Sequence
  chemically synthesized
tcattcttagcgttcccacgta

SEQ ID NO: 697028 - DNA, 22 bp, Artificial Sequence
  chemically synthesized
ttttcattcttagcgttcccac

SEQ ID NO: 697029 - DNA, 22 bp, Artificial Sequence
  chemically synthesized
attttcattcttagcgttccca

SEQ ID NO: 697030 - DNA, 22 bp, Artificial Sequence
  chemically synthesized
gtttattttcattcttagcgtt

SEQ ID NO: 697031 - DNA, 22 bp, Artificial Sequence
  chemically synthesized
cgtgggaacgctaagaatgaaa

SEQ ID NO: 697032 - DNA, 22 bp, Artificial Sequence
  chemically synthesized
atcaaagttagtttattttcat

SEQ ID NO: 697033 - DNA, 22 bp, Artificial Sequence
  chemically synthesized
agaatgaaaataaactaacttt

SEQ ID NO: 697034 - DNA, 22 bp, Artificial Sequence
  chemically synthesized
gaacccaaatatgtccctaatc

SEQ ID NO: 697035 - DNA, 22 bp, Artificial Sequence
  chemically synthesized
tagaacccaaatatgtccctaa

SEQ ID NO: 697036 - DNA, 22 bp, Artificial Sequence
  chemically synthesized
ctagaacccaaatatgtcccta

SEQ ID NO: 697037 - DNA, 22 bp, Artificial Sequence
  chemically synthesized
tctagaacccaaatatgtccct

SEQ ID NO: 697038 - DNA, 22 bp, Artificial Sequence
  chemically synthesized
actttgattagggacatatttg

SEQ ID NO: 697039 - DNA, 22 bp, Artificial Sequence
  chemically synthesized
tgattagggacatatttgggtt

SEQ ID NO: 697040 - DNA, 22 bp, Artificial Sequence
  chemically synthesized
gattagggacatatttgggttc

SEQ ID NO: 697041 - DNA, 22 bp, Artificial Sequence
  chemically synthesized
gaatattttctagaacccaaat

SEQ ID NO: 697042 - DNA, 22 bp, Artificial Sequence
  chemically synthesized
attagggacatatttgggttct

SEQ ID NO: 697043 - DNA, 22 bp, Artificial Sequence
  chemically synthesized
agaatattttctagaacccaaa

SEQ ID NO: 697044 - DNA, 22 bp, Artificial Sequence
  chemically synthesized
tagaatattttctagaacccaa

SEQ ID NO: 697045 - DNA, 22 bp, Artificial Sequence
  chemically synthesized
ttagaatattttctagaaccca

SEQ ID NO: 697046 - DNA, 22 bp, Artificial Sequence
  chemically synthesized
gggacatatttgggttctagaa

SEQ ID NO: 697047 - DNA, 22 bp, Artificial Sequence
  chemically synthesized
catttttagaatattttctaga

SEQ ID NO: 697048 - DNA, 22 bp, Artificial Sequence
  chemically synthesized
gggttctagaaaatattctaaa

SEQ ID NO: 697049 - DNA, 22 bp, Artificial Sequence
  chemically synthesized
ggttctagaaaatattctaaaa

SEQ ID NO: 697050 - DNA, 22 bp, Artificial Sequence
  chemically synthesized
tagaaaatattctaaaaatgca

SEQ ID NO: 697051 - DNA, 22 bp, Artificial Sequence
  chemically synthesized
gaaaatattctaaaaatgcagc

SEQ ID NO: 697052 - DNA, 22 bp, Artificial Sequence
  chemically synthesized
taaaaatgcagctcacactggg

SEQ ID NO: 697053 - DNA, 22 bp, Artificial Sequence
  chemically synthesized
atagagatatagccccagtgtg

SEQ ID NO: 697054 - DNA, 22 bp, Artificial Sequence
  chemically synthesized
aaaatgcagctcacactggggc

SEQ ID NO: 697055 - DNA, 22 bp, Artificial Sequence
  chemically synthesized
ggaaaacactcatagagatata

SEQ ID NO: 697056 - DNA, 22 bp, Artificial Sequence
  chemically synthesized
aggaaaacactcatagagatat

SEQ ID NO: 697057 - DNA, 22 bp, Artificial Sequence
  chemically synthesized
acactggggctatatctctatg

SEQ ID NO: 697058 - DNA, 22 bp, Artificial Sequence
  chemically synthesized
taggaaaacactcatagagata

SEQ ID NO: 697059 - DNA, 22 bp, Artificial Sequence
  chemically synthesized
ttaggaaaacactcatagagat

SEQ ID NO: 697060 - DNA, 22 bp, Artificial Sequence
  chemically synthesized
gggctatatctctatgagtgtt

SEQ ID NO: 697061 - DNA, 22 bp, Artificial Sequence
  chemically synthesized
aggtttttaggaaaacactcat

SEQ ID NO: 697062 - DNA, 22 bp, Artificial Sequence
  chemically synthesized
tatctctatgagtgttttccta

SEQ ID NO: 697063 - DNA, 22 bp, Artificial Sequence
  chemically synthesized
agtgttcaggtttttaggaaaa

SEQ ID NO: 697064 - DNA, 22 bp, Artificial Sequence
  chemically synthesized
tatgagtgttttcctaaaaacc

SEQ ID NO: 697065 - DNA, 22 bp, Artificial Sequence
  chemically synthesized
tgagtgttttcctaaaaacctg

SEQ ID NO: 697066 - DNA, 22 bp, Artificial Sequence
  chemically synthesized
gatactgagtgttcaggttttt

SEQ ID NO: 697067 - DNA, 22 bp, Artificial Sequence
  chemically synthesized
ttagatactgagtgttcaggtt

SEQ ID NO: 697068 - DNA, 22 bp, Artificial Sequence
  chemically synthesized
tattagatactgagtgttcagg

SEQ ID NO: 697069 - DNA, 22 bp, Artificial Sequence
  chemically synthesized
tcctaaaaacctgaacactcag

SEQ ID NO: 697070 - DNA, 22 bp, Artificial Sequence
  chemically synthesized
cctaaaaacctgaacactcagt

SEQ ID NO: 697071 - DNA, 22 bp, Artificial Sequence
  chemically synthesized
ctaaaaacctgaacactcagta

SEQ ID NO: 697072 - DNA, 22 bp, Artificial Sequence
  chemically synthesized
acctctattagatactgagtgt

SEQ ID NO: 697073 - DNA, 22 bp, Artificial Sequence
  chemically synthesized
aaaacctgaacactcagtatct

SEQ ID NO: 697074 - DNA, 22 bp, Artificial Sequence
  chemically synthesized
ttgacctctattagatactgag

SEQ ID NO: 697075 - DNA, 22 bp, Artificial Sequence
  chemically synthesized
attgacctctattagatactga

SEQ ID NO: 697076 - DNA, 22 bp, Artificial Sequence
  chemically synthesized
aacactcagtatctaatagagg

SEQ ID NO: 697077 - DNA, 22 bp, Artificial Sequence
  chemically synthesized
aagtcttattgacctctattag

SEQ ID NO: 697078 - DNA, 22 bp, Artificial Sequence
  chemically synthesized
gattgaagtcttattgacctct

SEQ ID NO: 697079 - DNA, 22 bp, Artificial Sequence
  chemically synthesized
agtatctaatagaggtcaataa

SEQ ID NO: 697080 - DNA, 22 bp, Artificial Sequence
  chemically synthesized
aaactggattgaagtcttattg

SEQ ID NO: 697081 - DNA, 22 bp, Artificial Sequence
  chemically synthesized
tgaaactggattgaagtcttat

SEQ ID NO: 697082 - DNA, 22 bp, Artificial Sequence
  chemically synthesized
atagaggtcaataagacttcaa

SEQ ID NO: 697083 - DNA, 22 bp, Artificial Sequence
  chemically synthesized
ctctgaaactggattgaagtct

SEQ ID NO: 697084 - DNA, 22 bp, Artificial Sequence
  chemically synthesized
tcctctgaaactggattgaagt

SEQ ID NO: 697085 - DNA, 22 bp, Artificial Sequence
  chemically synthesized
ctcctctgaaactggattgaag

SEQ ID NO: 697086 - DNA, 22 bp, Artificial Sequence
  chemically synthesized
tctcctctgaaactggattgaa

SEQ ID NO: 697087 - DNA, 22 bp, Artificial Sequence
  chemically synthesized
ttctcctctgaaactggattga

SEQ ID NO: 697088 - DNA, 22 bp, Artificial Sequence
  chemically synthesized
cttttctcctctgaaactggat

SEQ ID NO: 697089 - DNA, 22 bp, Artificial Sequence
  chemically synthesized
ccttttctcctctgaaactgga

SEQ ID NO: 697090 - DNA, 22 bp, Artificial Sequence
  chemically synthesized
tccttttctcctctgaaactgg

SEQ ID NO: 697091 - DNA, 22 bp, Artificial Sequence
  chemically synthesized
gctttccttttctcctctgaaa

SEQ ID NO: 697092 - DNA, 22 bp, Artificial Sequence
  chemically synthesized
caatccagtttcagaggagaaa

SEQ ID NO: 697093 - DNA, 22 bp, Artificial Sequence
  chemically synthesized
attggctttccttttctcctct

SEQ ID NO: 697094 - DNA, 22 bp, Artificial Sequence
  chemically synthesized
aatccagtttcagaggagaaaa

SEQ ID NO: 697095 - DNA, 22 bp, Artificial Sequence
  chemically synthesized
agaaatgttaattggctttcct

SEQ ID NO: 697096 - DNA, 22 bp, Artificial Sequence
  chemically synthesized
cagaggagaaaaggaaagccaa

SEQ ID NO: 697097 - DNA, 22 bp, Artificial Sequence
  chemically synthesized
aagaaatgttaattggctttcc

SEQ ID NO: 697098 - DNA, 22 bp, Artificial Sequence
  chemically synthesized
agaggagaaaaggaaagccaat

SEQ ID NO: 697099 - DNA, 22 bp, Artificial Sequence
  chemically synthesized
cttaagaaatgttaattggctt

SEQ ID NO: 697100 - DNA, 22 bp, Artificial Sequence
  chemically synthesized
tgacacataaggaatattgctt

SEQ ID NO: 697101 - DNA, 22 bp, Artificial Sequence
  chemically synthesized
atgacacataaggaatattgct

SEQ ID NO: 697102 - DNA, 22 bp, Artificial Sequence
  chemically synthesized
tatgacacataaggaatattgc

SEQ ID NO: 697103 - DNA, 22 bp, Artificial Sequence
  chemically synthesized
acatttcttaagcaatattcct

SEQ ID NO: 697104 - DNA, 22 bp, Artificial Sequence
  chemically synthesized
ctttatgacacataaggaatat

SEQ ID NO: 697105 - DNA, 22 bp, Artificial Sequence
  chemically synthesized
tactttatgacacataaggaat

SEQ ID NO: 697106 - DNA, 22 bp, Artificial Sequence
  chemically synthesized
cttaagcaatattccttatgtg

SEQ ID NO: 697107 - DNA, 22 bp, Artificial Sequence
  chemically synthesized
ttaagcaatattccttatgtgt

SEQ ID NO: 697108 - DNA, 22 bp, Artificial Sequence
  chemically synthesized
aagcaatattccttatgtgtca

SEQ ID NO: 697109 - DNA, 22 bp, Artificial Sequence
  chemically synthesized
agcaatattccttatgtgtcat

SEQ ID NO: 697110 - DNA, 22 bp, Artificial Sequence
  chemically synthesized
acgtgacacccattctacttta

SEQ ID NO: 697111 - DNA, 22 bp, Artificial Sequence
  chemically synthesized
cttatgtgtcataaagtagaat

SEQ ID NO: 697112 - DNA, 22 bp, Artificial Sequence
  chemically synthesized
aacgtgacacccattctacttt

SEQ ID NO: 697113 - DNA, 22 bp, Artificial Sequence
  chemically synthesized
atgtgtcataaagtagaatggg

SEQ ID NO: 697114 - DNA, 22 bp, Artificial Sequence
  chemically synthesized
cttaacgtgacacccattctac

SEQ ID NO: 697115 - DNA, 22 bp, Artificial Sequence
  chemically synthesized
tgtgtcataaagtagaatgggt

SEQ ID NO: 697116 - DNA, 22 bp, Artificial Sequence
  chemically synthesized
gcttaacgtgacacccattcta

SEQ ID NO: 697117 - DNA, 22 bp, Artificial Sequence
  chemically synthesized
agccatttgcttaacgtgacac

SEQ ID NO: 697118 - DNA, 22 bp, Artificial Sequence
  chemically synthesized
gagccatttgcttaacgtgaca

SEQ ID NO: 697119 - DNA, 22 bp, Artificial Sequence
  chemically synthesized
gtttgagccatttgcttaacgt

SEQ ID NO: 697120 - DNA, 22 bp, Artificial Sequence
  chemically synthesized
ttcgtttgagccatttgcttaa

SEQ ID NO: 697121 - DNA, 22 bp, Artificial Sequence
  chemically synthesized
tgttcgtttgagccatttgctt

SEQ ID NO: 697122 - DNA, 22 bp, Artificial Sequence
  chemically synthesized
agcaaatggctcaaacgaacag

SEQ ID NO: 697123 - DNA, 22 bp, Artificial Sequence
  chemically synthesized
tatcatatcccaactctgttcg

SEQ ID NO: 697124 - DNA, 22 bp, Artificial Sequence
  chemically synthesized
aaacgaacagagttgggatatg

SEQ ID NO: 697125 - DNA, 22 bp, Artificial Sequence
  chemically synthesized
aaacaactgtatcatatcccaa

SEQ ID NO: 697126 - DNA, 22 bp, Artificial Sequence
  chemically synthesized
gaaacaactgtatcatatccca

SEQ ID NO: 697127 - DNA, 22 bp, Artificial Sequence
  chemically synthesized
catttgaaacaactgtatcata

SEQ ID NO: 697128 - DNA, 22 bp, Artificial Sequence
  chemically synthesized
ggatatgatacagttgtttcaa

SEQ ID NO: 697129 - DNA, 22 bp, Artificial Sequence
  chemically synthesized
tttcaaatgcagatttatttga

SEQ ID NO: 697130 - DNA, 22 bp, Artificial Sequence
  chemically synthesized
caaatgcagatttatttgatgt

SEQ ID NO: 697131 - DNA, 22 bp, Artificial Sequence
  chemically synthesized
aaatgcagatttatttgatgtg

SEQ ID NO: 697132 - DNA, 22 bp, Artificial Sequence
  chemically synthesized
gaaaaaaaccagtagtcacatc

SEQ ID NO: 697133 - DNA, 22 bp, Artificial Sequence
  chemically synthesized
atttgatgtgactactggtttt

SEQ ID NO: 697134 - DNA, 22 bp, Artificial Sequence
  chemically synthesized
tttgatgtgactactggttttt

SEQ ID NO: 697135 - DNA, 22 bp, Artificial Sequence
  chemically synthesized
gatgtgactactggtttttttc

SEQ ID NO: 697136 - DNA, 22 bp, Artificial Sequence
  chemically synthesized
atgtgactactggtttttttct

SEQ ID NO: 697137 - DNA, 22 bp, Artificial Sequence
  chemically synthesized
cataatcacgtgttagaaaaaa

SEQ ID NO: 697138 - DNA, 22 bp, Artificial Sequence
  chemically synthesized
acataatcacgtgttagaaaaa

SEQ ID NO: 697139 - DNA, 22 bp, Artificial Sequence
  chemically synthesized
ttacataatcacgtgttagaaa

SEQ ID NO: 697140 - DNA, 22 bp, Artificial Sequence
  chemically synthesized
cttacataatcacgtgttagaa

SEQ ID NO: 697141 - DNA, 22 bp, Artificial Sequence
  chemically synthesized
tcttacataatcacgtgttaga

SEQ ID NO: 697142 - DNA, 22 bp, Artificial Sequence
  chemically synthesized
ctggtttttttctaacacgtga

SEQ ID NO: 697143 - DNA, 22 bp, Artificial Sequence
  chemically synthesized
gtttttttctaacacgtgatta

SEQ ID NO: 697144 - DNA, 22 bp, Artificial Sequence
  chemically synthesized
ttttctaacacgtgattatgta

SEQ ID NO: 697145 - DNA, 22 bp, Artificial Sequence
  chemically synthesized
tttctaacacgtgattatgtaa

SEQ ID NO: 697146 - DNA, 22 bp, Artificial Sequence
  chemically synthesized
ttctaacacgtgattatgtaag

SEQ ID NO: 697147 - DNA, 22 bp, Artificial Sequence
  chemically synthesized
aacatgcactttcttacataat

SEQ ID NO: 697148 - DNA, 22 bp, Artificial Sequence
  chemically synthesized
tctaacacgtgattatgtaaga

SEQ ID NO: 697149 - DNA, 22 bp, Artificial Sequence
  chemically synthesized
aaacatgcactttcttacataa

SEQ ID NO: 697150 - DNA, 22 bp, Artificial Sequence
  chemically synthesized
ctaacacgtgattatgtaagaa

SEQ ID NO: 697151 - DNA, 22 bp, Artificial Sequence
  chemically synthesized
taacacgtgattatgtaagaaa

SEQ ID NO: 697152 - DNA, 22 bp, Artificial Sequence
  chemically synthesized
ttaaacatgcactttcttacat

SEQ ID NO: 697153 - DNA, 22 bp, Artificial Sequence
  chemically synthesized
cttaaacatgcactttcttaca

SEQ ID NO: 697154 - DNA, 22 bp, Artificial Sequence
  chemically synthesized
acacgtgattatgtaagaaagt

SEQ ID NO: 697155 - DNA, 22 bp, Artificial Sequence
  chemically synthesized
tcttaaacatgcactttcttac

SEQ ID NO: 697156 - DNA, 22 bp, Artificial Sequence
  chemically synthesized
actttcttaaacatgcactttc

SEQ ID NO: 697157 - DNA, 22 bp, Artificial Sequence
  chemically synthesized
taactttcttaaacatgcactt

SEQ ID NO: 697158 - DNA, 22 bp, Artificial Sequence
  chemically synthesized
ctaactttcttaaacatgcact

SEQ ID NO: 697159 - DNA, 22 bp, Artificial Sequence
  chemically synthesized
tctaactttcttaaacatgcac

SEQ ID NO: 697160 - DNA, 22 bp, Artificial Sequence
  chemically synthesized
ttctaactttcttaaacatgca

SEQ ID NO: 697161 - DNA, 22 bp, Artificial Sequence
  chemically synthesized
tttctaactttcttaaacatgc

SEQ ID NO: 697162 - DNA, 22 bp, Artificial Sequence
  chemically synthesized
tgtaagaaagtgcatgtttaag

SEQ ID NO: 697163 - DNA, 22 bp, Artificial Sequence
  chemically synthesized
tttttctaactttcttaaacat

SEQ ID NO: 697164 - DNA, 22 bp, Artificial Sequence
  chemically synthesized
ctttttctaactttcttaaaca

SEQ ID NO: 697165 - DNA, 22 bp, Artificial Sequence
  chemically synthesized
tctttttctaactttcttaaac

SEQ ID NO: 697166 - DNA, 22 bp, Artificial Sequence
  chemically synthesized
cccattttctttttctaacttt

SEQ ID NO: 697167 - DNA, 22 bp, Artificial Sequence
  chemically synthesized
ccccattttctttttctaactt

SEQ ID NO: 697168 - DNA, 22 bp, Artificial Sequence
  chemically synthesized
tttccccattttctttttctaa

SEQ ID NO: 697169 - DNA, 22 bp, Artificial Sequence
  chemically synthesized
aagaaagttagaaaaagaaaat

SEQ ID NO: 697170 - DNA, 22 bp, Artificial Sequence
  chemically synthesized
agctatttccccattttctttt

SEQ ID NO: 697171 - DNA, 22 bp, Artificial Sequence
  chemically synthesized
agaaagttagaaaaagaaaatg

SEQ ID NO: 697172 - DNA, 22 bp, Artificial Sequence
  chemically synthesized
cagctatttccccattttcttt

SEQ ID NO: 697173 - DNA, 22 bp, Artificial Sequence
  chemically synthesized
tttcagctatttccccattttc

SEQ ID NO: 697174 - DNA, 22 bp, Artificial Sequence
  chemically synthesized
gaaaaagaaaatggggaaatag

SEQ ID NO: 697175 - DNA, 22 bp, Artificial Sequence
  chemically synthesized
tccaaaagaagaggagtaaatt

SEQ ID NO: 697176 - DNA, 22 bp, Artificial Sequence
  chemically synthesized
atccaaaagaagaggagtaaat

SEQ ID NO: 697177 - DNA, 22 bp, Artificial Sequence
  chemically synthesized
gtttatccaaaagaagaggagt

SEQ ID NO: 697178 - DNA, 22 bp, Artificial Sequence
  chemically synthesized
aaataatttactcctcttcttt

SEQ ID NO: 697179 - DNA, 22 bp, Artificial Sequence
  chemically synthesized
aagttggtttatccaaaagaag

SEQ ID NO: 697180 - DNA, 22 bp, Artificial Sequence
  chemically synthesized
actcctcttcttttggataaac

SEQ ID NO: 697181 - DNA, 22 bp, Artificial Sequence
  chemically synthesized
ctcctcttcttttggataaacc

SEQ ID NO: 697182 - DNA, 22 bp, Artificial Sequence
  chemically synthesized
ctcttcttttggataaaccaac

SEQ ID NO: 697183 - DNA, 22 bp, Artificial Sequence
  chemically synthesized
ttcttttggataaaccaacttg

SEQ ID NO: 697184 - DNA, 22 bp, Artificial Sequence
  chemically synthesized
cttttggataaaccaacttgaa

SEQ ID NO: 697185 - DNA, 22 bp, Artificial Sequence
  chemically synthesized
ttttggataaaccaacttgaat

SEQ ID NO: 697186 - DNA, 22 bp, Artificial Sequence
  chemically synthesized
ttggataaaccaacttgaatat

SEQ ID NO: 697187 - DNA, 22 bp, Artificial Sequence
  chemically synthesized
tggataaaccaacttgaatatg

SEQ ID NO: 697188 - DNA, 22 bp, Artificial Sequence
  chemically synthesized
ggataaaccaacttgaatatgt

SEQ ID NO: 697189 - DNA, 22 bp, Artificial Sequence
  chemically synthesized
gataaaccaacttgaatatgtt

SEQ ID NO: 697190 - DNA, 22 bp, Artificial Sequence
  chemically synthesized
gaaatgtgagaatgagcataga

SEQ ID NO: 697191 - DNA, 22 bp, Artificial Sequence
  chemically synthesized
ggaaatgtgagaatgagcatag

SEQ ID NO: 697192 - DNA, 22 bp, Artificial Sequence
  chemically synthesized
tggaaatgtgagaatgagcata

SEQ ID NO: 697193 - DNA, 22 bp, Artificial Sequence
  chemically synthesized
ttggaaatgtgagaatgagcat

SEQ ID NO: 697194 - DNA, 22 bp, Artificial Sequence
  chemically synthesized
gaatatgttctatgctcattct

SEQ ID NO: 697195 - DNA, 22 bp, Artificial Sequence
  chemically synthesized
aatatgttctatgctcattctc

SEQ ID NO: 697196 - DNA, 22 bp, Artificial Sequence
  chemically synthesized
gtggcacttttggaaatgtgag

SEQ ID NO: 697197 - DNA, 22 bp, Artificial Sequence
  chemically synthesized
tatgctcattctcacatttcca

SEQ ID NO: 697198 - DNA, 22 bp, Artificial Sequence
  chemically synthesized
tgctcattctcacatttccaaa

SEQ ID NO: 697199 - DNA, 22 bp, Artificial Sequence
  chemically synthesized
attcgtggcacttttggaaatg

SEQ ID NO: 697200 - DNA, 22 bp, Artificial Sequence
  chemically synthesized
cctcattcgtggcacttttgga

SEQ ID NO: 697201 - DNA, 22 bp, Artificial Sequence
  chemically synthesized
attctcacatttccaaaagtgc

SEQ ID NO: 697202 - DNA, 22 bp, Artificial Sequence
  chemically synthesized
cctgcctcattcgtggcacttt

SEQ ID NO: 697203 - DNA, 22 bp, Artificial Sequence
  chemically synthesized
tcacatttccaaaagtgccacg

SEQ ID NO: 697204 - DNA, 22 bp, Artificial Sequence
  chemically synthesized
acatttccaaaagtgccacgaa

SEQ ID NO: 697205 - DNA, 22 bp, Artificial Sequence
  chemically synthesized
ccaaaagtgccacgaatgaggc

SEQ ID NO: 697206 - DNA, 22 bp, Artificial Sequence
  chemically synthesized
caaaagtgccacgaatgaggca

SEQ ID NO: 697207 - DNA, 22 bp, Artificial Sequence
  chemically synthesized
taatacacatggtatagcattc

SEQ ID NO: 697208 - DNA, 22 bp, Artificial Sequence
  chemically synthesized
tattataatacacatggtatag

SEQ ID NO: 697209 - DNA, 22 bp, Artificial Sequence
  chemically synthesized
taccatgtgtattataatacag

SEQ ID NO: 697210 - DNA, 22 bp, Artificial Sequence
  chemically synthesized
atgtgtgtatggggaaaataat

SEQ ID NO: 697211 - DNA, 22 bp, Artificial Sequence
  chemically synthesized
aatgtgtgtatggggaaaataa

SEQ ID NO: 697212 - DNA, 22 bp, Artificial Sequence
  chemically synthesized
taatacaggattattttcccca

SEQ ID NO: 697213 - DNA, 22 bp, Artificial Sequence
  chemically synthesized
aaatttaatgtgtgtatgggga

SEQ ID NO: 697214 - DNA, 22 bp, Artificial Sequence
  chemically synthesized
ttttccccatacacacattaaa

SEQ ID NO: 697215 - DNA, 22 bp, Artificial Sequence
  chemically synthesized
tccccatacacacattaaattt

SEQ ID NO: 697216 - DNA, 22 bp, Artificial Sequence
  chemically synthesized
ccccatacacacattaaatttt

SEQ ID NO: 697217 - DNA, 22 bp, Artificial Sequence
  chemically synthesized
cccatacacacattaaatttta

SEQ ID NO: 697218 - DNA, 22 bp, Artificial Sequence
  chemically synthesized
tacatgtggcagctaaaattta

SEQ ID NO: 697219 - DNA, 22 bp, Artificial Sequence
  chemically synthesized
aattttagctgccacatgtata

SEQ ID NO: 697220 - DNA, 22 bp, Artificial Sequence
  chemically synthesized
tagctgccacatgtataggtgt

SEQ ID NO: 697221 - DNA, 22 bp, Artificial Sequence
  chemically synthesized
agctgccacatgtataggtgta

SEQ ID NO: 697222 - DNA, 22 bp, Artificial Sequence
  chemically synthesized
gctgccacatgtataggtgtat

SEQ ID NO: 697223 - DNA, 22 bp, Artificial Sequence
  chemically synthesized
ccacatgtataggtgtatgtat

SEQ ID NO: 697224 - DNA, 22 bp, Artificial Sequence
  chemically synthesized
tatggcatatgtcatgtggaaa

SEQ ID NO: 697225 - DNA, 22 bp, Artificial Sequence
  chemically synthesized
tatatggcatatgtcatgtgga

SEQ ID NO: 697226 - DNA, 22 bp, Artificial Sequence
  chemically synthesized
ccacctttccacatgacatatg

SEQ ID NO: 697227 - DNA, 22 bp, Artificial Sequence
  chemically synthesized
taacattctatatggcatatgt

SEQ ID NO: 697228 - DNA, 22 bp, Artificial Sequence
  chemically synthesized
tccacatgacatatgccatata

SEQ ID NO: 697229 - DNA, 22 bp, Artificial Sequence
  chemically synthesized
ccacatgacatatgccatatag

SEQ ID NO: 697230 - DNA, 22 bp, Artificial Sequence
  chemically synthesized
cacatgacatatgccatataga

SEQ ID NO: 697231 - DNA, 22 bp, Artificial Sequence
  chemically synthesized
cagaaaaatgttgtaacattct

SEQ ID NO: 697232 - DNA, 22 bp, Artificial Sequence
  chemically synthesized
acagaaaaatgttgtaacattc

SEQ ID NO: 697233 - DNA, 22 bp, Artificial Sequence
  chemically synthesized
tacagaaaaatgttgtaacatt

SEQ ID NO: 697234 - DNA, 22 bp, Artificial Sequence
  chemically synthesized
ttttacagaaaaatgttgtaac

SEQ ID NO: 697235 - DNA, 22 bp, Artificial Sequence
  chemically synthesized
attttacagaaaaatgttgtaa

SEQ ID NO: 697236 - DNA, 22 bp, Artificial Sequence
  chemically synthesized
tattttacagaaaaatgttgta

SEQ ID NO: 697237 - DNA, 22 bp, Artificial Sequence
  chemically synthesized
ttattttacagaaaaatgttgt

SEQ ID NO: 697238 - DNA, 22 bp, Artificial Sequence
  chemically synthesized
caacatttttctgtaaaataaa

SEQ ID NO: 697239 - DNA, 22 bp, Artificial Sequence
  chemically synthesized
ttctgtaaaataaaaatgtatc

SEQ ID NO: 697240 - DNA, 22 bp, Artificial Sequence
  chemically synthesized
tctgtaaaataaaaatgtatca

SEQ ID NO: 697241 - DNA, 22 bp, Artificial Sequence
  chemically synthesized
ctgtaaaataaaaatgtatcat

SEQ ID NO: 697242 - DNA, 22 bp, Artificial Sequence
  chemically synthesized
tgtaaaataaaaatgtatcatt

SEQ ID NO: 697243 - DNA, 22 bp, Artificial Sequence
  chemically synthesized
acagaatgtcatcaatgataca

SEQ ID NO: 697244 - DNA, 22 bp, Artificial Sequence
  chemically synthesized
taaaataaaaatgtatcattga

SEQ ID NO: 697245 - DNA, 22 bp, Artificial Sequence
  chemically synthesized
aacagaatgtcatcaatgatac

SEQ ID NO: 697246 - DNA, 22 bp, Artificial Sequence
  chemically synthesized
agtcttaacagaatgtcatcaa

SEQ ID NO: 697247 - DNA, 22 bp, Artificial Sequence
  chemically synthesized
atgacattctgttaagactcag

SEQ ID NO: 697248 - DNA, 22 bp, Artificial Sequence
  chemically synthesized
ggccaggatatagtagccactg

SEQ ID NO: 697249 - DNA, 22 bp, Artificial Sequence
  chemically synthesized
gggccaggatatagtagccact

SEQ ID NO: 697250 - DNA, 22 bp, Artificial Sequence
  chemically synthesized
tgttaagactcagtggctacta

SEQ ID NO: 697251 - DNA, 22 bp, Artificial Sequence
  chemically synthesized
tgggccaggatatagtagccac

SEQ ID NO: 697252 - DNA, 22 bp, Artificial Sequence
  chemically synthesized
ttgggccaggatatagtagcca

SEQ ID NO: 697253 - DNA, 22 bp, Artificial Sequence
  chemically synthesized
ttaagactcagtggctactata

SEQ ID NO: 697254 - DNA, 22 bp, Artificial Sequence
  chemically synthesized
tttgggccaggatatagtagcc

SEQ ID NO: 697255 - DNA, 22 bp, Artificial Sequence
  chemically synthesized
agactcagtggctactatatcc

SEQ ID NO: 697256 - DNA, 22 bp, Artificial Sequence
  chemically synthesized
ctttttgggccaggatatagta

SEQ ID NO: 697257 - DNA, 22 bp, Artificial Sequence
  chemically synthesized
agtggctactatatcctggccc

SEQ ID NO: 697258 - DNA, 22 bp, Artificial Sequence
  chemically synthesized
tggacaggacctactttttggg

SEQ ID NO: 697259 - DNA, 22 bp, Artificial Sequence
  chemically synthesized
ctatatcctggcccaaaaagta

SEQ ID NO: 697260 - DNA, 22 bp, Artificial Sequence
  chemically synthesized
tatcctggcccaaaaagtaggt

SEQ ID NO: 697261 - DNA, 22 bp, Artificial Sequence
  chemically synthesized
agcattgtggacaggacctact

SEQ ID NO: 697262 - DNA, 22 bp, Artificial Sequence
  chemically synthesized
gcccaaaaagtaggtcctgtcc

SEQ ID NO: 697263 - DNA, 22 bp, Artificial Sequence
  chemically synthesized
actgagcattgtggacaggacc

SEQ ID NO: 697264 - DNA, 22 bp, Artificial Sequence
  chemically synthesized
cactgagcattgtggacaggac

SEQ ID NO: 697265 - DNA, 22 bp, Artificial Sequence
  chemically synthesized
tcactgagcattgtggacagga

SEQ ID NO: 697266 - DNA, 22 bp, Artificial Sequence
  chemically synthesized
ttcactgagcattgtggacagg

SEQ ID NO: 697267 - DNA, 22 bp, Artificial Sequence
  chemically synthesized
tttttcactgagcattgtggac

SEQ ID NO: 697268 - DNA, 22 bp, Artificial Sequence
  chemically synthesized
ctgtttttcactgagcattgtg

SEQ ID NO: 697269 - DNA, 22 bp, Artificial Sequence
  chemically synthesized
atcaactactgtttttcactga

SEQ ID NO: 697270 - DNA, 22 bp, Artificial Sequence
  chemically synthesized
tccacaatgctcagtgaaaaac

SEQ ID NO: 697271 - DNA, 22 bp, Artificial Sequence
  chemically synthesized
aattgatcaactactgtttttc

SEQ ID NO: 697272 - DNA, 22 bp, Artificial Sequence
  chemically synthesized
aaattgatcaactactgttttt

SEQ ID NO: 697273 - DNA, 22 bp, Artificial Sequence
  chemically synthesized
taaattgatcaactactgtttt

SEQ ID NO: 697274 - DNA, 22 bp, Artificial Sequence
  chemically synthesized
agtgaaaaacagtagttgatca

SEQ ID NO: 697275 - DNA, 22 bp, Artificial Sequence
  chemically synthesized
gtggtcaatagagctttaaatt

SEQ ID NO: 697276 - DNA, 22 bp, Artificial Sequence
  chemically synthesized
tagtggtcaatagagctttaaa

SEQ ID NO: 697277 - DNA, 22 bp, Artificial Sequence
  chemically synthesized
ctagtggtcaatagagctttaa

SEQ ID NO: 697278 - DNA, 22 bp, Artificial Sequence
  chemically synthesized
tctagtggtcaatagagcttta

SEQ ID NO: 697279 - DNA, 22 bp, Artificial Sequence
  chemically synthesized
gttttctagtggtcaatagagc

SEQ ID NO: 697280 - DNA, 22 bp, Artificial Sequence
  chemically synthesized
atcaatttaaagctctattgac

SEQ ID NO: 697281 - DNA, 22 bp, Artificial Sequence
  chemically synthesized
tggttttctagtggtcaataga

SEQ ID NO: 697282 - DNA, 22 bp, Artificial Sequence
  chemically synthesized
ctggttttctagtggtcaatag

SEQ ID NO: 697283 - DNA, 22 bp, Artificial Sequence
  chemically synthesized
ttctggttttctagtggtcaat

SEQ ID NO: 697284 - DNA, 22 bp, Artificial Sequence
  chemically synthesized
cttctggttttctagtggtcaa

SEQ ID NO: 697285 - DNA, 22 bp, Artificial Sequence
  chemically synthesized
aaagctctattgaccactagaa

SEQ ID NO: 697286 - DNA, 22 bp, Artificial Sequence
  chemically synthesized
aagctctattgaccactagaaa

SEQ ID NO: 697287 - DNA, 22 bp, Artificial Sequence
  chemically synthesized
atgaggcttcttctggttttct

SEQ ID NO: 697288 - DNA, 22 bp, Artificial Sequence
  chemically synthesized
tattgaccactagaaaaccaga

SEQ ID NO: 697289 - DNA, 22 bp, Artificial Sequence
  chemically synthesized
ttgaccactagaaaaccagaag

SEQ ID NO: 697290 - DNA, 22 bp, Artificial Sequence
  chemically synthesized
accactagaaaaccagaagaag

SEQ ID NO: 697291 - DNA, 22 bp, Artificial Sequence
  chemically synthesized
aatatcattcatgaggcttctt

SEQ ID NO: 697292 - DNA, 22 bp, Artificial Sequence
  chemically synthesized
gaaaaccagaagaagcctcatg

SEQ ID NO: 697293 - DNA, 22 bp, Artificial Sequence
  chemically synthesized
ctaaatatcattcatgaggctt

SEQ ID NO: 697294 - DNA, 22 bp, Artificial Sequence
  chemically synthesized
cctaaatatcattcatgaggct

SEQ ID NO: 697295 - DNA, 22 bp, Artificial Sequence
  chemically synthesized
tcctaaatatcattcatgaggc

SEQ ID NO: 697296 - DNA, 22 bp, Artificial Sequence
  chemically synthesized
ttcctaaatatcattcatgagg

SEQ ID NO: 697297 - DNA, 22 bp, Artificial Sequence
  chemically synthesized
tttttcctaaatatcattcatg

SEQ ID NO: 697298 - DNA, 22 bp, Artificial Sequence
  chemically synthesized
gagtctgtttttcctaaatatc

SEQ ID NO: 697299 - DNA, 22 bp, Artificial Sequence
  chemically synthesized
atgaatgatatttaggaaaaac

SEQ ID NO: 697300 - DNA, 22 bp, Artificial Sequence
  chemically synthesized
agtagaactagagtctgttttt

SEQ ID NO: 697301 - DNA, 22 bp, Artificial Sequence
  chemically synthesized
cagtagaactagagtctgtttt

SEQ ID NO: 697302 - DNA, 22 bp, Artificial Sequence
  chemically synthesized
tttcagtagaactagagtctgt

SEQ ID NO: 697303 - DNA, 22 bp, Artificial Sequence
  chemically synthesized
gtttcagtagaactagagtctg

SEQ ID NO: 697304 - DNA, 22 bp, Artificial Sequence
  chemically synthesized
tgtttcagtagaactagagtct

SEQ ID NO: 697305 - DNA, 22 bp, Artificial Sequence
  chemically synthesized
aggaaaaacagactctagttct

SEQ ID NO: 697306 - DNA, 22 bp, Artificial Sequence
  chemically synthesized
ggaaaaacagactctagttcta

SEQ ID NO: 697307 - DNA, 22 bp, Artificial Sequence
  chemically synthesized
gctttgtttcagtagaactaga

SEQ ID NO: 697308 - DNA, 22 bp, Artificial Sequence
  chemically synthesized
tagctttgtttcagtagaacta

SEQ ID NO: 697309 - DNA, 22 bp, Artificial Sequence
  chemically synthesized
agctctagctttgtttcagtag

SEQ ID NO: 697310 - DNA, 22 bp, Artificial Sequence
  chemically synthesized
tcagctctagctttgtttcagt

SEQ ID NO: 697311 - DNA, 22 bp, Artificial Sequence
  chemically synthesized
tagttctactgaaacaaagcta

SEQ ID NO: 697312 - DNA, 22 bp, Artificial Sequence
  chemically synthesized
gttctactgaaacaaagctaga

SEQ ID NO: 697313 - DNA, 22 bp, Artificial Sequence
  chemically synthesized
ggaccactctcagctctagctt

SEQ ID NO: 697314 - DNA, 22 bp, Artificial Sequence
  chemically synthesized
tactgaaacaaagctagagctg

SEQ ID NO: 697315 - DNA, 22 bp, Artificial Sequence
  chemically synthesized
ctgaaacaaagctagagctgag

SEQ ID NO: 697316 - DNA, 22 bp, Artificial Sequence
  chemically synthesized
aaacaaagctagagctgagagt

SEQ ID NO: 697317 - DNA, 22 bp, Artificial Sequence
  chemically synthesized
gataatgcctgggaccactctc

SEQ ID NO: 697318 - DNA, 22 bp, Artificial Sequence
  chemically synthesized
aactagataatgcctgggacca

SEQ ID NO: 697319 - DNA, 22 bp, Artificial Sequence
  chemically synthesized
gagctgagagtggtcccaggca

SEQ ID NO: 697320 - DNA, 22 bp, Artificial Sequence
  chemically synthesized
agagtggtcccaggcattatct

SEQ ID NO: 697321 - DNA, 22 bp, Artificial Sequence
  chemically synthesized
aatgagaaggttgaactagata

SEQ ID NO: 697322 - DNA, 22 bp, Artificial Sequence
  chemically synthesized
aacctcaatgagaaggttgaac

SEQ ID NO: 697323 - DNA, 22 bp, Artificial Sequence
  chemically synthesized
gctcaacctcaatgagaaggtt

SEQ ID NO: 697324 - DNA, 22 bp, Artificial Sequence
  chemically synthesized
agctcaacctcaatgagaaggt

SEQ ID NO: 697325 - DNA, 22 bp, Artificial Sequence
  chemically synthesized
tctagttcaaccttctcattga

SEQ ID NO: 697326 - DNA, 22 bp, Artificial Sequence
  chemically synthesized
gttcaaccttctcattgaggtt

SEQ ID NO: 697327 - DNA, 22 bp, Artificial Sequence
  chemically synthesized
aaccttctcattgaggttgagc

SEQ ID NO: 697328 - DNA, 22 bp, Artificial Sequence
  chemically synthesized
ctcattgaggttgagctaagtt

SEQ ID NO: 697329 - DNA, 22 bp, Artificial Sequence
  chemically synthesized
tcattgaggttgagctaagtta

SEQ ID NO: 697330 - DNA, 22 bp, Artificial Sequence
  chemically synthesized
attgaggttgagctaagttata

SEQ ID NO: 697331 - DNA, 22 bp, Artificial Sequence
  chemically synthesized
aggttgagctaagttatactcc

SEQ ID NO: 697332 - DNA, 22 bp, Artificial Sequence
  chemically synthesized
acaatatgataaggagtataac

SEQ ID NO: 697333 - DNA, 22 bp, Artificial Sequence
  chemically synthesized
atctaacaatatgataaggagt

SEQ ID NO: 697334 - DNA, 22 bp, Artificial Sequence
  chemically synthesized
agctaagttatactccttatca

SEQ ID NO: 697335 - DNA, 22 bp, Artificial Sequence
  chemically synthesized
aatctaacaatatgataaggag

SEQ ID NO: 697336 - DNA, 22 bp, Artificial Sequence
  chemically synthesized
tcttaatctaacaatatgataa

SEQ ID NO: 697337 - DNA, 22 bp, Artificial Sequence
  chemically synthesized
agttatactccttatcatattg

SEQ ID NO: 697338 - DNA, 22 bp, Artificial Sequence
  chemically synthesized
tatcttaatctaacaatatgat

SEQ ID NO: 697339 - DNA, 22 bp, Artificial Sequence
  chemically synthesized
tactccttatcatattgttaga

SEQ ID NO: 697340 - DNA, 22 bp, Artificial Sequence
  chemically synthesized
cgttctatcttaatctaacaat

SEQ ID NO: 697341 - DNA, 22 bp, Artificial Sequence
  chemically synthesized
cttatcatattgttagattaag

SEQ ID NO: 697342 - DNA, 22 bp, Artificial Sequence
  chemically synthesized
gattccgttctatcttaatcta

SEQ ID NO: 697343 - DNA, 22 bp, Artificial Sequence
  chemically synthesized
atcatattgttagattaagata

SEQ ID NO: 697344 - DNA, 22 bp, Artificial Sequence
  chemically synthesized
tagattccgttctatcttaatc

SEQ ID NO: 697345 - DNA, 22 bp, Artificial Sequence
  chemically synthesized
tcatattgttagattaagatag

SEQ ID NO: 697346 - DNA, 22 bp, Artificial Sequence
  chemically synthesized
ttagattaagatagaacggaat

SEQ ID NO: 697347 - DNA, 22 bp, Artificial Sequence
  chemically synthesized
gattaagatagaacggaatcta

SEQ ID NO: 697348 - DNA, 22 bp, Artificial Sequence
  chemically synthesized
agatagaacggaatctagaact

SEQ ID NO: 697349 - DNA, 22 bp, Artificial Sequence
  chemically synthesized
gaactcatgttttggtatgtac

SEQ ID NO: 697350 - DNA, 22 bp, Artificial Sequence
  chemically synthesized
gcatggatgtatgaatggtaca

SEQ ID NO: 697351 - DNA, 22 bp, Artificial Sequence
  chemically synthesized
atgttttggtatgtaccattca

SEQ ID NO: 697352 - DNA, 22 bp, Artificial Sequence
  chemically synthesized
ggcatggatgtatgaatggtac

SEQ ID NO: 697353 - DNA, 22 bp, Artificial Sequence
  chemically synthesized
tggtatgtaccattcatacatc

SEQ ID NO: 697354 - DNA, 22 bp, Artificial Sequence
  chemically synthesized
ggtatgtaccattcatacatcc

SEQ ID NO: 697355 - DNA, 22 bp, Artificial Sequence
  chemically synthesized
gtatgtaccattcatacatcca

SEQ ID NO: 697356 - DNA, 22 bp, Artificial Sequence
  chemically synthesized
agggacagtccttggcatggat

SEQ ID NO: 697357 - DNA, 22 bp, Artificial Sequence
  chemically synthesized
aagggacagtccttggcatgga

SEQ ID NO: 697358 - DNA, 22 bp, Artificial Sequence
  chemically synthesized
gtgcttaagggacagtccttgg

SEQ ID NO: 697359 - DNA, 22 bp, Artificial Sequence
  chemically synthesized
atacatccatgccaaggactgt

SEQ ID NO: 697360 - DNA, 22 bp, Artificial Sequence
  chemically synthesized
ggtgcttaagggacagtccttg

SEQ ID NO: 697361 - DNA, 22 bp, Artificial Sequence
  chemically synthesized
cagtttggtgcttaagggacag

SEQ ID NO: 697362 - DNA, 22 bp, Artificial Sequence
  chemically synthesized
ctacagtttggtgcttaaggga

SEQ ID NO: 697363 - DNA, 22 bp, Artificial Sequence
  chemically synthesized
atagctcctacagtttggtgct

SEQ ID NO: 697364 - DNA, 22 bp, Artificial Sequence
  chemically synthesized
tcatagctcctacagtttggtg

SEQ ID NO: 697365 - DNA, 22 bp, Artificial Sequence
  chemically synthesized
ctcatagctcctacagtttggt

SEQ ID NO: 697366 - DNA, 22 bp, Artificial Sequence
  chemically synthesized
tcccttaagcaccaaactgtag

SEQ ID NO: 697367 - DNA, 22 bp, Artificial Sequence
  chemically synthesized
aagcaccaaactgtaggagcta

SEQ ID NO: 697368 - DNA, 22 bp, Artificial Sequence
  chemically synthesized
agcaccaaactgtaggagctat

SEQ ID NO: 697369 - DNA, 22 bp, Artificial Sequence
  chemically synthesized
atagagtttctcatagctccta

SEQ ID NO: 697370 - DNA, 22 bp, Artificial Sequence
  chemically synthesized
gatagagtttctcatagctcct

SEQ ID NO: 697371 - DNA, 22 bp, Artificial Sequence
  chemically synthesized
taggagctatgagaaactctat

SEQ ID NO: 697372 - DNA, 22 bp, Artificial Sequence
  chemically synthesized
ggaagcatgccgagtgtttgat

SEQ ID NO: 697373 - DNA, 22 bp, Artificial Sequence
  chemically synthesized
tgagaaactctatcaaacactc

SEQ ID NO: 697374 - DNA, 22 bp, Artificial Sequence
  chemically synthesized
gtgttaggaagcatgccgagtg

SEQ ID NO: 697375 - DNA, 22 bp, Artificial Sequence
  chemically synthesized
agtgttaggaagcatgccgagt

SEQ ID NO: 697376 - DNA, 22 bp, Artificial Sequence
  chemically synthesized
tagtgttaggaagcatgccgag

SEQ ID NO: 697377 - DNA, 22 bp, Artificial Sequence
  chemically synthesized
tatcaaacactcggcatgcttc

SEQ ID NO: 697378 - DNA, 22 bp, Artificial Sequence
  chemically synthesized
tcaaacactcggcatgcttcct

SEQ ID NO: 697379 - DNA, 22 bp, Artificial Sequence
  chemically synthesized
gacatgaactttagtgttagga

SEQ ID NO: 697380 - DNA, 22 bp, Artificial Sequence
  chemically synthesized
tagacatgaactttagtgttag

SEQ ID NO: 697381 - DNA, 22 bp, Artificial Sequence
  chemically synthesized
ggcatgcttcctaacactaaag

SEQ ID NO: 697382 - DNA, 22 bp, Artificial Sequence
  chemically synthesized
atgccctctagacatgaacttt

SEQ ID NO: 697383 - DNA, 22 bp, Artificial Sequence
  chemically synthesized
tcatgccctctagacatgaact

SEQ ID NO: 697384 - DNA, 22 bp, Artificial Sequence
  chemically synthesized
cctaacactaaagttcatgtct

SEQ ID NO: 697385 - DNA, 22 bp, Artificial Sequence
  chemically synthesized
ctaacactaaagttcatgtcta

SEQ ID NO: 697386 - DNA, 22 bp, Artificial Sequence
  chemically synthesized
acactaaagttcatgtctagag

SEQ ID NO: 697387 - DNA, 22 bp, Artificial Sequence
  chemically synthesized
aagttcatgtctagagggcatg

SEQ ID NO: 697388 - DNA, 22 bp, Artificial Sequence
  chemically synthesized
aaatccatctctcatgccctct

SEQ ID NO: 697389 - DNA, 22 bp, Artificial Sequence
  chemically synthesized
atgtctagagggcatgagagat

SEQ ID NO: 697390 - DNA, 22 bp, Artificial Sequence
  chemically synthesized
ccactcaaatccatctctcatg

SEQ ID NO: 697391 - DNA, 22 bp, Artificial Sequence
  chemically synthesized
accactcaaatccatctctcat

SEQ ID NO: 697392 - DNA, 22 bp, Artificial Sequence
  chemically synthesized
gatttaccactcaaatccatct

SEQ ID NO: 697393 - DNA, 22 bp, Artificial Sequence
  chemically synthesized
gagggcatgagagatggatttg

SEQ ID NO: 697394 - DNA, 22 bp, Artificial Sequence
  chemically synthesized
agatttaccactcaaatccatc

SEQ ID NO: 697395 - DNA, 22 bp, Artificial Sequence
  chemically synthesized
tgtgtcaatttagatttaccac

SEQ ID NO: 697396 - DNA, 22 bp, Artificial Sequence
  chemically synthesized
gtgtgtcaatttagatttacca

SEQ ID NO: 697397 - DNA, 22 bp, Artificial Sequence
  chemically synthesized
tagtatttgtgtgtcaatttag

SEQ ID NO: 697398 - DNA, 22 bp, Artificial Sequence
  chemically synthesized
gagtggtaaatctaaattgaca

SEQ ID NO: 697399 - DNA, 22 bp, Artificial Sequence
  chemically synthesized
gtagtatttgtgtgtcaattta

SEQ ID NO: 697400 - DNA, 22 bp, Artificial Sequence
  chemically synthesized
agtggtaaatctaaattgacac

SEQ ID NO: 697401 - DNA, 22 bp, Artificial Sequence
  chemically synthesized
aaaacaatcttgtagtatttgt

SEQ ID NO: 697402 - DNA, 22 bp, Artificial Sequence
  chemically synthesized
caaaacaatcttgtagtatttg

SEQ ID NO: 697403 - DNA, 22 bp, Artificial Sequence
  chemically synthesized
aattgacacacaaatactacaa

SEQ ID NO: 697404 - DNA, 22 bp, Artificial Sequence
  chemically synthesized
accttcaaaacaatcttgtagt

SEQ ID NO: 697405 - DNA, 22 bp, Artificial Sequence
  chemically synthesized
caccttcaaaacaatcttgtag

SEQ ID NO: 697406 - DNA, 22 bp, Artificial Sequence
  chemically synthesized
acacacaaatactacaagattg

SEQ ID NO: 697407 - DNA, 22 bp, Artificial Sequence
  chemically synthesized
atttcaccttcaaaacaatctt

SEQ ID NO: 697408 - DNA, 22 bp, Artificial Sequence
  chemically synthesized
actcatttcaccttcaaaacaa

SEQ ID NO: 697409 - DNA, 22 bp, Artificial Sequence
  chemically synthesized
ctgactcatttcaccttcaaaa

SEQ ID NO: 697410 - DNA, 22 bp, Artificial Sequence
  chemically synthesized
gctgactcatttcaccttcaaa

SEQ ID NO: 697411 - DNA, 22 bp, Artificial Sequence
  chemically synthesized
caagattgttttgaaggtgaaa

SEQ ID NO: 697412 - DNA, 22 bp, Artificial Sequence
  chemically synthesized
agtttgctgactcatttcacct

SEQ ID NO: 697413 - DNA, 22 bp, Artificial Sequence
  chemically synthesized
cagtttgctgactcatttcacc

SEQ ID NO: 697414 - DNA, 22 bp, Artificial Sequence
  chemically synthesized
tcagtttgctgactcatttcac

SEQ ID NO: 697415 - DNA, 22 bp, Artificial Sequence
  chemically synthesized
ttcagtttgctgactcatttca

SEQ ID NO: 697416 - DNA, 22 bp, Artificial Sequence
  chemically synthesized
ttttgaaggtgaaatgagtcag

SEQ ID NO: 697417 - DNA, 22 bp, Artificial Sequence
  chemically synthesized
tgaaggtgaaatgagtcagcaa

SEQ ID NO: 697418 - DNA, 22 bp, Artificial Sequence
  chemically synthesized
gaaggtgaaatgagtcagcaaa

SEQ ID NO: 697419 - DNA, 22 bp, Artificial Sequence
  chemically synthesized
tgtgcttttcagtttgctgact

SEQ ID NO: 697420 - DNA, 22 bp, Artificial Sequence
  chemically synthesized
aaggtgaaatgagtcagcaaac

SEQ ID NO: 697421 - DNA, 22 bp, Artificial Sequence
  chemically synthesized
tatgtgcttttcagtttgctga

SEQ ID NO: 697422 - DNA, 22 bp, Artificial Sequence
  chemically synthesized
atgaacatatgtcagtaattct

SEQ ID NO: 697423 - DNA, 22 bp, Artificial Sequence
  chemically synthesized
aaaagcacatagaattactgac

SEQ ID NO: 697424 - DNA, 22 bp, Artificial Sequence
  chemically synthesized
gaatgaattcatgaacatatgt

SEQ ID NO: 697425 - DNA, 22 bp, Artificial Sequence
  chemically synthesized
ctgacatatgttcatgaattca

SEQ ID NO: 697426 - DNA, 22 bp, Artificial Sequence
  chemically synthesized
gtaaatattggaatgaattcat

SEQ ID NO: 697427 - DNA, 22 bp, Artificial Sequence
  chemically synthesized
ggtaaatattggaatgaattca

SEQ ID NO: 697428 - DNA, 22 bp, Artificial Sequence
  chemically synthesized
acatatgttcatgaattcattc

SEQ ID NO: 697429 - DNA, 22 bp, Artificial Sequence
  chemically synthesized
atgaattcattccaatatttac

SEQ ID NO: 697430 - DNA, 22 bp, Artificial Sequence
  chemically synthesized
acagataacaggtacttggtaa

SEQ ID NO: 697431 - DNA, 22 bp, Artificial Sequence
  chemically synthesized
attccaatatttaccaagtacc

SEQ ID NO: 697432 - DNA, 22 bp, Artificial Sequence
  chemically synthesized
caatatttaccaagtacctgtt

SEQ ID NO: 697433 - DNA, 22 bp, Artificial Sequence
  chemically synthesized
gcatagtgcctcacagataaca

SEQ ID NO: 697434 - DNA, 22 bp, Artificial Sequence
  chemically synthesized
accaagtacctgttatctgtga

SEQ ID NO: 697435 - DNA, 22 bp, Artificial Sequence
  chemically synthesized
tagcatagtgcctcacagataa

SEQ ID NO: 697436 - DNA, 22 bp, Artificial Sequence
  chemically synthesized
ccaagtacctgttatctgtgag

SEQ ID NO: 697437 - DNA, 22 bp, Artificial Sequence
  chemically synthesized
ctagcatagtgcctcacagata

SEQ ID NO: 697438 - DNA, 22 bp, Artificial Sequence
  chemically synthesized
tctagcatagtgcctcacagat

SEQ ID NO: 697439 - DNA, 22 bp, Artificial Sequence
  chemically synthesized
ttctagcatagtgcctcacaga

SEQ ID NO: 697440 - DNA, 22 bp, Artificial Sequence
  chemically synthesized
tttctagcatagtgcctcacag

SEQ ID NO: 697441 - DNA, 22 bp, Artificial Sequence
  chemically synthesized
tttttctagcatagtgcctcac

SEQ ID NO: 697442 - DNA, 22 bp, Artificial Sequence
  chemically synthesized
tctctttttctagcatagtgcc

SEQ ID NO: 697443 - DNA, 22 bp, Artificial Sequence
  chemically synthesized
ttatctgtgaggcactatgcta

SEQ ID NO: 697444 - DNA, 22 bp, Artificial Sequence
  chemically synthesized
ttatctctttttctagcatagt

SEQ ID NO: 697445 - DNA, 22 bp, Artificial Sequence
  chemically synthesized
tctgtgaggcactatgctagaa

SEQ ID NO: 697446 - DNA, 22 bp, Artificial Sequence
  chemically synthesized
ttgttatctctttttctagcat

SEQ ID NO: 697447 - DNA, 22 bp, Artificial Sequence
  chemically synthesized
tgaggcactatgctagaaaaag

SEQ ID NO: 697448 - DNA, 22 bp, Artificial Sequence
  chemically synthesized
tgctagaaaaagagataacaac

SEQ ID NO: 697449 - DNA, 22 bp, Artificial Sequence
  chemically synthesized
caggaggatagctgttgttatc

SEQ ID NO: 697450 - DNA, 22 bp, Artificial Sequence
  chemically synthesized
gaaaaagagataacaacagcta

SEQ ID NO: 697451 - DNA, 22 bp, Artificial Sequence
  chemically synthesized
aaataacagactccaggaggat

SEQ ID NO: 697452 - DNA, 22 bp, Artificial Sequence
  chemically synthesized
actgaaataacagactccagga

SEQ ID NO: 697453 - DNA, 22 bp, Artificial Sequence
  chemically synthesized
gactgaaataacagactccagg

SEQ ID NO: 697454 - DNA, 22 bp, Artificial Sequence
  chemically synthesized
tcctcctggagtctgttatttc

SEQ ID NO: 697455 - DNA, 22 bp, Artificial Sequence
  chemically synthesized
tatcaccttgactgaaataaca

SEQ ID NO: 697456 - DNA, 22 bp, Artificial Sequence
  chemically synthesized
gtatcaccttgactgaaataac

SEQ ID NO: 697457 - DNA, 22 bp, Artificial Sequence
  chemically synthesized
ctggagtctgttatttcagtca

SEQ ID NO: 697458 - DNA, 22 bp, Artificial Sequence
  chemically synthesized
atttgtatcaccttgactgaaa

SEQ ID NO: 697459 - DNA, 22 bp, Artificial Sequence
  chemically synthesized
gagtctgttatttcagtcaagg

SEQ ID NO: 697460 - DNA, 22 bp, Artificial Sequence
  chemically synthesized
ataagctgatttgtatcacctt

SEQ ID NO: 697461 - DNA, 22 bp, Artificial Sequence
  chemically synthesized
ttatttcagtcaaggtgataca

SEQ ID NO: 697462 - DNA, 22 bp, Artificial Sequence
  chemically synthesized
cataagctgatttgtatcacct

SEQ ID NO: 697463 - DNA, 22 bp, Artificial Sequence
  chemically synthesized
tttcagtcaaggtgatacaaat

SEQ ID NO: 697464 - DNA, 22 bp, Artificial Sequence
  chemically synthesized
cagtcaaggtgatacaaatcag

SEQ ID NO: 697465 - DNA, 22 bp, Artificial Sequence
  chemically synthesized
tagtttcataagctgatttgta

SEQ ID NO: 697466 - DNA, 22 bp, Artificial Sequence
  chemically synthesized
agtcaaggtgatacaaatcagc

SEQ ID NO: 697467 - DNA, 22 bp, Artificial Sequence
  chemically synthesized
gtagtttcataagctgatttgt

SEQ ID NO: 697468 - DNA, 22 bp, Artificial Sequence
  chemically synthesized
tgtagtttcataagctgatttg

SEQ ID NO: 697469 - DNA, 22 bp, Artificial Sequence
  chemically synthesized
ttgtagtttcataagctgattt

SEQ ID NO: 697470 - DNA, 22 bp, Artificial Sequence
  chemically synthesized
tttgtagtttcataagctgatt

SEQ ID NO: 697471 - DNA, 22 bp, Artificial Sequence
  chemically synthesized
ttttgtagtttcataagctgat

SEQ ID NO: 697472 - DNA, 22 bp, Artificial Sequence
  chemically synthesized
acatccttttttgtagtttcat

SEQ ID NO: 697473 - DNA, 22 bp, Artificial Sequence
  chemically synthesized
atgaaactacaaaaaaggatgt

SEQ ID NO: 697474 - DNA, 22 bp, Artificial Sequence
  chemically synthesized
tgaaactacaaaaaaggatgtg

SEQ ID NO: 697475 - DNA, 22 bp, Artificial Sequence
  chemically synthesized
atgaaaaaaaccctcacatcct

SEQ ID NO: 697476 - DNA, 22 bp, Artificial Sequence
  chemically synthesized
caaaaaaggatgtgagggtttt

SEQ ID NO: 697477 - DNA, 22 bp, Artificial Sequence
  chemically synthesized
ataggttcatgaaaaaaaccct

SEQ ID NO: 697478 - DNA, 22 bp, Artificial Sequence
  chemically synthesized
tgtctcataggttcatgaaaaa

SEQ ID NO: 697479 - DNA, 22 bp, Artificial Sequence
  chemically synthesized
atatcatctgtgtctcataggt

SEQ ID NO: 697480 - DNA, 22 bp, Artificial Sequence
  chemically synthesized
ttttcatgaacctatgagacac

SEQ ID NO: 697481 - DNA, 22 bp, Artificial Sequence
  chemically synthesized
tttcatgaacctatgagacaca

SEQ ID NO: 697482 - DNA, 22 bp, Artificial Sequence
  chemically synthesized
ttcatgaacctatgagacacag

SEQ ID NO: 697483 - DNA, 22 bp, Artificial Sequence
  chemically synthesized
tcatgaacctatgagacacaga

SEQ ID NO: 697484 - DNA, 22 bp, Artificial Sequence
  chemically synthesized
catgaacctatgagacacagat

SEQ ID NO: 697485 - DNA, 22 bp, Artificial Sequence
  chemically synthesized
atgaacctatgagacacagatg

SEQ ID NO: 697486 - DNA, 22 bp, Artificial Sequence
  chemically synthesized
ggagatgtagatgttgatatca

SEQ ID NO: 697487 - DNA, 22 bp, Artificial Sequence
  chemically synthesized
tgagacacagatgatatcaaca

SEQ ID NO: 697488 - DNA, 22 bp, Artificial Sequence
  chemically synthesized
ttgggagatgtagatgttgata

SEQ ID NO: 697489 - DNA, 22 bp, Artificial Sequence
  chemically synthesized
gttgggagatgtagatgttgat

SEQ ID NO: 697490 - DNA, 22 bp, Artificial Sequence
  chemically synthesized
tagatcttgttgggagatgtag

SEQ ID NO: 697491 - DNA, 22 bp, Artificial Sequence
  chemically synthesized
atagatcttgttgggagatgta

SEQ ID NO: 697492 - DNA, 22 bp, Artificial Sequence
  chemically synthesized
tatagatcttgttgggagatgt

SEQ ID NO: 697493 - DNA, 22 bp, Artificial Sequence
  chemically synthesized
gttttatagatcttgttgggag

SEQ ID NO: 697494 - DNA, 22 bp, Artificial Sequence
  chemically synthesized
ggttttatagatcttgttggga

SEQ ID NO: 697495 - DNA, 22 bp, Artificial Sequence
  chemically synthesized
tggttttatagatcttgttggg

SEQ ID NO: 697496 - DNA, 22 bp, Artificial Sequence
  chemically synthesized
gttttggttttatagatcttgt

SEQ ID NO: 697497 - DNA, 22 bp, Artificial Sequence
  chemically synthesized
catctcccaacaagatctataa

SEQ ID NO: 697498 - DNA, 22 bp, Artificial Sequence
  chemically synthesized
agtctggttttggttttataga

SEQ ID NO: 697499 - DNA, 22 bp, Artificial Sequence
  chemically synthesized
ccaacaagatctataaaaccaa

SEQ ID NO: 697500 - DNA, 22 bp, Artificial Sequence
  chemically synthesized
tgcagagtgctgagtctggttt

SEQ ID NO: 697501 - DNA, 22 bp, Artificial Sequence
  chemically synthesized
taaaaccaaaaccagactcagc

SEQ ID NO: 697502 - DNA, 22 bp, Artificial Sequence
  chemically synthesized
agcactctgcacaacactatgg

SEQ ID NO: 697503 - DNA, 22 bp, Artificial Sequence
  chemically synthesized
tgcacaacactatggcacccct

SEQ ID NO: 697504 - DNA, 22 bp, Artificial Sequence
  chemically synthesized
aaagagagtgaaaggggtgcca

SEQ ID NO: 697505 - DNA, 22 bp, Artificial Sequence
  chemically synthesized
cacaacactatggcaccccttt

SEQ ID NO: 697506 - DNA, 22 bp, Artificial Sequence
  chemically synthesized
actgaaagagagtgaaaggggt

SEQ ID NO: 697507 - DNA, 22 bp, Artificial Sequence
  chemically synthesized
tggcacccctttcactctcttt

SEQ ID NO: 697508 - DNA, 22 bp, Artificial Sequence
  chemically synthesized
agatattaactgaaagagagtg

SEQ ID NO: 697509 - DNA, 22 bp, Artificial Sequence
  chemically synthesized
aggttaagatattaactgaaag

SEQ ID NO: 697510 - DNA, 22 bp, Artificial Sequence
  chemically synthesized
tcactctctttcagttaatatc

SEQ ID NO: 697511 - DNA, 22 bp, Artificial Sequence
  chemically synthesized
cactctctttcagttaatatct

SEQ ID NO: 697512 - DNA, 22 bp, Artificial Sequence
  chemically synthesized
actctctttcagttaatatctt

SEQ ID NO: 697513 - DNA, 22 bp, Artificial Sequence
  chemically synthesized
tctttcagttaatatcttaacc

SEQ ID NO: 697514 - DNA, 22 bp, Artificial Sequence
  chemically synthesized
tttcagttaatatcttaacctg

SEQ ID NO: 697515 - DNA, 22 bp, Artificial Sequence
  chemically synthesized
tcagttaatatcttaacctgaa

SEQ ID NO: 697516 - DNA, 22 bp, Artificial Sequence
  chemically synthesized
cagttaatatcttaacctgaat

SEQ ID NO: 697517 - DNA, 22 bp, Artificial Sequence
  chemically synthesized
agttaatatcttaacctgaatt

SEQ ID NO: 697518 - DNA, 22 bp, Artificial Sequence
  chemically synthesized
atatcttaacctgaattgtttt

SEQ ID NO: 697519 - DNA, 22 bp, Artificial Sequence
  chemically synthesized
atgatataatcatgaaaacaat

SEQ ID NO: 697520 - DNA, 22 bp, Artificial Sequence
  chemically synthesized
ttgatgatataatcatgaaaac

SEQ ID NO: 697521 - DNA, 22 bp, Artificial Sequence
  chemically synthesized
aacctgaattgttttcatgatt

SEQ ID NO: 697522 - DNA, 22 bp, Artificial Sequence
  chemically synthesized
acctgaattgttttcatgatta

SEQ ID NO: 697523 - DNA, 22 bp, Artificial Sequence
  chemically synthesized
aattgttttcatgattatatca

SEQ ID NO: 697524 - DNA, 22 bp, Artificial Sequence
  chemically synthesized
gtaatacattattgatgatata

SEQ ID NO: 697525 - DNA, 22 bp, Artificial Sequence
  chemically synthesized
ttttcatgattatatcatcaat

SEQ ID NO: 697526 - DNA, 22 bp, Artificial Sequence
  chemically synthesized
tcatgattatatcatcaataat

SEQ ID NO: 697527 - DNA, 22 bp, Artificial Sequence
  chemically synthesized
catgattatatcatcaataatg

SEQ ID NO: 697528 - DNA, 22 bp, Artificial Sequence
  chemically synthesized
atgattatatcatcaataatgt

SEQ ID NO: 697529 - DNA, 22 bp, Artificial Sequence
  chemically synthesized
tatcatcaataatgtattacca

SEQ ID NO: 697530 - DNA, 22 bp, Artificial Sequence
  chemically synthesized
gaaccacaatgaaggaatagtt

SEQ ID NO: 697531 - DNA, 22 bp, Artificial Sequence
  chemically synthesized
tggaaccacaatgaaggaatag

SEQ ID NO: 697532 - DNA, 22 bp, Artificial Sequence
  chemically synthesized
ccaactattccttcattgtggt

SEQ ID NO: 697533 - DNA, 22 bp, Artificial Sequence
  chemically synthesized
agtaagctctggaaccacaatg

SEQ ID NO: 697534 - DNA, 22 bp, Artificial Sequence
  chemically synthesized
ttccttcattgtggttccagag

SEQ ID NO: 697535 - DNA, 22 bp, Artificial Sequence
  chemically synthesized
agtctcagtaagctctggaacc

SEQ ID NO: 697536 - DNA, 22 bp, Artificial Sequence
  chemically synthesized
cttcattgtggttccagagctt

SEQ ID NO: 697537 - DNA, 22 bp, Artificial Sequence
  chemically synthesized
cctgagtctcagtaagctctgg

SEQ ID NO: 697538 - DNA, 22 bp, Artificial Sequence
  chemically synthesized
cattgtggttccagagcttact

SEQ ID NO: 697539 - DNA, 22 bp, Artificial Sequence
  chemically synthesized
attgtggttccagagcttactg

SEQ ID NO: 697540 - DNA, 22 bp, Artificial Sequence
  chemically synthesized
tggttccagagcttactgagac

SEQ ID NO: 697541 - DNA, 22 bp, Artificial Sequence
  chemically synthesized
cagagcttactgagactcaggt

SEQ ID NO: 697542 - DNA, 22 bp, Artificial Sequence
  chemically synthesized
aaaggtcacgttacctgagtct

SEQ ID NO: 697543 - DNA, 22 bp, Artificial Sequence
  chemically synthesized
caaaggtcacgttacctgagtc

SEQ ID NO: 697544 - DNA, 22 bp, Artificial Sequence
  chemically synthesized
actgagactcaggtaacgtgac

SEQ ID NO: 697545 - DNA, 22 bp, Artificial Sequence
  chemically synthesized
atggtttcaaaggtcacgttac

SEQ ID NO: 697546 - DNA, 22 bp, Artificial Sequence
  chemically synthesized
ctgagactcaggtaacgtgacc

SEQ ID NO: 697547 - DNA, 22 bp, Artificial Sequence
  chemically synthesized
gatggtttcaaaggtcacgtta

SEQ ID NO: 697548 - DNA, 22 bp, Artificial Sequence
  chemically synthesized
agactcaggtaacgtgaccttt

SEQ ID NO: 697549 - DNA, 22 bp, Artificial Sequence
  chemically synthesized
ccatttgatggtttcaaaggtc

SEQ ID NO: 697550 - DNA, 22 bp, Artificial Sequence
  chemically synthesized
tgccatttgatggtttcaaagg

SEQ ID NO: 697551 - DNA, 22 bp, Artificial Sequence
  chemically synthesized
aggtaacgtgacctttgaaacc

SEQ ID NO: 697552 - DNA, 22 bp, Artificial Sequence
  chemically synthesized
ctctgccatttgatggtttcaa

SEQ ID NO: 697553 - DNA, 22 bp, Artificial Sequence
  chemically synthesized
tcctctgccatttgatggtttc

SEQ ID NO: 697554 - DNA, 22 bp, Artificial Sequence
  chemically synthesized
ctcctctgccatttgatggttt

SEQ ID NO: 697555 - DNA, 22 bp, Artificial Sequence
  chemically synthesized
tctcctctgccatttgatggtt

SEQ ID NO: 697556 - DNA, 22 bp, Artificial Sequence
  chemically synthesized
tgttttctcctctgccatttga

SEQ ID NO: 697557 - DNA, 22 bp, Artificial Sequence
  chemically synthesized
ctgtgttttctcctctgccatt

SEQ ID NO: 697558 - DNA, 22 bp, Artificial Sequence
  chemically synthesized
tgaaaccatcaaatggcagagg

SEQ ID NO: 697559 - DNA, 22 bp, Artificial Sequence
  chemically synthesized
gaaaccatcaaatggcagagga

SEQ ID NO: 697560 - DNA, 22 bp, Artificial Sequence
  chemically synthesized
tgctgtgttttctcctctgcca

SEQ ID NO: 697561 - DNA, 22 bp, Artificial Sequence
  chemically synthesized
aaaccatcaaatggcagaggag

SEQ ID NO: 697562 - DNA, 22 bp, Artificial Sequence
  chemically synthesized
tctgctgtgttttctcctctgc

SEQ ID NO: 697563 - DNA, 22 bp, Artificial Sequence
  chemically synthesized
ctctgctgtgttttctcctctg

SEQ ID NO: 697564 - DNA, 22 bp, Artificial Sequence
  chemically synthesized
gtacacaaagataacccagagg

SEQ ID NO: 697565 - DNA, 22 bp, Artificial Sequence
  chemically synthesized
agtacacaaagataacccagag

SEQ ID NO: 697566 - DNA, 22 bp, Artificial Sequence
  chemically synthesized
tagtacacaaagataacccaga

SEQ ID NO: 697567 - DNA, 22 bp, Artificial Sequence
  chemically synthesized
acctctgggttatctttgtgta

SEQ ID NO: 697568 - DNA, 22 bp, Artificial Sequence
  chemically synthesized
aaaaggctttagtacacaaaga

SEQ ID NO: 697569 - DNA, 22 bp, Artificial Sequence
  chemically synthesized
caaaaggctttagtacacaaag

SEQ ID NO: 697570 - DNA, 22 bp, Artificial Sequence
  chemically synthesized
tcaaaaggctttagtacacaaa

SEQ ID NO: 697571 - DNA, 22 bp, Artificial Sequence
  chemically synthesized
ttcaaaaggctttagtacacaa

SEQ ID NO: 697572 - DNA, 22 bp, Artificial Sequence
  chemically synthesized
tgggttatctttgtgtactaaa

SEQ ID NO: 697573 - DNA, 22 bp, Artificial Sequence
  chemically synthesized
ggttatctttgtgtactaaagc

SEQ ID NO: 697574 - DNA, 22 bp, Artificial Sequence
  chemically synthesized
acttttcaaaaggctttagtac

SEQ ID NO: 697575 - DNA, 22 bp, Artificial Sequence
  chemically synthesized
tgacttttcaaaaggctttagt

SEQ ID NO: 697576 - DNA, 22 bp, Artificial Sequence
  chemically synthesized
tctttgtgtactaaagcctttt

SEQ ID NO: 697577 - DNA, 22 bp, Artificial Sequence
  chemically synthesized
atgctctgacttttcaaaaggc

SEQ ID NO: 697578 - DNA, 22 bp, Artificial Sequence
  chemically synthesized
tgtgtactaaagccttttgaaa

SEQ ID NO: 697579 - DNA, 22 bp, Artificial Sequence
  chemically synthesized
gtgtactaaagccttttgaaaa

SEQ ID NO: 697580 - DNA, 22 bp, Artificial Sequence
  chemically synthesized
tgtactaaagccttttgaaaag

SEQ ID NO: 697581 - DNA, 22 bp, Artificial Sequence
  chemically synthesized
aagccttttgaaaagtcagagc

SEQ ID NO: 697582 - DNA, 22 bp, Artificial Sequence
  chemically synthesized
ccaaaagcctgatgctctgact

SEQ ID NO: 697583 - DNA, 22 bp, Artificial Sequence
  chemically synthesized
ttgaaaagtcagagcatcaggc

SEQ ID NO: 697584 - DNA, 22 bp, Artificial Sequence
  chemically synthesized
tgaaaagtcagagcatcaggct

SEQ ID NO: 697585 - DNA, 22 bp, Artificial Sequence
  chemically synthesized
gaaaagtcagagcatcaggctt

SEQ ID NO: 697586 - DNA, 22 bp, Artificial Sequence
  chemically synthesized
aaaagtcagagcatcaggcttt

SEQ ID NO: 697587 - DNA, 22 bp, Artificial Sequence
  chemically synthesized
aaatcactgccaaaagcctgat

SEQ ID NO: 697588 - DNA, 22 bp, Artificial Sequence
  chemically synthesized
gaaatcactgccaaaagcctga

SEQ ID NO: 697589 - DNA, 22 bp, Artificial Sequence
  chemically synthesized
tgaaatcactgccaaaagcctg

SEQ ID NO: 697590 - DNA, 22 bp, Artificial Sequence
  chemically synthesized
ttgaaatcactgccaaaagcct

SEQ ID NO: 697591 - DNA, 22 bp, Artificial Sequence
  chemically synthesized
aatttttgaaatcactgccaaa

SEQ ID NO: 697592 - DNA, 22 bp, Artificial Sequence
  chemically synthesized
ggggtaattaaatttttgaaat

SEQ ID NO: 697593 - DNA, 22 bp, Artificial Sequence
  chemically synthesized
ttggcagtgatttcaaaaattt

SEQ ID NO: 697594 - DNA, 22 bp, Artificial Sequence
  chemically synthesized
tggcagtgatttcaaaaattta

SEQ ID NO: 697595 - DNA, 22 bp, Artificial Sequence
  chemically synthesized
ggcagtgatttcaaaaatttaa

SEQ ID NO: 697596 - DNA, 22 bp, Artificial Sequence
  chemically synthesized
gcagtgatttcaaaaatttaat

SEQ ID NO: 697597 - DNA, 22 bp, Artificial Sequence
  chemically synthesized
gtgaatgattcggggtaattaa

SEQ ID NO: 697598 - DNA, 22 bp, Artificial Sequence
  chemically synthesized
caaaaatttaattaccccgaat

SEQ ID NO: 697599 - DNA, 22 bp, Artificial Sequence
  chemically synthesized
aaaaatttaattaccccgaatc

SEQ ID NO: 697600 - DNA, 22 bp, Artificial Sequence
  chemically synthesized
aggatgctggtgaatgattcgg

SEQ ID NO: 697601 - DNA, 22 bp, Artificial Sequence
  chemically synthesized
gaggatgctggtgaatgattcg

SEQ ID NO: 697602 - DNA, 22 bp, Artificial Sequence
  chemically synthesized
tgaggatgctggtgaatgattc

SEQ ID NO: 697603 - DNA, 22 bp, Artificial Sequence
  chemically synthesized
aattaccccgaatcattcacca

SEQ ID NO: 697604 - DNA, 22 bp, Artificial Sequence
  chemically synthesized
attaccccgaatcattcaccag

SEQ ID NO: 697605 - DNA, 22 bp, Artificial Sequence
  chemically synthesized
ccccgaatcattcaccagcatc

SEQ ID NO: 697606 - DNA, 22 bp, Artificial Sequence
  chemically synthesized
tcagtctttgaggatgctggtg

SEQ ID NO: 697607 - DNA, 22 bp, Artificial Sequence
  chemically synthesized
atctgtcagtctttgaggatgc

SEQ ID NO: 697608 - DNA, 22 bp, Artificial Sequence
  chemically synthesized
gatctgtcagtctttgaggatg

SEQ ID NO: 697609 - DNA, 22 bp, Artificial Sequence
  chemically synthesized
atttgatctgtcagtctttgag

SEQ ID NO: 697610 - DNA, 22 bp, Artificial Sequence
  chemically synthesized
accagcatcctcaaagactgac

SEQ ID NO: 697611 - DNA, 22 bp, Artificial Sequence
  chemically synthesized
tctaatttgatctgtcagtctt

SEQ ID NO: 697612 - DNA, 22 bp, Artificial Sequence
  chemically synthesized
aaagactgacagatcaaattag

SEQ ID NO: 697613 - DNA, 22 bp, Artificial Sequence
  chemically synthesized
acagatcaaattagacagctga

SEQ ID NO: 697614 - DNA, 22 bp, Artificial Sequence
  chemically synthesized
gacagctgattctctgttgcat

SEQ ID NO: 697615 - DNA, 22 bp, Artificial Sequence
  chemically synthesized
atgataagaagtggatgcaaca

SEQ ID NO: 697616 - DNA, 22 bp, Artificial Sequence
  chemically synthesized
ttgatgataagaagtggatgca

SEQ ID NO: 697617 - DNA, 22 bp, Artificial Sequence
  chemically synthesized
attctctgttgcatccacttct

SEQ ID NO: 697618 - DNA, 22 bp, Artificial Sequence
  chemically synthesized
gcactattgatgataagaagtg

SEQ ID NO: 697619 - DNA, 22 bp, Artificial Sequence
  chemically synthesized
tctgttgcatccacttcttatc

SEQ ID NO: 697620 - DNA, 22 bp, Artificial Sequence
  chemically synthesized
agcactattgatgataagaagt

SEQ ID NO: 697621 - DNA, 22 bp, Artificial Sequence
  chemically synthesized
tgttgcatccacttcttatcat

SEQ ID NO: 697622 - DNA, 22 bp, Artificial Sequence
  chemically synthesized
tttagcactattgatgataaga

SEQ ID NO: 697623 - DNA, 22 bp, Artificial Sequence
  chemically synthesized
ttgcatccacttcttatcatca

SEQ ID NO: 697624 - DNA, 22 bp, Artificial Sequence
  chemically synthesized
catccacttcttatcatcaata

SEQ ID NO: 697625 - DNA, 22 bp, Artificial Sequence
  chemically synthesized
actatttagcactattgatgat

SEQ ID NO: 697626 - DNA, 22 bp, Artificial Sequence
  chemically synthesized
aactatttagcactattgatga

SEQ ID NO: 697627 - DNA, 22 bp, Artificial Sequence
  chemically synthesized
acttaactatttagcactattg

SEQ ID NO: 697628 - DNA, 22 bp, Artificial Sequence
  chemically synthesized
cacttaactatttagcactatt

SEQ ID NO: 697629 - DNA, 22 bp, Artificial Sequence
  chemically synthesized
cttatcatcaatagtgctaaat

SEQ ID NO: 697630 - DNA, 22 bp, Artificial Sequence
  chemically synthesized
ttatcatcaatagtgctaaata

SEQ ID NO: 697631 - DNA, 22 bp, Artificial Sequence
  chemically synthesized
atcatcaatagtgctaaatagt

SEQ ID NO: 697632 - DNA, 22 bp, Artificial Sequence
  chemically synthesized
tcatcaatagtgctaaatagtt

SEQ ID NO: 697633 - DNA, 22 bp, Artificial Sequence
  chemically synthesized
aatgtttcacttaactatttag

SEQ ID NO: 697634 - DNA, 22 bp, Artificial Sequence
  chemically synthesized
aatagttaagtgaaacatttaa

SEQ ID NO: 697635 - DNA, 22 bp, Artificial Sequence
  chemically synthesized
agtgaaacatttaatattattt

SEQ ID NO: 697636 - DNA, 22 bp, Artificial Sequence
  chemically synthesized
tcgggatagaaaggacaaataa

SEQ ID NO: 697637 - DNA, 22 bp, Artificial Sequence
  chemically synthesized
atcgggatagaaaggacaaata

SEQ ID NO: 697638 - DNA, 22 bp, Artificial Sequence
  chemically synthesized
aatattatttgtcctttctatc

SEQ ID NO: 697639 - DNA, 22 bp, Artificial Sequence
  chemically synthesized
atattatttgtcctttctatcc

SEQ ID NO: 697640 - DNA, 22 bp, Artificial Sequence
  chemically synthesized
caccatcaatcttatcgggata

SEQ ID NO: 697641 - DNA, 22 bp, Artificial Sequence
  chemically synthesized
tttgtcctttctatcccgataa

SEQ ID NO: 697642 - DNA, 22 bp, Artificial Sequence
  chemically synthesized
ttgcaccatcaatcttatcggg

SEQ ID NO: 697643 - DNA, 22 bp, Artificial Sequence
  chemically synthesized
gtcctttctatcccgataagat

SEQ ID NO: 697644 - DNA, 22 bp, Artificial Sequence
  chemically synthesized
attgcaccatcaatcttatcgg

SEQ ID NO: 697645 - DNA, 22 bp, Artificial Sequence
  chemically synthesized
tcctttctatcccgataagatt

SEQ ID NO: 697646 - DNA, 22 bp, Artificial Sequence
  chemically synthesized
ttattgcaccatcaatcttatc

SEQ ID NO: 697647 - DNA, 22 bp, Artificial Sequence
  chemically synthesized
tctatcccgataagattgatgg

SEQ ID NO: 697648 - DNA, 22 bp, Artificial Sequence
  chemically synthesized
ctatcccgataagattgatggt

SEQ ID NO: 697649 - DNA, 22 bp, Artificial Sequence
  chemically synthesized
tatcccgataagattgatggtg

SEQ ID NO: 697650 - DNA, 22 bp, Artificial Sequence
  chemically synthesized
aggattcttattgcaccatcaa

SEQ ID NO: 697651 - DNA, 22 bp, Artificial Sequence
  chemically synthesized
tcccgataagattgatggtgca

SEQ ID NO: 697652 - DNA, 22 bp, Artificial Sequence
  chemically synthesized
gaggattcttattgcaccatca

SEQ ID NO: 697653 - DNA, 22 bp, Artificial Sequence
  chemically synthesized
cccttgaggattcttattgcac

SEQ ID NO: 697654 - DNA, 22 bp, Artificial Sequence
  chemically synthesized
atattgcccttgaggattctta

SEQ ID NO: 697655 - DNA, 22 bp, Artificial Sequence
  chemically synthesized
catattgcccttgaggattctt

SEQ ID NO: 697656 - DNA, 22 bp, Artificial Sequence
  chemically synthesized
atggtgcaataagaatcctcaa

SEQ ID NO: 697657 - DNA, 22 bp, Artificial Sequence
  chemically synthesized
aagggcaatatgaagattcatt

SEQ ID NO: 697658 - DNA, 22 bp, Artificial Sequence
  chemically synthesized
cagagaagtgaaaatgaatctt

SEQ ID NO: 697659 - DNA, 22 bp, Artificial Sequence
  chemically synthesized
ccagagaagtgaaaatgaatct

SEQ ID NO: 697660 - DNA, 22 bp, Artificial Sequence
  chemically synthesized
tccagagaagtgaaaatgaatc

SEQ ID NO: 697661 - DNA, 22 bp, Artificial Sequence
  chemically synthesized
tgatcattttccagagaagtga

SEQ ID NO: 697662 - DNA, 22 bp, Artificial Sequence
  chemically synthesized
gtgatcattttccagagaagtg

SEQ ID NO: 697663 - DNA, 22 bp, Artificial Sequence
  chemically synthesized
tttgtgatcattttccagagaa

SEQ ID NO: 697664 - DNA, 22 bp, Artificial Sequence
  chemically synthesized
attttcacttctctggaaaatg

SEQ ID NO: 697665 - DNA, 22 bp, Artificial Sequence
  chemically synthesized
tcacttctctggaaaatgatca

SEQ ID NO: 697666 - DNA, 22 bp, Artificial Sequence
  chemically synthesized
cacttctctggaaaatgatcac

SEQ ID NO: 697667 - DNA, 22 bp, Artificial Sequence
  chemically synthesized
acttctctggaaaatgatcaca

SEQ ID NO: 697668 - DNA, 22 bp, Artificial Sequence
  chemically synthesized
gaaatagaaattgtttgtgatc

SEQ ID NO: 697669 - DNA, 22 bp, Artificial Sequence
  chemically synthesized
ctctggaaaatgatcacaaaca

SEQ ID NO: 697670 - DNA, 22 bp, Artificial Sequence
  chemically synthesized
cgaaatagaaattgtttgtgat

SEQ ID NO: 697671 - DNA, 22 bp, Artificial Sequence
  chemically synthesized
tctggaaaatgatcacaaacaa

SEQ ID NO: 697672 - DNA, 22 bp, Artificial Sequence
  chemically synthesized
tggaaaatgatcacaaacaatt

SEQ ID NO: 697673 - DNA, 22 bp, Artificial Sequence
  chemically synthesized
acttcgaaatagaaattgtttg

SEQ ID NO: 697674 - DNA, 22 bp, Artificial Sequence
  chemically synthesized
gaaaatgatcacaaacaatttc

SEQ ID NO: 697675 - DNA, 22 bp, Artificial Sequence
  chemically synthesized
tgaatgttgacttcgaaataga

SEQ ID NO: 697676 - DNA, 22 bp, Artificial Sequence
  chemically synthesized
gtgaatgttgacttcgaaatag

SEQ ID NO: 697677 - DNA, 22 bp, Artificial Sequence
  chemically synthesized
tgtgaatgttgacttcgaaata

SEQ ID NO: 697678 - DNA, 22 bp, Artificial Sequence
  chemically synthesized
attttgtgaatgttgacttcga

SEQ ID NO: 697679 - DNA, 22 bp, Artificial Sequence
  chemically synthesized
tgattttgtgaatgttgacttc

SEQ ID NO: 697680 - DNA, 22 bp, Artificial Sequence
  chemically synthesized
ctgattttgtgaatgttgactt

SEQ ID NO: 697681 - DNA, 22 bp, Artificial Sequence
  chemically synthesized
tctgattttgtgaatgttgact

SEQ ID NO: 697682 - DNA, 22 bp, Artificial Sequence
  chemically synthesized
ctatttcgaagtcaacattcac

SEQ ID NO: 697683 - DNA, 22 bp, Artificial Sequence
  chemically synthesized
tatttcgaagtcaacattcaca

SEQ ID NO: 697684 - DNA, 22 bp, Artificial Sequence
  chemically synthesized
tttcgaagtcaacattcacaaa

SEQ ID NO: 697685 - DNA, 22 bp, Artificial Sequence
  chemically synthesized
acattttctgattttgtgaatg

SEQ ID NO: 697686 - DNA, 22 bp, Artificial Sequence
  chemically synthesized
cgaagtcaacattcacaaaatc

SEQ ID NO: 697687 - DNA, 22 bp, Artificial Sequence
  chemically synthesized
gaagtcaacattcacaaaatca

SEQ ID NO: 697688 - DNA, 22 bp, Artificial Sequence
  chemically synthesized
cagtactaacattttctgattt

SEQ ID NO: 697689 - DNA, 22 bp, Artificial Sequence
  chemically synthesized
ccagtactaacattttctgatt

SEQ ID NO: 697690 - DNA, 22 bp, Artificial Sequence
  chemically synthesized
acaaaatcagaaaatgttagta

SEQ ID NO: 697691 - DNA, 22 bp, Artificial Sequence
  chemically synthesized
gtactggaaatgacctatgata

SEQ ID NO: 697692 - DNA, 22 bp, Artificial Sequence
  chemically synthesized
gaaatgacctatgatatcatgt

SEQ ID NO: 697693 - DNA, 22 bp, Artificial Sequence
  chemically synthesized
aggaagcagaatgacatgatat

SEQ ID NO: 697694 - DNA, 22 bp, Artificial Sequence
  chemically synthesized
aaggaagcagaatgacatgata

SEQ ID NO: 697695 - DNA, 22 bp, Artificial Sequence
  chemically synthesized
tcatttaaggaagcagaatgac

SEQ ID NO: 697696 - DNA, 22 bp, Artificial Sequence
  chemically synthesized
tgtcatttaaggaagcagaatg

SEQ ID NO: 697697 - DNA, 22 bp, Artificial Sequence
  chemically synthesized
tgatatcatgtcattctgcttc

SEQ ID NO: 697698 - DNA, 22 bp, Artificial Sequence
  chemically synthesized
cctctgtcatttaaggaagcag

SEQ ID NO: 697699 - DNA, 22 bp, Artificial Sequence
  chemically synthesized
tccctctgtcatttaaggaagc

SEQ ID NO: 697700 - DNA, 22 bp, Artificial Sequence
  chemically synthesized
ctccctctgtcatttaaggaag

SEQ ID NO: 697701 - DNA, 22 bp, Artificial Sequence
  chemically synthesized
agtttctccctctgtcatttaa

SEQ ID NO: 697702 - DNA, 22 bp, Artificial Sequence
  chemically synthesized
tgcttccttaaatgacagaggg

SEQ ID NO: 697703 - DNA, 22 bp, Artificial Sequence
  chemically synthesized
cttccttaaatgacagagggag

SEQ ID NO: 697704 - DNA, 22 bp, Artificial Sequence
  chemically synthesized
tgggcctcagtttctccctctg

SEQ ID NO: 697705 - DNA, 22 bp, Artificial Sequence
  chemically synthesized
ccttaaatgacagagggagaaa

SEQ ID NO: 697706 - DNA, 22 bp, Artificial Sequence
  chemically synthesized
tgtgggcctcagtttctccctc

SEQ ID NO: 697707 - DNA, 22 bp, Artificial Sequence
  chemically synthesized
cttaaatgacagagggagaaac

SEQ ID NO: 697708 - DNA, 22 bp, Artificial Sequence
  chemically synthesized
ctgtgggcctcagtttctccct

SEQ ID NO: 697709 - DNA, 22 bp, Artificial Sequence
  chemically synthesized
tctgtgggcctcagtttctccc

SEQ ID NO: 697710 - DNA, 22 bp, Artificial Sequence
  chemically synthesized
aaatgacagagggagaaactga

SEQ ID NO: 697711 - DNA, 22 bp, Artificial Sequence
  chemically synthesized
aatgacagagggagaaactgag

SEQ ID NO: 697712 - DNA, 22 bp, Artificial Sequence
  chemically synthesized
ttttctgtgggcctcagtttct

SEQ ID NO: 697713 - DNA, 22 bp, Artificial Sequence
  chemically synthesized
attttctgtgggcctcagtttc

SEQ ID NO: 697714 - DNA, 22 bp, Artificial Sequence
  chemically synthesized
cttattttctgtgggcctcagt

SEQ ID NO: 697715 - DNA, 22 bp, Artificial Sequence
  chemically synthesized
accaatgggaaattgcttattt

SEQ ID NO: 697716 - DNA, 22 bp, Artificial Sequence
  chemically synthesized
aggcccacagaaaataagcaat

SEQ ID NO: 697717 - DNA, 22 bp, Artificial Sequence
  chemically synthesized
gaccaatgggaaattgcttatt

SEQ ID NO: 697718 - DNA, 22 bp, Artificial Sequence
  chemically synthesized
atacttgaccaatgggaaattg

SEQ ID NO: 697719 - DNA, 22 bp, Artificial Sequence
  chemically synthesized
ttaatacttgaccaatgggaaa

SEQ ID NO: 697720 - DNA, 22 bp, Artificial Sequence
  chemically synthesized
gctattaatacttgaccaatgg

SEQ ID NO: 697721 - DNA, 22 bp, Artificial Sequence
  chemically synthesized
tcacctagctattaatacttga

SEQ ID NO: 697722 - DNA, 22 bp, Artificial Sequence
  chemically synthesized
ctgtcacctagctattaatact

SEQ ID NO: 697723 - DNA, 22 bp, Artificial Sequence
  chemically synthesized
cccattggtcaagtattaatag

SEQ ID NO: 697724 - DNA, 22 bp, Artificial Sequence
  chemically synthesized
actgtcacctagctattaatac

SEQ ID NO: 697725 - DNA, 22 bp, Artificial Sequence
  chemically synthesized
ccattggtcaagtattaatagc

SEQ ID NO: 697726 - DNA, 22 bp, Artificial Sequence
  chemically synthesized
tactgtcacctagctattaata

SEQ ID NO: 697727 - DNA, 22 bp, Artificial Sequence
  chemically synthesized
gtcaagtattaatagctaggtg

SEQ ID NO: 697728 - DNA, 22 bp, Artificial Sequence
  chemically synthesized
cagctttactgtcacctagcta

SEQ ID NO: 697729 - DNA, 22 bp, Artificial Sequence
  chemically synthesized
gttccagctttactgtcaccta

SEQ ID NO: 697730 - DNA, 22 bp, Artificial Sequence
  chemically synthesized
tagttccagctttactgtcacc

SEQ ID NO: 697731 - DNA, 22 bp, Artificial Sequence
  chemically synthesized
atagctaggtgacagtaaagct

SEQ ID NO: 697732 - DNA, 22 bp, Artificial Sequence
  chemically synthesized
aattctagttccagctttactg

SEQ ID NO: 697733 - DNA, 22 bp, Artificial Sequence
  chemically synthesized
gaattctagttccagctttact

SEQ ID NO: 697734 - DNA, 22 bp, Artificial Sequence
  chemically synthesized
ggtgacagtaaagctggaacta

SEQ ID NO: 697735 - DNA, 22 bp, Artificial Sequence
  chemically synthesized
ggcatcgcaagacttgaattct

SEQ ID NO: 697736 - DNA, 22 bp, Artificial Sequence
  chemically synthesized
gaactagaattcaagtcttgcg

SEQ ID NO: 697737 - DNA, 22 bp, Artificial Sequence
  chemically synthesized
aataggctaggcatcgcaagac

SEQ ID NO: 697738 - DNA, 22 bp, Artificial Sequence
  chemically synthesized
aaataggctaggcatcgcaaga

SEQ ID NO: 697739 - DNA, 22 bp, Artificial Sequence
  chemically synthesized
taaataggctaggcatcgcaag

SEQ ID NO: 697740 - DNA, 22 bp, Artificial Sequence
  chemically synthesized
gaattcaagtcttgcgatgcct

SEQ ID NO: 697741 - DNA, 22 bp, Artificial Sequence
  chemically synthesized
aagtcttgcgatgcctagccta

SEQ ID NO: 697742 - DNA, 22 bp, Artificial Sequence
  chemically synthesized
aataggggaaattttaaatagg

SEQ ID NO: 697743 - DNA, 22 bp, Artificial Sequence
  chemically synthesized
gcgatgcctagcctatttaaaa

SEQ ID NO: 697744 - DNA, 22 bp, Artificial Sequence
  chemically synthesized
cgatgcctagcctatttaaaat

SEQ ID NO: 697745 - DNA, 22 bp, Artificial Sequence
  chemically synthesized
gcctatttaaaatttcccctat

SEQ ID NO: 697746 - DNA, 22 bp, Artificial Sequence
  chemically synthesized
agacaacattaaataggggaaa

SEQ ID NO: 697747 - DNA, 22 bp, Artificial Sequence
  chemically synthesized
tttaaaatttcccctatttaat

SEQ ID NO: 697748 - DNA, 22 bp, Artificial Sequence
  chemically synthesized
gcagctaagacaacattaaata

SEQ ID NO: 697749 - DNA, 22 bp, Artificial Sequence
  chemically synthesized
aaaatttcccctatttaatgtt

SEQ ID NO: 697750 - DNA, 22 bp, Artificial Sequence
  chemically synthesized
agcagctaagacaacattaaat

SEQ ID NO: 697751 - DNA, 22 bp, Artificial Sequence
  chemically synthesized
aaatttcccctatttaatgttg

SEQ ID NO: 697752 - DNA, 22 bp, Artificial Sequence
  chemically synthesized
tagcagctaagacaacattaaa

SEQ ID NO: 697753 - DNA, 22 bp, Artificial Sequence
  chemically synthesized
ttagcagctaagacaacattaa

SEQ ID NO: 697754 - DNA, 22 bp, Artificial Sequence
  chemically synthesized
cccctatttaatgttgtcttag

SEQ ID NO: 697755 - DNA, 22 bp, Artificial Sequence
  chemically synthesized
ccctatttaatgttgtcttagc

SEQ ID NO: 697756 - DNA, 22 bp, Artificial Sequence
  chemically synthesized
tttaatgttgtcttagctgcta

SEQ ID NO: 697757 - DNA, 22 bp, Artificial Sequence
  chemically synthesized
aaaatataccttttagcagcta

SEQ ID NO: 697758 - DNA, 22 bp, Artificial Sequence
  chemically synthesized
caaaatataccttttagcagct

SEQ ID NO: 697759 - DNA, 22 bp, Artificial Sequence
  chemically synthesized
aatgttgtcttagctgctaaaa

SEQ ID NO: 697760 - DNA, 22 bp, Artificial Sequence
  chemically synthesized
atgttgtcttagctgctaaaag

SEQ ID NO: 697761 - DNA, 22 bp, Artificial Sequence
  chemically synthesized
ttcaaaatataccttttagcag

SEQ ID NO: 697762 - DNA, 22 bp, Artificial Sequence
  chemically synthesized
cttcaaaatataccttttagca

SEQ ID NO: 697763 - DNA, 22 bp, Artificial Sequence
  chemically synthesized
tcttcaaaatataccttttagc

SEQ ID NO: 697764 - DNA, 22 bp, Artificial Sequence
  chemically synthesized
ttcttcaaaatataccttttag

SEQ ID NO: 697765 - DNA, 22 bp, Artificial Sequence
  chemically synthesized
tcttagctgctaaaaggtatat

SEQ ID NO: 697766 - DNA, 22 bp, Artificial Sequence
  chemically synthesized
agctgctaaaaggtatattttg

SEQ ID NO: 697767 - DNA, 22 bp, Artificial Sequence
  chemically synthesized
gctgctaaaaggtatattttga

SEQ ID NO: 697768 - DNA, 22 bp, Artificial Sequence
  chemically synthesized
tgtatatttttcttcaaaatat

SEQ ID NO: 697769 - DNA, 22 bp, Artificial Sequence
  chemically synthesized
atgtatatttttcttcaaaata

SEQ ID NO: 697770 - DNA, 22 bp, Artificial Sequence
  chemically synthesized
ctaaaaggtatattttgaagaa

SEQ ID NO: 697771 - DNA, 22 bp, Artificial Sequence
  chemically synthesized
ttatgtatatttttcttcaaaa

SEQ ID NO: 697772 - DNA, 22 bp, Artificial Sequence
  chemically synthesized
cttatgtatatttttcttcaaa

SEQ ID NO: 697773 - DNA, 22 bp, Artificial Sequence
  chemically synthesized
aaaggtatattttgaagaaaaa

SEQ ID NO: 697774 - DNA, 22 bp, Artificial Sequence
  chemically synthesized
gtaagatccttcttatgtatat

SEQ ID NO: 697775 - DNA, 22 bp, Artificial Sequence
  chemically synthesized
tggtaagatccttcttatgtat

SEQ ID NO: 697776 - DNA, 22 bp, Artificial Sequence
  chemically synthesized
tgaagaaaaatatacataagaa

SEQ ID NO: 697777 - DNA, 22 bp, Artificial Sequence
  chemically synthesized
ctggtaagatccttcttatgta

SEQ ID NO: 697778 - DNA, 22 bp, Artificial Sequence
  chemically synthesized
gaagaaaaatatacataagaag

SEQ ID NO: 697779 - DNA, 22 bp, Artificial Sequence
  chemically synthesized
aagaaaaatatacataagaagg

SEQ ID NO: 697780 - DNA, 22 bp, Artificial Sequence
  chemically synthesized
tttctggtaagatccttcttat

SEQ ID NO: 697781 - DNA, 22 bp, Artificial Sequence
  chemically synthesized
tgctatttctggtaagatcctt

SEQ ID NO: 697782 - DNA, 22 bp, Artificial Sequence
  chemically synthesized
gtgctatttctggtaagatcct

SEQ ID NO: 697783 - DNA, 22 bp, Artificial Sequence
  chemically synthesized
tgtgctatttctggtaagatcc

SEQ ID NO: 697784 - DNA, 22 bp, Artificial Sequence
  chemically synthesized
accagaaatagcacaaaattat

SEQ ID NO: 697785 - DNA, 22 bp, Artificial Sequence
  chemically synthesized
ccagaaatagcacaaaattata

SEQ ID NO: 697786 - DNA, 22 bp, Artificial Sequence
  chemically synthesized
atacaatgtgaacacatcatgt

SEQ ID NO: 697787 - DNA, 22 bp, Artificial Sequence
  chemically synthesized
catacaatgtgaacacatcatg

SEQ ID NO: 697788 - DNA, 22 bp, Artificial Sequence
  chemically synthesized
tcatacaatgtgaacacatcat

SEQ ID NO: 697789 - DNA, 22 bp, Artificial Sequence
  chemically synthesized
tatactacatgatgtgttcaca

SEQ ID NO: 697790 - DNA, 22 bp, Artificial Sequence
  chemically synthesized
tcataatctttcatacaatgtg

SEQ ID NO: 697791 - DNA, 22 bp, Artificial Sequence
  chemically synthesized
catgatgtgttcacattgtatg

SEQ ID NO: 697792 - DNA, 22 bp, Artificial Sequence
  chemically synthesized
gtcataatctttcatacaatgt

SEQ ID NO: 697793 - DNA, 22 bp, Artificial Sequence
  chemically synthesized
tgtcataatctttcatacaatg

SEQ ID NO: 697794 - DNA, 22 bp, Artificial Sequence
  chemically synthesized
aattttgtcataatctttcata

SEQ ID NO: 697795 - DNA, 22 bp, Artificial Sequence
  chemically synthesized
acattgtatgaaagattatgac

SEQ ID NO: 697796 - DNA, 22 bp, Artificial Sequence
  chemically synthesized
aaaatcagttgaattttgtcat

SEQ ID NO: 697797 - DNA, 22 bp, Artificial Sequence
  chemically synthesized
tatgaaagattatgacaaaatt

SEQ ID NO: 697798 - DNA, 22 bp, Artificial Sequence
  chemically synthesized
gaaaatcagttgaattttgtca

SEQ ID NO: 697799 - DNA, 22 bp, Artificial Sequence
  chemically synthesized
ggtttgaaaatcagttgaattt

SEQ ID NO: 697800 - DNA, 22 bp, Artificial Sequence
  chemically synthesized
acattgggtttgaaaatcagtt

SEQ ID NO: 697801 - DNA, 22 bp, Artificial Sequence
  chemically synthesized
tgacaaaattcaactgattttc

SEQ ID NO: 697802 - DNA, 22 bp, Artificial Sequence
  chemically synthesized
tgacattgggtttgaaaatcag

SEQ ID NO: 697803 - DNA, 22 bp, Artificial Sequence
  chemically synthesized
ctgacattgggtttgaaaatca

SEQ ID NO: 697804 - DNA, 22 bp, Artificial Sequence
  chemically synthesized
aactgattttcaaacccaatgt

SEQ ID NO: 697805 - DNA, 22 bp, Artificial Sequence
  chemically synthesized
attttcaaacccaatgtcagaa

SEQ ID NO: 697806 - DNA, 22 bp, Artificial Sequence
  chemically synthesized
agaatgatacaagtcttctgac

SEQ ID NO: 697807 - DNA, 22 bp, Artificial Sequence
  chemically synthesized
tcaaacccaatgtcagaagact

SEQ ID NO: 697808 - DNA, 22 bp, Artificial Sequence
  chemically synthesized
caaacccaatgtcagaagactt

SEQ ID NO: 697809 - DNA, 22 bp, Artificial Sequence
  chemically synthesized
taagaatgatacaagtcttctg

SEQ ID NO: 697810 - DNA, 22 bp, Artificial Sequence
  chemically synthesized
aaacccaatgtcagaagacttg

SEQ ID NO: 697811 - DNA, 22 bp, Artificial Sequence
  chemically synthesized
ctaagaatgatacaagtcttct

SEQ ID NO: 697812 - DNA, 22 bp, Artificial Sequence
  chemically synthesized
ttctaagaatgatacaagtctt

SEQ ID NO: 697813 - DNA, 22 bp, Artificial Sequence
  chemically synthesized
actcttctaagaatgatacaag

SEQ ID NO: 697814 - DNA, 22 bp, Artificial Sequence
  chemically synthesized
cagacacctcactcttctaaga

SEQ ID NO: 697815 - DNA, 22 bp, Artificial Sequence
  chemically synthesized
ttccagacacctcactcttcta

SEQ ID NO: 697816 - DNA, 22 bp, Artificial Sequence
  chemically synthesized
attccagacacctcactcttct

SEQ ID NO: 697817 - DNA, 22 bp, Artificial Sequence
  chemically synthesized
gtatcattcttagaagagtgag

SEQ ID NO: 697818 - DNA, 22 bp, Artificial Sequence
  chemically synthesized
tatcattcttagaagagtgagg

SEQ ID NO: 697819 - DNA, 22 bp, Artificial Sequence
  chemically synthesized
ttattccagacacctcactctt

SEQ ID NO: 697820 - DNA, 22 bp, Artificial Sequence
  chemically synthesized
cttattccagacacctcactct

SEQ ID NO: 697821 - DNA, 22 bp, Artificial Sequence
  chemically synthesized
atttcttattccagacacctca

SEQ ID NO: 697822 - DNA, 22 bp, Artificial Sequence
  chemically synthesized
ttagaagagtgaggtgtctgga

SEQ ID NO: 697823 - DNA, 22 bp, Artificial Sequence
  chemically synthesized
ctcatttcttattccagacacc

SEQ ID NO: 697824 - DNA, 22 bp, Artificial Sequence
  chemically synthesized
cctcatttcttattccagacac

SEQ ID NO: 697825 - DNA, 22 bp, Artificial Sequence
  chemically synthesized
agaagagtgaggtgtctggaat

SEQ ID NO: 697826 - DNA, 22 bp, Artificial Sequence
  chemically synthesized
gaagagtgaggtgtctggaata

SEQ ID NO: 697827 - DNA, 22 bp, Artificial Sequence
  chemically synthesized
gaataagaaatgaggaaatttt

SEQ ID NO: 697828 - DNA, 22 bp, Artificial Sequence
  chemically synthesized
aaaaaaaaaaaaaaaaaaaaat

SEQ ID NO: 697829 - DNA, 22 bp, Artificial Sequence
  chemically synthesized
cctcaaaaaaaaaaaaaaaaaa

SEQ ID NO: 697830 - DNA, 22 bp, Artificial Sequence
  chemically synthesized
tgcctcaaaaaaaaaaaaaaaa

SEQ ID NO: 697831 - DNA, 22 bp, Artificial Sequence
  chemically synthesized
ttttttttttttttttttgagg

SEQ ID NO: 697832 - DNA, 22 bp, Artificial Sequence
  chemically synthesized
tttttttttttttttttgaggc

SEQ ID NO: 697833 - DNA, 22 bp, Artificial Sequence
  chemically synthesized
ttttttttttttttttgaggca

SEQ ID NO: 697834 - DNA, 22 bp, Artificial Sequence
  chemically synthesized
tttttttttttttttgaggcag

SEQ ID NO: 697835 - DNA, 22 bp, Artificial Sequence
  chemically synthesized
ttttttttttttttgaggcaga

SEQ ID NO: 697836 - DNA, 22 bp, Artificial Sequence
  chemically synthesized
tttttttttttttgaggcagag

SEQ ID NO: 697837 - DNA, 22 bp, Artificial Sequence
  chemically synthesized
ttttttttttttgaggcagagt

SEQ ID NO: 697838 - DNA, 22 bp, Artificial Sequence
  chemically synthesized
tttttttttttgaggcagagtc

SEQ ID NO: 697839 - DNA, 22 bp, Artificial Sequence
  chemically synthesized
ttttttttttgaggcagagtct

SEQ ID NO: 697840 - DNA, 22 bp, Artificial Sequence
  chemically synthesized
ggtgacagagcaagactctgcc

SEQ ID NO: 697841 - DNA, 22 bp, Artificial Sequence
  chemically synthesized
tttttttttgaggcagagtctt

SEQ ID NO: 697842 - DNA, 22 bp, Artificial Sequence
  chemically synthesized
ttttttttgaggcagagtcttg

SEQ ID NO: 697843 - DNA, 22 bp, Artificial Sequence
  chemically synthesized
tttttttgaggcagagtcttgc

SEQ ID NO: 697844 - DNA, 22 bp, Artificial Sequence
  chemically synthesized
ttttttgaggcagagtcttgct

SEQ ID NO: 697845 - DNA, 22 bp, Artificial Sequence
  chemically synthesized
tttttgaggcagagtcttgctc

SEQ ID NO: 697846 - DNA, 22 bp, Artificial Sequence
  chemically synthesized
ttttgaggcagagtcttgctct

SEQ ID NO: 697847 - DNA, 22 bp, Artificial Sequence
  chemically synthesized
tttgaggcagagtcttgctctg

SEQ ID NO: 697848 - DNA, 22 bp, Artificial Sequence
  chemically synthesized
cagcctgggtgacagagcaaga

SEQ ID NO: 697849 - DNA, 22 bp, Artificial Sequence
  chemically synthesized
ttgaggcagagtcttgctctgt

SEQ ID NO: 697850 - DNA, 22 bp, Artificial Sequence
  chemically synthesized
tgaggcagagtcttgctctgtc

SEQ ID NO: 697851 - DNA, 22 bp, Artificial Sequence
  chemically synthesized
gaggcagagtcttgctctgtca

SEQ ID NO: 697852 - DNA, 22 bp, Artificial Sequence
  chemically synthesized
aggcagagtcttgctctgtcac

SEQ ID NO: 697853 - DNA, 22 bp, Artificial Sequence
  chemically synthesized
cactccagcctgggtgacagag

SEQ ID NO: 697854 - DNA, 22 bp, Artificial Sequence
  chemically synthesized
gctctgtcacccaggctggagt

SEQ ID NO: 697855 - DNA, 22 bp, Artificial Sequence
  chemically synthesized
ctctgtcacccaggctggagtg

SEQ ID NO: 697856 - DNA, 22 bp, Artificial Sequence
  chemically synthesized
tgtcacccaggctggagtgcag

SEQ ID NO: 697857 - DNA, 22 bp, Artificial Sequence
  chemically synthesized
tcacccaggctggagtgcagtg

SEQ ID NO: 697858 - DNA, 22 bp, Artificial Sequence
  chemically synthesized
gagtgcagtggcgcgatctcgt

SEQ ID NO: 697859 - DNA, 22 bp, Artificial Sequence
  chemically synthesized
gtccactgcatgctccgcttcc

SEQ ID NO: 697860 - DNA, 22 bp, Artificial Sequence
  chemically synthesized
catgctccgcttcccgggttta

SEQ ID NO: 697861 - DNA, 22 bp, Artificial Sequence
  chemically synthesized
aggcaggagaatggcgtaaacc

SEQ ID NO: 697862 - DNA, 22 bp, Artificial Sequence
  chemically synthesized
cgcttcccgggtttacgccatt

SEQ ID NO: 697863 - DNA, 22 bp, Artificial Sequence
  chemically synthesized
cccgggtttacgccattctcct

SEQ ID NO: 697864 - DNA, 22 bp, Artificial Sequence
  chemically synthesized
ggaggctgaggcaggagaatgg

SEQ ID NO: 697865 - DNA, 22 bp, Artificial Sequence
  chemically synthesized
ccgggtttacgccattctcctg

SEQ ID NO: 697866 - DNA, 22 bp, Artificial Sequence
  chemically synthesized
gggaggctgaggcaggagaatg

SEQ ID NO: 697867 - DNA, 22 bp, Artificial Sequence
  chemically synthesized
cttgggaggctgaggcaggaga

SEQ ID NO: 697868 - DNA, 22 bp, Artificial Sequence
  chemically synthesized
acgccattctcctgcctcagcc

SEQ ID NO: 697869 - DNA, 22 bp, Artificial Sequence
  chemically synthesized
cgccattctcctgcctcagcct

SEQ ID NO: 697870 - DNA, 22 bp, Artificial Sequence
  chemically synthesized
tagtcccagctacttgggaggc

SEQ ID NO: 697871 - DNA, 22 bp, Artificial Sequence
  chemically synthesized
tcctgcctcagcctcccaagta

SEQ ID NO: 697872 - DNA, 22 bp, Artificial Sequence
  chemically synthesized
ctgcctcagcctcccaagtagc

SEQ ID NO: 697873 - DNA, 22 bp, Artificial Sequence
  chemically synthesized
cctcagcctcccaagtagctgg

SEQ ID NO: 697874 - DNA, 22 bp, Artificial Sequence
  chemically synthesized
agcctcccaagtagctgggact

SEQ ID NO: 697875 - DNA, 22 bp, Artificial Sequence
  chemically synthesized
ccaagtagctgggactacaggc

SEQ ID NO: 697876 - DNA, 22 bp, Artificial Sequence
  chemically synthesized
ggcgtggtggcgggcgcctgta

SEQ ID NO: 697877 - DNA, 22 bp, Artificial Sequence
  chemically synthesized
gctgggcgtggtggcgggcgcc

SEQ ID NO: 697878 - DNA, 22 bp, Artificial Sequence
  chemically synthesized
ggactacaggcgcccgccacca

SEQ ID NO: 697879 - DNA, 22 bp, Artificial Sequence
  chemically synthesized
caggcgcccgccaccacgccca

SEQ ID NO: 697880 - DNA, 22 bp, Artificial Sequence
  chemically synthesized
aaaatacaaaaaattagctggg

SEQ ID NO: 697881 - DNA, 22 bp, Artificial Sequence
  chemically synthesized
ctaaaaatacaaaaaattagct

SEQ ID NO: 697882 - DNA, 22 bp, Artificial Sequence
  chemically synthesized
tactaaaaatacaaaaaattag

SEQ ID NO: 697883 - DNA, 22 bp, Artificial Sequence
  chemically synthesized
attttttgtatttttagtagag

SEQ ID NO: 697884 - DNA, 22 bp, Artificial Sequence
  chemically synthesized
tttgtatttttagtagagacgg

SEQ ID NO: 697885 - DNA, 22 bp, Artificial Sequence
  chemically synthesized
ttgtatttttagtagagacggg

SEQ ID NO: 697886 - DNA, 22 bp, Artificial Sequence
  chemically synthesized
acatggtgaaaccccgtctcta

SEQ ID NO: 697887 - DNA, 22 bp, Artificial Sequence
  chemically synthesized
tgtatttttagtagagacgggg

SEQ ID NO: 697888 - DNA, 22 bp, Artificial Sequence
  chemically synthesized
gtatttttagtagagacggggt

SEQ ID NO: 697889 - DNA, 22 bp, Artificial Sequence
  chemically synthesized
tatttttagtagagacggggtt

SEQ ID NO: 697890 - DNA, 22 bp, Artificial Sequence
  chemically synthesized
gctaacatggtgaaaccccgtc

SEQ ID NO: 697891 - DNA, 22 bp, Artificial Sequence
  chemically synthesized
ttagtagagacggggtttcacc

SEQ ID NO: 697892 - DNA, 22 bp, Artificial Sequence
  chemically synthesized
tagtagagacggggtttcacca

SEQ ID NO: 697893 - DNA, 22 bp, Artificial Sequence
  chemically synthesized
agtagagacggggtttcaccat

SEQ ID NO: 697894 - DNA, 22 bp, Artificial Sequence
  chemically synthesized
gtagagacggggtttcaccatg

SEQ ID NO: 697895 - DNA, 22 bp, Artificial Sequence
  chemically synthesized
caccatgttagccaggatggtc

SEQ ID NO: 697896 - DNA, 22 bp, Artificial Sequence
  chemically synthesized
accatgttagccaggatggtct

SEQ ID NO: 697897 - DNA, 22 bp, Artificial Sequence
  chemically synthesized
gccaggatggtctccatctcct

SEQ ID NO: 697898 - DNA, 22 bp, Artificial Sequence
  chemically synthesized
aggcaggcagatcacgaggtca

SEQ ID NO: 697899 - DNA, 22 bp, Artificial Sequence
  chemically synthesized
catctcctgacctcgtgatctg

SEQ ID NO: 697900 - DNA, 22 bp, Artificial Sequence
  chemically synthesized
ggaggctgaggcaggcagatca

SEQ ID NO: 697901 - DNA, 22 bp, Artificial Sequence
  chemically synthesized
gggaggctgaggcaggcagatc

SEQ ID NO: 697902 - DNA, 22 bp, Artificial Sequence
  chemically synthesized
tgggaggctgaggcaggcagat

SEQ ID NO: 697903 - DNA, 22 bp, Artificial Sequence
  chemically synthesized
ctgacctcgtgatctgcctgcc

SEQ ID NO: 697904 - DNA, 22 bp, Artificial Sequence
  chemically synthesized
acctcgtgatctgcctgcctca

SEQ ID NO: 697905 - DNA, 22 bp, Artificial Sequence
  chemically synthesized
gtgatctgcctgcctcagcctc

SEQ ID NO: 697906 - DNA, 22 bp, Artificial Sequence
  chemically synthesized
taatcccagcactttgggaggc

SEQ ID NO: 697907 - DNA, 22 bp, Artificial Sequence
  chemically synthesized
cctgcctcagcctcccaaagtg

SEQ ID NO: 697908 - DNA, 22 bp, Artificial Sequence
  chemically synthesized
cctcagcctcccaaagtgctgg

SEQ ID NO: 697909 - DNA, 22 bp, Artificial Sequence
  chemically synthesized
acgcctgtaatcccagcacttt

SEQ ID NO: 697910 - DNA, 22 bp, Artificial Sequence
  chemically synthesized
agcctcccaaagtgctgggatt

SEQ ID NO: 697911 - DNA, 22 bp, Artificial Sequence
  chemically synthesized
ccaaagtgctgggattacaggc

SEQ ID NO: 697912 - DNA, 22 bp, Artificial Sequence
  chemically synthesized
aggccgggtgcggtggctcacg

SEQ ID NO: 697913 - DNA, 22 bp, Artificial Sequence
  chemically synthesized
ggattacaggcgtgagccaccg

SEQ ID NO: 697914 - DNA, 22 bp, Artificial Sequence
  chemically synthesized
ctcaggccgggtgcggtggctc

SEQ ID NO: 697915 - DNA, 22 bp, Artificial Sequence
  chemically synthesized
cctcaggccgggtgcggtggct

SEQ ID NO: 697916 - DNA, 22 bp, Artificial Sequence
  chemically synthesized
caggcgtgagccaccgcacccg

SEQ ID NO: 697917 - DNA, 22 bp, Artificial Sequence
  chemically synthesized
gagtatgatatcaacatagaaa

SEQ ID NO: 697918 - DNA, 22 bp, Artificial Sequence
  chemically synthesized
aggaaatgttttctatgttgat

SEQ ID NO: 697919 - DNA, 22 bp, Artificial Sequence
  chemically synthesized
taaagaaactggagtatgatat

SEQ ID NO: 697920 - DNA, 22 bp, Artificial Sequence
  chemically synthesized
tctatgttgatatcatactcca

SEQ ID NO: 697921 - DNA, 22 bp, Artificial Sequence
  chemically synthesized
ttataaagaaactggagtatga

SEQ ID NO: 697922 - DNA, 22 bp, Artificial Sequence
  chemically synthesized
ctatgttgatatcatactccag

SEQ ID NO: 697923 - DNA, 22 bp, Artificial Sequence
  chemically synthesized
attataaagaaactggagtatg

SEQ ID NO: 697924 - DNA, 22 bp, Artificial Sequence
  chemically synthesized
tatgttgatatcatactccagt

SEQ ID NO: 697925 - DNA, 22 bp, Artificial Sequence
  chemically synthesized
ttattataaagaaactggagta

SEQ ID NO: 697926 - DNA, 22 bp, Artificial Sequence
  chemically synthesized
tgttgatatcatactccagttt

SEQ ID NO: 697927 - DNA, 22 bp, Artificial Sequence
  chemically synthesized
atatcatactccagtttcttta

SEQ ID NO: 697928 - DNA, 22 bp, Artificial Sequence
  chemically synthesized
acaatgagatgggctcttatta

SEQ ID NO: 697929 - DNA, 22 bp, Artificial Sequence
  chemically synthesized
cagtttctttataataagagcc

SEQ ID NO: 697930 - DNA, 22 bp, Artificial Sequence
  chemically synthesized
tgacaatgagatgggctcttat

SEQ ID NO: 697931 - DNA, 22 bp, Artificial Sequence
  chemically synthesized
ctgacaatgagatgggctctta

SEQ ID NO: 697932 - DNA, 22 bp, Artificial Sequence
  chemically synthesized
ctttataataagagcccatctc

SEQ ID NO: 697933 - DNA, 22 bp, Artificial Sequence
  chemically synthesized
tttataataagagcccatctca

SEQ ID NO: 697934 - DNA, 22 bp, Artificial Sequence
  chemically synthesized
tataataagagcccatctcatt

SEQ ID NO: 697935 - DNA, 22 bp, Artificial Sequence
  chemically synthesized
ataataagagcccatctcattg

SEQ ID NO: 697936 - DNA, 22 bp, Artificial Sequence
  chemically synthesized
taataagagcccatctcattgt

SEQ ID NO: 697937 - DNA, 22 bp, Artificial Sequence
  chemically synthesized
cagtagacacgtcttctgacaa

SEQ ID NO: 697938 - DNA, 22 bp, Artificial Sequence
  chemically synthesized
gcagtagacacgtcttctgaca

SEQ ID NO: 697939 - DNA, 22 bp, Artificial Sequence
  chemically synthesized
gtttgcagtagacacgtcttct

SEQ ID NO: 697940 - DNA, 22 bp, Artificial Sequence
  chemically synthesized
gctggtttgcagtagacacgtc

SEQ ID NO: 697941 - DNA, 22 bp, Artificial Sequence
  chemically synthesized
attgtcagaagacgtgtctact

SEQ ID NO: 697942 - DNA, 22 bp, Artificial Sequence
  chemically synthesized
tgttggctggtttgcagtagac

SEQ ID NO: 697943 - DNA, 22 bp, Artificial Sequence
  chemically synthesized
tcagaagacgtgtctactgcaa

SEQ ID NO: 697944 - DNA, 22 bp, Artificial Sequence
  chemically synthesized
aatatccctgtgttggctggtt

SEQ ID NO: 697945 - DNA, 22 bp, Artificial Sequence
  chemically synthesized
ctgcaaaccagccaacacaggg

SEQ ID NO: 697946 - DNA, 22 bp, Artificial Sequence
  chemically synthesized
caaaccagccaacacagggata

SEQ ID NO: 697947 - DNA, 22 bp, Artificial Sequence
  chemically synthesized
acagcaatcaacgtgttaaata

SEQ ID NO: 697948 - DNA, 22 bp, Artificial Sequence
  chemically synthesized
aacagcaatcaacgtgttaaat

SEQ ID NO: 697949 - DNA, 22 bp, Artificial Sequence
  chemically synthesized
gccttaacagcaatcaacgtgt

SEQ ID NO: 697950 - DNA, 22 bp, Artificial Sequence
  chemically synthesized
agccttaacagcaatcaacgtg

SEQ ID NO: 697951 - DNA, 22 bp, Artificial Sequence
  chemically synthesized
catcttagccttaacagcaatc

SEQ ID NO: 697952 - DNA, 22 bp, Artificial Sequence
  chemically synthesized
aacacgttgattgctgttaagg

SEQ ID NO: 697953 - DNA, 22 bp, Artificial Sequence
  chemically synthesized
actacatcttagccttaacagc

SEQ ID NO: 697954 - DNA, 22 bp, Artificial Sequence
  chemically synthesized
acacgttgattgctgttaaggc

SEQ ID NO: 697955 - DNA, 22 bp, Artificial Sequence
  chemically synthesized
attgctgttaaggctaagatgt

SEQ ID NO: 697956 - DNA, 22 bp, Artificial Sequence
  chemically synthesized
ctgttaaggctaagatgtagtt

SEQ ID NO: 697957 - DNA, 22 bp, Artificial Sequence
  chemically synthesized
ttaaggctaagatgtagttagg

SEQ ID NO: 697958 - DNA, 22 bp, Artificial Sequence
  chemically synthesized
aggctaagatgtagttaggcac

SEQ ID NO: 697959 - DNA, 22 bp, Artificial Sequence
  chemically synthesized
tatacagagggagcagtgccta

SEQ ID NO: 697960 - DNA, 22 bp, Artificial Sequence
  chemically synthesized
atatacagagggagcagtgcct

SEQ ID NO: 697961 - DNA, 22 bp, Artificial Sequence
  chemically synthesized
agatgtagttaggcactgctcc

SEQ ID NO: 697962 - DNA, 22 bp, Artificial Sequence
  chemically synthesized
tatttatatacagagggagcag

SEQ ID NO: 697963 - DNA, 22 bp, Artificial Sequence
  chemically synthesized
ggcactgctccctctgtatata

SEQ ID NO: 697964 - DNA, 22 bp, Artificial Sequence
  chemically synthesized
agtacctgtatttatatacaga

SEQ ID NO: 697965 - DNA, 22 bp, Artificial Sequence
  chemically synthesized
cagtacctgtatttatatacag

SEQ ID NO: 697966 - DNA, 22 bp, Artificial Sequence
  chemically synthesized
tttcagtacctgtatttatata

SEQ ID NO: 697967 - DNA, 22 bp, Artificial Sequence
  chemically synthesized
ctccctctgtatataaatacag

SEQ ID NO: 697968 - DNA, 22 bp, Artificial Sequence
  chemically synthesized
ctatttcagtacctgtatttat

SEQ ID NO: 697969 - DNA, 22 bp, Artificial Sequence
  chemically synthesized
cctctgtatataaatacaggta

SEQ ID NO: 697970 - DNA, 22 bp, Artificial Sequence
  chemically synthesized
attgctatttcagtacctgtat

SEQ ID NO: 697971 - DNA, 22 bp, Artificial Sequence
  chemically synthesized
tgtatataaatacaggtactga

SEQ ID NO: 697972 - DNA, 22 bp, Artificial Sequence
  chemically synthesized
tatataaatacaggtactgaaa

SEQ ID NO: 697973 - DNA, 22 bp, Artificial Sequence
  chemically synthesized
ataatattgattgctatttcag

SEQ ID NO: 697974 - DNA, 22 bp, Artificial Sequence
  chemically synthesized
cataatattgattgctatttca

SEQ ID NO: 697975 - DNA, 22 bp, Artificial Sequence
  chemically synthesized
cttcataatattgattgctatt

SEQ ID NO: 697976 - DNA, 22 bp, Artificial Sequence
  chemically synthesized
ccttcataatattgattgctat

SEQ ID NO: 697977 - DNA, 22 bp, Artificial Sequence
  chemically synthesized
ttccttcataatattgattgct

SEQ ID NO: 697978 - DNA, 22 bp, Artificial Sequence
  chemically synthesized
cttccttcataatattgattgc

SEQ ID NO: 697979 - DNA, 22 bp, Artificial Sequence
  chemically synthesized
atttcttccttcataatattga

SEQ ID NO: 697980 - DNA, 22 bp, Artificial Sequence
  chemically synthesized
aaatagcaatcaatattatgaa

SEQ ID NO: 697981 - DNA, 22 bp, Artificial Sequence
  chemically synthesized
gttgatttcttccttcataata

SEQ ID NO: 697982 - DNA, 22 bp, Artificial Sequence
  chemically synthesized
gttggttgatttcttccttcat

SEQ ID NO: 697983 - DNA, 22 bp, Artificial Sequence
  chemically synthesized
ggttggttgatttcttccttca

SEQ ID NO: 697984 - DNA, 22 bp, Artificial Sequence
  chemically synthesized
tggttggttgatttcttccttc

SEQ ID NO: 697985 - DNA, 22 bp, Artificial Sequence
  chemically synthesized
aagttttggttggttgatttct

SEQ ID NO: 697986 - DNA, 22 bp, Artificial Sequence
  chemically synthesized
tgaaggaagaaatcaaccaacc

SEQ ID NO: 697987 - DNA, 22 bp, Artificial Sequence
  chemically synthesized
caattcaagttttggttggttg

SEQ ID NO: 697988 - DNA, 22 bp, Artificial Sequence
  chemically synthesized
ctccaattcaagttttggttgg

SEQ ID NO: 697989 - DNA, 22 bp, Artificial Sequence
  chemically synthesized
gtaccaggcattgctccaattc

SEQ ID NO: 697990 - DNA, 22 bp, Artificial Sequence
  chemically synthesized
ttggtaccaggcattgctccaa

SEQ ID NO: 697991 - DNA, 22 bp, Artificial Sequence
  chemically synthesized
gcccctgttggtaccaggcatt

SEQ ID NO: 697992 - DNA, 22 bp, Artificial Sequence
  chemically synthesized
gaattggagcaatgcctggtac

SEQ ID NO: 697993 - DNA, 22 bp, Artificial Sequence
  chemically synthesized
tagcccctgttggtaccaggca

SEQ ID NO: 697994 - DNA, 22 bp, Artificial Sequence
  chemically synthesized
aattggagcaatgcctggtacc

SEQ ID NO: 697995 - DNA, 22 bp, Artificial Sequence
  chemically synthesized
ttctagcccctgttggtaccag

SEQ ID NO: 697996 - DNA, 22 bp, Artificial Sequence
  chemically synthesized
gttctagcccctgttggtacca

SEQ ID NO: 697997 - DNA, 22 bp, Artificial Sequence
  chemically synthesized
gagcaatgcctggtaccaacag

SEQ ID NO: 697998 - DNA, 22 bp, Artificial Sequence
  chemically synthesized
ttgttctagcccctgttggtac

SEQ ID NO: 697999 - DNA, 22 bp, Artificial Sequence
  chemically synthesized
attcttgttctagcccctgttg

SEQ ID NO: 698000 - DNA, 22 bp, Artificial Sequence
  chemically synthesized
tcattcttgttctagcccctgt

SEQ ID NO: 698001 - DNA, 22 bp, Artificial Sequence
  chemically synthesized
ctctcattcttgttctagcccc

SEQ ID NO: 698002 - DNA, 22 bp, Artificial Sequence
  chemically synthesized
gctctcattcttgttctagccc

SEQ ID NO: 698003 - DNA, 22 bp, Artificial Sequence
  chemically synthesized
gtaccaacaggggctagaacaa

SEQ ID NO: 698004 - DNA, 22 bp, Artificial Sequence
  chemically synthesized
aagcatatcttgctctcattct

SEQ ID NO: 698005 - DNA, 22 bp, Artificial Sequence
  chemically synthesized
aaagcatatcttgctctcattc

SEQ ID NO: 698006 - DNA, 22 bp, Artificial Sequence
  chemically synthesized
gaacaagaatgagagcaagata

SEQ ID NO: 698007 - DNA, 22 bp, Artificial Sequence
  chemically synthesized
caaatatgtcccatgcttaaag

SEQ ID NO: 698008 - DNA, 22 bp, Artificial Sequence
  chemically synthesized
ggattccaaatatgtcccatgc

SEQ ID NO: 698009 - DNA, 22 bp, Artificial Sequence
  chemically synthesized
cggattccaaatatgtcccatg

SEQ ID NO: 698010 - DNA, 22 bp, Artificial Sequence
  chemically synthesized
tcggattccaaatatgtcccat

SEQ ID NO: 698011 - DNA, 22 bp, Artificial Sequence
  chemically synthesized
ttcggattccaaatatgtccca

SEQ ID NO: 698012 - DNA, 22 bp, Artificial Sequence
  chemically synthesized
tttcggattccaaatatgtccc

SEQ ID NO: 698013 - DNA, 22 bp, Artificial Sequence
  chemically synthesized
taagcatgggacatatttggaa

SEQ ID NO: 698014 - DNA, 22 bp, Artificial Sequence
  chemically synthesized
aagcatgggacatatttggaat

SEQ ID NO: 698015 - DNA, 22 bp, Artificial Sequence
  chemically synthesized
agcatgggacatatttggaatc

SEQ ID NO: 698016 - DNA, 22 bp, Artificial Sequence
  chemically synthesized
atggcaattttttcggattcca

SEQ ID NO: 698017 - DNA, 22 bp, Artificial Sequence
  chemically synthesized
catggcaattttttcggattcc

SEQ ID NO: 698018 - DNA, 22 bp, Artificial Sequence
  chemically synthesized
tcatggcaattttttcggattc

SEQ ID NO: 698019 - DNA, 22 bp, Artificial Sequence
  chemically synthesized
ctttcatggcaattttttcgga

SEQ ID NO: 698020 - DNA, 22 bp, Artificial Sequence
  chemically synthesized
ctactttcatggcaattttttc

SEQ ID NO: 698021 - DNA, 22 bp, Artificial Sequence
  chemically synthesized
ttactactttcatggcaatttt

SEQ ID NO: 698022 - DNA, 22 bp, Artificial Sequence
  chemically synthesized
ggaatccgaaaaaattgccatg

SEQ ID NO: 698023 - DNA, 22 bp, Artificial Sequence
  chemically synthesized
tattactactttcatggcaatt

SEQ ID NO: 698024 - DNA, 22 bp, Artificial Sequence
  chemically synthesized
gaatccgaaaaaattgccatga

SEQ ID NO: 698025 - DNA, 22 bp, Artificial Sequence
  chemically synthesized
cctctattactactttcatggc

SEQ ID NO: 698026 - DNA, 22 bp, Artificial Sequence
  chemically synthesized
tattgcctctattactactttc

SEQ ID NO: 698027 - DNA, 22 bp, Artificial Sequence
  chemically synthesized
ctgtattgcctctattactact

SEQ ID NO: 698028 - DNA, 22 bp, Artificial Sequence
  chemically synthesized
ccatgaaagtagtaatagaggc

SEQ ID NO: 698029 - DNA, 22 bp, Artificial Sequence
  chemically synthesized
ccccctactgtattgcctctat

SEQ ID NO: 698030 - DNA, 22 bp, Artificial Sequence
  chemically synthesized
ccctgccccctactgtattgcc

SEQ ID NO: 698031 - DNA, 22 bp, Artificial Sequence
  chemically synthesized
cccctgccccctactgtattgc

SEQ ID NO: 698032 - DNA, 22 bp, Artificial Sequence
  chemically synthesized
acaccaccttcccctgccccct

SEQ ID NO: 698033 - DNA, 22 bp, Artificial Sequence
  chemically synthesized
gacaccaccttcccctgccccc

SEQ ID NO: 698034 - DNA, 22 bp, Artificial Sequence
  chemically synthesized
aatcttgacaccaccttcccct

SEQ ID NO: 698035 - DNA, 22 bp, Artificial Sequence
  chemically synthesized
cagtagcatctgaatcttgaca

SEQ ID NO: 698036 - DNA, 22 bp, Artificial Sequence
  chemically synthesized
actccagtagcatctgaatctt

SEQ ID NO: 698037 - DNA, 22 bp, Artificial Sequence
  chemically synthesized
ccctaactccagtagcatctga

SEQ ID NO: 698038 - DNA, 22 bp, Artificial Sequence
  chemically synthesized
gtaccagtgttcccctaactcc

SEQ ID NO: 698039 - DNA, 22 bp, Artificial Sequence
  chemically synthesized
agtaccagtgttcccctaactc

SEQ ID NO: 698040 - DNA, 22 bp, Artificial Sequence
  chemically synthesized
agatgctactggagttagggga

SEQ ID NO: 698041 - DNA, 22 bp, Artificial Sequence
  chemically synthesized
tagtaccagtgttcccctaact

SEQ ID NO: 698042 - DNA, 22 bp, Artificial Sequence
  chemically synthesized
ttagtaccagtgttcccctaac

SEQ ID NO: 698043 - DNA, 22 bp, Artificial Sequence
  chemically synthesized
gtttttagtaccagtgttcccc

SEQ ID NO: 698044 - DNA, 22 bp, Artificial Sequence
  chemically synthesized
ctggagttaggggaacactggt

SEQ ID NO: 698045 - DNA, 22 bp, Artificial Sequence
  chemically synthesized
gtctggtttttagtaccagtgt

SEQ ID NO: 698046 - DNA, 22 bp, Artificial Sequence
  chemically synthesized
gagttaggggaacactggtact

SEQ ID NO: 698047 - DNA, 22 bp, Artificial Sequence
  chemically synthesized
ggtctggtttttagtaccagtg

SEQ ID NO: 698048 - DNA, 22 bp, Artificial Sequence
  chemically synthesized
ggggaacactggtactaaaaac

SEQ ID NO: 698049 - DNA, 22 bp, Artificial Sequence
  chemically synthesized
acggatcttggtctggttttta

SEQ ID NO: 698050 - DNA, 22 bp, Artificial Sequence
  chemically synthesized
aactcacggatcttggtctggt

SEQ ID NO: 698051 - DNA, 22 bp, Artificial Sequence
  chemically synthesized
gaactcacggatcttggtctgg

SEQ ID NO: 698052 - DNA, 22 bp, Artificial Sequence
  chemically synthesized
gtactaaaaaccagaccaagat

SEQ ID NO: 698053 - DNA, 22 bp, Artificial Sequence
  chemically synthesized
gtttgaactcacggatcttggt

SEQ ID NO: 698054 - DNA, 22 bp, Artificial Sequence
  chemically synthesized
tggtttgaactcacggatcttg

SEQ ID NO: 698055 - DNA, 22 bp, Artificial Sequence
  chemically synthesized
aaaaccagaccaagatccgtga

SEQ ID NO: 698056 - DNA, 22 bp, Artificial Sequence
  chemically synthesized
cattctggtttgaactcacgga

SEQ ID NO: 698057 - DNA, 22 bp, Artificial Sequence
  chemically synthesized
gtctacattctggtttgaactc

SEQ ID NO: 698058 - DNA, 22 bp, Artificial Sequence
  chemically synthesized
ttggtctacattctggtttgaa

SEQ ID NO: 698059 - DNA, 22 bp, Artificial Sequence
  chemically synthesized
tatcctgttggtctacattctg

SEQ ID NO: 698060 - DNA, 22 bp, Artificial Sequence
  chemically synthesized
tgtatcctgttggtctacattc

SEQ ID NO: 698061 - DNA, 22 bp, Artificial Sequence
  chemically synthesized
tctgtatcctgttggtctacat

SEQ ID NO: 698062 - DNA, 22 bp, Artificial Sequence
  chemically synthesized
aaaccagaatgtagaccaacag

SEQ ID NO: 698063 - DNA, 22 bp, Artificial Sequence
  chemically synthesized
gtatatgtggctctctgtatcc

SEQ ID NO: 698064 - DNA, 22 bp, Artificial Sequence
  chemically synthesized
ggtatatgtggctctctgtatc

SEQ ID NO: 698065 - DNA, 22 bp, Artificial Sequence
  chemically synthesized
tggtatatgtggctctctgtat

SEQ ID NO: 698066 - DNA, 22 bp, Artificial Sequence
  chemically synthesized
ttggtatatgtggctctctgta

SEQ ID NO: 698067 - DNA, 22 bp, Artificial Sequence
  chemically synthesized
ccttttggtatatgtggctctc

SEQ ID NO: 698068 - DNA, 22 bp, Artificial Sequence
  chemically synthesized
accttttggtatatgtggctct

SEQ ID NO: 698069 - DNA, 22 bp, Artificial Sequence
  chemically synthesized
gatttaccttttggtatatgtg

SEQ ID NO: 698070 - DNA, 22 bp, Artificial Sequence
  chemically synthesized
tctagatttaccttttggtata

SEQ ID NO: 698071 - DNA, 22 bp, Artificial Sequence
  chemically synthesized
tggccatctgtctagatttacc

SEQ ID NO: 698072 - DNA, 22 bp, Artificial Sequence
  chemically synthesized
gaactgtggccatctgtctaga

SEQ ID NO: 698073 - DNA, 22 bp, Artificial Sequence
  chemically synthesized
cctggaactgtggccatctgtc

SEQ ID NO: 698074 - DNA, 22 bp, Artificial Sequence
  chemically synthesized
tgcctggaactgtggccatctg

SEQ ID NO: 698075 - DNA, 22 bp, Artificial Sequence
  chemically synthesized
tctgcctggaactgtggccatc

SEQ ID NO: 698076 - DNA, 22 bp, Artificial Sequence
  chemically synthesized
actctctgcctggaactgtggc

SEQ ID NO: 698077 - DNA, 22 bp, Artificial Sequence
  chemically synthesized
gactctctgcctggaactgtgg

SEQ ID NO: 698078 - DNA, 22 bp, Artificial Sequence
  chemically synthesized
gacagatggccacagttccagg

SEQ ID NO: 698079 - DNA, 22 bp, Artificial Sequence
  chemically synthesized
tacgagtatttgactctctgcc

SEQ ID NO: 698080 - DNA, 22 bp, Artificial Sequence
  chemically synthesized
gtacgagtatttgactctctgc

SEQ ID NO: 698081 - DNA, 22 bp, Artificial Sequence
  chemically synthesized
tttgtacgagtatttgactctc

SEQ ID NO: 698082 - DNA, 22 bp, Artificial Sequence
  chemically synthesized
tatttgtacgagtatttgactc

SEQ ID NO: 698083 - DNA, 22 bp, Artificial Sequence
  chemically synthesized
caggcagagagtcaaatactcg

SEQ ID NO: 698084 - DNA, 22 bp, Artificial Sequence
  chemically synthesized
tagctctatttgtacgagtatt

SEQ ID NO: 698085 - DNA, 22 bp, Artificial Sequence
  chemically synthesized
ctatagctctatttgtacgagt

SEQ ID NO: 698086 - DNA, 22 bp, Artificial Sequence
  chemically synthesized
ccattcctatagctctatttgt

SEQ ID NO: 698087 - DNA, 22 bp, Artificial Sequence
  chemically synthesized
tggcctaccattcctatagctc

SEQ ID NO: 698088 - DNA, 22 bp, Artificial Sequence
  chemically synthesized
atggcctaccattcctatagct

SEQ ID NO: 698089 - DNA, 22 bp, Artificial Sequence
  chemically synthesized
gtacaaatagagctataggaat

SEQ ID NO: 698090 - DNA, 22 bp, Artificial Sequence
  chemically synthesized
ttatggcctaccattcctatag

SEQ ID NO: 698091 - DNA, 22 bp, Artificial Sequence
  chemically synthesized
cttatggcctaccattcctata

SEQ ID NO: 698092 - DNA, 22 bp, Artificial Sequence
  chemically synthesized
tcttcttatggcctaccattcc

SEQ ID NO: 698093 - DNA, 22 bp, Artificial Sequence
  chemically synthesized
tcctgtcttcttatggcctacc

SEQ ID NO: 698094 - DNA, 22 bp, Artificial Sequence
  chemically synthesized
actgtcctgtcttcttatggcc

SEQ ID NO: 698095 - DNA, 22 bp, Artificial Sequence
  chemically synthesized
taggaatggtaggccataagaa

SEQ ID NO: 698096 - DNA, 22 bp, Artificial Sequence
  chemically synthesized
tgactgtcctgtcttcttatgg

SEQ ID NO: 698097 - DNA, 22 bp, Artificial Sequence
  chemically synthesized
ggttctgactgtcctgtcttct

SEQ ID NO: 698098 - DNA, 22 bp, Artificial Sequence
  chemically synthesized
gggttctgactgtcctgtcttc

SEQ ID NO: 698099 - DNA, 22 bp, Artificial Sequence
  chemically synthesized
atttgggttctgactgtcctgt

SEQ ID NO: 698100 - DNA, 22 bp, Artificial Sequence
  chemically synthesized
ctgatttgggttctgactgtcc

SEQ ID NO: 698101 - DNA, 22 bp, Artificial Sequence
  chemically synthesized
acaaaattgctgatttgggttc

SEQ ID NO: 698102 - DNA, 22 bp, Artificial Sequence
  chemically synthesized
tgctgacaaaattgctgatttg

SEQ ID NO: 698103 - DNA, 22 bp, Artificial Sequence
  chemically synthesized
gtgctgacaaaattgctgattt

SEQ ID NO: 698104 - DNA, 22 bp, Artificial Sequence
  chemically synthesized
tttgtgctgacaaaattgctga

SEQ ID NO: 698105 - DNA, 22 bp, Artificial Sequence
  chemically synthesized
ctgtttgtgctgacaaaattgc

SEQ ID NO: 698106 - DNA, 22 bp, Artificial Sequence
  chemically synthesized
ttgctgtttgtgctgacaaaat

SEQ ID NO: 698107 - DNA, 22 bp, Artificial Sequence
  chemically synthesized
ctgttgctgtttgtgctgacaa

SEQ ID NO: 698108 - DNA, 22 bp, Artificial Sequence
  chemically synthesized
ttactgttgctgtttgtgctga

SEQ ID NO: 698109 - DNA, 22 bp, Artificial Sequence
  chemically synthesized
gttactgttgctgtttgtgctg

SEQ ID NO: 698110 - DNA, 22 bp, Artificial Sequence
  chemically synthesized
ttgttactgttgctgtttgtgc

SEQ ID NO: 698111 - DNA, 22 bp, Artificial Sequence
  chemically synthesized
cttgttactgttgctgtttgtg

SEQ ID NO: 698112 - DNA, 22 bp, Artificial Sequence
  chemically synthesized
tgtcagcacaaacagcaacagt

SEQ ID NO: 698113 - DNA, 22 bp, Artificial Sequence
  chemically synthesized
gtcagcacaaacagcaacagta

SEQ ID NO: 698114 - DNA, 22 bp, Artificial Sequence
  chemically synthesized
tcagcacaaacagcaacagtaa

SEQ ID NO: 698115 - DNA, 22 bp, Artificial Sequence
  chemically synthesized
agtcaacatttcttgttactgt

SEQ ID NO: 698116 - DNA, 22 bp, Artificial Sequence
  chemically synthesized
cagtcaacatttcttgttactg

SEQ ID NO: 698117 - DNA, 22 bp, Artificial Sequence
  chemically synthesized
cttcagtcaacatttcttgtta

SEQ ID NO: 698118 - DNA, 22 bp, Artificial Sequence
  chemically synthesized
acagttgcttcagtcaacattt

SEQ ID NO: 698119 - DNA, 22 bp, Artificial Sequence
  chemically synthesized
gatgaagttaacagttgcttca

SEQ ID NO: 698120 - DNA, 22 bp, Artificial Sequence
  chemically synthesized
ttggatgaagttaacagttgct

SEQ ID NO: 698121 - DNA, 22 bp, Artificial Sequence
  chemically synthesized
attggatgaagttaacagttgc

SEQ ID NO: 698122 - DNA, 22 bp, Artificial Sequence
  chemically synthesized
actgaagcaactgttaacttca

SEQ ID NO: 698123 - DNA, 22 bp, Artificial Sequence
  chemically synthesized
aagcaactgttaacttcatcca

SEQ ID NO: 698124 - DNA, 22 bp, Artificial Sequence
  chemically synthesized
ttaacttcatccaataaggttt

SEQ ID NO: 698125 - DNA, 22 bp, Artificial Sequence
  chemically synthesized
acttcatccaataaggttttat

SEQ ID NO: 698126 - DNA, 22 bp, Artificial Sequence
  chemically synthesized
gcaaaatgcgatataaaacctt

SEQ ID NO: 698127 - DNA, 22 bp, Artificial Sequence
  chemically synthesized
agcaaaatgcgatataaaacct

SEQ ID NO: 698128 - DNA, 22 bp, Artificial Sequence
  chemically synthesized
catccaataaggttttatatcg

SEQ ID NO: 698129 - DNA, 22 bp, Artificial Sequence
  chemically synthesized
cttagcaaaatgcgatataaaa

SEQ ID NO: 698130 - DNA, 22 bp, Artificial Sequence
  chemically synthesized
atccaataaggttttatatcgc

SEQ ID NO: 698131 - DNA, 22 bp, Artificial Sequence
  chemically synthesized
ctgcttagcaaaatgcgatata

SEQ ID NO: 698132 - DNA, 22 bp, Artificial Sequence
  chemically synthesized
cctgcttagcaaaatgcgatat

SEQ ID NO: 698133 - DNA, 22 bp, Artificial Sequence
  chemically synthesized
cttcctgcttagcaaaatgcga

SEQ ID NO: 698134 - DNA, 22 bp, Artificial Sequence
  chemically synthesized
ctgcttcctgcttagcaaaatg

SEQ ID NO: 698135 - DNA, 22 bp, Artificial Sequence
  chemically synthesized
tgctgcttcctgcttagcaaaa

SEQ ID NO: 698136 - DNA, 22 bp, Artificial Sequence
  chemically synthesized
ctgctgcttcctgcttagcaaa

SEQ ID NO: 698137 - DNA, 22 bp, Artificial Sequence
  chemically synthesized
tctgctgcttcctgcttagcaa

SEQ ID NO: 698138 - DNA, 22 bp, Artificial Sequence
  chemically synthesized
tatatcgcattttgctaagcag

SEQ ID NO: 698139 - DNA, 22 bp, Artificial Sequence
  chemically synthesized
atatcgcattttgctaagcagg

SEQ ID NO: 698140 - DNA, 22 bp, Artificial Sequence
  chemically synthesized
tatcgcattttgctaagcagga

SEQ ID NO: 698141 - DNA, 22 bp, Artificial Sequence
  chemically synthesized
acaactttctgctgcttcctgc

SEQ ID NO: 698142 - DNA, 22 bp, Artificial Sequence
  chemically synthesized
ctcacaactttctgctgcttcc

SEQ ID NO: 698143 - DNA, 22 bp, Artificial Sequence
  chemically synthesized
gctcacaactttctgctgcttc

SEQ ID NO: 698144 - DNA, 22 bp, Artificial Sequence
  chemically synthesized
tgctcacaactttctgctgctt

SEQ ID NO: 698145 - DNA, 22 bp, Artificial Sequence
  chemically synthesized
tgctaagcaggaagcagcagaa

SEQ ID NO: 698146 - DNA, 22 bp, Artificial Sequence
  chemically synthesized
gctaagcaggaagcagcagaaa

SEQ ID NO: 698147 - DNA, 22 bp, Artificial Sequence
  chemically synthesized
ctaagcaggaagcagcagaaag

SEQ ID NO: 698148 - DNA, 22 bp, Artificial Sequence
  chemically synthesized
agttttgctcacaactttctgc

SEQ ID NO: 698149 - DNA, 22 bp, Artificial Sequence
  chemically synthesized
agcaggaagcagcagaaagttg

SEQ ID NO: 698150 - DNA, 22 bp, Artificial Sequence
  chemically synthesized
catctgagttttgctcacaact

SEQ ID NO: 698151 - DNA, 22 bp, Artificial Sequence
  chemically synthesized
ttgcatctgagttttgctcaca

SEQ ID NO: 698152 - DNA, 22 bp, Artificial Sequence
  chemically synthesized
attgcatctgagttttgctcac

SEQ ID NO: 698153 - DNA, 22 bp, Artificial Sequence
  chemically synthesized
cacaaccatttattgcatctga

SEQ ID NO: 698154 - DNA, 22 bp, Artificial Sequence
  chemically synthesized
ccacaaccatttattgcatctg

SEQ ID NO: 698155 - DNA, 22 bp, Artificial Sequence
  chemically synthesized
tgagcaaaactcagatgcaata

SEQ ID NO: 698156 - DNA, 22 bp, Artificial Sequence
  chemically synthesized
aggcatgtttccacaaccattt

SEQ ID NO: 698157 - DNA, 22 bp, Artificial Sequence
  chemically synthesized
agatgcaataaatggttgtgga

SEQ ID NO: 698158 - DNA, 22 bp, Artificial Sequence
  chemically synthesized
aatctcaggcatgtttccacaa

SEQ ID NO: 698159 - DNA, 22 bp, Artificial Sequence
  chemically synthesized
tcaatctcaggcatgtttccac

SEQ ID NO: 698160 - DNA, 22 bp, Artificial Sequence
  chemically synthesized
actctcaatctcaggcatgttt

SEQ ID NO: 698161 - DNA, 22 bp, Artificial Sequence
  chemically synthesized
cactctcaatctcaggcatgtt

SEQ ID NO: 698162 - DNA, 22 bp, Artificial Sequence
  chemically synthesized
ttcactctcaatctcaggcatg

SEQ ID NO: 698163 - DNA, 22 bp, Artificial Sequence
  chemically synthesized
tcttcactctcaatctcaggca

SEQ ID NO: 698164 - DNA, 22 bp, Artificial Sequence
  chemically synthesized
ctcttcactctcaatctcaggc

SEQ ID NO: 698165 - DNA, 22 bp, Artificial Sequence
  chemically synthesized
tggaaacatgcctgagattgag

SEQ ID NO: 698166 - DNA, 22 bp, Artificial Sequence
  chemically synthesized
atcgacccttctcttcactctc

SEQ ID NO: 698167 - DNA, 22 bp, Artificial Sequence
  chemically synthesized
gatcgacccttctcttcactct

SEQ ID NO: 698168 - DNA, 22 bp, Artificial Sequence
  chemically synthesized
agattgagagtgaagagaaggg

SEQ ID NO: 698169 - DNA, 22 bp, Artificial Sequence
  chemically synthesized
atgaccttgatcgacccttctc

SEQ ID NO: 698170 - DNA, 22 bp, Artificial Sequence
  chemically synthesized
agagtgaagagaagggtcgatc

SEQ ID NO: 698171 - DNA, 22 bp, Artificial Sequence
  chemically synthesized
cctgatgaccttgatcgaccct

SEQ ID NO: 698172 - DNA, 22 bp, Artificial Sequence
  chemically synthesized
tatatgttgcctgatgaccttg

SEQ ID NO: 698173 - DNA, 22 bp, Artificial Sequence
  chemically synthesized
ctgtatatgttgcctgatgacc

SEQ ID NO: 698174 - DNA, 22 bp, Artificial Sequence
  chemically synthesized
tatatacattgctgtatatgtt

SEQ ID NO: 698175 - DNA, 22 bp, Artificial Sequence
  chemically synthesized
aatgttgtatatacattgctgt

SEQ ID NO: 698176 - DNA, 22 bp, Artificial Sequence
  chemically synthesized
gaatgttgtatatacattgctg

SEQ ID NO: 698177 - DNA, 22 bp, Artificial Sequence
  chemically synthesized
tgaatgttgtatatacattgct

SEQ ID NO: 698178 - DNA, 22 bp, Artificial Sequence
  chemically synthesized
gtaattttgaatgttgtatata

SEQ ID NO: 698179 - DNA, 22 bp, Artificial Sequence
  chemically synthesized
ctggtaattttgaatgttgtat

SEQ ID NO: 698180 - DNA, 22 bp, Artificial Sequence
  chemically synthesized
ctgctggtaattttgaatgttg

SEQ ID NO: 698181 - DNA, 22 bp, Artificial Sequence
  chemically synthesized
cctgctggtaattttgaatgtt

SEQ ID NO: 698182 - DNA, 22 bp, Artificial Sequence
  chemically synthesized
tcctgctggtaattttgaatgt

SEQ ID NO: 698183 - DNA, 22 bp, Artificial Sequence
  chemically synthesized
ttcctgctggtaattttgaatg

SEQ ID NO: 698184 - DNA, 22 bp, Artificial Sequence
  chemically synthesized
tcttttcctgctggtaattttg

SEQ ID NO: 698185 - DNA, 22 bp, Artificial Sequence
  chemically synthesized
atcttttcctgctggtaatttt

SEQ ID NO: 698186 - DNA, 22 bp, Artificial Sequence
  chemically synthesized
aaaattaccagcaggaaaagat

SEQ ID NO: 698187 - DNA, 22 bp, Artificial Sequence
  chemically synthesized
atgtccaaaggagtgtttatct

SEQ ID NO: 698188 - DNA, 22 bp, Artificial Sequence
  chemically synthesized
ccagcaggaaaagataaacact

SEQ ID NO: 698189 - DNA, 22 bp, Artificial Sequence
  chemically synthesized
aagaagcaactcatgtccaaag

SEQ ID NO: 698190 - DNA, 22 bp, Artificial Sequence
  chemically synthesized
ctttggacatgagttgcttctt

SEQ ID NO: 698191 - DNA, 22 bp, Artificial Sequence
  chemically synthesized
catgcaatgctcaagaagcaac

SEQ ID NO: 698192 - DNA, 22 bp, Artificial Sequence
  chemically synthesized
acatgcaatgctcaagaagcaa

SEQ ID NO: 698193 - DNA, 22 bp, Artificial Sequence
  chemically synthesized
tacatgcaatgctcaagaagca

SEQ ID NO: 698194 - DNA, 22 bp, Artificial Sequence
  chemically synthesized
tggacatgagttgcttcttgag

SEQ ID NO: 698195 - DNA, 22 bp, Artificial Sequence
  chemically synthesized
ttacatgcaatgctcaagaagc

SEQ ID NO: 698196 - DNA, 22 bp, Artificial Sequence
  chemically synthesized
ggacatgagttgcttcttgagc

SEQ ID NO: 698197 - DNA, 22 bp, Artificial Sequence
  chemically synthesized
tttacatgcaatgctcaagaag

SEQ ID NO: 698198 - DNA, 22 bp, Artificial Sequence
  chemically synthesized
gacatgagttgcttcttgagca

SEQ ID NO: 698199 - DNA, 22 bp, Artificial Sequence
  chemically synthesized
ttttacatgcaatgctcaagaa

SEQ ID NO: 698200 - DNA, 22 bp, Artificial Sequence
  chemically synthesized
tttttacatgcaatgctcaaga

SEQ ID NO: 698201 - DNA, 22 bp, Artificial Sequence
  chemically synthesized
agctttttttacatgcaatgct

SEQ ID NO: 698202 - DNA, 22 bp, Artificial Sequence
  chemically synthesized
ctcagctttttttacatgcaat

SEQ ID NO: 698203 - DNA, 22 bp, Artificial Sequence
  chemically synthesized
cttcttgagcattgcatgtaaa

SEQ ID NO: 698204 - DNA, 22 bp, Artificial Sequence
  chemically synthesized
actgctcagctttttttacatg

SEQ ID NO: 698205 - DNA, 22 bp, Artificial Sequence
  chemically synthesized
cttgagcattgcatgtaaaaaa

SEQ ID NO: 698206 - DNA, 22 bp, Artificial Sequence
  chemically synthesized
ttgagcattgcatgtaaaaaaa

SEQ ID NO: 698207 - DNA, 22 bp, Artificial Sequence
  chemically synthesized
ctaactgctcagctttttttac

SEQ ID NO: 698208 - DNA, 22 bp, Artificial Sequence
  chemically synthesized
gagcattgcatgtaaaaaaagc

SEQ ID NO: 698209 - DNA, 22 bp, Artificial Sequence
  chemically synthesized
gctaactgctcagcttttttta

SEQ ID NO: 698210 - DNA, 22 bp, Artificial Sequence
  chemically synthesized
agcattgcatgtaaaaaaagct

SEQ ID NO: 698211 - DNA, 22 bp, Artificial Sequence
  chemically synthesized
ggaacttgctaactgctcagct

SEQ ID NO: 698212 - DNA, 22 bp, Artificial Sequence
  chemically synthesized
catgtaaaaaaagctgagcagt

SEQ ID NO: 698213 - DNA, 22 bp, Artificial Sequence
  chemically synthesized
gggaacttgctaactgctcagc

SEQ ID NO: 698214 - DNA, 22 bp, Artificial Sequence
  chemically synthesized
ttgggaacttgctaactgctca

SEQ ID NO: 698215 - DNA, 22 bp, Artificial Sequence
  chemically synthesized
agcagttagcaagttcccaaga

SEQ ID NO: 698216 - DNA, 22 bp, Artificial Sequence
  chemically synthesized
gcaagttcccaagaaccccatc

SEQ ID NO: 698217 - DNA, 22 bp, Artificial Sequence
  chemically synthesized
acagaagagtgaaagatggggt

SEQ ID NO: 698218 - DNA, 22 bp, Artificial Sequence
  chemically synthesized
cacagaagagtgaaagatgggg

SEQ ID NO: 698219 - DNA, 22 bp, Artificial Sequence
  chemically synthesized
ccaagaaccccatctttcactc

SEQ ID NO: 698220 - DNA, 22 bp, Artificial Sequence
  chemically synthesized
aagcccttcacagaagagtgaa

SEQ ID NO: 698221 - DNA, 22 bp, Artificial Sequence
  chemically synthesized
tgaagcccttcacagaagagtg

SEQ ID NO: 698222 - DNA, 22 bp, Artificial Sequence
  chemically synthesized
gaaatatctctgaagcccttca

SEQ ID NO: 698223 - DNA, 22 bp, Artificial Sequence
  chemically synthesized
tcactcttctgtgaagggcttc

SEQ ID NO: 698224 - DNA, 22 bp, Artificial Sequence
  chemically synthesized
cgaaatatctctgaagcccttc

SEQ ID NO: 698225 - DNA, 22 bp, Artificial Sequence
  chemically synthesized
cactcttctgtgaagggcttca

SEQ ID NO: 698226 - DNA, 22 bp, Artificial Sequence
  chemically synthesized
tcgaaatatctctgaagccctt

SEQ ID NO: 698227 - DNA, 22 bp, Artificial Sequence
  chemically synthesized
actcttctgtgaagggcttcag

SEQ ID NO: 698228 - DNA, 22 bp, Artificial Sequence
  chemically synthesized
cctttcgaaatatctctgaagc

SEQ ID NO: 698229 - DNA, 22 bp, Artificial Sequence
  chemically synthesized
ttctgtgaagggcttcagagat

SEQ ID NO: 698230 - DNA, 22 bp, Artificial Sequence
  chemically synthesized
ctgtgaagggcttcagagatat

SEQ ID NO: 698231 - DNA, 22 bp, Artificial Sequence
  chemically synthesized
tgtgaagggcttcagagatatt

SEQ ID NO: 698232 - DNA, 22 bp, Artificial Sequence
  chemically synthesized
tgaagggcttcagagatatttc

SEQ ID NO: 698233 - DNA, 22 bp, Artificial Sequence
  chemically synthesized
atcaggttccctttcgaaatat

SEQ ID NO: 698234 - DNA, 22 bp, Artificial Sequence
  chemically synthesized
catcaggttccctttcgaaata

SEQ ID NO: 698235 - DNA, 22 bp, Artificial Sequence
  chemically synthesized
cagagatatttcgaaagggaac

SEQ ID NO: 698236 - DNA, 22 bp, Artificial Sequence
  chemically synthesized
agagatatttcgaaagggaacc

SEQ ID NO: 698237 - DNA, 22 bp, Artificial Sequence
  chemically synthesized
cgaaagggaacctgatgaaatg

SEQ ID NO: 698238 - DNA, 22 bp, Artificial Sequence
  chemically synthesized
gaaagggaacctgatgaaatgc

SEQ ID NO: 698239 - DNA, 22 bp, Artificial Sequence
  chemically synthesized
catcagcagtaatgcatttcat

SEQ ID NO: 698240 - DNA, 22 bp, Artificial Sequence
  chemically synthesized
actccatcagcagtaatgcatt

SEQ ID NO: 698241 - DNA, 22 bp, Artificial Sequence
  chemically synthesized
ctgactccatcagcagtaatgc

SEQ ID NO: 698242 - DNA, 22 bp, Artificial Sequence
  chemically synthesized
atgaaatgcattactgctgatg

SEQ ID NO: 698243 - DNA, 22 bp, Artificial Sequence
  chemically synthesized
aggagtaaacctgctgactcca

SEQ ID NO: 698244 - DNA, 22 bp, Artificial Sequence
  chemically synthesized
ctgctgatggagtcagcaggtt

SEQ ID NO: 698245 - DNA, 22 bp, Artificial Sequence
  chemically synthesized
ctgatggagtcagcaggtttac

SEQ ID NO: 698246 - DNA, 22 bp, Artificial Sequence
  chemically synthesized
atgaaactcaggagtaaacctg

SEQ ID NO: 698247 - DNA, 22 bp, Artificial Sequence
  chemically synthesized
atggagtcagcaggtttactcc

SEQ ID NO: 698248 - DNA, 22 bp, Artificial Sequence
  chemically synthesized
actaatgaaactcaggagtaaa

SEQ ID NO: 698249 - DNA, 22 bp, Artificial Sequence
  chemically synthesized
ggaagaattcactaatgaaact

SEQ ID NO: 698250 - DNA, 22 bp, Artificial Sequence
  chemically synthesized
actcctgagtttcattagtgaa

SEQ ID NO: 698251 - DNA, 22 bp, Artificial Sequence
  chemically synthesized
ctcctgagtttcattagtgaat

SEQ ID NO: 698252 - DNA, 22 bp, Artificial Sequence
  chemically synthesized
aatattgggaagaattcactaa

SEQ ID NO: 698253 - DNA, 22 bp, Artificial Sequence
  chemically synthesized
ctgagtttcattagtgaattct

SEQ ID NO: 698254 - DNA, 22 bp, Artificial Sequence
  chemically synthesized
ctaaatattgggaagaattcac

SEQ ID NO: 698255 - DNA, 22 bp, Artificial Sequence
  chemically synthesized
agtttcattagtgaattcttcc

SEQ ID NO: 698256 - DNA, 22 bp, Artificial Sequence
  chemically synthesized
tggttgctaaatattgggaaga

SEQ ID NO: 698257 - DNA, 22 bp, Artificial Sequence
  chemically synthesized
cattagtgaattcttcccaata

SEQ ID NO: 698258 - DNA, 22 bp, Artificial Sequence
  chemically synthesized
attagtgaattcttcccaatat

SEQ ID NO: 698259 - DNA, 22 bp, Artificial Sequence
  chemically synthesized
gtgaattcttcccaatatttag

SEQ ID NO: 698260 - DNA, 22 bp, Artificial Sequence
  chemically synthesized
aaagacgctgtggttgctaaat

SEQ ID NO: 698261 - DNA, 22 bp, Artificial Sequence
  chemically synthesized
caaagacgctgtggttgctaaa

SEQ ID NO: 698262 - DNA, 22 bp, Artificial Sequence
  chemically synthesized
ttcccaatatttagcaaccaca

SEQ ID NO: 698263 - DNA, 22 bp, Artificial Sequence
  chemically synthesized
cttcaaagacgctgtggttgct

SEQ ID NO: 698264 - DNA, 22 bp, Artificial Sequence
  chemically synthesized
cccaatatttagcaaccacagc

SEQ ID NO: 698265 - DNA, 22 bp, Artificial Sequence
  chemically synthesized
ccaatatttagcaaccacagcg

SEQ ID NO: 698266 - DNA, 22 bp, Artificial Sequence
  chemically synthesized
ctccttcaaagacgctgtggtt

SEQ ID NO: 698267 - DNA, 22 bp, Artificial Sequence
  chemically synthesized
cctccttcaaagacgctgtggt

SEQ ID NO: 698268 - DNA, 22 bp, Artificial Sequence
  chemically synthesized
tcctccttcaaagacgctgtgg

SEQ ID NO: 698269 - DNA, 22 bp, Artificial Sequence
  chemically synthesized
gtcctttcctccttcaaagacg

SEQ ID NO: 698270 - DNA, 22 bp, Artificial Sequence
  chemically synthesized
agcaaccacagcgtctttgaag

SEQ ID NO: 698271 - DNA, 22 bp, Artificial Sequence
  chemically synthesized
gcaaccacagcgtctttgaagg

SEQ ID NO: 698272 - DNA, 22 bp, Artificial Sequence
  chemically synthesized
gacaagctggtcctttcctcct

SEQ ID NO: 698273 - DNA, 22 bp, Artificial Sequence
  chemically synthesized
agacaagctggtcctttcctcc

SEQ ID NO: 698274 - DNA, 22 bp, Artificial Sequence
  chemically synthesized
tagacaagctggtcctttcctc

SEQ ID NO: 698275 - DNA, 22 bp, Artificial Sequence
  chemically synthesized
ttagacaagctggtcctttcct

SEQ ID NO: 698276 - DNA, 22 bp, Artificial Sequence
  chemically synthesized
atttttagacaagctggtcctt

SEQ ID NO: 698277 - DNA, 22 bp, Artificial Sequence
  chemically synthesized
gatttttagacaagctggtcct

SEQ ID NO: 698278 - DNA, 22 bp, Artificial Sequence
  chemically synthesized
tgaaggaggaaaggaccagctt

SEQ ID NO: 698279 - DNA, 22 bp, Artificial Sequence
  chemically synthesized
gaaggaggaaaggaccagcttg

SEQ ID NO: 698280 - DNA, 22 bp, Artificial Sequence
  chemically synthesized
aaggaggaaaggaccagcttgt

SEQ ID NO: 698281 - DNA, 22 bp, Artificial Sequence
  chemically synthesized
ggaaggatttgatttttagaca

SEQ ID NO: 698282 - DNA, 22 bp, Artificial Sequence
  chemically synthesized
aggaaggatttgatttttagac

SEQ ID NO: 698283 - DNA, 22 bp, Artificial Sequence
  chemically synthesized
tcccttaggaaggatttgattt

SEQ ID NO: 698284 - DNA, 22 bp, Artificial Sequence
  chemically synthesized
gtctaaaaatcaaatccttcct

SEQ ID NO: 698285 - DNA, 22 bp, Artificial Sequence
  chemically synthesized
tctaaaaatcaaatccttccta

SEQ ID NO: 698286 - DNA, 22 bp, Artificial Sequence
  chemically synthesized
ccagctgtcccttaggaaggat

SEQ ID NO: 698287 - DNA, 22 bp, Artificial Sequence
  chemically synthesized
tgccagctgtcccttaggaagg

SEQ ID NO: 698288 - DNA, 22 bp, Artificial Sequence
  chemically synthesized
ctgccagctgtcccttaggaag

SEQ ID NO: 698289 - DNA, 22 bp, Artificial Sequence
  chemically synthesized
aaaatcaaatccttcctaaggg

SEQ ID NO: 698290 - DNA, 22 bp, Artificial Sequence
  chemically synthesized
tatttctgccagctgtccctta

SEQ ID NO: 698291 - DNA, 22 bp, Artificial Sequence
  chemically synthesized
atatttctgccagctgtccctt

SEQ ID NO: 698292 - DNA, 22 bp, Artificial Sequence
  chemically synthesized
accttatatttctgccagctgt

SEQ ID NO: 698293 - DNA, 22 bp, Artificial Sequence
  chemically synthesized
gaccttatatttctgccagctg

SEQ ID NO: 698294 - DNA, 22 bp, Artificial Sequence
  chemically synthesized
cctaagggacagctggcagaaa

SEQ ID NO: 698295 - DNA, 22 bp, Artificial Sequence
  chemically synthesized
ctaagggacagctggcagaaat

SEQ ID NO: 698296 - DNA, 22 bp, Artificial Sequence
  chemically synthesized
agggacagctggcagaaatata

SEQ ID NO: 698297 - DNA, 22 bp, Artificial Sequence
  chemically synthesized
gcagaaatataaggtcaaacac

SEQ ID NO: 698298 - DNA, 22 bp, Artificial Sequence
  chemically synthesized
taataccagcaaaagtgtttga

SEQ ID NO: 698299 - DNA, 22 bp, Artificial Sequence
  chemically synthesized
tgtaataccagcaaaagtgttt

SEQ ID NO: 698300 - DNA, 22 bp, Artificial Sequence
  chemically synthesized
ctgtaataccagcaaaagtgtt

SEQ ID NO: 698301 - DNA, 22 bp, Artificial Sequence
  chemically synthesized
tctgtaataccagcaaaagtgt

SEQ ID NO: 698302 - DNA, 22 bp, Artificial Sequence
  chemically synthesized
ttctgtaataccagcaaaagtg

SEQ ID NO: 698303 - DNA, 22 bp, Artificial Sequence
  chemically synthesized
cttttctgtaataccagcaaaa

SEQ ID NO: 698304 - DNA, 22 bp, Artificial Sequence
  chemically synthesized
ctacttttctgtaataccagca

SEQ ID NO: 698305 - DNA, 22 bp, Artificial Sequence
  chemically synthesized
tgctacttttctgtaataccag

SEQ ID NO: 698306 - DNA, 22 bp, Artificial Sequence
  chemically synthesized
ctgctacttttctgtaatacca

SEQ ID NO: 698307 - DNA, 22 bp, Artificial Sequence
  chemically synthesized
tctgctacttttctgtaatacc

SEQ ID NO: 698308 - DNA, 22 bp, Artificial Sequence
  chemically synthesized
gttttctgctacttttctgtaa

SEQ ID NO: 698309 - DNA, 22 bp, Artificial Sequence
  chemically synthesized
ttgctggtattacagaaaagta

SEQ ID NO: 698310 - DNA, 22 bp, Artificial Sequence
  chemically synthesized
tgctggtattacagaaaagtag

SEQ ID NO: 698311 - DNA, 22 bp, Artificial Sequence
  chemically synthesized
gctggtattacagaaaagtagc

SEQ ID NO: 698312 - DNA, 22 bp, Artificial Sequence
  chemically synthesized
ctggtattacagaaaagtagca

SEQ ID NO: 698313 - DNA, 22 bp, Artificial Sequence
  chemically synthesized
gtattacagaaaagtagcagaa

SEQ ID NO: 698314 - DNA, 22 bp, Artificial Sequence
  chemically synthesized
gccgaaggttggttttctgcta

SEQ ID NO: 698315 - DNA, 22 bp, Artificial Sequence
  chemically synthesized
tagccgaaggttggttttctgc

SEQ ID NO: 698316 - DNA, 22 bp, Artificial Sequence
  chemically synthesized
cagaaaagtagcagaaaaccaa

SEQ ID NO: 698317 - DNA, 22 bp, Artificial Sequence
  chemically synthesized
gttctagccgaaggttggtttt

SEQ ID NO: 698318 - DNA, 22 bp, Artificial Sequence
  chemically synthesized
catatattagttctagccgaag

SEQ ID NO: 698319 - DNA, 22 bp, Artificial Sequence
  chemically synthesized
tgcatatattagttctagccga

SEQ ID NO: 698320 - DNA, 22 bp, Artificial Sequence
  chemically synthesized
ctgcatatattagttctagccg

SEQ ID NO: 698321 - DNA, 22 bp, Artificial Sequence
  chemically synthesized
ttctgcatatattagttctagc

SEQ ID NO: 698322 - DNA, 22 bp, Artificial Sequence
  chemically synthesized
cggctagaactaatatatgcag

SEQ ID NO: 698323 - DNA, 22 bp, Artificial Sequence
  chemically synthesized
ggctagaactaatatatgcaga

SEQ ID NO: 698324 - DNA, 22 bp, Artificial Sequence
  chemically synthesized
aggtcataacctcttctgcata

SEQ ID NO: 698325 - DNA, 22 bp, Artificial Sequence
  chemically synthesized
gaactaatatatgcagaagagg

SEQ ID NO: 698326 - DNA, 22 bp, Artificial Sequence
  chemically synthesized
atatatgcagaagaggttatga

SEQ ID NO: 698327 - DNA, 22 bp, Artificial Sequence
  chemically synthesized
gtgcagaaatggagagatcaat

SEQ ID NO: 698328 - DNA, 22 bp, Artificial Sequence
  chemically synthesized
tgacctcaattgatctctccat

SEQ ID NO: 698329 - DNA, 22 bp, Artificial Sequence
  chemically synthesized
ccattggtgcagaaatggagag

SEQ ID NO: 698330 - DNA, 22 bp, Artificial Sequence
  chemically synthesized
tctcccattggtgcagaaatgg

SEQ ID NO: 698331 - DNA, 22 bp, Artificial Sequence
  chemically synthesized
aattgatctctccatttctgca

SEQ ID NO: 698332 - DNA, 22 bp, Artificial Sequence
  chemically synthesized
ctgtctcccattggtgcagaaa

SEQ ID NO: 698333 - DNA, 22 bp, Artificial Sequence
  chemically synthesized
gctgtctcccattggtgcagaa

SEQ ID NO: 698334 - DNA, 22 bp, Artificial Sequence
  chemically synthesized
atctctccatttctgcaccaat

SEQ ID NO: 698335 - DNA, 22 bp, Artificial Sequence
  chemically synthesized
tttgctgtctcccattggtgca

SEQ ID NO: 698336 - DNA, 22 bp, Artificial Sequence
  chemically synthesized
tccatttctgcaccaatgggag

SEQ ID NO: 698337 - DNA, 22 bp, Artificial Sequence
  chemically synthesized
catttctgcaccaatgggagac

SEQ ID NO: 698338 - DNA, 22 bp, Artificial Sequence
  chemically synthesized
ctgcaccaatgggagacagcaa

SEQ ID NO: 698339 - DNA, 22 bp, Artificial Sequence
  chemically synthesized
tgcaccaatgggagacagcaaa

SEQ ID NO: 698340 - DNA, 22 bp, Artificial Sequence
  chemically synthesized
caccaatgggagacagcaaata

SEQ ID NO: 698341 - DNA, 22 bp, Artificial Sequence
  chemically synthesized
atgaagaaagtaaatgttattt

SEQ ID NO: 698342 - DNA, 22 bp, Artificial Sequence
  chemically synthesized
actcatgaagaaagtaaatgtt

SEQ ID NO: 698343 - DNA, 22 bp, Artificial Sequence
  chemically synthesized
cactcactcatgaagaaagtaa

SEQ ID NO: 698344 - DNA, 22 bp, Artificial Sequence
  chemically synthesized
ccactcactcatgaagaaagta

SEQ ID NO: 698345 - DNA, 22 bp, Artificial Sequence
  chemically synthesized
gtttccactcactcatgaagaa

SEQ ID NO: 698346 - DNA, 22 bp, Artificial Sequence
  chemically synthesized
tagtttccactcactcatgaag

SEQ ID NO: 698347 - DNA, 22 bp, Artificial Sequence
  chemically synthesized
tctctagtttccactcactcat

SEQ ID NO: 698348 - DNA, 22 bp, Artificial Sequence
  chemically synthesized
actttcttcatgagtgagtgga

SEQ ID NO: 698349 - DNA, 22 bp, Artificial Sequence
  chemically synthesized
ctttcttcatgagtgagtggaa

SEQ ID NO: 698350 - DNA, 22 bp, Artificial Sequence
  chemically synthesized
gcattgtctctagtttccactc

SEQ ID NO: 698351 - DNA, 22 bp, Artificial Sequence
  chemically synthesized
tcttcatgagtgagtggaaact

SEQ ID NO: 698352 - DNA, 22 bp, Artificial Sequence
  chemically synthesized
cttcatgagtgagtggaaacta

SEQ ID NO: 698353 - DNA, 22 bp, Artificial Sequence
  chemically synthesized
ttcatgagtgagtggaaactag

SEQ ID NO: 698354 - DNA, 22 bp, Artificial Sequence
  chemically synthesized
ttagcattgtctctagtttcca

SEQ ID NO: 698355 - DNA, 22 bp, Artificial Sequence
  chemically synthesized
gttagcattgtctctagtttcc

SEQ ID NO: 698356 - DNA, 22 bp, Artificial Sequence
  chemically synthesized
catgagtgagtggaaactagag

SEQ ID NO: 698357 - DNA, 22 bp, Artificial Sequence
  chemically synthesized
atgagtgagtggaaactagaga

SEQ ID NO: 698358 - DNA, 22 bp, Artificial Sequence
  chemically synthesized
tgaaatttgttagcattgtctc

SEQ ID NO: 698359 - DNA, 22 bp, Artificial Sequence
  chemically synthesized
gttatgaaatttgttagcattg

SEQ ID NO: 698360 - DNA, 22 bp, Artificial Sequence
  chemically synthesized
gagacaatgctaacaaatttca

SEQ ID NO: 698361 - DNA, 22 bp, Artificial Sequence
  chemically synthesized
gggtggcccaaatattggttat

SEQ ID NO: 698362 - DNA, 22 bp, Artificial Sequence
  chemically synthesized
acaaatttcataaccaatattt

SEQ ID NO: 698363 - DNA, 22 bp, Artificial Sequence
  chemically synthesized
cataaccaatatttgggccacc

SEQ ID NO: 698364 - DNA, 22 bp, Artificial Sequence
  chemically synthesized
ataaccaatatttgggccaccc

SEQ ID NO: 698365 - DNA, 22 bp, Artificial Sequence
  chemically synthesized
ggatgtcgtgactagggtggcc

SEQ ID NO: 698366 - DNA, 22 bp, Artificial Sequence
  chemically synthesized
gggatgtcgtgactagggtggc

SEQ ID NO: 698367 - DNA, 22 bp, Artificial Sequence
  chemically synthesized
tgggatgtcgtgactagggtgg

SEQ ID NO: 698368 - DNA, 22 bp, Artificial Sequence
  chemically synthesized
tttgggatgtcgtgactagggt

SEQ ID NO: 698369 - DNA, 22 bp, Artificial Sequence
  chemically synthesized
ctttgggatgtcgtgactaggg

SEQ ID NO: 698370 - DNA, 22 bp, Artificial Sequence
  chemically synthesized
gggccaccctagtcacgacatc

SEQ ID NO: 698371 - DNA, 22 bp, Artificial Sequence
  chemically synthesized
tatcttctttgggatgtcgtga

SEQ ID NO: 698372 - DNA, 22 bp, Artificial Sequence
  chemically synthesized
ggccaccctagtcacgacatcc

SEQ ID NO: 698373 - DNA, 22 bp, Artificial Sequence
  chemically synthesized
ttatatcttctttgggatgtcg

SEQ ID NO: 698374 - DNA, 22 bp, Artificial Sequence
  chemically synthesized
tgttatatcttctttgggatgt

SEQ ID NO: 698375 - DNA, 22 bp, Artificial Sequence
  chemically synthesized
gtcacgacatcccaaagaagat

SEQ ID NO: 698376 - DNA, 22 bp, Artificial Sequence
  chemically synthesized
cagctctgttatatcttctttg

SEQ ID NO: 698377 - DNA, 22 bp, Artificial Sequence
  chemically synthesized
ccagctctgttatatcttcttt

SEQ ID NO: 698378 - DNA, 22 bp, Artificial Sequence
  chemically synthesized
tccagctctgttatatcttctt

SEQ ID NO: 698379 - DNA, 22 bp, Artificial Sequence
  chemically synthesized
ttccagctctgttatatcttct

SEQ ID NO: 698380 - DNA, 22 bp, Artificial Sequence
  chemically synthesized
gatcttttccagctctgttata

SEQ ID NO: 698381 - DNA, 22 bp, Artificial Sequence
  chemically synthesized
cctggatcttttccagctctgt

SEQ ID NO: 698382 - DNA, 22 bp, Artificial Sequence
  chemically synthesized
ccctggatcttttccagctctg

SEQ ID NO: 698383 - DNA, 22 bp, Artificial Sequence
  chemically synthesized
tccctggatcttttccagctct

SEQ ID NO: 698384 - DNA, 22 bp, Artificial Sequence
  chemically synthesized
ttccctggatcttttccagctc

SEQ ID NO: 698385 - DNA, 22 bp, Artificial Sequence
  chemically synthesized
tttttccctggatcttttccag

SEQ ID NO: 698386 - DNA, 22 bp, Artificial Sequence
  chemically synthesized
gttgtttttccctggatctttt

SEQ ID NO: 698387 - DNA, 22 bp, Artificial Sequence
  chemically synthesized
agttgtttttccctggatcttt

SEQ ID NO: 698388 - DNA, 22 bp, Artificial Sequence
  chemically synthesized
tcttagttgtttttccctggat

SEQ ID NO: 698389 - DNA, 22 bp, Artificial Sequence
  chemically synthesized
attatcttagttgtttttccct

SEQ ID NO: 698390 - DNA, 22 bp, Artificial Sequence
  chemically synthesized
gattatcttagttgtttttccc

SEQ ID NO: 698391 - DNA, 22 bp, Artificial Sequence
  chemically synthesized
gaaaagatccagggaaaaacaa

SEQ ID NO: 698392 - DNA, 22 bp, Artificial Sequence
  chemically synthesized
cccttgattatcttagttgttt

SEQ ID NO: 698393 - DNA, 22 bp, Artificial Sequence
  chemically synthesized
ccccttgattatcttagttgtt

SEQ ID NO: 698394 - DNA, 22 bp, Artificial Sequence
  chemically synthesized
tccccttgattatcttagttgt

SEQ ID NO: 698395 - DNA, 22 bp, Artificial Sequence
  chemically synthesized
acggaaagataagctttcccct

SEQ ID NO: 698396 - DNA, 22 bp, Artificial Sequence
  chemically synthesized
gacggaaagataagctttcccc

SEQ ID NO: 698397 - DNA, 22 bp, Artificial Sequence
  chemically synthesized
agataatcaaggggaaagctta

SEQ ID NO: 698398 - DNA, 22 bp, Artificial Sequence
  chemically synthesized
tccttgacggaaagataagctt

SEQ ID NO: 698399 - DNA, 22 bp, Artificial Sequence
  chemically synthesized
gtctgtccttgacggaaagata

SEQ ID NO: 698400 - DNA, 22 bp, Artificial Sequence
  chemically synthesized
agtctgtccttgacggaaagat

SEQ ID NO: 698401 - DNA, 22 bp, Artificial Sequence
  chemically synthesized
tagtctgtccttgacggaaaga

SEQ ID NO: 698402 - DNA, 22 bp, Artificial Sequence
  chemically synthesized
ttagtctgtccttgacggaaag

SEQ ID NO: 698403 - DNA, 22 bp, Artificial Sequence
  chemically synthesized
gtcttttagtctgtccttgacg

SEQ ID NO: 698404 - DNA, 22 bp, Artificial Sequence
  chemically synthesized
agtcttttagtctgtccttgac

SEQ ID NO: 698405 - DNA, 22 bp, Artificial Sequence
  chemically synthesized
tagtcttttagtctgtccttga

SEQ ID NO: 698406 - DNA, 22 bp, Artificial Sequence
  chemically synthesized
ttagtcttttagtctgtccttg

SEQ ID NO: 698407 - DNA, 22 bp, Artificial Sequence
  chemically synthesized
tttagtcttttagtctgtcctt

SEQ ID NO: 698408 - DNA, 22 bp, Artificial Sequence
  chemically synthesized
atctttccgtcaaggacagact

SEQ ID NO: 698409 - DNA, 22 bp, Artificial Sequence
  chemically synthesized
tctttccgtcaaggacagacta

SEQ ID NO: 698410 - DNA, 22 bp, Artificial Sequence
  chemically synthesized
tccgtcaaggacagactaaaag

SEQ ID NO: 698411 - DNA, 22 bp, Artificial Sequence
  chemically synthesized
atcctttttagtcttttagtct

SEQ ID NO: 698412 - DNA, 22 bp, Artificial Sequence
  chemically synthesized
ccgtcaaggacagactaaaaga

SEQ ID NO: 698413 - DNA, 22 bp, Artificial Sequence
  chemically synthesized
cgtcaaggacagactaaaagac

SEQ ID NO: 698414 - DNA, 22 bp, Artificial Sequence
  chemically synthesized
taatcctttttagtcttttagt

SEQ ID NO: 698415 - DNA, 22 bp, Artificial Sequence
  chemically synthesized
agaaattctaatcctttttagt

SEQ ID NO: 698416 - DNA, 22 bp, Artificial Sequence
  chemically synthesized
aaagactaaaaaggattagaat

SEQ ID NO: 698417 - DNA, 22 bp, Artificial Sequence
  chemically synthesized
ccagtctgagaaattctaatcc

SEQ ID NO: 698418 - DNA, 22 bp, Artificial Sequence
  chemically synthesized
cccagtctgagaaattctaatc

SEQ ID NO: 698419 - DNA, 22 bp, Artificial Sequence
  chemically synthesized
atcttcccagtctgagaaattc

SEQ ID NO: 698420 - DNA, 22 bp, Artificial Sequence
  chemically synthesized
catcttcccagtctgagaaatt

SEQ ID NO: 698421 - DNA, 22 bp, Artificial Sequence
  chemically synthesized
aaaaggattagaatttctcaga

SEQ ID NO: 698422 - DNA, 22 bp, Artificial Sequence
  chemically synthesized
tcatcttcccagtctgagaaat

SEQ ID NO: 698423 - DNA, 22 bp, Artificial Sequence
  chemically synthesized
attttcatcttcccagtctgag

SEQ ID NO: 698424 - DNA, 22 bp, Artificial Sequence
  chemically synthesized
cattttcatcttcccagtctga

SEQ ID NO: 698425 - DNA, 22 bp, Artificial Sequence
  chemically synthesized
tcattttcatcttcccagtctg

SEQ ID NO: 698426 - DNA, 22 bp, Artificial Sequence
  chemically synthesized
ttcattttcatcttcccagtct

SEQ ID NO: 698427 - DNA, 22 bp, Artificial Sequence
  chemically synthesized
gaatttctcagactgggaagat

SEQ ID NO: 698428 - DNA, 22 bp, Artificial Sequence
  chemically synthesized
atgcttttcattttcatcttcc

SEQ ID NO: 698429 - DNA, 22 bp, Artificial Sequence
  chemically synthesized
ctcagactgggaagatgaaaat

SEQ ID NO: 698430 - DNA, 22 bp, Artificial Sequence
  chemically synthesized
ctaatgcttttcattttcatct

SEQ ID NO: 698431 - DNA, 22 bp, Artificial Sequence
  chemically synthesized
tcagactgggaagatgaaaatg

SEQ ID NO: 698432 - DNA, 22 bp, Artificial Sequence
  chemically synthesized
agactgggaagatgaaaatgaa

SEQ ID NO: 698433 - DNA, 22 bp, Artificial Sequence
  chemically synthesized
ccctactaatgcttttcatttt

SEQ ID NO: 698434 - DNA, 22 bp, Artificial Sequence
  chemically synthesized
ggaagatgaaaatgaaaagcat

SEQ ID NO: 698435 - DNA, 22 bp, Artificial Sequence
  chemically synthesized
acattcccctactaatgctttt

SEQ ID NO: 698436 - DNA, 22 bp, Artificial Sequence
  chemically synthesized
gcctcacattcccctactaatg

SEQ ID NO: 698437 - DNA, 22 bp, Artificial Sequence
  chemically synthesized
agcctcacattcccctactaat

SEQ ID NO: 698438 - DNA, 22 bp, Artificial Sequence
  chemically synthesized
tagcctcacattcccctactaa

SEQ ID NO: 698439 - DNA, 22 bp, Artificial Sequence
  chemically synthesized
tccagagtcgactttagcctca

SEQ ID NO: 698440 - DNA, 22 bp, Artificial Sequence
  chemically synthesized
gtaggggaatgtgaggctaaag

SEQ ID NO: 698441 - DNA, 22 bp, Artificial Sequence
  chemically synthesized
atccagagtcgactttagcctc

SEQ ID NO: 698442 - DNA, 22 bp, Artificial Sequence
  chemically synthesized
tatttatccagagtcgacttta

SEQ ID NO: 698443 - DNA, 22 bp, Artificial Sequence
  chemically synthesized
atatttatccagagtcgacttt

SEQ ID NO: 698444 - DNA, 22 bp, Artificial Sequence
  chemically synthesized
aagtcgactctggataaatata

SEQ ID NO: 698445 - DNA, 22 bp, Artificial Sequence
  chemically synthesized
agtaaaaacatttatatttatc

SEQ ID NO: 698446 - DNA, 22 bp, Artificial Sequence
  chemically synthesized
aaattcagtaaaaacatttata

SEQ ID NO: 698447 - DNA, 22 bp, Artificial Sequence
  chemically synthesized
gaaattcagtaaaaacatttat

SEQ ID NO: 698448 - DNA, 22 bp, Artificial Sequence
  chemically synthesized
tgaaattcagtaaaaacattta

SEQ ID NO: 698449 - DNA, 22 bp, Artificial Sequence
  chemically synthesized
tggataaatataaatgttttta

SEQ ID NO: 698450 - DNA, 22 bp, Artificial Sequence
  chemically synthesized
tttgaaattcagtaaaaacatt

SEQ ID NO: 698451 - DNA, 22 bp, Artificial Sequence
  chemically synthesized
gataaatataaatgtttttact

SEQ ID NO: 698452 - DNA, 22 bp, Artificial Sequence
  chemically synthesized
aattctttgaaattcagtaaaa

SEQ ID NO: 698453 - DNA, 22 bp, Artificial Sequence
  chemically synthesized
attaaattctttgaaattcagt

SEQ ID NO: 698454 - DNA, 22 bp, Artificial Sequence
  chemically synthesized
aattaaattctttgaaattcag

SEQ ID NO: 698455 - DNA, 22 bp, Artificial Sequence
  chemically synthesized
ttactgaatttcaaagaattta

SEQ ID NO: 698456 - DNA, 22 bp, Artificial Sequence
  chemically synthesized
tactgaatttcaaagaatttaa

SEQ ID NO: 698457 - DNA, 22 bp, Artificial Sequence
  chemically synthesized
actgaatttcaaagaatttaat

SEQ ID NO: 698458 - DNA, 22 bp, Artificial Sequence
  chemically synthesized
ctgaatttcaaagaatttaatt

SEQ ID NO: 698459 - DNA, 22 bp, Artificial Sequence
  chemically synthesized
aaggaatggccttaattaaatt

SEQ ID NO: 698460 - DNA, 22 bp, Artificial Sequence
  chemically synthesized
aatttcaaagaatttaattaag

SEQ ID NO: 698461 - DNA, 22 bp, Artificial Sequence
  chemically synthesized
acctcaaggaatggccttaatt

SEQ ID NO: 698462 - DNA, 22 bp, Artificial Sequence
  chemically synthesized
aacctcaaggaatggccttaat

SEQ ID NO: 698463 - DNA, 22 bp, Artificial Sequence
  chemically synthesized
caaagaatttaattaaggccat

SEQ ID NO: 698464 - DNA, 22 bp, Artificial Sequence
  chemically synthesized
taacctcaaggaatggccttaa

SEQ ID NO: 698465 - DNA, 22 bp, Artificial Sequence
  chemically synthesized
aaagaatttaattaaggccatt

SEQ ID NO: 698466 - DNA, 22 bp, Artificial Sequence
  chemically synthesized
catcctttaacctcaaggaatg

SEQ ID NO: 698467 - DNA, 22 bp, Artificial Sequence
  chemically synthesized
aattaaggccattccttgaggt

SEQ ID NO: 698468 - DNA, 22 bp, Artificial Sequence
  chemically synthesized
attaaggccattccttgaggtt

SEQ ID NO: 698469 - DNA, 22 bp, Artificial Sequence
  chemically synthesized
aatctgcatcctttaacctcaa

SEQ ID NO: 698470 - DNA, 22 bp, Artificial Sequence
  chemically synthesized
gaatctgcatcctttaacctca

SEQ ID NO: 698471 - DNA, 22 bp, Artificial Sequence
  chemically synthesized
aggccattccttgaggttaaag

SEQ ID NO: 698472 - DNA, 22 bp, Artificial Sequence
  chemically synthesized
ttgaatctgcatcctttaacct

SEQ ID NO: 698473 - DNA, 22 bp, Artificial Sequence
  chemically synthesized
tcttgaatctgcatcctttaac

SEQ ID NO: 698474 - DNA, 22 bp, Artificial Sequence
  chemically synthesized
ctcttgaatctgcatcctttaa

SEQ ID NO: 698475 - DNA, 22 bp, Artificial Sequence
  chemically synthesized
atttctcttgaatctgcatcct

SEQ ID NO: 698476 - DNA, 22 bp, Artificial Sequence
  chemically synthesized
cttgaggttaaaggatgcagat

SEQ ID NO: 698477 - DNA, 22 bp, Artificial Sequence
  chemically synthesized
aatttctcttgaatctgcatcc

SEQ ID NO: 698478 - DNA, 22 bp, Artificial Sequence
  chemically synthesized
taatttctcttgaatctgcatc

SEQ ID NO: 698479 - DNA, 22 bp, Artificial Sequence
  chemically synthesized
gaggttaaaggatgcagattca

SEQ ID NO: 698480 - DNA, 22 bp, Artificial Sequence
  chemically synthesized
aggttaaaggatgcagattcaa

SEQ ID NO: 698481 - DNA, 22 bp, Artificial Sequence
  chemically synthesized
aaggatgcagattcaagagaaa

SEQ ID NO: 698482 - DNA, 22 bp, Artificial Sequence
  chemically synthesized
tataaatataggcattttaatt

SEQ ID NO: 698483 - DNA, 22 bp, Artificial Sequence
  chemically synthesized
tatataaatataggcattttaa

SEQ ID NO: 698484 - DNA, 22 bp, Artificial Sequence
  chemically synthesized
ctatataaatataggcatttta

SEQ ID NO: 698485 - DNA, 22 bp, Artificial Sequence
  chemically synthesized
aagagaaattaaaatgcctata

SEQ ID NO: 698486 - DNA, 22 bp, Artificial Sequence
  chemically synthesized
aaatgcctatatttatatagaa

SEQ ID NO: 698487 - DNA, 22 bp, Artificial Sequence
  chemically synthesized
cataaatgtaccgacttctata

SEQ ID NO: 698488 - DNA, 22 bp, Artificial Sequence
  chemically synthesized
tatttatatagaagtcggtaca

SEQ ID NO: 698489 - DNA, 22 bp, Artificial Sequence
  chemically synthesized
atatagaagtcggtacatttat

SEQ ID NO: 698490 - DNA, 22 bp, Artificial Sequence
  chemically synthesized
tatagaagtcggtacatttatg

SEQ ID NO: 698491 - DNA, 22 bp, Artificial Sequence
  chemically synthesized
ataataatatgttccataaatg

SEQ ID NO: 698492 - DNA, 22 bp, Artificial Sequence
  chemically synthesized
aataataatatgttccataaat

SEQ ID NO: 698493 - DNA, 22 bp, Artificial Sequence
  chemically synthesized
tcttaataataatatgttccat

SEQ ID NO: 698494 - DNA, 22 bp, Artificial Sequence
  chemically synthesized
gtcttaataataatatgttcca

SEQ ID NO: 698495 - DNA, 22 bp, Artificial Sequence
  chemically synthesized
tgtcttaataataatatgttcc

SEQ ID NO: 698496 - DNA, 22 bp, Artificial Sequence
  chemically synthesized
agctttgtcttaataataatat

SEQ ID NO: 698497 - DNA, 22 bp, Artificial Sequence
  chemically synthesized
cagctttgtcttaataataata

SEQ ID NO: 698498 - DNA, 22 bp, Artificial Sequence
  chemically synthesized
atggaacatattattattaaga

SEQ ID NO: 698499 - DNA, 22 bp, Artificial Sequence
  chemically synthesized
tggaacatattattattaagac

SEQ ID NO: 698500 - DNA, 22 bp, Artificial Sequence
  chemically synthesized
cccacttcagctttgtcttaat

SEQ ID NO: 698501 - DNA, 22 bp, Artificial Sequence
  chemically synthesized
ttccccacttcagctttgtctt

SEQ ID NO: 698502 - DNA, 22 bp, Artificial Sequence
  chemically synthesized
ctattccccacttcagctttgt

SEQ ID NO: 698503 - DNA, 22 bp, Artificial Sequence
  chemically synthesized
cctattccccacttcagctttg

SEQ ID NO: 698504 - DNA, 22 bp, Artificial Sequence
  chemically synthesized
tcctattccccacttcagcttt

SEQ ID NO: 698505 - DNA, 22 bp, Artificial Sequence
  chemically synthesized
ttcctattccccacttcagctt

SEQ ID NO: 698506 - DNA, 22 bp, Artificial Sequence
  chemically synthesized
ttattaagacaaagctgaagtg

SEQ ID NO: 698507 - DNA, 22 bp, Artificial Sequence
  chemically synthesized
ttaagacaaagctgaagtgggg

SEQ ID NO: 698508 - DNA, 22 bp, Artificial Sequence
  chemically synthesized
agacaaagctgaagtggggaat

SEQ ID NO: 698509 - DNA, 22 bp, Artificial Sequence
  chemically synthesized
aagtggggaataggaaaagttt

SEQ ID NO: 698510 - DNA, 22 bp, Artificial Sequence
  chemically synthesized
tccaatggtgtcaaacttttcc

SEQ ID NO: 698511 - DNA, 22 bp, Artificial Sequence
  chemically synthesized
atccaatggtgtcaaacttttc

SEQ ID NO: 698512 - DNA, 22 bp, Artificial Sequence
  chemically synthesized
gcagtgagtttatccaatggtg

SEQ ID NO: 698513 - DNA, 22 bp, Artificial Sequence
  chemically synthesized
gacaccattggataaactcact

SEQ ID NO: 698514 - DNA, 22 bp, Artificial Sequence
  chemically synthesized
acaccattggataaactcactg

SEQ ID NO: 698515 - DNA, 22 bp, Artificial Sequence
  chemically synthesized
taaatcaactggcagtgagttt

SEQ ID NO: 698516 - DNA, 22 bp, Artificial Sequence
  chemically synthesized
gataaactcactgccagttgat

SEQ ID NO: 698517 - DNA, 22 bp, Artificial Sequence
  chemically synthesized
ataatgcattgtaaatcaactg

SEQ ID NO: 698518 - DNA, 22 bp, Artificial Sequence
  chemically synthesized
aataatgcattgtaaatcaact

SEQ ID NO: 698519 - DNA, 22 bp, Artificial Sequence
  chemically synthesized
ttaataatgcattgtaaatcaa

SEQ ID NO: 698520 - DNA, 22 bp, Artificial Sequence
  chemically synthesized
cttaataatgcattgtaaatca

SEQ ID NO: 698521 - DNA, 22 bp, Artificial Sequence
  chemically synthesized
actgccagttgatttacaatgc

SEQ ID NO: 698522 - DNA, 22 bp, Artificial Sequence
  chemically synthesized
ccagttgatttacaatgcatta

SEQ ID NO: 698523 - DNA, 22 bp, Artificial Sequence
  chemically synthesized
atttacaatgcattattaagaa

SEQ ID NO: 698524 - DNA, 22 bp, Artificial Sequence
  chemically synthesized
acaatgcattattaagaagtgg

SEQ ID NO: 698525 - DNA, 22 bp, Artificial Sequence
  chemically synthesized
caatgcattattaagaagtggt

SEQ ID NO: 698526 - DNA, 22 bp, Artificial Sequence
  chemically synthesized
ggatacatcatgaccacttctt

SEQ ID NO: 698527 - DNA, 22 bp, Artificial Sequence
  chemically synthesized
aaaattcggatacatcatgacc

SEQ ID NO: 698528 - DNA, 22 bp, Artificial Sequence
  chemically synthesized
aaaaattcggatacatcatgac

SEQ ID NO: 698529 - DNA, 22 bp, Artificial Sequence
  chemically synthesized
ttaagaagtggtcatgatgtat

SEQ ID NO: 698530 - DNA, 22 bp, Artificial Sequence
  chemically synthesized
ccttaaaaattcggatacatca

SEQ ID NO: 698531 - DNA, 22 bp, Artificial Sequence
  chemically synthesized
agaagtggtcatgatgtatccg

SEQ ID NO: 698532 - DNA, 22 bp, Artificial Sequence
  chemically synthesized
accttaaaaattcggatacatc

SEQ ID NO: 698533 - DNA, 22 bp, Artificial Sequence
  chemically synthesized
taccttaaaaattcggatacat

SEQ ID NO: 698534 - DNA, 22 bp, Artificial Sequence
  chemically synthesized
gtacattttaccttaaaaattc

SEQ ID NO: 698535 - DNA, 22 bp, Artificial Sequence
  chemically synthesized
tcaggtaacctagtacatttta

SEQ ID NO: 698536 - DNA, 22 bp, Artificial Sequence
  chemically synthesized
gtcaggtaacctagtacatttt

SEQ ID NO: 698537 - DNA, 22 bp, Artificial Sequence
  chemically synthesized
tgtcaggtaacctagtacattt

SEQ ID NO: 698538 - DNA, 22 bp, Artificial Sequence
  chemically synthesized
ttttgtcaggtaacctagtaca

SEQ ID NO: 698539 - DNA, 22 bp, Artificial Sequence
  chemically synthesized
ttaaggtaaaatgtactaggtt

SEQ ID NO: 698540 - DNA, 22 bp, Artificial Sequence
  chemically synthesized
taaggtaaaatgtactaggtta

SEQ ID NO: 698541 - DNA, 22 bp, Artificial Sequence
  chemically synthesized
aaggtaaaatgtactaggttac

SEQ ID NO: 698542 - DNA, 22 bp, Artificial Sequence
  chemically synthesized
aggtaaaatgtactaggttacc

SEQ ID NO: 698543 - DNA, 22 bp, Artificial Sequence
  chemically synthesized
ggttacctgacaaaacaaccat

SEQ ID NO: 698544 - DNA, 22 bp, Artificial Sequence
  chemically synthesized
cctgacaaaacaaccattggta

SEQ ID NO: 698545 - DNA, 22 bp, Artificial Sequence
  chemically synthesized
tcccagatgaagataccaatgg

SEQ ID NO: 698546 - DNA, 22 bp, Artificial Sequence
  chemically synthesized
tgtcccagatgaagataccaat

SEQ ID NO: 698547 - DNA, 22 bp, Artificial Sequence
  chemically synthesized
acaaaacaaccattggtatctt

SEQ ID NO: 698548 - DNA, 22 bp, Artificial Sequence
  chemically synthesized
gcccggaactctgtcccagatg

SEQ ID NO: 698549 - DNA, 22 bp, Artificial Sequence
  chemically synthesized
gtatcttcatctgggacagagt

SEQ ID NO: 698550 - DNA, 22 bp, Artificial Sequence
  chemically synthesized
catctgggacagagttccgggc

SEQ ID NO: 698551 - DNA, 22 bp, Artificial Sequence
  chemically synthesized
atctgggacagagttccgggct

SEQ ID NO: 698552 - DNA, 22 bp, Artificial Sequence
  chemically synthesized
ggacagagttccgggctagttg

SEQ ID NO: 698553 - DNA, 22 bp, Artificial Sequence
  chemically synthesized
ggtcagaccaacagggcaacta

SEQ ID NO: 698554 - DNA, 22 bp, Artificial Sequence
  chemically synthesized
cgggctagttgccctgttggtc

SEQ ID NO: 698555 - DNA, 22 bp, Artificial Sequence
  chemically synthesized
gttgccctgttggtctgaccca

SEQ ID NO: 698556 - DNA, 22 bp, Artificial Sequence
  chemically synthesized
ccctgttggtctgacccagtgt

SEQ ID NO: 698557 - DNA, 22 bp, Artificial Sequence
  chemically synthesized
ttggtctgacccagtgtgatat

SEQ ID NO: 698558 - DNA, 22 bp, Artificial Sequence
  chemically synthesized
gtctgacccagtgtgatatttc

SEQ ID NO: 698559 - DNA, 22 bp, Artificial Sequence
  chemically synthesized
acccagtgtgatatttcttatg

SEQ ID NO: 698560 - DNA, 22 bp, Artificial Sequence
  chemically synthesized
cagtatagatgtcataataaaa

SEQ ID NO: 698561 - DNA, 22 bp, Artificial Sequence
  chemically synthesized
cttatgcttttattatgacatc

SEQ ID NO: 698562 - DNA, 22 bp, Artificial Sequence
  chemically synthesized
ttatgcttttattatgacatct

SEQ ID NO: 698563 - DNA, 22 bp, Artificial Sequence
  chemically synthesized
atgcttttattatgacatctat

SEQ ID NO: 698564 - DNA, 22 bp, Artificial Sequence
  chemically synthesized
tgcttttattatgacatctata

SEQ ID NO: 698565 - DNA, 22 bp, Artificial Sequence
  chemically synthesized
ttattatgacatctatactgga

SEQ ID NO: 698566 - DNA, 22 bp, Artificial Sequence
  chemically synthesized
tattatgacatctatactggaa

SEQ ID NO: 698567 - DNA, 22 bp, Artificial Sequence
  chemically synthesized
attatgacatctatactggaac

SEQ ID NO: 698568 - DNA, 22 bp, Artificial Sequence
  chemically synthesized
ttatgacatctatactggaaca

SEQ ID NO: 698569 - DNA, 22 bp, Artificial Sequence
  chemically synthesized
tgacatctatactggaacatcc

SEQ ID NO: 698570 - DNA, 22 bp, Artificial Sequence
  chemically synthesized
tactggaacatcctgcatgcat

SEQ ID NO: 698571 - DNA, 22 bp, Artificial Sequence
  chemically synthesized
ggaatcccaaacatgcatgcag

SEQ ID NO: 698572 - DNA, 22 bp, Artificial Sequence
  chemically synthesized
aggaatcccaaacatgcatgca

SEQ ID NO: 698573 - DNA, 22 bp, Artificial Sequence
  chemically synthesized
gaacatcctgcatgcatgtttg

SEQ ID NO: 698574 - DNA, 22 bp, Artificial Sequence
  chemically synthesized
tcaaaagaatttaggaatccca

SEQ ID NO: 698575 - DNA, 22 bp, Artificial Sequence
  chemically synthesized
catgcatgtttgggattcctaa

SEQ ID NO: 698576 - DNA, 22 bp, Artificial Sequence
  chemically synthesized
gactgtcaaaagaatttaggaa

SEQ ID NO: 698577 - DNA, 22 bp, Artificial Sequence
  chemically synthesized
tggactgtcaaaagaatttagg

SEQ ID NO: 698578 - DNA, 22 bp, Artificial Sequence
  chemically synthesized
tattctggactgtcaaaagaat

SEQ ID NO: 698579 - DNA, 22 bp, Artificial Sequence
  chemically synthesized
gggattcctaaattcttttgac

SEQ ID NO: 698580 - DNA, 22 bp, Artificial Sequence
  chemically synthesized
ggattcctaaattcttttgaca

SEQ ID NO: 698581 - DNA, 22 bp, Artificial Sequence
  chemically synthesized
tgtattctggactgtcaaaaga

SEQ ID NO: 698582 - DNA, 22 bp, Artificial Sequence
  chemically synthesized
ctgtattctggactgtcaaaag

SEQ ID NO: 698583 - DNA, 22 bp, Artificial Sequence
  chemically synthesized
ttctgtattctggactgtcaaa

SEQ ID NO: 698584 - DNA, 22 bp, Artificial Sequence
  chemically synthesized
ctaaattcttttgacagtccag

SEQ ID NO: 698585 - DNA, 22 bp, Artificial Sequence
  chemically synthesized
ttcttctgtattctggactgtc

SEQ ID NO: 698586 - DNA, 22 bp, Artificial Sequence
  chemically synthesized
aattcttttgacagtccagaat

SEQ ID NO: 698587 - DNA, 22 bp, Artificial Sequence
  chemically synthesized
ttttgacagtccagaatacaga

SEQ ID NO: 698588 - DNA, 22 bp, Artificial Sequence
  chemically synthesized
gaaaattgttcttctgtattct

SEQ ID NO: 698589 - DNA, 22 bp, Artificial Sequence
  chemically synthesized
ttgacagtccagaatacagaag

SEQ ID NO: 698590 - DNA, 22 bp, Artificial Sequence
  chemically synthesized
tgacagtccagaatacagaaga

SEQ ID NO: 698591 - DNA, 22 bp, Artificial Sequence
  chemically synthesized
gacagtccagaatacagaagaa

SEQ ID NO: 698592 - DNA, 22 bp, Artificial Sequence
  chemically synthesized
acagtccagaatacagaagaac

SEQ ID NO: 698593 - DNA, 22 bp, Artificial Sequence
  chemically synthesized
atgagttagaaaattgttcttc

SEQ ID NO: 698594 - DNA, 22 bp, Artificial Sequence
  chemically synthesized
aatgagttagaaaattgttctt

SEQ ID NO: 698595 - DNA, 22 bp, Artificial Sequence
  chemically synthesized
ttaatgagttagaaaattgttc

SEQ ID NO: 698596 - DNA, 22 bp, Artificial Sequence
  chemically synthesized
cttaatgagttagaaaattgtt

SEQ ID NO: 698597 - DNA, 22 bp, Artificial Sequence
  chemically synthesized
tcttaatgagttagaaaattgt

SEQ ID NO: 698598 - DNA, 22 bp, Artificial Sequence
  chemically synthesized
ctttcttaatgagttagaaaat

SEQ ID NO: 698599 - DNA, 22 bp, Artificial Sequence
  chemically synthesized
gctttcttaatgagttagaaaa

SEQ ID NO: 698600 - DNA, 22 bp, Artificial Sequence
  chemically synthesized
ttgctttcttaatgagttagaa

SEQ ID NO: 698601 - DNA, 22 bp, Artificial Sequence
  chemically synthesized
tcttgctttcttaatgagttag

SEQ ID NO: 698602 - DNA, 22 bp, Artificial Sequence
  chemically synthesized
ggactctcttgctttcttaatg

SEQ ID NO: 698603 - DNA, 22 bp, Artificial Sequence
  chemically synthesized
tctaactcattaagaaagcaag

SEQ ID NO: 698604 - DNA, 22 bp, Artificial Sequence
  chemically synthesized
ctaactcattaagaaagcaaga

SEQ ID NO: 698605 - DNA, 22 bp, Artificial Sequence
  chemically synthesized
taactcattaagaaagcaagag

SEQ ID NO: 698606 - DNA, 22 bp, Artificial Sequence
  chemically synthesized
actcattaagaaagcaagagag

SEQ ID NO: 698607 - DNA, 22 bp, Artificial Sequence
  chemically synthesized
attaagaaagcaagagagtccc

SEQ ID NO: 698608 - DNA, 22 bp, Artificial Sequence
  chemically synthesized
agaaagcaagagagtcccagct

SEQ ID NO: 698609 - DNA, 22 bp, Artificial Sequence
  chemically synthesized
ccatatgggtaaaccaaacaga

SEQ ID NO: 698610 - DNA, 22 bp, Artificial Sequence
  chemically synthesized
ttggctctgtttggtttaccca

SEQ ID NO: 698611 - DNA, 22 bp, Artificial Sequence
  chemically synthesized
catgctcccatatgggtaaacc

SEQ ID NO: 698612 - DNA, 22 bp, Artificial Sequence
  chemically synthesized
ggctctgtttggtttacccata

SEQ ID NO: 698613 - DNA, 22 bp, Artificial Sequence
  chemically synthesized
gctctgtttggtttacccatat

SEQ ID NO: 698614 - DNA, 22 bp, Artificial Sequence
  chemically synthesized
tgttgcatgctcccatatgggt

SEQ ID NO: 698615 - DNA, 22 bp, Artificial Sequence
  chemically synthesized
atgttgcatgctcccatatggg

SEQ ID NO: 698616 - DNA, 22 bp, Artificial Sequence
  chemically synthesized
tgtttggtttacccatatggga

SEQ ID NO: 698617 - DNA, 22 bp, Artificial Sequence
  chemically synthesized
tatgttgcatgctcccatatgg

SEQ ID NO: 698618 - DNA, 22 bp, Artificial Sequence
  chemically synthesized
ttatgttgcatgctcccatatg

SEQ ID NO: 698619 - DNA, 22 bp, Artificial Sequence
  chemically synthesized
tttggtttacccatatgggagc

SEQ ID NO: 698620 - DNA, 22 bp, Artificial Sequence
  chemically synthesized
tttatgttgcatgctcccatat

SEQ ID NO: 698621 - DNA, 22 bp, Artificial Sequence
  chemically synthesized
ggtttacccatatgggagcatg

SEQ ID NO: 698622 - DNA, 22 bp, Artificial Sequence
  chemically synthesized
gtttacccatatgggagcatgc

SEQ ID NO: 698623 - DNA, 22 bp, Artificial Sequence
  chemically synthesized
acctttttatgttgcatgctcc

SEQ ID NO: 698624 - DNA, 22 bp, Artificial Sequence
  chemically synthesized
cacctttttatgttgcatgctc

SEQ ID NO: 698625 - DNA, 22 bp, Artificial Sequence
  chemically synthesized
tcacctttttatgttgcatgct

SEQ ID NO: 698626 - DNA, 22 bp, Artificial Sequence
  chemically synthesized
acccatatgggagcatgcaaca

SEQ ID NO: 698627 - DNA, 22 bp, Artificial Sequence
  chemically synthesized
cccatatgggagcatgcaacat

SEQ ID NO: 698628 - DNA, 22 bp, Artificial Sequence
  chemically synthesized
tttcacctttttatgttgcatg

SEQ ID NO: 698629 - DNA, 22 bp, Artificial Sequence
  chemically synthesized
ctttcacctttttatgttgcat

SEQ ID NO: 698630 - DNA, 22 bp, Artificial Sequence
  chemically synthesized
ggatttctttcacctttttatg

SEQ ID NO: 698631 - DNA, 22 bp, Artificial Sequence
  chemically synthesized
ttaggatttctttcaccttttt

SEQ ID NO: 698632 - DNA, 22 bp, Artificial Sequence
  chemically synthesized
tgttaggatttctttcaccttt

SEQ ID NO: 698633 - DNA, 22 bp, Artificial Sequence
  chemically synthesized
cattctgttaggatttctttca

SEQ ID NO: 698634 - DNA, 22 bp, Artificial Sequence
  chemically synthesized
ctgcattctgttaggatttctt

SEQ ID NO: 698635 - DNA, 22 bp, Artificial Sequence
  chemically synthesized
accagctgctgcattctgttag

SEQ ID NO: 698636 - DNA, 22 bp, Artificial Sequence
  chemically synthesized
aaccagctgctgcattctgtta

SEQ ID NO: 698637 - DNA, 22 bp, Artificial Sequence
  chemically synthesized
taaccagctgctgcattctgtt

SEQ ID NO: 698638 - DNA, 22 bp, Artificial Sequence
  chemically synthesized
acagaatgcagcagctggttaa

SEQ ID NO: 698639 - DNA, 22 bp, Artificial Sequence
  chemically synthesized
aatataatagcctttaaccagc

SEQ ID NO: 698640 - DNA, 22 bp, Artificial Sequence
  chemically synthesized
caatataatagcctttaaccag

SEQ ID NO: 698641 - DNA, 22 bp, Artificial Sequence
  chemically synthesized
atgaaaatttcaatataatagc

SEQ ID NO: 698642 - DNA, 22 bp, Artificial Sequence
  chemically synthesized
gttaaaggctattatattgaaa

SEQ ID NO: 698643 - DNA, 22 bp, Artificial Sequence
  chemically synthesized
tcaaactcatgaaaatttcaat

SEQ ID NO: 698644 - DNA, 22 bp, Artificial Sequence
  chemically synthesized
aaggctattatattgaaatttt

SEQ ID NO: 698645 - DNA, 22 bp, Artificial Sequence
  chemically synthesized
ctgtcaaactcatgaaaatttc

SEQ ID NO: 698646 - DNA, 22 bp, Artificial Sequence
  chemically synthesized
ttatattgaaattttcatgagt

SEQ ID NO: 698647 - DNA, 22 bp, Artificial Sequence
  chemically synthesized
gcctactgtcaaactcatgaaa

SEQ ID NO: 698648 - DNA, 22 bp, Artificial Sequence
  chemically synthesized
ggcctactgtcaaactcatgaa

SEQ ID NO: 698649 - DNA, 22 bp, Artificial Sequence
  chemically synthesized
tggcctactgtcaaactcatga

SEQ ID NO: 698650 - DNA, 22 bp, Artificial Sequence
  chemically synthesized
tattgaaattttcatgagtttg

SEQ ID NO: 698651 - DNA, 22 bp, Artificial Sequence
  chemically synthesized
ttggcctactgtcaaactcatg

SEQ ID NO: 698652 - DNA, 22 bp, Artificial Sequence
  chemically synthesized
tttggcctactgtcaaactcat

SEQ ID NO: 698653 - DNA, 22 bp, Artificial Sequence
  chemically synthesized
aaattttcatgagtttgacagt

SEQ ID NO: 698654 - DNA, 22 bp, Artificial Sequence
  chemically synthesized
tagttttttggcctactgtcaa

SEQ ID NO: 698655 - DNA, 22 bp, Artificial Sequence
  chemically synthesized
gtagttttttggcctactgtca

SEQ ID NO: 698656 - DNA, 22 bp, Artificial Sequence
  chemically synthesized
tgtagttttttggcctactgtc

SEQ ID NO: 698657 - DNA, 22 bp, Artificial Sequence
  chemically synthesized
tcatgagtttgacagtaggcca

SEQ ID NO: 698658 - DNA, 22 bp, Artificial Sequence
  chemically synthesized
catgagtttgacagtaggccaa

SEQ ID NO: 698659 - DNA, 22 bp, Artificial Sequence
  chemically synthesized
atgagtttgacagtaggccaaa

SEQ ID NO: 698660 - DNA, 22 bp, Artificial Sequence
  chemically synthesized
ccattttgtagttttttggcct

SEQ ID NO: 698661 - DNA, 22 bp, Artificial Sequence
  chemically synthesized
tgccattttgtagttttttggc

SEQ ID NO: 698662 - DNA, 22 bp, Artificial Sequence
  chemically synthesized
tctgccattttgtagttttttg

SEQ ID NO: 698663 - DNA, 22 bp, Artificial Sequence
  chemically synthesized
gacagtaggccaaaaaactaca

SEQ ID NO: 698664 - DNA, 22 bp, Artificial Sequence
  chemically synthesized
acagtaggccaaaaaactacaa

SEQ ID NO: 698665 - DNA, 22 bp, Artificial Sequence
  chemically synthesized
ctctctgccattttgtagtttt

SEQ ID NO: 698666 - DNA, 22 bp, Artificial Sequence
  chemically synthesized
tactctctgccattttgtagtt

SEQ ID NO: 698667 - DNA, 22 bp, Artificial Sequence
  chemically synthesized
ctactctctgccattttgtagt

SEQ ID NO: 698668 - DNA, 22 bp, Artificial Sequence
  chemically synthesized
tctactctctgccattttgtag

SEQ ID NO: 698669 - DNA, 22 bp, Artificial Sequence
  chemically synthesized
ttctactctctgccattttgta

SEQ ID NO: 698670 - DNA, 22 bp, Artificial Sequence
  chemically synthesized
ccttttctactctctgccattt

SEQ ID NO: 698671 - DNA, 22 bp, Artificial Sequence
  chemically synthesized
caactgccttttctactctctg

SEQ ID NO: 698672 - DNA, 22 bp, Artificial Sequence
  chemically synthesized
ttacaactgccttttctactct

SEQ ID NO: 698673 - DNA, 22 bp, Artificial Sequence
  chemically synthesized
caaaatggcagagagtagaaaa

SEQ ID NO: 698674 - DNA, 22 bp, Artificial Sequence
  chemically synthesized
aacctgttacaactgccttttc

SEQ ID NO: 698675 - DNA, 22 bp, Artificial Sequence
  chemically synthesized
aaaaaataatcaccaacaatgt

SEQ ID NO: 698676 - DNA, 22 bp, Artificial Sequence
  chemically synthesized
taacaggttgaacattgttggt

SEQ ID NO: 698677 - DNA, 22 bp, Artificial Sequence
  chemically synthesized
ccactgaaaaaataatcaccaa

SEQ ID NO: 698678 - DNA, 22 bp, Artificial Sequence
  chemically synthesized
attgccactgaaaaaataatca

SEQ ID NO: 698679 - DNA, 22 bp, Artificial Sequence
  chemically synthesized
aacattgttggtgattattttt

SEQ ID NO: 698680 - DNA, 22 bp, Artificial Sequence
  chemically synthesized
cattgccactgaaaaaataatc

SEQ ID NO: 698681 - DNA, 22 bp, Artificial Sequence
  chemically synthesized
tcattgccactgaaaaaataat

SEQ ID NO: 698682 - DNA, 22 bp, Artificial Sequence
  chemically synthesized
ttggtgattattttttcagtgg

SEQ ID NO: 698683 - DNA, 22 bp, Artificial Sequence
  chemically synthesized
cagctttcattgccactgaaaa

SEQ ID NO: 698684 - DNA, 22 bp, Artificial Sequence
  chemically synthesized
gtgattattttttcagtggcaa

SEQ ID NO: 698685 - DNA, 22 bp, Artificial Sequence
  chemically synthesized
attacagctttcattgccactg

SEQ ID NO: 698686 - DNA, 22 bp, Artificial Sequence
  chemically synthesized
gattacagctttcattgccact

SEQ ID NO: 698687 - DNA, 22 bp, Artificial Sequence
  chemically synthesized
tttgattacagctttcattgcc

SEQ ID NO: 698688 - DNA, 22 bp, Artificial Sequence
  chemically synthesized
ttttttcagtggcaatgaaagc

SEQ ID NO: 698689 - DNA, 22 bp, Artificial Sequence
  chemically synthesized
tttcagtggcaatgaaagctgt

SEQ ID NO: 698690 - DNA, 22 bp, Artificial Sequence
  chemically synthesized
ttcagtggcaatgaaagctgta

SEQ ID NO: 698691 - DNA, 22 bp, Artificial Sequence
  chemically synthesized
aggttatttgattacagctttc

SEQ ID NO: 698692 - DNA, 22 bp, Artificial Sequence
  chemically synthesized
tcagtggcaatgaaagctgtaa

SEQ ID NO: 698693 - DNA, 22 bp, Artificial Sequence
  chemically synthesized
caggttatttgattacagcttt

SEQ ID NO: 698694 - DNA, 22 bp, Artificial Sequence
  chemically synthesized
cagtggcaatgaaagctgtaat

SEQ ID NO: 698695 - DNA, 22 bp, Artificial Sequence
  chemically synthesized
tcaggttatttgattacagctt

SEQ ID NO: 698696 - DNA, 22 bp, Artificial Sequence
  chemically synthesized
agtggcaatgaaagctgtaatc

SEQ ID NO: 698697 - DNA, 22 bp, Artificial Sequence
  chemically synthesized
tttcaggttatttgattacagc

SEQ ID NO: 698698 - DNA, 22 bp, Artificial Sequence
  chemically synthesized
ccagcatctctttcaggttatt

SEQ ID NO: 698699 - DNA, 22 bp, Artificial Sequence
  chemically synthesized
ctgccagcatctctttcaggtt

SEQ ID NO: 698700 - DNA, 22 bp, Artificial Sequence
  chemically synthesized
taatcaaataacctgaaagaga

SEQ ID NO: 698701 - DNA, 22 bp, Artificial Sequence
  chemically synthesized
ttcctgccagcatctctttcag

SEQ ID NO: 698702 - DNA, 22 bp, Artificial Sequence
  chemically synthesized
attcctgccagcatctctttca

SEQ ID NO: 698703 - DNA, 22 bp, Artificial Sequence
  chemically synthesized
ccttattcctgccagcatctct

SEQ ID NO: 698704 - DNA, 22 bp, Artificial Sequence
  chemically synthesized
gggctcccttattcctgccagc

SEQ ID NO: 698705 - DNA, 22 bp, Artificial Sequence
  chemically synthesized
ggggctcccttattcctgccag

SEQ ID NO: 698706 - DNA, 22 bp, Artificial Sequence
  chemically synthesized
aaagagatgctggcaggaataa

SEQ ID NO: 698707 - DNA, 22 bp, Artificial Sequence
  chemically synthesized
ccttggggctcccttattcctg

SEQ ID NO: 698708 - DNA, 22 bp, Artificial Sequence
  chemically synthesized
tcccttggggctcccttattcc

SEQ ID NO: 698709 - DNA, 22 bp, Artificial Sequence
  chemically synthesized
cctctcccttggggctccctta

SEQ ID NO: 698710 - DNA, 22 bp, Artificial Sequence
  chemically synthesized
gcaggaataagggagccccaag

SEQ ID NO: 698711 - DNA, 22 bp, Artificial Sequence
  chemically synthesized
atattccctctcccttggggct

SEQ ID NO: 698712 - DNA, 22 bp, Artificial Sequence
  chemically synthesized
catattccctctcccttggggc

SEQ ID NO: 698713 - DNA, 22 bp, Artificial Sequence
  chemically synthesized
tcatattccctctcccttgggg

SEQ ID NO: 698714 - DNA, 22 bp, Artificial Sequence
  chemically synthesized
cagttttcatattccctctccc

SEQ ID NO: 698715 - DNA, 22 bp, Artificial Sequence
  chemically synthesized
ttacagttttcatattccctct

SEQ ID NO: 698716 - DNA, 22 bp, Artificial Sequence
  chemically synthesized
tccacagcatacatcattgtta

SEQ ID NO: 698717 - DNA, 22 bp, Artificial Sequence
  chemically synthesized
gtccacagcatacatcattgtt

SEQ ID NO: 698718 - DNA, 22 bp, Artificial Sequence
  chemically synthesized
tttgtccacagcatacatcatt

SEQ ID NO: 698719 - DNA, 22 bp, Artificial Sequence
  chemically synthesized
atttgtccacagcatacatcat

SEQ ID NO: 698720 - DNA, 22 bp, Artificial Sequence
  chemically synthesized
gtttatttgtccacagcataca

SEQ ID NO: 698721 - DNA, 22 bp, Artificial Sequence
  chemically synthesized
taacaatgatgtatgctgtgga

SEQ ID NO: 698722 - DNA, 22 bp, Artificial Sequence
  chemically synthesized
tctagtttatttgtccacagca

SEQ ID NO: 698723 - DNA, 22 bp, Artificial Sequence
  chemically synthesized
gtctagtttatttgtccacagc

SEQ ID NO: 698724 - DNA, 22 bp, Artificial Sequence
  chemically synthesized
cgtgtttgtctagtttatttgt

SEQ ID NO: 698725 - DNA, 22 bp, Artificial Sequence
  chemically synthesized
aaactacgtgtttgtctagttt

SEQ ID NO: 698726 - DNA, 22 bp, Artificial Sequence
  chemically synthesized
caaactacgtgtttgtctagtt

SEQ ID NO: 698727 - DNA, 22 bp, Artificial Sequence
  chemically synthesized
tggacaaataaactagacaaac

SEQ ID NO: 698728 - DNA, 22 bp, Artificial Sequence
  chemically synthesized
atacttcaaactacgtgtttgt

SEQ ID NO: 698729 - DNA, 22 bp, Artificial Sequence
  chemically synthesized
gatacttcaaactacgtgtttg

SEQ ID NO: 698730 - DNA, 22 bp, Artificial Sequence
  chemically synthesized
tgatacttcaaactacgtgttt

SEQ ID NO: 698731 - DNA, 22 bp, Artificial Sequence
  chemically synthesized
attttgatacttcaaactacgt

SEQ ID NO: 698732 - DNA, 22 bp, Artificial Sequence
  chemically synthesized
gattttgatacttcaaactacg

SEQ ID NO: 698733 - DNA, 22 bp, Artificial Sequence
  chemically synthesized
gacaaacacgtagtttgaagta

SEQ ID NO: 698734 - DNA, 22 bp, Artificial Sequence
  chemically synthesized
agaaccttgattttgatacttc

SEQ ID NO: 698735 - DNA, 22 bp, Artificial Sequence
  chemically synthesized
atatgaggctaagaaccttgat

SEQ ID NO: 698736 - DNA, 22 bp, Artificial Sequence
  chemically synthesized
gaagtatcaaaatcaaggttct

SEQ ID NO: 698737 - DNA, 22 bp, Artificial Sequence
  chemically synthesized
catatgaggctaagaaccttga

SEQ ID NO: 698738 - DNA, 22 bp, Artificial Sequence
  chemically synthesized
aagtatcaaaatcaaggttctt

SEQ ID NO: 698739 - DNA, 22 bp, Artificial Sequence
  chemically synthesized
tcatatgaggctaagaaccttg

SEQ ID NO: 698740 - DNA, 22 bp, Artificial Sequence
  chemically synthesized
ttcatatgaggctaagaacctt

SEQ ID NO: 698741 - DNA, 22 bp, Artificial Sequence
  chemically synthesized
acatcagcttttcatatgaggc

SEQ ID NO: 698742 - DNA, 22 bp, Artificial Sequence
  chemically synthesized
catcctgacatcagcttttcat

SEQ ID NO: 698743 - DNA, 22 bp, Artificial Sequence
  chemically synthesized
ttagcctcatatgaaaagctga

SEQ ID NO: 698744 - DNA, 22 bp, Artificial Sequence
  chemically synthesized
agcctcatatgaaaagctgatg

SEQ ID NO: 698745 - DNA, 22 bp, Artificial Sequence
  chemically synthesized
gcctcatatgaaaagctgatgt

SEQ ID NO: 698746 - DNA, 22 bp, Artificial Sequence
  chemically synthesized
tgcctgcatcctgacatcagct

SEQ ID NO: 698747 - DNA, 22 bp, Artificial Sequence
  chemically synthesized
atgcctgcatcctgacatcagc

SEQ ID NO: 698748 - DNA, 22 bp, Artificial Sequence
  chemically synthesized
atatgaaaagctgatgtcagga

SEQ ID NO: 698749 - DNA, 22 bp, Artificial Sequence
  chemically synthesized
atgtcaggatgcaggcataaac

SEQ ID NO: 698750 - DNA, 22 bp, Artificial Sequence
  chemically synthesized
caaatcaggcagtgtttatgcc

SEQ ID NO: 698751 - DNA, 22 bp, Artificial Sequence
  chemically synthesized
gcaaatcaggcagtgtttatgc

SEQ ID NO: 698752 - DNA, 22 bp, Artificial Sequence
  chemically synthesized
gtttgcaaatcaggcagtgttt

SEQ ID NO: 698753 - DNA, 22 bp, Artificial Sequence
  chemically synthesized
tagtttgcaaatcaggcagtgt

SEQ ID NO: 698754 - DNA, 22 bp, Artificial Sequence
  chemically synthesized
ctctagtttgcaaatcaggcag

SEQ ID NO: 698755 - DNA, 22 bp, Artificial Sequence
  chemically synthesized
gctctagtttgcaaatcaggca

SEQ ID NO: 698756 - DNA, 22 bp, Artificial Sequence
  chemically synthesized
tgctctagtttgcaaatcaggc

SEQ ID NO: 698757 - DNA, 22 bp, Artificial Sequence
  chemically synthesized
ttgctctagtttgcaaatcagg

SEQ ID NO: 698758 - DNA, 22 bp, Artificial Sequence
  chemically synthesized
acatcttttgctctagtttgca

SEQ ID NO: 698759 - DNA, 22 bp, Artificial Sequence
  chemically synthesized
cctgatttgcaaactagagcaa

SEQ ID NO: 698760 - DNA, 22 bp, Artificial Sequence
  chemically synthesized
agtcattaacatcttttgctct

SEQ ID NO: 698761 - DNA, 22 bp, Artificial Sequence
  chemically synthesized
atttgcaaactagagcaaaaga

SEQ ID NO: 698762 - DNA, 22 bp, Artificial Sequence
  chemically synthesized
aagtcattaacatcttttgctc

SEQ ID NO: 698763 - DNA, 22 bp, Artificial Sequence
  chemically synthesized
taagtcattaacatcttttgct

SEQ ID NO: 698764 - DNA, 22 bp, Artificial Sequence
  chemically synthesized
gcaaactagagcaaaagatgtt

SEQ ID NO: 698765 - DNA, 22 bp, Artificial Sequence
  chemically synthesized
caaactagagcaaaagatgtta

SEQ ID NO: 698766 - DNA, 22 bp, Artificial Sequence
  chemically synthesized
agattttaagtcattaacatct

SEQ ID NO: 698767 - DNA, 22 bp, Artificial Sequence
  chemically synthesized
gagattttaagtcattaacatc

SEQ ID NO: 698768 - DNA, 22 bp, Artificial Sequence
  chemically synthesized
ttgagattttaagtcattaaca

SEQ ID NO: 698769 - DNA, 22 bp, Artificial Sequence
  chemically synthesized
gagcaaaagatgttaatgactt

SEQ ID NO: 698770 - DNA, 22 bp, Artificial Sequence
  chemically synthesized
attcttgagattttaagtcatt

SEQ ID NO: 698771 - DNA, 22 bp, Artificial Sequence
  chemically synthesized
tgcactcattcttgagatttta

SEQ ID NO: 698772 - DNA, 22 bp, Artificial Sequence
  chemically synthesized
aattgtgcactcattcttgaga

SEQ ID NO: 698773 - DNA, 22 bp, Artificial Sequence
  chemically synthesized
atgacttaaaatctcaagaatg

SEQ ID NO: 698774 - DNA, 22 bp, Artificial Sequence
  chemically synthesized
ttgaattgtgcactcattcttg

SEQ ID NO: 698775 - DNA, 22 bp, Artificial Sequence
  chemically synthesized
gttgttgaattgtgcactcatt

SEQ ID NO: 698776 - DNA, 22 bp, Artificial Sequence
  chemically synthesized
aaaatctcaagaatgagtgcac

SEQ ID NO: 698777 - DNA, 22 bp, Artificial Sequence
  chemically synthesized
aaatctcaagaatgagtgcaca

SEQ ID NO: 698778 - DNA, 22 bp, Artificial Sequence
  chemically synthesized
ttggttgttgaattgtgcactc

SEQ ID NO: 698779 - DNA, 22 bp, Artificial Sequence
  chemically synthesized
ctgttggttgttgaattgtgca

SEQ ID NO: 698780 - DNA, 22 bp, Artificial Sequence
  chemically synthesized
aagaatgagtgcacaattcaac

SEQ ID NO: 698781 - DNA, 22 bp, Artificial Sequence
  chemically synthesized
taccagtggcacagttcctgtt

SEQ ID NO: 698782 - DNA, 22 bp, Artificial Sequence
  chemically synthesized
tataccagtggcacagttcctg

SEQ ID NO: 698783 - DNA, 22 bp, Artificial Sequence
  chemically synthesized
ctataccagtggcacagttcct

SEQ ID NO: 698784 - DNA, 22 bp, Artificial Sequence
  chemically synthesized
aacaaccaacaggaactgtgcc

SEQ ID NO: 698785 - DNA, 22 bp, Artificial Sequence
  chemically synthesized
tgccactggtatagaaacctct

SEQ ID NO: 698786 - DNA, 22 bp, Artificial Sequence
  chemically synthesized
gtatagaaacctcttgttatgt

SEQ ID NO: 698787 - DNA, 22 bp, Artificial Sequence
  chemically synthesized
ggataaagggatcgcccacata

SEQ ID NO: 698788 - DNA, 22 bp, Artificial Sequence
  chemically synthesized
aatgctgggataaagggatcgc

SEQ ID NO: 698789 - DNA, 22 bp, Artificial Sequence
  chemically synthesized
ttgttatgtgggcgatcccttt

SEQ ID NO: 698790 - DNA, 22 bp, Artificial Sequence
  chemically synthesized
caatgctgggataaagggatcg

SEQ ID NO: 698791 - DNA, 22 bp, Artificial Sequence
  chemically synthesized
tcaatgctgggataaagggatc

SEQ ID NO: 698792 - DNA, 22 bp, Artificial Sequence
  chemically synthesized
gttatgtgggcgatccctttat

SEQ ID NO: 698793 - DNA, 22 bp, Artificial Sequence
  chemically synthesized
ttcaatgctgggataaagggat

SEQ ID NO: 698794 - DNA, 22 bp, Artificial Sequence
  chemically synthesized
ttatgtgggcgatccctttatc

SEQ ID NO: 698795 - DNA, 22 bp, Artificial Sequence
  chemically synthesized
ttttcaatgctgggataaaggg

SEQ ID NO: 698796 - DNA, 22 bp, Artificial Sequence
  chemically synthesized
cttttcaatgctgggataaagg

SEQ ID NO: 698797 - DNA, 22 bp, Artificial Sequence
  chemically synthesized
tgtgggcgatccctttatccca

SEQ ID NO: 698798 - DNA, 22 bp, Artificial Sequence
  chemically synthesized
tcttttcaatgctgggataaag

SEQ ID NO: 698799 - DNA, 22 bp, Artificial Sequence
  chemically synthesized
ttcttttcaatgctgggataaa

SEQ ID NO: 698800 - DNA, 22 bp, Artificial Sequence
  chemically synthesized
tttcttttcaatgctgggataa

SEQ ID NO: 698801 - DNA, 22 bp, Artificial Sequence
  chemically synthesized
taactttttcttttcaatgctg

SEQ ID NO: 698802 - DNA, 22 bp, Artificial Sequence
  chemically synthesized
gtaactttttcttttcaatgct

SEQ ID NO: 698803 - DNA, 22 bp, Artificial Sequence
  chemically synthesized
tgtaactttttcttttcaatgc

SEQ ID NO: 698804 - DNA, 22 bp, Artificial Sequence
  chemically synthesized
tatcccagcattgaaaagaaaa

SEQ ID NO: 698805 - DNA, 22 bp, Artificial Sequence
  chemically synthesized
atcccagcattgaaaagaaaaa

SEQ ID NO: 698806 - DNA, 22 bp, Artificial Sequence
  chemically synthesized
atgctttgtaactttttctttt

SEQ ID NO: 698807 - DNA, 22 bp, Artificial Sequence
  chemically synthesized
tcccagcattgaaaagaaaaag

SEQ ID NO: 698808 - DNA, 22 bp, Artificial Sequence
  chemically synthesized
aatgctttgtaactttttcttt

SEQ ID NO: 698809 - DNA, 22 bp, Artificial Sequence
  chemically synthesized
taatgctttgtaactttttctt

SEQ ID NO: 698810 - DNA, 22 bp, Artificial Sequence
  chemically synthesized
ttaatgctttgtaactttttct

SEQ ID NO: 698811 - DNA, 22 bp, Artificial Sequence
  chemically synthesized
tgtttttaatgctttgtaactt

SEQ ID NO: 698812 - DNA, 22 bp, Artificial Sequence
  chemically synthesized
aaaagaaaaagttacaaagcat

SEQ ID NO: 698813 - DNA, 22 bp, Artificial Sequence
  chemically synthesized
gctatgtttttaatgctttgta

SEQ ID NO: 698814 - DNA, 22 bp, Artificial Sequence
  chemically synthesized
tggctatgtttttaatgctttg

SEQ ID NO: 698815 - DNA, 22 bp, Artificial Sequence
  chemically synthesized
tctggctatgtttttaatgctt

SEQ ID NO: 698816 - DNA, 22 bp, Artificial Sequence
  chemically synthesized
ctctggctatgtttttaatgct

SEQ ID NO: 698817 - DNA, 22 bp, Artificial Sequence
  chemically synthesized
caaagcattaaaaacatagcca

SEQ ID NO: 698818 - DNA, 22 bp, Artificial Sequence
  chemically synthesized
caaaaccaggtgtcttctctgg

SEQ ID NO: 698819 - DNA, 22 bp, Artificial Sequence
  chemically synthesized
aaaacatagccagagaagacac

SEQ ID NO: 698820 - DNA, 22 bp, Artificial Sequence
  chemically synthesized
ccacagatgcccagctgcaaaa

SEQ ID NO: 698821 - DNA, 22 bp, Artificial Sequence
  chemically synthesized
accacagatgcccagctgcaaa

SEQ ID NO: 698822 - DNA, 22 bp, Artificial Sequence
  chemically synthesized
taccacagatgcccagctgcaa

SEQ ID NO: 698823 - DNA, 22 bp, Artificial Sequence
  chemically synthesized
ttaccacagatgcccagctgca

SEQ ID NO: 698824 - DNA, 22 bp, Artificial Sequence
  chemically synthesized
gttttgcagctgggcatctgtg

SEQ ID NO: 698825 - DNA, 22 bp, Artificial Sequence
  chemically synthesized
tgcagctgggcatctgtggtaa

SEQ ID NO: 698826 - DNA, 22 bp, Artificial Sequence
  chemically synthesized
gcagctgggcatctgtggtaaa

SEQ ID NO: 698827 - DNA, 22 bp, Artificial Sequence
  chemically synthesized
cagtcaagagtttttaccacag

SEQ ID NO: 698828 - DNA, 22 bp, Artificial Sequence
  chemically synthesized
cagctgggcatctgtggtaaaa

SEQ ID NO: 698829 - DNA, 22 bp, Artificial Sequence
  chemically synthesized
ccagtcaagagtttttaccaca

SEQ ID NO: 698830 - DNA, 22 bp, Artificial Sequence
  chemically synthesized
acttccagtcaagagtttttac

SEQ ID NO: 698831 - DNA, 22 bp, Artificial Sequence
  chemically synthesized
gacttccagtcaagagttttta

SEQ ID NO: 698832 - DNA, 22 bp, Artificial Sequence
  chemically synthesized
ggcatctgtggtaaaaactctt

SEQ ID NO: 698833 - DNA, 22 bp, Artificial Sequence
  chemically synthesized
tcttgacttccagtcaagagtt

SEQ ID NO: 698834 - DNA, 22 bp, Artificial Sequence
  chemically synthesized
gtcttgacttccagtcaagagt

SEQ ID NO: 698835 - DNA, 22 bp, Artificial Sequence
  chemically synthesized
tttgtcttgacttccagtcaag

SEQ ID NO: 698836 - DNA, 22 bp, Artificial Sequence
  chemically synthesized
tggtaaaaactcttgactggaa

SEQ ID NO: 698837 - DNA, 22 bp, Artificial Sequence
  chemically synthesized
gtttgtcttgacttccagtcaa

SEQ ID NO: 698838 - DNA, 22 bp, Artificial Sequence
  chemically synthesized
tcttgtttgtcttgacttccag

SEQ ID NO: 698839 - DNA, 22 bp, Artificial Sequence
  chemically synthesized
atcttgtttgtcttgacttcca

SEQ ID NO: 698840 - DNA, 22 bp, Artificial Sequence
  chemically synthesized
tatcttgtttgtcttgacttcc

SEQ ID NO: 698841 - DNA, 22 bp, Artificial Sequence
  chemically synthesized
ttatcttgtttgtcttgacttc

SEQ ID NO: 698842 - DNA, 22 bp, Artificial Sequence
  chemically synthesized
tttatcttgtttgtcttgactt

SEQ ID NO: 698843 - DNA, 22 bp, Artificial Sequence
  chemically synthesized
ttttatcttgtttgtcttgact

SEQ ID NO: 698844 - DNA, 22 bp, Artificial Sequence
  chemically synthesized
ttttttatcttgtttgtcttga

SEQ ID NO: 698845 - DNA, 22 bp, Artificial Sequence
  chemically synthesized
ttgactggaagtcaagacaaac

SEQ ID NO: 698846 - DNA, 22 bp, Artificial Sequence
  chemically synthesized
gactggaagtcaagacaaacaa

SEQ ID NO: 698847 - DNA, 22 bp, Artificial Sequence
  chemically synthesized
ctcttttttatcttgtttgtct

SEQ ID NO: 698848 - DNA, 22 bp, Artificial Sequence
  chemically synthesized
actggaagtcaagacaaacaag

SEQ ID NO: 698849 - DNA, 22 bp, Artificial Sequence
  chemically synthesized
cctcttttttatcttgtttgtc

SEQ ID NO: 698850 - DNA, 22 bp, Artificial Sequence
  chemically synthesized
tcctcttttttatcttgtttgt

SEQ ID NO: 698851 - DNA, 22 bp, Artificial Sequence
  chemically synthesized
ttcctcttttttatcttgtttg

SEQ ID NO: 698852 - DNA, 22 bp, Artificial Sequence
  chemically synthesized
gaagtcaagacaaacaagataa

SEQ ID NO: 698853 - DNA, 22 bp, Artificial Sequence
  chemically synthesized
atttttcctcttttttatcttg

SEQ ID NO: 698854 - DNA, 22 bp, Artificial Sequence
  chemically synthesized
aaccagtcctcatttttcctct

SEQ ID NO: 698855 - DNA, 22 bp, Artificial Sequence
  chemically synthesized
caaccagtcctcatttttcctc

SEQ ID NO: 698856 - DNA, 22 bp, Artificial Sequence
  chemically synthesized
cagtgacagtgcttcaaccagt

SEQ ID NO: 698857 - DNA, 22 bp, Artificial Sequence
  chemically synthesized
acagtgacagtgcttcaaccag

SEQ ID NO: 698858 - DNA, 22 bp, Artificial Sequence
  chemically synthesized
gttgaagcactgtcactgtaaa

SEQ ID NO: 698859 - DNA, 22 bp, Artificial Sequence
  chemically synthesized
aagcactgtcactgtaaacgta

SEQ ID NO: 698860 - DNA, 22 bp, Artificial Sequence
  chemically synthesized
aaaagaacaaaaatacgtttac

SEQ ID NO: 698861 - DNA, 22 bp, Artificial Sequence
  chemically synthesized
gtctaaaaagaacaaaaatacg

SEQ ID NO: 698862 - DNA, 22 bp, Artificial Sequence
  chemically synthesized
ggtctaaaaagaacaaaaatac

SEQ ID NO: 698863 - DNA, 22 bp, Artificial Sequence
  chemically synthesized
tcactgtaaacgtatttttgtt

SEQ ID NO: 698864 - DNA, 22 bp, Artificial Sequence
  chemically synthesized
taaacgtatttttgttcttttt

SEQ ID NO: 698865 - DNA, 22 bp, Artificial Sequence
  chemically synthesized
agatgccgtcttggtctaaaaa

SEQ ID NO: 698866 - DNA, 22 bp, Artificial Sequence
  chemically synthesized
ttgttctttttagaccaagacg

SEQ ID NO: 698867 - DNA, 22 bp, Artificial Sequence
  chemically synthesized
tgttctttttagaccaagacgg

SEQ ID NO: 698868 - DNA, 22 bp, Artificial Sequence
  chemically synthesized
gttctttttagaccaagacggc

SEQ ID NO: 698869 - DNA, 22 bp, Artificial Sequence
  chemically synthesized
ataatctgagatgccgtcttgg

SEQ ID NO: 698870 - DNA, 22 bp, Artificial Sequence
  chemically synthesized
ttctttttagaccaagacggca

SEQ ID NO: 698871 - DNA, 22 bp, Artificial Sequence
  chemically synthesized
tttttagaccaagacggcatct

SEQ ID NO: 698872 - DNA, 22 bp, Artificial Sequence
  chemically synthesized
tttagaccaagacggcatctca

SEQ ID NO: 698873 - DNA, 22 bp, Artificial Sequence
  chemically synthesized
ttagaccaagacggcatctcag

SEQ ID NO: 698874 - DNA, 22 bp, Artificial Sequence
  chemically synthesized
tagaccaagacggcatctcaga

SEQ ID NO: 698875 - DNA, 22 bp, Artificial Sequence
  chemically synthesized
agaccaagacggcatctcagat

SEQ ID NO: 698876 - DNA, 22 bp, Artificial Sequence
  chemically synthesized
atgccgttcataatctgagatg

SEQ ID NO: 698877 - DNA, 22 bp, Artificial Sequence
  chemically synthesized
gaccaagacggcatctcagatt

SEQ ID NO: 698878 - DNA, 22 bp, Artificial Sequence
  chemically synthesized
aatgccgttcataatctgagat

SEQ ID NO: 698879 - DNA, 22 bp, Artificial Sequence
  chemically synthesized
tgcacagcttaatgccgttcat

SEQ ID NO: 698880 - DNA, 22 bp, Artificial Sequence
  chemically synthesized
atgcacagcttaatgccgttca

SEQ ID NO: 698881 - DNA, 22 bp, Artificial Sequence
  chemically synthesized
tatgcacagcttaatgccgttc

SEQ ID NO: 698882 - DNA, 22 bp, Artificial Sequence
  chemically synthesized
agattatgaacggcattaagct

SEQ ID NO: 698883 - DNA, 22 bp, Artificial Sequence
  chemically synthesized
ggtggactttatgcacagctta

SEQ ID NO: 698884 - DNA, 22 bp, Artificial Sequence
  chemically synthesized
tgaacggcattaagctgtgcat

SEQ ID NO: 698885 - DNA, 22 bp, Artificial Sequence
  chemically synthesized
atgtacaaggttcggtggactt

SEQ ID NO: 698886 - DNA, 22 bp, Artificial Sequence
  chemically synthesized
agctgtgcataaagtccaccga

SEQ ID NO: 698887 - DNA, 22 bp, Artificial Sequence
  chemically synthesized
gatgtacaaggttcggtggact

SEQ ID NO: 698888 - DNA, 22 bp, Artificial Sequence
  chemically synthesized
atttgatgtacaaggttcggtg

SEQ ID NO: 698889 - DNA, 22 bp, Artificial Sequence
  chemically synthesized
tgcataaagtccaccgaacctt

SEQ ID NO: 698890 - DNA, 22 bp, Artificial Sequence
  chemically synthesized
tggaaaccaaattaatttgatg

SEQ ID NO: 698891 - DNA, 22 bp, Artificial Sequence
  chemically synthesized
tatggaaaccaaattaatttga

SEQ ID NO: 698892 - DNA, 22 bp, Artificial Sequence
  chemically synthesized
gtacatcaaattaatttggttt

SEQ ID NO: 698893 - DNA, 22 bp, Artificial Sequence
  chemically synthesized
tacatcaaattaatttggtttc

SEQ ID NO: 698894 - DNA, 22 bp, Artificial Sequence
  chemically synthesized
aaatgttctatggaaaccaaat

SEQ ID NO: 698895 - DNA, 22 bp, Artificial Sequence
  chemically synthesized
tctaaaatgttctatggaaacc

SEQ ID NO: 698896 - DNA, 22 bp, Artificial Sequence
  chemically synthesized
ttatctaaaatgttctatggaa

SEQ ID NO: 698897 - DNA, 22 bp, Artificial Sequence
  chemically synthesized
ctattatctaaaatgttctatg

SEQ ID NO: 698898 - DNA, 22 bp, Artificial Sequence
  chemically synthesized
atttggtttccatagaacattt

SEQ ID NO: 698899 - DNA, 22 bp, Artificial Sequence
  chemically synthesized
ggtttccatagaacattttaga

SEQ ID NO: 698900 - DNA, 22 bp, Artificial Sequence
  chemically synthesized
gtttccatagaacattttagat

SEQ ID NO: 698901 - DNA, 22 bp, Artificial Sequence
  chemically synthesized
gccattactattatctaaaatg

SEQ ID NO: 698902 - DNA, 22 bp, Artificial Sequence
  chemically synthesized
ttagccattactattatctaaa

SEQ ID NO: 698903 - DNA, 22 bp, Artificial Sequence
  chemically synthesized
ccatagaacattttagataata

SEQ ID NO: 698904 - DNA, 22 bp, Artificial Sequence
  chemically synthesized
attagccattactattatctaa

SEQ ID NO: 698905 - DNA, 22 bp, Artificial Sequence
  chemically synthesized
catagaacattttagataatag

SEQ ID NO: 698906 - DNA, 22 bp, Artificial Sequence
  chemically synthesized
tgtcttattagccattactatt

SEQ ID NO: 698907 - DNA, 22 bp, Artificial Sequence
  chemically synthesized
gtgtcttattagccattactat

SEQ ID NO: 698908 - DNA, 22 bp, Artificial Sequence
  chemically synthesized
tagataatagtaatggctaata

SEQ ID NO: 698909 - DNA, 22 bp, Artificial Sequence
  chemically synthesized
agataatagtaatggctaataa

SEQ ID NO: 698910 - DNA, 22 bp, Artificial Sequence
  chemically synthesized
gataatagtaatggctaataag

SEQ ID NO: 698911 - DNA, 22 bp, Artificial Sequence
  chemically synthesized
atggcacttgtgtcttattagc

SEQ ID NO: 698912 - DNA, 22 bp, Artificial Sequence
  chemically synthesized
ataagacacaagtgccattaat

SEQ ID NO: 698913 - DNA, 22 bp, Artificial Sequence
  chemically synthesized
tcagtaagcagatgattaatgg

SEQ ID NO: 698914 - DNA, 22 bp, Artificial Sequence
  chemically synthesized
taaaatgaacattgtcagtaag

SEQ ID NO: 698915 - DNA, 22 bp, Artificial Sequence
  chemically synthesized
ataaaatgaacattgtcagtaa

SEQ ID NO: 698916 - DNA, 22 bp, Artificial Sequence
  chemically synthesized
atcatctgcttactgacaatgt

SEQ ID NO: 698917 - DNA, 22 bp, Artificial Sequence
  chemically synthesized
cttactgacaatgttcatttta

SEQ ID NO: 698918 - DNA, 22 bp, Artificial Sequence
  chemically synthesized
actgacaatgttcattttataa

SEQ ID NO: 698919 - DNA, 22 bp, Artificial Sequence
  chemically synthesized
ctgacaatgttcattttataaa

SEQ ID NO: 698920 - DNA, 22 bp, Artificial Sequence
  chemically synthesized
acaatgttcattttataaacat

SEQ ID NO: 698921 - DNA, 22 bp, Artificial Sequence
  chemically synthesized
taatatagggaaaacatacatg

SEQ ID NO: 698922 - DNA, 22 bp, Artificial Sequence
  chemically synthesized
attttataaacatgtatgtttt

SEQ ID NO: 698923 - DNA, 22 bp, Artificial Sequence
  chemically synthesized
aactgtaatatagggaaaacat

SEQ ID NO: 698924 - DNA, 22 bp, Artificial Sequence
  chemically synthesized
tataaacatgtatgttttccct

SEQ ID NO: 698925 - DNA, 22 bp, Artificial Sequence
  chemically synthesized
ataaacatgtatgttttcccta

SEQ ID NO: 698926 - DNA, 22 bp, Artificial Sequence
  chemically synthesized
taaacatgtatgttttccctat

SEQ ID NO: 698927 - DNA, 22 bp, Artificial Sequence
  chemically synthesized
tccctatattacagtttaacat

SEQ ID NO: 698928 - DNA, 22 bp, Artificial Sequence
  chemically synthesized
ccctatattacagtttaacatt

SEQ ID NO: 698929 - DNA, 22 bp, Artificial Sequence
  chemically synthesized
cctatattacagtttaacattt

SEQ ID NO: 698930 - DNA, 22 bp, Artificial Sequence
  chemically synthesized
aaatatgagtgtaaaatgttaa

SEQ ID NO: 698931 - DNA, 22 bp, Artificial Sequence
  chemically synthesized
tcaaatatgagtgtaaaatgtt

SEQ ID NO: 698932 - DNA, 22 bp, Artificial Sequence
  chemically synthesized
tattacagtttaacattttaca

SEQ ID NO: 698933 - DNA, 22 bp, Artificial Sequence
  chemically synthesized
ctcaaatatgagtgtaaaatgt

SEQ ID NO: 698934 - DNA, 22 bp, Artificial Sequence
  chemically synthesized
cagtttaacattttacactcat

SEQ ID NO: 698935 - DNA, 22 bp, Artificial Sequence
  chemically synthesized
aacattttacactcatatttga

SEQ ID NO: 698936 - DNA, 22 bp, Artificial Sequence
  chemically synthesized
acattttacactcatatttgag

SEQ ID NO: 698937 - DNA, 22 bp, Artificial Sequence
  chemically synthesized
gggatggtataatttctcaaat

SEQ ID NO: 698938 - DNA, 22 bp, Artificial Sequence
  chemically synthesized
tacactcatatttgagaaatta

SEQ ID NO: 698939 - DNA, 22 bp, Artificial Sequence
  chemically synthesized
acactcatatttgagaaattat

SEQ ID NO: 698940 - DNA, 22 bp, Artificial Sequence
  chemically synthesized
cactcatatttgagaaattata

SEQ ID NO: 698941 - DNA, 22 bp, Artificial Sequence
  chemically synthesized
aaattagggatggtataatttc

SEQ ID NO: 698942 - DNA, 22 bp, Artificial Sequence
  chemically synthesized
gaaattagggatggtataattt

SEQ ID NO: 698943 - DNA, 22 bp, Artificial Sequence
  chemically synthesized
tgaaattagggatggtataatt

SEQ ID NO: 698944 - DNA, 22 bp, Artificial Sequence
  chemically synthesized
atatttgagaaattataccatc

SEQ ID NO: 698945 - DNA, 22 bp, Artificial Sequence
  chemically synthesized
tttgaaattagggatggtataa

SEQ ID NO: 698946 - DNA, 22 bp, Artificial Sequence
  chemically synthesized
gagaaattataccatccctaat

SEQ ID NO: 698947 - DNA, 22 bp, Artificial Sequence
  chemically synthesized
agaaattataccatccctaatt

SEQ ID NO: 698948 - DNA, 22 bp, Artificial Sequence
  chemically synthesized
taatctctttgaaattagggat

SEQ ID NO: 698949 - DNA, 22 bp, Artificial Sequence
  chemically synthesized
caattataatctctttgaaatt

SEQ ID NO: 698950 - DNA, 22 bp, Artificial Sequence
  chemically synthesized
taccatccctaatttcaaagag

SEQ ID NO: 698951 - DNA, 22 bp, Artificial Sequence
  chemically synthesized
tacaattataatctctttgaaa

SEQ ID NO: 698952 - DNA, 22 bp, Artificial Sequence
  chemically synthesized
tctacaattataatctctttga

SEQ ID NO: 698953 - DNA, 22 bp, Artificial Sequence
  chemically synthesized
tctctacaattataatctcttt

SEQ ID NO: 698954 - DNA, 22 bp, Artificial Sequence
  chemically synthesized
atttcaaagagattataattgt

SEQ ID NO: 698955 - DNA, 22 bp, Artificial Sequence
  chemically synthesized
caaagagattataattgtagag

SEQ ID NO: 698956 - DNA, 22 bp, Artificial Sequence
  chemically synthesized
aaagagattataattgtagaga

SEQ ID NO: 698957 - DNA, 22 bp, Artificial Sequence
  chemically synthesized
tggagagcaattctctctacaa

SEQ ID NO: 698958 - DNA, 22 bp, Artificial Sequence
  chemically synthesized
atggagagcaattctctctaca

SEQ ID NO: 698959 - DNA, 22 bp, Artificial Sequence
  chemically synthesized
aaaccttatggagagcaattct

SEQ ID NO: 698960 - DNA, 22 bp, Artificial Sequence
  chemically synthesized
taattgtagagagaattgctct

SEQ ID NO: 698961 - DNA, 22 bp, Artificial Sequence
  chemically synthesized
tgaaaccttatggagagcaatt

SEQ ID NO: 698962 - DNA, 22 bp, Artificial Sequence
  chemically synthesized
tagagagaattgctctccataa

SEQ ID NO: 698963 - DNA, 22 bp, Artificial Sequence
  chemically synthesized
aaaaatatctctgaaaccttat

SEQ ID NO: 698964 - DNA, 22 bp, Artificial Sequence
  chemically synthesized
tcaaaaatatctctgaaacctt

SEQ ID NO: 698965 - DNA, 22 bp, Artificial Sequence
  chemically synthesized
ctcaaaaatatctctgaaacct

SEQ ID NO: 698966 - DNA, 22 bp, Artificial Sequence
  chemically synthesized
ctctccataaggtttcagagat

SEQ ID NO: 698967 - DNA, 22 bp, Artificial Sequence
  chemically synthesized
tccataaggtttcagagatatt

SEQ ID NO: 698968 - DNA, 22 bp, Artificial Sequence
  chemically synthesized
cataaggtttcagagatatttt

SEQ ID NO: 698969 - DNA, 22 bp, Artificial Sequence
  chemically synthesized
cgtaatttctcaaaaatatctc

SEQ ID NO: 698970 - DNA, 22 bp, Artificial Sequence
  chemically synthesized
cagagatatttttgagaaatta

SEQ ID NO: 698971 - DNA, 22 bp, Artificial Sequence
  chemically synthesized
agagatatttttgagaaattac

SEQ ID NO: 698972 - DNA, 22 bp, Artificial Sequence
  chemically synthesized
aaatgaggaaattacgtaattt

SEQ ID NO: 698973 - DNA, 22 bp, Artificial Sequence
  chemically synthesized
gaaatgaggaaattacgtaatt

SEQ ID NO: 698974 - DNA, 22 bp, Artificial Sequence
  chemically synthesized
cttgaaatgaggaaattacgta

SEQ ID NO: 698975 - DNA, 22 bp, Artificial Sequence
  chemically synthesized
ttgagaaattacgtaatttcct

SEQ ID NO: 698976 - DNA, 22 bp, Artificial Sequence
  chemically synthesized
tgagaaattacgtaatttcctc

SEQ ID NO: 698977 - DNA, 22 bp, Artificial Sequence
  chemically synthesized
gagaaattacgtaatttcctca

SEQ ID NO: 698978 - DNA, 22 bp, Artificial Sequence
  chemically synthesized
agaaattacgtaatttcctcat

SEQ ID NO: 698979 - DNA, 22 bp, Artificial Sequence
  chemically synthesized
aaataatcagttccttgaaatg

SEQ ID NO: 698980 - DNA, 22 bp, Artificial Sequence
  chemically synthesized
cgtaatttcctcatttcaagga

SEQ ID NO: 698981 - DNA, 22 bp, Artificial Sequence
  chemically synthesized
tgaaataatcagttccttgaaa

SEQ ID NO: 698982 - DNA, 22 bp, Artificial Sequence
  chemically synthesized
cctcatttcaaggaactgatta

SEQ ID NO: 698983 - DNA, 22 bp, Artificial Sequence
  chemically synthesized
ctcatttcaaggaactgattat

SEQ ID NO: 698984 - DNA, 22 bp, Artificial Sequence
  chemically synthesized
aaagcctctgaaataatcagtt

SEQ ID NO: 698985 - DNA, 22 bp, Artificial Sequence
  chemically synthesized
aaaagcctctgaaataatcagt

SEQ ID NO: 698986 - DNA, 22 bp, Artificial Sequence
  chemically synthesized
atttcaaggaactgattatttc

SEQ ID NO: 698987 - DNA, 22 bp, Artificial Sequence
  chemically synthesized
caaggaactgattatttcagag

SEQ ID NO: 698988 - DNA, 22 bp, Artificial Sequence
  chemically synthesized
aaggaactgattatttcagagg

SEQ ID NO: 698989 - DNA, 22 bp, Artificial Sequence
  chemically synthesized
attatttcagaggcttttaagg

SEQ ID NO: 698990 - DNA, 22 bp, Artificial Sequence
  chemically synthesized
tttcagaggcttttaaggtctc

SEQ ID NO: 698991 - DNA, 22 bp, Artificial Sequence
  chemically synthesized
cagaggcttttaaggtctccat

SEQ ID NO: 698992 - DNA, 22 bp, Artificial Sequence
  chemically synthesized
agaggcttttaaggtctccata

SEQ ID NO: 698993 - DNA, 22 bp, Artificial Sequence
  chemically synthesized
ccaaaaggtgagtatggagacc

SEQ ID NO: 698994 - DNA, 22 bp, Artificial Sequence
  chemically synthesized
gccaaaaggtgagtatggagac

SEQ ID NO: 698995 - DNA, 22 bp, Artificial Sequence
  chemically synthesized
ttaaggtctccatactcacctt

SEQ ID NO: 698996 - DNA, 22 bp, Artificial Sequence
  chemically synthesized
taaggtctccatactcaccttt

SEQ ID NO: 698997 - DNA, 22 bp, Artificial Sequence
  chemically synthesized
aaggtctccatactcacctttt

SEQ ID NO: 698998 - DNA, 22 bp, Artificial Sequence
  chemically synthesized
aggtctccatactcaccttttg

SEQ ID NO: 698999 - DNA, 22 bp, Artificial Sequence
  chemically synthesized
catactcaccttttggcaaatt

SEQ ID NO: 699000 - DNA, 22 bp, Artificial Sequence
  chemically synthesized
accttttggcaaattttcctgc

SEQ ID NO: 699001 - DNA, 22 bp, Artificial Sequence
  chemically synthesized
ttggcaaattttcctgcctatt

SEQ ID NO: 699002 - DNA, 22 bp, Artificial Sequence
  chemically synthesized
tggcaaattttcctgcctattg

SEQ ID NO: 699003 - DNA, 22 bp, Artificial Sequence
  chemically synthesized
ggcaaattttcctgcctattgt

SEQ ID NO: 699004 - DNA, 22 bp, Artificial Sequence
  chemically synthesized
gcaaattttcctgcctattgtt

SEQ ID NO: 699005 - DNA, 22 bp, Artificial Sequence
  chemically synthesized
atgataagagagagagaacaat

SEQ ID NO: 699006 - DNA, 22 bp, Artificial Sequence
  chemically synthesized
tcctgcctattgttctctctct

SEQ ID NO: 699007 - DNA, 22 bp, Artificial Sequence
  chemically synthesized
gctcatgataagagagagagaa

SEQ ID NO: 699008 - DNA, 22 bp, Artificial Sequence
  chemically synthesized
cctgcctattgttctctctctc

SEQ ID NO: 699009 - DNA, 22 bp, Artificial Sequence
  chemically synthesized
ctgcctattgttctctctctct

SEQ ID NO: 699010 - DNA, 22 bp, Artificial Sequence
  chemically synthesized
ctggctcatgataagagagaga

SEQ ID NO: 699011 - DNA, 22 bp, Artificial Sequence
  chemically synthesized
cctggctcatgataagagagag

SEQ ID NO: 699012 - DNA, 22 bp, Artificial Sequence
  chemically synthesized
cctattgttctctctctcttat

SEQ ID NO: 699013 - DNA, 22 bp, Artificial Sequence
  chemically synthesized
ttgttctctctctcttatcatg

SEQ ID NO: 699014 - DNA, 22 bp, Artificial Sequence
  chemically synthesized
tgcttcctggctcatgataaga

SEQ ID NO: 699015 - DNA, 22 bp, Artificial Sequence
  chemically synthesized
ttctctctctcttatcatgagc

SEQ ID NO: 699016 - DNA, 22 bp, Artificial Sequence
  chemically synthesized
ttatgcttcctggctcatgata

SEQ ID NO: 699017 - DNA, 22 bp, Artificial Sequence
  chemically synthesized
tctctctcttatcatgagccag

SEQ ID NO: 699018 - DNA, 22 bp, Artificial Sequence
  chemically synthesized
tctctcttatcatgagccagga

SEQ ID NO: 699019 - DNA, 22 bp, Artificial Sequence
  chemically synthesized
ggattattatgcttcctggctc

SEQ ID NO: 699020 - DNA, 22 bp, Artificial Sequence
  chemically synthesized
tctcttatcatgagccaggaag

SEQ ID NO: 699021 - DNA, 22 bp, Artificial Sequence
  chemically synthesized
aggattattatgcttcctggct

SEQ ID NO: 699022 - DNA, 22 bp, Artificial Sequence
  chemically synthesized
tcttatcatgagccaggaagca

SEQ ID NO: 699023 - DNA, 22 bp, Artificial Sequence
  chemically synthesized
ttatcatgagccaggaagcata

SEQ ID NO: 699024 - DNA, 22 bp, Artificial Sequence
  chemically synthesized
atcatgagccaggaagcataat

SEQ ID NO: 699025 - DNA, 22 bp, Artificial Sequence
  chemically synthesized
tcatgagccaggaagcataata

SEQ ID NO: 699026 - DNA, 22 bp, Artificial Sequence
  chemically synthesized
gtatataatttaggattattat

SEQ ID NO: 699027 - DNA, 22 bp, Artificial Sequence
  chemically synthesized
ggtatataatttaggattatta

SEQ ID NO: 699028 - DNA, 22 bp, Artificial Sequence
  chemically synthesized
aaatcttggtatataatttagg

SEQ ID NO: 699029 - DNA, 22 bp, Artificial Sequence
  chemically synthesized
aagagctcaaatcttggtatat

SEQ ID NO: 699030 - DNA, 22 bp, Artificial Sequence
  chemically synthesized
aaagagctcaaatcttggtata

SEQ ID NO: 699031 - DNA, 22 bp, Artificial Sequence
  chemically synthesized
taaagagctcaaatcttggtat

SEQ ID NO: 699032 - DNA, 22 bp, Artificial Sequence
  chemically synthesized
tttaaagagctcaaatcttggt

SEQ ID NO: 699033 - DNA, 22 bp, Artificial Sequence
  chemically synthesized
aattatataccaagatttgagc

SEQ ID NO: 699034 - DNA, 22 bp, Artificial Sequence
  chemically synthesized
tataccaagatttgagctcttt

SEQ ID NO: 699035 - DNA, 22 bp, Artificial Sequence
  chemically synthesized
accacacacctctttaaagagc

SEQ ID NO: 699036 - DNA, 22 bp, Artificial Sequence
  chemically synthesized
caccacacacctctttaaagag

SEQ ID NO: 699037 - DNA, 22 bp, Artificial Sequence
  chemically synthesized
caatttcaccacacacctcttt

SEQ ID NO: 699038 - DNA, 22 bp, Artificial Sequence
  chemically synthesized
gagctctttaaagaggtgtgtg

SEQ ID NO: 699039 - DNA, 22 bp, Artificial Sequence
  chemically synthesized
agctctttaaagaggtgtgtgg

SEQ ID NO: 699040 - DNA, 22 bp, Artificial Sequence
  chemically synthesized
tttaaagaggtgtgtggtgaaa

SEQ ID NO: 699041 - DNA, 22 bp, Artificial Sequence
  chemically synthesized
taaagaggtgtgtggtgaaatt

SEQ ID NO: 699042 - DNA, 22 bp, Artificial Sequence
  chemically synthesized
tcaacccactccaatttcacca

SEQ ID NO: 699043 - DNA, 22 bp, Artificial Sequence
  chemically synthesized
aaagaggtgtgtggtgaaattg

SEQ ID NO: 699044 - DNA, 22 bp, Artificial Sequence
  chemically synthesized
aagaggtgtgtggtgaaattgg

SEQ ID NO: 699045 - DNA, 22 bp, Artificial Sequence
  chemically synthesized
gatatgccctatcaacccactc

SEQ ID NO: 699046 - DNA, 22 bp, Artificial Sequence
  chemically synthesized
agatatgccctatcaacccact

SEQ ID NO: 699047 - DNA, 22 bp, Artificial Sequence
  chemically synthesized
tagatatgccctatcaacccac

SEQ ID NO: 699048 - DNA, 22 bp, Artificial Sequence
  chemically synthesized
gctttagatatgccctatcaac

SEQ ID NO: 699049 - DNA, 22 bp, Artificial Sequence
  chemically synthesized
attagctttagatatgccctat

SEQ ID NO: 699050 - DNA, 22 bp, Artificial Sequence
  chemically synthesized
aattagctttagatatgcccta

SEQ ID NO: 699051 - DNA, 22 bp, Artificial Sequence
  chemically synthesized
gagtgggttgatagggcatatc

SEQ ID NO: 699052 - DNA, 22 bp, Artificial Sequence
  chemically synthesized
tttaattagctttagatatgcc

SEQ ID NO: 699053 - DNA, 22 bp, Artificial Sequence
  chemically synthesized
cactgtttaattagctttagat

SEQ ID NO: 699054 - DNA, 22 bp, Artificial Sequence
  chemically synthesized
ccactgtttaattagctttaga

SEQ ID NO: 699055 - DNA, 22 bp, Artificial Sequence
  chemically synthesized
tccactgtttaattagctttag

SEQ ID NO: 699056 - DNA, 22 bp, Artificial Sequence
  chemically synthesized
atagggcatatctaaagctaat

SEQ ID NO: 699057 - DNA, 22 bp, Artificial Sequence
  chemically synthesized
ttccactgtttaattagcttta

SEQ ID NO: 699058 - DNA, 22 bp, Artificial Sequence
  chemically synthesized
tttttccactgtttaattagct

SEQ ID NO: 699059 - DNA, 22 bp, Artificial Sequence
  chemically synthesized
atttttccactgtttaattagc

SEQ ID NO: 699060 - DNA, 22 bp, Artificial Sequence
  chemically synthesized
tatttttccactgtttaattag

SEQ ID NO: 699061 - DNA, 22 bp, Artificial Sequence
  chemically synthesized
aagctaattaaacagtggaaaa

SEQ ID NO: 699062 - DNA, 22 bp, Artificial Sequence
  chemically synthesized
aaaaacaggaattttatttttc

SEQ ID NO: 699063 - DNA, 22 bp, Artificial Sequence
  chemically synthesized
attaaacagtggaaaaataaaa

SEQ ID NO: 699064 - DNA, 22 bp, Artificial Sequence
  chemically synthesized
aaaaaacaggaattttattttt

SEQ ID NO: 699065 - DNA, 22 bp, Artificial Sequence
  chemically synthesized
taaaaaacaggaattttatttt

SEQ ID NO: 699066 - DNA, 22 bp, Artificial Sequence
  chemically synthesized
aacagtggaaaaataaaattcc

SEQ ID NO: 699067 - DNA, 22 bp, Artificial Sequence
  chemically synthesized
ctttaaaaaacaggaattttat

SEQ ID NO: 699068 - DNA, 22 bp, Artificial Sequence
  chemically synthesized
actttaaaaaacaggaatttta

SEQ ID NO: 699069 - DNA, 22 bp, Artificial Sequence
  chemically synthesized
ttactttaaaaaacaggaattt

SEQ ID NO: 699070 - DNA, 22 bp, Artificial Sequence
  chemically synthesized
ctgttttttaaagtaagaattt

SEQ ID NO: 699071 - DNA, 22 bp, Artificial Sequence
  chemically synthesized
atgaacataatgtaaattctta

SEQ ID NO: 699072 - DNA, 22 bp, Artificial Sequence
  chemically synthesized
aatgaacataatgtaaattctt

SEQ ID NO: 699073 - DNA, 22 bp, Artificial Sequence
  chemically synthesized
ttttttaaagtaagaatttaca

SEQ ID NO: 699074 - DNA, 22 bp, Artificial Sequence
  chemically synthesized
taatgaacataatgtaaattct

SEQ ID NO: 699075 - DNA, 22 bp, Artificial Sequence
  chemically synthesized
tttaaagtaagaatttacatta

SEQ ID NO: 699076 - DNA, 22 bp, Artificial Sequence
  chemically synthesized
ttttaatgaacataatgtaaat

SEQ ID NO: 699077 - DNA, 22 bp, Artificial Sequence
  chemically synthesized
ttaaagtaagaatttacattat

SEQ ID NO: 699078 - DNA, 22 bp, Artificial Sequence
  chemically synthesized
taaagtaagaatttacattatg

SEQ ID NO: 699079 - DNA, 22 bp, Artificial Sequence
  chemically synthesized
aaagtaagaatttacattatgt

SEQ ID NO: 699080 - DNA, 22 bp, Artificial Sequence
  chemically synthesized
aagtaagaatttacattatgtt

SEQ ID NO: 699081 - DNA, 22 bp, Artificial Sequence
  chemically synthesized
attattttaatgaacataatgt

SEQ ID NO: 699082 - DNA, 22 bp, Artificial Sequence
  chemically synthesized
aaattcattattttaatgaaca

SEQ ID NO: 699083 - DNA, 22 bp, Artificial Sequence
  chemically synthesized
aaaattcattattttaatgaac

SEQ ID NO: 699084 - DNA, 22 bp, Artificial Sequence
  chemically synthesized
taaaattcattattttaatgaa

SEQ ID NO: 699085 - DNA, 22 bp, Artificial Sequence
  chemically synthesized
ttaaaattcattattttaatga

SEQ ID NO: 699086 - DNA, 22 bp, Artificial Sequence
  chemically synthesized
acattatgttcattaaaataat

SEQ ID NO: 699087 - DNA, 22 bp, Artificial Sequence
  chemically synthesized
tttttaaaattcattattttaa

SEQ ID NO: 699088 - DNA, 22 bp, Artificial Sequence
  chemically synthesized
cattatgttcattaaaataatg

SEQ ID NO: 699089 - DNA, 22 bp, Artificial Sequence
  chemically synthesized
atttttaaaattcattatttta

SEQ ID NO: 699090 - DNA, 22 bp, Artificial Sequence
  chemically synthesized
tatttttaaaattcattatttt

SEQ ID NO: 699091 - DNA, 22 bp, Artificial Sequence
  chemically synthesized
tgttcattaaaataatgaattt

SEQ ID NO: 699092 - DNA, 22 bp, Artificial Sequence
  chemically synthesized
attaaaataatgaattttaaaa

SEQ ID NO: 699093 - DNA, 22 bp, Artificial Sequence
  chemically synthesized
gataatatctttatttttaaaa

SEQ ID NO: 699094 - DNA, 22 bp, Artificial Sequence
  chemically synthesized
aaataatgaattttaaaaataa

SEQ ID NO: 699095 - DNA, 22 bp, Artificial Sequence
  chemically synthesized
ttcgataatatctttattttta

SEQ ID NO: 699096 - DNA, 22 bp, Artificial Sequence
  chemically synthesized
gttcgataatatctttattttt

SEQ ID NO: 699097 - DNA, 22 bp, Artificial Sequence
  chemically synthesized
tgttcgataatatctttatttt

SEQ ID NO: 699098 - DNA, 22 bp, Artificial Sequence
  chemically synthesized
ttgttcgataatatctttattt

SEQ ID NO: 699099 - DNA, 22 bp, Artificial Sequence
  chemically synthesized
agcttttgttcgataatatctt

SEQ ID NO: 699100 - DNA, 22 bp, Artificial Sequence
  chemically synthesized
taaaaataaagatattatcgaa

SEQ ID NO: 699101 - DNA, 22 bp, Artificial Sequence
  chemically synthesized
aaaaataaagatattatcgaac

SEQ ID NO: 699102 - DNA, 22 bp, Artificial Sequence
  chemically synthesized
aaaataaagatattatcgaaca

SEQ ID NO: 699103 - DNA, 22 bp, Artificial Sequence
  chemically synthesized
aaaaccgaagatctcagctttt

SEQ ID NO: 699104 - DNA, 22 bp, Artificial Sequence
  chemically synthesized
aaaaaccgaagatctcagcttt

SEQ ID NO: 699105 - DNA, 22 bp, Artificial Sequence
  chemically synthesized
tcgaacaaaagctgagatcttc

SEQ ID NO: 699106 - DNA, 22 bp, Artificial Sequence
  chemically synthesized
tccaaacttaaaaaccgaagat

SEQ ID NO: 699107 - DNA, 22 bp, Artificial Sequence
  chemically synthesized
tcctgtccaaacttaaaaaccg

SEQ ID NO: 699108 - DNA, 22 bp, Artificial Sequence
  chemically synthesized
agatcttcggtttttaagtttg

SEQ ID NO: 699109 - DNA, 22 bp, Artificial Sequence
  chemically synthesized
agttgtcctgtccaaacttaaa

SEQ ID NO: 699110 - DNA, 22 bp, Artificial Sequence
  chemically synthesized
attcagttgtcctgtccaaact

SEQ ID NO: 699111 - DNA, 22 bp, Artificial Sequence
  chemically synthesized
cggtttttaagtttggacagga

SEQ ID NO: 699112 - DNA, 22 bp, Artificial Sequence
  chemically synthesized
ggtttttaagtttggacaggac

SEQ ID NO: 699113 - DNA, 22 bp, Artificial Sequence
  chemically synthesized
ttaagtttggacaggacaactg

SEQ ID NO: 699114 - DNA, 22 bp, Artificial Sequence
  chemically synthesized
taagtttggacaggacaactga

SEQ ID NO: 699115 - DNA, 22 bp, Artificial Sequence
  chemically synthesized
aagtttggacaggacaactgaa

SEQ ID NO: 699116 - DNA, 22 bp, Artificial Sequence
  chemically synthesized
agtttggacaggacaactgaat

SEQ ID NO: 699117 - DNA, 22 bp, Artificial Sequence
  chemically synthesized
ggacaggacaactgaatgagtc

SEQ ID NO: 699118 - DNA, 22 bp, Artificial Sequence
  chemically synthesized
gacaggacaactgaatgagtca

SEQ ID NO: 699119 - DNA, 22 bp, Artificial Sequence
  chemically synthesized
agacgtaatgagcatgactcat

SEQ ID NO: 699120 - DNA, 22 bp, Artificial Sequence
  chemically synthesized
taagacgtaatgagcatgactc

SEQ ID NO: 699121 - DNA, 22 bp, Artificial Sequence
  chemically synthesized
gctctaagacgtaatgagcatg

SEQ ID NO: 699122 - DNA, 22 bp, Artificial Sequence
  chemically synthesized
agctctaagacgtaatgagcat

SEQ ID NO: 699123 - DNA, 22 bp, Artificial Sequence
  chemically synthesized
tagctctaagacgtaatgagca

SEQ ID NO: 699124 - DNA, 22 bp, Artificial Sequence
  chemically synthesized
ttagctctaagacgtaatgagc

SEQ ID NO: 699125 - DNA, 22 bp, Artificial Sequence
  chemically synthesized
tttagctctaagacgtaatgag

SEQ ID NO: 699126 - DNA, 22 bp, Artificial Sequence
  chemically synthesized
aatgagtcatgctcattacgtc

SEQ ID NO: 699127 - DNA, 22 bp, Artificial Sequence
  chemically synthesized
agatcctttttagctctaagac

SEQ ID NO: 699128 - DNA, 22 bp, Artificial Sequence
  chemically synthesized
attacgtcttagagctaaaaag

SEQ ID NO: 699129 - DNA, 22 bp, Artificial Sequence
  chemically synthesized
cgtcttagagctaaaaaggatc

SEQ ID NO: 699130 - DNA, 22 bp, Artificial Sequence
  chemically synthesized
gatgatatctaagatccttttt

SEQ ID NO: 699131 - DNA, 22 bp, Artificial Sequence
  chemically synthesized
gactagatgatatctaagatcc

SEQ ID NO: 699132 - DNA, 22 bp, Artificial Sequence
  chemically synthesized
agagctaaaaaggatcttagat

SEQ ID NO: 699133 - DNA, 22 bp, Artificial Sequence
  chemically synthesized
gagctaaaaaggatcttagata

SEQ ID NO: 699134 - DNA, 22 bp, Artificial Sequence
  chemically synthesized
aaaaggatcttagatatcatct

SEQ ID NO: 699135 - DNA, 22 bp, Artificial Sequence
  chemically synthesized
taaaataaagagttggactaga

SEQ ID NO: 699136 - DNA, 22 bp, Artificial Sequence
  chemically synthesized
ataaaataaagagttggactag

SEQ ID NO: 699137 - DNA, 22 bp, Artificial Sequence
  chemically synthesized
agatatcatctagtccaactct

SEQ ID NO: 699138 - DNA, 22 bp, Artificial Sequence
  chemically synthesized
gatatcatctagtccaactctt

SEQ ID NO: 699139 - DNA, 22 bp, Artificial Sequence
  chemically synthesized
atttataaaataaagagttgga

SEQ ID NO: 699140 - DNA, 22 bp, Artificial Sequence
  chemically synthesized
taatttataaaataaagagttg

SEQ ID NO: 699141 - DNA, 22 bp, Artificial Sequence
  chemically synthesized
ctaatttataaaataaagagtt

SEQ ID NO: 699142 - DNA, 22 bp, Artificial Sequence
  chemically synthesized
gtttctaatttataaaataaag

SEQ ID NO: 699143 - DNA, 22 bp, Artificial Sequence
  chemically synthesized
ggtttctaatttataaaataaa

SEQ ID NO: 699144 - DNA, 22 bp, Artificial Sequence
  chemically synthesized
gtccaactctttattttataaa

SEQ ID NO: 699145 - DNA, 22 bp, Artificial Sequence
  chemically synthesized
tttattttataaattagaaacc

SEQ ID NO: 699146 - DNA, 22 bp, Artificial Sequence
  chemically synthesized
tattttataaattagaaaccaa

SEQ ID NO: 699147 - DNA, 22 bp, Artificial Sequence
  chemically synthesized
attttataaattagaaaccaag

SEQ ID NO: 699148 - DNA, 22 bp, Artificial Sequence
  chemically synthesized
ttttataaattagaaaccaagg

SEQ ID NO: 699149 - DNA, 22 bp, Artificial Sequence
  chemically synthesized
tataaattagaaaccaaggttt

SEQ ID NO: 699150 - DNA, 22 bp, Artificial Sequence
  chemically synthesized
ataaattagaaaccaaggtttg

SEQ ID NO: 699151 - DNA, 22 bp, Artificial Sequence
  chemically synthesized
taaattagaaaccaaggtttgg

SEQ ID NO: 699152 - DNA, 22 bp, Artificial Sequence
  chemically synthesized
agccaccatgcccagccaaacc

SEQ ID NO: 699153 - DNA, 22 bp, Artificial Sequence
  chemically synthesized
gagccaccatgcccagccaaac

SEQ ID NO: 699154 - DNA, 22 bp, Artificial Sequence
  chemically synthesized
gaaaccaaggtttggctgggca

SEQ ID NO: 699155 - DNA, 22 bp, Artificial Sequence
  chemically synthesized
caggcttgagccaccatgccca

SEQ ID NO: 699156 - DNA, 22 bp, Artificial Sequence
  chemically synthesized
ggattacaggcttgagccacca

SEQ ID NO: 699157 - DNA, 22 bp, Artificial Sequence
  chemically synthesized
ggctgggcatggtggctcaagc

SEQ ID NO: 699158 - DNA, 22 bp, Artificial Sequence
  chemically synthesized
gctgggcatggtggctcaagcc

SEQ ID NO: 699159 - DNA, 22 bp, Artificial Sequence
  chemically synthesized
ggcatggtggctcaagcctgta

SEQ ID NO: 699160 - DNA, 22 bp, Artificial Sequence
  chemically synthesized
ccaaagtgctgggattacaggc

SEQ ID NO: 699161 - DNA, 22 bp, Artificial Sequence
  chemically synthesized
ggcctcccaaagtgctgggatt

SEQ ID NO: 699162 - DNA, 22 bp, Artificial Sequence
  chemically synthesized
aagcctgtaatcccagcacttt

SEQ ID NO: 699163 - DNA, 22 bp, Artificial Sequence
  chemically synthesized
taatcccagcactttgggaggc

SEQ ID NO: 699164 - DNA, 22 bp, Artificial Sequence
  chemically synthesized
aggtgatccacccgcctcggcc

SEQ ID NO: 699165 - DNA, 22 bp, Artificial Sequence
  chemically synthesized
acctcaggtgatccacccgcct

SEQ ID NO: 699166 - DNA, 22 bp, Artificial Sequence
  chemically synthesized
tgggaggccgaggcgggtggat

SEQ ID NO: 699167 - DNA, 22 bp, Artificial Sequence
  chemically synthesized
gggaggccgaggcgggtggatc

SEQ ID NO: 699168 - DNA, 22 bp, Artificial Sequence
  chemically synthesized
ctgacctcaggtgatccacccg

SEQ ID NO: 699169 - DNA, 22 bp, Artificial Sequence
  chemically synthesized
ggaggccgaggcgggtggatca

SEQ ID NO: 699170 - DNA, 22 bp, Artificial Sequence
  chemically synthesized
gaactcctgacctcaggtgatc

SEQ ID NO: 699171 - DNA, 22 bp, Artificial Sequence
  chemically synthesized
gtctcgaactcctgacctcagg

SEQ ID NO: 699172 - DNA, 22 bp, Artificial Sequence
  chemically synthesized
gtcaggctcgtctcgaactcct

SEQ ID NO: 699173 - DNA, 22 bp, Artificial Sequence
  chemically synthesized
aggtcaggagttcgagacgagc

SEQ ID NO: 699174 - DNA, 22 bp, Artificial Sequence
  chemically synthesized
accatattggtcaggctcgtct

SEQ ID NO: 699175 - DNA, 22 bp, Artificial Sequence
  chemically synthesized
caccatattggtcaggctcgtc

SEQ ID NO: 699176 - DNA, 22 bp, Artificial Sequence
  chemically synthesized
gagacgagcctgaccaatatgg

SEQ ID NO: 699177 - DNA, 22 bp, Artificial Sequence
  chemically synthesized
gtagagacgaggtttcaccata

SEQ ID NO: 699178 - DNA, 22 bp, Artificial Sequence
  chemically synthesized
agtagagacgaggtttcaccat

SEQ ID NO: 699179 - DNA, 22 bp, Artificial Sequence
  chemically synthesized
tagtagagacgaggtttcacca

SEQ ID NO: 699180 - DNA, 22 bp, Artificial Sequence
  chemically synthesized
ttagtagagacgaggtttcacc

SEQ ID NO: 699181 - DNA, 22 bp, Artificial Sequence
  chemically synthesized
accaatatggtgaaacctcgtc

SEQ ID NO: 699182 - DNA, 22 bp, Artificial Sequence
  chemically synthesized
tatttttagtagagacgaggtt

SEQ ID NO: 699183 - DNA, 22 bp, Artificial Sequence
  chemically synthesized
gtatttttagtagagacgaggt

SEQ ID NO: 699184 - DNA, 22 bp, Artificial Sequence
  chemically synthesized
tgtatttttagtagagacgagg

SEQ ID NO: 699185 - DNA, 22 bp, Artificial Sequence
  chemically synthesized
ttgtatttttagtagagacgag

SEQ ID NO: 699186 - DNA, 22 bp, Artificial Sequence
  chemically synthesized
atttttgtatttttagtagaga

SEQ ID NO: 699187 - DNA, 22 bp, Artificial Sequence
  chemically synthesized
gctaatttttgtatttttagta

SEQ ID NO: 699188 - DNA, 22 bp, Artificial Sequence
  chemically synthesized
ggctaatttttgtatttttagt

SEQ ID NO: 699189 - DNA, 22 bp, Artificial Sequence
  chemically synthesized
gtctctactaaaaatacaaaaa

SEQ ID NO: 699190 - DNA, 22 bp, Artificial Sequence
  chemically synthesized
tactaaaaatacaaaaattagc

SEQ ID NO: 699191 - DNA, 22 bp, Artificial Sequence
  chemically synthesized
ccaccatgcttggctaattttt

SEQ ID NO: 699192 - DNA, 22 bp, Artificial Sequence
  chemically synthesized
ctaaaaatacaaaaattagcca

SEQ ID NO: 699193 - DNA, 22 bp, Artificial Sequence
  chemically synthesized
aaaatacaaaaattagccaagc

SEQ ID NO: 699194 - DNA, 22 bp, Artificial Sequence
  chemically synthesized
caggcacctgccaccatgcttg

SEQ ID NO: 699195 - DNA, 22 bp, Artificial Sequence
  chemically synthesized
agactacaggcacctgccacca

SEQ ID NO: 699196 - DNA, 22 bp, Artificial Sequence
  chemically synthesized
gccaagcatggtggcaggtgcc

SEQ ID NO: 699197 - DNA, 22 bp, Artificial Sequence
  chemically synthesized
ccgagtagctgagactacaggc

SEQ ID NO: 699198 - DNA, 22 bp, Artificial Sequence
  chemically synthesized
gctcccgagtagctgagactac

SEQ ID NO: 699199 - DNA, 22 bp, Artificial Sequence
  chemically synthesized
agctcccgagtagctgagacta

SEQ ID NO: 699200 - DNA, 22 bp, Artificial Sequence
  chemically synthesized
gtcttagctcccgagtagctga

SEQ ID NO: 699201 - DNA, 22 bp, Artificial Sequence
  chemically synthesized
cgtcttagctcccgagtagctg

SEQ ID NO: 699202 - DNA, 22 bp, Artificial Sequence
  chemically synthesized
tcgtcttagctcccgagtagct

SEQ ID NO: 699203 - DNA, 22 bp, Artificial Sequence
  chemically synthesized
tttcgtcttagctcccgagtag

SEQ ID NO: 699204 - DNA, 22 bp, Artificial Sequence
  chemically synthesized
tagtctcagctactcgggagct

SEQ ID NO: 699205 - DNA, 22 bp, Artificial Sequence
  chemically synthesized
aagcaattctttcgtcttagct

SEQ ID NO: 699206 - DNA, 22 bp, Artificial Sequence
  chemically synthesized
agctactcgggagctaagacga

SEQ ID NO: 699207 - DNA, 22 bp, Artificial Sequence
  chemically synthesized
ctcgggagctaagacgaaagaa

SEQ ID NO: 699208 - DNA, 22 bp, Artificial Sequence
  chemically synthesized
ccgggttcaagcaattctttcg

SEQ ID NO: 699209 - DNA, 22 bp, Artificial Sequence
  chemically synthesized
gggagctaagacgaaagaattg

SEQ ID NO: 699210 - DNA, 22 bp, Artificial Sequence
  chemically synthesized
cctcccgggttcaagcaattct

SEQ ID NO: 699211 - DNA, 22 bp, Artificial Sequence
  chemically synthesized
agacgaaagaattgcttgaacc

SEQ ID NO: 699212 - DNA, 22 bp, Artificial Sequence
  chemically synthesized
caacccctgcctcccgggttca

SEQ ID NO: 699213 - DNA, 22 bp, Artificial Sequence
  chemically synthesized
actgcaacccctgcctcccggg

SEQ ID NO: 699214 - DNA, 22 bp, Artificial Sequence
  chemically synthesized
ggctcactgcaacccctgcctc

SEQ ID NO: 699215 - DNA, 22 bp, Artificial Sequence
  chemically synthesized
cttgaacccgggaggcaggggt

SEQ ID NO: 699216 - DNA, 22 bp, Artificial Sequence
  chemically synthesized
gaacccgggaggcaggggttgc

SEQ ID NO: 699217 - DNA, 22 bp, Artificial Sequence
  chemically synthesized
aacccgggaggcaggggttgca

SEQ ID NO: 699218 - DNA, 22 bp, Artificial Sequence
  chemically synthesized
gagtgcagtggcccgatctcgg

SEQ ID NO: 699219 - DNA, 22 bp, Artificial Sequence
  chemically synthesized
cagtgagccgagatcgggccac

SEQ ID NO: 699220 - DNA, 22 bp, Artificial Sequence
  chemically synthesized
cccaggctggagtgcagtggcc

SEQ ID NO: 699221 - DNA, 22 bp, Artificial Sequence
  chemically synthesized
ttgcccaggctggagtgcagtg

SEQ ID NO: 699222 - DNA, 22 bp, Artificial Sequence
  chemically synthesized
tgttgcccaggctggagtgcag

SEQ ID NO: 699223 - DNA, 22 bp, Artificial Sequence
  chemically synthesized
actctgttgcccaggctggagt

SEQ ID NO: 699224 - DNA, 22 bp, Artificial Sequence
  chemically synthesized
cactctgttgcccaggctggag

SEQ ID NO: 699225 - DNA, 22 bp, Artificial Sequence
  chemically synthesized
cactccagcctgggcaacagag

SEQ ID NO: 699226 - DNA, 22 bp, Artificial Sequence
  chemically synthesized
agatggagtttcactctgttgc

SEQ ID NO: 699227 - DNA, 22 bp, Artificial Sequence
  chemically synthesized
gagatggagtttcactctgttg

SEQ ID NO: 699228 - DNA, 22 bp, Artificial Sequence
  chemically synthesized
tgagatggagtttcactctgtt

SEQ ID NO: 699229 - DNA, 22 bp, Artificial Sequence
  chemically synthesized
ttgagatggagtttcactctgt

SEQ ID NO: 699230 - DNA, 22 bp, Artificial Sequence
  chemically synthesized
cagcctgggcaacagagtgaaa

SEQ ID NO: 699231 - DNA, 22 bp, Artificial Sequence
  chemically synthesized
tttgagatggagtttcactctg

SEQ ID NO: 699232 - DNA, 22 bp, Artificial Sequence
  chemically synthesized
ttttgagatggagtttcactct

SEQ ID NO: 699233 - DNA, 22 bp, Artificial Sequence
  chemically synthesized
tttttgagatggagtttcactc

SEQ ID NO: 699234 - DNA, 22 bp, Artificial Sequence
  chemically synthesized
ttttttgagatggagtttcact

SEQ ID NO: 699235 - DNA, 22 bp, Artificial Sequence
  chemically synthesized
tttttttgagatggagtttcac

SEQ ID NO: 699236 - DNA, 22 bp, Artificial Sequence
  chemically synthesized
ttttttttgagatggagtttca

SEQ ID NO: 699237 - DNA, 22 bp, Artificial Sequence
  chemically synthesized
tttttttttgagatggagtttc

SEQ ID NO: 699238 - DNA, 22 bp, Artificial Sequence
  chemically synthesized
ggcaacagagtgaaactccatc

SEQ ID NO: 699239 - DNA, 22 bp, Artificial Sequence
  chemically synthesized
ttttttttttgagatggagttt

SEQ ID NO: 699240 - DNA, 22 bp, Artificial Sequence
  chemically synthesized
tttttttttttgagatggagtt

SEQ ID NO: 699241 - DNA, 22 bp, Artificial Sequence
  chemically synthesized
ttttttttttttgagatggagt

SEQ ID NO: 699242 - DNA, 22 bp, Artificial Sequence
  chemically synthesized
tttttttttttttgagatggag

SEQ ID NO: 699243 - DNA, 22 bp, Artificial Sequence
  chemically synthesized
ttttttttttttttgagatgga

SEQ ID NO: 699244 - DNA, 22 bp, Artificial Sequence
  chemically synthesized
tttttttttttttttgagatgg

SEQ ID NO: 699245 - DNA, 22 bp, Artificial Sequence
  chemically synthesized
ttttttttttttttttgagatg

SEQ ID NO: 699246 - DNA, 22 bp, Artificial Sequence
  chemically synthesized
tttttttttttttttttgagat

SEQ ID NO: 699247 - DNA, 22 bp, Artificial Sequence
  chemically synthesized
ttttttttttttttttttgaga

SEQ ID NO: 699248 - DNA, 22 bp, Artificial Sequence
  chemically synthesized
tttttttttttttttttttgag

SEQ ID NO: 699249 - DNA, 22 bp, Artificial Sequence
  chemically synthesized
ttttttttttttttttttttga

SEQ ID NO: 699250 - DNA, 22 bp, Artificial Sequence
  chemically synthesized
tttttttttttttttttttttg

SEQ ID NO: 699251 - DNA, 22 bp, Artificial Sequence
  chemically synthesized
tttttttttttttttttttttt

SEQ ID NO: 699252 - DNA, 22 bp, Artificial Sequence
  chemically synthesized
tttttttttttttttttttttt

SEQ ID NO: 699253 - DNA, 22 bp, Artificial Sequence
  chemically synthesized
tttttttttttttttttttttt

SEQ ID NO: 699254 - DNA, 22 bp, Artificial Sequence
  chemically synthesized
tttttttttttttttttttttt

SEQ ID NO: 699255 - DNA, 22 bp, Artificial Sequence
  chemically synthesized
tttttttttttttttttttttt

SEQ ID NO: 699256 - DNA, 22 bp, Artificial Sequence
  chemically synthesized
catctcaaaaaaaaaaaaaaaa

SEQ ID NO: 699257 - DNA, 22 bp, Artificial Sequence
  chemically synthesized
cttttttttttttttttttttt

SEQ ID NO: 699258 - DNA, 22 bp, Artificial Sequence
  chemically synthesized
tctttttttttttttttttttt

SEQ ID NO: 699259 - DNA, 22 bp, Artificial Sequence
  chemically synthesized
tttctttttttttttttttttt

SEQ ID NO: 699260 - DNA, 22 bp, Artificial Sequence
  chemically synthesized
ctttcttttttttttttttttt

SEQ ID NO: 699261 - DNA, 22 bp, Artificial Sequence
  chemically synthesized
aaaaaaaaaaaaaaaaaaaaaa

SEQ ID NO: 699262 - DNA, 22 bp, Artificial Sequence
  chemically synthesized
gtttctttcttttttttttttt

SEQ ID NO: 699263 - DNA, 22 bp, Artificial Sequence
  chemically synthesized
ggtttctttctttttttttttt

SEQ ID NO: 699264 - DNA, 22 bp, Artificial Sequence
  chemically synthesized
taaaaatcttggtttctttctt

SEQ ID NO: 699265 - DNA, 22 bp, Artificial Sequence
  chemically synthesized
acctataaaaatcttggtttct

SEQ ID NO: 699266 - DNA, 22 bp, Artificial Sequence
  chemically synthesized
aacctataaaaatcttggtttc

SEQ ID NO: 699267 - DNA, 22 bp, Artificial Sequence
  chemically synthesized
ggcaagtcacttaacctataaa

SEQ ID NO: 699268 - DNA, 22 bp, Artificial Sequence
  chemically synthesized
aggcaagtcacttaacctataa

SEQ ID NO: 699269 - DNA, 22 bp, Artificial Sequence
  chemically synthesized
taggcaagtcacttaacctata

SEQ ID NO: 699270 - DNA, 22 bp, Artificial Sequence
  chemically synthesized
tatggctttaggcaagtcactt

SEQ ID NO: 699271 - DNA, 22 bp, Artificial Sequence
  chemically synthesized
ttataggttaagtgacttgcct

SEQ ID NO: 699272 - DNA, 22 bp, Artificial Sequence
  chemically synthesized
tataggttaagtgacttgccta

SEQ ID NO: 699273 - DNA, 22 bp, Artificial Sequence
  chemically synthesized
ataggttaagtgacttgcctaa

SEQ ID NO: 699274 - DNA, 22 bp, Artificial Sequence
  chemically synthesized
taggttaagtgacttgcctaaa

SEQ ID NO: 699275 - DNA, 22 bp, Artificial Sequence
  chemically synthesized
ggcgactgtatggctttaggca

SEQ ID NO: 699276 - DNA, 22 bp, Artificial Sequence
  chemically synthesized
agtgacttgcctaaagccatac

SEQ ID NO: 699277 - DNA, 22 bp, Artificial Sequence
  chemically synthesized
tcattaggcgactgtatggctt

SEQ ID NO: 699278 - DNA, 22 bp, Artificial Sequence
  chemically synthesized
tgtcattaggcgactgtatggc

SEQ ID NO: 699279 - DNA, 22 bp, Artificial Sequence
  chemically synthesized
gcctaaagccatacagtcgcct

SEQ ID NO: 699280 - DNA, 22 bp, Artificial Sequence
  chemically synthesized
cctaaagccatacagtcgccta

SEQ ID NO: 699281 - DNA, 22 bp, Artificial Sequence
  chemically synthesized
gaggctctgtcattaggcgact

SEQ ID NO: 699282 - DNA, 22 bp, Artificial Sequence
  chemically synthesized
agaggctctgtcattaggcgac

SEQ ID NO: 699283 - DNA, 22 bp, Artificial Sequence
  chemically synthesized
aagccatacagtcgcctaatga

SEQ ID NO: 699284 - DNA, 22 bp, Artificial Sequence
  chemically synthesized
gtcttagaggctctgtcattag

SEQ ID NO: 699285 - DNA, 22 bp, Artificial Sequence
  chemically synthesized
cagtctagtcttagaggctctg

SEQ ID NO: 699286 - DNA, 22 bp, Artificial Sequence
  chemically synthesized
gtcctccagtctagtcttagag

SEQ ID NO: 699287 - DNA, 22 bp, Artificial Sequence
  chemically synthesized
agtcctccagtctagtcttaga

SEQ ID NO: 699288 - DNA, 22 bp, Artificial Sequence
  chemically synthesized
atgacagagcctctaagactag

SEQ ID NO: 699289 - DNA, 22 bp, Artificial Sequence
  chemically synthesized
tagtcctccagtctagtcttag

SEQ ID NO: 699290 - DNA, 22 bp, Artificial Sequence
  chemically synthesized
aattttagtcctccagtctagt

SEQ ID NO: 699291 - DNA, 22 bp, Artificial Sequence
  chemically synthesized
caattttagtcctccagtctag

SEQ ID NO: 699292 - DNA, 22 bp, Artificial Sequence
  chemically synthesized
taagactagactggaggactaa

SEQ ID NO: 699293 - DNA, 22 bp, Artificial Sequence
  chemically synthesized
agactagactggaggactaaaa

SEQ ID NO: 699294 - DNA, 22 bp, Artificial Sequence
  chemically synthesized
gactggaggactaaaattgaag

SEQ ID NO: 699295 - DNA, 22 bp, Artificial Sequence
  chemically synthesized
tgaataagaaaacttcaatttt

SEQ ID NO: 699296 - DNA, 22 bp, Artificial Sequence
  chemically synthesized
gaggactaaaattgaagttttc

SEQ ID NO: 699297 - DNA, 22 bp, Artificial Sequence
  chemically synthesized
aaattgaagttttcttattcat

SEQ ID NO: 699298 - DNA, 22 bp, Artificial Sequence
  chemically synthesized
ataagggcacagatctatgaat

SEQ ID NO: 699299 - DNA, 22 bp, Artificial Sequence
  chemically synthesized
aagttttcttattcatagatct

SEQ ID NO: 699300 - DNA, 22 bp, Artificial Sequence
  chemically synthesized
tcttattcatagatctgtgccc

SEQ ID NO: 699301 - DNA, 22 bp, Artificial Sequence
  chemically synthesized
cttattcatagatctgtgccct

SEQ ID NO: 699302 - DNA, 22 bp, Artificial Sequence
  chemically synthesized
ttattcatagatctgtgccctt

SEQ ID NO: 699303 - DNA, 22 bp, Artificial Sequence
  chemically synthesized
attcatagatctgtgcccttat

SEQ ID NO: 699304 - DNA, 22 bp, Artificial Sequence
  chemically synthesized
ttcatagatctgtgcccttatc

SEQ ID NO: 699305 - DNA, 22 bp, Artificial Sequence
  chemically synthesized
atagatctgtgcccttatcaat

SEQ ID NO: 699306 - DNA, 22 bp, Artificial Sequence
  chemically synthesized
aagaccatggtgatggtattga

SEQ ID NO: 699307 - DNA, 22 bp, Artificial Sequence
  chemically synthesized
tgcccttatcaataccatcacc

SEQ ID NO: 699308 - DNA, 22 bp, Artificial Sequence
  chemically synthesized
atgtacctaaagaccatggtga

SEQ ID NO: 699309 - DNA, 22 bp, Artificial Sequence
  chemically synthesized
catgtacctaaagaccatggtg

SEQ ID NO: 699310 - DNA, 22 bp, Artificial Sequence
  chemically synthesized
atcaataccatcaccatggtct

SEQ ID NO: 699311 - DNA, 22 bp, Artificial Sequence
  chemically synthesized
tcaataccatcaccatggtctt

SEQ ID NO: 699312 - DNA, 22 bp, Artificial Sequence
  chemically synthesized
cttcatgtacctaaagaccatg

SEQ ID NO: 699313 - DNA, 22 bp, Artificial Sequence
  chemically synthesized
tccaatgctccttcatgtacct

SEQ ID NO: 699314 - DNA, 22 bp, Artificial Sequence
  chemically synthesized
gtccaatgctccttcatgtacc

SEQ ID NO: 699315 - DNA, 22 bp, Artificial Sequence
  chemically synthesized
tttgtccaatgctccttcatgt

SEQ ID NO: 699316 - DNA, 22 bp, Artificial Sequence
  chemically synthesized
taggtacatgaaggagcattgg

SEQ ID NO: 699317 - DNA, 22 bp, Artificial Sequence
  chemically synthesized
aggtacatgaaggagcattgga

SEQ ID NO: 699318 - DNA, 22 bp, Artificial Sequence
  chemically synthesized
ggtacatgaaggagcattggac

SEQ ID NO: 699319 - DNA, 22 bp, Artificial Sequence
  chemically synthesized
catatcctatttgtccaatgct

SEQ ID NO: 699320 - DNA, 22 bp, Artificial Sequence
  chemically synthesized
gagagcagctacatatcctatt

SEQ ID NO: 699321 - DNA, 22 bp, Artificial Sequence
  chemically synthesized
gacaaataggatatgtagctgc

SEQ ID NO: 699322 - DNA, 22 bp, Artificial Sequence
  chemically synthesized
agtggaattagagagcagctac

SEQ ID NO: 699323 - DNA, 22 bp, Artificial Sequence
  chemically synthesized
tcagtggaattagagagcagct

SEQ ID NO: 699324 - DNA, 22 bp, Artificial Sequence
  chemically synthesized
ctcagtggaattagagagcagc

SEQ ID NO: 699325 - DNA, 22 bp, Artificial Sequence
  chemically synthesized
tttctcagtggaattagagagc

SEQ ID NO: 699326 - DNA, 22 bp, Artificial Sequence
  chemically synthesized
ctgtttctcagtggaattagag

SEQ ID NO: 699327 - DNA, 22 bp, Artificial Sequence
  chemically synthesized
gctgtttctcagtggaattaga

SEQ ID NO: 699328 - DNA, 22 bp, Artificial Sequence
  chemically synthesized
ttgctgtttctcagtggaatta

SEQ ID NO: 699329 - DNA, 22 bp, Artificial Sequence
  chemically synthesized
gtctcttgctgtttctcagtgg

SEQ ID NO: 699330 - DNA, 22 bp, Artificial Sequence
  chemically synthesized
ctctctaattccactgagaaac

SEQ ID NO: 699331 - DNA, 22 bp, Artificial Sequence
  chemically synthesized
tctaattccactgagaaacagc

SEQ ID NO: 699332 - DNA, 22 bp, Artificial Sequence
  chemically synthesized
taattccactgagaaacagcaa

SEQ ID NO: 699333 - DNA, 22 bp, Artificial Sequence
  chemically synthesized
tgtattagtctcttgctgtttc

SEQ ID NO: 699334 - DNA, 22 bp, Artificial Sequence
  chemically synthesized
attccactgagaaacagcaaga

SEQ ID NO: 699335 - DNA, 22 bp, Artificial Sequence
  chemically synthesized
tgtgtattagtctcttgctgtt

SEQ ID NO: 699336 - DNA, 22 bp, Artificial Sequence
  chemically synthesized
ctgtgtattagtctcttgctgt

SEQ ID NO: 699337 - DNA, 22 bp, Artificial Sequence
  chemically synthesized
cactgagaaacagcaagagact

SEQ ID NO: 699338 - DNA, 22 bp, Artificial Sequence
  chemically synthesized
ccttctgtgtattagtctcttg

SEQ ID NO: 699339 - DNA, 22 bp, Artificial Sequence
  chemically synthesized
agaaacagcaagagactaatac

SEQ ID NO: 699340 - DNA, 22 bp, Artificial Sequence
  chemically synthesized
taattcccttctgtgtattagt

SEQ ID NO: 699341 - DNA, 22 bp, Artificial Sequence
  chemically synthesized
cagaaaagctgtaattcccttc

SEQ ID NO: 699342 - DNA, 22 bp, Artificial Sequence
  chemically synthesized
atacacagaagggaattacagc

SEQ ID NO: 699343 - DNA, 22 bp, Artificial Sequence
  chemically synthesized
cagcttttctggaatttgtctc

SEQ ID NO: 699344 - DNA, 22 bp, Artificial Sequence
  chemically synthesized
ttctggaatttgtctctttatt

SEQ ID NO: 699345 - DNA, 22 bp, Artificial Sequence
  chemically synthesized
cgtccaaaaaataataaagaga

SEQ ID NO: 699346 - DNA, 22 bp, Artificial Sequence
  chemically synthesized
tctggaatttgtctctttatta

SEQ ID NO: 699347 - DNA, 22 bp, Artificial Sequence
  chemically synthesized
ctggaatttgtctctttattat

SEQ ID NO: 699348 - DNA, 22 bp, Artificial Sequence
  chemically synthesized
tggaatttgtctctttattatt

SEQ ID NO: 699349 - DNA, 22 bp, Artificial Sequence
  chemically synthesized
gaatttgtctctttattatttt

SEQ ID NO: 699350 - DNA, 22 bp, Artificial Sequence
  chemically synthesized
gtctctttattattttttggac

SEQ ID NO: 699351 - DNA, 22 bp, Artificial Sequence
  chemically synthesized
tctctttattattttttggacg

SEQ ID NO: 699352 - DNA, 22 bp, Artificial Sequence
  chemically synthesized
tttattattttttggacggagt

SEQ ID NO: 699353 - DNA, 22 bp, Artificial Sequence
  chemically synthesized
tattattttttggacggagttc

SEQ ID NO: 699354 - DNA, 22 bp, Artificial Sequence
  chemically synthesized
attattttttggacggagttca

SEQ ID NO: 699355 - DNA, 22 bp, Artificial Sequence
  chemically synthesized
ttattttttggacggagttcat

SEQ ID NO: 699356 - DNA, 22 bp, Artificial Sequence
  chemically synthesized
tgagggaatggaaatgaactcc

SEQ ID NO: 699357 - DNA, 22 bp, Artificial Sequence
  chemically synthesized
ttttttggacggagttcatttc

SEQ ID NO: 699358 - DNA, 22 bp, Artificial Sequence
  chemically synthesized
ctgtgagggaatggaaatgaac

SEQ ID NO: 699359 - DNA, 22 bp, Artificial Sequence
  chemically synthesized
tttggacggagttcatttccat

SEQ ID NO: 699360 - DNA, 22 bp, Artificial Sequence
  chemically synthesized
ttggacggagttcatttccatt

SEQ ID NO: 699361 - DNA, 22 bp, Artificial Sequence
  chemically synthesized
tggacggagttcatttccattc

SEQ ID NO: 699362 - DNA, 22 bp, Artificial Sequence
  chemically synthesized
ggacggagttcatttccattcc

SEQ ID NO: 699363 - DNA, 22 bp, Artificial Sequence
  chemically synthesized
gacggagttcatttccattccc

SEQ ID NO: 699364 - DNA, 22 bp, Artificial Sequence
  chemically synthesized
atttccattccctcacagcaat

SEQ ID NO: 699365 - DNA, 22 bp, Artificial Sequence
  chemically synthesized
ccattccctcacagcaatgtac

SEQ ID NO: 699366 - DNA, 22 bp, Artificial Sequence
  chemically synthesized
caagagatcccagtacattgct

SEQ ID NO: 699367 - DNA, 22 bp, Artificial Sequence
  chemically synthesized
cattccctcacagcaatgtact

SEQ ID NO: 699368 - DNA, 22 bp, Artificial Sequence
  chemically synthesized
ctacaagagatcccagtacatt

SEQ ID NO: 699369 - DNA, 22 bp, Artificial Sequence
  chemically synthesized
tactacaagagatcccagtaca

SEQ ID NO: 699370 - DNA, 22 bp, Artificial Sequence
  chemically synthesized
cctcacagcaatgtactgggat

SEQ ID NO: 699371 - DNA, 22 bp, Artificial Sequence
  chemically synthesized
ctactacaagagatcccagtac

SEQ ID NO: 699372 - DNA, 22 bp, Artificial Sequence
  chemically synthesized
cttctactacaagagatcccag

SEQ ID NO: 699373 - DNA, 22 bp, Artificial Sequence
  chemically synthesized
acagcaatgtactgggatctct

SEQ ID NO: 699374 - DNA, 22 bp, Artificial Sequence
  chemically synthesized
atgttacttctactacaagaga

SEQ ID NO: 699375 - DNA, 22 bp, Artificial Sequence
  chemically synthesized
cctgatgttacttctactacaa

SEQ ID NO: 699376 - DNA, 22 bp, Artificial Sequence
  chemically synthesized
tccctgatgttacttctactac

SEQ ID NO: 699377 - DNA, 22 bp, Artificial Sequence
  chemically synthesized
ctccctgatgttacttctacta

SEQ ID NO: 699378 - DNA, 22 bp, Artificial Sequence
  chemically synthesized
ggatctcttgtagtagaagtaa

SEQ ID NO: 699379 - DNA, 22 bp, Artificial Sequence
  chemically synthesized
atcttctccctgatgttacttc

SEQ ID NO: 699380 - DNA, 22 bp, Artificial Sequence
  chemically synthesized
ttgtagtagaagtaacatcagg

SEQ ID NO: 699381 - DNA, 22 bp, Artificial Sequence
  chemically synthesized
gtagtagaagtaacatcaggga

SEQ ID NO: 699382 - DNA, 22 bp, Artificial Sequence
  chemically synthesized
tagtagaagtaacatcagggag

SEQ ID NO: 699383 - DNA, 22 bp, Artificial Sequence
  chemically synthesized
tatattcatcttctccctgatg

SEQ ID NO: 699384 - DNA, 22 bp, Artificial Sequence
  chemically synthesized
cctatatattcatcttctccct

SEQ ID NO: 699385 - DNA, 22 bp, Artificial Sequence
  chemically synthesized
ccctatatattcatcttctccc

SEQ ID NO: 699386 - DNA, 22 bp, Artificial Sequence
  chemically synthesized
tccctatatattcatcttctcc

SEQ ID NO: 699387 - DNA, 22 bp, Artificial Sequence
  chemically synthesized
tcctttccctatatattcatct

SEQ ID NO: 699388 - DNA, 22 bp, Artificial Sequence
  chemically synthesized
cccggtcccattgtcctttccc

SEQ ID NO: 699389 - DNA, 22 bp, Artificial Sequence
  chemically synthesized
gggtctccccggtcccattgtc

SEQ ID NO: 699390 - DNA, 22 bp, Artificial Sequence
  chemically synthesized
ctagggtctccccggtcccatt

SEQ ID NO: 699391 - DNA, 22 bp, Artificial Sequence
  chemically synthesized
acatggattgctagggtctccc

SEQ ID NO: 699392 - DNA, 22 bp, Artificial Sequence
  chemically synthesized
gaggtctcacatggattgctag

SEQ ID NO: 699393 - DNA, 22 bp, Artificial Sequence
  chemically synthesized
actagaggtctcacatggattg

SEQ ID NO: 699394 - DNA, 22 bp, Artificial Sequence
  chemically synthesized
gggctcactagaggtctcacat

SEQ ID NO: 699395 - DNA, 22 bp, Artificial Sequence
  chemically synthesized
ggggctcactagaggtctcaca

SEQ ID NO: 699396 - DNA, 22 bp, Artificial Sequence
  chemically synthesized
tttggggctcactagaggtctc

SEQ ID NO: 699397 - DNA, 22 bp, Artificial Sequence
  chemically synthesized
gcaatccatgtgagacctctag

SEQ ID NO: 699398 - DNA, 22 bp, Artificial Sequence
  chemically synthesized
gtttggggctcactagaggtct

SEQ ID NO: 699399 - DNA, 22 bp, Artificial Sequence
  chemically synthesized
cttgtttggggctcactagagg

SEQ ID NO: 699400 - DNA, 22 bp, Artificial Sequence
  chemically synthesized
caaatgactacttgtttggggc

SEQ ID NO: 699401 - DNA, 22 bp, Artificial Sequence
  chemically synthesized
tccaaatgactacttgtttggg

SEQ ID NO: 699402 - DNA, 22 bp, Artificial Sequence
  chemically synthesized
ttctccaaatgactacttgttt

SEQ ID NO: 699403 - DNA, 22 bp, Artificial Sequence
  chemically synthesized
tagtgagccccaaacaagtagt

SEQ ID NO: 699404 - DNA, 22 bp, Artificial Sequence
  chemically synthesized
gtgagccccaaacaagtagtca

SEQ ID NO: 699405 - DNA, 22 bp, Artificial Sequence
  chemically synthesized
ttattctccaaatgactacttg

SEQ ID NO: 699406 - DNA, 22 bp, Artificial Sequence
  chemically synthesized
agctattattctccaaatgact

SEQ ID NO: 699407 - DNA, 22 bp, Artificial Sequence
  chemically synthesized
aagctattattctccaaatgac

SEQ ID NO: 699408 - DNA, 22 bp, Artificial Sequence
  chemically synthesized
taagctattattctccaaatga

SEQ ID NO: 699409 - DNA, 22 bp, Artificial Sequence
  chemically synthesized
aagacacctttaagctattatt

SEQ ID NO: 699410 - DNA, 22 bp, Artificial Sequence
  chemically synthesized
ggagaataatagcttaaaggtg

SEQ ID NO: 699411 - DNA, 22 bp, Artificial Sequence
  chemically synthesized
gagaattcaagacacctttaag

SEQ ID NO: 699412 - DNA, 22 bp, Artificial Sequence
  chemically synthesized
gagaataatagcttaaaggtgt

SEQ ID NO: 699413 - DNA, 22 bp, Artificial Sequence
  chemically synthesized
ggatcactggagaattcaagac

SEQ ID NO: 699414 - DNA, 22 bp, Artificial Sequence
  chemically synthesized
aggatcactggagaattcaaga

SEQ ID NO: 699415 - DNA, 22 bp, Artificial Sequence
  chemically synthesized
taggatcactggagaattcaag

SEQ ID NO: 699416 - DNA, 22 bp, Artificial Sequence
  chemically synthesized
aaaggtgtcttgaattctccag

SEQ ID NO: 699417 - DNA, 22 bp, Artificial Sequence
  chemically synthesized
aaggtgtcttgaattctccagt

SEQ ID NO: 699418 - DNA, 22 bp, Artificial Sequence
  chemically synthesized
atagatgaggttttaggatcac

SEQ ID NO: 699419 - DNA, 22 bp, Artificial Sequence
  chemically synthesized
catagatgaggttttaggatca

SEQ ID NO: 699420 - DNA, 22 bp, Artificial Sequence
  chemically synthesized
gaattctccagtgatcctaaaa

SEQ ID NO: 699421 - DNA, 22 bp, Artificial Sequence
  chemically synthesized
tcatagatgaggttttaggatc

SEQ ID NO: 699422 - DNA, 22 bp, Artificial Sequence
  chemically synthesized
aattctccagtgatcctaaaac

SEQ ID NO: 699423 - DNA, 22 bp, Artificial Sequence
  chemically synthesized
ctttcatagatgaggttttagg

SEQ ID NO: 699424 - DNA, 22 bp, Artificial Sequence
  chemically synthesized
tcctttcatagatgaggtttta

SEQ ID NO: 699425 - DNA, 22 bp, Artificial Sequence
  chemically synthesized
tccagtgatcctaaaacctcat

SEQ ID NO: 699426 - DNA, 22 bp, Artificial Sequence
  chemically synthesized
ctcctttcatagatgaggtttt

SEQ ID NO: 699427 - DNA, 22 bp, Artificial Sequence
  chemically synthesized
tctcctttcatagatgaggttt

SEQ ID NO: 699428 - DNA, 22 bp, Artificial Sequence
  chemically synthesized
cagtgatcctaaaacctcatct

SEQ ID NO: 699429 - DNA, 22 bp, Artificial Sequence
  chemically synthesized
ttctcctttcatagatgaggtt

SEQ ID NO: 699430 - DNA, 22 bp, Artificial Sequence
  chemically synthesized
tttctcctttcatagatgaggt

SEQ ID NO: 699431 - DNA, 22 bp, Artificial Sequence
  chemically synthesized
tttttctcctttcatagatgag

SEQ ID NO: 699432 - DNA, 22 bp, Artificial Sequence
  chemically synthesized
aaacctcatctatgaaaggaga

SEQ ID NO: 699433 - DNA, 22 bp, Artificial Sequence
  chemically synthesized
aaataaagactctttttctcct

SEQ ID NO: 699434 - DNA, 22 bp, Artificial Sequence
  chemically synthesized
atctatgaaaggagaaaaagag

SEQ ID NO: 699435 - DNA, 22 bp, Artificial Sequence
  chemically synthesized
tgagctgaaataaagactcttt

SEQ ID NO: 699436 - DNA, 22 bp, Artificial Sequence
  chemically synthesized
tgaaaggagaaaaagagtcttt

SEQ ID NO: 699437 - DNA, 22 bp, Artificial Sequence
  chemically synthesized
atgagctgaaataaagactctt

SEQ ID NO: 699438 - DNA, 22 bp, Artificial Sequence
  chemically synthesized
tatgagctgaaataaagactct

SEQ ID NO: 699439 - DNA, 22 bp, Artificial Sequence
  chemically synthesized
ctttatgagctgaaataaagac

SEQ ID NO: 699440 - DNA, 22 bp, Artificial Sequence
  chemically synthesized
tccaattcctttatgagctgaa

SEQ ID NO: 699441 - DNA, 22 bp, Artificial Sequence
  chemically synthesized
atccaattcctttatgagctga

SEQ ID NO: 699442 - DNA, 22 bp, Artificial Sequence
  chemically synthesized
tatccaattcctttatgagctg

SEQ ID NO: 699443 - DNA, 22 bp, Artificial Sequence
  chemically synthesized
ttatccaattcctttatgagct

SEQ ID NO: 699444 - DNA, 22 bp, Artificial Sequence
  chemically synthesized
acttttatccaattcctttatg

SEQ ID NO: 699445 - DNA, 22 bp, Artificial Sequence
  chemically synthesized
tatttcagctcataaaggaatt

SEQ ID NO: 699446 - DNA, 22 bp, Artificial Sequence
  chemically synthesized
tcacttttatccaattccttta

SEQ ID NO: 699447 - DNA, 22 bp, Artificial Sequence
  chemically synthesized
atttcagctcataaaggaattg

SEQ ID NO: 699448 - DNA, 22 bp, Artificial Sequence
  chemically synthesized
tttcagctcataaaggaattgg

SEQ ID NO: 699449 - DNA, 22 bp, Artificial Sequence
  chemically synthesized
cagctcataaaggaattggata

SEQ ID NO: 699450 - DNA, 22 bp, Artificial Sequence
  chemically synthesized
agctcataaaggaattggataa

SEQ ID NO: 699451 - DNA, 22 bp, Artificial Sequence
  chemically synthesized
ataaagctctcacttttatcca

SEQ ID NO: 699452 - DNA, 22 bp, Artificial Sequence
  chemically synthesized
ataaaggaattggataaaagtg

SEQ ID NO: 699453 - DNA, 22 bp, Artificial Sequence
  chemically synthesized
aaccaattcataaagctctcac

SEQ ID NO: 699454 - DNA, 22 bp, Artificial Sequence
  chemically synthesized
caaccaattcataaagctctca

SEQ ID NO: 699455 - DNA, 22 bp, Artificial Sequence
  chemically synthesized
ttcaaccaattcataaagctct

SEQ ID NO: 699456 - DNA, 22 bp, Artificial Sequence
  chemically synthesized
cttcaaccaattcataaagctc

SEQ ID NO: 699457 - DNA, 22 bp, Artificial Sequence
  chemically synthesized
gataaaagtgagagctttatga

SEQ ID NO: 699458 - DNA, 22 bp, Artificial Sequence
  chemically synthesized
cttcttcaaccaattcataaag

SEQ ID NO: 699459 - DNA, 22 bp, Artificial Sequence
  chemically synthesized
ctacttcttcaaccaattcata

SEQ ID NO: 699460 - DNA, 22 bp, Artificial Sequence
  chemically synthesized
agacctgctacttcttcaacca

SEQ ID NO: 699461 - DNA, 22 bp, Artificial Sequence
  chemically synthesized
gagacctgctacttcttcaacc

SEQ ID NO: 699462 - DNA, 22 bp, Artificial Sequence
  chemically synthesized
tatgaattggttgaagaagtag

SEQ ID NO: 699463 - DNA, 22 bp, Artificial Sequence
  chemically synthesized
atgaattggttgaagaagtagc

SEQ ID NO: 699464 - DNA, 22 bp, Artificial Sequence
  chemically synthesized
tgaattggttgaagaagtagca

SEQ ID NO: 699465 - DNA, 22 bp, Artificial Sequence
  chemically synthesized
agatgtttgagacctgctactt

SEQ ID NO: 699466 - DNA, 22 bp, Artificial Sequence
  chemically synthesized
gttgaagaagtagcaggtctca

SEQ ID NO: 699467 - DNA, 22 bp, Artificial Sequence
  chemically synthesized
cgactaagatgtttgagacctg

SEQ ID NO: 699468 - DNA, 22 bp, Artificial Sequence
  chemically synthesized
ccgactaagatgtttgagacct

SEQ ID NO: 699469 - DNA, 22 bp, Artificial Sequence
  chemically synthesized
aagaagtagcaggtctcaaaca

SEQ ID NO: 699470 - DNA, 22 bp, Artificial Sequence
  chemically synthesized
tttccgactaagatgtttgaga

SEQ ID NO: 699471 - DNA, 22 bp, Artificial Sequence
  chemically synthesized
atttccgactaagatgtttgag

SEQ ID NO: 699472 - DNA, 22 bp, Artificial Sequence
  chemically synthesized
tatttccgactaagatgtttga

SEQ ID NO: 699473 - DNA, 22 bp, Artificial Sequence
  chemically synthesized
ttatttccgactaagatgtttg

SEQ ID NO: 699474 - DNA, 22 bp, Artificial Sequence
  chemically synthesized
acaaatttttatttccgactaa

SEQ ID NO: 699475 - DNA, 22 bp, Artificial Sequence
  chemically synthesized
aaacatcttagtcggaaataaa

SEQ ID NO: 699476 - DNA, 22 bp, Artificial Sequence
  chemically synthesized
tcctcacaaatttttatttccg

SEQ ID NO: 699477 - DNA, 22 bp, Artificial Sequence
  chemically synthesized
gtcctcacaaatttttatttcc

SEQ ID NO: 699478 - DNA, 22 bp, Artificial Sequence
  chemically synthesized
tgtcctcacaaatttttatttc

SEQ ID NO: 699479 - DNA, 22 bp, Artificial Sequence
  chemically synthesized
agtcggaaataaaaatttgtga

SEQ ID NO: 699480 - DNA, 22 bp, Artificial Sequence
  chemically synthesized
gtcggaaataaaaatttgtgag

SEQ ID NO: 699481 - DNA, 22 bp, Artificial Sequence
  chemically synthesized
catcagtgtctttgtcctcaca

SEQ ID NO: 699482 - DNA, 22 bp, Artificial Sequence
  chemically synthesized
ctacatcagtgtctttgtcctc

SEQ ID NO: 699483 - DNA, 22 bp, Artificial Sequence
  chemically synthesized
cctacatcagtgtctttgtcct

SEQ ID NO: 699484 - DNA, 22 bp, Artificial Sequence
  chemically synthesized
gtgaggacaaagacactgatgt

SEQ ID NO: 699485 - DNA, 22 bp, Artificial Sequence
  chemically synthesized
tgaggacaaagacactgatgta

SEQ ID NO: 699486 - DNA, 22 bp, Artificial Sequence
  chemically synthesized
gacagtgatttcctacatcagt

SEQ ID NO: 699487 - DNA, 22 bp, Artificial Sequence
  chemically synthesized
tagacagtgatttcctacatca

SEQ ID NO: 699488 - DNA, 22 bp, Artificial Sequence
  chemically synthesized
aaactctagacagtgatttcct

SEQ ID NO: 699489 - DNA, 22 bp, Artificial Sequence
  chemically synthesized
caaactctagacagtgatttcc

SEQ ID NO: 699490 - DNA, 22 bp, Artificial Sequence
  chemically synthesized
ttcaaactctagacagtgattt

SEQ ID NO: 699491 - DNA, 22 bp, Artificial Sequence
  chemically synthesized
cttcaaactctagacagtgatt

SEQ ID NO: 699492 - DNA, 22 bp, Artificial Sequence
  chemically synthesized
tcttcaaactctagacagtgat

SEQ ID NO: 699493 - DNA, 22 bp, Artificial Sequence
  chemically synthesized
atgtaggaaatcactgtctaga

SEQ ID NO: 699494 - DNA, 22 bp, Artificial Sequence
  chemically synthesized
tggaacaattttcttcaaactc

SEQ ID NO: 699495 - DNA, 22 bp, Artificial Sequence
  chemically synthesized
atggaacaattttcttcaaact

SEQ ID NO: 699496 - DNA, 22 bp, Artificial Sequence
  chemically synthesized
tatggaacaattttcttcaaac

SEQ ID NO: 699497 - DNA, 22 bp, Artificial Sequence
  chemically synthesized
tctagagtttgaagaaaattgt

SEQ ID NO: 699498 - DNA, 22 bp, Artificial Sequence
  chemically synthesized
tatattttatggaacaattttc

SEQ ID NO: 699499 - DNA, 22 bp, Artificial Sequence
  chemically synthesized
gagtttgaagaaaattgttcca

SEQ ID NO: 699500 - DNA, 22 bp, Artificial Sequence
  chemically synthesized
gaagaaaattgttccataaaat

SEQ ID NO: 699501 - DNA, 22 bp, Artificial Sequence
  chemically synthesized
catccactgtatattttatgga

SEQ ID NO: 699502 - DNA, 22 bp, Artificial Sequence
  chemically synthesized
aagaaaattgttccataaaata

SEQ ID NO: 699503 - DNA, 22 bp, Artificial Sequence
  chemically synthesized
acatccactgtatattttatgg

SEQ ID NO: 699504 - DNA, 22 bp, Artificial Sequence
  chemically synthesized
ccttacatccactgtatatttt

SEQ ID NO: 699505 - DNA, 22 bp, Artificial Sequence
  chemically synthesized
ttccataaaatatacagtggat

SEQ ID NO: 699506 - DNA, 22 bp, Artificial Sequence
  chemically synthesized
tatattaccttacatccactgt

SEQ ID NO: 699507 - DNA, 22 bp, Artificial Sequence
  chemically synthesized
cataaaatatacagtggatgta

SEQ ID NO: 699508 - DNA, 22 bp, Artificial Sequence
  chemically synthesized
tagacatgcactgtatattacc

SEQ ID NO: 699509 - DNA, 22 bp, Artificial Sequence
  chemically synthesized
ctgtagacatgcactgtatatt

SEQ ID NO: 699510 - DNA, 22 bp, Artificial Sequence
  chemically synthesized
aataatatattgctgtagacat

SEQ ID NO: 699511 - DNA, 22 bp, Artificial Sequence
  chemically synthesized
ttaaataatatattgctgtaga

SEQ ID NO: 699512 - DNA, 22 bp, Artificial Sequence
  chemically synthesized
attaaataatatattgctgtag

SEQ ID NO: 699513 - DNA, 22 bp, Artificial Sequence
  chemically synthesized
tattaaataatatattgctgta

SEQ ID NO: 699514 - DNA, 22 bp, Artificial Sequence
  chemically synthesized
aatcacatgctttattaaataa

SEQ ID NO: 699515 - DNA, 22 bp, Artificial Sequence
  chemically synthesized
aaatcacatgctttattaaata

SEQ ID NO: 699516 - DNA, 22 bp, Artificial Sequence
  chemically synthesized
cagcaatatattatttaataaa

SEQ ID NO: 699517 - DNA, 22 bp, Artificial Sequence
  chemically synthesized
tttaaatcacatgctttattaa

SEQ ID NO: 699518 - DNA, 22 bp, Artificial Sequence
  chemically synthesized
aatacctatttaaatcacatgc

SEQ ID NO: 699519 - DNA, 22 bp, Artificial Sequence
  chemically synthesized
aaatacctatttaaatcacatg

SEQ ID NO: 699520 - DNA, 22 bp, Artificial Sequence
  chemically synthesized
taaatacctatttaaatcacat

SEQ ID NO: 699521 - DNA, 22 bp, Artificial Sequence
  chemically synthesized
tttaataaagcatgtgatttaa

SEQ ID NO: 699522 - DNA, 22 bp, Artificial Sequence
  chemically synthesized
aataaagcatgtgatttaaata

SEQ ID NO: 699523 - DNA, 22 bp, Artificial Sequence
  chemically synthesized
ataaagcatgtgatttaaatag

SEQ ID NO: 699524 - DNA, 22 bp, Artificial Sequence
  chemically synthesized
tacattttaaatacctatttaa

SEQ ID NO: 699525 - DNA, 22 bp, Artificial Sequence
  chemically synthesized
aaaactgtacattttaaatacc

SEQ ID NO: 699526 - DNA, 22 bp, Artificial Sequence
  chemically synthesized
aaataggtatttaaaatgtaca

SEQ ID NO: 699527 - DNA, 22 bp, Artificial Sequence
  chemically synthesized
gtcactcaaaactgtacatttt

SEQ ID NO: 699528 - DNA, 22 bp, Artificial Sequence
  chemically synthesized
aataggtatttaaaatgtacag

SEQ ID NO: 699529 - DNA, 22 bp, Artificial Sequence
  chemically synthesized
attagtcactcaaaactgtaca

SEQ ID NO: 699530 - DNA, 22 bp, Artificial Sequence
  chemically synthesized
attcattagtcactcaaaactg

SEQ ID NO: 699531 - DNA, 22 bp, Artificial Sequence
  chemically synthesized
aattcattagtcactcaaaact

SEQ ID NO: 699532 - DNA, 22 bp, Artificial Sequence
  chemically synthesized
aaaatgtacagttttgagtgac

SEQ ID NO: 699533 - DNA, 22 bp, Artificial Sequence
  chemically synthesized
aaatgtacagttttgagtgact

SEQ ID NO: 699534 - DNA, 22 bp, Artificial Sequence
  chemically synthesized
tatttaattcattagtcactca

SEQ ID NO: 699535 - DNA, 22 bp, Artificial Sequence
  chemically synthesized
ttatatttaattcattagtcac

SEQ ID NO: 699536 - DNA, 22 bp, Artificial Sequence
  chemically synthesized
ttgttatatttaattcattagt

SEQ ID NO: 699537 - DNA, 22 bp, Artificial Sequence
  chemically synthesized
ttattgttatatttaattcatt

SEQ ID NO: 699538 - DNA, 22 bp, Artificial Sequence
  chemically synthesized
attattgttatatttaattcat

SEQ ID NO: 699539 - DNA, 22 bp, Artificial Sequence
  chemically synthesized
tattattgttatatttaattca

SEQ ID NO: 699540 - DNA, 22 bp, Artificial Sequence
  chemically synthesized
tgagtgactaatgaattaaata

SEQ ID NO: 699541 - DNA, 22 bp, Artificial Sequence
  chemically synthesized
gagtgactaatgaattaaatat

SEQ ID NO: 699542 - DNA, 22 bp, Artificial Sequence
  chemically synthesized
agtgactaatgaattaaatata

SEQ ID NO: 699543 - DNA, 22 bp, Artificial Sequence
  chemically synthesized
attttattattgttatatttaa

SEQ ID NO: 699544 - DNA, 22 bp, Artificial Sequence
  chemically synthesized
aattttattattgttatattta

SEQ ID NO: 699545 - DNA, 22 bp, Artificial Sequence
  chemically synthesized
atgaattaaatataacaataat

SEQ ID NO: 699546 - DNA, 22 bp, Artificial Sequence
  chemically synthesized
tgaatttaattttattattgtt

SEQ ID NO: 699547 - DNA, 22 bp, Artificial Sequence
  chemically synthesized
atgaatttaattttattattgt

SEQ ID NO: 699548 - DNA, 22 bp, Artificial Sequence
  chemically synthesized
tatgaatttaattttattattg

SEQ ID NO: 699549 - DNA, 22 bp, Artificial Sequence
  chemically synthesized
aatataacaataataaaattaa

SEQ ID NO: 699550 - DNA, 22 bp, Artificial Sequence
  chemically synthesized
atattttatgaatttaatttta

SEQ ID NO: 699551 - DNA, 22 bp, Artificial Sequence
  chemically synthesized
catattttatgaatttaatttt

SEQ ID NO: 699552 - DNA, 22 bp, Artificial Sequence
  chemically synthesized
tcatattttatgaatttaattt

SEQ ID NO: 699553 - DNA, 22 bp, Artificial Sequence
  chemically synthesized
gttttcatattttatgaattta

SEQ ID NO: 699554 - DNA, 22 bp, Artificial Sequence
  chemically synthesized
agttttcatattttatgaattt

SEQ ID NO: 699555 - DNA, 22 bp, Artificial Sequence
  chemically synthesized
tagttttcatattttatgaatt

SEQ ID NO: 699556 - DNA, 22 bp, Artificial Sequence
  chemically synthesized
ttagttttcatattttatgaat

SEQ ID NO: 699557 - DNA, 22 bp, Artificial Sequence
  chemically synthesized
tttagttttcatattttatgaa

SEQ ID NO: 699558 - DNA, 22 bp, Artificial Sequence
  chemically synthesized
ctttttagttttcatattttat

SEQ ID NO: 699559 - DNA, 22 bp, Artificial Sequence
  chemically synthesized
tgctttttagttttcatatttt

SEQ ID NO: 699560 - DNA, 22 bp, Artificial Sequence
  chemically synthesized
attctgctttttagttttcata

SEQ ID NO: 699561 - DNA, 22 bp, Artificial Sequence
  chemically synthesized
aattcataaaatatgaaaacta

SEQ ID NO: 699562 - DNA, 22 bp, Artificial Sequence
  chemically synthesized
gattctgctttttagttttcat

SEQ ID NO: 699563 - DNA, 22 bp, Artificial Sequence
  chemically synthesized
ataaaatatgaaaactaaaaag

SEQ ID NO: 699564 - DNA, 22 bp, Artificial Sequence
  chemically synthesized
gtatgtttgattctgcttttta

SEQ ID NO: 699565 - DNA, 22 bp, Artificial Sequence
  chemically synthesized
agtatgtttgattctgcttttt

SEQ ID NO: 699566 - DNA, 22 bp, Artificial Sequence
  chemically synthesized
tagtatgtttgattctgctttt

SEQ ID NO: 699567 - DNA, 22 bp, Artificial Sequence
  chemically synthesized
ttagtatgtttgattctgcttt

SEQ ID NO: 699568 - DNA, 22 bp, Artificial Sequence
  chemically synthesized
tttagtatgtttgattctgctt

SEQ ID NO: 699569 - DNA, 22 bp, Artificial Sequence
  chemically synthesized
ttttagtatgtttgattctgct

SEQ ID NO: 699570 - DNA, 22 bp, Artificial Sequence
  chemically synthesized
ttttttagtatgtttgattctg

SEQ ID NO: 699571 - DNA, 22 bp, Artificial Sequence
  chemically synthesized
aaaagcagaatcaaacatacta

SEQ ID NO: 699572 - DNA, 22 bp, Artificial Sequence
  chemically synthesized
aaaattcttttttagtatgttt

SEQ ID NO: 699573 - DNA, 22 bp, Artificial Sequence
  chemically synthesized
gaaaattcttttttagtatgtt

SEQ ID NO: 699574 - DNA, 22 bp, Artificial Sequence
  chemically synthesized
acttgaaaattcttttttagta

SEQ ID NO: 699575 - DNA, 22 bp, Artificial Sequence
  chemically synthesized
aacttgaaaattcttttttagt

SEQ ID NO: 699576 - DNA, 22 bp, Artificial Sequence
  chemically synthesized
ttaacttgaaaattctttttta

SEQ ID NO: 699577 - DNA, 22 bp, Artificial Sequence
  chemically synthesized
aaaaagaattttcaagttaaga

SEQ ID NO: 699578 - DNA, 22 bp, Artificial Sequence
  chemically synthesized
cagatgaggtatctcttaactt

SEQ ID NO: 699579 - DNA, 22 bp, Artificial Sequence
  chemically synthesized
ccagatgaggtatctcttaact

SEQ ID NO: 699580 - DNA, 22 bp, Artificial Sequence
  chemically synthesized
tccagatgaggtatctcttaac

SEQ ID NO: 699581 - DNA, 22 bp, Artificial Sequence
  chemically synthesized
ttccagatgaggtatctcttaa

SEQ ID NO: 699582 - DNA, 22 bp, Artificial Sequence
  chemically synthesized
catttttccagatgaggtatct

SEQ ID NO: 699583 - DNA, 22 bp, Artificial Sequence
  chemically synthesized
tcaagttaagagatacctcatc

SEQ ID NO: 699584 - DNA, 22 bp, Artificial Sequence
  chemically synthesized
caagttaagagatacctcatct

SEQ ID NO: 699585 - DNA, 22 bp, Artificial Sequence
  chemically synthesized
ttacatttttccagatgaggta

SEQ ID NO: 699586 - DNA, 22 bp, Artificial Sequence
  chemically synthesized
aagttaagagatacctcatctg

SEQ ID NO: 699587 - DNA, 22 bp, Artificial Sequence
  chemically synthesized
attacatttttccagatgaggt

SEQ ID NO: 699588 - DNA, 22 bp, Artificial Sequence
  chemically synthesized
tcttattacatttttccagatg

SEQ ID NO: 699589 - DNA, 22 bp, Artificial Sequence
  chemically synthesized
gtcttattacatttttccagat

SEQ ID NO: 699590 - DNA, 22 bp, Artificial Sequence
  chemically synthesized
agagatacctcatctggaaaaa

SEQ ID NO: 699591 - DNA, 22 bp, Artificial Sequence
  chemically synthesized
ccatttgtcttattacattttt

SEQ ID NO: 699592 - DNA, 22 bp, Artificial Sequence
  chemically synthesized
accatttgtcttattacatttt

SEQ ID NO: 699593 - DNA, 22 bp, Artificial Sequence
  chemically synthesized
atctggaaaaatgtaataagac

SEQ ID NO: 699594 - DNA, 22 bp, Artificial Sequence
  chemically synthesized
gaaaaatgtaataagacaaatg

SEQ ID NO: 699595 - DNA, 22 bp, Artificial Sequence
  chemically synthesized
ggaaacggtttaccatttgtct

SEQ ID NO: 699596 - DNA, 22 bp, Artificial Sequence
  chemically synthesized
aggaaacggtttaccatttgtc

SEQ ID NO: 699597 - DNA, 22 bp, Artificial Sequence
  chemically synthesized
taggaaacggtttaccatttgt

SEQ ID NO: 699598 - DNA, 22 bp, Artificial Sequence
  chemically synthesized
aggagaaatacatactttagga

SEQ ID NO: 699599 - DNA, 22 bp, Artificial Sequence
  chemically synthesized
caggagaaatacatactttagg

SEQ ID NO: 699600 - DNA, 22 bp, Artificial Sequence
  chemically synthesized
tcaggagaaatacatactttag

SEQ ID NO: 699601 - DNA, 22 bp, Artificial Sequence
  chemically synthesized
tttcaggagaaatacatacttt

SEQ ID NO: 699602 - DNA, 22 bp, Artificial Sequence
  chemically synthesized
actctttcaggagaaatacata

SEQ ID NO: 699603 - DNA, 22 bp, Artificial Sequence
  chemically synthesized
gactctttcaggagaaatacat

SEQ ID NO: 699604 - DNA, 22 bp, Artificial Sequence
  chemically synthesized
tgactctttcaggagaaataca

SEQ ID NO: 699605 - DNA, 22 bp, Artificial Sequence
  chemically synthesized
ttgactctttcaggagaaatac

SEQ ID NO: 699606 - DNA, 22 bp, Artificial Sequence
  chemically synthesized
cctaaagtatgtatttctcctg

SEQ ID NO: 699607 - DNA, 22 bp, Artificial Sequence
  chemically synthesized
ctaaagtatgtatttctcctga

SEQ ID NO: 699608 - DNA, 22 bp, Artificial Sequence
  chemically synthesized
aagtatgtatttctcctgaaag

SEQ ID NO: 699609 - DNA, 22 bp, Artificial Sequence
  chemically synthesized
ctcctgaaagagtcaaaagact

SEQ ID NO: 699610 - DNA, 22 bp, Artificial Sequence
  chemically synthesized
tcctgaaagagtcaaaagacta

SEQ ID NO: 699611 - DNA, 22 bp, Artificial Sequence
  chemically synthesized
ctgaaagagtcaaaagactacc

SEQ ID NO: 699612 - DNA, 22 bp, Artificial Sequence
  chemically synthesized
aaagagtcaaaagactaccttc

SEQ ID NO: 699613 - DNA, 22 bp, Artificial Sequence
  chemically synthesized
agaaaaatgggagtgaaggtag

SEQ ID NO: 699614 - DNA, 22 bp, Artificial Sequence
  chemically synthesized
actcagaaaaatgggagtgaag

SEQ ID NO: 699615 - DNA, 22 bp, Artificial Sequence
  chemically synthesized
ttaactcagaaaaatgggagtg

SEQ ID NO: 699616 - DNA, 22 bp, Artificial Sequence
  chemically synthesized
gttaactcagaaaaatgggagt

SEQ ID NO: 699617 - DNA, 22 bp, Artificial Sequence
  chemically synthesized
tgttaactcagaaaaatgggag

SEQ ID NO: 699618 - DNA, 22 bp, Artificial Sequence
  chemically synthesized
ttttgttaactcagaaaaatgg

SEQ ID NO: 699619 - DNA, 22 bp, Artificial Sequence
  chemically synthesized
tattttgttaactcagaaaaat

SEQ ID NO: 699620 - DNA, 22 bp, Artificial Sequence
  chemically synthesized
ccttcactcccatttttctgag

SEQ ID NO: 699621 - DNA, 22 bp, Artificial Sequence
  chemically synthesized
cactcccatttttctgagttaa

SEQ ID NO: 699622 - DNA, 22 bp, Artificial Sequence
  chemically synthesized
actcccatttttctgagttaac

SEQ ID NO: 699623 - DNA, 22 bp, Artificial Sequence
  chemically synthesized
tgcctctattttgttaactcag

SEQ ID NO: 699624 - DNA, 22 bp, Artificial Sequence
  chemically synthesized
atgcctctattttgttaactca

SEQ ID NO: 699625 - DNA, 22 bp, Artificial Sequence
  chemically synthesized
tatgcctctattttgttaactc

SEQ ID NO: 699626 - DNA, 22 bp, Artificial Sequence
  chemically synthesized
ccatttttctgagttaacaaaa

SEQ ID NO: 699627 - DNA, 22 bp, Artificial Sequence
  chemically synthesized
attttatgcctctattttgtta

SEQ ID NO: 699628 - DNA, 22 bp, Artificial Sequence
  chemically synthesized
gattttatgcctctattttgtt

SEQ ID NO: 699629 - DNA, 22 bp, Artificial Sequence
  chemically synthesized
ttctgagttaacaaaatagagg

SEQ ID NO: 699630 - DNA, 22 bp, Artificial Sequence
  chemically synthesized
tctgagttaacaaaatagaggc

SEQ ID NO: 699631 - DNA, 22 bp, Artificial Sequence
  chemically synthesized
ctgagttaacaaaatagaggca

SEQ ID NO: 699632 - DNA, 22 bp, Artificial Sequence
  chemically synthesized
tgagttaacaaaatagaggcat

SEQ ID NO: 699633 - DNA, 22 bp, Artificial Sequence
  chemically synthesized
agttaacaaaatagaggcataa

SEQ ID NO: 699634 - DNA, 22 bp, Artificial Sequence
  chemically synthesized
aagaaatttgattttatgcctc

SEQ ID NO: 699635 - DNA, 22 bp, Artificial Sequence
  chemically synthesized
acaaaatagaggcataaaatca

SEQ ID NO: 699636 - DNA, 22 bp, Artificial Sequence
  chemically synthesized
cagtcctcaagaaatttgattt

SEQ ID NO: 699637 - DNA, 22 bp, Artificial Sequence
  chemically synthesized
ctacagtcctcaagaaatttga

SEQ ID NO: 699638 - DNA, 22 bp, Artificial Sequence
  chemically synthesized
attactacagtcctcaagaaat

SEQ ID NO: 699639 - DNA, 22 bp, Artificial Sequence
  chemically synthesized
cattactacagtcctcaagaaa

SEQ ID NO: 699640 - DNA, 22 bp, Artificial Sequence
  chemically synthesized
gatcttcattactacagtcctc

SEQ ID NO: 699641 - DNA, 22 bp, Artificial Sequence
  chemically synthesized
cttgaggactgtagtaatgaag

SEQ ID NO: 699642 - DNA, 22 bp, Artificial Sequence
  chemically synthesized
ttgaggactgtagtaatgaaga

SEQ ID NO: 699643 - DNA, 22 bp, Artificial Sequence
  chemically synthesized
gaggactgtagtaatgaagatc

SEQ ID NO: 699644 - DNA, 22 bp, Artificial Sequence
  chemically synthesized
aggactgtagtaatgaagatct

SEQ ID NO: 699645 - DNA, 22 bp, Artificial Sequence
  chemically synthesized
tagtaatgaagatctaggactg

SEQ ID NO: 699646 - DNA, 22 bp, Artificial Sequence
  chemically synthesized
aagcaataacagcagtcctaga

SEQ ID NO: 699647 - DNA, 22 bp, Artificial Sequence
  chemically synthesized
taaagcaataacagcagtccta

SEQ ID NO: 699648 - DNA, 22 bp, Artificial Sequence
  chemically synthesized
ggttctaaagcaataacagcag

SEQ ID NO: 699649 - DNA, 22 bp, Artificial Sequence
  chemically synthesized
attcggttctaaagcaataaca

SEQ ID NO: 699650 - DNA, 22 bp, Artificial Sequence
  chemically synthesized
aattcggttctaaagcaataac

SEQ ID NO: 699651 - DNA, 22 bp, Artificial Sequence
  chemically synthesized
ttaattcggttctaaagcaata

SEQ ID NO: 699652 - DNA, 22 bp, Artificial Sequence
  chemically synthesized
cttaattcggttctaaagcaat

SEQ ID NO: 699653 - DNA, 22 bp, Artificial Sequence
  chemically synthesized
ggactgctgttattgctttaga

SEQ ID NO: 699654 - DNA, 22 bp, Artificial Sequence
  chemically synthesized
ttcttaattcggttctaaagca

SEQ ID NO: 699655 - DNA, 22 bp, Artificial Sequence
  chemically synthesized
ctgttattgctttagaaccgaa

SEQ ID NO: 699656 - DNA, 22 bp, Artificial Sequence
  chemically synthesized
ttattgctttagaaccgaatta

SEQ ID NO: 699657 - DNA, 22 bp, Artificial Sequence
  chemically synthesized
ttgctttagaaccgaattaaga

SEQ ID NO: 699658 - DNA, 22 bp, Artificial Sequence
  chemically synthesized
tccatcaattcttcttaattcg

SEQ ID NO: 699659 - DNA, 22 bp, Artificial Sequence
  chemically synthesized
ctttagaaccgaattaagaaga

SEQ ID NO: 699660 - DNA, 22 bp, Artificial Sequence
  chemically synthesized
actgtccatcaattcttcttaa

SEQ ID NO: 699661 - DNA, 22 bp, Artificial Sequence
  chemically synthesized
cactgtccatcaattcttctta

SEQ ID NO: 699662 - DNA, 22 bp, Artificial Sequence
  chemically synthesized
tagaaccgaattaagaagaatt

SEQ ID NO: 699663 - DNA, 22 bp, Artificial Sequence
  chemically synthesized
tcactgtccatcaattcttctt

SEQ ID NO: 699664 - DNA, 22 bp, Artificial Sequence
  chemically synthesized
agaaccgaattaagaagaattg

SEQ ID NO: 699665 - DNA, 22 bp, Artificial Sequence
  chemically synthesized
gaaccgaattaagaagaattga

SEQ ID NO: 699666 - DNA, 22 bp, Artificial Sequence
  chemically synthesized
tttcactgtccatcaattcttc

SEQ ID NO: 699667 - DNA, 22 bp, Artificial Sequence
  chemically synthesized
ttctttcactgtccatcaattc

SEQ ID NO: 699668 - DNA, 22 bp, Artificial Sequence
  chemically synthesized
attctttcactgtccatcaatt

SEQ ID NO: 699669 - DNA, 22 bp, Artificial Sequence
  chemically synthesized
tattctttcactgtccatcaat

SEQ ID NO: 699670 - DNA, 22 bp, Artificial Sequence
  chemically synthesized
ttattctttcactgtccatcaa

SEQ ID NO: 699671 - DNA, 22 bp, Artificial Sequence
  chemically synthesized
tttttattctttcactgtccat

SEQ ID NO: 699672 - DNA, 22 bp, Artificial Sequence
  chemically synthesized
agaagaattgatggacagtgaa

SEQ ID NO: 699673 - DNA, 22 bp, Artificial Sequence
  chemically synthesized
tcgaatctgtttttattctttc

SEQ ID NO: 699674 - DNA, 22 bp, Artificial Sequence
  chemically synthesized
atcgaatctgtttttattcttt

SEQ ID NO: 699675 - DNA, 22 bp, Artificial Sequence
  chemically synthesized
tatcgaatctgtttttattctt

SEQ ID NO: 699676 - DNA, 22 bp, Artificial Sequence
  chemically synthesized
atggacagtgaaagaataaaaa

SEQ ID NO: 699677 - DNA, 22 bp, Artificial Sequence
  chemically synthesized
ttatcgaatctgtttttattct

SEQ ID NO: 699678 - DNA, 22 bp, Artificial Sequence
  chemically synthesized
ccatcttttatcgaatctgttt

SEQ ID NO: 699679 - DNA, 22 bp, Artificial Sequence
  chemically synthesized
cgcctgccatcttttatcgaat

SEQ ID NO: 699680 - DNA, 22 bp, Artificial Sequence
  chemically synthesized
ccgcctgccatcttttatcgaa

SEQ ID NO: 699681 - DNA, 22 bp, Artificial Sequence
  chemically synthesized
tccgcctgccatcttttatcga

SEQ ID NO: 699682 - DNA, 22 bp, Artificial Sequence
  chemically synthesized
ttccgcctgccatcttttatcg

SEQ ID NO: 699683 - DNA, 22 bp, Artificial Sequence
  chemically synthesized
tttccgcctgccatcttttatc

SEQ ID NO: 699684 - DNA, 22 bp, Artificial Sequence
  chemically synthesized
ttttccgcctgccatcttttat

SEQ ID NO: 699685 - DNA, 22 bp, Artificial Sequence
  chemically synthesized
ccatttttttccgcctgccatc

SEQ ID NO: 699686 - DNA, 22 bp, Artificial Sequence
  chemically synthesized
cccatttttttccgcctgccat

SEQ ID NO: 699687 - DNA, 22 bp, Artificial Sequence
  chemically synthesized
tcccatttttttccgcctgcca

SEQ ID NO: 699688 - DNA, 22 bp, Artificial Sequence
  chemically synthesized
gataaaagatggcaggcggaaa

SEQ ID NO: 699689 - DNA, 22 bp, Artificial Sequence
  chemically synthesized
gatgttttcccatttttttccg

SEQ ID NO: 699690 - DNA, 22 bp, Artificial Sequence
  chemically synthesized
aaaatattagatgttttcccat

SEQ ID NO: 699691 - DNA, 22 bp, Artificial Sequence
  chemically synthesized
actaaaaatattagatgttttc

SEQ ID NO: 699692 - DNA, 22 bp, Artificial Sequence
  chemically synthesized
ccatgagtctgactaaaaatat

SEQ ID NO: 699693 - DNA, 22 bp, Artificial Sequence
  chemically synthesized
tgccatgagtctgactaaaaat

SEQ ID NO: 699694 - DNA, 22 bp, Artificial Sequence
  chemically synthesized
ctgccatgagtctgactaaaaa

SEQ ID NO: 699695 - DNA, 22 bp, Artificial Sequence
  chemically synthesized
cttctgccatgagtctgactaa

SEQ ID NO: 699696 - DNA, 22 bp, Artificial Sequence
  chemically synthesized
gcttctgccatgagtctgacta

SEQ ID NO: 699697 - DNA, 22 bp, Artificial Sequence
  chemically synthesized
atatttttagtcagactcatgg

SEQ ID NO: 699698 - DNA, 22 bp, Artificial Sequence
  chemically synthesized
aacttgcttctgccatgagtct

SEQ ID NO: 699699 - DNA, 22 bp, Artificial Sequence
  chemically synthesized
gaacttgcttctgccatgagtc

SEQ ID NO: 699700 - DNA, 22 bp, Artificial Sequence
  chemically synthesized
tgaacttgcttctgccatgagt

SEQ ID NO: 699701 - DNA, 22 bp, Artificial Sequence
  chemically synthesized
ttagtcagactcatggcagaag

SEQ ID NO: 699702 - DNA, 22 bp, Artificial Sequence
  chemically synthesized
tagtcagactcatggcagaagc

SEQ ID NO: 699703 - DNA, 22 bp, Artificial Sequence
  chemically synthesized
agtcagactcatggcagaagca

SEQ ID NO: 699704 - DNA, 22 bp, Artificial Sequence
  chemically synthesized
gtcagactcatggcagaagcaa

SEQ ID NO: 699705 - DNA, 22 bp, Artificial Sequence
  chemically synthesized
atggcagaagcaagttcaaaga

SEQ ID NO: 699706 - DNA, 22 bp, Artificial Sequence
  chemically synthesized
gataccaaccgaagtctttgaa

SEQ ID NO: 699707 - DNA, 22 bp, Artificial Sequence
  chemically synthesized
ataaaatagtcctcgataccaa

SEQ ID NO: 699708 - DNA, 22 bp, Artificial Sequence
  chemically synthesized
aaagacttcggttggtatcgag

SEQ ID NO: 699709 - DNA, 22 bp, Artificial Sequence
  chemically synthesized
ggttcataaaatagtcctcgat

SEQ ID NO: 699710 - DNA, 22 bp, Artificial Sequence
  chemically synthesized
ctgggttcataaaatagtcctc

SEQ ID NO: 699711 - DNA, 22 bp, Artificial Sequence
  chemically synthesized
cggttggtatcgaggactattt

SEQ ID NO: 699712 - DNA, 22 bp, Artificial Sequence
  chemically synthesized
actgggttcataaaatagtcct

SEQ ID NO: 699713 - DNA, 22 bp, Artificial Sequence
  chemically synthesized
ggttggtatcgaggactatttt

SEQ ID NO: 699714 - DNA, 22 bp, Artificial Sequence
  chemically synthesized
gtatcgaggactattttatgaa

SEQ ID NO: 699715 - DNA, 22 bp, Artificial Sequence
  chemically synthesized
caatttactgggttcataaaat

SEQ ID NO: 699716 - DNA, 22 bp, Artificial Sequence
  chemically synthesized
aacaacaattacaatttactgg

SEQ ID NO: 699717 - DNA, 22 bp, Artificial Sequence
  chemically synthesized
ttttatgaacccagtaaattgt

SEQ ID NO: 699718 - DNA, 22 bp, Artificial Sequence
  chemically synthesized
tatgaacccagtaaattgtaat

SEQ ID NO: 699719 - DNA, 22 bp, Artificial Sequence
  chemically synthesized
atgaacccagtaaattgtaatt

SEQ ID NO: 699720 - DNA, 22 bp, Artificial Sequence
  chemically synthesized
tgaacccagtaaattgtaattg

SEQ ID NO: 699721 - DNA, 22 bp, Artificial Sequence
  chemically synthesized
gaaacctcaacaacaattacaa

SEQ ID NO: 699722 - DNA, 22 bp, Artificial Sequence
  chemically synthesized
aattggaaacctcaacaacaat

SEQ ID NO: 699723 - DNA, 22 bp, Artificial Sequence
  chemically synthesized
gaattggaaacctcaacaacaa

SEQ ID NO: 699724 - DNA, 22 bp, Artificial Sequence
  chemically synthesized
tgaattggaaacctcaacaaca

SEQ ID NO: 699725 - DNA, 22 bp, Artificial Sequence
  chemically synthesized
actttgaattggaaacctcaac

SEQ ID NO: 699726 - DNA, 22 bp, Artificial Sequence
  chemically synthesized
aactttgaattggaaacctcaa

SEQ ID NO: 699727 - DNA, 22 bp, Artificial Sequence
  chemically synthesized
taattgttgttgaggtttccaa

SEQ ID NO: 699728 - DNA, 22 bp, Artificial Sequence
  chemically synthesized
aatttaactttgaattggaaac

SEQ ID NO: 699729 - DNA, 22 bp, Artificial Sequence
  chemically synthesized
aaatttaactttgaattggaaa

SEQ ID NO: 699730 - DNA, 22 bp, Artificial Sequence
  chemically synthesized
ttgttgaggtttccaattcaaa

SEQ ID NO: 699731 - DNA, 22 bp, Artificial Sequence
  chemically synthesized
acttaaatttaactttgaattg

SEQ ID NO: 699732 - DNA, 22 bp, Artificial Sequence
  chemically synthesized
ttgaggtttccaattcaaagtt

SEQ ID NO: 699733 - DNA, 22 bp, Artificial Sequence
  chemically synthesized
aggtttccaattcaaagttaaa

SEQ ID NO: 699734 - DNA, 22 bp, Artificial Sequence
  chemically synthesized
gagtctaacttaaatttaactt

SEQ ID NO: 699735 - DNA, 22 bp, Artificial Sequence
  chemically synthesized
ccaattcaaagttaaatttaag

SEQ ID NO: 699736 - DNA, 22 bp, Artificial Sequence
  chemically synthesized
caattcaaagttaaatttaagt

SEQ ID NO: 699737 - DNA, 22 bp, Artificial Sequence
  chemically synthesized
tgcactagagtctaacttaaat

SEQ ID NO: 699738 - DNA, 22 bp, Artificial Sequence
  chemically synthesized
aaagttaaatttaagttagact

SEQ ID NO: 699739 - DNA, 22 bp, Artificial Sequence
  chemically synthesized
atccattgtgcactagagtcta

SEQ ID NO: 699740 - DNA, 22 bp, Artificial Sequence
  chemically synthesized
tcatccattgtgcactagagtc

SEQ ID NO: 699741 - DNA, 22 bp, Artificial Sequence
  chemically synthesized
aatttaagttagactctagtgc

SEQ ID NO: 699742 - DNA, 22 bp, Artificial Sequence
  chemically synthesized
aagttagactctagtgcacaat

SEQ ID NO: 699743 - DNA, 22 bp, Artificial Sequence
  chemically synthesized
agttagactctagtgcacaatg

SEQ ID NO: 699744 - DNA, 22 bp, Artificial Sequence
  chemically synthesized
acagtctctcatccattgtgca

SEQ ID NO: 699745 - DNA, 22 bp, Artificial Sequence
  chemically synthesized
cacagtctctcatccattgtgc

SEQ ID NO: 699746 - DNA, 22 bp, Artificial Sequence
  chemically synthesized
gactctagtgcacaatggatga

SEQ ID NO: 699747 - DNA, 22 bp, Artificial Sequence
  chemically synthesized
tagtgcacaatggatgagagac

SEQ ID NO: 699748 - DNA, 22 bp, Artificial Sequence
  chemically synthesized
cgataccttcacagtctctcat

SEQ ID NO: 699749 - DNA, 22 bp, Artificial Sequence
  chemically synthesized
gtgcacaatggatgagagactg

SEQ ID NO: 699750 - DNA, 22 bp, Artificial Sequence
  chemically synthesized
agtgattacgataccttcacag

SEQ ID NO: 699751 - DNA, 22 bp, Artificial Sequence
  chemically synthesized
tgaaggtatcgtaatcactcaa

SEQ ID NO: 699752 - DNA, 22 bp, Artificial Sequence
  chemically synthesized
ggtcaacgtggaagagagagga

SEQ ID NO: 699753 - DNA, 22 bp, Artificial Sequence
  chemically synthesized
aatatcctctctcctctctctt

SEQ ID NO: 699754 - DNA, 22 bp, Artificial Sequence
  chemically synthesized
tctcctctctcttccacgttga

SEQ ID NO: 699755 - DNA, 22 bp, Artificial Sequence
  chemically synthesized
tcctctctcttccacgttgacc

SEQ ID NO: 699756 - DNA, 22 bp, Artificial Sequence
  chemically synthesized
ctctctcttccacgttgaccca

SEQ ID NO: 699757 - DNA, 22 bp, Artificial Sequence
  chemically synthesized
tctcttccacgttgacccaatg

SEQ ID NO: 699758 - DNA, 22 bp, Artificial Sequence
  chemically synthesized
tcttccacgttgacccaatgta

SEQ ID NO: 699759 - DNA, 22 bp, Artificial Sequence
  chemically synthesized
ttccacgttgacccaatgtatt

SEQ ID NO: 699760 - DNA, 22 bp, Artificial Sequence
  chemically synthesized
ccacgttgacccaatgtattgt

SEQ ID NO: 699761 - DNA, 22 bp, Artificial Sequence
  chemically synthesized
cacgttgacccaatgtattgtc

SEQ ID NO: 699762 - DNA, 22 bp, Artificial Sequence
  chemically synthesized
catgaaatataaatgacaatac

SEQ ID NO: 699763 - DNA, 22 bp, Artificial Sequence
  chemically synthesized
gcatgaaatataaatgacaata

SEQ ID NO: 699764 - DNA, 22 bp, Artificial Sequence
  chemically synthesized
tgcatgaaatataaatgacaat

SEQ ID NO: 699765 - DNA, 22 bp, Artificial Sequence
  chemically synthesized
acccaatgtattgtcatttata

SEQ ID NO: 699766 - DNA, 22 bp, Artificial Sequence
  chemically synthesized
tagtattttgcatgaaatataa

SEQ ID NO: 699767 - DNA, 22 bp, Artificial Sequence
  chemically synthesized
tgtagtattttgcatgaaatat

SEQ ID NO: 699768 - DNA, 22 bp, Artificial Sequence
  chemically synthesized
ctgtagtattttgcatgaaata

SEQ ID NO: 699769 - DNA, 22 bp, Artificial Sequence
  chemically synthesized
tcatttatatttcatgcaaaat

SEQ ID NO: 699770 - DNA, 22 bp, Artificial Sequence
  chemically synthesized
gaagcaccttctgtagtatttt

SEQ ID NO: 699771 - DNA, 22 bp, Artificial Sequence
  chemically synthesized
atatttcatgcaaaatactaca

SEQ ID NO: 699772 - DNA, 22 bp, Artificial Sequence
  chemically synthesized
ggaagcaccttctgtagtattt

SEQ ID NO: 699773 - DNA, 22 bp, Artificial Sequence
  chemically synthesized
tatttcatgcaaaatactacag

SEQ ID NO: 699774 - DNA, 22 bp, Artificial Sequence
  chemically synthesized
catgcaaaatactacagaaggt

SEQ ID NO: 699775 - DNA, 22 bp, Artificial Sequence
  chemically synthesized
atgcaaaatactacagaaggtg

SEQ ID NO: 699776 - DNA, 22 bp, Artificial Sequence
  chemically synthesized
cagaaggtgcttccaagcactc

SEQ ID NO: 699777 - DNA, 22 bp, Artificial Sequence
  chemically synthesized
tgccagtcaaaagaatacgagt

SEQ ID NO: 699778 - DNA, 22 bp, Artificial Sequence
  chemically synthesized
gtgccagtcaaaagaatacgag

SEQ ID NO: 699779 - DNA, 22 bp, Artificial Sequence
  chemically synthesized
ccaagcactcgtattcttttga

SEQ ID NO: 699780 - DNA, 22 bp, Artificial Sequence
  chemically synthesized
caagcactcgtattcttttgac

SEQ ID NO: 699781 - DNA, 22 bp, Artificial Sequence
  chemically synthesized
gaaacatttgtgccagtcaaaa

SEQ ID NO: 699782 - DNA, 22 bp, Artificial Sequence
  chemically synthesized
tggaaacatttgtgccagtcaa

SEQ ID NO: 699783 - DNA, 22 bp, Artificial Sequence
  chemically synthesized
ctggaaacatttgtgccagtca

SEQ ID NO: 699784 - DNA, 22 bp, Artificial Sequence
  chemically synthesized
tctggaaacatttgtgccagtc

SEQ ID NO: 699785 - DNA, 22 bp, Artificial Sequence
  chemically synthesized
gtattcttttgactggcacaaa

SEQ ID NO: 699786 - DNA, 22 bp, Artificial Sequence
  chemically synthesized
ttttctggaaacatttgtgcca

SEQ ID NO: 699787 - DNA, 22 bp, Artificial Sequence
  chemically synthesized
ttttgactggcacaaatgtttc

SEQ ID NO: 699788 - DNA, 22 bp, Artificial Sequence
  chemically synthesized
ttgactggcacaaatgtttcca

SEQ ID NO: 699789 - DNA, 22 bp, Artificial Sequence
  chemically synthesized
tgactggcacaaatgtttccag

SEQ ID NO: 699790 - DNA, 22 bp, Artificial Sequence
  chemically synthesized
gactggcacaaatgtttccaga

SEQ ID NO: 699791 - DNA, 22 bp, Artificial Sequence
  chemically synthesized
actggcacaaatgtttccagaa

SEQ ID NO: 699792 - DNA, 22 bp, Artificial Sequence
  chemically synthesized
gcacaaatgtttccagaaaaca

SEQ ID NO: 699793 - DNA, 22 bp, Artificial Sequence
  chemically synthesized
acaacagaaagatactgttttc

SEQ ID NO: 699794 - DNA, 22 bp, Artificial Sequence
  chemically synthesized
tcacctaacaacagaaagatac

SEQ ID NO: 699795 - DNA, 22 bp, Artificial Sequence
  chemically synthesized
gtcacctaacaacagaaagata

SEQ ID NO: 699796 - DNA, 22 bp, Artificial Sequence
  chemically synthesized
ccagaaaacagtatctttctgt

SEQ ID NO: 699797 - DNA, 22 bp, Artificial Sequence
  chemically synthesized
cagaaaacagtatctttctgtt

SEQ ID NO: 699798 - DNA, 22 bp, Artificial Sequence
  chemically synthesized
agtatttgtcacctaacaacag

SEQ ID NO: 699799 - DNA, 22 bp, Artificial Sequence
  chemically synthesized
tctgttgttaggtgacaaatac

SEQ ID NO: 699800 - DNA, 22 bp, Artificial Sequence
  chemically synthesized
ctgttgttaggtgacaaatact

SEQ ID NO: 699801 - DNA, 22 bp, Artificial Sequence
  chemically synthesized
tgttgttaggtgacaaatactg

SEQ ID NO: 699802 - DNA, 22 bp, Artificial Sequence
  chemically synthesized
atacataacactcagtatttgt

SEQ ID NO: 699803 - DNA, 22 bp, Artificial Sequence
  chemically synthesized
gatacataacactcagtatttg

SEQ ID NO: 699804 - DNA, 22 bp, Artificial Sequence
  chemically synthesized
ttgttaggtgacaaatactgag

SEQ ID NO: 699805 - DNA, 22 bp, Artificial Sequence
  chemically synthesized
ttgatacataacactcagtatt

SEQ ID NO: 699806 - DNA, 22 bp, Artificial Sequence
  chemically synthesized
ttaggtgacaaatactgagtgt

SEQ ID NO: 699807 - DNA, 22 bp, Artificial Sequence
  chemically synthesized
attcttgatacataacactcag

SEQ ID NO: 699808 - DNA, 22 bp, Artificial Sequence
  chemically synthesized
ggtgacaaatactgagtgttat

SEQ ID NO: 699809 - DNA, 22 bp, Artificial Sequence
  chemically synthesized
ttcattcttgatacataacact

SEQ ID NO: 699810 - DNA, 22 bp, Artificial Sequence
  chemically synthesized
gttgttcattcttgatacataa

SEQ ID NO: 699811 - DNA, 22 bp, Artificial Sequence
  chemically synthesized
agttgttcattcttgatacata

SEQ ID NO: 699812 - DNA, 22 bp, Artificial Sequence
  chemically synthesized
agtgttatgtatcaagaatgaa

SEQ ID NO: 699813 - DNA, 22 bp, Artificial Sequence
  chemically synthesized
gtagggcttagttgttcattct

SEQ ID NO: 699814 - DNA, 22 bp, Artificial Sequence
  chemically synthesized
tgtatcaagaatgaacaactaa

SEQ ID NO: 699815 - DNA, 22 bp, Artificial Sequence
  chemically synthesized
gactcgtagggcttagttgttc

SEQ ID NO: 699816 - DNA, 22 bp, Artificial Sequence
  chemically synthesized
agccctacgagtcgaggactgc

SEQ ID NO: 699817 - DNA, 22 bp, Artificial Sequence
  chemically synthesized
caaaaggcagaaagcagcagtc

SEQ ID NO: 699818 - DNA, 22 bp, Artificial Sequence
  chemically synthesized
ccaaaaggcagaaagcagcagt

SEQ ID NO: 699819 - DNA, 22 bp, Artificial Sequence
  chemically synthesized
cgagtcgaggactgctgctttc

SEQ ID NO: 699820 - DNA, 22 bp, Artificial Sequence
  chemically synthesized
catgtttccaaaaggcagaaag

SEQ ID NO: 699821 - DNA, 22 bp, Artificial Sequence
  chemically synthesized
ctgctttctgccttttggaaac

SEQ ID NO: 699822 - DNA, 22 bp, Artificial Sequence
  chemically synthesized
ctttctgccttttggaaacatg

SEQ ID NO: 699823 - DNA, 22 bp, Artificial Sequence
  chemically synthesized
tctgccttttggaaacatgtag

SEQ ID NO: 699824 - DNA, 22 bp, Artificial Sequence
  chemically synthesized
ggtgaatgaatactacatgttt

SEQ ID NO: 699825 - DNA, 22 bp, Artificial Sequence
  chemically synthesized
ctgccttttggaaacatgtagt

SEQ ID NO: 699826 - DNA, 22 bp, Artificial Sequence
  chemically synthesized
gggtgaatgaatactacatgtt

SEQ ID NO: 699827 - DNA, 22 bp, Artificial Sequence
  chemically synthesized
tgccttttggaaacatgtagta

SEQ ID NO: 699828 - DNA, 22 bp, Artificial Sequence
  chemically synthesized
tgggtgaatgaatactacatgt

SEQ ID NO: 699829 - DNA, 22 bp, Artificial Sequence
  chemically synthesized
ccttttggaaacatgtagtatt

SEQ ID NO: 699830 - DNA, 22 bp, Artificial Sequence
  chemically synthesized
ttttgggtgaatgaatactaca

SEQ ID NO: 699831 - DNA, 22 bp, Artificial Sequence
  chemically synthesized
ttggaaacatgtagtattcatt

SEQ ID NO: 699832 - DNA, 22 bp, Artificial Sequence
  chemically synthesized
tggaaacatgtagtattcattc

SEQ ID NO: 699833 - DNA, 22 bp, Artificial Sequence
  chemically synthesized
ggaaacatgtagtattcattca

SEQ ID NO: 699834 - DNA, 22 bp, Artificial Sequence
  chemically synthesized
gaaacatgtagtattcattcac

SEQ ID NO: 699835 - DNA, 22 bp, Artificial Sequence
  chemically synthesized
tatgtacacaactgttttgggt

SEQ ID NO: 699836 - DNA, 22 bp, Artificial Sequence
  chemically synthesized
attcacccaaaacagttgtgta

SEQ ID NO: 699837 - DNA, 22 bp, Artificial Sequence
  chemically synthesized
cgcagttatatgtacacaactg

SEQ ID NO: 699838 - DNA, 22 bp, Artificial Sequence
  chemically synthesized
ccgcagttatatgtacacaact

SEQ ID NO: 699839 - DNA, 22 bp, Artificial Sequence
  chemically synthesized
acccaaaacagttgtgtacata

SEQ ID NO: 699840 - DNA, 22 bp, Artificial Sequence
  chemically synthesized
tgtacatataactgcggaaatc

SEQ ID NO: 699841 - DNA, 22 bp, Artificial Sequence
  chemically synthesized
cgtcaaagatagaagatttccg

SEQ ID NO: 699842 - DNA, 22 bp, Artificial Sequence
  chemically synthesized
ccgtcaaagatagaagatttcc

SEQ ID NO: 699843 - DNA, 22 bp, Artificial Sequence
  chemically synthesized
ttccgtcaaagatagaagattt

SEQ ID NO: 699844 - DNA, 22 bp, Artificial Sequence
  chemically synthesized
cttccgtcaaagatagaagatt

SEQ ID NO: 699845 - DNA, 22 bp, Artificial Sequence
  chemically synthesized
ttcttccgtcaaagatagaaga

SEQ ID NO: 699846 - DNA, 22 bp, Artificial Sequence
  chemically synthesized
cttcttccgtcaaagatagaag

SEQ ID NO: 699847 - DNA, 22 bp, Artificial Sequence
  chemically synthesized
cggaaatcttctatctttgacg

SEQ ID NO: 699848 - DNA, 22 bp, Artificial Sequence
  chemically synthesized
acatttcttcttccgtcaaaga

SEQ ID NO: 699849 - DNA, 22 bp, Artificial Sequence
  chemically synthesized
tcacatttcttcttccgtcaaa

SEQ ID NO: 699850 - DNA, 22 bp, Artificial Sequence
  chemically synthesized
ctcacatttcttcttccgtcaa

SEQ ID NO: 699851 - DNA, 22 bp, Artificial Sequence
  chemically synthesized
tctcacatttcttcttccgtca

SEQ ID NO: 699852 - DNA, 22 bp, Artificial Sequence
  chemically synthesized
ctatctttgacggaagaagaaa

SEQ ID NO: 699853 - DNA, 22 bp, Artificial Sequence
  chemically synthesized
tatctttgacggaagaagaaat

SEQ ID NO: 699854 - DNA, 22 bp, Artificial Sequence
  chemically synthesized
ggggttttctcacatttcttct

SEQ ID NO: 699855 - DNA, 22 bp, Artificial Sequence
  chemically synthesized
tctttgacggaagaagaaatgt

SEQ ID NO: 699856 - DNA, 22 bp, Artificial Sequence
  chemically synthesized
aggggttttctcacatttcttc

SEQ ID NO: 699857 - DNA, 22 bp, Artificial Sequence
  chemically synthesized
tttaggggttttctcacatttc

SEQ ID NO: 699858 - DNA, 22 bp, Artificial Sequence
  chemically synthesized
tgacggaagaagaaatgtgaga

SEQ ID NO: 699859 - DNA, 22 bp, Artificial Sequence
  chemically synthesized
atttaggggttttctcacattt

SEQ ID NO: 699860 - DNA, 22 bp, Artificial Sequence
  chemically synthesized
gacggaagaagaaatgtgagaa

SEQ ID NO: 699861 - DNA, 22 bp, Artificial Sequence
  chemically synthesized
tatttaggggttttctcacatt

SEQ ID NO: 699862 - DNA, 22 bp, Artificial Sequence
  chemically synthesized
acggaagaagaaatgtgagaaa

SEQ ID NO: 699863 - DNA, 22 bp, Artificial Sequence
  chemically synthesized
ttatttaggggttttctcacat

SEQ ID NO: 699864 - DNA, 22 bp, Artificial Sequence
  chemically synthesized
ttttatttaggggttttctcac

SEQ ID NO: 699865 - DNA, 22 bp, Artificial Sequence
  chemically synthesized
cttttatttaggggttttctca

SEQ ID NO: 699866 - DNA, 22 bp, Artificial Sequence
  chemically synthesized
cgagaacaatttcttttattta

SEQ ID NO: 699867 - DNA, 22 bp, Artificial Sequence
  chemically synthesized
gcgagaacaatttcttttattt

SEQ ID NO: 699868 - DNA, 22 bp, Artificial Sequence
  chemically synthesized
tgcgagaacaatttcttttatt

SEQ ID NO: 699869 - DNA, 22 bp, Artificial Sequence
  chemically synthesized
aataaaagaaattgttctcgca

SEQ ID NO: 699870 - DNA, 22 bp, Artificial Sequence
  chemically synthesized
atagtgggagtcaatctttgcg

SEQ ID NO: 699871 - DNA, 22 bp, Artificial Sequence
  chemically synthesized
ttgatagtgggagtcaatcttt

SEQ ID NO: 699872 - DNA, 22 bp, Artificial Sequence
  chemically synthesized
attgatagtgggagtcaatctt

SEQ ID NO: 699873 - DNA, 22 bp, Artificial Sequence
  chemically synthesized
tattgatagtgggagtcaatct

SEQ ID NO: 699874 - DNA, 22 bp, Artificial Sequence
  chemically synthesized
ttctcgcaaagattgactccca

SEQ ID NO: 699875 - DNA, 22 bp, Artificial Sequence
  chemically synthesized
tcgcaaagattgactcccacta

SEQ ID NO: 699876 - DNA, 22 bp, Artificial Sequence
  chemically synthesized
gcaaagattgactcccactatc

SEQ ID NO: 699877 - DNA, 22 bp, Artificial Sequence
  chemically synthesized
cagataattttattgatagtgg

SEQ ID NO: 699878 - DNA, 22 bp, Artificial Sequence
  chemically synthesized
actcccactatcaataaaatta

SEQ ID NO: 699879 - DNA, 22 bp, Artificial Sequence
  chemically synthesized
ccactatcaataaaattatctg

SEQ ID NO: 699880 - DNA, 22 bp, Artificial Sequence
  chemically synthesized
tcaataaaattatctggagctt

SEQ ID NO: 699881 - DNA, 22 bp, Artificial Sequence
  chemically synthesized
acaatagaaccaaaagctccag

SEQ ID NO: 699882 - DNA, 22 bp, Artificial Sequence
  chemically synthesized
cacaatagaaccaaaagctcca

SEQ ID NO: 699883 - DNA, 22 bp, Artificial Sequence
  chemically synthesized
tcacaatagaaccaaaagctcc

SEQ ID NO: 699884 - DNA, 22 bp, Artificial Sequence
  chemically synthesized
ttcacaatagaaccaaaagctc

SEQ ID NO: 699885 - DNA, 22 bp, Artificial Sequence
  chemically synthesized
tctggagcttttggttctattg

SEQ ID NO: 699886 - DNA, 22 bp, Artificial Sequence
  chemically synthesized
gagcttttggttctattgtgaa

SEQ ID NO: 699887 - DNA, 22 bp, Artificial Sequence
  chemically synthesized
ttggttctattgtgaaaaatcc

SEQ ID NO: 699888 - DNA, 22 bp, Artificial Sequence
  chemically synthesized
tggttctattgtgaaaaatccg

SEQ ID NO: 699889 - DNA, 22 bp, Artificial Sequence
  chemically synthesized
tgacagagggggcggatttttc

SEQ ID NO: 699890 - DNA, 22 bp, Artificial Sequence
  chemically synthesized
ggttctattgtgaaaaatccgc

SEQ ID NO: 699891 - DNA, 22 bp, Artificial Sequence
  chemically synthesized
gtgacagagggggcggattttt

SEQ ID NO: 699892 - DNA, 22 bp, Artificial Sequence
  chemically synthesized
gttctattgtgaaaaatccgcc

SEQ ID NO: 699893 - DNA, 22 bp, Artificial Sequence
  chemically synthesized
tgtgacagagggggcggatttt

SEQ ID NO: 699894 - DNA, 22 bp, Artificial Sequence
  chemically synthesized
tattgtgaaaaatccgccccct

SEQ ID NO: 699895 - DNA, 22 bp, Artificial Sequence
  chemically synthesized
ttgtgaaaaatccgccccctct

SEQ ID NO: 699896 - DNA, 22 bp, Artificial Sequence
  chemically synthesized
tgaaaaatccgccccctctgtc

SEQ ID NO: 699897 - DNA, 22 bp, Artificial Sequence
  chemically synthesized
atgcaggatatatggtgtgttt

SEQ ID NO: 699898 - DNA, 22 bp, Artificial Sequence
  chemically synthesized
aatgcaggatatatggtgtgtt

SEQ ID NO: 699899 - DNA, 22 bp, Artificial Sequence
  chemically synthesized
tttaatgcaggatatatggtgt

SEQ ID NO: 699900 - DNA, 22 bp, Artificial Sequence
  chemically synthesized
tgtcacaaaacacaccatatat

SEQ ID NO: 699901 - DNA, 22 bp, Artificial Sequence
  chemically synthesized
atttaatgcaggatatatggtg

SEQ ID NO: 699902 - DNA, 22 bp, Artificial Sequence
  chemically synthesized
tcacaaaacacaccatatatcc

SEQ ID NO: 699903 - DNA, 22 bp, Artificial Sequence
  chemically synthesized
agaaaagtttatttaatgcagg

SEQ ID NO: 699904 - DNA, 22 bp, Artificial Sequence
  chemically synthesized
aagaaaagtttatttaatgcag

SEQ ID NO: 699905 - DNA, 22 bp, Artificial Sequence
  chemically synthesized
taagaaaagtttatttaatgca

SEQ ID NO: 699906 - DNA, 22 bp, Artificial Sequence
  chemically synthesized
ttaagaaaagtttatttaatgc

SEQ ID NO: 699907 - DNA, 22 bp, Artificial Sequence
  chemically synthesized
cattaaataaacttttcttaaa

SEQ ID NO: 699908 - DNA, 22 bp, Artificial Sequence
  chemically synthesized
aataaacttttcttaaaagtcg

SEQ ID NO: 699909 - DNA, 22 bp, Artificial Sequence
  chemically synthesized
atgcaatggggaacgactttta

SEQ ID NO: 699910 - DNA, 22 bp, Artificial Sequence
  chemically synthesized
ctgatgcaatggggaacgactt

SEQ ID NO: 699911 - DNA, 22 bp, Artificial Sequence
  chemically synthesized
gctgatgcaatggggaacgact

SEQ ID NO: 699912 - DNA, 22 bp, Artificial Sequence
  chemically synthesized
ttcttaaaagtcgttccccatt

SEQ ID NO: 699913 - DNA, 22 bp, Artificial Sequence
  chemically synthesized
tcttaaaagtcgttccccattg

SEQ ID NO: 699914 - DNA, 22 bp, Artificial Sequence
  chemically synthesized
cttaaaagtcgttccccattgc

SEQ ID NO: 699915 - DNA, 22 bp, Artificial Sequence
  chemically synthesized
ttaaaagtcgttccccattgca

SEQ ID NO: 699916 - DNA, 22 bp, Artificial Sequence
  chemically synthesized
taaatttgctgatgcaatgggg

SEQ ID NO: 699917 - DNA, 22 bp, Artificial Sequence
  chemically synthesized
aaaagtcgttccccattgcatc

SEQ ID NO: 699918 - DNA, 22 bp, Artificial Sequence
  chemically synthesized
aaagtcgttccccattgcatca

SEQ ID NO: 699919 - DNA, 22 bp, Artificial Sequence
  chemically synthesized
ccattgtaaatttgctgatgca

SEQ ID NO: 699920 - DNA, 22 bp, Artificial Sequence
  chemically synthesized
aaattaccattgtaaatttgct

SEQ ID NO: 699921 - DNA, 22 bp, Artificial Sequence
  chemically synthesized
cccattgcatcagcaaatttac

SEQ ID NO: 699922 - DNA, 22 bp, Artificial Sequence
  chemically synthesized
taaaattaccattgtaaatttg

SEQ ID NO: 699923 - DNA, 22 bp, Artificial Sequence
  chemically synthesized
ttctaaaattaccattgtaaat

SEQ ID NO: 699924 - DNA, 22 bp, Artificial Sequence
  chemically synthesized
attctaaaattaccattgtaaa

SEQ ID NO: 699925 - DNA, 22 bp, Artificial Sequence
  chemically synthesized
catcagcaaatttacaatggta

SEQ ID NO: 699926 - DNA, 22 bp, Artificial Sequence
  chemically synthesized
gataaaaaacttattctaaaat

SEQ ID NO: 699927 - DNA, 22 bp, Artificial Sequence
  chemically synthesized
ggataaaaaacttattctaaaa

SEQ ID NO: 699928 - DNA, 22 bp, Artificial Sequence
  chemically synthesized
acaatggtaattttagaataag

SEQ ID NO: 699929 - DNA, 22 bp, Artificial Sequence
  chemically synthesized
caatggtaattttagaataagt

SEQ ID NO: 699930 - DNA, 22 bp, Artificial Sequence
  chemically synthesized
aggaagcttggataaaaaactt

SEQ ID NO: 699931 - DNA, 22 bp, Artificial Sequence
  chemically synthesized
ctgaggaagcttggataaaaaa

SEQ ID NO: 699932 - DNA, 22 bp, Artificial Sequence
  chemically synthesized
cctgaggaagcttggataaaaa

SEQ ID NO: 699933 - DNA, 22 bp, Artificial Sequence
  chemically synthesized
tcctgaggaagcttggataaaa

SEQ ID NO: 699934 - DNA, 22 bp, Artificial Sequence
  chemically synthesized
tagaataagttttttatccaag

SEQ ID NO: 699935 - DNA, 22 bp, Artificial Sequence
  chemically synthesized
ttcctgaggaagcttggataaa

SEQ ID NO: 699936 - DNA, 22 bp, Artificial Sequence
  chemically synthesized
agaataagttttttatccaagc

SEQ ID NO: 699937 - DNA, 22 bp, Artificial Sequence
  chemically synthesized
tttcctgaggaagcttggataa

SEQ ID NO: 699938 - DNA, 22 bp, Artificial Sequence
  chemically synthesized
gaataagttttttatccaagct

SEQ ID NO: 699939 - DNA, 22 bp, Artificial Sequence
  chemically synthesized
ttttcctgaggaagcttggata

SEQ ID NO: 699940 - DNA, 22 bp, Artificial Sequence
  chemically synthesized
tttttcctgaggaagcttggat

SEQ ID NO: 699941 - DNA, 22 bp, Artificial Sequence
  chemically synthesized
ttttttcctgaggaagcttgga

SEQ ID NO: 699942 - DNA, 22 bp, Artificial Sequence
  chemically synthesized
tgtcttttttttcctgaggaag

SEQ ID NO: 699943 - DNA, 22 bp, Artificial Sequence
  chemically synthesized
tttatccaagcttcctcaggaa

SEQ ID NO: 699944 - DNA, 22 bp, Artificial Sequence
  chemically synthesized
ttatccaagcttcctcaggaaa

SEQ ID NO: 699945 - DNA, 22 bp, Artificial Sequence
  chemically synthesized
tatccaagcttcctcaggaaaa

SEQ ID NO: 699946 - DNA, 22 bp, Artificial Sequence
  chemically synthesized
atccaagcttcctcaggaaaaa

SEQ ID NO: 699947 - DNA, 22 bp, Artificial Sequence
  chemically synthesized
tccaagcttcctcaggaaaaaa

SEQ ID NO: 699948 - DNA, 22 bp, Artificial Sequence
  chemically synthesized
caatacctgtgtcttttttttc

SEQ ID NO: 699949 - DNA, 22 bp, Artificial Sequence
  chemically synthesized
gcctacaatacctgtgtctttt

SEQ ID NO: 699950 - DNA, 22 bp, Artificial Sequence
  chemically synthesized
cctcaggaaaaaaaagacacag

SEQ ID NO: 699951 - DNA, 22 bp, Artificial Sequence
  chemically synthesized
ctcaggaaaaaaaagacacagg

SEQ ID NO: 699952 - DNA, 22 bp, Artificial Sequence
  chemically synthesized
aggaaaaaaaagacacaggtat

SEQ ID NO: 699953 - DNA, 22 bp, Artificial Sequence
  chemically synthesized
gcctggcctacaatacctgtgt

SEQ ID NO: 699954 - DNA, 22 bp, Artificial Sequence
  chemically synthesized
aaatgcgacattagcctggcct

SEQ ID NO: 699955 - DNA, 22 bp, Artificial Sequence
  chemically synthesized
aaaatgcgacattagcctggcc

SEQ ID NO: 699956 - DNA, 22 bp, Artificial Sequence
  chemically synthesized
taaaatgcgacattagcctggc

SEQ ID NO: 699957 - DNA, 22 bp, Artificial Sequence
  chemically synthesized
ttaaaatgcgacattagcctgg

SEQ ID NO: 699958 - DNA, 22 bp, Artificial Sequence
  chemically synthesized
tttttaaaatgcgacattagcc

SEQ ID NO: 699959 - DNA, 22 bp, Artificial Sequence
  chemically synthesized
atttttaaaatgcgacattagc

SEQ ID NO: 699960 - DNA, 22 bp, Artificial Sequence
  chemically synthesized
taggccaggctaatgtcgcatt

SEQ ID NO: 699961 - DNA, 22 bp, Artificial Sequence
  chemically synthesized
acaagtgagtttatttttaaaa

SEQ ID NO: 699962 - DNA, 22 bp, Artificial Sequence
  chemically synthesized
atgtcgcattttaaaaataaac

SEQ ID NO: 699963 - DNA, 22 bp, Artificial Sequence
  chemically synthesized
tatattcacaagtgagtttatt

SEQ ID NO: 699964 - DNA, 22 bp, Artificial Sequence
  chemically synthesized
acctgtatattcacaagtgagt

SEQ ID NO: 699965 - DNA, 22 bp, Artificial Sequence
  chemically synthesized
taaaaataaactcacttgtgaa

SEQ ID NO: 699966 - DNA, 22 bp, Artificial Sequence
  chemically synthesized
aaaaataaactcacttgtgaat

SEQ ID NO: 699967 - DNA, 22 bp, Artificial Sequence
  chemically synthesized
aaaataaactcacttgtgaata

SEQ ID NO: 699968 - DNA, 22 bp, Artificial Sequence
  chemically synthesized
tgactaacctgtatattcacaa

SEQ ID NO: 699969 - DNA, 22 bp, Artificial Sequence
  chemically synthesized
ttgtgactaacctgtatattca

SEQ ID NO: 699970 - DNA, 22 bp, Artificial Sequence
  chemically synthesized
attgtgactaacctgtatattc

SEQ ID NO: 699971 - DNA, 22 bp, Artificial Sequence
  chemically synthesized
acttgtgaatatacaggttagt

SEQ ID NO: 699972 - DNA, 22 bp, Artificial Sequence
  chemically synthesized
gtgaatatacaggttagtcaca

SEQ ID NO: 699973 - DNA, 22 bp, Artificial Sequence
  chemically synthesized
tgaatatacaggttagtcacaa

SEQ ID NO: 699974 - DNA, 22 bp, Artificial Sequence
  chemically synthesized
aaagagcatttattgtgactaa

SEQ ID NO: 699975 - DNA, 22 bp, Artificial Sequence
  chemically synthesized
aaaagagcatttattgtgacta

SEQ ID NO: 699976 - DNA, 22 bp, Artificial Sequence
  chemically synthesized
taaaagagcatttattgtgact

SEQ ID NO: 699977 - DNA, 22 bp, Artificial Sequence
  chemically synthesized
ttaaaagagcatttattgtgac

SEQ ID NO: 699978 - DNA, 22 bp, Artificial Sequence
  chemically synthesized
gtcacaataaatgctcttttaa

SEQ ID NO: 699979 - DNA, 22 bp, Artificial Sequence
  chemically synthesized
gaagtatcacatttttaaaaga

SEQ ID NO: 699980 - DNA, 22 bp, Artificial Sequence
  chemically synthesized
ttttaaaaatgtgatacttcca

SEQ ID NO: 699981 - DNA, 22 bp, Artificial Sequence
  chemically synthesized
tatcaagtaagttggaagtatc

SEQ ID NO: 699982 - DNA, 22 bp, Artificial Sequence
  chemically synthesized
ttaaaaatgtgatacttccaac

SEQ ID NO: 699983 - DNA, 22 bp, Artificial Sequence
  chemically synthesized
taaaaatgtgatacttccaact

SEQ ID NO: 699984 - DNA, 22 bp, Artificial Sequence
  chemically synthesized
ctatatcaagtaagttggaagt

SEQ ID NO: 699985 - DNA, 22 bp, Artificial Sequence
  chemically synthesized
aaaaatgtgatacttccaactt

SEQ ID NO: 699986 - DNA, 22 bp, Artificial Sequence
  chemically synthesized
aaaatgtgatacttccaactta

SEQ ID NO: 699987 - DNA, 22 bp, Artificial Sequence
  chemically synthesized
ccaacttacttgatatagtagg

SEQ ID NO: 699988 - DNA, 22 bp, Artificial Sequence
  chemically synthesized
caacttacttgatatagtaggg

SEQ ID NO: 699989 - DNA, 22 bp, Artificial Sequence
  chemically synthesized
gccaaacaaagtgccctactat

SEQ ID NO: 699990 - DNA, 22 bp, Artificial Sequence
  chemically synthesized
acttgatatagtagggcacttt

SEQ ID NO: 699991 - DNA, 22 bp, Artificial Sequence
  chemically synthesized
cttgatatagtagggcactttg

SEQ ID NO: 699992 - DNA, 22 bp, Artificial Sequence
  chemically synthesized
gatatagtagggcactttgttt

SEQ ID NO: 699993 - DNA, 22 bp, Artificial Sequence
  chemically synthesized
atatagtagggcactttgtttg

SEQ ID NO: 699994 - DNA, 22 bp, Artificial Sequence
  chemically synthesized
ggagagagccatctcgccaaac

SEQ ID NO: 699995 - DNA, 22 bp, Artificial Sequence
  chemically synthesized
tgtttggcgagatggctctctc

SEQ ID NO: 699996 - DNA, 22 bp, Artificial Sequence
  chemically synthesized
gtttggcgagatggctctctcc

SEQ ID NO: 699997 - DNA, 22 bp, Artificial Sequence
  chemically synthesized
tttggcgagatggctctctccc

SEQ ID NO: 699998 - DNA, 22 bp, Artificial Sequence
  chemically synthesized
tccagggtccctgggagagagc

SEQ ID NO: 699999 - DNA, 22 bp, Artificial Sequence
  chemically synthesized
ggcgagatggctctctcccagg

SEQ ID NO: 700000 - DNA, 22 bp, Artificial Sequence
  chemically synthesized
gcgagatggctctctcccaggg

SEQ ID NO: 700001 - DNA, 22 bp, Artificial Sequence
  chemically synthesized
agcgtctgtccagggtccctgg

SEQ ID NO: 700002 - DNA, 22 bp, Artificial Sequence
  chemically synthesized
cagcgtctgtccagggtccctg

SEQ ID NO: 700003 - DNA, 22 bp, Artificial Sequence
  chemically synthesized
tcagcgtctgtccagggtccct

SEQ ID NO: 700004 - DNA, 22 bp, Artificial Sequence
  chemically synthesized
ttcagcgtctgtccagggtccc

SEQ ID NO: 700005 - DNA, 22 bp, Artificial Sequence
  chemically synthesized
ttttcagcgtctgtccagggtc

SEQ ID NO: 700006 - DNA, 22 bp, Artificial Sequence
  chemically synthesized
cttttcagcgtctgtccagggt

SEQ ID NO: 700007 - DNA, 22 bp, Artificial Sequence
  chemically synthesized
tctcccagggaccctggacaga

SEQ ID NO: 700008 - DNA, 22 bp, Artificial Sequence
  chemically synthesized
tcccagggaccctggacagacg

SEQ ID NO: 700009 - DNA, 22 bp, Artificial Sequence
  chemically synthesized
ccttcttttcagcgtctgtcca

SEQ ID NO: 700010 - DNA, 22 bp, Artificial Sequence
  chemically synthesized
ccagggaccctggacagacgct

SEQ ID NO: 700011 - DNA, 22 bp, Artificial Sequence
  chemically synthesized
ctcccttcttttcagcgtctgt

SEQ ID NO: 700012 - DNA, 22 bp, Artificial Sequence
  chemically synthesized
cctcccttcttttcagcgtctg

SEQ ID NO: 700013 - DNA, 22 bp, Artificial Sequence
  chemically synthesized
tcctcccttcttttcagcgtct

SEQ ID NO: 700014 - DNA, 22 bp, Artificial Sequence
  chemically synthesized
ttcctcccttcttttcagcgtc

SEQ ID NO: 700015 - DNA, 22 bp, Artificial Sequence
  chemically synthesized
tttcctcccttcttttcagcgt

SEQ ID NO: 700016 - DNA, 22 bp, Artificial Sequence
  chemically synthesized
ttttcctcccttcttttcagcg

SEQ ID NO: 700017 - DNA, 22 bp, Artificial Sequence
  chemically synthesized
tttttcctcccttcttttcagc

SEQ ID NO: 700018 - DNA, 22 bp, Artificial Sequence
  chemically synthesized
tttttttcctcccttcttttca

SEQ ID NO: 700019 - DNA, 22 bp, Artificial Sequence
  chemically synthesized
ctttttttcctcccttcttttc

SEQ ID NO: 700020 - DNA, 22 bp, Artificial Sequence
  chemically synthesized
tctttttttcctcccttctttt

SEQ ID NO: 700021 - DNA, 22 bp, Artificial Sequence
  chemically synthesized
gacagacgctgaaaagaaggga

SEQ ID NO: 700022 - DNA, 22 bp, Artificial Sequence
  chemically synthesized
cctttctttttttcctcccttc

SEQ ID NO: 700023 - DNA, 22 bp, Artificial Sequence
  chemically synthesized
gcctttctttttttcctccctt

SEQ ID NO: 700024 - DNA, 22 bp, Artificial Sequence
  chemically synthesized
cttgcctttctttttttcctcc

SEQ ID NO: 700025 - DNA, 22 bp, Artificial Sequence
  chemically synthesized
aaaagaagggaggaaaaaaaga

SEQ ID NO: 700026 - DNA, 22 bp, Artificial Sequence
  chemically synthesized
acctccttgcctttcttttttt

SEQ ID NO: 700027 - DNA, 22 bp, Artificial Sequence
  chemically synthesized
gacctccttgcctttctttttt

SEQ ID NO: 700028 - DNA, 22 bp, Artificial Sequence
  chemically synthesized
cgatgaatttgacctccttgcc

SEQ ID NO: 700029 - DNA, 22 bp, Artificial Sequence
  chemically synthesized
gcgatgaatttgacctccttgc

SEQ ID NO: 700030 - DNA, 22 bp, Artificial Sequence
  chemically synthesized
tttgcgatgaatttgacctcct

SEQ ID NO: 700031 - DNA, 22 bp, Artificial Sequence
  chemically synthesized
ctgtttgcgatgaatttgacct

SEQ ID NO: 700032 - DNA, 22 bp, Artificial Sequence
  chemically synthesized
cctgtttgcgatgaatttgacc

SEQ ID NO: 700033 - DNA, 22 bp, Artificial Sequence
  chemically synthesized
tcctgtttgcgatgaatttgac

SEQ ID NO: 700034 - DNA, 22 bp, Artificial Sequence
  chemically synthesized
tctttcctgtttgcgatgaatt

SEQ ID NO: 700035 - DNA, 22 bp, Artificial Sequence
  chemically synthesized
atgttgtctttcctgtttgcga

SEQ ID NO: 700036 - DNA, 22 bp, Artificial Sequence
  chemically synthesized
gagattaatgttgtctttcctg

SEQ ID NO: 700037 - DNA, 22 bp, Artificial Sequence
  chemically synthesized
tggagattaatgttgtctttcc

SEQ ID NO: 700038 - DNA, 22 bp, Artificial Sequence
  chemically synthesized
atcgcaaacaggaaagacaaca

SEQ ID NO: 700039 - DNA, 22 bp, Artificial Sequence
  chemically synthesized
taattctggagattaatgttgt

SEQ ID NO: 700040 - DNA, 22 bp, Artificial Sequence
  chemically synthesized
atctccagaattacaattttac

SEQ ID NO: 700041 - DNA, 22 bp, Artificial Sequence
  chemically synthesized
cagaattacaattttacactga

SEQ ID NO: 700042 - DNA, 22 bp, Artificial Sequence
  chemically synthesized
agcaaacagaccaatatcagtg

SEQ ID NO: 700043 - DNA, 22 bp, Artificial Sequence
  chemically synthesized
caattttacactgatattggtc

SEQ ID NO: 700044 - DNA, 22 bp, Artificial Sequence
  chemically synthesized
tacactgatattggtctgtttg

SEQ ID NO: 700045 - DNA, 22 bp, Artificial Sequence
  chemically synthesized
acactgatattggtctgtttgc

SEQ ID NO: 700046 - DNA, 22 bp, Artificial Sequence
  chemically synthesized
atgggcagctgagcaaacagac

SEQ ID NO: 700047 - DNA, 22 bp, Artificial Sequence
  chemically synthesized
cactgatattggtctgtttgct

SEQ ID NO: 700048 - DNA, 22 bp, Artificial Sequence
  chemically synthesized
catgggcagctgagcaaacaga

SEQ ID NO: 700049 - DNA, 22 bp, Artificial Sequence
  chemically synthesized
tcttcatgggcagctgagcaaa

SEQ ID NO: 700050 - DNA, 22 bp, Artificial Sequence
  chemically synthesized
atattggtctgtttgctcagct

SEQ ID NO: 700051 - DNA, 22 bp, Artificial Sequence
  chemically synthesized
gtctgtttgctcagctgcccat

SEQ ID NO: 700052 - DNA, 22 bp, Artificial Sequence
  chemically synthesized
atccatcctgtcttcatgggca

SEQ ID NO: 700053 - DNA, 22 bp, Artificial Sequence
  chemically synthesized
tttgctcagctgcccatgaaga

SEQ ID NO: 700054 - DNA, 22 bp, Artificial Sequence
  chemically synthesized
gctcagctgcccatgaagacag

SEQ ID NO: 700055 - DNA, 22 bp, Artificial Sequence
  chemically synthesized
ctcagctgcccatgaagacagg

SEQ ID NO: 700056 - DNA, 22 bp, Artificial Sequence
  chemically synthesized
agctgcccatgaagacaggatg

SEQ ID NO: 700057 - DNA, 22 bp, Artificial Sequence
  chemically synthesized
cccatgaagacaggatggatta

SEQ ID NO: 700058 - DNA, 22 bp, Artificial Sequence
  chemically synthesized
agaacagcaggttaatccatcc

SEQ ID NO: 700059 - DNA, 22 bp, Artificial Sequence
  chemically synthesized
cagaacagcaggttaatccatc

SEQ ID NO: 700060 - DNA, 22 bp, Artificial Sequence
  chemically synthesized
ggacagaaatttcagaacagca

SEQ ID NO: 700061 - DNA, 22 bp, Artificial Sequence
  chemically synthesized
gattaggacagaaatttcagaa

SEQ ID NO: 700062 - DNA, 22 bp, Artificial Sequence
  chemically synthesized
agattaggacagaaatttcaga

SEQ ID NO: 700063 - DNA, 22 bp, Artificial Sequence
  chemically synthesized
acctgctgttctgaaatttctg

SEQ ID NO: 700064 - DNA, 22 bp, Artificial Sequence
  chemically synthesized
gcttagattaggacagaaattt

SEQ ID NO: 700065 - DNA, 22 bp, Artificial Sequence
  chemically synthesized
cgcttagattaggacagaaatt

SEQ ID NO: 700066 - DNA, 22 bp, Artificial Sequence
  chemically synthesized
ctgttctgaaatttctgtccta

SEQ ID NO: 700067 - DNA, 22 bp, Artificial Sequence
  chemically synthesized
agtttcgcttagattaggacag

SEQ ID NO: 700068 - DNA, 22 bp, Artificial Sequence
  chemically synthesized
ttctgaaatttctgtcctaatc

SEQ ID NO: 700069 - DNA, 22 bp, Artificial Sequence
  chemically synthesized
tgaaatttctgtcctaatctaa

SEQ ID NO: 700070 - DNA, 22 bp, Artificial Sequence
  chemically synthesized
aaatttctgtcctaatctaagc

SEQ ID NO: 700071 - DNA, 22 bp, Artificial Sequence
  chemically synthesized
aatgagttcagtttcgcttaga

SEQ ID NO: 700072 - DNA, 22 bp, Artificial Sequence
  chemically synthesized
ctgtcctaatctaagcgaaact

SEQ ID NO: 700073 - DNA, 22 bp, Artificial Sequence
  chemically synthesized
tgtcctaatctaagcgaaactg

SEQ ID NO: 700074 - DNA, 22 bp, Artificial Sequence
  chemically synthesized
tcctaatctaagcgaaactgaa

SEQ ID NO: 700075 - DNA, 22 bp, Artificial Sequence
  chemically synthesized
tgcctgaatgagttcagtttcg

SEQ ID NO: 700076 - DNA, 22 bp, Artificial Sequence
  chemically synthesized
gtgcctgaatgagttcagtttc

SEQ ID NO: 700077 - DNA, 22 bp, Artificial Sequence
  chemically synthesized
tgtgcctgaatgagttcagttt

SEQ ID NO: 700078 - DNA, 22 bp, Artificial Sequence
  chemically synthesized
atctaagcgaaactgaactcat

SEQ ID NO: 700079 - DNA, 22 bp, Artificial Sequence
  chemically synthesized
tctttgtgcctgaatgagttca

SEQ ID NO: 700080 - DNA, 22 bp, Artificial Sequence
  chemically synthesized
atctttgtgcctgaatgagttc

SEQ ID NO: 700081 - DNA, 22 bp, Artificial Sequence
  chemically synthesized
agcgaaactgaactcattcagg

SEQ ID NO: 700082 - DNA, 22 bp, Artificial Sequence
  chemically synthesized
gcatttatctttgtgcctgaat

SEQ ID NO: 700083 - DNA, 22 bp, Artificial Sequence
  chemically synthesized
cgcatttatctttgtgcctgaa

SEQ ID NO: 700084 - DNA, 22 bp, Artificial Sequence
  chemically synthesized
ttcgcatttatctttgtgcctg

SEQ ID NO: 700085 - DNA, 22 bp, Artificial Sequence
  chemically synthesized
cttcgcatttatctttgtgcct

SEQ ID NO: 700086 - DNA, 22 bp, Artificial Sequence
  chemically synthesized
tcttcgcatttatctttgtgcc

SEQ ID NO: 700087 - DNA, 22 bp, Artificial Sequence
  chemically synthesized
ttcttcgcatttatctttgtgc

SEQ ID NO: 700088 - DNA, 22 bp, Artificial Sequence
  chemically synthesized
aactcattcaggcacaaagata

SEQ ID NO: 700089 - DNA, 22 bp, Artificial Sequence
  chemically synthesized
tttcttcgcatttatctttgtg

SEQ ID NO: 700090 - DNA, 22 bp, Artificial Sequence
  chemically synthesized
ttttcttcgcatttatctttgt

SEQ ID NO: 700091 - DNA, 22 bp, Artificial Sequence
  chemically synthesized
tttttcttcgcatttatctttg

SEQ ID NO: 700092 - DNA, 22 bp, Artificial Sequence
  chemically synthesized
ttttttcttcgcatttatcttt

SEQ ID NO: 700093 - DNA, 22 bp, Artificial Sequence
  chemically synthesized
tttttttcttcgcatttatctt

SEQ ID NO: 700094 - DNA, 22 bp, Artificial Sequence
  chemically synthesized
attcaggcacaaagataaatgc

SEQ ID NO: 700095 - DNA, 22 bp, Artificial Sequence
  chemically synthesized
aggcacaaagataaatgcgaag

SEQ ID NO: 700096 - DNA, 22 bp, Artificial Sequence
  chemically synthesized
tgggttttttttttcttcgcat

SEQ ID NO: 700097 - DNA, 22 bp, Artificial Sequence
  chemically synthesized
gtgggttttttttttcttcgca

SEQ ID NO: 700098 - DNA, 22 bp, Artificial Sequence
  chemically synthesized
gcagtggaaatgtttgtgggtt

SEQ ID NO: 700099 - DNA, 22 bp, Artificial Sequence
  chemically synthesized
agcagtggaaatgtttgtgggt

SEQ ID NO: 700100 - DNA, 22 bp, Artificial Sequence
  chemically synthesized
taggtttagcagtggaaatgtt

SEQ ID NO: 700101 - DNA, 22 bp, Artificial Sequence
  chemically synthesized
tataggtttagcagtggaaatg

SEQ ID NO: 700102 - DNA, 22 bp, Artificial Sequence
  chemically synthesized
ttctataggtttagcagtggaa

SEQ ID NO: 700103 - DNA, 22 bp, Artificial Sequence
  chemically synthesized
tctgttctataggtttagcagt

SEQ ID NO: 700104 - DNA, 22 bp, Artificial Sequence
  chemically synthesized
atctgttctataggtttagcag

SEQ ID NO: 700105 - DNA, 22 bp, Artificial Sequence
  chemically synthesized
ttatctgttctataggtttagc

SEQ ID NO: 700106 - DNA, 22 bp, Artificial Sequence
  chemically synthesized
cttatctgttctataggtttag

SEQ ID NO: 700107 - DNA, 22 bp, Artificial Sequence
  chemically synthesized
agtttcttatctgttctatagg

SEQ ID NO: 700108 - DNA, 22 bp, Artificial Sequence
  chemically synthesized
ccactgctaaacctatagaaca

SEQ ID NO: 700109 - DNA, 22 bp, Artificial Sequence
  chemically synthesized
cactgctaaacctatagaacag

SEQ ID NO: 700110 - DNA, 22 bp, Artificial Sequence
  chemically synthesized
attcagtttcttatctgttcta

SEQ ID NO: 700111 - DNA, 22 bp, Artificial Sequence
  chemically synthesized
ctaaacctatagaacagataag

SEQ ID NO: 700112 - DNA, 22 bp, Artificial Sequence
  chemically synthesized
ctcattcagtttcttatctgtt

SEQ ID NO: 700113 - DNA, 22 bp, Artificial Sequence
  chemically synthesized
aacctatagaacagataagaaa

SEQ ID NO: 700114 - DNA, 22 bp, Artificial Sequence
  chemically synthesized
tagaacagataagaaactgaat

SEQ ID NO: 700115 - DNA, 22 bp, Artificial Sequence
  chemically synthesized
aatgagtagactgacggggttt

SEQ ID NO: 700116 - DNA, 22 bp, Artificial Sequence
  chemically synthesized
aagggagacacatacaagaaac

SEQ ID NO: 700117 - DNA, 22 bp, Artificial Sequence
  chemically synthesized
acggggtttcttgtatgtgtct

SEQ ID NO: 700118 - DNA, 22 bp, Artificial Sequence
  chemically synthesized
taaaaaaaagcactcaagggag

SEQ ID NO: 700119 - DNA, 22 bp, Artificial Sequence
  chemically synthesized
cttgtatgtgtctcccttgagt

SEQ ID NO: 700120 - DNA, 22 bp, Artificial Sequence
  chemically synthesized
ttgtatgtgtctcccttgagtg

SEQ ID NO: 700121 - DNA, 22 bp, Artificial Sequence
  chemically synthesized
gtatgtgtctcccttgagtgct

SEQ ID NO: 700122 - DNA, 22 bp, Artificial Sequence
  chemically synthesized
tatgtgtctcccttgagtgctt

SEQ ID NO: 700123 - DNA, 22 bp, Artificial Sequence
  chemically synthesized
ccttgagtgcttttttttataa

SEQ ID NO: 700124 - DNA, 22 bp, Artificial Sequence
  chemically synthesized
gagtgcttttttttataatact

SEQ ID NO: 700125 - DNA, 22 bp, Artificial Sequence
  chemically synthesized
agtgcttttttttataatactt

SEQ ID NO: 700126 - DNA, 22 bp, Artificial Sequence
  chemically synthesized
agaaccagcaacaggaagtatt

SEQ ID NO: 700127 - DNA, 22 bp, Artificial Sequence
  chemically synthesized
ttttttataatacttcctgttg

SEQ ID NO: 700128 - DNA, 22 bp, Artificial Sequence
  chemically synthesized
tttttataatacttcctgttgc

SEQ ID NO: 700129 - DNA, 22 bp, Artificial Sequence
  chemically synthesized
ttttataatacttcctgttgct

SEQ ID NO: 700130 - DNA, 22 bp, Artificial Sequence
  chemically synthesized
tttataatacttcctgttgctg

SEQ ID NO: 700131 - DNA, 22 bp, Artificial Sequence
  chemically synthesized
ttataatacttcctgttgctgg

SEQ ID NO: 700132 - DNA, 22 bp, Artificial Sequence
  chemically synthesized
tataatacttcctgttgctggt

SEQ ID NO: 700133 - DNA, 22 bp, Artificial Sequence
  chemically synthesized
ataatacttcctgttgctggtt

SEQ ID NO: 700134 - DNA, 22 bp, Artificial Sequence
  chemically synthesized
taatacttcctgttgctggttc

SEQ ID NO: 700135 - DNA, 22 bp, Artificial Sequence
  chemically synthesized
cctgttgctggttctcaatatt

SEQ ID NO: 700136 - DNA, 22 bp, Artificial Sequence
  chemically synthesized
ctgttgctggttctcaatattt

SEQ ID NO: 700137 - DNA, 22 bp, Artificial Sequence
  chemically synthesized
ttgctggttctcaatatttttt

SEQ ID NO: 700138 - DNA, 22 bp, Artificial Sequence
  chemically synthesized
ctggttctcaatattttttact

SEQ ID NO: 700139 - DNA, 22 bp, Artificial Sequence
  chemically synthesized
gttctcaatattttttactatt

SEQ ID NO: 700140 - DNA, 22 bp, Artificial Sequence
  chemically synthesized
tcaatattttttactatttgac

SEQ ID NO: 700141 - DNA, 22 bp, Artificial Sequence
  chemically synthesized
aatattttttactatttgactg

SEQ ID NO: 700142 - DNA, 22 bp, Artificial Sequence
  chemically synthesized
aaataataaaatccagtcagtc

SEQ ID NO: 700143 - DNA, 22 bp, Artificial Sequence
  chemically synthesized
tttactatttgactgactggat

SEQ ID NO: 700144 - DNA, 22 bp, Artificial Sequence
  chemically synthesized
ttactatttgactgactggatt

SEQ ID NO: 700145 - DNA, 22 bp, Artificial Sequence
  chemically synthesized
ctgaaataataaaatccagtca

SEQ ID NO: 700146 - DNA, 22 bp, Artificial Sequence
  chemically synthesized
tactatttgactgactggattt

SEQ ID NO: 700147 - DNA, 22 bp, Artificial Sequence
  chemically synthesized
actatttgactgactggatttt

SEQ ID NO: 700148 - DNA, 22 bp, Artificial Sequence
  chemically synthesized
ctatttgactgactggatttta

SEQ ID NO: 700149 - DNA, 22 bp, Artificial Sequence
  chemically synthesized
agctactgaaataataaaatcc

SEQ ID NO: 700150 - DNA, 22 bp, Artificial Sequence
  chemically synthesized
tttgactgactggattttatta

SEQ ID NO: 700151 - DNA, 22 bp, Artificial Sequence
  chemically synthesized
cagctactgaaataataaaatc

SEQ ID NO: 700152 - DNA, 22 bp, Artificial Sequence
  chemically synthesized
gactgactggattttattattt

SEQ ID NO: 700153 - DNA, 22 bp, Artificial Sequence
  chemically synthesized
actgactggattttattatttc

SEQ ID NO: 700154 - DNA, 22 bp, Artificial Sequence
  chemically synthesized
actggattttattatttcagta

SEQ ID NO: 700155 - DNA, 22 bp, Artificial Sequence
  chemically synthesized
gattttattatttcagtagctg

SEQ ID NO: 700156 - DNA, 22 bp, Artificial Sequence
  chemically synthesized
tattatttcagtagctgaaata

SEQ ID NO: 700157 - DNA, 22 bp, Artificial Sequence
  chemically synthesized
attatttcagtagctgaaatat

SEQ ID NO: 700158 - DNA, 22 bp, Artificial Sequence
  chemically synthesized
ttatttcagtagctgaaatatc

SEQ ID NO: 700159 - DNA, 22 bp, Artificial Sequence
  chemically synthesized
tttcagtagctgaaatatccct

SEQ ID NO: 700160 - DNA, 22 bp, Artificial Sequence
  chemically synthesized
cagtagctgaaatatccctctg

SEQ ID NO: 700161 - DNA, 22 bp, Artificial Sequence
  chemically synthesized
agtagctgaaatatccctctgt

SEQ ID NO: 700162 - DNA, 22 bp, Artificial Sequence
  chemically synthesized
gaatgtaaatatatcacagagg

SEQ ID NO: 700163 - DNA, 22 bp, Artificial Sequence
  chemically synthesized
agaatgtaaatatatcacagag

SEQ ID NO: 700164 - DNA, 22 bp, Artificial Sequence
  chemically synthesized
aaatatccctctgtgatatatt

SEQ ID NO: 700165 - DNA, 22 bp, Artificial Sequence
  chemically synthesized
aataacttagaatgtaaatata

SEQ ID NO: 700166 - DNA, 22 bp, Artificial Sequence
  chemically synthesized
caataacttagaatgtaaatat

SEQ ID NO: 700167 - DNA, 22 bp, Artificial Sequence
  chemically synthesized
gcttcaataacttagaatgtaa

SEQ ID NO: 700168 - DNA, 22 bp, Artificial Sequence
  chemically synthesized
agcttcaataacttagaatgta

SEQ ID NO: 700169 - DNA, 22 bp, Artificial Sequence
  chemically synthesized
tgtgatatatttacattctaag

SEQ ID NO: 700170 - DNA, 22 bp, Artificial Sequence
  chemically synthesized
tagcttcaataacttagaatgt

SEQ ID NO: 700171 - DNA, 22 bp, Artificial Sequence
  chemically synthesized
tgatatatttacattctaagtt

SEQ ID NO: 700172 - DNA, 22 bp, Artificial Sequence
  chemically synthesized
ctttagcttcaataacttagaa

SEQ ID NO: 700173 - DNA, 22 bp, Artificial Sequence
  chemically synthesized
acattctaagttattgaagcta

SEQ ID NO: 700174 - DNA, 22 bp, Artificial Sequence
  chemically synthesized
cattctaagttattgaagctaa

SEQ ID NO: 700175 - DNA, 22 bp, Artificial Sequence
  chemically synthesized
taagttattgaagctaaagtaa

SEQ ID NO: 700176 - DNA, 22 bp, Artificial Sequence
  chemically synthesized
agttattgaagctaaagtaata

SEQ ID NO: 700177 - DNA, 22 bp, Artificial Sequence
  chemically synthesized
ttgaagctaaagtaatatgctt

SEQ ID NO: 700178 - DNA, 22 bp, Artificial Sequence
  chemically synthesized
aagctaaagtaatatgcttatc

SEQ ID NO: 700179 - DNA, 22 bp, Artificial Sequence
  chemically synthesized
aagtaatatgcttatcactctg

SEQ ID NO: 700180 - DNA, 22 bp, Artificial Sequence
  chemically synthesized
atcactctgatatggttgtttt

SEQ ID NO: 700181 - DNA, 22 bp, Artificial Sequence
  chemically synthesized
tcactctgatatggttgttttt

SEQ ID NO: 700182 - DNA, 22 bp, Artificial Sequence
  chemically synthesized
aaccaataaagataaaaacaac

SEQ ID NO: 700183 - DNA, 22 bp, Artificial Sequence
  chemically synthesized
aaaccaataaagataaaaacaa

SEQ ID NO: 700184 - DNA, 22 bp, Artificial Sequence
  chemically synthesized
taaaccaataaagataaaaaca

SEQ ID NO: 700185 - DNA, 22 bp, Artificial Sequence
  chemically synthesized
tttaaaccaataaagataaaaa

SEQ ID NO: 700186 - DNA, 22 bp, Artificial Sequence
  chemically synthesized
tgatatggttgtttttatcttt

SEQ ID NO: 700187 - DNA, 22 bp, Artificial Sequence
  chemically synthesized
tctttaaaccaataaagataaa

SEQ ID NO: 700188 - DNA, 22 bp, Artificial Sequence
  chemically synthesized
atatggttgtttttatctttat

SEQ ID NO: 700189 - DNA, 22 bp, Artificial Sequence
  chemically synthesized
gattctctttaaaccaataaag

SEQ ID NO: 700190 - DNA, 22 bp, Artificial Sequence
  chemically synthesized
ggattctctttaaaccaataaa

SEQ ID NO: 700191 - DNA, 22 bp, Artificial Sequence
  chemically synthesized
tttttatctttattggtttaaa

SEQ ID NO: 700192 - DNA, 22 bp, Artificial Sequence
  chemically synthesized
ttatctttattggtttaaagag

SEQ ID NO: 700193 - DNA, 22 bp, Artificial Sequence
  chemically synthesized
tatctttattggtttaaagaga

SEQ ID NO: 700194 - DNA, 22 bp, Artificial Sequence
  chemically synthesized
atctttattggtttaaagagaa

SEQ ID NO: 700195 - DNA, 22 bp, Artificial Sequence
  chemically synthesized
tctttattggtttaaagagaat

SEQ ID NO: 700196 - DNA, 22 bp, Artificial Sequence
  chemically synthesized
gtaagtgaatttggattctctt

SEQ ID NO: 700197 - DNA, 22 bp, Artificial Sequence
  chemically synthesized
ggtaagtgaatttggattctct

SEQ ID NO: 700198 - DNA, 22 bp, Artificial Sequence
  chemically synthesized
tattggtttaaagagaatccaa

SEQ ID NO: 700199 - DNA, 22 bp, Artificial Sequence
  chemically synthesized
attggtttaaagagaatccaaa

SEQ ID NO: 700200 - DNA, 22 bp, Artificial Sequence
  chemically synthesized
ttggtttaaagagaatccaaat

SEQ ID NO: 700201 - DNA, 22 bp, Artificial Sequence
  chemically synthesized
tttggtaagtgaatttggattc

SEQ ID NO: 700202 - DNA, 22 bp, Artificial Sequence
  chemically synthesized
gtttaaagagaatccaaattca

SEQ ID NO: 700203 - DNA, 22 bp, Artificial Sequence
  chemically synthesized
aaagagaatccaaattcactta

SEQ ID NO: 700204 - DNA, 22 bp, Artificial Sequence
  chemically synthesized
aagagaatccaaattcacttac

SEQ ID NO: 700205 - DNA, 22 bp, Artificial Sequence
  chemically synthesized
agcatctatttggtaagtgaat

SEQ ID NO: 700206 - DNA, 22 bp, Artificial Sequence
  chemically synthesized
aggcaccaaattaagcatctat

SEQ ID NO: 700207 - DNA, 22 bp, Artificial Sequence
  chemically synthesized
gaggcaccaaattaagcatcta

SEQ ID NO: 700208 - DNA, 22 bp, Artificial Sequence
  chemically synthesized
tgaggcaccaaattaagcatct

SEQ ID NO: 700209 - DNA, 22 bp, Artificial Sequence
  chemically synthesized
acttaccaaatagatgcttaat

SEQ ID NO: 700210 - DNA, 22 bp, Artificial Sequence
  chemically synthesized
accaaatagatgcttaatttgg

SEQ ID NO: 700211 - DNA, 22 bp, Artificial Sequence
  chemically synthesized
ccaaatagatgcttaatttggt

SEQ ID NO: 700212 - DNA, 22 bp, Artificial Sequence
  chemically synthesized
acattttgaggcaccaaattaa

SEQ ID NO: 700213 - DNA, 22 bp, Artificial Sequence
  chemically synthesized
gtcagctgacattttgaggcac

SEQ ID NO: 700214 - DNA, 22 bp, Artificial Sequence
  chemically synthesized
aatttggtgcctcaaaatgtca

SEQ ID NO: 700215 - DNA, 22 bp, Artificial Sequence
  chemically synthesized
atttggtgcctcaaaatgtcag

SEQ ID NO: 700216 - DNA, 22 bp, Artificial Sequence
  chemically synthesized
ggtgcctcaaaatgtcagctga

SEQ ID NO: 700217 - DNA, 22 bp, Artificial Sequence
  chemically synthesized
gtgcctcaaaatgtcagctgac

SEQ ID NO: 700218 - DNA, 22 bp, Artificial Sequence
  chemically synthesized
ataagatcacactggtcagctg

SEQ ID NO: 700219 - DNA, 22 bp, Artificial Sequence
  chemically synthesized
taataagatcacactggtcagc

SEQ ID NO: 700220 - DNA, 22 bp, Artificial Sequence
  chemically synthesized
ctaataagatcacactggtcag

SEQ ID NO: 700221 - DNA, 22 bp, Artificial Sequence
  chemically synthesized
tctaataagatcacactggtca

SEQ ID NO: 700222 - DNA, 22 bp, Artificial Sequence
  chemically synthesized
aaaatgtcagctgaccagtgtg

SEQ ID NO: 700223 - DNA, 22 bp, Artificial Sequence
  chemically synthesized
ttctaataagatcacactggtc

SEQ ID NO: 700224 - DNA, 22 bp, Artificial Sequence
  chemically synthesized
gtcaccttttctaataagatca

SEQ ID NO: 700225 - DNA, 22 bp, Artificial Sequence
  chemically synthesized
ggtcaccttttctaataagatc

SEQ ID NO: 700226 - DNA, 22 bp, Artificial Sequence
  chemically synthesized
tggtcaccttttctaataagat

SEQ ID NO: 700227 - DNA, 22 bp, Artificial Sequence
  chemically synthesized
ttggtcaccttttctaataaga

SEQ ID NO: 700228 - DNA, 22 bp, Artificial Sequence
  chemically synthesized
accagtgtgatcttattagaaa

SEQ ID NO: 700229 - DNA, 22 bp, Artificial Sequence
  chemically synthesized
acttttggtcaccttttctaat

SEQ ID NO: 700230 - DNA, 22 bp, Artificial Sequence
  chemically synthesized
cctcacttttggtcaccttttc

SEQ ID NO: 700231 - DNA, 22 bp, Artificial Sequence
  chemically synthesized
attagaaaaggtgaccaaaagt

SEQ ID NO: 700232 - DNA, 22 bp, Artificial Sequence
  chemically synthesized
ttagaaaaggtgaccaaaagtg

SEQ ID NO: 700233 - DNA, 22 bp, Artificial Sequence
  chemically synthesized
gaaaaggtgaccaaaagtgagg

SEQ ID NO: 700234 - DNA, 22 bp, Artificial Sequence
  chemically synthesized
atatcagtagacattccctcac

SEQ ID NO: 700235 - DNA, 22 bp, Artificial Sequence
  chemically synthesized
tgatatcagtagacattccctc

SEQ ID NO: 700236 - DNA, 22 bp, Artificial Sequence
  chemically synthesized
cgctctgatatcagtagacatt

SEQ ID NO: 700237 - DNA, 22 bp, Artificial Sequence
  chemically synthesized
ttacgctctgatatcagtagac

SEQ ID NO: 700238 - DNA, 22 bp, Artificial Sequence
  chemically synthesized
attacgctctgatatcagtaga

SEQ ID NO: 700239 - DNA, 22 bp, Artificial Sequence
  chemically synthesized
ataacaaaagtcttattacgct

SEQ ID NO: 700240 - DNA, 22 bp, Artificial Sequence
  chemically synthesized
ctgatatcagagcgtaataaga

SEQ ID NO: 700241 - DNA, 22 bp, Artificial Sequence
  chemically synthesized
atatcagagcgtaataagactt

SEQ ID NO: 700242 - DNA, 22 bp, Artificial Sequence
  chemically synthesized
atcactcataacaaaagtctta

SEQ ID NO: 700243 - DNA, 22 bp, Artificial Sequence
  chemically synthesized
acgtataggattcatcactcat

SEQ ID NO: 700244 - DNA, 22 bp, Artificial Sequence
  chemically synthesized
cacgtataggattcatcactca

SEQ ID NO: 700245 - DNA, 22 bp, Artificial Sequence
  chemically synthesized
ttgttatgagtgatgaatccta

SEQ ID NO: 700246 - DNA, 22 bp, Artificial Sequence
  chemically synthesized
tgttatgagtgatgaatcctat

SEQ ID NO: 700247 - DNA, 22 bp, Artificial Sequence
  chemically synthesized
gttatgagtgatgaatcctata

SEQ ID NO: 700248 - DNA, 22 bp, Artificial Sequence
  chemically synthesized
ttatgagtgatgaatcctatac

SEQ ID NO: 700249 - DNA, 22 bp, Artificial Sequence
  chemically synthesized
tgagtgatgaatcctatacgtg

SEQ ID NO: 700250 - DNA, 22 bp, Artificial Sequence
  chemically synthesized
gtatgtgaaatgaaatttcacg

SEQ ID NO: 700251 - DNA, 22 bp, Artificial Sequence
  chemically synthesized
ctagtatgtgaaatgaaatttc

SEQ ID NO: 700252 - DNA, 22 bp, Artificial Sequence
  chemically synthesized
tacgtgaaatttcatttcacat

SEQ ID NO: 700253 - DNA, 22 bp, Artificial Sequence
  chemically synthesized
catttcacatactaggaatttg

SEQ ID NO: 700254 - DNA, 22 bp, Artificial Sequence
  chemically synthesized
atttcacatactaggaatttgt

SEQ ID NO: 700255 - DNA, 22 bp, Artificial Sequence
  chemically synthesized
cacatactaggaatttgtttta

SEQ ID NO: 700256 - DNA, 22 bp, Artificial Sequence
  chemically synthesized
acatactaggaatttgttttat

SEQ ID NO: 700257 - DNA, 22 bp, Artificial Sequence
  chemically synthesized
ggaatttgttttattatgactt

SEQ ID NO: 700258 - DNA, 22 bp, Artificial Sequence
  chemically synthesized
accaatacacagtgaagtcata

SEQ ID NO: 700259 - DNA, 22 bp, Artificial Sequence
  chemically synthesized
gaccaatacacagtgaagtcat

SEQ ID NO: 700260 - DNA, 22 bp, Artificial Sequence
  chemically synthesized
gttttattatgacttcactgtg

SEQ ID NO: 700261 - DNA, 22 bp, Artificial Sequence
  chemically synthesized
atttgaccaatacacagtgaag

SEQ ID NO: 700262 - DNA, 22 bp, Artificial Sequence
  chemically synthesized
ttttattatgacttcactgtgt

SEQ ID NO: 700263 - DNA, 22 bp, Artificial Sequence
  chemically synthesized
tattatgacttcactgtgtatt

SEQ ID NO: 700264 - DNA, 22 bp, Artificial Sequence
  chemically synthesized
attatgacttcactgtgtattg

SEQ ID NO: 700265 - DNA, 22 bp, Artificial Sequence
  chemically synthesized
ttatgacttcactgtgtattgg

SEQ ID NO: 700266 - DNA, 22 bp, Artificial Sequence
  chemically synthesized
tgacttcactgtgtattggtca

SEQ ID NO: 700267 - DNA, 22 bp, Artificial Sequence
  chemically synthesized
cactgtgtattggtcaaatgaa

SEQ ID NO: 700268 - DNA, 22 bp, Artificial Sequence
  chemically synthesized
actgtgtattggtcaaatgaat

SEQ ID NO: 700269 - DNA, 22 bp, Artificial Sequence
  chemically synthesized
tgtattggtcaaatgaatgatc

SEQ ID NO: 700270 - DNA, 22 bp, Artificial Sequence
  chemically synthesized
gtcaaatgaatgatctttgcat

SEQ ID NO: 700271 - DNA, 22 bp, Artificial Sequence
  chemically synthesized
aaaaaaaaaaaaacaatgcaaa

SEQ ID NO: 700272 - DNA, 22 bp, Artificial Sequence
  chemically synthesized
agcctgaaaaaaaaaaaaacaa

SEQ ID NO: 700273 - DNA, 22 bp, Artificial Sequence
  chemically synthesized
aagcctgaaaaaaaaaaaaaca

SEQ ID NO: 700274 - DNA, 22 bp, Artificial Sequence
  chemically synthesized
caacttaagcctgaaaaaaaaa

SEQ ID NO: 700275 - DNA, 22 bp, Artificial Sequence
  chemically synthesized
tgcattgtttttttttttttca

SEQ ID NO: 700276 - DNA, 22 bp, Artificial Sequence
  chemically synthesized
gcattgtttttttttttttcag

SEQ ID NO: 700277 - DNA, 22 bp, Artificial Sequence
  chemically synthesized
cattgtttttttttttttcagg

SEQ ID NO: 700278 - DNA, 22 bp, Artificial Sequence
  chemically synthesized
tttttttttttttcaggcttaa

SEQ ID NO: 700279 - DNA, 22 bp, Artificial Sequence
  chemically synthesized
ttttttttttcaggcttaagtt

SEQ ID NO: 700280 - DNA, 22 bp, Artificial Sequence
  chemically synthesized
tttttttttcaggcttaagttg

SEQ ID NO: 700281 - DNA, 22 bp, Artificial Sequence
  chemically synthesized
ttttttttcaggcttaagttgt

SEQ ID NO: 700282 - DNA, 22 bp, Artificial Sequence
  chemically synthesized
tttttttcaggcttaagttgta

SEQ ID NO: 700283 - DNA, 22 bp, Artificial Sequence
  chemically synthesized
gggaagaaatcctacaacttaa

SEQ ID NO: 700284 - DNA, 22 bp, Artificial Sequence
  chemically synthesized
ttttttcaggcttaagttgtag

SEQ ID NO: 700285 - DNA, 22 bp, Artificial Sequence
  chemically synthesized
agggaagaaatcctacaactta

SEQ ID NO: 700286 - DNA, 22 bp, Artificial Sequence
  chemically synthesized
tttttcaggcttaagttgtagg

SEQ ID NO: 700287 - DNA, 22 bp, Artificial Sequence
  chemically synthesized
tagggaagaaatcctacaactt

SEQ ID NO: 700288 - DNA, 22 bp, Artificial Sequence
  chemically synthesized
ttttcaggcttaagttgtagga

SEQ ID NO: 700289 - DNA, 22 bp, Artificial Sequence
  chemically synthesized
tttcaggcttaagttgtaggat

SEQ ID NO: 700290 - DNA, 22 bp, Artificial Sequence
  chemically synthesized
ttcaggcttaagttgtaggatt

SEQ ID NO: 700291 - DNA, 22 bp, Artificial Sequence
  chemically synthesized
tcaggcttaagttgtaggattt

SEQ ID NO: 700292 - DNA, 22 bp, Artificial Sequence
  chemically synthesized
caggcttaagttgtaggatttc

SEQ ID NO: 700293 - DNA, 22 bp, Artificial Sequence
  chemically synthesized
agctttagggaagaaatcctac

SEQ ID NO: 700294 - DNA, 22 bp, Artificial Sequence
  chemically synthesized
aggcttaagttgtaggatttct

SEQ ID NO: 700295 - DNA, 22 bp, Artificial Sequence
  chemically synthesized
aagttgtaggatttcttcccta

SEQ ID NO: 700296 - DNA, 22 bp, Artificial Sequence
  chemically synthesized
agttgtaggatttcttccctaa

SEQ ID NO: 700297 - DNA, 22 bp, Artificial Sequence
  chemically synthesized
tagaggttcagctttagggaag

SEQ ID NO: 700298 - DNA, 22 bp, Artificial Sequence
  chemically synthesized
gtagaggttcagctttagggaa

SEQ ID NO: 700299 - DNA, 22 bp, Artificial Sequence
  chemically synthesized
taggatttcttccctaaagctg

SEQ ID NO: 700300 - DNA, 22 bp, Artificial Sequence
  chemically synthesized
cttccctaaagctgaacctcta

SEQ ID NO: 700301 - DNA, 22 bp, Artificial Sequence
  chemically synthesized
ttccctaaagctgaacctctac

SEQ ID NO: 700302 - DNA, 22 bp, Artificial Sequence
  chemically synthesized
ccctaaagctgaacctctacaa

SEQ ID NO: 700303 - DNA, 22 bp, Artificial Sequence
  chemically synthesized
cctaaagctgaacctctacaaa

SEQ ID NO: 700304 - DNA, 22 bp, Artificial Sequence
  chemically synthesized
aagctgaacctctacaaatata

SEQ ID NO: 700305 - DNA, 22 bp, Artificial Sequence
  chemically synthesized
aacctctacaaatatattttat

SEQ ID NO: 700306 - DNA, 22 bp, Artificial Sequence
  chemically synthesized
tacaaatatattttatatactg

SEQ ID NO: 700307 - DNA, 22 bp, Artificial Sequence
  chemically synthesized
caaatatattttatatactgtt

SEQ ID NO: 700308 - DNA, 22 bp, Artificial Sequence
  chemically synthesized
tatatactgtttgatctgatgg

SEQ ID NO: 700309 - DNA, 22 bp, Artificial Sequence
  chemically synthesized
atatactgtttgatctgatggt

SEQ ID NO: 700310 - DNA, 22 bp, Artificial Sequence
  chemically synthesized
tatactgtttgatctgatggtt

SEQ ID NO: 700311 - DNA, 22 bp, Artificial Sequence
  chemically synthesized
aagaaagaaaaaaaaccatcag

SEQ ID NO: 700312 - DNA, 22 bp, Artificial Sequence
  chemically synthesized
aaagaaagaaaaaaaaccatca

SEQ ID NO: 700313 - DNA, 22 bp, Artificial Sequence
  chemically synthesized
tcttaaagaaagaaaaaaaacc

SEQ ID NO: 700314 - DNA, 22 bp, Artificial Sequence
  chemically synthesized
tttgatctgatggttttttttc

SEQ ID NO: 700315 - DNA, 22 bp, Artificial Sequence
  chemically synthesized
gtcttaaagaaagaaaaaaaac

SEQ ID NO: 700316 - DNA, 22 bp, Artificial Sequence
  chemically synthesized
tgtcttaaagaaagaaaaaaaa

SEQ ID NO: 700317 - DNA, 22 bp, Artificial Sequence
  chemically synthesized
gatctgatggttttttttcttt

SEQ ID NO: 700318 - DNA, 22 bp, Artificial Sequence
  chemically synthesized
atctgatggttttttttctttc

SEQ ID NO: 700319 - DNA, 22 bp, Artificial Sequence
  chemically synthesized
ttttgtcttaaagaaagaaaaa

SEQ ID NO: 700320 - DNA, 22 bp, Artificial Sequence
  chemically synthesized
atggttttttttctttctttaa

SEQ ID NO: 700321 - DNA, 22 bp, Artificial Sequence
  chemically synthesized
aacaagattattttgtcttaaa

SEQ ID NO: 700322 - DNA, 22 bp, Artificial Sequence
  chemically synthesized
tttttctttctttaagacaaaa

SEQ ID NO: 700323 - DNA, 22 bp, Artificial Sequence
  chemically synthesized
ttttctttctttaagacaaaat

SEQ ID NO: 700324 - DNA, 22 bp, Artificial Sequence
  chemically synthesized
ctcaacaagattattttgtctt

SEQ ID NO: 700325 - DNA, 22 bp, Artificial Sequence
  chemically synthesized
tttctttctttaagacaaaata

SEQ ID NO: 700326 - DNA, 22 bp, Artificial Sequence
  chemically synthesized
ttctttctttaagacaaaataa

SEQ ID NO: 700327 - DNA, 22 bp, Artificial Sequence
  chemically synthesized
tctttctttaagacaaaataat

SEQ ID NO: 700328 - DNA, 22 bp, Artificial Sequence
  chemically synthesized
ctttctttaagacaaaataatc

SEQ ID NO: 700329 - DNA, 22 bp, Artificial Sequence
  chemically synthesized
tttctttaagacaaaataatct

SEQ ID NO: 700330 - DNA, 22 bp, Artificial Sequence
  chemically synthesized
tctttaagacaaaataatcttg

SEQ ID NO: 700331 - DNA, 22 bp, Artificial Sequence
  chemically synthesized
ctttaagacaaaataatcttgt

SEQ ID NO: 700332 - DNA, 22 bp, Artificial Sequence
  chemically synthesized
tttaagacaaaataatcttgtt

SEQ ID NO: 700333 - DNA, 22 bp, Artificial Sequence
  chemically synthesized
tagtgcctcctcaacaagatta

SEQ ID NO: 700334 - DNA, 22 bp, Artificial Sequence
  chemically synthesized
taagacaaaataatcttgttga

SEQ ID NO: 700335 - DNA, 22 bp, Artificial Sequence
  chemically synthesized
aagacaaaataatcttgttgag

SEQ ID NO: 700336 - DNA, 22 bp, Artificial Sequence
  chemically synthesized
agacaaaataatcttgttgagg

SEQ ID NO: 700337 - DNA, 22 bp, Artificial Sequence
  chemically synthesized
aggaaatgttatagtgcctcct

SEQ ID NO: 700338 - DNA, 22 bp, Artificial Sequence
  chemically synthesized
ttgaggaaatgttatagtgcct

SEQ ID NO: 700339 - DNA, 22 bp, Artificial Sequence
  chemically synthesized
gttgaggaggcactataacatt

SEQ ID NO: 700340 - DNA, 22 bp, Artificial Sequence
  chemically synthesized
tattgttgaggaaatgttatag

SEQ ID NO: 700341 - DNA, 22 bp, Artificial Sequence
  chemically synthesized
ttgaggaggcactataacattt

SEQ ID NO: 700342 - DNA, 22 bp, Artificial Sequence
  chemically synthesized
aggaggcactataacatttcct

SEQ ID NO: 700343 - DNA, 22 bp, Artificial Sequence
  chemically synthesized
aggaggaagattatattgttga

SEQ ID NO: 700344 - DNA, 22 bp, Artificial Sequence
  chemically synthesized
taacatttcctcaacaatataa

SEQ ID NO: 700345 - DNA, 22 bp, Artificial Sequence
  chemically synthesized
tattcaggaggaagattatatt

SEQ ID NO: 700346 - DNA, 22 bp, Artificial Sequence
  chemically synthesized
cctcaacaatataatcttcctc

SEQ ID NO: 700347 - DNA, 22 bp, Artificial Sequence
  chemically synthesized
ctcaacaatataatcttcctcc

SEQ ID NO: 700348 - DNA, 22 bp, Artificial Sequence
  chemically synthesized
aaactatattcaggaggaagat

SEQ ID NO: 700349 - DNA, 22 bp, Artificial Sequence
  chemically synthesized
aaaactatattcaggaggaaga

SEQ ID NO: 700350 - DNA, 22 bp, Artificial Sequence
  chemically synthesized
aacaatataatcttcctcctga

SEQ ID NO: 700351 - DNA, 22 bp, Artificial Sequence
  chemically synthesized
cagtgtcttaaaactatattca

SEQ ID NO: 700352 - DNA, 22 bp, Artificial Sequence
  chemically synthesized
aagctccagtgtcttaaaacta

SEQ ID NO: 700353 - DNA, 22 bp, Artificial Sequence
  chemically synthesized
cctcctgaatatagttttaaga

SEQ ID NO: 700354 - DNA, 22 bp, Artificial Sequence
  chemically synthesized
aaagctccagtgtcttaaaact

SEQ ID NO: 700355 - DNA, 22 bp, Artificial Sequence
  chemically synthesized
ctcctgaatatagttttaagac

SEQ ID NO: 700356 - DNA, 22 bp, Artificial Sequence
  chemically synthesized
ttaaagctccagtgtcttaaaa

SEQ ID NO: 700357 - DNA, 22 bp, Artificial Sequence
  chemically synthesized
cttaaagctccagtgtcttaaa

SEQ ID NO: 700358 - DNA, 22 bp, Artificial Sequence
  chemically synthesized
ctgaatatagttttaagacact

SEQ ID NO: 700359 - DNA, 22 bp, Artificial Sequence
  chemically synthesized
aatatagttttaagacactgga

SEQ ID NO: 700360 - DNA, 22 bp, Artificial Sequence
  chemically synthesized
tgtttcttaaagctccagtgtc

SEQ ID NO: 700361 - DNA, 22 bp, Artificial Sequence
  chemically synthesized
tgtgtttcttaaagctccagtg

SEQ ID NO: 700362 - DNA, 22 bp, Artificial Sequence
  chemically synthesized
taagacactggagctttaagaa

SEQ ID NO: 700363 - DNA, 22 bp, Artificial Sequence
  chemically synthesized
aagacactggagctttaagaaa

SEQ ID NO: 700364 - DNA, 22 bp, Artificial Sequence
  chemically synthesized
agacactggagctttaagaaac

SEQ ID NO: 700365 - DNA, 22 bp, Artificial Sequence
  chemically synthesized
ataatattctgtgtttcttaaa

SEQ ID NO: 700366 - DNA, 22 bp, Artificial Sequence
  chemically synthesized
tgataatattctgtgtttctta

SEQ ID NO: 700367 - DNA, 22 bp, Artificial Sequence
  chemically synthesized
ctgataatattctgtgtttctt

SEQ ID NO: 700368 - DNA, 22 bp, Artificial Sequence
  chemically synthesized
tttctgataatattctgtgttt

SEQ ID NO: 700369 - DNA, 22 bp, Artificial Sequence
  chemically synthesized
gagctttaagaaacacagaata

SEQ ID NO: 700370 - DNA, 22 bp, Artificial Sequence
  chemically synthesized
tgtttctgataatattctgtgt

SEQ ID NO: 700371 - DNA, 22 bp, Artificial Sequence
  chemically synthesized
ctgtttctgataatattctgtg

SEQ ID NO: 700372 - DNA, 22 bp, Artificial Sequence
  chemically synthesized
tttctgtttctgataatattct

SEQ ID NO: 700373 - DNA, 22 bp, Artificial Sequence
  chemically synthesized
atttctgtttctgataatattc

SEQ ID NO: 700374 - DNA, 22 bp, Artificial Sequence
  chemically synthesized
taagaaacacagaatattatca

SEQ ID NO: 700375 - DNA, 22 bp, Artificial Sequence
  chemically synthesized
tatttctgtttctgataatatt

SEQ ID NO: 700376 - DNA, 22 bp, Artificial Sequence
  chemically synthesized
aagaaacacagaatattatcag

SEQ ID NO: 700377 - DNA, 22 bp, Artificial Sequence
  chemically synthesized
ttatttctgtttctgataatat

SEQ ID NO: 700378 - DNA, 22 bp, Artificial Sequence
  chemically synthesized
agaaacacagaatattatcaga

SEQ ID NO: 700379 - DNA, 22 bp, Artificial Sequence
  chemically synthesized
ataagaatgcgtcttttatttc

SEQ ID NO: 700380 - DNA, 22 bp, Artificial Sequence
  chemically synthesized
tcagaaacagaaataaaagacg

SEQ ID NO: 700381 - DNA, 22 bp, Artificial Sequence
  chemically synthesized
gatattaataagaatgcgtctt

SEQ ID NO: 700382 - DNA, 22 bp, Artificial Sequence
  chemically synthesized
ctagatattaataagaatgcgt

SEQ ID NO: 700383 - DNA, 22 bp, Artificial Sequence
  chemically synthesized
ttattaatatctagcaacttta

SEQ ID NO: 700384 - DNA, 22 bp, Artificial Sequence
  chemically synthesized
attaatatctagcaactttatg

SEQ ID NO: 700385 - DNA, 22 bp, Artificial Sequence
  chemically synthesized
ttaatatctagcaactttatgt

SEQ ID NO: 700386 - DNA, 22 bp, Artificial Sequence
  chemically synthesized
atatctagcaactttatgtgtc

SEQ ID NO: 700387 - DNA, 22 bp, Artificial Sequence
  chemically synthesized
aggggaaaaagtatagacacat

SEQ ID NO: 700388 - DNA, 22 bp, Artificial Sequence
  chemically synthesized
gcaactttatgtgtctatactt

SEQ ID NO: 700389 - DNA, 22 bp, Artificial Sequence
  chemically synthesized
tatgtgtctatactttttcccc

SEQ ID NO: 700390 - DNA, 22 bp, Artificial Sequence
  chemically synthesized
atgtgtctatactttttcccct

SEQ ID NO: 700391 - DNA, 22 bp, Artificial Sequence
  chemically synthesized
tgtgtctatactttttcccctg

SEQ ID NO: 700392 - DNA, 22 bp, Artificial Sequence
  chemically synthesized
gcagaatgaaaattcaggggaa

SEQ ID NO: 700393 - DNA, 22 bp, Artificial Sequence
  chemically synthesized
ttagcagaatgaaaattcaggg

SEQ ID NO: 700394 - DNA, 22 bp, Artificial Sequence
  chemically synthesized
tactttttcccctgaattttca

SEQ ID NO: 700395 - DNA, 22 bp, Artificial Sequence
  chemically synthesized
aaattattagcagaatgaaaat

SEQ ID NO: 700396 - DNA, 22 bp, Artificial Sequence
  chemically synthesized
caaattattagcagaatgaaaa

SEQ ID NO: 700397 - DNA, 22 bp, Artificial Sequence
  chemically synthesized
tttcccctgaattttcattctg

SEQ ID NO: 700398 - DNA, 22 bp, Artificial Sequence
  chemically synthesized
ttcccctgaattttcattctgc

SEQ ID NO: 700399 - DNA, 22 bp, Artificial Sequence
  chemically synthesized
tcccctgaattttcattctgct

SEQ ID NO: 700400 - DNA, 22 bp, Artificial Sequence
  chemically synthesized
cccctgaattttcattctgcta

SEQ ID NO: 700401 - DNA, 22 bp, Artificial Sequence
  chemically synthesized
ccctgaattttcattctgctaa

SEQ ID NO: 700402 - DNA, 22 bp, Artificial Sequence
  chemically synthesized
tgcttcaaattattagcagaat

SEQ ID NO: 700403 - DNA, 22 bp, Artificial Sequence
  chemically synthesized
aattttcattctgctaataatt

SEQ ID NO: 700404 - DNA, 22 bp, Artificial Sequence
  chemically synthesized
tcattctgctaataatttgaag

SEQ ID NO: 700405 - DNA, 22 bp, Artificial Sequence
  chemically synthesized
cattctgctaataatttgaagc

SEQ ID NO: 700406 - DNA, 22 bp, Artificial Sequence
  chemically synthesized
attctgctaataatttgaagca

SEQ ID NO: 700407 - DNA, 22 bp, Artificial Sequence
  chemically synthesized
tgctaataatttgaagcacagc

SEQ ID NO: 700408 - DNA, 22 bp, Artificial Sequence
  chemically synthesized
ctaataatttgaagcacagctg

SEQ ID NO: 700409 - DNA, 22 bp, Artificial Sequence
  chemically synthesized
ataatttgaagcacagctgatg

SEQ ID NO: 700410 - DNA, 22 bp, Artificial Sequence
  chemically synthesized
gaagcacagctgatgctgacca

SEQ ID NO: 700411 - DNA, 22 bp, Artificial Sequence
  chemically synthesized
aagcacagctgatgctgaccat

SEQ ID NO: 700412 - DNA, 22 bp, Artificial Sequence
  chemically synthesized
ataggaggaaataatggtcagc

SEQ ID NO: 700413 - DNA, 22 bp, Artificial Sequence
  chemically synthesized
cataggaggaaataatggtcag

SEQ ID NO: 700414 - DNA, 22 bp, Artificial Sequence
  chemically synthesized
tcataggaggaaataatggtca

SEQ ID NO: 700415 - DNA, 22 bp, Artificial Sequence
  chemically synthesized
ttcataggaggaaataatggtc

SEQ ID NO: 700416 - DNA, 22 bp, Artificial Sequence
  chemically synthesized
atgctgaccattatttcctcct

SEQ ID NO: 700417 - DNA, 22 bp, Artificial Sequence
  chemically synthesized
aaagggagtttttcataggagg

SEQ ID NO: 700418 - DNA, 22 bp, Artificial Sequence
  chemically synthesized
aaaagggagtttttcataggag

SEQ ID NO: 700419 - DNA, 22 bp, Artificial Sequence
  chemically synthesized
accattatttcctcctatgaaa

SEQ ID NO: 700420 - DNA, 22 bp, Artificial Sequence
  chemically synthesized
atttaaaagggagtttttcata

SEQ ID NO: 700421 - DNA, 22 bp, Artificial Sequence
  chemically synthesized
tttcctcctatgaaaaactccc

SEQ ID NO: 700422 - DNA, 22 bp, Artificial Sequence
  chemically synthesized
cctcctatgaaaaactcccttt

SEQ ID NO: 700423 - DNA, 22 bp, Artificial Sequence
  chemically synthesized
ctcctatgaaaaactccctttt

SEQ ID NO: 700424 - DNA, 22 bp, Artificial Sequence
  chemically synthesized
tgagactaatttaaaagggagt

SEQ ID NO: 700425 - DNA, 22 bp, Artificial Sequence
  chemically synthesized
ctatgaaaaactcccttttaaa

SEQ ID NO: 700426 - DNA, 22 bp, Artificial Sequence
  chemically synthesized
ctgtgagactaatttaaaaggg

SEQ ID NO: 700427 - DNA, 22 bp, Artificial Sequence
  chemically synthesized
actgtgagactaatttaaaagg

SEQ ID NO: 700428 - DNA, 22 bp, Artificial Sequence
  chemically synthesized
tgaaaaactcccttttaaatta

SEQ ID NO: 700429 - DNA, 22 bp, Artificial Sequence
  chemically synthesized
ccttttaaattagtctcacagt

SEQ ID NO: 700430 - DNA, 22 bp, Artificial Sequence
  chemically synthesized
cggagtgaatttactgtgagac

SEQ ID NO: 700431 - DNA, 22 bp, Artificial Sequence
  chemically synthesized
ttaaattagtctcacagtaaat

SEQ ID NO: 700432 - DNA, 22 bp, Artificial Sequence
  chemically synthesized
taaattagtctcacagtaaatt

SEQ ID NO: 700433 - DNA, 22 bp, Artificial Sequence
  chemically synthesized
aaattagtctcacagtaaattc

SEQ ID NO: 700434 - DNA, 22 bp, Artificial Sequence
  chemically synthesized
aattagtctcacagtaaattca

SEQ ID NO: 700435 - DNA, 22 bp, Artificial Sequence
  chemically synthesized
aatacactgcggagtgaattta

SEQ ID NO: 700436 - DNA, 22 bp, Artificial Sequence
  chemically synthesized
gtctcacagtaaattcactccg

SEQ ID NO: 700437 - DNA, 22 bp, Artificial Sequence
  chemically synthesized
catctcaatacactgcggagtg

SEQ ID NO: 700438 - DNA, 22 bp, Artificial Sequence
  chemically synthesized
acatctcaatacactgcggagt

SEQ ID NO: 700439 - DNA, 22 bp, Artificial Sequence
  chemically synthesized
acagtaaattcactccgcagtg

SEQ ID NO: 700440 - DNA, 22 bp, Artificial Sequence
  chemically synthesized
ttacatctcaatacactgcgga

SEQ ID NO: 700441 - DNA, 22 bp, Artificial Sequence
  chemically synthesized
cttacatctcaatacactgcgg

SEQ ID NO: 700442 - DNA, 22 bp, Artificial Sequence
  chemically synthesized
tcttacatctcaatacactgcg

SEQ ID NO: 700443 - DNA, 22 bp, Artificial Sequence
  chemically synthesized
acgttttcttacatctcaatac

SEQ ID NO: 700444 - DNA, 22 bp, Artificial Sequence
  chemically synthesized
gacgttttcttacatctcaata

SEQ ID NO: 700445 - DNA, 22 bp, Artificial Sequence
  chemically synthesized
actccgcagtgtattgagatgt

SEQ ID NO: 700446 - DNA, 22 bp, Artificial Sequence
  chemically synthesized
tgacgttttcttacatctcaat

SEQ ID NO: 700447 - DNA, 22 bp, Artificial Sequence
  chemically synthesized
cgcagtgtattgagatgtaaga

SEQ ID NO: 700448 - DNA, 22 bp, Artificial Sequence
  chemically synthesized
gctttgacgttttcttacatct

SEQ ID NO: 700449 - DNA, 22 bp, Artificial Sequence
  chemically synthesized
agatgtaagaaaacgtcaaagc

SEQ ID NO: 700450 - DNA, 22 bp, Artificial Sequence
  chemically synthesized
tacagtgtagtcgaggatatat

SEQ ID NO: 700451 - DNA, 22 bp, Artificial Sequence
  chemically synthesized
atattatacagtgtagtcgagg

SEQ ID NO: 700452 - DNA, 22 bp, Artificial Sequence
  chemically synthesized
catattatacagtgtagtcgag

SEQ ID NO: 700453 - DNA, 22 bp, Artificial Sequence
  chemically synthesized
tcatattatacagtgtagtcga

SEQ ID NO: 700454 - DNA, 22 bp, Artificial Sequence
  chemically synthesized
tttcatattatacagtgtagtc

SEQ ID NO: 700455 - DNA, 22 bp, Artificial Sequence
  chemically synthesized
atatatcctcgactacactgta

SEQ ID NO: 700456 - DNA, 22 bp, Artificial Sequence
  chemically synthesized
ttctttcatattatacagtgta

SEQ ID NO: 700457 - DNA, 22 bp, Artificial Sequence
  chemically synthesized
gaagctgttctttcatattata

SEQ ID NO: 700458 - DNA, 22 bp, Artificial Sequence
  chemically synthesized
gactacactgtataatatgaaa

SEQ ID NO: 700459 - DNA, 22 bp, Artificial Sequence
  chemically synthesized
ttagaagctgttctttcatatt

SEQ ID NO: 700460 - DNA, 22 bp, Artificial Sequence
  chemically synthesized
attagaagctgttctttcatat

SEQ ID NO: 700461 - DNA, 22 bp, Artificial Sequence
  chemically synthesized
tattagaagctgttctttcata

SEQ ID NO: 700462 - DNA, 22 bp, Artificial Sequence
  chemically synthesized
ttattagaagctgttctttcat

SEQ ID NO: 700463 - DNA, 22 bp, Artificial Sequence
  chemically synthesized
cactgtataatatgaaagaaca

SEQ ID NO: 700464 - DNA, 22 bp, Artificial Sequence
  chemically synthesized
acttttattagaagctgttctt

SEQ ID NO: 700465 - DNA, 22 bp, Artificial Sequence
  chemically synthesized
tataatatgaaagaacagcttc

SEQ ID NO: 700466 - DNA, 22 bp, Artificial Sequence
  chemically synthesized
gcagtgggtgaagttaactttt

SEQ ID NO: 700467 - DNA, 22 bp, Artificial Sequence
  chemically synthesized
tctggcagtgggtgaagttaac

SEQ ID NO: 700468 - DNA, 22 bp, Artificial Sequence
  chemically synthesized
ctaataaaagttaacttcaccc

SEQ ID NO: 700469 - DNA, 22 bp, Artificial Sequence
  chemically synthesized
taataaaagttaacttcaccca

SEQ ID NO: 700470 - DNA, 22 bp, Artificial Sequence
  chemically synthesized
aattgtctggcagtgggtgaag

SEQ ID NO: 700471 - DNA, 22 bp, Artificial Sequence
  chemically synthesized
ataaaagttaacttcacccact

SEQ ID NO: 700472 - DNA, 22 bp, Artificial Sequence
  chemically synthesized
aaattgtctggcagtgggtgaa

SEQ ID NO: 700473 - DNA, 22 bp, Artificial Sequence
  chemically synthesized
cgcttaaattgtctggcagtgg

SEQ ID NO: 700474 - DNA, 22 bp, Artificial Sequence
  chemically synthesized
attacgcttaaattgtctggca

SEQ ID NO: 700475 - DNA, 22 bp, Artificial Sequence
  chemically synthesized
acttcacccactgccagacaat

SEQ ID NO: 700476 - DNA, 22 bp, Artificial Sequence
  chemically synthesized
cattacgcttaaattgtctggc

SEQ ID NO: 700477 - DNA, 22 bp, Artificial Sequence
  chemically synthesized
cacccactgccagacaatttaa

SEQ ID NO: 700478 - DNA, 22 bp, Artificial Sequence
  chemically synthesized
acccactgccagacaatttaag

SEQ ID NO: 700479 - DNA, 22 bp, Artificial Sequence
  chemically synthesized
gagtttcattacgcttaaattg

SEQ ID NO: 700480 - DNA, 22 bp, Artificial Sequence
  chemically synthesized
ccagacaatttaagcgtaatga

SEQ ID NO: 700481 - DNA, 22 bp, Artificial Sequence
  chemically synthesized
aagcgtaatgaaactccagctt

SEQ ID NO: 700482 - DNA, 22 bp, Artificial Sequence
  chemically synthesized
tataaaacaaagaagctggagt

SEQ ID NO: 700483 - DNA, 22 bp, Artificial Sequence
  chemically synthesized
agcgtaatgaaactccagcttc

SEQ ID NO: 700484 - DNA, 22 bp, Artificial Sequence
  chemically synthesized
tatataaaacaaagaagctgga

SEQ ID NO: 700485 - DNA, 22 bp, Artificial Sequence
  chemically synthesized
ctctatataaaacaaagaagct

SEQ ID NO: 700486 - DNA, 22 bp, Artificial Sequence
  chemically synthesized
ttactctatataaaacaaagaa

SEQ ID NO: 700487 - DNA, 22 bp, Artificial Sequence
  chemically synthesized
tattactctatataaaacaaag

SEQ ID NO: 700488 - DNA, 22 bp, Artificial Sequence
  chemically synthesized
cagcttctttgttttatataga

SEQ ID NO: 700489 - DNA, 22 bp, Artificial Sequence
  chemically synthesized
atccctctattactctatataa

SEQ ID NO: 700490 - DNA, 22 bp, Artificial Sequence
  chemically synthesized
gatccctctattactctatata

SEQ ID NO: 700491 - DNA, 22 bp, Artificial Sequence
  chemically synthesized
ctttgttttatatagagtaata

SEQ ID NO: 700492 - DNA, 22 bp, Artificial Sequence
  chemically synthesized
tttgttttatatagagtaatag

SEQ ID NO: 700493 - DNA, 22 bp, Artificial Sequence
  chemically synthesized
tgttttatatagagtaatagag

SEQ ID NO: 700494 - DNA, 22 bp, Artificial Sequence
  chemically synthesized
gttttatatagagtaatagagg

SEQ ID NO: 700495 - DNA, 22 bp, Artificial Sequence
  chemically synthesized
ggtgatttgatccctctattac

SEQ ID NO: 700496 - DNA, 22 bp, Artificial Sequence
  chemically synthesized
ttttatatagagtaatagaggg

SEQ ID NO: 700497 - DNA, 22 bp, Artificial Sequence
  chemically synthesized
tatatagagtaatagagggatc

SEQ ID NO: 700498 - DNA, 22 bp, Artificial Sequence
  chemically synthesized
atatagagtaatagagggatca

SEQ ID NO: 700499 - DNA, 22 bp, Artificial Sequence
  chemically synthesized
tatagagtaatagagggatcaa

SEQ ID NO: 700500 - DNA, 22 bp, Artificial Sequence
  chemically synthesized
aaggttgggtgatttgatccct

SEQ ID NO: 700501 - DNA, 22 bp, Artificial Sequence
  chemically synthesized
gttaaaggttgggtgatttgat

SEQ ID NO: 700502 - DNA, 22 bp, Artificial Sequence
  chemically synthesized
caaggtacaaaacagcatgtct

SEQ ID NO: 700503 - DNA, 22 bp, Artificial Sequence
  chemically synthesized
taaccagacatgctgttttgta

SEQ ID NO: 700504 - DNA, 22 bp, Artificial Sequence
  chemically synthesized
aaccagacatgctgttttgtac

SEQ ID NO: 700505 - DNA, 22 bp, Artificial Sequence
  chemically synthesized
accagacatgctgttttgtacc

SEQ ID NO: 700506 - DNA, 22 bp, Artificial Sequence
  chemically synthesized
aatgacatatctccaaggtaca

SEQ ID NO: 700507 - DNA, 22 bp, Artificial Sequence
  chemically synthesized
aaatgacatatctccaaggtac

SEQ ID NO: 700508 - DNA, 22 bp, Artificial Sequence
  chemically synthesized
ttttgtaccttggagatatgtc

SEQ ID NO: 700509 - DNA, 22 bp, Artificial Sequence
  chemically synthesized
tatcgtttaaatgacatatctc

SEQ ID NO: 700510 - DNA, 22 bp, Artificial Sequence
  chemically synthesized
tgtaccttggagatatgtcatt

SEQ ID NO: 700511 - DNA, 22 bp, Artificial Sequence
  chemically synthesized
ctatatcgtttaaatgacatat

SEQ ID NO: 700512 - DNA, 22 bp, Artificial Sequence
  chemically synthesized
gtaccttggagatatgtcattt

SEQ ID NO: 700513 - DNA, 22 bp, Artificial Sequence
  chemically synthesized
cctatatcgtttaaatgacata

SEQ ID NO: 700514 - DNA, 22 bp, Artificial Sequence
  chemically synthesized
taccttggagatatgtcattta

SEQ ID NO: 700515 - DNA, 22 bp, Artificial Sequence
  chemically synthesized
ggagatatgtcatttaaacgat

SEQ ID NO: 700516 - DNA, 22 bp, Artificial Sequence
  chemically synthesized
gagatatgtcatttaaacgata

SEQ ID NO: 700517 - DNA, 22 bp, Artificial Sequence
  chemically synthesized
aaacgatataggaaatggattt

SEQ ID NO: 700518 - DNA, 22 bp, Artificial Sequence
  chemically synthesized
ccggccaaatacaaatccattt

SEQ ID NO: 700519 - DNA, 22 bp, Artificial Sequence
  chemically synthesized
aacgatataggaaatggatttg

SEQ ID NO: 700520 - DNA, 22 bp, Artificial Sequence
  chemically synthesized
gtatttggccggtaattatgct

SEQ ID NO: 700521 - DNA, 22 bp, Artificial Sequence
  chemically synthesized
ccaaaatgaaaaagcataatta

SEQ ID NO: 700522 - DNA, 22 bp, Artificial Sequence
  chemically synthesized
tatttggccggtaattatgctt

SEQ ID NO: 700523 - DNA, 22 bp, Artificial Sequence
  chemically synthesized
ggccggtaattatgctttttca

SEQ ID NO: 700524 - DNA, 22 bp, Artificial Sequence
  chemically synthesized
cgtctgccaaaatgaaaaagca

SEQ ID NO: 700525 - DNA, 22 bp, Artificial Sequence
  chemically synthesized
gccggtaattatgctttttcat

SEQ ID NO: 700526 - DNA, 22 bp, Artificial Sequence
  chemically synthesized
ccgtctgccaaaatgaaaaagc

SEQ ID NO: 700527 - DNA, 22 bp, Artificial Sequence
  chemically synthesized
aaaatttccgtctgccaaaatg

SEQ ID NO: 700528 - DNA, 22 bp, Artificial Sequence
  chemically synthesized
tgctttttcattttggcagacg

SEQ ID NO: 700529 - DNA, 22 bp, Artificial Sequence
  chemically synthesized
tattaaaaatttccgtctgcca

SEQ ID NO: 700530 - DNA, 22 bp, Artificial Sequence
  chemically synthesized
tgtattaaaaatttccgtctgc

SEQ ID NO: 700531 - DNA, 22 bp, Artificial Sequence
  chemically synthesized
tttcattttggcagacggaaat

SEQ ID NO: 700532 - DNA, 22 bp, Artificial Sequence
  chemically synthesized
tctgtattaaaaatttccgtct

SEQ ID NO: 700533 - DNA, 22 bp, Artificial Sequence
  chemically synthesized
ttcattttggcagacggaaatt

SEQ ID NO: 700534 - DNA, 22 bp, Artificial Sequence
  chemically synthesized
ctctgtattaaaaatttccgtc

SEQ ID NO: 700535 - DNA, 22 bp, Artificial Sequence
  chemically synthesized
tcattttggcagacggaaattt

SEQ ID NO: 700536 - DNA, 22 bp, Artificial Sequence
  chemically synthesized
tctctgtattaaaaatttccgt

SEQ ID NO: 700537 - DNA, 22 bp, Artificial Sequence
  chemically synthesized
cattttggcagacggaaatttt

SEQ ID NO: 700538 - DNA, 22 bp, Artificial Sequence
  chemically synthesized
ttctctgtattaaaaatttccg

SEQ ID NO: 700539 - DNA, 22 bp, Artificial Sequence
  chemically synthesized
attttggcagacggaaattttt

SEQ ID NO: 700540 - DNA, 22 bp, Artificial Sequence
  chemically synthesized
tttctctgtattaaaaatttcc

SEQ ID NO: 700541 - DNA, 22 bp, Artificial Sequence
  chemically synthesized
ttttctctgtattaaaaatttc

SEQ ID NO: 700542 - DNA, 22 bp, Artificial Sequence
  chemically synthesized
tggcagacggaaatttttaata

SEQ ID NO: 700543 - DNA, 22 bp, Artificial Sequence
  chemically synthesized
ggcagacggaaatttttaatac

SEQ ID NO: 700544 - DNA, 22 bp, Artificial Sequence
  chemically synthesized
gcagacggaaatttttaataca

SEQ ID NO: 700545 - DNA, 22 bp, Artificial Sequence
  chemically synthesized
aatgtcttttttctctgtatta

SEQ ID NO: 700546 - DNA, 22 bp, Artificial Sequence
  chemically synthesized
ttaatacagagaaaaaagacat

SEQ ID NO: 700547 - DNA, 22 bp, Artificial Sequence
  chemically synthesized
taatacagagaaaaaagacatt

SEQ ID NO: 700548 - DNA, 22 bp, Artificial Sequence
  chemically synthesized
aatacagagaaaaaagacattt

SEQ ID NO: 700549 - DNA, 22 bp, Artificial Sequence
  chemically synthesized
aaaacagcagctaaatgtcttt

SEQ ID NO: 700550 - DNA, 22 bp, Artificial Sequence
  chemically synthesized
atacagagaaaaaagacattta

SEQ ID NO: 700551 - DNA, 22 bp, Artificial Sequence
  chemically synthesized
caaaacagcagctaaatgtctt

SEQ ID NO: 700552 - DNA, 22 bp, Artificial Sequence
  chemically synthesized
cttcaaaacagcagctaaatgt

SEQ ID NO: 700553 - DNA, 22 bp, Artificial Sequence
  chemically synthesized
agctgctgttttgaagtagtct

SEQ ID NO: 700554 - DNA, 22 bp, Artificial Sequence
  chemically synthesized
gctgctgttttgaagtagtctc

SEQ ID NO: 700555 - DNA, 22 bp, Artificial Sequence
  chemically synthesized
ctgttttgaagtagtctctgac

SEQ ID NO: 700556 - DNA, 22 bp, Artificial Sequence
  chemically synthesized
ttttgaagtagtctctgacttt

SEQ ID NO: 700557 - DNA, 22 bp, Artificial Sequence
  chemically synthesized
tgaagtagtctctgactttcca

SEQ ID NO: 700558 - DNA, 22 bp, Artificial Sequence
  chemically synthesized
gaagtagtctctgactttccat

SEQ ID NO: 700559 - DNA, 22 bp, Artificial Sequence
  chemically synthesized
aagtagtctctgactttccatt

SEQ ID NO: 700560 - DNA, 22 bp, Artificial Sequence
  chemically synthesized
tgactttccatttctttctgtc

SEQ ID NO: 700561 - DNA, 22 bp, Artificial Sequence
  chemically synthesized
actttccatttctttctgtcct

SEQ ID NO: 700562 - DNA, 22 bp, Artificial Sequence
  chemically synthesized
tccatttctttctgtccttctt

SEQ ID NO: 700563 - DNA, 22 bp, Artificial Sequence
  chemically synthesized
ccatttctttctgtccttcttt

SEQ ID NO: 700564 - DNA, 22 bp, Artificial Sequence
  chemically synthesized
catttctttctgtccttctttc

SEQ ID NO: 700565 - DNA, 22 bp, Artificial Sequence
  chemically synthesized
ctttctgtccttctttctctat

SEQ ID NO: 700566 - DNA, 22 bp, Artificial Sequence
  chemically synthesized
tttctgtccttctttctctatt

SEQ ID NO: 700567 - DNA, 22 bp, Artificial Sequence
  chemically synthesized
tctgtccttctttctctattcc

SEQ ID NO: 700568 - DNA, 22 bp, Artificial Sequence
  chemically synthesized
ctgtccttctttctctattcct

SEQ ID NO: 700569 - DNA, 22 bp, Artificial Sequence
  chemically synthesized
tgtccttctttctctattcctt

SEQ ID NO: 700570 - DNA, 22 bp, Artificial Sequence
  chemically synthesized
tccttctttctctattcctttc

SEQ ID NO: 700571 - DNA, 22 bp, Artificial Sequence
  chemically synthesized
ctttctctattcctttcttttc

SEQ ID NO: 700572 - DNA, 22 bp, Artificial Sequence
  chemically synthesized
tttctctattcctttcttttcc

SEQ ID NO: 700573 - DNA, 22 bp, Artificial Sequence
  chemically synthesized
tctctattcctttcttttccct

SEQ ID NO: 700574 - DNA, 22 bp, Artificial Sequence
  chemically synthesized
ctctattcctttcttttccctt

SEQ ID NO: 700575 - DNA, 22 bp, Artificial Sequence
  chemically synthesized
tctattcctttcttttcccttc

SEQ ID NO: 700576 - DNA, 22 bp, Artificial Sequence
  chemically synthesized
tattcctttcttttcccttcct

SEQ ID NO: 700577 - DNA, 22 bp, Artificial Sequence
  chemically synthesized
ttcctttcttttcccttcctcc

SEQ ID NO: 700578 - DNA, 22 bp, Artificial Sequence
  chemically synthesized
ctttcttttcccttcctcctgc

SEQ ID NO: 700579 - DNA, 22 bp, Artificial Sequence
  chemically synthesized
tcttttcccttcctcctgcctt

SEQ ID NO: 700580 - DNA, 22 bp, Artificial Sequence
  chemically synthesized
cttttcccttcctcctgccttc

SEQ ID NO: 700581 - DNA, 22 bp, Artificial Sequence
  chemically synthesized
ttttcccttcctcctgccttcc

SEQ ID NO: 700582 - DNA, 22 bp, Artificial Sequence
  chemically synthesized
ttcccttcctcctgccttccct

SEQ ID NO: 700583 - DNA, 22 bp, Artificial Sequence
  chemically synthesized
tcccttcctcctgccttccctg

SEQ ID NO: 700584 - DNA, 22 bp, Artificial Sequence
  chemically synthesized
cccttcctcctgccttccctgc

SEQ ID NO: 700585 - DNA, 22 bp, Artificial Sequence
  chemically synthesized
ccttcctcctgccttccctgct

SEQ ID NO: 700586 - DNA, 22 bp, Artificial Sequence
  chemically synthesized
cctcctgccttccctgcttccc

SEQ ID NO: 700587 - DNA, 22 bp, Artificial Sequence
  chemically synthesized
ctcctgccttccctgcttccct

SEQ ID NO: 700588 - DNA, 22 bp, Artificial Sequence
  chemically synthesized
ctgccttccctgcttccctttc

SEQ ID NO: 700589 - DNA, 22 bp, Artificial Sequence
  chemically synthesized
ccttccctgcttccctttccat

SEQ ID NO: 700590 - DNA, 22 bp, Artificial Sequence
  chemically synthesized
ccctgcttccctttccatcttt

SEQ ID NO: 700591 - DNA, 22 bp, Artificial Sequence
  chemically synthesized
cctgcttccctttccatctttg

SEQ ID NO: 700592 - DNA, 22 bp, Artificial Sequence
  chemically synthesized
cttccctttccatctttgcctt

SEQ ID NO: 700593 - DNA, 22 bp, Artificial Sequence
  chemically synthesized
ggaagagaatgagaaaggcaaa

SEQ ID NO: 700594 - DNA, 22 bp, Artificial Sequence
  chemically synthesized
ccctttccatctttgcctttct

SEQ ID NO: 700595 - DNA, 22 bp, Artificial Sequence
  chemically synthesized
cctttccatctttgcctttctc

SEQ ID NO: 700596 - DNA, 22 bp, Artificial Sequence
  chemically synthesized
tccatctttgcctttctcattc

SEQ ID NO: 700597 - DNA, 22 bp, Artificial Sequence
  chemically synthesized
ccatctttgcctttctcattct

SEQ ID NO: 700598 - DNA, 22 bp, Artificial Sequence
  chemically synthesized
catctttgcctttctcattctc

SEQ ID NO: 700599 - DNA, 22 bp, Artificial Sequence
  chemically synthesized
tgcctttctcattctcttccca

SEQ ID NO: 700600 - DNA, 22 bp, Artificial Sequence
  chemically synthesized
gcctttctcattctcttcccaa

SEQ ID NO: 700601 - DNA, 22 bp, Artificial Sequence
  chemically synthesized
cctttctcattctcttcccaac

SEQ ID NO: 700602 - DNA, 22 bp, Artificial Sequence
  chemically synthesized
tctcattctcttcccaactctt

SEQ ID NO: 700603 - DNA, 22 bp, Artificial Sequence
  chemically synthesized
ctcattctcttcccaactcttc

SEQ ID NO: 700604 - DNA, 22 bp, Artificial Sequence
  chemically synthesized
tcattctcttcccaactcttct

SEQ ID NO: 700605 - DNA, 22 bp, Artificial Sequence
  chemically synthesized
attctcttcccaactcttctct

SEQ ID NO: 700606 - DNA, 22 bp, Artificial Sequence
  chemically synthesized
tcttcccaactcttctcttgtc

SEQ ID NO: 700607 - DNA, 22 bp, Artificial Sequence
  chemically synthesized
cagaagaaaaaaggacaagaga

SEQ ID NO: 700608 - DNA, 22 bp, Artificial Sequence
  chemically synthesized
ttcccaactcttctcttgtcct

SEQ ID NO: 700609 - DNA, 22 bp, Artificial Sequence
  chemically synthesized
cccaactcttctcttgtccttt

SEQ ID NO: 700610 - DNA, 22 bp, Artificial Sequence
  chemically synthesized
ccaactcttctcttgtcctttt

SEQ ID NO: 700611 - DNA, 22 bp, Artificial Sequence
  chemically synthesized
catcctacagaagaaaaaagga

SEQ ID NO: 700612 - DNA, 22 bp, Artificial Sequence
  chemically synthesized
ttctcttgtccttttttcttct

SEQ ID NO: 700613 - DNA, 22 bp, Artificial Sequence
  chemically synthesized
ctcttgtccttttttcttctgt

SEQ ID NO: 700614 - DNA, 22 bp, Artificial Sequence
  chemically synthesized
tcttgtccttttttcttctgta

SEQ ID NO: 700615 - DNA, 22 bp, Artificial Sequence
  chemically synthesized
ttgtccttttttcttctgtagg

SEQ ID NO: 700616 - DNA, 22 bp, Artificial Sequence
  chemically synthesized
gtccttttttcttctgtaggat

SEQ ID NO: 700617 - DNA, 22 bp, Artificial Sequence
  chemically synthesized
tccttttttcttctgtaggatg

SEQ ID NO: 700618 - DNA, 22 bp, Artificial Sequence
  chemically synthesized
gacaggagagctgcatcctaca

SEQ ID NO: 700619 - DNA, 22 bp, Artificial Sequence
  chemically synthesized
ggacaggagagctgcatcctac

SEQ ID NO: 700620 - DNA, 22 bp, Artificial Sequence
  chemically synthesized
ttttcttctgtaggatgcagct

SEQ ID NO: 700621 - DNA, 22 bp, Artificial Sequence
  chemically synthesized
tttggacaggagagctgcatcc

SEQ ID NO: 700622 - DNA, 22 bp, Artificial Sequence
  chemically synthesized
tttcttctgtaggatgcagctc

SEQ ID NO: 700623 - DNA, 22 bp, Artificial Sequence
  chemically synthesized
atttggacaggagagctgcatc

SEQ ID NO: 700624 - DNA, 22 bp, Artificial Sequence
  chemically synthesized
ttcttctgtaggatgcagctct

SEQ ID NO: 700625 - DNA, 22 bp, Artificial Sequence
  chemically synthesized
tcttctgtaggatgcagctctc

SEQ ID NO: 700626 - DNA, 22 bp, Artificial Sequence
  chemically synthesized
cttctgtaggatgcagctctcc

SEQ ID NO: 700627 - DNA, 22 bp, Artificial Sequence
  chemically synthesized
ttctgtaggatgcagctctcct

SEQ ID NO: 700628 - DNA, 22 bp, Artificial Sequence
  chemically synthesized
ctgtaggatgcagctctcctgt

SEQ ID NO: 700629 - DNA, 22 bp, Artificial Sequence
  chemically synthesized
tgtaggatgcagctctcctgtc

SEQ ID NO: 700630 - DNA, 22 bp, Artificial Sequence
  chemically synthesized
tgaacttatttggacaggagag

SEQ ID NO: 700631 - DNA, 22 bp, Artificial Sequence
  chemically synthesized
taggatgcagctctcctgtcca

SEQ ID NO: 700632 - DNA, 22 bp, Artificial Sequence
  chemically synthesized
tgtgaacttatttggacaggag

SEQ ID NO: 700633 - DNA, 22 bp, Artificial Sequence
  chemically synthesized
ctctgtgaacttatttggacag

SEQ ID NO: 700634 - DNA, 22 bp, Artificial Sequence
  chemically synthesized
actctgtgaacttatttggaca

SEQ ID NO: 700635 - DNA, 22 bp, Artificial Sequence
  chemically synthesized
tttactctgtgaacttatttgg

SEQ ID NO: 700636 - DNA, 22 bp, Artificial Sequence
  chemically synthesized
atttactctgtgaacttatttg

SEQ ID NO: 700637 - DNA, 22 bp, Artificial Sequence
  chemically synthesized
tcctgtccaaataagttcacag

SEQ ID NO: 700638 - DNA, 22 bp, Artificial Sequence
  chemically synthesized
ctgtccaaataagttcacagag

SEQ ID NO: 700639 - DNA, 22 bp, Artificial Sequence
  chemically synthesized
tccaaataagttcacagagtaa

SEQ ID NO: 700640 - DNA, 22 bp, Artificial Sequence
  chemically synthesized
aatcagatcttatttactctgt

SEQ ID NO: 700641 - DNA, 22 bp, Artificial Sequence
  chemically synthesized
aaatcagatcttatttactctg

SEQ ID NO: 700642 - DNA, 22 bp, Artificial Sequence
  chemically synthesized
taaatcagatcttatttactct

SEQ ID NO: 700643 - DNA, 22 bp, Artificial Sequence
  chemically synthesized
ttaaatcagatcttatttactc

SEQ ID NO: 700644 - DNA, 22 bp, Artificial Sequence
  chemically synthesized
acagagtaaataagatctgatt

SEQ ID NO: 700645 - DNA, 22 bp, Artificial Sequence
  chemically synthesized
gcccatgtttttaaatcagatc

SEQ ID NO: 700646 - DNA, 22 bp, Artificial Sequence
  chemically synthesized
agcccatgtttttaaatcagat

SEQ ID NO: 700647 - DNA, 22 bp, Artificial Sequence
  chemically synthesized
gccttagcccatgtttttaaat

SEQ ID NO: 700648 - DNA, 22 bp, Artificial Sequence
  chemically synthesized
atttaaaaacatgggctaaggc

SEQ ID NO: 700649 - DNA, 22 bp, Artificial Sequence
  chemically synthesized
aaaaacatgggctaaggccagg

SEQ ID NO: 700650 - DNA, 22 bp, Artificial Sequence
  chemically synthesized
aaaacatgggctaaggccaggc

SEQ ID NO: 700651 - DNA, 22 bp, Artificial Sequence
  chemically synthesized
caggcgtgagccaccacgcctg

SEQ ID NO: 700652 - DNA, 22 bp, Artificial Sequence
  chemically synthesized
ggattacaggcgtgagccacca

SEQ ID NO: 700653 - DNA, 22 bp, Artificial Sequence
  chemically synthesized
aggccaggcgtggtggctcacg

SEQ ID NO: 700654 - DNA, 22 bp, Artificial Sequence
  chemically synthesized
ccaaagtgttgggattacaggc

SEQ ID NO: 700655 - DNA, 22 bp, Artificial Sequence
  chemically synthesized
agcctcccaaagtgttgggatt

SEQ ID NO: 700656 - DNA, 22 bp, Artificial Sequence
  chemically synthesized
acgcctgtaatcccaacacttt

SEQ ID NO: 700657 - DNA, 22 bp, Artificial Sequence
  chemically synthesized
cctcagcctcccaaagtgttgg

SEQ ID NO: 700658 - DNA, 22 bp, Artificial Sequence
  chemically synthesized
cctgcctcagcctcccaaagtg

SEQ ID NO: 700659 - DNA, 22 bp, Artificial Sequence
  chemically synthesized
taatcccaacactttgggaggc

SEQ ID NO: 700660 - DNA, 22 bp, Artificial Sequence
  chemically synthesized
agatgatctgcctgcctcagcc

SEQ ID NO: 700661 - DNA, 22 bp, Artificial Sequence
  chemically synthesized
aactcagatgatctgcctgcct

SEQ ID NO: 700662 - DNA, 22 bp, Artificial Sequence
  chemically synthesized
tgggaggctgaggcaggcagat

SEQ ID NO: 700663 - DNA, 22 bp, Artificial Sequence
  chemically synthesized
gggaggctgaggcaggcagatc

SEQ ID NO: 700664 - DNA, 22 bp, Artificial Sequence
  chemically synthesized
ctgaactcagatgatctgcctg

SEQ ID NO: 700665 - DNA, 22 bp, Artificial Sequence
  chemically synthesized
ggaggctgaggcaggcagatca

SEQ ID NO: 700666 - DNA, 22 bp, Artificial Sequence
  chemically synthesized
aactcctgaactcagatgatct

SEQ ID NO: 700667 - DNA, 22 bp, Artificial Sequence
  chemically synthesized
gaactcctgaactcagatgatc

SEQ ID NO: 700668 - DNA, 22 bp, Artificial Sequence
  chemically synthesized
aggcaggcagatcatctgagtt

SEQ ID NO: 700669 - DNA, 22 bp, Artificial Sequence
  chemically synthesized
gtcttgaactcctgaactcaga

SEQ ID NO: 700670 - DNA, 22 bp, Artificial Sequence
  chemically synthesized
gccaggctggtcttgaactcct

SEQ ID NO: 700671 - DNA, 22 bp, Artificial Sequence
  chemically synthesized
atgttggccaggctggtcttga

SEQ ID NO: 700672 - DNA, 22 bp, Artificial Sequence
  chemically synthesized
agttcaggagttcaagaccagc

SEQ ID NO: 700673 - DNA, 22 bp, Artificial Sequence
  chemically synthesized
ctcatgttggccaggctggtct

SEQ ID NO: 700674 - DNA, 22 bp, Artificial Sequence
  chemically synthesized
cctcatgttggccaggctggtc

SEQ ID NO: 700675 - DNA, 22 bp, Artificial Sequence
  chemically synthesized
aggagttcaagaccagcctggc

SEQ ID NO: 700676 - DNA, 22 bp, Artificial Sequence
  chemically synthesized
aagaccagcctggccaacatga

SEQ ID NO: 700677 - DNA, 22 bp, Artificial Sequence
  chemically synthesized
gtagagatagcgtttcctcatg

SEQ ID NO: 700678 - DNA, 22 bp, Artificial Sequence
  chemically synthesized
agtagagatagcgtttcctcat

SEQ ID NO: 700679 - DNA, 22 bp, Artificial Sequence
  chemically synthesized
tagtagagatagcgtttcctca

SEQ ID NO: 700680 - DNA, 22 bp, Artificial Sequence
  chemically synthesized
ttagtagagatagcgtttcctc

SEQ ID NO: 700681 - DNA, 22 bp, Artificial Sequence
  chemically synthesized
gccaacatgaggaaacgctatc

SEQ ID NO: 700682 - DNA, 22 bp, Artificial Sequence
  chemically synthesized
gtatttttagtagagatagcgt

SEQ ID NO: 700683 - DNA, 22 bp, Artificial Sequence
  chemically synthesized
ggtatttttagtagagatagcg

SEQ ID NO: 700684 - DNA, 22 bp, Artificial Sequence
  chemically synthesized
tggtatttttagtagagatagc

SEQ ID NO: 700685 - DNA, 22 bp, Artificial Sequence
  chemically synthesized
ttggtatttttagtagagatag

SEQ ID NO: 700686 - DNA, 22 bp, Artificial Sequence
  chemically synthesized
tttggtatttttagtagagata

SEQ ID NO: 700687 - DNA, 22 bp, Artificial Sequence
  chemically synthesized
ttttggtatttttagtagagat

SEQ ID NO: 700688 - DNA, 22 bp, Artificial Sequence
  chemically synthesized
tttttggtatttttagtagaga

SEQ ID NO: 700689 - DNA, 22 bp, Artificial Sequence
  chemically synthesized
ttttttggtatttttagtagag

SEQ ID NO: 700690 - DNA, 22 bp, Artificial Sequence
  chemically synthesized
tttttttggtatttttagtaga

SEQ ID NO: 700691 - DNA, 22 bp, Artificial Sequence
  chemically synthesized
ttttttttggtatttttagtag

SEQ ID NO: 700692 - DNA, 22 bp, Artificial Sequence
  chemically synthesized
tttttttttggtatttttagta

SEQ ID NO: 700693 - DNA, 22 bp, Artificial Sequence
  chemically synthesized
ttttttttttggtatttttagt

SEQ ID NO: 700694 - DNA, 22 bp, Artificial Sequence
  chemically synthesized
tttttttttttggtatttttag

SEQ ID NO: 700695 - DNA, 22 bp, Artificial Sequence
  chemically synthesized
ttttttttttttggtattttta

SEQ ID NO: 700696 - DNA, 22 bp, Artificial Sequence
  chemically synthesized
tttttttttttttggtattttt

SEQ ID NO: 700697 - DNA, 22 bp, Artificial Sequence
  chemically synthesized
ttttttttttttttggtatttt

SEQ ID NO: 700698 - DNA, 22 bp, Artificial Sequence
  chemically synthesized
tttttttttttttttggtattt

SEQ ID NO: 700699 - DNA, 22 bp, Artificial Sequence
  chemically synthesized
ttttttttttttttttggtatt

SEQ ID NO: 700700 - DNA, 22 bp, Artificial Sequence
  chemically synthesized
tctctactaaaaataccaaaaa

SEQ ID NO: 700701 - DNA, 22 bp, Artificial Sequence
  chemically synthesized
tttttttttttttttttggtat

SEQ ID NO: 700702 - DNA, 22 bp, Artificial Sequence
  chemically synthesized
ttttttttttttttttttggta

SEQ ID NO: 700703 - DNA, 22 bp, Artificial Sequence
  chemically synthesized
tttttttttttttttttttggt

SEQ ID NO: 700704 - DNA, 22 bp, Artificial Sequence
  chemically synthesized
tactaaaaataccaaaaaaaaa

SEQ ID NO: 700705 - DNA, 22 bp, Artificial Sequence
  chemically synthesized
ctaaaaataccaaaaaaaaaaa

SEQ ID NO: 700706 - DNA, 22 bp, Artificial Sequence
  chemically synthesized
aaaataccaaaaaaaaaaaaaa

SEQ ID NO: 700707 - DNA, 22 bp, Artificial Sequence
  chemically synthesized
ccaccatgcccggctttttttt

SEQ ID NO: 700708 - DNA, 22 bp, Artificial Sequence
  chemically synthesized
caggcacctgccaccatgcccg

SEQ ID NO: 700709 - DNA, 22 bp, Artificial Sequence
  chemically synthesized
ggattacaggcacctgccacca

SEQ ID NO: 700710 - DNA, 22 bp, Artificial Sequence
  chemically synthesized
ccgagtagctgggattacaggc

SEQ ID NO: 700711 - DNA, 22 bp, Artificial Sequence
  chemically synthesized
agtctcccgagtagctgggatt

SEQ ID NO: 700712 - DNA, 22 bp, Artificial Sequence
  chemically synthesized
cctcagtctcccgagtagctgg

SEQ ID NO: 700713 - DNA, 22 bp, Artificial Sequence
  chemically synthesized
ctgcctcagtctcccgagtagc

SEQ ID NO: 700714 - DNA, 22 bp, Artificial Sequence
  chemically synthesized
cctgcctcagtctcccgagtag

SEQ ID NO: 700715 - DNA, 22 bp, Artificial Sequence
  chemically synthesized
tcctgcctcagtctcccgagta

SEQ ID NO: 700716 - DNA, 22 bp, Artificial Sequence
  chemically synthesized
taatcccagctactcgggagac

SEQ ID NO: 700717 - DNA, 22 bp, Artificial Sequence
  chemically synthesized
aagtgattttcctgcctcagtc

SEQ ID NO: 700718 - DNA, 22 bp, Artificial Sequence
  chemically synthesized
ctcgggagactgaggcaggaaa

SEQ ID NO: 700719 - DNA, 22 bp, Artificial Sequence
  chemically synthesized
ggttcaagtgattttcctgcct

SEQ ID NO: 700720 - DNA, 22 bp, Artificial Sequence
  chemically synthesized
gggagactgaggcaggaaaatc

SEQ ID NO: 700721 - DNA, 22 bp, Artificial Sequence
  chemically synthesized
ctgggttcaagtgattttcctg

SEQ ID NO: 700722 - DNA, 22 bp, Artificial Sequence
  chemically synthesized
cctcctgggttcaagtgatttt

SEQ ID NO: 700723 - DNA, 22 bp, Artificial Sequence
  chemically synthesized
gcctcctgggttcaagtgattt

SEQ ID NO: 700724 - DNA, 22 bp, Artificial Sequence
  chemically synthesized
tgcctcctgggttcaagtgatt

SEQ ID NO: 700725 - DNA, 22 bp, Artificial Sequence
  chemically synthesized
aggcaggaaaatcacttgaacc

SEQ ID NO: 700726 - DNA, 22 bp, Artificial Sequence
  chemically synthesized
catcctttgcctcctgggttca

SEQ ID NO: 700727 - DNA, 22 bp, Artificial Sequence
  chemically synthesized
actgcatcctttgcctcctggg

SEQ ID NO: 700728 - DNA, 22 bp, Artificial Sequence
  chemically synthesized
agctcactgcatcctttgcctc

SEQ ID NO: 700729 - DNA, 22 bp, Artificial Sequence
  chemically synthesized
cagctcactgcatcctttgcct

SEQ ID NO: 700730 - DNA, 22 bp, Artificial Sequence
  chemically synthesized
gaacccaggaggcaaaggatgc

SEQ ID NO: 700731 - DNA, 22 bp, Artificial Sequence
  chemically synthesized
aacccaggaggcaaaggatgca

SEQ ID NO: 700732 - DNA, 22 bp, Artificial Sequence
  chemically synthesized
gagtgcagtggtgcgatttcag

SEQ ID NO: 700733 - DNA, 22 bp, Artificial Sequence
  chemically synthesized
tcgcccaggctggagtgcagtg

SEQ ID NO: 700734 - DNA, 22 bp, Artificial Sequence
  chemically synthesized
gtcgcccaggctggagtgcagt

SEQ ID NO: 700735 - DNA, 22 bp, Artificial Sequence
  chemically synthesized
aaatcgcaccactgcactccag

SEQ ID NO: 700736 - DNA, 22 bp, Artificial Sequence
  chemically synthesized
ttgtcgcccaggctggagtgca

SEQ ID NO: 700737 - DNA, 22 bp, Artificial Sequence
  chemically synthesized
ctcttgtcgcccaggctggagt

SEQ ID NO: 700738 - DNA, 22 bp, Artificial Sequence
  chemically synthesized
gctcttgtcgcccaggctggag

SEQ ID NO: 700739 - DNA, 22 bp, Artificial Sequence
  chemically synthesized
tgctcttgtcgcccaggctgga

SEQ ID NO: 700740 - DNA, 22 bp, Artificial Sequence
  chemically synthesized
gagttttgctcttgtcgcccag

SEQ ID NO: 700741 - DNA, 22 bp, Artificial Sequence
  chemically synthesized
cactccagcctgggcgacaaga

SEQ ID NO: 700742 - DNA, 22 bp, Artificial Sequence
  chemically synthesized
agttggagttttgctcttgtcg

SEQ ID NO: 700743 - DNA, 22 bp, Artificial Sequence
  chemically synthesized
cagttggagttttgctcttgtc

SEQ ID NO: 700744 - DNA, 22 bp, Artificial Sequence
  chemically synthesized
tcagttggagttttgctcttgt

SEQ ID NO: 700745 - DNA, 22 bp, Artificial Sequence
  chemically synthesized
cagcctgggcgacaagagcaaa

SEQ ID NO: 700746 - DNA, 22 bp, Artificial Sequence
  chemically synthesized
ttcagttggagttttgctcttg

SEQ ID NO: 700747 - DNA, 22 bp, Artificial Sequence
  chemically synthesized
tttttcagttggagttttgctc

SEQ ID NO: 700748 - DNA, 22 bp, Artificial Sequence
  chemically synthesized
gtttttcagttggagttttgct

SEQ ID NO: 700749 - DNA, 22 bp, Artificial Sequence
  chemically synthesized
ggcgacaagagcaaaactccaa

SEQ ID NO: 700750 - DNA, 22 bp, Artificial Sequence
  chemically synthesized
tttgtttttcagttggagtttt

SEQ ID NO: 700751 - DNA, 22 bp, Artificial Sequence
  chemically synthesized
gtttgtttttcagttggagttt

SEQ ID NO: 700752 - DNA, 22 bp, Artificial Sequence
  chemically synthesized
tttgtttgtttttcagttggag

SEQ ID NO: 700753 - DNA, 22 bp, Artificial Sequence
  chemically synthesized
gtttgtttgtttttcagttgga

SEQ ID NO: 700754 - DNA, 22 bp, Artificial Sequence
  chemically synthesized
tttgtttgtttgtttttcagtt

SEQ ID NO: 700755 - DNA, 22 bp, Artificial Sequence
  chemically synthesized
gtttgtttgtttgtttttcagt

SEQ ID NO: 700756 - DNA, 22 bp, Artificial Sequence
  chemically synthesized
tttgtttgtttgtttgtttttc

SEQ ID NO: 700757 - DNA, 22 bp, Artificial Sequence
  chemically synthesized
gtttgtttgtttgtttgttttt

SEQ ID NO: 700758 - DNA, 22 bp, Artificial Sequence
  chemically synthesized
caactgaaaaacaaacaaacaa

SEQ ID NO: 700759 - DNA, 22 bp, Artificial Sequence
  chemically synthesized
gcccatggtttgtttgtttgtt

SEQ ID NO: 700760 - DNA, 22 bp, Artificial Sequence
  chemically synthesized
aaaaacaaacaaacaaacaaac

SEQ ID NO: 700761 - DNA, 22 bp, Artificial Sequence
  chemically synthesized
accagataggtcaggaagtcta

SEQ ID NO: 700762 - DNA, 22 bp, Artificial Sequence
  chemically synthesized
tgaccagataggtcaggaagtc

SEQ ID NO: 700763 - DNA, 22 bp, Artificial Sequence
  chemically synthesized
gacttcctgacctatctggtca

SEQ ID NO: 700764 - DNA, 22 bp, Artificial Sequence
  chemically synthesized
cataacaacagactctgaccag

SEQ ID NO: 700765 - DNA, 22 bp, Artificial Sequence
  chemically synthesized
ccataacaacagactctgacca

SEQ ID NO: 700766 - DNA, 22 bp, Artificial Sequence
  chemically synthesized
cctgacctatctggtcagagtc

SEQ ID NO: 700767 - DNA, 22 bp, Artificial Sequence
  chemically synthesized
ctgacctatctggtcagagtct

SEQ ID NO: 700768 - DNA, 22 bp, Artificial Sequence
  chemically synthesized
acctatctggtcagagtctgtt

SEQ ID NO: 700769 - DNA, 22 bp, Artificial Sequence
  chemically synthesized
atatttccataacaacagactc

SEQ ID NO: 700770 - DNA, 22 bp, Artificial Sequence
  chemically synthesized
aatatttccataacaacagact

SEQ ID NO: 700771 - DNA, 22 bp, Artificial Sequence
  chemically synthesized
taatatttccataacaacagac

SEQ ID NO: 700772 - DNA, 22 bp, Artificial Sequence
  chemically synthesized
ttaatatttccataacaacaga

SEQ ID NO: 700773 - DNA, 22 bp, Artificial Sequence
  chemically synthesized
tctggtcagagtctgttgttat

SEQ ID NO: 700774 - DNA, 22 bp, Artificial Sequence
  chemically synthesized
tttaatatttccataacaacag

SEQ ID NO: 700775 - DNA, 22 bp, Artificial Sequence
  chemically synthesized
gtcagagtctgttgttatggaa

SEQ ID NO: 700776 - DNA, 22 bp, Artificial Sequence
  chemically synthesized
gctttttaatatttccataaca

SEQ ID NO: 700777 - DNA, 22 bp, Artificial Sequence
  chemically synthesized
tagagggctagctttttaatat

SEQ ID NO: 700778 - DNA, 22 bp, Artificial Sequence
  chemically synthesized
ttgttatggaaatattaaaaag

SEQ ID NO: 700779 - DNA, 22 bp, Artificial Sequence
  chemically synthesized
ctatagagggctagctttttaa

SEQ ID NO: 700780 - DNA, 22 bp, Artificial Sequence
  chemically synthesized
ttatggaaatattaaaaagcta

SEQ ID NO: 700781 - DNA, 22 bp, Artificial Sequence
  chemically synthesized
ctgctatagagggctagctttt

SEQ ID NO: 700782 - DNA, 22 bp, Artificial Sequence
  chemically synthesized
tggaaatattaaaaagctagcc

SEQ ID NO: 700783 - DNA, 22 bp, Artificial Sequence
  chemically synthesized
cctgctatagagggctagcttt

SEQ ID NO: 700784 - DNA, 22 bp, Artificial Sequence
  chemically synthesized
caccatgtttcctgctatagag

SEQ ID NO: 700785 - DNA, 22 bp, Artificial Sequence
  chemically synthesized
aaaagctagccctctatagcag

SEQ ID NO: 700786 - DNA, 22 bp, Artificial Sequence
  chemically synthesized
tccaccatgtttcctgctatag

SEQ ID NO: 700787 - DNA, 22 bp, Artificial Sequence
  chemically synthesized
gctctccaccatgtttcctgct

SEQ ID NO: 700788 - DNA, 22 bp, Artificial Sequence
  chemically synthesized
tggctctccaccatgtttcctg

SEQ ID NO: 700789 - DNA, 22 bp, Artificial Sequence
  chemically synthesized
gccctctatagcaggaaacatg

SEQ ID NO: 700790 - DNA, 22 bp, Artificial Sequence
  chemically synthesized
ctggctctccaccatgtttcct

SEQ ID NO: 700791 - DNA, 22 bp, Artificial Sequence
  chemically synthesized
tatagcaggaaacatggtggag

SEQ ID NO: 700792 - DNA, 22 bp, Artificial Sequence
  chemically synthesized
taatttctggctctccaccatg

SEQ ID NO: 700793 - DNA, 22 bp, Artificial Sequence
  chemically synthesized
tagcaggaaacatggtggagag

SEQ ID NO: 700794 - DNA, 22 bp, Artificial Sequence
  chemically synthesized
agcagccaggagctataatttc

SEQ ID NO: 700795 - DNA, 22 bp, Artificial Sequence
  chemically synthesized
agaagaaggtacactgagcagc

SEQ ID NO: 700796 - DNA, 22 bp, Artificial Sequence
  chemically synthesized
aagaagaaggtacactgagcag

SEQ ID NO: 700797 - DNA, 22 bp, Artificial Sequence
  chemically synthesized
taagaagaaggtacactgagca

SEQ ID NO: 700798 - DNA, 22 bp, Artificial Sequence
  chemically synthesized
tagctcctggctgctcagtgta

SEQ ID NO: 700799 - DNA, 22 bp, Artificial Sequence
  chemically synthesized
gtattttaagaagaaggtacac

SEQ ID NO: 700800 - DNA, 22 bp, Artificial Sequence
  chemically synthesized
ctggctgctcagtgtaccttct

SEQ ID NO: 700801 - DNA, 22 bp, Artificial Sequence
  chemically synthesized
gctgctcagtgtaccttcttct

SEQ ID NO: 700802 - DNA, 22 bp, Artificial Sequence
  chemically synthesized
ctcagtgtaccttcttcttaaa

SEQ ID NO: 700803 - DNA, 22 bp, Artificial Sequence
  chemically synthesized
tgatgctggtattttaagaaga

SEQ ID NO: 700804 - DNA, 22 bp, Artificial Sequence
  chemically synthesized
atgatgctggtattttaagaag

SEQ ID NO: 700805 - DNA, 22 bp, Artificial Sequence
  chemically synthesized
tatgatgctggtattttaagaa

SEQ ID NO: 700806 - DNA, 22 bp, Artificial Sequence
  chemically synthesized
agtgtaccttcttcttaaaata

SEQ ID NO: 700807 - DNA, 22 bp, Artificial Sequence
  chemically synthesized
ttatgatgctggtattttaaga

SEQ ID NO: 700808 - DNA, 22 bp, Artificial Sequence
  chemically synthesized
cttttatgatgctggtatttta

SEQ ID NO: 700809 - DNA, 22 bp, Artificial Sequence
  chemically synthesized
ccttttatgatgctggtatttt

SEQ ID NO: 700810 - DNA, 22 bp, Artificial Sequence
  chemically synthesized
ttccttttatgatgctggtatt

SEQ ID NO: 700811 - DNA, 22 bp, Artificial Sequence
  chemically synthesized
cttccttttatgatgctggtat

SEQ ID NO: 700812 - DNA, 22 bp, Artificial Sequence
  chemically synthesized
ttcttccttttatgatgctggt

SEQ ID NO: 700813 - DNA, 22 bp, Artificial Sequence
  chemically synthesized
cttcttaaaataccagcatcat

SEQ ID NO: 700814 - DNA, 22 bp, Artificial Sequence
  chemically synthesized
ttcttaaaataccagcatcata

SEQ ID NO: 700815 - DNA, 22 bp, Artificial Sequence
  chemically synthesized
tcttcttccttttatgatgctg

SEQ ID NO: 700816 - DNA, 22 bp, Artificial Sequence
  chemically synthesized
cttaaaataccagcatcataaa

SEQ ID NO: 700817 - DNA, 22 bp, Artificial Sequence
  chemically synthesized
ttaaaataccagcatcataaaa

SEQ ID NO: 700818 - DNA, 22 bp, Artificial Sequence
  chemically synthesized
aaaataccagcatcataaaagg

SEQ ID NO: 700819 - DNA, 22 bp, Artificial Sequence
  chemically synthesized
aaataccagcatcataaaagga

SEQ ID NO: 700820 - DNA, 22 bp, Artificial Sequence
  chemically synthesized
gagttctcttcttccttttatg

SEQ ID NO: 700821 - DNA, 22 bp, Artificial Sequence
  chemically synthesized
tggagttctcttcttcctttta

SEQ ID NO: 700822 - DNA, 22 bp, Artificial Sequence
  chemically synthesized
tctggagttctcttcttccttt

SEQ ID NO: 700823 - DNA, 22 bp, Artificial Sequence
  chemically synthesized
gaccaagagctctctggagttc

SEQ ID NO: 700824 - DNA, 22 bp, Artificial Sequence
  chemically synthesized
acagccagtgagggctggacca

SEQ ID NO: 700825 - DNA, 22 bp, Artificial Sequence
  chemically synthesized
cagagagctcttggtccagccc

SEQ ID NO: 700826 - DNA, 22 bp, Artificial Sequence
  chemically synthesized
gcattcacagccagtgagggct

SEQ ID NO: 700827 - DNA, 22 bp, Artificial Sequence
  chemically synthesized
ggcattcacagccagtgagggc

SEQ ID NO: 700828 - DNA, 22 bp, Artificial Sequence
  chemically synthesized
ttggtccagccctcactggctg

SEQ ID NO: 700829 - DNA, 22 bp, Artificial Sequence
  chemically synthesized
ggtccagccctcactggctgtg

SEQ ID NO: 700830 - DNA, 22 bp, Artificial Sequence
  chemically synthesized
gtccagccctcactggctgtga

SEQ ID NO: 700831 - DNA, 22 bp, Artificial Sequence
  chemically synthesized
acaggcttggcattcacagcca

SEQ ID NO: 700832 - DNA, 22 bp, Artificial Sequence
  chemically synthesized
ggtattcacaggcttggcattc

SEQ ID NO: 700833 - DNA, 22 bp, Artificial Sequence
  chemically synthesized
aggtattcacaggcttggcatt

SEQ ID NO: 700834 - DNA, 22 bp, Artificial Sequence
  chemically synthesized
actggctgtgaatgccaagcct

SEQ ID NO: 700835 - DNA, 22 bp, Artificial Sequence
  chemically synthesized
agtttaggtattcacaggcttg

SEQ ID NO: 700836 - DNA, 22 bp, Artificial Sequence
  chemically synthesized
gctgtgaatgccaagcctgtga

SEQ ID NO: 700837 - DNA, 22 bp, Artificial Sequence
  chemically synthesized
tcagtttaggtattcacaggct

SEQ ID NO: 700838 - DNA, 22 bp, Artificial Sequence
  chemically synthesized
ctcagtttaggtattcacaggc

SEQ ID NO: 700839 - DNA, 22 bp, Artificial Sequence
  chemically synthesized
tctcagtttaggtattcacagg

SEQ ID NO: 700840 - DNA, 22 bp, Artificial Sequence
  chemically synthesized
tgaatgccaagcctgtgaatac

SEQ ID NO: 700841 - DNA, 22 bp, Artificial Sequence
  chemically synthesized
ttctcagtttaggtattcacag

SEQ ID NO: 700842 - DNA, 22 bp, Artificial Sequence
  chemically synthesized
ttttctcagtttaggtattcac

SEQ ID NO: 700843 - DNA, 22 bp, Artificial Sequence
  chemically synthesized
tgaatacctaaactgagaaaag

SEQ ID NO: 700844 - DNA, 22 bp, Artificial Sequence
  chemically synthesized
aggaaagaatagccattctttt

SEQ ID NO: 700845 - DNA, 22 bp, Artificial Sequence
  chemically synthesized
aaggaaagaatagccattcttt

SEQ ID NO: 700846 - DNA, 22 bp, Artificial Sequence
  chemically synthesized
taaggaaagaatagccattctt

SEQ ID NO: 700847 - DNA, 22 bp, Artificial Sequence
  chemically synthesized
aactgagaaaagaatggctatt

SEQ ID NO: 700848 - DNA, 22 bp, Artificial Sequence
  chemically synthesized
agaaaagaatggctattctttc

SEQ ID NO: 700849 - DNA, 22 bp, Artificial Sequence
  chemically synthesized
agcccatagatacctttaagga

SEQ ID NO: 700850 - DNA, 22 bp, Artificial Sequence
  chemically synthesized
ttctttccttaaaggtatctat

SEQ ID NO: 700851 - DNA, 22 bp, Artificial Sequence
  chemically synthesized
tgaggcctcagcccatagatac

SEQ ID NO: 700852 - DNA, 22 bp, Artificial Sequence
  chemically synthesized
tttccttaaaggtatctatggg

SEQ ID NO: 700853 - DNA, 22 bp, Artificial Sequence
  chemically synthesized
tccttaaaggtatctatgggct

SEQ ID NO: 700854 - DNA, 22 bp, Artificial Sequence
  chemically synthesized
ccttaaaggtatctatgggctg

SEQ ID NO: 700855 - DNA, 22 bp, Artificial Sequence
  chemically synthesized
cttaaaggtatctatgggctga

SEQ ID NO: 700856 - DNA, 22 bp, Artificial Sequence
  chemically synthesized
aaaggtatctatgggctgaggc

SEQ ID NO: 700857 - DNA, 22 bp, Artificial Sequence
  chemically synthesized
aaggtatctatgggctgaggcc

SEQ ID NO: 700858 - DNA, 22 bp, Artificial Sequence
  chemically synthesized
tgggctgaggcctcacaatttc

SEQ ID NO: 700859 - DNA, 22 bp, Artificial Sequence
  chemically synthesized
gaaaggtataataagagaaatt

SEQ ID NO: 700860 - DNA, 22 bp, Artificial Sequence
  chemically synthesized
aggcctcacaatttctcttatt

SEQ ID NO: 700861 - DNA, 22 bp, Artificial Sequence
  chemically synthesized
acaatttctcttattatacctt

SEQ ID NO: 700862 - DNA, 22 bp, Artificial Sequence
  chemically synthesized
ctcttattatacctttctagtt

SEQ ID NO: 700863 - DNA, 22 bp, Artificial Sequence
  chemically synthesized
tcttattatacctttctagttt

SEQ ID NO: 700864 - DNA, 22 bp, Artificial Sequence
  chemically synthesized
ttattatacctttctagttttt

SEQ ID NO: 700865 - DNA, 22 bp, Artificial Sequence
  chemically synthesized
attatacctttctagttttttt

SEQ ID NO: 700866 - DNA, 22 bp, Artificial Sequence
  chemically synthesized
ttatacctttctagtttttttt

SEQ ID NO: 700867 - DNA, 22 bp, Artificial Sequence
  chemically synthesized
gaatgataaaaaaaaaaaaaaa

SEQ ID NO: 700868 - DNA, 22 bp, Artificial Sequence
  chemically synthesized
tacctttctagttttttttttt

SEQ ID NO: 700869 - DNA, 22 bp, Artificial Sequence
  chemically synthesized
tctagtttttttttttttttat

SEQ ID NO: 700870 - DNA, 22 bp, Artificial Sequence
  chemically synthesized
ctagtttttttttttttttatc

SEQ ID NO: 700871 - DNA, 22 bp, Artificial Sequence
  chemically synthesized
gaccactagaatgataaaaaaa

SEQ ID NO: 700872 - DNA, 22 bp, Artificial Sequence
  chemically synthesized
tagtttttttttttttttatca

SEQ ID NO: 700873 - DNA, 22 bp, Artificial Sequence
  chemically synthesized
tggaccactagaatgataaaaa

SEQ ID NO: 700874 - DNA, 22 bp, Artificial Sequence
  chemically synthesized
gtttttttttttttttatcatt

SEQ ID NO: 700875 - DNA, 22 bp, Artificial Sequence
  chemically synthesized
ctggaccactagaatgataaaa

SEQ ID NO: 700876 - DNA, 22 bp, Artificial Sequence
  chemically synthesized
ttttttttttttatcattctag

SEQ ID NO: 700877 - DNA, 22 bp, Artificial Sequence
  chemically synthesized
tttttttttttatcattctagt

SEQ ID NO: 700878 - DNA, 22 bp, Artificial Sequence
  chemically synthesized
ttttttttttatcattctagtg

SEQ ID NO: 700879 - DNA, 22 bp, Artificial Sequence
  chemically synthesized
tttttttttatcattctagtgg

SEQ ID NO: 700880 - DNA, 22 bp, Artificial Sequence
  chemically synthesized
ttttttttatcattctagtggt

SEQ ID NO: 700881 - DNA, 22 bp, Artificial Sequence
  chemically synthesized
tttttttatcattctagtggtc

SEQ ID NO: 700882 - DNA, 22 bp, Artificial Sequence
  chemically synthesized
ttttttatcattctagtggtcc

SEQ ID NO: 700883 - DNA, 22 bp, Artificial Sequence
  chemically synthesized
gaaagaatttctggaccactag

SEQ ID NO: 700884 - DNA, 22 bp, Artificial Sequence
  chemically synthesized
tttttatcattctagtggtcca

SEQ ID NO: 700885 - DNA, 22 bp, Artificial Sequence
  chemically synthesized
ttttatcattctagtggtccag

SEQ ID NO: 700886 - DNA, 22 bp, Artificial Sequence
  chemically synthesized
tttatcattctagtggtccaga

SEQ ID NO: 700887 - DNA, 22 bp, Artificial Sequence
  chemically synthesized
ttatcattctagtggtccagaa

SEQ ID NO: 700888 - DNA, 22 bp, Artificial Sequence
  chemically synthesized
tatcattctagtggtccagaaa

SEQ ID NO: 700889 - DNA, 22 bp, Artificial Sequence
  chemically synthesized
atcattctagtggtccagaaat

SEQ ID NO: 700890 - DNA, 22 bp, Artificial Sequence
  chemically synthesized
tcattctagtggtccagaaatt

SEQ ID NO: 700891 - DNA, 22 bp, Artificial Sequence
  chemically synthesized
caaattagaaagaatttctgga

SEQ ID NO: 700892 - DNA, 22 bp, Artificial Sequence
  chemically synthesized
tagtggtccagaaattctttct

SEQ ID NO: 700893 - DNA, 22 bp, Artificial Sequence
  chemically synthesized
gtggtccagaaattctttctaa

SEQ ID NO: 700894 - DNA, 22 bp, Artificial Sequence
  chemically synthesized
gcatcctccaaattagaaagaa

SEQ ID NO: 700895 - DNA, 22 bp, Artificial Sequence
  chemically synthesized
tttctaatttggaggatgctag

SEQ ID NO: 700896 - DNA, 22 bp, Artificial Sequence
  chemically synthesized
tcagaggatggtctagcatcct

SEQ ID NO: 700897 - DNA, 22 bp, Artificial Sequence
  chemically synthesized
tctaatttggaggatgctagac

SEQ ID NO: 700898 - DNA, 22 bp, Artificial Sequence
  chemically synthesized
ctaatttggaggatgctagacc

SEQ ID NO: 700899 - DNA, 22 bp, Artificial Sequence
  chemically synthesized
ctatcagaggatggtctagcat

SEQ ID NO: 700900 - DNA, 22 bp, Artificial Sequence
  chemically synthesized
taatttggaggatgctagacca

SEQ ID NO: 700901 - DNA, 22 bp, Artificial Sequence
  chemically synthesized
tgctatcagaggatggtctagc

SEQ ID NO: 700902 - DNA, 22 bp, Artificial Sequence
  chemically synthesized
atttggaggatgctagaccatc

SEQ ID NO: 700903 - DNA, 22 bp, Artificial Sequence
  chemically synthesized
ctgctatcagaggatggtctag

SEQ ID NO: 700904 - DNA, 22 bp, Artificial Sequence
  chemically synthesized
ttctgctatcagaggatggtct

SEQ ID NO: 700905 - DNA, 22 bp, Artificial Sequence
  chemically synthesized
ggaggatgctagaccatcctct

SEQ ID NO: 700906 - DNA, 22 bp, Artificial Sequence
  chemically synthesized
gaggatgctagaccatcctctg

SEQ ID NO: 700907 - DNA, 22 bp, Artificial Sequence
  chemically synthesized
gaccatcctctgatagcagaag

SEQ ID NO: 700908 - DNA, 22 bp, Artificial Sequence
  chemically synthesized
tgatagcagaagaatcactttg

SEQ ID NO: 700909 - DNA, 22 bp, Artificial Sequence
  chemically synthesized
atagcagaagaatcactttgga

SEQ ID NO: 700910 - DNA, 22 bp, Artificial Sequence
  chemically synthesized
agaatagtgtaggaaatccaaa

SEQ ID NO: 700911 - DNA, 22 bp, Artificial Sequence
  chemically synthesized
agagacgcctaagaatagtgta

SEQ ID NO: 700912 - DNA, 22 bp, Artificial Sequence
  chemically synthesized
tgagagacgcctaagaatagtg

SEQ ID NO: 700913 - DNA, 22 bp, Artificial Sequence
  chemically synthesized
tggatttcctacactattctta

SEQ ID NO: 700914 - DNA, 22 bp, Artificial Sequence
  chemically synthesized
ctgagagacgcctaagaatagt

SEQ ID NO: 700915 - DNA, 22 bp, Artificial Sequence
  chemically synthesized
ggatttcctacactattcttag

SEQ ID NO: 700916 - DNA, 22 bp, Artificial Sequence
  chemically synthesized
tctgagagacgcctaagaatag

SEQ ID NO: 700917 - DNA, 22 bp, Artificial Sequence
  chemically synthesized
gatttcctacactattcttagg

SEQ ID NO: 700918 - DNA, 22 bp, Artificial Sequence
  chemically synthesized
tttctgagagacgcctaagaat

SEQ ID NO: 700919 - DNA, 22 bp, Artificial Sequence
  chemically synthesized
ctttctgagagacgcctaagaa

SEQ ID NO: 700920 - DNA, 22 bp, Artificial Sequence
  chemically synthesized
cctacactattcttaggcgtct

SEQ ID NO: 700921 - DNA, 22 bp, Artificial Sequence
  chemically synthesized
ctacactattcttaggcgtctc

SEQ ID NO: 700922 - DNA, 22 bp, Artificial Sequence
  chemically synthesized
cactattcttaggcgtctctca

SEQ ID NO: 700923 - DNA, 22 bp, Artificial Sequence
  chemically synthesized
cagcacacttctttctgagaga

SEQ ID NO: 700924 - DNA, 22 bp, Artificial Sequence
  chemically synthesized
ttcttaggcgtctctcagaaag

SEQ ID NO: 700925 - DNA, 22 bp, Artificial Sequence
  chemically synthesized
tccagcacacttctttctgaga

SEQ ID NO: 700926 - DNA, 22 bp, Artificial Sequence
  chemically synthesized
ttaggcgtctctcagaaagaag

SEQ ID NO: 700927 - DNA, 22 bp, Artificial Sequence
  chemically synthesized
aggcgtctctcagaaagaagtg

SEQ ID NO: 700928 - DNA, 22 bp, Artificial Sequence
  chemically synthesized
ggcgtctctcagaaagaagtgt

SEQ ID NO: 700929 - DNA, 22 bp, Artificial Sequence
  chemically synthesized
tcagaaagaagtgtgctggaga

SEQ ID NO: 700930 - DNA, 22 bp, Artificial Sequence
  chemically synthesized
agaaagaagtgtgctggagagg

SEQ ID NO: 700931 - DNA, 22 bp, Artificial Sequence
  chemically synthesized
agccaggccaggcagccagcag

SEQ ID NO: 700932 - DNA, 22 bp, Artificial Sequence
  chemically synthesized
gagagggctgctggctgcctgg

SEQ ID NO: 700933 - DNA, 22 bp, Artificial Sequence
  chemically synthesized
ctggctgcctggcctggcttag

SEQ ID NO: 700934 - DNA, 22 bp, Artificial Sequence
  chemically synthesized
aggccgaaagcccctaagccag

SEQ ID NO: 700935 - DNA, 22 bp, Artificial Sequence
  chemically synthesized
caggccgaaagcccctaagcca

SEQ ID NO: 700936 - DNA, 22 bp, Artificial Sequence
  chemically synthesized
gctgcctggcctggcttagggg

SEQ ID NO: 700937 - DNA, 22 bp, Artificial Sequence
  chemically synthesized
tcaggccgaaagcccctaagcc

SEQ ID NO: 700938 - DNA, 22 bp, Artificial Sequence
  chemically synthesized
tttcaggccgaaagcccctaag

SEQ ID NO: 700939 - DNA, 22 bp, Artificial Sequence
  chemically synthesized
ctttcaggccgaaagcccctaa

SEQ ID NO: 700940 - DNA, 22 bp, Artificial Sequence
  chemically synthesized
cctggcctggcttaggggcttt

SEQ ID NO: 700941 - DNA, 22 bp, Artificial Sequence
  chemically synthesized
tttctttcaggccgaaagcccc

SEQ ID NO: 700942 - DNA, 22 bp, Artificial Sequence
  chemically synthesized
gcctggcttaggggctttcggc

SEQ ID NO: 700943 - DNA, 22 bp, Artificial Sequence
  chemically synthesized
gcttaggggctttcggcctgaa

SEQ ID NO: 700944 - DNA, 22 bp, Artificial Sequence
  chemically synthesized
gaggttgtttctttcaggccga

SEQ ID NO: 700945 - DNA, 22 bp, Artificial Sequence
  chemically synthesized
agaggttgtttctttcaggccg

SEQ ID NO: 700946 - DNA, 22 bp, Artificial Sequence
  chemically synthesized
aggggctttcggcctgaaagaa

SEQ ID NO: 700947 - DNA, 22 bp, Artificial Sequence
  chemically synthesized
cttagaggttgtttctttcagg

SEQ ID NO: 700948 - DNA, 22 bp, Artificial Sequence
  chemically synthesized
ggggctttcggcctgaaagaaa

SEQ ID NO: 700949 - DNA, 22 bp, Artificial Sequence
  chemically synthesized
gctgcttagaggttgtttcttt

SEQ ID NO: 700950 - DNA, 22 bp, Artificial Sequence
  chemically synthesized
tcgctgcttagaggttgtttct

SEQ ID NO: 700951 - DNA, 22 bp, Artificial Sequence
  chemically synthesized
tcggcctgaaagaaacaacctc

SEQ ID NO: 700952 - DNA, 22 bp, Artificial Sequence
  chemically synthesized
cggcctgaaagaaacaacctct

SEQ ID NO: 700953 - DNA, 22 bp, Artificial Sequence
  chemically synthesized
ggcctgaaagaaacaacctcta

SEQ ID NO: 700954 - DNA, 22 bp, Artificial Sequence
  chemically synthesized
tctctcgctgcttagaggttgt

SEQ ID NO: 700955 - DNA, 22 bp, Artificial Sequence
  chemically synthesized
tgtctctcgctgcttagaggtt

SEQ ID NO: 700956 - DNA, 22 bp, Artificial Sequence
  chemically synthesized
ctctgtctctcgctgcttagag

SEQ ID NO: 700957 - DNA, 22 bp, Artificial Sequence
  chemically synthesized
aaagaaacaacctctaagcagc

SEQ ID NO: 700958 - DNA, 22 bp, Artificial Sequence
  chemically synthesized
cctctgtctctcgctgcttaga

SEQ ID NO: 700959 - DNA, 22 bp, Artificial Sequence
  chemically synthesized
tcctctgtctctcgctgcttag

SEQ ID NO: 700960 - DNA, 22 bp, Artificial Sequence
  chemically synthesized
taagcagcgagagacagaggaa

SEQ ID NO: 700961 - DNA, 22 bp, Artificial Sequence
  chemically synthesized
agcagcgagagacagaggaaaa

SEQ ID NO: 700962 - DNA, 22 bp, Artificial Sequence
  chemically synthesized
agccaggcaacgccaattttcc

SEQ ID NO: 700963 - DNA, 22 bp, Artificial Sequence
  chemically synthesized
gctcagccaggcaacgccaatt

SEQ ID NO: 700964 - DNA, 22 bp, Artificial Sequence
  chemically synthesized
ccattagctcagccaggcaacg

SEQ ID NO: 700965 - DNA, 22 bp, Artificial Sequence
  chemically synthesized
cccattagctcagccaggcaac

SEQ ID NO: 700966 - DNA, 22 bp, Artificial Sequence
  chemically synthesized
gcgttgcctggctgagctaatg

SEQ ID NO: 700967 - DNA, 22 bp, Artificial Sequence
  chemically synthesized
cgtaggtcttcccattagctca

SEQ ID NO: 700968 - DNA, 22 bp, Artificial Sequence
  chemically synthesized
cctggctgagctaatgggaaga

SEQ ID NO: 700969 - DNA, 22 bp, Artificial Sequence
  chemically synthesized
gataccctacgtaggtcttccc

SEQ ID NO: 700970 - DNA, 22 bp, Artificial Sequence
  chemically synthesized
gctgagctaatgggaagaccta

SEQ ID NO: 700971 - DNA, 22 bp, Artificial Sequence
  chemically synthesized
tagataccctacgtaggtcttc

SEQ ID NO: 700972 - DNA, 22 bp, Artificial Sequence
  chemically synthesized
agctaatgggaagacctacgta

SEQ ID NO: 700973 - DNA, 22 bp, Artificial Sequence
  chemically synthesized
atgggaagacctacgtagggta

SEQ ID NO: 700974 - DNA, 22 bp, Artificial Sequence
  chemically synthesized
cgtagggtatctagagttgact

SEQ ID NO: 700975 - DNA, 22 bp, Artificial Sequence
  chemically synthesized
atgtaaacataaaaagtcaact

SEQ ID NO: 700976 - DNA, 22 bp, Artificial Sequence
  chemically synthesized
aatgtaaacataaaaagtcaac

SEQ ID NO: 700977 - DNA, 22 bp, Artificial Sequence
  chemically synthesized
taatgtaaacataaaaagtcaa

SEQ ID NO: 700978 - DNA, 22 bp, Artificial Sequence
  chemically synthesized
ttaatgtaaacataaaaagtca

SEQ ID NO: 700979 - DNA, 22 bp, Artificial Sequence
  chemically synthesized
cccttttaatgtaaacataaaa

SEQ ID NO: 700980 - DNA, 22 bp, Artificial Sequence
  chemically synthesized
ccccttttaatgtaaacataaa

SEQ ID NO: 700981 - DNA, 22 bp, Artificial Sequence
  chemically synthesized
tccccttttaatgtaaacataa

SEQ ID NO: 700982 - DNA, 22 bp, Artificial Sequence
  chemically synthesized
gagttgactttttatgtttaca

SEQ ID NO: 700983 - DNA, 22 bp, Artificial Sequence
  chemically synthesized
actttttatgtttacattaaaa

SEQ ID NO: 700984 - DNA, 22 bp, Artificial Sequence
  chemically synthesized
aaaattttccccttttaatgta

SEQ ID NO: 700985 - DNA, 22 bp, Artificial Sequence
  chemically synthesized
tttatgtttacattaaaagggg

SEQ ID NO: 700986 - DNA, 22 bp, Artificial Sequence
  chemically synthesized
attgaaaattttccccttttaa

SEQ ID NO: 700987 - DNA, 22 bp, Artificial Sequence
  chemically synthesized
ttatgtttacattaaaagggga

SEQ ID NO: 700988 - DNA, 22 bp, Artificial Sequence
  chemically synthesized
aattgaaaattttcccctttta

SEQ ID NO: 700989 - DNA, 22 bp, Artificial Sequence
  chemically synthesized
tatgtttacattaaaaggggaa

SEQ ID NO: 700990 - DNA, 22 bp, Artificial Sequence
  chemically synthesized
atgtttacattaaaaggggaaa

SEQ ID NO: 700991 - DNA, 22 bp, Artificial Sequence
  chemically synthesized
tgtttacattaaaaggggaaaa

SEQ ID NO: 700992 - DNA, 22 bp, Artificial Sequence
  chemically synthesized
acatttaattgaaaattttccc

SEQ ID NO: 700993 - DNA, 22 bp, Artificial Sequence
  chemically synthesized
acattaaaaggggaaaattttc

SEQ ID NO: 700994 - DNA, 22 bp, Artificial Sequence
  chemically synthesized
tgacatttaattgaaaattttc

SEQ ID NO: 700995 - DNA, 22 bp, Artificial Sequence
  chemically synthesized
cattaaaaggggaaaattttca

SEQ ID NO: 700996 - DNA, 22 bp, Artificial Sequence
  chemically synthesized
tctgacatttaattgaaaattt

SEQ ID NO: 700997 - DNA, 22 bp, Artificial Sequence
  chemically synthesized
ctctgacatttaattgaaaatt

SEQ ID NO: 700998 - DNA, 22 bp, Artificial Sequence
  chemically synthesized
aaaggggaaaattttcaattaa

SEQ ID NO: 700999 - DNA, 22 bp, Artificial Sequence
  chemically synthesized
ataacttctctgacatttaatt

SEQ ID NO: 701000 - DNA, 22 bp, Artificial Sequence
  chemically synthesized
tgataacttctctgacatttaa

SEQ ID NO: 701001 - DNA, 22 bp, Artificial Sequence
  chemically synthesized
tcaattaaatgtcagagaagtt

SEQ ID NO: 701002 - DNA, 22 bp, Artificial Sequence
  chemically synthesized
caattaaatgtcagagaagtta

SEQ ID NO: 701003 - DNA, 22 bp, Artificial Sequence
  chemically synthesized
aattaaatgtcagagaagttat

SEQ ID NO: 701004 - DNA, 22 bp, Artificial Sequence
  chemically synthesized
aagcatattctgataacttctc

SEQ ID NO: 701005 - DNA, 22 bp, Artificial Sequence
  chemically synthesized
gttcaagcatattctgataact

SEQ ID NO: 701006 - DNA, 22 bp, Artificial Sequence
  chemically synthesized
aatgtcagagaagttatcagaa

SEQ ID NO: 701007 - DNA, 22 bp, Artificial Sequence
  chemically synthesized
agttcaagcatattctgataac

SEQ ID NO: 701008 - DNA, 22 bp, Artificial Sequence
  chemically synthesized
tttagttcaagcatattctgat

SEQ ID NO: 701009 - DNA, 22 bp, Artificial Sequence
  chemically synthesized
agctatttagttcaagcatatt

SEQ ID NO: 701010 - DNA, 22 bp, Artificial Sequence
  chemically synthesized
cagctatttagttcaagcatat

SEQ ID NO: 701011 - DNA, 22 bp, Artificial Sequence
  chemically synthesized
tcagctatttagttcaagcata

SEQ ID NO: 701012 - DNA, 22 bp, Artificial Sequence
  chemically synthesized
tcagaatatgcttgaactaaat

SEQ ID NO: 701013 - DNA, 22 bp, Artificial Sequence
  chemically synthesized
aaaatattttcagctatttagt

SEQ ID NO: 701014 - DNA, 22 bp, Artificial Sequence
  chemically synthesized
aaaaatattttcagctatttag

SEQ ID NO: 701015 - DNA, 22 bp, Artificial Sequence
  chemically synthesized
taaaaatattttcagctattta

SEQ ID NO: 701016 - DNA, 22 bp, Artificial Sequence
  chemically synthesized
tttaaaaatattttcagctatt

SEQ ID NO: 701017 - DNA, 22 bp, Artificial Sequence
  chemically synthesized
gaactaaatagctgaaaatatt

SEQ ID NO: 701018 - DNA, 22 bp, Artificial Sequence
  chemically synthesized
aaattctttaaaaatattttca

SEQ ID NO: 701019 - DNA, 22 bp, Artificial Sequence
  chemically synthesized
aactaaatagctgaaaatattt

SEQ ID NO: 701020 - DNA, 22 bp, Artificial Sequence
  chemically synthesized
aaaattctttaaaaatattttc

SEQ ID NO: 701021 - DNA, 22 bp, Artificial Sequence
  chemically synthesized
taaaattctttaaaaatatttt

SEQ ID NO: 701022 - DNA, 22 bp, Artificial Sequence
  chemically synthesized
ttaaaattctttaaaaatattt

SEQ ID NO: 701023 - DNA, 22 bp, Artificial Sequence
  chemically synthesized
aatagctgaaaatatttttaaa

SEQ ID NO: 701024 - DNA, 22 bp, Artificial Sequence
  chemically synthesized
taatatttttaaaattctttaa

SEQ ID NO: 701025 - DNA, 22 bp, Artificial Sequence
  chemically synthesized
ataatatttttaaaattcttta

SEQ ID NO: 701026 - DNA, 22 bp, Artificial Sequence
  chemically synthesized
aaaatatttttaaagaatttta

SEQ ID NO: 701027 - DNA, 22 bp, Artificial Sequence
  chemically synthesized
gaatttataatatttttaaaat

SEQ ID NO: 701028 - DNA, 22 bp, Artificial Sequence
  chemically synthesized
ttaaagaattttaaaaatatta

SEQ ID NO: 701029 - DNA, 22 bp, Artificial Sequence
  chemically synthesized
atctagaatttataatattttt

SEQ ID NO: 701030 - DNA, 22 bp, Artificial Sequence
  chemically synthesized
taaagaattttaaaaatattat

SEQ ID NO: 701031 - DNA, 22 bp, Artificial Sequence
  chemically synthesized
aaagaattttaaaaatattata

SEQ ID NO: 701032 - DNA, 22 bp, Artificial Sequence
  chemically synthesized
aagaattttaaaaatattataa

SEQ ID NO: 701033 - DNA, 22 bp, Artificial Sequence
  chemically synthesized
atattgatctagaatttataat

SEQ ID NO: 701034 - DNA, 22 bp, Artificial Sequence
  chemically synthesized
catattgatctagaatttataa

SEQ ID NO: 701035 - DNA, 22 bp, Artificial Sequence
  chemically synthesized
taaaaatattataaattctaga

SEQ ID NO: 701036 - DNA, 22 bp, Artificial Sequence
  chemically synthesized
aaaaatattataaattctagat

SEQ ID NO: 701037 - DNA, 22 bp, Artificial Sequence
  chemically synthesized
aaaatattataaattctagatc

SEQ ID NO: 701038 - DNA, 22 bp, Artificial Sequence
  chemically synthesized
aaatttcatattgatctagaat

SEQ ID NO: 701039 - DNA, 22 bp, Artificial Sequence
  chemically synthesized
gaaatttcatattgatctagaa

SEQ ID NO: 701040 - DNA, 22 bp, Artificial Sequence
  chemically synthesized
taaattctagatcaatatgaaa

SEQ ID NO: 701041 - DNA, 22 bp, Artificial Sequence
  chemically synthesized
caaaagcttgaaatttcatatt

SEQ ID NO: 701042 - DNA, 22 bp, Artificial Sequence
  chemically synthesized
tagatcaatatgaaatttcaag

SEQ ID NO: 701043 - DNA, 22 bp, Artificial Sequence
  chemically synthesized
caattacaaaagcttgaaattt

SEQ ID NO: 701044 - DNA, 22 bp, Artificial Sequence
  chemically synthesized
gatcaatatgaaatttcaagct

SEQ ID NO: 701045 - DNA, 22 bp, Artificial Sequence
  chemically synthesized
agaactgcaattacaaaagctt

SEQ ID NO: 701046 - DNA, 22 bp, Artificial Sequence
  chemically synthesized
aagaactgcaattacaaaagct

SEQ ID NO: 701047 - DNA, 22 bp, Artificial Sequence
  chemically synthesized
caagcttttgtaattgcagttc

SEQ ID NO: 701048 - DNA, 22 bp, Artificial Sequence
  chemically synthesized
aagcttttgtaattgcagttct

SEQ ID NO: 701049 - DNA, 22 bp, Artificial Sequence
  chemically synthesized
ttgtaattgcagttcttaagtg

SEQ ID NO: 701050 - DNA, 22 bp, Artificial Sequence
  chemically synthesized
tgtaattgcagttcttaagtgt

SEQ ID NO: 701051 - DNA, 22 bp, Artificial Sequence
  chemically synthesized
gtaattgcagttcttaagtgtt

SEQ ID NO: 701052 - DNA, 22 bp, Artificial Sequence
  chemically synthesized
taattgcagttcttaagtgttc

SEQ ID NO: 701053 - DNA, 22 bp, Artificial Sequence
  chemically synthesized
aggaaaataaatgaacacttaa

SEQ ID NO: 701054 - DNA, 22 bp, Artificial Sequence
  chemically synthesized
aaggaaaataaatgaacactta

SEQ ID NO: 701055 - DNA, 22 bp, Artificial Sequence
  chemically synthesized
taaggaaaataaatgaacactt

SEQ ID NO: 701056 - DNA, 22 bp, Artificial Sequence
  chemically synthesized
ttaaggaaaataaatgaacact

SEQ ID NO: 701057 - DNA, 22 bp, Artificial Sequence
  chemically synthesized
tttaaggaaaataaatgaacac

SEQ ID NO: 701058 - DNA, 22 bp, Artificial Sequence
  chemically synthesized
ttttaaggaaaataaatgaaca

SEQ ID NO: 701059 - DNA, 22 bp, Artificial Sequence
  chemically synthesized
cagttcttaagtgttcatttat

SEQ ID NO: 701060 - DNA, 22 bp, Artificial Sequence
  chemically synthesized
ttaagtgttcatttattttcct

SEQ ID NO: 701061 - DNA, 22 bp, Artificial Sequence
  chemically synthesized
aagtgttcatttattttcctta

SEQ ID NO: 701062 - DNA, 22 bp, Artificial Sequence
  chemically synthesized
agtgttcatttattttccttaa

SEQ ID NO: 701063 - DNA, 22 bp, Artificial Sequence
  chemically synthesized
atttattttccttaaaaaagct

SEQ ID NO: 701064 - DNA, 22 bp, Artificial Sequence
  chemically synthesized
cacataagacaaaaagcttttt

SEQ ID NO: 701065 - DNA, 22 bp, Artificial Sequence
  chemically synthesized
attttccttaaaaaagcttttt

SEQ ID NO: 701066 - DNA, 22 bp, Artificial Sequence
  chemically synthesized
ttttccttaaaaaagctttttg

SEQ ID NO: 701067 - DNA, 22 bp, Artificial Sequence
  chemically synthesized
tccttaaaaaagctttttgtct

SEQ ID NO: 701068 - DNA, 22 bp, Artificial Sequence
  chemically synthesized
ccttaaaaaagctttttgtctt

SEQ ID NO: 701069 - DNA, 22 bp, Artificial Sequence
  chemically synthesized
atggctacacataagacaaaaa

SEQ ID NO: 701070 - DNA, 22 bp, Artificial Sequence
  chemically synthesized
cttaaaaaagctttttgtctta

SEQ ID NO: 701071 - DNA, 22 bp, Artificial Sequence
  chemically synthesized
gatggctacacataagacaaaa

SEQ ID NO: 701072 - DNA, 22 bp, Artificial Sequence
  chemically synthesized
aaaaaagctttttgtcttatgt

SEQ ID NO: 701073 - DNA, 22 bp, Artificial Sequence
  chemically synthesized
tttgatggctacacataagaca

SEQ ID NO: 701074 - DNA, 22 bp, Artificial Sequence
  chemically synthesized
aaaaagctttttgtcttatgtg

SEQ ID NO: 701075 - DNA, 22 bp, Artificial Sequence
  chemically synthesized
gacctatttgatggctacacat

SEQ ID NO: 701076 - DNA, 22 bp, Artificial Sequence
  chemically synthesized
tttgtcttatgtgtagccatca

SEQ ID NO: 701077 - DNA, 22 bp, Artificial Sequence
  chemically synthesized
ttgtcttatgtgtagccatcaa

SEQ ID NO: 701078 - DNA, 22 bp, Artificial Sequence
  chemically synthesized
tgtcttatgtgtagccatcaaa

SEQ ID NO: 701079 - DNA, 22 bp, Artificial Sequence
  chemically synthesized
gtcttatgtgtagccatcaaat

SEQ ID NO: 701080 - DNA, 22 bp, Artificial Sequence
  chemically synthesized
accattggacctatttgatggc

SEQ ID NO: 701081 - DNA, 22 bp, Artificial Sequence
  chemically synthesized
tcttatgtgtagccatcaaata

SEQ ID NO: 701082 - DNA, 22 bp, Artificial Sequence
  chemically synthesized
atgtgtagccatcaaataggtc

SEQ ID NO: 701083 - DNA, 22 bp, Artificial Sequence
  chemically synthesized
tgtgtagccatcaaataggtcc

SEQ ID NO: 701084 - DNA, 22 bp, Artificial Sequence
  chemically synthesized
aatctcaccattggacctattt

SEQ ID NO: 701085 - DNA, 22 bp, Artificial Sequence
  chemically synthesized
agaaaaaaaatacactgaatct

SEQ ID NO: 701086 - DNA, 22 bp, Artificial Sequence
  chemically synthesized
cagaaaaaaaatacactgaatc

SEQ ID NO: 701087 - DNA, 22 bp, Artificial Sequence
  chemically synthesized
tcagaaaaaaaatacactgaat

SEQ ID NO: 701088 - DNA, 22 bp, Artificial Sequence
  chemically synthesized
agtgtattttttttctgaaaga

SEQ ID NO: 701089 - DNA, 22 bp, Artificial Sequence
  chemically synthesized
tgaatcaaaggggaaaaacatc

SEQ ID NO: 701090 - DNA, 22 bp, Artificial Sequence
  chemically synthesized
tttttctgaaagatgtttttcc

SEQ ID NO: 701091 - DNA, 22 bp, Artificial Sequence
  chemically synthesized
ttttctgaaagatgtttttccc

SEQ ID NO: 701092 - DNA, 22 bp, Artificial Sequence
  chemically synthesized
tttctgaaagatgtttttcccc

SEQ ID NO: 701093 - DNA, 22 bp, Artificial Sequence
  chemically synthesized
ttctgaaagatgtttttcccct

SEQ ID NO: 701094 - DNA, 22 bp, Artificial Sequence
  chemically synthesized
tctgaaagatgtttttcccctt

SEQ ID NO: 701095 - DNA, 22 bp, Artificial Sequence
  chemically synthesized
ctgaaagatgtttttccccttt

SEQ ID NO: 701096 - DNA, 22 bp, Artificial Sequence
  chemically synthesized
tgaaagatgtttttcccctttg

SEQ ID NO: 701097 - DNA, 22 bp, Artificial Sequence
  chemically synthesized
taaactgtgaatcaaaggggaa

SEQ ID NO: 701098 - DNA, 22 bp, Artificial Sequence
  chemically synthesized
ataaactgtgaatcaaagggga

SEQ ID NO: 701099 - DNA, 22 bp, Artificial Sequence
  chemically synthesized
aaagatgtttttcccctttgat

SEQ ID NO: 701100 - DNA, 22 bp, Artificial Sequence
  chemically synthesized
ggtgaatttataaactgtgaat

SEQ ID NO: 701101 - DNA, 22 bp, Artificial Sequence
  chemically synthesized
aggtgaatttataaactgtgaa

SEQ ID NO: 701102 - DNA, 22 bp, Artificial Sequence
  chemically synthesized
ttcccctttgattcacagttta

SEQ ID NO: 701103 - DNA, 22 bp, Artificial Sequence
  chemically synthesized
tcccctttgattcacagtttat

SEQ ID NO: 701104 - DNA, 22 bp, Artificial Sequence
  chemically synthesized
cccctttgattcacagtttata

SEQ ID NO: 701105 - DNA, 22 bp, Artificial Sequence
  chemically synthesized
cttaggtgaatttataaactgt

SEQ ID NO: 701106 - DNA, 22 bp, Artificial Sequence
  chemically synthesized
ccctttgattcacagtttataa

SEQ ID NO: 701107 - DNA, 22 bp, Artificial Sequence
  chemically synthesized
tgattcacagtttataaattca

SEQ ID NO: 701108 - DNA, 22 bp, Artificial Sequence
  chemically synthesized
gattcacagtttataaattcac

SEQ ID NO: 701109 - DNA, 22 bp, Artificial Sequence
  chemically synthesized
attcacagtttataaattcacc

SEQ ID NO: 701110 - DNA, 22 bp, Artificial Sequence
  chemically synthesized
caaagcagttgcttaggtgaat

SEQ ID NO: 701111 - DNA, 22 bp, Artificial Sequence
  chemically synthesized
acagtttataaattcacctaag

SEQ ID NO: 701112 - DNA, 22 bp, Artificial Sequence
  chemically synthesized
ataaattcacctaagcaactgc

SEQ ID NO: 701113 - DNA, 22 bp, Artificial Sequence
  chemically synthesized
taaattcacctaagcaactgct

SEQ ID NO: 701114 - DNA, 22 bp, Artificial Sequence
  chemically synthesized
aaacaatgactgcaaagcagtt

SEQ ID NO: 701115 - DNA, 22 bp, Artificial Sequence
  chemically synthesized
caaacaatgactgcaaagcagt

SEQ ID NO: 701116 - DNA, 22 bp, Artificial Sequence
  chemically synthesized
acctaagcaactgctttgcagt

SEQ ID NO: 701117 - DNA, 22 bp, Artificial Sequence
  chemically synthesized
agcaactgctttgcagtcattg

SEQ ID NO: 701118 - DNA, 22 bp, Artificial Sequence
  chemically synthesized
taaggtttcaaacaatgactgc

SEQ ID NO: 701119 - DNA, 22 bp, Artificial Sequence
  chemically synthesized
ctttgcagtcattgtttgaaac

SEQ ID NO: 701120 - DNA, 22 bp, Artificial Sequence
  chemically synthesized
tgcagtcattgtttgaaacctt

SEQ ID NO: 701121 - DNA, 22 bp, Artificial Sequence
  chemically synthesized
gcagtcattgtttgaaacctta

SEQ ID NO: 701122 - DNA, 22 bp, Artificial Sequence
  chemically synthesized
agcataaaattgtaaggtttca

SEQ ID NO: 701123 - DNA, 22 bp, Artificial Sequence
  chemically synthesized
cagtcattgtttgaaaccttac

SEQ ID NO: 701124 - DNA, 22 bp, Artificial Sequence
  chemically synthesized
gagcataaaattgtaaggtttc

SEQ ID NO: 701125 - DNA, 22 bp, Artificial Sequence
  chemically synthesized
tgagcataaaattgtaaggttt

SEQ ID NO: 701126 - DNA, 22 bp, Artificial Sequence
  chemically synthesized
ttgagcataaaattgtaaggtt

SEQ ID NO: 701127 - DNA, 22 bp, Artificial Sequence
  chemically synthesized
tttgaaaccttacaattttatg

SEQ ID NO: 701128 - DNA, 22 bp, Artificial Sequence
  chemically synthesized
gaaaccttacaattttatgctc

SEQ ID NO: 701129 - DNA, 22 bp, Artificial Sequence
  chemically synthesized
aaaccttacaattttatgctca

SEQ ID NO: 701130 - DNA, 22 bp, Artificial Sequence
  chemically synthesized
tgtcaaggacatttttgagcat

SEQ ID NO: 701131 - DNA, 22 bp, Artificial Sequence
  chemically synthesized
ttgtgtcaaggacatttttgag

SEQ ID NO: 701132 - DNA, 22 bp, Artificial Sequence
  chemically synthesized
acaattttatgctcaaaaatgt

SEQ ID NO: 701133 - DNA, 22 bp, Artificial Sequence
  chemically synthesized
attgtgtcaaggacatttttga

SEQ ID NO: 701134 - DNA, 22 bp, Artificial Sequence
  chemically synthesized
caattttatgctcaaaaatgtc

SEQ ID NO: 701135 - DNA, 22 bp, Artificial Sequence
  chemically synthesized
tattgtgtcaaggacatttttg

SEQ ID NO: 701136 - DNA, 22 bp, Artificial Sequence
  chemically synthesized
ttattgtgtcaaggacattttt

SEQ ID NO: 701137 - DNA, 22 bp, Artificial Sequence
  chemically synthesized
tttattgtgtcaaggacatttt

SEQ ID NO: 701138 - DNA, 22 bp, Artificial Sequence
  chemically synthesized
ttttattgtgtcaaggacattt

SEQ ID NO: 701139 - DNA, 22 bp, Artificial Sequence
  chemically synthesized
tttttattgtgtcaaggacatt

SEQ ID NO: 701140 - DNA, 22 bp, Artificial Sequence
  chemically synthesized
ttttttattgtgtcaaggacat

SEQ ID NO: 701141 - DNA, 22 bp, Artificial Sequence
  chemically synthesized
tatgctcaaaaatgtccttgac

SEQ ID NO: 701142 - DNA, 22 bp, Artificial Sequence
  chemically synthesized
tttttttattgtgtcaaggaca

SEQ ID NO: 701143 - DNA, 22 bp, Artificial Sequence
  chemically synthesized
atgctcaaaaatgtccttgaca

SEQ ID NO: 701144 - DNA, 22 bp, Artificial Sequence
  chemically synthesized
ttttttttattgtgtcaaggac

SEQ ID NO: 701145 - DNA, 22 bp, Artificial Sequence
  chemically synthesized
tgctcaaaaatgtccttgacac

SEQ ID NO: 701146 - DNA, 22 bp, Artificial Sequence
  chemically synthesized
tttttttttattgtgtcaagga

SEQ ID NO: 701147 - DNA, 22 bp, Artificial Sequence
  chemically synthesized
ttttttttttattgtgtcaagg

SEQ ID NO: 701148 - DNA, 22 bp, Artificial Sequence
  chemically synthesized
tttttttttttattgtgtcaag

SEQ ID NO: 701149 - DNA, 22 bp, Artificial Sequence
  chemically synthesized
ttttttttttttattgtgtcaa

SEQ ID NO: 701150 - DNA, 22 bp, Artificial Sequence
  chemically synthesized
tttttttttttttattgtgtca

SEQ ID NO: 701151 - DNA, 22 bp, Artificial Sequence
  chemically synthesized
aaaaatgtccttgacacaataa

SEQ ID NO: 701152 - DNA, 22 bp, Artificial Sequence
  chemically synthesized
ttttttttttttttattgtgtc

SEQ ID NO: 701153 - DNA, 22 bp, Artificial Sequence
  chemically synthesized
tttttttttttttttattgtgt

SEQ ID NO: 701154 - DNA, 22 bp, Artificial Sequence
  chemically synthesized
ctttttttttttttttttattg

SEQ ID NO: 701155 - DNA, 22 bp, Artificial Sequence
  chemically synthesized
cctttttttttttttttttatt

SEQ ID NO: 701156 - DNA, 22 bp, Artificial Sequence
  chemically synthesized
tcctttttttttttttttttat

SEQ ID NO: 701157 - DNA, 22 bp, Artificial Sequence
  chemically synthesized
ttttcctttttttttttttttt

SEQ ID NO: 701158 - DNA, 22 bp, Artificial Sequence
  chemically synthesized
gacacaataaaaaaaaaaaaaa

SEQ ID NO: 701159 - DNA, 22 bp, Artificial Sequence
  chemically synthesized
ttattttccttttttttttttt

SEQ ID NO: 701160 - DNA, 22 bp, Artificial Sequence
  chemically synthesized
acacaataaaaaaaaaaaaaaa

SEQ ID NO: 701161 - DNA, 22 bp, Artificial Sequence
  chemically synthesized
ttgttattttcctttttttttt

SEQ ID NO: 701162 - DNA, 22 bp, Artificial Sequence
  chemically synthesized
tgatggggcagggaaggaatga

SEQ ID NO: 701163 - DNA, 22 bp, Artificial Sequence
  chemically synthesized
ccctcattccttccctgcccca

SEQ ID NO: 701164 - DNA, 22 bp, Artificial Sequence
  chemically synthesized
attccttccctgccccatcata

SEQ ID NO: 701165 - DNA, 22 bp, Artificial Sequence
  chemically synthesized
cttccctgccccatcataatca

SEQ ID NO: 701166 - DNA, 22 bp, Artificial Sequence
  chemically synthesized
ccctgccccatcataatcacat

SEQ ID NO: 701167 - DNA, 22 bp, Artificial Sequence
  chemically synthesized
cagtgtgtgtgtatgtgattat

SEQ ID NO: 701168 - DNA, 22 bp, Artificial Sequence
  chemically synthesized
cctgccccatcataatcacata

SEQ ID NO: 701169 - DNA, 22 bp, Artificial Sequence
  chemically synthesized
ccccatcataatcacatacaca

SEQ ID NO: 701170 - DNA, 22 bp, Artificial Sequence
  chemically synthesized
aagcaagtagttccagtgtgtg

SEQ ID NO: 701171 - DNA, 22 bp, Artificial Sequence
  chemically synthesized
taaagcaagtagttccagtgtg

SEQ ID NO: 701172 - DNA, 22 bp, Artificial Sequence
  chemically synthesized
ctaaagcaagtagttccagtgt

SEQ ID NO: 701173 - DNA, 22 bp, Artificial Sequence
  chemically synthesized
tttctaaagcaagtagttccag

SEQ ID NO: 701174 - DNA, 22 bp, Artificial Sequence
  chemically synthesized
tgtgttatttctaaagcaagta

SEQ ID NO: 701175 - DNA, 22 bp, Artificial Sequence
  chemically synthesized
gaactacttgctttagaaataa

SEQ ID NO: 701176 - DNA, 22 bp, Artificial Sequence
  chemically synthesized
tcatccaattgtgtgttatttc

SEQ ID NO: 701177 - DNA, 22 bp, Artificial Sequence
  chemically synthesized
cttgctttagaaataacacaca

SEQ ID NO: 701178 - DNA, 22 bp, Artificial Sequence
  chemically synthesized
gctttagaaataacacacaatt

SEQ ID NO: 701179 - DNA, 22 bp, Artificial Sequence
  chemically synthesized
ctttagaaataacacacaattg

SEQ ID NO: 701180 - DNA, 22 bp, Artificial Sequence
  chemically synthesized
tagaaataacacacaattggat

SEQ ID NO: 701181 - DNA, 22 bp, Artificial Sequence
  chemically synthesized
cgtagaactatcatccaattgt

SEQ ID NO: 701182 - DNA, 22 bp, Artificial Sequence
  chemically synthesized
agaaataacacacaattggatg

SEQ ID NO: 701183 - DNA, 22 bp, Artificial Sequence
  chemically synthesized
gaaataacacacaattggatga

SEQ ID NO: 701184 - DNA, 22 bp, Artificial Sequence
  chemically synthesized
aacccaattccgtagaactatc

SEQ ID NO: 701185 - DNA, 22 bp, Artificial Sequence
  chemically synthesized
gatgatagttctacggaattgg

SEQ ID NO: 701186 - DNA, 22 bp, Artificial Sequence
  chemically synthesized
agaaggagcactgaacccaatt

SEQ ID NO: 701187 - DNA, 22 bp, Artificial Sequence
  chemically synthesized
gagaaggagcactgaacccaat

SEQ ID NO: 701188 - DNA, 22 bp, Artificial Sequence
  chemically synthesized
ttgagaaggagcactgaaccca

SEQ ID NO: 701189 - DNA, 22 bp, Artificial Sequence
  chemically synthesized
tacggaattgggttcagtgctc

SEQ ID NO: 701190 - DNA, 22 bp, Artificial Sequence
  chemically synthesized
cggaattgggttcagtgctcct

SEQ ID NO: 701191 - DNA, 22 bp, Artificial Sequence
  chemically synthesized
agaatctcttgagaaggagcac

SEQ ID NO: 701192 - DNA, 22 bp, Artificial Sequence
  chemically synthesized
aagaatctcttgagaaggagca

SEQ ID NO: 701193 - DNA, 22 bp, Artificial Sequence
  chemically synthesized
ggttcagtgctccttctcaaga

SEQ ID NO: 701194 - DNA, 22 bp, Artificial Sequence
  chemically synthesized
agtgctccttctcaagagattc

SEQ ID NO: 701195 - DNA, 22 bp, Artificial Sequence
  chemically synthesized
tcgacaacccttaagaatctct

SEQ ID NO: 701196 - DNA, 22 bp, Artificial Sequence
  chemically synthesized
cttctcaagagattcttaaggg

SEQ ID NO: 701197 - DNA, 22 bp, Artificial Sequence
  chemically synthesized
ctcaagagattcttaagggttg

SEQ ID NO: 701198 - DNA, 22 bp, Artificial Sequence
  chemically synthesized
tcaagagattcttaagggttgt

SEQ ID NO: 701199 - DNA, 22 bp, Artificial Sequence
  chemically synthesized
aagagattcttaagggttgtcg

SEQ ID NO: 701200 - DNA, 22 bp, Artificial Sequence
  chemically synthesized
gcagccccaaatgaaattgtcg

SEQ ID NO: 701201 - DNA, 22 bp, Artificial Sequence
  chemically synthesized
ttaagggttgtcgacaatttca

SEQ ID NO: 701202 - DNA, 22 bp, Artificial Sequence
  chemically synthesized
aagggttgtcgacaatttcatt

SEQ ID NO: 701203 - DNA, 22 bp, Artificial Sequence
  chemically synthesized
agggttgtcgacaatttcattt

SEQ ID NO: 701204 - DNA, 22 bp, Artificial Sequence
  chemically synthesized
tcgacaatttcatttggggctg

SEQ ID NO: 701205 - DNA, 22 bp, Artificial Sequence
  chemically synthesized
catttggggctgccagatgatt

SEQ ID NO: 701206 - DNA, 22 bp, Artificial Sequence
  chemically synthesized
atttggggctgccagatgattc

SEQ ID NO: 701207 - DNA, 22 bp, Artificial Sequence
  chemically synthesized
ggggctgccagatgattctggt

SEQ ID NO: 701208 - DNA, 22 bp, Artificial Sequence
  chemically synthesized
aatagatggaagaccagaatca

SEQ ID NO: 701209 - DNA, 22 bp, Artificial Sequence
  chemically synthesized
gggctgccagatgattctggtc

SEQ ID NO: 701210 - DNA, 22 bp, Artificial Sequence
  chemically synthesized
gaatagatggaagaccagaatc

SEQ ID NO: 701211 - DNA, 22 bp, Artificial Sequence
  chemically synthesized
tgaatagatggaagaccagaat

SEQ ID NO: 701212 - DNA, 22 bp, Artificial Sequence
  chemically synthesized
ttgaatagatggaagaccagaa

SEQ ID NO: 701213 - DNA, 22 bp, Artificial Sequence
  chemically synthesized
ccagatgattctggtcttccat

SEQ ID NO: 701214 - DNA, 22 bp, Artificial Sequence
  chemically synthesized
atcaacttttgaatagatggaa

SEQ ID NO: 701215 - DNA, 22 bp, Artificial Sequence
  chemically synthesized
gatcaacttttgaatagatgga

SEQ ID NO: 701216 - DNA, 22 bp, Artificial Sequence
  chemically synthesized
tggtcttccatctattcaaaag

SEQ ID NO: 701217 - DNA, 22 bp, Artificial Sequence
  chemically synthesized
gtcttccatctattcaaaagtt

SEQ ID NO: 701218 - DNA, 22 bp, Artificial Sequence
  chemically synthesized
ccacatatttgatcaacttttg

SEQ ID NO: 701219 - DNA, 22 bp, Artificial Sequence
  chemically synthesized
ccatctattcaaaagttgatca

SEQ ID NO: 701220 - DNA, 22 bp, Artificial Sequence
  chemically synthesized
catctattcaaaagttgatcaa

SEQ ID NO: 701221 - DNA, 22 bp, Artificial Sequence
  chemically synthesized
tgagcactgccacatatttgat

SEQ ID NO: 701222 - DNA, 22 bp, Artificial Sequence
  chemically synthesized
ttcaaaagttgatcaaatatgt

SEQ ID NO: 701223 - DNA, 22 bp, Artificial Sequence
  chemically synthesized
gtgagcactgccacatatttga

SEQ ID NO: 701224 - DNA, 22 bp, Artificial Sequence
  chemically synthesized
aaaagttgatcaaatatgtggc

SEQ ID NO: 701225 - DNA, 22 bp, Artificial Sequence
  chemically synthesized
tggcacacttgtgagcactgcc

SEQ ID NO: 701226 - DNA, 22 bp, Artificial Sequence
  chemically synthesized
atcaaatatgtggcagtgctca

SEQ ID NO: 701227 - DNA, 22 bp, Artificial Sequence
  chemically synthesized
tgtggcacacttgtgagcactg

SEQ ID NO: 701228 - DNA, 22 bp, Artificial Sequence
  chemically synthesized
caagaaatgaaaaaattctgtg

SEQ ID NO: 701229 - DNA, 22 bp, Artificial Sequence
  chemically synthesized
acaagtgtgccacagaattttt

SEQ ID NO: 701230 - DNA, 22 bp, Artificial Sequence
  chemically synthesized
ctacaagaaatgaaaaaattct

SEQ ID NO: 701231 - DNA, 22 bp, Artificial Sequence
  chemically synthesized
gcatcagtactgctacaagaaa

SEQ ID NO: 701232 - DNA, 22 bp, Artificial Sequence
  chemically synthesized
ttggcatcagtactgctacaag

SEQ ID NO: 701233 - DNA, 22 bp, Artificial Sequence
  chemically synthesized
ttgttggcatcagtactgctac

SEQ ID NO: 701234 - DNA, 22 bp, Artificial Sequence
  chemically synthesized
tttcatttcttgtagcagtact

SEQ ID NO: 701235 - DNA, 22 bp, Artificial Sequence
  chemically synthesized
ttcatttcttgtagcagtactg

SEQ ID NO: 701236 - DNA, 22 bp, Artificial Sequence
  chemically synthesized
tcatttcttgtagcagtactga

SEQ ID NO: 701237 - DNA, 22 bp, Artificial Sequence
  chemically synthesized
catttcttgtagcagtactgat

SEQ ID NO: 701238 - DNA, 22 bp, Artificial Sequence
  chemically synthesized
atttcttgtagcagtactgatg

SEQ ID NO: 701239 - DNA, 22 bp, Artificial Sequence
  chemically synthesized
cttgtagcagtactgatgccaa

SEQ ID NO: 701240 - DNA, 22 bp, Artificial Sequence
  chemically synthesized
ttgtagcagtactgatgccaac

SEQ ID NO: 701241 - DNA, 22 bp, Artificial Sequence
  chemically synthesized
gtagcagtactgatgccaacaa

SEQ ID NO: 701242 - DNA, 22 bp, Artificial Sequence
  chemically synthesized
tagcagtactgatgccaacaac

SEQ ID NO: 701243 - DNA, 22 bp, Artificial Sequence
  chemically synthesized
agataagaaacagctgttgttg

SEQ ID NO: 701244 - DNA, 22 bp, Artificial Sequence
  chemically synthesized
atgccaacaacagctgtttctt

SEQ ID NO: 701245 - DNA, 22 bp, Artificial Sequence
  chemically synthesized
gtacactgagataagaaacagc

SEQ ID NO: 701246 - DNA, 22 bp, Artificial Sequence
  chemically synthesized
cactggtacactgagataagaa

SEQ ID NO: 701247 - DNA, 22 bp, Artificial Sequence
  chemically synthesized
ccactggtacactgagataaga

SEQ ID NO: 701248 - DNA, 22 bp, Artificial Sequence
  chemically synthesized
tttcttatctcagtgtaccagt

SEQ ID NO: 701249 - DNA, 22 bp, Artificial Sequence
  chemically synthesized
cttatctcagtgtaccagtgga

SEQ ID NO: 701250 - DNA, 22 bp, Artificial Sequence
  chemically synthesized
ttatctcagtgtaccagtggaa

SEQ ID NO: 701251 - DNA, 22 bp, Artificial Sequence
  chemically synthesized
atctcagtgtaccagtggaagc

SEQ ID NO: 701252 - DNA, 22 bp, Artificial Sequence
  chemically synthesized
tctcagtgtaccagtggaagct

SEQ ID NO: 701253 - DNA, 22 bp, Artificial Sequence
  chemically synthesized
tgaagaatgacaagcttccact

SEQ ID NO: 701254 - DNA, 22 bp, Artificial Sequence
  chemically synthesized
atgaagaatgacaagcttccac

SEQ ID NO: 701255 - DNA, 22 bp, Artificial Sequence
  chemically synthesized
tatgaagaatgacaagcttcca

SEQ ID NO: 701256 - DNA, 22 bp, Artificial Sequence
  chemically synthesized
agtgtaccagtggaagcttgtc

SEQ ID NO: 701257 - DNA, 22 bp, Artificial Sequence
  chemically synthesized
gctttatgaagaatgacaagct

SEQ ID NO: 701258 - DNA, 22 bp, Artificial Sequence
  chemically synthesized
cgtaggctagctttatgaagaa

SEQ ID NO: 701259 - DNA, 22 bp, Artificial Sequence
  chemically synthesized
ttacgtaggctagctttatgaa

SEQ ID NO: 701260 - DNA, 22 bp, Artificial Sequence
  chemically synthesized
gtcattcttcataaagctagcc

SEQ ID NO: 701261 - DNA, 22 bp, Artificial Sequence
  chemically synthesized
tcattcttcataaagctagcct

SEQ ID NO: 701262 - DNA, 22 bp, Artificial Sequence
  chemically synthesized
ttcataaagctagcctacgtaa

SEQ ID NO: 701263 - DNA, 22 bp, Artificial Sequence
  chemically synthesized
cataaagctagcctacgtaata

SEQ ID NO: 701264 - DNA, 22 bp, Artificial Sequence
  chemically synthesized
ataaagctagcctacgtaatag

SEQ ID NO: 701265 - DNA, 22 bp, Artificial Sequence
  chemically synthesized
gcctacgtaatagacacacaca

SEQ ID NO: 701266 - DNA, 22 bp, Artificial Sequence
  chemically synthesized
cgtaatagacacacacatcttt

SEQ ID NO: 701267 - DNA, 22 bp, Artificial Sequence
  chemically synthesized
aaaatggacacatcaggcataa

SEQ ID NO: 701268 - DNA, 22 bp, Artificial Sequence
  chemically synthesized
ctaaaaatggacacatcaggca

SEQ ID NO: 701269 - DNA, 22 bp, Artificial Sequence
  chemically synthesized
atgggctactaaaaatggacac

SEQ ID NO: 701270 - DNA, 22 bp, Artificial Sequence
  chemically synthesized
ttatgcctgatgtgtccatttt

SEQ ID NO: 701271 - DNA, 22 bp, Artificial Sequence
  chemically synthesized
gatgggctactaaaaatggaca

SEQ ID NO: 701272 - DNA, 22 bp, Artificial Sequence
  chemically synthesized
tatgcctgatgtgtccattttt

SEQ ID NO: 701273 - DNA, 22 bp, Artificial Sequence
  chemically synthesized
tgatgggctactaaaaatggac

SEQ ID NO: 701274 - DNA, 22 bp, Artificial Sequence
  chemically synthesized
atgcctgatgtgtccattttta

SEQ ID NO: 701275 - DNA, 22 bp, Artificial Sequence
  chemically synthesized
ttgatgggctactaaaaatgga

SEQ ID NO: 701276 - DNA, 22 bp, Artificial Sequence
  chemically synthesized
tgcctgatgtgtccatttttag

SEQ ID NO: 701277 - DNA, 22 bp, Artificial Sequence
  chemically synthesized
cttttgatgggctactaaaaat

SEQ ID NO: 701278 - DNA, 22 bp, Artificial Sequence
  chemically synthesized
gcttttgatgggctactaaaaa

SEQ ID NO: 701279 - DNA, 22 bp, Artificial Sequence
  chemically synthesized
atgtgtccatttttagtagccc

SEQ ID NO: 701280 - DNA, 22 bp, Artificial Sequence
  chemically synthesized
ccgataaatttgcttttgatgg

SEQ ID NO: 701281 - DNA, 22 bp, Artificial Sequence
  chemically synthesized
gccgataaatttgcttttgatg

SEQ ID NO: 701282 - DNA, 22 bp, Artificial Sequence
  chemically synthesized
ttagtagcccatcaaaagcaaa

SEQ ID NO: 701283 - DNA, 22 bp, Artificial Sequence
  chemically synthesized
tttgccgataaatttgcttttg

SEQ ID NO: 701284 - DNA, 22 bp, Artificial Sequence
  chemically synthesized
tagtagcccatcaaaagcaaat

SEQ ID NO: 701285 - DNA, 22 bp, Artificial Sequence
  chemically synthesized
agtagcccatcaaaagcaaatt

SEQ ID NO: 701286 - DNA, 22 bp, Artificial Sequence
  chemically synthesized
gtagcccatcaaaagcaaattt

SEQ ID NO: 701287 - DNA, 22 bp, Artificial Sequence
  chemically synthesized
atcggcaaatagtttctatatg

SEQ ID NO: 701288 - DNA, 22 bp, Artificial Sequence
  chemically synthesized
tcggcaaatagtttctatatga

SEQ ID NO: 701289 - DNA, 22 bp, Artificial Sequence
  chemically synthesized
ctatatgacaccgggttgtcct

SEQ ID NO: 701290 - DNA, 22 bp, Artificial Sequence
  chemically synthesized
tatatgacaccgggttgtcctt

SEQ ID NO: 701291 - DNA, 22 bp, Artificial Sequence
  chemically synthesized
tatgacaccgggttgtcctttg

SEQ ID NO: 701292 - DNA, 22 bp, Artificial Sequence
  chemically synthesized
tataagaaaataccaaaggaca

SEQ ID NO: 701293 - DNA, 22 bp, Artificial Sequence
  chemically synthesized
taagcacatctgtataagaaaa

SEQ ID NO: 701294 - DNA, 22 bp, Artificial Sequence
  chemically synthesized
tcctttggtattttcttataca

SEQ ID NO: 701295 - DNA, 22 bp, Artificial Sequence
  chemically synthesized
tggtattttcttatacagatgt

SEQ ID NO: 701296 - DNA, 22 bp, Artificial Sequence
  chemically synthesized
ggtattttcttatacagatgtg

SEQ ID NO: 701297 - DNA, 22 bp, Artificial Sequence
  chemically synthesized
gtattttcttatacagatgtgc

SEQ ID NO: 701298 - DNA, 22 bp, Artificial Sequence
  chemically synthesized
cacgtagtggttataagcacat

SEQ ID NO: 701299 - DNA, 22 bp, Artificial Sequence
  chemically synthesized
tcttatacagatgtgcttataa

SEQ ID NO: 701300 - DNA, 22 bp, Artificial Sequence
  chemically synthesized
cttatacagatgtgcttataac

SEQ ID NO: 701301 - DNA, 22 bp, Artificial Sequence
  chemically synthesized
ttatacagatgtgcttataacc

SEQ ID NO: 701302 - DNA, 22 bp, Artificial Sequence
  chemically synthesized
atacagatgtgcttataaccac

SEQ ID NO: 701303 - DNA, 22 bp, Artificial Sequence
  chemically synthesized
gaattacacgtagtggttataa

SEQ ID NO: 701304 - DNA, 22 bp, Artificial Sequence
  chemically synthesized
tacagatgtgcttataaccact

SEQ ID NO: 701305 - DNA, 22 bp, Artificial Sequence
  chemically synthesized
ccctggaattacacgtagtggt

SEQ ID NO: 701306 - DNA, 22 bp, Artificial Sequence
  chemically synthesized
ataaccactacgtgtaattcca

SEQ ID NO: 701307 - DNA, 22 bp, Artificial Sequence
  chemically synthesized
taaccactacgtgtaattccag

SEQ ID NO: 701308 - DNA, 22 bp, Artificial Sequence
  chemically synthesized
aatcacaaagctgccctggaat

SEQ ID NO: 701309 - DNA, 22 bp, Artificial Sequence
  chemically synthesized
cgtgtaattccagggcagcttt

SEQ ID NO: 701310 - DNA, 22 bp, Artificial Sequence
  chemically synthesized
aagaatctgaatcacaaagctg

SEQ ID NO: 701311 - DNA, 22 bp, Artificial Sequence
  chemically synthesized
cagggcagctttgtgattcaga

SEQ ID NO: 701312 - DNA, 22 bp, Artificial Sequence
  chemically synthesized
tacattcaagaatctgaatcac

SEQ ID NO: 701313 - DNA, 22 bp, Artificial Sequence
  chemically synthesized
gtacattcaagaatctgaatca

SEQ ID NO: 701314 - DNA, 22 bp, Artificial Sequence
  chemically synthesized
atttgtacattcaagaatctga

SEQ ID NO: 701315 - DNA, 22 bp, Artificial Sequence
  chemically synthesized
tgtgattcagattcttgaatgt

SEQ ID NO: 701316 - DNA, 22 bp, Artificial Sequence
  chemically synthesized
gtgattcagattcttgaatgta

SEQ ID NO: 701317 - DNA, 22 bp, Artificial Sequence
  chemically synthesized
tgattcagattcttgaatgtac

SEQ ID NO: 701318 - DNA, 22 bp, Artificial Sequence
  chemically synthesized
agattcttgaatgtacaaatca

SEQ ID NO: 701319 - DNA, 22 bp, Artificial Sequence
  chemically synthesized
ttgaatgtacaaatcaaccatt

SEQ ID NO: 701320 - DNA, 22 bp, Artificial Sequence
  chemically synthesized
gtgccgtatgataatggttgat

SEQ ID NO: 701321 - DNA, 22 bp, Artificial Sequence
  chemically synthesized
gaatgtacaaatcaaccattat

SEQ ID NO: 701322 - DNA, 22 bp, Artificial Sequence
  chemically synthesized
aatgtacaaatcaaccattatc

SEQ ID NO: 701323 - DNA, 22 bp, Artificial Sequence
  chemically synthesized
tcatacggcaccagcatcatgg

SEQ ID NO: 701324 - DNA, 22 bp, Artificial Sequence
  chemically synthesized
agtggacaataccccatgatgc

SEQ ID NO: 701325 - DNA, 22 bp, Artificial Sequence
  chemically synthesized
aattcagtggacaataccccat

SEQ ID NO: 701326 - DNA, 22 bp, Artificial Sequence
  chemically synthesized
tctaaattcagtggacaatacc

SEQ ID NO: 701327 - DNA, 22 bp, Artificial Sequence
  chemically synthesized
ctatctaaattcagtggacaat

SEQ ID NO: 701328 - DNA, 22 bp, Artificial Sequence
  chemically synthesized
gctatctaaattcagtggacaa

SEQ ID NO: 701329 - DNA, 22 bp, Artificial Sequence
  chemically synthesized
tccactgaatttagatagcaaa

SEQ ID NO: 701330 - DNA, 22 bp, Artificial Sequence
  chemically synthesized
aatttagatagcaaactacaca

SEQ ID NO: 701331 - DNA, 22 bp, Artificial Sequence
  chemically synthesized
caataaataaatgcatgtgtag

SEQ ID NO: 701332 - DNA, 22 bp, Artificial Sequence
  chemically synthesized
gcaataaataaatgcatgtgta

SEQ ID NO: 701333 - DNA, 22 bp, Artificial Sequence
  chemically synthesized
agatagcaaactacacatgcat

SEQ ID NO: 701334 - DNA, 22 bp, Artificial Sequence
  chemically synthesized
tgcaataaataaatgcatgtgt

SEQ ID NO: 701335 - DNA, 22 bp, Artificial Sequence
  chemically synthesized
gatagcaaactacacatgcatt

SEQ ID NO: 701336 - DNA, 22 bp, Artificial Sequence
  chemically synthesized
gttttgcaataaataaatgcat

SEQ ID NO: 701337 - DNA, 22 bp, Artificial Sequence
  chemically synthesized
agaggttggttttgcaataaat

SEQ ID NO: 701338 - DNA, 22 bp, Artificial Sequence
  chemically synthesized
cacatgcatttatttattgcaa

SEQ ID NO: 701339 - DNA, 22 bp, Artificial Sequence
  chemically synthesized
atttattgcaaaaccaacctct

SEQ ID NO: 701340 - DNA, 22 bp, Artificial Sequence
  chemically synthesized
tttattgcaaaaccaacctctg

SEQ ID NO: 701341 - DNA, 22 bp, Artificial Sequence
  chemically synthesized
attgcaaaaccaacctctgaat

SEQ ID NO: 701342 - DNA, 22 bp, Artificial Sequence
  chemically synthesized
ttgcaaaaccaacctctgaatt

SEQ ID NO: 701343 - DNA, 22 bp, Artificial Sequence
  chemically synthesized
taacacaaaaggaaattcagag

SEQ ID NO: 701344 - DNA, 22 bp, Artificial Sequence
  chemically synthesized
caaaaccaacctctgaatttcc

SEQ ID NO: 701345 - DNA, 22 bp, Artificial Sequence
  chemically synthesized
tgtctgtaacacaaaaggaaat

SEQ ID NO: 701346 - DNA, 22 bp, Artificial Sequence
  chemically synthesized
tgaatttccttttgtgttacag

SEQ ID NO: 701347 - DNA, 22 bp, Artificial Sequence
  chemically synthesized
aatttccttttgtgttacagac

SEQ ID NO: 701348 - DNA, 22 bp, Artificial Sequence
  chemically synthesized
ataacatactgtgtctgtaaca

SEQ ID NO: 701349 - DNA, 22 bp, Artificial Sequence
  chemically synthesized
aataacatactgtgtctgtaac

SEQ ID NO: 701350 - DNA, 22 bp, Artificial Sequence
  chemically synthesized
ttaataacatactgtgtctgta

SEQ ID NO: 701351 - DNA, 22 bp, Artificial Sequence
  chemically synthesized
ccttttgtgttacagacacagt

SEQ ID NO: 701352 - DNA, 22 bp, Artificial Sequence
  chemically synthesized
cttttgtgttacagacacagta

SEQ ID NO: 701353 - DNA, 22 bp, Artificial Sequence
  chemically synthesized
ctcttaataacatactgtgtct

SEQ ID NO: 701354 - DNA, 22 bp, Artificial Sequence
  chemically synthesized
gctcttaataacatactgtgtc

SEQ ID NO: 701355 - DNA, 22 bp, Artificial Sequence
  chemically synthesized
ttgtgttacagacacagtatgt

SEQ ID NO: 701356 - DNA, 22 bp, Artificial Sequence
  chemically synthesized
ttgctcttaataacatactgtg

SEQ ID NO: 701357 - DNA, 22 bp, Artificial Sequence
  chemically synthesized
tgtgttacagacacagtatgtt

SEQ ID NO: 701358 - DNA, 22 bp, Artificial Sequence
  chemically synthesized
cttgctcttaataacatactgt

SEQ ID NO: 701359 - DNA, 22 bp, Artificial Sequence
  chemically synthesized
gtgttacagacacagtatgtta

SEQ ID NO: 701360 - DNA, 22 bp, Artificial Sequence
  chemically synthesized
tcttgctcttaataacatactg

SEQ ID NO: 701361 - DNA, 22 bp, Artificial Sequence
  chemically synthesized
tgttacagacacagtatgttat

SEQ ID NO: 701362 - DNA, 22 bp, Artificial Sequence
  chemically synthesized
ccctttcttgctcttaataaca

SEQ ID NO: 701363 - DNA, 22 bp, Artificial Sequence
  chemically synthesized
cagacacagtatgttattaaga

SEQ ID NO: 701364 - DNA, 22 bp, Artificial Sequence
  chemically synthesized
ctaccctttcttgctcttaata

SEQ ID NO: 701365 - DNA, 22 bp, Artificial Sequence
  chemically synthesized
aagatagaattgctaccctttc

SEQ ID NO: 701366 - DNA, 22 bp, Artificial Sequence
  chemically synthesized
gaagatagaattgctacccttt

SEQ ID NO: 701367 - DNA, 22 bp, Artificial Sequence
  chemically synthesized
ttaagagcaagaaagggtagca

SEQ ID NO: 701368 - DNA, 22 bp, Artificial Sequence
  chemically synthesized
agagcaagaaagggtagcaatt

SEQ ID NO: 701369 - DNA, 22 bp, Artificial Sequence
  chemically synthesized
aaggaaggaaaagcatttgaag

SEQ ID NO: 701370 - DNA, 22 bp, Artificial Sequence
  chemically synthesized
tcacctcaaggaaggaaaagca

SEQ ID NO: 701371 - DNA, 22 bp, Artificial Sequence
  chemically synthesized
tatcttcaaatgcttttccttc

SEQ ID NO: 701372 - DNA, 22 bp, Artificial Sequence
  chemically synthesized
tcttcaaatgcttttccttcct

SEQ ID NO: 701373 - DNA, 22 bp, Artificial Sequence
  chemically synthesized
aatcctgtcacctcaaggaagg

SEQ ID NO: 701374 - DNA, 22 bp, Artificial Sequence
  chemically synthesized
caaatgcttttccttccttgag

SEQ ID NO: 701375 - DNA, 22 bp, Artificial Sequence
  chemically synthesized
aaatgcttttccttccttgagg

SEQ ID NO: 701376 - DNA, 22 bp, Artificial Sequence
  chemically synthesized
ttccttccttgaggtgacagga

SEQ ID NO: 701377 - DNA, 22 bp, Artificial Sequence
  chemically synthesized
tccttccttgaggtgacaggat

SEQ ID NO: 701378 - DNA, 22 bp, Artificial Sequence
  chemically synthesized
ccttccttgaggtgacaggatt

SEQ ID NO: 701379 - DNA, 22 bp, Artificial Sequence
  chemically synthesized
ggcacaatattgaatcctgtca

SEQ ID NO: 701380 - DNA, 22 bp, Artificial Sequence
  chemically synthesized
cttccttgaggtgacaggattc

SEQ ID NO: 701381 - DNA, 22 bp, Artificial Sequence
  chemically synthesized
gggcacaatattgaatcctgtc

SEQ ID NO: 701382 - DNA, 22 bp, Artificial Sequence
  chemically synthesized
ccttgaggtgacaggattcaat

SEQ ID NO: 701383 - DNA, 22 bp, Artificial Sequence
  chemically synthesized
cttgaggtgacaggattcaata

SEQ ID NO: 701384 - DNA, 22 bp, Artificial Sequence
  chemically synthesized
ccttgggcacaatattgaatcc

SEQ ID NO: 701385 - DNA, 22 bp, Artificial Sequence
  chemically synthesized
gaggtgacaggattcaatattg

SEQ ID NO: 701386 - DNA, 22 bp, Artificial Sequence
  chemically synthesized
aggtgacaggattcaatattgt

SEQ ID NO: 701387 - DNA, 22 bp, Artificial Sequence
  chemically synthesized
aaaactaccttgggcacaatat

SEQ ID NO: 701388 - DNA, 22 bp, Artificial Sequence
  chemically synthesized
caaaactaccttgggcacaata

SEQ ID NO: 701389 - DNA, 22 bp, Artificial Sequence
  chemically synthesized
tcaaaactaccttgggcacaat

SEQ ID NO: 701390 - DNA, 22 bp, Artificial Sequence
  chemically synthesized
tgattttcaaaactaccttggg

SEQ ID NO: 701391 - DNA, 22 bp, Artificial Sequence
  chemically synthesized
gtgattttcaaaactaccttgg

SEQ ID NO: 701392 - DNA, 22 bp, Artificial Sequence
  chemically synthesized
aatattgtgcccaaggtagttt

SEQ ID NO: 701393 - DNA, 22 bp, Artificial Sequence
  chemically synthesized
tgcttgtgattttcaaaactac

SEQ ID NO: 701394 - DNA, 22 bp, Artificial Sequence
  chemically synthesized
tgcccaaggtagttttgaaaat

SEQ ID NO: 701395 - DNA, 22 bp, Artificial Sequence
  chemically synthesized
aataatgtggcctgtgcttgtg

SEQ ID NO: 701396 - DNA, 22 bp, Artificial Sequence
  chemically synthesized
tgaaaatcacaagcacaggcca

SEQ ID NO: 701397 - DNA, 22 bp, Artificial Sequence
  chemically synthesized
ccctaaataatgtggcctgtgc

SEQ ID NO: 701398 - DNA, 22 bp, Artificial Sequence
  chemically synthesized
gaaaatcacaagcacaggccac

SEQ ID NO: 701399 - DNA, 22 bp, Artificial Sequence
  chemically synthesized
cccctaaataatgtggcctgtg

SEQ ID NO: 701400 - DNA, 22 bp, Artificial Sequence
  chemically synthesized
aaaatcacaagcacaggccaca

SEQ ID NO: 701401 - DNA, 22 bp, Artificial Sequence
  chemically synthesized
aaataacaacttcccctaaata

SEQ ID NO: 701402 - DNA, 22 bp, Artificial Sequence
  chemically synthesized
aaaacggctgaaataacaactt

SEQ ID NO: 701403 - DNA, 22 bp, Artificial Sequence
  chemically synthesized
aaaaacggctgaaataacaact

SEQ ID NO: 701404 - DNA, 22 bp, Artificial Sequence
  chemically synthesized
tttaggggaagttgttatttca

SEQ ID NO: 701405 - DNA, 22 bp, Artificial Sequence
  chemically synthesized
aggggaagttgttatttcagcc

SEQ ID NO: 701406 - DNA, 22 bp, Artificial Sequence
  chemically synthesized
ggggaagttgttatttcagccg

SEQ ID NO: 701407 - DNA, 22 bp, Artificial Sequence
  chemically synthesized
atcatgcatttaaaaacggctg

SEQ ID NO: 701408 - DNA, 22 bp, Artificial Sequence
  chemically synthesized
ttcatcatgcatttaaaaacgg

SEQ ID NO: 701409 - DNA, 22 bp, Artificial Sequence
  chemically synthesized
tgttcatcatgcatttaaaaac

SEQ ID NO: 701410 - DNA, 22 bp, Artificial Sequence
  chemically synthesized
ttatttcagccgtttttaaatg

SEQ ID NO: 701411 - DNA, 22 bp, Artificial Sequence
  chemically synthesized
tttcagccgtttttaaatgcat

SEQ ID NO: 701412 - DNA, 22 bp, Artificial Sequence
  chemically synthesized
cagccgtttttaaatgcatgat

SEQ ID NO: 701413 - DNA, 22 bp, Artificial Sequence
  chemically synthesized
agccgtttttaaatgcatgatg

SEQ ID NO: 701414 - DNA, 22 bp, Artificial Sequence
  chemically synthesized
gaacattctgttcatcatgcat

SEQ ID NO: 701415 - DNA, 22 bp, Artificial Sequence
  chemically synthesized
ggaacattctgttcatcatgca

SEQ ID NO: 701416 - DNA, 22 bp, Artificial Sequence
  chemically synthesized
ttaaatgcatgatgaacagaat

SEQ ID NO: 701417 - DNA, 22 bp, Artificial Sequence
  chemically synthesized
taaatgcatgatgaacagaatg

SEQ ID NO: 701418 - DNA, 22 bp, Artificial Sequence
  chemically synthesized
aaatgcatgatgaacagaatgt

SEQ ID NO: 701419 - DNA, 22 bp, Artificial Sequence
  chemically synthesized
aatgcatgatgaacagaatgtt

SEQ ID NO: 701420 - DNA, 22 bp, Artificial Sequence
  chemically synthesized
acaccagggtgcatcacttgga

SEQ ID NO: 701421 - DNA, 22 bp, Artificial Sequence
  chemically synthesized
aacaccagggtgcatcacttgg

SEQ ID NO: 701422 - DNA, 22 bp, Artificial Sequence
  chemically synthesized
aaatatgacttaacaccagggt

SEQ ID NO: 701423 - DNA, 22 bp, Artificial Sequence
  chemically synthesized
caagtgatgcaccctggtgtta

SEQ ID NO: 701424 - DNA, 22 bp, Artificial Sequence
  chemically synthesized
attaaaatatgacttaacacca

SEQ ID NO: 701425 - DNA, 22 bp, Artificial Sequence
  chemically synthesized
tgttgattaaaatatgacttaa

SEQ ID NO: 701426 - DNA, 22 bp, Artificial Sequence
  chemically synthesized
ggcccctatgttgattaaaata

SEQ ID NO: 701427 - DNA, 22 bp, Artificial Sequence
  chemically synthesized
gtgttaagtcatattttaatca

SEQ ID NO: 701428 - DNA, 22 bp, Artificial Sequence
  chemically synthesized
gttaggcccctatgttgattaa

SEQ ID NO: 701429 - DNA, 22 bp, Artificial Sequence
  chemically synthesized
tggttaggcccctatgttgatt

SEQ ID NO: 701430 - DNA, 22 bp, Artificial Sequence
  chemically synthesized
agtcatattttaatcaacatag

SEQ ID NO: 701431 - DNA, 22 bp, Artificial Sequence
  chemically synthesized
ctggttaggcccctatgttgat

SEQ ID NO: 701432 - DNA, 22 bp, Artificial Sequence
  chemically synthesized
tctggttaggcccctatgttga

SEQ ID NO: 701433 - DNA, 22 bp, Artificial Sequence
  chemically synthesized
attttctggttaggcccctatg

SEQ ID NO: 701434 - DNA, 22 bp, Artificial Sequence
  chemically synthesized
aattttctggttaggcccctat

SEQ ID NO: 701435 - DNA, 22 bp, Artificial Sequence
  chemically synthesized
taattttctggttaggccccta

SEQ ID NO: 701436 - DNA, 22 bp, Artificial Sequence
  chemically synthesized
ttaattttctggttaggcccct

SEQ ID NO: 701437 - DNA, 22 bp, Artificial Sequence
  chemically synthesized
tttaattttctggttaggcccc

SEQ ID NO: 701438 - DNA, 22 bp, Artificial Sequence
  chemically synthesized
taatcaacataggggcctaacc

SEQ ID NO: 701439 - DNA, 22 bp, Artificial Sequence
  chemically synthesized
aatcaacataggggcctaacca

SEQ ID NO: 701440 - DNA, 22 bp, Artificial Sequence
  chemically synthesized
tttttaattttctggttaggcc

SEQ ID NO: 701441 - DNA, 22 bp, Artificial Sequence
  chemically synthesized
atcaacataggggcctaaccag

SEQ ID NO: 701442 - DNA, 22 bp, Artificial Sequence
  chemically synthesized
gcattctttttaattttctggt

SEQ ID NO: 701443 - DNA, 22 bp, Artificial Sequence
  chemically synthesized
aaataacattagcattcttttt

SEQ ID NO: 701444 - DNA, 22 bp, Artificial Sequence
  chemically synthesized
accagaaaattaaaaagaatgc

SEQ ID NO: 701445 - DNA, 22 bp, Artificial Sequence
  chemically synthesized
aaaataacattagcattctttt

SEQ ID NO: 701446 - DNA, 22 bp, Artificial Sequence
  chemically synthesized
gcatgtcttaaaataacattag

SEQ ID NO: 701447 - DNA, 22 bp, Artificial Sequence
  chemically synthesized
ggcatgtcttaaaataacatta

SEQ ID NO: 701448 - DNA, 22 bp, Artificial Sequence
  chemically synthesized
tggcatgtcttaaaataacatt

SEQ ID NO: 701449 - DNA, 22 bp, Artificial Sequence
  chemically synthesized
aaaagaatgctaatgttatttt

SEQ ID NO: 701450 - DNA, 22 bp, Artificial Sequence
  chemically synthesized
ttggcatgtcttaaaataacat

SEQ ID NO: 701451 - DNA, 22 bp, Artificial Sequence
  chemically synthesized
ttttggcatgtcttaaaataac

SEQ ID NO: 701452 - DNA, 22 bp, Artificial Sequence
  chemically synthesized
atgttattttaagacatgccaa

SEQ ID NO: 701453 - DNA, 22 bp, Artificial Sequence
  chemically synthesized
cagaaagtgctcttttggcatg

SEQ ID NO: 701454 - DNA, 22 bp, Artificial Sequence
  chemically synthesized
ttttaagacatgccaaaagagc

SEQ ID NO: 701455 - DNA, 22 bp, Artificial Sequence
  chemically synthesized
gaattccagaaagtgctctttt

SEQ ID NO: 701456 - DNA, 22 bp, Artificial Sequence
  chemically synthesized
taagacatgccaaaagagcact

SEQ ID NO: 701457 - DNA, 22 bp, Artificial Sequence
  chemically synthesized
aagacatgccaaaagagcactt

SEQ ID NO: 701458 - DNA, 22 bp, Artificial Sequence
  chemically synthesized
agacatgccaaaagagcacttt

SEQ ID NO: 701459 - DNA, 22 bp, Artificial Sequence
  chemically synthesized
tgttggaattccagaaagtgct

SEQ ID NO: 701460 - DNA, 22 bp, Artificial Sequence
  chemically synthesized
gtgttggaattccagaaagtgc

SEQ ID NO: 701461 - DNA, 22 bp, Artificial Sequence
  chemically synthesized
tctggaattccaacacaaatac

SEQ ID NO: 701462 - DNA, 22 bp, Artificial Sequence
  chemically synthesized
ctggaattccaacacaaatacc

SEQ ID NO: 701463 - DNA, 22 bp, Artificial Sequence
  chemically synthesized
tggaattccaacacaaatacct

SEQ ID NO: 701464 - DNA, 22 bp, Artificial Sequence
  chemically synthesized
gaattccaacacaaataccttc

SEQ ID NO: 701465 - DNA, 22 bp, Artificial Sequence
  chemically synthesized
caacacaaataccttcattcat

SEQ ID NO: 701466 - DNA, 22 bp, Artificial Sequence
  chemically synthesized
cattcatctctctacttttctc

SEQ ID NO: 701467 - DNA, 22 bp, Artificial Sequence
  chemically synthesized
attcatctctctacttttctca

SEQ ID NO: 701468 - DNA, 22 bp, Artificial Sequence
  chemically synthesized
caaatccaccaagtatgagaaa

SEQ ID NO: 701469 - DNA, 22 bp, Artificial Sequence
  chemically synthesized
atctctctacttttctcatact

SEQ ID NO: 701470 - DNA, 22 bp, Artificial Sequence
  chemically synthesized
tctacttttctcatacttggtg

SEQ ID NO: 701471 - DNA, 22 bp, Artificial Sequence
  chemically synthesized
tacttttctcatacttggtgga

SEQ ID NO: 701472 - DNA, 22 bp, Artificial Sequence
  chemically synthesized
tcaaactccaaatccaccaagt

SEQ ID NO: 701473 - DNA, 22 bp, Artificial Sequence
  chemically synthesized
cttttctcatacttggtggatt

SEQ ID NO: 701474 - DNA, 22 bp, Artificial Sequence
  chemically synthesized
ttctcatacttggtggatttgg

SEQ ID NO: 701475 - DNA, 22 bp, Artificial Sequence
  chemically synthesized
tgttatcaaactccaaatccac

SEQ ID NO: 701476 - DNA, 22 bp, Artificial Sequence
  chemically synthesized
tctcatacttggtggatttgga

SEQ ID NO: 701477 - DNA, 22 bp, Artificial Sequence
  chemically synthesized
ctcatacttggtggatttggag

SEQ ID NO: 701478 - DNA, 22 bp, Artificial Sequence
  chemically synthesized
tcatacttggtggatttggagt

SEQ ID NO: 701479 - DNA, 22 bp, Artificial Sequence
  chemically synthesized
atacttggtggatttggagttt

SEQ ID NO: 701480 - DNA, 22 bp, Artificial Sequence
  chemically synthesized
acccacctatgttatcaaactc

SEQ ID NO: 701481 - DNA, 22 bp, Artificial Sequence
  chemically synthesized
gacccacctatgttatcaaact

SEQ ID NO: 701482 - DNA, 22 bp, Artificial Sequence
  chemically synthesized
ggtggatttggagtttgataac

SEQ ID NO: 701483 - DNA, 22 bp, Artificial Sequence
  chemically synthesized
tgacccacctatgttatcaaac

SEQ ID NO: 701484 - DNA, 22 bp, Artificial Sequence
  chemically synthesized
gtggatttggagtttgataaca

SEQ ID NO: 701485 - DNA, 22 bp, Artificial Sequence
  chemically synthesized
ttgacccacctatgttatcaaa

SEQ ID NO: 701486 - DNA, 22 bp, Artificial Sequence
  chemically synthesized
tttgacccacctatgttatcaa

SEQ ID NO: 701487 - DNA, 22 bp, Artificial Sequence
  chemically synthesized
ttttgacccacctatgttatca

SEQ ID NO: 701488 - DNA, 22 bp, Artificial Sequence
  chemically synthesized
ggagtttgataacataggtggg

SEQ ID NO: 701489 - DNA, 22 bp, Artificial Sequence
  chemically synthesized
gagtttgataacataggtgggt

SEQ ID NO: 701490 - DNA, 22 bp, Artificial Sequence
  chemically synthesized
tccccacttttttgacccacct

SEQ ID NO: 701491 - DNA, 22 bp, Artificial Sequence
  chemically synthesized
gataacataggtgggtcaaaaa

SEQ ID NO: 701492 - DNA, 22 bp, Artificial Sequence
  chemically synthesized
ataacataggtgggtcaaaaaa

SEQ ID NO: 701493 - DNA, 22 bp, Artificial Sequence
  chemically synthesized
aactgtccccacttttttgacc

SEQ ID NO: 701494 - DNA, 22 bp, Artificial Sequence
  chemically synthesized
tctaaactgtccccactttttt

SEQ ID NO: 701495 - DNA, 22 bp, Artificial Sequence
  chemically synthesized
atctaaactgtccccacttttt

SEQ ID NO: 701496 - DNA, 22 bp, Artificial Sequence
  chemically synthesized
tttatctaaactgtccccactt

SEQ ID NO: 701497 - DNA, 22 bp, Artificial Sequence
  chemically synthesized
tatcggttatttatctaaactg

SEQ ID NO: 701498 - DNA, 22 bp, Artificial Sequence
  chemically synthesized
ctgtatcggttatttatctaaa

SEQ ID NO: 701499 - DNA, 22 bp, Artificial Sequence
  chemically synthesized
cagtgattgctgtatcggttat

SEQ ID NO: 701500 - DNA, 22 bp, Artificial Sequence
  chemically synthesized
cctccagtgattgctgtatcgg

SEQ ID NO: 701501 - DNA, 22 bp, Artificial Sequence
  chemically synthesized
acctccagtgattgctgtatcg

SEQ ID NO: 701502 - DNA, 22 bp, Artificial Sequence
  chemically synthesized
agataaataaccgatacagcaa

SEQ ID NO: 701503 - DNA, 22 bp, Artificial Sequence
  chemically synthesized
tacctccagtgattgctgtatc

SEQ ID NO: 701504 - DNA, 22 bp, Artificial Sequence
  chemically synthesized
gataaataaccgatacagcaat

SEQ ID NO: 701505 - DNA, 22 bp, Artificial Sequence
  chemically synthesized
ttttacctccagtgattgctgt

SEQ ID NO: 701506 - DNA, 22 bp, Artificial Sequence
  chemically synthesized
tattttacctccagtgattgct

SEQ ID NO: 701507 - DNA, 22 bp, Artificial Sequence
  chemically synthesized
ctattttacctccagtgattgc

SEQ ID NO: 701508 - DNA, 22 bp, Artificial Sequence
  chemically synthesized
tctattttacctccagtgattg

SEQ ID NO: 701509 - DNA, 22 bp, Artificial Sequence
  chemically synthesized
aaccccagaggtgagttttcta

SEQ ID NO: 701510 - DNA, 22 bp, Artificial Sequence
  chemically synthesized
gaggtaaaatagaaaactcacc

SEQ ID NO: 701511 - DNA, 22 bp, Artificial Sequence
  chemically synthesized
ttcaaccccagaggtgagtttt

SEQ ID NO: 701512 - DNA, 22 bp, Artificial Sequence
  chemically synthesized
gttcaaccccagaggtgagttt

SEQ ID NO: 701513 - DNA, 22 bp, Artificial Sequence
  chemically synthesized
tgttcaaccccagaggtgagtt

SEQ ID NO: 701514 - DNA, 22 bp, Artificial Sequence
  chemically synthesized
ttgttcaaccccagaggtgagt

SEQ ID NO: 701515 - DNA, 22 bp, Artificial Sequence
  chemically synthesized
atgccttttgttcaaccccaga

SEQ ID NO: 701516 - DNA, 22 bp, Artificial Sequence
  chemically synthesized
cctaatgccttttgttcaaccc

SEQ ID NO: 701517 - DNA, 22 bp, Artificial Sequence
  chemically synthesized
acctctggggttgaacaaaagg

SEQ ID NO: 701518 - DNA, 22 bp, Artificial Sequence
  chemically synthesized
tggggttgaacaaaaggcatta

SEQ ID NO: 701519 - DNA, 22 bp, Artificial Sequence
  chemically synthesized
gtagatcctccctaatgccttt

SEQ ID NO: 701520 - DNA, 22 bp, Artificial Sequence
  chemically synthesized
gggttgaacaaaaggcattagg

SEQ ID NO: 701521 - DNA, 22 bp, Artificial Sequence
  chemically synthesized
aacaaaaggcattagggaggat

SEQ ID NO: 701522 - DNA, 22 bp, Artificial Sequence
  chemically synthesized
gaaaagacaaaacaagtctagt

SEQ ID NO: 701523 - DNA, 22 bp, Artificial Sequence
  chemically synthesized
gggaggatctactagacttgtt

SEQ ID NO: 701524 - DNA, 22 bp, Artificial Sequence
  chemically synthesized
tggaaaagacaaaacaagtcta

SEQ ID NO: 701525 - DNA, 22 bp, Artificial Sequence
  chemically synthesized
tatgacattctggaaaagacaa

SEQ ID NO: 701526 - DNA, 22 bp, Artificial Sequence
  chemically synthesized
ctagacttgttttgtcttttcc

SEQ ID NO: 701527 - DNA, 22 bp, Artificial Sequence
  chemically synthesized
atatgacattctggaaaagaca

SEQ ID NO: 701528 - DNA, 22 bp, Artificial Sequence
  chemically synthesized
gacttgttttgtcttttccaga

SEQ ID NO: 701529 - DNA, 22 bp, Artificial Sequence
  chemically synthesized
tatttatatgacattctggaaa

SEQ ID NO: 701530 - DNA, 22 bp, Artificial Sequence
  chemically synthesized
gttttgtcttttccagaatgtc

SEQ ID NO: 701531 - DNA, 22 bp, Artificial Sequence
  chemically synthesized
ttttgtcttttccagaatgtca

SEQ ID NO: 701532 - DNA, 22 bp, Artificial Sequence
  chemically synthesized
tgtcttttccagaatgtcatat

SEQ ID NO: 701533 - DNA, 22 bp, Artificial Sequence
  chemically synthesized
catactgtatttatatgacatt

SEQ ID NO: 701534 - DNA, 22 bp, Artificial Sequence
  chemically synthesized
gtcttttccagaatgtcatata

SEQ ID NO: 701535 - DNA, 22 bp, Artificial Sequence
  chemically synthesized
tcttttccagaatgtcatataa

SEQ ID NO: 701536 - DNA, 22 bp, Artificial Sequence
  chemically synthesized
ttccagaatgtcatataaatac

SEQ ID NO: 701537 - DNA, 22 bp, Artificial Sequence
  chemically synthesized
tccagaatgtcatataaataca

SEQ ID NO: 701538 - DNA, 22 bp, Artificial Sequence
  chemically synthesized
ccagaatgtcatataaatacag

SEQ ID NO: 701539 - DNA, 22 bp, Artificial Sequence
  chemically synthesized
cagaatgtcatataaatacagt

SEQ ID NO: 701540 - DNA, 22 bp, Artificial Sequence
  chemically synthesized
agtgaaataaaccagtatcaaa

SEQ ID NO: 701541 - DNA, 22 bp, Artificial Sequence
  chemically synthesized
tgctgagtgaaataaaccagta

SEQ ID NO: 701542 - DNA, 22 bp, Artificial Sequence
  chemically synthesized
tgcattatgctgagtgaaataa

SEQ ID NO: 701543 - DNA, 22 bp, Artificial Sequence
  chemically synthesized
ttgatactggtttatttcactc

SEQ ID NO: 701544 - DNA, 22 bp, Artificial Sequence
  chemically synthesized
tgatactggtttatttcactca

SEQ ID NO: 701545 - DNA, 22 bp, Artificial Sequence
  chemically synthesized
gatactggtttatttcactcag

SEQ ID NO: 701546 - DNA, 22 bp, Artificial Sequence
  chemically synthesized
atactggtttatttcactcagc

SEQ ID NO: 701547 - DNA, 22 bp, Artificial Sequence
  chemically synthesized
gtttatttcactcagcataatg

SEQ ID NO: 701548 - DNA, 22 bp, Artificial Sequence
  chemically synthesized
atttcactcagcataatgcata

SEQ ID NO: 701549 - DNA, 22 bp, Artificial Sequence
  chemically synthesized
tttcactcagcataatgcataa

SEQ ID NO: 701550 - DNA, 22 bp, Artificial Sequence
  chemically synthesized
cactcagcataatgcataatcc

SEQ ID NO: 701551 - DNA, 22 bp, Artificial Sequence
  chemically synthesized
atacagcaatatggattatgca

SEQ ID NO: 701552 - DNA, 22 bp, Artificial Sequence
  chemically synthesized
actcagcataatgcataatcca

SEQ ID NO: 701553 - DNA, 22 bp, Artificial Sequence
  chemically synthesized
agcataatgcataatccatatt

SEQ ID NO: 701554 - DNA, 22 bp, Artificial Sequence
  chemically synthesized
gcaatgaaaagaaacaaatcgt

SEQ ID NO: 701555 - DNA, 22 bp, Artificial Sequence
  chemically synthesized
agcaatgaaaagaaacaaatcg

SEQ ID NO: 701556 - DNA, 22 bp, Artificial Sequence
  chemically synthesized
ctgtatcaacgatttgtttctt

SEQ ID NO: 701557 - DNA, 22 bp, Artificial Sequence
  chemically synthesized
cttagcaatgaaaagaaacaaa

SEQ ID NO: 701558 - DNA, 22 bp, Artificial Sequence
  chemically synthesized
tatcaacgatttgtttcttttc

SEQ ID NO: 701559 - DNA, 22 bp, Artificial Sequence
  chemically synthesized
gtttcttttcattgctaagtag

SEQ ID NO: 701560 - DNA, 22 bp, Artificial Sequence
  chemically synthesized
tttcttttcattgctaagtagt

SEQ ID NO: 701561 - DNA, 22 bp, Artificial Sequence
  chemically synthesized
cttttcattgctaagtagtatg

SEQ ID NO: 701562 - DNA, 22 bp, Artificial Sequence
  chemically synthesized
ttttcattgctaagtagtatgc

SEQ ID NO: 701563 - DNA, 22 bp, Artificial Sequence
  chemically synthesized
ttcattgctaagtagtatgcca

SEQ ID NO: 701564 - DNA, 22 bp, Artificial Sequence
  chemically synthesized
tcattgctaagtagtatgccat

SEQ ID NO: 701565 - DNA, 22 bp, Artificial Sequence
  chemically synthesized
cattgctaagtagtatgccatt

SEQ ID NO: 701566 - DNA, 22 bp, Artificial Sequence
  chemically synthesized
attgctaagtagtatgccatta

SEQ ID NO: 701567 - DNA, 22 bp, Artificial Sequence
  chemically synthesized
tagtacacccatataatggcat

SEQ ID NO: 701568 - DNA, 22 bp, Artificial Sequence
  chemically synthesized
ctaagtagtatgccattatatg

SEQ ID NO: 701569 - DNA, 22 bp, Artificial Sequence
  chemically synthesized
agctgtagtacacccatataat

SEQ ID NO: 701570 - DNA, 22 bp, Artificial Sequence
  chemically synthesized
agtagtatgccattatatgggt

SEQ ID NO: 701571 - DNA, 22 bp, Artificial Sequence
  chemically synthesized
tatgggtgtactacagcttagt

SEQ ID NO: 701572 - DNA, 22 bp, Artificial Sequence
  chemically synthesized
aacaggtgaatggataactaag

SEQ ID NO: 701573 - DNA, 22 bp, Artificial Sequence
  chemically synthesized
gaacaggtgaatggataactaa

SEQ ID NO: 701574 - DNA, 22 bp, Artificial Sequence
  chemically synthesized
tgaacaggtgaatggataacta

SEQ ID NO: 701575 - DNA, 22 bp, Artificial Sequence
  chemically synthesized
cagcttagttatccattcacct

SEQ ID NO: 701576 - DNA, 22 bp, Artificial Sequence
  chemically synthesized
atgtctttgaacaggtgaatgg

SEQ ID NO: 701577 - DNA, 22 bp, Artificial Sequence
  chemically synthesized
agttatccattcacctgttcaa

SEQ ID NO: 701578 - DNA, 22 bp, Artificial Sequence
  chemically synthesized
gttatccattcacctgttcaaa

SEQ ID NO: 701579 - DNA, 22 bp, Artificial Sequence
  chemically synthesized
tccattcacctgttcaaagaca

SEQ ID NO: 701580 - DNA, 22 bp, Artificial Sequence
  chemically synthesized
aaagcaacctaatgtctttgaa

SEQ ID NO: 701581 - DNA, 22 bp, Artificial Sequence
  chemically synthesized
acctgttcaaagacattaggtt

SEQ ID NO: 701582 - DNA, 22 bp, Artificial Sequence
  chemically synthesized
ccaaatgctaaaagcaacctaa

SEQ ID NO: 701583 - DNA, 22 bp, Artificial Sequence
  chemically synthesized
ttcaaagacattaggttgcttt

SEQ ID NO: 701584 - DNA, 22 bp, Artificial Sequence
  chemically synthesized
aaagacattaggttgcttttag

SEQ ID NO: 701585 - DNA, 22 bp, Artificial Sequence
  chemically synthesized
atgattgccaaatgctaaaagc

SEQ ID NO: 701586 - DNA, 22 bp, Artificial Sequence
  chemically synthesized
ttcatgattgccaaatgctaaa

SEQ ID NO: 701587 - DNA, 22 bp, Artificial Sequence
  chemically synthesized
attcatgattgccaaatgctaa

SEQ ID NO: 701588 - DNA, 22 bp, Artificial Sequence
  chemically synthesized
tattcatgattgccaaatgcta

SEQ ID NO: 701589 - DNA, 22 bp, Artificial Sequence
  chemically synthesized
ggttgcttttagcatttggcaa

SEQ ID NO: 701590 - DNA, 22 bp, Artificial Sequence
  chemically synthesized
cttttagcatttggcaatcatg

SEQ ID NO: 701591 - DNA, 22 bp, Artificial Sequence
  chemically synthesized
ataccagctttattcatgattg

SEQ ID NO: 701592 - DNA, 22 bp, Artificial Sequence
  chemically synthesized
ttagcatttggcaatcatgaat

SEQ ID NO: 701593 - DNA, 22 bp, Artificial Sequence
  chemically synthesized
tagcatttggcaatcatgaata

SEQ ID NO: 701594 - DNA, 22 bp, Artificial Sequence
  chemically synthesized
agcatttggcaatcatgaataa

SEQ ID NO: 701595 - DNA, 22 bp, Artificial Sequence
  chemically synthesized
gcatttggcaatcatgaataaa

SEQ ID NO: 701596 - DNA, 22 bp, Artificial Sequence
  chemically synthesized
ggcaatcatgaataaagctggt

SEQ ID NO: 701597 - DNA, 22 bp, Artificial Sequence
  chemically synthesized
gcaatcatgaataaagctggta

SEQ ID NO: 701598 - DNA, 22 bp, Artificial Sequence
  chemically synthesized
tacacaaatgttgataccagct

SEQ ID NO: 701599 - DNA, 22 bp, Artificial Sequence
  chemically synthesized
tgcaaacacctgtacacaaatg

SEQ ID NO: 701600 - DNA, 22 bp, Artificial Sequence
  chemically synthesized
atgcaaacacctgtacacaaat

SEQ ID NO: 701601 - DNA, 22 bp, Artificial Sequence
  chemically synthesized
gtatcaacatttgtgtacaggt

SEQ ID NO: 701602 - DNA, 22 bp, Artificial Sequence
  chemically synthesized
tgcttatgcaaacacctgtaca

SEQ ID NO: 701603 - DNA, 22 bp, Artificial Sequence
  chemically synthesized
atgcttatgcaaacacctgtac

SEQ ID NO: 701604 - DNA, 22 bp, Artificial Sequence
  chemically synthesized
gtgtacaggtgtttgcataagc

SEQ ID NO: 701605 - DNA, 22 bp, Artificial Sequence
  chemically synthesized
tgtacaggtgtttgcataagca

SEQ ID NO: 701606 - DNA, 22 bp, Artificial Sequence
  chemically synthesized
gagaaatgaaaacttatgctta

SEQ ID NO: 701607 - DNA, 22 bp, Artificial Sequence
  chemically synthesized
agagaaatgaaaacttatgctt

SEQ ID NO: 701608 - DNA, 22 bp, Artificial Sequence
  chemically synthesized
atcttagagaaatgaaaactta

SEQ ID NO: 701609 - DNA, 22 bp, Artificial Sequence
  chemically synthesized
gcataagcataagttttcattt

SEQ ID NO: 701610 - DNA, 22 bp, Artificial Sequence
  chemically synthesized
cataagcataagttttcatttc

SEQ ID NO: 701611 - DNA, 22 bp, Artificial Sequence
  chemically synthesized
agcattcatcttagagaaatga

SEQ ID NO: 701612 - DNA, 22 bp, Artificial Sequence
  chemically synthesized
aagcattcatcttagagaaatg

SEQ ID NO: 701613 - DNA, 22 bp, Artificial Sequence
  chemically synthesized
ttaagcattcatcttagagaaa

SEQ ID NO: 701614 - DNA, 22 bp, Artificial Sequence
  chemically synthesized
tcatttctctaagatgaatgct

SEQ ID NO: 701615 - DNA, 22 bp, Artificial Sequence
  chemically synthesized
catttctctaagatgaatgctt

SEQ ID NO: 701616 - DNA, 22 bp, Artificial Sequence
  chemically synthesized
atttctctaagatgaatgctta

SEQ ID NO: 701617 - DNA, 22 bp, Artificial Sequence
  chemically synthesized
caagcccactcttaagcattca

SEQ ID NO: 701618 - DNA, 22 bp, Artificial Sequence
  chemically synthesized
ctctaagatgaatgcttaagag

SEQ ID NO: 701619 - DNA, 22 bp, Artificial Sequence
  chemically synthesized
tctaagatgaatgcttaagagt

SEQ ID NO: 701620 - DNA, 22 bp, Artificial Sequence
  chemically synthesized
taagatgaatgcttaagagtgg

SEQ ID NO: 701621 - DNA, 22 bp, Artificial Sequence
  chemically synthesized
taaccctacaagcccactctta

SEQ ID NO: 701622 - DNA, 22 bp, Artificial Sequence
  chemically synthesized
agatgaatgcttaagagtgggc

SEQ ID NO: 701623 - DNA, 22 bp, Artificial Sequence
  chemically synthesized
ttgtaaccctacaagcccactc

SEQ ID NO: 701624 - DNA, 22 bp, Artificial Sequence
  chemically synthesized
aagagtgggcttgtagggttac

SEQ ID NO: 701625 - DNA, 22 bp, Artificial Sequence
  chemically synthesized
agagtgggcttgtagggttaca

SEQ ID NO: 701626 - DNA, 22 bp, Artificial Sequence
  chemically synthesized
gcaatgaaaaatctgttgtaac

SEQ ID NO: 701627 - DNA, 22 bp, Artificial Sequence
  chemically synthesized
agcaatgaaaaatctgttgtaa

SEQ ID NO: 701628 - DNA, 22 bp, Artificial Sequence
  chemically synthesized
tagcaatgaaaaatctgttgta

SEQ ID NO: 701629 - DNA, 22 bp, Artificial Sequence
  chemically synthesized
ttagcaatgaaaaatctgttgt

SEQ ID NO: 701630 - DNA, 22 bp, Artificial Sequence
  chemically synthesized
tttagcaatgaaaaatctgttg

SEQ ID NO: 701631 - DNA, 22 bp, Artificial Sequence
  chemically synthesized
gtagggttacaacagatttttc

SEQ ID NO: 701632 - DNA, 22 bp, Artificial Sequence
  chemically synthesized
tagggttacaacagatttttca

SEQ ID NO: 701633 - DNA, 22 bp, Artificial Sequence
  chemically synthesized
caacagatttttcattgctaaa

SEQ ID NO: 701634 - DNA, 22 bp, Artificial Sequence
  chemically synthesized
ttcattgctaaaaaattcccac

SEQ ID NO: 701635 - DNA, 22 bp, Artificial Sequence
  chemically synthesized
tcattgctaaaaaattcccact

SEQ ID NO: 701636 - DNA, 22 bp, Artificial Sequence
  chemically synthesized
cattgctaaaaaattcccactt

SEQ ID NO: 701637 - DNA, 22 bp, Artificial Sequence
  chemically synthesized
attgctaaaaaattcccactta

SEQ ID NO: 701638 - DNA, 22 bp, Artificial Sequence
  chemically synthesized
ctaaaaaattcccacttatgga

SEQ ID NO: 701639 - DNA, 22 bp, Artificial Sequence
  chemically synthesized
aaaaattcccacttatggatgt

SEQ ID NO: 701640 - DNA, 22 bp, Artificial Sequence
  chemically synthesized
aataaatcatggtacatccata

SEQ ID NO: 701641 - DNA, 22 bp, Artificial Sequence
  chemically synthesized
ttcaataaatcatggtacatcc

SEQ ID NO: 701642 - DNA, 22 bp, Artificial Sequence
  chemically synthesized
attcaataaatcatggtacatc

SEQ ID NO: 701643 - DNA, 22 bp, Artificial Sequence
  chemically synthesized
ccacttatggatgtaccatgat

SEQ ID NO: 701644 - DNA, 22 bp, Artificial Sequence
  chemically synthesized
atggatgtaccatgatttattg

SEQ ID NO: 701645 - DNA, 22 bp, Artificial Sequence
  chemically synthesized
tggatgtaccatgatttattga

SEQ ID NO: 701646 - DNA, 22 bp, Artificial Sequence
  chemically synthesized
ccaaagagggaatttattcaat

SEQ ID NO: 701647 - DNA, 22 bp, Artificial Sequence
  chemically synthesized
tatgttcccaaagagggaattt

SEQ ID NO: 701648 - DNA, 22 bp, Artificial Sequence
  chemically synthesized
atatgttcccaaagagggaatt

SEQ ID NO: 701649 - DNA, 22 bp, Artificial Sequence
  chemically synthesized
attgaataaattccctctttgg

SEQ ID NO: 701650 - DNA, 22 bp, Artificial Sequence
  chemically synthesized
ttgaataaattccctctttggg

SEQ ID NO: 701651 - DNA, 22 bp, Artificial Sequence
  chemically synthesized
aataaattccctctttgggaac

SEQ ID NO: 701652 - DNA, 22 bp, Artificial Sequence
  chemically synthesized
gagacaacttatatgttcccaa

SEQ ID NO: 701653 - DNA, 22 bp, Artificial Sequence
  chemically synthesized
cctctttgggaacatataagtt

SEQ ID NO: 701654 - DNA, 22 bp, Artificial Sequence
  chemically synthesized
tttgggaacatataagttgtct

SEQ ID NO: 701655 - DNA, 22 bp, Artificial Sequence
  chemically synthesized
tgggaacatataagttgtctcc

SEQ ID NO: 701656 - DNA, 22 bp, Artificial Sequence
  chemically synthesized
gggaacatataagttgtctcca

SEQ ID NO: 701657 - DNA, 22 bp, Artificial Sequence
  chemically synthesized
ggaacatataagttgtctccag

SEQ ID NO: 701658 - DNA, 22 bp, Artificial Sequence
  chemically synthesized
gaacagtgaaaaactggagaca

SEQ ID NO: 701659 - DNA, 22 bp, Artificial Sequence
  chemically synthesized
agaacagtgaaaaactggagac

SEQ ID NO: 701660 - DNA, 22 bp, Artificial Sequence
  chemically synthesized
cttagaacagtgaaaaactgga

SEQ ID NO: 701661 - DNA, 22 bp, Artificial Sequence
  chemically synthesized
acttagaacagtgaaaaactgg

SEQ ID NO: 701662 - DNA, 22 bp, Artificial Sequence
  chemically synthesized
tggccttacttagaacagtgaa

SEQ ID NO: 701663 - DNA, 22 bp, Artificial Sequence
  chemically synthesized
tctccagtttttcactgttcta

SEQ ID NO: 701664 - DNA, 22 bp, Artificial Sequence
  chemically synthesized
actgtggccttacttagaacag

SEQ ID NO: 701665 - DNA, 22 bp, Artificial Sequence
  chemically synthesized
cagtttttcactgttctaagta

SEQ ID NO: 701666 - DNA, 22 bp, Artificial Sequence
  chemically synthesized
ttcactgttctaagtaaggcca

SEQ ID NO: 701667 - DNA, 22 bp, Artificial Sequence
  chemically synthesized
tcactgttctaagtaaggccac

SEQ ID NO: 701668 - DNA, 22 bp, Artificial Sequence
  chemically synthesized
cactgttctaagtaaggccaca

SEQ ID NO: 701669 - DNA, 22 bp, Artificial Sequence
  chemically synthesized
actgttctaagtaaggccacag

SEQ ID NO: 701670 - DNA, 22 bp, Artificial Sequence
  chemically synthesized
caaagatgttcactgtggcctt

SEQ ID NO: 701671 - DNA, 22 bp, Artificial Sequence
  chemically synthesized
ttctaagtaaggccacagtgaa

SEQ ID NO: 701672 - DNA, 22 bp, Artificial Sequence
  chemically synthesized
tctacaaagatgttcactgtgg

SEQ ID NO: 701673 - DNA, 22 bp, Artificial Sequence
  chemically synthesized
atctacaaagatgttcactgtg

SEQ ID NO: 701674 - DNA, 22 bp, Artificial Sequence
  chemically synthesized
taagtaaggccacagtgaacat

SEQ ID NO: 701675 - DNA, 22 bp, Artificial Sequence
  chemically synthesized
agtaaggccacagtgaacatct

SEQ ID NO: 701676 - DNA, 22 bp, Artificial Sequence
  chemically synthesized
aaatatgtgcaaagatttatct

SEQ ID NO: 701677 - DNA, 22 bp, Artificial Sequence
  chemically synthesized
tgtagataaatctttgcacata

SEQ ID NO: 701678 - DNA, 22 bp, Artificial Sequence
  chemically synthesized
gtagataaatctttgcacatat

SEQ ID NO: 701679 - DNA, 22 bp, Artificial Sequence
  chemically synthesized
tagataaatctttgcacatatt

SEQ ID NO: 701680 - DNA, 22 bp, Artificial Sequence
  chemically synthesized
aaaaagtaactaaaatatgtgc

SEQ ID NO: 701681 - DNA, 22 bp, Artificial Sequence
  chemically synthesized
aaaaaagtaactaaaatatgtg

SEQ ID NO: 701682 - DNA, 22 bp, Artificial Sequence
  chemically synthesized
taaaaaagtaactaaaatatgt

SEQ ID NO: 701683 - DNA, 22 bp, Artificial Sequence
  chemically synthesized
ctttaaaaaagtaactaaaata

SEQ ID NO: 701684 - DNA, 22 bp, Artificial Sequence
  chemically synthesized
gctttaaaaaagtaactaaaat

SEQ ID NO: 701685 - DNA, 22 bp, Artificial Sequence
  chemically synthesized
tgctttaaaaaagtaactaaaa

SEQ ID NO: 701686 - DNA, 22 bp, Artificial Sequence
  chemically synthesized
tgcacatattttagttactttt

SEQ ID NO: 701687 - DNA, 22 bp, Artificial Sequence
  chemically synthesized
gcacatattttagttacttttt

SEQ ID NO: 701688 - DNA, 22 bp, Artificial Sequence
  chemically synthesized
cacatattttagttactttttt

SEQ ID NO: 701689 - DNA, 22 bp, Artificial Sequence
  chemically synthesized
ggaattttgctttaaaaaagta

SEQ ID NO: 701690 - DNA, 22 bp, Artificial Sequence
  chemically synthesized
taggaattttgctttaaaaaag

SEQ ID NO: 701691 - DNA, 22 bp, Artificial Sequence
  chemically synthesized
ctaggaattttgctttaaaaaa

SEQ ID NO: 701692 - DNA, 22 bp, Artificial Sequence
  chemically synthesized
tagttacttttttaaagcaaaa

SEQ ID NO: 701693 - DNA, 22 bp, Artificial Sequence
  chemically synthesized
agttacttttttaaagcaaaat

SEQ ID NO: 701694 - DNA, 22 bp, Artificial Sequence
  chemically synthesized
gttacttttttaaagcaaaatt

SEQ ID NO: 701695 - DNA, 22 bp, Artificial Sequence
  chemically synthesized
cttttttaaagcaaaattccta

SEQ ID NO: 701696 - DNA, 22 bp, Artificial Sequence
  chemically synthesized
ttttaaagcaaaattcctagaa

SEQ ID NO: 701697 - DNA, 22 bp, Artificial Sequence
  chemically synthesized
tttaaagcaaaattcctagaag

SEQ ID NO: 701698 - DNA, 22 bp, Artificial Sequence
  chemically synthesized
ttaaagcaaaattcctagaagt

SEQ ID NO: 701699 - DNA, 22 bp, Artificial Sequence
  chemically synthesized
taaagcaaaattcctagaagta

SEQ ID NO: 701700 - DNA, 22 bp, Artificial Sequence
  chemically synthesized
atcaagtaaatatacttctagg

SEQ ID NO: 701701 - DNA, 22 bp, Artificial Sequence
  chemically synthesized
aaagcaaaattcctagaagtat

SEQ ID NO: 701702 - DNA, 22 bp, Artificial Sequence
  chemically synthesized
aatcaagtaaatatacttctag

SEQ ID NO: 701703 - DNA, 22 bp, Artificial Sequence
  chemically synthesized
aagcaaaattcctagaagtata

SEQ ID NO: 701704 - DNA, 22 bp, Artificial Sequence
  chemically synthesized
taatcaagtaaatatacttcta

SEQ ID NO: 701705 - DNA, 22 bp, Artificial Sequence
  chemically synthesized
atagcctttaatcaagtaaata

SEQ ID NO: 701706 - DNA, 22 bp, Artificial Sequence
  chemically synthesized
ctagaagtatatttacttgatt

SEQ ID NO: 701707 - DNA, 22 bp, Artificial Sequence
  chemically synthesized
gaagtatatttacttgattaaa

SEQ ID NO: 701708 - DNA, 22 bp, Artificial Sequence
  chemically synthesized
aaacattcatagcctttaatca

SEQ ID NO: 701709 - DNA, 22 bp, Artificial Sequence
  chemically synthesized
aaaacattcatagcctttaatc

SEQ ID NO: 701710 - DNA, 22 bp, Artificial Sequence
  chemically synthesized
taaaacattcatagcctttaat

SEQ ID NO: 701711 - DNA, 22 bp, Artificial Sequence
  chemically synthesized
ttaaaacattcatagcctttaa

SEQ ID NO: 701712 - DNA, 22 bp, Artificial Sequence
  chemically synthesized
acttgattaaaggctatgaatg

SEQ ID NO: 701713 - DNA, 22 bp, Artificial Sequence
  chemically synthesized
cttgattaaaggctatgaatgt

SEQ ID NO: 701714 - DNA, 22 bp, Artificial Sequence
  chemically synthesized
gattaaaggctatgaatgtttt

SEQ ID NO: 701715 - DNA, 22 bp, Artificial Sequence
  chemically synthesized
attaaaggctatgaatgtttta

SEQ ID NO: 701716 - DNA, 22 bp, Artificial Sequence
  chemically synthesized
tgtaaaatgtttttaaaacatt

SEQ ID NO: 701717 - DNA, 22 bp, Artificial Sequence
  chemically synthesized
atgtaaaatgtttttaaaacat

SEQ ID NO: 701718 - DNA, 22 bp, Artificial Sequence
  chemically synthesized
aaggctatgaatgttttaaaaa

SEQ ID NO: 701719 - DNA, 22 bp, Artificial Sequence
  chemically synthesized
tgaatgttttaaaaacatttta

SEQ ID NO: 701720 - DNA, 22 bp, Artificial Sequence
  chemically synthesized
ccataagtgtaatttatgtaaa

SEQ ID NO: 701721 - DNA, 22 bp, Artificial Sequence
  chemically synthesized
taaaaacattttacataaatta

SEQ ID NO: 701722 - DNA, 22 bp, Artificial Sequence
  chemically synthesized
ctgccataagtgtaatttatgt

SEQ ID NO: 701723 - DNA, 22 bp, Artificial Sequence
  chemically synthesized
aaaaacattttacataaattac

SEQ ID NO: 701724 - DNA, 22 bp, Artificial Sequence
  chemically synthesized
aaaacattttacataaattaca

SEQ ID NO: 701725 - DNA, 22 bp, Artificial Sequence
  chemically synthesized
tgctgccataagtgtaatttat

SEQ ID NO: 701726 - DNA, 22 bp, Artificial Sequence
  chemically synthesized
ctgctgccataagtgtaattta

SEQ ID NO: 701727 - DNA, 22 bp, Artificial Sequence
  chemically synthesized
tacataaattacacttatggca

SEQ ID NO: 701728 - DNA, 22 bp, Artificial Sequence
  chemically synthesized
acataaattacacttatggcag

SEQ ID NO: 701729 - DNA, 22 bp, Artificial Sequence
  chemically synthesized
cataaattacacttatggcagc

SEQ ID NO: 701730 - DNA, 22 bp, Artificial Sequence
  chemically synthesized
cacttatggcagcagaagcctc

SEQ ID NO: 701731 - DNA, 22 bp, Artificial Sequence
  chemically synthesized
tatcaataaagagaggcttctg

SEQ ID NO: 701732 - DNA, 22 bp, Artificial Sequence
  chemically synthesized
atatcaataaagagaggcttct

SEQ ID NO: 701733 - DNA, 22 bp, Artificial Sequence
  chemically synthesized
atggcagcagaagcctctcttt

SEQ ID NO: 701734 - DNA, 22 bp, Artificial Sequence
  chemically synthesized
tggcagcagaagcctctcttta

SEQ ID NO: 701735 - DNA, 22 bp, Artificial Sequence
  chemically synthesized
cacttatatcaataaagagagg

SEQ ID NO: 701736 - DNA, 22 bp, Artificial Sequence
  chemically synthesized
acacttatatcaataaagagag

SEQ ID NO: 701737 - DNA, 22 bp, Artificial Sequence
  chemically synthesized
tacacttatatcaataaagaga

SEQ ID NO: 701738 - DNA, 22 bp, Artificial Sequence
  chemically synthesized
tttacacttatatcaataaaga

SEQ ID NO: 701739 - DNA, 22 bp, Artificial Sequence
  chemically synthesized
tctttacacttatatcaataaa

SEQ ID NO: 701740 - DNA, 22 bp, Artificial Sequence
  chemically synthesized
ctctttacacttatatcaataa

SEQ ID NO: 701741 - DNA, 22 bp, Artificial Sequence
  chemically synthesized
tctctttacacttatatcaata

SEQ ID NO: 701742 - DNA, 22 bp, Artificial Sequence
  chemically synthesized
ttctctttacacttatatcaat

SEQ ID NO: 701743 - DNA, 22 bp, Artificial Sequence
  chemically synthesized
atttttctctttacacttatat

SEQ ID NO: 701744 - DNA, 22 bp, Artificial Sequence
  chemically synthesized
tctttattgatataagtgtaaa

SEQ ID NO: 701745 - DNA, 22 bp, Artificial Sequence
  chemically synthesized
tttattgatataagtgtaaaga

SEQ ID NO: 701746 - DNA, 22 bp, Artificial Sequence
  chemically synthesized
tattgatataagtgtaaagaga

SEQ ID NO: 701747 - DNA, 22 bp, Artificial Sequence
  chemically synthesized
attgatataagtgtaaagagaa

SEQ ID NO: 701748 - DNA, 22 bp, Artificial Sequence
  chemically synthesized
ttgatataagtgtaaagagaaa

SEQ ID NO: 701749 - DNA, 22 bp, Artificial Sequence
  chemically synthesized
cagaaaattgatttttctcttt

SEQ ID NO: 701750 - DNA, 22 bp, Artificial Sequence
  chemically synthesized
atataagtgtaaagagaaaaat

SEQ ID NO: 701751 - DNA, 22 bp, Artificial Sequence
  chemically synthesized
acctgcagaaaattgatttttc

SEQ ID NO: 701752 - DNA, 22 bp, Artificial Sequence
  chemically synthesized
ttgacctgcagaaaattgattt

SEQ ID NO: 701753 - DNA, 22 bp, Artificial Sequence
  chemically synthesized
aatactattgacctgcagaaaa

SEQ ID NO: 701754 - DNA, 22 bp, Artificial Sequence
  chemically synthesized
tgccaactaaatactattgacc

SEQ ID NO: 701755 - DNA, 22 bp, Artificial Sequence
  chemically synthesized
tctgcaggtcaatagtatttag

SEQ ID NO: 701756 - DNA, 22 bp, Artificial Sequence
  chemically synthesized
ctgcaggtcaatagtatttagt

SEQ ID NO: 701757 - DNA, 22 bp, Artificial Sequence
  chemically synthesized
agaattatgccaactaaatact

SEQ ID NO: 701758 - DNA, 22 bp, Artificial Sequence
  chemically synthesized
tgcaggtcaatagtatttagtt

SEQ ID NO: 701759 - DNA, 22 bp, Artificial Sequence
  chemically synthesized
gagaattatgccaactaaatac

SEQ ID NO: 701760 - DNA, 22 bp, Artificial Sequence
  chemically synthesized
tgagaattatgccaactaaata

SEQ ID NO: 701761 - DNA, 22 bp, Artificial Sequence
  chemically synthesized
caggtcaatagtatttagttgg

SEQ ID NO: 701762 - DNA, 22 bp, Artificial Sequence
  chemically synthesized
ctttgagaattatgccaactaa

SEQ ID NO: 701763 - DNA, 22 bp, Artificial Sequence
  chemically synthesized
gctttgagaattatgccaacta

SEQ ID NO: 701764 - DNA, 22 bp, Artificial Sequence
  chemically synthesized
acttgctttgagaattatgcca

SEQ ID NO: 701765 - DNA, 22 bp, Artificial Sequence
  chemically synthesized
agttggcataattctcaaagca

SEQ ID NO: 701766 - DNA, 22 bp, Artificial Sequence
  chemically synthesized
gttggcataattctcaaagcaa

SEQ ID NO: 701767 - DNA, 22 bp, Artificial Sequence
  chemically synthesized
gcataattctcaaagcaagtta

SEQ ID NO: 701768 - DNA, 22 bp, Artificial Sequence
  chemically synthesized
tatcaagcagtatatctaactt

SEQ ID NO: 701769 - DNA, 22 bp, Artificial Sequence
  chemically synthesized
ctgtatcaagcagtatatctaa

SEQ ID NO: 701770 - DNA, 22 bp, Artificial Sequence
  chemically synthesized
tcaaagcaagttagatatactg

SEQ ID NO: 701771 - DNA, 22 bp, Artificial Sequence
  chemically synthesized
aaagcaagttagatatactgct

SEQ ID NO: 701772 - DNA, 22 bp, Artificial Sequence
  chemically synthesized
ccaaataatctactgtatcaag

SEQ ID NO: 701773 - DNA, 22 bp, Artificial Sequence
  chemically synthesized
gatatactgcttgatacagtag

SEQ ID NO: 701774 - DNA, 22 bp, Artificial Sequence
  chemically synthesized
cttgatacagtagattatttgg

SEQ ID NO: 701775 - DNA, 22 bp, Artificial Sequence
  chemically synthesized
gatacagtagattatttgggaa

SEQ ID NO: 701776 - DNA, 22 bp, Artificial Sequence
  chemically synthesized
atacagtagattatttgggaac

SEQ ID NO: 701777 - DNA, 22 bp, Artificial Sequence
  chemically synthesized
tttgggaacattcctctcacac

SEQ ID NO: 701778 - DNA, 22 bp, Artificial Sequence
  chemically synthesized
gggaacattcctctcacactct

SEQ ID NO: 701779 - DNA, 22 bp, Artificial Sequence
  chemically synthesized
ggaacattcctctcacactctc

SEQ ID NO: 701780 - DNA, 22 bp, Artificial Sequence
  chemically synthesized
tcaggggaagaggagagtgtga

SEQ ID NO: 701781 - DNA, 22 bp, Artificial Sequence
  chemically synthesized
cagtctatcaggggaagaggag

SEQ ID NO: 701782 - DNA, 22 bp, Artificial Sequence
  chemically synthesized
acagtctatcaggggaagagga

SEQ ID NO: 701783 - DNA, 22 bp, Artificial Sequence
  chemically synthesized
ctctcacactctcctcttcccc

SEQ ID NO: 701784 - DNA, 22 bp, Artificial Sequence
  chemically synthesized
tacagtctatcaggggaagagg

SEQ ID NO: 701785 - DNA, 22 bp, Artificial Sequence
  chemically synthesized
tcacactctcctcttcccctga

SEQ ID NO: 701786 - DNA, 22 bp, Artificial Sequence
  chemically synthesized
acactctcctcttcccctgata

SEQ ID NO: 701787 - DNA, 22 bp, Artificial Sequence
  chemically synthesized
agttttacagtctatcagggga

SEQ ID NO: 701788 - DNA, 22 bp, Artificial Sequence
  chemically synthesized
tgagttttacagtctatcaggg

SEQ ID NO: 701789 - DNA, 22 bp, Artificial Sequence
  chemically synthesized
tcctcttcccctgatagactgt

SEQ ID NO: 701790 - DNA, 22 bp, Artificial Sequence
  chemically synthesized
aactctgagttttacagtctat

SEQ ID NO: 701791 - DNA, 22 bp, Artificial Sequence
  chemically synthesized
ctcttcccctgatagactgtaa

SEQ ID NO: 701792 - DNA, 22 bp, Artificial Sequence
  chemically synthesized
taaactctgagttttacagtct

SEQ ID NO: 701793 - DNA, 22 bp, Artificial Sequence
  chemically synthesized
ctaaactctgagttttacagtc

SEQ ID NO: 701794 - DNA, 22 bp, Artificial Sequence
  chemically synthesized
ttcccctgatagactgtaaaac

SEQ ID NO: 701795 - DNA, 22 bp, Artificial Sequence
  chemically synthesized
tctaaactctgagttttacagt

SEQ ID NO: 701796 - DNA, 22 bp, Artificial Sequence
  chemically synthesized
cccctgatagactgtaaaactc

SEQ ID NO: 701797 - DNA, 22 bp, Artificial Sequence
  chemically synthesized
ccctgatagactgtaaaactca

SEQ ID NO: 701798 - DNA, 22 bp, Artificial Sequence
  chemically synthesized
atagactgtaaaactcagagtt

SEQ ID NO: 701799 - DNA, 22 bp, Artificial Sequence
  chemically synthesized
agtgcctttctaaactctgagt

SEQ ID NO: 701800 - DNA, 22 bp, Artificial Sequence
  chemically synthesized
taaaactcagagtttagaaagg

SEQ ID NO: 701801 - DNA, 22 bp, Artificial Sequence
  chemically synthesized
agagtttagaaaggcactcagg

SEQ ID NO: 701802 - DNA, 22 bp, Artificial Sequence
  chemically synthesized
aaatagaaagccaacatcctga

SEQ ID NO: 701803 - DNA, 22 bp, Artificial Sequence
  chemically synthesized
gaaatagaaagccaacatcctg

SEQ ID NO: 701804 - DNA, 22 bp, Artificial Sequence
  chemically synthesized
agaaaggcactcaggatgttgg

SEQ ID NO: 701805 - DNA, 22 bp, Artificial Sequence
  chemically synthesized
tgaaatagaaagccaacatcct

SEQ ID NO: 701806 - DNA, 22 bp, Artificial Sequence
  chemically synthesized
gaaaggcactcaggatgttggc

SEQ ID NO: 701807 - DNA, 22 bp, Artificial Sequence
  chemically synthesized
ggctttgaaatagaaagccaac

SEQ ID NO: 701808 - DNA, 22 bp, Artificial Sequence
  chemically synthesized
gattgggctttgaaatagaaag

SEQ ID NO: 701809 - DNA, 22 bp, Artificial Sequence
  chemically synthesized
aggatgttggctttctatttca

SEQ ID NO: 701810 - DNA, 22 bp, Artificial Sequence
  chemically synthesized
aagatgctggattgggctttga

SEQ ID NO: 701811 - DNA, 22 bp, Artificial Sequence
  chemically synthesized
gctttctatttcaaagcccaat

SEQ ID NO: 701812 - DNA, 22 bp, Artificial Sequence
  chemically synthesized
tcaagatgctggattgggcttt

SEQ ID NO: 701813 - DNA, 22 bp, Artificial Sequence
  chemically synthesized
tctatttcaaagcccaatccag

SEQ ID NO: 701814 - DNA, 22 bp, Artificial Sequence
  chemically synthesized
cctctcaagatgctggattggg

SEQ ID NO: 701815 - DNA, 22 bp, Artificial Sequence
  chemically synthesized
ctatttcaaagcccaatccagc

SEQ ID NO: 701816 - DNA, 22 bp, Artificial Sequence
  chemically synthesized
tatttcaaagcccaatccagca

SEQ ID NO: 701817 - DNA, 22 bp, Artificial Sequence
  chemically synthesized
tttcaaagcccaatccagcatc

SEQ ID NO: 701818 - DNA, 22 bp, Artificial Sequence
  chemically synthesized
caaagcccaatccagcatcttg

SEQ ID NO: 701819 - DNA, 22 bp, Artificial Sequence
  chemically synthesized
aaagcccaatccagcatcttga

SEQ ID NO: 701820 - DNA, 22 bp, Artificial Sequence
  chemically synthesized
tatccagctccctctcaagatg

SEQ ID NO: 701821 - DNA, 22 bp, Artificial Sequence
  chemically synthesized
ctatatccagctccctctcaag

SEQ ID NO: 701822 - DNA, 22 bp, Artificial Sequence
  chemically synthesized
tgctatatccagctccctctca

SEQ ID NO: 701823 - DNA, 22 bp, Artificial Sequence
  chemically synthesized
ctgctatatccagctccctctc

SEQ ID NO: 701824 - DNA, 22 bp, Artificial Sequence
  chemically synthesized
tctgctatatccagctccctct

SEQ ID NO: 701825 - DNA, 22 bp, Artificial Sequence
  chemically synthesized
gacattttctgctatatccagc

SEQ ID NO: 701826 - DNA, 22 bp, Artificial Sequence
  chemically synthesized
tggacattttctgctatatcca

SEQ ID NO: 701827 - DNA, 22 bp, Artificial Sequence
  chemically synthesized
gagagggagctggatatagcag

SEQ ID NO: 701828 - DNA, 22 bp, Artificial Sequence
  chemically synthesized
agagggagctggatatagcaga

SEQ ID NO: 701829 - DNA, 22 bp, Artificial Sequence
  chemically synthesized
tactctggacattttctgctat

SEQ ID NO: 701830 - DNA, 22 bp, Artificial Sequence
  chemically synthesized
aatctgtactctggacattttc

SEQ ID NO: 701831 - DNA, 22 bp, Artificial Sequence
  chemically synthesized
tgaatctgtactctggacattt

SEQ ID NO: 701832 - DNA, 22 bp, Artificial Sequence
  chemically synthesized
gatatagcagaaaatgtccaga

SEQ ID NO: 701833 - DNA, 22 bp, Artificial Sequence
  chemically synthesized
ctgaatctgtactctggacatt

SEQ ID NO: 701834 - DNA, 22 bp, Artificial Sequence
  chemically synthesized
ttctgaatctgtactctggaca

SEQ ID NO: 701835 - DNA, 22 bp, Artificial Sequence
  chemically synthesized
aaatccagttcttctgaatctg

SEQ ID NO: 701836 - DNA, 22 bp, Artificial Sequence
  chemically synthesized
agaagaactggatttgagtcct

SEQ ID NO: 701837 - DNA, 22 bp, Artificial Sequence
  chemically synthesized
gatttgagtcctgactccccta

SEQ ID NO: 701838 - DNA, 22 bp, Artificial Sequence
  chemically synthesized
agatcatgaagtgataggggag

SEQ ID NO: 701839 - DNA, 22 bp, Artificial Sequence
  chemically synthesized
aagatcatgaagtgatagggga

SEQ ID NO: 701840 - DNA, 22 bp, Artificial Sequence
  chemically synthesized
gagtcctgactcccctatcact

SEQ ID NO: 701841 - DNA, 22 bp, Artificial Sequence
  chemically synthesized
agtcctgactcccctatcactt

SEQ ID NO: 701842 - DNA, 22 bp, Artificial Sequence
  chemically synthesized
gcttaagatcatgaagtgatag

SEQ ID NO: 701843 - DNA, 22 bp, Artificial Sequence
  chemically synthesized
actcccctatcacttcatgatc

SEQ ID NO: 701844 - DNA, 22 bp, Artificial Sequence
  chemically synthesized
ccctatcacttcatgatcttaa

SEQ ID NO: 701845 - DNA, 22 bp, Artificial Sequence
  chemically synthesized
tcacttcatgatcttaagctag

SEQ ID NO: 701846 - DNA, 22 bp, Artificial Sequence
  chemically synthesized
ggcaggaaaaagactagcttaa

SEQ ID NO: 701847 - DNA, 22 bp, Artificial Sequence
  chemically synthesized
aggcaggaaaaagactagctta

SEQ ID NO: 701848 - DNA, 22 bp, Artificial Sequence
  chemically synthesized
catgatcttaagctagtctttt

SEQ ID NO: 701849 - DNA, 22 bp, Artificial Sequence
  chemically synthesized
atgatcttaagctagtcttttt

SEQ ID NO: 701850 - DNA, 22 bp, Artificial Sequence
  chemically synthesized
aagctagtctttttcctgccta

SEQ ID NO: 701851 - DNA, 22 bp, Artificial Sequence
  chemically synthesized
agctagtctttttcctgcctaa

SEQ ID NO: 701852 - DNA, 22 bp, Artificial Sequence
  chemically synthesized
gtctttttcctgcctaagcctt

SEQ ID NO: 701853 - DNA, 22 bp, Artificial Sequence
  chemically synthesized
gaatataaggaaaataaggctt

SEQ ID NO: 701854 - DNA, 22 bp, Artificial Sequence
  chemically synthesized
tttcctgcctaagccttatttt

SEQ ID NO: 701855 - DNA, 22 bp, Artificial Sequence
  chemically synthesized
ttcctgcctaagccttattttc

SEQ ID NO: 701856 - DNA, 22 bp, Artificial Sequence
  chemically synthesized
tcctgcctaagccttattttcc

SEQ ID NO: 701857 - DNA, 22 bp, Artificial Sequence
  chemically synthesized
cctgcctaagccttattttcct

SEQ ID NO: 701858 - DNA, 22 bp, Artificial Sequence
  chemically synthesized
ctgcctaagccttattttcctt

SEQ ID NO: 701859 - DNA, 22 bp, Artificial Sequence
  chemically synthesized
ccattggaatataaggaaaata

SEQ ID NO: 701860 - DNA, 22 bp, Artificial Sequence
  chemically synthesized
cctaagccttattttccttata

SEQ ID NO: 701861 - DNA, 22 bp, Artificial Sequence
  chemically synthesized
ttcccattggaatataaggaaa

SEQ ID NO: 701862 - DNA, 22 bp, Artificial Sequence
  chemically synthesized
agccttattttccttatattcc

SEQ ID NO: 701863 - DNA, 22 bp, Artificial Sequence
  chemically synthesized
attttccttatattccaatggg

SEQ ID NO: 701864 - DNA, 22 bp, Artificial Sequence
  chemically synthesized
ttttccttatattccaatggga

SEQ ID NO: 701865 - DNA, 22 bp, Artificial Sequence
  chemically synthesized
tccttatattccaatgggaata

SEQ ID NO: 701866 - DNA, 22 bp, Artificial Sequence
  chemically synthesized
ccttatattccaatgggaataa

SEQ ID NO: 701867 - DNA, 22 bp, Artificial Sequence
  chemically synthesized
cttatattccaatgggaataat

SEQ ID NO: 701868 - DNA, 22 bp, Artificial Sequence
  chemically synthesized
gtgagggagatatcattattcc

SEQ ID NO: 701869 - DNA, 22 bp, Artificial Sequence
  chemically synthesized
atattccaatgggaataatgat

SEQ ID NO: 701870 - DNA, 22 bp, Artificial Sequence
  chemically synthesized
ggtgagggagatatcattattc

SEQ ID NO: 701871 - DNA, 22 bp, Artificial Sequence
  chemically synthesized
tattccaatgggaataatgata

SEQ ID NO: 701872 - DNA, 22 bp, Artificial Sequence
  chemically synthesized
tggtgagggagatatcattatt

SEQ ID NO: 701873 - DNA, 22 bp, Artificial Sequence
  chemically synthesized
caatgggaataatgatatctcc

SEQ ID NO: 701874 - DNA, 22 bp, Artificial Sequence
  chemically synthesized
acaacattttggtgagggagat

SEQ ID NO: 701875 - DNA, 22 bp, Artificial Sequence
  chemically synthesized
tcctgacaacattttggtgagg

SEQ ID NO: 701876 - DNA, 22 bp, Artificial Sequence
  chemically synthesized
atcctgacaacattttggtgag

SEQ ID NO: 701877 - DNA, 22 bp, Artificial Sequence
  chemically synthesized
tatcctgacaacattttggtga

SEQ ID NO: 701878 - DNA, 22 bp, Artificial Sequence
  chemically synthesized
attttatcctgacaacattttg

SEQ ID NO: 701879 - DNA, 22 bp, Artificial Sequence
  chemically synthesized
ctcattttatcctgacaacatt

SEQ ID NO: 701880 - DNA, 22 bp, Artificial Sequence
  chemically synthesized
cctcattttatcctgacaacat

SEQ ID NO: 701881 - DNA, 22 bp, Artificial Sequence
  chemically synthesized
cctcaccaaaatgttgtcagga

SEQ ID NO: 701882 - DNA, 22 bp, Artificial Sequence
  chemically synthesized
atttcctcattttatcctgaca

SEQ ID NO: 701883 - DNA, 22 bp, Artificial Sequence
  chemically synthesized
accaaaatgttgtcaggataaa

SEQ ID NO: 701884 - DNA, 22 bp, Artificial Sequence
  chemically synthesized
atattgatttcctcattttatc

SEQ ID NO: 701885 - DNA, 22 bp, Artificial Sequence
  chemically synthesized
catattgatttcctcattttat

SEQ ID NO: 701886 - DNA, 22 bp, Artificial Sequence
  chemically synthesized
tcaggataaaatgaggaaatca

SEQ ID NO: 701887 - DNA, 22 bp, Artificial Sequence
  chemically synthesized
caaagcaatttcatattgattt

SEQ ID NO: 701888 - DNA, 22 bp, Artificial Sequence
  chemically synthesized
acaaagcaatttcatattgatt

SEQ ID NO: 701889 - DNA, 22 bp, Artificial Sequence
  chemically synthesized
tacaaagcaatttcatattgat

SEQ ID NO: 701890 - DNA, 22 bp, Artificial Sequence
  chemically synthesized
acattttacaaagcaatttcat

SEQ ID NO: 701891 - DNA, 22 bp, Artificial Sequence
  chemically synthesized
tgtggtgattaacattttacaa

SEQ ID NO: 701892 - DNA, 22 bp, Artificial Sequence
  chemically synthesized
gtgtggtgattaacattttaca

SEQ ID NO: 701893 - DNA, 22 bp, Artificial Sequence
  chemically synthesized
tttgtgtggtgattaacatttt

SEQ ID NO: 701894 - DNA, 22 bp, Artificial Sequence
  chemically synthesized
ctttgtaaaatgttaatcacca

SEQ ID NO: 701895 - DNA, 22 bp, Artificial Sequence
  chemically synthesized
tgtaaaatgttaatcaccacac

SEQ ID NO: 701896 - DNA, 22 bp, Artificial Sequence
  chemically synthesized
caaacattatttgtgtggtgat

SEQ ID NO: 701897 - DNA, 22 bp, Artificial Sequence
  chemically synthesized
gtaaaatgttaatcaccacaca

SEQ ID NO: 701898 - DNA, 22 bp, Artificial Sequence
  chemically synthesized
taaaatgttaatcaccacacaa

SEQ ID NO: 701899 - DNA, 22 bp, Artificial Sequence
  chemically synthesized
tgtgattacaaacattatttgt

SEQ ID NO: 701900 - DNA, 22 bp, Artificial Sequence
  chemically synthesized
atcaccacacaaataatgtttg

SEQ ID NO: 701901 - DNA, 22 bp, Artificial Sequence
  chemically synthesized
agacaacacatcatagctatgt

SEQ ID NO: 701902 - DNA, 22 bp, Artificial Sequence
  chemically synthesized
gtaatcacatagctatgatgtg

SEQ ID NO: 701903 - DNA, 22 bp, Artificial Sequence
  chemically synthesized
taatcacatagctatgatgtgt

SEQ ID NO: 701904 - DNA, 22 bp, Artificial Sequence
  chemically synthesized
accatcattcagacaacacatc

SEQ ID NO: 701905 - DNA, 22 bp, Artificial Sequence
  chemically synthesized
cacaattaaccatcattcagac

SEQ ID NO: 701906 - DNA, 22 bp, Artificial Sequence
  chemically synthesized
tgatgtgttgtctgaatgatgg

SEQ ID NO: 701907 - DNA, 22 bp, Artificial Sequence
  chemically synthesized
gttccacaattaaccatcattc

SEQ ID NO: 701908 - DNA, 22 bp, Artificial Sequence
  chemically synthesized
tctgaatgatggttaattgtgg

SEQ ID NO: 701909 - DNA, 22 bp, Artificial Sequence
  chemically synthesized
aatgatggttaattgtggaacc

SEQ ID NO: 701910 - DNA, 22 bp, Artificial Sequence
  chemically synthesized
cccaggtgagagagaaagaatt

SEQ ID NO: 701911 - DNA, 22 bp, Artificial Sequence
  chemically synthesized
attgtggaaccaattctttctc

SEQ ID NO: 701912 - DNA, 22 bp, Artificial Sequence
  chemically synthesized
tggaaccaattctttctctctc

SEQ ID NO: 701913 - DNA, 22 bp, Artificial Sequence
  chemically synthesized
cagataaatgctgcccaggtga

SEQ ID NO: 701914 - DNA, 22 bp, Artificial Sequence
  chemically synthesized
tttctctctcacctgggcagca

SEQ ID NO: 701915 - DNA, 22 bp, Artificial Sequence
  chemically synthesized
tctctctcacctgggcagcatt

SEQ ID NO: 701916 - DNA, 22 bp, Artificial Sequence
  chemically synthesized
ctctctcacctgggcagcattt

SEQ ID NO: 701917 - DNA, 22 bp, Artificial Sequence
  chemically synthesized
aaggctgcagataaatgctgcc

SEQ ID NO: 701918 - DNA, 22 bp, Artificial Sequence
  chemically synthesized
tctctcacctgggcagcattta

SEQ ID NO: 701919 - DNA, 22 bp, Artificial Sequence
  chemically synthesized
tctcacctgggcagcatttatc

SEQ ID NO: 701920 - DNA, 22 bp, Artificial Sequence
  chemically synthesized
tcacctgggcagcatttatctg

SEQ ID NO: 701921 - DNA, 22 bp, Artificial Sequence
  chemically synthesized
acctgggcagcatttatctgca

SEQ ID NO: 701922 - DNA, 22 bp, Artificial Sequence
  chemically synthesized
ggagtggattcaaggctgcaga

SEQ ID NO: 701923 - DNA, 22 bp, Artificial Sequence
  chemically synthesized
ggcagcatttatctgcagcctt

SEQ ID NO: 701924 - DNA, 22 bp, Artificial Sequence
  chemically synthesized
acagtagttaggagtggattca

SEQ ID NO: 701925 - DNA, 22 bp, Artificial Sequence
  chemically synthesized
atctgcagccttgaatccactc

SEQ ID NO: 701926 - DNA, 22 bp, Artificial Sequence
  chemically synthesized
tctgcagccttgaatccactcc

SEQ ID NO: 701927 - DNA, 22 bp, Artificial Sequence
  chemically synthesized
cagccttgaatccactcctaac

SEQ ID NO: 701928 - DNA, 22 bp, Artificial Sequence
  chemically synthesized
gaatccactcctaactactgtt

SEQ ID NO: 701929 - DNA, 22 bp, Artificial Sequence
  chemically synthesized
aatccactcctaactactgtta

SEQ ID NO: 701930 - DNA, 22 bp, Artificial Sequence
  chemically synthesized
catgtggcacattaacagtagt

SEQ ID NO: 701931 - DNA, 22 bp, Artificial Sequence
  chemically synthesized
tactacatgtggcacattaaca

SEQ ID NO: 701932 - DNA, 22 bp, Artificial Sequence
  chemically synthesized
atactacatgtggcacattaac

SEQ ID NO: 701933 - DNA, 22 bp, Artificial Sequence
  chemically synthesized
tatactacatgtggcacattaa

SEQ ID NO: 701934 - DNA, 22 bp, Artificial Sequence
  chemically synthesized
ctaactactgttaatgtgccac

SEQ ID NO: 701935 - DNA, 22 bp, Artificial Sequence
  chemically synthesized
actactgttaatgtgccacatg

SEQ ID NO: 701936 - DNA, 22 bp, Artificial Sequence
  chemically synthesized
ccatactttatactacatgtgg

SEQ ID NO: 701937 - DNA, 22 bp, Artificial Sequence
  chemically synthesized
ctgttaatgtgccacatgtagt

SEQ ID NO: 701938 - DNA, 22 bp, Artificial Sequence
  chemically synthesized
tgccatactttatactacatgt

SEQ ID NO: 701939 - DNA, 22 bp, Artificial Sequence
  chemically synthesized
ttaatgtgccacatgtagtata

SEQ ID NO: 701940 - DNA, 22 bp, Artificial Sequence
  chemically synthesized
tctgccatactttatactacat

SEQ ID NO: 701941 - DNA, 22 bp, Artificial Sequence
  chemically synthesized
tctctgccatactttatactac

SEQ ID NO: 701942 - DNA, 22 bp, Artificial Sequence
  chemically synthesized
atgtgccacatgtagtataaag

SEQ ID NO: 701943 - DNA, 22 bp, Artificial Sequence
  chemically synthesized
ctctctgccatactttatacta

SEQ ID NO: 701944 - DNA, 22 bp, Artificial Sequence
  chemically synthesized
aaaggcatttctctctgccata

SEQ ID NO: 701945 - DNA, 22 bp, Artificial Sequence
  chemically synthesized
ttcaaaggcatttctctctgcc

SEQ ID NO: 701946 - DNA, 22 bp, Artificial Sequence
  chemically synthesized
gatactattcaaaggcatttct

SEQ ID NO: 701947 - DNA, 22 bp, Artificial Sequence
  chemically synthesized
tgaatagtatctaactgcctgg

SEQ ID NO: 701948 - DNA, 22 bp, Artificial Sequence
  chemically synthesized
gaatagtatctaactgcctggg

SEQ ID NO: 701949 - DNA, 22 bp, Artificial Sequence
  chemically synthesized
aatagtatctaactgcctgggc

SEQ ID NO: 701950 - DNA, 22 bp, Artificial Sequence
  chemically synthesized
actgcctgggcttatggtactt

SEQ ID NO: 701951 - DNA, 22 bp, Artificial Sequence
  chemically synthesized
cctgggcttatggtacttcttt

SEQ ID NO: 701952 - DNA, 22 bp, Artificial Sequence
  chemically synthesized
ggcttatggtacttctttctac

SEQ ID NO: 701953 - DNA, 22 bp, Artificial Sequence
  chemically synthesized
ggaagacagagatgtagaaaga

SEQ ID NO: 701954 - DNA, 22 bp, Artificial Sequence
  chemically synthesized
atggtacttctttctacatctc

SEQ ID NO: 701955 - DNA, 22 bp, Artificial Sequence
  chemically synthesized
tggtacttctttctacatctct

SEQ ID NO: 701956 - DNA, 22 bp, Artificial Sequence
  chemically synthesized
gtctaggaagacagagatgtag

SEQ ID NO: 701957 - DNA, 22 bp, Artificial Sequence
  chemically synthesized
ctttctacatctctgtcttcct

SEQ ID NO: 701958 - DNA, 22 bp, Artificial Sequence
  chemically synthesized
tttctacatctctgtcttccta

SEQ ID NO: 701959 - DNA, 22 bp, Artificial Sequence
  chemically synthesized
tctacatctctgtcttcctaga

SEQ ID NO: 701960 - DNA, 22 bp, Artificial Sequence
  chemically synthesized
ctacatctctgtcttcctagac

SEQ ID NO: 701961 - DNA, 22 bp, Artificial Sequence
  chemically synthesized
tacatctctgtcttcctagacc

SEQ ID NO: 701962 - DNA, 22 bp, Artificial Sequence
  chemically synthesized
tatagatgtcattggtctagga

SEQ ID NO: 701963 - DNA, 22 bp, Artificial Sequence
  chemically synthesized
catctctgtcttcctagaccaa

SEQ ID NO: 701964 - DNA, 22 bp, Artificial Sequence
  chemically synthesized
ttgtatagatgtcattggtcta

SEQ ID NO: 701965 - DNA, 22 bp, Artificial Sequence
  chemically synthesized
tgtcttcctagaccaatgacat

SEQ ID NO: 701966 - DNA, 22 bp, Artificial Sequence
  chemically synthesized
tcttcctagaccaatgacatct

SEQ ID NO: 701967 - DNA, 22 bp, Artificial Sequence
  chemically synthesized
cctagaccaatgacatctatac

SEQ ID NO: 701968 - DNA, 22 bp, Artificial Sequence
  chemically synthesized
ctagaccaatgacatctataca

SEQ ID NO: 701969 - DNA, 22 bp, Artificial Sequence
  chemically synthesized
gaccaatgacatctatacaaca

SEQ ID NO: 701970 - DNA, 22 bp, Artificial Sequence
  chemically synthesized
agaatgaaagatctgttgtata

SEQ ID NO: 701971 - DNA, 22 bp, Artificial Sequence
  chemically synthesized
gctaagaatgaaagatctgttg

SEQ ID NO: 701972 - DNA, 22 bp, Artificial Sequence
  chemically synthesized
tacaacagatctttcattctta

SEQ ID NO: 701973 - DNA, 22 bp, Artificial Sequence
  chemically synthesized
tcattcttagctagaccattta

SEQ ID NO: 701974 - DNA, 22 bp, Artificial Sequence
  chemically synthesized
atgaatggtggataaatggtct

SEQ ID NO: 701975 - DNA, 22 bp, Artificial Sequence
  chemically synthesized
cattcttagctagaccatttat

SEQ ID NO: 701976 - DNA, 22 bp, Artificial Sequence
  chemically synthesized
attcttagctagaccatttatc

SEQ ID NO: 701977 - DNA, 22 bp, Artificial Sequence
  chemically synthesized
ttagctagaccatttatccacc

SEQ ID NO: 701978 - DNA, 22 bp, Artificial Sequence
  chemically synthesized
atgctgatgaatggtggataaa

SEQ ID NO: 701979 - DNA, 22 bp, Artificial Sequence
  chemically synthesized
agctagaccatttatccaccat

SEQ ID NO: 701980 - DNA, 22 bp, Artificial Sequence
  chemically synthesized
gctagaccatttatccaccatt

SEQ ID NO: 701981 - DNA, 22 bp, Artificial Sequence
  chemically synthesized
tcattcatgctgatgaatggtg

SEQ ID NO: 701982 - DNA, 22 bp, Artificial Sequence
  chemically synthesized
gaccatttatccaccattcatc

SEQ ID NO: 701983 - DNA, 22 bp, Artificial Sequence
  chemically synthesized
atcattcatgctgatgaatggt

SEQ ID NO: 701984 - DNA, 22 bp, Artificial Sequence
  chemically synthesized
tttatcattcatgctgatgaat

SEQ ID NO: 701985 - DNA, 22 bp, Artificial Sequence
  chemically synthesized
atccaccattcatcagcatgaa

SEQ ID NO: 701986 - DNA, 22 bp, Artificial Sequence
  chemically synthesized
atctgtttatcattcatgctga

SEQ ID NO: 701987 - DNA, 22 bp, Artificial Sequence
  chemically synthesized
tccaccattcatcagcatgaat

SEQ ID NO: 701988 - DNA, 22 bp, Artificial Sequence
  chemically synthesized
atcagcatgaatgataaacaga

SEQ ID NO: 701989 - DNA, 22 bp, Artificial Sequence
  chemically synthesized
cataaaatatagactaatctgt

SEQ ID NO: 701990 - DNA, 22 bp, Artificial Sequence
  chemically synthesized
actgcataaaatatagactaat

SEQ ID NO: 701991 - DNA, 22 bp, Artificial Sequence
  chemically synthesized
cactgcataaaatatagactaa

SEQ ID NO: 701992 - DNA, 22 bp, Artificial Sequence
  chemically synthesized
tcactgcataaaatatagacta

SEQ ID NO: 701993 - DNA, 22 bp, Artificial Sequence
  chemically synthesized
attttcactgcataaaatatag

SEQ ID NO: 701994 - DNA, 22 bp, Artificial Sequence
  chemically synthesized
tgattttcactgcataaaatat

SEQ ID NO: 701995 - DNA, 22 bp, Artificial Sequence
  chemically synthesized
gtctatattttatgcagtgaaa

SEQ ID NO: 701996 - DNA, 22 bp, Artificial Sequence
  chemically synthesized
tgggcctctgattttcactgca

SEQ ID NO: 701997 - DNA, 22 bp, Artificial Sequence
  chemically synthesized
tattttatgcagtgaaaatcag

SEQ ID NO: 701998 - DNA, 22 bp, Artificial Sequence
  chemically synthesized
atcagtctatgggcctctgatt

SEQ ID NO: 701999 - DNA, 22 bp, Artificial Sequence
  chemically synthesized
tatgcagtgaaaatcagaggcc

SEQ ID NO: 702000 - DNA, 22 bp, Artificial Sequence
  chemically synthesized
atgcagtgaaaatcagaggccc

SEQ ID NO: 702001 - DNA, 22 bp, Artificial Sequence
  chemically synthesized
tgcagtgaaaatcagaggccca

SEQ ID NO: 702002 - DNA, 22 bp, Artificial Sequence
  chemically synthesized
ccaaatgctaatcagtctatgg

SEQ ID NO: 702003 - DNA, 22 bp, Artificial Sequence
  chemically synthesized
atgattgccaaatgctaatcag

SEQ ID NO: 702004 - DNA, 22 bp, Artificial Sequence
  chemically synthesized
ttcatgattgccaaatgctaat

SEQ ID NO: 702005 - DNA, 22 bp, Artificial Sequence
  chemically synthesized
attcatgattgccaaatgctaa

SEQ ID NO: 702006 - DNA, 22 bp, Artificial Sequence
  chemically synthesized
tattcatgattgccaaatgcta

SEQ ID NO: 702007 - DNA, 22 bp, Artificial Sequence
  chemically synthesized
attagcatttggcaatcatgaa

SEQ ID NO: 702008 - DNA, 22 bp, Artificial Sequence
  chemically synthesized
ataccagctttattcatgattg

SEQ ID NO: 702009 - DNA, 22 bp, Artificial Sequence
  chemically synthesized
gcatttggcaatcatgaataaa

SEQ ID NO: 702010 - DNA, 22 bp, Artificial Sequence
  chemically synthesized
ggcaatcatgaataaagctggt

SEQ ID NO: 702011 - DNA, 22 bp, Artificial Sequence
  chemically synthesized
gcaatcatgaataaagctggta

SEQ ID NO: 702012 - DNA, 22 bp, Artificial Sequence
  chemically synthesized
tacacaaatgttgataccagct

SEQ ID NO: 702013 - DNA, 22 bp, Artificial Sequence
  chemically synthesized
atgcaaatacctgtacacaaat

SEQ ID NO: 702014 - DNA, 22 bp, Artificial Sequence
  chemically synthesized
gtatcaacatttgtgtacaggt

SEQ ID NO: 702015 - DNA, 22 bp, Artificial Sequence
  chemically synthesized
tgctgatgcaaatacctgtaca

SEQ ID NO: 702016 - DNA, 22 bp, Artificial Sequence
  chemically synthesized
atgctgatgcaaatacctgtac

SEQ ID NO: 702017 - DNA, 22 bp, Artificial Sequence
  chemically synthesized
gtgtacaggtatttgcatcagc

SEQ ID NO: 702018 - DNA, 22 bp, Artificial Sequence
  chemically synthesized
tgtacaggtatttgcatcagca

SEQ ID NO: 702019 - DNA, 22 bp, Artificial Sequence
  chemically synthesized
agtgaaaagaaccaaacttatg

SEQ ID NO: 702020 - DNA, 22 bp, Artificial Sequence
  chemically synthesized
cagtgaaaagaaccaaacttat

SEQ ID NO: 702021 - DNA, 22 bp, Artificial Sequence
  chemically synthesized
gcatcagcataagtttggttct

SEQ ID NO: 702022 - DNA, 22 bp, Artificial Sequence
  chemically synthesized
catcagcataagtttggttctt

SEQ ID NO: 702023 - DNA, 22 bp, Artificial Sequence
  chemically synthesized
catttcagtgaaaagaaccaaa

SEQ ID NO: 702024 - DNA, 22 bp, Artificial Sequence
  chemically synthesized
gcatttcagtgaaaagaaccaa

SEQ ID NO: 702025 - DNA, 22 bp, Artificial Sequence
  chemically synthesized
acttgcatttcagtgaaaagaa

SEQ ID NO: 702026 - DNA, 22 bp, Artificial Sequence
  chemically synthesized
cacttgcatttcagtgaaaaga

SEQ ID NO: 702027 - DNA, 22 bp, Artificial Sequence
  chemically synthesized
tcacttgcatttcagtgaaaag

SEQ ID NO: 702028 - DNA, 22 bp, Artificial Sequence
  chemically synthesized
tcctttcacttgcatttcagtg

SEQ ID NO: 702029 - DNA, 22 bp, Artificial Sequence
  chemically synthesized
gtcctttcacttgcatttcagt

SEQ ID NO: 702030 - DNA, 22 bp, Artificial Sequence
  chemically synthesized
ggttcttttcactgaaatgcaa

SEQ ID NO: 702031 - DNA, 22 bp, Artificial Sequence
  chemically synthesized
gttcttttcactgaaatgcaag

SEQ ID NO: 702032 - DNA, 22 bp, Artificial Sequence
  chemically synthesized
ttttcactgaaatgcaagtgaa

SEQ ID NO: 702033 - DNA, 22 bp, Artificial Sequence
  chemically synthesized
tggtcttgtcctttcacttgca

SEQ ID NO: 702034 - DNA, 22 bp, Artificial Sequence
  chemically synthesized
atggtcttgtcctttcacttgc

SEQ ID NO: 702035 - DNA, 22 bp, Artificial Sequence
  chemically synthesized
ttcactgaaatgcaagtgaaag

SEQ ID NO: 702036 - DNA, 22 bp, Artificial Sequence
  chemically synthesized
tcactgaaatgcaagtgaaagg

SEQ ID NO: 702037 - DNA, 22 bp, Artificial Sequence
  chemically synthesized
cactgaaatgcaagtgaaagga

SEQ ID NO: 702038 - DNA, 22 bp, Artificial Sequence
  chemically synthesized
actgaaatgcaagtgaaaggac

SEQ ID NO: 702039 - DNA, 22 bp, Artificial Sequence
  chemically synthesized
gtacttatggtcttgtcctttc

SEQ ID NO: 702040 - DNA, 22 bp, Artificial Sequence
  chemically synthesized
aaatgcaagtgaaaggacaaga

SEQ ID NO: 702041 - DNA, 22 bp, Artificial Sequence
  chemically synthesized
tagtacttatggtcttgtcctt

SEQ ID NO: 702042 - DNA, 22 bp, Artificial Sequence
  chemically synthesized
tgattctagtacttatggtctt

SEQ ID NO: 702043 - DNA, 22 bp, Artificial Sequence
  chemically synthesized
ctatgattctagtacttatggt

SEQ ID NO: 702044 - DNA, 22 bp, Artificial Sequence
  chemically synthesized
atagcatctgctatgattctag

SEQ ID NO: 702045 - DNA, 22 bp, Artificial Sequence
  chemically synthesized
tcatagcatctgctatgattct

SEQ ID NO: 702046 - DNA, 22 bp, Artificial Sequence
  chemically synthesized
gaatcatagcagatgctatgag

SEQ ID NO: 702047 - DNA, 22 bp, Artificial Sequence
  chemically synthesized
aagagtccagccattctcatag

SEQ ID NO: 702048 - DNA, 22 bp, Artificial Sequence
  chemically synthesized
aaagagtccagccattctcata

SEQ ID NO: 702049 - DNA, 22 bp, Artificial Sequence
  chemically synthesized
cttaaagagtccagccattctc

SEQ ID NO: 702050 - DNA, 22 bp, Artificial Sequence
  chemically synthesized
ccttaaagagtccagccattct

SEQ ID NO: 702051 - DNA, 22 bp, Artificial Sequence
  chemically synthesized
cttccttaaagagtccagccat

SEQ ID NO: 702052 - DNA, 22 bp, Artificial Sequence
  chemically synthesized
ccttccttaaagagtccagcca

SEQ ID NO: 702053 - DNA, 22 bp, Artificial Sequence
  chemically synthesized
tgagaatggctggactctttaa

SEQ ID NO: 702054 - DNA, 22 bp, Artificial Sequence
  chemically synthesized
tacgatcttccttccttaaaga

SEQ ID NO: 702055 - DNA, 22 bp, Artificial Sequence
  chemically synthesized
gtacgatcttccttccttaaag

SEQ ID NO: 702056 - DNA, 22 bp, Artificial Sequence
  chemically synthesized
tgtacgatcttccttccttaaa

SEQ ID NO: 702057 - DNA, 22 bp, Artificial Sequence
  chemically synthesized
tttgtacgatcttccttcctta

SEQ ID NO: 702058 - DNA, 22 bp, Artificial Sequence
  chemically synthesized
tctttgtacgatcttccttcct

SEQ ID NO: 702059 - DNA, 22 bp, Artificial Sequence
  chemically synthesized
gactctttaaggaaggaagatc

SEQ ID NO: 702060 - DNA, 22 bp, Artificial Sequence
  chemically synthesized
tttaaggaaggaagatcgtaca

SEQ ID NO: 702061 - DNA, 22 bp, Artificial Sequence
  chemically synthesized
taaggaaggaagatcgtacaaa

SEQ ID NO: 702062 - DNA, 22 bp, Artificial Sequence
  chemically synthesized
aaggaaggaagatcgtacaaag

SEQ ID NO: 702063 - DNA, 22 bp, Artificial Sequence
  chemically synthesized
aggaaggaagatcgtacaaaga

SEQ ID NO: 702064 - DNA, 22 bp, Artificial Sequence
  chemically synthesized
tatgaaaatgtggtgtatacat

SEQ ID NO: 702065 - DNA, 22 bp, Artificial Sequence
  chemically synthesized
cattgtatgaaaatgtggtgta

SEQ ID NO: 702066 - DNA, 22 bp, Artificial Sequence
  chemically synthesized
catgtatacaccacattttcat

SEQ ID NO: 702067 - DNA, 22 bp, Artificial Sequence
  chemically synthesized
aatggtattccattgtatgaaa

SEQ ID NO: 702068 - DNA, 22 bp, Artificial Sequence
  chemically synthesized
atgctgaatggtattccattgt

SEQ ID NO: 702069 - DNA, 22 bp, Artificial Sequence
  chemically synthesized
aatgctgaatggtattccattg

SEQ ID NO: 702070 - DNA, 22 bp, Artificial Sequence
  chemically synthesized
taatgctgaatggtattccatt

SEQ ID NO: 702071 - DNA, 22 bp, Artificial Sequence
  chemically synthesized
ttaatgctgaatggtattccat

SEQ ID NO: 702072 - DNA, 22 bp, Artificial Sequence
  chemically synthesized
tttaatgctgaatggtattcca

SEQ ID NO: 702073 - DNA, 22 bp, Artificial Sequence
  chemically synthesized
ttttaatgctgaatggtattcc

SEQ ID NO: 702074 - DNA, 22 bp, Artificial Sequence
  chemically synthesized
tttttaatgctgaatggtattc

SEQ ID NO: 702075 - DNA, 22 bp, Artificial Sequence
  chemically synthesized
ttttttaatgctgaatggtatt

SEQ ID NO: 702076 - DNA, 22 bp, Artificial Sequence
  chemically synthesized
tcatacaatggaataccattca

SEQ ID NO: 702077 - DNA, 22 bp, Artificial Sequence
  chemically synthesized
catacaatggaataccattcag

SEQ ID NO: 702078 - DNA, 22 bp, Artificial Sequence
  chemically synthesized
ttttttttaatgctgaatggta

SEQ ID NO: 702079 - DNA, 22 bp, Artificial Sequence
  chemically synthesized
atacaatggaataccattcagc

SEQ ID NO: 702080 - DNA, 22 bp, Artificial Sequence
  chemically synthesized
cttttttttaatgctgaatggt

SEQ ID NO: 702081 - DNA, 22 bp, Artificial Sequence
  chemically synthesized
agcattaaaaaaaagaaggttc

SEQ ID NO: 702082 - DNA, 22 bp, Artificial Sequence
  chemically synthesized
tcaccaatggtaggaaccttct

SEQ ID NO: 702083 - DNA, 22 bp, Artificial Sequence
  chemically synthesized
aaaaaaagaaggttcctaccat

SEQ ID NO: 702084 - DNA, 22 bp, Artificial Sequence
  chemically synthesized
caaggcccatccacattgtcac

SEQ ID NO: 702085 - DNA, 22 bp, Artificial Sequence
  chemically synthesized
ctaccattggtgacaatgtgga

SEQ ID NO: 702086 - DNA, 22 bp, Artificial Sequence
  chemically synthesized
ccattggtgacaatgtggatgg

SEQ ID NO: 702087 - DNA, 22 bp, Artificial Sequence
  chemically synthesized
agcatgtctgcaaggcccatcc

SEQ ID NO: 702088 - DNA, 22 bp, Artificial Sequence
  chemically synthesized
gtgacaatgtggatgggccttg

SEQ ID NO: 702089 - DNA, 22 bp, Artificial Sequence
  chemically synthesized
actgagcatgtctgcaaggccc

SEQ ID NO: 702090 - DNA, 22 bp, Artificial Sequence
  chemically synthesized
cactgagcatgtctgcaaggcc

SEQ ID NO: 702091 - DNA, 22 bp, Artificial Sequence
  chemically synthesized
tttcactgagcatgtctgcaag

SEQ ID NO: 702092 - DNA, 22 bp, Artificial Sequence
  chemically synthesized
atttcactgagcatgtctgcaa

SEQ ID NO: 702093 - DNA, 22 bp, Artificial Sequence
  chemically synthesized
gcttatttcactgagcatgtct

SEQ ID NO: 702094 - DNA, 22 bp, Artificial Sequence
  chemically synthesized
tgactggcttatttcactgagc

SEQ ID NO: 702095 - DNA, 22 bp, Artificial Sequence
  chemically synthesized
tatgactggcttatttcactga

SEQ ID NO: 702096 - DNA, 22 bp, Artificial Sequence
  chemically synthesized
ctatgactggcttatttcactg

SEQ ID NO: 702097 - DNA, 22 bp, Artificial Sequence
  chemically synthesized
gcagacatgctcagtgaaataa

SEQ ID NO: 702098 - DNA, 22 bp, Artificial Sequence
  chemically synthesized
cagacatgctcagtgaaataag

SEQ ID NO: 702099 - DNA, 22 bp, Artificial Sequence
  chemically synthesized
tccttctatgactggcttattt

SEQ ID NO: 702100 - DNA, 22 bp, Artificial Sequence
  chemically synthesized
atccttctatgactggcttatt

SEQ ID NO: 702101 - DNA, 22 bp, Artificial Sequence
  chemically synthesized
agtgaaataagccagtcataga

SEQ ID NO: 702102 - DNA, 22 bp, Artificial Sequence
  chemically synthesized
ataaaagtggagtcatacagca

SEQ ID NO: 702103 - DNA, 22 bp, Artificial Sequence
  chemically synthesized
cataaaagtggagtcatacagc

SEQ ID NO: 702104 - DNA, 22 bp, Artificial Sequence
  chemically synthesized
agacacttcataaaagtggagt

SEQ ID NO: 702105 - DNA, 22 bp, Artificial Sequence
  chemically synthesized
cagacacttcataaaagtggag

SEQ ID NO: 702106 - DNA, 22 bp, Artificial Sequence
  chemically synthesized
tttcagacacttcataaaagtg

SEQ ID NO: 702107 - DNA, 22 bp, Artificial Sequence
  chemically synthesized
tatgactccacttttatgaagt

SEQ ID NO: 702108 - DNA, 22 bp, Artificial Sequence
  chemically synthesized
actatttcagacacttcataaa

SEQ ID NO: 702109 - DNA, 22 bp, Artificial Sequence
  chemically synthesized
cacttttatgaagtgtctgaaa

SEQ ID NO: 702110 - DNA, 22 bp, Artificial Sequence
  chemically synthesized
tgaggttgactatttcagacac

SEQ ID NO: 702111 - DNA, 22 bp, Artificial Sequence
  chemically synthesized
tatgaggttgactatttcagac

SEQ ID NO: 702112 - DNA, 22 bp, Artificial Sequence
  chemically synthesized
ctatgaggttgactatttcaga

SEQ ID NO: 702113 - DNA, 22 bp, Artificial Sequence
  chemically synthesized
ttatgaagtgtctgaaatagtc

SEQ ID NO: 702114 - DNA, 22 bp, Artificial Sequence
  chemically synthesized
tatgaagtgtctgaaatagtca

SEQ ID NO: 702115 - DNA, 22 bp, Artificial Sequence
  chemically synthesized
cttctatgaggttgactatttc

SEQ ID NO: 702116 - DNA, 22 bp, Artificial Sequence
  chemically synthesized
atgaagtgtctgaaatagtcaa

SEQ ID NO: 702117 - DNA, 22 bp, Artificial Sequence
  chemically synthesized
tgaagtgtctgaaatagtcaac

SEQ ID NO: 702118 - DNA, 22 bp, Artificial Sequence
  chemically synthesized
ctgcttctatgaggttgactat

SEQ ID NO: 702119 - DNA, 22 bp, Artificial Sequence
  chemically synthesized
actgcttctatgaggttgacta

SEQ ID NO: 702120 - DNA, 22 bp, Artificial Sequence
  chemically synthesized
tttactgcttctatgaggttga

SEQ ID NO: 702121 - DNA, 22 bp, Artificial Sequence
  chemically synthesized
tatttactgcttctatgaggtt

SEQ ID NO: 702122 - DNA, 22 bp, Artificial Sequence
  chemically synthesized
ctatttactgcttctatgaggt

SEQ ID NO: 702123 - DNA, 22 bp, Artificial Sequence
  chemically synthesized
tctatttactgcttctatgagg

SEQ ID NO: 702124 - DNA, 22 bp, Artificial Sequence
  chemically synthesized
ttctatttactgcttctatgag

SEQ ID NO: 702125 - DNA, 22 bp, Artificial Sequence
  chemically synthesized
aaatagtcaacctcatagaagc

SEQ ID NO: 702126 - DNA, 22 bp, Artificial Sequence
  chemically synthesized
gcaaccacttttctatttactg

SEQ ID NO: 702127 - DNA, 22 bp, Artificial Sequence
  chemically synthesized
tggcaaccacttttctatttac

SEQ ID NO: 702128 - DNA, 22 bp, Artificial Sequence
  chemically synthesized
ctggcaaccacttttctattta

SEQ ID NO: 702129 - DNA, 22 bp, Artificial Sequence
  chemically synthesized
atagaagcagtaaatagaaaag

SEQ ID NO: 702130 - DNA, 22 bp, Artificial Sequence
  chemically synthesized
tcttctggcaaccacttttcta

SEQ ID NO: 702131 - DNA, 22 bp, Artificial Sequence
  chemically synthesized
ccctgtcttctggcaaccactt

SEQ ID NO: 702132 - DNA, 22 bp, Artificial Sequence
  chemically synthesized
ccctgccctgtcttctggcaac

SEQ ID NO: 702133 - DNA, 22 bp, Artificial Sequence
  chemically synthesized
cccctgccctgtcttctggcaa

SEQ ID NO: 702134 - DNA, 22 bp, Artificial Sequence
  chemically synthesized
gtttcccctgccctgtcttctg

SEQ ID NO: 702135 - DNA, 22 bp, Artificial Sequence
  chemically synthesized
tcgtttcccctgccctgtcttc

SEQ ID NO: 702136 - DNA, 22 bp, Artificial Sequence
  chemically synthesized
ctcgtttcccctgccctgtctt

SEQ ID NO: 702137 - DNA, 22 bp, Artificial Sequence
  chemically synthesized
ccagaagacagggcaggggaaa

SEQ ID NO: 702138 - DNA, 22 bp, Artificial Sequence
  chemically synthesized
aataacaatttctcgtttcccc

SEQ ID NO: 702139 - DNA, 22 bp, Artificial Sequence
  chemically synthesized
attgaataacaatttctcgttt

SEQ ID NO: 702140 - DNA, 22 bp, Artificial Sequence
  chemically synthesized
tactcattgaataacaatttct

SEQ ID NO: 702141 - DNA, 22 bp, Artificial Sequence
  chemically synthesized
atactcattgaataacaatttc

SEQ ID NO: 702142 - DNA, 22 bp, Artificial Sequence
  chemically synthesized
tatactcattgaataacaattt

SEQ ID NO: 702143 - DNA, 22 bp, Artificial Sequence
  chemically synthesized
cataagtgaaactttatactca

SEQ ID NO: 702144 - DNA, 22 bp, Artificial Sequence
  chemically synthesized
gcataagtgaaactttatactc

SEQ ID NO: 702145 - DNA, 22 bp, Artificial Sequence
  chemically synthesized
ttattcaatgagtataaagttt

SEQ ID NO: 702146 - DNA, 22 bp, Artificial Sequence
  chemically synthesized
atcttgcataagtgaaacttta

SEQ ID NO: 702147 - DNA, 22 bp, Artificial Sequence
  chemically synthesized
ttcaatgagtataaagtttcac

SEQ ID NO: 702148 - DNA, 22 bp, Artificial Sequence
  chemically synthesized
ctcatcttgcataagtgaaact

SEQ ID NO: 702149 - DNA, 22 bp, Artificial Sequence
  chemically synthesized
aatgagtataaagtttcactta

SEQ ID NO: 702150 - DNA, 22 bp, Artificial Sequence
  chemically synthesized
actcatcttgcataagtgaaac

SEQ ID NO: 702151 - DNA, 22 bp, Artificial Sequence
  chemically synthesized
gaacttactcatcttgcataag

SEQ ID NO: 702152 - DNA, 22 bp, Artificial Sequence
  chemically synthesized
tagaacttactcatcttgcata

SEQ ID NO: 702153 - DNA, 22 bp, Artificial Sequence
  chemically synthesized
cacttatgcaagatgagtaagt

SEQ ID NO: 702154 - DNA, 22 bp, Artificial Sequence
  chemically synthesized
acttatgcaagatgagtaagtt

SEQ ID NO: 702155 - DNA, 22 bp, Artificial Sequence
  chemically synthesized
atgcaagatgagtaagttctag

SEQ ID NO: 702156 - DNA, 22 bp, Artificial Sequence
  chemically synthesized
tacagcagatctctagaactta

SEQ ID NO: 702157 - DNA, 22 bp, Artificial Sequence
  chemically synthesized
tgcaagatgagtaagttctaga

SEQ ID NO: 702158 - DNA, 22 bp, Artificial Sequence
  chemically synthesized
tgttgtacagcagatctctaga

SEQ ID NO: 702159 - DNA, 22 bp, Artificial Sequence
  chemically synthesized
taggcactatgttgtacagcag

SEQ ID NO: 702160 - DNA, 22 bp, Artificial Sequence
  chemically synthesized
actataggcactatgttgtaca

SEQ ID NO: 702161 - DNA, 22 bp, Artificial Sequence
  chemically synthesized
tagagatctgctgtacaacata

SEQ ID NO: 702162 - DNA, 22 bp, Artificial Sequence
  chemically synthesized
gagatctgctgtacaacatagt

SEQ ID NO: 702163 - DNA, 22 bp, Artificial Sequence
  chemically synthesized
ttaactataggcactatgttgt

SEQ ID NO: 702164 - DNA, 22 bp, Artificial Sequence
  chemically synthesized
ctgtacaacatagtgcctatag

SEQ ID NO: 702165 - DNA, 22 bp, Artificial Sequence
  chemically synthesized
cacagtattgttaactataggc

SEQ ID NO: 702166 - DNA, 22 bp, Artificial Sequence
  chemically synthesized
tacaacatagtgcctatagtta

SEQ ID NO: 702167 - DNA, 22 bp, Artificial Sequence
  chemically synthesized
agtgcactacacagtattgtta

SEQ ID NO: 702168 - DNA, 22 bp, Artificial Sequence
  chemically synthesized
aagtgcactacacagtattgtt

SEQ ID NO: 702169 - DNA, 22 bp, Artificial Sequence
  chemically synthesized
taagtgcactacacagtattgt

SEQ ID NO: 702170 - DNA, 22 bp, Artificial Sequence
  chemically synthesized
agttttaagtgcactacacagt

SEQ ID NO: 702171 - DNA, 22 bp, Artificial Sequence
  chemically synthesized
tagttaacaatactgtgtagtg

SEQ ID NO: 702172 - DNA, 22 bp, Artificial Sequence
  chemically synthesized
aagttttaagtgcactacacag

SEQ ID NO: 702173 - DNA, 22 bp, Artificial Sequence
  chemically synthesized
acaatactgtgtagtgcactta

SEQ ID NO: 702174 - DNA, 22 bp, Artificial Sequence
  chemically synthesized
atccccttaagttttaagtgca

SEQ ID NO: 702175 - DNA, 22 bp, Artificial Sequence
  chemically synthesized
aatccccttaagttttaagtgc

SEQ ID NO: 702176 - DNA, 22 bp, Artificial Sequence
  chemically synthesized
ttaatccccttaagttttaagt

SEQ ID NO: 702177 - DNA, 22 bp, Artificial Sequence
  chemically synthesized
tgtagtgcacttaaaacttaag

SEQ ID NO: 702178 - DNA, 22 bp, Artificial Sequence
  chemically synthesized
aaaacttaaggggattaagagg

SEQ ID NO: 702179 - DNA, 22 bp, Artificial Sequence
  chemically synthesized
aaacttaaggggattaagaggg

SEQ ID NO: 702180 - DNA, 22 bp, Artificial Sequence
  chemically synthesized
aaggggattaagagggtccacc

SEQ ID NO: 702181 - DNA, 22 bp, Artificial Sequence
  chemically synthesized
aggggattaagagggtccacct

SEQ ID NO: 702182 - DNA, 22 bp, Artificial Sequence
  chemically synthesized
agagggtccacctcggccgggc

SEQ ID NO: 702183 - DNA, 22 bp, Artificial Sequence
  chemically synthesized
caggggtgagccaccgcgcccg

SEQ ID NO: 702184 - DNA, 22 bp, Artificial Sequence
  chemically synthesized
ggattacaggggtgagccaccg

SEQ ID NO: 702185 - DNA, 22 bp, Artificial Sequence
  chemically synthesized
ggccgggcgcggtggctcaccc

SEQ ID NO: 702186 - DNA, 22 bp, Artificial Sequence
  chemically synthesized
ccaaagtgctgggattacaggg

SEQ ID NO: 702187 - DNA, 22 bp, Artificial Sequence
  chemically synthesized
gcctcccaaagtgctgggatta

SEQ ID NO: 702188 - DNA, 22 bp, Artificial Sequence
  chemically synthesized
ggcctcccaaagtgctgggatt

SEQ ID NO: 702189 - DNA, 22 bp, Artificial Sequence
  chemically synthesized
acccctgtaatcccagcacttt

SEQ ID NO: 702190 - DNA, 22 bp, Artificial Sequence
  chemically synthesized
accttggcctcccaaagtgctg

SEQ ID NO: 702191 - DNA, 22 bp, Artificial Sequence
  chemically synthesized
ctcaccttggcctcccaaagtg

SEQ ID NO: 702192 - DNA, 22 bp, Artificial Sequence
  chemically synthesized
taatcccagcactttgggaggc

SEQ ID NO: 702193 - DNA, 22 bp, Artificial Sequence
  chemically synthesized
gtgatctgctcaccttggcctc

SEQ ID NO: 702194 - DNA, 22 bp, Artificial Sequence
  chemically synthesized
acctcgtgatctgctcaccttg

SEQ ID NO: 702195 - DNA, 22 bp, Artificial Sequence
  chemically synthesized
gacctcgtgatctgctcacctt

SEQ ID NO: 702196 - DNA, 22 bp, Artificial Sequence
  chemically synthesized
ttgacctcgtgatctgctcacc

SEQ ID NO: 702197 - DNA, 22 bp, Artificial Sequence
  chemically synthesized
tgggaggccaaggtgagcagat

SEQ ID NO: 702198 - DNA, 22 bp, Artificial Sequence
  chemically synthesized
gggaggccaaggtgagcagatc

SEQ ID NO: 702199 - DNA, 22 bp, Artificial Sequence
  chemically synthesized
ggaggccaaggtgagcagatca

SEQ ID NO: 702200 - DNA, 22 bp, Artificial Sequence
  chemically synthesized
gatctcttgacctcgtgatctg

SEQ ID NO: 702201 - DNA, 22 bp, Artificial Sequence
  chemically synthesized
accacatcggccaggatggtct

SEQ ID NO: 702202 - DNA, 22 bp, Artificial Sequence
  chemically synthesized
caccacatcggccaggatggtc

SEQ ID NO: 702203 - DNA, 22 bp, Artificial Sequence
  chemically synthesized
gtagagatggggtttcaccaca

SEQ ID NO: 702204 - DNA, 22 bp, Artificial Sequence
  chemically synthesized
agtagagatggggtttcaccac

SEQ ID NO: 702205 - DNA, 22 bp, Artificial Sequence
  chemically synthesized
tagtagagatggggtttcacca

SEQ ID NO: 702206 - DNA, 22 bp, Artificial Sequence
  chemically synthesized
ttagtagagatggggtttcacc

SEQ ID NO: 702207 - DNA, 22 bp, Artificial Sequence
  chemically synthesized
gccgatgtggtgaaaccccatc

SEQ ID NO: 702208 - DNA, 22 bp, Artificial Sequence
  chemically synthesized
tatttttagtagagatggggtt

SEQ ID NO: 702209 - DNA, 22 bp, Artificial Sequence
  chemically synthesized
gtatttttagtagagatggggt

SEQ ID NO: 702210 - DNA, 22 bp, Artificial Sequence
  chemically synthesized
tgtatttttagtagagatgggg

SEQ ID NO: 702211 - DNA, 22 bp, Artificial Sequence
  chemically synthesized
ttgtatttttagtagagatggg

SEQ ID NO: 702212 - DNA, 22 bp, Artificial Sequence
  chemically synthesized
atttttgtatttttagtagaga

SEQ ID NO: 702213 - DNA, 22 bp, Artificial Sequence
  chemically synthesized
gcccagctaatttttgtatttt

SEQ ID NO: 702214 - DNA, 22 bp, Artificial Sequence
  chemically synthesized
tactaaaaatacaaaaattagc

SEQ ID NO: 702215 - DNA, 22 bp, Artificial Sequence
  chemically synthesized
ctaaaaatacaaaaattagctg

SEQ ID NO: 702216 - DNA, 22 bp, Artificial Sequence
  chemically synthesized
aaaatacaaaaattagctgggc

SEQ ID NO: 702217 - DNA, 22 bp, Artificial Sequence
  chemically synthesized
taggtgcgcgccacctcgccca

SEQ ID NO: 702218 - DNA, 22 bp, Artificial Sequence
  chemically synthesized
ggactataggtgcgcgccacct

SEQ ID NO: 702219 - DNA, 22 bp, Artificial Sequence
  chemically synthesized
gctgggcgaggtggcgcgcacc

SEQ ID NO: 702220 - DNA, 22 bp, Artificial Sequence
  chemically synthesized
ggcgaggtggcgcgcacctata

SEQ ID NO: 702221 - DNA, 22 bp, Artificial Sequence
  chemically synthesized
ccgagtagctgggactataggt

SEQ ID NO: 702222 - DNA, 22 bp, Artificial Sequence
  chemically synthesized
agcctcccgagtagctgggact

SEQ ID NO: 702223 - DNA, 22 bp, Artificial Sequence
  chemically synthesized
cctcagcctcccgagtagctgg

SEQ ID NO: 702224 - DNA, 22 bp, Artificial Sequence
  chemically synthesized
ctgcctcagcctcccgagtagc

SEQ ID NO: 702225 - DNA, 22 bp, Artificial Sequence
  chemically synthesized
tcctgcctcagcctcccgagta

SEQ ID NO: 702226 - DNA, 22 bp, Artificial Sequence
  chemically synthesized
tagtcccagctactcgggaggc

SEQ ID NO: 702227 - DNA, 22 bp, Artificial Sequence
  chemically synthesized
aagcgattctcctgcctcagcc

SEQ ID NO: 702228 - DNA, 22 bp, Artificial Sequence
  chemically synthesized
ctcgggaggctgaggcaggaga

SEQ ID NO: 702229 - DNA, 22 bp, Artificial Sequence
  chemically synthesized
gggaggctgaggcaggagaatc

SEQ ID NO: 702230 - DNA, 22 bp, Artificial Sequence
  chemically synthesized
ccaggttcaagcgattctcctg

SEQ ID NO: 702231 - DNA, 22 bp, Artificial Sequence
  chemically synthesized
cacctcccaggttcaagcgatt

SEQ ID NO: 702232 - DNA, 22 bp, Artificial Sequence
  chemically synthesized
aggcaggagaatcgcttgaacc

SEQ ID NO: 702233 - DNA, 22 bp, Artificial Sequence
  chemically synthesized
caacctccacctcccaggttca

SEQ ID NO: 702234 - DNA, 22 bp, Artificial Sequence
  chemically synthesized
actgcaacctccacctcccagg

SEQ ID NO: 702235 - DNA, 22 bp, Artificial Sequence
  chemically synthesized
agctgactgcaacctccacctc

SEQ ID NO: 702236 - DNA, 22 bp, Artificial Sequence
  chemically synthesized
gaacctgggaggtggaggttgc

SEQ ID NO: 702237 - DNA, 22 bp, Artificial Sequence
  chemically synthesized
aacctgggaggtggaggttgca

SEQ ID NO: 702238 - DNA, 22 bp, Artificial Sequence
  chemically synthesized
ggaggtggaggttgcagtcagc

SEQ ID NO: 702239 - DNA, 22 bp, Artificial Sequence
  chemically synthesized
gagtgcagtggcacgatctcag

SEQ ID NO: 702240 - DNA, 22 bp, Artificial Sequence
  chemically synthesized
cagtcagctgagatcgtgccac

SEQ ID NO: 702241 - DNA, 22 bp, Artificial Sequence
  chemically synthesized
tcgccaggctggagtgcagtgg

SEQ ID NO: 702242 - DNA, 22 bp, Artificial Sequence
  chemically synthesized
tgtcgccaggctggagtgcagt

SEQ ID NO: 702243 - DNA, 22 bp, Artificial Sequence
  chemically synthesized
agatcgtgccactgcactccag

SEQ ID NO: 702244 - DNA, 22 bp, Artificial Sequence
  chemically synthesized
ctctgtcgccaggctggagtgc

SEQ ID NO: 702245 - DNA, 22 bp, Artificial Sequence
  chemically synthesized
gctctgtcgccaggctggagtg

SEQ ID NO: 702246 - DNA, 22 bp, Artificial Sequence
  chemically synthesized
cactccagcctggcgacagagc

SEQ ID NO: 702247 - DNA, 22 bp, Artificial Sequence
  chemically synthesized
agatggaatcttgctctgtcgc

SEQ ID NO: 702248 - DNA, 22 bp, Artificial Sequence
  chemically synthesized
gagatggaatcttgctctgtcg

SEQ ID NO: 702249 - DNA, 22 bp, Artificial Sequence
  chemically synthesized
tgagatggaatcttgctctgtc

SEQ ID NO: 702250 - DNA, 22 bp, Artificial Sequence
  chemically synthesized
ttgagatggaatcttgctctgt

SEQ ID NO: 702251 - DNA, 22 bp, Artificial Sequence
  chemically synthesized
tttgagatggaatcttgctctg

SEQ ID NO: 702252 - DNA, 22 bp, Artificial Sequence
  chemically synthesized
cagcctggcgacagagcaagat

SEQ ID NO: 702253 - DNA, 22 bp, Artificial Sequence
  chemically synthesized
ttttgagatggaatcttgctct

SEQ ID NO: 702254 - DNA, 22 bp, Artificial Sequence
  chemically synthesized
tttttgagatggaatcttgctc

SEQ ID NO: 702255 - DNA, 22 bp, Artificial Sequence
  chemically synthesized
ttttttgagatggaatcttgct

SEQ ID NO: 702256 - DNA, 22 bp, Artificial Sequence
  chemically synthesized
tttttttgagatggaatcttgc

SEQ ID NO: 702257 - DNA, 22 bp, Artificial Sequence
  chemically synthesized
ttttttttgagatggaatcttg

SEQ ID NO: 702258 - DNA, 22 bp, Artificial Sequence
  chemically synthesized
tttttttttgagatggaatctt

SEQ ID NO: 702259 - DNA, 22 bp, Artificial Sequence
  chemically synthesized
ttttttttttgagatggaatct

SEQ ID NO: 702260 - DNA, 22 bp, Artificial Sequence
  chemically synthesized
gcgacagagcaagattccatct

SEQ ID NO: 702261 - DNA, 22 bp, Artificial Sequence
  chemically synthesized
tttttttttttgagatggaatc

SEQ ID NO: 702262 - DNA, 22 bp, Artificial Sequence
  chemically synthesized
ttttttttttttgagatggaat

SEQ ID NO: 702263 - DNA, 22 bp, Artificial Sequence
  chemically synthesized
tttttttttttttgagatggaa

SEQ ID NO: 702264 - DNA, 22 bp, Artificial Sequence
  chemically synthesized
ttttttttttttttgagatgga

SEQ ID NO: 702265 - DNA, 22 bp, Artificial Sequence
  chemically synthesized
tttttttttttttttgagatgg

SEQ ID NO: 702266 - DNA, 22 bp, Artificial Sequence
  chemically synthesized
ttttttttttttttttgagatg

SEQ ID NO: 702267 - DNA, 22 bp, Artificial Sequence
  chemically synthesized
tttttttttttttttttgagat

SEQ ID NO: 702268 - DNA, 22 bp, Artificial Sequence
  chemically synthesized
ttttttttttttttttttgaga

SEQ ID NO: 702269 - DNA, 22 bp, Artificial Sequence
  chemically synthesized
tttttttttttttttttttgag

SEQ ID NO: 702270 - DNA, 22 bp, Artificial Sequence
  chemically synthesized
ttttttttttttttttttttga

SEQ ID NO: 702271 - DNA, 22 bp, Artificial Sequence
  chemically synthesized
tttttttttttttttttttttg

SEQ ID NO: 702272 - DNA, 22 bp, Artificial Sequence
  chemically synthesized
tttttttttttttttttttttt

SEQ ID NO: 702273 - DNA, 22 bp, Artificial Sequence
  chemically synthesized
tttttttttttttttttttttt

SEQ ID NO: 702274 - DNA, 22 bp, Artificial Sequence
  chemically synthesized
tttttttttttttttttttttt

SEQ ID NO: 702275 - DNA, 22 bp, Artificial Sequence
  chemically synthesized
tttttttttttttttttttttt

SEQ ID NO: 702276 - DNA, 22 bp, Artificial Sequence
  chemically synthesized
tttttttttttttttttttttt

SEQ ID NO: 702277 - DNA, 22 bp, Artificial Sequence
  chemically synthesized
tttttttttttttttttttttt

SEQ ID NO: 702278 - DNA, 22 bp, Artificial Sequence
  chemically synthesized
catctcaaaaaaaaaaaaaaaa

SEQ ID NO: 702279 - DNA, 22 bp, Artificial Sequence
  chemically synthesized
tttttttttttttttttttttt

SEQ ID NO: 702280 - DNA, 22 bp, Artificial Sequence
  chemically synthesized
tttttttttttttttttttttt

SEQ ID NO: 702281 - DNA, 22 bp, Artificial Sequence
  chemically synthesized
aaaaaaaaaaaaaaaaaaaaaa

SEQ ID NO: 702282 - DNA, 22 bp, Artificial Sequence
  chemically synthesized
tgcatggcaagaacacaacatg

SEQ ID NO: 702283 - DNA, 22 bp, Artificial Sequence
  chemically synthesized
tgtgtgtctgtgcatggcaaga

SEQ ID NO: 702284 - DNA, 22 bp, Artificial Sequence
  chemically synthesized
gtgtgtgtctgtgcatggcaag

SEQ ID NO: 702285 - DNA, 22 bp, Artificial Sequence
  chemically synthesized
tgtgtgtgtctgtgcatggcaa

SEQ ID NO: 702286 - DNA, 22 bp, Artificial Sequence
  chemically synthesized
atgttgtgttcttgccatgcac

SEQ ID NO: 702287 - DNA, 22 bp, Artificial Sequence
  chemically synthesized
ttgtgtgtgtctgtgcatggca

SEQ ID NO: 702288 - DNA, 22 bp, Artificial Sequence
  chemically synthesized
cttttgtgtgtgtctgtgcatg

SEQ ID NO: 702289 - DNA, 22 bp, Artificial Sequence
  chemically synthesized
gcttttgtgtgtgtctgtgcat

SEQ ID NO: 702290 - DNA, 22 bp, Artificial Sequence
  chemically synthesized
tgcttttgtgtgtgtctgtgca

SEQ ID NO: 702291 - DNA, 22 bp, Artificial Sequence
  chemically synthesized
tgttcttgccatgcacagacac

SEQ ID NO: 702292 - DNA, 22 bp, Artificial Sequence
  chemically synthesized
ttgccatgcacagacacacaca

SEQ ID NO: 702293 - DNA, 22 bp, Artificial Sequence
  chemically synthesized
gccatgcacagacacacacaaa

SEQ ID NO: 702294 - DNA, 22 bp, Artificial Sequence
  chemically synthesized
tgtccctttgcttttgtgtgtg

SEQ ID NO: 702295 - DNA, 22 bp, Artificial Sequence
  chemically synthesized
ccatgcacagacacacacaaaa

SEQ ID NO: 702296 - DNA, 22 bp, Artificial Sequence
  chemically synthesized
gtgtccctttgcttttgtgtgt

SEQ ID NO: 702297 - DNA, 22 bp, Artificial Sequence
  chemically synthesized
tgtgtccctttgcttttgtgtg

SEQ ID NO: 702298 - DNA, 22 bp, Artificial Sequence
  chemically synthesized
caaaagttttgtgtccctttgc

SEQ ID NO: 702299 - DNA, 22 bp, Artificial Sequence
  chemically synthesized
cctacaaaagttttgtgtccct

SEQ ID NO: 702300 - DNA, 22 bp, Artificial Sequence
  chemically synthesized
attacctacaaaagttttgtgt

SEQ ID NO: 702301 - DNA, 22 bp, Artificial Sequence
  chemically synthesized
aagataacgaacatattcatta

SEQ ID NO: 702302 - DNA, 22 bp, Artificial Sequence
  chemically synthesized
ttgtaggtaatgaatatgttcg

SEQ ID NO: 702303 - DNA, 22 bp, Artificial Sequence
  chemically synthesized
tgtaggtaatgaatatgttcgt

SEQ ID NO: 702304 - DNA, 22 bp, Artificial Sequence
  chemically synthesized
gtaggtaatgaatatgttcgtt

SEQ ID NO: 702305 - DNA, 22 bp, Artificial Sequence
  chemically synthesized
taggtaatgaatatgttcgtta

SEQ ID NO: 702306 - DNA, 22 bp, Artificial Sequence
  chemically synthesized
ccacagtcaaactaaagataac

SEQ ID NO: 702307 - DNA, 22 bp, Artificial Sequence
  chemically synthesized
ttgccacagtcaaactaaagat

SEQ ID NO: 702308 - DNA, 22 bp, Artificial Sequence
  chemically synthesized
gttatctttagtttgactgtgg

SEQ ID NO: 702309 - DNA, 22 bp, Artificial Sequence
  chemically synthesized
tctttagtttgactgtggcaat

SEQ ID NO: 702310 - DNA, 22 bp, Artificial Sequence
  chemically synthesized
tagtttgactgtggcaatagta

SEQ ID NO: 702311 - DNA, 22 bp, Artificial Sequence
  chemically synthesized
agtttgactgtggcaatagtat

SEQ ID NO: 702312 - DNA, 22 bp, Artificial Sequence
  chemically synthesized
gtttgactgtggcaatagtatc

SEQ ID NO: 702313 - DNA, 22 bp, Artificial Sequence
  chemically synthesized
gactgtggcaatagtatcttgg

SEQ ID NO: 702314 - DNA, 22 bp, Artificial Sequence
  chemically synthesized
actgtggcaatagtatcttggg

SEQ ID NO: 702315 - DNA, 22 bp, Artificial Sequence
  chemically synthesized
gacatatgtatacacccaagat

SEQ ID NO: 702316 - DNA, 22 bp, Artificial Sequence
  chemically synthesized
ggacatatgtatacacccaaga

SEQ ID NO: 702317 - DNA, 22 bp, Artificial Sequence
  chemically synthesized
tggcaatagtatcttgggtgta

SEQ ID NO: 702318 - DNA, 22 bp, Artificial Sequence
  chemically synthesized
gtaagtttggacatatgtatac

SEQ ID NO: 702319 - DNA, 22 bp, Artificial Sequence
  chemically synthesized
ggtaagtttggacatatgtata

SEQ ID NO: 702320 - DNA, 22 bp, Artificial Sequence
  chemically synthesized
gggtgtatacatatgtccaaac

SEQ ID NO: 702321 - DNA, 22 bp, Artificial Sequence
  chemically synthesized
ggtgtatacatatgtccaaact

SEQ ID NO: 702322 - DNA, 22 bp, Artificial Sequence
  chemically synthesized
atatatgtaatttggtaagttt

SEQ ID NO: 702323 - DNA, 22 bp, Artificial Sequence
  chemically synthesized
aatatatgtaatttggtaagtt

SEQ ID NO: 702324 - DNA, 22 bp, Artificial Sequence
  chemically synthesized
accaaattacatatattaaata

SEQ ID NO: 702325 - DNA, 22 bp, Artificial Sequence
  chemically synthesized
ccaaattacatatattaaatat

SEQ ID NO: 702326 - DNA, 22 bp, Artificial Sequence
  chemically synthesized
tatgcaaaaatatgcatattta

SEQ ID NO: 702327 - DNA, 22 bp, Artificial Sequence
  chemically synthesized
catatattaaatatgcatattt

SEQ ID NO: 702328 - DNA, 22 bp, Artificial Sequence
  chemically synthesized
gggtataattatatgcaaaaat

SEQ ID NO: 702329 - DNA, 22 bp, Artificial Sequence
  chemically synthesized
ggggtataattatatgcaaaaa

SEQ ID NO: 702330 - DNA, 22 bp, Artificial Sequence
  chemically synthesized
aatatgcatatttttgcatata

SEQ ID NO: 702331 - DNA, 22 bp, Artificial Sequence
  chemically synthesized
ttggggtataattatatgcaaa

SEQ ID NO: 702332 - DNA, 22 bp, Artificial Sequence
  chemically synthesized
cttggggtataattatatgcaa

SEQ ID NO: 702333 - DNA, 22 bp, Artificial Sequence
  chemically synthesized
tcttggggtataattatatgca

SEQ ID NO: 702334 - DNA, 22 bp, Artificial Sequence
  chemically synthesized
tagctttcttggggtataatta

SEQ ID NO: 702335 - DNA, 22 bp, Artificial Sequence
  chemically synthesized
atagctttcttggggtataatt

SEQ ID NO: 702336 - DNA, 22 bp, Artificial Sequence
  chemically synthesized
tatagctttcttggggtataat

SEQ ID NO: 702337 - DNA, 22 bp, Artificial Sequence
  chemically synthesized
ttatagctttcttggggtataa

SEQ ID NO: 702338 - DNA, 22 bp, Artificial Sequence
  chemically synthesized
ttgcatataattataccccaag

SEQ ID NO: 702339 - DNA, 22 bp, Artificial Sequence
  chemically synthesized
tgcatataattataccccaaga

SEQ ID NO: 702340 - DNA, 22 bp, Artificial Sequence
  chemically synthesized
gcatataattataccccaagaa

SEQ ID NO: 702341 - DNA, 22 bp, Artificial Sequence
  chemically synthesized
catataattataccccaagaaa

SEQ ID NO: 702342 - DNA, 22 bp, Artificial Sequence
  chemically synthesized
tacttttatagctttcttgggg

SEQ ID NO: 702343 - DNA, 22 bp, Artificial Sequence
  chemically synthesized
gtacttttatagctttcttggg

SEQ ID NO: 702344 - DNA, 22 bp, Artificial Sequence
  chemically synthesized
tgtacttttatagctttcttgg

SEQ ID NO: 702345 - DNA, 22 bp, Artificial Sequence
  chemically synthesized
ttgtacttttatagctttcttg

SEQ ID NO: 702346 - DNA, 22 bp, Artificial Sequence
  chemically synthesized
tttgtacttttatagctttctt

SEQ ID NO: 702347 - DNA, 22 bp, Artificial Sequence
  chemically synthesized
ttttgtacttttatagctttct

SEQ ID NO: 702348 - DNA, 22 bp, Artificial Sequence
  chemically synthesized
tttttgtacttttatagctttc

SEQ ID NO: 702349 - DNA, 22 bp, Artificial Sequence
  chemically synthesized
ttttttgtacttttatagcttt

SEQ ID NO: 702350 - DNA, 22 bp, Artificial Sequence
  chemically synthesized
tttttttgtacttttatagctt

SEQ ID NO: 702351 - DNA, 22 bp, Artificial Sequence
  chemically synthesized
ttttttttgtacttttatagct

SEQ ID NO: 702352 - DNA, 22 bp, Artificial Sequence
  chemically synthesized
taccccaagaaagctataaaag

SEQ ID NO: 702353 - DNA, 22 bp, Artificial Sequence
  chemically synthesized
tttttttttgtacttttatagc

SEQ ID NO: 702354 - DNA, 22 bp, Artificial Sequence
  chemically synthesized
ttttttttttgtacttttatag

SEQ ID NO: 702355 - DNA, 22 bp, Artificial Sequence
  chemically synthesized
tttttttttttgtacttttata

SEQ ID NO: 702356 - DNA, 22 bp, Artificial Sequence
  chemically synthesized
atctttttttttttttgtactt

SEQ ID NO: 702357 - DNA, 22 bp, Artificial Sequence
  chemically synthesized
tactcatctttttttttttttg

SEQ ID NO: 702358 - DNA, 22 bp, Artificial Sequence
  chemically synthesized
taaaagtacaaaaaaaaaaaaa

SEQ ID NO: 702359 - DNA, 22 bp, Artificial Sequence
  chemically synthesized
cactgtactcatcttttttttt

SEQ ID NO: 702360 - DNA, 22 bp, Artificial Sequence
  chemically synthesized
ctccactgtactcatctttttt

SEQ ID NO: 702361 - DNA, 22 bp, Artificial Sequence
  chemically synthesized
cctccactgtactcatcttttt

SEQ ID NO: 702362 - DNA, 22 bp, Artificial Sequence
  chemically synthesized
tcctccactgtactcatctttt

SEQ ID NO: 702363 - DNA, 22 bp, Artificial Sequence
  chemically synthesized
ttttcctccactgtactcatct

SEQ ID NO: 702364 - DNA, 22 bp, Artificial Sequence
  chemically synthesized
gttttcctccactgtactcatc

SEQ ID NO: 702365 - DNA, 22 bp, Artificial Sequence
  chemically synthesized
tgttttcctccactgtactcat

SEQ ID NO: 702366 - DNA, 22 bp, Artificial Sequence
  chemically synthesized
ttgttttcctccactgtactca

SEQ ID NO: 702367 - DNA, 22 bp, Artificial Sequence
  chemically synthesized
ccttttgttttcctccactgta

SEQ ID NO: 702368 - DNA, 22 bp, Artificial Sequence
  chemically synthesized
ccagggtacattcccttttgtt

SEQ ID NO: 702369 - DNA, 22 bp, Artificial Sequence
  chemically synthesized
gccagggtacattcccttttgt

SEQ ID NO: 702370 - DNA, 22 bp, Artificial Sequence
  chemically synthesized
ggggcatttgccagggtacatt

SEQ ID NO: 702371 - DNA, 22 bp, Artificial Sequence
  chemically synthesized
gggggcatttgccagggtacat

SEQ ID NO: 702372 - DNA, 22 bp, Artificial Sequence
  chemically synthesized
ccaccgccatttgggggcattt

SEQ ID NO: 702373 - DNA, 22 bp, Artificial Sequence
  chemically synthesized
ctgccaccgccatttgggggca

SEQ ID NO: 702374 - DNA, 22 bp, Artificial Sequence
  chemically synthesized
tactgccaccgccatttggggg

SEQ ID NO: 702375 - DNA, 22 bp, Artificial Sequence
  chemically synthesized
gcaaatgcccccaaatggcggt

SEQ ID NO: 702376 - DNA, 22 bp, Artificial Sequence
  chemically synthesized
acagcagttctactgccaccgc

SEQ ID NO: 702377 - DNA, 22 bp, Artificial Sequence
  chemically synthesized
gacagcagttctactgccaccg

SEQ ID NO: 702378 - DNA, 22 bp, Artificial Sequence
  chemically synthesized
tgacagcagttctactgccacc

SEQ ID NO: 702379 - DNA, 22 bp, Artificial Sequence
  chemically synthesized
tttgacagcagttctactgcca

SEQ ID NO: 702380 - DNA, 22 bp, Artificial Sequence
  chemically synthesized
ctttgacagcagttctactgcc

SEQ ID NO: 702381 - DNA, 22 bp, Artificial Sequence
  chemically synthesized
tctttgacagcagttctactgc

SEQ ID NO: 702382 - DNA, 22 bp, Artificial Sequence
  chemically synthesized
ttctttgacagcagttctactg

SEQ ID NO: 702383 - DNA, 22 bp, Artificial Sequence
  chemically synthesized
tttttctttgacagcagttcta

SEQ ID NO: 702384 - DNA, 22 bp, Artificial Sequence
  chemically synthesized
tattatttttctttgacagcag

SEQ ID NO: 702385 - DNA, 22 bp, Artificial Sequence
  chemically synthesized
tgtattatttttctttgacagc

SEQ ID NO: 702386 - DNA, 22 bp, Artificial Sequence
  chemically synthesized
ctgtattatttttctttgacag

SEQ ID NO: 702387 - DNA, 22 bp, Artificial Sequence
  chemically synthesized
gcttctgtattatttttctttg

SEQ ID NO: 702388 - DNA, 22 bp, Artificial Sequence
  chemically synthesized
tagcttctgtattatttttctt

SEQ ID NO: 702389 - DNA, 22 bp, Artificial Sequence
  chemically synthesized
ttctagcttctgtattattttt

SEQ ID NO: 702390 - DNA, 22 bp, Artificial Sequence
  chemically synthesized
attctagcttctgtattatttt

SEQ ID NO: 702391 - DNA, 22 bp, Artificial Sequence
  chemically synthesized
tattctagcttctgtattattt

SEQ ID NO: 702392 - DNA, 22 bp, Artificial Sequence
  chemically synthesized
ctgtcaaagaaaaataatacag

SEQ ID NO: 702393 - DNA, 22 bp, Artificial Sequence
  chemically synthesized
tcaaagaaaaataatacagaag

SEQ ID NO: 702394 - DNA, 22 bp, Artificial Sequence
  chemically synthesized
atcccactttattctagcttct

SEQ ID NO: 702395 - DNA, 22 bp, Artificial Sequence
  chemically synthesized
catcccactttattctagcttc

SEQ ID NO: 702396 - DNA, 22 bp, Artificial Sequence
  chemically synthesized
tgtttcatcccactttattcta

SEQ ID NO: 702397 - DNA, 22 bp, Artificial Sequence
  chemically synthesized
gtgtttcatcccactttattct

SEQ ID NO: 702398 - DNA, 22 bp, Artificial Sequence
  chemically synthesized
ttgtgtttcatcccactttatt

SEQ ID NO: 702399 - DNA, 22 bp, Artificial Sequence
  chemically synthesized
ttcttgtgtttcatcccacttt

SEQ ID NO: 702400 - DNA, 22 bp, Artificial Sequence
  chemically synthesized
ggctgttcttgtgtttcatccc

SEQ ID NO: 702401 - DNA, 22 bp, Artificial Sequence
  chemically synthesized
gaataaagtgggatgaaacaca

SEQ ID NO: 702402 - DNA, 22 bp, Artificial Sequence
  chemically synthesized
accagctaggctgttcttgtgt

SEQ ID NO: 702403 - DNA, 22 bp, Artificial Sequence
  chemically synthesized
caccagctaggctgttcttgtg

SEQ ID NO: 702404 - DNA, 22 bp, Artificial Sequence
  chemically synthesized
tacttcaccagctaggctgttc

SEQ ID NO: 702405 - DNA, 22 bp, Artificial Sequence
  chemically synthesized
atacttcaccagctaggctgtt

SEQ ID NO: 702406 - DNA, 22 bp, Artificial Sequence
  chemically synthesized
cttatacttcaccagctaggct

SEQ ID NO: 702407 - DNA, 22 bp, Artificial Sequence
  chemically synthesized
aagaattgcttatacttcacca

SEQ ID NO: 702408 - DNA, 22 bp, Artificial Sequence
  chemically synthesized
tcaggctcaagaattgcttata

SEQ ID NO: 702409 - DNA, 22 bp, Artificial Sequence
  chemically synthesized
gctggtgaagtataagcaattc

SEQ ID NO: 702410 - DNA, 22 bp, Artificial Sequence
  chemically synthesized
gtctgtcaggctcaagaattgc

SEQ ID NO: 702411 - DNA, 22 bp, Artificial Sequence
  chemically synthesized
gtgaagtataagcaattcttga

SEQ ID NO: 702412 - DNA, 22 bp, Artificial Sequence
  chemically synthesized
agtctgtcaggctcaagaattg

SEQ ID NO: 702413 - DNA, 22 bp, Artificial Sequence
  chemically synthesized
cacccttagtctgtcaggctca

SEQ ID NO: 702414 - DNA, 22 bp, Artificial Sequence
  chemically synthesized
tacacccttagtctgtcaggct

SEQ ID NO: 702415 - DNA, 22 bp, Artificial Sequence
  chemically synthesized
ctacacccttagtctgtcaggc

SEQ ID NO: 702416 - DNA, 22 bp, Artificial Sequence
  chemically synthesized
ttctacacccttagtctgtcag

SEQ ID NO: 702417 - DNA, 22 bp, Artificial Sequence
  chemically synthesized
cttctacacccttagtctgtca

SEQ ID NO: 702418 - DNA, 22 bp, Artificial Sequence
  chemically synthesized
ttcttctacacccttagtctgt

SEQ ID NO: 702419 - DNA, 22 bp, Artificial Sequence
  chemically synthesized
cttcttctacacccttagtctg

SEQ ID NO: 702420 - DNA, 22 bp, Artificial Sequence
  chemically synthesized
ttgagcctgacagactaagggt

SEQ ID NO: 702421 - DNA, 22 bp, Artificial Sequence
  chemically synthesized
gagcctgacagactaagggtgt

SEQ ID NO: 702422 - DNA, 22 bp, Artificial Sequence
  chemically synthesized
agcctgacagactaagggtgta

SEQ ID NO: 702423 - DNA, 22 bp, Artificial Sequence
  chemically synthesized
acagactaagggtgtagaagaa

SEQ ID NO: 702424 - DNA, 22 bp, Artificial Sequence
  chemically synthesized
agggtgtagaagaagaagatgt

SEQ ID NO: 702425 - DNA, 22 bp, Artificial Sequence
  chemically synthesized
aggtcaccagtgatcgtgggat

SEQ ID NO: 702426 - DNA, 22 bp, Artificial Sequence
  chemically synthesized
gaggtcaccagtgatcgtggga

SEQ ID NO: 702427 - DNA, 22 bp, Artificial Sequence
  chemically synthesized
tgaggtcaccagtgatcgtggg

SEQ ID NO: 702428 - DNA, 22 bp, Artificial Sequence
  chemically synthesized
ttgaggtcaccagtgatcgtgg

SEQ ID NO: 702429 - DNA, 22 bp, Artificial Sequence
  chemically synthesized
cccttttgaggtcaccagtgat

SEQ ID NO: 702430 - DNA, 22 bp, Artificial Sequence
  chemically synthesized
gatcccacgatcactggtgacc

SEQ ID NO: 702431 - DNA, 22 bp, Artificial Sequence
  chemically synthesized
atcccacgatcactggtgacct

SEQ ID NO: 702432 - DNA, 22 bp, Artificial Sequence
  chemically synthesized
gtgtgaaattgcccttttgagg

SEQ ID NO: 702433 - DNA, 22 bp, Artificial Sequence
  chemically synthesized
atcactagtgtgaaattgccct

SEQ ID NO: 702434 - DNA, 22 bp, Artificial Sequence
  chemically synthesized
gtgacctcaaaagggcaatttc

SEQ ID NO: 702435 - DNA, 22 bp, Artificial Sequence
  chemically synthesized
tgatcactagtgtgaaattgcc

SEQ ID NO: 702436 - DNA, 22 bp, Artificial Sequence
  chemically synthesized
agcctctgatcactagtgtgaa

SEQ ID NO: 702437 - DNA, 22 bp, Artificial Sequence
  chemically synthesized
aaaagggcaatttcacactagt

SEQ ID NO: 702438 - DNA, 22 bp, Artificial Sequence
  chemically synthesized
cagcctctgatcactagtgtga

SEQ ID NO: 702439 - DNA, 22 bp, Artificial Sequence
  chemically synthesized
cttcagcctctgatcactagtg

SEQ ID NO: 702440 - DNA, 22 bp, Artificial Sequence
  chemically synthesized
cctccttcagcctctgatcact

SEQ ID NO: 702441 - DNA, 22 bp, Artificial Sequence
  chemically synthesized
ctccctccttcagcctctgatc

SEQ ID NO: 702442 - DNA, 22 bp, Artificial Sequence
  chemically synthesized
cacactagtgatcagaggctga

SEQ ID NO: 702443 - DNA, 22 bp, Artificial Sequence
  chemically synthesized
acactagtgatcagaggctgaa

SEQ ID NO: 702444 - DNA, 22 bp, Artificial Sequence
  chemically synthesized
cgtctactccctccttcagcct

SEQ ID NO: 702445 - DNA, 22 bp, Artificial Sequence
  chemically synthesized
gtgatcagaggctgaaggaggg

SEQ ID NO: 702446 - DNA, 22 bp, Artificial Sequence
  chemically synthesized
ccctccgtctactccctccttc

SEQ ID NO: 702447 - DNA, 22 bp, Artificial Sequence
  chemically synthesized
cccctccgtctactccctcctt

SEQ ID NO: 702448 - DNA, 22 bp, Artificial Sequence
  chemically synthesized
cttcccctccgtctactccctc

SEQ ID NO: 702449 - DNA, 22 bp, Artificial Sequence
  chemically synthesized
gcttcccctccgtctactccct

SEQ ID NO: 702450 - DNA, 22 bp, Artificial Sequence
  chemically synthesized
aaggagggagtagacggagggg

SEQ ID NO: 702451 - DNA, 22 bp, Artificial Sequence
  chemically synthesized
aaatgcttgcttcccctccgtc

SEQ ID NO: 702452 - DNA, 22 bp, Artificial Sequence
  chemically synthesized
tcaaatgcttgcttcccctccg

SEQ ID NO: 702453 - DNA, 22 bp, Artificial Sequence
  chemically synthesized
ctcaaatgcttgcttcccctcc

SEQ ID NO: 702454 - DNA, 22 bp, Artificial Sequence
  chemically synthesized
tacacaacttctcaaatgcttg

SEQ ID NO: 702455 - DNA, 22 bp, Artificial Sequence
  chemically synthesized
atacacaacttctcaaatgctt

SEQ ID NO: 702456 - DNA, 22 bp, Artificial Sequence
  chemically synthesized
tatacacaacttctcaaatgct

SEQ ID NO: 702457 - DNA, 22 bp, Artificial Sequence
  chemically synthesized
ttatacacaacttctcaaatgc

SEQ ID NO: 702458 - DNA, 22 bp, Artificial Sequence
  chemically synthesized
tttatacacaacttctcaaatg

SEQ ID NO: 702459 - DNA, 22 bp, Artificial Sequence
  chemically synthesized
tttttatacacaacttctcaaa

SEQ ID NO: 702460 - DNA, 22 bp, Artificial Sequence
  chemically synthesized
ctctttttatacacaacttctc

SEQ ID NO: 702461 - DNA, 22 bp, Artificial Sequence
  chemically synthesized
cctctttttatacacaacttct

SEQ ID NO: 702462 - DNA, 22 bp, Artificial Sequence
  chemically synthesized
tcctctttttatacacaacttc

SEQ ID NO: 702463 - DNA, 22 bp, Artificial Sequence
  chemically synthesized
ttttcctctttttatacacaac

SEQ ID NO: 702464 - DNA, 22 bp, Artificial Sequence
  chemically synthesized
tgttttcctctttttatacaca

SEQ ID NO: 702465 - DNA, 22 bp, Artificial Sequence
  chemically synthesized
ctgttttcctctttttatacac

SEQ ID NO: 702466 - DNA, 22 bp, Artificial Sequence
  chemically synthesized
gagaagttgtgtataaaaagag

SEQ ID NO: 702467 - DNA, 22 bp, Artificial Sequence
  chemically synthesized
agaagttgtgtataaaaagagg

SEQ ID NO: 702468 - DNA, 22 bp, Artificial Sequence
  chemically synthesized
catttctgttttcctcttttta

SEQ ID NO: 702469 - DNA, 22 bp, Artificial Sequence
  chemically synthesized
ccatttctgttttcctcttttt

SEQ ID NO: 702470 - DNA, 22 bp, Artificial Sequence
  chemically synthesized
tccatttctgttttcctctttt

SEQ ID NO: 702471 - DNA, 22 bp, Artificial Sequence
  chemically synthesized
tgtataaaaagaggaaaacaga

SEQ ID NO: 702472 - DNA, 22 bp, Artificial Sequence
  chemically synthesized
cccctttccatttctgttttcc

SEQ ID NO: 702473 - DNA, 22 bp, Artificial Sequence
  chemically synthesized
cagagcacaagagagggatgac

SEQ ID NO: 702474 - DNA, 22 bp, Artificial Sequence
  chemically synthesized
attgttggtcatccctctcttg

SEQ ID NO: 702475 - DNA, 22 bp, Artificial Sequence
  chemically synthesized
ggttacagagcacaagagaggg

SEQ ID NO: 702476 - DNA, 22 bp, Artificial Sequence
  chemically synthesized
ttggtcatccctctcttgtgct

SEQ ID NO: 702477 - DNA, 22 bp, Artificial Sequence
  chemically synthesized
gtcatccctctcttgtgctctg

SEQ ID NO: 702478 - DNA, 22 bp, Artificial Sequence
  chemically synthesized
aataggctgggttacagagcac

SEQ ID NO: 702479 - DNA, 22 bp, Artificial Sequence
  chemically synthesized
tcttgtgctctgtaacccagcc

SEQ ID NO: 702480 - DNA, 22 bp, Artificial Sequence
  chemically synthesized
ttgtgctctgtaacccagccta

SEQ ID NO: 702481 - DNA, 22 bp, Artificial Sequence
  chemically synthesized
gtgctctgtaacccagcctatt

SEQ ID NO: 702482 - DNA, 22 bp, Artificial Sequence
  chemically synthesized
tgctctgtaacccagcctattc

SEQ ID NO: 702483 - DNA, 22 bp, Artificial Sequence
  chemically synthesized
agtaatgaagtgaactgaatag

SEQ ID NO: 702484 - DNA, 22 bp, Artificial Sequence
  chemically synthesized
tgtaacccagcctattcagttc

SEQ ID NO: 702485 - DNA, 22 bp, Artificial Sequence
  chemically synthesized
taacccagcctattcagttcac

SEQ ID NO: 702486 - DNA, 22 bp, Artificial Sequence
  chemically synthesized
agcaaattcagtaatgaagtga

SEQ ID NO: 702487 - DNA, 22 bp, Artificial Sequence
  chemically synthesized
ttcagttcacttcattactgaa

SEQ ID NO: 702488 - DNA, 22 bp, Artificial Sequence
  chemically synthesized
agttcacttcattactgaattt

SEQ ID NO: 702489 - DNA, 22 bp, Artificial Sequence
  chemically synthesized
taaagaaaccctaagcaaattc

SEQ ID NO: 702490 - DNA, 22 bp, Artificial Sequence
  chemically synthesized
acttcattactgaatttgctta

SEQ ID NO: 702491 - DNA, 22 bp, Artificial Sequence
  chemically synthesized
cattactgaatttgcttagggt

SEQ ID NO: 702492 - DNA, 22 bp, Artificial Sequence
  chemically synthesized
attactgaatttgcttagggtt

SEQ ID NO: 702493 - DNA, 22 bp, Artificial Sequence
  chemically synthesized
acgttataaagaaaccctaagc

SEQ ID NO: 702494 - DNA, 22 bp, Artificial Sequence
  chemically synthesized
aacgttataaagaaaccctaag

SEQ ID NO: 702495 - DNA, 22 bp, Artificial Sequence
  chemically synthesized
ctgaatttgcttagggtttctt

SEQ ID NO: 702496 - DNA, 22 bp, Artificial Sequence
  chemically synthesized
aatttgcttagggtttctttat

SEQ ID NO: 702497 - DNA, 22 bp, Artificial Sequence
  chemically synthesized
catataatttaacgttataaag

SEQ ID NO: 702498 - DNA, 22 bp, Artificial Sequence
  chemically synthesized
gcttagggtttctttataacgt

SEQ ID NO: 702499 - DNA, 22 bp, Artificial Sequence
  chemically synthesized
gcatataatttaacgttataaa

SEQ ID NO: 702500 - DNA, 22 bp, Artificial Sequence
  chemically synthesized
cttagggtttctttataacgtt

SEQ ID NO: 702501 - DNA, 22 bp, Artificial Sequence
  chemically synthesized
tgcatataatttaacgttataa

SEQ ID NO: 702502 - DNA, 22 bp, Artificial Sequence
  chemically synthesized
agggtttctttataacgttaaa

SEQ ID NO: 702503 - DNA, 22 bp, Artificial Sequence
  chemically synthesized
gggtttctttataacgttaaat

SEQ ID NO: 702504 - DNA, 22 bp, Artificial Sequence
  chemically synthesized
ctttataacgttaaattatatg

SEQ ID NO: 702505 - DNA, 22 bp, Artificial Sequence
  chemically synthesized
tttataacgttaaattatatgc

SEQ ID NO: 702506 - DNA, 22 bp, Artificial Sequence
  chemically synthesized
tataacgttaaattatatgcaa

SEQ ID NO: 702507 - DNA, 22 bp, Artificial Sequence
  chemically synthesized
ataacgttaaattatatgcaaa

SEQ ID NO: 702508 - DNA, 22 bp, Artificial Sequence
  chemically synthesized
taacgttaaattatatgcaaaa

SEQ ID NO: 702509 - DNA, 22 bp, Artificial Sequence
  chemically synthesized
aattatatgcaaaatgtatttc

SEQ ID NO: 702510 - DNA, 22 bp, Artificial Sequence
  chemically synthesized
ggaaatgaaaacgatagaaata

SEQ ID NO: 702511 - DNA, 22 bp, Artificial Sequence
  chemically synthesized
tatgcaaaatgtatttctatcg

SEQ ID NO: 702512 - DNA, 22 bp, Artificial Sequence
  chemically synthesized
aggaaatgaaaacgatagaaat

SEQ ID NO: 702513 - DNA, 22 bp, Artificial Sequence
  chemically synthesized
taggaaatgaaaacgatagaaa

SEQ ID NO: 702514 - DNA, 22 bp, Artificial Sequence
  chemically synthesized
tgactttaggaaatgaaaacga

SEQ ID NO: 702515 - DNA, 22 bp, Artificial Sequence
  chemically synthesized
attatgactttaggaaatgaaa

SEQ ID NO: 702516 - DNA, 22 bp, Artificial Sequence
  chemically synthesized
ctatcgttttcatttcctaaag

SEQ ID NO: 702517 - DNA, 22 bp, Artificial Sequence
  chemically synthesized
tatcgttttcatttcctaaagt

SEQ ID NO: 702518 - DNA, 22 bp, Artificial Sequence
  chemically synthesized
tcgttttcatttcctaaagtca

SEQ ID NO: 702519 - DNA, 22 bp, Artificial Sequence
  chemically synthesized
taatcctgattatgactttagg

SEQ ID NO: 702520 - DNA, 22 bp, Artificial Sequence
  chemically synthesized
tattataatcctgattatgact

SEQ ID NO: 702521 - DNA, 22 bp, Artificial Sequence
  chemically synthesized
tcatttcctaaagtcataatca

SEQ ID NO: 702522 - DNA, 22 bp, Artificial Sequence
  chemically synthesized
catttcctaaagtcataatcag

SEQ ID NO: 702523 - DNA, 22 bp, Artificial Sequence
  chemically synthesized
atttcctaaagtcataatcagg

SEQ ID NO: 702524 - DNA, 22 bp, Artificial Sequence
  chemically synthesized
cctaaagtcataatcaggatta

SEQ ID NO: 702525 - DNA, 22 bp, Artificial Sequence
  chemically synthesized
aatactgtattataatcctgat

SEQ ID NO: 702526 - DNA, 22 bp, Artificial Sequence
  chemically synthesized
ctaaagtcataatcaggattat

SEQ ID NO: 702527 - DNA, 22 bp, Artificial Sequence
  chemically synthesized
aaatactgtattataatcctga

SEQ ID NO: 702528 - DNA, 22 bp, Artificial Sequence
  chemically synthesized
aagtcataatcaggattataat

SEQ ID NO: 702529 - DNA, 22 bp, Artificial Sequence
  chemically synthesized
catgaaagcttaaatactgtat

SEQ ID NO: 702530 - DNA, 22 bp, Artificial Sequence
  chemically synthesized
ataactacatgaaagcttaaat

SEQ ID NO: 702531 - DNA, 22 bp, Artificial Sequence
  chemically synthesized
taatacagtatttaagctttca

SEQ ID NO: 702532 - DNA, 22 bp, Artificial Sequence
  chemically synthesized
aacactaataactacatgaaag

SEQ ID NO: 702533 - DNA, 22 bp, Artificial Sequence
  chemically synthesized
aagctttcatgtagttattagt

SEQ ID NO: 702534 - DNA, 22 bp, Artificial Sequence
  chemically synthesized
agctttcatgtagttattagtg

SEQ ID NO: 702535 - DNA, 22 bp, Artificial Sequence
  chemically synthesized
tcatgtagttattagtgttgaa

SEQ ID NO: 702536 - DNA, 22 bp, Artificial Sequence
  chemically synthesized
catgtagttattagtgttgaat

SEQ ID NO: 702537 - DNA, 22 bp, Artificial Sequence
  chemically synthesized
atgtagttattagtgttgaata

SEQ ID NO: 702538 - DNA, 22 bp, Artificial Sequence
  chemically synthesized
cacatatatacatatatattca

SEQ ID NO: 702539 - DNA, 22 bp, Artificial Sequence
  chemically synthesized
ttagtgttgaatatatatgtat

SEQ ID NO: 702540 - DNA, 22 bp, Artificial Sequence
  chemically synthesized
gtgttgaatatatatgtatata

SEQ ID NO: 702541 - DNA, 22 bp, Artificial Sequence
  chemically synthesized
aatatatatgtatatatgtgta

SEQ ID NO: 702542 - DNA, 22 bp, Artificial Sequence
  chemically synthesized
gaatgggaaaaattacacatat

SEQ ID NO: 702543 - DNA, 22 bp, Artificial Sequence
  chemically synthesized
ttcccattccaatttttttctg

SEQ ID NO: 702544 - DNA, 22 bp, Artificial Sequence
  chemically synthesized
tcccattccaatttttttctgt

SEQ ID NO: 702545 - DNA, 22 bp, Artificial Sequence
  chemically synthesized
cccattccaatttttttctgta

SEQ ID NO: 702546 - DNA, 22 bp, Artificial Sequence
  chemically synthesized
ccattccaatttttttctgtat

SEQ ID NO: 702547 - DNA, 22 bp, Artificial Sequence
  chemically synthesized
caatttttttctgtatgatttc

SEQ ID NO: 702548 - DNA, 22 bp, Artificial Sequence
  chemically synthesized
ttttctgtatgatttctatttt

SEQ ID NO: 702549 - DNA, 22 bp, Artificial Sequence
  chemically synthesized
tttctgtatgatttctattttc

SEQ ID NO: 702550 - DNA, 22 bp, Artificial Sequence
  chemically synthesized
ttctgtatgatttctattttct

SEQ ID NO: 702551 - DNA, 22 bp, Artificial Sequence
  chemically synthesized
tctgtatgatttctattttctt

SEQ ID NO: 702552 - DNA, 22 bp, Artificial Sequence
  chemically synthesized
ctgtatgatttctattttcttt

SEQ ID NO: 702553 - DNA, 22 bp, Artificial Sequence
  chemically synthesized
tgtatgatttctattttctttt

SEQ ID NO: 702554 - DNA, 22 bp, Artificial Sequence
  chemically synthesized
tatgcgtcacatcaaaagaaaa

SEQ ID NO: 702555 - DNA, 22 bp, Artificial Sequence
  chemically synthesized
tatgatttctattttcttttga

SEQ ID NO: 702556 - DNA, 22 bp, Artificial Sequence
  chemically synthesized
ctattttcttttgatgtgacgc

SEQ ID NO: 702557 - DNA, 22 bp, Artificial Sequence
  chemically synthesized
caggaactatatgcgtcacatc

SEQ ID NO: 702558 - DNA, 22 bp, Artificial Sequence
  chemically synthesized
tattttcttttgatgtgacgca

SEQ ID NO: 702559 - DNA, 22 bp, Artificial Sequence
  chemically synthesized
ttttcttttgatgtgacgcata

SEQ ID NO: 702560 - DNA, 22 bp, Artificial Sequence
  chemically synthesized
ctacaggaactatatgcgtcac

SEQ ID NO: 702561 - DNA, 22 bp, Artificial Sequence
  chemically synthesized
gctacaggaactatatgcgtca

SEQ ID NO: 702562 - DNA, 22 bp, Artificial Sequence
  chemically synthesized
tcttttgatgtgacgcatatag

SEQ ID NO: 702563 - DNA, 22 bp, Artificial Sequence
  chemically synthesized
ttgctacaggaactatatgcgt

SEQ ID NO: 702564 - DNA, 22 bp, Artificial Sequence
  chemically synthesized
cttttgatgtgacgcatatagt

SEQ ID NO: 702565 - DNA, 22 bp, Artificial Sequence
  chemically synthesized
ttttgatgtgacgcatatagtt

SEQ ID NO: 702566 - DNA, 22 bp, Artificial Sequence
  chemically synthesized
ctcttgctacaggaactatatg

SEQ ID NO: 702567 - DNA, 22 bp, Artificial Sequence
  chemically synthesized
ttgatgtgacgcatatagttcc

SEQ ID NO: 702568 - DNA, 22 bp, Artificial Sequence
  chemically synthesized
actcttgctacaggaactatat

SEQ ID NO: 702569 - DNA, 22 bp, Artificial Sequence
  chemically synthesized
tgatgtgacgcatatagttcct

SEQ ID NO: 702570 - DNA, 22 bp, Artificial Sequence
  chemically synthesized
gatgtgacgcatatagttcctg

SEQ ID NO: 702571 - DNA, 22 bp, Artificial Sequence
  chemically synthesized
atgtgacgcatatagttcctgt

SEQ ID NO: 702572 - DNA, 22 bp, Artificial Sequence
  chemically synthesized
aatgacagaaaacttactcttg

SEQ ID NO: 702573 - DNA, 22 bp, Artificial Sequence
  chemically synthesized
aaatgacagaaaacttactctt

SEQ ID NO: 702574 - DNA, 22 bp, Artificial Sequence
  chemically synthesized
atttaaatgacagaaaacttac

SEQ ID NO: 702575 - DNA, 22 bp, Artificial Sequence
  chemically synthesized
ctgtagcaagagtaagttttct

SEQ ID NO: 702576 - DNA, 22 bp, Artificial Sequence
  chemically synthesized
catttaaatgacagaaaactta

SEQ ID NO: 702577 - DNA, 22 bp, Artificial Sequence
  chemically synthesized
tcatttaaatgacagaaaactt

SEQ ID NO: 702578 - DNA, 22 bp, Artificial Sequence
  chemically synthesized
tagcaagagtaagttttctgtc

SEQ ID NO: 702579 - DNA, 22 bp, Artificial Sequence
  chemically synthesized
gcctttcatttaaatgacagaa

SEQ ID NO: 702580 - DNA, 22 bp, Artificial Sequence
  chemically synthesized
ggcctttcatttaaatgacaga

SEQ ID NO: 702581 - DNA, 22 bp, Artificial Sequence
  chemically synthesized
acttggcctttcatttaaatga

SEQ ID NO: 702582 - DNA, 22 bp, Artificial Sequence
  chemically synthesized
aacttggcctttcatttaaatg

SEQ ID NO: 702583 - DNA, 22 bp, Artificial Sequence
  chemically synthesized
aatttaacttggcctttcattt

SEQ ID NO: 702584 - DNA, 22 bp, Artificial Sequence
  chemically synthesized
tctgtcatttaaatgaaaggcc

SEQ ID NO: 702585 - DNA, 22 bp, Artificial Sequence
  chemically synthesized
ctgtcatttaaatgaaaggcca

SEQ ID NO: 702586 - DNA, 22 bp, Artificial Sequence
  chemically synthesized
tgtcatttaaatgaaaggccaa

SEQ ID NO: 702587 - DNA, 22 bp, Artificial Sequence
  chemically synthesized
tcatttaaatgaaaggccaagt

SEQ ID NO: 702588 - DNA, 22 bp, Artificial Sequence
  chemically synthesized
aaaagtgttaaatttaacttgg

SEQ ID NO: 702589 - DNA, 22 bp, Artificial Sequence
  chemically synthesized
gaaaagtgttaaatttaacttg

SEQ ID NO: 702590 - DNA, 22 bp, Artificial Sequence
  chemically synthesized
aaatgaaaggccaagttaaatt

SEQ ID NO: 702591 - DNA, 22 bp, Artificial Sequence
  chemically synthesized
tgaaaagtgttaaatttaactt

SEQ ID NO: 702592 - DNA, 22 bp, Artificial Sequence
  chemically synthesized
aatgaaaggccaagttaaattt

SEQ ID NO: 702593 - DNA, 22 bp, Artificial Sequence
  chemically synthesized
acgttttgaaaagtgttaaatt

SEQ ID NO: 702594 - DNA, 22 bp, Artificial Sequence
  chemically synthesized
aacgttttgaaaagtgttaaat

SEQ ID NO: 702595 - DNA, 22 bp, Artificial Sequence
  chemically synthesized
atttaacgttttgaaaagtgtt

SEQ ID NO: 702596 - DNA, 22 bp, Artificial Sequence
  chemically synthesized
aatttaacgttttgaaaagtgt

SEQ ID NO: 702597 - DNA, 22 bp, Artificial Sequence
  chemically synthesized
taatttaacgttttgaaaagtg

SEQ ID NO: 702598 - DNA, 22 bp, Artificial Sequence
  chemically synthesized
ttttaatttaacgttttgaaaa

SEQ ID NO: 702599 - DNA, 22 bp, Artificial Sequence
  chemically synthesized
attttaatttaacgttttgaaa

SEQ ID NO: 702600 - DNA, 22 bp, Artificial Sequence
  chemically synthesized
aatttaacacttttcaaaacgt

SEQ ID NO: 702601 - DNA, 22 bp, Artificial Sequence
  chemically synthesized
tccttattttaatttaacgttt

SEQ ID NO: 702602 - DNA, 22 bp, Artificial Sequence
  chemically synthesized
aacacttttcaaaacgttaaat

SEQ ID NO: 702603 - DNA, 22 bp, Artificial Sequence
  chemically synthesized
acacttttcaaaacgttaaatt

SEQ ID NO: 702604 - DNA, 22 bp, Artificial Sequence
  chemically synthesized
ttcaaaacgttaaattaaaata

SEQ ID NO: 702605 - DNA, 22 bp, Artificial Sequence
  chemically synthesized
tcaaaacgttaaattaaaataa

SEQ ID NO: 702606 - DNA, 22 bp, Artificial Sequence
  chemically synthesized
caaaacgttaaattaaaataag

SEQ ID NO: 702607 - DNA, 22 bp, Artificial Sequence
  chemically synthesized
aaaacgttaaattaaaataagg

SEQ ID NO: 702608 - DNA, 22 bp, Artificial Sequence
  chemically synthesized
aattaaaataaggatagtgctt

SEQ ID NO: 702609 - DNA, 22 bp, Artificial Sequence
  chemically synthesized
aaataaggatagtgctttatat

SEQ ID NO: 702610 - DNA, 22 bp, Artificial Sequence
  chemically synthesized
atatacgatatagacatataaa

SEQ ID NO: 702611 - DNA, 22 bp, Artificial Sequence
  chemically synthesized
gatatacgatatagacatataa

SEQ ID NO: 702612 - DNA, 22 bp, Artificial Sequence
  chemically synthesized
tgatatacgatatagacatata

SEQ ID NO: 702613 - DNA, 22 bp, Artificial Sequence
  chemically synthesized
ttgatatacgatatagacatat

SEQ ID NO: 702614 - DNA, 22 bp, Artificial Sequence
  chemically synthesized
cttttgatatacgatatagaca

SEQ ID NO: 702615 - DNA, 22 bp, Artificial Sequence
  chemically synthesized
acttttgatatacgatatagac

SEQ ID NO: 702616 - DNA, 22 bp, Artificial Sequence
  chemically synthesized
tacttttgatatacgatataga

SEQ ID NO: 702617 - DNA, 22 bp, Artificial Sequence
  chemically synthesized
tatatgtctatatcgtatatca

SEQ ID NO: 702618 - DNA, 22 bp, Artificial Sequence
  chemically synthesized
aatctttacttttgatatacga

SEQ ID NO: 702619 - DNA, 22 bp, Artificial Sequence
  chemically synthesized
atatgtctatatcgtatatcaa

SEQ ID NO: 702620 - DNA, 22 bp, Artificial Sequence
  chemically synthesized
tatgtctatatcgtatatcaaa

SEQ ID NO: 702621 - DNA, 22 bp, Artificial Sequence
  chemically synthesized
attgaatctttacttttgatat

SEQ ID NO: 702622 - DNA, 22 bp, Artificial Sequence
  chemically synthesized
cattgaatctttacttttgata

SEQ ID NO: 702623 - DNA, 22 bp, Artificial Sequence
  chemically synthesized
tcattgaatctttacttttgat

SEQ ID NO: 702624 - DNA, 22 bp, Artificial Sequence
  chemically synthesized
tatcgtatatcaaaagtaaaga

SEQ ID NO: 702625 - DNA, 22 bp, Artificial Sequence
  chemically synthesized
aagttttcattgaatctttact

SEQ ID NO: 702626 - DNA, 22 bp, Artificial Sequence
  chemically synthesized
aaagttttcattgaatctttac

SEQ ID NO: 702627 - DNA, 22 bp, Artificial Sequence
  chemically synthesized
gtaagtgatcttaaagttttca

SEQ ID NO: 702628 - DNA, 22 bp, Artificial Sequence
  chemically synthesized
agtaagtgatcttaaagttttc

SEQ ID NO: 702629 - DNA, 22 bp, Artificial Sequence
  chemically synthesized
aaagtttagtaagtgatcttaa

SEQ ID NO: 702630 - DNA, 22 bp, Artificial Sequence
  chemically synthesized
gaaagtttagtaagtgatctta

SEQ ID NO: 702631 - DNA, 22 bp, Artificial Sequence
  chemically synthesized
aatgaaaactttaagatcactt

SEQ ID NO: 702632 - DNA, 22 bp, Artificial Sequence
  chemically synthesized
tgaaagtttagtaagtgatctt

SEQ ID NO: 702633 - DNA, 22 bp, Artificial Sequence
  chemically synthesized
cccatctttgaaagtttagtaa

SEQ ID NO: 702634 - DNA, 22 bp, Artificial Sequence
  chemically synthesized
taagatcacttactaaactttc

SEQ ID NO: 702635 - DNA, 22 bp, Artificial Sequence
  chemically synthesized
aagatcacttactaaactttca

SEQ ID NO: 702636 - DNA, 22 bp, Artificial Sequence
  chemically synthesized
agatcacttactaaactttcaa

SEQ ID NO: 702637 - DNA, 22 bp, Artificial Sequence
  chemically synthesized
tggaaagtctgcccatctttga

SEQ ID NO: 702638 - DNA, 22 bp, Artificial Sequence
  chemically synthesized
atggaaagtctgcccatctttg

SEQ ID NO: 702639 - DNA, 22 bp, Artificial Sequence
  chemically synthesized
tatggaaagtctgcccatcttt

SEQ ID NO: 702640 - DNA, 22 bp, Artificial Sequence
  chemically synthesized
actaaactttcaaagatgggca

SEQ ID NO: 702641 - DNA, 22 bp, Artificial Sequence
  chemically synthesized
ctaaactttcaaagatgggcag

SEQ ID NO: 702642 - DNA, 22 bp, Artificial Sequence
  chemically synthesized
aactttcaaagatgggcagact

SEQ ID NO: 702643 - DNA, 22 bp, Artificial Sequence
  chemically synthesized
aaatctttatggaaagtctgcc

SEQ ID NO: 702644 - DNA, 22 bp, Artificial Sequence
  chemically synthesized
tcaaagatgggcagactttcca

SEQ ID NO: 702645 - DNA, 22 bp, Artificial Sequence
  chemically synthesized
ttgaaatctttatggaaagtct

SEQ ID NO: 702646 - DNA, 22 bp, Artificial Sequence
  chemically synthesized
caaagatgggcagactttccat

SEQ ID NO: 702647 - DNA, 22 bp, Artificial Sequence
  chemically synthesized
aaagatgggcagactttccata

SEQ ID NO: 702648 - DNA, 22 bp, Artificial Sequence
  chemically synthesized
ctgttgaaatctttatggaaag

SEQ ID NO: 702649 - DNA, 22 bp, Artificial Sequence
  chemically synthesized
tgctgttgaaatctttatggaa

SEQ ID NO: 702650 - DNA, 22 bp, Artificial Sequence
  chemically synthesized
tctctgctgttgaaatctttat

SEQ ID NO: 702651 - DNA, 22 bp, Artificial Sequence
  chemically synthesized
tccataaagatttcaacagcag

SEQ ID NO: 702652 - DNA, 22 bp, Artificial Sequence
  chemically synthesized
ccataaagatttcaacagcaga

SEQ ID NO: 702653 - DNA, 22 bp, Artificial Sequence
  chemically synthesized
cataaagatttcaacagcagag

SEQ ID NO: 702654 - DNA, 22 bp, Artificial Sequence
  chemically synthesized
gaatgtagcccatctgtctctg

SEQ ID NO: 702655 - DNA, 22 bp, Artificial Sequence
  chemically synthesized
tggaatgtagcccatctgtctc

SEQ ID NO: 702656 - DNA, 22 bp, Artificial Sequence
  chemically synthesized
tctggaatgtagcccatctgtc

SEQ ID NO: 702657 - DNA, 22 bp, Artificial Sequence
  chemically synthesized
caacagcagagacagatgggct

SEQ ID NO: 702658 - DNA, 22 bp, Artificial Sequence
  chemically synthesized
aacagcagagacagatgggcta

SEQ ID NO: 702659 - DNA, 22 bp, Artificial Sequence
  chemically synthesized
ctctctggaatgtagcccatct

SEQ ID NO: 702660 - DNA, 22 bp, Artificial Sequence
  chemically synthesized
cctctctggaatgtagcccatc

SEQ ID NO: 702661 - DNA, 22 bp, Artificial Sequence
  chemically synthesized
tgaccttcctctctggaatgta

SEQ ID NO: 702662 - DNA, 22 bp, Artificial Sequence
  chemically synthesized
gtgaccttcctctctggaatgt

SEQ ID NO: 702663 - DNA, 22 bp, Artificial Sequence
  chemically synthesized
ttgtgaccttcctctctggaat

SEQ ID NO: 702664 - DNA, 22 bp, Artificial Sequence
  chemically synthesized
atcactcttgtgaccttcctct

SEQ ID NO: 702665 - DNA, 22 bp, Artificial Sequence
  chemically synthesized
cattccagagaggaaggtcaca

SEQ ID NO: 702666 - DNA, 22 bp, Artificial Sequence
  chemically synthesized
attcatcactcttgtgaccttc

SEQ ID NO: 702667 - DNA, 22 bp, Artificial Sequence
  chemically synthesized
cagagaggaaggtcacaagagt

SEQ ID NO: 702668 - DNA, 22 bp, Artificial Sequence
  chemically synthesized
gaggtctcattcatcactcttg

SEQ ID NO: 702669 - DNA, 22 bp, Artificial Sequence
  chemically synthesized
tggcagacattagaggtctcat

SEQ ID NO: 702670 - DNA, 22 bp, Artificial Sequence
  chemically synthesized
acagctatggcagacattagag

SEQ ID NO: 702671 - DNA, 22 bp, Artificial Sequence
  chemically synthesized
cacagctatggcagacattaga

SEQ ID NO: 702672 - DNA, 22 bp, Artificial Sequence
  chemically synthesized
tcacagctatggcagacattag

SEQ ID NO: 702673 - DNA, 22 bp, Artificial Sequence
  chemically synthesized
taatgtctgccatagctgtgaa

SEQ ID NO: 702674 - DNA, 22 bp, Artificial Sequence
  chemically synthesized
gccataaagattttcacagcta

SEQ ID NO: 702675 - DNA, 22 bp, Artificial Sequence
  chemically synthesized
atgtctgccatagctgtgaaaa

SEQ ID NO: 702676 - DNA, 22 bp, Artificial Sequence
  chemically synthesized
gttagccataaagattttcaca

SEQ ID NO: 702677 - DNA, 22 bp, Artificial Sequence
  chemically synthesized
agttagccataaagattttcac

SEQ ID NO: 702678 - DNA, 22 bp, Artificial Sequence
  chemically synthesized
tagttagccataaagattttca

SEQ ID NO: 702679 - DNA, 22 bp, Artificial Sequence
  chemically synthesized
ccatagctgtgaaaatctttat

SEQ ID NO: 702680 - DNA, 22 bp, Artificial Sequence
  chemically synthesized
ggaattttagttagccataaag

SEQ ID NO: 702681 - DNA, 22 bp, Artificial Sequence
  chemically synthesized
gttaggaattttagttagccat

SEQ ID NO: 702682 - DNA, 22 bp, Artificial Sequence
  chemically synthesized
tgaaaatctttatggctaacta

SEQ ID NO: 702683 - DNA, 22 bp, Artificial Sequence
  chemically synthesized
ttcgttaggaattttagttagc

SEQ ID NO: 702684 - DNA, 22 bp, Artificial Sequence
  chemically synthesized
ttattcgttaggaattttagtt

SEQ ID NO: 702685 - DNA, 22 bp, Artificial Sequence
  chemically synthesized
tatggctaactaaaattcctaa

SEQ ID NO: 702686 - DNA, 22 bp, Artificial Sequence
  chemically synthesized
atggctaactaaaattcctaac

SEQ ID NO: 702687 - DNA, 22 bp, Artificial Sequence
  chemically synthesized
tggctaactaaaattcctaacg

SEQ ID NO: 702688 - DNA, 22 bp, Artificial Sequence
  chemically synthesized
caggttgttattcgttaggaat

SEQ ID NO: 702689 - DNA, 22 bp, Artificial Sequence
  chemically synthesized
acaggttgttattcgttaggaa

SEQ ID NO: 702690 - DNA, 22 bp, Artificial Sequence
  chemically synthesized
actaaaattcctaacgaataac

SEQ ID NO: 702691 - DNA, 22 bp, Artificial Sequence
  chemically synthesized
aaattcctaacgaataacaacc

SEQ ID NO: 702692 - DNA, 22 bp, Artificial Sequence
  chemically synthesized
atataatatttacaggttgtta

SEQ ID NO: 702693 - DNA, 22 bp, Artificial Sequence
  chemically synthesized
ctaacgaataacaacctgtaaa

SEQ ID NO: 702694 - DNA, 22 bp, Artificial Sequence
  chemically synthesized
acgaataacaacctgtaaatat

SEQ ID NO: 702695 - DNA, 22 bp, Artificial Sequence
  chemically synthesized
acagctcatataatatttacag

SEQ ID NO: 702696 - DNA, 22 bp, Artificial Sequence
  chemically synthesized
tctgacagctcatataatattt

SEQ ID NO: 702697 - DNA, 22 bp, Artificial Sequence
  chemically synthesized
tctgtctgacagctcatataat

SEQ ID NO: 702698 - DNA, 22 bp, Artificial Sequence
  chemically synthesized
taaatattatatgagctgtcag

SEQ ID NO: 702699 - DNA, 22 bp, Artificial Sequence
  chemically synthesized
agcattatctgtctgacagctc

SEQ ID NO: 702700 - DNA, 22 bp, Artificial Sequence
  chemically synthesized
agagctcagcattatctgtctg

SEQ ID NO: 702701 - DNA, 22 bp, Artificial Sequence
  chemically synthesized
tatgagctgtcagacagataat

SEQ ID NO: 702702 - DNA, 22 bp, Artificial Sequence
  chemically synthesized
tcagacagataatgctgagctc

SEQ ID NO: 702703 - DNA, 22 bp, Artificial Sequence
  chemically synthesized
accatgtgcaatggtctcagag

SEQ ID NO: 702704 - DNA, 22 bp, Artificial Sequence
  chemically synthesized
ttcaccatgtgcaatggtctca

SEQ ID NO: 702705 - DNA, 22 bp, Artificial Sequence
  chemically synthesized
tgttcaccatgtgcaatggtct

SEQ ID NO: 702706 - DNA, 22 bp, Artificial Sequence
  chemically synthesized
agctctgagaccattgcacatg

SEQ ID NO: 702707 - DNA, 22 bp, Artificial Sequence
  chemically synthesized
tgagaccattgcacatggtgaa

SEQ ID NO: 702708 - DNA, 22 bp, Artificial Sequence
  chemically synthesized
agaccattgcacatggtgaaca

SEQ ID NO: 702709 - DNA, 22 bp, Artificial Sequence
  chemically synthesized
cacatggtgaacagaataccac

SEQ ID NO: 702710 - DNA, 22 bp, Artificial Sequence
  chemically synthesized
acaaatcccatggtgtggtatt

SEQ ID NO: 702711 - DNA, 22 bp, Artificial Sequence
  chemically synthesized
ctgacaaatcccatggtgtggt

SEQ ID NO: 702712 - DNA, 22 bp, Artificial Sequence
  chemically synthesized
gcaatctactgacaaatcccat

SEQ ID NO: 702713 - DNA, 22 bp, Artificial Sequence
  chemically synthesized
ggcaatctactgacaaatccca

SEQ ID NO: 702714 - DNA, 22 bp, Artificial Sequence
  chemically synthesized
aatgacttggcaatctactgac

SEQ ID NO: 702715 - DNA, 22 bp, Artificial Sequence
  chemically synthesized
taaatgacttggcaatctactg

SEQ ID NO: 702716 - DNA, 22 bp, Artificial Sequence
  chemically synthesized
atactctaaatgacttggcaat

SEQ ID NO: 702717 - DNA, 22 bp, Artificial Sequence
  chemically synthesized
gtcagtagattgccaagtcatt

SEQ ID NO: 702718 - DNA, 22 bp, Artificial Sequence
  chemically synthesized
tcagtagattgccaagtcattt

SEQ ID NO: 702719 - DNA, 22 bp, Artificial Sequence
  chemically synthesized
ccaagtcatttagagtatcagg

SEQ ID NO: 702720 - DNA, 22 bp, Artificial Sequence
  chemically synthesized
ccagatcaaatgtgagcctgat

SEQ ID NO: 702721 - DNA, 22 bp, Artificial Sequence
  chemically synthesized
cccagatcaaatgtgagcctga

SEQ ID NO: 702722 - DNA, 22 bp, Artificial Sequence
  chemically synthesized
acttcccagatcaaatgtgagc

SEQ ID NO: 702723 - DNA, 22 bp, Artificial Sequence
  chemically synthesized
gacttcccagatcaaatgtgag

SEQ ID NO: 702724 - DNA, 22 bp, Artificial Sequence
  chemically synthesized
agagtatcaggctcacatttga

SEQ ID NO: 702725 - DNA, 22 bp, Artificial Sequence
  chemically synthesized
gagtatcaggctcacatttgat

SEQ ID NO: 702726 - DNA, 22 bp, Artificial Sequence
  chemically synthesized
ttgacttcccagatcaaatgtg

SEQ ID NO: 702727 - DNA, 22 bp, Artificial Sequence
  chemically synthesized
gtatgaactcttgacttcccag

SEQ ID NO: 702728 - DNA, 22 bp, Artificial Sequence
  chemically synthesized
agtatgaactcttgacttccca

SEQ ID NO: 702729 - DNA, 22 bp, Artificial Sequence
  chemically synthesized
tagtatgaactcttgacttccc

SEQ ID NO: 702730 - DNA, 22 bp, Artificial Sequence
  chemically synthesized
acatttgatctgggaagtcaag

SEQ ID NO: 702731 - DNA, 22 bp, Artificial Sequence
  chemically synthesized
gatctgggaagtcaagagttca

SEQ ID NO: 702732 - DNA, 22 bp, Artificial Sequence
  chemically synthesized
atctgggaagtcaagagttcat

SEQ ID NO: 702733 - DNA, 22 bp, Artificial Sequence
  chemically synthesized
ccaagaattttagtatgaactc

SEQ ID NO: 702734 - DNA, 22 bp, Artificial Sequence
  chemically synthesized
gccaagaattttagtatgaact

SEQ ID NO: 702735 - DNA, 22 bp, Artificial Sequence
  chemically synthesized
ggaagtcaagagttcatactaa

SEQ ID NO: 702736 - DNA, 22 bp, Artificial Sequence
  chemically synthesized
agtcaccttgccaagaatttta

SEQ ID NO: 702737 - DNA, 22 bp, Artificial Sequence
  chemically synthesized
caactcagtcaccttgccaaga

SEQ ID NO: 702738 - DNA, 22 bp, Artificial Sequence
  chemically synthesized
atactaaaattcttggcaaggt

SEQ ID NO: 702739 - DNA, 22 bp, Artificial Sequence
  chemically synthesized
tgcaactcagtcaccttgccaa

SEQ ID NO: 702740 - DNA, 22 bp, Artificial Sequence
  chemically synthesized
tctctgcaactcagtcaccttg

SEQ ID NO: 702741 - DNA, 22 bp, Artificial Sequence
  chemically synthesized
atctctgcaactcagtcacctt

SEQ ID NO: 702742 - DNA, 22 bp, Artificial Sequence
  chemically synthesized
aaattcttggcaaggtgactga

SEQ ID NO: 702743 - DNA, 22 bp, Artificial Sequence
  chemically synthesized
tatctctgcaactcagtcacct

SEQ ID NO: 702744 - DNA, 22 bp, Artificial Sequence
  chemically synthesized
ttggcaaggtgactgagttgca

SEQ ID NO: 702745 - DNA, 22 bp, Artificial Sequence
  chemically synthesized
ggcaaggtgactgagttgcaga

SEQ ID NO: 702746 - DNA, 22 bp, Artificial Sequence
  chemically synthesized
gcaaggtgactgagttgcagag

SEQ ID NO: 702747 - DNA, 22 bp, Artificial Sequence
  chemically synthesized
gatatagttttatctctgcaac

SEQ ID NO: 702748 - DNA, 22 bp, Artificial Sequence
  chemically synthesized
gatattagatatagttttatct

SEQ ID NO: 702749 - DNA, 22 bp, Artificial Sequence
  chemically synthesized
agttgcagagataaaactatat

SEQ ID NO: 702750 - DNA, 22 bp, Artificial Sequence
  chemically synthesized
cagagataaaactatatctaat

SEQ ID NO: 702751 - DNA, 22 bp, Artificial Sequence
  chemically synthesized
tgcagccatcagcactggatat

SEQ ID NO: 702752 - DNA, 22 bp, Artificial Sequence
  chemically synthesized
tatctaatatccagtgctgatg

SEQ ID NO: 702753 - DNA, 22 bp, Artificial Sequence
  chemically synthesized
tgtgactgtgcagccatcagca

SEQ ID NO: 702754 - DNA, 22 bp, Artificial Sequence
  chemically synthesized
gtgtgactgtgcagccatcagc

SEQ ID NO: 702755 - DNA, 22 bp, Artificial Sequence
  chemically synthesized
tgtgtgactgtgcagccatcag

SEQ ID NO: 702756 - DNA, 22 bp, Artificial Sequence
  chemically synthesized
atatccagtgctgatggctgca

SEQ ID NO: 702757 - DNA, 22 bp, Artificial Sequence
  chemically synthesized
gactttgtgtgactgtgcagcc

SEQ ID NO: 702758 - DNA, 22 bp, Artificial Sequence
  chemically synthesized
ttagactttgtgtgactgtgca

SEQ ID NO: 702759 - DNA, 22 bp, Artificial Sequence
  chemically synthesized
gctattagactttgtgtgactg

SEQ ID NO: 702760 - DNA, 22 bp, Artificial Sequence
  chemically synthesized
ggctattagactttgtgtgact

SEQ ID NO: 702761 - DNA, 22 bp, Artificial Sequence
  chemically synthesized
tggctattagactttgtgtgac

SEQ ID NO: 702762 - DNA, 22 bp, Artificial Sequence
  chemically synthesized
atggctgcacagtcacacaaag

SEQ ID NO: 702763 - DNA, 22 bp, Artificial Sequence
  chemically synthesized
cacagtcacacaaagtctaata

SEQ ID NO: 702764 - DNA, 22 bp, Artificial Sequence
  chemically synthesized
atgagtaatgccgcccaacttt

SEQ ID NO: 702765 - DNA, 22 bp, Artificial Sequence
  chemically synthesized
catgagtaatgccgcccaactt

SEQ ID NO: 702766 - DNA, 22 bp, Artificial Sequence
  chemically synthesized
tcatgagtaatgccgcccaact

SEQ ID NO: 702767 - DNA, 22 bp, Artificial Sequence
  chemically synthesized
ttcatgagtaatgccgcccaac

SEQ ID NO: 702768 - DNA, 22 bp, Artificial Sequence
  chemically synthesized
tttcatgagtaatgccgcccaa

SEQ ID NO: 702769 - DNA, 22 bp, Artificial Sequence
  chemically synthesized
ttttcatgagtaatgccgccca

SEQ ID NO: 702770 - DNA, 22 bp, Artificial Sequence
  chemically synthesized
atagccaaagttgggcggcatt

SEQ ID NO: 702771 - DNA, 22 bp, Artificial Sequence
  chemically synthesized
tttttcatgagtaatgccgccc

SEQ ID NO: 702772 - DNA, 22 bp, Artificial Sequence
  chemically synthesized
ttttttcatgagtaatgccgcc

SEQ ID NO: 702773 - DNA, 22 bp, Artificial Sequence
  chemically synthesized
tttttttcatgagtaatgccgc

SEQ ID NO: 702774 - DNA, 22 bp, Artificial Sequence
  chemically synthesized
ttttttttcatgagtaatgccg

SEQ ID NO: 702775 - DNA, 22 bp, Artificial Sequence
  chemically synthesized
tttttttttcatgagtaatgcc

SEQ ID NO: 702776 - DNA, 22 bp, Artificial Sequence
  chemically synthesized
tttttttttttcatgagtaatg

SEQ ID NO: 702777 - DNA, 22 bp, Artificial Sequence
  chemically synthesized
ctttttttttttcatgagtaat

SEQ ID NO: 702778 - DNA, 22 bp, Artificial Sequence
  chemically synthesized
tctttttttttttcatgagtaa

SEQ ID NO: 702779 - DNA, 22 bp, Artificial Sequence
  chemically synthesized
ttctttttttttttcatgagta

SEQ ID NO: 702780 - DNA, 22 bp, Artificial Sequence
  chemically synthesized
tttctttttttttttcatgagt

SEQ ID NO: 702781 - DNA, 22 bp, Artificial Sequence
  chemically synthesized
ttttctttttttttttcatgag

SEQ ID NO: 702782 - DNA, 22 bp, Artificial Sequence
  chemically synthesized
tttttctttttttttttcatga

SEQ ID NO: 702783 - DNA, 22 bp, Artificial Sequence
  chemically synthesized
ggcggcattactcatgaaaaaa

SEQ ID NO: 702784 - DNA, 22 bp, Artificial Sequence
  chemically synthesized
ttttttctttttttttttcatg

SEQ ID NO: 702785 - DNA, 22 bp, Artificial Sequence
  chemically synthesized
ctcatgaaaaaaaaaaagaaaa

SEQ ID NO: 702786 - DNA, 22 bp, Artificial Sequence
  chemically synthesized
gaagcagcttttttttcttttt

SEQ ID NO: 702787 - DNA, 22 bp, Artificial Sequence
  chemically synthesized
atgaaaaaaaaaaagaaaaaaa

SEQ ID NO: 702788 - DNA, 22 bp, Artificial Sequence
  chemically synthesized
taagtcggttagaagcagcttt

SEQ ID NO: 702789 - DNA, 22 bp, Artificial Sequence
  chemically synthesized
tataagtcggttagaagcagct

SEQ ID NO: 702790 - DNA, 22 bp, Artificial Sequence
  chemically synthesized
ctataagtcggttagaagcagc

SEQ ID NO: 702791 - DNA, 22 bp, Artificial Sequence
  chemically synthesized
tctataagtcggttagaagcag

SEQ ID NO: 702792 - DNA, 22 bp, Artificial Sequence
  chemically synthesized
aagttttctataagtcggttag

SEQ ID NO: 702793 - DNA, 22 bp, Artificial Sequence
  chemically synthesized
gaagttttctataagtcggtta

SEQ ID NO: 702794 - DNA, 22 bp, Artificial Sequence
  chemically synthesized
tgaagttttctataagtcggtt

SEQ ID NO: 702795 - DNA, 22 bp, Artificial Sequence
  chemically synthesized
ttgaagttttctataagtcggt

SEQ ID NO: 702796 - DNA, 22 bp, Artificial Sequence
  chemically synthesized
cttctaaccgacttatagaaaa

SEQ ID NO: 702797 - DNA, 22 bp, Artificial Sequence
  chemically synthesized
ctaaccgacttatagaaaactt

SEQ ID NO: 702798 - DNA, 22 bp, Artificial Sequence
  chemically synthesized
taaccgacttatagaaaacttc

SEQ ID NO: 702799 - DNA, 22 bp, Artificial Sequence
  chemically synthesized
accgacttatagaaaacttcaa

SEQ ID NO: 702800 - DNA, 22 bp, Artificial Sequence
  chemically synthesized
ataatcaccgtgatgtttttga

SEQ ID NO: 702801 - DNA, 22 bp, Artificial Sequence
  chemically synthesized
atagaaaacttcaaaaacatca

SEQ ID NO: 702802 - DNA, 22 bp, Artificial Sequence
  chemically synthesized
taataatcaccgtgatgttttt

SEQ ID NO: 702803 - DNA, 22 bp, Artificial Sequence
  chemically synthesized
tagaaaacttcaaaaacatcac

SEQ ID NO: 702804 - DNA, 22 bp, Artificial Sequence
  chemically synthesized
ctaataatcaccgtgatgtttt

SEQ ID NO: 702805 - DNA, 22 bp, Artificial Sequence
  chemically synthesized
ttctaataatcaccgtgatgtt

SEQ ID NO: 702806 - DNA, 22 bp, Artificial Sequence
  chemically synthesized
ctcttctaataatcaccgtgat

SEQ ID NO: 702807 - DNA, 22 bp, Artificial Sequence
  chemically synthesized
actcttctaataatcaccgtga

SEQ ID NO: 702808 - DNA, 22 bp, Artificial Sequence
  chemically synthesized
ttactcttctaataatcaccgt

SEQ ID NO: 702809 - DNA, 22 bp, Artificial Sequence
  chemically synthesized
cttactcttctaataatcaccg

SEQ ID NO: 702810 - DNA, 22 bp, Artificial Sequence
  chemically synthesized
caaaaacatcacggtgattatt

SEQ ID NO: 702811 - DNA, 22 bp, Artificial Sequence
  chemically synthesized
tcttactcttctaataatcacc

SEQ ID NO: 702812 - DNA, 22 bp, Artificial Sequence
  chemically synthesized
aaaaacatcacggtgattatta

SEQ ID NO: 702813 - DNA, 22 bp, Artificial Sequence
  chemically synthesized
ctttcttactcttctaataatc

SEQ ID NO: 702814 - DNA, 22 bp, Artificial Sequence
  chemically synthesized
attgctttcttactcttctaat

SEQ ID NO: 702815 - DNA, 22 bp, Artificial Sequence
  chemically synthesized
gattgctttcttactcttctaa

SEQ ID NO: 702816 - DNA, 22 bp, Artificial Sequence
  chemically synthesized
ggaagcttgattgctttcttac

SEQ ID NO: 702817 - DNA, 22 bp, Artificial Sequence
  chemically synthesized
aggaagcttgattgctttctta

SEQ ID NO: 702818 - DNA, 22 bp, Artificial Sequence
  chemically synthesized
ttagaagagtaagaaagcaatc

SEQ ID NO: 702819 - DNA, 22 bp, Artificial Sequence
  chemically synthesized
accttaggaagcttgattgctt

SEQ ID NO: 702820 - DNA, 22 bp, Artificial Sequence
  chemically synthesized
gaagagtaagaaagcaatcaag

SEQ ID NO: 702821 - DNA, 22 bp, Artificial Sequence
  chemically synthesized
tatctgaccttaggaagcttga

SEQ ID NO: 702822 - DNA, 22 bp, Artificial Sequence
  chemically synthesized
ctatatctgaccttaggaagct

SEQ ID NO: 702823 - DNA, 22 bp, Artificial Sequence
  chemically synthesized
cctatatctgaccttaggaagc

SEQ ID NO: 702824 - DNA, 22 bp, Artificial Sequence
  chemically synthesized
tcttcctatatctgaccttagg

SEQ ID NO: 702825 - DNA, 22 bp, Artificial Sequence
  chemically synthesized
cctaaggtcagatataggaaga

SEQ ID NO: 702826 - DNA, 22 bp, Artificial Sequence
  chemically synthesized
tgtaggtatctatcttcctata

SEQ ID NO: 702827 - DNA, 22 bp, Artificial Sequence
  chemically synthesized
ctaaggtcagatataggaagat

SEQ ID NO: 702828 - DNA, 22 bp, Artificial Sequence
  chemically synthesized
atgtaggtatctatcttcctat

SEQ ID NO: 702829 - DNA, 22 bp, Artificial Sequence
  chemically synthesized
aggtcagatataggaagataga

SEQ ID NO: 702830 - DNA, 22 bp, Artificial Sequence
  chemically synthesized
tttatgtaggtatctatcttcc

SEQ ID NO: 702831 - DNA, 22 bp, Artificial Sequence
  chemically synthesized
tatttatgtaggtatctatctt

SEQ ID NO: 702832 - DNA, 22 bp, Artificial Sequence
  chemically synthesized
atggctctatttatgtaggtat

SEQ ID NO: 702833 - DNA, 22 bp, Artificial Sequence
  chemically synthesized
ttcatggctctatttatgtagg

SEQ ID NO: 702834 - DNA, 22 bp, Artificial Sequence
  chemically synthesized
agcataaattattcatggctct

SEQ ID NO: 702835 - DNA, 22 bp, Artificial Sequence
  chemically synthesized
gagcataaattattcatggctc

SEQ ID NO: 702836 - DNA, 22 bp, Artificial Sequence
  chemically synthesized
cttgagcataaattattcatgg

SEQ ID NO: 702837 - DNA, 22 bp, Artificial Sequence
  chemically synthesized
cataaatagagccatgaataat

SEQ ID NO: 702838 - DNA, 22 bp, Artificial Sequence
  chemically synthesized
gaaaattccttgagcataaatt

SEQ ID NO: 702839 - DNA, 22 bp, Artificial Sequence
  chemically synthesized
ctcgaaaattccttgagcataa

SEQ ID NO: 702840 - DNA, 22 bp, Artificial Sequence
  chemically synthesized
actcgaaaattccttgagcata

SEQ ID NO: 702841 - DNA, 22 bp, Artificial Sequence
  chemically synthesized
gaatttactcgaaaattccttg

SEQ ID NO: 702842 - DNA, 22 bp, Artificial Sequence
  chemically synthesized
tgttcgaatttactcgaaaatt

SEQ ID NO: 702843 - DNA, 22 bp, Artificial Sequence
  chemically synthesized
atgctcaaggaattttcgagta

SEQ ID NO: 702844 - DNA, 22 bp, Artificial Sequence
  chemically synthesized
tgctcaaggaattttcgagtaa

SEQ ID NO: 702845 - DNA, 22 bp, Artificial Sequence
  chemically synthesized
aaggaattttcgagtaaattcg

SEQ ID NO: 702846 - DNA, 22 bp, Artificial Sequence
  chemically synthesized
tcgagtaaattcgaacataatt

SEQ ID NO: 702847 - DNA, 22 bp, Artificial Sequence
  chemically synthesized
cgagtaaattcgaacataattg

SEQ ID NO: 702848 - DNA, 22 bp, Artificial Sequence
  chemically synthesized
gagtaaattcgaacataattgg

SEQ ID NO: 702849 - DNA, 22 bp, Artificial Sequence
  chemically synthesized
gtaatgcagtcagccaattatg

SEQ ID NO: 702850 - DNA, 22 bp, Artificial Sequence
  chemically synthesized
cctggtaatgcagtcagccaat

SEQ ID NO: 702851 - DNA, 22 bp, Artificial Sequence
  chemically synthesized
gaacataattggctgactgcat

SEQ ID NO: 702852 - DNA, 22 bp, Artificial Sequence
  chemically synthesized
gaggaaagttccctggtaatgc

SEQ ID NO: 702853 - DNA, 22 bp, Artificial Sequence
  chemically synthesized
cctggaggaaagttccctggta

SEQ ID NO: 702854 - DNA, 22 bp, Artificial Sequence
  chemically synthesized
gctgactgcattaccagggaac

SEQ ID NO: 702855 - DNA, 22 bp, Artificial Sequence
  chemically synthesized
actgcattaccagggaactttc

SEQ ID NO: 702856 - DNA, 22 bp, Artificial Sequence
  chemically synthesized
cattaccagggaactttcctcc

SEQ ID NO: 702857 - DNA, 22 bp, Artificial Sequence
  chemically synthesized
taaccaccattacctggaggaa

SEQ ID NO: 702858 - DNA, 22 bp, Artificial Sequence
  chemically synthesized
ccagggaactttcctccaggta

SEQ ID NO: 702859 - DNA, 22 bp, Artificial Sequence
  chemically synthesized
tcctccaggtaatggtggttac

SEQ ID NO: 702860 - DNA, 22 bp, Artificial Sequence
  chemically synthesized
cctccaggtaatggtggttaca

SEQ ID NO: 702861 - DNA, 22 bp, Artificial Sequence
  chemically synthesized
ctccaggtaatggtggttacag

SEQ ID NO: 702862 - DNA, 22 bp, Artificial Sequence
  chemically synthesized
caggtaatggtggttacagtct

SEQ ID NO: 702863 - DNA, 22 bp, Artificial Sequence
  chemically synthesized
acccagatggcccaaagactgt

SEQ ID NO: 702864 - DNA, 22 bp, Artificial Sequence
  chemically synthesized
aacccagatggcccaaagactg

SEQ ID NO: 702865 - DNA, 22 bp, Artificial Sequence
  chemically synthesized
acttaacccagatggcccaaag

SEQ ID NO: 702866 - DNA, 22 bp, Artificial Sequence
  chemically synthesized
cagtctttgggccatctgggtt

SEQ ID NO: 702867 - DNA, 22 bp, Artificial Sequence
  chemically synthesized
gtaacctgacttaacccagatg

SEQ ID NO: 702868 - DNA, 22 bp, Artificial Sequence
  chemically synthesized
ttagtaacctgacttaacccag

SEQ ID NO: 702869 - DNA, 22 bp, Artificial Sequence
  chemically synthesized
gttagtaacctgacttaaccca

SEQ ID NO: 702870 - DNA, 22 bp, Artificial Sequence
  chemically synthesized
tgggccatctgggttaagtcag

SEQ ID NO: 702871 - DNA, 22 bp, Artificial Sequence
  chemically synthesized
gggccatctgggttaagtcagg

SEQ ID NO: 702872 - DNA, 22 bp, Artificial Sequence
  chemically synthesized
acttgttagtaacctgacttaa

SEQ ID NO: 702873 - DNA, 22 bp, Artificial Sequence
  chemically synthesized
ggccatctgggttaagtcaggt

SEQ ID NO: 702874 - DNA, 22 bp, Artificial Sequence
  chemically synthesized
cattgacttgttagtaacctga

SEQ ID NO: 702875 - DNA, 22 bp, Artificial Sequence
  chemically synthesized
ggttaagtcaggttactaacaa

SEQ ID NO: 702876 - DNA, 22 bp, Artificial Sequence
  chemically synthesized
gcgatattgcattgacttgtta

SEQ ID NO: 702877 - DNA, 22 bp, Artificial Sequence
  chemically synthesized
agtcaggttactaacaagtcaa

SEQ ID NO: 702878 - DNA, 22 bp, Artificial Sequence
  chemically synthesized
ctaacaagtcaatgcaatatcg

SEQ ID NO: 702879 - DNA, 22 bp, Artificial Sequence
  chemically synthesized
acaagtcaatgcaatatcgcca

SEQ ID NO: 702880 - DNA, 22 bp, Artificial Sequence
  chemically synthesized
cagagacagtaaaggcacctgg

SEQ ID NO: 702881 - DNA, 22 bp, Artificial Sequence
  chemically synthesized
aaagtacatctgcagagacagt

SEQ ID NO: 702882 - DNA, 22 bp, Artificial Sequence
  chemically synthesized
aaaagtacatctgcagagacag

SEQ ID NO: 702883 - DNA, 22 bp, Artificial Sequence
  chemically synthesized
taaaagtacatctgcagagaca

SEQ ID NO: 702884 - DNA, 22 bp, Artificial Sequence
  chemically synthesized
ttaaaagtacatctgcagagac

SEQ ID NO: 702885 - DNA, 22 bp, Artificial Sequence
  chemically synthesized
tcgtcttttaaaagtacatctg

SEQ ID NO: 702886 - DNA, 22 bp, Artificial Sequence
  chemically synthesized
tactgtctctgcagatgtactt

SEQ ID NO: 702887 - DNA, 22 bp, Artificial Sequence
  chemically synthesized
actgtctctgcagatgtacttt

SEQ ID NO: 702888 - DNA, 22 bp, Artificial Sequence
  chemically synthesized
ctgtctctgcagatgtactttt

SEQ ID NO: 702889 - DNA, 22 bp, Artificial Sequence
  chemically synthesized
cctgtcgtcttttaaaagtaca

SEQ ID NO: 702890 - DNA, 22 bp, Artificial Sequence
  chemically synthesized
tctctgcagatgtacttttaaa

SEQ ID NO: 702891 - DNA, 22 bp, Artificial Sequence
  chemically synthesized
tgcagatgtacttttaaaagac

SEQ ID NO: 702892 - DNA, 22 bp, Artificial Sequence
  chemically synthesized
cagatgtacttttaaaagacga

SEQ ID NO: 702893 - DNA, 22 bp, Artificial Sequence
  chemically synthesized
agcaaatggtgtggactgcctg

SEQ ID NO: 702894 - DNA, 22 bp, Artificial Sequence
  chemically synthesized
ttaaaagacgacaggcagtcca

SEQ ID NO: 702895 - DNA, 22 bp, Artificial Sequence
  chemically synthesized
taaaagacgacaggcagtccac

SEQ ID NO: 702896 - DNA, 22 bp, Artificial Sequence
  chemically synthesized
aaaagacgacaggcagtccaca

SEQ ID NO: 702897 - DNA, 22 bp, Artificial Sequence
  chemically synthesized
aaagacgacaggcagtccacac

SEQ ID NO: 702898 - DNA, 22 bp, Artificial Sequence
  chemically synthesized
acacagagagcgttcagcaaat

SEQ ID NO: 702899 - DNA, 22 bp, Artificial Sequence
  chemically synthesized
cacacagagagcgttcagcaaa

SEQ ID NO: 702900 - DNA, 22 bp, Artificial Sequence
  chemically synthesized
tcacacagagagcgttcagcaa

SEQ ID NO: 702901 - DNA, 22 bp, Artificial Sequence
  chemically synthesized
atacaatacctttcacacagag

SEQ ID NO: 702902 - DNA, 22 bp, Artificial Sequence
  chemically synthesized
gctgaacgctctctgtgtgaaa

SEQ ID NO: 702903 - DNA, 22 bp, Artificial Sequence
  chemically synthesized
ctgaacgctctctgtgtgaaag

SEQ ID NO: 702904 - DNA, 22 bp, Artificial Sequence
  chemically synthesized
aacgctctctgtgtgaaaggta

SEQ ID NO: 702905 - DNA, 22 bp, Artificial Sequence
  chemically synthesized
gtgcctaatacaatacctttca

SEQ ID NO: 702906 - DNA, 22 bp, Artificial Sequence
  chemically synthesized
cctggtgcctaatacaatacct

SEQ ID NO: 702907 - DNA, 22 bp, Artificial Sequence
  chemically synthesized
ccctggtgcctaatacaatacc

SEQ ID NO: 702908 - DNA, 22 bp, Artificial Sequence
  chemically synthesized
tctgtgtgaaaggtattgtatt

SEQ ID NO: 702909 - DNA, 22 bp, Artificial Sequence
  chemically synthesized
tgtgtgaaaggtattgtattag

SEQ ID NO: 702910 - DNA, 22 bp, Artificial Sequence
  chemically synthesized
tgtgaaaggtattgtattaggc

SEQ ID NO: 702911 - DNA, 22 bp, Artificial Sequence
  chemically synthesized
aaatttccctggtgcctaatac

SEQ ID NO: 702912 - DNA, 22 bp, Artificial Sequence
  chemically synthesized
gaaatttccctggtgcctaata

SEQ ID NO: 702913 - DNA, 22 bp, Artificial Sequence
  chemically synthesized
cttgaaatttccctggtgccta

SEQ ID NO: 702914 - DNA, 22 bp, Artificial Sequence
  chemically synthesized
ccttgaaatttccctggtgcct

SEQ ID NO: 702915 - DNA, 22 bp, Artificial Sequence
  chemically synthesized
tccttgaaatttccctggtgcc

SEQ ID NO: 702916 - DNA, 22 bp, Artificial Sequence
  chemically synthesized
ctttccttgaaatttccctggt

SEQ ID NO: 702917 - DNA, 22 bp, Artificial Sequence
  chemically synthesized
actttccttgaaatttccctgg

SEQ ID NO: 702918 - DNA, 22 bp, Artificial Sequence
  chemically synthesized
tactttccttgaaatttccctg

SEQ ID NO: 702919 - DNA, 22 bp, Artificial Sequence
  chemically synthesized
tattaggcaccagggaaatttc

SEQ ID NO: 702920 - DNA, 22 bp, Artificial Sequence
  chemically synthesized
aaattttactttccttgaaatt

SEQ ID NO: 702921 - DNA, 22 bp, Artificial Sequence
  chemically synthesized
ggcaccagggaaatttcaagga

SEQ ID NO: 702922 - DNA, 22 bp, Artificial Sequence
  chemically synthesized
caaattttactttccttgaaat

SEQ ID NO: 702923 - DNA, 22 bp, Artificial Sequence
  chemically synthesized
aggtttcaaattttactttcct

SEQ ID NO: 702924 - DNA, 22 bp, Artificial Sequence
  chemically synthesized
tctcaggtttcaaattttactt

SEQ ID NO: 702925 - DNA, 22 bp, Artificial Sequence
  chemically synthesized
ctgtctcaggtttcaaatttta

SEQ ID NO: 702926 - DNA, 22 bp, Artificial Sequence
  chemically synthesized
caaggaaagtaaaatttgaaac

SEQ ID NO: 702927 - DNA, 22 bp, Artificial Sequence
  chemically synthesized
aaggaaagtaaaatttgaaacc

SEQ ID NO: 702928 - DNA, 22 bp, Artificial Sequence
  chemically synthesized
cctactgtctcaggtttcaaat

SEQ ID NO: 702929 - DNA, 22 bp, Artificial Sequence
  chemically synthesized
ctccctactgtctcaggtttca

SEQ ID NO: 702930 - DNA, 22 bp, Artificial Sequence
  chemically synthesized
agttgctccctactgtctcagg

SEQ ID NO: 702931 - DNA, 22 bp, Artificial Sequence
  chemically synthesized
atatctgagttgctccctactg

SEQ ID NO: 702932 - DNA, 22 bp, Artificial Sequence
  chemically synthesized
gaaacctgagacagtagggagc

SEQ ID NO: 702933 - DNA, 22 bp, Artificial Sequence
  chemically synthesized
aatatctgagttgctccctact

SEQ ID NO: 702934 - DNA, 22 bp, Artificial Sequence
  chemically synthesized
aaacctgagacagtagggagca

SEQ ID NO: 702935 - DNA, 22 bp, Artificial Sequence
  chemically synthesized
taatatctgagttgctccctac

SEQ ID NO: 702936 - DNA, 22 bp, Artificial Sequence
  chemically synthesized
ttaatatctgagttgctcccta

SEQ ID NO: 702937 - DNA, 22 bp, Artificial Sequence
  chemically synthesized
gtttttaatatctgagttgctc

SEQ ID NO: 702938 - DNA, 22 bp, Artificial Sequence
  chemically synthesized
ggtttttaatatctgagttgct

SEQ ID NO: 702939 - DNA, 22 bp, Artificial Sequence
  chemically synthesized
agacagtagggagcaactcaga

SEQ ID NO: 702940 - DNA, 22 bp, Artificial Sequence
  chemically synthesized
tgatcatttggtttttaatatc

SEQ ID NO: 702941 - DNA, 22 bp, Artificial Sequence
  chemically synthesized
agatattaaaaaccaaatgatc

SEQ ID NO: 702942 - DNA, 22 bp, Artificial Sequence
  chemically synthesized
aaaaccaaatgatcatagatgg

SEQ ID NO: 702943 - DNA, 22 bp, Artificial Sequence
  chemically synthesized
atggatgtacatcccatctatg

SEQ ID NO: 702944 - DNA, 22 bp, Artificial Sequence
  chemically synthesized
taatggatgtacatcccatcta

SEQ ID NO: 702945 - DNA, 22 bp, Artificial Sequence
  chemically synthesized
ctaatggatgtacatcccatct

SEQ ID NO: 702946 - DNA, 22 bp, Artificial Sequence
  chemically synthesized
tctaatggatgtacatcccatc

SEQ ID NO: 702947 - DNA, 22 bp, Artificial Sequence
  chemically synthesized
gctttctaatggatgtacatcc

SEQ ID NO: 702948 - DNA, 22 bp, Artificial Sequence
  chemically synthesized
tcgctttctaatggatgtacat

SEQ ID NO: 702949 - DNA, 22 bp, Artificial Sequence
  chemically synthesized
ctcgctttctaatggatgtaca

SEQ ID NO: 702950 - DNA, 22 bp, Artificial Sequence
  chemically synthesized
ttctcgctttctaatggatgta

SEQ ID NO: 702951 - DNA, 22 bp, Artificial Sequence
  chemically synthesized
actcttctcgctttctaatgga

SEQ ID NO: 702952 - DNA, 22 bp, Artificial Sequence
  chemically synthesized
tcactcttctcgctttctaatg

SEQ ID NO: 702953 - DNA, 22 bp, Artificial Sequence
  chemically synthesized
ctcactcttctcgctttctaat

SEQ ID NO: 702954 - DNA, 22 bp, Artificial Sequence
  chemically synthesized
tctcactcttctcgctttctaa

SEQ ID NO: 702955 - DNA, 22 bp, Artificial Sequence
  chemically synthesized
tttctcactcttctcgctttct

SEQ ID NO: 702956 - DNA, 22 bp, Artificial Sequence
  chemically synthesized
gttctttctcactcttctcgct

SEQ ID NO: 702957 - DNA, 22 bp, Artificial Sequence
  chemically synthesized
ctagttctttctcactcttctc

SEQ ID NO: 702958 - DNA, 22 bp, Artificial Sequence
  chemically synthesized
attgctagttctttctcactct

SEQ ID NO: 702959 - DNA, 22 bp, Artificial Sequence
  chemically synthesized
gaaagcgagaagagtgagaaag

SEQ ID NO: 702960 - DNA, 22 bp, Artificial Sequence
  chemically synthesized
cgttaattgctagttctttctc

SEQ ID NO: 702961 - DNA, 22 bp, Artificial Sequence
  chemically synthesized
gcgttaattgctagttctttct

SEQ ID NO: 702962 - DNA, 22 bp, Artificial Sequence
  chemically synthesized
tgcgttaattgctagttctttc

SEQ ID NO: 702963 - DNA, 22 bp, Artificial Sequence
  chemically synthesized
ttgcgttaattgctagttcttt

SEQ ID NO: 702964 - DNA, 22 bp, Artificial Sequence
  chemically synthesized
tttgcgttaattgctagttctt

SEQ ID NO: 702965 - DNA, 22 bp, Artificial Sequence
  chemically synthesized
tttttgcgttaattgctagttc

SEQ ID NO: 702966 - DNA, 22 bp, Artificial Sequence
  chemically synthesized
tactctttttgcgttaattgct

SEQ ID NO: 702967 - DNA, 22 bp, Artificial Sequence
  chemically synthesized
ctatactctttttgcgttaatt

SEQ ID NO: 702968 - DNA, 22 bp, Artificial Sequence
  chemically synthesized
tcctatactctttttgcgttaa

SEQ ID NO: 702969 - DNA, 22 bp, Artificial Sequence
  chemically synthesized
aatctctcctatactctttttg

SEQ ID NO: 702970 - DNA, 22 bp, Artificial Sequence
  chemically synthesized
gcaattaacgcaaaaagagtat

SEQ ID NO: 702971 - DNA, 22 bp, Artificial Sequence
  chemically synthesized
acgcaaaaagagtataggagag

SEQ ID NO: 702972 - DNA, 22 bp, Artificial Sequence
  chemically synthesized
agtgaaaaatgggccccaaatt

SEQ ID NO: 702973 - DNA, 22 bp, Artificial Sequence
  chemically synthesized
acaactgagtgaaaaatgggcc

SEQ ID NO: 702974 - DNA, 22 bp, Artificial Sequence
  chemically synthesized
cacaactgagtgaaaaatgggc

SEQ ID NO: 702975 - DNA, 22 bp, Artificial Sequence
  chemically synthesized
tcacaactgagtgaaaaatggg

SEQ ID NO: 702976 - DNA, 22 bp, Artificial Sequence
  chemically synthesized
tttcacaactgagtgaaaaatg

SEQ ID NO: 702977 - DNA, 22 bp, Artificial Sequence
  chemically synthesized
aatttggggcccatttttcact

SEQ ID NO: 702978 - DNA, 22 bp, Artificial Sequence
  chemically synthesized
gttctttcacaactgagtgaaa

SEQ ID NO: 702979 - DNA, 22 bp, Artificial Sequence
  chemically synthesized
agttctttcacaactgagtgaa

SEQ ID NO: 702980 - DNA, 22 bp, Artificial Sequence
  chemically synthesized
ggggcccatttttcactcagtt

SEQ ID NO: 702981 - DNA, 22 bp, Artificial Sequence
  chemically synthesized
gggcccatttttcactcagttg

SEQ ID NO: 702982 - DNA, 22 bp, Artificial Sequence
  chemically synthesized
ttcactcagttgtgaaagaact

SEQ ID NO: 702983 - DNA, 22 bp, Artificial Sequence
  chemically synthesized
tcactcagttgtgaaagaacta

SEQ ID NO: 702984 - DNA, 22 bp, Artificial Sequence
  chemically synthesized
cactcagttgtgaaagaactaa

SEQ ID NO: 702985 - DNA, 22 bp, Artificial Sequence
  chemically synthesized
aggtatacatgtttagttcttt

SEQ ID NO: 702986 - DNA, 22 bp, Artificial Sequence
  chemically synthesized
actcagttgtgaaagaactaaa

SEQ ID NO: 702987 - DNA, 22 bp, Artificial Sequence
  chemically synthesized
agttgtgaaagaactaaacatg

SEQ ID NO: 702988 - DNA, 22 bp, Artificial Sequence
  chemically synthesized
tgaaagaactaaacatgtatac

SEQ ID NO: 702989 - DNA, 22 bp, Artificial Sequence
  chemically synthesized
accatgaggccatggctaaggt

SEQ ID NO: 702990 - DNA, 22 bp, Artificial Sequence
  chemically synthesized
aacatgtataccttagccatgg

SEQ ID NO: 702991 - DNA, 22 bp, Artificial Sequence
  chemically synthesized
cgctcaccatgaggccatggct

SEQ ID NO: 702992 - DNA, 22 bp, Artificial Sequence
  chemically synthesized
agccatggcctcatggtgagcg

SEQ ID NO: 702993 - DNA, 22 bp, Artificial Sequence
  chemically synthesized
ggaagcacactgcgctcaccat

SEQ ID NO: 702994 - DNA, 22 bp, Artificial Sequence
  chemically synthesized
gccatggcctcatggtgagcgc

SEQ ID NO: 702995 - DNA, 22 bp, Artificial Sequence
  chemically synthesized
atggtgagcgcagtgtgcttcc

SEQ ID NO: 702996 - DNA, 22 bp, Artificial Sequence
  chemically synthesized
cctagctccttgaccttggctt

SEQ ID NO: 702997 - DNA, 22 bp, Artificial Sequence
  chemically synthesized
ctagctccttgaccttggcttg

SEQ ID NO: 702998 - DNA, 22 bp, Artificial Sequence
  chemically synthesized
gctccttgaccttggcttgctt

SEQ ID NO: 702999 - DNA, 22 bp, Artificial Sequence
  chemically synthesized
cttgaccttggcttgcttgacc

SEQ ID NO: 703000 - DNA, 22 bp, Artificial Sequence
  chemically synthesized
aagcaagtcacatggtcaagca

SEQ ID NO: 703001 - DNA, 22 bp, Artificial Sequence
  chemically synthesized
gaccttggcttgcttgaccatg

SEQ ID NO: 703002 - DNA, 22 bp, Artificial Sequence
  chemically synthesized
accttggcttgcttgaccatgt

SEQ ID NO: 703003 - DNA, 22 bp, Artificial Sequence
  chemically synthesized
ctaaagcaagtcacatggtcaa

SEQ ID NO: 703004 - DNA, 22 bp, Artificial Sequence
  chemically synthesized
ggcttgcttgaccatgtgactt

SEQ ID NO: 703005 - DNA, 22 bp, Artificial Sequence
  chemically synthesized
gcttgcttgaccatgtgacttg

SEQ ID NO: 703006 - DNA, 22 bp, Artificial Sequence
  chemically synthesized
gcttgaccatgtgacttgcttt

SEQ ID NO: 703007 - DNA, 22 bp, Artificial Sequence
  chemically synthesized
cttgaccatgtgacttgcttta

SEQ ID NO: 703008 - DNA, 22 bp, Artificial Sequence
  chemically synthesized
acatcatatctgctaaagcaag

SEQ ID NO: 703009 - DNA, 22 bp, Artificial Sequence
  chemically synthesized
gaccatgtgacttgctttagca

SEQ ID NO: 703010 - DNA, 22 bp, Artificial Sequence
  chemically synthesized
accatgtgacttgctttagcag

SEQ ID NO: 703011 - DNA, 22 bp, Artificial Sequence
  chemically synthesized
ttcacatcatatctgctaaagc

SEQ ID NO: 703012 - DNA, 22 bp, Artificial Sequence
  chemically synthesized
tgttcacatcatatctgctaaa

SEQ ID NO: 703013 - DNA, 22 bp, Artificial Sequence
  chemically synthesized
gctttagcagatatgatgtgaa

SEQ ID NO: 703014 - DNA, 22 bp, Artificial Sequence
  chemically synthesized
ctttagcagatatgatgtgaac

SEQ ID NO: 703015 - DNA, 22 bp, Artificial Sequence
  chemically synthesized
tagcagatatgatgtgaacaga

SEQ ID NO: 703016 - DNA, 22 bp, Artificial Sequence
  chemically synthesized
agcagatatgatgtgaacagag

SEQ ID NO: 703017 - DNA, 22 bp, Artificial Sequence
  chemically synthesized
gcagatatgatgtgaacagagg

SEQ ID NO: 703018 - DNA, 22 bp, Artificial Sequence
  chemically synthesized
ccagtgtgacaagcctctgttc

SEQ ID NO: 703019 - DNA, 22 bp, Artificial Sequence
  chemically synthesized
atggcagattgccagtgtgaca

SEQ ID NO: 703020 - DNA, 22 bp, Artificial Sequence
  chemically synthesized
tcatggcagattgccagtgtga

SEQ ID NO: 703021 - DNA, 22 bp, Artificial Sequence
  chemically synthesized
gggcatgttctcatggcagatt

SEQ ID NO: 703022 - DNA, 22 bp, Artificial Sequence
  chemically synthesized
gtcacactggcaatctgccatg

SEQ ID NO: 703023 - DNA, 22 bp, Artificial Sequence
  chemically synthesized
tcacactggcaatctgccatga

SEQ ID NO: 703024 - DNA, 22 bp, Artificial Sequence
  chemically synthesized
gcaatctgccatgagaacatgc

SEQ ID NO: 703025 - DNA, 22 bp, Artificial Sequence
  chemically synthesized
ccatgagaacatgccccaggtt

SEQ ID NO: 703026 - DNA, 22 bp, Artificial Sequence
  chemically synthesized
aaggatcagaagcaacctgggg

SEQ ID NO: 703027 - DNA, 22 bp, Artificial Sequence
  chemically synthesized
tgagccccagactaaaggatca

SEQ ID NO: 703028 - DNA, 22 bp, Artificial Sequence
  chemically synthesized
ggttgtgagccccagactaaag

SEQ ID NO: 703029 - DNA, 22 bp, Artificial Sequence
  chemically synthesized
cttctgatcctttagtctgggg

SEQ ID NO: 703030 - DNA, 22 bp, Artificial Sequence
  chemically synthesized
ctgatcctttagtctggggctc

SEQ ID NO: 703031 - DNA, 22 bp, Artificial Sequence
  chemically synthesized
tgatcctttagtctggggctca

SEQ ID NO: 703032 - DNA, 22 bp, Artificial Sequence
  chemically synthesized
atcctttagtctggggctcaca

SEQ ID NO: 703033 - DNA, 22 bp, Artificial Sequence
  chemically synthesized
aatgtgttgggttgtgagcccc

SEQ ID NO: 703034 - DNA, 22 bp, Artificial Sequence
  chemically synthesized
taaatgtgttgggttgtgagcc

SEQ ID NO: 703035 - DNA, 22 bp, Artificial Sequence
  chemically synthesized
ctaaatgtgttgggttgtgagc

SEQ ID NO: 703036 - DNA, 22 bp, Artificial Sequence
  chemically synthesized
tagtctggggctcacaacccaa

SEQ ID NO: 703037 - DNA, 22 bp, Artificial Sequence
  chemically synthesized
agtctggggctcacaacccaac

SEQ ID NO: 703038 - DNA, 22 bp, Artificial Sequence
  chemically synthesized
gtctggggctcacaacccaaca

SEQ ID NO: 703039 - DNA, 22 bp, Artificial Sequence
  chemically synthesized
gatggtttctaaatgtgttggg

SEQ ID NO: 703040 - DNA, 22 bp, Artificial Sequence
  chemically synthesized
agatggtttctaaatgtgttgg

SEQ ID NO: 703041 - DNA, 22 bp, Artificial Sequence
  chemically synthesized
gggctcacaacccaacacattt

SEQ ID NO: 703042 - DNA, 22 bp, Artificial Sequence
  chemically synthesized
agtttagatggtttctaaatgt

SEQ ID NO: 703043 - DNA, 22 bp, Artificial Sequence
  chemically synthesized
acaacccaacacatttagaaac

SEQ ID NO: 703044 - DNA, 22 bp, Artificial Sequence
  chemically synthesized
tgagttcagtttagatggtttc

SEQ ID NO: 703045 - DNA, 22 bp, Artificial Sequence
  chemically synthesized
ggctgtgagttcagtttagatg

SEQ ID NO: 703046 - DNA, 22 bp, Artificial Sequence
  chemically synthesized
taggctgtgagttcagtttaga

SEQ ID NO: 703047 - DNA, 22 bp, Artificial Sequence
  chemically synthesized
agaaaccatctaaactgaactc

SEQ ID NO: 703048 - DNA, 22 bp, Artificial Sequence
  chemically synthesized
gaaaccatctaaactgaactca

SEQ ID NO: 703049 - DNA, 22 bp, Artificial Sequence
  chemically synthesized
gcctctaggctgtgagttcagt

SEQ ID NO: 703050 - DNA, 22 bp, Artificial Sequence
  chemically synthesized
ggttcgcctctaggctgtgagt

SEQ ID NO: 703051 - DNA, 22 bp, Artificial Sequence
  chemically synthesized
aactgaactcacagcctagagg

SEQ ID NO: 703052 - DNA, 22 bp, Artificial Sequence
  chemically synthesized
aactcacagcctagaggcgaac

SEQ ID NO: 703053 - DNA, 22 bp, Artificial Sequence
  chemically synthesized
aagcatgcctgggttcgcctct

SEQ ID NO: 703054 - DNA, 22 bp, Artificial Sequence
  chemically synthesized
acagcctagaggcgaacccagg

SEQ ID NO: 703055 - DNA, 22 bp, Artificial Sequence
  chemically synthesized
atactgaagcatgcctgggttc

SEQ ID NO: 703056 - DNA, 22 bp, Artificial Sequence
  chemically synthesized
catactgaagcatgcctgggtt

SEQ ID NO: 703057 - DNA, 22 bp, Artificial Sequence
  chemically synthesized
cttcatactgaagcatgcctgg

SEQ ID NO: 703058 - DNA, 22 bp, Artificial Sequence
  chemically synthesized
tacttcatactgaagcatgcct

SEQ ID NO: 703059 - DNA, 22 bp, Artificial Sequence
  chemically synthesized
gaggcgaacccaggcatgcttc

SEQ ID NO: 703060 - DNA, 22 bp, Artificial Sequence
  chemically synthesized
gaaagctctacttcatactgaa

SEQ ID NO: 703061 - DNA, 22 bp, Artificial Sequence
  chemically synthesized
actggaaagctctacttcatac

SEQ ID NO: 703062 - DNA, 22 bp, Artificial Sequence
  chemically synthesized
gactggaaagctctacttcata

SEQ ID NO: 703063 - DNA, 22 bp, Artificial Sequence
  chemically synthesized
cagtatgaagtagagctttcca

SEQ ID NO: 703064 - DNA, 22 bp, Artificial Sequence
  chemically synthesized
agtatgaagtagagctttccag

SEQ ID NO: 703065 - DNA, 22 bp, Artificial Sequence
  chemically synthesized
gataaaacttgactggaaagct

SEQ ID NO: 703066 - DNA, 22 bp, Artificial Sequence
  chemically synthesized
gggtgatctggataaaacttga

SEQ ID NO: 703067 - DNA, 22 bp, Artificial Sequence
  chemically synthesized
taattcgggtgatctggataaa

SEQ ID NO: 703068 - DNA, 22 bp, Artificial Sequence
  chemically synthesized
tccagtcaagttttatccagat

SEQ ID NO: 703069 - DNA, 22 bp, Artificial Sequence
  chemically synthesized
ccagtcaagttttatccagatc

SEQ ID NO: 703070 - DNA, 22 bp, Artificial Sequence
  chemically synthesized
cagtcaagttttatccagatca

SEQ ID NO: 703071 - DNA, 22 bp, Artificial Sequence
  chemically synthesized
caggtcaactgtaattcgggtg

SEQ ID NO: 703072 - DNA, 22 bp, Artificial Sequence
  chemically synthesized
tatccagatcacccgaattaca

SEQ ID NO: 703073 - DNA, 22 bp, Artificial Sequence
  chemically synthesized
atccagatcacccgaattacag

SEQ ID NO: 703074 - DNA, 22 bp, Artificial Sequence
  chemically synthesized
tccagatcacccgaattacagt

SEQ ID NO: 703075 - DNA, 22 bp, Artificial Sequence
  chemically synthesized
tgggtctacaggtcaactgtaa

SEQ ID NO: 703076 - DNA, 22 bp, Artificial Sequence
  chemically synthesized
atgggtctacaggtcaactgta

SEQ ID NO: 703077 - DNA, 22 bp, Artificial Sequence
  chemically synthesized
atgcttatgggtctacaggtca

SEQ ID NO: 703078 - DNA, 22 bp, Artificial Sequence
  chemically synthesized
tcatgcttatgggtctacaggt

SEQ ID NO: 703079 - DNA, 22 bp, Artificial Sequence
  chemically synthesized
ttctcatgcttatgggtctaca

SEQ ID NO: 703080 - DNA, 22 bp, Artificial Sequence
  chemically synthesized
tgttctcatgcttatgggtcta

SEQ ID NO: 703081 - DNA, 22 bp, Artificial Sequence
  chemically synthesized
cagttgacctgtagacccataa

SEQ ID NO: 703082 - DNA, 22 bp, Artificial Sequence
  chemically synthesized
ctgttctcatgcttatgggtct

SEQ ID NO: 703083 - DNA, 22 bp, Artificial Sequence
  chemically synthesized
acctgtagacccataagcatga

SEQ ID NO: 703084 - DNA, 22 bp, Artificial Sequence
  chemically synthesized
tagacccataagcatgagaaca

SEQ ID NO: 703085 - DNA, 22 bp, Artificial Sequence
  chemically synthesized
tacaagaatataaagcttctgt

SEQ ID NO: 703086 - DNA, 22 bp, Artificial Sequence
  chemically synthesized
ctatacaagaatataaagcttc

SEQ ID NO: 703087 - DNA, 22 bp, Artificial Sequence
  chemically synthesized
tatattcttgtatagtagttat

SEQ ID NO: 703088 - DNA, 22 bp, Artificial Sequence
  chemically synthesized
atattcttgtatagtagttata

SEQ ID NO: 703089 - DNA, 22 bp, Artificial Sequence
  chemically synthesized
tattcttgtatagtagttatat

SEQ ID NO: 703090 - DNA, 22 bp, Artificial Sequence
  chemically synthesized
ttgtatagtagttatattgtgg

SEQ ID NO: 703091 - DNA, 22 bp, Artificial Sequence
  chemically synthesized
gtatagtagttatattgtggca

SEQ ID NO: 703092 - DNA, 22 bp, Artificial Sequence
  chemically synthesized
tatccacaataatgccacaata

SEQ ID NO: 703093 - DNA, 22 bp, Artificial Sequence
  chemically synthesized
tatagtagttatattgtggcat

SEQ ID NO: 703094 - DNA, 22 bp, Artificial Sequence
  chemically synthesized
tcagctgtatccacaataatgc

SEQ ID NO: 703095 - DNA, 22 bp, Artificial Sequence
  chemically synthesized
tgtcagctgtatccacaataat

SEQ ID NO: 703096 - DNA, 22 bp, Artificial Sequence
  chemically synthesized
tctgtcagctgtatccacaata

SEQ ID NO: 703097 - DNA, 22 bp, Artificial Sequence
  chemically synthesized
tattgtggcattattgtggata

SEQ ID NO: 703098 - DNA, 22 bp, Artificial Sequence
  chemically synthesized
tctctgtcagctgtatccacaa

SEQ ID NO: 703099 - DNA, 22 bp, Artificial Sequence
  chemically synthesized
ctctctctgtcagctgtatcca

SEQ ID NO: 703100 - DNA, 22 bp, Artificial Sequence
  chemically synthesized
tggcattattgtggatacagct

SEQ ID NO: 703101 - DNA, 22 bp, Artificial Sequence
  chemically synthesized
ctcctctctctgtcagctgtat

SEQ ID NO: 703102 - DNA, 22 bp, Artificial Sequence
  chemically synthesized
tactcctctctctgtcagctgt

SEQ ID NO: 703103 - DNA, 22 bp, Artificial Sequence
  chemically synthesized
tctactcctctctctgtcagct

SEQ ID NO: 703104 - DNA, 22 bp, Artificial Sequence
  chemically synthesized
ttgtggatacagctgacagaga

SEQ ID NO: 703105 - DNA, 22 bp, Artificial Sequence
  chemically synthesized
tctctactcctctctctgtcag

SEQ ID NO: 703106 - DNA, 22 bp, Artificial Sequence
  chemically synthesized
tctctctactcctctctctgtc

SEQ ID NO: 703107 - DNA, 22 bp, Artificial Sequence
  chemically synthesized
tggatacagctgacagagagag

SEQ ID NO: 703108 - DNA, 22 bp, Artificial Sequence
  chemically synthesized
ctctctctactcctctctctgt

SEQ ID NO: 703109 - DNA, 22 bp, Artificial Sequence
  chemically synthesized
cccttctctctctactcctctc

SEQ ID NO: 703110 - DNA, 22 bp, Artificial Sequence
  chemically synthesized
tccccttctctctctactcctc

SEQ ID NO: 703111 - DNA, 22 bp, Artificial Sequence
  chemically synthesized
acagagagaggagtagagagag

SEQ ID NO: 703112 - DNA, 22 bp, Artificial Sequence
  chemically synthesized
ccctctccccttctctctctac

SEQ ID NO: 703113 - DNA, 22 bp, Artificial Sequence
  chemically synthesized
cccctctccccttctctctcta

SEQ ID NO: 703114 - DNA, 22 bp, Artificial Sequence
  chemically synthesized
tttcccctctccccttctctct

SEQ ID NO: 703115 - DNA, 22 bp, Artificial Sequence
  chemically synthesized
tgatactgtttcccctctcccc

SEQ ID NO: 703116 - DNA, 22 bp, Artificial Sequence
  chemically synthesized
atgatactgtttcccctctccc

SEQ ID NO: 703117 - DNA, 22 bp, Artificial Sequence
  chemically synthesized
tatgatactgtttcccctctcc

SEQ ID NO: 703118 - DNA, 22 bp, Artificial Sequence
  chemically synthesized
atctttatgatactgtttcccc

SEQ ID NO: 703119 - DNA, 22 bp, Artificial Sequence
  chemically synthesized
aatctttatgatactgtttccc

SEQ ID NO: 703120 - DNA, 22 bp, Artificial Sequence
  chemically synthesized
taatctttatgatactgtttcc

SEQ ID NO: 703121 - DNA, 22 bp, Artificial Sequence
  chemically synthesized
tttaatctttatgatactgttt

SEQ ID NO: 703122 - DNA, 22 bp, Artificial Sequence
  chemically synthesized
ttctttaatctttatgatactg

SEQ ID NO: 703123 - DNA, 22 bp, Artificial Sequence
  chemically synthesized
attctttaatctttatgatact

SEQ ID NO: 703124 - DNA, 22 bp, Artificial Sequence
  chemically synthesized
tattctttaatctttatgatac

SEQ ID NO: 703125 - DNA, 22 bp, Artificial Sequence
  chemically synthesized
ttattctttaatctttatgata

SEQ ID NO: 703126 - DNA, 22 bp, Artificial Sequence
  chemically synthesized
tttattctttaatctttatgat

SEQ ID NO: 703127 - DNA, 22 bp, Artificial Sequence
  chemically synthesized
gaggatattttttattctttaa

SEQ ID NO: 703128 - DNA, 22 bp, Artificial Sequence
  chemically synthesized
gctggaggatattttttattct

SEQ ID NO: 703129 - DNA, 22 bp, Artificial Sequence
  chemically synthesized
ggctggaggatattttttattc

SEQ ID NO: 703130 - DNA, 22 bp, Artificial Sequence
  chemically synthesized
tggctggaggatattttttatt

SEQ ID NO: 703131 - DNA, 22 bp, Artificial Sequence
  chemically synthesized
aagaataaaaaatatcctccag

SEQ ID NO: 703132 - DNA, 22 bp, Artificial Sequence
  chemically synthesized
gtaacaaatgggagagactttg

SEQ ID NO: 703133 - DNA, 22 bp, Artificial Sequence
  chemically synthesized
cagccaaagtctctcccatttg

SEQ ID NO: 703134 - DNA, 22 bp, Artificial Sequence
  chemically synthesized
gtagaggcagtggctagtaaca

SEQ ID NO: 703135 - DNA, 22 bp, Artificial Sequence
  chemically synthesized
tcccatttgttactagccactg

SEQ ID NO: 703136 - DNA, 22 bp, Artificial Sequence
  chemically synthesized
ccatttgttactagccactgcc

SEQ ID NO: 703137 - DNA, 22 bp, Artificial Sequence
  chemically synthesized
catgttagtagaggcagtggct

SEQ ID NO: 703138 - DNA, 22 bp, Artificial Sequence
  chemically synthesized
gcatgttagtagaggcagtggc

SEQ ID NO: 703139 - DNA, 22 bp, Artificial Sequence
  chemically synthesized
tgcatgttagtagaggcagtgg

SEQ ID NO: 703140 - DNA, 22 bp, Artificial Sequence
  chemically synthesized
gttactagccactgcctctact

SEQ ID NO: 703141 - DNA, 22 bp, Artificial Sequence
  chemically synthesized
ttactagccactgcctctacta

SEQ ID NO: 703142 - DNA, 22 bp, Artificial Sequence
  chemically synthesized
atctttgcatgttagtagaggc

SEQ ID NO: 703143 - DNA, 22 bp, Artificial Sequence
  chemically synthesized
ctagccactgcctctactaaca

SEQ ID NO: 703144 - DNA, 22 bp, Artificial Sequence
  chemically synthesized
gccactgcctctactaacatgc

SEQ ID NO: 703145 - DNA, 22 bp, Artificial Sequence
  chemically synthesized
cctctactaacatgcaaagatt

SEQ ID NO: 703146 - DNA, 22 bp, Artificial Sequence
  chemically synthesized
tactaacatgcaaagattaatg

SEQ ID NO: 703147 - DNA, 22 bp, Artificial Sequence
  chemically synthesized
ctaacatgcaaagattaatggg

SEQ ID NO: 703148 - DNA, 22 bp, Artificial Sequence
  chemically synthesized
acatgcaaagattaatggggat

SEQ ID NO: 703149 - DNA, 22 bp, Artificial Sequence
  chemically synthesized
cacagaccaaagaggatgataa

SEQ ID NO: 703150 - DNA, 22 bp, Artificial Sequence
  chemically synthesized
atggggattatcatcctctttg

SEQ ID NO: 703151 - DNA, 22 bp, Artificial Sequence
  chemically synthesized
aactgcacagaccaaagaggat

SEQ ID NO: 703152 - DNA, 22 bp, Artificial Sequence
  chemically synthesized
tcatcctctttggtctgtgcag

SEQ ID NO: 703153 - DNA, 22 bp, Artificial Sequence
  chemically synthesized
tttggtctgtgcagttgagacg

SEQ ID NO: 703154 - DNA, 22 bp, Artificial Sequence
  chemically synthesized
tggtctgtgcagttgagacgtg

SEQ ID NO: 703155 - DNA, 22 bp, Artificial Sequence
  chemically synthesized
ggtctgtgcagttgagacgtgt

SEQ ID NO: 703156 - DNA, 22 bp, Artificial Sequence
  chemically synthesized
gtctgtgcagttgagacgtgtg

SEQ ID NO: 703157 - DNA, 22 bp, Artificial Sequence
  chemically synthesized
tgcagttgagacgtgtgggttg

SEQ ID NO: 703158 - DNA, 22 bp, Artificial Sequence
  chemically synthesized
cagacaccagtgaatagcaacc

SEQ ID NO: 703159 - DNA, 22 bp, Artificial Sequence
  chemically synthesized
agacgtgtgggttgctattcac

SEQ ID NO: 703160 - DNA, 22 bp, Artificial Sequence
  chemically synthesized
gaaaaggggttccagacaccag

SEQ ID NO: 703161 - DNA, 22 bp, Artificial Sequence
  chemically synthesized
agaaaaggggttccagacacca

SEQ ID NO: 703162 - DNA, 22 bp, Artificial Sequence
  chemically synthesized
ctattcactggtgtctggaacc

SEQ ID NO: 703163 - DNA, 22 bp, Artificial Sequence
  chemically synthesized
ttcactggtgtctggaacccct

SEQ ID NO: 703164 - DNA, 22 bp, Artificial Sequence
  chemically synthesized
tcagccttagaaaaggggttcc

SEQ ID NO: 703165 - DNA, 22 bp, Artificial Sequence
  chemically synthesized
actggtgtctggaacccctttt

SEQ ID NO: 703166 - DNA, 22 bp, Artificial Sequence
  chemically synthesized
gtgtctggaaccccttttctaa

SEQ ID NO: 703167 - DNA, 22 bp, Artificial Sequence
  chemically synthesized
tggattatcagccttagaaaag

SEQ ID NO: 703168 - DNA, 22 bp, Artificial Sequence
  chemically synthesized
ttatggattatcagccttagaa

SEQ ID NO: 703169 - DNA, 22 bp, Artificial Sequence
  chemically synthesized
gaaccccttttctaaggctgat

SEQ ID NO: 703170 - DNA, 22 bp, Artificial Sequence
  chemically synthesized
taactattatggattatcagcc

SEQ ID NO: 703171 - DNA, 22 bp, Artificial Sequence
  chemically synthesized
gtaactattatggattatcagc

SEQ ID NO: 703172 - DNA, 22 bp, Artificial Sequence
  chemically synthesized
ttctaaggctgataatccataa

SEQ ID NO: 703173 - DNA, 22 bp, Artificial Sequence
  chemically synthesized
tctaaggctgataatccataat

SEQ ID NO: 703174 - DNA, 22 bp, Artificial Sequence
  chemically synthesized
atacttgtaactattatggatt

SEQ ID NO: 703175 - DNA, 22 bp, Artificial Sequence
  chemically synthesized
ctaaggctgataatccataata

SEQ ID NO: 703176 - DNA, 22 bp, Artificial Sequence
  chemically synthesized
taaggctgataatccataatag

SEQ ID NO: 703177 - DNA, 22 bp, Artificial Sequence
  chemically synthesized
aggctgataatccataatagtt

SEQ ID NO: 703178 - DNA, 22 bp, Artificial Sequence
  chemically synthesized
aagttcatacttgtaactatta

SEQ ID NO: 703179 - DNA, 22 bp, Artificial Sequence
  chemically synthesized
ataatccataatagttacaagt

SEQ ID NO: 703180 - DNA, 22 bp, Artificial Sequence
  chemically synthesized
acatattcaagttcatacttgt

SEQ ID NO: 703181 - DNA, 22 bp, Artificial Sequence
  chemically synthesized
ctaacatattcaagttcatact

SEQ ID NO: 703182 - DNA, 22 bp, Artificial Sequence
  chemically synthesized
actaacatattcaagttcatac

SEQ ID NO: 703183 - DNA, 22 bp, Artificial Sequence
  chemically synthesized
caagtatgaacttgaatatgtt

SEQ ID NO: 703184 - DNA, 22 bp, Artificial Sequence
  chemically synthesized
gaacaatttactaacatattca

SEQ ID NO: 703185 - DNA, 22 bp, Artificial Sequence
  chemically synthesized
agactagaacaatttactaaca

SEQ ID NO: 703186 - DNA, 22 bp, Artificial Sequence
  chemically synthesized
gaatatgttagtaaattgttct

SEQ ID NO: 703187 - DNA, 22 bp, Artificial Sequence
  chemically synthesized
aatatgttagtaaattgttcta

SEQ ID NO: 703188 - DNA, 22 bp, Artificial Sequence
  chemically synthesized
acagaagagaaaactgagacta

SEQ ID NO: 703189 - DNA, 22 bp, Artificial Sequence
  chemically synthesized
gtaaattgttctagtctcagtt

SEQ ID NO: 703190 - DNA, 22 bp, Artificial Sequence
  chemically synthesized
cacagaagagaaaactgagact

SEQ ID NO: 703191 - DNA, 22 bp, Artificial Sequence
  chemically synthesized
catttcacagaagagaaaactg

SEQ ID NO: 703192 - DNA, 22 bp, Artificial Sequence
  chemically synthesized
ttctagtctcagttttctcttc

SEQ ID NO: 703193 - DNA, 22 bp, Artificial Sequence
  chemically synthesized
tctccatttcacagaagagaaa

SEQ ID NO: 703194 - DNA, 22 bp, Artificial Sequence
  chemically synthesized
tagtctcagttttctcttctgt

SEQ ID NO: 703195 - DNA, 22 bp, Artificial Sequence
  chemically synthesized
ttgtctccatttcacagaagag

SEQ ID NO: 703196 - DNA, 22 bp, Artificial Sequence
  chemically synthesized
gtctcagttttctcttctgtga

SEQ ID NO: 703197 - DNA, 22 bp, Artificial Sequence
  chemically synthesized
ttattgtctccatttcacagaa

SEQ ID NO: 703198 - DNA, 22 bp, Artificial Sequence
  chemically synthesized
agttttctcttctgtgaaatgg

SEQ ID NO: 703199 - DNA, 22 bp, Artificial Sequence
  chemically synthesized
tctcttctgtgaaatggagaca

SEQ ID NO: 703200 - DNA, 22 bp, Artificial Sequence
  chemically synthesized
ctcttctgtgaaatggagacaa

SEQ ID NO: 703201 - DNA, 22 bp, Artificial Sequence
  chemically synthesized
tcttctgtgaaatggagacaat

SEQ ID NO: 703202 - DNA, 22 bp, Artificial Sequence
  chemically synthesized
ttctgtgaaatggagacaataa

SEQ ID NO: 703203 - DNA, 22 bp, Artificial Sequence
  chemically synthesized
aaataaggactgttattgtctc

SEQ ID NO: 703204 - DNA, 22 bp, Artificial Sequence
  chemically synthesized
aaaataaggactgttattgtct

SEQ ID NO: 703205 - DNA, 22 bp, Artificial Sequence
  chemically synthesized
ctgtgaaatggagacaataaca

SEQ ID NO: 703206 - DNA, 22 bp, Artificial Sequence
  chemically synthesized
taaaataaggactgttattgtc

SEQ ID NO: 703207 - DNA, 22 bp, Artificial Sequence
  chemically synthesized
tgtgaaatggagacaataacag

SEQ ID NO: 703208 - DNA, 22 bp, Artificial Sequence
  chemically synthesized
tgaaatggagacaataacagtc

SEQ ID NO: 703209 - DNA, 22 bp, Artificial Sequence
  chemically synthesized
acaccaacctttaaaataagga

SEQ ID NO: 703210 - DNA, 22 bp, Artificial Sequence
  chemically synthesized
atcctcacaccaacctttaaaa

SEQ ID NO: 703211 - DNA, 22 bp, Artificial Sequence
  chemically synthesized
aatcctcacaccaacctttaaa

SEQ ID NO: 703212 - DNA, 22 bp, Artificial Sequence
  chemically synthesized
acccgtttaatcctcacaccaa

SEQ ID NO: 703213 - DNA, 22 bp, Artificial Sequence
  chemically synthesized
attttaaaggttggtgtgagga

SEQ ID NO: 703214 - DNA, 22 bp, Artificial Sequence
  chemically synthesized
ttttaaaggttggtgtgaggat

SEQ ID NO: 703215 - DNA, 22 bp, Artificial Sequence
  chemically synthesized
taaaggttggtgtgaggattaa

SEQ ID NO: 703216 - DNA, 22 bp, Artificial Sequence
  chemically synthesized
aaaggttggtgtgaggattaaa

SEQ ID NO: 703217 - DNA, 22 bp, Artificial Sequence
  chemically synthesized
aaggttggtgtgaggattaaac

SEQ ID NO: 703218 - DNA, 22 bp, Artificial Sequence
  chemically synthesized
catagattaacccgtttaatcc

SEQ ID NO: 703219 - DNA, 22 bp, Artificial Sequence
  chemically synthesized
gcatagattaacccgtttaatc

SEQ ID NO: 703220 - DNA, 22 bp, Artificial Sequence
  chemically synthesized
tgcatagattaacccgtttaat

SEQ ID NO: 703221 - DNA, 22 bp, Artificial Sequence
  chemically synthesized
gtgtgaggattaaacgggttaa

SEQ ID NO: 703222 - DNA, 22 bp, Artificial Sequence
  chemically synthesized
aacgggttaatctatgcaaaat

SEQ ID NO: 703223 - DNA, 22 bp, Artificial Sequence
  chemically synthesized
acacagaggaagcattttgcat

SEQ ID NO: 703224 - DNA, 22 bp, Artificial Sequence
  chemically synthesized
aacacagaggaagcattttgca

SEQ ID NO: 703225 - DNA, 22 bp, Artificial Sequence
  chemically synthesized
ttaacacagaggaagcattttg

SEQ ID NO: 703226 - DNA, 22 bp, Artificial Sequence
  chemically synthesized
atctatgcaaaatgcttcctct

SEQ ID NO: 703227 - DNA, 22 bp, Artificial Sequence
  chemically synthesized
tgctcttaacacagaggaagca

SEQ ID NO: 703228 - DNA, 22 bp, Artificial Sequence
  chemically synthesized
tgtgctcttaacacagaggaag

SEQ ID NO: 703229 - DNA, 22 bp, Artificial Sequence
  chemically synthesized
tgcaaaatgcttcctctgtgtt

SEQ ID NO: 703230 - DNA, 22 bp, Artificial Sequence
  chemically synthesized
cctctgtgttaagagcacagag

SEQ ID NO: 703231 - DNA, 22 bp, Artificial Sequence
  chemically synthesized
ctctgtgttaagagcacagagc

SEQ ID NO: 703232 - DNA, 22 bp, Artificial Sequence
  chemically synthesized
aaaagtatcgagcgctctgtgc

SEQ ID NO: 703233 - DNA, 22 bp, Artificial Sequence
  chemically synthesized
aaaaagtatcgagcgctctgtg

SEQ ID NO: 703234 - DNA, 22 bp, Artificial Sequence
  chemically synthesized
tgtgttaagagcacagagcgct

SEQ ID NO: 703235 - DNA, 22 bp, Artificial Sequence
  chemically synthesized
taaaaagtatcgagcgctctgt

SEQ ID NO: 703236 - DNA, 22 bp, Artificial Sequence
  chemically synthesized
ttaaaaagtatcgagcgctctg

SEQ ID NO: 703237 - DNA, 22 bp, Artificial Sequence
  chemically synthesized
tgttaagagcacagagcgctcg

SEQ ID NO: 703238 - DNA, 22 bp, Artificial Sequence
  chemically synthesized
agagcacagagcgctcgatact

SEQ ID NO: 703239 - DNA, 22 bp, Artificial Sequence
  chemically synthesized
gaatttttaaaaagtatcgagc

SEQ ID NO: 703240 - DNA, 22 bp, Artificial Sequence
  chemically synthesized
taaacgtaggagttggaatttt

SEQ ID NO: 703241 - DNA, 22 bp, Artificial Sequence
  chemically synthesized
gatactttttaaaaattccaac

SEQ ID NO: 703242 - DNA, 22 bp, Artificial Sequence
  chemically synthesized
tttaaaaattccaactcctacg

SEQ ID NO: 703243 - DNA, 22 bp, Artificial Sequence
  chemically synthesized
ttaaaaattccaactcctacgt

SEQ ID NO: 703244 - DNA, 22 bp, Artificial Sequence
  chemically synthesized
taaaaattccaactcctacgtt

SEQ ID NO: 703245 - DNA, 22 bp, Artificial Sequence
  chemically synthesized
aaaaattccaactcctacgttt

SEQ ID NO: 703246 - DNA, 22 bp, Artificial Sequence
  chemically synthesized
aaaattccaactcctacgttta

SEQ ID NO: 703247 - DNA, 22 bp, Artificial Sequence
  chemically synthesized
atgatgaaaataattataaacg

SEQ ID NO: 703248 - DNA, 22 bp, Artificial Sequence
  chemically synthesized
caactcctacgtttataattat

SEQ ID NO: 703249 - DNA, 22 bp, Artificial Sequence
  chemically synthesized
cattaatgatgaaaataattat

SEQ ID NO: 703250 - DNA, 22 bp, Artificial Sequence
  chemically synthesized
ctacgtttataattattttcat

SEQ ID NO: 703251 - DNA, 22 bp, Artificial Sequence
  chemically synthesized
gctacattaatgatgaaaataa

SEQ ID NO: 703252 - DNA, 22 bp, Artificial Sequence
  chemically synthesized
cgtttataattattttcatcat

SEQ ID NO: 703253 - DNA, 22 bp, Artificial Sequence
  chemically synthesized
ataactagctacattaatgatg

SEQ ID NO: 703254 - DNA, 22 bp, Artificial Sequence
  chemically synthesized
ataattattttcatcattaatg

SEQ ID NO: 703255 - DNA, 22 bp, Artificial Sequence
  chemically synthesized
taattattttcatcattaatgt

SEQ ID NO: 703256 - DNA, 22 bp, Artificial Sequence
  chemically synthesized
ttttcatcattaatgtagctag

SEQ ID NO: 703257 - DNA, 22 bp, Artificial Sequence
  chemically synthesized
tcatcattaatgtagctagtta

SEQ ID NO: 703258 - DNA, 22 bp, Artificial Sequence
  chemically synthesized
catcattaatgtagctagttat

SEQ ID NO: 703259 - DNA, 22 bp, Artificial Sequence
  chemically synthesized
atcattaatgtagctagttatc

SEQ ID NO: 703260 - DNA, 22 bp, Artificial Sequence
  chemically synthesized
atgtagctagttatcaggatat

SEQ ID NO: 703261 - DNA, 22 bp, Artificial Sequence
  chemically synthesized
gtgaatgagataaatatcctga

SEQ ID NO: 703262 - DNA, 22 bp, Artificial Sequence
  chemically synthesized
gttatcaggatatttatctcat

SEQ ID NO: 703263 - DNA, 22 bp, Artificial Sequence
  chemically synthesized
gcagtaagttcgtgaatgagat

SEQ ID NO: 703264 - DNA, 22 bp, Artificial Sequence
  chemically synthesized
tcaggatatttatctcattcac

SEQ ID NO: 703265 - DNA, 22 bp, Artificial Sequence
  chemically synthesized
acattggcagtaagttcgtgaa

SEQ ID NO: 703266 - DNA, 22 bp, Artificial Sequence
  chemically synthesized
ctcacattggcagtaagttcgt

SEQ ID NO: 703267 - DNA, 22 bp, Artificial Sequence
  chemically synthesized
atctcattcacgaacttactgc

SEQ ID NO: 703268 - DNA, 22 bp, Artificial Sequence
  chemically synthesized
tctcattcacgaacttactgcc

SEQ ID NO: 703269 - DNA, 22 bp, Artificial Sequence
  chemically synthesized
ggattcctcacattggcagtaa

SEQ ID NO: 703270 - DNA, 22 bp, Artificial Sequence
  chemically synthesized
attcacgaacttactgccaatg

SEQ ID NO: 703271 - DNA, 22 bp, Artificial Sequence
  chemically synthesized
ccctgggattcctcacattggc

SEQ ID NO: 703272 - DNA, 22 bp, Artificial Sequence
  chemically synthesized
acgaacttactgccaatgtgag

SEQ ID NO: 703273 - DNA, 22 bp, Artificial Sequence
  chemically synthesized
gttaccctgggattcctcacat

SEQ ID NO: 703274 - DNA, 22 bp, Artificial Sequence
  chemically synthesized
ctggttaccctgggattcctca

SEQ ID NO: 703275 - DNA, 22 bp, Artificial Sequence
  chemically synthesized
cctggttaccctgggattcctc

SEQ ID NO: 703276 - DNA, 22 bp, Artificial Sequence
  chemically synthesized
actgccaatgtgaggaatccca

SEQ ID NO: 703277 - DNA, 22 bp, Artificial Sequence
  chemically synthesized
tcctggttaccctgggattcct

SEQ ID NO: 703278 - DNA, 22 bp, Artificial Sequence
  chemically synthesized
ctgccaatgtgaggaatcccag

SEQ ID NO: 703279 - DNA, 22 bp, Artificial Sequence
  chemically synthesized
ccaatgtgaggaatcccagggt

SEQ ID NO: 703280 - DNA, 22 bp, Artificial Sequence
  chemically synthesized
tcactttcctggttaccctggg

SEQ ID NO: 703281 - DNA, 22 bp, Artificial Sequence
  chemically synthesized
tgtcactttcctggttaccctg

SEQ ID NO: 703282 - DNA, 22 bp, Artificial Sequence
  chemically synthesized
gaaccatggaaagtctctgtca

SEQ ID NO: 703283 - DNA, 22 bp, Artificial Sequence
  chemically synthesized
tagaaccatggaaagtctctgt

SEQ ID NO: 703284 - DNA, 22 bp, Artificial Sequence
  chemically synthesized
actctagaaccatggaaagtct

SEQ ID NO: 703285 - DNA, 22 bp, Artificial Sequence
  chemically synthesized
aactctagaaccatggaaagtc

SEQ ID NO: 703286 - DNA, 22 bp, Artificial Sequence
  chemically synthesized
acagtcagtttaactctagaac

SEQ ID NO: 703287 - DNA, 22 bp, Artificial Sequence
  chemically synthesized
tccatggttctagagttaaact

SEQ ID NO: 703288 - DNA, 22 bp, Artificial Sequence
  chemically synthesized
ccatggttctagagttaaactg

SEQ ID NO: 703289 - DNA, 22 bp, Artificial Sequence
  chemically synthesized
gtggttaacagtcagtttaact

SEQ ID NO: 703290 - DNA, 22 bp, Artificial Sequence
  chemically synthesized
catggttctagagttaaactga

SEQ ID NO: 703291 - DNA, 22 bp, Artificial Sequence
  chemically synthesized
ggtggttaacagtcagtttaac

SEQ ID NO: 703292 - DNA, 22 bp, Artificial Sequence
  chemically synthesized
tggtggttaacagtcagtttaa

SEQ ID NO: 703293 - DNA, 22 bp, Artificial Sequence
  chemically synthesized
tagagttaaactgactgttaac

SEQ ID NO: 703294 - DNA, 22 bp, Artificial Sequence
  chemically synthesized
gagttaaactgactgttaacca

SEQ ID NO: 703295 - DNA, 22 bp, Artificial Sequence
  chemically synthesized
gtcccatgctttggtggttaac

SEQ ID NO: 703296 - DNA, 22 bp, Artificial Sequence
  chemically synthesized
aactgactgttaaccaccaaag

SEQ ID NO: 703297 - DNA, 22 bp, Artificial Sequence
  chemically synthesized
cctggtcccatgctttggtggt

SEQ ID NO: 703298 - DNA, 22 bp, Artificial Sequence
  chemically synthesized
gttccctggtcccatgctttgg

SEQ ID NO: 703299 - DNA, 22 bp, Artificial Sequence
  chemically synthesized
actgttaaccaccaaagcatgg

SEQ ID NO: 703300 - DNA, 22 bp, Artificial Sequence
  chemically synthesized
actagttccctggtcccatgct

SEQ ID NO: 703301 - DNA, 22 bp, Artificial Sequence
  chemically synthesized
ttaaccaccaaagcatgggacc

SEQ ID NO: 703302 - DNA, 22 bp, Artificial Sequence
  chemically synthesized
aactagttccctggtcccatgc

SEQ ID NO: 703303 - DNA, 22 bp, Artificial Sequence
  chemically synthesized
accaccaaagcatgggaccagg

SEQ ID NO: 703304 - DNA, 22 bp, Artificial Sequence
  chemically synthesized
cttaactagttccctggtccca

SEQ ID NO: 703305 - DNA, 22 bp, Artificial Sequence
  chemically synthesized
ccttaactagttccctggtccc

SEQ ID NO: 703306 - DNA, 22 bp, Artificial Sequence
  chemically synthesized
tttccttaactagttccctggt

SEQ ID NO: 703307 - DNA, 22 bp, Artificial Sequence
  chemically synthesized
gaaaaagaggaagaaagattat

SEQ ID NO: 703308 - DNA, 22 bp, Artificial Sequence
  chemically synthesized
gttaaggaaataatctttcttc

SEQ ID NO: 703309 - DNA, 22 bp, Artificial Sequence
  chemically synthesized
aggaaataatctttcttcctct

SEQ ID NO: 703310 - DNA, 22 bp, Artificial Sequence
  chemically synthesized
aagagtcagaaaatggctagaa

SEQ ID NO: 703311 - DNA, 22 bp, Artificial Sequence
  chemically synthesized
tcttcctctttttctagccatt

SEQ ID NO: 703312 - DNA, 22 bp, Artificial Sequence
  chemically synthesized
aaagagtcagaaaatggctaga

SEQ ID NO: 703313 - DNA, 22 bp, Artificial Sequence
  chemically synthesized
cttcctctttttctagccattt

SEQ ID NO: 703314 - DNA, 22 bp, Artificial Sequence
  chemically synthesized
taaagagtcagaaaatggctag

SEQ ID NO: 703315 - DNA, 22 bp, Artificial Sequence
  chemically synthesized
ttcctctttttctagccatttt

SEQ ID NO: 703316 - DNA, 22 bp, Artificial Sequence
  chemically synthesized
ttaaagagtcagaaaatggcta

SEQ ID NO: 703317 - DNA, 22 bp, Artificial Sequence
  chemically synthesized
tttaaagagtcagaaaatggct

SEQ ID NO: 703318 - DNA, 22 bp, Artificial Sequence
  chemically synthesized
cctctttttctagccattttct

SEQ ID NO: 703319 - DNA, 22 bp, Artificial Sequence
  chemically synthesized
ctctttttctagccattttctg

SEQ ID NO: 703320 - DNA, 22 bp, Artificial Sequence
  chemically synthesized
tttttctagccattttctgact

SEQ ID NO: 703321 - DNA, 22 bp, Artificial Sequence
  chemically synthesized
tttctagccattttctgactct

SEQ ID NO: 703322 - DNA, 22 bp, Artificial Sequence
  chemically synthesized
ttctagccattttctgactctt

SEQ ID NO: 703323 - DNA, 22 bp, Artificial Sequence
  chemically synthesized
tctagccattttctgactcttt

SEQ ID NO: 703324 - DNA, 22 bp, Artificial Sequence
  chemically synthesized
ctagccattttctgactcttta

SEQ ID NO: 703325 - DNA, 22 bp, Artificial Sequence
  chemically synthesized
tagccattttctgactctttaa

SEQ ID NO: 703326 - DNA, 22 bp, Artificial Sequence
  chemically synthesized
gccattttctgactctttaaaa

SEQ ID NO: 703327 - DNA, 22 bp, Artificial Sequence
  chemically synthesized
agaaccgcgtaacattttttaa

SEQ ID NO: 703328 - DNA, 22 bp, Artificial Sequence
  chemically synthesized
tgagaaccgcgtaacatttttt

SEQ ID NO: 703329 - DNA, 22 bp, Artificial Sequence
  chemically synthesized
tctgactctttaaaaaatgtta

SEQ ID NO: 703330 - DNA, 22 bp, Artificial Sequence
  chemically synthesized
ctgactctttaaaaaatgttac

SEQ ID NO: 703331 - DNA, 22 bp, Artificial Sequence
  chemically synthesized
tgactctttaaaaaatgttacg

SEQ ID NO: 703332 - DNA, 22 bp, Artificial Sequence
  chemically synthesized
ctctgagaaccgcgtaacattt

SEQ ID NO: 703333 - DNA, 22 bp, Artificial Sequence
  chemically synthesized
actctttaaaaaatgttacgcg

SEQ ID NO: 703334 - DNA, 22 bp, Artificial Sequence
  chemically synthesized
ttactctgagaaccgcgtaaca

SEQ ID NO: 703335 - DNA, 22 bp, Artificial Sequence
  chemically synthesized
attactctgagaaccgcgtaac

SEQ ID NO: 703336 - DNA, 22 bp, Artificial Sequence
  chemically synthesized
tattactctgagaaccgcgtaa

SEQ ID NO: 703337 - DNA, 22 bp, Artificial Sequence
  chemically synthesized
tttaaaaaatgttacgcggttc

SEQ ID NO: 703338 - DNA, 22 bp, Artificial Sequence
  chemically synthesized
taaaaaatgttacgcggttctc

SEQ ID NO: 703339 - DNA, 22 bp, Artificial Sequence
  chemically synthesized
aaaaaatgttacgcggttctca

SEQ ID NO: 703340 - DNA, 22 bp, Artificial Sequence
  chemically synthesized
aaaaatgttacgcggttctcag

SEQ ID NO: 703341 - DNA, 22 bp, Artificial Sequence
  chemically synthesized
atgttttattactctgagaacc

SEQ ID NO: 703342 - DNA, 22 bp, Artificial Sequence
  chemically synthesized
cgttcatgttttattactctga

SEQ ID NO: 703343 - DNA, 22 bp, Artificial Sequence
  chemically synthesized
cgcggttctcagagtaataaaa

SEQ ID NO: 703344 - DNA, 22 bp, Artificial Sequence
  chemically synthesized
tctccgttcatgttttattact

SEQ ID NO: 703345 - DNA, 22 bp, Artificial Sequence
  chemically synthesized
gtctccgttcatgttttattac

SEQ ID NO: 703346 - DNA, 22 bp, Artificial Sequence
  chemically synthesized
tcagagtaataaaacatgaacg

SEQ ID NO: 703347 - DNA, 22 bp, Artificial Sequence
  chemically synthesized
agagtaataaaacatgaacgga

SEQ ID NO: 703348 - DNA, 22 bp, Artificial Sequence
  chemically synthesized
atagtaaacatcagcatcagaa

SEQ ID NO: 703349 - DNA, 22 bp, Artificial Sequence
  chemically synthesized
catagtaaacatcagcatcaga

SEQ ID NO: 703350 - DNA, 22 bp, Artificial Sequence
  chemically synthesized
cctcttggcattctgatgctga

SEQ ID NO: 703351 - DNA, 22 bp, Artificial Sequence
  chemically synthesized
tcatagtaaacatcagcatcag

SEQ ID NO: 703352 - DNA, 22 bp, Artificial Sequence
  chemically synthesized
ctcttggcattctgatgctgat

SEQ ID NO: 703353 - DNA, 22 bp, Artificial Sequence
  chemically synthesized
ttggcattctgatgctgatgtt

SEQ ID NO: 703354 - DNA, 22 bp, Artificial Sequence
  chemically synthesized
attttcatagtaaacatcagca

SEQ ID NO: 703355 - DNA, 22 bp, Artificial Sequence
  chemically synthesized
ggcattctgatgctgatgttta

SEQ ID NO: 703356 - DNA, 22 bp, Artificial Sequence
  chemically synthesized
gcattctgatgctgatgtttac

SEQ ID NO: 703357 - DNA, 22 bp, Artificial Sequence
  chemically synthesized
tgatgctgatgtttactatgaa

SEQ ID NO: 703358 - DNA, 22 bp, Artificial Sequence
  chemically synthesized
atgctgatgtttactatgaaaa

SEQ ID NO: 703359 - DNA, 22 bp, Artificial Sequence
  chemically synthesized
atgtttactatgaaaatcaact

SEQ ID NO: 703360 - DNA, 22 bp, Artificial Sequence
  chemically synthesized
actatgaaaatcaactgtgttt

SEQ ID NO: 703361 - DNA, 22 bp, Artificial Sequence
  chemically synthesized
ctatgaaaatcaactgtgtttt

SEQ ID NO: 703362 - DNA, 22 bp, Artificial Sequence
  chemically synthesized
tgaaaatcaactgtgttttatc

SEQ ID NO: 703363 - DNA, 22 bp, Artificial Sequence
  chemically synthesized
atatagtatataatgataaaac

SEQ ID NO: 703364 - DNA, 22 bp, Artificial Sequence
  chemically synthesized
tgttttatcattatatactata

SEQ ID NO: 703365 - DNA, 22 bp, Artificial Sequence
  chemically synthesized
aagcaatactaatatagtatat

SEQ ID NO: 703366 - DNA, 22 bp, Artificial Sequence
  chemically synthesized
tgaagcaatactaatatagtat

SEQ ID NO: 703367 - DNA, 22 bp, Artificial Sequence
  chemically synthesized
tatcattatatactatattagt

SEQ ID NO: 703368 - DNA, 22 bp, Artificial Sequence
  chemically synthesized
atcattatatactatattagta

SEQ ID NO: 703369 - DNA, 22 bp, Artificial Sequence
  chemically synthesized
tcattatatactatattagtat

SEQ ID NO: 703370 - DNA, 22 bp, Artificial Sequence
  chemically synthesized
aattctgaagcaatactaatat

SEQ ID NO: 703371 - DNA, 22 bp, Artificial Sequence
  chemically synthesized
gaattctgaagcaatactaata

SEQ ID NO: 703372 - DNA, 22 bp, Artificial Sequence
  chemically synthesized
tgaattctgaagcaatactaat

SEQ ID NO: 703373 - DNA, 22 bp, Artificial Sequence
  chemically synthesized
ttttgaattctgaagcaatact

SEQ ID NO: 703374 - DNA, 22 bp, Artificial Sequence
  chemically synthesized
tatactatattagtattgcttc

SEQ ID NO: 703375 - DNA, 22 bp, Artificial Sequence
  chemically synthesized
attttgaattctgaagcaatac

SEQ ID NO: 703376 - DNA, 22 bp, Artificial Sequence
  chemically synthesized
tttattttgaattctgaagcaa

SEQ ID NO: 703377 - DNA, 22 bp, Artificial Sequence
  chemically synthesized
tattagtattgcttcagaattc

SEQ ID NO: 703378 - DNA, 22 bp, Artificial Sequence
  chemically synthesized
gctatttattttgaattctgaa

SEQ ID NO: 703379 - DNA, 22 bp, Artificial Sequence
  chemically synthesized
agctatttattttgaattctga

SEQ ID NO: 703380 - DNA, 22 bp, Artificial Sequence
  chemically synthesized
gtattgcttcagaattcaaaat

SEQ ID NO: 703381 - DNA, 22 bp, Artificial Sequence
  chemically synthesized
aaaatatttagctatttatttt

SEQ ID NO: 703382 - DNA, 22 bp, Artificial Sequence
  chemically synthesized
cttcagaattcaaaataaatag

SEQ ID NO: 703383 - DNA, 22 bp, Artificial Sequence
  chemically synthesized
taaaaatatttagctatttatt

SEQ ID NO: 703384 - DNA, 22 bp, Artificial Sequence
  chemically synthesized
ctaaaaatatttagctatttat

SEQ ID NO: 703385 - DNA, 22 bp, Artificial Sequence
  chemically synthesized
cagaattcaaaataaatagcta

SEQ ID NO: 703386 - DNA, 22 bp, Artificial Sequence
  chemically synthesized
agaattcaaaataaatagctaa

SEQ ID NO: 703387 - DNA, 22 bp, Artificial Sequence
  chemically synthesized
tttctaaaaatatttagctatt

SEQ ID NO: 703388 - DNA, 22 bp, Artificial Sequence
  chemically synthesized
atttctaaaaatatttagctat

SEQ ID NO: 703389 - DNA, 22 bp, Artificial Sequence
  chemically synthesized
tttatttctaaaaatatttagc

SEQ ID NO: 703390 - DNA, 22 bp, Artificial Sequence
  chemically synthesized
atttatttctaaaaatatttag

SEQ ID NO: 703391 - DNA, 22 bp, Artificial Sequence
  chemically synthesized
aaaataaatagctaaatatttt

SEQ ID NO: 703392 - DNA, 22 bp, Artificial Sequence
  chemically synthesized
tatttatttctaaaaatattta

SEQ ID NO: 703393 - DNA, 22 bp, Artificial Sequence
  chemically synthesized
aacaagaatgttttatttattt

SEQ ID NO: 703394 - DNA, 22 bp, Artificial Sequence
  chemically synthesized
aatatttttagaaataaataaa

SEQ ID NO: 703395 - DNA, 22 bp, Artificial Sequence
  chemically synthesized
aaattaaacaagaatgttttat

SEQ ID NO: 703396 - DNA, 22 bp, Artificial Sequence
  chemically synthesized
ttagaaataaataaaacattct

SEQ ID NO: 703397 - DNA, 22 bp, Artificial Sequence
  chemically synthesized
tagaaataaataaaacattctt

SEQ ID NO: 703398 - DNA, 22 bp, Artificial Sequence
  chemically synthesized
agaaataaataaaacattcttg

SEQ ID NO: 703399 - DNA, 22 bp, Artificial Sequence
  chemically synthesized
gaaataaataaaacattcttgt

SEQ ID NO: 703400 - DNA, 22 bp, Artificial Sequence
  chemically synthesized
aaaatcagaaccaacaattgaa

SEQ ID NO: 703401 - DNA, 22 bp, Artificial Sequence
  chemically synthesized
aaaaatcagaaccaacaattga

SEQ ID NO: 703402 - DNA, 22 bp, Artificial Sequence
  chemically synthesized
ttgtttaatttcaattgttggt

SEQ ID NO: 703403 - DNA, 22 bp, Artificial Sequence
  chemically synthesized
gtttaatttcaattgttggttc

SEQ ID NO: 703404 - DNA, 22 bp, Artificial Sequence
  chemically synthesized
gtttaaaaatcagaaccaacaa

SEQ ID NO: 703405 - DNA, 22 bp, Artificial Sequence
  chemically synthesized
tttaatttcaattgttggttct

SEQ ID NO: 703406 - DNA, 22 bp, Artificial Sequence
  chemically synthesized
agtttaaaaatcagaaccaaca

SEQ ID NO: 703407 - DNA, 22 bp, Artificial Sequence
  chemically synthesized
aatttcaattgttggttctgat

SEQ ID NO: 703408 - DNA, 22 bp, Artificial Sequence
  chemically synthesized
atttcaattgttggttctgatt

SEQ ID NO: 703409 - DNA, 22 bp, Artificial Sequence
  chemically synthesized
caattgttggttctgattttta

SEQ ID NO: 703410 - DNA, 22 bp, Artificial Sequence
  chemically synthesized
aattgttggttctgatttttaa

SEQ ID NO: 703411 - DNA, 22 bp, Artificial Sequence
  chemically synthesized
tgtaaaaatttagtttaaaaat

SEQ ID NO: 703412 - DNA, 22 bp, Artificial Sequence
  chemically synthesized
ttggttctgatttttaaactaa

SEQ ID NO: 703413 - DNA, 22 bp, Artificial Sequence
  chemically synthesized
gttatgtaaaaatttagtttaa

SEQ ID NO: 703414 - DNA, 22 bp, Artificial Sequence
  chemically synthesized
ggttatgtaaaaatttagttta

SEQ ID NO: 703415 - DNA, 22 bp, Artificial Sequence
  chemically synthesized
gttctgatttttaaactaaatt

SEQ ID NO: 703416 - DNA, 22 bp, Artificial Sequence
  chemically synthesized
tgatttttaaactaaattttta

SEQ ID NO: 703417 - DNA, 22 bp, Artificial Sequence
  chemically synthesized
atttttaaactaaatttttaca

SEQ ID NO: 703418 - DNA, 22 bp, Artificial Sequence
  chemically synthesized
ttaaactaaatttttacataac

SEQ ID NO: 703419 - DNA, 22 bp, Artificial Sequence
  chemically synthesized
taaactaaatttttacataacc

SEQ ID NO: 703420 - DNA, 22 bp, Artificial Sequence
  chemically synthesized
aaactaaatttttacataacca

SEQ ID NO: 703421 - DNA, 22 bp, Artificial Sequence
  chemically synthesized
aactaaatttttacataaccaa

SEQ ID NO: 703422 - DNA, 22 bp, Artificial Sequence
  chemically synthesized
aatttttacataaccaagctta

SEQ ID NO: 703423 - DNA, 22 bp, Artificial Sequence
  chemically synthesized
ttacataaccaagcttactatt

SEQ ID NO: 703424 - DNA, 22 bp, Artificial Sequence
  chemically synthesized
aataggaaaaaaaatagtaagc

SEQ ID NO: 703425 - DNA, 22 bp, Artificial Sequence
  chemically synthesized
tacataaccaagcttactattt

SEQ ID NO: 703426 - DNA, 22 bp, Artificial Sequence
  chemically synthesized
aaataggaaaaaaaatagtaag

SEQ ID NO: 703427 - DNA, 22 bp, Artificial Sequence
  chemically synthesized
acataaccaagcttactatttt

SEQ ID NO: 703428 - DNA, 22 bp, Artificial Sequence
  chemically synthesized
cataaccaagcttactattttt

SEQ ID NO: 703429 - DNA, 22 bp, Artificial Sequence
  chemically synthesized
actattttttttcctatttaaa

SEQ ID NO: 703430 - DNA, 22 bp, Artificial Sequence
  chemically synthesized
ctattttttttcctatttaaat

SEQ ID NO: 703431 - DNA, 22 bp, Artificial Sequence
  chemically synthesized
ttttttttcctatttaaattgg

SEQ ID NO: 703432 - DNA, 22 bp, Artificial Sequence
  chemically synthesized
tttttcctatttaaattggtgt

SEQ ID NO: 703433 - DNA, 22 bp, Artificial Sequence
  chemically synthesized
ttttcctatttaaattggtgtg

SEQ ID NO: 703434 - DNA, 22 bp, Artificial Sequence
  chemically synthesized
acatgaatcacccacaccaatt

SEQ ID NO: 703435 - DNA, 22 bp, Artificial Sequence
  chemically synthesized
tttcctatttaaattggtgtgg

SEQ ID NO: 703436 - DNA, 22 bp, Artificial Sequence
  chemically synthesized
ttcctatttaaattggtgtggg

SEQ ID NO: 703437 - DNA, 22 bp, Artificial Sequence
  chemically synthesized
tcctatttaaattggtgtgggt

SEQ ID NO: 703438 - DNA, 22 bp, Artificial Sequence
  chemically synthesized
cctatttaaattggtgtgggtg

SEQ ID NO: 703439 - DNA, 22 bp, Artificial Sequence
  chemically synthesized
ctatttaaattggtgtgggtga

SEQ ID NO: 703440 - DNA, 22 bp, Artificial Sequence
  chemically synthesized
cattaacatgaatcacccacac

SEQ ID NO: 703441 - DNA, 22 bp, Artificial Sequence
  chemically synthesized
tttaaattggtgtgggtgattc

SEQ ID NO: 703442 - DNA, 22 bp, Artificial Sequence
  chemically synthesized
aaattggtgtgggtgattcatg

SEQ ID NO: 703443 - DNA, 22 bp, Artificial Sequence
  chemically synthesized
aattggtgtgggtgattcatgt

SEQ ID NO: 703444 - DNA, 22 bp, Artificial Sequence
  chemically synthesized
gtgtgggtgattcatgttaatg

SEQ ID NO: 703445 - DNA, 22 bp, Artificial Sequence
  chemically synthesized
aggtcagagaattccattaaca

SEQ ID NO: 703446 - DNA, 22 bp, Artificial Sequence
  chemically synthesized
caggtcagagaattccattaac

SEQ ID NO: 703447 - DNA, 22 bp, Artificial Sequence
  chemically synthesized
atgttaatggaattctctgacc

SEQ ID NO: 703448 - DNA, 22 bp, Artificial Sequence
  chemically synthesized
atggaattctctgacctgaagt

SEQ ID NO: 703449 - DNA, 22 bp, Artificial Sequence
  chemically synthesized
aacaagacagcacataacttca

SEQ ID NO: 703450 - DNA, 22 bp, Artificial Sequence
  chemically synthesized
aaacaagacagcacataacttc

SEQ ID NO: 703451 - DNA, 22 bp, Artificial Sequence
  chemically synthesized
tctgacctgaagttatgtgctg

SEQ ID NO: 703452 - DNA, 22 bp, Artificial Sequence
  chemically synthesized
tgacctgaagttatgtgctgtc

SEQ ID NO: 703453 - DNA, 22 bp, Artificial Sequence
  chemically synthesized
tgtcttaaacaagacagcacat

SEQ ID NO: 703454 - DNA, 22 bp, Artificial Sequence
  chemically synthesized
atgtcttaaacaagacagcaca

SEQ ID NO: 703455 - DNA, 22 bp, Artificial Sequence
  chemically synthesized
acctgaagttatgtgctgtctt

SEQ ID NO: 703456 - DNA, 22 bp, Artificial Sequence
  chemically synthesized
aagttatgtgctgtcttgttta

SEQ ID NO: 703457 - DNA, 22 bp, Artificial Sequence
  chemically synthesized
tgtgctgtcttgtttaagacat

SEQ ID NO: 703458 - DNA, 22 bp, Artificial Sequence
  chemically synthesized
tcttgtttaagacataagcctt

SEQ ID NO: 703459 - DNA, 22 bp, Artificial Sequence
  chemically synthesized
gtttaagacataagccttgctg

SEQ ID NO: 703460 - DNA, 22 bp, Artificial Sequence
  chemically synthesized
tttaagacataagccttgctgc

SEQ ID NO: 703461 - DNA, 22 bp, Artificial Sequence
  chemically synthesized
aagacataagccttgctgcccc

SEQ ID NO: 703462 - DNA, 22 bp, Artificial Sequence
  chemically synthesized
agacataagccttgctgccccc

SEQ ID NO: 703463 - DNA, 22 bp, Artificial Sequence
  chemically synthesized
gctgcccccgcctttttttttt

SEQ ID NO: 703464 - DNA, 22 bp, Artificial Sequence
  chemically synthesized
ctgcccccgccttttttttttt

SEQ ID NO: 703465 - DNA, 22 bp, Artificial Sequence
  chemically synthesized
cccccgcctttttttttttttt

SEQ ID NO: 703466 - DNA, 22 bp, Artificial Sequence
  chemically synthesized
aggcaaaaaaaaaaaaaaaaaa

SEQ ID NO: 703467 - DNA, 22 bp, Artificial Sequence
  chemically synthesized
caggcaaaaaaaaaaaaaaaaa

SEQ ID NO: 703468 - DNA, 22 bp, Artificial Sequence
  chemically synthesized
tcttcaggcaaaaaaaaaaaaa

SEQ ID NO: 703469 - DNA, 22 bp, Artificial Sequence
  chemically synthesized
tttttttttttttttttttttt

SEQ ID NO: 703470 - DNA, 22 bp, Artificial Sequence
  chemically synthesized
tttttttttttttttttttttt

SEQ ID NO: 703471 - DNA, 22 bp, Artificial Sequence
  chemically synthesized
tttttttttttttttttttttt

SEQ ID NO: 703472 - DNA, 22 bp, Artificial Sequence
  chemically synthesized
ttatcttcaggcaaaaaaaaaa

SEQ ID NO: 703473 - DNA, 22 bp, Artificial Sequence
  chemically synthesized
tttttttttttttttttttttg

SEQ ID NO: 703474 - DNA, 22 bp, Artificial Sequence
  chemically synthesized
gttatcttcaggcaaaaaaaaa

SEQ ID NO: 703475 - DNA, 22 bp, Artificial Sequence
  chemically synthesized
ttttttttttttttttttttgc

SEQ ID NO: 703476 - DNA, 22 bp, Artificial Sequence
  chemically synthesized
tttttttttttttttttttgcc

SEQ ID NO: 703477 - DNA, 22 bp, Artificial Sequence
  chemically synthesized
ttttttttttttttttttgcct

SEQ ID NO: 703478 - DNA, 22 bp, Artificial Sequence
  chemically synthesized
tttttttttttttttttgcctg

SEQ ID NO: 703479 - DNA, 22 bp, Artificial Sequence
  chemically synthesized
ttttttttttttttttgcctga

SEQ ID NO: 703480 - DNA, 22 bp, Artificial Sequence
  chemically synthesized
tttttttttttttttgcctgaa

SEQ ID NO: 703481 - DNA, 22 bp, Artificial Sequence
  chemically synthesized
ttttttttttttttgcctgaag

SEQ ID NO: 703482 - DNA, 22 bp, Artificial Sequence
  chemically synthesized
tttttttttttttgcctgaaga

SEQ ID NO: 703483 - DNA, 22 bp, Artificial Sequence
  chemically synthesized
ttttttttttttgcctgaagat

SEQ ID NO: 703484 - DNA, 22 bp, Artificial Sequence
  chemically synthesized
tttttttttttgcctgaagata

SEQ ID NO: 703485 - DNA, 22 bp, Artificial Sequence
  chemically synthesized
ttttttttttgcctgaagataa

SEQ ID NO: 703486 - DNA, 22 bp, Artificial Sequence
  chemically synthesized
atgacaaccttgttatcttcag

SEQ ID NO: 703487 - DNA, 22 bp, Artificial Sequence
  chemically synthesized
tttttttttgcctgaagataac

SEQ ID NO: 703488 - DNA, 22 bp, Artificial Sequence
  chemically synthesized
ttttttttgcctgaagataaca

SEQ ID NO: 703489 - DNA, 22 bp, Artificial Sequence
  chemically synthesized
tttttttgcctgaagataacaa

SEQ ID NO: 703490 - DNA, 22 bp, Artificial Sequence
  chemically synthesized
ttttttgcctgaagataacaag

SEQ ID NO: 703491 - DNA, 22 bp, Artificial Sequence
  chemically synthesized
tttttgcctgaagataacaagg

SEQ ID NO: 703492 - DNA, 22 bp, Artificial Sequence
  chemically synthesized
ttttgcctgaagataacaaggt

SEQ ID NO: 703493 - DNA, 22 bp, Artificial Sequence
  chemically synthesized
tttgcctgaagataacaaggtt

SEQ ID NO: 703494 - DNA, 22 bp, Artificial Sequence
  chemically synthesized
ttgcctgaagataacaaggttg

SEQ ID NO: 703495 - DNA, 22 bp, Artificial Sequence
  chemically synthesized
tgcctgaagataacaaggttgt

SEQ ID NO: 703496 - DNA, 22 bp, Artificial Sequence
  chemically synthesized
gcctgaagataacaaggttgtc

SEQ ID NO: 703497 - DNA, 22 bp, Artificial Sequence
  chemically synthesized
cctgaagataacaaggttgtca

SEQ ID NO: 703498 - DNA, 22 bp, Artificial Sequence
  chemically synthesized
aagataacaaggttgtcatgag

SEQ ID NO: 703499 - DNA, 22 bp, Artificial Sequence
  chemically synthesized
gaacccaacacaaaagctcatg

SEQ ID NO: 703500 - DNA, 22 bp, Artificial Sequence
  chemically synthesized
ctggaacccaacacaaaagctc

SEQ ID NO: 703501 - DNA, 22 bp, Artificial Sequence
  chemically synthesized
ttcctggaacccaacacaaaag

SEQ ID NO: 703502 - DNA, 22 bp, Artificial Sequence
  chemically synthesized
tcatgagcttttgtgttgggtt

SEQ ID NO: 703503 - DNA, 22 bp, Artificial Sequence
  chemically synthesized
agttattcctggaacccaacac

SEQ ID NO: 703504 - DNA, 22 bp, Artificial Sequence
  chemically synthesized
cagttattcctggaacccaaca

SEQ ID NO: 703505 - DNA, 22 bp, Artificial Sequence
  chemically synthesized
catcttcagttattcctggaac

SEQ ID NO: 703506 - DNA, 22 bp, Artificial Sequence
  chemically synthesized
ttgtgttgggttccaggaataa

SEQ ID NO: 703507 - DNA, 22 bp, Artificial Sequence
  chemically synthesized
tgtgttgggttccaggaataac

SEQ ID NO: 703508 - DNA, 22 bp, Artificial Sequence
  chemically synthesized
gtgttgggttccaggaataact

SEQ ID NO: 703509 - DNA, 22 bp, Artificial Sequence
  chemically synthesized
aactgcatcttcagttattcct

SEQ ID NO: 703510 - DNA, 22 bp, Artificial Sequence
  chemically synthesized
tgttgggttccaggaataactg

SEQ ID NO: 703511 - DNA, 22 bp, Artificial Sequence
  chemically synthesized
gaactgcatcttcagttattcc

SEQ ID NO: 703512 - DNA, 22 bp, Artificial Sequence
  chemically synthesized
tgaactgcatcttcagttattc

SEQ ID NO: 703513 - DNA, 22 bp, Artificial Sequence
  chemically synthesized
ggttccaggaataactgaagat

SEQ ID NO: 703514 - DNA, 22 bp, Artificial Sequence
  chemically synthesized
agttttgaactgcatcttcagt

SEQ ID NO: 703515 - DNA, 22 bp, Artificial Sequence
  chemically synthesized
caggaataactgaagatgcagt

SEQ ID NO: 703516 - DNA, 22 bp, Artificial Sequence
  chemically synthesized
gaggaagattcagttttgaact

SEQ ID NO: 703517 - DNA, 22 bp, Artificial Sequence
  chemically synthesized
ttagaggaagattcagttttga

SEQ ID NO: 703518 - DNA, 22 bp, Artificial Sequence
  chemically synthesized
aagatgcagttcaaaactgaat

SEQ ID NO: 703519 - DNA, 22 bp, Artificial Sequence
  chemically synthesized
aaaactgaatcttcctctaata

SEQ ID NO: 703520 - DNA, 22 bp, Artificial Sequence
  chemically synthesized
gagcagatacatctattagagg

SEQ ID NO: 703521 - DNA, 22 bp, Artificial Sequence
  chemically synthesized
aatcttcctctaatagatgtat

SEQ ID NO: 703522 - DNA, 22 bp, Artificial Sequence
  chemically synthesized
cctctaatagatgtatctgctc

SEQ ID NO: 703523 - DNA, 22 bp, Artificial Sequence
  chemically synthesized
ctctaatagatgtatctgctcc

SEQ ID NO: 703524 - DNA, 22 bp, Artificial Sequence
  chemically synthesized
gtccaggagatctggagcagat

SEQ ID NO: 703525 - DNA, 22 bp, Artificial Sequence
  chemically synthesized
ggtccaggagatctggagcaga

SEQ ID NO: 703526 - DNA, 22 bp, Artificial Sequence
  chemically synthesized
taatagatgtatctgctccaga

SEQ ID NO: 703527 - DNA, 22 bp, Artificial Sequence
  chemically synthesized
atagatgtatctgctccagatc

SEQ ID NO: 703528 - DNA, 22 bp, Artificial Sequence
  chemically synthesized
aaaagacttggtccaggagatc

SEQ ID NO: 703529 - DNA, 22 bp, Artificial Sequence
  chemically synthesized
ctccagatctcctggaccaagt

SEQ ID NO: 703530 - DNA, 22 bp, Artificial Sequence
  chemically synthesized
cagatctcctggaccaagtctt

SEQ ID NO: 703531 - DNA, 22 bp, Artificial Sequence
  chemically synthesized
ctggaccaagtcttttgaatta

SEQ ID NO: 703532 - DNA, 22 bp, Artificial Sequence
  chemically synthesized
gaccaagtcttttgaattactt

SEQ ID NO: 703533 - DNA, 22 bp, Artificial Sequence
  chemically synthesized
tcaagggaaagaaagtaattca

SEQ ID NO: 703534 - DNA, 22 bp, Artificial Sequence
  chemically synthesized
gaccagctatcaagggaaagaa

SEQ ID NO: 703535 - DNA, 22 bp, Artificial Sequence
  chemically synthesized
ttgaattactttctttcccttg

SEQ ID NO: 703536 - DNA, 22 bp, Artificial Sequence
  chemically synthesized
tgaattactttctttcccttga

SEQ ID NO: 703537 - DNA, 22 bp, Artificial Sequence
  chemically synthesized
gaattactttctttcccttgat

SEQ ID NO: 703538 - DNA, 22 bp, Artificial Sequence
  chemically synthesized
aattactttctttcccttgata

SEQ ID NO: 703539 - DNA, 22 bp, Artificial Sequence
  chemically synthesized
gacctagaccagctatcaaggg

SEQ ID NO: 703540 - DNA, 22 bp, Artificial Sequence
  chemically synthesized
ctttctttcccttgatagctgg

SEQ ID NO: 703541 - DNA, 22 bp, Artificial Sequence
  chemically synthesized
tctttcccttgatagctggtct

SEQ ID NO: 703542 - DNA, 22 bp, Artificial Sequence
  chemically synthesized
ctttcccttgatagctggtcta

SEQ ID NO: 703543 - DNA, 22 bp, Artificial Sequence
  chemically synthesized
tagaattcgacctagaccagct

SEQ ID NO: 703544 - DNA, 22 bp, Artificial Sequence
  chemically synthesized
tttcccttgatagctggtctag

SEQ ID NO: 703545 - DNA, 22 bp, Artificial Sequence
  chemically synthesized
tcccttgatagctggtctaggt

SEQ ID NO: 703546 - DNA, 22 bp, Artificial Sequence
  chemically synthesized
cccttgatagctggtctaggtc

SEQ ID NO: 703547 - DNA, 22 bp, Artificial Sequence
  chemically synthesized
ccttgatagctggtctaggtcg

SEQ ID NO: 703548 - DNA, 22 bp, Artificial Sequence
  chemically synthesized
atgttatagaattcgacctaga

SEQ ID NO: 703549 - DNA, 22 bp, Artificial Sequence
  chemically synthesized
gatagctggtctaggtcgaatt

SEQ ID NO: 703550 - DNA, 22 bp, Artificial Sequence
  chemically synthesized
atagctggtctaggtcgaattc

SEQ ID NO: 703551 - DNA, 22 bp, Artificial Sequence
  chemically synthesized
gtctaggtcgaattctataaca

SEQ ID NO: 703552 - DNA, 22 bp, Artificial Sequence
  chemically synthesized
ggtcgaattctataacatgaac

SEQ ID NO: 703553 - DNA, 22 bp, Artificial Sequence
  chemically synthesized
aggaggtgaaaagtgaaggagt

SEQ ID NO: 703554 - DNA, 22 bp, Artificial Sequence
  chemically synthesized
tataacatgaactccttcactt

SEQ ID NO: 703555 - DNA, 22 bp, Artificial Sequence
  chemically synthesized
tcaggaggtgaaaagtgaagga

SEQ ID NO: 703556 - DNA, 22 bp, Artificial Sequence
  chemically synthesized
taacatgaactccttcactttt

SEQ ID NO: 703557 - DNA, 22 bp, Artificial Sequence
  chemically synthesized
ttctcaggaggtgaaaagtgaa

SEQ ID NO: 703558 - DNA, 22 bp, Artificial Sequence
  chemically synthesized
attctcaggaggtgaaaagtga

SEQ ID NO: 703559 - DNA, 22 bp, Artificial Sequence
  chemically synthesized
cttcacttttcacctcctgaga

SEQ ID NO: 703560 - DNA, 22 bp, Artificial Sequence
  chemically synthesized
cacttttcacctcctgagaata

SEQ ID NO: 703561 - DNA, 22 bp, Artificial Sequence
  chemically synthesized
acttttcacctcctgagaataa

SEQ ID NO: 703562 - DNA, 22 bp, Artificial Sequence
  chemically synthesized
gggacagaagggatttattctc

SEQ ID NO: 703563 - DNA, 22 bp, Artificial Sequence
  chemically synthesized
ttcacctcctgagaataaatcc

SEQ ID NO: 703564 - DNA, 22 bp, Artificial Sequence
  chemically synthesized
tcacctcctgagaataaatccc

SEQ ID NO: 703565 - DNA, 22 bp, Artificial Sequence
  chemically synthesized
cacctcctgagaataaatccct

SEQ ID NO: 703566 - DNA, 22 bp, Artificial Sequence
  chemically synthesized
acctcctgagaataaatccctt

SEQ ID NO: 703567 - DNA, 22 bp, Artificial Sequence
  chemically synthesized
ctgagaataaatcccttctgtc

SEQ ID NO: 703568 - DNA, 22 bp, Artificial Sequence
  chemically synthesized
tggtgtgagttagggacagaag

SEQ ID NO: 703569 - DNA, 22 bp, Artificial Sequence
  chemically synthesized
agaataaatcccttctgtccct

SEQ ID NO: 703570 - DNA, 22 bp, Artificial Sequence
  chemically synthesized
atggtgtgagttagggacagaa

SEQ ID NO: 703571 - DNA, 22 bp, Artificial Sequence
  chemically synthesized
atttatggtgtgagttagggac

SEQ ID NO: 703572 - DNA, 22 bp, Artificial Sequence
  chemically synthesized
ctgtccctaactcacaccataa

SEQ ID NO: 703573 - DNA, 22 bp, Artificial Sequence
  chemically synthesized
tgtccctaactcacaccataaa

SEQ ID NO: 703574 - DNA, 22 bp, Artificial Sequence
  chemically synthesized
tccctaactcacaccataaatg

SEQ ID NO: 703575 - DNA, 22 bp, Artificial Sequence
  chemically synthesized
actcacaccataaatgagctca

SEQ ID NO: 703576 - DNA, 22 bp, Artificial Sequence
  chemically synthesized
acaccataaatgagctcatttc

SEQ ID NO: 703577 - DNA, 22 bp, Artificial Sequence
  chemically synthesized
atttcattccattcctcttcga

SEQ ID NO: 703578 - DNA, 22 bp, Artificial Sequence
  chemically synthesized
tggaaaaaaaaaatcgaagagg

SEQ ID NO: 703579 - DNA, 22 bp, Artificial Sequence
  chemically synthesized
cattccattcctcttcgatttt

SEQ ID NO: 703580 - DNA, 22 bp, Artificial Sequence
  chemically synthesized
attccattcctcttcgattttt

SEQ ID NO: 703581 - DNA, 22 bp, Artificial Sequence
  chemically synthesized
cattcctcttcgattttttttt

SEQ ID NO: 703582 - DNA, 22 bp, Artificial Sequence
  chemically synthesized
ctcttcgattttttttttccac

SEQ ID NO: 703583 - DNA, 22 bp, Artificial Sequence
  chemically synthesized
agcaggaaatgtctgtggaaaa

SEQ ID NO: 703584 - DNA, 22 bp, Artificial Sequence
  chemically synthesized
ttcgattttttttttccacaga

SEQ ID NO: 703585 - DNA, 22 bp, Artificial Sequence
  chemically synthesized
cgattttttttttccacagaca

SEQ ID NO: 703586 - DNA, 22 bp, Artificial Sequence
  chemically synthesized
gattttttttttccacagacat

SEQ ID NO: 703587 - DNA, 22 bp, Artificial Sequence
  chemically synthesized
tttttttccacagacatttcct

SEQ ID NO: 703588 - DNA, 22 bp, Artificial Sequence
  chemically synthesized
ttttttccacagacatttcctg

SEQ ID NO: 703589 - DNA, 22 bp, Artificial Sequence
  chemically synthesized
tttttccacagacatttcctgc

SEQ ID NO: 703590 - DNA, 22 bp, Artificial Sequence
  chemically synthesized
ttttccacagacatttcctgct

SEQ ID NO: 703591 - DNA, 22 bp, Artificial Sequence
  chemically synthesized
tttccacagacatttcctgctc

SEQ ID NO: 703592 - DNA, 22 bp, Artificial Sequence
  chemically synthesized
ttccacagacatttcctgctca

SEQ ID NO: 703593 - DNA, 22 bp, Artificial Sequence
  chemically synthesized
tccacagacatttcctgctcag

SEQ ID NO: 703594 - DNA, 22 bp, Artificial Sequence
  chemically synthesized
ccacagacatttcctgctcaga

SEQ ID NO: 703595 - DNA, 22 bp, Artificial Sequence
  chemically synthesized
cacagacatttcctgctcagac

SEQ ID NO: 703596 - DNA, 22 bp, Artificial Sequence
  chemically synthesized
atagggaaagaaaaagtctgag

SEQ ID NO: 703597 - DNA, 22 bp, Artificial Sequence
  chemically synthesized
gatagggaaagaaaaagtctga

SEQ ID NO: 703598 - DNA, 22 bp, Artificial Sequence
  chemically synthesized
cctgctcagactttttctttcc

SEQ ID NO: 703599 - DNA, 22 bp, Artificial Sequence
  chemically synthesized
ctgctcagactttttctttccc

SEQ ID NO: 703600 - DNA, 22 bp, Artificial Sequence
  chemically synthesized
ctcagactttttctttccctat

SEQ ID NO: 703601 - DNA, 22 bp, Artificial Sequence
  chemically synthesized
agactttttctttccctatcaa

SEQ ID NO: 703602 - DNA, 22 bp, Artificial Sequence
  chemically synthesized
gtcaacatgagggcaatttgat

SEQ ID NO: 703603 - DNA, 22 bp, Artificial Sequence
  chemically synthesized
tttctttccctatcaaattgcc

SEQ ID NO: 703604 - DNA, 22 bp, Artificial Sequence
  chemically synthesized
ttctttccctatcaaattgccc

SEQ ID NO: 703605 - DNA, 22 bp, Artificial Sequence
  chemically synthesized
tctttccctatcaaattgccct

SEQ ID NO: 703606 - DNA, 22 bp, Artificial Sequence
  chemically synthesized
ctttccctatcaaattgccctc

SEQ ID NO: 703607 - DNA, 22 bp, Artificial Sequence
  chemically synthesized
tttccctatcaaattgccctca

SEQ ID NO: 703608 - DNA, 22 bp, Artificial Sequence
  chemically synthesized
tccctatcaaattgccctcatg

SEQ ID NO: 703609 - DNA, 22 bp, Artificial Sequence
  chemically synthesized
ccctatcaaattgccctcatgt

SEQ ID NO: 703610 - DNA, 22 bp, Artificial Sequence
  chemically synthesized
aaggattagtcaacatgagggc

SEQ ID NO: 703611 - DNA, 22 bp, Artificial Sequence
  chemically synthesized
cctatcaaattgccctcatgtt

SEQ ID NO: 703612 - DNA, 22 bp, Artificial Sequence
  chemically synthesized
tcaaattgccctcatgttgact

SEQ ID NO: 703613 - DNA, 22 bp, Artificial Sequence
  chemically synthesized
ccctcatgttgactaatccttc

SEQ ID NO: 703614 - DNA, 22 bp, Artificial Sequence
  chemically synthesized
atgttgactaatccttcaatta

SEQ ID NO: 703615 - DNA, 22 bp, Artificial Sequence
  chemically synthesized
actaatccttcaattattctct

SEQ ID NO: 703616 - DNA, 22 bp, Artificial Sequence
  chemically synthesized
atccttcaattattctctctcg

SEQ ID NO: 703617 - DNA, 22 bp, Artificial Sequence
  chemically synthesized
caattattctctctcgtctgcc

SEQ ID NO: 703618 - DNA, 22 bp, Artificial Sequence
  chemically synthesized
aattattctctctcgtctgcct

SEQ ID NO: 703619 - DNA, 22 bp, Artificial Sequence
  chemically synthesized
atgagatagaaataggcagacg

SEQ ID NO: 703620 - DNA, 22 bp, Artificial Sequence
  chemically synthesized
aatgagatagaaataggcagac

SEQ ID NO: 703621 - DNA, 22 bp, Artificial Sequence
  chemically synthesized
taatgagatagaaataggcaga

SEQ ID NO: 703622 - DNA, 22 bp, Artificial Sequence
  chemically synthesized
ttctctctcgtctgcctatttc

SEQ ID NO: 703623 - DNA, 22 bp, Artificial Sequence
  chemically synthesized
tctctcgtctgcctatttctat

SEQ ID NO: 703624 - DNA, 22 bp, Artificial Sequence
  chemically synthesized
atgttttaatgagatagaaata

SEQ ID NO: 703625 - DNA, 22 bp, Artificial Sequence
  chemically synthesized
tctcgtctgcctatttctatct

SEQ ID NO: 703626 - DNA, 22 bp, Artificial Sequence
  chemically synthesized
tcgtctgcctatttctatctca

SEQ ID NO: 703627 - DNA, 22 bp, Artificial Sequence
  chemically synthesized
gtctgcctatttctatctcatt

SEQ ID NO: 703628 - DNA, 22 bp, Artificial Sequence
  chemically synthesized
cctatttctatctcattaaaac

SEQ ID NO: 703629 - DNA, 22 bp, Artificial Sequence
  chemically synthesized
gagagcactaatgttttaatga

SEQ ID NO: 703630 - DNA, 22 bp, Artificial Sequence
  chemically synthesized
agagagcactaatgttttaatg

SEQ ID NO: 703631 - DNA, 22 bp, Artificial Sequence
  chemically synthesized
tagagagcactaatgttttaat

SEQ ID NO: 703632 - DNA, 22 bp, Artificial Sequence
  chemically synthesized
tttctatctcattaaaacatta

SEQ ID NO: 703633 - DNA, 22 bp, Artificial Sequence
  chemically synthesized
ctatctcattaaaacattagtg

SEQ ID NO: 703634 - DNA, 22 bp, Artificial Sequence
  chemically synthesized
tatctcattaaaacattagtgc

SEQ ID NO: 703635 - DNA, 22 bp, Artificial Sequence
  chemically synthesized
tctcattaaaacattagtgctc

SEQ ID NO: 703636 - DNA, 22 bp, Artificial Sequence
  chemically synthesized
attaaaacattagtgctctcta

SEQ ID NO: 703637 - DNA, 22 bp, Artificial Sequence
  chemically synthesized
aaacattagtgctctctaaaac

SEQ ID NO: 703638 - DNA, 22 bp, Artificial Sequence
  chemically synthesized
gtgctctctaaaacctatattt

SEQ ID NO: 703639 - DNA, 22 bp, Artificial Sequence
  chemically synthesized
tctaaaacctatatttatattc

SEQ ID NO: 703640 - DNA, 22 bp, Artificial Sequence
  chemically synthesized
cgtatgtataatgaatataaat

SEQ ID NO: 703641 - DNA, 22 bp, Artificial Sequence
  chemically synthesized
acgtatgtataatgaatataaa

SEQ ID NO: 703642 - DNA, 22 bp, Artificial Sequence
  chemically synthesized
taaaacctatatttatattcat

SEQ ID NO: 703643 - DNA, 22 bp, Artificial Sequence
  chemically synthesized
ttacgtatgtataatgaatata

SEQ ID NO: 703644 - DNA, 22 bp, Artificial Sequence
  chemically synthesized
aaacctatatttatattcatta

SEQ ID NO: 703645 - DNA, 22 bp, Artificial Sequence
  chemically synthesized
cttacgtatgtataatgaatat

SEQ ID NO: 703646 - DNA, 22 bp, Artificial Sequence
  chemically synthesized
tatttatattcattatacatac

SEQ ID NO: 703647 - DNA, 22 bp, Artificial Sequence
  chemically synthesized
atattcattatacatacgtaag

SEQ ID NO: 703648 - DNA, 22 bp, Artificial Sequence
  chemically synthesized
tattcattatacatacgtaaga

SEQ ID NO: 703649 - DNA, 22 bp, Artificial Sequence
  chemically synthesized
agaaaagggatttcttacgtat

SEQ ID NO: 703650 - DNA, 22 bp, Artificial Sequence
  chemically synthesized
ttcagaaaagggatttcttacg

SEQ ID NO: 703651 - DNA, 22 bp, Artificial Sequence
  chemically synthesized
attatacatacgtaagaaatcc

SEQ ID NO: 703652 - DNA, 22 bp, Artificial Sequence
  chemically synthesized
tgttcagaaaagggatttctta

SEQ ID NO: 703653 - DNA, 22 bp, Artificial Sequence
  chemically synthesized
ctgttcagaaaagggatttctt

SEQ ID NO: 703654 - DNA, 22 bp, Artificial Sequence
  chemically synthesized
tacatacgtaagaaatcccttt

SEQ ID NO: 703655 - DNA, 22 bp, Artificial Sequence
  chemically synthesized
ccgcccttctgttcagaaaagg

SEQ ID NO: 703656 - DNA, 22 bp, Artificial Sequence
  chemically synthesized
accgcccttctgttcagaaaag

SEQ ID NO: 703657 - DNA, 22 bp, Artificial Sequence
  chemically synthesized
cttaccgcccttctgttcagaa

SEQ ID NO: 703658 - DNA, 22 bp, Artificial Sequence
  chemically synthesized
ttctgaacagaagggcggtaag

SEQ ID NO: 703659 - DNA, 22 bp, Artificial Sequence
  chemically synthesized
gtgtgtagtctccttaccgccc

SEQ ID NO: 703660 - DNA, 22 bp, Artificial Sequence
  chemically synthesized
tctgaacagaagggcggtaagg

SEQ ID NO: 703661 - DNA, 22 bp, Artificial Sequence
  chemically synthesized
cgtgtgtagtctccttaccgcc

SEQ ID NO: 703662 - DNA, 22 bp, Artificial Sequence
  chemically synthesized
ctgaacagaagggcggtaagga

SEQ ID NO: 703663 - DNA, 22 bp, Artificial Sequence
  chemically synthesized
tgaacagaagggcggtaaggag

SEQ ID NO: 703664 - DNA, 22 bp, Artificial Sequence
  chemically synthesized
aacagaagggcggtaaggagac

SEQ ID NO: 703665 - DNA, 22 bp, Artificial Sequence
  chemically synthesized
cagtttcgtgtgtagtctcctt

SEQ ID NO: 703666 - DNA, 22 bp, Artificial Sequence
  chemically synthesized
ccagtttcgtgtgtagtctcct

SEQ ID NO: 703667 - DNA, 22 bp, Artificial Sequence
  chemically synthesized
tccagtttcgtgtgtagtctcc

SEQ ID NO: 703668 - DNA, 22 bp, Artificial Sequence
  chemically synthesized
cctttccagtttcgtgtgtagt

SEQ ID NO: 703669 - DNA, 22 bp, Artificial Sequence
  chemically synthesized
cacacgaaactggaaagggaga

SEQ ID NO: 703670 - DNA, 22 bp, Artificial Sequence
  chemically synthesized
gaaagggagatattcatctttt

SEQ ID NO: 703671 - DNA, 22 bp, Artificial Sequence
  chemically synthesized
tatccaaaaaaaaaaaaaaaga

SEQ ID NO: 703672 - DNA, 22 bp, Artificial Sequence
  chemically synthesized
tgtatccaaaaaaaaaaaaaaa

SEQ ID NO: 703673 - DNA, 22 bp, Artificial Sequence
  chemically synthesized
atctttttttttttttttggat

SEQ ID NO: 703674 - DNA, 22 bp, Artificial Sequence
  chemically synthesized
tttttttttttttggatacaga

SEQ ID NO: 703675 - DNA, 22 bp, Artificial Sequence
  chemically synthesized
ttttttttttttggatacagag

SEQ ID NO: 703676 - DNA, 22 bp, Artificial Sequence
  chemically synthesized
tttttttttttggatacagagt

SEQ ID NO: 703677 - DNA, 22 bp, Artificial Sequence
  chemically synthesized
ttttttttttggatacagagtc

SEQ ID NO: 703678 - DNA, 22 bp, Artificial Sequence
  chemically synthesized
tttttttttggatacagagtct

SEQ ID NO: 703679 - DNA, 22 bp, Artificial Sequence
  chemically synthesized
ggtgacggagcaagactctgta

SEQ ID NO: 703680 - DNA, 22 bp, Artificial Sequence
  chemically synthesized
ttttttttggatacagagtctt

SEQ ID NO: 703681 - DNA, 22 bp, Artificial Sequence
  chemically synthesized
tttttttggatacagagtcttg

SEQ ID NO: 703682 - DNA, 22 bp, Artificial Sequence
  chemically synthesized
ttttttggatacagagtcttgc

SEQ ID NO: 703683 - DNA, 22 bp, Artificial Sequence
  chemically synthesized
tttttggatacagagtcttgct

SEQ ID NO: 703684 - DNA, 22 bp, Artificial Sequence
  chemically synthesized
ttttggatacagagtcttgctc

SEQ ID NO: 703685 - DNA, 22 bp, Artificial Sequence
  chemically synthesized
tttggatacagagtcttgctcc

SEQ ID NO: 703686 - DNA, 22 bp, Artificial Sequence
  chemically synthesized
ttggatacagagtcttgctccg

SEQ ID NO: 703687 - DNA, 22 bp, Artificial Sequence
  chemically synthesized
cagcctgggtgacggagcaaga

SEQ ID NO: 703688 - DNA, 22 bp, Artificial Sequence
  chemically synthesized
tggatacagagtcttgctccgt

SEQ ID NO: 703689 - DNA, 22 bp, Artificial Sequence
  chemically synthesized
ggatacagagtcttgctccgtc

SEQ ID NO: 703690 - DNA, 22 bp, Artificial Sequence
  chemically synthesized
gatacagagtcttgctccgtca

SEQ ID NO: 703691 - DNA, 22 bp, Artificial Sequence
  chemically synthesized
cgctccagcctgggtgacggag

SEQ ID NO: 703692 - DNA, 22 bp, Artificial Sequence
  chemically synthesized
gctccgtcacccaggctggagc

SEQ ID NO: 703693 - DNA, 22 bp, Artificial Sequence
  chemically synthesized
ctccgtcacccaggctggagcg

SEQ ID NO: 703694 - DNA, 22 bp, Artificial Sequence
  chemically synthesized
cgtcacccaggctggagcgcaa

SEQ ID NO: 703695 - DNA, 22 bp, Artificial Sequence
  chemically synthesized
cagtgagccgagatcgcgccat

SEQ ID NO: 703696 - DNA, 22 bp, Artificial Sequence
  chemically synthesized
gagcgcaatggcgcgatctcgg

SEQ ID NO: 703697 - DNA, 22 bp, Artificial Sequence
  chemically synthesized
aacccaggaggcggaggttgca

SEQ ID NO: 703698 - DNA, 22 bp, Artificial Sequence
  chemically synthesized
gaacccaggaggcggaggttgc

SEQ ID NO: 703699 - DNA, 22 bp, Artificial Sequence
  chemically synthesized
cttgaacccaggaggcggaggt

SEQ ID NO: 703700 - DNA, 22 bp, Artificial Sequence
  chemically synthesized
ggctcactgcaacctccgcctc

SEQ ID NO: 703701 - DNA, 22 bp, Artificial Sequence
  chemically synthesized
actgcaacctccgcctcctggg

SEQ ID NO: 703702 - DNA, 22 bp, Artificial Sequence
  chemically synthesized
caacctccgcctcctgggttca

SEQ ID NO: 703703 - DNA, 22 bp, Artificial Sequence
  chemically synthesized
aggcaggagaattgcttgaacc

SEQ ID NO: 703704 - DNA, 22 bp, Artificial Sequence
  chemically synthesized
cgcctcctgggttcaagcaatt

SEQ ID NO: 703705 - DNA, 22 bp, Artificial Sequence
  chemically synthesized
ggaggctgaggcaggagaattg

SEQ ID NO: 703706 - DNA, 22 bp, Artificial Sequence
  chemically synthesized
ctgggttcaagcaattctcctg

SEQ ID NO: 703707 - DNA, 22 bp, Artificial Sequence
  chemically synthesized
gggaggctgaggcaggagaatt

SEQ ID NO: 703708 - DNA, 22 bp, Artificial Sequence
  chemically synthesized
ggttcaagcaattctcctgcct

SEQ ID NO: 703709 - DNA, 22 bp, Artificial Sequence
  chemically synthesized
cttgggaggctgaggcaggaga

SEQ ID NO: 703710 - DNA, 22 bp, Artificial Sequence
  chemically synthesized
aagcaattctcctgcctcagcc

SEQ ID NO: 703711 - DNA, 22 bp, Artificial Sequence
  chemically synthesized
taatcccagctacttgggaggc

SEQ ID NO: 703712 - DNA, 22 bp, Artificial Sequence
  chemically synthesized
tcctgcctcagcctcccaagta

SEQ ID NO: 703713 - DNA, 22 bp, Artificial Sequence
  chemically synthesized
ctgcctcagcctcccaagtagc

SEQ ID NO: 703714 - DNA, 22 bp, Artificial Sequence
  chemically synthesized
cctcagcctcccaagtagctgg

SEQ ID NO: 703715 - DNA, 22 bp, Artificial Sequence
  chemically synthesized
agcctcccaagtagctgggatt

SEQ ID NO: 703716 - DNA, 22 bp, Artificial Sequence
  chemically synthesized
ccaagtagctgggattacaggt

SEQ ID NO: 703717 - DNA, 22 bp, Artificial Sequence
  chemically synthesized
ggcatggtgacaggcacctgta

SEQ ID NO: 703718 - DNA, 22 bp, Artificial Sequence
  chemically synthesized
gctgggcatggtgacaggcacc

SEQ ID NO: 703719 - DNA, 22 bp, Artificial Sequence
  chemically synthesized
ggattacaggtgcctgtcacca

SEQ ID NO: 703720 - DNA, 22 bp, Artificial Sequence
  chemically synthesized
caggtgcctgtcaccatgccca

SEQ ID NO: 703721 - DNA, 22 bp, Artificial Sequence
  chemically synthesized
aaaaatacaaaagttagctggg

SEQ ID NO: 703722 - DNA, 22 bp, Artificial Sequence
  chemically synthesized
ctgaaaaatacaaaagttagct

SEQ ID NO: 703723 - DNA, 22 bp, Artificial Sequence
  chemically synthesized
tcaccatgcccagctaactttt

SEQ ID NO: 703724 - DNA, 22 bp, Artificial Sequence
  chemically synthesized
tactgaaaaatacaaaagttag

SEQ ID NO: 703725 - DNA, 22 bp, Artificial Sequence
  chemically synthesized
acttttgtatttttcagtagag

SEQ ID NO: 703726 - DNA, 22 bp, Artificial Sequence
  chemically synthesized
ttgtatttttcagtagagacgg

SEQ ID NO: 703727 - DNA, 22 bp, Artificial Sequence
  chemically synthesized
tgtatttttcagtagagacggg

SEQ ID NO: 703728 - DNA, 22 bp, Artificial Sequence
  chemically synthesized
gtatttttcagtagagacgggg

SEQ ID NO: 703729 - DNA, 22 bp, Artificial Sequence
  chemically synthesized
tatttttcagtagagacggggt

SEQ ID NO: 703730 - DNA, 22 bp, Artificial Sequence
  chemically synthesized
accaacatggtgaaaccccgtc

SEQ ID NO: 703731 - DNA, 22 bp, Artificial Sequence
  chemically synthesized
ttcagtagagacggggtttcac

SEQ ID NO: 703732 - DNA, 22 bp, Artificial Sequence
  chemically synthesized
tcagtagagacggggtttcacc

SEQ ID NO: 703733 - DNA, 22 bp, Artificial Sequence
  chemically synthesized
cagtagagacggggtttcacca

SEQ ID NO: 703734 - DNA, 22 bp, Artificial Sequence
  chemically synthesized
agtagagacggggtttcaccat

SEQ ID NO: 703735 - DNA, 22 bp, Artificial Sequence
  chemically synthesized
aagaccagcctgaccaacatgg

SEQ ID NO: 703736 - DNA, 22 bp, Artificial Sequence
  chemically synthesized
caccatgttggtcaggctggtc

SEQ ID NO: 703737 - DNA, 22 bp, Artificial Sequence
  chemically synthesized
accatgttggtcaggctggtct

SEQ ID NO: 703738 - DNA, 22 bp, Artificial Sequence
  chemically synthesized
aggtcaggagttcaagaccagc

SEQ ID NO: 703739 - DNA, 22 bp, Artificial Sequence
  chemically synthesized
gtcaggctggtcttgaactcct

SEQ ID NO: 703740 - DNA, 22 bp, Artificial Sequence
  chemically synthesized
gtcttgaactcctgacctcagg

SEQ ID NO: 703741 - DNA, 22 bp, Artificial Sequence
  chemically synthesized
gaactcctgacctcaggtgatc

SEQ ID NO: 703742 - DNA, 22 bp, Artificial Sequence
  chemically synthesized
aactcctgacctcaggtgatcc

SEQ ID NO: 703743 - DNA, 22 bp, Artificial Sequence
  chemically synthesized
ggaggccaaggtgggtggatca

SEQ ID NO: 703744 - DNA, 22 bp, Artificial Sequence
  chemically synthesized
ctgacctcaggtgatccaccca

SEQ ID NO: 703745 - DNA, 22 bp, Artificial Sequence
  chemically synthesized
gggaggccaaggtgggtggatc

SEQ ID NO: 703746 - DNA, 22 bp, Artificial Sequence
  chemically synthesized
tgggaggccaaggtgggtggat

SEQ ID NO: 703747 - DNA, 22 bp, Artificial Sequence
  chemically synthesized
acctcaggtgatccacccacct

SEQ ID NO: 703748 - DNA, 22 bp, Artificial Sequence
  chemically synthesized
aggtgatccacccaccttggcc

SEQ ID NO: 703749 - DNA, 22 bp, Artificial Sequence
  chemically synthesized
tgatcccagcactttgggaggc

SEQ ID NO: 703750 - DNA, 22 bp, Artificial Sequence
  chemically synthesized
acgcctgtgatcccagcacttt

SEQ ID NO: 703751 - DNA, 22 bp, Artificial Sequence
  chemically synthesized
ggcctcccaaagtgctgggatc

SEQ ID NO: 703752 - DNA, 22 bp, Artificial Sequence
  chemically synthesized
gcctcccaaagtgctgggatca

SEQ ID NO: 703753 - DNA, 22 bp, Artificial Sequence
  chemically synthesized
ccaaagtgctgggatcacaggc

SEQ ID NO: 703754 - DNA, 22 bp, Artificial Sequence
  chemically synthesized
gggccgggcgcggtggctcacg

SEQ ID NO: 703755 - DNA, 22 bp, Artificial Sequence
  chemically synthesized
ggatcacaggcgtgagccaccg

SEQ ID NO: 703756 - DNA, 22 bp, Artificial Sequence
  chemically synthesized
ataagatgaatatctcgggccg

SEQ ID NO: 703757 - DNA, 22 bp, Artificial Sequence
  chemically synthesized
tgataagatgaatatctcgggc

SEQ ID NO: 703758 - DNA, 22 bp, Artificial Sequence
  chemically synthesized
gccattctgataagatgaatat

SEQ ID NO: 703759 - DNA, 22 bp, Artificial Sequence
  chemically synthesized
agccattctgataagatgaata

SEQ ID NO: 703760 - DNA, 22 bp, Artificial Sequence
  chemically synthesized
cttagccattctgataagatga

SEQ ID NO: 703761 - DNA, 22 bp, Artificial Sequence
  chemically synthesized
tacttagccattctgataagat

SEQ ID NO: 703762 - DNA, 22 bp, Artificial Sequence
  chemically synthesized
ctacttagccattctgataaga

SEQ ID NO: 703763 - DNA, 22 bp, Artificial Sequence
  chemically synthesized
ccttctacttagccattctgat

SEQ ID NO: 703764 - DNA, 22 bp, Artificial Sequence
  chemically synthesized
tcccttctacttagccattctg

SEQ ID NO: 703765 - DNA, 22 bp, Artificial Sequence
  chemically synthesized
ctcccttctacttagccattct

SEQ ID NO: 703766 - DNA, 22 bp, Artificial Sequence
  chemically synthesized
atcttatcagaatggctaagta

SEQ ID NO: 703767 - DNA, 22 bp, Artificial Sequence
  chemically synthesized
atcagaatggctaagtagaagg

SEQ ID NO: 703768 - DNA, 22 bp, Artificial Sequence
  chemically synthesized
tcagaatggctaagtagaaggg

SEQ ID NO: 703769 - DNA, 22 bp, Artificial Sequence
  chemically synthesized
agtgatgaaaaatcagtttctc

SEQ ID NO: 703770 - DNA, 22 bp, Artificial Sequence
  chemically synthesized
agtagaagggagaaactgattt

SEQ ID NO: 703771 - DNA, 22 bp, Artificial Sequence
  chemically synthesized
atttttcatcactgaatgcatc

SEQ ID NO: 703772 - DNA, 22 bp, Artificial Sequence
  chemically synthesized
gcaagagtcacaagatgcattc

SEQ ID NO: 703773 - DNA, 22 bp, Artificial Sequence
  chemically synthesized
ttcatcactgaatgcatcttgt

SEQ ID NO: 703774 - DNA, 22 bp, Artificial Sequence
  chemically synthesized
tcatcactgaatgcatcttgtg

SEQ ID NO: 703775 - DNA, 22 bp, Artificial Sequence
  chemically synthesized
catcactgaatgcatcttgtga

SEQ ID NO: 703776 - DNA, 22 bp, Artificial Sequence
  chemically synthesized
acctagcaagagtcacaagatg

SEQ ID NO: 703777 - DNA, 22 bp, Artificial Sequence
  chemically synthesized
atcactgaatgcatcttgtgac

SEQ ID NO: 703778 - DNA, 22 bp, Artificial Sequence
  chemically synthesized
atctcacctagcaagagtcaca

SEQ ID NO: 703779 - DNA, 22 bp, Artificial Sequence
  chemically synthesized
aatgcatcttgtgactcttgct

SEQ ID NO: 703780 - DNA, 22 bp, Artificial Sequence
  chemically synthesized
gtccctgatctcacctagcaag

SEQ ID NO: 703781 - DNA, 22 bp, Artificial Sequence
  chemically synthesized
ggtccctgatctcacctagcaa

SEQ ID NO: 703782 - DNA, 22 bp, Artificial Sequence
  chemically synthesized
cttggtccctgatctcacctag

SEQ ID NO: 703783 - DNA, 22 bp, Artificial Sequence
  chemically synthesized
gtgactcttgctaggtgagatc

SEQ ID NO: 703784 - DNA, 22 bp, Artificial Sequence
  chemically synthesized
tgactcttgctaggtgagatca

SEQ ID NO: 703785 - DNA, 22 bp, Artificial Sequence
  chemically synthesized
taattgcttggtccctgatctc

SEQ ID NO: 703786 - DNA, 22 bp, Artificial Sequence
  chemically synthesized
ataattgcttggtccctgatct

SEQ ID NO: 703787 - DNA, 22 bp, Artificial Sequence
  chemically synthesized
ttgctaggtgagatcagggacc

SEQ ID NO: 703788 - DNA, 22 bp, Artificial Sequence
  chemically synthesized
gctaggtgagatcagggaccaa

SEQ ID NO: 703789 - DNA, 22 bp, Artificial Sequence
  chemically synthesized
ctaggtgagatcagggaccaag

SEQ ID NO: 703790 - DNA, 22 bp, Artificial Sequence
  chemically synthesized
ggtgagatcagggaccaagcaa

SEQ ID NO: 703791 - DNA, 22 bp, Artificial Sequence
  chemically synthesized
gcaaagaatgtttataattgct

SEQ ID NO: 703792 - DNA, 22 bp, Artificial Sequence
  chemically synthesized
agcaaagaatgtttataattgc

SEQ ID NO: 703793 - DNA, 22 bp, Artificial Sequence
  chemically synthesized
ataggaacttagcaaagaatgt

SEQ ID NO: 703794 - DNA, 22 bp, Artificial Sequence
  chemically synthesized
gataggaacttagcaaagaatg

SEQ ID NO: 703795 - DNA, 22 bp, Artificial Sequence
  chemically synthesized
tgataggaacttagcaaagaat

SEQ ID NO: 703796 - DNA, 22 bp, Artificial Sequence
  chemically synthesized
ttgataggaacttagcaaagaa

SEQ ID NO: 703797 - DNA, 22 bp, Artificial Sequence
  chemically synthesized
cttttgataggaacttagcaaa

SEQ ID NO: 703798 - DNA, 22 bp, Artificial Sequence
  chemically synthesized
taaacattctttgctaagttcc

SEQ ID NO: 703799 - DNA, 22 bp, Artificial Sequence
  chemically synthesized
tttgctaagttcctatcaaaag

SEQ ID NO: 703800 - DNA, 22 bp, Artificial Sequence
  chemically synthesized
tgctaagttcctatcaaaagga

SEQ ID NO: 703801 - DNA, 22 bp, Artificial Sequence
  chemically synthesized
gctaagttcctatcaaaaggaa

SEQ ID NO: 703802 - DNA, 22 bp, Artificial Sequence
  chemically synthesized
ctaagttcctatcaaaaggaat

SEQ ID NO: 703803 - DNA, 22 bp, Artificial Sequence
  chemically synthesized
agttcctatcaaaaggaatacc

SEQ ID NO: 703804 - DNA, 22 bp, Artificial Sequence
  chemically synthesized
ctatcaaaaggaataccctcta

SEQ ID NO: 703805 - DNA, 22 bp, Artificial Sequence
  chemically synthesized
tcaaaaggaataccctctactt

SEQ ID NO: 703806 - DNA, 22 bp, Artificial Sequence
  chemically synthesized
catgcaaatccaaagtagaggg

SEQ ID NO: 703807 - DNA, 22 bp, Artificial Sequence
  chemically synthesized
aggctacatgcaaatccaaagt

SEQ ID NO: 703808 - DNA, 22 bp, Artificial Sequence
  chemically synthesized
tccctgaggctacatgcaaatc

SEQ ID NO: 703809 - DNA, 22 bp, Artificial Sequence
  chemically synthesized
tactttggatttgcatgtagcc

SEQ ID NO: 703810 - DNA, 22 bp, Artificial Sequence
  chemically synthesized
ctttggatttgcatgtagcctc

SEQ ID NO: 703811 - DNA, 22 bp, Artificial Sequence
  chemically synthesized
tggatttgcatgtagcctcagg

SEQ ID NO: 703812 - DNA, 22 bp, Artificial Sequence
  chemically synthesized
acgcatattgtccctgaggcta

SEQ ID NO: 703813 - DNA, 22 bp, Artificial Sequence
  chemically synthesized
ggatttgcatgtagcctcaggg

SEQ ID NO: 703814 - DNA, 22 bp, Artificial Sequence
  chemically synthesized
gatttgcatgtagcctcaggga

SEQ ID NO: 703815 - DNA, 22 bp, Artificial Sequence
  chemically synthesized
gcatgtagcctcagggacaata

SEQ ID NO: 703816 - DNA, 22 bp, Artificial Sequence
  chemically synthesized
agtattaacgcatattgtccct

SEQ ID NO: 703817 - DNA, 22 bp, Artificial Sequence
  chemically synthesized
catgtagcctcagggacaatat

SEQ ID NO: 703818 - DNA, 22 bp, Artificial Sequence
  chemically synthesized
gttgagtattaacgcatattgt

SEQ ID NO: 703819 - DNA, 22 bp, Artificial Sequence
  chemically synthesized
tctagttgagtattaacgcata

SEQ ID NO: 703820 - DNA, 22 bp, Artificial Sequence
  chemically synthesized
tatctagttgagtattaacgca

SEQ ID NO: 703821 - DNA, 22 bp, Artificial Sequence
  chemically synthesized
agggacaatatgcgttaatact

SEQ ID NO: 703822 - DNA, 22 bp, Artificial Sequence
  chemically synthesized
atactcaactagatagaacatc

SEQ ID NO: 703823 - DNA, 22 bp, Artificial Sequence
  chemically synthesized
cacagtgagagaaaggagatgt

SEQ ID NO: 703824 - DNA, 22 bp, Artificial Sequence
  chemically synthesized
aactagatagaacatctccttt

SEQ ID NO: 703825 - DNA, 22 bp, Artificial Sequence
  chemically synthesized
gatagaacatctcctttctctc

SEQ ID NO: 703826 - DNA, 22 bp, Artificial Sequence
  chemically synthesized
ctttctctcactgtggaatgga

SEQ ID NO: 703827 - DNA, 22 bp, Artificial Sequence
  chemically synthesized
tctctcactgtggaatggattc

SEQ ID NO: 703828 - DNA, 22 bp, Artificial Sequence
  chemically synthesized
ctctcactgtggaatggattcc

SEQ ID NO: 703829 - DNA, 22 bp, Artificial Sequence
  chemically synthesized
tctcactgtggaatggattcct

SEQ ID NO: 703830 - DNA, 22 bp, Artificial Sequence
  chemically synthesized
tcactgtggaatggattcctcc

SEQ ID NO: 703831 - DNA, 22 bp, Artificial Sequence
  chemically synthesized
actgtggaatggattcctccct

SEQ ID NO: 703832 - DNA, 22 bp, Artificial Sequence
  chemically synthesized
tggaatggattcctcccttcca

SEQ ID NO: 703833 - DNA, 22 bp, Artificial Sequence
  chemically synthesized
ctcccttccattctactcccat

SEQ ID NO: 703834 - DNA, 22 bp, Artificial Sequence
  chemically synthesized
ccttccattctactcccattgc

SEQ ID NO: 703835 - DNA, 22 bp, Artificial Sequence
  chemically synthesized
ccattctactcccattgcaccc

SEQ ID NO: 703836 - DNA, 22 bp, Artificial Sequence
  chemically synthesized
cattctactcccattgcaccca

SEQ ID NO: 703837 - DNA, 22 bp, Artificial Sequence
  chemically synthesized
cagtggtagtaaatagtgggtg

SEQ ID NO: 703838 - DNA, 22 bp, Artificial Sequence
  chemically synthesized
tactcccattgcacccactatt

SEQ ID NO: 703839 - DNA, 22 bp, Artificial Sequence
  chemically synthesized
ctcccattgcacccactattta

SEQ ID NO: 703840 - DNA, 22 bp, Artificial Sequence
  chemically synthesized
ctacagtggtagtaaatagtgg

SEQ ID NO: 703841 - DNA, 22 bp, Artificial Sequence
  chemically synthesized
ccattgcacccactatttacta

SEQ ID NO: 703842 - DNA, 22 bp, Artificial Sequence
  chemically synthesized
cacccactatttactaccactg

SEQ ID NO: 703843 - DNA, 22 bp, Artificial Sequence
  chemically synthesized
taaaaaatgacctcctacagtg

SEQ ID NO: 703844 - DNA, 22 bp, Artificial Sequence
  chemically synthesized
tttactaccactgtaggaggtc

SEQ ID NO: 703845 - DNA, 22 bp, Artificial Sequence
  chemically synthesized
actaccactgtaggaggtcatt

SEQ ID NO: 703846 - DNA, 22 bp, Artificial Sequence
  chemically synthesized
ctaccactgtaggaggtcattt

SEQ ID NO: 703847 - DNA, 22 bp, Artificial Sequence
  chemically synthesized
ccactgtaggaggtcatttttt

SEQ ID NO: 703848 - DNA, 22 bp, Artificial Sequence
  chemically synthesized
taggaggtcattttttataggt

SEQ ID NO: 703849 - DNA, 22 bp, Artificial Sequence
  chemically synthesized
aataccaatcacaaaagacaga

SEQ ID NO: 703850 - DNA, 22 bp, Artificial Sequence
  chemically synthesized
aaataccaatcacaaaagacag

SEQ ID NO: 703851 - DNA, 22 bp, Artificial Sequence
  chemically synthesized
tttataggtctgtcttttgtga

SEQ ID NO: 703852 - DNA, 22 bp, Artificial Sequence
  chemically synthesized
ttataggtctgtcttttgtgat

SEQ ID NO: 703853 - DNA, 22 bp, Artificial Sequence
  chemically synthesized
tataggtctgtcttttgtgatt

SEQ ID NO: 703854 - DNA, 22 bp, Artificial Sequence
  chemically synthesized
ataggtctgtcttttgtgattg

SEQ ID NO: 703855 - DNA, 22 bp, Artificial Sequence
  chemically synthesized
taggtctgtcttttgtgattgg

SEQ ID NO: 703856 - DNA, 22 bp, Artificial Sequence
  chemically synthesized
ggacatttaaataccaatcaca

SEQ ID NO: 703857 - DNA, 22 bp, Artificial Sequence
  chemically synthesized
gggacatttaaataccaatcac

SEQ ID NO: 703858 - DNA, 22 bp, Artificial Sequence
  chemically synthesized
ccttgggacatttaaataccaa

SEQ ID NO: 703859 - DNA, 22 bp, Artificial Sequence
  chemically synthesized
tcttttgtgattggtatttaaa

SEQ ID NO: 703860 - DNA, 22 bp, Artificial Sequence
  chemically synthesized
ttgccttgggacatttaaatac

SEQ ID NO: 703861 - DNA, 22 bp, Artificial Sequence
  chemically synthesized
ttgtgattggtatttaaatgtc

SEQ ID NO: 703862 - DNA, 22 bp, Artificial Sequence
  chemically synthesized
tgtgattggtatttaaatgtcc

SEQ ID NO: 703863 - DNA, 22 bp, Artificial Sequence
  chemically synthesized
gtgattggtatttaaatgtccc

SEQ ID NO: 703864 - DNA, 22 bp, Artificial Sequence
  chemically synthesized
tgattggtatttaaatgtccca

SEQ ID NO: 703865 - DNA, 22 bp, Artificial Sequence
  chemically synthesized
gtatttaaatgtcccaaggcaa

SEQ ID NO: 703866 - DNA, 22 bp, Artificial Sequence
  chemically synthesized
aaatgtcccaaggcaataattc

SEQ ID NO: 703867 - DNA, 22 bp, Artificial Sequence
  chemically synthesized
aatgtcccaaggcaataattct

SEQ ID NO: 703868 - DNA, 22 bp, Artificial Sequence
  chemically synthesized
aaatatgaagataaaaagagaa

SEQ ID NO: 703869 - DNA, 22 bp, Artificial Sequence
  chemically synthesized
tctttttatcttcatatttcag

SEQ ID NO: 703870 - DNA, 22 bp, Artificial Sequence
  chemically synthesized
tttttatcttcatatttcaggt

SEQ ID NO: 703871 - DNA, 22 bp, Artificial Sequence
  chemically synthesized
acaaaaacgagtcacctgaaat

SEQ ID NO: 703872 - DNA, 22 bp, Artificial Sequence
  chemically synthesized
tttatcttcatatttcaggtga

SEQ ID NO: 703873 - DNA, 22 bp, Artificial Sequence
  chemically synthesized
ttatcttcatatttcaggtgac

SEQ ID NO: 703874 - DNA, 22 bp, Artificial Sequence
  chemically synthesized
tatcttcatatttcaggtgact

SEQ ID NO: 703875 - DNA, 22 bp, Artificial Sequence
  chemically synthesized
ttaacaaaaacgagtcacctga

SEQ ID NO: 703876 - DNA, 22 bp, Artificial Sequence
  chemically synthesized
atcttcatatttcaggtgactc

SEQ ID NO: 703877 - DNA, 22 bp, Artificial Sequence
  chemically synthesized
attaacaaaaacgagtcacctg

SEQ ID NO: 703878 - DNA, 22 bp, Artificial Sequence
  chemically synthesized
tcttcatatttcaggtgactcg

SEQ ID NO: 703879 - DNA, 22 bp, Artificial Sequence
  chemically synthesized
catatttcaggtgactcgtttt

SEQ ID NO: 703880 - DNA, 22 bp, Artificial Sequence
  chemically synthesized
tatttattaacaaaaacgagtc

SEQ ID NO: 703881 - DNA, 22 bp, Artificial Sequence
  chemically synthesized
atatttcaggtgactcgttttt

SEQ ID NO: 703882 - DNA, 22 bp, Artificial Sequence
  chemically synthesized
ctatatttattaacaaaaacga

SEQ ID NO: 703883 - DNA, 22 bp, Artificial Sequence
  chemically synthesized
caggtgactcgtttttgttaat

SEQ ID NO: 703884 - DNA, 22 bp, Artificial Sequence
  chemically synthesized
attcctatatttattaacaaaa

SEQ ID NO: 703885 - DNA, 22 bp, Artificial Sequence
  chemically synthesized
aggtgactcgtttttgttaata

SEQ ID NO: 703886 - DNA, 22 bp, Artificial Sequence
  chemically synthesized
attcattcctatatttattaac

SEQ ID NO: 703887 - DNA, 22 bp, Artificial Sequence
  chemically synthesized
attcattcattcctatatttat

SEQ ID NO: 703888 - DNA, 22 bp, Artificial Sequence
  chemically synthesized
gtttttgttaataaatatagga

SEQ ID NO: 703889 - DNA, 22 bp, Artificial Sequence
  chemically synthesized
ttgttaataaatataggaatga

SEQ ID NO: 703890 - DNA, 22 bp, Artificial Sequence
  chemically synthesized
tgttaataaatataggaatgaa

SEQ ID NO: 703891 - DNA, 22 bp, Artificial Sequence
  chemically synthesized
gttaataaatataggaatgaat

SEQ ID NO: 703892 - DNA, 22 bp, Artificial Sequence
  chemically synthesized
tagtattcattcattcattcct

SEQ ID NO: 703893 - DNA, 22 bp, Artificial Sequence
  chemically synthesized
ttaataaatataggaatgaatg

SEQ ID NO: 703894 - DNA, 22 bp, Artificial Sequence
  chemically synthesized
ataaatataggaatgaatgaat

SEQ ID NO: 703895 - DNA, 22 bp, Artificial Sequence
  chemically synthesized
tgcctgtagtattcattcattc

SEQ ID NO: 703896 - DNA, 22 bp, Artificial Sequence
  chemically synthesized
ctgtgcctgtagtattcattca

SEQ ID NO: 703897 - DNA, 22 bp, Artificial Sequence
  chemically synthesized
actgtgcctgtagtattcattc

SEQ ID NO: 703898 - DNA, 22 bp, Artificial Sequence
  chemically synthesized
cttactgtgcctgtagtattca

SEQ ID NO: 703899 - DNA, 22 bp, Artificial Sequence
  chemically synthesized
ttacttactgtgcctgtagtat

SEQ ID NO: 703900 - DNA, 22 bp, Artificial Sequence
  chemically synthesized
tagcattgttacttactgtgcc

SEQ ID NO: 703901 - DNA, 22 bp, Artificial Sequence
  chemically synthesized
caggcacagtaagtaacaatgc

SEQ ID NO: 703902 - DNA, 22 bp, Artificial Sequence
  chemically synthesized
agaagtgacatggtgcctgtag

SEQ ID NO: 703903 - DNA, 22 bp, Artificial Sequence
  chemically synthesized
agctaagaagtgacatggtgcc

SEQ ID NO: 703904 - DNA, 22 bp, Artificial Sequence
  chemically synthesized
tgagctaagaagtgacatggtg

SEQ ID NO: 703905 - DNA, 22 bp, Artificial Sequence
  chemically synthesized
caggcaccatgtcacttcttag

SEQ ID NO: 703906 - DNA, 22 bp, Artificial Sequence
  chemically synthesized
tgagaagggaagtcatagaatt

SEQ ID NO: 703907 - DNA, 22 bp, Artificial Sequence
  chemically synthesized
gtgagaagggaagtcatagaat

SEQ ID NO: 703908 - DNA, 22 bp, Artificial Sequence
  chemically synthesized
cttagctcagaattctatgact

SEQ ID NO: 703909 - DNA, 22 bp, Artificial Sequence
  chemically synthesized
tgtgagaagggaagtcatagaa

SEQ ID NO: 703910 - DNA, 22 bp, Artificial Sequence
  chemically synthesized
ttagctcagaattctatgactt

SEQ ID NO: 703911 - DNA, 22 bp, Artificial Sequence
  chemically synthesized
agctcagaattctatgacttcc

SEQ ID NO: 703912 - DNA, 22 bp, Artificial Sequence
  chemically synthesized
gctcagaattctatgacttccc

SEQ ID NO: 703913 - DNA, 22 bp, Artificial Sequence
  chemically synthesized
agaattctatgacttcccttct

SEQ ID NO: 703914 - DNA, 22 bp, Artificial Sequence
  chemically synthesized
gcatatatgctttgtgagaagg

SEQ ID NO: 703915 - DNA, 22 bp, Artificial Sequence
  chemically synthesized
ggcatatatgctttgtgagaag

SEQ ID NO: 703916 - DNA, 22 bp, Artificial Sequence
  chemically synthesized
tggcatatatgctttgtgagaa

SEQ ID NO: 703917 - DNA, 22 bp, Artificial Sequence
  chemically synthesized
tatgacttcccttctcacaaag

SEQ ID NO: 703918 - DNA, 22 bp, Artificial Sequence
  chemically synthesized
tgacttcccttctcacaaagca

SEQ ID NO: 703919 - DNA, 22 bp, Artificial Sequence
  chemically synthesized
aaagcctttggcatatatgctt

SEQ ID NO: 703920 - DNA, 22 bp, Artificial Sequence
  chemically synthesized
cccttctcacaaagcatatatg

SEQ ID NO: 703921 - DNA, 22 bp, Artificial Sequence
  chemically synthesized
ccttctcacaaagcatatatgc

SEQ ID NO: 703922 - DNA, 22 bp, Artificial Sequence
  chemically synthesized
ctcacaaagcatatatgccaaa

SEQ ID NO: 703923 - DNA, 22 bp, Artificial Sequence
  chemically synthesized
tcgttaaaagcctttggcatat

SEQ ID NO: 703924 - DNA, 22 bp, Artificial Sequence
  chemically synthesized
tcacaaagcatatatgccaaag

SEQ ID NO: 703925 - DNA, 22 bp, Artificial Sequence
  chemically synthesized
acaaagcatatatgccaaaggc

SEQ ID NO: 703926 - DNA, 22 bp, Artificial Sequence
  chemically synthesized
gctatcgttaaaagcctttggc

SEQ ID NO: 703927 - DNA, 22 bp, Artificial Sequence
  chemically synthesized
tggttggctatcgttaaaagcc

SEQ ID NO: 703928 - DNA, 22 bp, Artificial Sequence
  chemically synthesized
tcaactatggttggctatcgtt

SEQ ID NO: 703929 - DNA, 22 bp, Artificial Sequence
  chemically synthesized
atcaactatggttggctatcgt

SEQ ID NO: 703930 - DNA, 22 bp, Artificial Sequence
  chemically synthesized
ttaacgatagccaaccatagtt

SEQ ID NO: 703931 - DNA, 22 bp, Artificial Sequence
  chemically synthesized
taacgatagccaaccatagttg

SEQ ID NO: 703932 - DNA, 22 bp, Artificial Sequence
  chemically synthesized
aacgatagccaaccatagttga

SEQ ID NO: 703933 - DNA, 22 bp, Artificial Sequence
  chemically synthesized
acgatagccaaccatagttgat

SEQ ID NO: 703934 - DNA, 22 bp, Artificial Sequence
  chemically synthesized
ataagacccttcctcgtctggc

SEQ ID NO: 703935 - DNA, 22 bp, Artificial Sequence
  chemically synthesized
cctcgtctggcccttggtcact

SEQ ID NO: 703936 - DNA, 22 bp, Artificial Sequence
  chemically synthesized
ctcgtctggcccttggtcactc

SEQ ID NO: 703937 - DNA, 22 bp, Artificial Sequence
  chemically synthesized
gtctggcccttggtcactcact

SEQ ID NO: 703938 - DNA, 22 bp, Artificial Sequence
  chemically synthesized
gcccttggtcactcactgacct

SEQ ID NO: 703939 - DNA, 22 bp, Artificial Sequence
  chemically synthesized
ggtcactcactgacctcctatc

SEQ ID NO: 703940 - DNA, 22 bp, Artificial Sequence
  chemically synthesized
gtcactcactgacctcctatca

SEQ ID NO: 703941 - DNA, 22 bp, Artificial Sequence
  chemically synthesized
actgacctcctatcattcacca

SEQ ID NO: 703942 - DNA, 22 bp, Artificial Sequence
  chemically synthesized
acctcctatcattcaccatctt

SEQ ID NO: 703943 - DNA, 22 bp, Artificial Sequence
  chemically synthesized
aagccaaggaagaaagatggtg

SEQ ID NO: 703944 - DNA, 22 bp, Artificial Sequence
  chemically synthesized
ctatcattcaccatctttcttc

SEQ ID NO: 703945 - DNA, 22 bp, Artificial Sequence
  chemically synthesized
tcattcaccatctttcttcctt

SEQ ID NO: 703946 - DNA, 22 bp, Artificial Sequence
  chemically synthesized
accatctttcttccttggcttc

SEQ ID NO: 703947 - DNA, 22 bp, Artificial Sequence
  chemically synthesized
tcttccttggcttcagtcatac

SEQ ID NO: 703948 - DNA, 22 bp, Artificial Sequence
  chemically synthesized
cttccttggcttcagtcatact

SEQ ID NO: 703949 - DNA, 22 bp, Artificial Sequence
  chemically synthesized
ttccttggcttcagtcatactg

SEQ ID NO: 703950 - DNA, 22 bp, Artificial Sequence
  chemically synthesized
atagcaaggaagccagtatgac

SEQ ID NO: 703951 - DNA, 22 bp, Artificial Sequence
  chemically synthesized
ccttggcttcagtcatactggc

SEQ ID NO: 703952 - DNA, 22 bp, Artificial Sequence
  chemically synthesized
cttggcttcagtcatactggct

SEQ ID NO: 703953 - DNA, 22 bp, Artificial Sequence
  chemically synthesized
ggcttcagtcatactggcttcc

SEQ ID NO: 703954 - DNA, 22 bp, Artificial Sequence
  chemically synthesized
gcttcagtcatactggcttcct

SEQ ID NO: 703955 - DNA, 22 bp, Artificial Sequence
  chemically synthesized
cagtcatactggcttccttgct

SEQ ID NO: 703956 - DNA, 22 bp, Artificial Sequence
  chemically synthesized
agaaatattaatagcaaggaag

SEQ ID NO: 703957 - DNA, 22 bp, Artificial Sequence
  chemically synthesized
agtcatactggcttccttgcta

SEQ ID NO: 703958 - DNA, 22 bp, Artificial Sequence
  chemically synthesized
gagaaatattaatagcaaggaa

SEQ ID NO: 703959 - DNA, 22 bp, Artificial Sequence
  chemically synthesized
gagggtttgagaaatattaata

SEQ ID NO: 703960 - DNA, 22 bp, Artificial Sequence
  chemically synthesized
agagggtttgagaaatattaat

SEQ ID NO: 703961 - DNA, 22 bp, Artificial Sequence
  chemically synthesized
gcttccttgctattaatatttc

SEQ ID NO: 703962 - DNA, 22 bp, Artificial Sequence
  chemically synthesized
ccttgctattaatatttctcaa

SEQ ID NO: 703963 - DNA, 22 bp, Artificial Sequence
  chemically synthesized
cttgctattaatatttctcaaa

SEQ ID NO: 703964 - DNA, 22 bp, Artificial Sequence
  chemically synthesized
gctattaatatttctcaaaccc

SEQ ID NO: 703965 - DNA, 22 bp, Artificial Sequence
  chemically synthesized
ctattaatatttctcaaaccct

SEQ ID NO: 703966 - DNA, 22 bp, Artificial Sequence
  chemically synthesized
ttaatatttctcaaaccctcta

SEQ ID NO: 703967 - DNA, 22 bp, Artificial Sequence
  chemically synthesized
atatttctcaaaccctctaagc

SEQ ID NO: 703968 - DNA, 22 bp, Artificial Sequence
  chemically synthesized
ctcaaaccctctaagcatgctc

SEQ ID NO: 703969 - DNA, 22 bp, Artificial Sequence
  chemically synthesized
tcaaaccctctaagcatgctcc

SEQ ID NO: 703970 - DNA, 22 bp, Artificial Sequence
  chemically synthesized
aaaccctctaagcatgctccat

SEQ ID NO: 703971 - DNA, 22 bp, Artificial Sequence
  chemically synthesized
taagcatgctccatcttggatc

SEQ ID NO: 703972 - DNA, 22 bp, Artificial Sequence
  chemically synthesized
agcatgctccatcttggatcct

SEQ ID NO: 703973 - DNA, 22 bp, Artificial Sequence
  chemically synthesized
catcttggatcctttactttta

SEQ ID NO: 703974 - DNA, 22 bp, Artificial Sequence
  chemically synthesized
caggtggaggaaacagtaaaag

SEQ ID NO: 703975 - DNA, 22 bp, Artificial Sequence
  chemically synthesized
ggatcctttacttttactgttt

SEQ ID NO: 703976 - DNA, 22 bp, Artificial Sequence
  chemically synthesized
gatcctttacttttactgtttc

SEQ ID NO: 703977 - DNA, 22 bp, Artificial Sequence
  chemically synthesized
tacttttactgtttcctccacc

SEQ ID NO: 703978 - DNA, 22 bp, Artificial Sequence
  chemically synthesized
acttttactgtttcctccacct

SEQ ID NO: 703979 - DNA, 22 bp, Artificial Sequence
  chemically synthesized
cttttactgtttcctccacctg

SEQ ID NO: 703980 - DNA, 22 bp, Artificial Sequence
  chemically synthesized
ttactgtttcctccacctggaa

SEQ ID NO: 703981 - DNA, 22 bp, Artificial Sequence
  chemically synthesized
ggggacaaagtgttccaggtgg

SEQ ID NO: 703982 - DNA, 22 bp, Artificial Sequence
  chemically synthesized
tactgtttcctccacctggaac

SEQ ID NO: 703983 - DNA, 22 bp, Artificial Sequence
  chemically synthesized
actgtttcctccacctggaaca

SEQ ID NO: 703984 - DNA, 22 bp, Artificial Sequence
  chemically synthesized
ctgtttcctccacctggaacac

SEQ ID NO: 703985 - DNA, 22 bp, Artificial Sequence
  chemically synthesized
tttcctccacctggaacacttt

SEQ ID NO: 703986 - DNA, 22 bp, Artificial Sequence
  chemically synthesized
cctccacctggaacactttgtc

SEQ ID NO: 703987 - DNA, 22 bp, Artificial Sequence
  chemically synthesized
ctccacctggaacactttgtcc

SEQ ID NO: 703988 - DNA, 22 bp, Artificial Sequence
  chemically synthesized
cacctggaacactttgtccccc

SEQ ID NO: 703989 - DNA, 22 bp, Artificial Sequence
  chemically synthesized
gaacactttgtcccccaatatc

SEQ ID NO: 703990 - DNA, 22 bp, Artificial Sequence
  chemically synthesized
tgtcccccaatatctgactggt

SEQ ID NO: 703991 - DNA, 22 bp, Artificial Sequence
  chemically synthesized
gtcccccaatatctgactggtg

SEQ ID NO: 703992 - DNA, 22 bp, Artificial Sequence
  chemically synthesized
tcccccaatatctgactggtgt

SEQ ID NO: 703993 - DNA, 22 bp, Artificial Sequence
  chemically synthesized
agtagagatgtgaggaagtaca

SEQ ID NO: 703994 - DNA, 22 bp, Artificial Sequence
  chemically synthesized
cagtagagatgtgaggaagtac

SEQ ID NO: 703995 - DNA, 22 bp, Artificial Sequence
  chemically synthesized
actggtgtacttcctcacatct

SEQ ID NO: 703996 - DNA, 22 bp, Artificial Sequence
  chemically synthesized
gtgtacttcctcacatctctac

SEQ ID NO: 703997 - DNA, 22 bp, Artificial Sequence
  chemically synthesized
cctcacatctctactgaaatgt

SEQ ID NO: 703998 - DNA, 22 bp, Artificial Sequence
  chemically synthesized
ctcacatctctactgaaatgtc

SEQ ID NO: 703999 - DNA, 22 bp, Artificial Sequence
  chemically synthesized
acatctctactgaaatgtcacc

SEQ ID NO: 704000 - DNA, 22 bp, Artificial Sequence
  chemically synthesized
gtggagtggtcaggaatggtga

SEQ ID NO: 704001 - DNA, 22 bp, Artificial Sequence
  chemically synthesized
agtggagtggtcaggaatggtg

SEQ ID NO: 704002 - DNA, 22 bp, Artificial Sequence
  chemically synthesized
tactgaaatgtcaccattcctg

SEQ ID NO: 704003 - DNA, 22 bp, Artificial Sequence
  chemically synthesized
tagtggagtggtcaggaatggt

SEQ ID NO: 704004 - DNA, 22 bp, Artificial Sequence
  chemically synthesized
ttagtggagtggtcaggaatgg

SEQ ID NO: 704005 - DNA, 22 bp, Artificial Sequence
  chemically synthesized
ctgaaatgtcaccattcctgac

SEQ ID NO: 704006 - DNA, 22 bp, Artificial Sequence
  chemically synthesized
aaatgtcaccattcctgaccac

SEQ ID NO: 704007 - DNA, 22 bp, Artificial Sequence
  chemically synthesized
ctgaccactccactaaaagggt

SEQ ID NO: 704008 - DNA, 22 bp, Artificial Sequence
  chemically synthesized
accactccactaaaagggtccc

SEQ ID NO: 704009 - DNA, 22 bp, Artificial Sequence
  chemically synthesized
gaggatgggagaaggggaccct

SEQ ID NO: 704010 - DNA, 22 bp, Artificial Sequence
  chemically synthesized
cactaaaagggtccccttctcc

SEQ ID NO: 704011 - DNA, 22 bp, Artificial Sequence
  chemically synthesized
aaggggctagaggatgggagaa

SEQ ID NO: 704012 - DNA, 22 bp, Artificial Sequence
  chemically synthesized
aaagggtccccttctcccatcc

SEQ ID NO: 704013 - DNA, 22 bp, Artificial Sequence
  chemically synthesized
ctcccatcctctagccccttta

SEQ ID NO: 704014 - DNA, 22 bp, Artificial Sequence
  chemically synthesized
tcccatcctctagcccctttag

SEQ ID NO: 704015 - DNA, 22 bp, Artificial Sequence
  chemically synthesized
ccatcctctagcccctttagcc

SEQ ID NO: 704016 - DNA, 22 bp, Artificial Sequence
  chemically synthesized
aaaacaaagaataaagcaggct

SEQ ID NO: 704017 - DNA, 22 bp, Artificial Sequence
  chemically synthesized
aaaaacaaagaataaagcaggc

SEQ ID NO: 704018 - DNA, 22 bp, Artificial Sequence
  chemically synthesized
tagcccctttagcctgctttat

SEQ ID NO: 704019 - DNA, 22 bp, Artificial Sequence
  chemically synthesized
gcccctttagcctgctttattc

SEQ ID NO: 704020 - DNA, 22 bp, Artificial Sequence
  chemically synthesized
atttaaaaacaaagaataaagc

SEQ ID NO: 704021 - DNA, 22 bp, Artificial Sequence
  chemically synthesized
gatttaaaaacaaagaataaag

SEQ ID NO: 704022 - DNA, 22 bp, Artificial Sequence
  chemically synthesized
tagcctgctttattctttgttt

SEQ ID NO: 704023 - DNA, 22 bp, Artificial Sequence
  chemically synthesized
agcctgctttattctttgtttt

SEQ ID NO: 704024 - DNA, 22 bp, Artificial Sequence
  chemically synthesized
gcctgctttattctttgttttt

SEQ ID NO: 704025 - DNA, 22 bp, Artificial Sequence
  chemically synthesized
ctttattctttgtttttaaatc

SEQ ID NO: 704026 - DNA, 22 bp, Artificial Sequence
  chemically synthesized
tattctttgtttttaaatcaaa

SEQ ID NO: 704027 - DNA, 22 bp, Artificial Sequence
  chemically synthesized
attctttgtttttaaatcaaac

SEQ ID NO: 704028 - DNA, 22 bp, Artificial Sequence
  chemically synthesized
ttctttgtttttaaatcaaact

SEQ ID NO: 704029 - DNA, 22 bp, Artificial Sequence
  chemically synthesized
tttgtttttaaatcaaacttat

SEQ ID NO: 704030 - DNA, 22 bp, Artificial Sequence
  chemically synthesized
tgtttttaaatcaaacttatca

SEQ ID NO: 704031 - DNA, 22 bp, Artificial Sequence
  chemically synthesized
gtttttaaatcaaacttatcat

SEQ ID NO: 704032 - DNA, 22 bp, Artificial Sequence
  chemically synthesized
tttttaaatcaaacttatcatg

SEQ ID NO: 704033 - DNA, 22 bp, Artificial Sequence
  chemically synthesized
ttaaatcaaacttatcatgacc

SEQ ID NO: 704034 - DNA, 22 bp, Artificial Sequence
  chemically synthesized
taaatcaaacttatcatgacct

SEQ ID NO: 704035 - DNA, 22 bp, Artificial Sequence
  chemically synthesized
aaatcaaacttatcatgacctg

SEQ ID NO: 704036 - DNA, 22 bp, Artificial Sequence
  chemically synthesized
aatcaaacttatcatgacctga

SEQ ID NO: 704037 - DNA, 22 bp, Artificial Sequence
  chemically synthesized
acaagagaagatggacaatcag

SEQ ID NO: 704038 - DNA, 22 bp, Artificial Sequence
  chemically synthesized
aacaagagaagatggacaatca

SEQ ID NO: 704039 - DNA, 22 bp, Artificial Sequence
  chemically synthesized
taacaagagaagatggacaatc

SEQ ID NO: 704040 - DNA, 22 bp, Artificial Sequence
  chemically synthesized
atcatgacctgattgtccatct

SEQ ID NO: 704041 - DNA, 22 bp, Artificial Sequence
  chemically synthesized
tcatgacctgattgtccatctt

SEQ ID NO: 704042 - DNA, 22 bp, Artificial Sequence
  chemically synthesized
cattttaacaagagaagatgga

SEQ ID NO: 704043 - DNA, 22 bp, Artificial Sequence
  chemically synthesized
acattttaacaagagaagatgg

SEQ ID NO: 704044 - DNA, 22 bp, Artificial Sequence
  chemically synthesized
attgtccatcttctcttgttaa

SEQ ID NO: 704045 - DNA, 22 bp, Artificial Sequence
  chemically synthesized
tggagcttacattttaacaaga

SEQ ID NO: 704046 - DNA, 22 bp, Artificial Sequence
  chemically synthesized
tccatcttctcttgttaaaatg

SEQ ID NO: 704047 - DNA, 22 bp, Artificial Sequence
  chemically synthesized
ttgtggagcttacattttaaca

SEQ ID NO: 704048 - DNA, 22 bp, Artificial Sequence
  chemically synthesized
attgtggagcttacattttaac

SEQ ID NO: 704049 - DNA, 22 bp, Artificial Sequence
  chemically synthesized
tttattgtggagcttacatttt

SEQ ID NO: 704050 - DNA, 22 bp, Artificial Sequence
  chemically synthesized
atttattgtggagcttacattt

SEQ ID NO: 704051 - DNA, 22 bp, Artificial Sequence
  chemically synthesized
ctcttgttaaaatgtaagctcc

SEQ ID NO: 704052 - DNA, 22 bp, Artificial Sequence
  chemically synthesized
tcttgttaaaatgtaagctcca

SEQ ID NO: 704053 - DNA, 22 bp, Artificial Sequence
  chemically synthesized
ttgttaaaatgtaagctccaca

SEQ ID NO: 704054 - DNA, 22 bp, Artificial Sequence
  chemically synthesized
gttaaaatgtaagctccacaat

SEQ ID NO: 704055 - DNA, 22 bp, Artificial Sequence
  chemically synthesized
ttaaaatgtaagctccacaata

SEQ ID NO: 704056 - DNA, 22 bp, Artificial Sequence
  chemically synthesized
aaatgtaagctccacaataaat

SEQ ID NO: 704057 - DNA, 22 bp, Artificial Sequence
  chemically synthesized
cacaataaataaactttgtttt

SEQ ID NO: 704058 - DNA, 22 bp, Artificial Sequence
  chemically synthesized
gggaaacggcagtaaataaaac

SEQ ID NO: 704059 - DNA, 22 bp, Artificial Sequence
  chemically synthesized
ggaactggggaaacggcagtaa

SEQ ID NO: 704060 - DNA, 22 bp, Artificial Sequence
  chemically synthesized
tgttttatttactgccgtttcc

SEQ ID NO: 704061 - DNA, 22 bp, Artificial Sequence
  chemically synthesized
gttttatttactgccgtttccc

SEQ ID NO: 704062 - DNA, 22 bp, Artificial Sequence
  chemically synthesized
atctaggaactggggaaacggc

SEQ ID NO: 704063 - DNA, 22 bp, Artificial Sequence
  chemically synthesized
ttttatttactgccgtttcccc

SEQ ID NO: 704064 - DNA, 22 bp, Artificial Sequence
  chemically synthesized
tgatctaggaactggggaaacg

SEQ ID NO: 704065 - DNA, 22 bp, Artificial Sequence
  chemically synthesized
tatttactgccgtttccccagt

SEQ ID NO: 704066 - DNA, 22 bp, Artificial Sequence
  chemically synthesized
atttactgccgtttccccagtt

SEQ ID NO: 704067 - DNA, 22 bp, Artificial Sequence
  chemically synthesized
tttactgccgtttccccagttc

SEQ ID NO: 704068 - DNA, 22 bp, Artificial Sequence
  chemically synthesized
actgccgtttccccagttccta

SEQ ID NO: 704069 - DNA, 22 bp, Artificial Sequence
  chemically synthesized
ctgccgtttccccagttcctag

SEQ ID NO: 704070 - DNA, 22 bp, Artificial Sequence
  chemically synthesized
ccgtttccccagttcctagatc

SEQ ID NO: 704071 - DNA, 22 bp, Artificial Sequence
  chemically synthesized
ccccagttcctagatcagagtt

SEQ ID NO: 704072 - DNA, 22 bp, Artificial Sequence
  chemically synthesized
cccagttcctagatcagagttt

SEQ ID NO: 704073 - DNA, 22 bp, Artificial Sequence
  chemically synthesized
aatgaccaatgtaaatcaaact

SEQ ID NO: 704074 - DNA, 22 bp, Artificial Sequence
  chemically synthesized
ctagatcagagtttgatttaca

SEQ ID NO: 704075 - DNA, 22 bp, Artificial Sequence
  chemically synthesized
ttgaatgaccaatgtaaatcaa

SEQ ID NO: 704076 - DNA, 22 bp, Artificial Sequence
  chemically synthesized
gatcagagtttgatttacattg

SEQ ID NO: 704077 - DNA, 22 bp, Artificial Sequence
  chemically synthesized
aacaaatgtctgttgaatgacc

SEQ ID NO: 704078 - DNA, 22 bp, Artificial Sequence
  chemically synthesized
gatttacattggtcattcaaca

SEQ ID NO: 704079 - DNA, 22 bp, Artificial Sequence
  chemically synthesized
atttacattggtcattcaacag

SEQ ID NO: 704080 - DNA, 22 bp, Artificial Sequence
  chemically synthesized
ctcaacaaatgtctgttgaatg

SEQ ID NO: 704081 - DNA, 22 bp, Artificial Sequence
  chemically synthesized
ttactcaacaaatgtctgttga

SEQ ID NO: 704082 - DNA, 22 bp, Artificial Sequence
  chemically synthesized
acattggtcattcaacagacat

SEQ ID NO: 704083 - DNA, 22 bp, Artificial Sequence
  chemically synthesized
gttactcaacaaatgtctgttg

SEQ ID NO: 704084 - DNA, 22 bp, Artificial Sequence
  chemically synthesized
cattggtcattcaacagacatt

SEQ ID NO: 704085 - DNA, 22 bp, Artificial Sequence
  chemically synthesized
tgttactcaacaaatgtctgtt

SEQ ID NO: 704086 - DNA, 22 bp, Artificial Sequence
  chemically synthesized
actttgttactcaacaaatgtc

SEQ ID NO: 704087 - DNA, 22 bp, Artificial Sequence
  chemically synthesized
gtcattcaacagacatttgttg

SEQ ID NO: 704088 - DNA, 22 bp, Artificial Sequence
  chemically synthesized
attcactttgttactcaacaaa

SEQ ID NO: 704089 - DNA, 22 bp, Artificial Sequence
  chemically synthesized
aacagacatttgttgagtaaca

SEQ ID NO: 704090 - DNA, 22 bp, Artificial Sequence
  chemically synthesized
agaattgattcactttgttact

SEQ ID NO: 704091 - DNA, 22 bp, Artificial Sequence
  chemically synthesized
gttgagtaacaaagtgaatcaa

SEQ ID NO: 704092 - DNA, 22 bp, Artificial Sequence
  chemically synthesized
ttgagtaacaaagtgaatcaat

SEQ ID NO: 704093 - DNA, 22 bp, Artificial Sequence
  chemically synthesized
agtcagttaagaattgattcac

SEQ ID NO: 704094 - DNA, 22 bp, Artificial Sequence
  chemically synthesized
cagtcagttaagaattgattca

SEQ ID NO: 704095 - DNA, 22 bp, Artificial Sequence
  chemically synthesized
agtaacaaagtgaatcaattct

SEQ ID NO: 704096 - DNA, 22 bp, Artificial Sequence
  chemically synthesized
tcttcagtcagttaagaattga

SEQ ID NO: 704097 - DNA, 22 bp, Artificial Sequence
  chemically synthesized
atcttcagtcagttaagaattg

SEQ ID NO: 704098 - DNA, 22 bp, Artificial Sequence
  chemically synthesized
tatcttcagtcagttaagaatt

SEQ ID NO: 704099 - DNA, 22 bp, Artificial Sequence
  chemically synthesized
actttatcttcagtcagttaag

SEQ ID NO: 704100 - DNA, 22 bp, Artificial Sequence
  chemically synthesized
cactttatcttcagtcagttaa

SEQ ID NO: 704101 - DNA, 22 bp, Artificial Sequence
  chemically synthesized
atgaacttcactttatcttcag

SEQ ID NO: 704102 - DNA, 22 bp, Artificial Sequence
  chemically synthesized
ttaactgactgaagataaagtg

SEQ ID NO: 704103 - DNA, 22 bp, Artificial Sequence
  chemically synthesized
aactgactgaagataaagtgaa

SEQ ID NO: 704104 - DNA, 22 bp, Artificial Sequence
  chemically synthesized
actgactgaagataaagtgaag

SEQ ID NO: 704105 - DNA, 22 bp, Artificial Sequence
  chemically synthesized
actgaagataaagtgaagttca

SEQ ID NO: 704106 - DNA, 22 bp, Artificial Sequence
  chemically synthesized
aagataaagtgaagttcattaa

SEQ ID NO: 704107 - DNA, 22 bp, Artificial Sequence
  chemically synthesized
atgtccagaaagagttaatgaa

SEQ ID NO: 704108 - DNA, 22 bp, Artificial Sequence
  chemically synthesized
gtctaatgtccagaaagagtta

SEQ ID NO: 704109 - DNA, 22 bp, Artificial Sequence
  chemically synthesized
agtctaatgtccagaaagagtt

SEQ ID NO: 704110 - DNA, 22 bp, Artificial Sequence
  chemically synthesized
gtgcttagtctaatgtccagaa

SEQ ID NO: 704111 - DNA, 22 bp, Artificial Sequence
  chemically synthesized
attaactctttctggacattag

SEQ ID NO: 704112 - DNA, 22 bp, Artificial Sequence
  chemically synthesized
gcctggtgcttagtctaatgtc

SEQ ID NO: 704113 - DNA, 22 bp, Artificial Sequence
  chemically synthesized
agcctggtgcttagtctaatgt

SEQ ID NO: 704114 - DNA, 22 bp, Artificial Sequence
  chemically synthesized
actctttctggacattagacta

SEQ ID NO: 704115 - DNA, 22 bp, Artificial Sequence
  chemically synthesized
tttctggacattagactaagca

SEQ ID NO: 704116 - DNA, 22 bp, Artificial Sequence
  chemically synthesized
tctggacattagactaagcacc

SEQ ID NO: 704117 - DNA, 22 bp, Artificial Sequence
  chemically synthesized
ctggacattagactaagcacca

SEQ ID NO: 704118 - DNA, 22 bp, Artificial Sequence
  chemically synthesized
tggacattagactaagcaccag

SEQ ID NO: 704119 - DNA, 22 bp, Artificial Sequence
  chemically synthesized
gacattagactaagcaccaggc

SEQ ID NO: 704120 - DNA, 22 bp, Artificial Sequence
  chemically synthesized
ataaaatgaaagaacttagcct

SEQ ID NO: 704121 - DNA, 22 bp, Artificial Sequence
  chemically synthesized
gactaagcaccaggctaagttc

SEQ ID NO: 704122 - DNA, 22 bp, Artificial Sequence
  chemically synthesized
agcaccaggctaagttctttca

SEQ ID NO: 704123 - DNA, 22 bp, Artificial Sequence
  chemically synthesized
ccagtctaataaaatgaaagaa

SEQ ID NO: 704124 - DNA, 22 bp, Artificial Sequence
  chemically synthesized
ttcccagtctaataaaatgaaa

SEQ ID NO: 704125 - DNA, 22 bp, Artificial Sequence
  chemically synthesized
agttctttcattttattagact

SEQ ID NO: 704126 - DNA, 22 bp, Artificial Sequence
  chemically synthesized
aaagattgttcccagtctaata

SEQ ID NO: 704127 - DNA, 22 bp, Artificial Sequence
  chemically synthesized
aaaagattgttcccagtctaat

SEQ ID NO: 704128 - DNA, 22 bp, Artificial Sequence
  chemically synthesized
tttcattttattagactgggaa

SEQ ID NO: 704129 - DNA, 22 bp, Artificial Sequence
  chemically synthesized
tcattttattagactgggaaca

SEQ ID NO: 704130 - DNA, 22 bp, Artificial Sequence
  chemically synthesized
cattttattagactgggaacaa

SEQ ID NO: 704131 - DNA, 22 bp, Artificial Sequence
  chemically synthesized
attttattagactgggaacaat

SEQ ID NO: 704132 - DNA, 22 bp, Artificial Sequence
  chemically synthesized
ggcacttaaaagattgttccca

SEQ ID NO: 704133 - DNA, 22 bp, Artificial Sequence
  chemically synthesized
tattagactgggaacaatcttt

SEQ ID NO: 704134 - DNA, 22 bp, Artificial Sequence
  chemically synthesized
attagactgggaacaatctttt

SEQ ID NO: 704135 - DNA, 22 bp, Artificial Sequence
  chemically synthesized
ttagactgggaacaatctttta

SEQ ID NO: 704136 - DNA, 22 bp, Artificial Sequence
  chemically synthesized
gactgggaacaatcttttaagt

SEQ ID NO: 704137 - DNA, 22 bp, Artificial Sequence
  chemically synthesized
aatgaataactgggcacttaaa

SEQ ID NO: 704138 - DNA, 22 bp, Artificial Sequence
  chemically synthesized
ggaacaatcttttaagtgccca

SEQ ID NO: 704139 - DNA, 22 bp, Artificial Sequence
  chemically synthesized
attgaatgaataactgggcact

SEQ ID NO: 704140 - DNA, 22 bp, Artificial Sequence
  chemically synthesized
gattgaatgaataactgggcac

SEQ ID NO: 704141 - DNA, 22 bp, Artificial Sequence
  chemically synthesized
ttaagtgcccagttattcattc

SEQ ID NO: 704142 - DNA, 22 bp, Artificial Sequence
  chemically synthesized
taagtgcccagttattcattca

SEQ ID NO: 704143 - DNA, 22 bp, Artificial Sequence
  chemically synthesized
aagtgcccagttattcattcaa

SEQ ID NO: 704144 - DNA, 22 bp, Artificial Sequence
  chemically synthesized
agtgcccagttattcattcaat

SEQ ID NO: 704145 - DNA, 22 bp, Artificial Sequence
  chemically synthesized
gatgcaggatatgccttgattg

SEQ ID NO: 704146 - DNA, 22 bp, Artificial Sequence
  chemically synthesized
ttcattcaatcaaggcatatcc

SEQ ID NO: 704147 - DNA, 22 bp, Artificial Sequence
  chemically synthesized
catattagatgcaggatatgcc

SEQ ID NO: 704148 - DNA, 22 bp, Artificial Sequence
  chemically synthesized
gcatattagatgcaggatatgc

SEQ ID NO: 704149 - DNA, 22 bp, Artificial Sequence
  chemically synthesized
attcaatcaaggcatatcctgc

SEQ ID NO: 704150 - DNA, 22 bp, Artificial Sequence
  chemically synthesized
aatcaaggcatatcctgcatct

SEQ ID NO: 704151 - DNA, 22 bp, Artificial Sequence
  chemically synthesized
acacaacatcttgcatattaga

SEQ ID NO: 704152 - DNA, 22 bp, Artificial Sequence
  chemically synthesized
catctaacacaacatcttgcat

SEQ ID NO: 704153 - DNA, 22 bp, Artificial Sequence
  chemically synthesized
gcatctaacacaacatcttgca

SEQ ID NO: 704154 - DNA, 22 bp, Artificial Sequence
  chemically synthesized
tgcatctaacacaacatcttgc

SEQ ID NO: 704155 - DNA, 22 bp, Artificial Sequence
  chemically synthesized
catctaatatgcaagatgttgt

SEQ ID NO: 704156 - DNA, 22 bp, Artificial Sequence
  chemically synthesized
atatgcaagatgttgtgttaga

SEQ ID NO: 704157 - DNA, 22 bp, Artificial Sequence
  chemically synthesized
aaaataattttgcatctaacac

SEQ ID NO: 704158 - DNA, 22 bp, Artificial Sequence
  chemically synthesized
ttaaaaataattttgcatctaa

SEQ ID NO: 704159 - DNA, 22 bp, Artificial Sequence
  chemically synthesized
attaaaaataattttgcatcta

SEQ ID NO: 704160 - DNA, 22 bp, Artificial Sequence
  chemically synthesized
tattaaaaataattttgcatct

SEQ ID NO: 704161 - DNA, 22 bp, Artificial Sequence
  chemically synthesized
ttattaaaaataattttgcatc

SEQ ID NO: 704162 - DNA, 22 bp, Artificial Sequence
  chemically synthesized
tttattaaaaataattttgcat

SEQ ID NO: 704163 - DNA, 22 bp, Artificial Sequence
  chemically synthesized
ttttattaaaaataattttgca

SEQ ID NO: 704164 - DNA, 22 bp, Artificial Sequence
  chemically synthesized
cttttttattaaaaataatttt

SEQ ID NO: 704165 - DNA, 22 bp, Artificial Sequence
  chemically synthesized
tgttagatgcaaaattattttt

SEQ ID NO: 704166 - DNA, 22 bp, Artificial Sequence
  chemically synthesized
cattacttttttattaaaaata

SEQ ID NO: 704167 - DNA, 22 bp, Artificial Sequence
  chemically synthesized
gatgcaaaattatttttaataa

SEQ ID NO: 704168 - DNA, 22 bp, Artificial Sequence
  chemically synthesized
tttttaataaaaaagtaatgca

SEQ ID NO: 704169 - DNA, 22 bp, Artificial Sequence
  chemically synthesized
agggcatagggcctgcattact

SEQ ID NO: 704170 - DNA, 22 bp, Artificial Sequence
  chemically synthesized
aagggcatagggcctgcattac

SEQ ID NO: 704171 - DNA, 22 bp, Artificial Sequence
  chemically synthesized
ttaataaaaaagtaatgcaggc

SEQ ID NO: 704172 - DNA, 22 bp, Artificial Sequence
  chemically synthesized
taagggcatagggcctgcatta

SEQ ID NO: 704173 - DNA, 22 bp, Artificial Sequence
  chemically synthesized
taataaaaaagtaatgcaggcc

SEQ ID NO: 704174 - DNA, 22 bp, Artificial Sequence
  chemically synthesized
aataaaaaagtaatgcaggccc

SEQ ID NO: 704175 - DNA, 22 bp, Artificial Sequence
  chemically synthesized
ataaaaaagtaatgcaggccct

SEQ ID NO: 704176 - DNA, 22 bp, Artificial Sequence
  chemically synthesized
gagtgtgagcactttaagggca

SEQ ID NO: 704177 - DNA, 22 bp, Artificial Sequence
  chemically synthesized
tgcccttaaagtgctcacactc

SEQ ID NO: 704178 - DNA, 22 bp, Artificial Sequence
  chemically synthesized
aaaggaaatatgttggagtgtg

SEQ ID NO: 704179 - DNA, 22 bp, Artificial Sequence
  chemically synthesized
gaaaggaaatatgttggagtgt

SEQ ID NO: 704180 - DNA, 22 bp, Artificial Sequence
  chemically synthesized
aaagtgctcacactccaacata

SEQ ID NO: 704181 - DNA, 22 bp, Artificial Sequence
  chemically synthesized
aagtgctcacactccaacatat

SEQ ID NO: 704182 - DNA, 22 bp, Artificial Sequence
  chemically synthesized
acactccaacatatttcctttc

SEQ ID NO: 704183 - DNA, 22 bp, Artificial Sequence
  chemically synthesized
caacatatttcctttcaagatc

SEQ ID NO: 704184 - DNA, 22 bp, Artificial Sequence
  chemically synthesized
cctttcaagatctatgttactg

SEQ ID NO: 704185 - DNA, 22 bp, Artificial Sequence
  chemically synthesized
ctttcaagatctatgttactga

SEQ ID NO: 704186 - DNA, 22 bp, Artificial Sequence
  chemically synthesized
gaacgtaagatggtcagtaaca

SEQ ID NO: 704187 - DNA, 22 bp, Artificial Sequence
  chemically synthesized
tcaagatctatgttactgacca

SEQ ID NO: 704188 - DNA, 22 bp, Artificial Sequence
  chemically synthesized
caagatctatgttactgaccat

SEQ ID NO: 704189 - DNA, 22 bp, Artificial Sequence
  chemically synthesized
aagatctatgttactgaccatc

SEQ ID NO: 704190 - DNA, 22 bp, Artificial Sequence
  chemically synthesized
tgttactgaccatcttacgttc

SEQ ID NO: 704191 - DNA, 22 bp, Artificial Sequence
  chemically synthesized
ctgaccatcttacgttctaact

SEQ ID NO: 704192 - DNA, 22 bp, Artificial Sequence
  chemically synthesized
accatcttacgttctaactctt

SEQ ID NO: 704193 - DNA, 22 bp, Artificial Sequence
  chemically synthesized
acgttctaactcttgcctgtca

SEQ ID NO: 704194 - DNA, 22 bp, Artificial Sequence
  chemically synthesized
cgttctaactcttgcctgtcat

SEQ ID NO: 704195 - DNA, 22 bp, Artificial Sequence
  chemically synthesized
agcagcatacatgcccatgaca

SEQ ID NO: 704196 - DNA, 22 bp, Artificial Sequence
  chemically synthesized
taactcttgcctgtcatgggca

SEQ ID NO: 704197 - DNA, 22 bp, Artificial Sequence
  chemically synthesized
actcttgcctgtcatgggcatg

SEQ ID NO: 704198 - DNA, 22 bp, Artificial Sequence
  chemically synthesized
agctcagcagcatacatgccca

SEQ ID NO: 704199 - DNA, 22 bp, Artificial Sequence
  chemically synthesized
aagctcagcagcatacatgccc

SEQ ID NO: 704200 - DNA, 22 bp, Artificial Sequence
  chemically synthesized
ttgcctgtcatgggcatgtatg

SEQ ID NO: 704201 - DNA, 22 bp, Artificial Sequence
  chemically synthesized
gcctgtcatgggcatgtatgct

SEQ ID NO: 704202 - DNA, 22 bp, Artificial Sequence
  chemically synthesized
cctgtcatgggcatgtatgctg

SEQ ID NO: 704203 - DNA, 22 bp, Artificial Sequence
  chemically synthesized
aaccttaagctcagcagcatac

SEQ ID NO: 704204 - DNA, 22 bp, Artificial Sequence
  chemically synthesized
aaaccttaagctcagcagcata

SEQ ID NO: 704205 - DNA, 22 bp, Artificial Sequence
  chemically synthesized
tcatgggcatgtatgctgctga

SEQ ID NO: 704206 - DNA, 22 bp, Artificial Sequence
  chemically synthesized
ccttaaaccttaagctcagcag

SEQ ID NO: 704207 - DNA, 22 bp, Artificial Sequence
  chemically synthesized
accttaaaccttaagctcagca

SEQ ID NO: 704208 - DNA, 22 bp, Artificial Sequence
  chemically synthesized
ttaccttaaaccttaagctcag

SEQ ID NO: 704209 - DNA, 22 bp, Artificial Sequence
  chemically synthesized
catgaatctcttaccttaaacc

SEQ ID NO: 704210 - DNA, 22 bp, Artificial Sequence
  chemically synthesized
ctgagcttaaggtttaaggtaa

SEQ ID NO: 704211 - DNA, 22 bp, Artificial Sequence
  chemically synthesized
agcttaaggtttaaggtaagag

SEQ ID NO: 704212 - DNA, 22 bp, Artificial Sequence
  chemically synthesized
aaggtttaaggtaagagattca

SEQ ID NO: 704213 - DNA, 22 bp, Artificial Sequence
  chemically synthesized
aggtttaaggtaagagattcat

SEQ ID NO: 704214 - DNA, 22 bp, Artificial Sequence
  chemically synthesized
aaggtaagagattcatgtaatt

SEQ ID NO: 704215 - DNA, 22 bp, Artificial Sequence
  chemically synthesized
gggacagcataaaattacatga

SEQ ID NO: 704216 - DNA, 22 bp, Artificial Sequence
  chemically synthesized
aggtaagagattcatgtaattt

SEQ ID NO: 704217 - DNA, 22 bp, Artificial Sequence
  chemically synthesized
ggggacagcataaaattacatg

SEQ ID NO: 704218 - DNA, 22 bp, Artificial Sequence
  chemically synthesized
tggggacagcataaaattacat

SEQ ID NO: 704219 - DNA, 22 bp, Artificial Sequence
  chemically synthesized
atgtaattttatgctgtcccca

SEQ ID NO: 704220 - DNA, 22 bp, Artificial Sequence
  chemically synthesized
ataggtaaggactttggggaca

SEQ ID NO: 704221 - DNA, 22 bp, Artificial Sequence
  chemically synthesized
cattaataggtaaggactttgg

SEQ ID NO: 704222 - DNA, 22 bp, Artificial Sequence
  chemically synthesized
tatgctgtccccaaagtcctta

SEQ ID NO: 704223 - DNA, 22 bp, Artificial Sequence
  chemically synthesized
atgctgtccccaaagtccttac

SEQ ID NO: 704224 - DNA, 22 bp, Artificial Sequence
  chemically synthesized
tgctgtccccaaagtccttacc

SEQ ID NO: 704225 - DNA, 22 bp, Artificial Sequence
  chemically synthesized
atgatctccattaataggtaag

SEQ ID NO: 704226 - DNA, 22 bp, Artificial Sequence
  chemically synthesized
tccccaaagtccttacctatta

SEQ ID NO: 704227 - DNA, 22 bp, Artificial Sequence
  chemically synthesized
aggtgtccaacctcatgatctc

SEQ ID NO: 704228 - DNA, 22 bp, Artificial Sequence
  chemically synthesized
acctattaatggagatcatgag

SEQ ID NO: 704229 - DNA, 22 bp, Artificial Sequence
  chemically synthesized
aaggtgtccaacctcatgatct

SEQ ID NO: 704230 - DNA, 22 bp, Artificial Sequence
  chemically synthesized
cctattaatggagatcatgagg

SEQ ID NO: 704231 - DNA, 22 bp, Artificial Sequence
  chemically synthesized
tttaaggtgtccaacctcatga

SEQ ID NO: 704232 - DNA, 22 bp, Artificial Sequence
  chemically synthesized
ttaatggagatcatgaggttgg

SEQ ID NO: 704233 - DNA, 22 bp, Artificial Sequence
  chemically synthesized
ttatttaaggtgtccaacctca

SEQ ID NO: 704234 - DNA, 22 bp, Artificial Sequence
  chemically synthesized
atggagatcatgaggttggaca

SEQ ID NO: 704235 - DNA, 22 bp, Artificial Sequence
  chemically synthesized
ttattatttaaggtgtccaacc

SEQ ID NO: 704236 - DNA, 22 bp, Artificial Sequence
  chemically synthesized
gacaccttaaataataataatc

SEQ ID NO: 704237 - DNA, 22 bp, Artificial Sequence
  chemically synthesized
aggataagtagtgattattatt

SEQ ID NO: 704238 - DNA, 22 bp, Artificial Sequence
  chemically synthesized
ttcaggataagtagtgattatt

SEQ ID NO: 704239 - DNA, 22 bp, Artificial Sequence
  chemically synthesized
gttcaggataagtagtgattat

SEQ ID NO: 704240 - DNA, 22 bp, Artificial Sequence
  chemically synthesized
tgttcaggataagtagtgatta

SEQ ID NO: 704241 - DNA, 22 bp, Artificial Sequence
  chemically synthesized
aaataataataatcactactta

SEQ ID NO: 704242 - DNA, 22 bp, Artificial Sequence
  chemically synthesized
ttttgttcaggataagtagtga

SEQ ID NO: 704243 - DNA, 22 bp, Artificial Sequence
  chemically synthesized
aataataataatcactacttat

SEQ ID NO: 704244 - DNA, 22 bp, Artificial Sequence
  chemically synthesized
attattttgttcaggataagta

SEQ ID NO: 704245 - DNA, 22 bp, Artificial Sequence
  chemically synthesized
ataatgaggttgattattttgt

SEQ ID NO: 704246 - DNA, 22 bp, Artificial Sequence
  chemically synthesized
cataatgaggttgattattttg

SEQ ID NO: 704247 - DNA, 22 bp, Artificial Sequence
  chemically synthesized
cttatcctgaacaaaataatca

SEQ ID NO: 704248 - DNA, 22 bp, Artificial Sequence
  chemically synthesized
tcataatgaggttgattatttt

SEQ ID NO: 704249 - DNA, 22 bp, Artificial Sequence
  chemically synthesized
atcctgaacaaaataatcaacc

SEQ ID NO: 704250 - DNA, 22 bp, Artificial Sequence
  chemically synthesized
ctttcataatgaggttgattat

SEQ ID NO: 704251 - DNA, 22 bp, Artificial Sequence
  chemically synthesized
tcctgaacaaaataatcaacct

SEQ ID NO: 704252 - DNA, 22 bp, Artificial Sequence
  chemically synthesized
gctttcataatgaggttgatta

SEQ ID NO: 704253 - DNA, 22 bp, Artificial Sequence
  chemically synthesized
ttgctttcataatgaggttgat

SEQ ID NO: 704254 - DNA, 22 bp, Artificial Sequence
  chemically synthesized
aacaaaataatcaacctcatta

SEQ ID NO: 704255 - DNA, 22 bp, Artificial Sequence
  chemically synthesized
ctcttgctttcataatgaggtt

SEQ ID NO: 704256 - DNA, 22 bp, Artificial Sequence
  chemically synthesized
actcttgctttcataatgaggt

SEQ ID NO: 704257 - DNA, 22 bp, Artificial Sequence
  chemically synthesized
atttactcttgctttcataatg

SEQ ID NO: 704258 - DNA, 22 bp, Artificial Sequence
  chemically synthesized
gatttactcttgctttcataat

SEQ ID NO: 704259 - DNA, 22 bp, Artificial Sequence
  chemically synthesized
ggtaatttgatttactcttgct

SEQ ID NO: 704260 - DNA, 22 bp, Artificial Sequence
  chemically synthesized
attatgaaagcaagagtaaatc

SEQ ID NO: 704261 - DNA, 22 bp, Artificial Sequence
  chemically synthesized
tgaaagcaagagtaaatcaaat

SEQ ID NO: 704262 - DNA, 22 bp, Artificial Sequence
  chemically synthesized
cagtcactgggtaatttgattt

SEQ ID NO: 704263 - DNA, 22 bp, Artificial Sequence
  chemically synthesized
taataggcccattacagtcact

SEQ ID NO: 704264 - DNA, 22 bp, Artificial Sequence
  chemically synthesized
cccagtgactgtaatgggccta

SEQ ID NO: 704265 - DNA, 22 bp, Artificial Sequence
  chemically synthesized
agaaaaaggtattataataggc

SEQ ID NO: 704266 - DNA, 22 bp, Artificial Sequence
  chemically synthesized
taatgggcctattataatacct

SEQ ID NO: 704267 - DNA, 22 bp, Artificial Sequence
  chemically synthesized
gaagcatctaagaaaaaggtat

SEQ ID NO: 704268 - DNA, 22 bp, Artificial Sequence
  chemically synthesized
agaagcatctaagaaaaaggta

SEQ ID NO: 704269 - DNA, 22 bp, Artificial Sequence
  chemically synthesized
ttataatacctttttcttagat

SEQ ID NO: 704270 - DNA, 22 bp, Artificial Sequence
  chemically synthesized
taatacctttttcttagatgct

SEQ ID NO: 704271 - DNA, 22 bp, Artificial Sequence
  chemically synthesized
acaggcatttagaagcatctaa

SEQ ID NO: 704272 - DNA, 22 bp, Artificial Sequence
  chemically synthesized
tttcttagatgcttctaaatgc

SEQ ID NO: 704273 - DNA, 22 bp, Artificial Sequence
  chemically synthesized
ttcttagatgcttctaaatgcc

SEQ ID NO: 704274 - DNA, 22 bp, Artificial Sequence
  chemically synthesized
tcttagatgcttctaaatgcct

SEQ ID NO: 704275 - DNA, 22 bp, Artificial Sequence
  chemically synthesized
cttagatgcttctaaatgcctg

SEQ ID NO: 704276 - DNA, 22 bp, Artificial Sequence
  chemically synthesized
ttagatgcttctaaatgcctgt

SEQ ID NO: 704277 - DNA, 22 bp, Artificial Sequence
  chemically synthesized
agatgcttctaaatgcctgtca

SEQ ID NO: 704278 - DNA, 22 bp, Artificial Sequence
  chemically synthesized
gatgcttctaaatgcctgtcaa

SEQ ID NO: 704279 - DNA, 22 bp, Artificial Sequence
  chemically synthesized
tgagggggcaatgaaattgaca

SEQ ID NO: 704280 - DNA, 22 bp, Artificial Sequence
  chemically synthesized
ctaaatgcctgtcaatttcatt

SEQ ID NO: 704281 - DNA, 22 bp, Artificial Sequence
  chemically synthesized
taaatgcctgtcaatttcattg

SEQ ID NO: 704282 - DNA, 22 bp, Artificial Sequence
  chemically synthesized
aatgcctgtcaatttcattgcc

SEQ ID NO: 704283 - DNA, 22 bp, Artificial Sequence
  chemically synthesized
tcaatttcattgccccctcaca

SEQ ID NO: 704284 - DNA, 22 bp, Artificial Sequence
  chemically synthesized
gaggaagccaatctgtgagggg

SEQ ID NO: 704285 - DNA, 22 bp, Artificial Sequence
  chemically synthesized
ctggaggaagccaatctgtgag

SEQ ID NO: 704286 - DNA, 22 bp, Artificial Sequence
  chemically synthesized
cctggaggaagccaatctgtga

SEQ ID NO: 704287 - DNA, 22 bp, Artificial Sequence
  chemically synthesized
cattgccccctcacagattggc

SEQ ID NO: 704288 - DNA, 22 bp, Artificial Sequence
  chemically synthesized
attgccccctcacagattggct

SEQ ID NO: 704289 - DNA, 22 bp, Artificial Sequence
  chemically synthesized
gcttcctggaggaagccaatct

SEQ ID NO: 704290 - DNA, 22 bp, Artificial Sequence
  chemically synthesized
ccccctcacagattggcttcct

SEQ ID NO: 704291 - DNA, 22 bp, Artificial Sequence
  chemically synthesized
gagttggcttcctggaggaagc

SEQ ID NO: 704292 - DNA, 22 bp, Artificial Sequence
  chemically synthesized
agagttggcttcctggaggaag

SEQ ID NO: 704293 - DNA, 22 bp, Artificial Sequence
  chemically synthesized
acagattggcttcctccaggaa

SEQ ID NO: 704294 - DNA, 22 bp, Artificial Sequence
  chemically synthesized
ccttagagttggcttcctggag

SEQ ID NO: 704295 - DNA, 22 bp, Artificial Sequence
  chemically synthesized
gcttcctccaggaagccaactc

SEQ ID NO: 704296 - DNA, 22 bp, Artificial Sequence
  chemically synthesized
atcattgccttagagttggctt

SEQ ID NO: 704297 - DNA, 22 bp, Artificial Sequence
  chemically synthesized
taatcattgccttagagttggc

SEQ ID NO: 704298 - DNA, 22 bp, Artificial Sequence
  chemically synthesized
cctccaggaagccaactctaag

SEQ ID NO: 704299 - DNA, 22 bp, Artificial Sequence
  chemically synthesized
tctaatcattgccttagagttg

SEQ ID NO: 704300 - DNA, 22 bp, Artificial Sequence
  chemically synthesized
ctccaggaagccaactctaagg

SEQ ID NO: 704301 - DNA, 22 bp, Artificial Sequence
  chemically synthesized
ctctctaatcattgccttagag

SEQ ID NO: 704302 - DNA, 22 bp, Artificial Sequence
  chemically synthesized
caggaagccaactctaaggcaa

SEQ ID NO: 704303 - DNA, 22 bp, Artificial Sequence
  chemically synthesized
tcctgctctctaatcattgcct

SEQ ID NO: 704304 - DNA, 22 bp, Artificial Sequence
  chemically synthesized
tctatcctgctctctaatcatt

SEQ ID NO: 704305 - DNA, 22 bp, Artificial Sequence
  chemically synthesized
taaggcaatgattagagagcag

SEQ ID NO: 704306 - DNA, 22 bp, Artificial Sequence
  chemically synthesized
aggcaatgattagagagcagga

SEQ ID NO: 704307 - DNA, 22 bp, Artificial Sequence
  chemically synthesized
cacagttgtctatcctgctctc

SEQ ID NO: 704308 - DNA, 22 bp, Artificial Sequence
  chemically synthesized
ccacagttgtctatcctgctct

SEQ ID NO: 704309 - DNA, 22 bp, Artificial Sequence
  chemically synthesized
ccttccacagttgtctatcctg

SEQ ID NO: 704310 - DNA, 22 bp, Artificial Sequence
  chemically synthesized
cccttccacagttgtctatcct

SEQ ID NO: 704311 - DNA, 22 bp, Artificial Sequence
  chemically synthesized
acttcccttccacagttgtcta

SEQ ID NO: 704312 - DNA, 22 bp, Artificial Sequence
  chemically synthesized
cacttcccttccacagttgtct

SEQ ID NO: 704313 - DNA, 22 bp, Artificial Sequence
  chemically synthesized
gagagcaggatagacaactgtg

SEQ ID NO: 704314 - DNA, 22 bp, Artificial Sequence
  chemically synthesized
tcacttcccttccacagttgtc

SEQ ID NO: 704315 - DNA, 22 bp, Artificial Sequence
  chemically synthesized
tttcacttcccttccacagttg

SEQ ID NO: 704316 - DNA, 22 bp, Artificial Sequence
  chemically synthesized
ctttcacttcccttccacagtt

SEQ ID NO: 704317 - DNA, 22 bp, Artificial Sequence
  chemically synthesized
tttctttcacttcccttccaca

SEQ ID NO: 704318 - DNA, 22 bp, Artificial Sequence
  chemically synthesized
ctgtttctttcacttcccttcc

SEQ ID NO: 704319 - DNA, 22 bp, Artificial Sequence
  chemically synthesized
ttcctgtttctttcacttccct

SEQ ID NO: 704320 - DNA, 22 bp, Artificial Sequence
  chemically synthesized
tattcctgtttctttcacttcc

SEQ ID NO: 704321 - DNA, 22 bp, Artificial Sequence
  chemically synthesized
ctattcctgtttctttcacttc

SEQ ID NO: 704322 - DNA, 22 bp, Artificial Sequence
  chemically synthesized
tttctattcctgtttctttcac

SEQ ID NO: 704323 - DNA, 22 bp, Artificial Sequence
  chemically synthesized
tggaagggaagtgaaagaaaca

SEQ ID NO: 704324 - DNA, 22 bp, Artificial Sequence
  chemically synthesized
cctatttctattcctgtttctt

SEQ ID NO: 704325 - DNA, 22 bp, Artificial Sequence
  chemically synthesized
tccctatttctattcctgtttc

SEQ ID NO: 704326 - DNA, 22 bp, Artificial Sequence
  chemically synthesized
ctccctatttctattcctgttt

SEQ ID NO: 704327 - DNA, 22 bp, Artificial Sequence
  chemically synthesized
acttctccctatttctattcct

SEQ ID NO: 704328 - DNA, 22 bp, Artificial Sequence
  chemically synthesized
gacttctccctatttctattcc

SEQ ID NO: 704329 - DNA, 22 bp, Artificial Sequence
  chemically synthesized
accttgacttctccctatttct

SEQ ID NO: 704330 - DNA, 22 bp, Artificial Sequence
  chemically synthesized
cattcaccttgacttctcccta

SEQ ID NO: 704331 - DNA, 22 bp, Artificial Sequence
  chemically synthesized
ggtctgcattcaccttgacttc

SEQ ID NO: 704332 - DNA, 22 bp, Artificial Sequence
  chemically synthesized
tcactgggtctgcattcacctt

SEQ ID NO: 704333 - DNA, 22 bp, Artificial Sequence
  chemically synthesized
aatgagactgtcactgggtctg

SEQ ID NO: 704334 - DNA, 22 bp, Artificial Sequence
  chemically synthesized
ccatggggttgaatgagactgt

SEQ ID NO: 704335 - DNA, 22 bp, Artificial Sequence
  chemically synthesized
aagagctcccatggggttgaat

SEQ ID NO: 704336 - DNA, 22 bp, Artificial Sequence
  chemically synthesized
gctcaagagctcccatggggtt

SEQ ID NO: 704337 - DNA, 22 bp, Artificial Sequence
  chemically synthesized
tagctcaagagctcccatgggg

SEQ ID NO: 704338 - DNA, 22 bp, Artificial Sequence
  chemically synthesized
attcaaccccatgggagctctt

SEQ ID NO: 704339 - DNA, 22 bp, Artificial Sequence
  chemically synthesized
acattctagctcaagagctccc

SEQ ID NO: 704340 - DNA, 22 bp, Artificial Sequence
  chemically synthesized
aaccccatgggagctcttgagc

SEQ ID NO: 704341 - DNA, 22 bp, Artificial Sequence
  chemically synthesized
aggagaacattaacattctagc

SEQ ID NO: 704342 - DNA, 22 bp, Artificial Sequence
  chemically synthesized
ttgagctagaatgttaatgttc

SEQ ID NO: 704343 - DNA, 22 bp, Artificial Sequence
  chemically synthesized
gcccaactcaggagaacattaa

SEQ ID NO: 704344 - DNA, 22 bp, Artificial Sequence
  chemically synthesized
gagctagaatgttaatgttctc

SEQ ID NO: 704345 - DNA, 22 bp, Artificial Sequence
  chemically synthesized
ggcccaactcaggagaacatta

SEQ ID NO: 704346 - DNA, 22 bp, Artificial Sequence
  chemically synthesized
agctagaatgttaatgttctcc

SEQ ID NO: 704347 - DNA, 22 bp, Artificial Sequence
  chemically synthesized
tggcccaactcaggagaacatt

SEQ ID NO: 704348 - DNA, 22 bp, Artificial Sequence
  chemically synthesized
gaatgttaatgttctcctgagt

SEQ ID NO: 704349 - DNA, 22 bp, Artificial Sequence
  chemically synthesized
gccattttggcccaactcagga

SEQ ID NO: 704350 - DNA, 22 bp, Artificial Sequence
  chemically synthesized
atgttctcctgagttgggccaa

SEQ ID NO: 704351 - DNA, 22 bp, Artificial Sequence
  chemically synthesized
tcctgagttgggccaaaatggc

SEQ ID NO: 704352 - DNA, 22 bp, Artificial Sequence
  chemically synthesized
ctgagttgggccaaaatggcca

SEQ ID NO: 704353 - DNA, 22 bp, Artificial Sequence
  chemically synthesized
agttgggccaaaatggccaggt

SEQ ID NO: 704354 - DNA, 22 bp, Artificial Sequence
  chemically synthesized
ggccaaaatggccaggtcatta

SEQ ID NO: 704355 - DNA, 22 bp, Artificial Sequence
  chemically synthesized
atcagtgtaggggaataatgac

SEQ ID NO: 704356 - DNA, 22 bp, Artificial Sequence
  chemically synthesized
ctgatcagtgtaggggaataat

SEQ ID NO: 704357 - DNA, 22 bp, Artificial Sequence
  chemically synthesized
cctgatcagtgtaggggaataa

SEQ ID NO: 704358 - DNA, 22 bp, Artificial Sequence
  chemically synthesized
ttcctgatcagtgtaggggaat

SEQ ID NO: 704359 - DNA, 22 bp, Artificial Sequence
  chemically synthesized
caggggcagctcttcctgatca

SEQ ID NO: 704360 - DNA, 22 bp, Artificial Sequence
  chemically synthesized
ttcccctacactgatcaggaag

SEQ ID NO: 704361 - DNA, 22 bp, Artificial Sequence
  chemically synthesized
acaggggcagctcttcctgatc

SEQ ID NO: 704362 - DNA, 22 bp, Artificial Sequence
  chemically synthesized
ccctacactgatcaggaagagc

SEQ ID NO: 704363 - DNA, 22 bp, Artificial Sequence
  chemically synthesized
cactgatcaggaagagctgccc

SEQ ID NO: 704364 - DNA, 22 bp, Artificial Sequence
  chemically synthesized
atcaggaagagctgcccctgta

SEQ ID NO: 704365 - DNA, 22 bp, Artificial Sequence
  chemically synthesized
acccaagatcataccccttaca

SEQ ID NO: 704366 - DNA, 22 bp, Artificial Sequence
  chemically synthesized
cctcacccaagatcatacccct

SEQ ID NO: 704367 - DNA, 22 bp, Artificial Sequence
  chemically synthesized
cccctgtaaggggtatgatctt

SEQ ID NO: 704368 - DNA, 22 bp, Artificial Sequence
  chemically synthesized
catcagctgcctcacccaagat

SEQ ID NO: 704369 - DNA, 22 bp, Artificial Sequence
  chemically synthesized
taaggggtatgatcttgggtga

SEQ ID NO: 704370 - DNA, 22 bp, Artificial Sequence
  chemically synthesized
aggaattgcatcagctgcctca

SEQ ID NO: 704371 - DNA, 22 bp, Artificial Sequence
  chemically synthesized
caggaattgcatcagctgcctc

SEQ ID NO: 704372 - DNA, 22 bp, Artificial Sequence
  chemically synthesized
gggtgaggcagctgatgcaatt

SEQ ID NO: 704373 - DNA, 22 bp, Artificial Sequence
  chemically synthesized
ggtgaggcagctgatgcaattc

SEQ ID NO: 704374 - DNA, 22 bp, Artificial Sequence
  chemically synthesized
agcagacaatcttcaggaattg

SEQ ID NO: 704375 - DNA, 22 bp, Artificial Sequence
  chemically synthesized
atgcaattcctgaagattgtct

SEQ ID NO: 704376 - DNA, 22 bp, Artificial Sequence
  chemically synthesized
ctgaagattgtctgctgaggac

SEQ ID NO: 704377 - DNA, 22 bp, Artificial Sequence
  chemically synthesized
gatgaaagggagtgtcctcagc

SEQ ID NO: 704378 - DNA, 22 bp, Artificial Sequence
  chemically synthesized
aagattgtctgctgaggacact

SEQ ID NO: 704379 - DNA, 22 bp, Artificial Sequence
  chemically synthesized
tcgatgaaagggagtgtcctca

SEQ ID NO: 704380 - DNA, 22 bp, Artificial Sequence
  chemically synthesized
gtctctcgatgaaagggagtgt

SEQ ID NO: 704381 - DNA, 22 bp, Artificial Sequence
  chemically synthesized
agtctctcgatgaaagggagtg

SEQ ID NO: 704382 - DNA, 22 bp, Artificial Sequence
  chemically synthesized
tctgctgaggacactccctttc

SEQ ID NO: 704383 - DNA, 22 bp, Artificial Sequence
  chemically synthesized
tagtctctcgatgaaagggagt

SEQ ID NO: 704384 - DNA, 22 bp, Artificial Sequence
  chemically synthesized
ctgaggacactccctttcatcg

SEQ ID NO: 704385 - DNA, 22 bp, Artificial Sequence
  chemically synthesized
aggacactccctttcatcgaga

SEQ ID NO: 704386 - DNA, 22 bp, Artificial Sequence
  chemically synthesized
gggaccctttagtctctcgatg

SEQ ID NO: 704387 - DNA, 22 bp, Artificial Sequence
  chemically synthesized
agggaccctttagtctctcgat

SEQ ID NO: 704388 - DNA, 22 bp, Artificial Sequence
  chemically synthesized
cctttcatcgagagactaaagg

SEQ ID NO: 704389 - DNA, 22 bp, Artificial Sequence
  chemically synthesized
catccttagggaccctttagtc

SEQ ID NO: 704390 - DNA, 22 bp, Artificial Sequence
  chemically synthesized
tgcatccttagggaccctttag

SEQ ID NO: 704391 - DNA, 22 bp, Artificial Sequence
  chemically synthesized
tcatcgagagactaaagggtcc

SEQ ID NO: 704392 - DNA, 22 bp, Artificial Sequence
  chemically synthesized
ctgcatccttagggacccttta

SEQ ID NO: 704393 - DNA, 22 bp, Artificial Sequence
  chemically synthesized
catcgagagactaaagggtccc

SEQ ID NO: 704394 - DNA, 22 bp, Artificial Sequence
  chemically synthesized
tctgcatccttagggacccttt

SEQ ID NO: 704395 - DNA, 22 bp, Artificial Sequence
  chemically synthesized
atcgagagactaaagggtccct

SEQ ID NO: 704396 - DNA, 22 bp, Artificial Sequence
  chemically synthesized
ttctgcatccttagggaccctt

SEQ ID NO: 704397 - DNA, 22 bp, Artificial Sequence
  chemically synthesized
cttttctgcatccttagggacc

SEQ ID NO: 704398 - DNA, 22 bp, Artificial Sequence
  chemically synthesized
aagttgcttttctgcatcctta

SEQ ID NO: 704399 - DNA, 22 bp, Artificial Sequence
  chemically synthesized
gaagttgcttttctgcatcctt

SEQ ID NO: 704400 - DNA, 22 bp, Artificial Sequence
  chemically synthesized
aagggtccctaaggatgcagaa

SEQ ID NO: 704401 - DNA, 22 bp, Artificial Sequence
  chemically synthesized
tttgaagttgcttttctgcatc

SEQ ID NO: 704402 - DNA, 22 bp, Artificial Sequence
  chemically synthesized
aggaattatttgaagttgcttt

SEQ ID NO: 704403 - DNA, 22 bp, Artificial Sequence
  chemically synthesized
aggatgcagaaaagcaacttca

SEQ ID NO: 704404 - DNA, 22 bp, Artificial Sequence
  chemically synthesized
tgcctgaggaattatttgaagt

SEQ ID NO: 704405 - DNA, 22 bp, Artificial Sequence
  chemically synthesized
aatacagtgacctatgcctgag

SEQ ID NO: 704406 - DNA, 22 bp, Artificial Sequence
  chemically synthesized
caaataattcctcaggcatagg

SEQ ID NO: 704407 - DNA, 22 bp, Artificial Sequence
  chemically synthesized
aaataattcctcaggcataggt

SEQ ID NO: 704408 - DNA, 22 bp, Artificial Sequence
  chemically synthesized
ctcaggcataggtcactgtatt

SEQ ID NO: 704409 - DNA, 22 bp, Artificial Sequence
  chemically synthesized
aggcataggtcactgtatttag

SEQ ID NO: 704410 - DNA, 22 bp, Artificial Sequence
  chemically synthesized
tggtaatgaaagtcatgtggaa

SEQ ID NO: 704411 - DNA, 22 bp, Artificial Sequence
  chemically synthesized
gtggtaatgaaagtcatgtgga

SEQ ID NO: 704412 - DNA, 22 bp, Artificial Sequence
  chemically synthesized
tatttagtgttccacatgactt

SEQ ID NO: 704413 - DNA, 22 bp, Artificial Sequence
  chemically synthesized
agtgttccacatgactttcatt

SEQ ID NO: 704414 - DNA, 22 bp, Artificial Sequence
  chemically synthesized
gtgttccacatgactttcatta

SEQ ID NO: 704415 - DNA, 22 bp, Artificial Sequence
  chemically synthesized
cacaatttgtggtaatgaaagt

SEQ ID NO: 704416 - DNA, 22 bp, Artificial Sequence
  chemically synthesized
cacatgactttcattaccacaa

SEQ ID NO: 704417 - DNA, 22 bp, Artificial Sequence
  chemically synthesized
taccaatgcctgcacaatttgt

SEQ ID NO: 704418 - DNA, 22 bp, Artificial Sequence
  chemically synthesized
ataccaatgcctgcacaatttg

SEQ ID NO: 704419 - DNA, 22 bp, Artificial Sequence
  chemically synthesized
tataccaatgcctgcacaattt

SEQ ID NO: 704420 - DNA, 22 bp, Artificial Sequence
  chemically synthesized
tcattaccacaaattgtgcagg

SEQ ID NO: 704421 - DNA, 22 bp, Artificial Sequence
  chemically synthesized
cattaccacaaattgtgcaggc

SEQ ID NO: 704422 - DNA, 22 bp, Artificial Sequence
  chemically synthesized
ctttataccaatgcctgcacaa

SEQ ID NO: 704423 - DNA, 22 bp, Artificial Sequence
  chemically synthesized
attaccacaaattgtgcaggca

SEQ ID NO: 704424 - DNA, 22 bp, Artificial Sequence
  chemically synthesized
ccacaaattgtgcaggcattgg

SEQ ID NO: 704425 - DNA, 22 bp, Artificial Sequence
  chemically synthesized
agaatcactcctttataccaat

SEQ ID NO: 704426 - DNA, 22 bp, Artificial Sequence
  chemically synthesized
gttgagaatcactcctttatac

SEQ ID NO: 704427 - DNA, 22 bp, Artificial Sequence
  chemically synthesized
tgcaggcattggtataaaggag

SEQ ID NO: 704428 - DNA, 22 bp, Artificial Sequence
  chemically synthesized
cccctagttgagaatcactcct

SEQ ID NO: 704429 - DNA, 22 bp, Artificial Sequence
  chemically synthesized
gtataaaggagtgattctcaac

SEQ ID NO: 704430 - DNA, 22 bp, Artificial Sequence
  chemically synthesized
ggtgaaattgcccctagttgag

SEQ ID NO: 704431 - DNA, 22 bp, Artificial Sequence
  chemically synthesized
ttgggtgaaattgcccctagtt

SEQ ID NO: 704432 - DNA, 22 bp, Artificial Sequence
  chemically synthesized
tcaactaggggcaatttcaccc

SEQ ID NO: 704433 - DNA, 22 bp, Artificial Sequence
  chemically synthesized
atgtcccctgttgggtgaaatt

SEQ ID NO: 704434 - DNA, 22 bp, Artificial Sequence
  chemically synthesized
aactaggggcaatttcacccaa

SEQ ID NO: 704435 - DNA, 22 bp, Artificial Sequence
  chemically synthesized
tctgatgtcccctgttgggtga

SEQ ID NO: 704436 - DNA, 22 bp, Artificial Sequence
  chemically synthesized
ggggcaatttcacccaacaggg

SEQ ID NO: 704437 - DNA, 22 bp, Artificial Sequence
  chemically synthesized
tctgtctgatgtcccctgttgg

SEQ ID NO: 704438 - DNA, 22 bp, Artificial Sequence
  chemically synthesized
cacccaacaggggacatcagac

SEQ ID NO: 704439 - DNA, 22 bp, Artificial Sequence
  chemically synthesized
cagacattgtctgtctgatgtc

SEQ ID NO: 704440 - DNA, 22 bp, Artificial Sequence
  chemically synthesized
acccaacaggggacatcagaca

SEQ ID NO: 704441 - DNA, 22 bp, Artificial Sequence
  chemically synthesized
tgacaaccaaaaatgtctccag

SEQ ID NO: 704442 - DNA, 22 bp, Artificial Sequence
  chemically synthesized
gctgtgacaaccaaaaatgtct

SEQ ID NO: 704443 - DNA, 22 bp, Artificial Sequence
  chemically synthesized
agctgtgacaaccaaaaatgtc

SEQ ID NO: 704444 - DNA, 22 bp, Artificial Sequence
  chemically synthesized
ccttagctgtgacaaccaaaaa

SEQ ID NO: 704445 - DNA, 22 bp, Artificial Sequence
  chemically synthesized
ccctcccttagctgtgacaacc

SEQ ID NO: 704446 - DNA, 22 bp, Artificial Sequence
  chemically synthesized
gagacatttttggttgtcacag

SEQ ID NO: 704447 - DNA, 22 bp, Artificial Sequence
  chemically synthesized
ttggttgtcacagctaagggag

SEQ ID NO: 704448 - DNA, 22 bp, Artificial Sequence
  chemically synthesized
tggttgtcacagctaagggagg

SEQ ID NO: 704449 - DNA, 22 bp, Artificial Sequence
  chemically synthesized
ggttgtcacagctaagggaggg

SEQ ID NO: 704450 - DNA, 22 bp, Artificial Sequence
  chemically synthesized
gttgtcacagctaagggagggg

SEQ ID NO: 704451 - DNA, 22 bp, Artificial Sequence
  chemically synthesized
catgccagtagcactcccctcc

SEQ ID NO: 704452 - DNA, 22 bp, Artificial Sequence
  chemically synthesized
tcacagctaagggaggggagtg

SEQ ID NO: 704453 - DNA, 22 bp, Artificial Sequence
  chemically synthesized
actacatgccagtagcactccc

SEQ ID NO: 704454 - DNA, 22 bp, Artificial Sequence
  chemically synthesized
ctcactacatgccagtagcact

SEQ ID NO: 704455 - DNA, 22 bp, Artificial Sequence
  chemically synthesized
tactcactacatgccagtagca

SEQ ID NO: 704456 - DNA, 22 bp, Artificial Sequence
  chemically synthesized
agggaggggagtgctactggca

SEQ ID NO: 704457 - DNA, 22 bp, Artificial Sequence
  chemically synthesized
gcctctactcactacatgccag

SEQ ID NO: 704458 - DNA, 22 bp, Artificial Sequence
  chemically synthesized
tggcctctactcactacatgcc

SEQ ID NO: 704459 - DNA, 22 bp, Artificial Sequence
  chemically synthesized
tctctggcctctactcactaca

SEQ ID NO: 704460 - DNA, 22 bp, Artificial Sequence
  chemically synthesized
ctggcatgtagtgagtagaggc

SEQ ID NO: 704461 - DNA, 22 bp, Artificial Sequence
  chemically synthesized
tgcattatctctggcctctact

SEQ ID NO: 704462 - DNA, 22 bp, Artificial Sequence
  chemically synthesized
gcatgtagtgagtagaggccag

SEQ ID NO: 704463 - DNA, 22 bp, Artificial Sequence
  chemically synthesized
tcctgtgcattatctctggcct

SEQ ID NO: 704464 - DNA, 22 bp, Artificial Sequence
  chemically synthesized
ggggctgtcctgtgcattatct

SEQ ID NO: 704465 - DNA, 22 bp, Artificial Sequence
  chemically synthesized
ttgggggctgtcctgtgcatta

SEQ ID NO: 704466 - DNA, 22 bp, Artificial Sequence
  chemically synthesized
tgggcaaaaattattgggggct

SEQ ID NO: 704467 - DNA, 22 bp, Artificial Sequence
  chemically synthesized
tgtgggcaaaaattattggggg

SEQ ID NO: 704468 - DNA, 22 bp, Artificial Sequence
  chemically synthesized
ttgcccacagaggtgtgatccc

SEQ ID NO: 704469 - DNA, 22 bp, Artificial Sequence
  chemically synthesized
tgcccacagaggtgtgatccca

SEQ ID NO: 704470 - DNA, 22 bp, Artificial Sequence
  chemically synthesized
gcccacagaggtgtgatcccac

SEQ ID NO: 704471 - DNA, 22 bp, Artificial Sequence
  chemically synthesized
cccacagaggtgtgatcccacc

SEQ ID NO: 704472 - DNA, 22 bp, Artificial Sequence
  chemically synthesized
cgcaacagaaatggtgggatca

SEQ ID NO: 704473 - DNA, 22 bp, Artificial Sequence
  chemically synthesized
gcgcaacagaaatggtgggatc

SEQ ID NO: 704474 - DNA, 22 bp, Artificial Sequence
  chemically synthesized
tgcgcaacagaaatggtgggat

SEQ ID NO: 704475 - DNA, 22 bp, Artificial Sequence
  chemically synthesized
gaatacaaagctttgcgcaaca

SEQ ID NO: 704476 - DNA, 22 bp, Artificial Sequence
  chemically synthesized
tcctagaatacaaagctttgcg

SEQ ID NO: 704477 - DNA, 22 bp, Artificial Sequence
  chemically synthesized
ctgttgcgcaaagctttgtatt

SEQ ID NO: 704478 - DNA, 22 bp, Artificial Sequence
  chemically synthesized
tgttgcgcaaagctttgtattc

SEQ ID NO: 704479 - DNA, 22 bp, Artificial Sequence
  chemically synthesized
tcatctgtcctagaatacaaag

SEQ ID NO: 704480 - DNA, 22 bp, Artificial Sequence
  chemically synthesized
gtcatctgtcctagaatacaaa

SEQ ID NO: 704481 - DNA, 22 bp, Artificial Sequence
  chemically synthesized
ttgcgcaaagctttgtattcta

SEQ ID NO: 704482 - DNA, 22 bp, Artificial Sequence
  chemically synthesized
tgtcatctgtcctagaatacaa

SEQ ID NO: 704483 - DNA, 22 bp, Artificial Sequence
  chemically synthesized
cgcaaagctttgtattctagga

SEQ ID NO: 704484 - DNA, 22 bp, Artificial Sequence
  chemically synthesized
gggtagcattttgtcatctgtc

SEQ ID NO: 704485 - DNA, 22 bp, Artificial Sequence
  chemically synthesized
tgtattctaggacagatgacaa

SEQ ID NO: 704486 - DNA, 22 bp, Artificial Sequence
  chemically synthesized
gtattctaggacagatgacaaa

SEQ ID NO: 704487 - DNA, 22 bp, Artificial Sequence
  chemically synthesized
tattctaggacagatgacaaaa

SEQ ID NO: 704488 - DNA, 22 bp, Artificial Sequence
  chemically synthesized
gcctggggtagcattttgtcat

SEQ ID NO: 704489 - DNA, 22 bp, Artificial Sequence
  chemically synthesized
ggcctggggtagcattttgtca

SEQ ID NO: 704490 - DNA, 22 bp, Artificial Sequence
  chemically synthesized
taggacagatgacaaaatgcta

SEQ ID NO: 704491 - DNA, 22 bp, Artificial Sequence
  chemically synthesized
ggacagatgacaaaatgctacc

SEQ ID NO: 704492 - DNA, 22 bp, Artificial Sequence
  chemically synthesized
tgagtttggcctggggtagcat

SEQ ID NO: 704493 - DNA, 22 bp, Artificial Sequence
  chemically synthesized
gtgagtttggcctggggtagca

SEQ ID NO: 704494 - DNA, 22 bp, Artificial Sequence
  chemically synthesized
ccccaggccaaactcacaaatg

SEQ ID NO: 704495 - DNA, 22 bp, Artificial Sequence
  chemically synthesized
agaaaatgaaggcatttgtgag

SEQ ID NO: 704496 - DNA, 22 bp, Artificial Sequence
  chemically synthesized
ctcagaaaatgaaggcatttgt

SEQ ID NO: 704497 - DNA, 22 bp, Artificial Sequence
  chemically synthesized
cactactcagaaaatgaaggca

SEQ ID NO: 704498 - DNA, 22 bp, Artificial Sequence
  chemically synthesized
acactactcagaaaatgaaggc

SEQ ID NO: 704499 - DNA, 22 bp, Artificial Sequence
  chemically synthesized
tacactactcagaaaatgaagg

SEQ ID NO: 704500 - DNA, 22 bp, Artificial Sequence
  chemically synthesized
ttacactactcagaaaatgaag

SEQ ID NO: 704501 - DNA, 22 bp, Artificial Sequence
  chemically synthesized
acaaatgccttcattttctgag

SEQ ID NO: 704502 - DNA, 22 bp, Artificial Sequence
  chemically synthesized
aaaagtgtatttttacactact

SEQ ID NO: 704503 - DNA, 22 bp, Artificial Sequence
  chemically synthesized
tgaaaagtgtatttttacacta

SEQ ID NO: 704504 - DNA, 22 bp, Artificial Sequence
  chemically synthesized
cattttctgagtagtgtaaaaa

SEQ ID NO: 704505 - DNA, 22 bp, Artificial Sequence
  chemically synthesized
attttctgagtagtgtaaaaat

SEQ ID NO: 704506 - DNA, 22 bp, Artificial Sequence
  chemically synthesized
gctctgaaaagtgtatttttac

SEQ ID NO: 704507 - DNA, 22 bp, Artificial Sequence
  chemically synthesized
tctgagtagtgtaaaaatacac

SEQ ID NO: 704508 - DNA, 22 bp, Artificial Sequence
  chemically synthesized
ctgagtagtgtaaaaatacact

SEQ ID NO: 704509 - DNA, 22 bp, Artificial Sequence
  chemically synthesized
tgagtagtgtaaaaatacactt

SEQ ID NO: 704510 - DNA, 22 bp, Artificial Sequence
  chemically synthesized
agtagtgtaaaaatacactttt

SEQ ID NO: 704511 - DNA, 22 bp, Artificial Sequence
  chemically synthesized
gtggaatgctggctctgaaaag

SEQ ID NO: 704512 - DNA, 22 bp, Artificial Sequence
  chemically synthesized
gggccagataattagtggaatg

SEQ ID NO: 704513 - DNA, 22 bp, Artificial Sequence
  chemically synthesized
ttcagagccagcattccactaa

SEQ ID NO: 704514 - DNA, 22 bp, Artificial Sequence
  chemically synthesized
ggggccagataattagtggaat

SEQ ID NO: 704515 - DNA, 22 bp, Artificial Sequence
  chemically synthesized
tcagagccagcattccactaat

SEQ ID NO: 704516 - DNA, 22 bp, Artificial Sequence
  chemically synthesized
cagagccagcattccactaatt

SEQ ID NO: 704517 - DNA, 22 bp, Artificial Sequence
  chemically synthesized
agagccagcattccactaatta

SEQ ID NO: 704518 - DNA, 22 bp, Artificial Sequence
  chemically synthesized
gcatttggggccagataattag

SEQ ID NO: 704519 - DNA, 22 bp, Artificial Sequence
  chemically synthesized
ttggcatttggggccagataat

SEQ ID NO: 704520 - DNA, 22 bp, Artificial Sequence
  chemically synthesized
cactaattatctggccccaaat

SEQ ID NO: 704521 - DNA, 22 bp, Artificial Sequence
  chemically synthesized
ggcactattggcatttggggcc

SEQ ID NO: 704522 - DNA, 22 bp, Artificial Sequence
  chemically synthesized
attatctggccccaaatgccaa

SEQ ID NO: 704523 - DNA, 22 bp, Artificial Sequence
  chemically synthesized
acctgggcactattggcatttg

SEQ ID NO: 704524 - DNA, 22 bp, Artificial Sequence
  chemically synthesized
gacctgggcactattggcattt

SEQ ID NO: 704525 - DNA, 22 bp, Artificial Sequence
  chemically synthesized
ttgacctgggcactattggcat

SEQ ID NO: 704526 - DNA, 22 bp, Artificial Sequence
  chemically synthesized
tctggccccaaatgccaatagt

SEQ ID NO: 704527 - DNA, 22 bp, Artificial Sequence
  chemically synthesized
cttgacctgggcactattggca

SEQ ID NO: 704528 - DNA, 22 bp, Artificial Sequence
  chemically synthesized
tcttgacctgggcactattggc

SEQ ID NO: 704529 - DNA, 22 bp, Artificial Sequence
  chemically synthesized
gccccaaatgccaatagtgccc

SEQ ID NO: 704530 - DNA, 22 bp, Artificial Sequence
  chemically synthesized
ggctttcttgacctgggcacta

SEQ ID NO: 704531 - DNA, 22 bp, Artificial Sequence
  chemically synthesized
taaactaggctttcttgacctg

SEQ ID NO: 704532 - DNA, 22 bp, Artificial Sequence
  chemically synthesized
acaggccacaggccagactgta

SEQ ID NO: 704533 - DNA, 22 bp, Artificial Sequence
  chemically synthesized
gtttacagtctggcctgtggcc

SEQ ID NO: 704534 - DNA, 22 bp, Artificial Sequence
  chemically synthesized
acagtctggcctgtggcctgtg

SEQ ID NO: 704535 - DNA, 22 bp, Artificial Sequence
  chemically synthesized
cagtctggcctgtggcctgtga

SEQ ID NO: 704536 - DNA, 22 bp, Artificial Sequence
  chemically synthesized
agggtaatgccatctcacaggc

SEQ ID NO: 704537 - DNA, 22 bp, Artificial Sequence
  chemically synthesized
gcctgtggcctgtgagatggca

SEQ ID NO: 704538 - DNA, 22 bp, Artificial Sequence
  chemically synthesized
tccatctaagggtaatgccatc

SEQ ID NO: 704539 - DNA, 22 bp, Artificial Sequence
  chemically synthesized
tggcctgtgagatggcattacc

SEQ ID NO: 704540 - DNA, 22 bp, Artificial Sequence
  chemically synthesized
ttatccatctaagggtaatgcc

SEQ ID NO: 704541 - DNA, 22 bp, Artificial Sequence
  chemically synthesized
attatccatctaagggtaatgc

SEQ ID NO: 704542 - DNA, 22 bp, Artificial Sequence
  chemically synthesized
tttattatccatctaagggtaa

SEQ ID NO: 704543 - DNA, 22 bp, Artificial Sequence
  chemically synthesized
tgagatggcattacccttagat

SEQ ID NO: 704544 - DNA, 22 bp, Artificial Sequence
  chemically synthesized
gttatttattatccatctaagg

SEQ ID NO: 704545 - DNA, 22 bp, Artificial Sequence
  chemically synthesized
gattagttatttattatccatc

SEQ ID NO: 704546 - DNA, 22 bp, Artificial Sequence
  chemically synthesized
attggattagttatttattatc

SEQ ID NO: 704547 - DNA, 22 bp, Artificial Sequence
  chemically synthesized
cccttagatggataataaataa

SEQ ID NO: 704548 - DNA, 22 bp, Artificial Sequence
  chemically synthesized
agatggataataaataactaat

SEQ ID NO: 704549 - DNA, 22 bp, Artificial Sequence
  chemically synthesized
gatggataataaataactaatc

SEQ ID NO: 704550 - DNA, 22 bp, Artificial Sequence
  chemically synthesized
caagacaaagcatctgattgga

SEQ ID NO: 704551 - DNA, 22 bp, Artificial Sequence
  chemically synthesized
tccaagacaaagcatctgattg

SEQ ID NO: 704552 - DNA, 22 bp, Artificial Sequence
  chemically synthesized
aagctctccaagacaaagcatc

SEQ ID NO: 704553 - DNA, 22 bp, Artificial Sequence
  chemically synthesized
atccaatcagatgctttgtctt

SEQ ID NO: 704554 - DNA, 22 bp, Artificial Sequence
  chemically synthesized
cattcaagctctccaagacaaa

SEQ ID NO: 704555 - DNA, 22 bp, Artificial Sequence
  chemically synthesized
tgtattacattcaagctctcca

SEQ ID NO: 704556 - DNA, 22 bp, Artificial Sequence
  chemically synthesized
tgtgtattacattcaagctctc

SEQ ID NO: 704557 - DNA, 22 bp, Artificial Sequence
  chemically synthesized
tctctgtgtattacattcaagc

SEQ ID NO: 704558 - DNA, 22 bp, Artificial Sequence
  chemically synthesized
tgtcttggagagcttgaatgta

SEQ ID NO: 704559 - DNA, 22 bp, Artificial Sequence
  chemically synthesized
atctctgtgtattacattcaag

SEQ ID NO: 704560 - DNA, 22 bp, Artificial Sequence
  chemically synthesized
gtcttggagagcttgaatgtaa

SEQ ID NO: 704561 - DNA, 22 bp, Artificial Sequence
  chemically synthesized
tcttggagagcttgaatgtaat

SEQ ID NO: 704562 - DNA, 22 bp, Artificial Sequence
  chemically synthesized
tttatctctgtgtattacattc

SEQ ID NO: 704563 - DNA, 22 bp, Artificial Sequence
  chemically synthesized
tgtttatctctgtgtattacat

SEQ ID NO: 704564 - DNA, 22 bp, Artificial Sequence
  chemically synthesized
ggagagcttgaatgtaatacac

SEQ ID NO: 704565 - DNA, 22 bp, Artificial Sequence
  chemically synthesized
gagagcttgaatgtaatacaca

SEQ ID NO: 704566 - DNA, 22 bp, Artificial Sequence
  chemically synthesized
tcatctctgtttatctctgtgt

SEQ ID NO: 704567 - DNA, 22 bp, Artificial Sequence
  chemically synthesized
gaatgtaatacacagagataaa

SEQ ID NO: 704568 - DNA, 22 bp, Artificial Sequence
  chemically synthesized
aatgtaatacacagagataaac

SEQ ID NO: 704569 - DNA, 22 bp, Artificial Sequence
  chemically synthesized
cccacccatctgtcatctctgt

SEQ ID NO: 704570 - DNA, 22 bp, Artificial Sequence
  chemically synthesized
ccccacccatctgtcatctctg

SEQ ID NO: 704571 - DNA, 22 bp, Artificial Sequence
  chemically synthesized
aacttccccacccatctgtcat

SEQ ID NO: 704572 - DNA, 22 bp, Artificial Sequence
  chemically synthesized
aaacttccccacccatctgtca

SEQ ID NO: 704573 - DNA, 22 bp, Artificial Sequence
  chemically synthesized
taaacttccccacccatctgtc

SEQ ID NO: 704574 - DNA, 22 bp, Artificial Sequence
  chemically synthesized
ttaaacttccccacccatctgt

SEQ ID NO: 704575 - DNA, 22 bp, Artificial Sequence
  chemically synthesized
tttaaacttccccacccatctg

SEQ ID NO: 704576 - DNA, 22 bp, Artificial Sequence
  chemically synthesized
tccgactttttaaacttcccca

SEQ ID NO: 704577 - DNA, 22 bp, Artificial Sequence
  chemically synthesized
ttatccgactttttaaacttcc

SEQ ID NO: 704578 - DNA, 22 bp, Artificial Sequence
  chemically synthesized
gttatccgactttttaaacttc

SEQ ID NO: 704579 - DNA, 22 bp, Artificial Sequence
  chemically synthesized
tgttatccgactttttaaactt

SEQ ID NO: 704580 - DNA, 22 bp, Artificial Sequence
  chemically synthesized
ctttgttatccgactttttaaa

SEQ ID NO: 704581 - DNA, 22 bp, Artificial Sequence
  chemically synthesized
cctttgttatccgactttttaa

SEQ ID NO: 704582 - DNA, 22 bp, Artificial Sequence
  chemically synthesized
ttcctttgttatccgacttttt

SEQ ID NO: 704583 - DNA, 22 bp, Artificial Sequence
  chemically synthesized
cttcctttgttatccgactttt

SEQ ID NO: 704584 - DNA, 22 bp, Artificial Sequence
  chemically synthesized
tcttcctttgttatccgacttt

SEQ ID NO: 704585 - DNA, 22 bp, Artificial Sequence
  chemically synthesized
cattttcttcctttgttatccg

SEQ ID NO: 704586 - DNA, 22 bp, Artificial Sequence
  chemically synthesized
ccattttcttcctttgttatcc

SEQ ID NO: 704587 - DNA, 22 bp, Artificial Sequence
  chemically synthesized
aaaaagtcggataacaaaggaa

SEQ ID NO: 704588 - DNA, 22 bp, Artificial Sequence
  chemically synthesized
aaaagtcggataacaaaggaag

SEQ ID NO: 704589 - DNA, 22 bp, Artificial Sequence
  chemically synthesized
tgacttccattttcttcctttg

SEQ ID NO: 704590 - DNA, 22 bp, Artificial Sequence
  chemically synthesized
atgacttccattttcttccttt

SEQ ID NO: 704591 - DNA, 22 bp, Artificial Sequence
  chemically synthesized
ttatgacttccattttcttcct

SEQ ID NO: 704592 - DNA, 22 bp, Artificial Sequence
  chemically synthesized
cttatgacttccattttcttcc

SEQ ID NO: 704593 - DNA, 22 bp, Artificial Sequence
  chemically synthesized
tcttatgacttccattttcttc

SEQ ID NO: 704594 - DNA, 22 bp, Artificial Sequence
  chemically synthesized
ctttcttatgacttccattttc

SEQ ID NO: 704595 - DNA, 22 bp, Artificial Sequence
  chemically synthesized
tactttcttatgacttccattt

SEQ ID NO: 704596 - DNA, 22 bp, Artificial Sequence
  chemically synthesized
ctactttcttatgacttccatt

SEQ ID NO: 704597 - DNA, 22 bp, Artificial Sequence
  chemically synthesized
tagtttctactttcttatgact

SEQ ID NO: 704598 - DNA, 22 bp, Artificial Sequence
  chemically synthesized
atagtttctactttcttatgac

SEQ ID NO: 704599 - DNA, 22 bp, Artificial Sequence
  chemically synthesized
cttatagtttctactttcttat

SEQ ID NO: 704600 - DNA, 22 bp, Artificial Sequence
  chemically synthesized
tacttatagtttctactttctt

SEQ ID NO: 704601 - DNA, 22 bp, Artificial Sequence
  chemically synthesized
ctacttatagtttctactttct

SEQ ID NO: 704602 - DNA, 22 bp, Artificial Sequence
  chemically synthesized
acaccttctacttatagtttct

SEQ ID NO: 704603 - DNA, 22 bp, Artificial Sequence
  chemically synthesized
cacctaacaccttctacttata

SEQ ID NO: 704604 - DNA, 22 bp, Artificial Sequence
  chemically synthesized
tccacctaacaccttctactta

SEQ ID NO: 704605 - DNA, 22 bp, Artificial Sequence
  chemically synthesized
tctccacctaacaccttctact

SEQ ID NO: 704606 - DNA, 22 bp, Artificial Sequence
  chemically synthesized
ctctccacctaacaccttctac

SEQ ID NO: 704607 - DNA, 22 bp, Artificial Sequence
  chemically synthesized
ttctctccacctaacaccttct

SEQ ID NO: 704608 - DNA, 22 bp, Artificial Sequence
  chemically synthesized
tcttctctccacctaacacctt

SEQ ID NO: 704609 - DNA, 22 bp, Artificial Sequence
  chemically synthesized
tctcttctctccacctaacacc

SEQ ID NO: 704610 - DNA, 22 bp, Artificial Sequence
  chemically synthesized
ctctcttctctccacctaacac

SEQ ID NO: 704611 - DNA, 22 bp, Artificial Sequence
  chemically synthesized
taagtagaaggtgttaggtgga

SEQ ID NO: 704612 - DNA, 22 bp, Artificial Sequence
  chemically synthesized
cagtatcatatcttctctcttc

SEQ ID NO: 704613 - DNA, 22 bp, Artificial Sequence
  chemically synthesized
ttacagtatcatatcttctctc

SEQ ID NO: 704614 - DNA, 22 bp, Artificial Sequence
  chemically synthesized
ggtggagagaagagagaagata

SEQ ID NO: 704615 - DNA, 22 bp, Artificial Sequence
  chemically synthesized
agactattacagtatcatatct

SEQ ID NO: 704616 - DNA, 22 bp, Artificial Sequence
  chemically synthesized
cagactattacagtatcatatc

SEQ ID NO: 704617 - DNA, 22 bp, Artificial Sequence
  chemically synthesized
ccatagacttcagactattaca

SEQ ID NO: 704618 - DNA, 22 bp, Artificial Sequence
  chemically synthesized
ctgccatagacttcagactatt

SEQ ID NO: 704619 - DNA, 22 bp, Artificial Sequence
  chemically synthesized
gctgccatagacttcagactat

SEQ ID NO: 704620 - DNA, 22 bp, Artificial Sequence
  chemically synthesized
taatagtctgaagtctatggca

SEQ ID NO: 704621 - DNA, 22 bp, Artificial Sequence
  chemically synthesized
tatatgcatttgctgccataga

SEQ ID NO: 704622 - DNA, 22 bp, Artificial Sequence
  chemically synthesized
tgtatatgcatttgctgccata

SEQ ID NO: 704623 - DNA, 22 bp, Artificial Sequence
  chemically synthesized
ctgtatatgcatttgctgccat

SEQ ID NO: 704624 - DNA, 22 bp, Artificial Sequence
  chemically synthesized
tctgtatatgcatttgctgcca

SEQ ID NO: 704625 - DNA, 22 bp, Artificial Sequence
  chemically synthesized
tttctgtatatgcatttgctgc

SEQ ID NO: 704626 - DNA, 22 bp, Artificial Sequence
  chemically synthesized
ctttctgtatatgcatttgctg

SEQ ID NO: 704627 - DNA, 22 bp, Artificial Sequence
  chemically synthesized
aagtctatggcagcaaatgcat

SEQ ID NO: 704628 - DNA, 22 bp, Artificial Sequence
  chemically synthesized
cttctttctgtatatgcatttg

SEQ ID NO: 704629 - DNA, 22 bp, Artificial Sequence
  chemically synthesized
gcttctttctgtatatgcattt

SEQ ID NO: 704630 - DNA, 22 bp, Artificial Sequence
  chemically synthesized
tggcagcaaatgcatatacaga

SEQ ID NO: 704631 - DNA, 22 bp, Artificial Sequence
  chemically synthesized
cgtggtgtctgttgttccatgt

SEQ ID NO: 704632 - DNA, 22 bp, Artificial Sequence
  chemically synthesized
gtggtgtctgttgttccatgtt

SEQ ID NO: 704633 - DNA, 22 bp, Artificial Sequence
  chemically synthesized
ttgttccatgttattcttttct

SEQ ID NO: 704634 - DNA, 22 bp, Artificial Sequence
  chemically synthesized
ttccatgttattcttttctttc

SEQ ID NO: 704635 - DNA, 22 bp, Artificial Sequence
  chemically synthesized
catgttattcttttctttcttt

SEQ ID NO: 704636 - DNA, 22 bp, Artificial Sequence
  chemically synthesized
aaaaaaaaaaaaaaagaaagaa

SEQ ID NO: 704637 - DNA, 22 bp, Artificial Sequence
  chemically synthesized
ttcttttctttctttctttttt

SEQ ID NO: 704638 - DNA, 22 bp, Artificial Sequence
  chemically synthesized
ttttctttctttcttttttttt

SEQ ID NO: 704639 - DNA, 22 bp, Artificial Sequence
  chemically synthesized
catctcaaaaaaaaaaaaaaag

SEQ ID NO: 704640 - DNA, 22 bp, Artificial Sequence
  chemically synthesized
ttctttctttcttttttttttt

SEQ ID NO: 704641 - DNA, 22 bp, Artificial Sequence
  chemically synthesized
tctttctttctttttttttttt

SEQ ID NO: 704642 - DNA, 22 bp, Artificial Sequence
  chemically synthesized
ctttctttcttttttttttttt

SEQ ID NO: 704643 - DNA, 22 bp, Artificial Sequence
  chemically synthesized
tttctttctttttttttttttt

SEQ ID NO: 704644 - DNA, 22 bp, Artificial Sequence
  chemically synthesized
tctttctttttttttttttttg

SEQ ID NO: 704645 - DNA, 22 bp, Artificial Sequence
  chemically synthesized
ctttctttttttttttttttga

SEQ ID NO: 704646 - DNA, 22 bp, Artificial Sequence
  chemically synthesized
tttctttttttttttttttgag

SEQ ID NO: 704647 - DNA, 22 bp, Artificial Sequence
  chemically synthesized
tctttttttttttttttgagat

SEQ ID NO: 704648 - DNA, 22 bp, Artificial Sequence
  chemically synthesized
ctttttttttttttttgagatg

SEQ ID NO: 704649 - DNA, 22 bp, Artificial Sequence
  chemically synthesized
tttttttttttttttgagatgg

SEQ ID NO: 704650 - DNA, 22 bp, Artificial Sequence
  chemically synthesized
tttttttttttttgagatggag

SEQ ID NO: 704651 - DNA, 22 bp, Artificial Sequence
  chemically synthesized
ttttttttttttgagatggagt

SEQ ID NO: 704652 - DNA, 22 bp, Artificial Sequence
  chemically synthesized
tttttttttttgagatggagtc

SEQ ID NO: 704653 - DNA, 22 bp, Artificial Sequence
  chemically synthesized
ttttttttttgagatggagtct

SEQ ID NO: 704654 - DNA, 22 bp, Artificial Sequence
  chemically synthesized
ggcaacagggcgagactccatc

SEQ ID NO: 704655 - DNA, 22 bp, Artificial Sequence
  chemically synthesized
tttttttttgagatggagtctc

SEQ ID NO: 704656 - DNA, 22 bp, Artificial Sequence
  chemically synthesized
ttttttttgagatggagtctcg

SEQ ID NO: 704657 - DNA, 22 bp, Artificial Sequence
  chemically synthesized
tttttttgagatggagtctcgc

SEQ ID NO: 704658 - DNA, 22 bp, Artificial Sequence
  chemically synthesized
ttttttgagatggagtctcgcc

SEQ ID NO: 704659 - DNA, 22 bp, Artificial Sequence
  chemically synthesized
tttttgagatggagtctcgccc

SEQ ID NO: 704660 - DNA, 22 bp, Artificial Sequence
  chemically synthesized
ttttgagatggagtctcgccct

SEQ ID NO: 704661 - DNA, 22 bp, Artificial Sequence
  chemically synthesized
tttgagatggagtctcgccctg

SEQ ID NO: 704662 - DNA, 22 bp, Artificial Sequence
  chemically synthesized
ttgagatggagtctcgccctgt

SEQ ID NO: 704663 - DNA, 22 bp, Artificial Sequence
  chemically synthesized
tgagatggagtctcgccctgtt

SEQ ID NO: 704664 - DNA, 22 bp, Artificial Sequence
  chemically synthesized
gagatggagtctcgccctgttg

SEQ ID NO: 704665 - DNA, 22 bp, Artificial Sequence
  chemically synthesized
agatggagtctcgccctgttgc

SEQ ID NO: 704666 - DNA, 22 bp, Artificial Sequence
  chemically synthesized
cacaccagcctaggcaacaggg

SEQ ID NO: 704667 - DNA, 22 bp, Artificial Sequence
  chemically synthesized
gccctgttgcctaggctggtgt

SEQ ID NO: 704668 - DNA, 22 bp, Artificial Sequence
  chemically synthesized
ttgcctaggctggtgtgcaatg

SEQ ID NO: 704669 - DNA, 22 bp, Artificial Sequence
  chemically synthesized
cctaggctggtgtgcaatggtg

SEQ ID NO: 704670 - DNA, 22 bp, Artificial Sequence
  chemically synthesized
ggctggtgtgcaatggtgtgat

SEQ ID NO: 704671 - DNA, 22 bp, Artificial Sequence
  chemically synthesized
cagtgagccaagatcacaccat

SEQ ID NO: 704672 - DNA, 22 bp, Artificial Sequence
  chemically synthesized
gtgtgcaatggtgtgatcttgg

SEQ ID NO: 704673 - DNA, 22 bp, Artificial Sequence
  chemically synthesized
aacccaggagacggaggttgca

SEQ ID NO: 704674 - DNA, 22 bp, Artificial Sequence
  chemically synthesized
gaacccaggagacggaggttgc

SEQ ID NO: 704675 - DNA, 22 bp, Artificial Sequence
  chemically synthesized
ggctcactgcaacctccgtctc

SEQ ID NO: 704676 - DNA, 22 bp, Artificial Sequence
  chemically synthesized
gctcactgcaacctccgtctcc

SEQ ID NO: 704677 - DNA, 22 bp, Artificial Sequence
  chemically synthesized
actgcaacctccgtctcctggg

SEQ ID NO: 704678 - DNA, 22 bp, Artificial Sequence
  chemically synthesized
caacctccgtctcctgggttca

SEQ ID NO: 704679 - DNA, 22 bp, Artificial Sequence
  chemically synthesized
aggcaggagaatcgcttgaacc

SEQ ID NO: 704680 - DNA, 22 bp, Artificial Sequence
  chemically synthesized
cgtctcctgggttcaagcgatt

SEQ ID NO: 704681 - DNA, 22 bp, Artificial Sequence
  chemically synthesized
ctgggttcaagcgattctcctg

SEQ ID NO: 704682 - DNA, 22 bp, Artificial Sequence
  chemically synthesized
aggaggctgaggcaggagaatc

SEQ ID NO: 704683 - DNA, 22 bp, Artificial Sequence
  chemically synthesized
ggttcaagcgattctcctgcct

SEQ ID NO: 704684 - DNA, 22 bp, Artificial Sequence
  chemically synthesized
ctcaggaggctgaggcaggaga

SEQ ID NO: 704685 - DNA, 22 bp, Artificial Sequence
  chemically synthesized
aagcgattctcctgcctcagcc

SEQ ID NO: 704686 - DNA, 22 bp, Artificial Sequence
  chemically synthesized
taatcccagctactcaggaggc

SEQ ID NO: 704687 - DNA, 22 bp, Artificial Sequence
  chemically synthesized
tcctgcctcagcctcctgagta

SEQ ID NO: 704688 - DNA, 22 bp, Artificial Sequence
  chemically synthesized
ctgcctcagcctcctgagtagc

SEQ ID NO: 704689 - DNA, 22 bp, Artificial Sequence
  chemically synthesized
cctcagcctcctgagtagctgg

SEQ ID NO: 704690 - DNA, 22 bp, Artificial Sequence
  chemically synthesized
agcctcctgagtagctgggatt

SEQ ID NO: 704691 - DNA, 22 bp, Artificial Sequence
  chemically synthesized
ctgagtagctgggattacaggt

SEQ ID NO: 704692 - DNA, 22 bp, Artificial Sequence
  chemically synthesized
agtagctgggattacaggtgtg

SEQ ID NO: 704693 - DNA, 22 bp, Artificial Sequence
  chemically synthesized
gccaggcatggtggcgcacacc

SEQ ID NO: 704694 - DNA, 22 bp, Artificial Sequence
  chemically synthesized
ggattacaggtgtgcgccacca

SEQ ID NO: 704695 - DNA, 22 bp, Artificial Sequence
  chemically synthesized
caggtgtgcgccaccatgcctg

SEQ ID NO: 704696 - DNA, 22 bp, Artificial Sequence
  chemically synthesized
aagacacaaaaaattagccagg

SEQ ID NO: 704697 - DNA, 22 bp, Artificial Sequence
  chemically synthesized
ctaaagacacaaaaaattagcc

SEQ ID NO: 704698 - DNA, 22 bp, Artificial Sequence
  chemically synthesized
tactaaagacacaaaaaattag

SEQ ID NO: 704699 - DNA, 22 bp, Artificial Sequence
  chemically synthesized
tctctactaaagacacaaaaaa

SEQ ID NO: 704700 - DNA, 22 bp, Artificial Sequence
  chemically synthesized
gctaattttttgtgtctttagt

SEQ ID NO: 704701 - DNA, 22 bp, Artificial Sequence
  chemically synthesized
attttttgtgtctttagtagag

SEQ ID NO: 704702 - DNA, 22 bp, Artificial Sequence
  chemically synthesized
tttgtgtctttagtagagacag

SEQ ID NO: 704703 - DNA, 22 bp, Artificial Sequence
  chemically synthesized
ttgtgtctttagtagagacagg

SEQ ID NO: 704704 - DNA, 22 bp, Artificial Sequence
  chemically synthesized
tgtgtctttagtagagacaggg

SEQ ID NO: 704705 - DNA, 22 bp, Artificial Sequence
  chemically synthesized
gtgtctttagtagagacagggt

SEQ ID NO: 704706 - DNA, 22 bp, Artificial Sequence
  chemically synthesized
tgtctttagtagagacagggtt

SEQ ID NO: 704707 - DNA, 22 bp, Artificial Sequence
  chemically synthesized
gccaacatggtgaaaccctgtc

SEQ ID NO: 704708 - DNA, 22 bp, Artificial Sequence
  chemically synthesized
tagtagagacagggtttcacca

SEQ ID NO: 704709 - DNA, 22 bp, Artificial Sequence
  chemically synthesized
agtagagacagggtttcaccat

SEQ ID NO: 704710 - DNA, 22 bp, Artificial Sequence
  chemically synthesized
gtagagacagggtttcaccatg

SEQ ID NO: 704711 - DNA, 22 bp, Artificial Sequence
  chemically synthesized
gagaccaacctggccaacatgg

SEQ ID NO: 704712 - DNA, 22 bp, Artificial Sequence
  chemically synthesized
caccatgttggccaggttggtc

SEQ ID NO: 704713 - DNA, 22 bp, Artificial Sequence
  chemically synthesized
accatgttggccaggttggtct

SEQ ID NO: 704714 - DNA, 22 bp, Artificial Sequence
  chemically synthesized
gccaggttggtctccaactcct

SEQ ID NO: 704715 - DNA, 22 bp, Artificial Sequence
  chemically synthesized
gtctccaactcctgacctcgtg

SEQ ID NO: 704716 - DNA, 22 bp, Artificial Sequence
  chemically synthesized
aggcgggcggatcacgaggtca

SEQ ID NO: 704717 - DNA, 22 bp, Artificial Sequence
  chemically synthesized
caactcctgacctcgtgatccg

SEQ ID NO: 704718 - DNA, 22 bp, Artificial Sequence
  chemically synthesized
ggaggctgaggcgggcggatca

SEQ ID NO: 704719 - DNA, 22 bp, Artificial Sequence
  chemically synthesized
gggaggctgaggcgggcggatc

SEQ ID NO: 704720 - DNA, 22 bp, Artificial Sequence
  chemically synthesized
tgggaggctgaggcgggcggat

SEQ ID NO: 704721 - DNA, 22 bp, Artificial Sequence
  chemically synthesized
ctgacctcgtgatccgcccgcc

SEQ ID NO: 704722 - DNA, 22 bp, Artificial Sequence
  chemically synthesized
acctcgtgatccgcccgcctca

SEQ ID NO: 704723 - DNA, 22 bp, Artificial Sequence
  chemically synthesized
gtgatccgcccgcctcagcctc

SEQ ID NO: 704724 - DNA, 22 bp, Artificial Sequence
  chemically synthesized
taatcccagcactttgggaggc

SEQ ID NO: 704725 - DNA, 22 bp, Artificial Sequence
  chemically synthesized
acacctataatcccagcacttt

SEQ ID NO: 704726 - DNA, 22 bp, Artificial Sequence
  chemically synthesized
agcctcccaaagtgctgggatt

SEQ ID NO: 704727 - DNA, 22 bp, Artificial Sequence
  chemically synthesized
ccaaagtgctgggattataggt

SEQ ID NO: 704728 - DNA, 22 bp, Artificial Sequence
  chemically synthesized
ggattataggtgtgagccaccg

SEQ ID NO: 704729 - DNA, 22 bp, Artificial Sequence
  chemically synthesized
taggtgtgagccaccgcgcccg

SEQ ID NO: 704730 - DNA, 22 bp, Artificial Sequence
  chemically synthesized
aggatacagagaggcatgaaga

SEQ ID NO: 704731 - DNA, 22 bp, Artificial Sequence
  chemically synthesized
caggatacagagaggcatgaag

SEQ ID NO: 704732 - DNA, 22 bp, Artificial Sequence
  chemically synthesized
tcaggatacagagaggcatgaa

SEQ ID NO: 704733 - DNA, 22 bp, Artificial Sequence
  chemically synthesized
ttcttcatgcctctctgtatcc

SEQ ID NO: 704734 - DNA, 22 bp, Artificial Sequence
  chemically synthesized
ttcatgcctctctgtatcctga

SEQ ID NO: 704735 - DNA, 22 bp, Artificial Sequence
  chemically synthesized
catgcctctctgtatcctgaaa

SEQ ID NO: 704736 - DNA, 22 bp, Artificial Sequence
  chemically synthesized
atgcctctctgtatcctgaaaa

SEQ ID NO: 704737 - DNA, 22 bp, Artificial Sequence
  chemically synthesized
ggtgataaggaacattttcagg

SEQ ID NO: 704738 - DNA, 22 bp, Artificial Sequence
  chemically synthesized
aggtgataaggaacattttcag

SEQ ID NO: 704739 - DNA, 22 bp, Artificial Sequence
  chemically synthesized
tctgtatcctgaaaatgttcct

SEQ ID NO: 704740 - DNA, 22 bp, Artificial Sequence
  chemically synthesized
tgtatcctgaaaatgttcctta

SEQ ID NO: 704741 - DNA, 22 bp, Artificial Sequence
  chemically synthesized
tatcctgaaaatgttccttatc

SEQ ID NO: 704742 - DNA, 22 bp, Artificial Sequence
  chemically synthesized
aaaatgttccttatcacctaag

SEQ ID NO: 704743 - DNA, 22 bp, Artificial Sequence
  chemically synthesized
taagggacagggataggcttag

SEQ ID NO: 704744 - DNA, 22 bp, Artificial Sequence
  chemically synthesized
cttatcacctaagcctatccct

SEQ ID NO: 704745 - DNA, 22 bp, Artificial Sequence
  chemically synthesized
aggctgtaagggacagggatag

SEQ ID NO: 704746 - DNA, 22 bp, Artificial Sequence
  chemically synthesized
atcacctaagcctatccctgtc

SEQ ID NO: 704747 - DNA, 22 bp, Artificial Sequence
  chemically synthesized
aaggctgtaagggacagggata

SEQ ID NO: 704748 - DNA, 22 bp, Artificial Sequence
  chemically synthesized
tcacctaagcctatccctgtcc

SEQ ID NO: 704749 - DNA, 22 bp, Artificial Sequence
  chemically synthesized
cttaaggctgtaagggacaggg

SEQ ID NO: 704750 - DNA, 22 bp, Artificial Sequence
  chemically synthesized
agcctatccctgtcccttacag

SEQ ID NO: 704751 - DNA, 22 bp, Artificial Sequence
  chemically synthesized
tgtctccttaaggctgtaaggg

SEQ ID NO: 704752 - DNA, 22 bp, Artificial Sequence
  chemically synthesized
tccctgtcccttacagccttaa

SEQ ID NO: 704753 - DNA, 22 bp, Artificial Sequence
  chemically synthesized
tgtgctatgtctccttaaggct

SEQ ID NO: 704754 - DNA, 22 bp, Artificial Sequence
  chemically synthesized
ttatgtgctatgtctccttaag

SEQ ID NO: 704755 - DNA, 22 bp, Artificial Sequence
  chemically synthesized
tcccttacagccttaaggagac

SEQ ID NO: 704756 - DNA, 22 bp, Artificial Sequence
  chemically synthesized
tgttatgtgctatgtctcctta

SEQ ID NO: 704757 - DNA, 22 bp, Artificial Sequence
  chemically synthesized
ctctgttatgtgctatgtctcc

SEQ ID NO: 704758 - DNA, 22 bp, Artificial Sequence
  chemically synthesized
acagccttaaggagacatagca

SEQ ID NO: 704759 - DNA, 22 bp, Artificial Sequence
  chemically synthesized
cagccttaaggagacatagcac

SEQ ID NO: 704760 - DNA, 22 bp, Artificial Sequence
  chemically synthesized
caggtactgctctgttatgtgc

SEQ ID NO: 704761 - DNA, 22 bp, Artificial Sequence
  chemically synthesized
aaggagacatagcacataacag

SEQ ID NO: 704762 - DNA, 22 bp, Artificial Sequence
  chemically synthesized
aggagacatagcacataacaga

SEQ ID NO: 704763 - DNA, 22 bp, Artificial Sequence
  chemically synthesized
aggcgactgcaggtactgctct

SEQ ID NO: 704764 - DNA, 22 bp, Artificial Sequence
  chemically synthesized
caggcgactgcaggtactgctc

SEQ ID NO: 704765 - DNA, 22 bp, Artificial Sequence
  chemically synthesized
atttcaggcgactgcaggtact

SEQ ID NO: 704766 - DNA, 22 bp, Artificial Sequence
  chemically synthesized
gatttcaggcgactgcaggtac

SEQ ID NO: 704767 - DNA, 22 bp, Artificial Sequence
  chemically synthesized
cagtaaaaatcatcttgatttc

SEQ ID NO: 704768 - DNA, 22 bp, Artificial Sequence
  chemically synthesized
cagtcgcctgaaatcaagatga

SEQ ID NO: 704769 - DNA, 22 bp, Artificial Sequence
  chemically synthesized
agatatctgcagtaaaaatcat

SEQ ID NO: 704770 - DNA, 22 bp, Artificial Sequence
  chemically synthesized
cagatatctgcagtaaaaatca

SEQ ID NO: 704771 - DNA, 22 bp, Artificial Sequence
  chemically synthesized
tcagatatctgcagtaaaaatc

SEQ ID NO: 704772 - DNA, 22 bp, Artificial Sequence
  chemically synthesized
aaatcaagatgatttttactgc

SEQ ID NO: 704773 - DNA, 22 bp, Artificial Sequence
  chemically synthesized
aatagactttcagatatctgca

SEQ ID NO: 704774 - DNA, 22 bp, Artificial Sequence
  chemically synthesized
aaatagactttcagatatctgc

SEQ ID NO: 704775 - DNA, 22 bp, Artificial Sequence
  chemically synthesized
taaatagactttcagatatctg

SEQ ID NO: 704776 - DNA, 22 bp, Artificial Sequence
  chemically synthesized
ttaaatagactttcagatatct

SEQ ID NO: 704777 - DNA, 22 bp, Artificial Sequence
  chemically synthesized
ttactgcagatatctgaaagtc

SEQ ID NO: 704778 - DNA, 22 bp, Artificial Sequence
  chemically synthesized
gatttttaaatagactttcaga

SEQ ID NO: 704779 - DNA, 22 bp, Artificial Sequence
  chemically synthesized
tactgcagatatctgaaagtct

SEQ ID NO: 704780 - DNA, 22 bp, Artificial Sequence
  chemically synthesized
actgcagatatctgaaagtcta

SEQ ID NO: 704781 - DNA, 22 bp, Artificial Sequence
  chemically synthesized
tagatttttaaatagactttca

SEQ ID NO: 704782 - DNA, 22 bp, Artificial Sequence
  chemically synthesized
ctgcagatatctgaaagtctat

SEQ ID NO: 704783 - DNA, 22 bp, Artificial Sequence
  chemically synthesized
cagatatctgaaagtctattta

SEQ ID NO: 704784 - DNA, 22 bp, Artificial Sequence
  chemically synthesized
aaaaccattctagatttttaaa

SEQ ID NO: 704785 - DNA, 22 bp, Artificial Sequence
  chemically synthesized
aaaaaccattctagatttttaa

SEQ ID NO: 704786 - DNA, 22 bp, Artificial Sequence
  chemically synthesized
aaagtctatttaaaaatctaga

SEQ ID NO: 704787 - DNA, 22 bp, Artificial Sequence
  chemically synthesized
gtttaaaaaccattctagattt

SEQ ID NO: 704788 - DNA, 22 bp, Artificial Sequence
  chemically synthesized
ctggtttaaaaaccattctaga

SEQ ID NO: 704789 - DNA, 22 bp, Artificial Sequence
  chemically synthesized
ttcctggtttaaaaaccattct

SEQ ID NO: 704790 - DNA, 22 bp, Artificial Sequence
  chemically synthesized
tttaaaaatctagaatggtttt

SEQ ID NO: 704791 - DNA, 22 bp, Artificial Sequence
  chemically synthesized
aaaaatctagaatggtttttaa

SEQ ID NO: 704792 - DNA, 22 bp, Artificial Sequence
  chemically synthesized
aaaatctagaatggtttttaaa

SEQ ID NO: 704793 - DNA, 22 bp, Artificial Sequence
  chemically synthesized
cataaactgttcctggtttaaa

SEQ ID NO: 704794 - DNA, 22 bp, Artificial Sequence
  chemically synthesized
acataaactgttcctggtttaa

SEQ ID NO: 704795 - DNA, 22 bp, Artificial Sequence
  chemically synthesized
gaatggtttttaaaccaggaac

SEQ ID NO: 704796 - DNA, 22 bp, Artificial Sequence
  chemically synthesized
gtagacttacataaactgttcc

SEQ ID NO: 704797 - DNA, 22 bp, Artificial Sequence
  chemically synthesized
agtagacttacataaactgttc

SEQ ID NO: 704798 - DNA, 22 bp, Artificial Sequence
  chemically synthesized
tagtagacttacataaactgtt

SEQ ID NO: 704799 - DNA, 22 bp, Artificial Sequence
  chemically synthesized
ttaaaccaggaacagtttatgt

SEQ ID NO: 704800 - DNA, 22 bp, Artificial Sequence
  chemically synthesized
tttagtagacttacataaactg

SEQ ID NO: 704801 - DNA, 22 bp, Artificial Sequence
  chemically synthesized
taaaccaggaacagtttatgta

SEQ ID NO: 704802 - DNA, 22 bp, Artificial Sequence
  chemically synthesized
aaaccaggaacagtttatgtaa

SEQ ID NO: 704803 - DNA, 22 bp, Artificial Sequence
  chemically synthesized
aaccaggaacagtttatgtaag

SEQ ID NO: 704804 - DNA, 22 bp, Artificial Sequence
  chemically synthesized
ttctttagtagacttacataaa

SEQ ID NO: 704805 - DNA, 22 bp, Artificial Sequence
  chemically synthesized
gttctttagtagacttacataa

SEQ ID NO: 704806 - DNA, 22 bp, Artificial Sequence
  chemically synthesized
tgttctttagtagacttacata

SEQ ID NO: 704807 - DNA, 22 bp, Artificial Sequence
  chemically synthesized
atgtaagtctactaaagaacaa

SEQ ID NO: 704808 - DNA, 22 bp, Artificial Sequence
  chemically synthesized
tgtaagtctactaaagaacaaa

SEQ ID NO: 704809 - DNA, 22 bp, Artificial Sequence
  chemically synthesized
aagtgaggacaaaaggcatttt

SEQ ID NO: 704810 - DNA, 22 bp, Artificial Sequence
  chemically synthesized
gaagtgaggacaaaaggcattt

SEQ ID NO: 704811 - DNA, 22 bp, Artificial Sequence
  chemically synthesized
tgaagtgaggacaaaaggcatt

SEQ ID NO: 704812 - DNA, 22 bp, Artificial Sequence
  chemically synthesized
ctaaagaacaaaatgccttttg

SEQ ID NO: 704813 - DNA, 22 bp, Artificial Sequence
  chemically synthesized
aagaacaaaatgccttttgtcc

SEQ ID NO: 704814 - DNA, 22 bp, Artificial Sequence
  chemically synthesized
gtgagaactttgaagtgaggac

SEQ ID NO: 704815 - DNA, 22 bp, Artificial Sequence
  chemically synthesized
tggtgagaactttgaagtgagg

SEQ ID NO: 704816 - DNA, 22 bp, Artificial Sequence
  chemically synthesized
ctggtgagaactttgaagtgag

SEQ ID NO: 704817 - DNA, 22 bp, Artificial Sequence
  chemically synthesized
tctggtgagaactttgaagtga

SEQ ID NO: 704818 - DNA, 22 bp, Artificial Sequence
  chemically synthesized
ttgtcctcacttcaaagttctc

SEQ ID NO: 704819 - DNA, 22 bp, Artificial Sequence
  chemically synthesized
tgtcctcacttcaaagttctca

SEQ ID NO: 704820 - DNA, 22 bp, Artificial Sequence
  chemically synthesized
gtcctcacttcaaagttctcac

SEQ ID NO: 704821 - DNA, 22 bp, Artificial Sequence
  chemically synthesized
tcctcacttcaaagttctcacc

SEQ ID NO: 704822 - DNA, 22 bp, Artificial Sequence
  chemically synthesized
caaagtactttctggtgagaac

SEQ ID NO: 704823 - DNA, 22 bp, Artificial Sequence
  chemically synthesized
acttcaaagttctcaccagaaa

SEQ ID NO: 704824 - DNA, 22 bp, Artificial Sequence
  chemically synthesized
ggattacaaagtactttctggt

SEQ ID NO: 704825 - DNA, 22 bp, Artificial Sequence
  chemically synthesized
gggattacaaagtactttctgg

SEQ ID NO: 704826 - DNA, 22 bp, Artificial Sequence
  chemically synthesized
caaagttctcaccagaaagtac

SEQ ID NO: 704827 - DNA, 22 bp, Artificial Sequence
  chemically synthesized
aaagttctcaccagaaagtact

SEQ ID NO: 704828 - DNA, 22 bp, Artificial Sequence
  chemically synthesized
tcaccagaaagtactttgtaat

SEQ ID NO: 704829 - DNA, 22 bp, Artificial Sequence
  chemically synthesized
accagaaagtactttgtaatcc

SEQ ID NO: 704830 - DNA, 22 bp, Artificial Sequence
  chemically synthesized
agaacacaaccagtttgggatt

SEQ ID NO: 704831 - DNA, 22 bp, Artificial Sequence
  chemically synthesized
cagaacacaaccagtttgggat

SEQ ID NO: 704832 - DNA, 22 bp, Artificial Sequence
  chemically synthesized
tcagaacacaaccagtttggga

SEQ ID NO: 704833 - DNA, 22 bp, Artificial Sequence
  chemically synthesized
cattttcagaacacaaccagtt

SEQ ID NO: 704834 - DNA, 22 bp, Artificial Sequence
  chemically synthesized
ccattttcagaacacaaccagt

SEQ ID NO: 704835 - DNA, 22 bp, Artificial Sequence
  chemically synthesized
tgtaatcccaaactggttgtgt

SEQ ID NO: 704836 - DNA, 22 bp, Artificial Sequence
  chemically synthesized
tccattttcagaacacaaccag

SEQ ID NO: 704837 - DNA, 22 bp, Artificial Sequence
  chemically synthesized
gtaatcccaaactggttgtgtt

SEQ ID NO: 704838 - DNA, 22 bp, Artificial Sequence
  chemically synthesized
taatcccaaactggttgtgttc

SEQ ID NO: 704839 - DNA, 22 bp, Artificial Sequence
  chemically synthesized
gatgttttccattttcagaaca

SEQ ID NO: 704840 - DNA, 22 bp, Artificial Sequence
  chemically synthesized
ggatgttttccattttcagaac

SEQ ID NO: 704841 - DNA, 22 bp, Artificial Sequence
  chemically synthesized
catttggatgttttccattttc

SEQ ID NO: 704842 - DNA, 22 bp, Artificial Sequence
  chemically synthesized
ccatttggatgttttccatttt

SEQ ID NO: 704843 - DNA, 22 bp, Artificial Sequence
  chemically synthesized
gttgtgttctgaaaatggaaaa

SEQ ID NO: 704844 - DNA, 22 bp, Artificial Sequence
  chemically synthesized
tccatttggatgttttccattt

SEQ ID NO: 704845 - DNA, 22 bp, Artificial Sequence
  chemically synthesized
ttccatttggatgttttccatt

SEQ ID NO: 704846 - DNA, 22 bp, Artificial Sequence
  chemically synthesized
tgttctgaaaatggaaaacatc

SEQ ID NO: 704847 - DNA, 22 bp, Artificial Sequence
  chemically synthesized
gtttttccatttggatgttttc

SEQ ID NO: 704848 - DNA, 22 bp, Artificial Sequence
  chemically synthesized
cgtttttccatttggatgtttt

SEQ ID NO: 704849 - DNA, 22 bp, Artificial Sequence
  chemically synthesized
tcgtttttccatttggatgttt

SEQ ID NO: 704850 - DNA, 22 bp, Artificial Sequence
  chemically synthesized
tgaaaatggaaaacatccaaat

SEQ ID NO: 704851 - DNA, 22 bp, Artificial Sequence
  chemically synthesized
ctttcgtttttccatttggatg

SEQ ID NO: 704852 - DNA, 22 bp, Artificial Sequence
  chemically synthesized
aaaatggaaaacatccaaatgg

SEQ ID NO: 704853 - DNA, 22 bp, Artificial Sequence
  chemically synthesized
tgggcaagaatcattactttcg

SEQ ID NO: 704854 - DNA, 22 bp, Artificial Sequence
  chemically synthesized
ttgcccacagggatgtgatccc

SEQ ID NO: 704855 - DNA, 22 bp, Artificial Sequence
  chemically synthesized
gcccacagggatgtgatcccac

SEQ ID NO: 704856 - DNA, 22 bp, Artificial Sequence
  chemically synthesized
cccacagggatgtgatcccact

SEQ ID NO: 704857 - DNA, 22 bp, Artificial Sequence
  chemically synthesized
cacaacagaaatagtgggatca

SEQ ID NO: 704858 - DNA, 22 bp, Artificial Sequence
  chemically synthesized
gcacaacagaaatagtgggatc

SEQ ID NO: 704859 - DNA, 22 bp, Artificial Sequence
  chemically synthesized
tgcacaacagaaatagtgggat

SEQ ID NO: 704860 - DNA, 22 bp, Artificial Sequence
  chemically synthesized
tccaaaatacaaagctttgcac

SEQ ID NO: 704861 - DNA, 22 bp, Artificial Sequence
  chemically synthesized
tttctgttgtgcaaagctttgt

SEQ ID NO: 704862 - DNA, 22 bp, Artificial Sequence
  chemically synthesized
ctgttgtgcaaagctttgtatt

SEQ ID NO: 704863 - DNA, 22 bp, Artificial Sequence
  chemically synthesized
tcatctgtccaaaatacaaagc

SEQ ID NO: 704864 - DNA, 22 bp, Artificial Sequence
  chemically synthesized
tgttgtgcaaagctttgtattt

SEQ ID NO: 704865 - DNA, 22 bp, Artificial Sequence
  chemically synthesized
gtcatctgtccaaaatacaaag

SEQ ID NO: 704866 - DNA, 22 bp, Artificial Sequence
  chemically synthesized
tgtcatctgtccaaaatacaaa

SEQ ID NO: 704867 - DNA, 22 bp, Artificial Sequence
  chemically synthesized
ttgtgcaaagctttgtattttg

SEQ ID NO: 704868 - DNA, 22 bp, Artificial Sequence
  chemically synthesized
tgcaaagctttgtattttggac

SEQ ID NO: 704869 - DNA, 22 bp, Artificial Sequence
  chemically synthesized
gggtagcattttgtcatctgtc

SEQ ID NO: 704870 - DNA, 22 bp, Artificial Sequence
  chemically synthesized
tgtattttggacagatgacaaa

SEQ ID NO: 704871 - DNA, 22 bp, Artificial Sequence
  chemically synthesized
gtattttggacagatgacaaaa

SEQ ID NO: 704872 - DNA, 22 bp, Artificial Sequence
  chemically synthesized
tattttggacagatgacaaaat

SEQ ID NO: 704873 - DNA, 22 bp, Artificial Sequence
  chemically synthesized
gcctggggtagcattttgtcat

SEQ ID NO: 704874 - DNA, 22 bp, Artificial Sequence
  chemically synthesized
ggcctggggtagcattttgtca

SEQ ID NO: 704875 - DNA, 22 bp, Artificial Sequence
  chemically synthesized
tggacagatgacaaaatgctac

SEQ ID NO: 704876 - DNA, 22 bp, Artificial Sequence
  chemically synthesized
ggacagatgacaaaatgctacc

SEQ ID NO: 704877 - DNA, 22 bp, Artificial Sequence
  chemically synthesized
gacagatgacaaaatgctaccc

SEQ ID NO: 704878 - DNA, 22 bp, Artificial Sequence
  chemically synthesized
tgaatttggcctggggtagcat

SEQ ID NO: 704879 - DNA, 22 bp, Artificial Sequence
  chemically synthesized
gtgaatttggcctggggtagca

SEQ ID NO: 704880 - DNA, 22 bp, Artificial Sequence
  chemically synthesized
ccccaggccaaattcacaaatg

SEQ ID NO: 704881 - DNA, 22 bp, Artificial Sequence
  chemically synthesized
cccagaaaatgaaggcatttgt

SEQ ID NO: 704882 - DNA, 22 bp, Artificial Sequence
  chemically synthesized
cactacccagaaaatgaaggca

SEQ ID NO: 704883 - DNA, 22 bp, Artificial Sequence
  chemically synthesized
acactacccagaaaatgaaggc

SEQ ID NO: 704884 - DNA, 22 bp, Artificial Sequence
  chemically synthesized
tacactacccagaaaatgaagg

SEQ ID NO: 704885 - DNA, 22 bp, Artificial Sequence
  chemically synthesized
ttacactacccagaaaatgaag

SEQ ID NO: 704886 - DNA, 22 bp, Artificial Sequence
  chemically synthesized
acaaatgccttcattttctggg

SEQ ID NO: 704887 - DNA, 22 bp, Artificial Sequence
  chemically synthesized
aagggtgtatttttacactacc

SEQ ID NO: 704888 - DNA, 22 bp, Artificial Sequence
  chemically synthesized
tgaagggtgtatttttacacta

SEQ ID NO: 704889 - DNA, 22 bp, Artificial Sequence
  chemically synthesized
cattttctgggtagtgtaaaaa

SEQ ID NO: 704890 - DNA, 22 bp, Artificial Sequence
  chemically synthesized
attttctgggtagtgtaaaaat

SEQ ID NO: 704891 - DNA, 22 bp, Artificial Sequence
  chemically synthesized
gctctgaagggtgtatttttac

SEQ ID NO: 704892 - DNA, 22 bp, Artificial Sequence
  chemically synthesized
tctgggtagtgtaaaaatacac

SEQ ID NO: 704893 - DNA, 22 bp, Artificial Sequence
  chemically synthesized
ctgggtagtgtaaaaatacacc

SEQ ID NO: 704894 - DNA, 22 bp, Artificial Sequence
  chemically synthesized
tgggtagtgtaaaaatacaccc

SEQ ID NO: 704895 - DNA, 22 bp, Artificial Sequence
  chemically synthesized
ggtagtgtaaaaatacaccctt

SEQ ID NO: 704896 - DNA, 22 bp, Artificial Sequence
  chemically synthesized
gtggaatgctggctctgaaggg

SEQ ID NO: 704897 - DNA, 22 bp, Artificial Sequence
  chemically synthesized
ggtggaatgctggctctgaagg

SEQ ID NO: 704898 - DNA, 22 bp, Artificial Sequence
  chemically synthesized
tggtggaatgctggctctgaag

SEQ ID NO: 704899 - DNA, 22 bp, Artificial Sequence
  chemically synthesized
ttttggtggaatgctggctctg

SEQ ID NO: 704900 - DNA, 22 bp, Artificial Sequence
  chemically synthesized
cagagccagcattccaccaaaa

SEQ ID NO: 704901 - DNA, 22 bp, Artificial Sequence
  chemically synthesized
agagccagcattccaccaaaat

SEQ ID NO: 704902 - DNA, 22 bp, Artificial Sequence
  chemically synthesized
taacatgggcactattttggtg

SEQ ID NO: 704903 - DNA, 22 bp, Artificial Sequence
  chemically synthesized
ataacatgggcactattttggt

SEQ ID NO: 704904 - DNA, 22 bp, Artificial Sequence
  chemically synthesized
tataacatgggcactattttgg

SEQ ID NO: 704905 - DNA, 22 bp, Artificial Sequence
  chemically synthesized
aatcagttttataacatgggca

SEQ ID NO: 704906 - DNA, 22 bp, Artificial Sequence
  chemically synthesized
caccaaaatagtgcccatgtta

SEQ ID NO: 704907 - DNA, 22 bp, Artificial Sequence
  chemically synthesized
tgaatcagttttataacatggg

SEQ ID NO: 704908 - DNA, 22 bp, Artificial Sequence
  chemically synthesized
taaaactgattcagaactctgg

SEQ ID NO: 704909 - DNA, 22 bp, Artificial Sequence
  chemically synthesized
gggccaagagaccagcaccaga

SEQ ID NO: 704910 - DNA, 22 bp, Artificial Sequence
  chemically synthesized
attcagaactctggtgctggtc

SEQ ID NO: 704911 - DNA, 22 bp, Artificial Sequence
  chemically synthesized
agaactctggtgctggtctctt

SEQ ID NO: 704912 - DNA, 22 bp, Artificial Sequence
  chemically synthesized
atgaggagctagggccaagaga

SEQ ID NO: 704913 - DNA, 22 bp, Artificial Sequence
  chemically synthesized
tggtgctggtctcttggcccta

SEQ ID NO: 704914 - DNA, 22 bp, Artificial Sequence
  chemically synthesized
gtgctggtctcttggccctagc

SEQ ID NO: 704915 - DNA, 22 bp, Artificial Sequence
  chemically synthesized
ggcctcatgaggagctagggcc

SEQ ID NO: 704916 - DNA, 22 bp, Artificial Sequence
  chemically synthesized
tgggcctcatgaggagctaggg

SEQ ID NO: 704917 - DNA, 22 bp, Artificial Sequence
  chemically synthesized
ctgggcctcatgaggagctagg

SEQ ID NO: 704918 - DNA, 22 bp, Artificial Sequence
  chemically synthesized
gtctcttggccctagctcctca

SEQ ID NO: 704919 - DNA, 22 bp, Artificial Sequence
  chemically synthesized
ttctgggcctcatgaggagcta

SEQ ID NO: 704920 - DNA, 22 bp, Artificial Sequence
  chemically synthesized
ttggccctagctcctcatgagg

SEQ ID NO: 704921 - DNA, 22 bp, Artificial Sequence
  chemically synthesized
ggccctagctcctcatgaggcc

SEQ ID NO: 704922 - DNA, 22 bp, Artificial Sequence
  chemically synthesized
gccctagctcctcatgaggccc

SEQ ID NO: 704923 - DNA, 22 bp, Artificial Sequence
  chemically synthesized
tgacagattcttctgggcctca

SEQ ID NO: 704924 - DNA, 22 bp, Artificial Sequence
  chemically synthesized
gctcctcatgaggcccagaaga

SEQ ID NO: 704925 - DNA, 22 bp, Artificial Sequence
  chemically synthesized
attgtgacagattcttctgggc

SEQ ID NO: 704926 - DNA, 22 bp, Artificial Sequence
  chemically synthesized
ctcattgtgacagattcttctg

SEQ ID NO: 704927 - DNA, 22 bp, Artificial Sequence
  chemically synthesized
ctcatgaggcccagaagaatct

SEQ ID NO: 704928 - DNA, 22 bp, Artificial Sequence
  chemically synthesized
cctcattgtgacagattcttct

SEQ ID NO: 704929 - DNA, 22 bp, Artificial Sequence
  chemically synthesized
atgaggcccagaagaatctgtc

SEQ ID NO: 704930 - DNA, 22 bp, Artificial Sequence
  chemically synthesized
atcttcctcattgtgacagatt

SEQ ID NO: 704931 - DNA, 22 bp, Artificial Sequence
  chemically synthesized
catcttcctcattgtgacagat

SEQ ID NO: 704932 - DNA, 22 bp, Artificial Sequence
  chemically synthesized
tttcatcttcctcattgtgaca

SEQ ID NO: 704933 - DNA, 22 bp, Artificial Sequence
  chemically synthesized
atttcatcttcctcattgtgac

SEQ ID NO: 704934 - DNA, 22 bp, Artificial Sequence
  chemically synthesized
ttatttcatcttcctcattgtg

SEQ ID NO: 704935 - DNA, 22 bp, Artificial Sequence
  chemically synthesized
cttatttcatcttcctcattgt

SEQ ID NO: 704936 - DNA, 22 bp, Artificial Sequence
  chemically synthesized
tcttatttcatcttcctcattg

SEQ ID NO: 704937 - DNA, 22 bp, Artificial Sequence
  chemically synthesized
tttcttatttcatcttcctcat

SEQ ID NO: 704938 - DNA, 22 bp, Artificial Sequence
  chemically synthesized
ctttcttatttcatcttcctca

SEQ ID NO: 704939 - DNA, 22 bp, Artificial Sequence
  chemically synthesized
tttctttcttatttcatcttcc

SEQ ID NO: 704940 - DNA, 22 bp, Artificial Sequence
  chemically synthesized
tcacaatgaggaagatgaaata

SEQ ID NO: 704941 - DNA, 22 bp, Artificial Sequence
  chemically synthesized
gcccggtggcatggaagagatg

SEQ ID NO: 704942 - DNA, 22 bp, Artificial Sequence
  chemically synthesized
gtctcatctcttccatgccacc

SEQ ID NO: 704943 - DNA, 22 bp, Artificial Sequence
  chemically synthesized
tctcatctcttccatgccaccg

SEQ ID NO: 704944 - DNA, 22 bp, Artificial Sequence
  chemically synthesized
catggaaattagcccggtggca

SEQ ID NO: 704945 - DNA, 22 bp, Artificial Sequence
  chemically synthesized
acatggaaattagcccggtggc

SEQ ID NO: 704946 - DNA, 22 bp, Artificial Sequence
  chemically synthesized
atctcttccatgccaccgggct

SEQ ID NO: 704947 - DNA, 22 bp, Artificial Sequence
  chemically synthesized
ttccatgccaccgggctaattt

SEQ ID NO: 704948 - DNA, 22 bp, Artificial Sequence
  chemically synthesized
ccatgccaccgggctaatttcc

SEQ ID NO: 704949 - DNA, 22 bp, Artificial Sequence
  chemically synthesized
catgccaccgggctaatttcca

SEQ ID NO: 704950 - DNA, 22 bp, Artificial Sequence
  chemically synthesized
gtcacggacttacatggaaatt

SEQ ID NO: 704951 - DNA, 22 bp, Artificial Sequence
  chemically synthesized
cgtcacggacttacatggaaat

SEQ ID NO: 704952 - DNA, 22 bp, Artificial Sequence
  chemically synthesized
cttcgtcacggacttacatgga

SEQ ID NO: 704953 - DNA, 22 bp, Artificial Sequence
  chemically synthesized
atttccatgtaagtccgtgacg

SEQ ID NO: 704954 - DNA, 22 bp, Artificial Sequence
  chemically synthesized
accaccactccttcgtcacgga

SEQ ID NO: 704955 - DNA, 22 bp, Artificial Sequence
  chemically synthesized
ccatgtaagtccgtgacgaagg

SEQ ID NO: 704956 - DNA, 22 bp, Artificial Sequence
  chemically synthesized
catgtaagtccgtgacgaagga

SEQ ID NO: 704957 - DNA, 22 bp, Artificial Sequence
  chemically synthesized
gatcactaaccaccactccttc

SEQ ID NO: 704958 - DNA, 22 bp, Artificial Sequence
  chemically synthesized
gctggatcactaaccaccactc

SEQ ID NO: 704959 - DNA, 22 bp, Artificial Sequence
  chemically synthesized
agctggatcactaaccaccact

SEQ ID NO: 704960 - DNA, 22 bp, Artificial Sequence
  chemically synthesized
aatgggcgcatttagctggatc

SEQ ID NO: 704961 - DNA, 22 bp, Artificial Sequence
  chemically synthesized
gagctgaatgggcgcatttagc

SEQ ID NO: 704962 - DNA, 22 bp, Artificial Sequence
  chemically synthesized
agagctgaatgggcgcatttag

SEQ ID NO: 704963 - DNA, 22 bp, Artificial Sequence
  chemically synthesized
tagagctgaatgggcgcattta

SEQ ID NO: 704964 - DNA, 22 bp, Artificial Sequence
  chemically synthesized
gtgatccagctaaatgcgccca

SEQ ID NO: 704965 - DNA, 22 bp, Artificial Sequence
  chemically synthesized
gctttagagctgaatgggcgca

SEQ ID NO: 704966 - DNA, 22 bp, Artificial Sequence
  chemically synthesized
aatgcgcccattcagctctaaa

SEQ ID NO: 704967 - DNA, 22 bp, Artificial Sequence
  chemically synthesized
tcataccccatgcataatctgg

SEQ ID NO: 704968 - DNA, 22 bp, Artificial Sequence
  chemically synthesized
agctctaaagccagattatgca

SEQ ID NO: 704969 - DNA, 22 bp, Artificial Sequence
  chemically synthesized
ctatcataccccatgcataatc

SEQ ID NO: 704970 - DNA, 22 bp, Artificial Sequence
  chemically synthesized
taaagccagattatgcatgggg

SEQ ID NO: 704971 - DNA, 22 bp, Artificial Sequence
  chemically synthesized
aagccagattatgcatggggta

SEQ ID NO: 704972 - DNA, 22 bp, Artificial Sequence
  chemically synthesized
tgaagctgctatcataccccat

SEQ ID NO: 704973 - DNA, 22 bp, Artificial Sequence
  chemically synthesized
atgaagctgctatcatacccca

SEQ ID NO: 704974 - DNA, 22 bp, Artificial Sequence
  chemically synthesized
tatgaagctgctatcatacccc

SEQ ID NO: 704975 - DNA, 22 bp, Artificial Sequence
  chemically synthesized
gactttatgaagctgctatcat

SEQ ID NO: 704976 - DNA, 22 bp, Artificial Sequence
  chemically synthesized
tgcatggggtatgatagcagct

SEQ ID NO: 704977 - DNA, 22 bp, Artificial Sequence
  chemically synthesized
ctagactttatgaagctgctat

SEQ ID NO: 704978 - DNA, 22 bp, Artificial Sequence
  chemically synthesized
tcctagactttatgaagctgct

SEQ ID NO: 704979 - DNA, 22 bp, Artificial Sequence
  chemically synthesized
acctctcctagactttatgaag

SEQ ID NO: 704980 - DNA, 22 bp, Artificial Sequence
  chemically synthesized
cataaagtctaggagaggttaa

SEQ ID NO: 704981 - DNA, 22 bp, Artificial Sequence
  chemically synthesized
ataaagtctaggagaggttaat

SEQ ID NO: 704982 - DNA, 22 bp, Artificial Sequence
  chemically synthesized
agtggaacaacaatagtattaa

SEQ ID NO: 704983 - DNA, 22 bp, Artificial Sequence
  chemically synthesized
ggagaggttaatactattgttg

SEQ ID NO: 704984 - DNA, 22 bp, Artificial Sequence
  chemically synthesized
atactattgttgttccactcag

SEQ ID NO: 704985 - DNA, 22 bp, Artificial Sequence
  chemically synthesized
agtaaaagggatctgagtggaa

SEQ ID NO: 704986 - DNA, 22 bp, Artificial Sequence
  chemically synthesized
ttgttgttccactcagatccct

SEQ ID NO: 704987 - DNA, 22 bp, Artificial Sequence
  chemically synthesized
ttgttccactcagatccctttt

SEQ ID NO: 704988 - DNA, 22 bp, Artificial Sequence
  chemically synthesized
ttccactcagatcccttttact

SEQ ID NO: 704989 - DNA, 22 bp, Artificial Sequence
  chemically synthesized
ggtgaaccagctcagtaaaagg

SEQ ID NO: 704990 - DNA, 22 bp, Artificial Sequence
  chemically synthesized
cactcagatcccttttactgag

SEQ ID NO: 704991 - DNA, 22 bp, Artificial Sequence
  chemically synthesized
cggctgggtgaaccagctcagt

SEQ ID NO: 704992 - DNA, 22 bp, Artificial Sequence
  chemically synthesized
agatcccttttactgagctggt

SEQ ID NO: 704993 - DNA, 22 bp, Artificial Sequence
  chemically synthesized
ttactgagctggttcacccagc

SEQ ID NO: 704994 - DNA, 22 bp, Artificial Sequence
  chemically synthesized
acaacaactgcggctgggtgaa

SEQ ID NO: 704995 - DNA, 22 bp, Artificial Sequence
  chemically synthesized
tactgagctggttcacccagcc

SEQ ID NO: 704996 - DNA, 22 bp, Artificial Sequence
  chemically synthesized
actgagctggttcacccagccg

SEQ ID NO: 704997 - DNA, 22 bp, Artificial Sequence
  chemically synthesized
ctgagctggttcacccagccgc

SEQ ID NO: 704998 - DNA, 22 bp, Artificial Sequence
  chemically synthesized
agctggttcacccagccgcagt

SEQ ID NO: 704999 - DNA, 22 bp, Artificial Sequence
  chemically synthesized
gttcacccagccgcagttgttg

SEQ ID NO: 705000 - DNA, 22 bp, Artificial Sequence
  chemically synthesized
gcaaccaacactcacaacaact

SEQ ID NO: 705001 - DNA, 22 bp, Artificial Sequence
  chemically synthesized
agcaaccaacactcacaacaac

SEQ ID NO: 705002 - DNA, 22 bp, Artificial Sequence
  chemically synthesized
acccagccgcagttgttgtgag

SEQ ID NO: 705003 - DNA, 22 bp, Artificial Sequence
  chemically synthesized
ttgtgagtgttggttgctaagg

SEQ ID NO: 705004 - DNA, 22 bp, Artificial Sequence
  chemically synthesized
tgagtgttggttgctaaggcct

SEQ ID NO: 705005 - DNA, 22 bp, Artificial Sequence
  chemically synthesized
gtgaaaggaccaatgaggcctt

SEQ ID NO: 705006 - DNA, 22 bp, Artificial Sequence
  chemically synthesized
tggtgaaaggaccaatgaggcc

SEQ ID NO: 705007 - DNA, 22 bp, Artificial Sequence
  chemically synthesized
ctggtgaaaggaccaatgaggc

SEQ ID NO: 705008 - DNA, 22 bp, Artificial Sequence
  chemically synthesized
gttgctaaggcctcattggtcc

SEQ ID NO: 705009 - DNA, 22 bp, Artificial Sequence
  chemically synthesized
ctaaggcctcattggtcctttc

SEQ ID NO: 705010 - DNA, 22 bp, Artificial Sequence
  chemically synthesized
aggcctcattggtcctttcacc

SEQ ID NO: 705011 - DNA, 22 bp, Artificial Sequence
  chemically synthesized
gccaagggaggatttctggtga

SEQ ID NO: 705012 - DNA, 22 bp, Artificial Sequence
  chemically synthesized
ggccaagggaggatttctggtg

SEQ ID NO: 705013 - DNA, 22 bp, Artificial Sequence
  chemically synthesized
attggtcctttcaccagaaatc

SEQ ID NO: 705014 - DNA, 22 bp, Artificial Sequence
  chemically synthesized
gtcctttcaccagaaatcctcc

SEQ ID NO: 705015 - DNA, 22 bp, Artificial Sequence
  chemically synthesized
ccatttggccaagggaggattt

SEQ ID NO: 705016 - DNA, 22 bp, Artificial Sequence
  chemically synthesized
tcaccagaaatcctcccttggc

SEQ ID NO: 705017 - DNA, 22 bp, Artificial Sequence
  chemically synthesized
caccagaaatcctcccttggcc

SEQ ID NO: 705018 - DNA, 22 bp, Artificial Sequence
  chemically synthesized
accagaaatcctcccttggcca

SEQ ID NO: 705019 - DNA, 22 bp, Artificial Sequence
  chemically synthesized
ccttggccaaatgggaactgct

SEQ ID NO: 705020 - DNA, 22 bp, Artificial Sequence
  chemically synthesized
ggccaaatgggaactgctttgc

SEQ ID NO: 705021 - DNA, 22 bp, Artificial Sequence
  chemically synthesized
gccaaatgggaactgctttgct

SEQ ID NO: 705022 - DNA, 22 bp, Artificial Sequence
  chemically synthesized
gggagtaggagatagcaaagca

SEQ ID NO: 705023 - DNA, 22 bp, Artificial Sequence
  chemically synthesized
tggggagtaggagatagcaaag

SEQ ID NO: 705024 - DNA, 22 bp, Artificial Sequence
  chemically synthesized
ctggggagtaggagatagcaaa

SEQ ID NO: 705025 - DNA, 22 bp, Artificial Sequence
  chemically synthesized
tggatttctggggagtaggaga

SEQ ID NO: 705026 - DNA, 22 bp, Artificial Sequence
  chemically synthesized
ctttgctatctcctactcccca

SEQ ID NO: 705027 - DNA, 22 bp, Artificial Sequence
  chemically synthesized
gctgtggatttctggggagtag

SEQ ID NO: 705028 - DNA, 22 bp, Artificial Sequence
  chemically synthesized
tgctatctcctactccccagaa

SEQ ID NO: 705029 - DNA, 22 bp, Artificial Sequence
  chemically synthesized
gctatctcctactccccagaaa

SEQ ID NO: 705030 - DNA, 22 bp, Artificial Sequence
  chemically synthesized
ctatctcctactccccagaaat

SEQ ID NO: 705031 - DNA, 22 bp, Artificial Sequence
  chemically synthesized
gtcattggctgtggatttctgg

SEQ ID NO: 705032 - DNA, 22 bp, Artificial Sequence
  chemically synthesized
tctcctactccccagaaatcca

SEQ ID NO: 705033 - DNA, 22 bp, Artificial Sequence
  chemically synthesized
ctactccccagaaatccacagc

SEQ ID NO: 705034 - DNA, 22 bp, Artificial Sequence
  chemically synthesized
ctccccagaaatccacagccaa

SEQ ID NO: 705035 - DNA, 22 bp, Artificial Sequence
  chemically synthesized
cccagaaatccacagccaatga

SEQ ID NO: 705036 - DNA, 22 bp, Artificial Sequence
  chemically synthesized
ccgtgtgaattagtcattggct

SEQ ID NO: 705037 - DNA, 22 bp, Artificial Sequence
  chemically synthesized
cccgtgtgaattagtcattggc

SEQ ID NO: 705038 - DNA, 22 bp, Artificial Sequence
  chemically synthesized
tcccgtgtgaattagtcattgg

SEQ ID NO: 705039 - DNA, 22 bp, Artificial Sequence
  chemically synthesized
ttttcccgtgtgaattagtcat

SEQ ID NO: 705040 - DNA, 22 bp, Artificial Sequence
  chemically synthesized
attttcccgtgtgaattagtca

SEQ ID NO: 705041 - DNA, 22 bp, Artificial Sequence
  chemically synthesized
tattttcccgtgtgaattagtc

SEQ ID NO: 705042 - DNA, 22 bp, Artificial Sequence
  chemically synthesized
ttattttcccgtgtgaattagt

SEQ ID NO: 705043 - DNA, 22 bp, Artificial Sequence
  chemically synthesized
ggcttttattttcccgtgtgaa

SEQ ID NO: 705044 - DNA, 22 bp, Artificial Sequence
  chemically synthesized
attcacacgggaaaataaaagc

SEQ ID NO: 705045 - DNA, 22 bp, Artificial Sequence
  chemically synthesized
acacgggaaaataaaagcccag

SEQ ID NO: 705046 - DNA, 22 bp, Artificial Sequence
  chemically synthesized
caggcgtgagccaccgcgccca

SEQ ID NO: 705047 - DNA, 22 bp, Artificial Sequence
  chemically synthesized
ggattacaggcgtgagccaccg

SEQ ID NO: 705048 - DNA, 22 bp, Artificial Sequence
  chemically synthesized
gctgggcgcggtggctcacgcc

SEQ ID NO: 705049 - DNA, 22 bp, Artificial Sequence
  chemically synthesized
ggcgcggtggctcacgcctgta

SEQ ID NO: 705050 - DNA, 22 bp, Artificial Sequence
  chemically synthesized
caaaagtgctgggattacaggc

SEQ ID NO: 705051 - DNA, 22 bp, Artificial Sequence
  chemically synthesized
ggtctccaaaagtgctgggatt

SEQ ID NO: 705052 - DNA, 22 bp, Artificial Sequence
  chemically synthesized
acgcctgtaatcccagcacttt

SEQ ID NO: 705053 - DNA, 22 bp, Artificial Sequence
  chemically synthesized
cctcggtctccaaaagtgctgg

SEQ ID NO: 705054 - DNA, 22 bp, Artificial Sequence
  chemically synthesized
taatcccagcacttttggagac

SEQ ID NO: 705055 - DNA, 22 bp, Artificial Sequence
  chemically synthesized
atccgcctgcctcggtctccaa

SEQ ID NO: 705056 - DNA, 22 bp, Artificial Sequence
  chemically synthesized
ctgatccgcctgcctcggtctc

SEQ ID NO: 705057 - DNA, 22 bp, Artificial Sequence
  chemically synthesized
atctcctgatccgcctgcctcg

SEQ ID NO: 705058 - DNA, 22 bp, Artificial Sequence
  chemically synthesized
ctgatctcctgatccgcctgcc

SEQ ID NO: 705059 - DNA, 22 bp, Artificial Sequence
  chemically synthesized
ttggagaccgaggcaggcggat

SEQ ID NO: 705060 - DNA, 22 bp, Artificial Sequence
  chemically synthesized
tggagaccgaggcaggcggatc

SEQ ID NO: 705061 - DNA, 22 bp, Artificial Sequence
  chemically synthesized
ggagaccgaggcaggcggatca

SEQ ID NO: 705062 - DNA, 22 bp, Artificial Sequence
  chemically synthesized
gagaccgaggcaggcggatcag

SEQ ID NO: 705063 - DNA, 22 bp, Artificial Sequence
  chemically synthesized
gaactcctgatctcctgatccg

SEQ ID NO: 705064 - DNA, 22 bp, Artificial Sequence
  chemically synthesized
gtctcgaactcctgatctcctg

SEQ ID NO: 705065 - DNA, 22 bp, Artificial Sequence
  chemically synthesized
gccaggctggtctcgaactcct

SEQ ID NO: 705066 - DNA, 22 bp, Artificial Sequence
  chemically synthesized
ggttggccaggctggtctcgaa

SEQ ID NO: 705067 - DNA, 22 bp, Artificial Sequence
  chemically synthesized
actaggttggccaggctggtct

SEQ ID NO: 705068 - DNA, 22 bp, Artificial Sequence
  chemically synthesized
cactaggttggccaggctggtc

SEQ ID NO: 705069 - DNA, 22 bp, Artificial Sequence
  chemically synthesized
gagaccagcctggccaacctag

SEQ ID NO: 705070 - DNA, 22 bp, Artificial Sequence
  chemically synthesized
gagacggggtttcactaggttg

SEQ ID NO: 705071 - DNA, 22 bp, Artificial Sequence
  chemically synthesized
ctagagacggggtttcactagg

SEQ ID NO: 705072 - DNA, 22 bp, Artificial Sequence
  chemically synthesized
actagagacggggtttcactag

SEQ ID NO: 705073 - DNA, 22 bp, Artificial Sequence
  chemically synthesized
tactagagacggggtttcacta

SEQ ID NO: 705074 - DNA, 22 bp, Artificial Sequence
  chemically synthesized
ttactagagacggggtttcact

SEQ ID NO: 705075 - DNA, 22 bp, Artificial Sequence
  chemically synthesized
gccaacctagtgaaaccccgtc

SEQ ID NO: 705076 - DNA, 22 bp, Artificial Sequence
  chemically synthesized
tatttttactagagacggggtt

SEQ ID NO: 705077 - DNA, 22 bp, Artificial Sequence
  chemically synthesized
gtatttttactagagacggggt

SEQ ID NO: 705078 - DNA, 22 bp, Artificial Sequence
  chemically synthesized
tgtatttttactagagacgggg

SEQ ID NO: 705079 - DNA, 22 bp, Artificial Sequence
  chemically synthesized
ttgtatttttactagagacggg

SEQ ID NO: 705080 - DNA, 22 bp, Artificial Sequence
  chemically synthesized
tttgtatttttactagagacgg

SEQ ID NO: 705081 - DNA, 22 bp, Artificial Sequence
  chemically synthesized
ttttgtatttttactagagacg

SEQ ID NO: 705082 - DNA, 22 bp, Artificial Sequence
  chemically synthesized
tttttgtatttttactagagac

SEQ ID NO: 705083 - DNA, 22 bp, Artificial Sequence
  chemically synthesized
ttttttgtatttttactagaga

SEQ ID NO: 705084 - DNA, 22 bp, Artificial Sequence
  chemically synthesized
gtgaaaccccgtctctagtaaa

SEQ ID NO: 705085 - DNA, 22 bp, Artificial Sequence
  chemically synthesized
tttttttgtatttttactagag

SEQ ID NO: 705086 - DNA, 22 bp, Artificial Sequence
  chemically synthesized
ttttttttgtatttttactaga

SEQ ID NO: 705087 - DNA, 22 bp, Artificial Sequence
  chemically synthesized
tttttttttgtatttttactag

SEQ ID NO: 705088 - DNA, 22 bp, Artificial Sequence
  chemically synthesized
ttttttttttgtatttttacta

SEQ ID NO: 705089 - DNA, 22 bp, Artificial Sequence
  chemically synthesized
tttttttttttgtatttttact

SEQ ID NO: 705090 - DNA, 22 bp, Artificial Sequence
  chemically synthesized
ttttttttttttgtatttttac

SEQ ID NO: 705091 - DNA, 22 bp, Artificial Sequence
  chemically synthesized
tttttttttttttgtattttta

SEQ ID NO: 705092 - DNA, 22 bp, Artificial Sequence
  chemically synthesized
ttttttttttttttgtattttt

SEQ ID NO: 705093 - DNA, 22 bp, Artificial Sequence
  chemically synthesized
tttttttttttttttgtatttt

SEQ ID NO: 705094 - DNA, 22 bp, Artificial Sequence
  chemically synthesized
ttttttttttttttttgtattt

SEQ ID NO: 705095 - DNA, 22 bp, Artificial Sequence
  chemically synthesized
tttttttttttttttttgtatt

SEQ ID NO: 705096 - DNA, 22 bp, Artificial Sequence
  chemically synthesized
ttttttttttttttttttgtat

SEQ ID NO: 705097 - DNA, 22 bp, Artificial Sequence
  chemically synthesized
tttttttttttttttttttgta

SEQ ID NO: 705098 - DNA, 22 bp, Artificial Sequence
  chemically synthesized
ttttttttttttttttttttgt

SEQ ID NO: 705099 - DNA, 22 bp, Artificial Sequence
  chemically synthesized
tagtaaaaatacaaaaaaaaaa

SEQ ID NO: 705100 - DNA, 22 bp, Artificial Sequence
  chemically synthesized
gtaaaaatacaaaaaaaaaaaa

SEQ ID NO: 705101 - DNA, 22 bp, Artificial Sequence
  chemically synthesized
gatttttttttttttttttttt

SEQ ID NO: 705102 - DNA, 22 bp, Artificial Sequence
  chemically synthesized
ccgcgcctggattttttttttt

SEQ ID NO: 705103 - DNA, 22 bp, Artificial Sequence
  chemically synthesized
ggactaccgcgcctggattttt

SEQ ID NO: 705104 - DNA, 22 bp, Artificial Sequence
  chemically synthesized
ccgagtagctgggactaccgcg

SEQ ID NO: 705105 - DNA, 22 bp, Artificial Sequence
  chemically synthesized
agcctcccgagtagctgggact

SEQ ID NO: 705106 - DNA, 22 bp, Artificial Sequence
  chemically synthesized
cctcagcctcccgagtagctgg

SEQ ID NO: 705107 - DNA, 22 bp, Artificial Sequence
  chemically synthesized
ctgcctcagcctcccgagtagc

SEQ ID NO: 705108 - DNA, 22 bp, Artificial Sequence
  chemically synthesized
tcctgcctcagcctcccgagta

SEQ ID NO: 705109 - DNA, 22 bp, Artificial Sequence
  chemically synthesized
ttctcctgcctcagcctcccga

SEQ ID NO: 705110 - DNA, 22 bp, Artificial Sequence
  chemically synthesized
aagctattctcctgcctcagcc

SEQ ID NO: 705111 - DNA, 22 bp, Artificial Sequence
  chemically synthesized
ctcgggaggctgaggcaggaga

SEQ ID NO: 705112 - DNA, 22 bp, Artificial Sequence
  chemically synthesized
gggaggctgaggcaggagaata

SEQ ID NO: 705113 - DNA, 22 bp, Artificial Sequence
  chemically synthesized
ccaggttcaagctattctcctg

SEQ ID NO: 705114 - DNA, 22 bp, Artificial Sequence
  chemically synthesized
cgcctcccaggttcaagctatt

SEQ ID NO: 705115 - DNA, 22 bp, Artificial Sequence
  chemically synthesized
aggcaggagaatagcttgaacc

SEQ ID NO: 705116 - DNA, 22 bp, Artificial Sequence
  chemically synthesized
caacctccgcctcccaggttca

SEQ ID NO: 705117 - DNA, 22 bp, Artificial Sequence
  chemically synthesized
actgcaacctccgcctcccagg

SEQ ID NO: 705118 - DNA, 22 bp, Artificial Sequence
  chemically synthesized
gctcactgcaacctccgcctcc

SEQ ID NO: 705119 - DNA, 22 bp, Artificial Sequence
  chemically synthesized
ggctcactgcaacctccgcctc

SEQ ID NO: 705120 - DNA, 22 bp, Artificial Sequence
  chemically synthesized
gaacctgggaggcggaggttgc

SEQ ID NO: 705121 - DNA, 22 bp, Artificial Sequence
  chemically synthesized
aacctgggaggcggaggttgca

SEQ ID NO: 705122 - DNA, 22 bp, Artificial Sequence
  chemically synthesized
ggaggcggaggttgcagtgagc

SEQ ID NO: 705123 - DNA, 22 bp, Artificial Sequence
  chemically synthesized
gagtgcaatggcgtgatcttgg

SEQ ID NO: 705124 - DNA, 22 bp, Artificial Sequence
  chemically synthesized
cagtgagccaagatcacgccat

SEQ ID NO: 705125 - DNA, 22 bp, Artificial Sequence
  chemically synthesized
tcacccaaactggagtgcaatg

SEQ ID NO: 705126 - DNA, 22 bp, Artificial Sequence
  chemically synthesized
tgtcacccaaactggagtgcaa

SEQ ID NO: 705127 - DNA, 22 bp, Artificial Sequence
  chemically synthesized
ttctgtcacccaaactggagtg

SEQ ID NO: 705128 - DNA, 22 bp, Artificial Sequence
  chemically synthesized
gttctgtcacccaaactggagt

SEQ ID NO: 705129 - DNA, 22 bp, Artificial Sequence
  chemically synthesized
cactccagtttgggtgacagaa

SEQ ID NO: 705130 - DNA, 22 bp, Artificial Sequence
  chemically synthesized
agatggagtcttgttctgtcac

SEQ ID NO: 705131 - DNA, 22 bp, Artificial Sequence
  chemically synthesized
gagatggagtcttgttctgtca

SEQ ID NO: 705132 - DNA, 22 bp, Artificial Sequence
  chemically synthesized
tgagatggagtcttgttctgtc

SEQ ID NO: 705133 - DNA, 22 bp, Artificial Sequence
  chemically synthesized
cagtttgggtgacagaacaaga

SEQ ID NO: 705134 - DNA, 22 bp, Artificial Sequence
  chemically synthesized
ttttgagatggagtcttgttct

SEQ ID NO: 705135 - DNA, 22 bp, Artificial Sequence
  chemically synthesized
gttttgagatggagtcttgttc

SEQ ID NO: 705136 - DNA, 22 bp, Artificial Sequence
  chemically synthesized
tttgttttgagatggagtcttg

SEQ ID NO: 705137 - DNA, 22 bp, Artificial Sequence
  chemically synthesized
gggtgacagaacaagactccat

SEQ ID NO: 705138 - DNA, 22 bp, Artificial Sequence
  chemically synthesized
gtttgttttgagatggagtctt

SEQ ID NO: 705139 - DNA, 22 bp, Artificial Sequence
  chemically synthesized
ggtgacagaacaagactccatc

SEQ ID NO: 705140 - DNA, 22 bp, Artificial Sequence
  chemically synthesized
tttgtttgttttgagatggagt

SEQ ID NO: 705141 - DNA, 22 bp, Artificial Sequence
  chemically synthesized
gtttgtttgttttgagatggag

SEQ ID NO: 705142 - DNA, 22 bp, Artificial Sequence
  chemically synthesized
tgtttgtttgttttgagatgga

SEQ ID NO: 705143 - DNA, 22 bp, Artificial Sequence
  chemically synthesized
ttgtttgtttgttttgagatgg

SEQ ID NO: 705144 - DNA, 22 bp, Artificial Sequence
  chemically synthesized
tttgtttgtttgttttgagatg

SEQ ID NO: 705145 - DNA, 22 bp, Artificial Sequence
  chemically synthesized
ggctttttgtttgtttgttttg

SEQ ID NO: 705146 - DNA, 22 bp, Artificial Sequence
  chemically synthesized
catctcaaaacaaacaaacaaa

SEQ ID NO: 705147 - DNA, 22 bp, Artificial Sequence
  chemically synthesized
aaaacaaacaaacaaaaagccc

SEQ ID NO: 705148 - DNA, 22 bp, Artificial Sequence
  chemically synthesized
agataaggggcctgggcttttt

SEQ ID NO: 705149 - DNA, 22 bp, Artificial Sequence
  chemically synthesized
gagataaggggcctgggctttt

SEQ ID NO: 705150 - DNA, 22 bp, Artificial Sequence
  chemically synthesized
tgagataaggggcctgggcttt

SEQ ID NO: 705151 - DNA, 22 bp, Artificial Sequence
  chemically synthesized
ctttgagataaggggcctgggc

SEQ ID NO: 705152 - DNA, 22 bp, Artificial Sequence
  chemically synthesized
tccctactttgagataaggggc

SEQ ID NO: 705153 - DNA, 22 bp, Artificial Sequence
  chemically synthesized
gagaacaaattgtccctacttt

SEQ ID NO: 705154 - DNA, 22 bp, Artificial Sequence
  chemically synthesized
tggagaacaaattgtccctact

SEQ ID NO: 705155 - DNA, 22 bp, Artificial Sequence
  chemically synthesized
atctcaaagtagggacaatttg

SEQ ID NO: 705156 - DNA, 22 bp, Artificial Sequence
  chemically synthesized
tctcaaagtagggacaatttgt

SEQ ID NO: 705157 - DNA, 22 bp, Artificial Sequence
  chemically synthesized
aaagtagggacaatttgttctc

SEQ ID NO: 705158 - DNA, 22 bp, Artificial Sequence
  chemically synthesized
atcccacagggagctctggaga

SEQ ID NO: 705159 - DNA, 22 bp, Artificial Sequence
  chemically synthesized
gatcccacagggagctctggag

SEQ ID NO: 705160 - DNA, 22 bp, Artificial Sequence
  chemically synthesized
agcttgatcccacagggagctc

SEQ ID NO: 705161 - DNA, 22 bp, Artificial Sequence
  chemically synthesized
cagcttgatcccacagggagct

SEQ ID NO: 705162 - DNA, 22 bp, Artificial Sequence
  chemically synthesized
gttctccagagctccctgtggg

SEQ ID NO: 705163 - DNA, 22 bp, Artificial Sequence
  chemically synthesized
ttctccagagctccctgtggga

SEQ ID NO: 705164 - DNA, 22 bp, Artificial Sequence
  chemically synthesized
acttcagcttgatcccacaggg

SEQ ID NO: 705165 - DNA, 22 bp, Artificial Sequence
  chemically synthesized
tccagagctccctgtgggatca

SEQ ID NO: 705166 - DNA, 22 bp, Artificial Sequence
  chemically synthesized
cagagctccctgtgggatcaag

SEQ ID NO: 705167 - DNA, 22 bp, Artificial Sequence
  chemically synthesized
cctgtgggatcaagctgaagtg

SEQ ID NO: 705168 - DNA, 22 bp, Artificial Sequence
  chemically synthesized
tgggatcaagctgaagtgagtc

SEQ ID NO: 705169 - DNA, 22 bp, Artificial Sequence
  chemically synthesized
agtgggaaggaagagactcact

SEQ ID NO: 705170 - DNA, 22 bp, Artificial Sequence
  chemically synthesized
aagtgagtctcttccttcccac

SEQ ID NO: 705171 - DNA, 22 bp, Artificial Sequence
  chemically synthesized
gtcaaggagttaagtgggaagg

SEQ ID NO: 705172 - DNA, 22 bp, Artificial Sequence
  chemically synthesized
ttccttcccacttaactccttg

SEQ ID NO: 705173 - DNA, 22 bp, Artificial Sequence
  chemically synthesized
ccttcccacttaactccttgac

SEQ ID NO: 705174 - DNA, 22 bp, Artificial Sequence
  chemically synthesized
cttcccacttaactccttgacc

SEQ ID NO: 705175 - DNA, 22 bp, Artificial Sequence
  chemically synthesized
cccacttaactccttgaccagc

SEQ ID NO: 705176 - DNA, 22 bp, Artificial Sequence
  chemically synthesized
ccacttaactccttgaccagca

SEQ ID NO: 705177 - DNA, 22 bp, Artificial Sequence
  chemically synthesized
aactccttgaccagcatccttc

SEQ ID NO: 705178 - DNA, 22 bp, Artificial Sequence
  chemically synthesized
actccttgaccagcatccttct

SEQ ID NO: 705179 - DNA, 22 bp, Artificial Sequence
  chemically synthesized
cttgaccagcatccttcttact

SEQ ID NO: 705180 - DNA, 22 bp, Artificial Sequence
  chemically synthesized
gaccagcatccttcttacttta

SEQ ID NO: 705181 - DNA, 22 bp, Artificial Sequence
  chemically synthesized
accagcatccttcttactttat

SEQ ID NO: 705182 - DNA, 22 bp, Artificial Sequence
  chemically synthesized
cttactttatcctgcttccctc

SEQ ID NO: 705183 - DNA, 22 bp, Artificial Sequence
  chemically synthesized
ttactttatcctgcttccctca

SEQ ID NO: 705184 - DNA, 22 bp, Artificial Sequence
  chemically synthesized
aggtgaaagggagtgagggaag

SEQ ID NO: 705185 - DNA, 22 bp, Artificial Sequence
  chemically synthesized
actttatcctgcttccctcact

SEQ ID NO: 705186 - DNA, 22 bp, Artificial Sequence
  chemically synthesized
ctttatcctgcttccctcactc

SEQ ID NO: 705187 - DNA, 22 bp, Artificial Sequence
  chemically synthesized
ttcaggtgaaagggagtgaggg

SEQ ID NO: 705188 - DNA, 22 bp, Artificial Sequence
  chemically synthesized
gttcaggtgaaagggagtgagg

SEQ ID NO: 705189 - DNA, 22 bp, Artificial Sequence
  chemically synthesized
tatcctgcttccctcactccct

SEQ ID NO: 705190 - DNA, 22 bp, Artificial Sequence
  chemically synthesized
atcctgcttccctcactccctt

SEQ ID NO: 705191 - DNA, 22 bp, Artificial Sequence
  chemically synthesized
tcctgcttccctcactcccttt

SEQ ID NO: 705192 - DNA, 22 bp, Artificial Sequence
  chemically synthesized
cttccctcactccctttcacct

SEQ ID NO: 705193 - DNA, 22 bp, Artificial Sequence
  chemically synthesized
ccctcactccctttcacctgaa

SEQ ID NO: 705194 - DNA, 22 bp, Artificial Sequence
  chemically synthesized
cctcactccctttcacctgaac

SEQ ID NO: 705195 - DNA, 22 bp, Artificial Sequence
  chemically synthesized
tagaagtaatttgttcaggtga

SEQ ID NO: 705196 - DNA, 22 bp, Artificial Sequence
  chemically synthesized
gtagaagtaatttgttcaggtg

SEQ ID NO: 705197 - DNA, 22 bp, Artificial Sequence
  chemically synthesized
ttgtagaagtaatttgttcagg

SEQ ID NO: 705198 - DNA, 22 bp, Artificial Sequence
  chemically synthesized
actccctttcacctgaacaaat

SEQ ID NO: 705199 - DNA, 22 bp, Artificial Sequence
  chemically synthesized
cttgtagaagtaatttgttcag

SEQ ID NO: 705200 - DNA, 22 bp, Artificial Sequence
  chemically synthesized
cctttcacctgaacaaattact

SEQ ID NO: 705201 - DNA, 22 bp, Artificial Sequence
  chemically synthesized
tcacctgaacaaattacttcta

SEQ ID NO: 705202 - DNA, 22 bp, Artificial Sequence
  chemically synthesized
cacctgaacaaattacttctac

SEQ ID NO: 705203 - DNA, 22 bp, Artificial Sequence
  chemically synthesized
acctgaacaaattacttctaca

SEQ ID NO: 705204 - DNA, 22 bp, Artificial Sequence
  chemically synthesized
gatagatggggcttcttgtaga

SEQ ID NO: 705205 - DNA, 22 bp, Artificial Sequence
  chemically synthesized
aacaaattacttctacaagaag

SEQ ID NO: 705206 - DNA, 22 bp, Artificial Sequence
  chemically synthesized
agatagatggggcttcttgtag

SEQ ID NO: 705207 - DNA, 22 bp, Artificial Sequence
  chemically synthesized
tttagatagatggggcttcttg

SEQ ID NO: 705208 - DNA, 22 bp, Artificial Sequence
  chemically synthesized
cttctacaagaagccccatcta

SEQ ID NO: 705209 - DNA, 22 bp, Artificial Sequence
  chemically synthesized
ctacaagaagccccatctatct

SEQ ID NO: 705210 - DNA, 22 bp, Artificial Sequence
  chemically synthesized
tacaagaagccccatctatcta

SEQ ID NO: 705211 - DNA, 22 bp, Artificial Sequence
  chemically synthesized
caagaagccccatctatctaaa

SEQ ID NO: 705212 - DNA, 22 bp, Artificial Sequence
  chemically synthesized
gaagtagagccctatttagata

SEQ ID NO: 705213 - DNA, 22 bp, Artificial Sequence
  chemically synthesized
ggtaaaatccctagaagtagag

SEQ ID NO: 705214 - DNA, 22 bp, Artificial Sequence
  chemically synthesized
tctaaatagggctctacttcta

SEQ ID NO: 705215 - DNA, 22 bp, Artificial Sequence
  chemically synthesized
aggtaaaatccctagaagtaga

SEQ ID NO: 705216 - DNA, 22 bp, Artificial Sequence
  chemically synthesized
aatagggctctacttctaggga

SEQ ID NO: 705217 - DNA, 22 bp, Artificial Sequence
  chemically synthesized
gccttaggtaaaatccctagaa

SEQ ID NO: 705218 - DNA, 22 bp, Artificial Sequence
  chemically synthesized
accctagccttaggtaaaatcc

SEQ ID NO: 705219 - DNA, 22 bp, Artificial Sequence
  chemically synthesized
tacttctagggattttacctaa

SEQ ID NO: 705220 - DNA, 22 bp, Artificial Sequence
  chemically synthesized
ctcaccctagccttaggtaaaa

SEQ ID NO: 705221 - DNA, 22 bp, Artificial Sequence
  chemically synthesized
cttctagggattttacctaagg

SEQ ID NO: 705222 - DNA, 22 bp, Artificial Sequence
  chemically synthesized
ctagggattttacctaaggcta

SEQ ID NO: 705223 - DNA, 22 bp, Artificial Sequence
  chemically synthesized
tagggattttacctaaggctag

SEQ ID NO: 705224 - DNA, 22 bp, Artificial Sequence
  chemically synthesized
gggattttacctaaggctaggg

SEQ ID NO: 705225 - DNA, 22 bp, Artificial Sequence
  chemically synthesized
tacctaaggctagggtgagcaa

SEQ ID NO: 705226 - DNA, 22 bp, Artificial Sequence
  chemically synthesized
acctaaggctagggtgagcaac

SEQ ID NO: 705227 - DNA, 22 bp, Artificial Sequence
  chemically synthesized
cctaaggctagggtgagcaact

SEQ ID NO: 705228 - DNA, 22 bp, Artificial Sequence
  chemically synthesized
aggctagggtgagcaactatct

SEQ ID NO: 705229 - DNA, 22 bp, Artificial Sequence
  chemically synthesized
tagtcccaggcaaaccaagata

SEQ ID NO: 705230 - DNA, 22 bp, Artificial Sequence
  chemically synthesized
gggtgagcaactatcttggttt

SEQ ID NO: 705231 - DNA, 22 bp, Artificial Sequence
  chemically synthesized
tgtagtcccaggcaaaccaaga

SEQ ID NO: 705232 - DNA, 22 bp, Artificial Sequence
  chemically synthesized
caggaaatctctgtagtcccag

SEQ ID NO: 705233 - DNA, 22 bp, Artificial Sequence
  chemically synthesized
tcttggtttgcctgggactaca

SEQ ID NO: 705234 - DNA, 22 bp, Artificial Sequence
  chemically synthesized
ccaggaaatctctgtagtccca

SEQ ID NO: 705235 - DNA, 22 bp, Artificial Sequence
  chemically synthesized
tccaggaaatctctgtagtccc

SEQ ID NO: 705236 - DNA, 22 bp, Artificial Sequence
  chemically synthesized
ggtttgcctgggactacagaga

SEQ ID NO: 705237 - DNA, 22 bp, Artificial Sequence
  chemically synthesized
gtttgcctgggactacagagat

SEQ ID NO: 705238 - DNA, 22 bp, Artificial Sequence
  chemically synthesized
ccattttccaggaaatctctgt

SEQ ID NO: 705239 - DNA, 22 bp, Artificial Sequence
  chemically synthesized
gcctgggactacagagatttcc

SEQ ID NO: 705240 - DNA, 22 bp, Artificial Sequence
  chemically synthesized
cctgggactacagagatttcct

SEQ ID NO: 705241 - DNA, 22 bp, Artificial Sequence
  chemically synthesized
gaattcccattttccaggaaat

SEQ ID NO: 705242 - DNA, 22 bp, Artificial Sequence
  chemically synthesized
ggactacagagatttcctggaa

SEQ ID NO: 705243 - DNA, 22 bp, Artificial Sequence
  chemically synthesized
gcactggaattcccattttcca

SEQ ID NO: 705244 - DNA, 22 bp, Artificial Sequence
  chemically synthesized
cagagatttcctggaaaatggg

SEQ ID NO: 705245 - DNA, 22 bp, Artificial Sequence
  chemically synthesized
agcactggaattcccattttcc

SEQ ID NO: 705246 - DNA, 22 bp, Artificial Sequence
  chemically synthesized
ccggatttagcactggaattcc

SEQ ID NO: 705247 - DNA, 22 bp, Artificial Sequence
  chemically synthesized
cctggaaaatgggaattccagt

SEQ ID NO: 705248 - DNA, 22 bp, Artificial Sequence
  chemically synthesized
cccggatttagcactggaattc

SEQ ID NO: 705249 - DNA, 22 bp, Artificial Sequence
  chemically synthesized
ctggaaaatgggaattccagtg

SEQ ID NO: 705250 - DNA, 22 bp, Artificial Sequence
  chemically synthesized
tcccggatttagcactggaatt

SEQ ID NO: 705251 - DNA, 22 bp, Artificial Sequence
  chemically synthesized
gaaaatgggaattccagtgcta

SEQ ID NO: 705252 - DNA, 22 bp, Artificial Sequence
  chemically synthesized
ggactttcccggatttagcact

SEQ ID NO: 705253 - DNA, 22 bp, Artificial Sequence
  chemically synthesized
tctgggactttcccggatttag

SEQ ID NO: 705254 - DNA, 22 bp, Artificial Sequence
  chemically synthesized
gtctgggactttcccggattta

SEQ ID NO: 705255 - DNA, 22 bp, Artificial Sequence
  chemically synthesized
gtttgtctgggactttcccgga

SEQ ID NO: 705256 - DNA, 22 bp, Artificial Sequence
  chemically synthesized
cagtgctaaatccgggaaagtc

SEQ ID NO: 705257 - DNA, 22 bp, Artificial Sequence
  chemically synthesized
atcctggtttgtctgggacttt

SEQ ID NO: 705258 - DNA, 22 bp, Artificial Sequence
  chemically synthesized
aatccgggaaagtcccagacaa

SEQ ID NO: 705259 - DNA, 22 bp, Artificial Sequence
  chemically synthesized
cagagtgaccactcatcctggt

SEQ ID NO: 705260 - DNA, 22 bp, Artificial Sequence
  chemically synthesized
tgtgcgttgcagagtgaccact

SEQ ID NO: 705261 - DNA, 22 bp, Artificial Sequence
  chemically synthesized
atgtgcgttgcagagtgaccac

SEQ ID NO: 705262 - DNA, 22 bp, Artificial Sequence
  chemically synthesized
aggatccaaatatttatgtgcg

SEQ ID NO: 705263 - DNA, 22 bp, Artificial Sequence
  chemically synthesized
tgcaacgcacataaatatttgg

SEQ ID NO: 705264 - DNA, 22 bp, Artificial Sequence
  chemically synthesized
caacgcacataaatatttggat

SEQ ID NO: 705265 - DNA, 22 bp, Artificial Sequence
  chemically synthesized
gcaggaaggatgctcaggatcc

SEQ ID NO: 705266 - DNA, 22 bp, Artificial Sequence
  chemically synthesized
agcaggaaggatgctcaggatc

SEQ ID NO: 705267 - DNA, 22 bp, Artificial Sequence
  chemically synthesized
ataaacttagcaggaaggatgc

SEQ ID NO: 705268 - DNA, 22 bp, Artificial Sequence
  chemically synthesized
cataaacttagcaggaaggatg

SEQ ID NO: 705269 - DNA, 22 bp, Artificial Sequence
  chemically synthesized
ggatcctgagcatccttcctgc

SEQ ID NO: 705270 - DNA, 22 bp, Artificial Sequence
  chemically synthesized
gatcctgagcatccttcctgct

SEQ ID NO: 705271 - DNA, 22 bp, Artificial Sequence
  chemically synthesized
agcatccttcctgctaagttta

SEQ ID NO: 705272 - DNA, 22 bp, Artificial Sequence
  chemically synthesized
taggcaaagaatcttcataaac

SEQ ID NO: 705273 - DNA, 22 bp, Artificial Sequence
  chemically synthesized
cctgctaagtttatgaagattc

SEQ ID NO: 705274 - DNA, 22 bp, Artificial Sequence
  chemically synthesized
ctgctaagtttatgaagattct

SEQ ID NO: 705275 - DNA, 22 bp, Artificial Sequence
  chemically synthesized
ctaagtttatgaagattctttg

SEQ ID NO: 705276 - DNA, 22 bp, Artificial Sequence
  chemically synthesized
aagtccctgtaggcaaagaatc

SEQ ID NO: 705277 - DNA, 22 bp, Artificial Sequence
  chemically synthesized
agtttatgaagattctttgcct

SEQ ID NO: 705278 - DNA, 22 bp, Artificial Sequence
  chemically synthesized
atgaagattctttgcctacagg

SEQ ID NO: 705279 - DNA, 22 bp, Artificial Sequence
  chemically synthesized
tgaagattctttgcctacaggg

SEQ ID NO: 705280 - DNA, 22 bp, Artificial Sequence
  chemically synthesized
gatcactcaagtccctgtaggc

SEQ ID NO: 705281 - DNA, 22 bp, Artificial Sequence
  chemically synthesized
ggatcactcaagtccctgtagg

SEQ ID NO: 705282 - DNA, 22 bp, Artificial Sequence
  chemically synthesized
tttggatcactcaagtccctgt

SEQ ID NO: 705283 - DNA, 22 bp, Artificial Sequence
  chemically synthesized
tttgcctacagggacttgagtg

SEQ ID NO: 705284 - DNA, 22 bp, Artificial Sequence
  chemically synthesized
tgttatttggatcactcaagtc

SEQ ID NO: 705285 - DNA, 22 bp, Artificial Sequence
  chemically synthesized
tgcctacagggacttgagtgat

SEQ ID NO: 705286 - DNA, 22 bp, Artificial Sequence
  chemically synthesized
gcctacagggacttgagtgatc

SEQ ID NO: 705287 - DNA, 22 bp, Artificial Sequence
  chemically synthesized
cctacagggacttgagtgatcc

SEQ ID NO: 705288 - DNA, 22 bp, Artificial Sequence
  chemically synthesized
tctatgttatttggatcactca

SEQ ID NO: 705289 - DNA, 22 bp, Artificial Sequence
  chemically synthesized
atctatgttatttggatcactc

SEQ ID NO: 705290 - DNA, 22 bp, Artificial Sequence
  chemically synthesized
cagggacttgagtgatccaaat

SEQ ID NO: 705291 - DNA, 22 bp, Artificial Sequence
  chemically synthesized
atttatctatgttatttggatc

SEQ ID NO: 705292 - DNA, 22 bp, Artificial Sequence
  chemically synthesized
gagtgatccaaataacatagat

SEQ ID NO: 705293 - DNA, 22 bp, Artificial Sequence
  chemically synthesized
agtgatccaaataacatagata

SEQ ID NO: 705294 - DNA, 22 bp, Artificial Sequence
  chemically synthesized
ccagaaatgactaatttatcta

SEQ ID NO: 705295 - DNA, 22 bp, Artificial Sequence
  chemically synthesized
cccagaaatgactaatttatct

SEQ ID NO: 705296 - DNA, 22 bp, Artificial Sequence
  chemically synthesized
tgcatagatggtttcccagaaa

SEQ ID NO: 705297 - DNA, 22 bp, Artificial Sequence
  chemically synthesized
gtgcatagatggtttcccagaa

SEQ ID NO: 705298 - DNA, 22 bp, Artificial Sequence
  chemically synthesized
tgtgcatagatggtttcccaga

SEQ ID NO: 705299 - DNA, 22 bp, Artificial Sequence
  chemically synthesized
ttgtgcatagatggtttcccag

SEQ ID NO: 705300 - DNA, 22 bp, Artificial Sequence
  chemically synthesized
tttgtgcatagatggtttccca

SEQ ID NO: 705301 - DNA, 22 bp, Artificial Sequence
  chemically synthesized
ttttgtgcatagatggtttccc

SEQ ID NO: 705302 - DNA, 22 bp, Artificial Sequence
  chemically synthesized
tttttgtgcatagatggtttcc

SEQ ID NO: 705303 - DNA, 22 bp, Artificial Sequence
  chemically synthesized
ttttttgtgcatagatggtttc

SEQ ID NO: 705304 - DNA, 22 bp, Artificial Sequence
  chemically synthesized
gtcatttctgggaaaccatcta

SEQ ID NO: 705305 - DNA, 22 bp, Artificial Sequence
  chemically synthesized
tttttttgtgcatagatggttt

SEQ ID NO: 705306 - DNA, 22 bp, Artificial Sequence
  chemically synthesized
ttttttttgtgcatagatggtt

SEQ ID NO: 705307 - DNA, 22 bp, Artificial Sequence
  chemically synthesized
tttttttttgtgcatagatggt

SEQ ID NO: 705308 - DNA, 22 bp, Artificial Sequence
  chemically synthesized
ttttttttttgtgcatagatgg

SEQ ID NO: 705309 - DNA, 22 bp, Artificial Sequence
  chemically synthesized
tttttttttttgtgcatagatg

SEQ ID NO: 705310 - DNA, 22 bp, Artificial Sequence
  chemically synthesized
ttttttttttttgtgcatagat

SEQ ID NO: 705311 - DNA, 22 bp, Artificial Sequence
  chemically synthesized
tttttttttttttgtgcataga

SEQ ID NO: 705312 - DNA, 22 bp, Artificial Sequence
  chemically synthesized
ctgggaaaccatctatgcacaa

SEQ ID NO: 705313 - DNA, 22 bp, Artificial Sequence
  chemically synthesized
ttttttttttttttgtgcatag

SEQ ID NO: 705314 - DNA, 22 bp, Artificial Sequence
  chemically synthesized
tgggaaaccatctatgcacaaa

SEQ ID NO: 705315 - DNA, 22 bp, Artificial Sequence
  chemically synthesized
tttttttttttttttgtgcata

SEQ ID NO: 705316 - DNA, 22 bp, Artificial Sequence
  chemically synthesized
ttttttttttttttttgtgcat

SEQ ID NO: 705317 - DNA, 22 bp, Artificial Sequence
  chemically synthesized
ggaaaccatctatgcacaaaaa

SEQ ID NO: 705318 - DNA, 22 bp, Artificial Sequence
  chemically synthesized
tttttttttttttttttgtgca

SEQ ID NO: 705319 - DNA, 22 bp, Artificial Sequence
  chemically synthesized
ttttttttttttttttttgtgc

SEQ ID NO: 705320 - DNA, 22 bp, Artificial Sequence
  chemically synthesized
tttttttttttttttttttgtg

SEQ ID NO: 705321 - DNA, 22 bp, Artificial Sequence
  chemically synthesized
tttttttttttttttttttttt

SEQ ID NO: 705322 - DNA, 22 bp, Artificial Sequence
  chemically synthesized
gttttttttttttttttttttt

SEQ ID NO: 705323 - DNA, 22 bp, Artificial Sequence
  chemically synthesized
tgtttttttttttttttttttt

SEQ ID NO: 705324 - DNA, 22 bp, Artificial Sequence
  chemically synthesized
tgcacaaaaaaaaaaaaaaaaa

SEQ ID NO: 705325 - DNA, 22 bp, Artificial Sequence
  chemically synthesized
gggcactttgtttttttttttt

SEQ ID NO: 705326 - DNA, 22 bp, Artificial Sequence
  chemically synthesized
caaattggggcactttgttttt

SEQ ID NO: 705327 - DNA, 22 bp, Artificial Sequence
  chemically synthesized
gcaaatactacaaattggggca

SEQ ID NO: 705328 - DNA, 22 bp, Artificial Sequence
  chemically synthesized
catggaaattggcaaatactac

SEQ ID NO: 705329 - DNA, 22 bp, Artificial Sequence
  chemically synthesized
ctccatggaaattggcaaatac

SEQ ID NO: 705330 - DNA, 22 bp, Artificial Sequence
  chemically synthesized
actccatggaaattggcaaata

SEQ ID NO: 705331 - DNA, 22 bp, Artificial Sequence
  chemically synthesized
gtagtatttgccaatttccatg

SEQ ID NO: 705332 - DNA, 22 bp, Artificial Sequence
  chemically synthesized
tagtatttgccaatttccatgg

SEQ ID NO: 705333 - DNA, 22 bp, Artificial Sequence
  chemically synthesized
gccaatttccatggagtaaatc

SEQ ID NO: 705334 - DNA, 22 bp, Artificial Sequence
  chemically synthesized
ccaatttccatggagtaaatct

SEQ ID NO: 705335 - DNA, 22 bp, Artificial Sequence
  chemically synthesized
aaatcaggcatagtgggaagat

SEQ ID NO: 705336 - DNA, 22 bp, Artificial Sequence
  chemically synthesized
ccatggagtaaatcttcccact

SEQ ID NO: 705337 - DNA, 22 bp, Artificial Sequence
  chemically synthesized
gaaatcaggcatagtgggaaga

SEQ ID NO: 705338 - DNA, 22 bp, Artificial Sequence
  chemically synthesized
catggagtaaatcttcccacta

SEQ ID NO: 705339 - DNA, 22 bp, Artificial Sequence
  chemically synthesized
gtagcttgaaatcaggcatagt

SEQ ID NO: 705340 - DNA, 22 bp, Artificial Sequence
  chemically synthesized
ggtagcttgaaatcaggcatag

SEQ ID NO: 705341 - DNA, 22 bp, Artificial Sequence
  chemically synthesized
tggtagcttgaaatcaggcata

SEQ ID NO: 705342 - DNA, 22 bp, Artificial Sequence
  chemically synthesized
cctttggtagcttgaaatcagg

SEQ ID NO: 705343 - DNA, 22 bp, Artificial Sequence
  chemically synthesized
cccactatgcctgatttcaagc

SEQ ID NO: 705344 - DNA, 22 bp, Artificial Sequence
  chemically synthesized
ccactatgcctgatttcaagct

SEQ ID NO: 705345 - DNA, 22 bp, Artificial Sequence
  chemically synthesized
agcctacctttggtagcttgaa

SEQ ID NO: 705346 - DNA, 22 bp, Artificial Sequence
  chemically synthesized
ttaagcctacctttggtagctt

SEQ ID NO: 705347 - DNA, 22 bp, Artificial Sequence
  chemically synthesized
tgcctgatttcaagctaccaaa

SEQ ID NO: 705348 - DNA, 22 bp, Artificial Sequence
  chemically synthesized
gttattaagcctacctttggta

SEQ ID NO: 705349 - DNA, 22 bp, Artificial Sequence
  chemically synthesized
atttcaagctaccaaaggtagg

SEQ ID NO: 705350 - DNA, 22 bp, Artificial Sequence
  chemically synthesized
caagctaccaaaggtaggctta

SEQ ID NO: 705351 - DNA, 22 bp, Artificial Sequence
  chemically synthesized
tgagctagttattaagcctacc

SEQ ID NO: 705352 - DNA, 22 bp, Artificial Sequence
  chemically synthesized
aagctaccaaaggtaggcttaa

SEQ ID NO: 705353 - DNA, 22 bp, Artificial Sequence
  chemically synthesized
ccaaaggtaggcttaataacta

SEQ ID NO: 705354 - DNA, 22 bp, Artificial Sequence
  chemically synthesized
taaaatatacaggaattgtgag

SEQ ID NO: 705355 - DNA, 22 bp, Artificial Sequence
  chemically synthesized
aataactagctcacaattcctg

SEQ ID NO: 705356 - DNA, 22 bp, Artificial Sequence
  chemically synthesized
ataactagctcacaattcctgt

SEQ ID NO: 705357 - DNA, 22 bp, Artificial Sequence
  chemically synthesized
gctcacaattcctgtatatttt

SEQ ID NO: 705358 - DNA, 22 bp, Artificial Sequence
  chemically synthesized
aagagagccaattgtaaaatat

SEQ ID NO: 705359 - DNA, 22 bp, Artificial Sequence
  chemically synthesized
acaattcctgtatattttacaa

SEQ ID NO: 705360 - DNA, 22 bp, Artificial Sequence
  chemically synthesized
ctgtatattttacaattggctc

SEQ ID NO: 705361 - DNA, 22 bp, Artificial Sequence
  chemically synthesized
caatggctcaagagagccaatt

SEQ ID NO: 705362 - DNA, 22 bp, Artificial Sequence
  chemically synthesized
acaatggctcaagagagccaat

SEQ ID NO: 705363 - DNA, 22 bp, Artificial Sequence
  chemically synthesized
tatattttacaattggctctct

SEQ ID NO: 705364 - DNA, 22 bp, Artificial Sequence
  chemically synthesized
gcttacaatggctcaagagagc

SEQ ID NO: 705365 - DNA, 22 bp, Artificial Sequence
  chemically synthesized
tacaattggctctcttgagcca

SEQ ID NO: 705366 - DNA, 22 bp, Artificial Sequence
  chemically synthesized
acaattggctctcttgagccat

SEQ ID NO: 705367 - DNA, 22 bp, Artificial Sequence
  chemically synthesized
caattggctctcttgagccatt

SEQ ID NO: 705368 - DNA, 22 bp, Artificial Sequence
  chemically synthesized
gggctggcttacaatggctcaa

SEQ ID NO: 705369 - DNA, 22 bp, Artificial Sequence
  chemically synthesized
tgctggggctggcttacaatgg

SEQ ID NO: 705370 - DNA, 22 bp, Artificial Sequence
  chemically synthesized
gctctcttgagccattgtaagc

SEQ ID NO: 705371 - DNA, 22 bp, Artificial Sequence
  chemically synthesized
tgtgctggggctggcttacaat

SEQ ID NO: 705372 - DNA, 22 bp, Artificial Sequence
  chemically synthesized
ctgtgctggggctggcttacaa

SEQ ID NO: 705373 - DNA, 22 bp, Artificial Sequence
  chemically synthesized
tcttgagccattgtaagccagc

SEQ ID NO: 705374 - DNA, 22 bp, Artificial Sequence
  chemically synthesized
ttgagccattgtaagccagccc

SEQ ID NO: 705375 - DNA, 22 bp, Artificial Sequence
  chemically synthesized
gagccattgtaagccagcccca

SEQ ID NO: 705376 - DNA, 22 bp, Artificial Sequence
  chemically synthesized
agccattgtaagccagccccag

SEQ ID NO: 705377 - DNA, 22 bp, Artificial Sequence
  chemically synthesized
tgggaatttctgtgctggggct

SEQ ID NO: 705378 - DNA, 22 bp, Artificial Sequence
  chemically synthesized
ctatgggaatttctgtgctggg

SEQ ID NO: 705379 - DNA, 22 bp, Artificial Sequence
  chemically synthesized
tgctatgggaatttctgtgctg

SEQ ID NO: 705380 - DNA, 22 bp, Artificial Sequence
  chemically synthesized
taagccagccccagcacagaaa

SEQ ID NO: 705381 - DNA, 22 bp, Artificial Sequence
  chemically synthesized
ctgctatgggaatttctgtgct

SEQ ID NO: 705382 - DNA, 22 bp, Artificial Sequence
  chemically synthesized
tttctgctatgggaatttctgt

SEQ ID NO: 705383 - DNA, 22 bp, Artificial Sequence
  chemically synthesized
gtttctgctatgggaatttctg

SEQ ID NO: 705384 - DNA, 22 bp, Artificial Sequence
  chemically synthesized
tgtttctgctatgggaatttct

SEQ ID NO: 705385 - DNA, 22 bp, Artificial Sequence
  chemically synthesized
ttgtttctgctatgggaatttc

SEQ ID NO: 705386 - DNA, 22 bp, Artificial Sequence
  chemically synthesized
ccatagcagaaacaaaaacgtt

SEQ ID NO: 705387 - DNA, 22 bp, Artificial Sequence
  chemically synthesized
aacacatgaggaaacagaacgt

SEQ ID NO: 705388 - DNA, 22 bp, Artificial Sequence
  chemically synthesized
gaacacatgaggaaacagaacg

SEQ ID NO: 705389 - DNA, 22 bp, Artificial Sequence
  chemically synthesized
tatatcccatcaatttgaacac

SEQ ID NO: 705390 - DNA, 22 bp, Artificial Sequence
  chemically synthesized
tgtttcctcatgtgttcaaatt

SEQ ID NO: 705391 - DNA, 22 bp, Artificial Sequence
  chemically synthesized
tttcctcatgtgttcaaattga

SEQ ID NO: 705392 - DNA, 22 bp, Artificial Sequence
  chemically synthesized
cctcatgtgttcaaattgatgg

SEQ ID NO: 705393 - DNA, 22 bp, Artificial Sequence
  chemically synthesized
gccctatatatcccatcaattt

SEQ ID NO: 705394 - DNA, 22 bp, Artificial Sequence
  chemically synthesized
ctcatgtgttcaaattgatggg

SEQ ID NO: 705395 - DNA, 22 bp, Artificial Sequence
  chemically synthesized
atgtgttcaaattgatgggata

SEQ ID NO: 705396 - DNA, 22 bp, Artificial Sequence
  chemically synthesized
catcgttggccctatatatccc

SEQ ID NO: 705397 - DNA, 22 bp, Artificial Sequence
  chemically synthesized
gcatcgttggccctatatatcc

SEQ ID NO: 705398 - DNA, 22 bp, Artificial Sequence
  chemically synthesized
tgcatcgttggccctatatatc

SEQ ID NO: 705399 - DNA, 22 bp, Artificial Sequence
  chemically synthesized
aaattgatgggatatatagggc

SEQ ID NO: 705400 - DNA, 22 bp, Artificial Sequence
  chemically synthesized
atgggatatatagggccaacga

SEQ ID NO: 705401 - DNA, 22 bp, Artificial Sequence
  chemically synthesized
gcaaccagattttgcatcgttg

SEQ ID NO: 705402 - DNA, 22 bp, Artificial Sequence
  chemically synthesized
cagtatcattagcaaccagatt

SEQ ID NO: 705403 - DNA, 22 bp, Artificial Sequence
  chemically synthesized
acagtatcattagcaaccagat

SEQ ID NO: 705404 - DNA, 22 bp, Artificial Sequence
  chemically synthesized
tacagtatcattagcaaccaga

SEQ ID NO: 705405 - DNA, 22 bp, Artificial Sequence
  chemically synthesized
ctttacagtatcattagcaacc

SEQ ID NO: 705406 - DNA, 22 bp, Artificial Sequence
  chemically synthesized
gctttacagtatcattagcaac

SEQ ID NO: 705407 - DNA, 22 bp, Artificial Sequence
  chemically synthesized
tttgctttacagtatcattagc

SEQ ID NO: 705408 - DNA, 22 bp, Artificial Sequence
  chemically synthesized
atttgctttacagtatcattag

SEQ ID NO: 705409 - DNA, 22 bp, Artificial Sequence
  chemically synthesized
agatttatttgctttacagtat

SEQ ID NO: 705410 - DNA, 22 bp, Artificial Sequence
  chemically synthesized
gttgctaatgatactgtaaagc

SEQ ID NO: 705411 - DNA, 22 bp, Artificial Sequence
  chemically synthesized
tcagatttatttgctttacagt

SEQ ID NO: 705412 - DNA, 22 bp, Artificial Sequence
  chemically synthesized
ctaatgatactgtaaagcaaat

SEQ ID NO: 705413 - DNA, 22 bp, Artificial Sequence
  chemically synthesized
atgatactgtaaagcaaataaa

SEQ ID NO: 705414 - DNA, 22 bp, Artificial Sequence
  chemically synthesized
cccaataagctctcagatttat

SEQ ID NO: 705415 - DNA, 22 bp, Artificial Sequence
  chemically synthesized
taaagcaaataaatctgagagc

SEQ ID NO: 705416 - DNA, 22 bp, Artificial Sequence
  chemically synthesized
aaatgtatactccccaataagc

SEQ ID NO: 705417 - DNA, 22 bp, Artificial Sequence
  chemically synthesized
gctcaaatgtatactccccaat

SEQ ID NO: 705418 - DNA, 22 bp, Artificial Sequence
  chemically synthesized
agctcaaatgtatactccccaa

SEQ ID NO: 705419 - DNA, 22 bp, Artificial Sequence
  chemically synthesized
tagctcaaatgtatactcccca

SEQ ID NO: 705420 - DNA, 22 bp, Artificial Sequence
  chemically synthesized
agagcttattggggagtataca

SEQ ID NO: 705421 - DNA, 22 bp, Artificial Sequence
  chemically synthesized
ctttagctcaaatgtatactcc

SEQ ID NO: 705422 - DNA, 22 bp, Artificial Sequence
  chemically synthesized
tcctttagctcaaatgtatact

SEQ ID NO: 705423 - DNA, 22 bp, Artificial Sequence
  chemically synthesized
ctcctttagctcaaatgtatac

SEQ ID NO: 705424 - DNA, 22 bp, Artificial Sequence
  chemically synthesized
tctcctttagctcaaatgtata

SEQ ID NO: 705425 - DNA, 22 bp, Artificial Sequence
  chemically synthesized
ttctcctttagctcaaatgtat

SEQ ID NO: 705426 - DNA, 22 bp, Artificial Sequence
  chemically synthesized
attggggagtatacatttgagc

SEQ ID NO: 705427 - DNA, 22 bp, Artificial Sequence
  chemically synthesized
ttggggagtatacatttgagct

SEQ ID NO: 705428 - DNA, 22 bp, Artificial Sequence
  chemically synthesized
gggagtatacatttgagctaaa

SEQ ID NO: 705429 - DNA, 22 bp, Artificial Sequence
  chemically synthesized
tcatggcccttttctcctttag

SEQ ID NO: 705430 - DNA, 22 bp, Artificial Sequence
  chemically synthesized
gagctaaaggagaaaagggcca

SEQ ID NO: 705431 - DNA, 22 bp, Artificial Sequence
  chemically synthesized
agctaaaggagaaaagggccat

SEQ ID NO: 705432 - DNA, 22 bp, Artificial Sequence
  chemically synthesized
aaatgtgttgtcatggcccttt

SEQ ID NO: 705433 - DNA, 22 bp, Artificial Sequence
  chemically synthesized
aaaatgtgttgtcatggccctt

SEQ ID NO: 705434 - DNA, 22 bp, Artificial Sequence
  chemically synthesized
ttaaaatgtgttgtcatggccc

SEQ ID NO: 705435 - DNA, 22 bp, Artificial Sequence
  chemically synthesized
cttaaaatgtgttgtcatggcc

SEQ ID NO: 705436 - DNA, 22 bp, Artificial Sequence
  chemically synthesized
aaggagaaaagggccatgacaa

SEQ ID NO: 705437 - DNA, 22 bp, Artificial Sequence
  chemically synthesized
ttcttaaaatgtgttgtcatgg

SEQ ID NO: 705438 - DNA, 22 bp, Artificial Sequence
  chemically synthesized
tcttcttaaaatgtgttgtcat

SEQ ID NO: 705439 - DNA, 22 bp, Artificial Sequence
  chemically synthesized
tattctcttcttaaaatgtgtt

SEQ ID NO: 705440 - DNA, 22 bp, Artificial Sequence
  chemically synthesized
cagcagtaataattatattctc

SEQ ID NO: 705441 - DNA, 22 bp, Artificial Sequence
  chemically synthesized
taagaagagaatataattatta

SEQ ID NO: 705442 - DNA, 22 bp, Artificial Sequence
  chemically synthesized
aagaagagaatataattattac

SEQ ID NO: 705443 - DNA, 22 bp, Artificial Sequence
  chemically synthesized
agaagagaatataattattact

SEQ ID NO: 705444 - DNA, 22 bp, Artificial Sequence
  chemically synthesized
caatgcccataaaaagcagcta

SEQ ID NO: 705445 - DNA, 22 bp, Artificial Sequence
  chemically synthesized
ccaatgcccataaaaagcagct

SEQ ID NO: 705446 - DNA, 22 bp, Artificial Sequence
  chemically synthesized
tccaatgcccataaaaagcagc

SEQ ID NO: 705447 - DNA, 22 bp, Artificial Sequence
  chemically synthesized
ttactgctgtagctgcttttta

SEQ ID NO: 705448 - DNA, 22 bp, Artificial Sequence
  chemically synthesized
ctgctgtagctgctttttatgg

SEQ ID NO: 705449 - DNA, 22 bp, Artificial Sequence
  chemically synthesized
ctgtagctgctttttatgggca

SEQ ID NO: 705450 - DNA, 22 bp, Artificial Sequence
  chemically synthesized
tagctgctttttatgggcattg

SEQ ID NO: 705451 - DNA, 22 bp, Artificial Sequence
  chemically synthesized
aaagacagcctttccaatgccc

SEQ ID NO: 705452 - DNA, 22 bp, Artificial Sequence
  chemically synthesized
ctttttatgggcattggaaagg

SEQ ID NO: 705453 - DNA, 22 bp, Artificial Sequence
  chemically synthesized
tttatgggcattggaaaggctg

SEQ ID NO: 705454 - DNA, 22 bp, Artificial Sequence
  chemically synthesized
taaattcaaagacagcctttcc

SEQ ID NO: 705455 - DNA, 22 bp, Artificial Sequence
  chemically synthesized
ttatgggcattggaaaggctgt

SEQ ID NO: 705456 - DNA, 22 bp, Artificial Sequence
  chemically synthesized
tatgggcattggaaaggctgtc

SEQ ID NO: 705457 - DNA, 22 bp, Artificial Sequence
  chemically synthesized
atgggcattggaaaggctgtct

SEQ ID NO: 705458 - DNA, 22 bp, Artificial Sequence
  chemically synthesized
tgggcattggaaaggctgtctt

SEQ ID NO: 705459 - DNA, 22 bp, Artificial Sequence
  chemically synthesized
ataatgcccctataaattcaaa

SEQ ID NO: 705460 - DNA, 22 bp, Artificial Sequence
  chemically synthesized
gaaaggctgtctttgaatttat

SEQ ID NO: 705461 - DNA, 22 bp, Artificial Sequence
  chemically synthesized
tctttgaatttataggggcatt

SEQ ID NO: 705462 - DNA, 22 bp, Artificial Sequence
  chemically synthesized
ccagtgatgctgataatgcccc

SEQ ID NO: 705463 - DNA, 22 bp, Artificial Sequence
  chemically synthesized
tgaatttataggggcattatca

SEQ ID NO: 705464 - DNA, 22 bp, Artificial Sequence
  chemically synthesized
gaatttataggggcattatcag

SEQ ID NO: 705465 - DNA, 22 bp, Artificial Sequence
  chemically synthesized
aatttataggggcattatcagc

SEQ ID NO: 705466 - DNA, 22 bp, Artificial Sequence
  chemically synthesized
ataggggcattatcagcatcac

SEQ ID NO: 705467 - DNA, 22 bp, Artificial Sequence
  chemically synthesized
taggggcattatcagcatcact

SEQ ID NO: 705468 - DNA, 22 bp, Artificial Sequence
  chemically synthesized
tcagcatcactggtaggtcaca

SEQ ID NO: 705469 - DNA, 22 bp, Artificial Sequence
  chemically synthesized
ggacaaatgccatgtgacctac

SEQ ID NO: 705470 - DNA, 22 bp, Artificial Sequence
  chemically synthesized
gggacaaatgccatgtgaccta

SEQ ID NO: 705471 - DNA, 22 bp, Artificial Sequence
  chemically synthesized
ggaatttgggacaaatgccatg

SEQ ID NO: 705472 - DNA, 22 bp, Artificial Sequence
  chemically synthesized
gtaggtcacatggcatttgtcc

SEQ ID NO: 705473 - DNA, 22 bp, Artificial Sequence
  chemically synthesized
tcccaagtgttaggaatttggg

SEQ ID NO: 705474 - DNA, 22 bp, Artificial Sequence
  chemically synthesized
gtcccaaattcctaacacttgg

SEQ ID NO: 705475 - DNA, 22 bp, Artificial Sequence
  chemically synthesized
tcccaaattcctaacacttggg

SEQ ID NO: 705476 - DNA, 22 bp, Artificial Sequence
  chemically synthesized
agcagtcacatgttgtcccaag

SEQ ID NO: 705477 - DNA, 22 bp, Artificial Sequence
  chemically synthesized
cagcagtcacatgttgtcccaa

SEQ ID NO: 705478 - DNA, 22 bp, Artificial Sequence
  chemically synthesized
ttcagcagtcacatgttgtccc

SEQ ID NO: 705479 - DNA, 22 bp, Artificial Sequence
  chemically synthesized
cttcagcagtcacatgttgtcc

SEQ ID NO: 705480 - DNA, 22 bp, Artificial Sequence
  chemically synthesized
ctaacacttgggacaacatgtg

SEQ ID NO: 705481 - DNA, 22 bp, Artificial Sequence
  chemically synthesized
acacttgggacaacatgtgact

SEQ ID NO: 705482 - DNA, 22 bp, Artificial Sequence
  chemically synthesized
agccagtttcttcagcagtcac

SEQ ID NO: 705483 - DNA, 22 bp, Artificial Sequence
  chemically synthesized
gagccagtttcttcagcagtca

SEQ ID NO: 705484 - DNA, 22 bp, Artificial Sequence
  chemically synthesized
gggacaacatgtgactgctgaa

SEQ ID NO: 705485 - DNA, 22 bp, Artificial Sequence
  chemically synthesized
ggacaacatgtgactgctgaag

SEQ ID NO: 705486 - DNA, 22 bp, Artificial Sequence
  chemically synthesized
agggtgaaatgatttgagccag

SEQ ID NO: 705487 - DNA, 22 bp, Artificial Sequence
  chemically synthesized
ctgaagaaactggctcaaatca

SEQ ID NO: 705488 - DNA, 22 bp, Artificial Sequence
  chemically synthesized
aagaaactggctcaaatcattt

SEQ ID NO: 705489 - DNA, 22 bp, Artificial Sequence
  chemically synthesized
aagtaaaatctcagggtgaaat

SEQ ID NO: 705490 - DNA, 22 bp, Artificial Sequence
  chemically synthesized
caagtaaaatctcagggtgaaa

SEQ ID NO: 705491 - DNA, 22 bp, Artificial Sequence
  chemically synthesized
tcaagtaaaatctcagggtgaa

SEQ ID NO: 705492 - DNA, 22 bp, Artificial Sequence
  chemically synthesized
gctcaaatcatttcaccctgag

SEQ ID NO: 705493 - DNA, 22 bp, Artificial Sequence
  chemically synthesized
tttcaagtaaaatctcagggtg

SEQ ID NO: 705494 - DNA, 22 bp, Artificial Sequence
  chemically synthesized
tctttcaagtaaaatctcaggg

SEQ ID NO: 705495 - DNA, 22 bp, Artificial Sequence
  chemically synthesized
aaatcatttcaccctgagattt

SEQ ID NO: 705496 - DNA, 22 bp, Artificial Sequence
  chemically synthesized
aaattctctttcaagtaaaatc

SEQ ID NO: 705497 - DNA, 22 bp, Artificial Sequence
  chemically synthesized
caccctgagattttacttgaaa

SEQ ID NO: 705498 - DNA, 22 bp, Artificial Sequence
  chemically synthesized
accctgagattttacttgaaag

SEQ ID NO: 705499 - DNA, 22 bp, Artificial Sequence
  chemically synthesized
caggctaaaattctctttcaag

SEQ ID NO: 705500 - DNA, 22 bp, Artificial Sequence
  chemically synthesized
gcaggctaaaattctctttcaa

SEQ ID NO: 705501 - DNA, 22 bp, Artificial Sequence
  chemically synthesized
agattttacttgaaagagaatt

SEQ ID NO: 705502 - DNA, 22 bp, Artificial Sequence
  chemically synthesized
tacttgaaagagaattttagcc

SEQ ID NO: 705503 - DNA, 22 bp, Artificial Sequence
  chemically synthesized
acttgaaagagaattttagcct

SEQ ID NO: 705504 - DNA, 22 bp, Artificial Sequence
  chemically synthesized
cttgaaagagaattttagcctg

SEQ ID NO: 705505 - DNA, 22 bp, Artificial Sequence
  chemically synthesized
gaaagagaattttagcctgcaa

SEQ ID NO: 705506 - DNA, 22 bp, Artificial Sequence
  chemically synthesized
aaagagaattttagcctgcaaa

SEQ ID NO: 705507 - DNA, 22 bp, Artificial Sequence
  chemically synthesized
caggtccaatgtgagatgattt

SEQ ID NO: 705508 - DNA, 22 bp, Artificial Sequence
  chemically synthesized
gcaggtccaatgtgagatgatt

SEQ ID NO: 705509 - DNA, 22 bp, Artificial Sequence
  chemically synthesized
tgcaggtccaatgtgagatgat

SEQ ID NO: 705510 - DNA, 22 bp, Artificial Sequence
  chemically synthesized
tagcctgcaaatcatctcacat

SEQ ID NO: 705511 - DNA, 22 bp, Artificial Sequence
  chemically synthesized
agcctgcaaatcatctcacatt

SEQ ID NO: 705512 - DNA, 22 bp, Artificial Sequence
  chemically synthesized
gcctgcaaatcatctcacattg

SEQ ID NO: 705513 - DNA, 22 bp, Artificial Sequence
  chemically synthesized
caaatcatctcacattggacct

SEQ ID NO: 705514 - DNA, 22 bp, Artificial Sequence
  chemically synthesized
acattggacctgcaaaattctt

SEQ ID NO: 705515 - DNA, 22 bp, Artificial Sequence
  chemically synthesized
gacctgcaaaattctttctgac

SEQ ID NO: 705516 - DNA, 22 bp, Artificial Sequence
  chemically synthesized
caaaattctttctgacttttat

SEQ ID NO: 705517 - DNA, 22 bp, Artificial Sequence
  chemically synthesized
tttctgacttttatcatgatgg

SEQ ID NO: 705518 - DNA, 22 bp, Artificial Sequence
  chemically synthesized
tctgacttttatcatgatggct

SEQ ID NO: 705519 - DNA, 22 bp, Artificial Sequence
  chemically synthesized
ctgacttttatcatgatggctt

SEQ ID NO: 705520 - DNA, 22 bp, Artificial Sequence
  chemically synthesized
tgacttttatcatgatggctta

SEQ ID NO: 705521 - DNA, 22 bp, Artificial Sequence
  chemically synthesized
acttttatcatgatggcttatt

SEQ ID NO: 705522 - DNA, 22 bp, Artificial Sequence
  chemically synthesized
ttatcatgatggcttattttga

SEQ ID NO: 705523 - DNA, 22 bp, Artificial Sequence
  chemically synthesized
tatcatgatggcttattttgat

SEQ ID NO: 705524 - DNA, 22 bp, Artificial Sequence
  chemically synthesized
atcatgatggcttattttgatg

SEQ ID NO: 705525 - DNA, 22 bp, Artificial Sequence
  chemically synthesized
tcatgatggcttattttgatgt

SEQ ID NO: 705526 - DNA, 22 bp, Artificial Sequence
  chemically synthesized
aaaaaaataaaaacatcaaaat

SEQ ID NO: 705527 - DNA, 22 bp, Artificial Sequence
  chemically synthesized
catctcaaaaaaataaaaacat

SEQ ID NO: 705528 - DNA, 22 bp, Artificial Sequence
  chemically synthesized
attttgatgtttttattttttt

SEQ ID NO: 705529 - DNA, 22 bp, Artificial Sequence
  chemically synthesized
ttttgatgtttttatttttttg

SEQ ID NO: 705530 - DNA, 22 bp, Artificial Sequence
  chemically synthesized
tgatgtttttatttttttgaga

SEQ ID NO: 705531 - DNA, 22 bp, Artificial Sequence
  chemically synthesized
gatgtttttatttttttgagat

SEQ ID NO: 705532 - DNA, 22 bp, Artificial Sequence
  chemically synthesized
atgtttttatttttttgagatg

SEQ ID NO: 705533 - DNA, 22 bp, Artificial Sequence
  chemically synthesized
ttatttttttgagatgcagttt

SEQ ID NO: 705534 - DNA, 22 bp, Artificial Sequence
  chemically synthesized
tatttttttgagatgcagtttc

SEQ ID NO: 705535 - DNA, 22 bp, Artificial Sequence
  chemically synthesized
ggcaacaagagtgaaactgcat

SEQ ID NO: 705536 - DNA, 22 bp, Artificial Sequence
  chemically synthesized
atttttttgagatgcagtttca

SEQ ID NO: 705537 - DNA, 22 bp, Artificial Sequence
  chemically synthesized
tttttttgagatgcagtttcac

SEQ ID NO: 705538 - DNA, 22 bp, Artificial Sequence
  chemically synthesized
ttttgagatgcagtttcactct

SEQ ID NO: 705539 - DNA, 22 bp, Artificial Sequence
  chemically synthesized
tttgagatgcagtttcactctt

SEQ ID NO: 705540 - DNA, 22 bp, Artificial Sequence
  chemically synthesized
ttgagatgcagtttcactcttg

SEQ ID NO: 705541 - DNA, 22 bp, Artificial Sequence
  chemically synthesized
cagcctgggcaacaagagtgaa

SEQ ID NO: 705542 - DNA, 22 bp, Artificial Sequence
  chemically synthesized
tgagatgcagtttcactcttgt

SEQ ID NO: 705543 - DNA, 22 bp, Artificial Sequence
  chemically synthesized
gagatgcagtttcactcttgtt

SEQ ID NO: 705544 - DNA, 22 bp, Artificial Sequence
  chemically synthesized
agatgcagtttcactcttgttg

SEQ ID NO: 705545 - DNA, 22 bp, Artificial Sequence
  chemically synthesized
cactccagcctgggcaacaaga

SEQ ID NO: 705546 - DNA, 22 bp, Artificial Sequence
  chemically synthesized
cgccattgcactccagcctggg

SEQ ID NO: 705547 - DNA, 22 bp, Artificial Sequence
  chemically synthesized
cactcttgttgcccaggctgga

SEQ ID NO: 705548 - DNA, 22 bp, Artificial Sequence
  chemically synthesized
actcttgttgcccaggctggag

SEQ ID NO: 705549 - DNA, 22 bp, Artificial Sequence
  chemically synthesized
ttgttgcccaggctggagtgca

SEQ ID NO: 705550 - DNA, 22 bp, Artificial Sequence
  chemically synthesized
gttgcccaggctggagtgcaat

SEQ ID NO: 705551 - DNA, 22 bp, Artificial Sequence
  chemically synthesized
ttgcccaggctggagtgcaatg

SEQ ID NO: 705552 - DNA, 22 bp, Artificial Sequence
  chemically synthesized
cccaggctggagtgcaatggcg

SEQ ID NO: 705553 - DNA, 22 bp, Artificial Sequence
  chemically synthesized
cagtgagccgagattgcgccat

SEQ ID NO: 705554 - DNA, 22 bp, Artificial Sequence
  chemically synthesized
gagtgcaatggcgcaatctcgg

SEQ ID NO: 705555 - DNA, 22 bp, Artificial Sequence
  chemically synthesized
aacccaggaggcagaggttgca

SEQ ID NO: 705556 - DNA, 22 bp, Artificial Sequence
  chemically synthesized
gaacccaggaggcagaggttgc

SEQ ID NO: 705557 - DNA, 22 bp, Artificial Sequence
  chemically synthesized
ggctcactgcaacctctgcctc

SEQ ID NO: 705558 - DNA, 22 bp, Artificial Sequence
  chemically synthesized
actgcaacctctgcctcctggg

SEQ ID NO: 705559 - DNA, 22 bp, Artificial Sequence
  chemically synthesized
caacctctgcctcctgggttca

SEQ ID NO: 705560 - DNA, 22 bp, Artificial Sequence
  chemically synthesized
aggcaggagaatcacttgaacc

SEQ ID NO: 705561 - DNA, 22 bp, Artificial Sequence
  chemically synthesized
tgcctcctgggttcaagtgatt

SEQ ID NO: 705562 - DNA, 22 bp, Artificial Sequence
  chemically synthesized
cctcctgggttcaagtgattct

SEQ ID NO: 705563 - DNA, 22 bp, Artificial Sequence
  chemically synthesized
ctgggttcaagtgattctcctg

SEQ ID NO: 705564 - DNA, 22 bp, Artificial Sequence
  chemically synthesized
gagaggctgaggcaggagaatc

SEQ ID NO: 705565 - DNA, 22 bp, Artificial Sequence
  chemically synthesized
ggttcaagtgattctcctgcct

SEQ ID NO: 705566 - DNA, 22 bp, Artificial Sequence
  chemically synthesized
ctcgagaggctgaggcaggaga

SEQ ID NO: 705567 - DNA, 22 bp, Artificial Sequence
  chemically synthesized
aagtgattctcctgcctcagcc

SEQ ID NO: 705568 - DNA, 22 bp, Artificial Sequence
  chemically synthesized
taatcccagctactcgagaggc

SEQ ID NO: 705569 - DNA, 22 bp, Artificial Sequence
  chemically synthesized
tcctgcctcagcctctcgagta

SEQ ID NO: 705570 - DNA, 22 bp, Artificial Sequence
  chemically synthesized
ctgcctcagcctctcgagtagc

SEQ ID NO: 705571 - DNA, 22 bp, Artificial Sequence
  chemically synthesized
cctcagcctctcgagtagctgg

SEQ ID NO: 705572 - DNA, 22 bp, Artificial Sequence
  chemically synthesized
agcctctcgagtagctgggatt

SEQ ID NO: 705573 - DNA, 22 bp, Artificial Sequence
  chemically synthesized
tcgagtagctgggattacagat

SEQ ID NO: 705574 - DNA, 22 bp, Artificial Sequence
  chemically synthesized
gagtagctgggattacagatgc

SEQ ID NO: 705575 - DNA, 22 bp, Artificial Sequence
  chemically synthesized
ggcgtggtggcatgcatctgta

SEQ ID NO: 705576 - DNA, 22 bp, Artificial Sequence
  chemically synthesized
gctgggcgtggtggcatgcatc

SEQ ID NO: 705577 - DNA, 22 bp, Artificial Sequence
  chemically synthesized
ggattacagatgcatgccacca

SEQ ID NO: 705578 - DNA, 22 bp, Artificial Sequence
  chemically synthesized
cagatgcatgccaccacgccca

SEQ ID NO: 705579 - DNA, 22 bp, Artificial Sequence
  chemically synthesized
aaaatacaaaattagctgggcg

SEQ ID NO: 705580 - DNA, 22 bp, Artificial Sequence
  chemically synthesized
ctaaaaatacaaaattagctgg

SEQ ID NO: 705581 - DNA, 22 bp, Artificial Sequence
  chemically synthesized
tactaaaaatacaaaattagct

SEQ ID NO: 705582 - DNA, 22 bp, Artificial Sequence
  chemically synthesized
tctctactaaaaatacaaaatt

SEQ ID NO: 705583 - DNA, 22 bp, Artificial Sequence
  chemically synthesized
attttgtatttttagtagagac

SEQ ID NO: 705584 - DNA, 22 bp, Artificial Sequence
  chemically synthesized
tgtatttttagtagagacaggg

SEQ ID NO: 705585 - DNA, 22 bp, Artificial Sequence
  chemically synthesized
gtatttttagtagagacagggt

SEQ ID NO: 705586 - DNA, 22 bp, Artificial Sequence
  chemically synthesized
tatttttagtagagacagggtt

SEQ ID NO: 705587 - DNA, 22 bp, Artificial Sequence
  chemically synthesized
accaacatggagaaaccctgtc

SEQ ID NO: 705588 - DNA, 22 bp, Artificial Sequence
  chemically synthesized
ttagtagagacagggtttctcc

SEQ ID NO: 705589 - DNA, 22 bp, Artificial Sequence
  chemically synthesized
tagtagagacagggtttctcca

SEQ ID NO: 705590 - DNA, 22 bp, Artificial Sequence
  chemically synthesized
agtagagacagggtttctccat

SEQ ID NO: 705591 - DNA, 22 bp, Artificial Sequence
  chemically synthesized
gtagagacagggtttctccatg

SEQ ID NO: 705592 - DNA, 22 bp, Artificial Sequence
  chemically synthesized
aagaccagcctgaccaacatgg

SEQ ID NO: 705593 - DNA, 22 bp, Artificial Sequence
  chemically synthesized
ctccatgttggtcaggctggtc

SEQ ID NO: 705594 - DNA, 22 bp, Artificial Sequence
  chemically synthesized
tccatgttggtcaggctggtct

SEQ ID NO: 705595 - DNA, 22 bp, Artificial Sequence
  chemically synthesized
catgttggtcaggctggtcttg

SEQ ID NO: 705596 - DNA, 22 bp, Artificial Sequence
  chemically synthesized
aggtcaggagttcaagaccagc

SEQ ID NO: 705597 - DNA, 22 bp, Artificial Sequence
  chemically synthesized
gtcaggctggtcttgaactcct

SEQ ID NO: 705598 - DNA, 22 bp, Artificial Sequence
  chemically synthesized
gtcttgaactcctgacctcagg

SEQ ID NO: 705599 - DNA, 22 bp, Artificial Sequence
  chemically synthesized
gaactcctgacctcaggtgatc

SEQ ID NO: 705600 - DNA, 22 bp, Artificial Sequence
  chemically synthesized
aactcctgacctcaggtgatct

SEQ ID NO: 705601 - DNA, 22 bp, Artificial Sequence
  chemically synthesized
ggaggccgaggcgggcagatca

SEQ ID NO: 705602 - DNA, 22 bp, Artificial Sequence
  chemically synthesized
ctgacctcaggtgatctgcccg

SEQ ID NO: 705603 - DNA, 22 bp, Artificial Sequence
  chemically synthesized
gggaggccgaggcgggcagatc

SEQ ID NO: 705604 - DNA, 22 bp, Artificial Sequence
  chemically synthesized
tgggaggccgaggcgggcagat

SEQ ID NO: 705605 - DNA, 22 bp, Artificial Sequence
  chemically synthesized
acctcaggtgatctgcccgcct

SEQ ID NO: 705606 - DNA, 22 bp, Artificial Sequence
  chemically synthesized
aggtgatctgcccgcctcggcc

SEQ ID NO: 705607 - DNA, 22 bp, Artificial Sequence
  chemically synthesized
cccgcctcggcctcccaaagtg

SEQ ID NO: 705608 - DNA, 22 bp, Artificial Sequence
  chemically synthesized
acgccagtaatcccagcacttt

SEQ ID NO: 705609 - DNA, 22 bp, Artificial Sequence
  chemically synthesized
ggcctcccaaagtgctgggatt

SEQ ID NO: 705610 - DNA, 22 bp, Artificial Sequence
  chemically synthesized
ccaaagtgctgggattactggc

SEQ ID NO: 705611 - DNA, 22 bp, Artificial Sequence
  chemically synthesized
ggattactggcgtgagccaccg

SEQ ID NO: 705612 - DNA, 22 bp, Artificial Sequence
  chemically synthesized
ctggcgtgagccaccgcacccg

SEQ ID NO: 705613 - DNA, 22 bp, Artificial Sequence
  chemically synthesized
gcgtgagccaccgcacccggcc

SEQ ID NO: 705614 - DNA, 22 bp, Artificial Sequence
  chemically synthesized
aataagccatcatgaggccggg

SEQ ID NO: 705615 - DNA, 22 bp, Artificial Sequence
  chemically synthesized
aaataagccatcatgaggccgg

SEQ ID NO: 705616 - DNA, 22 bp, Artificial Sequence
  chemically synthesized
gcttaaataagccatcatgagg

SEQ ID NO: 705617 - DNA, 22 bp, Artificial Sequence
  chemically synthesized
agattggcttaaataagccatc

SEQ ID NO: 705618 - DNA, 22 bp, Artificial Sequence
  chemically synthesized
cagattggcttaaataagccat

SEQ ID NO: 705619 - DNA, 22 bp, Artificial Sequence
  chemically synthesized
aagcttcagattggcttaaata

SEQ ID NO: 705620 - DNA, 22 bp, Artificial Sequence
  chemically synthesized
aaagcttcagattggcttaaat

SEQ ID NO: 705621 - DNA, 22 bp, Artificial Sequence
  chemically synthesized
atgatggcttatttaagccaat

SEQ ID NO: 705622 - DNA, 22 bp, Artificial Sequence
  chemically synthesized
atttaagccaatctgaagcttt

SEQ ID NO: 705623 - DNA, 22 bp, Artificial Sequence
  chemically synthesized
tttaagccaatctgaagcttta

SEQ ID NO: 705624 - DNA, 22 bp, Artificial Sequence
  chemically synthesized
aagccaatctgaagctttaaat

SEQ ID NO: 705625 - DNA, 22 bp, Artificial Sequence
  chemically synthesized
agccaatctgaagctttaaatt

SEQ ID NO: 705626 - DNA, 22 bp, Artificial Sequence
  chemically synthesized
aaatatgagtggggcaataatt

SEQ ID NO: 705627 - DNA, 22 bp, Artificial Sequence
  chemically synthesized
gaaatatgagtggggcaataat

SEQ ID NO: 705628 - DNA, 22 bp, Artificial Sequence
  chemically synthesized
aagctttaaattattgccccac

SEQ ID NO: 705629 - DNA, 22 bp, Artificial Sequence
  chemically synthesized
taaattattgccccactcatat

SEQ ID NO: 705630 - DNA, 22 bp, Artificial Sequence
  chemically synthesized
aaattattgccccactcatatt

SEQ ID NO: 705631 - DNA, 22 bp, Artificial Sequence
  chemically synthesized
aattattgccccactcatattt

SEQ ID NO: 705632 - DNA, 22 bp, Artificial Sequence
  chemically synthesized
ttgccccactcatatttcaaat

SEQ ID NO: 705633 - DNA, 22 bp, Artificial Sequence
  chemically synthesized
aggggacagacaatttgaaata

SEQ ID NO: 705634 - DNA, 22 bp, Artificial Sequence
  chemically synthesized
ccccactcatatttcaaattgt

SEQ ID NO: 705635 - DNA, 22 bp, Artificial Sequence
  chemically synthesized
atatttcaaattgtctgtcccc

SEQ ID NO: 705636 - DNA, 22 bp, Artificial Sequence
  chemically synthesized
ccagtgtcctcaggggacagac

SEQ ID NO: 705637 - DNA, 22 bp, Artificial Sequence
  chemically synthesized
tgctaccagtgtcctcagggga

SEQ ID NO: 705638 - DNA, 22 bp, Artificial Sequence
  chemically synthesized
caaattgtctgtcccctgagga

SEQ ID NO: 705639 - DNA, 22 bp, Artificial Sequence
  chemically synthesized
aaattgtctgtcccctgaggac

SEQ ID NO: 705640 - DNA, 22 bp, Artificial Sequence
  chemically synthesized
caacctatgctaccagtgtcct

SEQ ID NO: 705641 - DNA, 22 bp, Artificial Sequence
  chemically synthesized
tctgtcccctgaggacactggt

SEQ ID NO: 705642 - DNA, 22 bp, Artificial Sequence
  chemically synthesized
tcccctgaggacactggtagca

SEQ ID NO: 705643 - DNA, 22 bp, Artificial Sequence
  chemically synthesized
acagtgctccaacctatgctac

SEQ ID NO: 705644 - DNA, 22 bp, Artificial Sequence
  chemically synthesized
aacagtgctccaacctatgcta

SEQ ID NO: 705645 - DNA, 22 bp, Artificial Sequence
  chemically synthesized
aggacactggtagcataggttg

SEQ ID NO: 705646 - DNA, 22 bp, Artificial Sequence
  chemically synthesized
acttaacagtgctccaacctat

SEQ ID NO: 705647 - DNA, 22 bp, Artificial Sequence
  chemically synthesized
cacttaacagtgctccaaccta

SEQ ID NO: 705648 - DNA, 22 bp, Artificial Sequence
  chemically synthesized
gtagcataggttggagcactgt

SEQ ID NO: 705649 - DNA, 22 bp, Artificial Sequence
  chemically synthesized
acatttcacttaacagtgctcc

SEQ ID NO: 705650 - DNA, 22 bp, Artificial Sequence
  chemically synthesized
ctgacatttcacttaacagtgc

SEQ ID NO: 705651 - DNA, 22 bp, Artificial Sequence
  chemically synthesized
ataattgctgacatttcactta

SEQ ID NO: 705652 - DNA, 22 bp, Artificial Sequence
  chemically synthesized
gagcactgttaagtgaaatgtc

SEQ ID NO: 705653 - DNA, 22 bp, Artificial Sequence
  chemically synthesized
agcacatctaataattgctgac

SEQ ID NO: 705654 - DNA, 22 bp, Artificial Sequence
  chemically synthesized
ttaagtgaaatgtcagcaatta

SEQ ID NO: 705655 - DNA, 22 bp, Artificial Sequence
  chemically synthesized
aagcacatctaataattgctga

SEQ ID NO: 705656 - DNA, 22 bp, Artificial Sequence
  chemically synthesized
taagcacatctaataattgctg

SEQ ID NO: 705657 - DNA, 22 bp, Artificial Sequence
  chemically synthesized
agtgaaatgtcagcaattatta

SEQ ID NO: 705658 - DNA, 22 bp, Artificial Sequence
  chemically synthesized
aaaaataggggaaacctttaag

SEQ ID NO: 705659 - DNA, 22 bp, Artificial Sequence
  chemically synthesized
aaaaaataggggaaacctttaa

SEQ ID NO: 705660 - DNA, 22 bp, Artificial Sequence
  chemically synthesized
taaaaaataggggaaaccttta

SEQ ID NO: 705661 - DNA, 22 bp, Artificial Sequence
  chemically synthesized
ttagatgtgcttaaaggtttcc

SEQ ID NO: 705662 - DNA, 22 bp, Artificial Sequence
  chemically synthesized
gatgtgcttaaaggtttcccct

SEQ ID NO: 705663 - DNA, 22 bp, Artificial Sequence
  chemically synthesized
attttaaaaaataggggaaacc

SEQ ID NO: 705664 - DNA, 22 bp, Artificial Sequence
  chemically synthesized
aattttaaaaaataggggaaac

SEQ ID NO: 705665 - DNA, 22 bp, Artificial Sequence
  chemically synthesized
aaaggtttcccctattttttaa

SEQ ID NO: 705666 - DNA, 22 bp, Artificial Sequence
  chemically synthesized
aaggtttcccctattttttaaa

SEQ ID NO: 705667 - DNA, 22 bp, Artificial Sequence
  chemically synthesized
cacatacacacttaattttaaa

SEQ ID NO: 705668 - DNA, 22 bp, Artificial Sequence
  chemically synthesized
cccctattttttaaaattaagt

SEQ ID NO: 705669 - DNA, 22 bp, Artificial Sequence
  chemically synthesized
ccctattttttaaaattaagtg

SEQ ID NO: 705670 - DNA, 22 bp, Artificial Sequence
  chemically synthesized
cccactacacatacacacttaa

SEQ ID NO: 705671 - DNA, 22 bp, Artificial Sequence
  chemically synthesized
ttttttaaaattaagtgtgtat

SEQ ID NO: 705672 - DNA, 22 bp, Artificial Sequence
  chemically synthesized
tttaaaattaagtgtgtatgtg

SEQ ID NO: 705673 - DNA, 22 bp, Artificial Sequence
  chemically synthesized
ttaaaattaagtgtgtatgtgt

SEQ ID NO: 705674 - DNA, 22 bp, Artificial Sequence
  chemically synthesized
taaaattaagtgtgtatgtgta

SEQ ID NO: 705675 - DNA, 22 bp, Artificial Sequence
  chemically synthesized
gacattccccactacacataca

SEQ ID NO: 705676 - DNA, 22 bp, Artificial Sequence
  chemically synthesized
aaaattaagtgtgtatgtgtag

SEQ ID NO: 705677 - DNA, 22 bp, Artificial Sequence
  chemically synthesized
aaattaagtgtgtatgtgtagt

SEQ ID NO: 705678 - DNA, 22 bp, Artificial Sequence
  chemically synthesized
atcctggacattccccactaca

SEQ ID NO: 705679 - DNA, 22 bp, Artificial Sequence
  chemically synthesized
catcctggacattccccactac

SEQ ID NO: 705680 - DNA, 22 bp, Artificial Sequence
  chemically synthesized
agtgtgtatgtgtagtggggaa

SEQ ID NO: 705681 - DNA, 22 bp, Artificial Sequence
  chemically synthesized
tcatcctggacattccccacta

SEQ ID NO: 705682 - DNA, 22 bp, Artificial Sequence
  chemically synthesized
ccaagctttcatcctggacatt

SEQ ID NO: 705683 - DNA, 22 bp, Artificial Sequence
  chemically synthesized
agagttgccaagctttcatcct

SEQ ID NO: 705684 - DNA, 22 bp, Artificial Sequence
  chemically synthesized
gagagttgccaagctttcatcc

SEQ ID NO: 705685 - DNA, 22 bp, Artificial Sequence
  chemically synthesized
tcttgagagttgccaagctttc

SEQ ID NO: 705686 - DNA, 22 bp, Artificial Sequence
  chemically synthesized
tatcttgagagttgccaagctt

SEQ ID NO: 705687 - DNA, 22 bp, Artificial Sequence
  chemically synthesized
ctatcttgagagttgccaagct

SEQ ID NO: 705688 - DNA, 22 bp, Artificial Sequence
  chemically synthesized
tttctatcttgagagttgccaa

SEQ ID NO: 705689 - DNA, 22 bp, Artificial Sequence
  chemically synthesized
gtttctatcttgagagttgcca

SEQ ID NO: 705690 - DNA, 22 bp, Artificial Sequence
  chemically synthesized
gcagtttgtttctatcttgaga

SEQ ID NO: 705691 - DNA, 22 bp, Artificial Sequence
  chemically synthesized
ggcaactctcaagatagaaaca

SEQ ID NO: 705692 - DNA, 22 bp, Artificial Sequence
  chemically synthesized
gcaactctcaagatagaaacaa

SEQ ID NO: 705693 - DNA, 22 bp, Artificial Sequence
  chemically synthesized
tcaagatagaaacaaactgcta

SEQ ID NO: 705694 - DNA, 22 bp, Artificial Sequence
  chemically synthesized
atacatagggcctagcagtttg

SEQ ID NO: 705695 - DNA, 22 bp, Artificial Sequence
  chemically synthesized
gatacatagggcctagcagttt

SEQ ID NO: 705696 - DNA, 22 bp, Artificial Sequence
  chemically synthesized
aagatagaaacaaactgctagg

SEQ ID NO: 705697 - DNA, 22 bp, Artificial Sequence
  chemically synthesized
cttgatacatagggcctagcag

SEQ ID NO: 705698 - DNA, 22 bp, Artificial Sequence
  chemically synthesized
tccttgatacatagggcctagc

SEQ ID NO: 705699 - DNA, 22 bp, Artificial Sequence
  chemically synthesized
ctccttgatacatagggcctag

SEQ ID NO: 705700 - DNA, 22 bp, Artificial Sequence
  chemically synthesized
cagtttctccttgatacatagg

SEQ ID NO: 705701 - DNA, 22 bp, Artificial Sequence
  chemically synthesized
acagtttctccttgatacatag

SEQ ID NO: 705702 - DNA, 22 bp, Artificial Sequence
  chemically synthesized
tacagtttctccttgatacata

SEQ ID NO: 705703 - DNA, 22 bp, Artificial Sequence
  chemically synthesized
ttacagtttctccttgatacat

SEQ ID NO: 705704 - DNA, 22 bp, Artificial Sequence
  chemically synthesized
ctaggccctatgtatcaaggag

SEQ ID NO: 705705 - DNA, 22 bp, Artificial Sequence
  chemically synthesized
ggccctatgtatcaaggagaaa

SEQ ID NO: 705706 - DNA, 22 bp, Artificial Sequence
  chemically synthesized
aagcttttacagtttctccttg

SEQ ID NO: 705707 - DNA, 22 bp, Artificial Sequence
  chemically synthesized
tgtatcaaggagaaactgtaaa

SEQ ID NO: 705708 - DNA, 22 bp, Artificial Sequence
  chemically synthesized
tcaaagtgactcaagcttttac

SEQ ID NO: 705709 - DNA, 22 bp, Artificial Sequence
  chemically synthesized
gtcaaagtgactcaagctttta

SEQ ID NO: 705710 - DNA, 22 bp, Artificial Sequence
  chemically synthesized
ttgtcaaagtgactcaagcttt

SEQ ID NO: 705711 - DNA, 22 bp, Artificial Sequence
  chemically synthesized
tcttgtcaaagtgactcaagct

SEQ ID NO: 705712 - DNA, 22 bp, Artificial Sequence
  chemically synthesized
tctcttgtcaaagtgactcaag

SEQ ID NO: 705713 - DNA, 22 bp, Artificial Sequence
  chemically synthesized
ctctcttgtcaaagtgactcaa

SEQ ID NO: 705714 - DNA, 22 bp, Artificial Sequence
  chemically synthesized
tctctcttgtcaaagtgactca

SEQ ID NO: 705715 - DNA, 22 bp, Artificial Sequence
  chemically synthesized
ttctctcttgtcaaagtgactc

SEQ ID NO: 705716 - DNA, 22 bp, Artificial Sequence
  chemically synthesized
tttctctcttgtcaaagtgact

SEQ ID NO: 705717 - DNA, 22 bp, Artificial Sequence
  chemically synthesized
taaaagcttgagtcactttgac

SEQ ID NO: 705718 - DNA, 22 bp, Artificial Sequence
  chemically synthesized
agtctttttctctcttgtcaaa

SEQ ID NO: 705719 - DNA, 22 bp, Artificial Sequence
  chemically synthesized
gttaagtctttttctctcttgt

SEQ ID NO: 705720 - DNA, 22 bp, Artificial Sequence
  chemically synthesized
gagtcactttgacaagagagaa

SEQ ID NO: 705721 - DNA, 22 bp, Artificial Sequence
  chemically synthesized
agtcactttgacaagagagaaa

SEQ ID NO: 705722 - DNA, 22 bp, Artificial Sequence
  chemically synthesized
tgacaagagagaaaaagactta

SEQ ID NO: 705723 - DNA, 22 bp, Artificial Sequence
  chemically synthesized
gacaagagagaaaaagacttaa

SEQ ID NO: 705724 - DNA, 22 bp, Artificial Sequence
  chemically synthesized
acaagagagaaaaagacttaac

SEQ ID NO: 705725 - DNA, 22 bp, Artificial Sequence
  chemically synthesized
atcatatccctggttaagtctt

SEQ ID NO: 705726 - DNA, 22 bp, Artificial Sequence
  chemically synthesized
aatcatatccctggttaagtct

SEQ ID NO: 705727 - DNA, 22 bp, Artificial Sequence
  chemically synthesized
ccttaatcatatccctggttaa

SEQ ID NO: 705728 - DNA, 22 bp, Artificial Sequence
  chemically synthesized
actgccttaatcatatccctgg

SEQ ID NO: 705729 - DNA, 22 bp, Artificial Sequence
  chemically synthesized
aactgccttaatcatatccctg

SEQ ID NO: 705730 - DNA, 22 bp, Artificial Sequence
  chemically synthesized
caatcttaactgccttaatcat

SEQ ID NO: 705731 - DNA, 22 bp, Artificial Sequence
  chemically synthesized
acaatcttaactgccttaatca

SEQ ID NO: 705732 - DNA, 22 bp, Artificial Sequence
  chemically synthesized
aaccagggatatgattaaggca

SEQ ID NO: 705733 - DNA, 22 bp, Artificial Sequence
  chemically synthesized
tacaatcttaactgccttaatc

SEQ ID NO: 705734 - DNA, 22 bp, Artificial Sequence
  chemically synthesized
accagggatatgattaaggcag

SEQ ID NO: 705735 - DNA, 22 bp, Artificial Sequence
  chemically synthesized
caggctttacaatcttaactgc

SEQ ID NO: 705736 - DNA, 22 bp, Artificial Sequence
  chemically synthesized
gcaggctttacaatcttaactg

SEQ ID NO: 705737 - DNA, 22 bp, Artificial Sequence
  chemically synthesized
ttgcaggctttacaatcttaac

SEQ ID NO: 705738 - DNA, 22 bp, Artificial Sequence
  chemically synthesized
cttgcaggctttacaatcttaa

SEQ ID NO: 705739 - DNA, 22 bp, Artificial Sequence
  chemically synthesized
tttcttgcaggctttacaatct

SEQ ID NO: 705740 - DNA, 22 bp, Artificial Sequence
  chemically synthesized
aggcagttaagattgtaaagcc

SEQ ID NO: 705741 - DNA, 22 bp, Artificial Sequence
  chemically synthesized
atccattatttcttgcaggctt

SEQ ID NO: 705742 - DNA, 22 bp, Artificial Sequence
  chemically synthesized
agattgtaaagcctgcaagaaa

SEQ ID NO: 705743 - DNA, 22 bp, Artificial Sequence
  chemically synthesized
taaagcctgcaagaaataatgg

SEQ ID NO: 705744 - DNA, 22 bp, Artificial Sequence
  chemically synthesized
taaaaagaaataactgatccat

SEQ ID NO: 705745 - DNA, 22 bp, Artificial Sequence
  chemically synthesized
caagaaataatggatcagttat

SEQ ID NO: 705746 - DNA, 22 bp, Artificial Sequence
  chemically synthesized
tgagacactgtaaaaagaaata

SEQ ID NO: 705747 - DNA, 22 bp, Artificial Sequence
  chemically synthesized
agattatgagacactgtaaaaa

SEQ ID NO: 705748 - DNA, 22 bp, Artificial Sequence
  chemically synthesized
tcagattatgagacactgtaaa

SEQ ID NO: 705749 - DNA, 22 bp, Artificial Sequence
  chemically synthesized
ctcagattatgagacactgtaa

SEQ ID NO: 705750 - DNA, 22 bp, Artificial Sequence
  chemically synthesized
tttctttttacagtgtctcata

SEQ ID NO: 705751 - DNA, 22 bp, Artificial Sequence
  chemically synthesized
ctttttacagtgtctcataatc

SEQ ID NO: 705752 - DNA, 22 bp, Artificial Sequence
  chemically synthesized
tttttacagtgtctcataatct

SEQ ID NO: 705753 - DNA, 22 bp, Artificial Sequence
  chemically synthesized
agtgaccttctcagattatgag

SEQ ID NO: 705754 - DNA, 22 bp, Artificial Sequence
  chemically synthesized
tttacagtgtctcataatctga

SEQ ID NO: 705755 - DNA, 22 bp, Artificial Sequence
  chemically synthesized
ttacagtgtctcataatctgag

SEQ ID NO: 705756 - DNA, 22 bp, Artificial Sequence
  chemically synthesized
tacagtgtctcataatctgaga

SEQ ID NO: 705757 - DNA, 22 bp, Artificial Sequence
  chemically synthesized
attgagtgaccttctcagatta

SEQ ID NO: 705758 - DNA, 22 bp, Artificial Sequence
  chemically synthesized
acagtgtctcataatctgagaa

SEQ ID NO: 705759 - DNA, 22 bp, Artificial Sequence
  chemically synthesized
cattgagtgaccttctcagatt

SEQ ID NO: 705760 - DNA, 22 bp, Artificial Sequence
  chemically synthesized
cagtgtctcataatctgagaag

SEQ ID NO: 705761 - DNA, 22 bp, Artificial Sequence
  chemically synthesized
tttcattgagtgaccttctcag

SEQ ID NO: 705762 - DNA, 22 bp, Artificial Sequence
  chemically synthesized
ataatctgagaaggtcactcaa

SEQ ID NO: 705763 - DNA, 22 bp, Artificial Sequence
  chemically synthesized
aaagctgtttcattgagtgacc

SEQ ID NO: 705764 - DNA, 22 bp, Artificial Sequence
  chemically synthesized
aaaagctgtttcattgagtgac

SEQ ID NO: 705765 - DNA, 22 bp, Artificial Sequence
  chemically synthesized
aatttaaaagctgtttcattga

SEQ ID NO: 705766 - DNA, 22 bp, Artificial Sequence
  chemically synthesized
agaaggtcactcaatgaaacag

SEQ ID NO: 705767 - DNA, 22 bp, Artificial Sequence
  chemically synthesized
tgaatttaaaagctgtttcatt

SEQ ID NO: 705768 - DNA, 22 bp, Artificial Sequence
  chemically synthesized
ttctgaatttaaaagctgtttc

SEQ ID NO: 705769 - DNA, 22 bp, Artificial Sequence
  chemically synthesized
attctgaatttaaaagctgttt

SEQ ID NO: 705770 - DNA, 22 bp, Artificial Sequence
  chemically synthesized
tttattctgaatttaaaagctg

SEQ ID NO: 705771 - DNA, 22 bp, Artificial Sequence
  chemically synthesized
ctatttattctgaatttaaaag

SEQ ID NO: 705772 - DNA, 22 bp, Artificial Sequence
  chemically synthesized
actatttattctgaatttaaaa

SEQ ID NO: 705773 - DNA, 22 bp, Artificial Sequence
  chemically synthesized
aatgaaacagcttttaaattca

SEQ ID NO: 705774 - DNA, 22 bp, Artificial Sequence
  chemically synthesized
tactatttattctgaatttaaa

SEQ ID NO: 705775 - DNA, 22 bp, Artificial Sequence
  chemically synthesized
ttactatttattctgaatttaa

SEQ ID NO: 705776 - DNA, 22 bp, Artificial Sequence
  chemically synthesized
tttactatttattctgaattta

SEQ ID NO: 705777 - DNA, 22 bp, Artificial Sequence
  chemically synthesized
ctttttactatttattctgaat

SEQ ID NO: 705778 - DNA, 22 bp, Artificial Sequence
  chemically synthesized
cctttttactatttattctgaa

SEQ ID NO: 705779 - DNA, 22 bp, Artificial Sequence
  chemically synthesized
ttaaattcagaataaatagtaa

SEQ ID NO: 705780 - DNA, 22 bp, Artificial Sequence
  chemically synthesized
taaattcagaataaatagtaaa

SEQ ID NO: 705781 - DNA, 22 bp, Artificial Sequence
  chemically synthesized
aaattcagaataaatagtaaaa

SEQ ID NO: 705782 - DNA, 22 bp, Artificial Sequence
  chemically synthesized
aattcagaataaatagtaaaaa

SEQ ID NO: 705783 - DNA, 22 bp, Artificial Sequence
  chemically synthesized
aaagacaaatttcctttttact

SEQ ID NO: 705784 - DNA, 22 bp, Artificial Sequence
  chemically synthesized
tgaaagacaaatttccttttta

SEQ ID NO: 705785 - DNA, 22 bp, Artificial Sequence
  chemically synthesized
agaataaatagtaaaaaggaaa

SEQ ID NO: 705786 - DNA, 22 bp, Artificial Sequence
  chemically synthesized
cagtggcaatgggactctgaaa

SEQ ID NO: 705787 - DNA, 22 bp, Artificial Sequence
  chemically synthesized
gcagtggcaatgggactctgaa

SEQ ID NO: 705788 - DNA, 22 bp, Artificial Sequence
  chemically synthesized
ttgcagtggcaatgggactctg

SEQ ID NO: 705789 - DNA, 22 bp, Artificial Sequence
  chemically synthesized
gtctttcagagtcccattgcca

SEQ ID NO: 705790 - DNA, 22 bp, Artificial Sequence
  chemically synthesized
tctttcagagtcccattgccac

SEQ ID NO: 705791 - DNA, 22 bp, Artificial Sequence
  chemically synthesized
tcagagtcccattgccactgca

SEQ ID NO: 705792 - DNA, 22 bp, Artificial Sequence
  chemically synthesized
cagagtcccattgccactgcaa

SEQ ID NO: 705793 - DNA, 22 bp, Artificial Sequence
  chemically synthesized
accagtgacctcttgcagtggc

SEQ ID NO: 705794 - DNA, 22 bp, Artificial Sequence
  chemically synthesized
agagtcccattgccactgcaag

SEQ ID NO: 705795 - DNA, 22 bp, Artificial Sequence
  chemically synthesized
aaccagtgacctcttgcagtgg

SEQ ID NO: 705796 - DNA, 22 bp, Artificial Sequence
  chemically synthesized
taaccagtgacctcttgcagtg

SEQ ID NO: 705797 - DNA, 22 bp, Artificial Sequence
  chemically synthesized
ttaaccagtgacctcttgcagt

SEQ ID NO: 705798 - DNA, 22 bp, Artificial Sequence
  chemically synthesized
cagcttttaaccagtgacctct

SEQ ID NO: 705799 - DNA, 22 bp, Artificial Sequence
  chemically synthesized
ccactgcaagaggtcactggtt

SEQ ID NO: 705800 - DNA, 22 bp, Artificial Sequence
  chemically synthesized
tactccagcttttaaccagtga

SEQ ID NO: 705801 - DNA, 22 bp, Artificial Sequence
  chemically synthesized
atactccagcttttaaccagtg

SEQ ID NO: 705802 - DNA, 22 bp, Artificial Sequence
  chemically synthesized
tatactccagcttttaaccagt

SEQ ID NO: 705803 - DNA, 22 bp, Artificial Sequence
  chemically synthesized
caagaggtcactggttaaaagc

SEQ ID NO: 705804 - DNA, 22 bp, Artificial Sequence
  chemically synthesized
gttaaaagctggagtataaaat

SEQ ID NO: 705805 - DNA, 22 bp, Artificial Sequence
  chemically synthesized
aaagctggagtataaaatgtta

SEQ ID NO: 705806 - DNA, 22 bp, Artificial Sequence
  chemically synthesized
gagtataaaatgttacctttat

SEQ ID NO: 705807 - DNA, 22 bp, Artificial Sequence
  chemically synthesized
taatggaaaaaaaacaataaag

SEQ ID NO: 705808 - DNA, 22 bp, Artificial Sequence
  chemically synthesized
gtaatggaaaaaaaacaataaa

SEQ ID NO: 705809 - DNA, 22 bp, Artificial Sequence
  chemically synthesized
tgtaatggaaaaaaaacaataa

SEQ ID NO: 705810 - DNA, 22 bp, Artificial Sequence
  chemically synthesized
cctttgtaatggaaaaaaaaca

SEQ ID NO: 705811 - DNA, 22 bp, Artificial Sequence
  chemically synthesized
cctttattgttttttttccatt

SEQ ID NO: 705812 - DNA, 22 bp, Artificial Sequence
  chemically synthesized
tattgttttttttccattacaa

SEQ ID NO: 705813 - DNA, 22 bp, Artificial Sequence
  chemically synthesized
attgttttttttccattacaaa

SEQ ID NO: 705814 - DNA, 22 bp, Artificial Sequence
  chemically synthesized
ttgttttttttccattacaaag

SEQ ID NO: 705815 - DNA, 22 bp, Artificial Sequence
  chemically synthesized
ttttttttccattacaaaggta

SEQ ID NO: 705816 - DNA, 22 bp, Artificial Sequence
  chemically synthesized
gtaatagcatgtactacctttg

SEQ ID NO: 705817 - DNA, 22 bp, Artificial Sequence
  chemically synthesized
tttttccattacaaaggtagta

SEQ ID NO: 705818 - DNA, 22 bp, Artificial Sequence
  chemically synthesized
ttttccattacaaaggtagtac

SEQ ID NO: 705819 - DNA, 22 bp, Artificial Sequence
  chemically synthesized
tggtaatagcatgtactacctt

SEQ ID NO: 705820 - DNA, 22 bp, Artificial Sequence
  chemically synthesized
tttccattacaaaggtagtaca

SEQ ID NO: 705821 - DNA, 22 bp, Artificial Sequence
  chemically synthesized
ctggtaatagcatgtactacct

SEQ ID NO: 705822 - DNA, 22 bp, Artificial Sequence
  chemically synthesized
ttccattacaaaggtagtacat

SEQ ID NO: 705823 - DNA, 22 bp, Artificial Sequence
  chemically synthesized
tctggtaatagcatgtactacc

SEQ ID NO: 705824 - DNA, 22 bp, Artificial Sequence
  chemically synthesized
tccattacaaaggtagtacatg

SEQ ID NO: 705825 - DNA, 22 bp, Artificial Sequence
  chemically synthesized
ccattacaaaggtagtacatgc

SEQ ID NO: 705826 - DNA, 22 bp, Artificial Sequence
  chemically synthesized
cattacaaaggtagtacatgct

SEQ ID NO: 705827 - DNA, 22 bp, Artificial Sequence
  chemically synthesized
caaattttctggtaatagcatg

SEQ ID NO: 705828 - DNA, 22 bp, Artificial Sequence
  chemically synthesized
caaaggtagtacatgctattac

SEQ ID NO: 705829 - DNA, 22 bp, Artificial Sequence
  chemically synthesized
acaaattttctggtaatagcat

SEQ ID NO: 705830 - DNA, 22 bp, Artificial Sequence
  chemically synthesized
tacaaattttctggtaatagca

SEQ ID NO: 705831 - DNA, 22 bp, Artificial Sequence
  chemically synthesized
ttacaaattttctggtaatagc

SEQ ID NO: 705832 - DNA, 22 bp, Artificial Sequence
  chemically synthesized
cttttacaaattttctggtaat

SEQ ID NO: 705833 - DNA, 22 bp, Artificial Sequence
  chemically synthesized
acttttacaaattttctggtaa

SEQ ID NO: 705834 - DNA, 22 bp, Artificial Sequence
  chemically synthesized
tacttttacaaattttctggta

SEQ ID NO: 705835 - DNA, 22 bp, Artificial Sequence
  chemically synthesized
ttacttttacaaattttctggt

SEQ ID NO: 705836 - DNA, 22 bp, Artificial Sequence
  chemically synthesized
tttacttttacaaattttctgg

SEQ ID NO: 705837 - DNA, 22 bp, Artificial Sequence
  chemically synthesized
tttttacttttacaaattttct

SEQ ID NO: 705838 - DNA, 22 bp, Artificial Sequence
  chemically synthesized
ctttttacttttacaaattttc

SEQ ID NO: 705839 - DNA, 22 bp, Artificial Sequence
  chemically synthesized
tctttttacttttacaaatttt

SEQ ID NO: 705840 - DNA, 22 bp, Artificial Sequence
  chemically synthesized
tttctttttacttttacaaatt

SEQ ID NO: 705841 - DNA, 22 bp, Artificial Sequence
  chemically synthesized
ctttctttttacttttacaaat

SEQ ID NO: 705842 - DNA, 22 bp, Artificial Sequence
  chemically synthesized
ttaccagaaaatttgtaaaagt

SEQ ID NO: 705843 - DNA, 22 bp, Artificial Sequence
  chemically synthesized
ccagaaaatttgtaaaagtaaa

SEQ ID NO: 705844 - DNA, 22 bp, Artificial Sequence
  chemically synthesized
catcatttctttctttttactt

SEQ ID NO: 705845 - DNA, 22 bp, Artificial Sequence
  chemically synthesized
ttgcatcatttctttcttttta

SEQ ID NO: 705846 - DNA, 22 bp, Artificial Sequence
  chemically synthesized
gtaaaagtaaaaagaaagaaat

SEQ ID NO: 705847 - DNA, 22 bp, Artificial Sequence
  chemically synthesized
taaaagtaaaaagaaagaaatg

SEQ ID NO: 705848 - DNA, 22 bp, Artificial Sequence
  chemically synthesized
tttgtcttttggtatcttttta

SEQ ID NO: 705849 - DNA, 22 bp, Artificial Sequence
  chemically synthesized
gtcttttggtatctttttattt

SEQ ID NO: 705850 - DNA, 22 bp, Artificial Sequence
  chemically synthesized
tcttttggtatctttttatttt

SEQ ID NO: 705851 - DNA, 22 bp, Artificial Sequence
  chemically synthesized
ttggtatctttttattttccat

SEQ ID NO: 705852 - DNA, 22 bp, Artificial Sequence
  chemically synthesized
tggtatctttttattttccatt

SEQ ID NO: 705853 - DNA, 22 bp, Artificial Sequence
  chemically synthesized
ggtatctttttattttccattt

SEQ ID NO: 705854 - DNA, 22 bp, Artificial Sequence
  chemically synthesized
gtatctttttattttccatttt

SEQ ID NO: 705855 - DNA, 22 bp, Artificial Sequence
  chemically synthesized
tttattttccatttttccttta

SEQ ID NO: 705856 - DNA, 22 bp, Artificial Sequence
  chemically synthesized
ttattttccatttttcctttat

SEQ ID NO: 705857 - DNA, 22 bp, Artificial Sequence
  chemically synthesized
tattttccatttttcctttatg

SEQ ID NO: 705858 - DNA, 22 bp, Artificial Sequence
  chemically synthesized
attttccatttttcctttatgt

SEQ ID NO: 705859 - DNA, 22 bp, Artificial Sequence
  chemically synthesized
ttttccatttttcctttatgtg

SEQ ID NO: 705860 - DNA, 22 bp, Artificial Sequence
  chemically synthesized
tccatttttcctttatgtgtac

SEQ ID NO: 705861 - DNA, 22 bp, Artificial Sequence
  chemically synthesized
ccatttttcctttatgtgtaca

SEQ ID NO: 705862 - DNA, 22 bp, Artificial Sequence
  chemically synthesized
catttttcctttatgtgtacat

SEQ ID NO: 705863 - DNA, 22 bp, Artificial Sequence
  chemically synthesized
ttcctttatgtgtacatttctg

SEQ ID NO: 705864 - DNA, 22 bp, Artificial Sequence
  chemically synthesized
tcctttatgtgtacatttctgt

SEQ ID NO: 705865 - DNA, 22 bp, Artificial Sequence
  chemically synthesized
cctttatgtgtacatttctgtt

SEQ ID NO: 705866 - DNA, 22 bp, Artificial Sequence
  chemically synthesized
ctttatgtgtacatttctgtta

SEQ ID NO: 705867 - DNA, 22 bp, Artificial Sequence
  chemically synthesized
tatgtgtacatttctgttattt

SEQ ID NO: 705868 - DNA, 22 bp, Artificial Sequence
  chemically synthesized
atgtgtacatttctgttatttt

SEQ ID NO: 705869 - DNA, 22 bp, Artificial Sequence
  chemically synthesized
caaaataaaataaaaataacag

SEQ ID NO: 705870 - DNA, 22 bp, Artificial Sequence
  chemically synthesized
tgtgtacatttctgttattttt

SEQ ID NO: 705871 - DNA, 22 bp, Artificial Sequence
  chemically synthesized
tattacaaaataaaataaaaat

SEQ ID NO: 705872 - DNA, 22 bp, Artificial Sequence
  chemically synthesized
ctgttatttttattttattttg

SEQ ID NO: 705873 - DNA, 22 bp, Artificial Sequence
  chemically synthesized
tgttatttttattttattttgt

SEQ ID NO: 705874 - DNA, 22 bp, Artificial Sequence
  chemically synthesized
ttatttttattttattttgtaa

SEQ ID NO: 705875 - DNA, 22 bp, Artificial Sequence
  chemically synthesized
tttttattttattttgtaatat

SEQ ID NO: 705876 - DNA, 22 bp, Artificial Sequence
  chemically synthesized
ttattttattttgtaatatagt

SEQ ID NO: 705877 - DNA, 22 bp, Artificial Sequence
  chemically synthesized
tattttattttgtaatatagtt

SEQ ID NO: 705878 - DNA, 22 bp, Artificial Sequence
  chemically synthesized
cagcatgatcacaactatatta

SEQ ID NO: 705879 - DNA, 22 bp, Artificial Sequence
  chemically synthesized
attttattttgtaatatagttg

SEQ ID NO: 705880 - DNA, 22 bp, Artificial Sequence
  chemically synthesized
ttttattttgtaatatagttgt

SEQ ID NO: 705881 - DNA, 22 bp, Artificial Sequence
  chemically synthesized
tattttgtaatatagttgtgat

SEQ ID NO: 705882 - DNA, 22 bp, Artificial Sequence
  chemically synthesized
attttgtaatatagttgtgatc

SEQ ID NO: 705883 - DNA, 22 bp, Artificial Sequence
  chemically synthesized
ttttgtaatatagttgtgatca

SEQ ID NO: 705884 - DNA, 22 bp, Artificial Sequence
  chemically synthesized
aaaattacagcatgatcacaac

SEQ ID NO: 705885 - DNA, 22 bp, Artificial Sequence
  chemically synthesized
caaaattacagcatgatcacaa

SEQ ID NO: 705886 - DNA, 22 bp, Artificial Sequence
  chemically synthesized
tgtaatatagttgtgatcatgc

SEQ ID NO: 705887 - DNA, 22 bp, Artificial Sequence
  chemically synthesized
gtaatatagttgtgatcatgct

SEQ ID NO: 705888 - DNA, 22 bp, Artificial Sequence
  chemically synthesized
taatatagttgtgatcatgctg

SEQ ID NO: 705889 - DNA, 22 bp, Artificial Sequence
  chemically synthesized
acttcaaaattacagcatgatc

SEQ ID NO: 705890 - DNA, 22 bp, Artificial Sequence
  chemically synthesized
tgatcatgctgtaattttgaag

SEQ ID NO: 705891 - DNA, 22 bp, Artificial Sequence
  chemically synthesized
agggaaaaggctgacttcaaaa

SEQ ID NO: 705892 - DNA, 22 bp, Artificial Sequence
  chemically synthesized
taattttgaagtcagccttttc

SEQ ID NO: 705893 - DNA, 22 bp, Artificial Sequence
  chemically synthesized
tgaagtcagccttttcccttaa

SEQ ID NO: 705894 - DNA, 22 bp, Artificial Sequence
  chemically synthesized
gaagtcagccttttcccttaat

SEQ ID NO: 705895 - DNA, 22 bp, Artificial Sequence
  chemically synthesized
aagtcagccttttcccttaatg

SEQ ID NO: 705896 - DNA, 22 bp, Artificial Sequence
  chemically synthesized
taccatgtaatacattaaggga

SEQ ID NO: 705897 - DNA, 22 bp, Artificial Sequence
  chemically synthesized
ttcccttaatgtattacatggt

SEQ ID NO: 705898 - DNA, 22 bp, Artificial Sequence
  chemically synthesized
tcccttaatgtattacatggta

SEQ ID NO: 705899 - DNA, 22 bp, Artificial Sequence
  chemically synthesized
cccttaatgtattacatggtac

SEQ ID NO: 705900 - DNA, 22 bp, Artificial Sequence
  chemically synthesized
tcaaagtcgactgtaccatgta

SEQ ID NO: 705901 - DNA, 22 bp, Artificial Sequence
  chemically synthesized
ccttaatgtattacatggtaca

SEQ ID NO: 705902 - DNA, 22 bp, Artificial Sequence
  chemically synthesized
atcaaagtcgactgtaccatgt

SEQ ID NO: 705903 - DNA, 22 bp, Artificial Sequence
  chemically synthesized
tatcaaagtcgactgtaccatg

SEQ ID NO: 705904 - DNA, 22 bp, Artificial Sequence
  chemically synthesized
ttatcaaagtcgactgtaccat

SEQ ID NO: 705905 - DNA, 22 bp, Artificial Sequence
  chemically synthesized
aatgtattacatggtacagtcg

SEQ ID NO: 705906 - DNA, 22 bp, Artificial Sequence
  chemically synthesized
atgtattacatggtacagtcga

SEQ ID NO: 705907 - DNA, 22 bp, Artificial Sequence
  chemically synthesized
catggtacagtcgactttgata

SEQ ID NO: 705908 - DNA, 22 bp, Artificial Sequence
  chemically synthesized
tatggtcgtttttatcaaagtc

SEQ ID NO: 705909 - DNA, 22 bp, Artificial Sequence
  chemically synthesized
atatggtcgtttttatcaaagt

SEQ ID NO: 705910 - DNA, 22 bp, Artificial Sequence
  chemically synthesized
tatatggtcgtttttatcaaag

SEQ ID NO: 705911 - DNA, 22 bp, Artificial Sequence
  chemically synthesized
ataactttatatggtcgttttt

SEQ ID NO: 705912 - DNA, 22 bp, Artificial Sequence
  chemically synthesized
tgataaaaacgaccatataaag

SEQ ID NO: 705913 - DNA, 22 bp, Artificial Sequence
  chemically synthesized
gataaaaacgaccatataaagt

SEQ ID NO: 705914 - DNA, 22 bp, Artificial Sequence
  chemically synthesized
atagcattcataactttatatg

SEQ ID NO: 705915 - DNA, 22 bp, Artificial Sequence
  chemically synthesized
ataaaaacgaccatataaagtt

SEQ ID NO: 705916 - DNA, 22 bp, Artificial Sequence
  chemically synthesized
agcaaagactaatagcattcat

SEQ ID NO: 705917 - DNA, 22 bp, Artificial Sequence
  chemically synthesized
tcagcaaagactaatagcattc

SEQ ID NO: 705918 - DNA, 22 bp, Artificial Sequence
  chemically synthesized
ctcagcaaagactaatagcatt

SEQ ID NO: 705919 - DNA, 22 bp, Artificial Sequence
  chemically synthesized
cttctcagcaaagactaatagc

SEQ ID NO: 705920 - DNA, 22 bp, Artificial Sequence
  chemically synthesized
ttgcttctcagcaaagactaat

SEQ ID NO: 705921 - DNA, 22 bp, Artificial Sequence
  chemically synthesized
tgttgcttctcagcaaagacta

SEQ ID NO: 705922 - DNA, 22 bp, Artificial Sequence
  chemically synthesized
ctgttgcttctcagcaaagact

SEQ ID NO: 705923 - DNA, 22 bp, Artificial Sequence
  chemically synthesized
tgaatgctattagtctttgctg

SEQ ID NO: 705924 - DNA, 22 bp, Artificial Sequence
  chemically synthesized
tctgttgcttctcagcaaagac

SEQ ID NO: 705925 - DNA, 22 bp, Artificial Sequence
  chemically synthesized
ttctgttgcttctcagcaaaga

SEQ ID NO: 705926 - DNA, 22 bp, Artificial Sequence
  chemically synthesized
ttagtctttgctgagaagcaac

SEQ ID NO: 705927 - DNA, 22 bp, Artificial Sequence
  chemically synthesized
gtctttgctgagaagcaacaga

SEQ ID NO: 705928 - DNA, 22 bp, Artificial Sequence
  chemically synthesized
tgctgagaagcaacagaaaagg

SEQ ID NO: 705929 - DNA, 22 bp, Artificial Sequence
  chemically synthesized
gctgagaagcaacagaaaaggt

SEQ ID NO: 705930 - DNA, 22 bp, Artificial Sequence
  chemically synthesized
ctgagaagcaacagaaaaggtc

SEQ ID NO: 705931 - DNA, 22 bp, Artificial Sequence
  chemically synthesized
aataaataatgtgaccttttct

SEQ ID NO: 705932 - DNA, 22 bp, Artificial Sequence
  chemically synthesized
agaagcaacagaaaaggtcaca

SEQ ID NO: 705933 - DNA, 22 bp, Artificial Sequence
  chemically synthesized
tcacatagtagacactcaataa

SEQ ID NO: 705934 - DNA, 22 bp, Artificial Sequence
  chemically synthesized
tttattgagtgtctactatgtg

SEQ ID NO: 705935 - DNA, 22 bp, Artificial Sequence
  chemically synthesized
gcatagtggctatcacatagta

SEQ ID NO: 705936 - DNA, 22 bp, Artificial Sequence
  chemically synthesized
agcatagtggctatcacatagt

SEQ ID NO: 705937 - DNA, 22 bp, Artificial Sequence
  chemically synthesized
attgagtgtctactatgtgata

SEQ ID NO: 705938 - DNA, 22 bp, Artificial Sequence
  chemically synthesized
ttgagtgtctactatgtgatag

SEQ ID NO: 705939 - DNA, 22 bp, Artificial Sequence
  chemically synthesized
agtgtctactatgtgatagcca

SEQ ID NO: 705940 - DNA, 22 bp, Artificial Sequence
  chemically synthesized
ctatgtgatagccactatgcta

SEQ ID NO: 705941 - DNA, 22 bp, Artificial Sequence
  chemically synthesized
tgtgatagccactatgctaaat

SEQ ID NO: 705942 - DNA, 22 bp, Artificial Sequence
  chemically synthesized
ataatacacagaggcatgagat

SEQ ID NO: 705943 - DNA, 22 bp, Artificial Sequence
  chemically synthesized
tgctaaatctcatgcctctgtg

SEQ ID NO: 705944 - DNA, 22 bp, Artificial Sequence
  chemically synthesized
acattgataatacacagaggca

SEQ ID NO: 705945 - DNA, 22 bp, Artificial Sequence
  chemically synthesized
gacattgataatacacagaggc

SEQ ID NO: 705946 - DNA, 22 bp, Artificial Sequence
  chemically synthesized
ttgacattgataatacacagag

SEQ ID NO: 705947 - DNA, 22 bp, Artificial Sequence
  chemically synthesized
aatctcatgcctctgtgtatta

SEQ ID NO: 705948 - DNA, 22 bp, Artificial Sequence
  chemically synthesized
actcttgacattgataatacac

SEQ ID NO: 705949 - DNA, 22 bp, Artificial Sequence
  chemically synthesized
atgcctctgtgtattatcaatg

SEQ ID NO: 705950 - DNA, 22 bp, Artificial Sequence
  chemically synthesized
tgtgtattatcaatgtcaagag

SEQ ID NO: 705951 - DNA, 22 bp, Artificial Sequence
  chemically synthesized
tgtattatcaatgtcaagagtg

SEQ ID NO: 705952 - DNA, 22 bp, Artificial Sequence
  chemically synthesized
tcaatgtcaagagtgaatttac

SEQ ID NO: 705953 - DNA, 22 bp, Artificial Sequence
  chemically synthesized
tacccaaaagaagaagaggtaa

SEQ ID NO: 705954 - DNA, 22 bp, Artificial Sequence
  chemically synthesized
atacccaaaagaagaagaggta

SEQ ID NO: 705955 - DNA, 22 bp, Artificial Sequence
  chemically synthesized
tgtcttatacccaaaagaagaa

SEQ ID NO: 705956 - DNA, 22 bp, Artificial Sequence
  chemically synthesized
acctcttcttcttttgggtata

SEQ ID NO: 705957 - DNA, 22 bp, Artificial Sequence
  chemically synthesized
cctcttcttcttttgggtataa

SEQ ID NO: 705958 - DNA, 22 bp, Artificial Sequence
  chemically synthesized
ttcttcttttgggtataagaca

SEQ ID NO: 705959 - DNA, 22 bp, Artificial Sequence
  chemically synthesized
cagaatgaattatgtcttatac

SEQ ID NO: 705960 - DNA, 22 bp, Artificial Sequence
  chemically synthesized
acagaatgaattatgtcttata

SEQ ID NO: 705961 - DNA, 22 bp, Artificial Sequence
  chemically synthesized
cttcttttgggtataagacata

SEQ ID NO: 705962 - DNA, 22 bp, Artificial Sequence
  chemically synthesized
ttcttttgggtataagacataa

SEQ ID NO: 705963 - DNA, 22 bp, Artificial Sequence
  chemically synthesized
cttttgggtataagacataatt

SEQ ID NO: 705964 - DNA, 22 bp, Artificial Sequence
  chemically synthesized
ttttgggtataagacataattc

SEQ ID NO: 705965 - DNA, 22 bp, Artificial Sequence
  chemically synthesized
ttgggtataagacataattcat

SEQ ID NO: 705966 - DNA, 22 bp, Artificial Sequence
  chemically synthesized
tgggtataagacataattcatt

SEQ ID NO: 705967 - DNA, 22 bp, Artificial Sequence
  chemically synthesized
gggtataagacataattcattc

SEQ ID NO: 705968 - DNA, 22 bp, Artificial Sequence
  chemically synthesized
ggtataagacataattcattct

SEQ ID NO: 705969 - DNA, 22 bp, Artificial Sequence
  chemically synthesized
agtaaatatttacagaatgaat

SEQ ID NO: 705970 - DNA, 22 bp, Artificial Sequence
  chemically synthesized
gtagatgttcagtaaatattta

SEQ ID NO: 705971 - DNA, 22 bp, Artificial Sequence
  chemically synthesized
ggtagatgttcagtaaatattt

SEQ ID NO: 705972 - DNA, 22 bp, Artificial Sequence
  chemically synthesized
attctgtaaatatttactgaac

SEQ ID NO: 705973 - DNA, 22 bp, Artificial Sequence
  chemically synthesized
tgtaaatatttactgaacatct

SEQ ID NO: 705974 - DNA, 22 bp, Artificial Sequence
  chemically synthesized
taaatatttactgaacatctac

SEQ ID NO: 705975 - DNA, 22 bp, Artificial Sequence
  chemically synthesized
atgtggtatgtggtacttggta

SEQ ID NO: 705976 - DNA, 22 bp, Artificial Sequence
  chemically synthesized
actgaacatctaccaagtacca

SEQ ID NO: 705977 - DNA, 22 bp, Artificial Sequence
  chemically synthesized
ctgaacatctaccaagtaccac

SEQ ID NO: 705978 - DNA, 22 bp, Artificial Sequence
  chemically synthesized
aacatctaccaagtaccacata

SEQ ID NO: 705979 - DNA, 22 bp, Artificial Sequence
  chemically synthesized
cagtacctaatgtggtatgtgg

SEQ ID NO: 705980 - DNA, 22 bp, Artificial Sequence
  chemically synthesized
tacagtacctaatgtggtatgt

SEQ ID NO: 705981 - DNA, 22 bp, Artificial Sequence
  chemically synthesized
ccaagtaccacataccacatta

SEQ ID NO: 705982 - DNA, 22 bp, Artificial Sequence
  chemically synthesized
tattctacagtacctaatgtgg

SEQ ID NO: 705983 - DNA, 22 bp, Artificial Sequence
  chemically synthesized
acagttatattctacagtacct

SEQ ID NO: 705984 - DNA, 22 bp, Artificial Sequence
  chemically synthesized
ttgacagttatattctacagta

SEQ ID NO: 705985 - DNA, 22 bp, Artificial Sequence
  chemically synthesized
gttgacagttatattctacagt

SEQ ID NO: 705986 - DNA, 22 bp, Artificial Sequence
  chemically synthesized
gtcttgttgacagttatattct

SEQ ID NO: 705987 - DNA, 22 bp, Artificial Sequence
  chemically synthesized
ggtactgtagaatataactgtc

SEQ ID NO: 705988 - DNA, 22 bp, Artificial Sequence
  chemically synthesized
tagaatataactgtcaacaaga

SEQ ID NO: 705989 - DNA, 22 bp, Artificial Sequence
  chemically synthesized
aaatgtcaggatagtattagtc

SEQ ID NO: 705990 - DNA, 22 bp, Artificial Sequence
  chemically synthesized
taaaatgtcaggatagtattag

SEQ ID NO: 705991 - DNA, 22 bp, Artificial Sequence
  chemically synthesized
tcaacaagactaatactatcct

SEQ ID NO: 705992 - DNA, 22 bp, Artificial Sequence
  chemically synthesized
atctctaaaatgtcaggatagt

SEQ ID NO: 705993 - DNA, 22 bp, Artificial Sequence
  chemically synthesized
aatctctaaaatgtcaggatag

SEQ ID NO: 705994 - DNA, 22 bp, Artificial Sequence
  chemically synthesized
atactatcctgacattttagag

SEQ ID NO: 705995 - DNA, 22 bp, Artificial Sequence
  chemically synthesized
tcctgacattttagagattaag

SEQ ID NO: 705996 - DNA, 22 bp, Artificial Sequence
  chemically synthesized
acattttagagattaaggtcta

SEQ ID NO: 705997 - DNA, 22 bp, Artificial Sequence
  chemically synthesized
tagagattaaggtctatctttt

SEQ ID NO: 705998 - DNA, 22 bp, Artificial Sequence
  chemically synthesized
agagattaaggtctatcttttt

SEQ ID NO: 705999 - DNA, 22 bp, Artificial Sequence
  chemically synthesized
gagattaaggtctatctttttg

SEQ ID NO: 706000 - DNA, 22 bp, Artificial Sequence
  chemically synthesized
acgagtgataaataatcaaaaa

SEQ ID NO: 706001 - DNA, 22 bp, Artificial Sequence
  chemically synthesized
aggtctatctttttgattattt

SEQ ID NO: 706002 - DNA, 22 bp, Artificial Sequence
  chemically synthesized
tataactaacgagtgataaata

SEQ ID NO: 706003 - DNA, 22 bp, Artificial Sequence
  chemically synthesized
gtataactaacgagtgataaat

SEQ ID NO: 706004 - DNA, 22 bp, Artificial Sequence
  chemically synthesized
tctttttgattatttatcactc

SEQ ID NO: 706005 - DNA, 22 bp, Artificial Sequence
  chemically synthesized
tttgtataactaacgagtgata

SEQ ID NO: 706006 - DNA, 22 bp, Artificial Sequence
  chemically synthesized
tttgattatttatcactcgtta

SEQ ID NO: 706007 - DNA, 22 bp, Artificial Sequence
  chemically synthesized
ttgattatttatcactcgttag

SEQ ID NO: 706008 - DNA, 22 bp, Artificial Sequence
  chemically synthesized
tgattatttatcactcgttagt

SEQ ID NO: 706009 - DNA, 22 bp, Artificial Sequence
  chemically synthesized
gattatttatcactcgttagtt

SEQ ID NO: 706010 - DNA, 22 bp, Artificial Sequence
  chemically synthesized
attatttatcactcgttagtta

SEQ ID NO: 706011 - DNA, 22 bp, Artificial Sequence
  chemically synthesized
aatagttgtttgtataactaac

SEQ ID NO: 706012 - DNA, 22 bp, Artificial Sequence
  chemically synthesized
tttatcactcgttagttataca

SEQ ID NO: 706013 - DNA, 22 bp, Artificial Sequence
  chemically synthesized
atcactcgttagttatacaaac

SEQ ID NO: 706014 - DNA, 22 bp, Artificial Sequence
  chemically synthesized
tcactcgttagttatacaaaca

SEQ ID NO: 706015 - DNA, 22 bp, Artificial Sequence
  chemically synthesized
gaacggctcaatagttgtttgt

SEQ ID NO: 706016 - DNA, 22 bp, Artificial Sequence
  chemically synthesized
gttagttatacaaacaactatt

SEQ ID NO: 706017 - DNA, 22 bp, Artificial Sequence
  chemically synthesized
gttatacaaacaactattgagc

SEQ ID NO: 706018 - DNA, 22 bp, Artificial Sequence
  chemically synthesized
cacattagaacggctcaatagt

SEQ ID NO: 706019 - DNA, 22 bp, Artificial Sequence
  chemically synthesized
gcacattagaacggctcaatag

SEQ ID NO: 706020 - DNA, 22 bp, Artificial Sequence
  chemically synthesized
tgcacattagaacggctcaata

SEQ ID NO: 706021 - DNA, 22 bp, Artificial Sequence
  chemically synthesized
tacaaacaactattgagccgtt

SEQ ID NO: 706022 - DNA, 22 bp, Artificial Sequence
  chemically synthesized
ttgagccgttctaatgtgcaaa

SEQ ID NO: 706023 - DNA, 22 bp, Artificial Sequence
  chemically synthesized
aaagtccagtgttttgcacatt

SEQ ID NO: 706024 - DNA, 22 bp, Artificial Sequence
  chemically synthesized
agccgttctaatgtgcaaaaca

SEQ ID NO: 706025 - DNA, 22 bp, Artificial Sequence
  chemically synthesized
atctgaaagtccagtgttttgc

SEQ ID NO: 706026 - DNA, 22 bp, Artificial Sequence
  chemically synthesized
taatgtgcaaaacactggactt

SEQ ID NO: 706027 - DNA, 22 bp, Artificial Sequence
  chemically synthesized
atgtgcaaaacactggactttc

SEQ ID NO: 706028 - DNA, 22 bp, Artificial Sequence
  chemically synthesized
caaggatctaatctgaaagtcc

SEQ ID NO: 706029 - DNA, 22 bp, Artificial Sequence
  chemically synthesized
ccaaggatctaatctgaaagtc

SEQ ID NO: 706030 - DNA, 22 bp, Artificial Sequence
  chemically synthesized
aagatgatttccaaggatctaa

SEQ ID NO: 706031 - DNA, 22 bp, Artificial Sequence
  chemically synthesized
gactttcagattagatccttgg

SEQ ID NO: 706032 - DNA, 22 bp, Artificial Sequence
  chemically synthesized
tgaagatgatttccaaggatct

SEQ ID NO: 706033 - DNA, 22 bp, Artificial Sequence
  chemically synthesized
ctgaagatgatttccaaggatc

SEQ ID NO: 706034 - DNA, 22 bp, Artificial Sequence
  chemically synthesized
tctgaagatgatttccaaggat

SEQ ID NO: 706035 - DNA, 22 bp, Artificial Sequence
  chemically synthesized
tcagattagatccttggaaatc

SEQ ID NO: 706036 - DNA, 22 bp, Artificial Sequence
  chemically synthesized
ctttctgaagatgatttccaag

SEQ ID NO: 706037 - DNA, 22 bp, Artificial Sequence
  chemically synthesized
cagattagatccttggaaatca

SEQ ID NO: 706038 - DNA, 22 bp, Artificial Sequence
  chemically synthesized
agattagatccttggaaatcat

SEQ ID NO: 706039 - DNA, 22 bp, Artificial Sequence
  chemically synthesized
tcctttctgaagatgatttcca

SEQ ID NO: 706040 - DNA, 22 bp, Artificial Sequence
  chemically synthesized
ctctcctttctgaagatgattt

SEQ ID NO: 706041 - DNA, 22 bp, Artificial Sequence
  chemically synthesized
gatccttggaaatcatcttcag

SEQ ID NO: 706042 - DNA, 22 bp, Artificial Sequence
  chemically synthesized
ggaaatcatcttcagaaaggag

SEQ ID NO: 706043 - DNA, 22 bp, Artificial Sequence
  chemically synthesized
gaaatcatcttcagaaaggaga

SEQ ID NO: 706044 - DNA, 22 bp, Artificial Sequence
  chemically synthesized
atggtcagtataagtagttcct

SEQ ID NO: 706045 - DNA, 22 bp, Artificial Sequence
  chemically synthesized
aatggtcagtataagtagttcc

SEQ ID NO: 706046 - DNA, 22 bp, Artificial Sequence
  chemically synthesized
cagaaaggagaggaactactta

SEQ ID NO: 706047 - DNA, 22 bp, Artificial Sequence
  chemically synthesized
agaaaggagaggaactacttat

SEQ ID NO: 706048 - DNA, 22 bp, Artificial Sequence
  chemically synthesized
catttaatggtcagtataagta

SEQ ID NO: 706049 - DNA, 22 bp, Artificial Sequence
  chemically synthesized
gcatttaatggtcagtataagt

SEQ ID NO: 706050 - DNA, 22 bp, Artificial Sequence
  chemically synthesized
ttgcatttaatggtcagtataa

SEQ ID NO: 706051 - DNA, 22 bp, Artificial Sequence
  chemically synthesized
tcttgcatttaatggtcagtat

SEQ ID NO: 706052 - DNA, 22 bp, Artificial Sequence
  chemically synthesized
attctcttgcatttaatggtca

SEQ ID NO: 706053 - DNA, 22 bp, Artificial Sequence
  chemically synthesized
attcattctcttgcatttaatg

SEQ ID NO: 706054 - DNA, 22 bp, Artificial Sequence
  chemically synthesized
cttatactgaccattaaatgca

SEQ ID NO: 706055 - DNA, 22 bp, Artificial Sequence
  chemically synthesized
cattcattctcttgcatttaat

SEQ ID NO: 706056 - DNA, 22 bp, Artificial Sequence
  chemically synthesized
atactgaccattaaatgcaaga

SEQ ID NO: 706057 - DNA, 22 bp, Artificial Sequence
  chemically synthesized
tactgaccattaaatgcaagag

SEQ ID NO: 706058 - DNA, 22 bp, Artificial Sequence
  chemically synthesized
accattaaatgcaagagaatga

SEQ ID NO: 706059 - DNA, 22 bp, Artificial Sequence
  chemically synthesized
gtcatgaaagtttcattcattc

SEQ ID NO: 706060 - DNA, 22 bp, Artificial Sequence
  chemically synthesized
aatgcaagagaatgaatgaaac

SEQ ID NO: 706061 - DNA, 22 bp, Artificial Sequence
  chemically synthesized
gagtcaaactagtcatgaaagt

SEQ ID NO: 706062 - DNA, 22 bp, Artificial Sequence
  chemically synthesized
ttagagtcaaactagtcatgaa

SEQ ID NO: 706063 - DNA, 22 bp, Artificial Sequence
  chemically synthesized
atgcatgcctgttagagtcaaa

SEQ ID NO: 706064 - DNA, 22 bp, Artificial Sequence
  chemically synthesized
aatgcatgcctgttagagtcaa

SEQ ID NO: 706065 - DNA, 22 bp, Artificial Sequence
  chemically synthesized
tcatgactagtttgactctaac

SEQ ID NO: 706066 - DNA, 22 bp, Artificial Sequence
  chemically synthesized
catgactagtttgactctaaca

SEQ ID NO: 706067 - DNA, 22 bp, Artificial Sequence
  chemically synthesized
atgactagtttgactctaacag

SEQ ID NO: 706068 - DNA, 22 bp, Artificial Sequence
  chemically synthesized
gtttgactctaacaggcatgca

SEQ ID NO: 706069 - DNA, 22 bp, Artificial Sequence
  chemically synthesized
atagtataacttaatgcatgcc

SEQ ID NO: 706070 - DNA, 22 bp, Artificial Sequence
  chemically synthesized
gatagtataacttaatgcatgc

SEQ ID NO: 706071 - DNA, 22 bp, Artificial Sequence
  chemically synthesized
gactctaacaggcatgcattaa

SEQ ID NO: 706072 - DNA, 22 bp, Artificial Sequence
  chemically synthesized
actctaacaggcatgcattaag

SEQ ID NO: 706073 - DNA, 22 bp, Artificial Sequence
  chemically synthesized
taacaggcatgcattaagttat

SEQ ID NO: 706074 - DNA, 22 bp, Artificial Sequence
  chemically synthesized
tcagcttgatagtataacttaa

SEQ ID NO: 706075 - DNA, 22 bp, Artificial Sequence
  chemically synthesized
acaggcatgcattaagttatac

SEQ ID NO: 706076 - DNA, 22 bp, Artificial Sequence
  chemically synthesized
ctatcagcttgatagtataact

SEQ ID NO: 706077 - DNA, 22 bp, Artificial Sequence
  chemically synthesized
ttactatcagcttgatagtata

SEQ ID NO: 706078 - DNA, 22 bp, Artificial Sequence
  chemically synthesized
agttatactatcaagctgatag

SEQ ID NO: 706079 - DNA, 22 bp, Artificial Sequence
  chemically synthesized
gtatcattattactatcagctt

SEQ ID NO: 706080 - DNA, 22 bp, Artificial Sequence
  chemically synthesized
tactatcaagctgatagtaata

SEQ ID NO: 706081 - DNA, 22 bp, Artificial Sequence
  chemically synthesized
gcattagtatcattattactat

SEQ ID NO: 706082 - DNA, 22 bp, Artificial Sequence
  chemically synthesized
agcattagtatcattattacta

SEQ ID NO: 706083 - DNA, 22 bp, Artificial Sequence
  chemically synthesized
tagcattagtatcattattact

SEQ ID NO: 706084 - DNA, 22 bp, Artificial Sequence
  chemically synthesized
tcaagctgatagtaataatgat

SEQ ID NO: 706085 - DNA, 22 bp, Artificial Sequence
  chemically synthesized
gctttagcattagtatcattat

SEQ ID NO: 706086 - DNA, 22 bp, Artificial Sequence
  chemically synthesized
ttagctttagcattagtatcat

SEQ ID NO: 706087 - DNA, 22 bp, Artificial Sequence
  chemically synthesized
atagtaataatgatactaatgc

SEQ ID NO: 706088 - DNA, 22 bp, Artificial Sequence
  chemically synthesized
ctattagctttagcattagtat

SEQ ID NO: 706089 - DNA, 22 bp, Artificial Sequence
  chemically synthesized
gctattagctttagcattagta

SEQ ID NO: 706090 - DNA, 22 bp, Artificial Sequence
  chemically synthesized
aagtgtttgctattagctttag

SEQ ID NO: 706091 - DNA, 22 bp, Artificial Sequence
  chemically synthesized
ttcaagtgtttgctattagctt

SEQ ID NO: 706092 - DNA, 22 bp, Artificial Sequence
  chemically synthesized
atgctaaagctaatagcaaaca

SEQ ID NO: 706093 - DNA, 22 bp, Artificial Sequence
  chemically synthesized
aagctaatagcaaacacttgaa

SEQ ID NO: 706094 - DNA, 22 bp, Artificial Sequence
  chemically synthesized
gaacatagtaagtgctattcaa

SEQ ID NO: 706095 - DNA, 22 bp, Artificial Sequence
  chemically synthesized
atagcaaacacttgaatagcac

SEQ ID NO: 706096 - DNA, 22 bp, Artificial Sequence
  chemically synthesized
gagtagtgcctggaacatagta

SEQ ID NO: 706097 - DNA, 22 bp, Artificial Sequence
  chemically synthesized
agagtagtgcctggaacatagt

SEQ ID NO: 706098 - DNA, 22 bp, Artificial Sequence
  chemically synthesized
gaatagcacttactatgttcca

SEQ ID NO: 706099 - DNA, 22 bp, Artificial Sequence
  chemically synthesized
aatagcacttactatgttccag

SEQ ID NO: 706100 - DNA, 22 bp, Artificial Sequence
  chemically synthesized
taaaacccttagagtagtgcct

SEQ ID NO: 706101 - DNA, 22 bp, Artificial Sequence
  chemically synthesized
gtaaaacccttagagtagtgcc

SEQ ID NO: 706102 - DNA, 22 bp, Artificial Sequence
  chemically synthesized
actatgttccaggcactactct

SEQ ID NO: 706103 - DNA, 22 bp, Artificial Sequence
  chemically synthesized
ctatgttccaggcactactcta

SEQ ID NO: 706104 - DNA, 22 bp, Artificial Sequence
  chemically synthesized
tgttccaggcactactctaagg

SEQ ID NO: 706105 - DNA, 22 bp, Artificial Sequence
  chemically synthesized
atatttgtaaaacccttagagt

SEQ ID NO: 706106 - DNA, 22 bp, Artificial Sequence
  chemically synthesized
caggcactactctaagggtttt

SEQ ID NO: 706107 - DNA, 22 bp, Artificial Sequence
  chemically synthesized
ctctaagggttttacaaatatt

SEQ ID NO: 706108 - DNA, 22 bp, Artificial Sequence
  chemically synthesized
taagggttttacaaatattaac

SEQ ID NO: 706109 - DNA, 22 bp, Artificial Sequence
  chemically synthesized
agggttttacaaatattaactg

SEQ ID NO: 706110 - DNA, 22 bp, Artificial Sequence
  chemically synthesized
cagtgaagatcaaacagttaat

SEQ ID NO: 706111 - DNA, 22 bp, Artificial Sequence
  chemically synthesized
tacaaatattaactgtttgatc

SEQ ID NO: 706112 - DNA, 22 bp, Artificial Sequence
  chemically synthesized
acaaatattaactgtttgatct

SEQ ID NO: 706113 - DNA, 22 bp, Artificial Sequence
  chemically synthesized
caaatattaactgtttgatctt

SEQ ID NO: 706114 - DNA, 22 bp, Artificial Sequence
  chemically synthesized
atagggttacagtgaagatcaa

SEQ ID NO: 706115 - DNA, 22 bp, Artificial Sequence
  chemically synthesized
catagggttacagtgaagatca

SEQ ID NO: 706116 - DNA, 22 bp, Artificial Sequence
  chemically synthesized
tttcatagggttacagtgaaga

SEQ ID NO: 706117 - DNA, 22 bp, Artificial Sequence
  chemically synthesized
actgtttgatcttcactgtaac

SEQ ID NO: 706118 - DNA, 22 bp, Artificial Sequence
  chemically synthesized
tattatttcatagggttacagt

SEQ ID NO: 706119 - DNA, 22 bp, Artificial Sequence
  chemically synthesized
tttgatcttcactgtaacccta

SEQ ID NO: 706120 - DNA, 22 bp, Artificial Sequence
  chemically synthesized
gatcttcactgtaaccctatga

SEQ ID NO: 706121 - DNA, 22 bp, Artificial Sequence
  chemically synthesized
atcttcactgtaaccctatgaa

SEQ ID NO: 706122 - DNA, 22 bp, Artificial Sequence
  chemically synthesized
cactgtaaccctatgaaataat

SEQ ID NO: 706123 - DNA, 22 bp, Artificial Sequence
  chemically synthesized
actgtaaccctatgaaataata

SEQ ID NO: 706124 - DNA, 22 bp, Artificial Sequence
  chemically synthesized
ggtgaaatatggctgtattatt

SEQ ID NO: 706125 - DNA, 22 bp, Artificial Sequence
  chemically synthesized
taaccctatgaaataatacagc

SEQ ID NO: 706126 - DNA, 22 bp, Artificial Sequence
  chemically synthesized
aattcggtgaaatatggctgta

SEQ ID NO: 706127 - DNA, 22 bp, Artificial Sequence
  chemically synthesized
tgaaataatacagccatatttc

SEQ ID NO: 706128 - DNA, 22 bp, Artificial Sequence
  chemically synthesized
caccgaattcaatatcccattg

SEQ ID NO: 706129 - DNA, 22 bp, Artificial Sequence
  chemically synthesized
accgaattcaatatcccattgg

SEQ ID NO: 706130 - DNA, 22 bp, Artificial Sequence
  chemically synthesized
aatatcccattggtcgtatggt

SEQ ID NO: 706131 - DNA, 22 bp, Artificial Sequence
  chemically synthesized
aaatcagaatgcaccatacgac

SEQ ID NO: 706132 - DNA, 22 bp, Artificial Sequence
  chemically synthesized
tgaaatcagaatgcaccatacg

SEQ ID NO: 706133 - DNA, 22 bp, Artificial Sequence
  chemically synthesized
aacagttctgaaatcagaatgc

SEQ ID NO: 706134 - DNA, 22 bp, Artificial Sequence
  chemically synthesized
caacagttctgaaatcagaatg

SEQ ID NO: 706135 - DNA, 22 bp, Artificial Sequence
  chemically synthesized
gtcgtatggtgcattctgattt

SEQ ID NO: 706136 - DNA, 22 bp, Artificial Sequence
  chemically synthesized
cacccacgtttcaacagttctg

SEQ ID NO: 706137 - DNA, 22 bp, Artificial Sequence
  chemically synthesized
ccacccacgtttcaacagttct

SEQ ID NO: 706138 - DNA, 22 bp, Artificial Sequence
  chemically synthesized
tccacccacgtttcaacagttc

SEQ ID NO: 706139 - DNA, 22 bp, Artificial Sequence
  chemically synthesized
ttccacccacgtttcaacagtt

SEQ ID NO: 706140 - DNA, 22 bp, Artificial Sequence
  chemically synthesized
tgatttcagaactgttgaaacg

SEQ ID NO: 706141 - DNA, 22 bp, Artificial Sequence
  chemically synthesized
atttcagaactgttgaaacgtg

SEQ ID NO: 706142 - DNA, 22 bp, Artificial Sequence
  chemically synthesized
cagaactgttgaaacgtgggtg

SEQ ID NO: 706143 - DNA, 22 bp, Artificial Sequence
  chemically synthesized
agaactgttgaaacgtgggtgg

SEQ ID NO: 706144 - DNA, 22 bp, Artificial Sequence
  chemically synthesized
taagacacacttttccacccac

SEQ ID NO: 706145 - DNA, 22 bp, Artificial Sequence
  chemically synthesized
ttgaaacgtgggtggaaaagtg

SEQ ID NO: 706146 - DNA, 22 bp, Artificial Sequence
  chemically synthesized
aaacgtgggtggaaaagtgtgt

SEQ ID NO: 706147 - DNA, 22 bp, Artificial Sequence
  chemically synthesized
gtcaattgtaagacacactttt

SEQ ID NO: 706148 - DNA, 22 bp, Artificial Sequence
  chemically synthesized
ggtcaattgtaagacacacttt

SEQ ID NO: 706149 - DNA, 22 bp, Artificial Sequence
  chemically synthesized
acaattgaccaaatatgttact

SEQ ID NO: 706150 - DNA, 22 bp, Artificial Sequence
  chemically synthesized
caattgaccaaatatgttacta

SEQ ID NO: 706151 - DNA, 22 bp, Artificial Sequence
  chemically synthesized
aaatagggataatagtaacata

SEQ ID NO: 706152 - DNA, 22 bp, Artificial Sequence
  chemically synthesized
aaaatagggataatagtaacat

SEQ ID NO: 706153 - DNA, 22 bp, Artificial Sequence
  chemically synthesized
taaaatagggataatagtaaca

SEQ ID NO: 706154 - DNA, 22 bp, Artificial Sequence
  chemically synthesized
accaaatatgttactattatcc

SEQ ID NO: 706155 - DNA, 22 bp, Artificial Sequence
  chemically synthesized
atctttaaaatagggataatag

SEQ ID NO: 706156 - DNA, 22 bp, Artificial Sequence
  chemically synthesized
catctttaaaatagggataata

SEQ ID NO: 706157 - DNA, 22 bp, Artificial Sequence
  chemically synthesized
ttcatctttaaaatagggataa

SEQ ID NO: 706158 - DNA, 22 bp, Artificial Sequence
  chemically synthesized
ttcttcatctttaaaataggga

SEQ ID NO: 706159 - DNA, 22 bp, Artificial Sequence
  chemically synthesized
attcttcatctttaaaataggg

SEQ ID NO: 706160 - DNA, 22 bp, Artificial Sequence
  chemically synthesized
tattcttcatctttaaaatagg

SEQ ID NO: 706161 - DNA, 22 bp, Artificial Sequence
  chemically synthesized
tttattcttcatctttaaaata

SEQ ID NO: 706162 - DNA, 22 bp, Artificial Sequence
  chemically synthesized
ctattatccctattttaaagat

SEQ ID NO: 706163 - DNA, 22 bp, Artificial Sequence
  chemically synthesized
tctttattcttcatctttaaaa

SEQ ID NO: 706164 - DNA, 22 bp, Artificial Sequence
  chemically synthesized
ctctttattcttcatctttaaa

SEQ ID NO: 706165 - DNA, 22 bp, Artificial Sequence
  chemically synthesized
tctctttattcttcatctttaa

SEQ ID NO: 706166 - DNA, 22 bp, Artificial Sequence
  chemically synthesized
ttatccctattttaaagatgaa

SEQ ID NO: 706167 - DNA, 22 bp, Artificial Sequence
  chemically synthesized
tttctctttattcttcatcttt

SEQ ID NO: 706168 - DNA, 22 bp, Artificial Sequence
  chemically synthesized
ctttctctttattcttcatctt

SEQ ID NO: 706169 - DNA, 22 bp, Artificial Sequence
  chemically synthesized
tccctattttaaagatgaagaa

SEQ ID NO: 706170 - DNA, 22 bp, Artificial Sequence
  chemically synthesized
tctttctctttattcttcatct

SEQ ID NO: 706171 - DNA, 22 bp, Artificial Sequence
  chemically synthesized
ttctttctctttattcttcatc

SEQ ID NO: 706172 - DNA, 22 bp, Artificial Sequence
  chemically synthesized
tttctttctctttattcttcat

SEQ ID NO: 706173 - DNA, 22 bp, Artificial Sequence
  chemically synthesized
ttttctttctctttattcttca

SEQ ID NO: 706174 - DNA, 22 bp, Artificial Sequence
  chemically synthesized
ttttaaagatgaagaataaaga

SEQ ID NO: 706175 - DNA, 22 bp, Artificial Sequence
  chemically synthesized
tgcttttttctttctctttatt

SEQ ID NO: 706176 - DNA, 22 bp, Artificial Sequence
  chemically synthesized
taaagatgaagaataaagagaa

SEQ ID NO: 706177 - DNA, 22 bp, Artificial Sequence
  chemically synthesized
atgcttttttctttctctttat

SEQ ID NO: 706178 - DNA, 22 bp, Artificial Sequence
  chemically synthesized
aaagatgaagaataaagagaaa

SEQ ID NO: 706179 - DNA, 22 bp, Artificial Sequence
  chemically synthesized
tatgcttttttctttctcttta

SEQ ID NO: 706180 - DNA, 22 bp, Artificial Sequence
  chemically synthesized
aagatgaagaataaagagaaag

SEQ ID NO: 706181 - DNA, 22 bp, Artificial Sequence
  chemically synthesized
agacactttatgcttttttctt

SEQ ID NO: 706182 - DNA, 22 bp, Artificial Sequence
  chemically synthesized
actcagacactttatgcttttt

SEQ ID NO: 706183 - DNA, 22 bp, Artificial Sequence
  chemically synthesized
aaatattgactcagacacttta

SEQ ID NO: 706184 - DNA, 22 bp, Artificial Sequence
  chemically synthesized
ggttcaaatattgactcagaca

SEQ ID NO: 706185 - DNA, 22 bp, Artificial Sequence
  chemically synthesized
actgggttcaaatattgactca

SEQ ID NO: 706186 - DNA, 22 bp, Artificial Sequence
  chemically synthesized
taaaatgaaactgactgggttc

SEQ ID NO: 706187 - DNA, 22 bp, Artificial Sequence
  chemically synthesized
agtcaatatttgaacccagtca

SEQ ID NO: 706188 - DNA, 22 bp, Artificial Sequence
  chemically synthesized
gaacccagtcagtttcatttta

SEQ ID NO: 706189 - DNA, 22 bp, Artificial Sequence
  chemically synthesized
aacccagtcagtttcattttac

SEQ ID NO: 706190 - DNA, 22 bp, Artificial Sequence
  chemically synthesized
agagtaaaagctgtaaaatgaa

SEQ ID NO: 706191 - DNA, 22 bp, Artificial Sequence
  chemically synthesized
cattttacagcttttactctta

SEQ ID NO: 706192 - DNA, 22 bp, Artificial Sequence
  chemically synthesized
attttacagcttttactcttaa

SEQ ID NO: 706193 - DNA, 22 bp, Artificial Sequence
  chemically synthesized
tacagcttttactcttaaccgc

SEQ ID NO: 706194 - DNA, 22 bp, Artificial Sequence
  chemically synthesized
acagcttttactcttaaccgct

SEQ ID NO: 706195 - DNA, 22 bp, Artificial Sequence
  chemically synthesized
cagcttttactcttaaccgcta

SEQ ID NO: 706196 - DNA, 22 bp, Artificial Sequence
  chemically synthesized
tcaaaatggtatcgatagcggt

SEQ ID NO: 706197 - DNA, 22 bp, Artificial Sequence
  chemically synthesized
atcaaaatggtatcgatagcgg

SEQ ID NO: 706198 - DNA, 22 bp, Artificial Sequence
  chemically synthesized
ttactcttaaccgctatcgata

SEQ ID NO: 706199 - DNA, 22 bp, Artificial Sequence
  chemically synthesized
tactcttaaccgctatcgatac

SEQ ID NO: 706200 - DNA, 22 bp, Artificial Sequence
  chemically synthesized
actcttaaccgctatcgatacc

SEQ ID NO: 706201 - DNA, 22 bp, Artificial Sequence
  chemically synthesized
ccttatcaaaatggtatcgata

SEQ ID NO: 706202 - DNA, 22 bp, Artificial Sequence
  chemically synthesized
ctcttaaccgctatcgatacca

SEQ ID NO: 706203 - DNA, 22 bp, Artificial Sequence
  chemically synthesized
ttaaccgctatcgataccattt

SEQ ID NO: 706204 - DNA, 22 bp, Artificial Sequence
  chemically synthesized
aaccgctatcgataccattttg

SEQ ID NO: 706205 - DNA, 22 bp, Artificial Sequence
  chemically synthesized
accgctatcgataccattttga

SEQ ID NO: 706206 - DNA, 22 bp, Artificial Sequence
  chemically synthesized
aaaactgccttatcaaaatggt

SEQ ID NO: 706207 - DNA, 22 bp, Artificial Sequence
  chemically synthesized
ggctaaaaactgccttatcaaa

SEQ ID NO: 706208 - DNA, 22 bp, Artificial Sequence
  chemically synthesized
tcgataccattttgataaggca

SEQ ID NO: 706209 - DNA, 22 bp, Artificial Sequence
  chemically synthesized
tgggctaaaaactgccttatca

SEQ ID NO: 706210 - DNA, 22 bp, Artificial Sequence
  chemically synthesized
aacacctctgggctaaaaactg

SEQ ID NO: 706211 - DNA, 22 bp, Artificial Sequence
  chemically synthesized
tcaacacctctgggctaaaaac

SEQ ID NO: 706212 - DNA, 22 bp, Artificial Sequence
  chemically synthesized
tgataaggcagtttttagccca

SEQ ID NO: 706213 - DNA, 22 bp, Artificial Sequence
  chemically synthesized
tctcaacacctctgggctaaaa

SEQ ID NO: 706214 - DNA, 22 bp, Artificial Sequence
  chemically synthesized
gataaggcagtttttagcccag

SEQ ID NO: 706215 - DNA, 22 bp, Artificial Sequence
  chemically synthesized
ctctcaacacctctgggctaaa

SEQ ID NO: 706216 - DNA, 22 bp, Artificial Sequence
  chemically synthesized
ataaggcagtttttagcccaga

SEQ ID NO: 706217 - DNA, 22 bp, Artificial Sequence
  chemically synthesized
tctctcaacacctctgggctaa

SEQ ID NO: 706218 - DNA, 22 bp, Artificial Sequence
  chemically synthesized
ttctctcaacacctctgggcta

SEQ ID NO: 706219 - DNA, 22 bp, Artificial Sequence
  chemically synthesized
aatttttctctcaacacctctg

SEQ ID NO: 706220 - DNA, 22 bp, Artificial Sequence
  chemically synthesized
ttagcccagaggtgttgagaga

SEQ ID NO: 706221 - DNA, 22 bp, Artificial Sequence
  chemically synthesized
tagcccagaggtgttgagagaa

SEQ ID NO: 706222 - DNA, 22 bp, Artificial Sequence
  chemically synthesized
agcccagaggtgttgagagaaa

SEQ ID NO: 706223 - DNA, 22 bp, Artificial Sequence
  chemically synthesized
gcccagaggtgttgagagaaaa

SEQ ID NO: 706224 - DNA, 22 bp, Artificial Sequence
  chemically synthesized
cataacctaaatttttctctca

SEQ ID NO: 706225 - DNA, 22 bp, Artificial Sequence
  chemically synthesized
acataacctaaatttttctctc

SEQ ID NO: 706226 - DNA, 22 bp, Artificial Sequence
  chemically synthesized
atttacataacctaaatttttc

SEQ ID NO: 706227 - DNA, 22 bp, Artificial Sequence
  chemically synthesized
agttgatttacataacctaaat

SEQ ID NO: 706228 - DNA, 22 bp, Artificial Sequence
  chemically synthesized
agagaaaaatttaggttatgta

SEQ ID NO: 706229 - DNA, 22 bp, Artificial Sequence
  chemically synthesized
gccatcctaagttgatttacat

SEQ ID NO: 706230 - DNA, 22 bp, Artificial Sequence
  chemically synthesized
ggccatcctaagttgatttaca

SEQ ID NO: 706231 - DNA, 22 bp, Artificial Sequence
  chemically synthesized
gtttggccatcctaagttgatt

SEQ ID NO: 706232 - DNA, 22 bp, Artificial Sequence
  chemically synthesized
cgtttggccatcctaagttgat

SEQ ID NO: 706233 - DNA, 22 bp, Artificial Sequence
  chemically synthesized
aggttatgtaaatcaacttagg

SEQ ID NO: 706234 - DNA, 22 bp, Artificial Sequence
  chemically synthesized
ggttatgtaaatcaacttagga

SEQ ID NO: 706235 - DNA, 22 bp, Artificial Sequence
  chemically synthesized
ttcgtttggccatcctaagttg

SEQ ID NO: 706236 - DNA, 22 bp, Artificial Sequence
  chemically synthesized
ctcttcgtttggccatcctaag

SEQ ID NO: 706237 - DNA, 22 bp, Artificial Sequence
  chemically synthesized
tgtaaatcaacttaggatggcc

SEQ ID NO: 706238 - DNA, 22 bp, Artificial Sequence
  chemically synthesized
gtatattcctcttcgtttggcc

SEQ ID NO: 706239 - DNA, 22 bp, Artificial Sequence
  chemically synthesized
tcgtatattcctcttcgtttgg

SEQ ID NO: 706240 - DNA, 22 bp, Artificial Sequence
  chemically synthesized
tctcgtatattcctcttcgttt

SEQ ID NO: 706241 - DNA, 22 bp, Artificial Sequence
  chemically synthesized
aggatggccaaacgaagaggaa

SEQ ID NO: 706242 - DNA, 22 bp, Artificial Sequence
  chemically synthesized
ttctctcgtatattcctcttcg

SEQ ID NO: 706243 - DNA, 22 bp, Artificial Sequence
  chemically synthesized
ggatggccaaacgaagaggaat

SEQ ID NO: 706244 - DNA, 22 bp, Artificial Sequence
  chemically synthesized
ccaacgattattctctcgtata

SEQ ID NO: 706245 - DNA, 22 bp, Artificial Sequence
  chemically synthesized
ttgccaacgattattctctcgt

SEQ ID NO: 706246 - DNA, 22 bp, Artificial Sequence
  chemically synthesized
ctattgccaacgattattctct

SEQ ID NO: 706247 - DNA, 22 bp, Artificial Sequence
  chemically synthesized
tctgctattgccaacgattatt

SEQ ID NO: 706248 - DNA, 22 bp, Artificial Sequence
  chemically synthesized
gtctatctgctattgccaacga

SEQ ID NO: 706249 - DNA, 22 bp, Artificial Sequence
  chemically synthesized
tctagtctatctgctattgcca

SEQ ID NO: 706250 - DNA, 22 bp, Artificial Sequence
  chemically synthesized
gcaatagcagatagactagaca

SEQ ID NO: 706251 - DNA, 22 bp, Artificial Sequence
  chemically synthesized
agaagaaatgcccaggccaata

SEQ ID NO: 706252 - DNA, 22 bp, Artificial Sequence
  chemically synthesized
gacagttattggcctgggcatt

SEQ ID NO: 706253 - DNA, 22 bp, Artificial Sequence
  chemically synthesized
cccgttaagaagaaatgcccag

SEQ ID NO: 706254 - DNA, 22 bp, Artificial Sequence
  chemically synthesized
acccgttaagaagaaatgccca

SEQ ID NO: 706255 - DNA, 22 bp, Artificial Sequence
  chemically synthesized
ccttacccgttaagaagaaatg

SEQ ID NO: 706256 - DNA, 22 bp, Artificial Sequence
  chemically synthesized
ttggcctgggcatttcttctta

SEQ ID NO: 706257 - DNA, 22 bp, Artificial Sequence
  chemically synthesized
gcctgggcatttcttcttaacg

SEQ ID NO: 706258 - DNA, 22 bp, Artificial Sequence
  chemically synthesized
ggcatttcttcttaacgggtaa

SEQ ID NO: 706259 - DNA, 22 bp, Artificial Sequence
  chemically synthesized
cttcttaacgggtaaggcagtg

SEQ ID NO: 706260 - DNA, 22 bp, Artificial Sequence
  chemically synthesized
ttcttaacgggtaaggcagtgt

SEQ ID NO: 706261 - DNA, 22 bp, Artificial Sequence
  chemically synthesized
cttaacgggtaaggcagtgtga

SEQ ID NO: 706262 - DNA, 22 bp, Artificial Sequence
  chemically synthesized
ttaacgggtaaggcagtgtgat

SEQ ID NO: 706263 - DNA, 22 bp, Artificial Sequence
  chemically synthesized
aacgggtaaggcagtgtgatgt

SEQ ID NO: 706264 - DNA, 22 bp, Artificial Sequence
  chemically synthesized
acgggtaaggcagtgtgatgtg

SEQ ID NO: 706265 - DNA, 22 bp, Artificial Sequence
  chemically synthesized
gacatccaagccacacatcaca

SEQ ID NO: 706266 - DNA, 22 bp, Artificial Sequence
  chemically synthesized
tggacatccaagccacacatca

SEQ ID NO: 706267 - DNA, 22 bp, Artificial Sequence
  chemically synthesized
ctggacatccaagccacacatc

SEQ ID NO: 706268 - DNA, 22 bp, Artificial Sequence
  chemically synthesized
gaacccagtttctggacatcca

SEQ ID NO: 706269 - DNA, 22 bp, Artificial Sequence
  chemically synthesized
ggactggaacccagtttctgga

SEQ ID NO: 706270 - DNA, 22 bp, Artificial Sequence
  chemically synthesized
ggatgtccagaaactgggttcc

SEQ ID NO: 706271 - DNA, 22 bp, Artificial Sequence
  chemically synthesized
gatgtccagaaactgggttcca

SEQ ID NO: 706272 - DNA, 22 bp, Artificial Sequence
  chemically synthesized
taatactgggactggaacccag

SEQ ID NO: 706273 - DNA, 22 bp, Artificial Sequence
  chemically synthesized
ggttccagtcccagtattataa

SEQ ID NO: 706274 - DNA, 22 bp, Artificial Sequence
  chemically synthesized
cagtcccagtattataactatc

SEQ ID NO: 706275 - DNA, 22 bp, Artificial Sequence
  chemically synthesized
taactatctttgtgaccttggt

SEQ ID NO: 706276 - DNA, 22 bp, Artificial Sequence
  chemically synthesized
tctttgtgaccttggttatgtc

SEQ ID NO: 706277 - DNA, 22 bp, Artificial Sequence
  chemically synthesized
tgtgaccttggttatgtcattt

SEQ ID NO: 706278 - DNA, 22 bp, Artificial Sequence
  chemically synthesized
gtgaccttggttatgtcatttg

SEQ ID NO: 706279 - DNA, 22 bp, Artificial Sequence
  chemically synthesized
tgaccttggttatgtcatttga

SEQ ID NO: 706280 - DNA, 22 bp, Artificial Sequence
  chemically synthesized
ggttatgtcatttgatcgttct

SEQ ID NO: 706281 - DNA, 22 bp, Artificial Sequence
  chemically synthesized
gttatgtcatttgatcgttctg

SEQ ID NO: 706282 - DNA, 22 bp, Artificial Sequence
  chemically synthesized
tgtcatttgatcgttctgcacc

SEQ ID NO: 706283 - DNA, 22 bp, Artificial Sequence
  chemically synthesized
cagataatgaaataggtgcaga

SEQ ID NO: 706284 - DNA, 22 bp, Artificial Sequence
  chemically synthesized
acagataatgaaataggtgcag

SEQ ID NO: 706285 - DNA, 22 bp, Artificial Sequence
  chemically synthesized
tacagataatgaaataggtgca

SEQ ID NO: 706286 - DNA, 22 bp, Artificial Sequence
  chemically synthesized
ttttacagataatgaaataggt

SEQ ID NO: 706287 - DNA, 22 bp, Artificial Sequence
  chemically synthesized
gatcgttctgcacctatttcat

SEQ ID NO: 706288 - DNA, 22 bp, Artificial Sequence
  chemically synthesized
attttacagataatgaaatagg

SEQ ID NO: 706289 - DNA, 22 bp, Artificial Sequence
  chemically synthesized
atcgttctgcacctatttcatt

SEQ ID NO: 706290 - DNA, 22 bp, Artificial Sequence
  chemically synthesized
cttattttacagataatgaaat

SEQ ID NO: 706291 - DNA, 22 bp, Artificial Sequence
  chemically synthesized
ccttattttacagataatgaaa

SEQ ID NO: 706292 - DNA, 22 bp, Artificial Sequence
  chemically synthesized
tccttattttacagataatgaa

SEQ ID NO: 706293 - DNA, 22 bp, Artificial Sequence
  chemically synthesized
tgcacctatttcattatctgta

SEQ ID NO: 706294 - DNA, 22 bp, Artificial Sequence
  chemically synthesized
cacctatttcattatctgtaaa

SEQ ID NO: 706295 - DNA, 22 bp, Artificial Sequence
  chemically synthesized
gagccctttccttattttacag

SEQ ID NO: 706296 - DNA, 22 bp, Artificial Sequence
  chemically synthesized
tttcattatctgtaaaataagg

SEQ ID NO: 706297 - DNA, 22 bp, Artificial Sequence
  chemically synthesized
cattatctgtaaaataaggaaa

SEQ ID NO: 706298 - DNA, 22 bp, Artificial Sequence
  chemically synthesized
attatctgtaaaataaggaaag

SEQ ID NO: 706299 - DNA, 22 bp, Artificial Sequence
  chemically synthesized
aatcattcgagccctttcctta

SEQ ID NO: 706300 - DNA, 22 bp, Artificial Sequence
  chemically synthesized
tctgtaaaataaggaaagggct

SEQ ID NO: 706301 - DNA, 22 bp, Artificial Sequence
  chemically synthesized
taaaataaggaaagggctcgaa

SEQ ID NO: 706302 - DNA, 22 bp, Artificial Sequence
  chemically synthesized
agaaacattgaatcattcgagc

SEQ ID NO: 706303 - DNA, 22 bp, Artificial Sequence
  chemically synthesized
gagaaacattgaatcattcgag

SEQ ID NO: 706304 - DNA, 22 bp, Artificial Sequence
  chemically synthesized
gaatgattcaatgtttctcaaa

SEQ ID NO: 706305 - DNA, 22 bp, Artificial Sequence
  chemically synthesized
cagtcgaaatagtttgagaaac

SEQ ID NO: 706306 - DNA, 22 bp, Artificial Sequence
  chemically synthesized
tgggttgcagtcgaaatagttt

SEQ ID NO: 706307 - DNA, 22 bp, Artificial Sequence
  chemically synthesized
aatgtttctcaaactatttcga

SEQ ID NO: 706308 - DNA, 22 bp, Artificial Sequence
  chemically synthesized
tgtgggttgcagtcgaaatagt

SEQ ID NO: 706309 - DNA, 22 bp, Artificial Sequence
  chemically synthesized
ctgtgggttgcagtcgaaatag

SEQ ID NO: 706310 - DNA, 22 bp, Artificial Sequence
  chemically synthesized
ttctgtgggttgcagtcgaaat

SEQ ID NO: 706311 - DNA, 22 bp, Artificial Sequence
  chemically synthesized
cttctgtgggttgcagtcgaaa

SEQ ID NO: 706312 - DNA, 22 bp, Artificial Sequence
  chemically synthesized
tcttctgtgggttgcagtcgaa

SEQ ID NO: 706313 - DNA, 22 bp, Artificial Sequence
  chemically synthesized
ttcttctgtgggttgcagtcga

SEQ ID NO: 706314 - DNA, 22 bp, Artificial Sequence
  chemically synthesized
ctcaaactatttcgactgcaac

SEQ ID NO: 706315 - DNA, 22 bp, Artificial Sequence
  chemically synthesized
tcaaactatttcgactgcaacc

SEQ ID NO: 706316 - DNA, 22 bp, Artificial Sequence
  chemically synthesized
aaactatttcgactgcaaccca

SEQ ID NO: 706317 - DNA, 22 bp, Artificial Sequence
  chemically synthesized
tttcgactgcaacccacagaag

SEQ ID NO: 706318 - DNA, 22 bp, Artificial Sequence
  chemically synthesized
cgactgcaacccacagaagaaa

SEQ ID NO: 706319 - DNA, 22 bp, Artificial Sequence
  chemically synthesized
gactgcaacccacagaagaaaa

SEQ ID NO: 706320 - DNA, 22 bp, Artificial Sequence
  chemically synthesized
caacccacagaagaaaaacgtt

SEQ ID NO: 706321 - DNA, 22 bp, Artificial Sequence
  chemically synthesized
tacactgtgatctggcgtgcgc

SEQ ID NO: 706322 - DNA, 22 bp, Artificial Sequence
  chemically synthesized
acactgtgatctggcgtgcgcg

SEQ ID NO: 706323 - DNA, 22 bp, Artificial Sequence
  chemically synthesized
cactgtgatctggcgtgcgcgc

SEQ ID NO: 706324 - DNA, 22 bp, Artificial Sequence
  chemically synthesized
tgatctggcgtgcgcgcgtgcg

SEQ ID NO: 706325 - DNA, 22 bp, Artificial Sequence
  chemically synthesized
gcgtgcgcgcgtgcgtgcgcgc

SEQ ID NO: 706326 - DNA, 22 bp, Artificial Sequence
  chemically synthesized
gatatgtgtgtacatgcgtgtg

SEQ ID NO: 706327 - DNA, 22 bp, Artificial Sequence
  chemically synthesized
ttagatatgtgtgtacatgcgt

SEQ ID NO: 706328 - DNA, 22 bp, Artificial Sequence
  chemically synthesized
gttagatatgtgtgtacatgcg

SEQ ID NO: 706329 - DNA, 22 bp, Artificial Sequence
  chemically synthesized
atttgttagatatgtgtgtaca

SEQ ID NO: 706330 - DNA, 22 bp, Artificial Sequence
  chemically synthesized
gcggtggttaatttgttagata

SEQ ID NO: 706331 - DNA, 22 bp, Artificial Sequence
  chemically synthesized
ggcggtggttaatttgttagat

SEQ ID NO: 706332 - DNA, 22 bp, Artificial Sequence
  chemically synthesized
tggcggtggttaatttgttaga

SEQ ID NO: 706333 - DNA, 22 bp, Artificial Sequence
  chemically synthesized
ttttggcggtggttaatttgtt

SEQ ID NO: 706334 - DNA, 22 bp, Artificial Sequence
  chemically synthesized
agtgttgttttggcggtggtta

SEQ ID NO: 706335 - DNA, 22 bp, Artificial Sequence
  chemically synthesized
acaaattaaccaccgccaaaac

SEQ ID NO: 706336 - DNA, 22 bp, Artificial Sequence
  chemically synthesized
agcaaggttaagtgttgttttg

SEQ ID NO: 706337 - DNA, 22 bp, Artificial Sequence
  chemically synthesized
accaccgccaaaacaacactta

SEQ ID NO: 706338 - DNA, 22 bp, Artificial Sequence
  chemically synthesized
cctaagcaaggttaagtgttgt

SEQ ID NO: 706339 - DNA, 22 bp, Artificial Sequence
  chemically synthesized
gaaaatatcagagtgcattacc

SEQ ID NO: 706340 - DNA, 22 bp, Artificial Sequence
  chemically synthesized
aaccttgcttaggtaatgcact

SEQ ID NO: 706341 - DNA, 22 bp, Artificial Sequence
  chemically synthesized
accttgcttaggtaatgcactc

SEQ ID NO: 706342 - DNA, 22 bp, Artificial Sequence
  chemically synthesized
gcttaggtaatgcactctgata

SEQ ID NO: 706343 - DNA, 22 bp, Artificial Sequence
  chemically synthesized
cttaggtaatgcactctgatat

SEQ ID NO: 706344 - DNA, 22 bp, Artificial Sequence
  chemically synthesized
aggtaatgcactctgatatttt

SEQ ID NO: 706345 - DNA, 22 bp, Artificial Sequence
  chemically synthesized
ggtaatgcactctgatattttc

SEQ ID NO: 706346 - DNA, 22 bp, Artificial Sequence
  chemically synthesized
tgatattttctaatctgttcca

SEQ ID NO: 706347 - DNA, 22 bp, Artificial Sequence
  chemically synthesized
atattttctaatctgttccatt

SEQ ID NO: 706348 - DNA, 22 bp, Artificial Sequence
  chemically synthesized
gtatggaatggaatggaatgga

SEQ ID NO: 706349 - DNA, 22 bp, Artificial Sequence
  chemically synthesized
tctaatctgttccattccattc

SEQ ID NO: 706350 - DNA, 22 bp, Artificial Sequence
  chemically synthesized
ctaatctgttccattccattcc

SEQ ID NO: 706351 - DNA, 22 bp, Artificial Sequence
  chemically synthesized
taatctgttccattccattcca

SEQ ID NO: 706352 - DNA, 22 bp, Artificial Sequence
  chemically synthesized
actggtatggaatggaatggaa

SEQ ID NO: 706353 - DNA, 22 bp, Artificial Sequence
  chemically synthesized
gactggtatggaatggaatgga

SEQ ID NO: 706354 - DNA, 22 bp, Artificial Sequence
  chemically synthesized
atctgttccattccattccatt

SEQ ID NO: 706355 - DNA, 22 bp, Artificial Sequence
  chemically synthesized
tgactggtatggaatggaatgg

SEQ ID NO: 706356 - DNA, 22 bp, Artificial Sequence
  chemically synthesized
ttgactggtatggaatggaatg

SEQ ID NO: 706357 - DNA, 22 bp, Artificial Sequence
  chemically synthesized
ttccattccattccattccata

SEQ ID NO: 706358 - DNA, 22 bp, Artificial Sequence
  chemically synthesized
cattccattccattccatacca

SEQ ID NO: 706359 - DNA, 22 bp, Artificial Sequence
  chemically synthesized
cattccattccataccagtcaa

SEQ ID NO: 706360 - DNA, 22 bp, Artificial Sequence
  chemically synthesized
caaccaacaatttttgactggt

SEQ ID NO: 706361 - DNA, 22 bp, Artificial Sequence
  chemically synthesized
acaaccaacaatttttgactgg

SEQ ID NO: 706362 - DNA, 22 bp, Artificial Sequence
  chemically synthesized
cattccataccagtcaaaaatt

SEQ ID NO: 706363 - DNA, 22 bp, Artificial Sequence
  chemically synthesized
atgacttacaaccaacaatttt

SEQ ID NO: 706364 - DNA, 22 bp, Artificial Sequence
  chemically synthesized
cataccagtcaaaaattgttgg

SEQ ID NO: 706365 - DNA, 22 bp, Artificial Sequence
  chemically synthesized
aatgacttacaaccaacaattt

SEQ ID NO: 706366 - DNA, 22 bp, Artificial Sequence
  chemically synthesized
aaatcagtttaatgacttacaa

SEQ ID NO: 706367 - DNA, 22 bp, Artificial Sequence
  chemically synthesized
ttggttgtaagtcattaaactg

SEQ ID NO: 706368 - DNA, 22 bp, Artificial Sequence
  chemically synthesized
gcaaatcctaaaatcagtttaa

SEQ ID NO: 706369 - DNA, 22 bp, Artificial Sequence
  chemically synthesized
gttgtaagtcattaaactgatt

SEQ ID NO: 706370 - DNA, 22 bp, Artificial Sequence
  chemically synthesized
attagcaaatcctaaaatcagt

SEQ ID NO: 706371 - DNA, 22 bp, Artificial Sequence
  chemically synthesized
taagtcattaaactgattttag

SEQ ID NO: 706372 - DNA, 22 bp, Artificial Sequence
  chemically synthesized
aactgattttaggatttgctaa

SEQ ID NO: 706373 - DNA, 22 bp, Artificial Sequence
  chemically synthesized
aggtgtggctcattagcaaatc

SEQ ID NO: 706374 - DNA, 22 bp, Artificial Sequence
  chemically synthesized
tgaggtgtggctcattagcaaa

SEQ ID NO: 706375 - DNA, 22 bp, Artificial Sequence
  chemically synthesized
attttaggatttgctaatgagc

SEQ ID NO: 706376 - DNA, 22 bp, Artificial Sequence
  chemically synthesized
taggatttgctaatgagccaca

SEQ ID NO: 706377 - DNA, 22 bp, Artificial Sequence
  chemically synthesized
caaactctgaggtgtggctcat

SEQ ID NO: 706378 - DNA, 22 bp, Artificial Sequence
  chemically synthesized
aggatttgctaatgagccacac

SEQ ID NO: 706379 - DNA, 22 bp, Artificial Sequence
  chemically synthesized
ccaaactctgaggtgtggctca

SEQ ID NO: 706380 - DNA, 22 bp, Artificial Sequence
  chemically synthesized
ggatttgctaatgagccacacc

SEQ ID NO: 706381 - DNA, 22 bp, Artificial Sequence
  chemically synthesized
gctaatgagccacacctcagag

SEQ ID NO: 706382 - DNA, 22 bp, Artificial Sequence
  chemically synthesized
ctaatgagccacacctcagagt

SEQ ID NO: 706383 - DNA, 22 bp, Artificial Sequence
  chemically synthesized
atgagccacacctcagagtttg

SEQ ID NO: 706384 - DNA, 22 bp, Artificial Sequence
  chemically synthesized
taccagtagtttccaaactctg

SEQ ID NO: 706385 - DNA, 22 bp, Artificial Sequence
  chemically synthesized
gaaagtatctataccagtagtt

SEQ ID NO: 706386 - DNA, 22 bp, Artificial Sequence
  chemically synthesized
agaaagtatctataccagtagt

SEQ ID NO: 706387 - DNA, 22 bp, Artificial Sequence
  chemically synthesized
agagtttggaaactactggtat

SEQ ID NO: 706388 - DNA, 22 bp, Artificial Sequence
  chemically synthesized
ggaaactactggtatagatact

SEQ ID NO: 706389 - DNA, 22 bp, Artificial Sequence
  chemically synthesized
gaaactactggtatagatactt

SEQ ID NO: 706390 - DNA, 22 bp, Artificial Sequence
  chemically synthesized
gagataagcttagaaagtatct

SEQ ID NO: 706391 - DNA, 22 bp, Artificial Sequence
  chemically synthesized
actggagataagcttagaaagt

SEQ ID NO: 706392 - DNA, 22 bp, Artificial Sequence
  chemically synthesized
ctggtatagatactttctaagc

SEQ ID NO: 706393 - DNA, 22 bp, Artificial Sequence
  chemically synthesized
ctaactggagataagcttagaa

SEQ ID NO: 706394 - DNA, 22 bp, Artificial Sequence
  chemically synthesized
gtatagatactttctaagctta

SEQ ID NO: 706395 - DNA, 22 bp, Artificial Sequence
  chemically synthesized
cctaactggagataagcttaga

SEQ ID NO: 706396 - DNA, 22 bp, Artificial Sequence
  chemically synthesized
tggagtttcctaactggagata

SEQ ID NO: 706397 - DNA, 22 bp, Artificial Sequence
  chemically synthesized
tctaagcttatctccagttagg

SEQ ID NO: 706398 - DNA, 22 bp, Artificial Sequence
  chemically synthesized
ctaagcttatctccagttagga

SEQ ID NO: 706399 - DNA, 22 bp, Artificial Sequence
  chemically synthesized
tgctgtggagtttcctaactgg

SEQ ID NO: 706400 - DNA, 22 bp, Artificial Sequence
  chemically synthesized
taagcttatctccagttaggaa

SEQ ID NO: 706401 - DNA, 22 bp, Artificial Sequence
  chemically synthesized
gtgctgtggagtttcctaactg

SEQ ID NO: 706402 - DNA, 22 bp, Artificial Sequence
  chemically synthesized
agcttatctccagttaggaaac

SEQ ID NO: 706403 - DNA, 22 bp, Artificial Sequence
  chemically synthesized
ttgtgctgtggagtttcctaac

SEQ ID NO: 706404 - DNA, 22 bp, Artificial Sequence
  chemically synthesized
atctccagttaggaaactccac

SEQ ID NO: 706405 - DNA, 22 bp, Artificial Sequence
  chemically synthesized
tctccagttaggaaactccaca

SEQ ID NO: 706406 - DNA, 22 bp, Artificial Sequence
  chemically synthesized
cagttaggaaactccacagcac

SEQ ID NO: 706407 - DNA, 22 bp, Artificial Sequence
  chemically synthesized
ggaaactccacagcacaagagg

SEQ ID NO: 706408 - DNA, 22 bp, Artificial Sequence
  chemically synthesized
ccacccaggagccctcttgtgc

SEQ ID NO: 706409 - DNA, 22 bp, Artificial Sequence
  chemically synthesized
cacagcacaagagggctcctgg

SEQ ID NO: 706410 - DNA, 22 bp, Artificial Sequence
  chemically synthesized
ccagccccactcccacccagga

SEQ ID NO: 706411 - DNA, 22 bp, Artificial Sequence
  chemically synthesized
aagttcccagccccactcccac

SEQ ID NO: 706412 - DNA, 22 bp, Artificial Sequence
  chemically synthesized
ctgaagttcccagccccactcc

SEQ ID NO: 706413 - DNA, 22 bp, Artificial Sequence
  chemically synthesized
actgaagttcccagccccactc

SEQ ID NO: 706414 - DNA, 22 bp, Artificial Sequence
  chemically synthesized
tactgaagttcccagccccact

SEQ ID NO: 706415 - DNA, 22 bp, Artificial Sequence
  chemically synthesized
tttactgaagttcccagcccca

SEQ ID NO: 706416 - DNA, 22 bp, Artificial Sequence
  chemically synthesized
ctgggtgggagtggggctggga

SEQ ID NO: 706417 - DNA, 22 bp, Artificial Sequence
  chemically synthesized
tctttactgaagttcccagccc

SEQ ID NO: 706418 - DNA, 22 bp, Artificial Sequence
  chemically synthesized
ggtgggagtggggctgggaact

SEQ ID NO: 706419 - DNA, 22 bp, Artificial Sequence
  chemically synthesized
ggaacttcagtaaagagaggga

SEQ ID NO: 706420 - DNA, 22 bp, Artificial Sequence
  chemically synthesized
tgaggcaaaagggtcaagtccc

SEQ ID NO: 706421 - DNA, 22 bp, Artificial Sequence
  chemically synthesized
cagtaaagagagggacttgacc

SEQ ID NO: 706422 - DNA, 22 bp, Artificial Sequence
  chemically synthesized
atgaggcaaaagggtcaagtcc

SEQ ID NO: 706423 - DNA, 22 bp, Artificial Sequence
  chemically synthesized
agtaaagagagggacttgaccc

SEQ ID NO: 706424 - DNA, 22 bp, Artificial Sequence
  chemically synthesized
gacccttttgcctcataaatac

SEQ ID NO: 706425 - DNA, 22 bp, Artificial Sequence
  chemically synthesized
aaaagaaaatgagtatttatga

SEQ ID NO: 706426 - DNA, 22 bp, Artificial Sequence
  chemically synthesized
acccttttgcctcataaatact

SEQ ID NO: 706427 - DNA, 22 bp, Artificial Sequence
  chemically synthesized
ttgcctcataaatactcatttt

SEQ ID NO: 706428 - DNA, 22 bp, Artificial Sequence
  chemically synthesized
tgcctcataaatactcattttc

SEQ ID NO: 706429 - DNA, 22 bp, Artificial Sequence
  chemically synthesized
gcctcataaatactcattttct

SEQ ID NO: 706430 - DNA, 22 bp, Artificial Sequence
  chemically synthesized
cctcataaatactcattttctt

SEQ ID NO: 706431 - DNA, 22 bp, Artificial Sequence
  chemically synthesized
ataaatactcattttcttttta

SEQ ID NO: 706432 - DNA, 22 bp, Artificial Sequence
  chemically synthesized
tagaaacgtgatccaattaaaa

SEQ ID NO: 706433 - DNA, 22 bp, Artificial Sequence
  chemically synthesized
attttctttttaattggatcac

SEQ ID NO: 706434 - DNA, 22 bp, Artificial Sequence
  chemically synthesized
aaggttgtagaaacgtgatcca

SEQ ID NO: 706435 - DNA, 22 bp, Artificial Sequence
  chemically synthesized
tctttttaattggatcacgttt

SEQ ID NO: 706436 - DNA, 22 bp, Artificial Sequence
  chemically synthesized
ctttttaattggatcacgtttc

SEQ ID NO: 706437 - DNA, 22 bp, Artificial Sequence
  chemically synthesized
ctaaaggttgtagaaacgtgat

SEQ ID NO: 706438 - DNA, 22 bp, Artificial Sequence
  chemically synthesized
tttttaattggatcacgtttct

SEQ ID NO: 706439 - DNA, 22 bp, Artificial Sequence
  chemically synthesized
tgctaaaggttgtagaaacgtg

SEQ ID NO: 706440 - DNA, 22 bp, Artificial Sequence
  chemically synthesized
tttaattggatcacgtttctac

SEQ ID NO: 706441 - DNA, 22 bp, Artificial Sequence
  chemically synthesized
ctgctaaaggttgtagaaacgt

SEQ ID NO: 706442 - DNA, 22 bp, Artificial Sequence
  chemically synthesized
ttaattggatcacgtttctaca

SEQ ID NO: 706443 - DNA, 22 bp, Artificial Sequence
  chemically synthesized
taattggatcacgtttctacaa

SEQ ID NO: 706444 - DNA, 22 bp, Artificial Sequence
  chemically synthesized
aattggatcacgtttctacaac

SEQ ID NO: 706445 - DNA, 22 bp, Artificial Sequence
  chemically synthesized
attggatcacgtttctacaacc

SEQ ID NO: 706446 - DNA, 22 bp, Artificial Sequence
  chemically synthesized
gatcacgtttctacaaccttta

SEQ ID NO: 706447 - DNA, 22 bp, Artificial Sequence
  chemically synthesized
atgacaaaaaatttctgctaaa

SEQ ID NO: 706448 - DNA, 22 bp, Artificial Sequence
  chemically synthesized
aatgacaaaaaatttctgctaa

SEQ ID NO: 706449 - DNA, 22 bp, Artificial Sequence
  chemically synthesized
taatgacaaaaaatttctgcta

SEQ ID NO: 706450 - DNA, 22 bp, Artificial Sequence
  chemically synthesized
ctacaacctttagcagaaattt

SEQ ID NO: 706451 - DNA, 22 bp, Artificial Sequence
  chemically synthesized
tacaacctttagcagaaatttt

SEQ ID NO: 706452 - DNA, 22 bp, Artificial Sequence
  chemically synthesized
caacctttagcagaaatttttt

SEQ ID NO: 706453 - DNA, 22 bp, Artificial Sequence
  chemically synthesized
ccagatgctttaatgacaaaaa

SEQ ID NO: 706454 - DNA, 22 bp, Artificial Sequence
  chemically synthesized
gccagatgctttaatgacaaaa

SEQ ID NO: 706455 - DNA, 22 bp, Artificial Sequence
  chemically synthesized
tagcagaaattttttgtcatta

SEQ ID NO: 706456 - DNA, 22 bp, Artificial Sequence
  chemically synthesized
agcagaaattttttgtcattaa

SEQ ID NO: 706457 - DNA, 22 bp, Artificial Sequence
  chemically synthesized
gcagaaattttttgtcattaaa

SEQ ID NO: 706458 - DNA, 22 bp, Artificial Sequence
  chemically synthesized
atgtggtatttgccagatgctt

SEQ ID NO: 706459 - DNA, 22 bp, Artificial Sequence
  chemically synthesized
aatgtggtatttgccagatgct

SEQ ID NO: 706460 - DNA, 22 bp, Artificial Sequence
  chemically synthesized
tttgtcattaaagcatctggca

SEQ ID NO: 706461 - DNA, 22 bp, Artificial Sequence
  chemically synthesized
ttgtcattaaagcatctggcaa

SEQ ID NO: 706462 - DNA, 22 bp, Artificial Sequence
  chemically synthesized
tgtcattaaagcatctggcaaa

SEQ ID NO: 706463 - DNA, 22 bp, Artificial Sequence
  chemically synthesized
gtcattaaagcatctggcaaat

SEQ ID NO: 706464 - DNA, 22 bp, Artificial Sequence
  chemically synthesized
ccttaatgtggtatttgccaga

SEQ ID NO: 706465 - DNA, 22 bp, Artificial Sequence
  chemically synthesized
tcattaaagcatctggcaaata

SEQ ID NO: 706466 - DNA, 22 bp, Artificial Sequence
  chemically synthesized
gccttaatgtggtatttgccag

SEQ ID NO: 706467 - DNA, 22 bp, Artificial Sequence
  chemically synthesized
tgccttaatgtggtatttgcca

SEQ ID NO: 706468 - DNA, 22 bp, Artificial Sequence
  chemically synthesized
aagcatctggcaaataccacat

SEQ ID NO: 706469 - DNA, 22 bp, Artificial Sequence
  chemically synthesized
gcaaataccacattaaggcaaa

SEQ ID NO: 706470 - DNA, 22 bp, Artificial Sequence
  chemically synthesized
tgccatggatcacagtgaatct

SEQ ID NO: 706471 - DNA, 22 bp, Artificial Sequence
  chemically synthesized
atgccatggatcacagtgaatc

SEQ ID NO: 706472 - DNA, 22 bp, Artificial Sequence
  chemically synthesized
tatgccatggatcacagtgaat

SEQ ID NO: 706473 - DNA, 22 bp, Artificial Sequence
  chemically synthesized
aggcaaagattcactgtgatcc

SEQ ID NO: 706474 - DNA, 22 bp, Artificial Sequence
  chemically synthesized
aactttatgccatggatcacag

SEQ ID NO: 706475 - DNA, 22 bp, Artificial Sequence
  chemically synthesized
acactaaactttatgccatgga

SEQ ID NO: 706476 - DNA, 22 bp, Artificial Sequence
  chemically synthesized
cacactaaactttatgccatgg

SEQ ID NO: 706477 - DNA, 22 bp, Artificial Sequence
  chemically synthesized
actgtgatccatggcataaagt

SEQ ID NO: 706478 - DNA, 22 bp, Artificial Sequence
  chemically synthesized
atttcacactaaactttatgcc

SEQ ID NO: 706479 - DNA, 22 bp, Artificial Sequence
  chemically synthesized
tgatccatggcataaagtttag

SEQ ID NO: 706480 - DNA, 22 bp, Artificial Sequence
  chemically synthesized
aggcacaccagttaatttcaca

SEQ ID NO: 706481 - DNA, 22 bp, Artificial Sequence
  chemically synthesized
caggcacaccagttaatttcac

SEQ ID NO: 706482 - DNA, 22 bp, Artificial Sequence
  chemically synthesized
tcaggcacaccagttaatttca

SEQ ID NO: 706483 - DNA, 22 bp, Artificial Sequence
  chemically synthesized
ttcaggcacaccagttaatttc

SEQ ID NO: 706484 - DNA, 22 bp, Artificial Sequence
  chemically synthesized
tttcaggcacaccagttaattt

SEQ ID NO: 706485 - DNA, 22 bp, Artificial Sequence
  chemically synthesized
agtgtgaaattaactggtgtgc

SEQ ID NO: 706486 - DNA, 22 bp, Artificial Sequence
  chemically synthesized
gtgtgaaattaactggtgtgcc

SEQ ID NO: 706487 - DNA, 22 bp, Artificial Sequence
  chemically synthesized
tggaagcctttttcaggcacac

SEQ ID NO: 706488 - DNA, 22 bp, Artificial Sequence
  chemically synthesized
actggtgtgcctgaaaaaggct

SEQ ID NO: 706489 - DNA, 22 bp, Artificial Sequence
  chemically synthesized
ggtgactgtggaagcctttttc

SEQ ID NO: 706490 - DNA, 22 bp, Artificial Sequence
  chemically synthesized
aggtgactgtggaagccttttt

SEQ ID NO: 706491 - DNA, 22 bp, Artificial Sequence
  chemically synthesized
taggtgactgtggaagcctttt

SEQ ID NO: 706492 - DNA, 22 bp, Artificial Sequence
  chemically synthesized
gtgtgcctgaaaaaggcttcca

SEQ ID NO: 706493 - DNA, 22 bp, Artificial Sequence
  chemically synthesized
cagttttaggtgactgtggaag

SEQ ID NO: 706494 - DNA, 22 bp, Artificial Sequence
  chemically synthesized
tccagttttaggtgactgtgga

SEQ ID NO: 706495 - DNA, 22 bp, Artificial Sequence
  chemically synthesized
aaaaaggcttccacagtcacct

SEQ ID NO: 706496 - DNA, 22 bp, Artificial Sequence
  chemically synthesized
tagttctccagttttaggtgac

SEQ ID NO: 706497 - DNA, 22 bp, Artificial Sequence
  chemically synthesized
ccacagtcacctaaaactggag

SEQ ID NO: 706498 - DNA, 22 bp, Artificial Sequence
  chemically synthesized
cacagtcacctaaaactggaga

SEQ ID NO: 706499 - DNA, 22 bp, Artificial Sequence
  chemically synthesized
agaggataaggagtctatagtt

SEQ ID NO: 706500 - DNA, 22 bp, Artificial Sequence
  chemically synthesized
taagaggataaggagtctatag

SEQ ID NO: 706501 - DNA, 22 bp, Artificial Sequence
  chemically synthesized
aaactggagaactatagactcc

SEQ ID NO: 706502 - DNA, 22 bp, Artificial Sequence
  chemically synthesized
agactctaagaggataaggagt

SEQ ID NO: 706503 - DNA, 22 bp, Artificial Sequence
  chemically synthesized
gagaactatagactccttatcc

SEQ ID NO: 706504 - DNA, 22 bp, Artificial Sequence
  chemically synthesized
tacactgagactctaagaggat

SEQ ID NO: 706505 - DNA, 22 bp, Artificial Sequence
  chemically synthesized
tagactccttatcctcttagag

SEQ ID NO: 706506 - DNA, 22 bp, Artificial Sequence
  chemically synthesized
ttatacactgagactctaagag

SEQ ID NO: 706507 - DNA, 22 bp, Artificial Sequence
  chemically synthesized
attatacactgagactctaaga

SEQ ID NO: 706508 - DNA, 22 bp, Artificial Sequence
  chemically synthesized
tattatacactgagactctaag

SEQ ID NO: 706509 - DNA, 22 bp, Artificial Sequence
  chemically synthesized
ttattatacactgagactctaa

SEQ ID NO: 706510 - DNA, 22 bp, Artificial Sequence
  chemically synthesized
cttatcctcttagagtctcagt

SEQ ID NO: 706511 - DNA, 22 bp, Artificial Sequence
  chemically synthesized
atcctcttagagtctcagtgta

SEQ ID NO: 706512 - DNA, 22 bp, Artificial Sequence
  chemically synthesized
gaatttttattatacactgaga

SEQ ID NO: 706513 - DNA, 22 bp, Artificial Sequence
  chemically synthesized
tcctcttagagtctcagtgtat

SEQ ID NO: 706514 - DNA, 22 bp, Artificial Sequence
  chemically synthesized
ggaatttttattatacactgag

SEQ ID NO: 706515 - DNA, 22 bp, Artificial Sequence
  chemically synthesized
ttggaatttttattatacactg

SEQ ID NO: 706516 - DNA, 22 bp, Artificial Sequence
  chemically synthesized
ttagagtctcagtgtataataa

SEQ ID NO: 706517 - DNA, 22 bp, Artificial Sequence
  chemically synthesized
agagtctcagtgtataataaaa

SEQ ID NO: 706518 - DNA, 22 bp, Artificial Sequence
  chemically synthesized
gagtctcagtgtataataaaaa

SEQ ID NO: 706519 - DNA, 22 bp, Artificial Sequence
  chemically synthesized
gaattcttggaatttttattat

SEQ ID NO: 706520 - DNA, 22 bp, Artificial Sequence
  chemically synthesized
ttagaattcttggaatttttat

SEQ ID NO: 706521 - DNA, 22 bp, Artificial Sequence
  chemically synthesized
gttagaattcttggaattttta

SEQ ID NO: 706522 - DNA, 22 bp, Artificial Sequence
  chemically synthesized
ttgttagaattcttggaatttt

SEQ ID NO: 706523 - DNA, 22 bp, Artificial Sequence
  chemically synthesized
agtgtataataaaaattccaag

SEQ ID NO: 706524 - DNA, 22 bp, Artificial Sequence
  chemically synthesized
cttgttagaattcttggaattt

SEQ ID NO: 706525 - DNA, 22 bp, Artificial Sequence
  chemically synthesized
tttcttgttagaattcttggaa

SEQ ID NO: 706526 - DNA, 22 bp, Artificial Sequence
  chemically synthesized
atttcttgttagaattcttgga

SEQ ID NO: 706527 - DNA, 22 bp, Artificial Sequence
  chemically synthesized
caagaattctaacaagaaataa

SEQ ID NO: 706528 - DNA, 22 bp, Artificial Sequence
  chemically synthesized
aaagataagcaagtttatttct

SEQ ID NO: 706529 - DNA, 22 bp, Artificial Sequence
  chemically synthesized
caaagataagcaagtttatttc

SEQ ID NO: 706530 - DNA, 22 bp, Artificial Sequence
  chemically synthesized
ggtttcaaagataagcaagttt

SEQ ID NO: 706531 - DNA, 22 bp, Artificial Sequence
  chemically synthesized
taacaagaaataaacttgctta

SEQ ID NO: 706532 - DNA, 22 bp, Artificial Sequence
  chemically synthesized
acaagaaataaacttgcttatc

SEQ ID NO: 706533 - DNA, 22 bp, Artificial Sequence
  chemically synthesized
gaaaaacactaggtttcaaaga

SEQ ID NO: 706534 - DNA, 22 bp, Artificial Sequence
  chemically synthesized
gcttatctttgaaacctagtgt

SEQ ID NO: 706535 - DNA, 22 bp, Artificial Sequence
  chemically synthesized
cttatctttgaaacctagtgtt

SEQ ID NO: 706536 - DNA, 22 bp, Artificial Sequence
  chemically synthesized
ataagattggaaaaacactagg

SEQ ID NO: 706537 - DNA, 22 bp, Artificial Sequence
  chemically synthesized
atctttgaaacctagtgttttt

SEQ ID NO: 706538 - DNA, 22 bp, Artificial Sequence
  chemically synthesized
tctttgaaacctagtgtttttc

SEQ ID NO: 706539 - DNA, 22 bp, Artificial Sequence
  chemically synthesized
attaataagattggaaaaacac

SEQ ID NO: 706540 - DNA, 22 bp, Artificial Sequence
  chemically synthesized
tgaaacctagtgtttttccaat

SEQ ID NO: 706541 - DNA, 22 bp, Artificial Sequence
  chemically synthesized
gaaacctagtgtttttccaatc

SEQ ID NO: 706542 - DNA, 22 bp, Artificial Sequence
  chemically synthesized
aaacctagtgtttttccaatct

SEQ ID NO: 706543 - DNA, 22 bp, Artificial Sequence
  chemically synthesized
gtgtttttccaatcttattaat

SEQ ID NO: 706544 - DNA, 22 bp, Artificial Sequence
  chemically synthesized
aaaaaaatagtactgattaata

SEQ ID NO: 706545 - DNA, 22 bp, Artificial Sequence
  chemically synthesized
gaaaaaaatagtactgattaat

SEQ ID NO: 706546 - DNA, 22 bp, Artificial Sequence
  chemically synthesized
ttccaatcttattaatcagtac

SEQ ID NO: 706547 - DNA, 22 bp, Artificial Sequence
  chemically synthesized
tccaatcttattaatcagtact

SEQ ID NO: 706548 - DNA, 22 bp, Artificial Sequence
  chemically synthesized
ccaatcttattaatcagtacta

SEQ ID NO: 706549 - DNA, 22 bp, Artificial Sequence
  chemically synthesized
caatcttattaatcagtactat

SEQ ID NO: 706550 - DNA, 22 bp, Artificial Sequence
  chemically synthesized
tcccttgaaaaaaatagtactg

SEQ ID NO: 706551 - DNA, 22 bp, Artificial Sequence
  chemically synthesized
attaatcagtactatttttttc

SEQ ID NO: 706552 - DNA, 22 bp, Artificial Sequence
  chemically synthesized
ttaatcagtactatttttttca

SEQ ID NO: 706553 - DNA, 22 bp, Artificial Sequence
  chemically synthesized
ataactgtcccttgaaaaaaat

SEQ ID NO: 706554 - DNA, 22 bp, Artificial Sequence
  chemically synthesized
gataactgtcccttgaaaaaaa

SEQ ID NO: 706555 - DNA, 22 bp, Artificial Sequence
  chemically synthesized
tgataactgtcccttgaaaaaa

SEQ ID NO: 706556 - DNA, 22 bp, Artificial Sequence
  chemically synthesized
atcagtactatttttttcaagg

SEQ ID NO: 706557 - DNA, 22 bp, Artificial Sequence
  chemically synthesized
ggttttgataactgtcccttga

SEQ ID NO: 706558 - DNA, 22 bp, Artificial Sequence
  chemically synthesized
tattaggttttgataactgtcc

SEQ ID NO: 706559 - DNA, 22 bp, Artificial Sequence
  chemically synthesized
tttttttcaagggacagttatc

SEQ ID NO: 706560 - DNA, 22 bp, Artificial Sequence
  chemically synthesized
ttttcaagggacagttatcaaa

SEQ ID NO: 706561 - DNA, 22 bp, Artificial Sequence
  chemically synthesized
tttcaagggacagttatcaaaa

SEQ ID NO: 706562 - DNA, 22 bp, Artificial Sequence
  chemically synthesized
ttcaagggacagttatcaaaac

SEQ ID NO: 706563 - DNA, 22 bp, Artificial Sequence
  chemically synthesized
atgttatattaggttttgataa

SEQ ID NO: 706564 - DNA, 22 bp, Artificial Sequence
  chemically synthesized
tcaagggacagttatcaaaacc

SEQ ID NO: 706565 - DNA, 22 bp, Artificial Sequence
  chemically synthesized
caagggacagttatcaaaacct

SEQ ID NO: 706566 - DNA, 22 bp, Artificial Sequence
  chemically synthesized
aagggacagttatcaaaaccta

SEQ ID NO: 706567 - DNA, 22 bp, Artificial Sequence
  chemically synthesized
aaacattaatgttatattaggt

SEQ ID NO: 706568 - DNA, 22 bp, Artificial Sequence
  chemically synthesized
aaaacattaatgttatattagg

SEQ ID NO: 706569 - DNA, 22 bp, Artificial Sequence
  chemically synthesized
taaaacattaatgttatattag

SEQ ID NO: 706570 - DNA, 22 bp, Artificial Sequence
  chemically synthesized
tttaaaacattaatgttatatt

SEQ ID NO: 706571 - DNA, 22 bp, Artificial Sequence
  chemically synthesized
tcaaaacctaatataacattaa

SEQ ID NO: 706572 - DNA, 22 bp, Artificial Sequence
  chemically synthesized
caagccaggttctttaaaacat

SEQ ID NO: 706573 - DNA, 22 bp, Artificial Sequence
  chemically synthesized
atataacattaatgttttaaag

SEQ ID NO: 706574 - DNA, 22 bp, Artificial Sequence
  chemically synthesized
ccaagccaggttctttaaaaca

SEQ ID NO: 706575 - DNA, 22 bp, Artificial Sequence
  chemically synthesized
tccaagccaggttctttaaaac

SEQ ID NO: 706576 - DNA, 22 bp, Artificial Sequence
  chemically synthesized
atgttttaaagaacctggcttg

SEQ ID NO: 706577 - DNA, 22 bp, Artificial Sequence
  chemically synthesized
aaagaatattttccaagccagg

SEQ ID NO: 706578 - DNA, 22 bp, Artificial Sequence
  chemically synthesized
aaaagaatattttccaagccag

SEQ ID NO: 706579 - DNA, 22 bp, Artificial Sequence
  chemically synthesized
taaagaacctggcttggaaaat

SEQ ID NO: 706580 - DNA, 22 bp, Artificial Sequence
  chemically synthesized
aaagaacctggcttggaaaata

SEQ ID NO: 706581 - DNA, 22 bp, Artificial Sequence
  chemically synthesized
aagaacctggcttggaaaatat

SEQ ID NO: 706582 - DNA, 22 bp, Artificial Sequence
  chemically synthesized
cagaggtcccttaaaagaatat

SEQ ID NO: 706583 - DNA, 22 bp, Artificial Sequence
  chemically synthesized
gcttggaaaatattcttttaag

SEQ ID NO: 706584 - DNA, 22 bp, Artificial Sequence
  chemically synthesized
ggaaaatattcttttaagggac

SEQ ID NO: 706585 - DNA, 22 bp, Artificial Sequence
  chemically synthesized
caagttccagaggtcccttaaa

SEQ ID NO: 706586 - DNA, 22 bp, Artificial Sequence
  chemically synthesized
gaaaatattcttttaagggacc

SEQ ID NO: 706587 - DNA, 22 bp, Artificial Sequence
  chemically synthesized
acaagttccagaggtcccttaa

SEQ ID NO: 706588 - DNA, 22 bp, Artificial Sequence
  chemically synthesized
tacaagttccagaggtccctta

SEQ ID NO: 706589 - DNA, 22 bp, Artificial Sequence
  chemically synthesized
atattttacaagttccagaggt

SEQ ID NO: 706590 - DNA, 22 bp, Artificial Sequence
  chemically synthesized
aatattttacaagttccagagg

SEQ ID NO: 706591 - DNA, 22 bp, Artificial Sequence
  chemically synthesized
ttttaagggacctctggaactt

SEQ ID NO: 706592 - DNA, 22 bp, Artificial Sequence
  chemically synthesized
ttaatattttacaagttccaga

SEQ ID NO: 706593 - DNA, 22 bp, Artificial Sequence
  chemically synthesized
cttaatattttacaagttccag

SEQ ID NO: 706594 - DNA, 22 bp, Artificial Sequence
  chemically synthesized
ttaagggacctctggaacttgt

SEQ ID NO: 706595 - DNA, 22 bp, Artificial Sequence
  chemically synthesized
tcttaatattttacaagttcca

SEQ ID NO: 706596 - DNA, 22 bp, Artificial Sequence
  chemically synthesized
taagggacctctggaacttgta

SEQ ID NO: 706597 - DNA, 22 bp, Artificial Sequence
  chemically synthesized
aagggacctctggaacttgtaa

SEQ ID NO: 706598 - DNA, 22 bp, Artificial Sequence
  chemically synthesized
agggacctctggaacttgtaaa

SEQ ID NO: 706599 - DNA, 22 bp, Artificial Sequence
  chemically synthesized
tggaacttgtaaaatattaaga

SEQ ID NO: 706600 - DNA, 22 bp, Artificial Sequence
  chemically synthesized
gaacttgtaaaatattaagaaa

SEQ ID NO: 706601 - DNA, 22 bp, Artificial Sequence
  chemically synthesized
gtaaaatattaagaaaaccatg

SEQ ID NO: 706602 - DNA, 22 bp, Artificial Sequence
  chemically synthesized
taaaatattaagaaaaccatgg

SEQ ID NO: 706603 - DNA, 22 bp, Artificial Sequence
  chemically synthesized
taacagtaaaaagaatccatgg

SEQ ID NO: 706604 - DNA, 22 bp, Artificial Sequence
  chemically synthesized
tataacagtaaaaagaatccat

SEQ ID NO: 706605 - DNA, 22 bp, Artificial Sequence
  chemically synthesized
agaaaaccatggattcttttta

SEQ ID NO: 706606 - DNA, 22 bp, Artificial Sequence
  chemically synthesized
tttttactgttatagaatgatt

SEQ ID NO: 706607 - DNA, 22 bp, Artificial Sequence
  chemically synthesized
ggtaaagggagaaatcattcta

SEQ ID NO: 706608 - DNA, 22 bp, Artificial Sequence
  chemically synthesized
gggtaaagggagaaatcattct

SEQ ID NO: 706609 - DNA, 22 bp, Artificial Sequence
  chemically synthesized
tttactgttatagaatgatttc

SEQ ID NO: 706610 - DNA, 22 bp, Artificial Sequence
  chemically synthesized
ttactgttatagaatgatttct

SEQ ID NO: 706611 - DNA, 22 bp, Artificial Sequence
  chemically synthesized
tactgttatagaatgatttctc

SEQ ID NO: 706612 - DNA, 22 bp, Artificial Sequence
  chemically synthesized
actgttatagaatgatttctcc

SEQ ID NO: 706613 - DNA, 22 bp, Artificial Sequence
  chemically synthesized
ctgttatagaatgatttctccc

SEQ ID NO: 706614 - DNA, 22 bp, Artificial Sequence
  chemically synthesized
tatatttgggtaaagggagaaa

SEQ ID NO: 706615 - DNA, 22 bp, Artificial Sequence
  chemically synthesized
ttatagaatgatttctcccttt

SEQ ID NO: 706616 - DNA, 22 bp, Artificial Sequence
  chemically synthesized
tagaatgatttctccctttacc

SEQ ID NO: 706617 - DNA, 22 bp, Artificial Sequence
  chemically synthesized
ctccctttacccaaatatatag

SEQ ID NO: 706618 - DNA, 22 bp, Artificial Sequence
  chemically synthesized
tccctttacccaaatatatagt

SEQ ID NO: 706619 - DNA, 22 bp, Artificial Sequence
  chemically synthesized
accaagaaagatcactatatat

SEQ ID NO: 706620 - DNA, 22 bp, Artificial Sequence
  chemically synthesized
cctttacccaaatatatagtga

SEQ ID NO: 706621 - DNA, 22 bp, Artificial Sequence
  chemically synthesized
tcaccaagaaagatcactatat

SEQ ID NO: 706622 - DNA, 22 bp, Artificial Sequence
  chemically synthesized
ctcaccaagaaagatcactata

SEQ ID NO: 706623 - DNA, 22 bp, Artificial Sequence
  chemically synthesized
tctcaccaagaaagatcactat

SEQ ID NO: 706624 - DNA, 22 bp, Artificial Sequence
  chemically synthesized
tacccaaatatatagtgatctt

SEQ ID NO: 706625 - DNA, 22 bp, Artificial Sequence
  chemically synthesized
ttctcaccaagaaagatcacta

SEQ ID NO: 706626 - DNA, 22 bp, Artificial Sequence
  chemically synthesized
acccaaatatatagtgatcttt

SEQ ID NO: 706627 - DNA, 22 bp, Artificial Sequence
  chemically synthesized
cccaaatatatagtgatctttc

SEQ ID NO: 706628 - DNA, 22 bp, Artificial Sequence
  chemically synthesized
cttttctcaccaagaaagatca

SEQ ID NO: 706629 - DNA, 22 bp, Artificial Sequence
  chemically synthesized
tacttttctcaccaagaaagat

SEQ ID NO: 706630 - DNA, 22 bp, Artificial Sequence
  chemically synthesized
aattctacttttctcaccaaga

SEQ ID NO: 706631 - DNA, 22 bp, Artificial Sequence
  chemically synthesized
taaattctacttttctcaccaa

SEQ ID NO: 706632 - DNA, 22 bp, Artificial Sequence
  chemically synthesized
ttctaaattctacttttctcac

SEQ ID NO: 706633 - DNA, 22 bp, Artificial Sequence
  chemically synthesized
tgttctaaattctacttttctc

SEQ ID NO: 706634 - DNA, 22 bp, Artificial Sequence
  chemically synthesized
ctgttctaaattctacttttct

SEQ ID NO: 706635 - DNA, 22 bp, Artificial Sequence
  chemically synthesized
tcttggtgagaaaagtagaatt

SEQ ID NO: 706636 - DNA, 22 bp, Artificial Sequence
  chemically synthesized
cttggtgagaaaagtagaattt

SEQ ID NO: 706637 - DNA, 22 bp, Artificial Sequence
  chemically synthesized
gtcttctgttctaaattctact

SEQ ID NO: 706638 - DNA, 22 bp, Artificial Sequence
  chemically synthesized
ttggtgagaaaagtagaattta

SEQ ID NO: 706639 - DNA, 22 bp, Artificial Sequence
  chemically synthesized
tggtcttctgttctaaattcta

SEQ ID NO: 706640 - DNA, 22 bp, Artificial Sequence
  chemically synthesized
ggtgagaaaagtagaatttaga

SEQ ID NO: 706641 - DNA, 22 bp, Artificial Sequence
  chemically synthesized
gtgagaaaagtagaatttagaa

SEQ ID NO: 706642 - DNA, 22 bp, Artificial Sequence
  chemically synthesized
tctggtcttctgttctaaattc

SEQ ID NO: 706643 - DNA, 22 bp, Artificial Sequence
  chemically synthesized
aattctctggtcttctgttcta

SEQ ID NO: 706644 - DNA, 22 bp, Artificial Sequence
  chemically synthesized
caattctctggtcttctgttct

SEQ ID NO: 706645 - DNA, 22 bp, Artificial Sequence
  chemically synthesized
tttcaattctctggtcttctgt

SEQ ID NO: 706646 - DNA, 22 bp, Artificial Sequence
  chemically synthesized
accattatttcaattctctggt

SEQ ID NO: 706647 - DNA, 22 bp, Artificial Sequence
  chemically synthesized
agaacagaagaccagagaattg

SEQ ID NO: 706648 - DNA, 22 bp, Artificial Sequence
  chemically synthesized
gaacagaagaccagagaattga

SEQ ID NO: 706649 - DNA, 22 bp, Artificial Sequence
  chemically synthesized
ctgaccattatttcaattctct

SEQ ID NO: 706650 - DNA, 22 bp, Artificial Sequence
  chemically synthesized
cctgaccattatttcaattctc

SEQ ID NO: 706651 - DNA, 22 bp, Artificial Sequence
  chemically synthesized
tcctgaccattatttcaattct

SEQ ID NO: 706652 - DNA, 22 bp, Artificial Sequence
  chemically synthesized
ttcctgaccattatttcaattc

SEQ ID NO: 706653 - DNA, 22 bp, Artificial Sequence
  chemically synthesized
aagatttttcctgaccattatt

SEQ ID NO: 706654 - DNA, 22 bp, Artificial Sequence
  chemically synthesized
aaagatttttcctgaccattat

SEQ ID NO: 706655 - DNA, 22 bp, Artificial Sequence
  chemically synthesized
aaataatggtcaggaaaaatct

SEQ ID NO: 706656 - DNA, 22 bp, Artificial Sequence
  chemically synthesized
aaaaaaagaatttaaagatttt

SEQ ID NO: 706657 - DNA, 22 bp, Artificial Sequence
  chemically synthesized
tctcaaaaaaagaatttaaaga

SEQ ID NO: 706658 - DNA, 22 bp, Artificial Sequence
  chemically synthesized
tgtctcaaaaaaagaatttaaa

SEQ ID NO: 706659 - DNA, 22 bp, Artificial Sequence
  chemically synthesized
taaattctttttttgagacaga

SEQ ID NO: 706660 - DNA, 22 bp, Artificial Sequence
  chemically synthesized
aaattctttttttgagacagag

SEQ ID NO: 706661 - DNA, 22 bp, Artificial Sequence
  chemically synthesized
aattctttttttgagacagagt

SEQ ID NO: 706662 - DNA, 22 bp, Artificial Sequence
  chemically synthesized
ggtgatagagagagactctgtc

SEQ ID NO: 706663 - DNA, 22 bp, Artificial Sequence
  chemically synthesized
tttttttgagacagagtctctc

SEQ ID NO: 706664 - DNA, 22 bp, Artificial Sequence
  chemically synthesized
tttttgagacagagtctctctc

SEQ ID NO: 706665 - DNA, 22 bp, Artificial Sequence
  chemically synthesized
ttttgagacagagtctctctct

SEQ ID NO: 706666 - DNA, 22 bp, Artificial Sequence
  chemically synthesized
tttgagacagagtctctctcta

SEQ ID NO: 706667 - DNA, 22 bp, Artificial Sequence
  chemically synthesized
ttgagacagagtctctctctat

SEQ ID NO: 706668 - DNA, 22 bp, Artificial Sequence
  chemically synthesized
tgagacagagtctctctctatc

SEQ ID NO: 706669 - DNA, 22 bp, Artificial Sequence
  chemically synthesized
gagacagagtctctctctatca

SEQ ID NO: 706670 - DNA, 22 bp, Artificial Sequence
  chemically synthesized
agacagagtctctctctatcac

SEQ ID NO: 706671 - DNA, 22 bp, Artificial Sequence
  chemically synthesized
cagtccagcctgggtgatagag

SEQ ID NO: 706672 - DNA, 22 bp, Artificial Sequence
  chemically synthesized
tctctatcacccaggctggact

SEQ ID NO: 706673 - DNA, 22 bp, Artificial Sequence
  chemically synthesized
tctatcacccaggctggactgc

SEQ ID NO: 706674 - DNA, 22 bp, Artificial Sequence
  chemically synthesized
agatcatgccactgcagtccag

SEQ ID NO: 706675 - DNA, 22 bp, Artificial Sequence
  chemically synthesized
tatcacccaggctggactgcag

SEQ ID NO: 706676 - DNA, 22 bp, Artificial Sequence
  chemically synthesized
tcacccaggctggactgcagtg

SEQ ID NO: 706677 - DNA, 22 bp, Artificial Sequence
  chemically synthesized
cagtgagctgagatcatgccac

SEQ ID NO: 706678 - DNA, 22 bp, Artificial Sequence
  chemically synthesized
gactgcagtggcatgatctcag

SEQ ID NO: 706679 - DNA, 22 bp, Artificial Sequence
  chemically synthesized
cagtggcatgatctcagctcac

SEQ ID NO: 706680 - DNA, 22 bp, Artificial Sequence
  chemically synthesized
gaggtggaggttgcagtgagct

SEQ ID NO: 706681 - DNA, 22 bp, Artificial Sequence
  chemically synthesized
aaccctggaggtggaggttgca

SEQ ID NO: 706682 - DNA, 22 bp, Artificial Sequence
  chemically synthesized
gaaccctggaggtggaggttgc

SEQ ID NO: 706683 - DNA, 22 bp, Artificial Sequence
  chemically synthesized
agctcactgcaacctccacctc

SEQ ID NO: 706684 - DNA, 22 bp, Artificial Sequence
  chemically synthesized
actgcaacctccacctccaggg

SEQ ID NO: 706685 - DNA, 22 bp, Artificial Sequence
  chemically synthesized
caacctccacctccagggttca

SEQ ID NO: 706686 - DNA, 22 bp, Artificial Sequence
  chemically synthesized
aggcaggagaatggcttgaacc

SEQ ID NO: 706687 - DNA, 22 bp, Artificial Sequence
  chemically synthesized
cacctccagggttcaagccatt

SEQ ID NO: 706688 - DNA, 22 bp, Artificial Sequence
  chemically synthesized
ggaggctgaggcaggagaatgg

SEQ ID NO: 706689 - DNA, 22 bp, Artificial Sequence
  chemically synthesized
cagggttcaagccattctcctg

SEQ ID NO: 706690 - DNA, 22 bp, Artificial Sequence
  chemically synthesized
aggaggctgaggcaggagaatg

SEQ ID NO: 706691 - DNA, 22 bp, Artificial Sequence
  chemically synthesized
cttaggaggctgaggcaggaga

SEQ ID NO: 706692 - DNA, 22 bp, Artificial Sequence
  chemically synthesized
aagccattctcctgcctcagcc

SEQ ID NO: 706693 - DNA, 22 bp, Artificial Sequence
  chemically synthesized
taatcccagctgcttaggaggc

SEQ ID NO: 706694 - DNA, 22 bp, Artificial Sequence
  chemically synthesized
tcctgcctcagcctcctaagca

SEQ ID NO: 706695 - DNA, 22 bp, Artificial Sequence
  chemically synthesized
ctgcctcagcctcctaagcagc

SEQ ID NO: 706696 - DNA, 22 bp, Artificial Sequence
  chemically synthesized
gcctgtaatcccagctgcttag

SEQ ID NO: 706697 - DNA, 22 bp, Artificial Sequence
  chemically synthesized
cctcagcctcctaagcagctgg

SEQ ID NO: 706698 - DNA, 22 bp, Artificial Sequence
  chemically synthesized
agcctcctaagcagctgggatt

SEQ ID NO: 706699 - DNA, 22 bp, Artificial Sequence
  chemically synthesized
ctaagcagctgggattacaggc

SEQ ID NO: 706700 - DNA, 22 bp, Artificial Sequence
  chemically synthesized
agcagctgggattacaggcgag

SEQ ID NO: 706701 - DNA, 22 bp, Artificial Sequence
  chemically synthesized
ggcgtggtggcactcgcctgta

SEQ ID NO: 706702 - DNA, 22 bp, Artificial Sequence
  chemically synthesized
gctgggcgtggtggcactcgcc

SEQ ID NO: 706703 - DNA, 22 bp, Artificial Sequence
  chemically synthesized
ggattacaggcgagtgccacca

SEQ ID NO: 706704 - DNA, 22 bp, Artificial Sequence
  chemically synthesized
caggcgagtgccaccacgccca

SEQ ID NO: 706705 - DNA, 22 bp, Artificial Sequence
  chemically synthesized
aaaatacaaaaattagctgggc

SEQ ID NO: 706706 - DNA, 22 bp, Artificial Sequence
  chemically synthesized
tactaaaaatacaaaaattagc

SEQ ID NO: 706707 - DNA, 22 bp, Artificial Sequence
  chemically synthesized
atttttgtatttttagtacaga

SEQ ID NO: 706708 - DNA, 22 bp, Artificial Sequence
  chemically synthesized
gtgaaacccccatctgtactaa

SEQ ID NO: 706709 - DNA, 22 bp, Artificial Sequence
  chemically synthesized
ttgtatttttagtacagatggg

SEQ ID NO: 706710 - DNA, 22 bp, Artificial Sequence
  chemically synthesized
tgtatttttagtacagatgggg

SEQ ID NO: 706711 - DNA, 22 bp, Artificial Sequence
  chemically synthesized
gtatttttagtacagatggggg

SEQ ID NO: 706712 - DNA, 22 bp, Artificial Sequence
  chemically synthesized
tatttttagtacagatgggggt

SEQ ID NO: 706713 - DNA, 22 bp, Artificial Sequence
  chemically synthesized
gccaacctggtgaaacccccat

SEQ ID NO: 706714 - DNA, 22 bp, Artificial Sequence
  chemically synthesized
ttagtacagatgggggtttcac

SEQ ID NO: 706715 - DNA, 22 bp, Artificial Sequence
  chemically synthesized
tagtacagatgggggtttcacc

SEQ ID NO: 706716 - DNA, 22 bp, Artificial Sequence
  chemically synthesized
agtacagatgggggtttcacca

SEQ ID NO: 706717 - DNA, 22 bp, Artificial Sequence
  chemically synthesized
gtacagatgggggtttcaccag

SEQ ID NO: 706718 - DNA, 22 bp, Artificial Sequence
  chemically synthesized
aagaccagcctggccaacctgg

SEQ ID NO: 706719 - DNA, 22 bp, Artificial Sequence
  chemically synthesized
caccaggttggccaggctggtc

SEQ ID NO: 706720 - DNA, 22 bp, Artificial Sequence
  chemically synthesized
accaggttggccaggctggtct

SEQ ID NO: 706721 - DNA, 22 bp, Artificial Sequence
  chemically synthesized
aggtcaggagttcaagaccagc

SEQ ID NO: 706722 - DNA, 22 bp, Artificial Sequence
  chemically synthesized
gaggtcaggagttcaagaccag

SEQ ID NO: 706723 - DNA, 22 bp, Artificial Sequence
  chemically synthesized
gccaggctggtcttgaactcct

SEQ ID NO: 706724 - DNA, 22 bp, Artificial Sequence
  chemically synthesized
gtcttgaactcctgacctcaag

SEQ ID NO: 706725 - DNA, 22 bp, Artificial Sequence
  chemically synthesized
aggtgggcagatcacttgaggt

SEQ ID NO: 706726 - DNA, 22 bp, Artificial Sequence
  chemically synthesized
gaactcctgacctcaagtgatc

SEQ ID NO: 706727 - DNA, 22 bp, Artificial Sequence
  chemically synthesized
aactcctgacctcaagtgatct

SEQ ID NO: 706728 - DNA, 22 bp, Artificial Sequence
  chemically synthesized
ggaggctgaggtgggcagatca

SEQ ID NO: 706729 - DNA, 22 bp, Artificial Sequence
  chemically synthesized
ctgacctcaagtgatctgccca

SEQ ID NO: 706730 - DNA, 22 bp, Artificial Sequence
  chemically synthesized
gggaggctgaggtgggcagatc

SEQ ID NO: 706731 - DNA, 22 bp, Artificial Sequence
  chemically synthesized
tgggaggctgaggtgggcagat

SEQ ID NO: 706732 - DNA, 22 bp, Artificial Sequence
  chemically synthesized
acctcaagtgatctgcccacct

SEQ ID NO: 706733 - DNA, 22 bp, Artificial Sequence
  chemically synthesized
aagtgatctgcccacctcagcc

SEQ ID NO: 706734 - DNA, 22 bp, Artificial Sequence
  chemically synthesized
taatcccatcactttgggaggc

SEQ ID NO: 706735 - DNA, 22 bp, Artificial Sequence
  chemically synthesized
cccacctcagcctcccaaagtg

SEQ ID NO: 706736 - DNA, 22 bp, Artificial Sequence
  chemically synthesized
acacctgtaatcccatcacttt

SEQ ID NO: 706737 - DNA, 22 bp, Artificial Sequence
  chemically synthesized
agcctcccaaagtgatgggatt

SEQ ID NO: 706738 - DNA, 22 bp, Artificial Sequence
  chemically synthesized
ccaaagtgatgggattacaggt

SEQ ID NO: 706739 - DNA, 22 bp, Artificial Sequence
  chemically synthesized
ggcgtggtggctcacacctgta

SEQ ID NO: 706740 - DNA, 22 bp, Artificial Sequence
  chemically synthesized
ttgggcgtggtggctcacacct

SEQ ID NO: 706741 - DNA, 22 bp, Artificial Sequence
  chemically synthesized
gttgggcgtggtggctcacacc

SEQ ID NO: 706742 - DNA, 22 bp, Artificial Sequence
  chemically synthesized
aagatttgttgggcgtggtggc

SEQ ID NO: 706743 - DNA, 22 bp, Artificial Sequence
  chemically synthesized
aaagatttgttgggcgtggtgg

SEQ ID NO: 706744 - DNA, 22 bp, Artificial Sequence
  chemically synthesized
caggtgtgagccaccacgccca

SEQ ID NO: 706745 - DNA, 22 bp, Artificial Sequence
  chemically synthesized
aagagtttaaagatttgttggg

SEQ ID NO: 706746 - DNA, 22 bp, Artificial Sequence
  chemically synthesized
gaagagtttaaagatttgttgg

SEQ ID NO: 706747 - DNA, 22 bp, Artificial Sequence
  chemically synthesized
tgaagagtttaaagatttgttg

SEQ ID NO: 706748 - DNA, 22 bp, Artificial Sequence
  chemically synthesized
ttgaagagtttaaagatttgtt

SEQ ID NO: 706749 - DNA, 22 bp, Artificial Sequence
  chemically synthesized
ttttgaagagtttaaagatttg

SEQ ID NO: 706750 - DNA, 22 bp, Artificial Sequence
  chemically synthesized
cttttgaagagtttaaagattt

SEQ ID NO: 706751 - DNA, 22 bp, Artificial Sequence
  chemically synthesized
tcttttgaagagtttaaagatt

SEQ ID NO: 706752 - DNA, 22 bp, Artificial Sequence
  chemically synthesized
ttcttttgaagagtttaaagat

SEQ ID NO: 706753 - DNA, 22 bp, Artificial Sequence
  chemically synthesized
tccttttcttttgaagagttta

SEQ ID NO: 706754 - DNA, 22 bp, Artificial Sequence
  chemically synthesized
aaaattgtccttttcttttgaa

SEQ ID NO: 706755 - DNA, 22 bp, Artificial Sequence
  chemically synthesized
taaactcttcaaaagaaaagga

SEQ ID NO: 706756 - DNA, 22 bp, Artificial Sequence
  chemically synthesized
aaactcttcaaaagaaaaggac

SEQ ID NO: 706757 - DNA, 22 bp, Artificial Sequence
  chemically synthesized
aactcttcaaaagaaaaggaca

SEQ ID NO: 706758 - DNA, 22 bp, Artificial Sequence
  chemically synthesized
ttcaaaagaaaaggacaatttt

SEQ ID NO: 706759 - DNA, 22 bp, Artificial Sequence
  chemically synthesized
gcatagtagtctgaaaattgtc

SEQ ID NO: 706760 - DNA, 22 bp, Artificial Sequence
  chemically synthesized
caaaagaaaaggacaattttca

SEQ ID NO: 706761 - DNA, 22 bp, Artificial Sequence
  chemically synthesized
aaaagaaaaggacaattttcag

SEQ ID NO: 706762 - DNA, 22 bp, Artificial Sequence
  chemically synthesized
gttggcatagtagtctgaaaat

SEQ ID NO: 706763 - DNA, 22 bp, Artificial Sequence
  chemically synthesized
attggttggcatagtagtctga

SEQ ID NO: 706764 - DNA, 22 bp, Artificial Sequence
  chemically synthesized
aagtattcattggttggcatag

SEQ ID NO: 706765 - DNA, 22 bp, Artificial Sequence
  chemically synthesized
tcagactactatgccaaccaat

SEQ ID NO: 706766 - DNA, 22 bp, Artificial Sequence
  chemically synthesized
cagactactatgccaaccaatg

SEQ ID NO: 706767 - DNA, 22 bp, Artificial Sequence
  chemically synthesized
agactactatgccaaccaatga

SEQ ID NO: 706768 - DNA, 22 bp, Artificial Sequence
  chemically synthesized
agaaagtactaaagtattcatt

SEQ ID NO: 706769 - DNA, 22 bp, Artificial Sequence
  chemically synthesized
ctatgccaaccaatgaatactt

SEQ ID NO: 706770 - DNA, 22 bp, Artificial Sequence
  chemically synthesized
tgccaaccaatgaatactttag

SEQ ID NO: 706771 - DNA, 22 bp, Artificial Sequence
  chemically synthesized
tgattaagaaagtactaaagta

SEQ ID NO: 706772 - DNA, 22 bp, Artificial Sequence
  chemically synthesized
atatgtctgtgattaagaaagt

SEQ ID NO: 706773 - DNA, 22 bp, Artificial Sequence
  chemically synthesized
catatgtctgtgattaagaaag

SEQ ID NO: 706774 - DNA, 22 bp, Artificial Sequence
  chemically synthesized
ttcatatgtctgtgattaagaa

SEQ ID NO: 706775 - DNA, 22 bp, Artificial Sequence
  chemically synthesized
tagtactttcttaatcacagac

SEQ ID NO: 706776 - DNA, 22 bp, Artificial Sequence
  chemically synthesized
agtactttcttaatcacagaca

SEQ ID NO: 706777 - DNA, 22 bp, Artificial Sequence
  chemically synthesized
gtactttcttaatcacagacat

SEQ ID NO: 706778 - DNA, 22 bp, Artificial Sequence
  chemically synthesized
tcagtctcttcatatgtctgtg

SEQ ID NO: 706779 - DNA, 22 bp, Artificial Sequence
  chemically synthesized
tcttaatcacagacatatgaag

SEQ ID NO: 706780 - DNA, 22 bp, Artificial Sequence
  chemically synthesized
cttaatcacagacatatgaaga

SEQ ID NO: 706781 - DNA, 22 bp, Artificial Sequence
  chemically synthesized
ttaatcacagacatatgaagag

SEQ ID NO: 706782 - DNA, 22 bp, Artificial Sequence
  chemically synthesized
aatcacagacatatgaagagac

SEQ ID NO: 706783 - DNA, 22 bp, Artificial Sequence
  chemically synthesized
atcacagacatatgaagagact

SEQ ID NO: 706784 - DNA, 22 bp, Artificial Sequence
  chemically synthesized
gtaggtatattgtcagtctctt

SEQ ID NO: 706785 - DNA, 22 bp, Artificial Sequence
  chemically synthesized
tatatgtataattggtaggtat

SEQ ID NO: 706786 - DNA, 22 bp, Artificial Sequence
  chemically synthesized
tagttatatatgtataattggt

SEQ ID NO: 706787 - DNA, 22 bp, Artificial Sequence
  chemically synthesized
acaatatacctaccaattatac

SEQ ID NO: 706788 - DNA, 22 bp, Artificial Sequence
  chemically synthesized
atagttatatatgtataattgg

SEQ ID NO: 706789 - DNA, 22 bp, Artificial Sequence
  chemically synthesized
atttatagttatatatgtataa

SEQ ID NO: 706790 - DNA, 22 bp, Artificial Sequence
  chemically synthesized
tatactaatttatagttatata

SEQ ID NO: 706791 - DNA, 22 bp, Artificial Sequence
  chemically synthesized
ccaattatacatatataactat

SEQ ID NO: 706792 - DNA, 22 bp, Artificial Sequence
  chemically synthesized
aattatatactaatttatagtt

SEQ ID NO: 706793 - DNA, 22 bp, Artificial Sequence
  chemically synthesized
aaattatatactaatttatagt

SEQ ID NO: 706794 - DNA, 22 bp, Artificial Sequence
  chemically synthesized
tacatatataactataaattag

SEQ ID NO: 706795 - DNA, 22 bp, Artificial Sequence
  chemically synthesized
tttaaattatatactaatttat

SEQ ID NO: 706796 - DNA, 22 bp, Artificial Sequence
  chemically synthesized
aattatttaaattatatactaa

SEQ ID NO: 706797 - DNA, 22 bp, Artificial Sequence
  chemically synthesized
aaattatttaaattatatacta

SEQ ID NO: 706798 - DNA, 22 bp, Artificial Sequence
  chemically synthesized
tcatttaaattatttaaattat

SEQ ID NO: 706799 - DNA, 22 bp, Artificial Sequence
  chemically synthesized
taaattagtatataatttaaat

SEQ ID NO: 706800 - DNA, 22 bp, Artificial Sequence
  chemically synthesized
gtatataatttaaataatttaa

SEQ ID NO: 706801 - DNA, 22 bp, Artificial Sequence
  chemically synthesized
caataaaattatcatttaaatt

SEQ ID NO: 706802 - DNA, 22 bp, Artificial Sequence
  chemically synthesized
acaataaaattatcatttaaat

SEQ ID NO: 706803 - DNA, 22 bp, Artificial Sequence
  chemically synthesized
aaataatttaaatgataatttt

SEQ ID NO: 706804 - DNA, 22 bp, Artificial Sequence
  chemically synthesized
aataatttaaatgataatttta

SEQ ID NO: 706805 - DNA, 22 bp, Artificial Sequence
  chemically synthesized
aaatgataattttattgtaaat

SEQ ID NO: 706806 - DNA, 22 bp, Artificial Sequence
  chemically synthesized
aatgataattttattgtaaatt

SEQ ID NO: 706807 - DNA, 22 bp, Artificial Sequence
  chemically synthesized
aaatatgtatataatttacaat

SEQ ID NO: 706808 - DNA, 22 bp, Artificial Sequence
  chemically synthesized
caaatatgtatataatttacaa

SEQ ID NO: 706809 - DNA, 22 bp, Artificial Sequence
  chemically synthesized
tattgtaaattatatacatatt

SEQ ID NO: 706810 - DNA, 22 bp, Artificial Sequence
  chemically synthesized
attgtaaattatatacatattt

SEQ ID NO: 706811 - DNA, 22 bp, Artificial Sequence
  chemically synthesized
ttgtaaattatatacatatttg

SEQ ID NO: 706812 - DNA, 22 bp, Artificial Sequence
  chemically synthesized
atagtgtgacttcaaatatgta

SEQ ID NO: 706813 - DNA, 22 bp, Artificial Sequence
  chemically synthesized
taatagtgtgacttcaaatatg

SEQ ID NO: 706814 - DNA, 22 bp, Artificial Sequence
  chemically synthesized
taaattatatacatatttgaag

SEQ ID NO: 706815 - DNA, 22 bp, Artificial Sequence
  chemically synthesized
tatacatatttgaagtcacact

SEQ ID NO: 706816 - DNA, 22 bp, Artificial Sequence
  chemically synthesized
gaagtcacactattagaatttc

SEQ ID NO: 706817 - DNA, 22 bp, Artificial Sequence
  chemically synthesized
aagtcacactattagaatttct

SEQ ID NO: 706818 - DNA, 22 bp, Artificial Sequence
  chemically synthesized
aaccaagaaaaaggagaaattc

SEQ ID NO: 706819 - DNA, 22 bp, Artificial Sequence
  chemically synthesized
aaaccaagaaaaaggagaaatt

SEQ ID NO: 706820 - DNA, 22 bp, Artificial Sequence
  chemically synthesized
caacttaaaccaagaaaaagga

SEQ ID NO: 706821 - DNA, 22 bp, Artificial Sequence
  chemically synthesized
ttagaatttctcctttttcttg

SEQ ID NO: 706822 - DNA, 22 bp, Artificial Sequence
  chemically synthesized
tacaacttaaaccaagaaaaag

SEQ ID NO: 706823 - DNA, 22 bp, Artificial Sequence
  chemically synthesized
ctacaacttaaaccaagaaaaa

SEQ ID NO: 706824 - DNA, 22 bp, Artificial Sequence
  chemically synthesized
gaatttctcctttttcttggtt

SEQ ID NO: 706825 - DNA, 22 bp, Artificial Sequence
  chemically synthesized
acttctacaacttaaaccaaga

SEQ ID NO: 706826 - DNA, 22 bp, Artificial Sequence
  chemically synthesized
ctcctttttcttggtttaagtt

SEQ ID NO: 706827 - DNA, 22 bp, Artificial Sequence
  chemically synthesized
attgacttctacaacttaaacc

SEQ ID NO: 706828 - DNA, 22 bp, Artificial Sequence
  chemically synthesized
tcctttttcttggtttaagttg

SEQ ID NO: 706829 - DNA, 22 bp, Artificial Sequence
  chemically synthesized
ctttttcttggtttaagttgta

SEQ ID NO: 706830 - DNA, 22 bp, Artificial Sequence
  chemically synthesized
ctaattgacttctacaacttaa

SEQ ID NO: 706831 - DNA, 22 bp, Artificial Sequence
  chemically synthesized
tttcttggtttaagttgtagaa

SEQ ID NO: 706832 - DNA, 22 bp, Artificial Sequence
  chemically synthesized
ctcctaattgacttctacaact

SEQ ID NO: 706833 - DNA, 22 bp, Artificial Sequence
  chemically synthesized
ttcttggtttaagttgtagaag

SEQ ID NO: 706834 - DNA, 22 bp, Artificial Sequence
  chemically synthesized
tcttggtttaagttgtagaagt

SEQ ID NO: 706835 - DNA, 22 bp, Artificial Sequence
  chemically synthesized
cttggtttaagttgtagaagtc

SEQ ID NO: 706836 - DNA, 22 bp, Artificial Sequence
  chemically synthesized
ctactcctaattgacttctaca

SEQ ID NO: 706837 - DNA, 22 bp, Artificial Sequence
  chemically synthesized
ttggtttaagttgtagaagtca

SEQ ID NO: 706838 - DNA, 22 bp, Artificial Sequence
  chemically synthesized
ggtttaagttgtagaagtcaat

SEQ ID NO: 706839 - DNA, 22 bp, Artificial Sequence
  chemically synthesized
gtttaagttgtagaagtcaatt

SEQ ID NO: 706840 - DNA, 22 bp, Artificial Sequence
  chemically synthesized
aagttgtagaagtcaattagga

SEQ ID NO: 706841 - DNA, 22 bp, Artificial Sequence
  chemically synthesized
atacactgctactcctaattga

SEQ ID NO: 706842 - DNA, 22 bp, Artificial Sequence
  chemically synthesized
agttgtagaagtcaattaggag

SEQ ID NO: 706843 - DNA, 22 bp, Artificial Sequence
  chemically synthesized
aatacactgctactcctaattg

SEQ ID NO: 706844 - DNA, 22 bp, Artificial Sequence
  chemically synthesized
taatacactgctactcctaatt

SEQ ID NO: 706845 - DNA, 22 bp, Artificial Sequence
  chemically synthesized
tagaagtcaattaggagtagca

SEQ ID NO: 706846 - DNA, 22 bp, Artificial Sequence
  chemically synthesized
gttttaatacactgctactcct

SEQ ID NO: 706847 - DNA, 22 bp, Artificial Sequence
  chemically synthesized
tagttttaatacactgctactc

SEQ ID NO: 706848 - DNA, 22 bp, Artificial Sequence
  chemically synthesized
ctagttttaatacactgctact

SEQ ID NO: 706849 - DNA, 22 bp, Artificial Sequence
  chemically synthesized
cttctagttttaatacactgct

SEQ ID NO: 706850 - DNA, 22 bp, Artificial Sequence
  chemically synthesized
acttctagttttaatacactgc

SEQ ID NO: 706851 - DNA, 22 bp, Artificial Sequence
  chemically synthesized
tccttacttctagttttaatac

SEQ ID NO: 706852 - DNA, 22 bp, Artificial Sequence
  chemically synthesized
ggagtagcagtgtattaaaact

SEQ ID NO: 706853 - DNA, 22 bp, Artificial Sequence
  chemically synthesized
gtccttacttctagttttaata

SEQ ID NO: 706854 - DNA, 22 bp, Artificial Sequence
  chemically synthesized
acttgtccttacttctagtttt

SEQ ID NO: 706855 - DNA, 22 bp, Artificial Sequence
  chemically synthesized
atagacactaacttgtccttac

SEQ ID NO: 706856 - DNA, 22 bp, Artificial Sequence
  chemically synthesized
aaactagaagtaaggacaagtt

SEQ ID NO: 706857 - DNA, 22 bp, Artificial Sequence
  chemically synthesized
cgctgatagacactaacttgtc

SEQ ID NO: 706858 - DNA, 22 bp, Artificial Sequence
  chemically synthesized
tccgctgatagacactaacttg

SEQ ID NO: 706859 - DNA, 22 bp, Artificial Sequence
  chemically synthesized
ctccgctgatagacactaactt

SEQ ID NO: 706860 - DNA, 22 bp, Artificial Sequence
  chemically synthesized
gaagtaaggacaagttagtgtc

SEQ ID NO: 706861 - DNA, 22 bp, Artificial Sequence
  chemically synthesized
tgaaatatgacccttctccgct

SEQ ID NO: 706862 - DNA, 22 bp, Artificial Sequence
  chemically synthesized
gtgtctatcagcggagaagggt

SEQ ID NO: 706863 - DNA, 22 bp, Artificial Sequence
  chemically synthesized
tcagcggagaagggtcatattt

SEQ ID NO: 706864 - DNA, 22 bp, Artificial Sequence
  chemically synthesized
agagaaaatgagaagagaaaag

SEQ ID NO: 706865 - DNA, 22 bp, Artificial Sequence
  chemically synthesized
cacaatgcttttctcttctcat

SEQ ID NO: 706866 - DNA, 22 bp, Artificial Sequence
  chemically synthesized
acaatgcttttctcttctcatt

SEQ ID NO: 706867 - DNA, 22 bp, Artificial Sequence
  chemically synthesized
gatctaagagaaaatgagaaga

SEQ ID NO: 706868 - DNA, 22 bp, Artificial Sequence
  chemically synthesized
agatctaagagaaaatgagaag

SEQ ID NO: 706869 - DNA, 22 bp, Artificial Sequence
  chemically synthesized
tcttagatctaagagaaaatga

SEQ ID NO: 706870 - DNA, 22 bp, Artificial Sequence
  chemically synthesized
atcttagatctaagagaaaatg

SEQ ID NO: 706871 - DNA, 22 bp, Artificial Sequence
  chemically synthesized
tatcttagatctaagagaaaat

SEQ ID NO: 706872 - DNA, 22 bp, Artificial Sequence
  chemically synthesized
ttatcttagatctaagagaaaa

SEQ ID NO: 706873 - DNA, 22 bp, Artificial Sequence
  chemically synthesized
ttctcttctcattttctcttag

SEQ ID NO: 706874 - DNA, 22 bp, Artificial Sequence
  chemically synthesized
tctcttctcattttctcttaga

SEQ ID NO: 706875 - DNA, 22 bp, Artificial Sequence
  chemically synthesized
ttttatcttagatctaagagaa

SEQ ID NO: 706876 - DNA, 22 bp, Artificial Sequence
  chemically synthesized
ctcttctcattttctcttagat

SEQ ID NO: 706877 - DNA, 22 bp, Artificial Sequence
  chemically synthesized
cttttatcttagatctaagaga

SEQ ID NO: 706878 - DNA, 22 bp, Artificial Sequence
  chemically synthesized
tcttctcattttctcttagatc

SEQ ID NO: 706879 - DNA, 22 bp, Artificial Sequence
  chemically synthesized
tcttttatcttagatctaagag

SEQ ID NO: 706880 - DNA, 22 bp, Artificial Sequence
  chemically synthesized
ttcttttatcttagatctaaga

SEQ ID NO: 706881 - DNA, 22 bp, Artificial Sequence
  chemically synthesized
ttctcattttctcttagatcta

SEQ ID NO: 706882 - DNA, 22 bp, Artificial Sequence
  chemically synthesized
tttcttttatcttagatctaag

SEQ ID NO: 706883 - DNA, 22 bp, Artificial Sequence
  chemically synthesized
ctcattttctcttagatctaag

SEQ ID NO: 706884 - DNA, 22 bp, Artificial Sequence
  chemically synthesized
tcattttctcttagatctaaga

SEQ ID NO: 706885 - DNA, 22 bp, Artificial Sequence
  chemically synthesized
attttctcttagatctaagata

SEQ ID NO: 706886 - DNA, 22 bp, Artificial Sequence
  chemically synthesized
tctcttagatctaagataaaag

SEQ ID NO: 706887 - DNA, 22 bp, Artificial Sequence
  chemically synthesized
aagaaattttttcttttatctt

SEQ ID NO: 706888 - DNA, 22 bp, Artificial Sequence
  chemically synthesized
ctcttagatctaagataaaaga

SEQ ID NO: 706889 - DNA, 22 bp, Artificial Sequence
  chemically synthesized
tcttagatctaagataaaagaa

SEQ ID NO: 706890 - DNA, 22 bp, Artificial Sequence
  chemically synthesized
ttagatctaagataaaagaaaa

SEQ ID NO: 706891 - DNA, 22 bp, Artificial Sequence
  chemically synthesized
agatctaagataaaagaaaaaa

SEQ ID NO: 706892 - DNA, 22 bp, Artificial Sequence
  chemically synthesized
gatctaagataaaagaaaaaat

SEQ ID NO: 706893 - DNA, 22 bp, Artificial Sequence
  chemically synthesized
catgttaaagaaattttttctt

SEQ ID NO: 706894 - DNA, 22 bp, Artificial Sequence
  chemically synthesized
tacatgttaaagaaattttttc

SEQ ID NO: 706895 - DNA, 22 bp, Artificial Sequence
  chemically synthesized
agataaaagaaaaaatttcttt

SEQ ID NO: 706896 - DNA, 22 bp, Artificial Sequence
  chemically synthesized
gtggcccaatctctacatgtta

SEQ ID NO: 706897 - DNA, 22 bp, Artificial Sequence
  chemically synthesized
ctggtggcccaatctctacatg

SEQ ID NO: 706898 - DNA, 22 bp, Artificial Sequence
  chemically synthesized
cctggtggcccaatctctacat

SEQ ID NO: 706899 - DNA, 22 bp, Artificial Sequence
  chemically synthesized
ttcctggtggcccaatctctac

SEQ ID NO: 706900 - DNA, 22 bp, Artificial Sequence
  chemically synthesized
cttcctggtggcccaatctcta

SEQ ID NO: 706901 - DNA, 22 bp, Artificial Sequence
  chemically synthesized
ctttaacatgtagagattgggc

SEQ ID NO: 706902 - DNA, 22 bp, Artificial Sequence
  chemically synthesized
tttaacatgtagagattgggcc

SEQ ID NO: 706903 - DNA, 22 bp, Artificial Sequence
  chemically synthesized
tttcttcctggtggcccaatct

SEQ ID NO: 706904 - DNA, 22 bp, Artificial Sequence
  chemically synthesized
taacatgtagagattgggccac

SEQ ID NO: 706905 - DNA, 22 bp, Artificial Sequence
  chemically synthesized
aacatgtagagattgggccacc

SEQ ID NO: 706906 - DNA, 22 bp, Artificial Sequence
  chemically synthesized
acatgtagagattgggccacca

SEQ ID NO: 706907 - DNA, 22 bp, Artificial Sequence
  chemically synthesized
actgtttcttcctggtggccca

SEQ ID NO: 706908 - DNA, 22 bp, Artificial Sequence
  chemically synthesized
aaaaaaagaattcactgtttct

SEQ ID NO: 706909 - DNA, 22 bp, Artificial Sequence
  chemically synthesized
ggccaccaggaagaaacagtga

SEQ ID NO: 706910 - DNA, 22 bp, Artificial Sequence
  chemically synthesized
ctaaaaaaaagaattcactgtt

SEQ ID NO: 706911 - DNA, 22 bp, Artificial Sequence
  chemically synthesized
actaaaaaaaagaattcactgt

SEQ ID NO: 706912 - DNA, 22 bp, Artificial Sequence
  chemically synthesized
tactaaaaaaaagaattcactg

SEQ ID NO: 706913 - DNA, 22 bp, Artificial Sequence
  chemically synthesized
ttactaaaaaaaagaattcact

SEQ ID NO: 706914 - DNA, 22 bp, Artificial Sequence
  chemically synthesized
ttttttttagtaaaaggctgcc

SEQ ID NO: 706915 - DNA, 22 bp, Artificial Sequence
  chemically synthesized
tcagaagacagaggcagccttt

SEQ ID NO: 706916 - DNA, 22 bp, Artificial Sequence
  chemically synthesized
atcagaagacagaggcagcctt

SEQ ID NO: 706917 - DNA, 22 bp, Artificial Sequence
  chemically synthesized
ttttttagtaaaaggctgcctc

SEQ ID NO: 706918 - DNA, 22 bp, Artificial Sequence
  chemically synthesized
tttttagtaaaaggctgcctct

SEQ ID NO: 706919 - DNA, 22 bp, Artificial Sequence
  chemically synthesized
ttttagtaaaaggctgcctctg

SEQ ID NO: 706920 - DNA, 22 bp, Artificial Sequence
  chemically synthesized
tttatcagaagacagaggcagc

SEQ ID NO: 706921 - DNA, 22 bp, Artificial Sequence
  chemically synthesized
tttagtaaaaggctgcctctgt

SEQ ID NO: 706922 - DNA, 22 bp, Artificial Sequence
  chemically synthesized
ttagtaaaaggctgcctctgtc

SEQ ID NO: 706923 - DNA, 22 bp, Artificial Sequence
  chemically synthesized
tagtaaaaggctgcctctgtct

SEQ ID NO: 706924 - DNA, 22 bp, Artificial Sequence
  chemically synthesized
ttgtttatcagaagacagaggc

SEQ ID NO: 706925 - DNA, 22 bp, Artificial Sequence
  chemically synthesized
agtaaaaggctgcctctgtctt

SEQ ID NO: 706926 - DNA, 22 bp, Artificial Sequence
  chemically synthesized
gtaaaaggctgcctctgtcttc

SEQ ID NO: 706927 - DNA, 22 bp, Artificial Sequence
  chemically synthesized
tctgttgtttatcagaagacag

SEQ ID NO: 706928 - DNA, 22 bp, Artificial Sequence
  chemically synthesized
ccagctgtctgttgtttatcag

SEQ ID NO: 706929 - DNA, 22 bp, Artificial Sequence
  chemically synthesized
cctctgtcttctgataaacaac

SEQ ID NO: 706930 - DNA, 22 bp, Artificial Sequence
  chemically synthesized
cattaccagctgtctgttgttt

SEQ ID NO: 706931 - DNA, 22 bp, Artificial Sequence
  chemically synthesized
tgtcttctgataaacaacagac

SEQ ID NO: 706932 - DNA, 22 bp, Artificial Sequence
  chemically synthesized
tcttctgataaacaacagacag

SEQ ID NO: 706933 - DNA, 22 bp, Artificial Sequence
  chemically synthesized
ctgataaacaacagacagctgg

SEQ ID NO: 706934 - DNA, 22 bp, Artificial Sequence
  chemically synthesized
gaaattacattaccagctgtct

SEQ ID NO: 706935 - DNA, 22 bp, Artificial Sequence
  chemically synthesized
tgataaacaacagacagctggt

SEQ ID NO: 706936 - DNA, 22 bp, Artificial Sequence
  chemically synthesized
ggaaattacattaccagctgtc

SEQ ID NO: 706937 - DNA, 22 bp, Artificial Sequence
  chemically synthesized
ataaacaacagacagctggtaa

SEQ ID NO: 706938 - DNA, 22 bp, Artificial Sequence
  chemically synthesized
tttggaaattacattaccagct

SEQ ID NO: 706939 - DNA, 22 bp, Artificial Sequence
  chemically synthesized
gaaattatttggaaattacatt

SEQ ID NO: 706940 - DNA, 22 bp, Artificial Sequence
  chemically synthesized
ggaaattatttggaaattacat

SEQ ID NO: 706941 - DNA, 22 bp, Artificial Sequence
  chemically synthesized
tggaaattatttggaaattaca

SEQ ID NO: 706942 - DNA, 22 bp, Artificial Sequence
  chemically synthesized
ccctttggaaattatttggaaa

SEQ ID NO: 706943 - DNA, 22 bp, Artificial Sequence
  chemically synthesized
gtaatgtaatttccaaataatt

SEQ ID NO: 706944 - DNA, 22 bp, Artificial Sequence
  chemically synthesized
ccaaataatttccaaaggggag

SEQ ID NO: 706945 - DNA, 22 bp, Artificial Sequence
  chemically synthesized
caaataatttccaaaggggagt

SEQ ID NO: 706946 - DNA, 22 bp, Artificial Sequence
  chemically synthesized
ccaaaggggagtgtgtgtgtgt

SEQ ID NO: 706947 - DNA, 22 bp, Artificial Sequence
  chemically synthesized
caaaggggagtgtgtgtgtgtg

SEQ ID NO: 706948 - DNA, 22 bp, Artificial Sequence
  chemically synthesized
acacacacacacacacacacac

SEQ ID NO: 706949 - DNA, 22 bp, Artificial Sequence
  chemically synthesized
tcacacacacacacacacacac

SEQ ID NO: 706950 - DNA, 22 bp, Artificial Sequence
  chemically synthesized
tctcacacacacacacacacac

SEQ ID NO: 706951 - DNA, 22 bp, Artificial Sequence
  chemically synthesized
tctctcacacacacacacacac

SEQ ID NO: 706952 - DNA, 22 bp, Artificial Sequence
  chemically synthesized
tctctctcacacacacacacac

SEQ ID NO: 706953 - DNA, 22 bp, Artificial Sequence
  chemically synthesized
tctctctctcacacacacacac

SEQ ID NO: 706954 - DNA, 22 bp, Artificial Sequence
  chemically synthesized
tctctctctctcacacacacac

SEQ ID NO: 706955 - DNA, 22 bp, Artificial Sequence
  chemically synthesized
tctctctctctctcacacacac

SEQ ID NO: 706956 - DNA, 22 bp, Artificial Sequence
  chemically synthesized
tctctctctctctctcacacac

SEQ ID NO: 706957 - DNA, 22 bp, Artificial Sequence
  chemically synthesized
tctctctctctctctctcacac

SEQ ID NO: 706958 - DNA, 22 bp, Artificial Sequence
  chemically synthesized
gcacgtgtgtgcactctctctc

SEQ ID NO: 706959 - DNA, 22 bp, Artificial Sequence
  chemically synthesized
tctcgcacgtgtgtgcactctc

SEQ ID NO: 706960 - DNA, 22 bp, Artificial Sequence
  chemically synthesized
tgtctcgcacgtgtgtgcactc

SEQ ID NO: 706961 - DNA, 22 bp, Artificial Sequence
  chemically synthesized
tctgtctcgcacgtgtgtgcac

SEQ ID NO: 706962 - DNA, 22 bp, Artificial Sequence
  chemically synthesized
tctctgtctcgcacgtgtgtgc

SEQ ID NO: 706963 - DNA, 22 bp, Artificial Sequence
  chemically synthesized
tctctctgtctcgcacgtgtgt

SEQ ID NO: 706964 - DNA, 22 bp, Artificial Sequence
  chemically synthesized
tctctctctgtctcgcacgtgt

SEQ ID NO: 706965 - DNA, 22 bp, Artificial Sequence
  chemically synthesized
tctctctctctgtctcgcacgt

SEQ ID NO: 706966 - DNA, 22 bp, Artificial Sequence
  chemically synthesized
tctctctctctctgtctcgcac

SEQ ID NO: 706967 - DNA, 22 bp, Artificial Sequence
  chemically synthesized
ttctctctctctctctgtctcg

SEQ ID NO: 706968 - DNA, 22 bp, Artificial Sequence
  chemically synthesized
attctctctctctctctgtctc

SEQ ID NO: 706969 - DNA, 22 bp, Artificial Sequence
  chemically synthesized
tcttattctctctctctctctg

SEQ ID NO: 706970 - DNA, 22 bp, Artificial Sequence
  chemically synthesized
atcttattctctctctctctct

SEQ ID NO: 706971 - DNA, 22 bp, Artificial Sequence
  chemically synthesized
tttatcttattctctctctctc

SEQ ID NO: 706972 - DNA, 22 bp, Artificial Sequence
  chemically synthesized
tgtttatcttattctctctctc

SEQ ID NO: 706973 - DNA, 22 bp, Artificial Sequence
  chemically synthesized
tctctgtttatcttattctctc

SEQ ID NO: 706974 - DNA, 22 bp, Artificial Sequence
  chemically synthesized
ctgtctctgtttatcttattct

SEQ ID NO: 706975 - DNA, 22 bp, Artificial Sequence
  chemically synthesized
actgtctctgtttatcttattc

SEQ ID NO: 706976 - DNA, 22 bp, Artificial Sequence
  chemically synthesized
cacccgccagcgtaaacatgct

SEQ ID NO: 706977 - DNA, 22 bp, Artificial Sequence
  chemically synthesized
attgcacccgccagcgtaaaca

SEQ ID NO: 706978 - DNA, 22 bp, Artificial Sequence
  chemically synthesized
ctaattgcacccgccagcgtaa

SEQ ID NO: 706979 - DNA, 22 bp, Artificial Sequence
  chemically synthesized
acgctggcgggtgcaattagta

SEQ ID NO: 706980 - DNA, 22 bp, Artificial Sequence
  chemically synthesized
cgctggcgggtgcaattagtag

SEQ ID NO: 706981 - DNA, 22 bp, Artificial Sequence
  chemically synthesized
gcgggtgcaattagtagttcct

SEQ ID NO: 706982 - DNA, 22 bp, Artificial Sequence
  chemically synthesized
caaagaaaagaaaaataaggag

SEQ ID NO: 706983 - DNA, 22 bp, Artificial Sequence
  chemically synthesized
gtagttcctccttatttttctt

SEQ ID NO: 706984 - DNA, 22 bp, Artificial Sequence
  chemically synthesized
gaaattacaaagaaaagaaaaa

SEQ ID NO: 706985 - DNA, 22 bp, Artificial Sequence
  chemically synthesized
agaaattacaaagaaaagaaaa

SEQ ID NO: 706986 - DNA, 22 bp, Artificial Sequence
  chemically synthesized
ctccttatttttcttttctttg

SEQ ID NO: 706987 - DNA, 22 bp, Artificial Sequence
  chemically synthesized
aagcttagaaattacaaagaaa

SEQ ID NO: 706988 - DNA, 22 bp, Artificial Sequence
  chemically synthesized
cttatttttcttttctttgtaa

SEQ ID NO: 706989 - DNA, 22 bp, Artificial Sequence
  chemically synthesized
ctaaagcttagaaattacaaag

SEQ ID NO: 706990 - DNA, 22 bp, Artificial Sequence
  chemically synthesized
atttttcttttctttgtaattt

SEQ ID NO: 706991 - DNA, 22 bp, Artificial Sequence
  chemically synthesized
tttttcttttctttgtaatttc

SEQ ID NO: 706992 - DNA, 22 bp, Artificial Sequence
  chemically synthesized
ttcttttctttgtaatttctaa

SEQ ID NO: 706993 - DNA, 22 bp, Artificial Sequence
  chemically synthesized
tcttttctttgtaatttctaag

SEQ ID NO: 706994 - DNA, 22 bp, Artificial Sequence
  chemically synthesized
cttttctttgtaatttctaagc

SEQ ID NO: 706995 - DNA, 22 bp, Artificial Sequence
  chemically synthesized
ttttctttgtaatttctaagct

SEQ ID NO: 706996 - DNA, 22 bp, Artificial Sequence
  chemically synthesized
ttctttgtaatttctaagcttt

SEQ ID NO: 706997 - DNA, 22 bp, Artificial Sequence
  chemically synthesized
tctttgtaatttctaagcttta

SEQ ID NO: 706998 - DNA, 22 bp, Artificial Sequence
  chemically synthesized
ctttgtaatttctaagctttag

SEQ ID NO: 706999 - DNA, 22 bp, Artificial Sequence
  chemically synthesized
tttgtaatttctaagctttagg

SEQ ID NO: 707000 - DNA, 22 bp, Artificial Sequence
  chemically synthesized
tgtaatttctaagctttaggag

SEQ ID NO: 707001 - DNA, 22 bp, Artificial Sequence
  chemically synthesized
gtaatttctaagctttaggagc

SEQ ID NO: 707002 - DNA, 22 bp, Artificial Sequence
  chemically synthesized
taatttctaagctttaggagcc

SEQ ID NO: 707003 - DNA, 22 bp, Artificial Sequence
  chemically synthesized
taaataataatagggtggctcc

SEQ ID NO: 707004 - DNA, 22 bp, Artificial Sequence
  chemically synthesized
ctaagctttaggagccacccta

SEQ ID NO: 707005 - DNA, 22 bp, Artificial Sequence
  chemically synthesized
taagctttaggagccaccctat

SEQ ID NO: 707006 - DNA, 22 bp, Artificial Sequence
  chemically synthesized
ctataaataataatagggtggc

SEQ ID NO: 707007 - DNA, 22 bp, Artificial Sequence
  chemically synthesized
agctttaggagccaccctatta

SEQ ID NO: 707008 - DNA, 22 bp, Artificial Sequence
  chemically synthesized
aggttactataaataataatag

SEQ ID NO: 707009 - DNA, 22 bp, Artificial Sequence
  chemically synthesized
taggagccaccctattattatt

SEQ ID NO: 707010 - DNA, 22 bp, Artificial Sequence
  chemically synthesized
caggttactataaataataata

SEQ ID NO: 707011 - DNA, 22 bp, Artificial Sequence
  chemically synthesized
aggagccaccctattattattt

SEQ ID NO: 707012 - DNA, 22 bp, Artificial Sequence
  chemically synthesized
tcaggttactataaataataat

SEQ ID NO: 707013 - DNA, 22 bp, Artificial Sequence
  chemically synthesized
ggagccaccctattattattta

SEQ ID NO: 707014 - DNA, 22 bp, Artificial Sequence
  chemically synthesized
gtaatgtgctttcaggttacta

SEQ ID NO: 707015 - DNA, 22 bp, Artificial Sequence
  chemically synthesized
agtaatgtgctttcaggttact

SEQ ID NO: 707016 - DNA, 22 bp, Artificial Sequence
  chemically synthesized
ttattatttatagtaacctgaa

SEQ ID NO: 707017 - DNA, 22 bp, Artificial Sequence
  chemically synthesized
ttatttatagtaacctgaaagc

SEQ ID NO: 707018 - DNA, 22 bp, Artificial Sequence
  chemically synthesized
tttatagtaacctgaaagcaca

SEQ ID NO: 707019 - DNA, 22 bp, Artificial Sequence
  chemically synthesized
atagtaacctgaaagcacatta

SEQ ID NO: 707020 - DNA, 22 bp, Artificial Sequence
  chemically synthesized
atacatgtttagtaatgtgctt

SEQ ID NO: 707021 - DNA, 22 bp, Artificial Sequence
  chemically synthesized
tagtaacctgaaagcacattac

SEQ ID NO: 707022 - DNA, 22 bp, Artificial Sequence
  chemically synthesized
agttgatacatgtttagtaatg

SEQ ID NO: 707023 - DNA, 22 bp, Artificial Sequence
  chemically synthesized
aaagcacattactaaacatgta

SEQ ID NO: 707024 - DNA, 22 bp, Artificial Sequence
  chemically synthesized
gacaggcctgagttgatacatg

SEQ ID NO: 707025 - DNA, 22 bp, Artificial Sequence
  chemically synthesized
agacaggcctgagttgatacat

SEQ ID NO: 707026 - DNA, 22 bp, Artificial Sequence
  chemically synthesized
tagacaggcctgagttgataca

SEQ ID NO: 707027 - DNA, 22 bp, Artificial Sequence
  chemically synthesized
ttagacaggcctgagttgatac

SEQ ID NO: 707028 - DNA, 22 bp, Artificial Sequence
  chemically synthesized
tttagacaggcctgagttgata

SEQ ID NO: 707029 - DNA, 22 bp, Artificial Sequence
  chemically synthesized
ttttagacaggcctgagttgat

SEQ ID NO: 707030 - DNA, 22 bp, Artificial Sequence
  chemically synthesized
tttttagacaggcctgagttga

SEQ ID NO: 707031 - DNA, 22 bp, Artificial Sequence
  chemically synthesized
ctaaacatgtatcaactcaggc

SEQ ID NO: 707032 - DNA, 22 bp, Artificial Sequence
  chemically synthesized
ttttttagacaggcctgagttg

SEQ ID NO: 707033 - DNA, 22 bp, Artificial Sequence
  chemically synthesized
aacatgtatcaactcaggcctg

SEQ ID NO: 707034 - DNA, 22 bp, Artificial Sequence
  chemically synthesized
atacttttttttagacaggcct

SEQ ID NO: 707035 - DNA, 22 bp, Artificial Sequence
  chemically synthesized
aattgatacttttttttagaca

SEQ ID NO: 707036 - DNA, 22 bp, Artificial Sequence
  chemically synthesized
gaattgatacttttttttagac

SEQ ID NO: 707037 - DNA, 22 bp, Artificial Sequence
  chemically synthesized
aggcctgtctaaaaaaaagtat

SEQ ID NO: 707038 - DNA, 22 bp, Artificial Sequence
  chemically synthesized
aatgaatttgaattgatacttt

SEQ ID NO: 707039 - DNA, 22 bp, Artificial Sequence
  chemically synthesized
tctaaaaaaaagtatcaattca

SEQ ID NO: 707040 - DNA, 22 bp, Artificial Sequence
  chemically synthesized
aaaaaaagtatcaattcaaatt

SEQ ID NO: 707041 - DNA, 22 bp, Artificial Sequence
  chemically synthesized
aggtcatattaaatgaatttga

SEQ ID NO: 707042 - DNA, 22 bp, Artificial Sequence
  chemically synthesized
taaggtcatattaaatgaattt

SEQ ID NO: 707043 - DNA, 22 bp, Artificial Sequence
  chemically synthesized
ctctaaggtcatattaaatgaa

SEQ ID NO: 707044 - DNA, 22 bp, Artificial Sequence
  chemically synthesized
aatattcctctaaggtcatatt

SEQ ID NO: 707045 - DNA, 22 bp, Artificial Sequence
  chemically synthesized
aaatattcctctaaggtcatat

SEQ ID NO: 707046 - DNA, 22 bp, Artificial Sequence
  chemically synthesized
aaattcatttaatatgacctta

SEQ ID NO: 707047 - DNA, 22 bp, Artificial Sequence
  chemically synthesized
taaatattcctctaaggtcata

SEQ ID NO: 707048 - DNA, 22 bp, Artificial Sequence
  chemically synthesized
atttaatatgaccttagaggaa

SEQ ID NO: 707049 - DNA, 22 bp, Artificial Sequence
  chemically synthesized
aatatgaccttagaggaatatt

SEQ ID NO: 707050 - DNA, 22 bp, Artificial Sequence
  chemically synthesized
atatgaccttagaggaatattt

SEQ ID NO: 707051 - DNA, 22 bp, Artificial Sequence
  chemically synthesized
agaggaatatttaaaacatatt

SEQ ID NO: 707052 - DNA, 22 bp, Artificial Sequence
  chemically synthesized
gaggaatatttaaaacatattt

SEQ ID NO: 707053 - DNA, 22 bp, Artificial Sequence
  chemically synthesized
cccccaccaatgaataaaaata

SEQ ID NO: 707054 - DNA, 22 bp, Artificial Sequence
  chemically synthesized
ccccccaccaatgaataaaaat

SEQ ID NO: 707055 - DNA, 22 bp, Artificial Sequence
  chemically synthesized
aaaacatatttttattcattgg

SEQ ID NO: 707056 - DNA, 22 bp, Artificial Sequence
  chemically synthesized
aaacatatttttattcattggt

SEQ ID NO: 707057 - DNA, 22 bp, Artificial Sequence
  chemically synthesized
taaaagcagcttccccccacca

SEQ ID NO: 707058 - DNA, 22 bp, Artificial Sequence
  chemically synthesized
ctataaaagcagcttcccccca

SEQ ID NO: 707059 - DNA, 22 bp, Artificial Sequence
  chemically synthesized
ttattcattggtggggggaagc

SEQ ID NO: 707060 - DNA, 22 bp, Artificial Sequence
  chemically synthesized
tattcattggtggggggaagct

SEQ ID NO: 707061 - DNA, 22 bp, Artificial Sequence
  chemically synthesized
attcattggtggggggaagctg

SEQ ID NO: 707062 - DNA, 22 bp, Artificial Sequence
  chemically synthesized
ctactataaaagcagcttcccc

SEQ ID NO: 707063 - DNA, 22 bp, Artificial Sequence
  chemically synthesized
ttcattggtggggggaagctgc

SEQ ID NO: 707064 - DNA, 22 bp, Artificial Sequence
  chemically synthesized
gctactataaaagcagcttccc

SEQ ID NO: 707065 - DNA, 22 bp, Artificial Sequence
  chemically synthesized
attggtggggggaagctgcttt

SEQ ID NO: 707066 - DNA, 22 bp, Artificial Sequence
  chemically synthesized
gtggggggaagctgcttttata

SEQ ID NO: 707067 - DNA, 22 bp, Artificial Sequence
  chemically synthesized
aagtcacgtatttgctactata

SEQ ID NO: 707068 - DNA, 22 bp, Artificial Sequence
  chemically synthesized
tgaagtcacgtatttgctacta

SEQ ID NO: 707069 - DNA, 22 bp, Artificial Sequence
  chemically synthesized
cttttatagtagcaaatacgtg

SEQ ID NO: 707070 - DNA, 22 bp, Artificial Sequence
  chemically synthesized
ttatagtagcaaatacgtgact

SEQ ID NO: 707071 - DNA, 22 bp, Artificial Sequence
  chemically synthesized
tatagtagcaaatacgtgactt

SEQ ID NO: 707072 - DNA, 22 bp, Artificial Sequence
  chemically synthesized
atagtagcaaatacgtgacttc

SEQ ID NO: 707073 - DNA, 22 bp, Artificial Sequence
  chemically synthesized
tagtagcaaatacgtgacttca

SEQ ID NO: 707074 - DNA, 22 bp, Artificial Sequence
  chemically synthesized
aagcaggacatctctgaagtca

SEQ ID NO: 707075 - DNA, 22 bp, Artificial Sequence
  chemically synthesized
gaagcaggacatctctgaagtc

SEQ ID NO: 707076 - DNA, 22 bp, Artificial Sequence
  chemically synthesized
cagagatgtcctgcttcaaata

SEQ ID NO: 707077 - DNA, 22 bp, Artificial Sequence
  chemically synthesized
agagatgtcctgcttcaaatat

SEQ ID NO: 707078 - DNA, 22 bp, Artificial Sequence
  chemically synthesized
aaaaaaaaaaaaaaatcaccat

SEQ ID NO: 707079 - DNA, 22 bp, Artificial Sequence
  chemically synthesized
aaaaaaaaaaaaaaaatcacca

SEQ ID NO: 707080 - DNA, 22 bp, Artificial Sequence
  chemically synthesized
cttcaaatatggtgattttttt

SEQ ID NO: 707081 - DNA, 22 bp, Artificial Sequence
  chemically synthesized
aatttaaaaaaaaaaaaaaaat

SEQ ID NO: 707082 - DNA, 22 bp, Artificial Sequence
  chemically synthesized
caaatatggtgatttttttttt

SEQ ID NO: 707083 - DNA, 22 bp, Artificial Sequence
  chemically synthesized
aaatatggtgattttttttttt

SEQ ID NO: 707084 - DNA, 22 bp, Artificial Sequence
  chemically synthesized
accctaaatttaaaaaaaaaaa

SEQ ID NO: 707085 - DNA, 22 bp, Artificial Sequence
  chemically synthesized
tttttttttttttaaatttagg

SEQ ID NO: 707086 - DNA, 22 bp, Artificial Sequence
  chemically synthesized
ttttttttttttaaatttaggg

SEQ ID NO: 707087 - DNA, 22 bp, Artificial Sequence
  chemically synthesized
tttttttttttaaatttagggt

SEQ ID NO: 707088 - DNA, 22 bp, Artificial Sequence
  chemically synthesized
ttttttttttaaatttagggtc

SEQ ID NO: 707089 - DNA, 22 bp, Artificial Sequence
  chemically synthesized
tttttttttaaatttagggtca

SEQ ID NO: 707090 - DNA, 22 bp, Artificial Sequence
  chemically synthesized
ttttttttaaatttagggtcag

SEQ ID NO: 707091 - DNA, 22 bp, Artificial Sequence
  chemically synthesized
tttttttaaatttagggtcagg

SEQ ID NO: 707092 - DNA, 22 bp, Artificial Sequence
  chemically synthesized
ttttttaaatttagggtcaggg

SEQ ID NO: 707093 - DNA, 22 bp, Artificial Sequence
  chemically synthesized
tttttaaatttagggtcagggt

SEQ ID NO: 707094 - DNA, 22 bp, Artificial Sequence
  chemically synthesized
ttttaaatttagggtcagggtc

SEQ ID NO: 707095 - DNA, 22 bp, Artificial Sequence
  chemically synthesized
tttaaatttagggtcagggtct

SEQ ID NO: 707096 - DNA, 22 bp, Artificial Sequence
  chemically synthesized
tgtgacagagcaagaccctgac

SEQ ID NO: 707097 - DNA, 22 bp, Artificial Sequence
  chemically synthesized
ttaaatttagggtcagggtctt

SEQ ID NO: 707098 - DNA, 22 bp, Artificial Sequence
  chemically synthesized
taaatttagggtcagggtcttg

SEQ ID NO: 707099 - DNA, 22 bp, Artificial Sequence
  chemically synthesized
aaatttagggtcagggtcttgc

SEQ ID NO: 707100 - DNA, 22 bp, Artificial Sequence
  chemically synthesized
aatttagggtcagggtcttgct

SEQ ID NO: 707101 - DNA, 22 bp, Artificial Sequence
  chemically synthesized
caatctgtgtgacagagcaaga

SEQ ID NO: 707102 - DNA, 22 bp, Artificial Sequence
  chemically synthesized
agggtcagggtcttgctctgtc

SEQ ID NO: 707103 - DNA, 22 bp, Artificial Sequence
  chemically synthesized
gggtcagggtcttgctctgtca

SEQ ID NO: 707104 - DNA, 22 bp, Artificial Sequence
  chemically synthesized
gctctgtcacacagattggagt

SEQ ID NO: 707105 - DNA, 22 bp, Artificial Sequence
  chemically synthesized
ctctgtcacacagattggagtg

SEQ ID NO: 707106 - DNA, 22 bp, Artificial Sequence
  chemically synthesized
tgtcacacagattggagtgcgg

SEQ ID NO: 707107 - DNA, 22 bp, Artificial Sequence
  chemically synthesized
tcacacagattggagtgcgggg

SEQ ID NO: 707108 - DNA, 22 bp, Artificial Sequence
  chemically synthesized
cagtgatccataatccaccccc

SEQ ID NO: 707109 - DNA, 22 bp, Artificial Sequence
  chemically synthesized
gagtgcgggggggggtggatta

SEQ ID NO: 707110 - DNA, 22 bp, Artificial Sequence
  chemically synthesized
agcccaagaggtcaaggctgca

SEQ ID NO: 707111 - DNA, 22 bp, Artificial Sequence
  chemically synthesized
gagcccaagaggtcaaggctgc

SEQ ID NO: 707112 - DNA, 22 bp, Artificial Sequence
  chemically synthesized
tggatcactgcagccttgacct

SEQ ID NO: 707113 - DNA, 22 bp, Artificial Sequence
  chemically synthesized
cagccttgacctcttgggctca

SEQ ID NO: 707114 - DNA, 22 bp, Artificial Sequence
  chemically synthesized
aggcaggaggatcacttgagcc

SEQ ID NO: 707115 - DNA, 22 bp, Artificial Sequence
  chemically synthesized
gacctcttgggctcaagtgatc

SEQ ID NO: 707116 - DNA, 22 bp, Artificial Sequence
  chemically synthesized
acctcttgggctcaagtgatcc

SEQ ID NO: 707117 - DNA, 22 bp, Artificial Sequence
  chemically synthesized
ggaaactgaggcaggaggatca

SEQ ID NO: 707118 - DNA, 22 bp, Artificial Sequence
  chemically synthesized
ttgggctcaagtgatcctcctg

SEQ ID NO: 707119 - DNA, 22 bp, Artificial Sequence
  chemically synthesized
gggaaactgaggcaggaggatc

SEQ ID NO: 707120 - DNA, 22 bp, Artificial Sequence
  chemically synthesized
tgggaaactgaggcaggaggat

SEQ ID NO: 707121 - DNA, 22 bp, Artificial Sequence
  chemically synthesized
gggctcaagtgatcctcctgcc

SEQ ID NO: 707122 - DNA, 22 bp, Artificial Sequence
  chemically synthesized
ggctcaagtgatcctcctgcct

SEQ ID NO: 707123 - DNA, 22 bp, Artificial Sequence
  chemically synthesized
tttgggaaactgaggcaggagg

SEQ ID NO: 707124 - DNA, 22 bp, Artificial Sequence
  chemically synthesized
aagtgatcctcctgcctcagtt

SEQ ID NO: 707125 - DNA, 22 bp, Artificial Sequence
  chemically synthesized
taatcccaattctttgggaaac

SEQ ID NO: 707126 - DNA, 22 bp, Artificial Sequence
  chemically synthesized
ctgcctcagtttcccaaagaat

SEQ ID NO: 707127 - DNA, 22 bp, Artificial Sequence
  chemically synthesized
cctcagtttcccaaagaattgg

SEQ ID NO: 707128 - DNA, 22 bp, Artificial Sequence
  chemically synthesized
atgcctataatcccaattcttt

SEQ ID NO: 707129 - DNA, 22 bp, Artificial Sequence
  chemically synthesized
agtttcccaaagaattgggatt

SEQ ID NO: 707130 - DNA, 22 bp, Artificial Sequence
  chemically synthesized
cccaaagaattgggattatagg

SEQ ID NO: 707131 - DNA, 22 bp, Artificial Sequence
  chemically synthesized
ccaaagaattgggattataggc

SEQ ID NO: 707132 - DNA, 22 bp, Artificial Sequence
  chemically synthesized
ggcatggtgtggctcatgccta

SEQ ID NO: 707133 - DNA, 22 bp, Artificial Sequence
  chemically synthesized
agctaggcatggtgtggctcat

SEQ ID NO: 707134 - DNA, 22 bp, Artificial Sequence
  chemically synthesized
ggattataggcatgagccacac

SEQ ID NO: 707135 - DNA, 22 bp, Artificial Sequence
  chemically synthesized
gagctaggcatggtgtggctca

SEQ ID NO: 707136 - DNA, 22 bp, Artificial Sequence
  chemically synthesized
taggcatgagccacaccatgcc

SEQ ID NO: 707137 - DNA, 22 bp, Artificial Sequence
  chemically synthesized
ggtgtgccatccaaaccgtatt

SEQ ID NO: 707138 - DNA, 22 bp, Artificial Sequence
  chemically synthesized
gctcaaatacggtttggatggc

SEQ ID NO: 707139 - DNA, 22 bp, Artificial Sequence
  chemically synthesized
aaatacggtttggatggcacac

SEQ ID NO: 707140 - DNA, 22 bp, Artificial Sequence
  chemically synthesized
caccagaaattgggtgtgccat

SEQ ID NO: 707141 - DNA, 22 bp, Artificial Sequence
  chemically synthesized
gaaaattgcaccagaaattggg

SEQ ID NO: 707142 - DNA, 22 bp, Artificial Sequence
  chemically synthesized
ggatggcacacccaatttctgg

SEQ ID NO: 707143 - DNA, 22 bp, Artificial Sequence
  chemically synthesized
tagaaaattgcaccagaaattg

SEQ ID NO: 707144 - DNA, 22 bp, Artificial Sequence
  chemically synthesized
gatggcacacccaatttctggt

SEQ ID NO: 707145 - DNA, 22 bp, Artificial Sequence
  chemically synthesized
cctctagaaaattgcaccagaa

SEQ ID NO: 707146 - DNA, 22 bp, Artificial Sequence
  chemically synthesized
acctctagaaaattgcaccaga

SEQ ID NO: 707147 - DNA, 22 bp, Artificial Sequence
  chemically synthesized
ccaaacttacctctagaaaatt

SEQ ID NO: 707148 - DNA, 22 bp, Artificial Sequence
  chemically synthesized
ctggtgcaattttctagaggta

SEQ ID NO: 707149 - DNA, 22 bp, Artificial Sequence
  chemically synthesized
tggtgcaattttctagaggtaa

SEQ ID NO: 707150 - DNA, 22 bp, Artificial Sequence
  chemically synthesized
gtgcaattttctagaggtaagt

SEQ ID NO: 707151 - DNA, 22 bp, Artificial Sequence
  chemically synthesized
aagtgtattgccaaacttacct

SEQ ID NO: 707152 - DNA, 22 bp, Artificial Sequence
  chemically synthesized
caagtgtattgccaaacttacc

SEQ ID NO: 707153 - DNA, 22 bp, Artificial Sequence
  chemically synthesized
tcaagtgtattgccaaacttac

SEQ ID NO: 707154 - DNA, 22 bp, Artificial Sequence
  chemically synthesized
ttcaagtgtattgccaaactta

SEQ ID NO: 707155 - DNA, 22 bp, Artificial Sequence
  chemically synthesized
tctagaggtaagtttggcaata

SEQ ID NO: 707156 - DNA, 22 bp, Artificial Sequence
  chemically synthesized
ctagaggtaagtttggcaatac

SEQ ID NO: 707157 - DNA, 22 bp, Artificial Sequence
  chemically synthesized
tagaggtaagtttggcaataca

SEQ ID NO: 707158 - DNA, 22 bp, Artificial Sequence
  chemically synthesized
gaggtaagtttggcaatacact

SEQ ID NO: 707159 - DNA, 22 bp, Artificial Sequence
  chemically synthesized
gtaagccttttcaagtgtattg

SEQ ID NO: 707160 - DNA, 22 bp, Artificial Sequence
  chemically synthesized
cattcgtaagccttttcaagtg

SEQ ID NO: 707161 - DNA, 22 bp, Artificial Sequence
  chemically synthesized
acattcgtaagccttttcaagt

SEQ ID NO: 707162 - DNA, 22 bp, Artificial Sequence
  chemically synthesized
ggcaatacacttgaaaaggctt

SEQ ID NO: 707163 - DNA, 22 bp, Artificial Sequence
  chemically synthesized
gcaatacacttgaaaaggctta

SEQ ID NO: 707164 - DNA, 22 bp, Artificial Sequence
  chemically synthesized
aagaatgtttacattcgtaagc

SEQ ID NO: 707165 - DNA, 22 bp, Artificial Sequence
  chemically synthesized
gaaaaggcttacgaatgtaaac

SEQ ID NO: 707166 - DNA, 22 bp, Artificial Sequence
  chemically synthesized
aaaaggcttacgaatgtaaaca

SEQ ID NO: 707167 - DNA, 22 bp, Artificial Sequence
  chemically synthesized
tcatgttaaagaatgtttacat

SEQ ID NO: 707168 - DNA, 22 bp, Artificial Sequence
  chemically synthesized
acgaatgtaaacattctttaac

SEQ ID NO: 707169 - DNA, 22 bp, Artificial Sequence
  chemically synthesized
cgaatgtaaacattctttaaca

SEQ ID NO: 707170 - DNA, 22 bp, Artificial Sequence
  chemically synthesized
aaggtggaattgtcatgttaaa

SEQ ID NO: 707171 - DNA, 22 bp, Artificial Sequence
  chemically synthesized
tttaacatgacaattccacctt

SEQ ID NO: 707172 - DNA, 22 bp, Artificial Sequence
  chemically synthesized
taacatgacaattccaccttta

SEQ ID NO: 707173 - DNA, 22 bp, Artificial Sequence
  chemically synthesized
aacatgacaattccacctttag

SEQ ID NO: 707174 - DNA, 22 bp, Artificial Sequence
  chemically synthesized
caggataaatgcctaaaggtgg

SEQ ID NO: 707175 - DNA, 22 bp, Artificial Sequence
  chemically synthesized
acatgacaattccacctttagg

SEQ ID NO: 707176 - DNA, 22 bp, Artificial Sequence
  chemically synthesized
tacaggataaatgcctaaaggt

SEQ ID NO: 707177 - DNA, 22 bp, Artificial Sequence
  chemically synthesized
ctacaggataaatgcctaaagg

SEQ ID NO: 707178 - DNA, 22 bp, Artificial Sequence
  chemically synthesized
tctacaggataaatgcctaaag

SEQ ID NO: 707179 - DNA, 22 bp, Artificial Sequence
  chemically synthesized
tttctacaggataaatgcctaa

SEQ ID NO: 707180 - DNA, 22 bp, Artificial Sequence
  chemically synthesized
agattctttctacaggataaat

SEQ ID NO: 707181 - DNA, 22 bp, Artificial Sequence
  chemically synthesized
cacctttaggcatttatcctgt

SEQ ID NO: 707182 - DNA, 22 bp, Artificial Sequence
  chemically synthesized
taggcatttatcctgtagaaag

SEQ ID NO: 707183 - DNA, 22 bp, Artificial Sequence
  chemically synthesized
aggcatttatcctgtagaaaga

SEQ ID NO: 707184 - DNA, 22 bp, Artificial Sequence
  chemically synthesized
ggcatttatcctgtagaaagaa

SEQ ID NO: 707185 - DNA, 22 bp, Artificial Sequence
  chemically synthesized
caaatatctcagattctttcta

SEQ ID NO: 707186 - DNA, 22 bp, Artificial Sequence
  chemically synthesized
acaaatatctcagattctttct

SEQ ID NO: 707187 - DNA, 22 bp, Artificial Sequence
  chemically synthesized
tacaaatatctcagattctttc

SEQ ID NO: 707188 - DNA, 22 bp, Artificial Sequence
  chemically synthesized
atcctgtagaaagaatctgaga

SEQ ID NO: 707189 - DNA, 22 bp, Artificial Sequence
  chemically synthesized
tcctgtagaaagaatctgagat

SEQ ID NO: 707190 - DNA, 22 bp, Artificial Sequence
  chemically synthesized
tacctttacaaatatctcagat

SEQ ID NO: 707191 - DNA, 22 bp, Artificial Sequence
  chemically synthesized
atacctttacaaatatctcaga

SEQ ID NO: 707192 - DNA, 22 bp, Artificial Sequence
  chemically synthesized
tatacctttacaaatatctcag

SEQ ID NO: 707193 - DNA, 22 bp, Artificial Sequence
  chemically synthesized
ttatacctttacaaatatctca

SEQ ID NO: 707194 - DNA, 22 bp, Artificial Sequence
  chemically synthesized
tagaaagaatctgagatatttg

SEQ ID NO: 707195 - DNA, 22 bp, Artificial Sequence
  chemically synthesized
tttatacctttacaaatatctc

SEQ ID NO: 707196 - DNA, 22 bp, Artificial Sequence
  chemically synthesized
atatcctttttatacctttaca

SEQ ID NO: 707197 - DNA, 22 bp, Artificial Sequence
  chemically synthesized
agatatttgtaaaggtataaaa

SEQ ID NO: 707198 - DNA, 22 bp, Artificial Sequence
  chemically synthesized
tggctaatatcctttttatacc

SEQ ID NO: 707199 - DNA, 22 bp, Artificial Sequence
  chemically synthesized
gtaaaggtataaaaaggatatt

SEQ ID NO: 707200 - DNA, 22 bp, Artificial Sequence
  chemically synthesized
taaaggtataaaaaggatatta

SEQ ID NO: 707201 - DNA, 22 bp, Artificial Sequence
  chemically synthesized
tatcgagcattatggctaatat

SEQ ID NO: 707202 - DNA, 22 bp, Artificial Sequence
  chemically synthesized
ttatatcgagcattatggctaa

SEQ ID NO: 707203 - DNA, 22 bp, Artificial Sequence
  chemically synthesized
attatatcgagcattatggcta

SEQ ID NO: 707204 - DNA, 22 bp, Artificial Sequence
  chemically synthesized
tattatatcgagcattatggct

SEQ ID NO: 707205 - DNA, 22 bp, Artificial Sequence
  chemically synthesized
acaatctttattatatcgagca

SEQ ID NO: 707206 - DNA, 22 bp, Artificial Sequence
  chemically synthesized
cacaatctttattatatcgagc

SEQ ID NO: 707207 - DNA, 22 bp, Artificial Sequence
  chemically synthesized
tttcacaatctttattatatcg

SEQ ID NO: 707208 - DNA, 22 bp, Artificial Sequence
  chemically synthesized
gccataatgctcgatataataa

SEQ ID NO: 707209 - DNA, 22 bp, Artificial Sequence
  chemically synthesized
gatataataaagattgtgaaat

SEQ ID NO: 707210 - DNA, 22 bp, Artificial Sequence
  chemically synthesized
aatataaagattatttcacaat

SEQ ID NO: 707211 - DNA, 22 bp, Artificial Sequence
  chemically synthesized
ctcaatataaagattatttcac

SEQ ID NO: 707212 - DNA, 22 bp, Artificial Sequence
  chemically synthesized
aattgctcaatataaagattat

SEQ ID NO: 707213 - DNA, 22 bp, Artificial Sequence
  chemically synthesized
taaattgctcaatataaagatt

SEQ ID NO: 707214 - DNA, 22 bp, Artificial Sequence
  chemically synthesized
tgaaataatctttatattgagc

SEQ ID NO: 707215 - DNA, 22 bp, Artificial Sequence
  chemically synthesized
ccaacacaattctaaattgctc

SEQ ID NO: 707216 - DNA, 22 bp, Artificial Sequence
  chemically synthesized
accaacacaattctaaattgct

SEQ ID NO: 707217 - DNA, 22 bp, Artificial Sequence
  chemically synthesized
tatattgagcaatttagaattg

SEQ ID NO: 707218 - DNA, 22 bp, Artificial Sequence
  chemically synthesized
atattgagcaatttagaattgt

SEQ ID NO: 707219 - DNA, 22 bp, Artificial Sequence
  chemically synthesized
tattgagcaatttagaattgtg

SEQ ID NO: 707220 - DNA, 22 bp, Artificial Sequence
  chemically synthesized
taccaaatttaccaacacaatt

SEQ ID NO: 707221 - DNA, 22 bp, Artificial Sequence
  chemically synthesized
agcaatttagaattgtgttggt

SEQ ID NO: 707222 - DNA, 22 bp, Artificial Sequence
  chemically synthesized
tggctgtaccaaatttaccaac

SEQ ID NO: 707223 - DNA, 22 bp, Artificial Sequence
  chemically synthesized
tgtggctgtaccaaatttacca

SEQ ID NO: 707224 - DNA, 22 bp, Artificial Sequence
  chemically synthesized
ctgtggctgtaccaaatttacc

SEQ ID NO: 707225 - DNA, 22 bp, Artificial Sequence
  chemically synthesized
agaattgtgttggtaaatttgg

SEQ ID NO: 707226 - DNA, 22 bp, Artificial Sequence
  chemically synthesized
gaattgtgttggtaaatttggt

SEQ ID NO: 707227 - DNA, 22 bp, Artificial Sequence
  chemically synthesized
ttctgtggctgtaccaaattta

SEQ ID NO: 707228 - DNA, 22 bp, Artificial Sequence
  chemically synthesized
tcttctgtggctgtaccaaatt

SEQ ID NO: 707229 - DNA, 22 bp, Artificial Sequence
  chemically synthesized
tgttggtaaatttggtacagcc

SEQ ID NO: 707230 - DNA, 22 bp, Artificial Sequence
  chemically synthesized
atactctcttctgtggctgtac

SEQ ID NO: 707231 - DNA, 22 bp, Artificial Sequence
  chemically synthesized
gtaaatttggtacagccacaga

SEQ ID NO: 707232 - DNA, 22 bp, Artificial Sequence
  chemically synthesized
gctaatactctcttctgtggct

SEQ ID NO: 707233 - DNA, 22 bp, Artificial Sequence
  chemically synthesized
ggtacagccacagaagagagta

SEQ ID NO: 707234 - DNA, 22 bp, Artificial Sequence
  chemically synthesized
atgactggctaatactctcttc

SEQ ID NO: 707235 - DNA, 22 bp, Artificial Sequence
  chemically synthesized
gtacagccacagaagagagtat

SEQ ID NO: 707236 - DNA, 22 bp, Artificial Sequence
  chemically synthesized
taatgactggctaatactctct

SEQ ID NO: 707237 - DNA, 22 bp, Artificial Sequence
  chemically synthesized
ctaatgactggctaatactctc

SEQ ID NO: 707238 - DNA, 22 bp, Artificial Sequence
  chemically synthesized
tctaatgactggctaatactct

SEQ ID NO: 707239 - DNA, 22 bp, Artificial Sequence
  chemically synthesized
ttctaatgactggctaatactc

SEQ ID NO: 707240 - DNA, 22 bp, Artificial Sequence
  chemically synthesized
agagtaatttttctaatgactg

SEQ ID NO: 707241 - DNA, 22 bp, Artificial Sequence
  chemically synthesized
cagagtaatttttctaatgact

SEQ ID NO: 707242 - DNA, 22 bp, Artificial Sequence
  chemically synthesized
ttcagagtaatttttctaatga

SEQ ID NO: 707243 - DNA, 22 bp, Artificial Sequence
  chemically synthesized
cttcagagtaatttttctaatg

SEQ ID NO: 707244 - DNA, 22 bp, Artificial Sequence
  chemically synthesized
ttcttcagagtaatttttctaa

SEQ ID NO: 707245 - DNA, 22 bp, Artificial Sequence
  chemically synthesized
gccagtcattagaaaaattact

SEQ ID NO: 707246 - DNA, 22 bp, Artificial Sequence
  chemically synthesized
aatattcttcttcagagtaatt

SEQ ID NO: 707247 - DNA, 22 bp, Artificial Sequence
  chemically synthesized
aaatattcttcttcagagtaat

SEQ ID NO: 707248 - DNA, 22 bp, Artificial Sequence
  chemically synthesized
gaaaaattactctgaagaagaa

SEQ ID NO: 707249 - DNA, 22 bp, Artificial Sequence
  chemically synthesized
gtgtgtttaaatattcttcttc

SEQ ID NO: 707250 - DNA, 22 bp, Artificial Sequence
  chemically synthesized
cgtgtgtttaaatattcttctt

SEQ ID NO: 707251 - DNA, 22 bp, Artificial Sequence
  chemically synthesized
tcgtgtgtttaaatattcttct

SEQ ID NO: 707252 - DNA, 22 bp, Artificial Sequence
  chemically synthesized
ctctgaagaagaatatttaaac

SEQ ID NO: 707253 - DNA, 22 bp, Artificial Sequence
  chemically synthesized
caatattttcgtgtgtttaaat

SEQ ID NO: 707254 - DNA, 22 bp, Artificial Sequence
  chemically synthesized
tgaagaagaatatttaaacaca

SEQ ID NO: 707255 - DNA, 22 bp, Artificial Sequence
  chemically synthesized
ccaatattttcgtgtgtttaaa

SEQ ID NO: 707256 - DNA, 22 bp, Artificial Sequence
  chemically synthesized
tccaatattttcgtgtgtttaa

SEQ ID NO: 707257 - DNA, 22 bp, Artificial Sequence
  chemically synthesized
aagaagaatatttaaacacacg

SEQ ID NO: 707258 - DNA, 22 bp, Artificial Sequence
  chemically synthesized
tctttccaatattttcgtgtgt

SEQ ID NO: 707259 - DNA, 22 bp, Artificial Sequence
  chemically synthesized
aaactatctttccaatattttc

SEQ ID NO: 707260 - DNA, 22 bp, Artificial Sequence
  chemically synthesized
aaaactatctttccaatatttt

SEQ ID NO: 707261 - DNA, 22 bp, Artificial Sequence
  chemically synthesized
aaacacacgaaaatattggaaa

SEQ ID NO: 707262 - DNA, 22 bp, Artificial Sequence
  chemically synthesized
aacacacgaaaatattggaaag

SEQ ID NO: 707263 - DNA, 22 bp, Artificial Sequence
  chemically synthesized
ccttaaaactatctttccaata

SEQ ID NO: 707264 - DNA, 22 bp, Artificial Sequence
  chemically synthesized
cccttaaaactatctttccaat

SEQ ID NO: 707265 - DNA, 22 bp, Artificial Sequence
  chemically synthesized
tcccttaaaactatctttccaa

SEQ ID NO: 707266 - DNA, 22 bp, Artificial Sequence
  chemically synthesized
ttcccttaaaactatctttcca

SEQ ID NO: 707267 - DNA, 22 bp, Artificial Sequence
  chemically synthesized
tttcccttaaaactatctttcc

SEQ ID NO: 707268 - DNA, 22 bp, Artificial Sequence
  chemically synthesized
ttttcccttaaaactatctttc

SEQ ID NO: 707269 - DNA, 22 bp, Artificial Sequence
  chemically synthesized
cttttttcccttaaaactatct

SEQ ID NO: 707270 - DNA, 22 bp, Artificial Sequence
  chemically synthesized
tgagctgcttttttcccttaaa

SEQ ID NO: 707271 - DNA, 22 bp, Artificial Sequence
  chemically synthesized
atgagctgcttttttcccttaa

SEQ ID NO: 707272 - DNA, 22 bp, Artificial Sequence
  chemically synthesized
gaaagatagttttaagggaaaa

SEQ ID NO: 707273 - DNA, 22 bp, Artificial Sequence
  chemically synthesized
tatgagctgcttttttccctta

SEQ ID NO: 707274 - DNA, 22 bp, Artificial Sequence
  chemically synthesized
cagttttatgagctgctttttt

SEQ ID NO: 707275 - DNA, 22 bp, Artificial Sequence
  chemically synthesized
taagggaaaaaagcagctcata

SEQ ID NO: 707276 - DNA, 22 bp, Artificial Sequence
  chemically synthesized
aagggaaaaaagcagctcataa

SEQ ID NO: 707277 - DNA, 22 bp, Artificial Sequence
  chemically synthesized
agggaaaaaagcagctcataaa

SEQ ID NO: 707278 - DNA, 22 bp, Artificial Sequence
  chemically synthesized
ataaaactgtagcatgttttta

SEQ ID NO: 707279 - DNA, 22 bp, Artificial Sequence
  chemically synthesized
aaccatgcgcagataaaaacat

SEQ ID NO: 707280 - DNA, 22 bp, Artificial Sequence
  chemically synthesized
aaaccatgcgcagataaaaaca

SEQ ID NO: 707281 - DNA, 22 bp, Artificial Sequence
  chemically synthesized
taaaccatgcgcagataaaaac

SEQ ID NO: 707282 - DNA, 22 bp, Artificial Sequence
  chemically synthesized
ttaaaccatgcgcagataaaaa

SEQ ID NO: 707283 - DNA, 22 bp, Artificial Sequence
  chemically synthesized
ttttaaaccatgcgcagataaa

SEQ ID NO: 707284 - DNA, 22 bp, Artificial Sequence
  chemically synthesized
cttttaaaccatgcgcagataa

SEQ ID NO: 707285 - DNA, 22 bp, Artificial Sequence
  chemically synthesized
tcttttaaaccatgcgcagata

SEQ ID NO: 707286 - DNA, 22 bp, Artificial Sequence
  chemically synthesized
tagcatgtttttatctgcgcat

SEQ ID NO: 707287 - DNA, 22 bp, Artificial Sequence
  chemically synthesized
ttcttttaaaccatgcgcagat

SEQ ID NO: 707288 - DNA, 22 bp, Artificial Sequence
  chemically synthesized
ttttcttttaaaccatgcgcag

SEQ ID NO: 707289 - DNA, 22 bp, Artificial Sequence
  chemically synthesized
tcttttcttttaaaccatgcgc

SEQ ID NO: 707290 - DNA, 22 bp, Artificial Sequence
  chemically synthesized
tctcttttcttttaaaccatgc

SEQ ID NO: 707291 - DNA, 22 bp, Artificial Sequence
  chemically synthesized
ttatctgcgcatggtttaaaag

SEQ ID NO: 707292 - DNA, 22 bp, Artificial Sequence
  chemically synthesized
tatctgcgcatggtttaaaaga

SEQ ID NO: 707293 - DNA, 22 bp, Artificial Sequence
  chemically synthesized
atctgcgcatggtttaaaagaa

SEQ ID NO: 707294 - DNA, 22 bp, Artificial Sequence
  chemically synthesized
tctgcgcatggtttaaaagaaa

SEQ ID NO: 707295 - DNA, 22 bp, Artificial Sequence
  chemically synthesized
cgcatggtttaaaagaaaagag

SEQ ID NO: 707296 - DNA, 22 bp, Artificial Sequence
  chemically synthesized
aaaagaaaagagagaggccggg

SEQ ID NO: 707297 - DNA, 22 bp, Artificial Sequence
  chemically synthesized
aaagaaaagagagaggccgggc

SEQ ID NO: 707298 - DNA, 22 bp, Artificial Sequence
  chemically synthesized
caggcatgagccaccacgcccg

SEQ ID NO: 707299 - DNA, 22 bp, Artificial Sequence
  chemically synthesized
agattacaggcatgagccacca

SEQ ID NO: 707300 - DNA, 22 bp, Artificial Sequence
  chemically synthesized
ccaaagtgttgagattacaggc

SEQ ID NO: 707301 - DNA, 22 bp, Artificial Sequence
  chemically synthesized
aggcctcccaaagtgttgagat

SEQ ID NO: 707302 - DNA, 22 bp, Artificial Sequence
  chemically synthesized
atgcctgtaatctcaacacttt

SEQ ID NO: 707303 - DNA, 22 bp, Artificial Sequence
  chemically synthesized
taatctcaacactttgggaggc

SEQ ID NO: 707304 - DNA, 22 bp, Artificial Sequence
  chemically synthesized
aacactttgggaggcctcagtg

SEQ ID NO: 707305 - DNA, 22 bp, Artificial Sequence
  chemically synthesized
aagtaatccacccactgaggcc

SEQ ID NO: 707306 - DNA, 22 bp, Artificial Sequence
  chemically synthesized
tgggaggcctcagtgggtggat

SEQ ID NO: 707307 - DNA, 22 bp, Artificial Sequence
  chemically synthesized
tggcctcaagtaatccacccac

SEQ ID NO: 707308 - DNA, 22 bp, Artificial Sequence
  chemically synthesized
gggaggcctcagtgggtggatt

SEQ ID NO: 707309 - DNA, 22 bp, Artificial Sequence
  chemically synthesized
gtggcctcaagtaatccaccca

SEQ ID NO: 707310 - DNA, 22 bp, Artificial Sequence
  chemically synthesized
ggaggcctcagtgggtggatta

SEQ ID NO: 707311 - DNA, 22 bp, Artificial Sequence
  chemically synthesized
gaacttgtggcctcaagtaatc

SEQ ID NO: 707312 - DNA, 22 bp, Artificial Sequence
  chemically synthesized
agtgggtggattacttgaggcc

SEQ ID NO: 707313 - DNA, 22 bp, Artificial Sequence
  chemically synthesized
gtctcgaacttgtggcctcaag

SEQ ID NO: 707314 - DNA, 22 bp, Artificial Sequence
  chemically synthesized
gccaggctggtctcgaacttgt

SEQ ID NO: 707315 - DNA, 22 bp, Artificial Sequence
  chemically synthesized
cttgaggccacaagttcgagac

SEQ ID NO: 707316 - DNA, 22 bp, Artificial Sequence
  chemically synthesized
tgttggccaggctggtctcgaa

SEQ ID NO: 707317 - DNA, 22 bp, Artificial Sequence
  chemically synthesized
gaggccacaagttcgagaccag

SEQ ID NO: 707318 - DNA, 22 bp, Artificial Sequence
  chemically synthesized
aggccacaagttcgagaccagc

SEQ ID NO: 707319 - DNA, 22 bp, Artificial Sequence
  chemically synthesized
actatgttggccaggctggtct

SEQ ID NO: 707320 - DNA, 22 bp, Artificial Sequence
  chemically synthesized
cactatgttggccaggctggtc

SEQ ID NO: 707321 - DNA, 22 bp, Artificial Sequence
  chemically synthesized
gagaccagcctggccaacatag

SEQ ID NO: 707322 - DNA, 22 bp, Artificial Sequence
  chemically synthesized
gtagagacggggtttcactatg

SEQ ID NO: 707323 - DNA, 22 bp, Artificial Sequence
  chemically synthesized
agtagagacggggtttcactat

SEQ ID NO: 707324 - DNA, 22 bp, Artificial Sequence
  chemically synthesized
tagtagagacggggtttcacta

SEQ ID NO: 707325 - DNA, 22 bp, Artificial Sequence
  chemically synthesized
ttagtagagacggggtttcact

SEQ ID NO: 707326 - DNA, 22 bp, Artificial Sequence
  chemically synthesized
gccaacatagtgaaaccccgtc

SEQ ID NO: 707327 - DNA, 22 bp, Artificial Sequence
  chemically synthesized
tatttttagtagagacggggtt

SEQ ID NO: 707328 - DNA, 22 bp, Artificial Sequence
  chemically synthesized
gtatttttagtagagacggggt

SEQ ID NO: 707329 - DNA, 22 bp, Artificial Sequence
  chemically synthesized
tgtatttttagtagagacgggg

SEQ ID NO: 707330 - DNA, 22 bp, Artificial Sequence
  chemically synthesized
ttgtatttttagtagagacggg

SEQ ID NO: 707331 - DNA, 22 bp, Artificial Sequence
  chemically synthesized
tttgtatttttagtagagacgg

SEQ ID NO: 707332 - DNA, 22 bp, Artificial Sequence
  chemically synthesized
attttttgtatttttagtagag

SEQ ID NO: 707333 - DNA, 22 bp, Artificial Sequence
  chemically synthesized
gctaattttttgtatttttagt

SEQ ID NO: 707334 - DNA, 22 bp, Artificial Sequence
  chemically synthesized
ggctaattttttgtatttttag

SEQ ID NO: 707335 - DNA, 22 bp, Artificial Sequence
  chemically synthesized
tactaaaaatacaaaaaattag

SEQ ID NO: 707336 - DNA, 22 bp, Artificial Sequence
  chemically synthesized
ctaaaaatacaaaaaattagcc

SEQ ID NO: 707337 - DNA, 22 bp, Artificial Sequence
  chemically synthesized
aaaatacaaaaaattagccaag

SEQ ID NO: 707338 - DNA, 22 bp, Artificial Sequence
  chemically synthesized
caggaatacgccaccacgcttg

SEQ ID NO: 707339 - DNA, 22 bp, Artificial Sequence
  chemically synthesized
ggattacaggaatacgccacca

SEQ ID NO: 707340 - DNA, 22 bp, Artificial Sequence
  chemically synthesized
gccaagcgtggtggcgtattcc

SEQ ID NO: 707341 - DNA, 22 bp, Artificial Sequence
  chemically synthesized
ccgagtagctgggattacagga

SEQ ID NO: 707342 - DNA, 22 bp, Artificial Sequence
  chemically synthesized
agcctcccgagtagctgggatt

SEQ ID NO: 707343 - DNA, 22 bp, Artificial Sequence
  chemically synthesized
atgactcagcctcccgagtagc

SEQ ID NO: 707344 - DNA, 22 bp, Artificial Sequence
  chemically synthesized
ctgtaatcccagctactcggga

SEQ ID NO: 707345 - DNA, 22 bp, Artificial Sequence
  chemically synthesized
tcatgactcagcctcccgagta

SEQ ID NO: 707346 - DNA, 22 bp, Artificial Sequence
  chemically synthesized
taatcccagctactcgggaggc

SEQ ID NO: 707347 - DNA, 22 bp, Artificial Sequence
  chemically synthesized
gcgattctcatgactcagcctc

SEQ ID NO: 707348 - DNA, 22 bp, Artificial Sequence
  chemically synthesized
tagcgattctcatgactcagcc

SEQ ID NO: 707349 - DNA, 22 bp, Artificial Sequence
  chemically synthesized
ctcgggaggctgagtcatgaga

SEQ ID NO: 707350 - DNA, 22 bp, Artificial Sequence
  chemically synthesized
ggttctagcgattctcatgact

SEQ ID NO: 707351 - DNA, 22 bp, Artificial Sequence
  chemically synthesized
gggaggctgagtcatgagaatc

SEQ ID NO: 707352 - DNA, 22 bp, Artificial Sequence
  chemically synthesized
ccccgtcctgggttctagcgat

SEQ ID NO: 707353 - DNA, 22 bp, Artificial Sequence
  chemically synthesized
agtcatgagaatcgctagaacc

SEQ ID NO: 707354 - DNA, 22 bp, Artificial Sequence
  chemically synthesized
caacctcccccgtcctgggttc

SEQ ID NO: 707355 - DNA, 22 bp, Artificial Sequence
  chemically synthesized
actgcaacctcccccgtcctgg

SEQ ID NO: 707356 - DNA, 22 bp, Artificial Sequence
  chemically synthesized
agctcactgcaacctcccccgt

SEQ ID NO: 707357 - DNA, 22 bp, Artificial Sequence
  chemically synthesized
gaacccaggacgggggaggttg

SEQ ID NO: 707358 - DNA, 22 bp, Artificial Sequence
  chemically synthesized
agacagagtgcaatctcagctc

SEQ ID NO: 707359 - DNA, 22 bp, Artificial Sequence
  chemically synthesized
gagacagagtgcaatctcagct

SEQ ID NO: 707360 - DNA, 22 bp, Artificial Sequence
  chemically synthesized
tgagacagagtgcaatctcagc

SEQ ID NO: 707361 - DNA, 22 bp, Artificial Sequence
  chemically synthesized
ttgagacagagtgcaatctcag

SEQ ID NO: 707362 - DNA, 22 bp, Artificial Sequence
  chemically synthesized
tttgagacagagtgcaatctca

SEQ ID NO: 707363 - DNA, 22 bp, Artificial Sequence
  chemically synthesized
ttttttgagacagagtgcaatc

SEQ ID NO: 707364 - DNA, 22 bp, Artificial Sequence
  chemically synthesized
cagtgagctgagattgcactct

SEQ ID NO: 707365 - DNA, 22 bp, Artificial Sequence
  chemically synthesized
gttttttgagacagagtgcaat

SEQ ID NO: 707366 - DNA, 22 bp, Artificial Sequence
  chemically synthesized
tgttttttgagacagagtgcaa

SEQ ID NO: 707367 - DNA, 22 bp, Artificial Sequence
  chemically synthesized
ttgttttttgagacagagtgca

SEQ ID NO: 707368 - DNA, 22 bp, Artificial Sequence
  chemically synthesized
tttgttttttgagacagagtgc

SEQ ID NO: 707369 - DNA, 22 bp, Artificial Sequence
  chemically synthesized
ttttgttttttgagacagagtg

SEQ ID NO: 707370 - DNA, 22 bp, Artificial Sequence
  chemically synthesized
tttttttgttttttgagacaga

SEQ ID NO: 707371 - DNA, 22 bp, Artificial Sequence
  chemically synthesized
atttttttgttttttgagacag

SEQ ID NO: 707372 - DNA, 22 bp, Artificial Sequence
  chemically synthesized
tatttttttgttttttgagaca

SEQ ID NO: 707373 - DNA, 22 bp, Artificial Sequence
  chemically synthesized
agattgcactctgtctcaaaaa

SEQ ID NO: 707374 - DNA, 22 bp, Artificial Sequence
  chemically synthesized
ttatttttttgttttttgagac

SEQ ID NO: 707375 - DNA, 22 bp, Artificial Sequence
  chemically synthesized
tttatttttttgttttttgaga

SEQ ID NO: 707376 - DNA, 22 bp, Artificial Sequence
  chemically synthesized
ttttatttttttgttttttgag

SEQ ID NO: 707377 - DNA, 22 bp, Artificial Sequence
  chemically synthesized
tttttttatttttttgtttttt

SEQ ID NO: 707378 - DNA, 22 bp, Artificial Sequence
  chemically synthesized
cactctgtctcaaaaaacaaaa

SEQ ID NO: 707379 - DNA, 22 bp, Artificial Sequence
  chemically synthesized
atttttttatttttttgttttt

SEQ ID NO: 707380 - DNA, 22 bp, Artificial Sequence
  chemically synthesized
tatttttttatttttttgtttt

SEQ ID NO: 707381 - DNA, 22 bp, Artificial Sequence
  chemically synthesized
ttatttttttatttttttgttt

SEQ ID NO: 707382 - DNA, 22 bp, Artificial Sequence
  chemically synthesized
tgtctcaaaaaacaaaaaaata

SEQ ID NO: 707383 - DNA, 22 bp, Artificial Sequence
  chemically synthesized
tcttttatttttttattttttt

SEQ ID NO: 707384 - DNA, 22 bp, Artificial Sequence
  chemically synthesized
tctcaaaaaacaaaaaaataaa

SEQ ID NO: 707385 - DNA, 22 bp, Artificial Sequence
  chemically synthesized
tatcttttatttttttattttt

SEQ ID NO: 707386 - DNA, 22 bp, Artificial Sequence
  chemically synthesized
aaaaaacaaaaaaataaaaaaa

SEQ ID NO: 707387 - DNA, 22 bp, Artificial Sequence
  chemically synthesized
cgtgtgtgtgtgtgtgtgtgta

SEQ ID NO: 707388 - DNA, 22 bp, Artificial Sequence
  chemically synthesized
tggttgcgtgtgtgtgtgtgtg

SEQ ID NO: 707389 - DNA, 22 bp, Artificial Sequence
  chemically synthesized
gtggttgcgtgtgtgtgtgtgt

SEQ ID NO: 707390 - DNA, 22 bp, Artificial Sequence
  chemically synthesized
ttgtggttgcgtgtgtgtgtgt

SEQ ID NO: 707391 - DNA, 22 bp, Artificial Sequence
  chemically synthesized
gatacacacacacacacacaca

SEQ ID NO: 707392 - DNA, 22 bp, Artificial Sequence
  chemically synthesized
atacacacacacacacacacac

SEQ ID NO: 707393 - DNA, 22 bp, Artificial Sequence
  chemically synthesized
tcttgtggttgcgtgtgtgtgt

SEQ ID NO: 707394 - DNA, 22 bp, Artificial Sequence
  chemically synthesized
ctcttgtggttgcgtgtgtgtg

SEQ ID NO: 707395 - DNA, 22 bp, Artificial Sequence
  chemically synthesized
tatttctcttgtggttgcgtgt

SEQ ID NO: 707396 - DNA, 22 bp, Artificial Sequence
  chemically synthesized
tgtatttctcttgtggttgcgt

SEQ ID NO: 707397 - DNA, 22 bp, Artificial Sequence
  chemically synthesized
ctgtatttctcttgtggttgcg

SEQ ID NO: 707398 - DNA, 22 bp, Artificial Sequence
  chemically synthesized
tctgtatttctcttgtggttgc

SEQ ID NO: 707399 - DNA, 22 bp, Artificial Sequence
  chemically synthesized
tatactttctgtatttctcttg

SEQ ID NO: 707400 - DNA, 22 bp, Artificial Sequence
  chemically synthesized
atatactttctgtatttctctt

SEQ ID NO: 707401 - DNA, 22 bp, Artificial Sequence
  chemically synthesized
gtttatatactttctgtatttc

SEQ ID NO: 707402 - DNA, 22 bp, Artificial Sequence
  chemically synthesized
ggtttatatactttctgtattt

SEQ ID NO: 707403 - DNA, 22 bp, Artificial Sequence
  chemically synthesized
tcagaaatttggtttatatact

SEQ ID NO: 707404 - DNA, 22 bp, Artificial Sequence
  chemically synthesized
agagataatcactatcagaaat

SEQ ID NO: 707405 - DNA, 22 bp, Artificial Sequence
  chemically synthesized
tgactcagagataatcactatc

SEQ ID NO: 707406 - DNA, 22 bp, Artificial Sequence
  chemically synthesized
ctgatagtgattatctctgagt

SEQ ID NO: 707407 - DNA, 22 bp, Artificial Sequence
  chemically synthesized
tgatagtgattatctctgagtc

SEQ ID NO: 707408 - DNA, 22 bp, Artificial Sequence
  chemically synthesized
atagtgattatctctgagtcat

SEQ ID NO: 707409 - DNA, 22 bp, Artificial Sequence
  chemically synthesized
tctctgagtcataggattatgg

SEQ ID NO: 707410 - DNA, 22 bp, Artificial Sequence
  chemically synthesized
tgagtcataggattatggatac

SEQ ID NO: 707411 - DNA, 22 bp, Artificial Sequence
  chemically synthesized
agtcataggattatggatactt

SEQ ID NO: 707412 - DNA, 22 bp, Artificial Sequence
  chemically synthesized
tggatactttttcttttcttgt

SEQ ID NO: 707413 - DNA, 22 bp, Artificial Sequence
  chemically synthesized
gaaagcccacagtacaaacaag

SEQ ID NO: 707414 - DNA, 22 bp, Artificial Sequence
  chemically synthesized
ggaaagcccacagtacaaacaa

SEQ ID NO: 707415 - DNA, 22 bp, Artificial Sequence
  chemically synthesized
tttcttttcttgtttgtactgt

SEQ ID NO: 707416 - DNA, 22 bp, Artificial Sequence
  chemically synthesized
ttcttttcttgtttgtactgtg

SEQ ID NO: 707417 - DNA, 22 bp, Artificial Sequence
  chemically synthesized
tcttttcttgtttgtactgtgg

SEQ ID NO: 707418 - DNA, 22 bp, Artificial Sequence
  chemically synthesized
cttttcttgtttgtactgtggg

SEQ ID NO: 707419 - DNA, 22 bp, Artificial Sequence
  chemically synthesized
ttttcttgtttgtactgtgggc

SEQ ID NO: 707420 - DNA, 22 bp, Artificial Sequence
  chemically synthesized
ttcttgtttgtactgtgggctt

SEQ ID NO: 707421 - DNA, 22 bp, Artificial Sequence
  chemically synthesized
tcttgtttgtactgtgggcttt

SEQ ID NO: 707422 - DNA, 22 bp, Artificial Sequence
  chemically synthesized
cttgtttgtactgtgggctttc

SEQ ID NO: 707423 - DNA, 22 bp, Artificial Sequence
  chemically synthesized
ttgtttgtactgtgggctttcc

SEQ ID NO: 707424 - DNA, 22 bp, Artificial Sequence
  chemically synthesized
gtttgtactgtgggctttccaa

SEQ ID NO: 707425 - DNA, 22 bp, Artificial Sequence
  chemically synthesized
tttgtactgtgggctttccaaa

SEQ ID NO: 707426 - DNA, 22 bp, Artificial Sequence
  chemically synthesized
gtactgtgggctttccaaattt

SEQ ID NO: 707427 - DNA, 22 bp, Artificial Sequence
  chemically synthesized
tactgtgggctttccaaatttt

SEQ ID NO: 707428 - DNA, 22 bp, Artificial Sequence
  chemically synthesized
tacacatcaagaaaaatttgga

SEQ ID NO: 707429 - DNA, 22 bp, Artificial Sequence
  chemically synthesized
tatacacatcaagaaaaatttg

SEQ ID NO: 707430 - DNA, 22 bp, Artificial Sequence
  chemically synthesized
tgggctttccaaatttttcttg

SEQ ID NO: 707431 - DNA, 22 bp, Artificial Sequence
  chemically synthesized
tccaaatttttcttgatgtgta

SEQ ID NO: 707432 - DNA, 22 bp, Artificial Sequence
  chemically synthesized
ccaaatttttcttgatgtgtat

SEQ ID NO: 707433 - DNA, 22 bp, Artificial Sequence
  chemically synthesized
caaaggtactctatacacatca

SEQ ID NO: 707434 - DNA, 22 bp, Artificial Sequence
  chemically synthesized
caaatttttcttgatgtgtata

SEQ ID NO: 707435 - DNA, 22 bp, Artificial Sequence
  chemically synthesized
aaattacaaaggtactctatac

SEQ ID NO: 707436 - DNA, 22 bp, Artificial Sequence
  chemically synthesized
aaaattacaaaggtactctata

SEQ ID NO: 707437 - DNA, 22 bp, Artificial Sequence
  chemically synthesized
ttcttgatgtgtatagagtacc

SEQ ID NO: 707438 - DNA, 22 bp, Artificial Sequence
  chemically synthesized
taaaattacaaaggtactctat

SEQ ID NO: 707439 - DNA, 22 bp, Artificial Sequence
  chemically synthesized
tcttgatgtgtatagagtacct

SEQ ID NO: 707440 - DNA, 22 bp, Artificial Sequence
  chemically synthesized
ttaaaattacaaaggtactcta

SEQ ID NO: 707441 - DNA, 22 bp, Artificial Sequence
  chemically synthesized
cttgatgtgtatagagtacctt

SEQ ID NO: 707442 - DNA, 22 bp, Artificial Sequence
  chemically synthesized
tttaaaattacaaaggtactct

SEQ ID NO: 707443 - DNA, 22 bp, Artificial Sequence
  chemically synthesized
ttgatgtgtatagagtaccttt

SEQ ID NO: 707444 - DNA, 22 bp, Artificial Sequence
  chemically synthesized
gatgtgtatagagtacctttgt

SEQ ID NO: 707445 - DNA, 22 bp, Artificial Sequence
  chemically synthesized
atgtgtatagagtacctttgta

SEQ ID NO: 707446 - DNA, 22 bp, Artificial Sequence
  chemically synthesized
tactttttaaaattacaaaggt

SEQ ID NO: 707447 - DNA, 22 bp, Artificial Sequence
  chemically synthesized
cattgtactttttaaaattaca

SEQ ID NO: 707448 - DNA, 22 bp, Artificial Sequence
  chemically synthesized
acattgtactttttaaaattac

SEQ ID NO: 707449 - DNA, 22 bp, Artificial Sequence
  chemically synthesized
tacattgtactttttaaaatta

SEQ ID NO: 707450 - DNA, 22 bp, Artificial Sequence
  chemically synthesized
tttacattgtactttttaaaat

SEQ ID NO: 707451 - DNA, 22 bp, Artificial Sequence
  chemically synthesized
ctttacattgtactttttaaaa

SEQ ID NO: 707452 - DNA, 22 bp, Artificial Sequence
  chemically synthesized
tttctttacattgtacttttta

SEQ ID NO: 707453 - DNA, 22 bp, Artificial Sequence
  chemically synthesized
tgtaattttaaaaagtacaatg

SEQ ID NO: 707454 - DNA, 22 bp, Artificial Sequence
  chemically synthesized
gtaattttaaaaagtacaatgt

SEQ ID NO: 707455 - DNA, 22 bp, Artificial Sequence
  chemically synthesized
taattttaaaaagtacaatgta

SEQ ID NO: 707456 - DNA, 22 bp, Artificial Sequence
  chemically synthesized
aggatggattgtttctttacat

SEQ ID NO: 707457 - DNA, 22 bp, Artificial Sequence
  chemically synthesized
taaaaagtacaatgtaaagaaa

SEQ ID NO: 707458 - DNA, 22 bp, Artificial Sequence
  chemically synthesized
aaaaagtacaatgtaaagaaac

SEQ ID NO: 707459 - DNA, 22 bp, Artificial Sequence
  chemically synthesized
aaaagtacaatgtaaagaaaca

SEQ ID NO: 707460 - DNA, 22 bp, Artificial Sequence
  chemically synthesized
agaaataggacggtgagactaa

SEQ ID NO: 707461 - DNA, 22 bp, Artificial Sequence
  chemically synthesized
aagaaataggacggtgagacta

SEQ ID NO: 707462 - DNA, 22 bp, Artificial Sequence
  chemically synthesized
agggatatttaagaaataggac

SEQ ID NO: 707463 - DNA, 22 bp, Artificial Sequence
  chemically synthesized
aagggatatttaagaaatagga

SEQ ID NO: 707464 - DNA, 22 bp, Artificial Sequence
  chemically synthesized
agtctcaccgtcctatttctta

SEQ ID NO: 707465 - DNA, 22 bp, Artificial Sequence
  chemically synthesized
gtctcaccgtcctatttcttaa

SEQ ID NO: 707466 - DNA, 22 bp, Artificial Sequence
  chemically synthesized
gtttaagggatatttaagaaat

SEQ ID NO: 707467 - DNA, 22 bp, Artificial Sequence
  chemically synthesized
ggtttaagggatatttaagaaa

SEQ ID NO: 707468 - DNA, 22 bp, Artificial Sequence
  chemically synthesized
accgtcctatttcttaaatatc

SEQ ID NO: 707469 - DNA, 22 bp, Artificial Sequence
  chemically synthesized
tttcttaaatatcccttaaacc

SEQ ID NO: 707470 - DNA, 22 bp, Artificial Sequence
  chemically synthesized
cttaaatatcccttaaaccaag

SEQ ID NO: 707471 - DNA, 22 bp, Artificial Sequence
  chemically synthesized
ttaaatatcccttaaaccaagt

SEQ ID NO: 707472 - DNA, 22 bp, Artificial Sequence
  chemically synthesized
aaatatcccttaaaccaagttg

SEQ ID NO: 707473 - DNA, 22 bp, Artificial Sequence
  chemically synthesized
aatatcccttaaaccaagttgg

SEQ ID NO: 707474 - DNA, 22 bp, Artificial Sequence
  chemically synthesized
caggtataaagaaaataccaac

SEQ ID NO: 707475 - DNA, 22 bp, Artificial Sequence
  chemically synthesized
gcaggtataaagaaaataccaa

SEQ ID NO: 707476 - DNA, 22 bp, Artificial Sequence
  chemically synthesized
cttgcaggtataaagaaaatac

SEQ ID NO: 707477 - DNA, 22 bp, Artificial Sequence
  chemically synthesized
aaaccaagttggtattttcttt

SEQ ID NO: 707478 - DNA, 22 bp, Artificial Sequence
  chemically synthesized
gcttgcaggtataaagaaaata

SEQ ID NO: 707479 - DNA, 22 bp, Artificial Sequence
  chemically synthesized
aaccaagttggtattttcttta

SEQ ID NO: 707480 - DNA, 22 bp, Artificial Sequence
  chemically synthesized
tgcttgcaggtataaagaaaat

SEQ ID NO: 707481 - DNA, 22 bp, Artificial Sequence
  chemically synthesized
aaagctttgcttgcaggtataa

SEQ ID NO: 707482 - DNA, 22 bp, Artificial Sequence
  chemically synthesized
aaaagctttgcttgcaggtata

SEQ ID NO: 707483 - DNA, 22 bp, Artificial Sequence
  chemically synthesized
gtattttctttatacctgcaag

SEQ ID NO: 707484 - DNA, 22 bp, Artificial Sequence
  chemically synthesized
tctttatacctgcaagcaaagc

SEQ ID NO: 707485 - DNA, 22 bp, Artificial Sequence
  chemically synthesized
ctttatacctgcaagcaaagct

SEQ ID NO: 707486 - DNA, 22 bp, Artificial Sequence
  chemically synthesized
tttatacctgcaagcaaagctt

SEQ ID NO: 707487 - DNA, 22 bp, Artificial Sequence
  chemically synthesized
tatacctgcaagcaaagctttt

SEQ ID NO: 707488 - DNA, 22 bp, Artificial Sequence
  chemically synthesized
atacctgcaagcaaagctttta

SEQ ID NO: 707489 - DNA, 22 bp, Artificial Sequence
  chemically synthesized
tacctgcaagcaaagcttttaa

SEQ ID NO: 707490 - DNA, 22 bp, Artificial Sequence
  chemically synthesized
caagcaaagcttttaagcgtat

SEQ ID NO: 707491 - DNA, 22 bp, Artificial Sequence
  chemically synthesized
gatgcccatgtggaatatcaat

SEQ ID NO: 707492 - DNA, 22 bp, Artificial Sequence
  chemically synthesized
ggatgcccatgtggaatatcaa

SEQ ID NO: 707493 - DNA, 22 bp, Artificial Sequence
  chemically synthesized
ttaagcgtatattgatattcca

SEQ ID NO: 707494 - DNA, 22 bp, Artificial Sequence
  chemically synthesized
taagcgtatattgatattccac

SEQ ID NO: 707495 - DNA, 22 bp, Artificial Sequence
  chemically synthesized
ttggatgcccatgtggaatatc

SEQ ID NO: 707496 - DNA, 22 bp, Artificial Sequence
  chemically synthesized
aagcgtatattgatattccaca

SEQ ID NO: 707497 - DNA, 22 bp, Artificial Sequence
  chemically synthesized
agcgtatattgatattccacat

SEQ ID NO: 707498 - DNA, 22 bp, Artificial Sequence
  chemically synthesized
atattccacatgggcatccaag

SEQ ID NO: 707499 - DNA, 22 bp, Artificial Sequence
  chemically synthesized
cacatgggcatccaagagactg

SEQ ID NO: 707500 - DNA, 22 bp, Artificial Sequence
  chemically synthesized
aatggagccagccccggaagtc

SEQ ID NO: 707501 - DNA, 22 bp, Artificial Sequence
  chemically synthesized
cctgaatggagccagccccgga

SEQ ID NO: 707502 - DNA, 22 bp, Artificial Sequence
  chemically synthesized
cctgcctgaatggagccagccc

SEQ ID NO: 707503 - DNA, 22 bp, Artificial Sequence
  chemically synthesized
atgacttccggggctggctcca

SEQ ID NO: 707504 - DNA, 22 bp, Artificial Sequence
  chemically synthesized
atctacctgcctgaatggagcc

SEQ ID NO: 707505 - DNA, 22 bp, Artificial Sequence
  chemically synthesized
ccggggctggctccattcaggc

SEQ ID NO: 707506 - DNA, 22 bp, Artificial Sequence
  chemically synthesized
cggggctggctccattcaggca

SEQ ID NO: 707507 - DNA, 22 bp, Artificial Sequence
  chemically synthesized
ataaagagactgatctacctgc

SEQ ID NO: 707508 - DNA, 22 bp, Artificial Sequence
  chemically synthesized
gctccattcaggcaggtagatc

SEQ ID NO: 707509 - DNA, 22 bp, Artificial Sequence
  chemically synthesized
cattcaggcaggtagatcagtc

SEQ ID NO: 707510 - DNA, 22 bp, Artificial Sequence
  chemically synthesized
aggcaggtagatcagtctcttt

SEQ ID NO: 707511 - DNA, 22 bp, Artificial Sequence
  chemically synthesized
gacacaggtattcataaagaga

SEQ ID NO: 707512 - DNA, 22 bp, Artificial Sequence
  chemically synthesized
ttagacacaggtattcataaag

SEQ ID NO: 707513 - DNA, 22 bp, Artificial Sequence
  chemically synthesized
tttatgaatacctgtgtctaac

SEQ ID NO: 707514 - DNA, 22 bp, Artificial Sequence
  chemically synthesized
tatgaatacctgtgtctaacag

SEQ ID NO: 707515 - DNA, 22 bp, Artificial Sequence
  chemically synthesized
atgaatacctgtgtctaacagg

SEQ ID NO: 707516 - DNA, 22 bp, Artificial Sequence
  chemically synthesized
tgaatacctgtgtctaacaggc

SEQ ID NO: 707517 - DNA, 22 bp, Artificial Sequence
  chemically synthesized
cagaaaggtcaggcctgttaga

SEQ ID NO: 707518 - DNA, 22 bp, Artificial Sequence
  chemically synthesized
ccagaaaggtcaggcctgttag

SEQ ID NO: 707519 - DNA, 22 bp, Artificial Sequence
  chemically synthesized
tgtctaacaggcctgacctttc

SEQ ID NO: 707520 - DNA, 22 bp, Artificial Sequence
  chemically synthesized
acaggcctgacctttctggaag

SEQ ID NO: 707521 - DNA, 22 bp, Artificial Sequence
  chemically synthesized
acctttctggaagtgggcactg

SEQ ID NO: 707522 - DNA, 22 bp, Artificial Sequence
  chemically synthesized
aaaccatatcacatcagtgccc

SEQ ID NO: 707523 - DNA, 22 bp, Artificial Sequence
  chemically synthesized
caaaccatatcacatcagtgcc

SEQ ID NO: 707524 - DNA, 22 bp, Artificial Sequence
  chemically synthesized
tcaaaccatatcacatcagtgc

SEQ ID NO: 707525 - DNA, 22 bp, Artificial Sequence
  chemically synthesized
tctggaagtgggcactgatgtg

SEQ ID NO: 707526 - DNA, 22 bp, Artificial Sequence
  chemically synthesized
ctggaagtgggcactgatgtga

SEQ ID NO: 707527 - DNA, 22 bp, Artificial Sequence
  chemically synthesized
tggaagtgggcactgatgtgat

SEQ ID NO: 707528 - DNA, 22 bp, Artificial Sequence
  chemically synthesized
gaagtgggcactgatgtgatat

SEQ ID NO: 707529 - DNA, 22 bp, Artificial Sequence
  chemically synthesized
acacctttcaaaccatatcaca

SEQ ID NO: 707530 - DNA, 22 bp, Artificial Sequence
  chemically synthesized
tcacacctttcaaaccatatca

SEQ ID NO: 707531 - DNA, 22 bp, Artificial Sequence
  chemically synthesized
atgtgatatggtttgaaaggtg

SEQ ID NO: 707532 - DNA, 22 bp, Artificial Sequence
  chemically synthesized
aggggccaaggggagcattctc

SEQ ID NO: 707533 - DNA, 22 bp, Artificial Sequence
  chemically synthesized
gaggggccaaggggagcattct

SEQ ID NO: 707534 - DNA, 22 bp, Artificial Sequence
  chemically synthesized
tgaggggccaaggggagcattc

SEQ ID NO: 707535 - DNA, 22 bp, Artificial Sequence
  chemically synthesized
gaaaggtgtgagaatgctcccc

SEQ ID NO: 707536 - DNA, 22 bp, Artificial Sequence
  chemically synthesized
aaaggtgtgagaatgctcccct

SEQ ID NO: 707537 - DNA, 22 bp, Artificial Sequence
  chemically synthesized
tgaggaaggaactttgaggggc

SEQ ID NO: 707538 - DNA, 22 bp, Artificial Sequence
  chemically synthesized
agctgtgaggaaggaactttga

SEQ ID NO: 707539 - DNA, 22 bp, Artificial Sequence
  chemically synthesized
cccttggcccctcaaagttcct

SEQ ID NO: 707540 - DNA, 22 bp, Artificial Sequence
  chemically synthesized
tgagctgtgaggaaggaacttt

SEQ ID NO: 707541 - DNA, 22 bp, Artificial Sequence
  chemically synthesized
ggcccctcaaagttccttcctc

SEQ ID NO: 707542 - DNA, 22 bp, Artificial Sequence
  chemically synthesized
gcccctcaaagttccttcctca

SEQ ID NO: 707543 - DNA, 22 bp, Artificial Sequence
  chemically synthesized
aaagttccttcctcacagctca

SEQ ID NO: 707544 - DNA, 22 bp, Artificial Sequence
  chemically synthesized
cttcctcacagctcagagctta

SEQ ID NO: 707545 - DNA, 22 bp, Artificial Sequence
  chemically synthesized
cctcacagctcagagcttatgg

SEQ ID NO: 707546 - DNA, 22 bp, Artificial Sequence
  chemically synthesized
ctcacagctcagagcttatggc

SEQ ID NO: 707547 - DNA, 22 bp, Artificial Sequence
  chemically synthesized
acagctcagagcttatggccga

SEQ ID NO: 707548 - DNA, 22 bp, Artificial Sequence
  chemically synthesized
aggtggtagaacatcggccata

SEQ ID NO: 707549 - DNA, 22 bp, Artificial Sequence
  chemically synthesized
agagcttatggccgatgttcta

SEQ ID NO: 707550 - DNA, 22 bp, Artificial Sequence
  chemically synthesized
atggccgatgttctaccacctc

SEQ ID NO: 707551 - DNA, 22 bp, Artificial Sequence
  chemically synthesized
tggccgatgttctaccacctca

SEQ ID NO: 707552 - DNA, 22 bp, Artificial Sequence
  chemically synthesized
gtgtgaaaatccataagcctga

SEQ ID NO: 707553 - DNA, 22 bp, Artificial Sequence
  chemically synthesized
ttagtgtgaaaatccataagcc

SEQ ID NO: 707554 - DNA, 22 bp, Artificial Sequence
  chemically synthesized
attagtgtgaaaatccataagc

SEQ ID NO: 707555 - DNA, 22 bp, Artificial Sequence
  chemically synthesized
taccacctcaggcttatggatt

SEQ ID NO: 707556 - DNA, 22 bp, Artificial Sequence
  chemically synthesized
tattagtgtgaaaatccataag

SEQ ID NO: 707557 - DNA, 22 bp, Artificial Sequence
  chemically synthesized
ccacctcaggcttatggatttt

SEQ ID NO: 707558 - DNA, 22 bp, Artificial Sequence
  chemically synthesized
cattttattagtgtgaaaatcc

SEQ ID NO: 707559 - DNA, 22 bp, Artificial Sequence
  chemically synthesized
gcattttattagtgtgaaaatc

SEQ ID NO: 707560 - DNA, 22 bp, Artificial Sequence
  chemically synthesized
aggcttatggattttcacacta

SEQ ID NO: 707561 - DNA, 22 bp, Artificial Sequence
  chemically synthesized
tttgcattttattagtgtgaaa

SEQ ID NO: 707562 - DNA, 22 bp, Artificial Sequence
  chemically synthesized
ggttatttgcattttattagtg

SEQ ID NO: 707563 - DNA, 22 bp, Artificial Sequence
  chemically synthesized
atggattttcacactaataaaa

SEQ ID NO: 707564 - DNA, 22 bp, Artificial Sequence
  chemically synthesized
tggattttcacactaataaaat

SEQ ID NO: 707565 - DNA, 22 bp, Artificial Sequence
  chemically synthesized
ctgggttatttgcattttatta

SEQ ID NO: 707566 - DNA, 22 bp, Artificial Sequence
  chemically synthesized
tcctgggttatttgcattttat

SEQ ID NO: 707567 - DNA, 22 bp, Artificial Sequence
  chemically synthesized
ctcctgggttatttgcatttta

SEQ ID NO: 707568 - DNA, 22 bp, Artificial Sequence
  chemically synthesized
tcacactaataaaatgcaaata

SEQ ID NO: 707569 - DNA, 22 bp, Artificial Sequence
  chemically synthesized
cacactaataaaatgcaaataa

SEQ ID NO: 707570 - DNA, 22 bp, Artificial Sequence
  chemically synthesized
acactaataaaatgcaaataac

SEQ ID NO: 707571 - DNA, 22 bp, Artificial Sequence
  chemically synthesized
atgtgtacttctcctgggttat

SEQ ID NO: 707572 - DNA, 22 bp, Artificial Sequence
  chemically synthesized
ataaaatgcaaataacccagga

SEQ ID NO: 707573 - DNA, 22 bp, Artificial Sequence
  chemically synthesized
aatgtgtacttctcctgggtta

SEQ ID NO: 707574 - DNA, 22 bp, Artificial Sequence
  chemically synthesized
acccaagtgataggtaaagttt

SEQ ID NO: 707575 - DNA, 22 bp, Artificial Sequence
  chemically synthesized
aacccaagtgataggtaaagtt

SEQ ID NO: 707576 - DNA, 22 bp, Artificial Sequence
  chemically synthesized
atttaacccaagtgataggtaa

SEQ ID NO: 707577 - DNA, 22 bp, Artificial Sequence
  chemically synthesized
aactttacctatcacttgggtt

SEQ ID NO: 707578 - DNA, 22 bp, Artificial Sequence
  chemically synthesized
tacctatcacttgggttaaatg

SEQ ID NO: 707579 - DNA, 22 bp, Artificial Sequence
  chemically synthesized
acctatcacttgggttaaatga

SEQ ID NO: 707580 - DNA, 22 bp, Artificial Sequence
  chemically synthesized
cctatcacttgggttaaatgag

SEQ ID NO: 707581 - DNA, 22 bp, Artificial Sequence
  chemically synthesized
agaaaatgatatactcatttaa

SEQ ID NO: 707582 - DNA, 22 bp, Artificial Sequence
  chemically synthesized
cagaaaatgatatactcattta

SEQ ID NO: 707583 - DNA, 22 bp, Artificial Sequence
  chemically synthesized
tcagaaaatgatatactcattt

SEQ ID NO: 707584 - DNA, 22 bp, Artificial Sequence
  chemically synthesized
tcacttgggttaaatgagtata

SEQ ID NO: 707585 - DNA, 22 bp, Artificial Sequence
  chemically synthesized
ttttcagaaaatgatatactca

SEQ ID NO: 707586 - DNA, 22 bp, Artificial Sequence
  chemically synthesized
gggttaaatgagtatatcattt

SEQ ID NO: 707587 - DNA, 22 bp, Artificial Sequence
  chemically synthesized
ggttaaatgagtatatcatttt

SEQ ID NO: 707588 - DNA, 22 bp, Artificial Sequence
  chemically synthesized
aaacctattttcagaaaatgat

SEQ ID NO: 707589 - DNA, 22 bp, Artificial Sequence
  chemically synthesized
aatgagtatatcattttctgaa

SEQ ID NO: 707590 - DNA, 22 bp, Artificial Sequence
  chemically synthesized
cccattaaaacctattttcaga

SEQ ID NO: 707591 - DNA, 22 bp, Artificial Sequence
  chemically synthesized
acccattaaaacctattttcag

SEQ ID NO: 707592 - DNA, 22 bp, Artificial Sequence
  chemically synthesized
ccatgtcttacccattaaaacc

SEQ ID NO: 707593 - DNA, 22 bp, Artificial Sequence
  chemically synthesized
tctgaaaataggttttaatggg

SEQ ID NO: 707594 - DNA, 22 bp, Artificial Sequence
  chemically synthesized
ctgaaaataggttttaatgggt

SEQ ID NO: 707595 - DNA, 22 bp, Artificial Sequence
  chemically synthesized
tgaaaataggttttaatgggta

SEQ ID NO: 707596 - DNA, 22 bp, Artificial Sequence
  chemically synthesized
aattcccatgtcttacccatta

SEQ ID NO: 707597 - DNA, 22 bp, Artificial Sequence
  chemically synthesized
aaaataggttttaatgggtaag

SEQ ID NO: 707598 - DNA, 22 bp, Artificial Sequence
  chemically synthesized
tgaattcccatgtcttacccat

SEQ ID NO: 707599 - DNA, 22 bp, Artificial Sequence
  chemically synthesized
cccctctgaattcccatgtctt

SEQ ID NO: 707600 - DNA, 22 bp, Artificial Sequence
  chemically synthesized
taatgggtaagacatgggaatt

SEQ ID NO: 707601 - DNA, 22 bp, Artificial Sequence
  chemically synthesized
actccccctctgaattcccatg

SEQ ID NO: 707602 - DNA, 22 bp, Artificial Sequence
  chemically synthesized
aatgggtaagacatgggaattc

SEQ ID NO: 707603 - DNA, 22 bp, Artificial Sequence
  chemically synthesized
atgggtaagacatgggaattca

SEQ ID NO: 707604 - DNA, 22 bp, Artificial Sequence
  chemically synthesized
cctgactccccctctgaattcc

SEQ ID NO: 707605 - DNA, 22 bp, Artificial Sequence
  chemically synthesized
tccctgactccccctctgaatt

SEQ ID NO: 707606 - DNA, 22 bp, Artificial Sequence
  chemically synthesized
ctccctgactccccctctgaat

SEQ ID NO: 707607 - DNA, 22 bp, Artificial Sequence
  chemically synthesized
ttctccctgactccccctctga

SEQ ID NO: 707608 - DNA, 22 bp, Artificial Sequence
  chemically synthesized
cttctccctgactccccctctg

SEQ ID NO: 707609 - DNA, 22 bp, Artificial Sequence
  chemically synthesized
tcttctccctgactccccctct

SEQ ID NO: 707610 - DNA, 22 bp, Artificial Sequence
  chemically synthesized
atattttcttctccctgactcc

SEQ ID NO: 707611 - DNA, 22 bp, Artificial Sequence
  chemically synthesized
attcatattttcttctccctga

SEQ ID NO: 707612 - DNA, 22 bp, Artificial Sequence
  chemically synthesized
agagggggagtcagggagaaga

SEQ ID NO: 707613 - DNA, 22 bp, Artificial Sequence
  chemically synthesized
agacaccaggtatattcattca

SEQ ID NO: 707614 - DNA, 22 bp, Artificial Sequence
  chemically synthesized
ctcagacaccaggtatattcat

SEQ ID NO: 707615 - DNA, 22 bp, Artificial Sequence
  chemically synthesized
ctcctcagacaccaggtatatt

SEQ ID NO: 707616 - DNA, 22 bp, Artificial Sequence
  chemically synthesized
attactcctcagacaccaggta

SEQ ID NO: 707617 - DNA, 22 bp, Artificial Sequence
  chemically synthesized
tgaatattaattactcctcaga

SEQ ID NO: 707618 - DNA, 22 bp, Artificial Sequence
  chemically synthesized
ttatgaatattaattactcctc

SEQ ID NO: 707619 - DNA, 22 bp, Artificial Sequence
  chemically synthesized
gtgtctgaggagtaattaatat

SEQ ID NO: 707620 - DNA, 22 bp, Artificial Sequence
  chemically synthesized
aggagtaattaatattcataat

SEQ ID NO: 707621 - DNA, 22 bp, Artificial Sequence
  chemically synthesized
atattcataatagtactatttt

SEQ ID NO: 707622 - DNA, 22 bp, Artificial Sequence
  chemically synthesized
ataaaccataaataaaaaatag

SEQ ID NO: 707623 - DNA, 22 bp, Artificial Sequence
  chemically synthesized
ataatagtactattttttattt

SEQ ID NO: 707624 - DNA, 22 bp, Artificial Sequence
  chemically synthesized
agcgactcataaaccataaata

SEQ ID NO: 707625 - DNA, 22 bp, Artificial Sequence
  chemically synthesized
ctaagcgactcataaaccataa

SEQ ID NO: 707626 - DNA, 22 bp, Artificial Sequence
  chemically synthesized
ttttttatttatggtttatgag

SEQ ID NO: 707627 - DNA, 22 bp, Artificial Sequence
  chemically synthesized
tttatttatggtttatgagtcg

SEQ ID NO: 707628 - DNA, 22 bp, Artificial Sequence
  chemically synthesized
ttatttatggtttatgagtcgc

SEQ ID NO: 707629 - DNA, 22 bp, Artificial Sequence
  chemically synthesized
tatttatggtttatgagtcgct

SEQ ID NO: 707630 - DNA, 22 bp, Artificial Sequence
  chemically synthesized
atttatggtttatgagtcgctt

SEQ ID NO: 707631 - DNA, 22 bp, Artificial Sequence
  chemically synthesized
tttatggtttatgagtcgctta

SEQ ID NO: 707632 - DNA, 22 bp, Artificial Sequence
  chemically synthesized
atggtttatgagtcgcttagga

SEQ ID NO: 707633 - DNA, 22 bp, Artificial Sequence
  chemically synthesized
tggtttatgagtcgcttaggag

SEQ ID NO: 707634 - DNA, 22 bp, Artificial Sequence
  chemically synthesized
aatgtgataacatactcctaag

SEQ ID NO: 707635 - DNA, 22 bp, Artificial Sequence
  chemically synthesized
atgagtcgcttaggagtatgtt

SEQ ID NO: 707636 - DNA, 22 bp, Artificial Sequence
  chemically synthesized
tgagtcgcttaggagtatgtta

SEQ ID NO: 707637 - DNA, 22 bp, Artificial Sequence
  chemically synthesized
agattaaatgtgataacatact

SEQ ID NO: 707638 - DNA, 22 bp, Artificial Sequence
  chemically synthesized
attgagattaaatgtgataaca

SEQ ID NO: 707639 - DNA, 22 bp, Artificial Sequence
  chemically synthesized
aattgagattaaatgtgataac

SEQ ID NO: 707640 - DNA, 22 bp, Artificial Sequence
  chemically synthesized
aggagtatgttatcacatttaa

SEQ ID NO: 707641 - DNA, 22 bp, Artificial Sequence
  chemically synthesized
ggagtatgttatcacatttaat

SEQ ID NO: 707642 - DNA, 22 bp, Artificial Sequence
  chemically synthesized
gatttaattgagattaaatgtg

SEQ ID NO: 707643 - DNA, 22 bp, Artificial Sequence
  chemically synthesized
ttcgatttaattgagattaaat

SEQ ID NO: 707644 - DNA, 22 bp, Artificial Sequence
  chemically synthesized
tattcgatttaattgagattaa

SEQ ID NO: 707645 - DNA, 22 bp, Artificial Sequence
  chemically synthesized
tcacatttaatctcaattaaat

SEQ ID NO: 707646 - DNA, 22 bp, Artificial Sequence
  chemically synthesized
gtgacagccattctattcgatt

SEQ ID NO: 707647 - DNA, 22 bp, Artificial Sequence
  chemically synthesized
aatctcaattaaatcgaataga

SEQ ID NO: 707648 - DNA, 22 bp, Artificial Sequence
  chemically synthesized
ggtgacagccattctattcgat

SEQ ID NO: 707649 - DNA, 22 bp, Artificial Sequence
  chemically synthesized
atctcaattaaatcgaatagaa

SEQ ID NO: 707650 - DNA, 22 bp, Artificial Sequence
  chemically synthesized
ccttggtgacagccattctatt

SEQ ID NO: 707651 - DNA, 22 bp, Artificial Sequence
  chemically synthesized
gccttggtgacagccattctat

SEQ ID NO: 707652 - DNA, 22 bp, Artificial Sequence
  chemically synthesized
aattaaatcgaatagaatggct

SEQ ID NO: 707653 - DNA, 22 bp, Artificial Sequence
  chemically synthesized
acttgccttggtgacagccatt

SEQ ID NO: 707654 - DNA, 22 bp, Artificial Sequence
  chemically synthesized
aacttgccttggtgacagccat

SEQ ID NO: 707655 - DNA, 22 bp, Artificial Sequence
  chemically synthesized
aatcgaatagaatggctgtcac

SEQ ID NO: 707656 - DNA, 22 bp, Artificial Sequence
  chemically synthesized
cttaacttgccttggtgacagc

SEQ ID NO: 707657 - DNA, 22 bp, Artificial Sequence
  chemically synthesized
gtctacttaacttgccttggtg

SEQ ID NO: 707658 - DNA, 22 bp, Artificial Sequence
  chemically synthesized
tggtctacttaacttgccttgg

SEQ ID NO: 707659 - DNA, 22 bp, Artificial Sequence
  chemically synthesized
caaatctctggtctacttaact

SEQ ID NO: 707660 - DNA, 22 bp, Artificial Sequence
  chemically synthesized
tcaccaaggcaagttaagtaga

SEQ ID NO: 707661 - DNA, 22 bp, Artificial Sequence
  chemically synthesized
ccaaatctctggtctacttaac

SEQ ID NO: 707662 - DNA, 22 bp, Artificial Sequence
  chemically synthesized
tccaaatctctggtctacttaa

SEQ ID NO: 707663 - DNA, 22 bp, Artificial Sequence
  chemically synthesized
catctttccaaatctctggtct

SEQ ID NO: 707664 - DNA, 22 bp, Artificial Sequence
  chemically synthesized
tgcatctttccaaatctctggt

SEQ ID NO: 707665 - DNA, 22 bp, Artificial Sequence
  chemically synthesized
ctgcatctttccaaatctctgg

SEQ ID NO: 707666 - DNA, 22 bp, Artificial Sequence
  chemically synthesized
gtcttctgcatctttccaaatc

SEQ ID NO: 707667 - DNA, 22 bp, Artificial Sequence
  chemically synthesized
agtagaccagagatttggaaag

SEQ ID NO: 707668 - DNA, 22 bp, Artificial Sequence
  chemically synthesized
cgtcttctgcatctttccaaat

SEQ ID NO: 707669 - DNA, 22 bp, Artificial Sequence
  chemically synthesized
cagatttcgtcttctgcatctt

SEQ ID NO: 707670 - DNA, 22 bp, Artificial Sequence
  chemically synthesized
ggaaagatgcagaagacgaaat

SEQ ID NO: 707671 - DNA, 22 bp, Artificial Sequence
  chemically synthesized
gaaagatgcagaagacgaaatc

SEQ ID NO: 707672 - DNA, 22 bp, Artificial Sequence
  chemically synthesized
gaaaaatgataaaggctacaga

SEQ ID NO: 707673 - DNA, 22 bp, Artificial Sequence
  chemically synthesized
tagaaaaatgataaaggctaca

SEQ ID NO: 707674 - DNA, 22 bp, Artificial Sequence
  chemically synthesized
ggaacggctctagaaaaatgat

SEQ ID NO: 707675 - DNA, 22 bp, Artificial Sequence
  chemically synthesized
aggaacggctctagaaaaatga

SEQ ID NO: 707676 - DNA, 22 bp, Artificial Sequence
  chemically synthesized
taggaacggctctagaaaaatg

SEQ ID NO: 707677 - DNA, 22 bp, Artificial Sequence
  chemically synthesized
ttaggaacggctctagaaaaat

SEQ ID NO: 707678 - DNA, 22 bp, Artificial Sequence
  chemically synthesized
tagcctttatcatttttctaga

SEQ ID NO: 707679 - DNA, 22 bp, Artificial Sequence
  chemically synthesized
tatcatttttctagagccgttc

SEQ ID NO: 707680 - DNA, 22 bp, Artificial Sequence
  chemically synthesized
atcatttttctagagccgttcc

SEQ ID NO: 707681 - DNA, 22 bp, Artificial Sequence
  chemically synthesized
tcatttttctagagccgttcct

SEQ ID NO: 707682 - DNA, 22 bp, Artificial Sequence
  chemically synthesized
ttctagagccgttcctaaaagc

SEQ ID NO: 707683 - DNA, 22 bp, Artificial Sequence
  chemically synthesized
tctagagccgttcctaaaagcc

SEQ ID NO: 707684 - DNA, 22 bp, Artificial Sequence
  chemically synthesized
ctagagccgttcctaaaagcca

SEQ ID NO: 707685 - DNA, 22 bp, Artificial Sequence
  chemically synthesized
tagagccgttcctaaaagccac

SEQ ID NO: 707686 - DNA, 22 bp, Artificial Sequence
  chemically synthesized
aatgagtgggatcgtggctttt

SEQ ID NO: 707687 - DNA, 22 bp, Artificial Sequence
  chemically synthesized
gagccgttcctaaaagccacga

SEQ ID NO: 707688 - DNA, 22 bp, Artificial Sequence
  chemically synthesized
tctaaatgagtgggatcgtggc

SEQ ID NO: 707689 - DNA, 22 bp, Artificial Sequence
  chemically synthesized
atctaaatgagtgggatcgtgg

SEQ ID NO: 707690 - DNA, 22 bp, Artificial Sequence
  chemically synthesized
ctaaaagccacgatcccactca

SEQ ID NO: 707691 - DNA, 22 bp, Artificial Sequence
  chemically synthesized
aaagccacgatcccactcattt

SEQ ID NO: 707692 - DNA, 22 bp, Artificial Sequence
  chemically synthesized
aagcagtttatctaaatgagtg

SEQ ID NO: 707693 - DNA, 22 bp, Artificial Sequence
  chemically synthesized
atttagataaactgctttaact

SEQ ID NO: 707694 - DNA, 22 bp, Artificial Sequence
  chemically synthesized
agataaactgctttaacttatc

SEQ ID NO: 707695 - DNA, 22 bp, Artificial Sequence
  chemically synthesized
ccaagaaaaagggataagttaa

SEQ ID NO: 707696 - DNA, 22 bp, Artificial Sequence
  chemically synthesized
gataaactgctttaacttatcc

SEQ ID NO: 707697 - DNA, 22 bp, Artificial Sequence
  chemically synthesized
gagttgccaagaaaaagggata

SEQ ID NO: 707698 - DNA, 22 bp, Artificial Sequence
  chemically synthesized
ggagttgccaagaaaaagggat

SEQ ID NO: 707699 - DNA, 22 bp, Artificial Sequence
  chemically synthesized
tggagttgccaagaaaaaggga

SEQ ID NO: 707700 - DNA, 22 bp, Artificial Sequence
  chemically synthesized
ctttaacttatccctttttctt

SEQ ID NO: 707701 - DNA, 22 bp, Artificial Sequence
  chemically synthesized
taacttatccctttttcttggc

SEQ ID NO: 707702 - DNA, 22 bp, Artificial Sequence
  chemically synthesized
aacttatccctttttcttggca

SEQ ID NO: 707703 - DNA, 22 bp, Artificial Sequence
  chemically synthesized
acttatccctttttcttggcaa

SEQ ID NO: 707704 - DNA, 22 bp, Artificial Sequence
  chemically synthesized
acaatgctttggagttgccaag

SEQ ID NO: 707705 - DNA, 22 bp, Artificial Sequence
  chemically synthesized
cacaatgctttggagttgccaa

SEQ ID NO: 707706 - DNA, 22 bp, Artificial Sequence
  chemically synthesized
atccctttttcttggcaactcc

SEQ ID NO: 707707 - DNA, 22 bp, Artificial Sequence
  chemically synthesized
tccctttttcttggcaactcca

SEQ ID NO: 707708 - DNA, 22 bp, Artificial Sequence
  chemically synthesized
tttcttggcaactccaaagcat

SEQ ID NO: 707709 - DNA, 22 bp, Artificial Sequence
  chemically synthesized
ttcttggcaactccaaagcatt

SEQ ID NO: 707710 - DNA, 22 bp, Artificial Sequence
  chemically synthesized
tcttggcaactccaaagcattg

SEQ ID NO: 707711 - DNA, 22 bp, Artificial Sequence
  chemically synthesized
gacacagtttcacaatgctttg

SEQ ID NO: 707712 - DNA, 22 bp, Artificial Sequence
  chemically synthesized
cttggcaactccaaagcattgt

SEQ ID NO: 707713 - DNA, 22 bp, Artificial Sequence
  chemically synthesized
ggacacagtttcacaatgcttt

SEQ ID NO: 707714 - DNA, 22 bp, Artificial Sequence
  chemically synthesized
ttggcaactccaaagcattgtg

SEQ ID NO: 707715 - DNA, 22 bp, Artificial Sequence
  chemically synthesized
ggcaactccaaagcattgtgaa

SEQ ID NO: 707716 - DNA, 22 bp, Artificial Sequence
  chemically synthesized
tttggacacagtttcacaatgc

SEQ ID NO: 707717 - DNA, 22 bp, Artificial Sequence
  chemically synthesized
gcaactccaaagcattgtgaaa

SEQ ID NO: 707718 - DNA, 22 bp, Artificial Sequence
  chemically synthesized
gttatttggacacagtttcaca

SEQ ID NO: 707719 - DNA, 22 bp, Artificial Sequence
  chemically synthesized
caaagcattgtgaaactgtgtc

SEQ ID NO: 707720 - DNA, 22 bp, Artificial Sequence
  chemically synthesized
tgaaactgtgtccaaataacta

SEQ ID NO: 707721 - DNA, 22 bp, Artificial Sequence
  chemically synthesized
tccgcatgtggtctagttattt

SEQ ID NO: 707722 - DNA, 22 bp, Artificial Sequence
  chemically synthesized
ttatccgcatgtggtctagtta

SEQ ID NO: 707723 - DNA, 22 bp, Artificial Sequence
  chemically synthesized
attatccgcatgtggtctagtt

SEQ ID NO: 707724 - DNA, 22 bp, Artificial Sequence
  chemically synthesized
tattatccgcatgtggtctagt

SEQ ID NO: 707725 - DNA, 22 bp, Artificial Sequence
  chemically synthesized
tgtccaaataactagaccacat

SEQ ID NO: 707726 - DNA, 22 bp, Artificial Sequence
  chemically synthesized
actttattatccgcatgtggtc

SEQ ID NO: 707727 - DNA, 22 bp, Artificial Sequence
  chemically synthesized
taactttattatccgcatgtgg

SEQ ID NO: 707728 - DNA, 22 bp, Artificial Sequence
  chemically synthesized
gctctaactttattatccgcat

SEQ ID NO: 707729 - DNA, 22 bp, Artificial Sequence
  chemically synthesized
gactggctctaactttattatc

SEQ ID NO: 707730 - DNA, 22 bp, Artificial Sequence
  chemically synthesized
gaccacatgcggataataaagt

SEQ ID NO: 707731 - DNA, 22 bp, Artificial Sequence
  chemically synthesized
tggactggctctaactttatta

SEQ ID NO: 707732 - DNA, 22 bp, Artificial Sequence
  chemically synthesized
ctggactggctctaactttatt

SEQ ID NO: 707733 - DNA, 22 bp, Artificial Sequence
  chemically synthesized
tctggactggctctaactttat

SEQ ID NO: 707734 - DNA, 22 bp, Artificial Sequence
  chemically synthesized
ttttctggactggctctaactt

SEQ ID NO: 707735 - DNA, 22 bp, Artificial Sequence
  chemically synthesized
attttctggactggctctaact

SEQ ID NO: 707736 - DNA, 22 bp, Artificial Sequence
  chemically synthesized
agaagaagtatcttattttctg

SEQ ID NO: 707737 - DNA, 22 bp, Artificial Sequence
  chemically synthesized
gagccagtccagaaaataagat

SEQ ID NO: 707738 - DNA, 22 bp, Artificial Sequence
  chemically synthesized
tcatacatcgataatagattaa

SEQ ID NO: 707739 - DNA, 22 bp, Artificial Sequence
  chemically synthesized
gtcatacatcgataatagatta

SEQ ID NO: 707740 - DNA, 22 bp, Artificial Sequence
  chemically synthesized
tgtcatacatcgataatagatt

SEQ ID NO: 707741 - DNA, 22 bp, Artificial Sequence
  chemically synthesized
ttgtcatacatcgataatagat

SEQ ID NO: 707742 - DNA, 22 bp, Artificial Sequence
  chemically synthesized
cttcttaatctattatcgatgt

SEQ ID NO: 707743 - DNA, 22 bp, Artificial Sequence
  chemically synthesized
tgtttttgtcatacatcgataa

SEQ ID NO: 707744 - DNA, 22 bp, Artificial Sequence
  chemically synthesized
ttcttaatctattatcgatgta

SEQ ID NO: 707745 - DNA, 22 bp, Artificial Sequence
  chemically synthesized
cttaatctattatcgatgtatg

SEQ ID NO: 707746 - DNA, 22 bp, Artificial Sequence
  chemically synthesized
ttaatctattatcgatgtatga

SEQ ID NO: 707747 - DNA, 22 bp, Artificial Sequence
  chemically synthesized
aatctattatcgatgtatgaca

SEQ ID NO: 707748 - DNA, 22 bp, Artificial Sequence
  chemically synthesized
gtcctgtgtttttgtcatacat

SEQ ID NO: 707749 - DNA, 22 bp, Artificial Sequence
  chemically synthesized
atctattatcgatgtatgacaa

SEQ ID NO: 707750 - DNA, 22 bp, Artificial Sequence
  chemically synthesized
ttatcgatgtatgacaaaaaca

SEQ ID NO: 707751 - DNA, 22 bp, Artificial Sequence
  chemically synthesized
tcgatgtatgacaaaaacacag

SEQ ID NO: 707752 - DNA, 22 bp, Artificial Sequence
  chemically synthesized
gaaggtgttggtcctgtgtttt

SEQ ID NO: 707753 - DNA, 22 bp, Artificial Sequence
  chemically synthesized
ctggaaggtgttggtcctgtgt

SEQ ID NO: 707754 - DNA, 22 bp, Artificial Sequence
  chemically synthesized
cctggaaggtgttggtcctgtg

SEQ ID NO: 707755 - DNA, 22 bp, Artificial Sequence
  chemically synthesized
aacaaaatttcctggaaggtgt

SEQ ID NO: 707756 - DNA, 22 bp, Artificial Sequence
  chemically synthesized
gaacaaaatttcctggaaggtg

SEQ ID NO: 707757 - DNA, 22 bp, Artificial Sequence
  chemically synthesized
tgaacaaaatttcctggaaggt

SEQ ID NO: 707758 - DNA, 22 bp, Artificial Sequence
  chemically synthesized
ttgaacaaaatttcctggaagg

SEQ ID NO: 707759 - DNA, 22 bp, Artificial Sequence
  chemically synthesized
tttgaacaaaatttcctggaag

SEQ ID NO: 707760 - DNA, 22 bp, Artificial Sequence
  chemically synthesized
tctttttgaacaaaatttcctg

SEQ ID NO: 707761 - DNA, 22 bp, Artificial Sequence
  chemically synthesized
ttgtctttttgaacaaaatttc

SEQ ID NO: 707762 - DNA, 22 bp, Artificial Sequence
  chemically synthesized
gctgttgtctttttgaacaaaa

SEQ ID NO: 707763 - DNA, 22 bp, Artificial Sequence
  chemically synthesized
ccaggaaattttgttcaaaaag

SEQ ID NO: 707764 - DNA, 22 bp, Artificial Sequence
  chemically synthesized
caggaaattttgttcaaaaaga

SEQ ID NO: 707765 - DNA, 22 bp, Artificial Sequence
  chemically synthesized
cagttggctgttgtctttttga

SEQ ID NO: 707766 - DNA, 22 bp, Artificial Sequence
  chemically synthesized
tgttcaaaaagacaacagccaa

SEQ ID NO: 707767 - DNA, 22 bp, Artificial Sequence
  chemically synthesized
gttcaaaaagacaacagccaac

SEQ ID NO: 707768 - DNA, 22 bp, Artificial Sequence
  chemically synthesized
ttcaaaaagacaacagccaact

SEQ ID NO: 707769 - DNA, 22 bp, Artificial Sequence
  chemically synthesized
tcatgtgtgtctccagttggct

SEQ ID NO: 707770 - DNA, 22 bp, Artificial Sequence
  chemically synthesized
aaaaagacaacagccaactgga

SEQ ID NO: 707771 - DNA, 22 bp, Artificial Sequence
  chemically synthesized
agtagatgttgtcatgtgtgtc

SEQ ID NO: 707772 - DNA, 22 bp, Artificial Sequence
  chemically synthesized
gagtagatgttgtcatgtgtgt

SEQ ID NO: 707773 - DNA, 22 bp, Artificial Sequence
  chemically synthesized
aagtatttgagtagatgttgtc

SEQ ID NO: 707774 - DNA, 22 bp, Artificial Sequence
  chemically synthesized
gagacacacatgacaacatcta

SEQ ID NO: 707775 - DNA, 22 bp, Artificial Sequence
  chemically synthesized
aaagtatttgagtagatgttgt

SEQ ID NO: 707776 - DNA, 22 bp, Artificial Sequence
  chemically synthesized
taaagtatttgagtagatgttg

SEQ ID NO: 707777 - DNA, 22 bp, Artificial Sequence
  chemically synthesized
acaaatactttaaagtatttga

SEQ ID NO: 707778 - DNA, 22 bp, Artificial Sequence
  chemically synthesized
ctcaaatactttaaagtatttg

SEQ ID NO: 707779 - DNA, 22 bp, Artificial Sequence
  chemically synthesized
aaatactttaaagtatttgtga

SEQ ID NO: 707780 - DNA, 22 bp, Artificial Sequence
  chemically synthesized
ataaaaagatccacgctcacaa

SEQ ID NO: 707781 - DNA, 22 bp, Artificial Sequence
  chemically synthesized
taaagtatttgtgagcgtggat

SEQ ID NO: 707782 - DNA, 22 bp, Artificial Sequence
  chemically synthesized
aaagtatttgtgagcgtggatc

SEQ ID NO: 707783 - DNA, 22 bp, Artificial Sequence
  chemically synthesized
aagtatttgtgagcgtggatct

SEQ ID NO: 707784 - DNA, 22 bp, Artificial Sequence
  chemically synthesized
cacgggttaataaaaagatcca

SEQ ID NO: 707785 - DNA, 22 bp, Artificial Sequence
  chemically synthesized
tccacgggttaataaaaagatc

SEQ ID NO: 707786 - DNA, 22 bp, Artificial Sequence
  chemically synthesized
gtgagcgtggatctttttatta

SEQ ID NO: 707787 - DNA, 22 bp, Artificial Sequence
  chemically synthesized
tgagcgtggatctttttattaa

SEQ ID NO: 707788 - DNA, 22 bp, Artificial Sequence
  chemically synthesized
cattctccacgggttaataaaa

SEQ ID NO: 707789 - DNA, 22 bp, Artificial Sequence
  chemically synthesized
ccattctccacgggttaataaa

SEQ ID NO: 707790 - DNA, 22 bp, Artificial Sequence
  chemically synthesized
tccattctccacgggttaataa

SEQ ID NO: 707791 - DNA, 22 bp, Artificial Sequence
  chemically synthesized
ttccattctccacgggttaata

SEQ ID NO: 707792 - DNA, 22 bp, Artificial Sequence
  chemically synthesized
ttttccattctccacgggttaa

SEQ ID NO: 707793 - DNA, 22 bp, Artificial Sequence
  chemically synthesized
cttttccattctccacgggtta

SEQ ID NO: 707794 - DNA, 22 bp, Artificial Sequence
  chemically synthesized
tcttttccattctccacgggtt

SEQ ID NO: 707795 - DNA, 22 bp, Artificial Sequence
  chemically synthesized
ctttcttttccattctccacgg

SEQ ID NO: 707796 - DNA, 22 bp, Artificial Sequence
  chemically synthesized
cctttcttttccattctccacg

SEQ ID NO: 707797 - DNA, 22 bp, Artificial Sequence
  chemically synthesized
tttattaacccgtggagaatgg

SEQ ID NO: 707798 - DNA, 22 bp, Artificial Sequence
  chemically synthesized
ttattaacccgtggagaatgga

SEQ ID NO: 707799 - DNA, 22 bp, Artificial Sequence
  chemically synthesized
tattaacccgtggagaatggaa

SEQ ID NO: 707800 - DNA, 22 bp, Artificial Sequence
  chemically synthesized
attaacccgtggagaatggaaa

SEQ ID NO: 707801 - DNA, 22 bp, Artificial Sequence
  chemically synthesized
ttaacccgtggagaatggaaaa

SEQ ID NO: 707802 - DNA, 22 bp, Artificial Sequence
  chemically synthesized
atcatttcctttcttttccatt

SEQ ID NO: 707803 - DNA, 22 bp, Artificial Sequence
  chemically synthesized
acccgtggagaatggaaaagaa

SEQ ID NO: 707804 - DNA, 22 bp, Artificial Sequence
  chemically synthesized
tgatcatttcctttcttttcca

SEQ ID NO: 707805 - DNA, 22 bp, Artificial Sequence
  chemically synthesized
ctgatcatttcctttcttttcc

SEQ ID NO: 707806 - DNA, 22 bp, Artificial Sequence
  chemically synthesized
tctgatcatttcctttcttttc

SEQ ID NO: 707807 - DNA, 22 bp, Artificial Sequence
  chemically synthesized
ccattttctgatcatttccttt

SEQ ID NO: 707808 - DNA, 22 bp, Artificial Sequence
  chemically synthesized
attgccattttctgatcatttc

SEQ ID NO: 707809 - DNA, 22 bp, Artificial Sequence
  chemically synthesized
cattgccattttctgatcattt

SEQ ID NO: 707810 - DNA, 22 bp, Artificial Sequence
  chemically synthesized
tcattgccattttctgatcatt

SEQ ID NO: 707811 - DNA, 22 bp, Artificial Sequence
  chemically synthesized
tttcattgccattttctgatca

SEQ ID NO: 707812 - DNA, 22 bp, Artificial Sequence
  chemically synthesized
ccatattctttcattgccattt

SEQ ID NO: 707813 - DNA, 22 bp, Artificial Sequence
  chemically synthesized
tgccatattctttcattgccat

SEQ ID NO: 707814 - DNA, 22 bp, Artificial Sequence
  chemically synthesized
ctgccatattctttcattgcca

SEQ ID NO: 707815 - DNA, 22 bp, Artificial Sequence
  chemically synthesized
ttctgccatattctttcattgc

SEQ ID NO: 707816 - DNA, 22 bp, Artificial Sequence
  chemically synthesized
cattcttctgccatattctttc

SEQ ID NO: 707817 - DNA, 22 bp, Artificial Sequence
  chemically synthesized
tatgatctccattcttctgcca

SEQ ID NO: 707818 - DNA, 22 bp, Artificial Sequence
  chemically synthesized
tgtatgatctccattcttctgc

SEQ ID NO: 707819 - DNA, 22 bp, Artificial Sequence
  chemically synthesized
tagagaggaagtaattctgtat

SEQ ID NO: 707820 - DNA, 22 bp, Artificial Sequence
  chemically synthesized
atagagaggaagtaattctgta

SEQ ID NO: 707821 - DNA, 22 bp, Artificial Sequence
  chemically synthesized
tatagagaggaagtaattctgt

SEQ ID NO: 707822 - DNA, 22 bp, Artificial Sequence
  chemically synthesized
tatattttatagagaggaagta

SEQ ID NO: 707823 - DNA, 22 bp, Artificial Sequence
  chemically synthesized
atatattttatagagaggaagt

SEQ ID NO: 707824 - DNA, 22 bp, Artificial Sequence
  chemically synthesized
atttatatattttatagagagg

SEQ ID NO: 707825 - DNA, 22 bp, Artificial Sequence
  chemically synthesized
aatttatatattttatagagag

SEQ ID NO: 707826 - DNA, 22 bp, Artificial Sequence
  chemically synthesized
cttaatttatatattttataga

SEQ ID NO: 707827 - DNA, 22 bp, Artificial Sequence
  chemically synthesized
acttaatttatatattttatag

SEQ ID NO: 707828 - DNA, 22 bp, Artificial Sequence
  chemically synthesized
tacttaatttatatattttata

SEQ ID NO: 707829 - DNA, 22 bp, Artificial Sequence
  chemically synthesized
cttcctctctataaaatatata

SEQ ID NO: 707830 - DNA, 22 bp, Artificial Sequence
  chemically synthesized
cctctctataaaatatataaat

SEQ ID NO: 707831 - DNA, 22 bp, Artificial Sequence
  chemically synthesized
taattttacttaatttatatat

SEQ ID NO: 707832 - DNA, 22 bp, Artificial Sequence
  chemically synthesized
ctctctataaaatatataaatt

SEQ ID NO: 707833 - DNA, 22 bp, Artificial Sequence
  chemically synthesized
tctataaaatatataaattaag

SEQ ID NO: 707834 - DNA, 22 bp, Artificial Sequence
  chemically synthesized
tataaaatatataaattaagta

SEQ ID NO: 707835 - DNA, 22 bp, Artificial Sequence
  chemically synthesized
taaaatatataaattaagtaaa

SEQ ID NO: 707836 - DNA, 22 bp, Artificial Sequence
  chemically synthesized
agcatcgcactgtaattttact

SEQ ID NO: 707837 - DNA, 22 bp, Artificial Sequence
  chemically synthesized
aagcatcgcactgtaattttac

SEQ ID NO: 707838 - DNA, 22 bp, Artificial Sequence
  chemically synthesized
taagcatcgcactgtaatttta

SEQ ID NO: 707839 - DNA, 22 bp, Artificial Sequence
  chemically synthesized
ttaagcatcgcactgtaatttt

SEQ ID NO: 707840 - DNA, 22 bp, Artificial Sequence
  chemically synthesized
tgtttttaagcatcgcactgta

SEQ ID NO: 707841 - DNA, 22 bp, Artificial Sequence
  chemically synthesized
agtaaaattacagtgcgatgct

SEQ ID NO: 707842 - DNA, 22 bp, Artificial Sequence
  chemically synthesized
cagagtctgtgtttttaagcat

SEQ ID NO: 707843 - DNA, 22 bp, Artificial Sequence
  chemically synthesized
gctccagagtctgtgtttttaa

SEQ ID NO: 707844 - DNA, 22 bp, Artificial Sequence
  chemically synthesized
cagtgcgatgcttaaaaacaca

SEQ ID NO: 707845 - DNA, 22 bp, Artificial Sequence
  chemically synthesized
aagaagttggctccagagtctg

SEQ ID NO: 707846 - DNA, 22 bp, Artificial Sequence
  chemically synthesized
aaaaacacagactctggagcca

SEQ ID NO: 707847 - DNA, 22 bp, Artificial Sequence
  chemically synthesized
aaaacacagactctggagccaa

SEQ ID NO: 707848 - DNA, 22 bp, Artificial Sequence
  chemically synthesized
aaactcaagaagttggctccag

SEQ ID NO: 707849 - DNA, 22 bp, Artificial Sequence
  chemically synthesized
tggagccaacttcttgagtttc

SEQ ID NO: 707850 - DNA, 22 bp, Artificial Sequence
  chemically synthesized
gagccaacttcttgagtttcaa

SEQ ID NO: 707851 - DNA, 22 bp, Artificial Sequence
  chemically synthesized
gtagatgagggagccaggattg

SEQ ID NO: 707852 - DNA, 22 bp, Artificial Sequence
  chemically synthesized
cttgagtttcaatcctggctcc

SEQ ID NO: 707853 - DNA, 22 bp, Artificial Sequence
  chemically synthesized
ttgagtttcaatcctggctccc

SEQ ID NO: 707854 - DNA, 22 bp, Artificial Sequence
  chemically synthesized
gagtttcaatcctggctccctc

SEQ ID NO: 707855 - DNA, 22 bp, Artificial Sequence
  chemically synthesized
agtttcaatcctggctccctca

SEQ ID NO: 707856 - DNA, 22 bp, Artificial Sequence
  chemically synthesized
atacagctagtagatgagggag

SEQ ID NO: 707857 - DNA, 22 bp, Artificial Sequence
  chemically synthesized
caatcctggctccctcatctac

SEQ ID NO: 707858 - DNA, 22 bp, Artificial Sequence
  chemically synthesized
aatcctggctccctcatctact

SEQ ID NO: 707859 - DNA, 22 bp, Artificial Sequence
  chemically synthesized
gctccctcatctactagctgta

SEQ ID NO: 707860 - DNA, 22 bp, Artificial Sequence
  chemically synthesized
aggcacacattcatacagctag

SEQ ID NO: 707861 - DNA, 22 bp, Artificial Sequence
  chemically synthesized
cctcatctactagctgtatgaa

SEQ ID NO: 707862 - DNA, 22 bp, Artificial Sequence
  chemically synthesized
atctactagctgtatgaatgtg

SEQ ID NO: 707863 - DNA, 22 bp, Artificial Sequence
  chemically synthesized
ctagctgtatgaatgtgtgcct

SEQ ID NO: 707864 - DNA, 22 bp, Artificial Sequence
  chemically synthesized
gctgtatgaatgtgtgcctcag

SEQ ID NO: 707865 - DNA, 22 bp, Artificial Sequence
  chemically synthesized
aatgatgaagaaactgaggcac

SEQ ID NO: 707866 - DNA, 22 bp, Artificial Sequence
  chemically synthesized
caatgatgaagaaactgaggca

SEQ ID NO: 707867 - DNA, 22 bp, Artificial Sequence
  chemically synthesized
tatgaatgtgtgcctcagtttc

SEQ ID NO: 707868 - DNA, 22 bp, Artificial Sequence
  chemically synthesized
tacccatttcaatgatgaagaa

SEQ ID NO: 707869 - DNA, 22 bp, Artificial Sequence
  chemically synthesized
ttatacccatttcaatgatgaa

SEQ ID NO: 707870 - DNA, 22 bp, Artificial Sequence
  chemically synthesized
agtttcttcatcattgaaatgg

SEQ ID NO: 707871 - DNA, 22 bp, Artificial Sequence
  chemically synthesized
cttcatcattgaaatgggtata

SEQ ID NO: 707872 - DNA, 22 bp, Artificial Sequence
  chemically synthesized
ttcatcattgaaatgggtataa

SEQ ID NO: 707873 - DNA, 22 bp, Artificial Sequence
  chemically synthesized
catcattgaaatgggtataata

SEQ ID NO: 707874 - DNA, 22 bp, Artificial Sequence
  chemically synthesized
atcattgaaatgggtataataa

SEQ ID NO: 707875 - DNA, 22 bp, Artificial Sequence
  chemically synthesized
aggtaggtaccattattatacc

SEQ ID NO: 707876 - DNA, 22 bp, Artificial Sequence
  chemically synthesized
aaggtaggtaccattattatac

SEQ ID NO: 707877 - DNA, 22 bp, Artificial Sequence
  chemically synthesized
aaatgggtataataatggtacc

SEQ ID NO: 707878 - DNA, 22 bp, Artificial Sequence
  chemically synthesized
aatcccttaaggtaggtaccat

SEQ ID NO: 707879 - DNA, 22 bp, Artificial Sequence
  chemically synthesized
caatcccttaaggtaggtacca

SEQ ID NO: 707880 - DNA, 22 bp, Artificial Sequence
  chemically synthesized
tagcaatcccttcaatccctta

SEQ ID NO: 707881 - DNA, 22 bp, Artificial Sequence
  chemically synthesized
atagcaatcccttcaatccctt

SEQ ID NO: 707882 - DNA, 22 bp, Artificial Sequence
  chemically synthesized
atccttatagcaatcccttcaa

SEQ ID NO: 707883 - DNA, 22 bp, Artificial Sequence
  chemically synthesized
aatccttatagcaatcccttca

SEQ ID NO: 707884 - DNA, 22 bp, Artificial Sequence
  chemically synthesized
ccttaagggattgaagggattg

SEQ ID NO: 707885 - DNA, 22 bp, Artificial Sequence
  chemically synthesized
gtttaatccttatagcaatccc

SEQ ID NO: 707886 - DNA, 22 bp, Artificial Sequence
  chemically synthesized
aagggattgaagggattgctat

SEQ ID NO: 707887 - DNA, 22 bp, Artificial Sequence
  chemically synthesized
agggattgaagggattgctata

SEQ ID NO: 707888 - DNA, 22 bp, Artificial Sequence
  chemically synthesized
actagtttaatccttatagcaa

SEQ ID NO: 707889 - DNA, 22 bp, Artificial Sequence
  chemically synthesized
aactagtttaatccttatagca

SEQ ID NO: 707890 - DNA, 22 bp, Artificial Sequence
  chemically synthesized
taactagtttaatccttatagc

SEQ ID NO: 707891 - DNA, 22 bp, Artificial Sequence
  chemically synthesized
aagggattgctataaggattaa

SEQ ID NO: 707892 - DNA, 22 bp, Artificial Sequence
  chemically synthesized
cagattttaactagtttaatcc

SEQ ID NO: 707893 - DNA, 22 bp, Artificial Sequence
  chemically synthesized
ctataaggattaaactagttaa

SEQ ID NO: 707894 - DNA, 22 bp, Artificial Sequence
  chemically synthesized
taaggattaaactagttaaaat

SEQ ID NO: 707895 - DNA, 22 bp, Artificial Sequence
  chemically synthesized
gaaatgttacagattttaacta

SEQ ID NO: 707896 - DNA, 22 bp, Artificial Sequence
  chemically synthesized
tgcctagaaatgttacagattt

SEQ ID NO: 707897 - DNA, 22 bp, Artificial Sequence
  chemically synthesized
gtgcctagaaatgttacagatt

SEQ ID NO: 707898 - DNA, 22 bp, Artificial Sequence
  chemically synthesized
tgtgcctagaaatgttacagat

SEQ ID NO: 707899 - DNA, 22 bp, Artificial Sequence
  chemically synthesized
aactagttaaaatctgtaacat

SEQ ID NO: 707900 - DNA, 22 bp, Artificial Sequence
  chemically synthesized
ctttgtgcctagaaatgttaca

SEQ ID NO: 707901 - DNA, 22 bp, Artificial Sequence
  chemically synthesized
gttaaaatctgtaacatttcta

SEQ ID NO: 707902 - DNA, 22 bp, Artificial Sequence
  chemically synthesized
aaatctgtaacatttctaggca

SEQ ID NO: 707903 - DNA, 22 bp, Artificial Sequence
  chemically synthesized
acgcaattactttgtgcctaga

SEQ ID NO: 707904 - DNA, 22 bp, Artificial Sequence
  chemically synthesized
aacgcaattactttgtgcctag

SEQ ID NO: 707905 - DNA, 22 bp, Artificial Sequence
  chemically synthesized
taacgcaattactttgtgccta

SEQ ID NO: 707906 - DNA, 22 bp, Artificial Sequence
  chemically synthesized
taacatttctaggcacaaagta

SEQ ID NO: 707907 - DNA, 22 bp, Artificial Sequence
  chemically synthesized
tccatcattttaacgcaattac

SEQ ID NO: 707908 - DNA, 22 bp, Artificial Sequence
  chemically synthesized
ctaggcacaaagtaattgcgtt

SEQ ID NO: 707909 - DNA, 22 bp, Artificial Sequence
  chemically synthesized
atccatcattttaacgcaatta

SEQ ID NO: 707910 - DNA, 22 bp, Artificial Sequence
  chemically synthesized
taggcacaaagtaattgcgtta

SEQ ID NO: 707911 - DNA, 22 bp, Artificial Sequence
  chemically synthesized
ggcacaaagtaattgcgttaaa

SEQ ID NO: 707912 - DNA, 22 bp, Artificial Sequence
  chemically synthesized
cgttaaaatgatggataaaccc

SEQ ID NO: 707913 - DNA, 22 bp, Artificial Sequence
  chemically synthesized
aaatgatggataaaccctcata

SEQ ID NO: 707914 - DNA, 22 bp, Artificial Sequence
  chemically synthesized
tggtcatatatgagtatatatg

SEQ ID NO: 707915 - DNA, 22 bp, Artificial Sequence
  chemically synthesized
gtggtcatatatgagtatatat

SEQ ID NO: 707916 - DNA, 22 bp, Artificial Sequence
  chemically synthesized
cttgtggtcatatatgagtata

SEQ ID NO: 707917 - DNA, 22 bp, Artificial Sequence
  chemically synthesized
ccttgtggtcatatatgagtat

SEQ ID NO: 707918 - DNA, 22 bp, Artificial Sequence
  chemically synthesized
atatatactcatatatgaccac

SEQ ID NO: 707919 - DNA, 22 bp, Artificial Sequence
  chemically synthesized
atgtatttccttgtggtcatat

SEQ ID NO: 707920 - DNA, 22 bp, Artificial Sequence
  chemically synthesized
tgatgtatttccttgtggtcat

SEQ ID NO: 707921 - DNA, 22 bp, Artificial Sequence
  chemically synthesized
gcattctgatgtatttccttgt

SEQ ID NO: 707922 - DNA, 22 bp, Artificial Sequence
  chemically synthesized
atatatgaccacaaggaaatac

SEQ ID NO: 707923 - DNA, 22 bp, Artificial Sequence
  chemically synthesized
ttagcattctgatgtatttcct

SEQ ID NO: 707924 - DNA, 22 bp, Artificial Sequence
  chemically synthesized
acatctgttagcattctgatgt

SEQ ID NO: 707925 - DNA, 22 bp, Artificial Sequence
  chemically synthesized
ccacatggagttaacatctgtt

SEQ ID NO: 707926 - DNA, 22 bp, Artificial Sequence
  chemically synthesized
accacatggagttaacatctgt

SEQ ID NO: 707927 - DNA, 22 bp, Artificial Sequence
  chemically synthesized
taccacatggagttaacatctg

SEQ ID NO: 707928 - DNA, 22 bp, Artificial Sequence
  chemically synthesized
acagatgttaactccatgtggt

SEQ ID NO: 707929 - DNA, 22 bp, Artificial Sequence
  chemically synthesized
aaaagccatactttaccacatg

SEQ ID NO: 707930 - DNA, 22 bp, Artificial Sequence
  chemically synthesized
aaaaagccatactttaccacat

SEQ ID NO: 707931 - DNA, 22 bp, Artificial Sequence
  chemically synthesized
gtatttaaaaagccatacttta

SEQ ID NO: 707932 - DNA, 22 bp, Artificial Sequence
  chemically synthesized
actccatgtggtaaagtatggc

SEQ ID NO: 707933 - DNA, 22 bp, Artificial Sequence
  chemically synthesized
ggtatttaaaaagccatacttt

SEQ ID NO: 707934 - DNA, 22 bp, Artificial Sequence
  chemically synthesized
tggtatttaaaaagccatactt

SEQ ID NO: 707935 - DNA, 22 bp, Artificial Sequence
  chemically synthesized
ttggtatttaaaaagccatact

SEQ ID NO: 707936 - DNA, 22 bp, Artificial Sequence
  chemically synthesized
tttggtatttaaaaagccatac

SEQ ID NO: 707937 - DNA, 22 bp, Artificial Sequence
  chemically synthesized
catgtggtaaagtatggctttt

SEQ ID NO: 707938 - DNA, 22 bp, Artificial Sequence
  chemically synthesized
agttttttggtatttaaaaagc

SEQ ID NO: 707939 - DNA, 22 bp, Artificial Sequence
  chemically synthesized
tttaaataccaaaaaactcaac

SEQ ID NO: 707940 - DNA, 22 bp, Artificial Sequence
  chemically synthesized
ttaaataccaaaaaactcaaca

SEQ ID NO: 707941 - DNA, 22 bp, Artificial Sequence
  chemically synthesized
taaaagtatatgtgttgagttt

SEQ ID NO: 707942 - DNA, 22 bp, Artificial Sequence
  chemically synthesized
taaataccaaaaaactcaacac

SEQ ID NO: 707943 - DNA, 22 bp, Artificial Sequence
  chemically synthesized
aaataccaaaaaactcaacaca

SEQ ID NO: 707944 - DNA, 22 bp, Artificial Sequence
  chemically synthesized
aataccaaaaaactcaacacat

SEQ ID NO: 707945 - DNA, 22 bp, Artificial Sequence
  chemically synthesized
attataaaagtatatgtgttga

SEQ ID NO: 707946 - DNA, 22 bp, Artificial Sequence
  chemically synthesized
gattataaaagtatatgtgttg

SEQ ID NO: 707947 - DNA, 22 bp, Artificial Sequence
  chemically synthesized
tttgattataaaagtatatgtg

SEQ ID NO: 707948 - DNA, 22 bp, Artificial Sequence
  chemically synthesized
atttgattataaaagtatatgt

SEQ ID NO: 707949 - DNA, 22 bp, Artificial Sequence
  chemically synthesized
tatttgattataaaagtatatg

SEQ ID NO: 707950 - DNA, 22 bp, Artificial Sequence
  chemically synthesized
ttatttgattataaaagtatat

SEQ ID NO: 707951 - DNA, 22 bp, Artificial Sequence
  chemically synthesized
tttatttgattataaaagtata

SEQ ID NO: 707952 - DNA, 22 bp, Artificial Sequence
  chemically synthesized
aacacatatacttttataatca

SEQ ID NO: 707953 - DNA, 22 bp, Artificial Sequence
  chemically synthesized
taccactttttatttgattata

SEQ ID NO: 707954 - DNA, 22 bp, Artificial Sequence
  chemically synthesized
ataccactttttatttgattat

SEQ ID NO: 707955 - DNA, 22 bp, Artificial Sequence
  chemically synthesized
atttataccactttttatttga

SEQ ID NO: 707956 - DNA, 22 bp, Artificial Sequence
  chemically synthesized
ttataatcaaataaaaagtggt

SEQ ID NO: 707957 - DNA, 22 bp, Artificial Sequence
  chemically synthesized
atgttaatttataccacttttt

SEQ ID NO: 707958 - DNA, 22 bp, Artificial Sequence
  chemically synthesized
tataatcaaataaaaagtggta

SEQ ID NO: 707959 - DNA, 22 bp, Artificial Sequence
  chemically synthesized
ataatcaaataaaaagtggtat

SEQ ID NO: 707960 - DNA, 22 bp, Artificial Sequence
  chemically synthesized
taatcaaataaaaagtggtata

SEQ ID NO: 707961 - DNA, 22 bp, Artificial Sequence
  chemically synthesized
attaatgttaatttataccact

SEQ ID NO: 707962 - DNA, 22 bp, Artificial Sequence
  chemically synthesized
tgattaatgttaatttatacca

SEQ ID NO: 707963 - DNA, 22 bp, Artificial Sequence
  chemically synthesized
ctctgattaatgttaatttata

SEQ ID NO: 707964 - DNA, 22 bp, Artificial Sequence
  chemically synthesized
cctctgattaatgttaatttat

SEQ ID NO: 707965 - DNA, 22 bp, Artificial Sequence
  chemically synthesized
tcctctgattaatgttaattta

SEQ ID NO: 707966 - DNA, 22 bp, Artificial Sequence
  chemically synthesized
ttttcctctgattaatgttaat

SEQ ID NO: 707967 - DNA, 22 bp, Artificial Sequence
  chemically synthesized
gcaagcacctgttttcctctga

SEQ ID NO: 707968 - DNA, 22 bp, Artificial Sequence
  chemically synthesized
acattaatcagaggaaaacagg

SEQ ID NO: 707969 - DNA, 22 bp, Artificial Sequence
  chemically synthesized
aattggcaagcacctgttttcc

SEQ ID NO: 707970 - DNA, 22 bp, Artificial Sequence
  chemically synthesized
atcagaggaaaacaggtgcttg

SEQ ID NO: 707971 - DNA, 22 bp, Artificial Sequence
  chemically synthesized
catattaaattggcaagcacct

SEQ ID NO: 707972 - DNA, 22 bp, Artificial Sequence
  chemically synthesized
tacaatattgcatattaaattg

SEQ ID NO: 707973 - DNA, 22 bp, Artificial Sequence
  chemically synthesized
atacaatattgcatattaaatt

SEQ ID NO: 707974 - DNA, 22 bp, Artificial Sequence
  chemically synthesized
tttatacaatattgcatattaa

SEQ ID NO: 707975 - DNA, 22 bp, Artificial Sequence
  chemically synthesized
gccaatttaatatgcaatattg

SEQ ID NO: 707976 - DNA, 22 bp, Artificial Sequence
  chemically synthesized
ccaatttaatatgcaatattgt

SEQ ID NO: 707977 - DNA, 22 bp, Artificial Sequence
  chemically synthesized
gaaaatcctatttatacaatat

SEQ ID NO: 707978 - DNA, 22 bp, Artificial Sequence
  chemically synthesized
aatatgcaatattgtataaata

SEQ ID NO: 707979 - DNA, 22 bp, Artificial Sequence
  chemically synthesized
atatgcaatattgtataaatag

SEQ ID NO: 707980 - DNA, 22 bp, Artificial Sequence
  chemically synthesized
agtattagaaaatcctatttat

SEQ ID NO: 707981 - DNA, 22 bp, Artificial Sequence
  chemically synthesized
aagtattagaaaatcctattta

SEQ ID NO: 707982 - DNA, 22 bp, Artificial Sequence
  chemically synthesized
aaagtttaagtattagaaaatc

SEQ ID NO: 707983 - DNA, 22 bp, Artificial Sequence
  chemically synthesized
tataaataggattttctaatac

SEQ ID NO: 707984 - DNA, 22 bp, Artificial Sequence
  chemically synthesized
actgaaagtttaagtattagaa

SEQ ID NO: 707985 - DNA, 22 bp, Artificial Sequence
  chemically synthesized
gttaactgaaagtttaagtatt

SEQ ID NO: 707986 - DNA, 22 bp, Artificial Sequence
  chemically synthesized
ggttaactgaaagtttaagtat

SEQ ID NO: 707987 - DNA, 22 bp, Artificial Sequence
  chemically synthesized
tctaatacttaaactttcagtt

SEQ ID NO: 707988 - DNA, 22 bp, Artificial Sequence
  chemically synthesized
ctaatacttaaactttcagtta

SEQ ID NO: 707989 - DNA, 22 bp, Artificial Sequence
  chemically synthesized
taatacttaaactttcagttaa

SEQ ID NO: 707990 - DNA, 22 bp, Artificial Sequence
  chemically synthesized
atacttaaactttcagttaacc

SEQ ID NO: 707991 - DNA, 22 bp, Artificial Sequence
  chemically synthesized
agagaaataaccttggttaact

SEQ ID NO: 707992 - DNA, 22 bp, Artificial Sequence
  chemically synthesized
aaactttcagttaaccaaggtt

SEQ ID NO: 707993 - DNA, 22 bp, Artificial Sequence
  chemically synthesized
aactttcagttaaccaaggtta

SEQ ID NO: 707994 - DNA, 22 bp, Artificial Sequence
  chemically synthesized
atactaagagaaataaccttgg

SEQ ID NO: 707995 - DNA, 22 bp, Artificial Sequence
  chemically synthesized
tcagttaaccaaggttatttct

SEQ ID NO: 707996 - DNA, 22 bp, Artificial Sequence
  chemically synthesized
cagttaaccaaggttatttctc

SEQ ID NO: 707997 - DNA, 22 bp, Artificial Sequence
  chemically synthesized
agttaaccaaggttatttctct

SEQ ID NO: 707998 - DNA, 22 bp, Artificial Sequence
  chemically synthesized
taattaatactaagagaaataa

SEQ ID NO: 707999 - DNA, 22 bp, Artificial Sequence
  chemically synthesized
ataattaatactaagagaaata

SEQ ID NO: 708000 - DNA, 22 bp, Artificial Sequence
  chemically synthesized
tataattaatactaagagaaat

SEQ ID NO: 708001 - DNA, 22 bp, Artificial Sequence
  chemically synthesized
ttataattaatactaagagaaa

SEQ ID NO: 708002 - DNA, 22 bp, Artificial Sequence
  chemically synthesized
accaaggttatttctcttagta

SEQ ID NO: 708003 - DNA, 22 bp, Artificial Sequence
  chemically synthesized
tgtttttataattaatactaag

SEQ ID NO: 708004 - DNA, 22 bp, Artificial Sequence
  chemically synthesized
attatgtttttataattaatac

SEQ ID NO: 708005 - DNA, 22 bp, Artificial Sequence
  chemically synthesized
tttctcttagtattaattataa

SEQ ID NO: 708006 - DNA, 22 bp, Artificial Sequence
  chemically synthesized
ttaattatgtttttataattaa

SEQ ID NO: 708007 - DNA, 22 bp, Artificial Sequence
  chemically synthesized
attaattatgtttttataatta

SEQ ID NO: 708008 - DNA, 22 bp, Artificial Sequence
  chemically synthesized
tattaattatgtttttataatt

SEQ ID NO: 708009 - DNA, 22 bp, Artificial Sequence
  chemically synthesized
ctcttagtattaattataaaaa

SEQ ID NO: 708010 - DNA, 22 bp, Artificial Sequence
  chemically synthesized
tcttagtattaattataaaaac

SEQ ID NO: 708011 - DNA, 22 bp, Artificial Sequence
  chemically synthesized
ttttattaattatgtttttata

SEQ ID NO: 708012 - DNA, 22 bp, Artificial Sequence
  chemically synthesized
ttagtattaattataaaaacat

SEQ ID NO: 708013 - DNA, 22 bp, Artificial Sequence
  chemically synthesized
agtattaattataaaaacataa

SEQ ID NO: 708014 - DNA, 22 bp, Artificial Sequence
  chemically synthesized
ctattttattaattatgttttt

SEQ ID NO: 708015 - DNA, 22 bp, Artificial Sequence
  chemically synthesized
gtattaattataaaaacataat

SEQ ID NO: 708016 - DNA, 22 bp, Artificial Sequence
  chemically synthesized
gctattttattaattatgtttt

SEQ ID NO: 708017 - DNA, 22 bp, Artificial Sequence
  chemically synthesized
tgctattttattaattatgttt

SEQ ID NO: 708018 - DNA, 22 bp, Artificial Sequence
  chemically synthesized
gttttgctattttattaattat

SEQ ID NO: 708019 - DNA, 22 bp, Artificial Sequence
  chemically synthesized
attataaaaacataattaataa

SEQ ID NO: 708020 - DNA, 22 bp, Artificial Sequence
  chemically synthesized
ctggttttgctattttattaat

SEQ ID NO: 708021 - DNA, 22 bp, Artificial Sequence
  chemically synthesized
actggttttgctattttattaa

SEQ ID NO: 708022 - DNA, 22 bp, Artificial Sequence
  chemically synthesized
taaaaacataattaataaaata

SEQ ID NO: 708023 - DNA, 22 bp, Artificial Sequence
  chemically synthesized
tttactggttttgctattttat

SEQ ID NO: 708024 - DNA, 22 bp, Artificial Sequence
  chemically synthesized
atttactggttttgctatttta

SEQ ID NO: 708025 - DNA, 22 bp, Artificial Sequence
  chemically synthesized
tatttactggttttgctatttt

SEQ ID NO: 708026 - DNA, 22 bp, Artificial Sequence
  chemically synthesized
ttatttactggttttgctattt

SEQ ID NO: 708027 - DNA, 22 bp, Artificial Sequence
  chemically synthesized
tttatttactggttttgctatt

SEQ ID NO: 708028 - DNA, 22 bp, Artificial Sequence
  chemically synthesized
tttttatttactggttttgcta

SEQ ID NO: 708029 - DNA, 22 bp, Artificial Sequence
  chemically synthesized
ataaaatagcaaaaccagtaaa

SEQ ID NO: 708030 - DNA, 22 bp, Artificial Sequence
  chemically synthesized
gccattctttttatttactggt

SEQ ID NO: 708031 - DNA, 22 bp, Artificial Sequence
  chemically synthesized
tagccattctttttatttactg

SEQ ID NO: 708032 - DNA, 22 bp, Artificial Sequence
  chemically synthesized
acctctagccattctttttatt

SEQ ID NO: 708033 - DNA, 22 bp, Artificial Sequence
  chemically synthesized
gacctctagccattctttttat

SEQ ID NO: 708034 - DNA, 22 bp, Artificial Sequence
  chemically synthesized
ttgacctctagccattcttttt

SEQ ID NO: 708035 - DNA, 22 bp, Artificial Sequence
  chemically synthesized
ttcttgacctctagccattctt

SEQ ID NO: 708036 - DNA, 22 bp, Artificial Sequence
  chemically synthesized
gttcttgacctctagccattct

SEQ ID NO: 708037 - DNA, 22 bp, Artificial Sequence
  chemically synthesized
tgttcttgacctctagccattc

SEQ ID NO: 708038 - DNA, 22 bp, Artificial Sequence
  chemically synthesized
ttgttcttgacctctagccatt

SEQ ID NO: 708039 - DNA, 22 bp, Artificial Sequence
  chemically synthesized
cttttgttcttgacctctagcc

SEQ ID NO: 708040 - DNA, 22 bp, Artificial Sequence
  chemically synthesized
tccttttgttcttgacctctag

SEQ ID NO: 708041 - DNA, 22 bp, Artificial Sequence
  chemically synthesized
tattctccttttgttcttgacc

SEQ ID NO: 708042 - DNA, 22 bp, Artificial Sequence
  chemically synthesized
gtattctccttttgttcttgac

SEQ ID NO: 708043 - DNA, 22 bp, Artificial Sequence
  chemically synthesized
gaggtcaagaacaaaaggagaa

SEQ ID NO: 708044 - DNA, 22 bp, Artificial Sequence
  chemically synthesized
gtgagccttgtattctcctttt

SEQ ID NO: 708045 - DNA, 22 bp, Artificial Sequence
  chemically synthesized
cattcgtgagccttgtattctc

SEQ ID NO: 708046 - DNA, 22 bp, Artificial Sequence
  chemically synthesized
ggattacattcgtgagccttgt

SEQ ID NO: 708047 - DNA, 22 bp, Artificial Sequence
  chemically synthesized
ccaaagtgctaggattacattc

SEQ ID NO: 708048 - DNA, 22 bp, Artificial Sequence
  chemically synthesized
gcctcccaaagtgctaggatta

SEQ ID NO: 708049 - DNA, 22 bp, Artificial Sequence
  chemically synthesized
ggcctcccaaagtgctaggatt

SEQ ID NO: 708050 - DNA, 22 bp, Artificial Sequence
  chemically synthesized
acgaatgtaatcctagcacttt

SEQ ID NO: 708051 - DNA, 22 bp, Artificial Sequence
  chemically synthesized
gccttggcctcccaaagtgcta

SEQ ID NO: 708052 - DNA, 22 bp, Artificial Sequence
  chemically synthesized
aagtgatccactcgccttggcc

SEQ ID NO: 708053 - DNA, 22 bp, Artificial Sequence
  chemically synthesized
gcactttgggaggccaaggcga

SEQ ID NO: 708054 - DNA, 22 bp, Artificial Sequence
  chemically synthesized
acctcaagtgatccactcgcct

SEQ ID NO: 708055 - DNA, 22 bp, Artificial Sequence
  chemically synthesized
tgggaggccaaggcgagtggat

SEQ ID NO: 708056 - DNA, 22 bp, Artificial Sequence
  chemically synthesized
gggaggccaaggcgagtggatc

SEQ ID NO: 708057 - DNA, 22 bp, Artificial Sequence
  chemically synthesized
ctgacctcaagtgatccactcg

SEQ ID NO: 708058 - DNA, 22 bp, Artificial Sequence
  chemically synthesized
ggaggccaaggcgagtggatca

SEQ ID NO: 708059 - DNA, 22 bp, Artificial Sequence
  chemically synthesized
gagctcctgacctcaagtgatc

SEQ ID NO: 708060 - DNA, 22 bp, Artificial Sequence
  chemically synthesized
gtctcgagctcctgacctcaag

SEQ ID NO: 708061 - DNA, 22 bp, Artificial Sequence
  chemically synthesized
gtcaggctggtctcgagctcct

SEQ ID NO: 708062 - DNA, 22 bp, Artificial Sequence
  chemically synthesized
gaggtcaggagctcgagaccag

SEQ ID NO: 708063 - DNA, 22 bp, Artificial Sequence
  chemically synthesized
aggtcaggagctcgagaccagc

SEQ ID NO: 708064 - DNA, 22 bp, Artificial Sequence
  chemically synthesized
accacattggtcaggctggtct

SEQ ID NO: 708065 - DNA, 22 bp, Artificial Sequence
  chemically synthesized
caccacattggtcaggctggtc

SEQ ID NO: 708066 - DNA, 22 bp, Artificial Sequence
  chemically synthesized
gagaccagcctgaccaatgtgg

SEQ ID NO: 708067 - DNA, 22 bp, Artificial Sequence
  chemically synthesized
gtagagacgaggcttcaccaca

SEQ ID NO: 708068 - DNA, 22 bp, Artificial Sequence
  chemically synthesized
agtagagacgaggcttcaccac

SEQ ID NO: 708069 - DNA, 22 bp, Artificial Sequence
  chemically synthesized
tagtagagacgaggcttcacca

SEQ ID NO: 708070 - DNA, 22 bp, Artificial Sequence
  chemically synthesized
ttagtagagacgaggcttcacc

SEQ ID NO: 708071 - DNA, 22 bp, Artificial Sequence
  chemically synthesized
tttagtagagacgaggcttcac

SEQ ID NO: 708072 - DNA, 22 bp, Artificial Sequence
  chemically synthesized
ttttagtagagacgaggcttca

SEQ ID NO: 708073 - DNA, 22 bp, Artificial Sequence
  chemically synthesized
accaatgtggtgaagcctcgtc

SEQ ID NO: 708074 - DNA, 22 bp, Artificial Sequence
  chemically synthesized
tatttttttagtagagacgagg

SEQ ID NO: 708075 - DNA, 22 bp, Artificial Sequence
  chemically synthesized
gtatttttttagtagagacgag

SEQ ID NO: 708076 - DNA, 22 bp, Artificial Sequence
  chemically synthesized
tgtatttttttagtagagacga

SEQ ID NO: 708077 - DNA, 22 bp, Artificial Sequence
  chemically synthesized
ttgtatttttttagtagagacg

SEQ ID NO: 708078 - DNA, 22 bp, Artificial Sequence
  chemically synthesized
gtctctactaaaaaaatacaaa

SEQ ID NO: 708079 - DNA, 22 bp, Artificial Sequence
  chemically synthesized
tactaaaaaaatacaaaaatta

SEQ ID NO: 708080 - DNA, 22 bp, Artificial Sequence
  chemically synthesized
ctaaaaaaatacaaaaattatc

SEQ ID NO: 708081 - DNA, 22 bp, Artificial Sequence
  chemically synthesized
aaaaaatacaaaaattatctgg

SEQ ID NO: 708082 - DNA, 22 bp, Artificial Sequence
  chemically synthesized
caggtgtacaccaccaggccca

SEQ ID NO: 708083 - DNA, 22 bp, Artificial Sequence
  chemically synthesized
ggactacaggtgtacaccacca

SEQ ID NO: 708084 - DNA, 22 bp, Artificial Sequence
  chemically synthesized
tctgggcctggtggtgtacacc

SEQ ID NO: 708085 - DNA, 22 bp, Artificial Sequence
  chemically synthesized
ggcctggtggtgtacacctgta

SEQ ID NO: 708086 - DNA, 22 bp, Artificial Sequence
  chemically synthesized
ccgagtagctgggactacaggt

SEQ ID NO: 708087 - DNA, 22 bp, Artificial Sequence
  chemically synthesized
gtggtgtacacctgtagtccca

SEQ ID NO: 708088 - DNA, 22 bp, Artificial Sequence
  chemically synthesized
agcctcccgagtagctgggact

SEQ ID NO: 708089 - DNA, 22 bp, Artificial Sequence
  chemically synthesized
cctcagcctcccgagtagctgg

SEQ ID NO: 708090 - DNA, 22 bp, Artificial Sequence
  chemically synthesized
ctgcctcagcctcccgagtagc

SEQ ID NO: 708091 - DNA, 22 bp, Artificial Sequence
  chemically synthesized
tcctgcctcagcctcccgagta

SEQ ID NO: 708092 - DNA, 22 bp, Artificial Sequence
  chemically synthesized
tagtcccagctactcgggaggc

SEQ ID NO: 708093 - DNA, 22 bp, Artificial Sequence
  chemically synthesized
ttctcctgcctcagcctcccga

SEQ ID NO: 708094 - DNA, 22 bp, Artificial Sequence
  chemically synthesized
aaactattctcctgcctcagcc

SEQ ID NO: 708095 - DNA, 22 bp, Artificial Sequence
  chemically synthesized
ctcgggaggctgaggcaggaga

SEQ ID NO: 708096 - DNA, 22 bp, Artificial Sequence
  chemically synthesized
gggaggctgaggcaggagaata

SEQ ID NO: 708097 - DNA, 22 bp, Artificial Sequence
  chemically synthesized
ccgggttcaaactattctcctg

SEQ ID NO: 708098 - DNA, 22 bp, Artificial Sequence
  chemically synthesized
cgcctcccgggttcaaactatt

SEQ ID NO: 708099 - DNA, 22 bp, Artificial Sequence
  chemically synthesized
aggcaggagaatagtttgaacc

SEQ ID NO: 708100 - DNA, 22 bp, Artificial Sequence
  chemically synthesized
caacctccgcctcccgggttca

SEQ ID NO: 708101 - DNA, 22 bp, Artificial Sequence
  chemically synthesized
actgcaacctccgcctcccggg

SEQ ID NO: 708102 - DNA, 22 bp, Artificial Sequence
  chemically synthesized
gctcactgcaacctccgcctcc

SEQ ID NO: 708103 - DNA, 22 bp, Artificial Sequence
  chemically synthesized
ggctcactgcaacctccgcctc

SEQ ID NO: 708104 - DNA, 22 bp, Artificial Sequence
  chemically synthesized
gaacccgggaggcggaggttgc

SEQ ID NO: 708105 - DNA, 22 bp, Artificial Sequence
  chemically synthesized
aacccgggaggcggaggttgca

SEQ ID NO: 708106 - DNA, 22 bp, Artificial Sequence
  chemically synthesized
tgagtgcagtggcgtgatcttg

SEQ ID NO: 708107 - DNA, 22 bp, Artificial Sequence
  chemically synthesized
cagtgagccaagatcacgccac

SEQ ID NO: 708108 - DNA, 22 bp, Artificial Sequence
  chemically synthesized
tcacccaggctgtgagtgcagt

SEQ ID NO: 708109 - DNA, 22 bp, Artificial Sequence
  chemically synthesized
tgtcacccaggctgtgagtgca

SEQ ID NO: 708110 - DNA, 22 bp, Artificial Sequence
  chemically synthesized
attctgtcacccaggctgtgag

SEQ ID NO: 708111 - DNA, 22 bp, Artificial Sequence
  chemically synthesized
cactcacagcctgggtgacaga

SEQ ID NO: 708112 - DNA, 22 bp, Artificial Sequence
  chemically synthesized
agagggagcctcattctgtcac

SEQ ID NO: 708113 - DNA, 22 bp, Artificial Sequence
  chemically synthesized
gagagggagcctcattctgtca

SEQ ID NO: 708114 - DNA, 22 bp, Artificial Sequence
  chemically synthesized
tgagagggagcctcattctgtc

SEQ ID NO: 708115 - DNA, 22 bp, Artificial Sequence
  chemically synthesized
acagcctgggtgacagaatgag

SEQ ID NO: 708116 - DNA, 22 bp, Artificial Sequence
  chemically synthesized
ttgagagggagcctcattctgt

SEQ ID NO: 708117 - DNA, 22 bp, Artificial Sequence
  chemically synthesized
tttgagagggagcctcattctg

SEQ ID NO: 708118 - DNA, 22 bp, Artificial Sequence
  chemically synthesized
ttttgagagggagcctcattct

SEQ ID NO: 708119 - DNA, 22 bp, Artificial Sequence
  chemically synthesized
tttttgagagggagcctcattc

SEQ ID NO: 708120 - DNA, 22 bp, Artificial Sequence
  chemically synthesized
ttttttgagagggagcctcatt

SEQ ID NO: 708121 - DNA, 22 bp, Artificial Sequence
  chemically synthesized
tttttttgagagggagcctcat

SEQ ID NO: 708122 - DNA, 22 bp, Artificial Sequence
  chemically synthesized
ttttttttgagagggagcctca

SEQ ID NO: 708123 - DNA, 22 bp, Artificial Sequence
  chemically synthesized
tttttttttgagagggagcctc

SEQ ID NO: 708124 - DNA, 22 bp, Artificial Sequence
  chemically synthesized
ggtgacagaatgaggctccctc

SEQ ID NO: 708125 - DNA, 22 bp, Artificial Sequence
  chemically synthesized
ttttttttttgagagggagcct

SEQ ID NO: 708126 - DNA, 22 bp, Artificial Sequence
  chemically synthesized
tttttttttttgagagggagcc

SEQ ID NO: 708127 - DNA, 22 bp, Artificial Sequence
  chemically synthesized
ttttttttttttgagagggagc

SEQ ID NO: 708128 - DNA, 22 bp, Artificial Sequence
  chemically synthesized
tttttttttttttgagagggag

SEQ ID NO: 708129 - DNA, 22 bp, Artificial Sequence
  chemically synthesized
ttttttttttttttgagaggga

SEQ ID NO: 708130 - DNA, 22 bp, Artificial Sequence
  chemically synthesized
tttttttttttttttgagaggg

SEQ ID NO: 708131 - DNA, 22 bp, Artificial Sequence
  chemically synthesized
ttttttttttttttttgagagg

SEQ ID NO: 708132 - DNA, 22 bp, Artificial Sequence
  chemically synthesized
tttttttttttttttttgagag

SEQ ID NO: 708133 - DNA, 22 bp, Artificial Sequence
  chemically synthesized
ttttttttttttttttttgaga

SEQ ID NO: 708134 - DNA, 22 bp, Artificial Sequence
  chemically synthesized
tttttttttttttttttttgag

SEQ ID NO: 708135 - DNA, 22 bp, Artificial Sequence
  chemically synthesized
ttttttttttttttttttttga

SEQ ID NO: 708136 - DNA, 22 bp, Artificial Sequence
  chemically synthesized
tttttttttttttttttttttg

SEQ ID NO: 708137 - DNA, 22 bp, Artificial Sequence
  chemically synthesized
tttttttttttttttttttttt

SEQ ID NO: 708138 - DNA, 22 bp, Artificial Sequence
  chemically synthesized
tttttttttttttttttttttt

SEQ ID NO: 708139 - DNA, 22 bp, Artificial Sequence
  chemically synthesized
tttttttttttttttttttttt

SEQ ID NO: 708140 - DNA, 22 bp, Artificial Sequence
  chemically synthesized
tttttttttttttttttttttt

SEQ ID NO: 708141 - DNA, 22 bp, Artificial Sequence
  chemically synthesized
tttttttttttttttttttttt

SEQ ID NO: 708142 - DNA, 22 bp, Artificial Sequence
  chemically synthesized
tttttttttttttttttttttt

SEQ ID NO: 708143 - DNA, 22 bp, Artificial Sequence
  chemically synthesized
cctctcaaaaaaaaaaaaaaaa

SEQ ID NO: 708144 - DNA, 22 bp, Artificial Sequence
  chemically synthesized
tttttttttttttttttttttt

SEQ ID NO: 708145 - DNA, 22 bp, Artificial Sequence
  chemically synthesized
tttttttttttttttttttttt

SEQ ID NO: 708146 - DNA, 22 bp, Artificial Sequence
  chemically synthesized
tttttttttttttttttttttt

SEQ ID NO: 708147 - DNA, 22 bp, Artificial Sequence
  chemically synthesized
tttttttttttttttttttttt

SEQ ID NO: 708148 - DNA, 22 bp, Artificial Sequence
  chemically synthesized
tcaaaaaaaaaaaaaaaaaaaa

SEQ ID NO: 708149 - DNA, 22 bp, Artificial Sequence
  chemically synthesized
tttttttttttttttttttttt

SEQ ID NO: 708150 - DNA, 22 bp, Artificial Sequence
  chemically synthesized
tttttttttttttttttttttt

SEQ ID NO: 708151 - DNA, 22 bp, Artificial Sequence
  chemically synthesized
aaaaaaaaaaaaaaaaaaaaaa

SEQ ID NO: 708152 - DNA, 22 bp, Artificial Sequence
  chemically synthesized
cttttttttttttttttttttt

SEQ ID NO: 708153 - DNA, 22 bp, Artificial Sequence
  chemically synthesized
cctttttttttttttttttttt

SEQ ID NO: 708154 - DNA, 22 bp, Artificial Sequence
  chemically synthesized
catccttccttttttttttttt

SEQ ID NO: 708155 - DNA, 22 bp, Artificial Sequence
  chemically synthesized
gcatccttcctttttttttttt

SEQ ID NO: 708156 - DNA, 22 bp, Artificial Sequence
  chemically synthesized
tttgcatccttccttttttttt

SEQ ID NO: 708157 - DNA, 22 bp, Artificial Sequence
  chemically synthesized
actgtttgcatccttccttttt

SEQ ID NO: 708158 - DNA, 22 bp, Artificial Sequence
  chemically synthesized
cctaactgtttgcatccttcct

SEQ ID NO: 708159 - DNA, 22 bp, Artificial Sequence
  chemically synthesized
ccctaactgtttgcatccttcc

SEQ ID NO: 708160 - DNA, 22 bp, Artificial Sequence
  chemically synthesized
tccctaactgtttgcatccttc

SEQ ID NO: 708161 - DNA, 22 bp, Artificial Sequence
  chemically synthesized
ctttccctaactgtttgcatcc

SEQ ID NO: 708162 - DNA, 22 bp, Artificial Sequence
  chemically synthesized
cctttccctaactgtttgcatc

SEQ ID NO: 708163 - DNA, 22 bp, Artificial Sequence
  chemically synthesized
tgggcatttcctttccctaact

SEQ ID NO: 708164 - DNA, 22 bp, Artificial Sequence
  chemically synthesized
agcctatgggcatttcctttcc

SEQ ID NO: 708165 - DNA, 22 bp, Artificial Sequence
  chemically synthesized
aaacctcagcctatgggcattt

SEQ ID NO: 708166 - DNA, 22 bp, Artificial Sequence
  chemically synthesized
gggaaaggaaatgcccataggc

SEQ ID NO: 708167 - DNA, 22 bp, Artificial Sequence
  chemically synthesized
caagttgaaacctcagcctatg

SEQ ID NO: 708168 - DNA, 22 bp, Artificial Sequence
  chemically synthesized
tgcctccaagttgaaacctcag

SEQ ID NO: 708169 - DNA, 22 bp, Artificial Sequence
  chemically synthesized
aggtttcaacttggaggcatag

SEQ ID NO: 708170 - DNA, 22 bp, Artificial Sequence
  chemically synthesized
caacttggaggcatagtattta

SEQ ID NO: 708171 - DNA, 22 bp, Artificial Sequence
  chemically synthesized
aacttggaggcatagtatttat

SEQ ID NO: 708172 - DNA, 22 bp, Artificial Sequence
  chemically synthesized
tatatcaataataaataaatac

SEQ ID NO: 708173 - DNA, 22 bp, Artificial Sequence
  chemically synthesized
ggaggcatagtatttatttatt

SEQ ID NO: 708174 - DNA, 22 bp, Artificial Sequence
  chemically synthesized
gaggcatagtatttatttatta

SEQ ID NO: 708175 - DNA, 22 bp, Artificial Sequence
  chemically synthesized
atttattattgatatataatat

SEQ ID NO: 708176 - DNA, 22 bp, Artificial Sequence
  chemically synthesized
tttattattgatatataatatt

SEQ ID NO: 708177 - DNA, 22 bp, Artificial Sequence
  chemically synthesized
ataaatatgtaaaatattatat

SEQ ID NO: 708178 - DNA, 22 bp, Artificial Sequence
  chemically synthesized
attattgatatataatatttta

SEQ ID NO: 708179 - DNA, 22 bp, Artificial Sequence
  chemically synthesized
ttattgatatataatattttac

SEQ ID NO: 708180 - DNA, 22 bp, Artificial Sequence
  chemically synthesized
cctcataaatatgtaaaatatt

SEQ ID NO: 708181 - DNA, 22 bp, Artificial Sequence
  chemically synthesized
ttgatatataatattttacata

SEQ ID NO: 708182 - DNA, 22 bp, Artificial Sequence
  chemically synthesized
atatataatattttacatattt

SEQ ID NO: 708183 - DNA, 22 bp, Artificial Sequence
  chemically synthesized
tacatatttatgaggtaatgtg

SEQ ID NO: 708184 - DNA, 22 bp, Artificial Sequence
  chemically synthesized
acatatttatgaggtaatgtga

SEQ ID NO: 708185 - DNA, 22 bp, Artificial Sequence
  chemically synthesized
catatttatgaggtaatgtgat

SEQ ID NO: 708186 - DNA, 22 bp, Artificial Sequence
  chemically synthesized
tgccagtaaaatatcacattac

SEQ ID NO: 708187 - DNA, 22 bp, Artificial Sequence
  chemically synthesized
tatgccagtaaaatatcacatt

SEQ ID NO: 708188 - DNA, 22 bp, Artificial Sequence
  chemically synthesized
atgaggtaatgtgatattttac

SEQ ID NO: 708189 - DNA, 22 bp, Artificial Sequence
  chemically synthesized
tgaggtaatgtgatattttact

SEQ ID NO: 708190 - DNA, 22 bp, Artificial Sequence
  chemically synthesized
tgcattctatgccagtaaaata

SEQ ID NO: 708191 - DNA, 22 bp, Artificial Sequence
  chemically synthesized
atcattatgcattctatgccag

SEQ ID NO: 708192 - DNA, 22 bp, Artificial Sequence
  chemically synthesized
gatcattatgcattctatgcca

SEQ ID NO: 708193 - DNA, 22 bp, Artificial Sequence
  chemically synthesized
acttgatcattatgcattctat

SEQ ID NO: 708194 - DNA, 22 bp, Artificial Sequence
  chemically synthesized
tactggcatagaatgcataatg

SEQ ID NO: 708195 - DNA, 22 bp, Artificial Sequence
  chemically synthesized
actggcatagaatgcataatga

SEQ ID NO: 708196 - DNA, 22 bp, Artificial Sequence
  chemically synthesized
ctggcatagaatgcataatgat

SEQ ID NO: 708197 - DNA, 22 bp, Artificial Sequence
  chemically synthesized
gcatagaatgcataatgatcaa

SEQ ID NO: 708198 - DNA, 22 bp, Artificial Sequence
  chemically synthesized
aaataccctgacttgatcatta

SEQ ID NO: 708199 - DNA, 22 bp, Artificial Sequence
  chemically synthesized
aaagtaatggatgcctcaaata

SEQ ID NO: 708200 - DNA, 22 bp, Artificial Sequence
  chemically synthesized
gaggcatccattactttgagta

SEQ ID NO: 708201 - DNA, 22 bp, Artificial Sequence
  chemically synthesized
aggcatccattactttgagtat

SEQ ID NO: 708202 - DNA, 22 bp, Artificial Sequence
  chemically synthesized
ccaatacatagacaaatgacaa

SEQ ID NO: 708203 - DNA, 22 bp, Artificial Sequence
  chemically synthesized
ctttgagtatttgtcatttgtc

SEQ ID NO: 708204 - DNA, 22 bp, Artificial Sequence
  chemically synthesized
ttcccaatacatagacaaatga

SEQ ID NO: 708205 - DNA, 22 bp, Artificial Sequence
  chemically synthesized
tgagtatttgtcatttgtctat

SEQ ID NO: 708206 - DNA, 22 bp, Artificial Sequence
  chemically synthesized
gagtatttgtcatttgtctatg

SEQ ID NO: 708207 - DNA, 22 bp, Artificial Sequence
  chemically synthesized
agtatttgtcatttgtctatgt

SEQ ID NO: 708208 - DNA, 22 bp, Artificial Sequence
  chemically synthesized
aattgttcccaatacatagaca

SEQ ID NO: 708209 - DNA, 22 bp, Artificial Sequence
  chemically synthesized
gaattgttcccaatacatagac

SEQ ID NO: 708210 - DNA, 22 bp, Artificial Sequence
  chemically synthesized
gtcatttgtctatgtattggga

SEQ ID NO: 708211 - DNA, 22 bp, Artificial Sequence
  chemically synthesized
tcatttgtctatgtattgggaa

SEQ ID NO: 708212 - DNA, 22 bp, Artificial Sequence
  chemically synthesized
gtctatgtattgggaacaattc

SEQ ID NO: 708213 - DNA, 22 bp, Artificial Sequence
  chemically synthesized
tctatgtattgggaacaattca

SEQ ID NO: 708214 - DNA, 22 bp, Artificial Sequence
  chemically synthesized
tgtattgggaacaattcaagcc

SEQ ID NO: 708215 - DNA, 22 bp, Artificial Sequence
  chemically synthesized
aaagtaccaagaagaaagggct

SEQ ID NO: 708216 - DNA, 22 bp, Artificial Sequence
  chemically synthesized
ggaacaattcaagccctttctt

SEQ ID NO: 708217 - DNA, 22 bp, Artificial Sequence
  chemically synthesized
caaagtaccaagaagaaagggc

SEQ ID NO: 708218 - DNA, 22 bp, Artificial Sequence
  chemically synthesized
tatatttcaaagtaccaagaag

SEQ ID NO: 708219 - DNA, 22 bp, Artificial Sequence
  chemically synthesized
aagccctttcttcttggtactt

SEQ ID NO: 708220 - DNA, 22 bp, Artificial Sequence
  chemically synthesized
tcttcttggtactttgaaatat

SEQ ID NO: 708221 - DNA, 22 bp, Artificial Sequence
  chemically synthesized
cttcttggtactttgaaatata

SEQ ID NO: 708222 - DNA, 22 bp, Artificial Sequence
  chemically synthesized
ttcttggtactttgaaatatac

SEQ ID NO: 708223 - DNA, 22 bp, Artificial Sequence
  chemically synthesized
acaacgatgtgttgtatatttc

SEQ ID NO: 708224 - DNA, 22 bp, Artificial Sequence
  chemically synthesized
cttggtactttgaaatatacaa

SEQ ID NO: 708225 - DNA, 22 bp, Artificial Sequence
  chemically synthesized
ttggtactttgaaatatacaac

SEQ ID NO: 708226 - DNA, 22 bp, Artificial Sequence
  chemically synthesized
ggtactttgaaatatacaacac

SEQ ID NO: 708227 - DNA, 22 bp, Artificial Sequence
  chemically synthesized
gtactttgaaatatacaacaca

SEQ ID NO: 708228 - DNA, 22 bp, Artificial Sequence
  chemically synthesized
tagttaacaacgatgtgttgta

SEQ ID NO: 708229 - DNA, 22 bp, Artificial Sequence
  chemically synthesized
tgaaatatacaacacatcgttg

SEQ ID NO: 708230 - DNA, 22 bp, Artificial Sequence
  chemically synthesized
gaaatatacaacacatcgttgt

SEQ ID NO: 708231 - DNA, 22 bp, Artificial Sequence
  chemically synthesized
aaatatacaacacatcgttgtt

SEQ ID NO: 708232 - DNA, 22 bp, Artificial Sequence
  chemically synthesized
acagcagaatagagtgactgta

SEQ ID NO: 708233 - DNA, 22 bp, Artificial Sequence
  chemically synthesized
gacagcagaatagagtgactgt

SEQ ID NO: 708234 - DNA, 22 bp, Artificial Sequence
  chemically synthesized
ttaactacagtcactctattct

SEQ ID NO: 708235 - DNA, 22 bp, Artificial Sequence
  chemically synthesized
tatcatttgacagcagaataga

SEQ ID NO: 708236 - DNA, 22 bp, Artificial Sequence
  chemically synthesized
actacagtcactctattctgct

SEQ ID NO: 708237 - DNA, 22 bp, Artificial Sequence
  chemically synthesized
cagtcactctattctgctgtca

SEQ ID NO: 708238 - DNA, 22 bp, Artificial Sequence
  chemically synthesized
cgttatatcatttgacagcaga

SEQ ID NO: 708239 - DNA, 22 bp, Artificial Sequence
  chemically synthesized
tattctgctgtcaaatgatata

SEQ ID NO: 708240 - DNA, 22 bp, Artificial Sequence
  chemically synthesized
ttctgctgtcaaatgatataac

SEQ ID NO: 708241 - DNA, 22 bp, Artificial Sequence
  chemically synthesized
gatagaaggactacgttatatc

SEQ ID NO: 708242 - DNA, 22 bp, Artificial Sequence
  chemically synthesized
tgctgtcaaatgatataacgta

SEQ ID NO: 708243 - DNA, 22 bp, Artificial Sequence
  chemically synthesized
ctgtcaaatgatataacgtagt

SEQ ID NO: 708244 - DNA, 22 bp, Artificial Sequence
  chemically synthesized
tcaaatgatataacgtagtcct

SEQ ID NO: 708245 - DNA, 22 bp, Artificial Sequence
  chemically synthesized
atgggtacaaacatccagttag

SEQ ID NO: 708246 - DNA, 22 bp, Artificial Sequence
  chemically synthesized
ctatctaactggatgtttgtac

SEQ ID NO: 708247 - DNA, 22 bp, Artificial Sequence
  chemically synthesized
tatctaactggatgtttgtacc

SEQ ID NO: 708248 - DNA, 22 bp, Artificial Sequence
  chemically synthesized
tctaactggatgtttgtaccca

SEQ ID NO: 708249 - DNA, 22 bp, Artificial Sequence
  chemically synthesized
actggatgtttgtacccattaa

SEQ ID NO: 708250 - DNA, 22 bp, Artificial Sequence
  chemically synthesized
gatgtttgtacccattaaccac

SEQ ID NO: 708251 - DNA, 22 bp, Artificial Sequence
  chemically synthesized
gtacccattaaccaccctctct

SEQ ID NO: 708252 - DNA, 22 bp, Artificial Sequence
  chemically synthesized
tacccattaaccaccctctctt

SEQ ID NO: 708253 - DNA, 22 bp, Artificial Sequence
  chemically synthesized
accaccctctctttatctcccc

SEQ ID NO: 708254 - DNA, 22 bp, Artificial Sequence
  chemically synthesized
ggaaaggtgtgtgggtagaggg

SEQ ID NO: 708255 - DNA, 22 bp, Artificial Sequence
  chemically synthesized
tctttatctccccctctaccca

SEQ ID NO: 708256 - DNA, 22 bp, Artificial Sequence
  chemically synthesized
tttatctccccctctacccaca

SEQ ID NO: 708257 - DNA, 22 bp, Artificial Sequence
  chemically synthesized
tatctccccctctacccacaca

SEQ ID NO: 708258 - DNA, 22 bp, Artificial Sequence
  chemically synthesized
atctccccctctacccacacac

SEQ ID NO: 708259 - DNA, 22 bp, Artificial Sequence
  chemically synthesized
tctccccctctacccacacacc

SEQ ID NO: 708260 - DNA, 22 bp, Artificial Sequence
  chemically synthesized
gtggctgggaaaggtgtgtggg

SEQ ID NO: 708261 - DNA, 22 bp, Artificial Sequence
  chemically synthesized
cccctctacccacacacctttc

SEQ ID NO: 708262 - DNA, 22 bp, Artificial Sequence
  chemically synthesized
tacccacacacctttcccagcc

SEQ ID NO: 708263 - DNA, 22 bp, Artificial Sequence
  chemically synthesized
cccacacacctttcccagccac

SEQ ID NO: 708264 - DNA, 22 bp, Artificial Sequence
  chemically synthesized
tcccagccactagtatctatca

SEQ ID NO: 708265 - DNA, 22 bp, Artificial Sequence
  chemically synthesized
cccagccactagtatctatcat

SEQ ID NO: 708266 - DNA, 22 bp, Artificial Sequence
  chemically synthesized
ccagccactagtatctatcatt

SEQ ID NO: 708267 - DNA, 22 bp, Artificial Sequence
  chemically synthesized
ataataaacatagaatagaatg

SEQ ID NO: 708268 - DNA, 22 bp, Artificial Sequence
  chemically synthesized
gtatctatcattctattctatg

SEQ ID NO: 708269 - DNA, 22 bp, Artificial Sequence
  chemically synthesized
aaaaaattgataataaacatag

SEQ ID NO: 708270 - DNA, 22 bp, Artificial Sequence
  chemically synthesized
tcattctattctatgtttatta

SEQ ID NO: 708271 - DNA, 22 bp, Artificial Sequence
  chemically synthesized
tattctatgtttattatcaatt

SEQ ID NO: 708272 - DNA, 22 bp, Artificial Sequence
  chemically synthesized
tgggagctaaaaaaattgataa

SEQ ID NO: 708273 - DNA, 22 bp, Artificial Sequence
  chemically synthesized
ttctatgtttattatcaatttt

SEQ ID NO: 708274 - DNA, 22 bp, Artificial Sequence
  chemically synthesized
gtgggagctaaaaaaattgata

SEQ ID NO: 708275 - DNA, 22 bp, Artificial Sequence
  chemically synthesized
ttgtgggagctaaaaaaattga

SEQ ID NO: 708276 - DNA, 22 bp, Artificial Sequence
  chemically synthesized
tatgtttattatcaattttttt

SEQ ID NO: 708277 - DNA, 22 bp, Artificial Sequence
  chemically synthesized
tgtttattatcaatttttttag

SEQ ID NO: 708278 - DNA, 22 bp, Artificial Sequence
  chemically synthesized
ctcttgtgggagctaaaaaaat

SEQ ID NO: 708279 - DNA, 22 bp, Artificial Sequence
  chemically synthesized
actcttgtgggagctaaaaaaa

SEQ ID NO: 708280 - DNA, 22 bp, Artificial Sequence
  chemically synthesized
ttactcttgtgggagctaaaaa

SEQ ID NO: 708281 - DNA, 22 bp, Artificial Sequence
  chemically synthesized
attatcaatttttttagctccc

SEQ ID NO: 708282 - DNA, 22 bp, Artificial Sequence
  chemically synthesized
ttatcaatttttttagctccca

SEQ ID NO: 708283 - DNA, 22 bp, Artificial Sequence
  chemically synthesized
tcaatttttttagctcccacaa

SEQ ID NO: 708284 - DNA, 22 bp, Artificial Sequence
  chemically synthesized
ttttagctcccacaagagtaag

SEQ ID NO: 708285 - DNA, 22 bp, Artificial Sequence
  chemically synthesized
tttagctcccacaagagtaaga

SEQ ID NO: 708286 - DNA, 22 bp, Artificial Sequence
  chemically synthesized
ttagctcccacaagagtaagaa

SEQ ID NO: 708287 - DNA, 22 bp, Artificial Sequence
  chemically synthesized
tagctcccacaagagtaagaac

SEQ ID NO: 708288 - DNA, 22 bp, Artificial Sequence
  chemically synthesized
agctcccacaagagtaagaaca

SEQ ID NO: 708289 - DNA, 22 bp, Artificial Sequence
  chemically synthesized
gctcccacaagagtaagaacat

SEQ ID NO: 708290 - DNA, 22 bp, Artificial Sequence
  chemically synthesized
ccacaagagtaagaacatgcga

SEQ ID NO: 708291 - DNA, 22 bp, Artificial Sequence
  chemically synthesized
gcacagaaagacaaaaatcgca

SEQ ID NO: 708292 - DNA, 22 bp, Artificial Sequence
  chemically synthesized
agtgaaataaccctggcacaga

SEQ ID NO: 708293 - DNA, 22 bp, Artificial Sequence
  chemically synthesized
ttgtctttctgtgccagggtta

SEQ ID NO: 708294 - DNA, 22 bp, Artificial Sequence
  chemically synthesized
tgttaagtgaaataaccctggc

SEQ ID NO: 708295 - DNA, 22 bp, Artificial Sequence
  chemically synthesized
tgtctttctgtgccagggttat

SEQ ID NO: 708296 - DNA, 22 bp, Artificial Sequence
  chemically synthesized
gtctttctgtgccagggttatt

SEQ ID NO: 708297 - DNA, 22 bp, Artificial Sequence
  chemically synthesized
tctttctgtgccagggttattt

SEQ ID NO: 708298 - DNA, 22 bp, Artificial Sequence
  chemically synthesized
tctgtgccagggttatttcact

SEQ ID NO: 708299 - DNA, 22 bp, Artificial Sequence
  chemically synthesized
ctgtgccagggttatttcactt

SEQ ID NO: 708300 - DNA, 22 bp, Artificial Sequence
  chemically synthesized
tgtgccagggttatttcactta

SEQ ID NO: 708301 - DNA, 22 bp, Artificial Sequence
  chemically synthesized
gaggtcattatgttaagtgaaa

SEQ ID NO: 708302 - DNA, 22 bp, Artificial Sequence
  chemically synthesized
tgccagggttatttcacttaac

SEQ ID NO: 708303 - DNA, 22 bp, Artificial Sequence
  chemically synthesized
tttcacttaacataatgacctc

SEQ ID NO: 708304 - DNA, 22 bp, Artificial Sequence
  chemically synthesized
cacttaacataatgacctccag

SEQ ID NO: 708305 - DNA, 22 bp, Artificial Sequence
  chemically synthesized
acttaacataatgacctccagt

SEQ ID NO: 708306 - DNA, 22 bp, Artificial Sequence
  chemically synthesized
aacataatgacctccagttcca

SEQ ID NO: 708307 - DNA, 22 bp, Artificial Sequence
  chemically synthesized
acataatgacctccagttccat

SEQ ID NO: 708308 - DNA, 22 bp, Artificial Sequence
  chemically synthesized
acagcaacatggatggaactgg

SEQ ID NO: 708309 - DNA, 22 bp, Artificial Sequence
  chemically synthesized
cagttccatccatgttgctgtg

SEQ ID NO: 708310 - DNA, 22 bp, Artificial Sequence
  chemically synthesized
catccatgttgctgtgaatgac

SEQ ID NO: 708311 - DNA, 22 bp, Artificial Sequence
  chemically synthesized
caagaatgaaaccatgtcattc

SEQ ID NO: 708312 - DNA, 22 bp, Artificial Sequence
  chemically synthesized
ctgtgaatgacatggtttcatt

SEQ ID NO: 708313 - DNA, 22 bp, Artificial Sequence
  chemically synthesized
tgaatgacatggtttcattctt

SEQ ID NO: 708314 - DNA, 22 bp, Artificial Sequence
  chemically synthesized
tacacaatgaaacactgcaaga

SEQ ID NO: 708315 - DNA, 22 bp, Artificial Sequence
  chemically synthesized
cattcttgcagtgtttcattgt

SEQ ID NO: 708316 - DNA, 22 bp, Artificial Sequence
  chemically synthesized
attcttgcagtgtttcattgtg

SEQ ID NO: 708317 - DNA, 22 bp, Artificial Sequence
  chemically synthesized
ttgcagtgtttcattgtgtaca

SEQ ID NO: 708318 - DNA, 22 bp, Artificial Sequence
  chemically synthesized
gcagtgtttcattgtgtacaga

SEQ ID NO: 708319 - DNA, 22 bp, Artificial Sequence
  chemically synthesized
cagtgtttcattgtgtacagat

SEQ ID NO: 708320 - DNA, 22 bp, Artificial Sequence
  chemically synthesized
cattgtgtacagataccacata

SEQ ID NO: 708321 - DNA, 22 bp, Artificial Sequence
  chemically synthesized
attgtgtacagataccacatat

SEQ ID NO: 708322 - DNA, 22 bp, Artificial Sequence
  chemically synthesized
tgtacagataccacatattctt

SEQ ID NO: 708323 - DNA, 22 bp, Artificial Sequence
  chemically synthesized
agtgtatatcaacagatgaatg

SEQ ID NO: 708324 - DNA, 22 bp, Artificial Sequence
  chemically synthesized
tttatccattcatctgttgata

SEQ ID NO: 708325 - DNA, 22 bp, Artificial Sequence
  chemically synthesized
tatccattcatctgttgatata

SEQ ID NO: 708326 - DNA, 22 bp, Artificial Sequence
  chemically synthesized
atccattcatctgttgatatac

SEQ ID NO: 708327 - DNA, 22 bp, Artificial Sequence
  chemically synthesized
tccattcatctgttgatataca

SEQ ID NO: 708328 - DNA, 22 bp, Artificial Sequence
  chemically synthesized
atctgttgatatacacttaggt

SEQ ID NO: 708329 - DNA, 22 bp, Artificial Sequence
  chemically synthesized
ttgatatacacttaggttgatt

SEQ ID NO: 708330 - DNA, 22 bp, Artificial Sequence
  chemically synthesized
atatacacttaggttgatttca

SEQ ID NO: 708331 - DNA, 22 bp, Artificial Sequence
  chemically synthesized
aaacagcaaagatgtgaaatca

SEQ ID NO: 708332 - DNA, 22 bp, Artificial Sequence
  chemically synthesized
aaaacagcaaagatgtgaaatc

SEQ ID NO: 708333 - DNA, 22 bp, Artificial Sequence
  chemically synthesized
tttaaaacagcaaagatgtgaa

SEQ ID NO: 708334 - DNA, 22 bp, Artificial Sequence
  chemically synthesized
aggttgatttcacatctttgct

SEQ ID NO: 708335 - DNA, 22 bp, Artificial Sequence
  chemically synthesized
ggttgatttcacatctttgctg

SEQ ID NO: 708336 - DNA, 22 bp, Artificial Sequence
  chemically synthesized
atttcacatctttgctgtttta

SEQ ID NO: 708337 - DNA, 22 bp, Artificial Sequence
  chemically synthesized
tcacagcactgtttaaaacagc

SEQ ID NO: 708338 - DNA, 22 bp, Artificial Sequence
  chemically synthesized
atcacagcactgtttaaaacag

SEQ ID NO: 708339 - DNA, 22 bp, Artificial Sequence
  chemically synthesized
cacatctttgctgttttaaaca

SEQ ID NO: 708340 - DNA, 22 bp, Artificial Sequence
  chemically synthesized
acatctttgctgttttaaacag

SEQ ID NO: 708341 - DNA, 22 bp, Artificial Sequence
  chemically synthesized
catgcttatcacagcactgttt

SEQ ID NO: 708342 - DNA, 22 bp, Artificial Sequence
  chemically synthesized
gcatgcttatcacagcactgtt

SEQ ID NO: 708343 - DNA, 22 bp, Artificial Sequence
  chemically synthesized
tgctgttttaaacagtgctgtg

SEQ ID NO: 708344 - DNA, 22 bp, Artificial Sequence
  chemically synthesized
gctgttttaaacagtgctgtga

SEQ ID NO: 708345 - DNA, 22 bp, Artificial Sequence
  chemically synthesized
ctgttttaaacagtgctgtgat

SEQ ID NO: 708346 - DNA, 22 bp, Artificial Sequence
  chemically synthesized
cacttgcatgcttatcacagca

SEQ ID NO: 708347 - DNA, 22 bp, Artificial Sequence
  chemically synthesized
ttttaaacagtgctgtgataag

SEQ ID NO: 708348 - DNA, 22 bp, Artificial Sequence
  chemically synthesized
taaacagtgctgtgataagcat

SEQ ID NO: 708349 - DNA, 22 bp, Artificial Sequence
  chemically synthesized
aaacagtgctgtgataagcatg

SEQ ID NO: 708350 - DNA, 22 bp, Artificial Sequence
  chemically synthesized
aacagtgctgtgataagcatgc

SEQ ID NO: 708351 - DNA, 22 bp, Artificial Sequence
  chemically synthesized
tgataagcatgcaagtgcaggt

SEQ ID NO: 708352 - DNA, 22 bp, Artificial Sequence
  chemically synthesized
agaaatcagtatatcaaaaggg

SEQ ID NO: 708353 - DNA, 22 bp, Artificial Sequence
  chemically synthesized
tccatcccaaagctaagaaatc

SEQ ID NO: 708354 - DNA, 22 bp, Artificial Sequence
  chemically synthesized
ttgatatactgatttcttagct

SEQ ID NO: 708355 - DNA, 22 bp, Artificial Sequence
  chemically synthesized
tgatatactgatttcttagctt

SEQ ID NO: 708356 - DNA, 22 bp, Artificial Sequence
  chemically synthesized
gatatactgatttcttagcttt

SEQ ID NO: 708357 - DNA, 22 bp, Artificial Sequence
  chemically synthesized
gttatccatcccaaagctaaga

SEQ ID NO: 708358 - DNA, 22 bp, Artificial Sequence
  chemically synthesized
atatactgatttcttagctttg

SEQ ID NO: 708359 - DNA, 22 bp, Artificial Sequence
  chemically synthesized
ctggttatccatcccaaagcta

SEQ ID NO: 708360 - DNA, 22 bp, Artificial Sequence
  chemically synthesized
atttcttagctttgggatggat

SEQ ID NO: 708361 - DNA, 22 bp, Artificial Sequence
  chemically synthesized
cttagctttgggatggataacc

SEQ ID NO: 708362 - DNA, 22 bp, Artificial Sequence
  chemically synthesized
ttagctttgggatggataacca

SEQ ID NO: 708363 - DNA, 22 bp, Artificial Sequence
  chemically synthesized
gcaatcccactactggttatcc

SEQ ID NO: 708364 - DNA, 22 bp, Artificial Sequence
  chemically synthesized
agctttgggatggataaccagt

SEQ ID NO: 708365 - DNA, 22 bp, Artificial Sequence
  chemically synthesized
gctttgggatggataaccagta

SEQ ID NO: 708366 - DNA, 22 bp, Artificial Sequence
  chemically synthesized
tgggatggataaccagtagtgg

SEQ ID NO: 708367 - DNA, 22 bp, Artificial Sequence
  chemically synthesized
gggatggataaccagtagtggg

SEQ ID NO: 708368 - DNA, 22 bp, Artificial Sequence
  chemically synthesized
ccatctggcaatcccactactg

SEQ ID NO: 708369 - DNA, 22 bp, Artificial Sequence
  chemically synthesized
ggatggataaccagtagtggga

SEQ ID NO: 708370 - DNA, 22 bp, Artificial Sequence
  chemically synthesized
accatctggcaatcccactact

SEQ ID NO: 708371 - DNA, 22 bp, Artificial Sequence
  chemically synthesized
ccttaccatctggcaatcccac

SEQ ID NO: 708372 - DNA, 22 bp, Artificial Sequence
  chemically synthesized
taaatagaactaccttaccatc

SEQ ID NO: 708373 - DNA, 22 bp, Artificial Sequence
  chemically synthesized
ccagatggtaaggtagttctat

SEQ ID NO: 708374 - DNA, 22 bp, Artificial Sequence
  chemically synthesized
aacaaactgtaaatagaactac

SEQ ID NO: 708375 - DNA, 22 bp, Artificial Sequence
  chemically synthesized
tcaacaaactgtaaatagaact

SEQ ID NO: 708376 - DNA, 22 bp, Artificial Sequence
  chemically synthesized
tatttacagtttgttgagaatc

SEQ ID NO: 708377 - DNA, 22 bp, Artificial Sequence
  chemically synthesized
gtaacagtatgaagattctcaa

SEQ ID NO: 708378 - DNA, 22 bp, Artificial Sequence
  chemically synthesized
tttacagtttgttgagaatctt

SEQ ID NO: 708379 - DNA, 22 bp, Artificial Sequence
  chemically synthesized
acagtttgttgagaatcttcat

SEQ ID NO: 708380 - DNA, 22 bp, Artificial Sequence
  chemically synthesized
cagtttgttgagaatcttcata

SEQ ID NO: 708381 - DNA, 22 bp, Artificial Sequence
  chemically synthesized
gttgagaatcttcatactgtta

SEQ ID NO: 708382 - DNA, 22 bp, Artificial Sequence
  chemically synthesized
ttgagaatcttcatactgttac

SEQ ID NO: 708383 - DNA, 22 bp, Artificial Sequence
  chemically synthesized
agaatcttcatactgttactaa

SEQ ID NO: 708384 - DNA, 22 bp, Artificial Sequence
  chemically synthesized
atgaaaatgtaacagtaaatta

SEQ ID NO: 708385 - DNA, 22 bp, Artificial Sequence
  chemically synthesized
catactgttactaatttactgt

SEQ ID NO: 708386 - DNA, 22 bp, Artificial Sequence
  chemically synthesized
atactgttactaatttactgtt

SEQ ID NO: 708387 - DNA, 22 bp, Artificial Sequence
  chemically synthesized
ttactaatttactgttacattt

SEQ ID NO: 708388 - DNA, 22 bp, Artificial Sequence
  chemically synthesized
cagtgttgatgaaaatgtaaca

SEQ ID NO: 708389 - DNA, 22 bp, Artificial Sequence
  chemically synthesized
acagtgttgatgaaaatgtaac

SEQ ID NO: 708390 - DNA, 22 bp, Artificial Sequence
  chemically synthesized
tacagtgttgatgaaaatgtaa

SEQ ID NO: 708391 - DNA, 22 bp, Artificial Sequence
  chemically synthesized
ctaatttactgttacattttca

SEQ ID NO: 708392 - DNA, 22 bp, Artificial Sequence
  chemically synthesized
ttacagtgttgatgaaaatgta

SEQ ID NO: 708393 - DNA, 22 bp, Artificial Sequence
  chemically synthesized
ttttacagtgttgatgaaaatg

SEQ ID NO: 708394 - DNA, 22 bp, Artificial Sequence
  chemically synthesized
atttactgttacattttcatca

SEQ ID NO: 708395 - DNA, 22 bp, Artificial Sequence
  chemically synthesized
actgttacattttcatcaacac

SEQ ID NO: 708396 - DNA, 22 bp, Artificial Sequence
  chemically synthesized
ctgttacattttcatcaacact

SEQ ID NO: 708397 - DNA, 22 bp, Artificial Sequence
  chemically synthesized
ttacattttcatcaacactgta

SEQ ID NO: 708398 - DNA, 22 bp, Artificial Sequence
  chemically synthesized
cattttcatcaacactgtaaaa

SEQ ID NO: 708399 - DNA, 22 bp, Artificial Sequence
  chemically synthesized
tcatcaacactgtaaaagagtt

SEQ ID NO: 708400 - DNA, 22 bp, Artificial Sequence
  chemically synthesized
catcaacactgtaaaagagttc

SEQ ID NO: 708401 - DNA, 22 bp, Artificial Sequence
  chemically synthesized
atcaacactgtaaaagagttcc

SEQ ID NO: 708402 - DNA, 22 bp, Artificial Sequence
  chemically synthesized
gtgagaatgtgaagaaagggaa

SEQ ID NO: 708403 - DNA, 22 bp, Artificial Sequence
  chemically synthesized
tggtgagaatgtgaagaaaggg

SEQ ID NO: 708404 - DNA, 22 bp, Artificial Sequence
  chemically synthesized
taaaagagttccctttcttcac

SEQ ID NO: 708405 - DNA, 22 bp, Artificial Sequence
  chemically synthesized
cctttcttcacattctcaccag

SEQ ID NO: 708406 - DNA, 22 bp, Artificial Sequence
  chemically synthesized
tcttcacattctcaccagaatc

SEQ ID NO: 708407 - DNA, 22 bp, Artificial Sequence
  chemically synthesized
cttcacattctcaccagaatct

SEQ ID NO: 708408 - DNA, 22 bp, Artificial Sequence
  chemically synthesized
ttcacattctcaccagaatctg

SEQ ID NO: 708409 - DNA, 22 bp, Artificial Sequence
  chemically synthesized
cacattctcaccagaatctgtt

SEQ ID NO: 708410 - DNA, 22 bp, Artificial Sequence
  chemically synthesized
acattctcaccagaatctgtta

SEQ ID NO: 708411 - DNA, 22 bp, Artificial Sequence
  chemically synthesized
aaaagacaaaaaataacagatt

SEQ ID NO: 708412 - DNA, 22 bp, Artificial Sequence
  chemically synthesized
ttcaaaagacaaaaaataacag

SEQ ID NO: 708413 - DNA, 22 bp, Artificial Sequence
  chemically synthesized
tcaccagaatctgttatttttt

SEQ ID NO: 708414 - DNA, 22 bp, Artificial Sequence
  chemically synthesized
ttattcaaaagacaaaaaataa

SEQ ID NO: 708415 - DNA, 22 bp, Artificial Sequence
  chemically synthesized
accagaatctgttattttttgt

SEQ ID NO: 708416 - DNA, 22 bp, Artificial Sequence
  chemically synthesized
gaatggctattattcaaaagac

SEQ ID NO: 708417 - DNA, 22 bp, Artificial Sequence
  chemically synthesized
ttattttttgtcttttgaataa

SEQ ID NO: 708418 - DNA, 22 bp, Artificial Sequence
  chemically synthesized
ttttttgtcttttgaataatag

SEQ ID NO: 708419 - DNA, 22 bp, Artificial Sequence
  chemically synthesized
tttgtcttttgaataatagcca

SEQ ID NO: 708420 - DNA, 22 bp, Artificial Sequence
  chemically synthesized
ccccaattagaatggctattat

SEQ ID NO: 708421 - DNA, 22 bp, Artificial Sequence
  chemically synthesized
ttgtcttttgaataatagccat

SEQ ID NO: 708422 - DNA, 22 bp, Artificial Sequence
  chemically synthesized
accccaattagaatggctatta

SEQ ID NO: 708423 - DNA, 22 bp, Artificial Sequence
  chemically synthesized
tgtcttttgaataatagccatt

SEQ ID NO: 708424 - DNA, 22 bp, Artificial Sequence
  chemically synthesized
gtcttttgaataatagccattc

SEQ ID NO: 708425 - DNA, 22 bp, Artificial Sequence
  chemically synthesized
tcttttgaataatagccattct

SEQ ID NO: 708426 - DNA, 22 bp, Artificial Sequence
  chemically synthesized
ttgaataatagccattctaatt

SEQ ID NO: 708427 - DNA, 22 bp, Artificial Sequence
  chemically synthesized
tgaataatagccattctaattg

SEQ ID NO: 708428 - DNA, 22 bp, Artificial Sequence
  chemically synthesized
gaataatagccattctaattgg

SEQ ID NO: 708429 - DNA, 22 bp, Artificial Sequence
  chemically synthesized
aataatagccattctaattggg

SEQ ID NO: 708430 - DNA, 22 bp, Artificial Sequence
  chemically synthesized
taattggggtaagacgatatat

SEQ ID NO: 708431 - DNA, 22 bp, Artificial Sequence
  chemically synthesized
attggggtaagacgatatatca

SEQ ID NO: 708432 - DNA, 22 bp, Artificial Sequence
  chemically synthesized
gggtaagacgatatatcatgtg

SEQ ID NO: 708433 - DNA, 22 bp, Artificial Sequence
  chemically synthesized
atcaccagggaaatgcaaatca

SEQ ID NO: 708434 - DNA, 22 bp, Artificial Sequence
  chemically synthesized
aacatcactaatcaccagggaa

SEQ ID NO: 708435 - DNA, 22 bp, Artificial Sequence
  chemically synthesized
gatttgcatttccctggtgatt

SEQ ID NO: 708436 - DNA, 22 bp, Artificial Sequence
  chemically synthesized
atttgcatttccctggtgatta

SEQ ID NO: 708437 - DNA, 22 bp, Artificial Sequence
  chemically synthesized
gcatttccctggtgattagtga

SEQ ID NO: 708438 - DNA, 22 bp, Artificial Sequence
  chemically synthesized
catttccctggtgattagtgat

SEQ ID NO: 708439 - DNA, 22 bp, Artificial Sequence
  chemically synthesized
ccctggtgattagtgatgttga

SEQ ID NO: 708440 - DNA, 22 bp, Artificial Sequence
  chemically synthesized
cctggtgattagtgatgttgag

SEQ ID NO: 708441 - DNA, 22 bp, Artificial Sequence
  chemically synthesized
gtgattagtgatgttgagcatt

SEQ ID NO: 708442 - DNA, 22 bp, Artificial Sequence
  chemically synthesized
gtgatgttgagcattttttcat

SEQ ID NO: 708443 - DNA, 22 bp, Artificial Sequence
  chemically synthesized
agcattttttcatatacctgtt

SEQ ID NO: 708444 - DNA, 22 bp, Artificial Sequence
  chemically synthesized
tttcatatacctgttggccatt

SEQ ID NO: 708445 - DNA, 22 bp, Artificial Sequence
  chemically synthesized
ttcatatacctgttggccattt

SEQ ID NO: 708446 - DNA, 22 bp, Artificial Sequence
  chemically synthesized
tcatatacctgttggccatttg

SEQ ID NO: 708447 - DNA, 22 bp, Artificial Sequence
  chemically synthesized
catatacctgttggccatttgt

SEQ ID NO: 708448 - DNA, 22 bp, Artificial Sequence
  chemically synthesized
aaaagaaggcatacaaatggcc

SEQ ID NO: 708449 - DNA, 22 bp, Artificial Sequence
  chemically synthesized
atatacctgttggccatttgta

SEQ ID NO: 708450 - DNA, 22 bp, Artificial Sequence
  chemically synthesized
tcaaaagaaggcatacaaatgg

SEQ ID NO: 708451 - DNA, 22 bp, Artificial Sequence
  chemically synthesized
ttggccatttgtatgccttctt

SEQ ID NO: 708452 - DNA, 22 bp, Artificial Sequence
  chemically synthesized
gccatttgtatgccttcttttg

SEQ ID NO: 708453 - DNA, 22 bp, Artificial Sequence
  chemically synthesized
gtatgccttcttttgagaattg

SEQ ID NO: 708454 - DNA, 22 bp, Artificial Sequence
  chemically synthesized
tgaaatgagtgacaattctcaa

SEQ ID NO: 708455 - DNA, 22 bp, Artificial Sequence
  chemically synthesized
tatgccttcttttgagaattgt

SEQ ID NO: 708456 - DNA, 22 bp, Artificial Sequence
  chemically synthesized
atgaaatgagtgacaattctca

SEQ ID NO: 708457 - DNA, 22 bp, Artificial Sequence
  chemically synthesized
ccttatgaaatgagtgacaatt

SEQ ID NO: 708458 - DNA, 22 bp, Artificial Sequence
  chemically synthesized
cttttgagaattgtcactcatt

SEQ ID NO: 708459 - DNA, 22 bp, Artificial Sequence
  chemically synthesized
ttttgagaattgtcactcattt

SEQ ID NO: 708460 - DNA, 22 bp, Artificial Sequence
  chemically synthesized
ttgagaattgtcactcatttca

SEQ ID NO: 708461 - DNA, 22 bp, Artificial Sequence
  chemically synthesized
tgagaattgtcactcatttcat

SEQ ID NO: 708462 - DNA, 22 bp, Artificial Sequence
  chemically synthesized
gagaattgtcactcatttcata

SEQ ID NO: 708463 - DNA, 22 bp, Artificial Sequence
  chemically synthesized
agaattgtcactcatttcataa

SEQ ID NO: 708464 - DNA, 22 bp, Artificial Sequence
  chemically synthesized
aatgatccctgccttatgaaat

SEQ ID NO: 708465 - DNA, 22 bp, Artificial Sequence
  chemically synthesized
attaaatgatccctgccttatg

SEQ ID NO: 708466 - DNA, 22 bp, Artificial Sequence
  chemically synthesized
tcactcatttcataaggcaggg

SEQ ID NO: 708467 - DNA, 22 bp, Artificial Sequence
  chemically synthesized
atttcataaggcagggatcatt

SEQ ID NO: 708468 - DNA, 22 bp, Artificial Sequence
  chemically synthesized
aataattcattaaatgatccct

SEQ ID NO: 708469 - DNA, 22 bp, Artificial Sequence
  chemically synthesized
aaataattcattaaatgatccc

SEQ ID NO: 708470 - DNA, 22 bp, Artificial Sequence
  chemically synthesized
taaataattcattaaatgatcc

SEQ ID NO: 708471 - DNA, 22 bp, Artificial Sequence
  chemically synthesized
cataaggcagggatcatttaat

SEQ ID NO: 708472 - DNA, 22 bp, Artificial Sequence
  chemically synthesized
tttaaataattcattaaatgat

SEQ ID NO: 708473 - DNA, 22 bp, Artificial Sequence
  chemically synthesized
ataaggcagggatcatttaatg

SEQ ID NO: 708474 - DNA, 22 bp, Artificial Sequence
  chemically synthesized
taattctttaaataattcatta

SEQ ID NO: 708475 - DNA, 22 bp, Artificial Sequence
  chemically synthesized
tataattctttaaataattcat

SEQ ID NO: 708476 - DNA, 22 bp, Artificial Sequence
  chemically synthesized
tgactctataattctttaaata

SEQ ID NO: 708477 - DNA, 22 bp, Artificial Sequence
  chemically synthesized
ctgtgactctataattctttaa

SEQ ID NO: 708478 - DNA, 22 bp, Artificial Sequence
  chemically synthesized
aatgaattatttaaagaattat

SEQ ID NO: 708479 - DNA, 22 bp, Artificial Sequence
  chemically synthesized
atgaattatttaaagaattata

SEQ ID NO: 708480 - DNA, 22 bp, Artificial Sequence
  chemically synthesized
tttaaagaattatagagtcaca

SEQ ID NO: 708481 - DNA, 22 bp, Artificial Sequence
  chemically synthesized
aaagaattatagagtcacagta

SEQ ID NO: 708482 - DNA, 22 bp, Artificial Sequence
  chemically synthesized
aagaattatagagtcacagtaa

SEQ ID NO: 708483 - DNA, 22 bp, Artificial Sequence
  chemically synthesized
tagagtcacagtaacatatatt

SEQ ID NO: 708484 - DNA, 22 bp, Artificial Sequence
  chemically synthesized
taatatgatcatccaatatatg

SEQ ID NO: 708485 - DNA, 22 bp, Artificial Sequence
  chemically synthesized
tgatatcatgtaattataatat

SEQ ID NO: 708486 - DNA, 22 bp, Artificial Sequence
  chemically synthesized
gatgatcatattataattacat

SEQ ID NO: 708487 - DNA, 22 bp, Artificial Sequence
  chemically synthesized
ataattatgatatcatgtaatt

SEQ ID NO: 708488 - DNA, 22 bp, Artificial Sequence
  chemically synthesized
ataaagctaataattatgatat

SEQ ID NO: 708489 - DNA, 22 bp, Artificial Sequence
  chemically synthesized
taattacatgatatcataatta

SEQ ID NO: 708490 - DNA, 22 bp, Artificial Sequence
  chemically synthesized
agttcataaagctaataattat

SEQ ID NO: 708491 - DNA, 22 bp, Artificial Sequence
  chemically synthesized
catgatatcataattattagct

SEQ ID NO: 708492 - DNA, 22 bp, Artificial Sequence
  chemically synthesized
tcagttcagttcataaagctaa

SEQ ID NO: 708493 - DNA, 22 bp, Artificial Sequence
  chemically synthesized
cctatcagttcagttcataaag

SEQ ID NO: 708494 - DNA, 22 bp, Artificial Sequence
  chemically synthesized
tgcctatcagttcagttcataa

SEQ ID NO: 708495 - DNA, 22 bp, Artificial Sequence
  chemically synthesized
ctgcctatcagttcagttcata

SEQ ID NO: 708496 - DNA, 22 bp, Artificial Sequence
  chemically synthesized
atttctgcctatcagttcagtt

SEQ ID NO: 708497 - DNA, 22 bp, Artificial Sequence
  chemically synthesized
ttagctttatgaactgaactga

SEQ ID NO: 708498 - DNA, 22 bp, Artificial Sequence
  chemically synthesized
aatttctgcctatcagttcagt

SEQ ID NO: 708499 - DNA, 22 bp, Artificial Sequence
  chemically synthesized
taatttctgcctatcagttcag

SEQ ID NO: 708500 - DNA, 22 bp, Artificial Sequence
  chemically synthesized
ttaatttctgcctatcagttca

SEQ ID NO: 708501 - DNA, 22 bp, Artificial Sequence
  chemically synthesized
gctttatgaactgaactgatag

SEQ ID NO: 708502 - DNA, 22 bp, Artificial Sequence
  chemically synthesized
tatgaactgaactgataggcag

SEQ ID NO: 708503 - DNA, 22 bp, Artificial Sequence
  chemically synthesized
agtttttaatttctgcctatca

SEQ ID NO: 708504 - DNA, 22 bp, Artificial Sequence
  chemically synthesized
atgaactgaactgataggcaga

SEQ ID NO: 708505 - DNA, 22 bp, Artificial Sequence
  chemically synthesized
gagtttttaatttctgcctatc

SEQ ID NO: 708506 - DNA, 22 bp, Artificial Sequence
  chemically synthesized
tgaactgaactgataggcagaa

SEQ ID NO: 708507 - DNA, 22 bp, Artificial Sequence
  chemically synthesized
tgagtttttaatttctgcctat

SEQ ID NO: 708508 - DNA, 22 bp, Artificial Sequence
  chemically synthesized
ttgagtttttaatttctgccta

SEQ ID NO: 708509 - DNA, 22 bp, Artificial Sequence
  chemically synthesized
aactgataggcagaaattaaaa

SEQ ID NO: 708510 - DNA, 22 bp, Artificial Sequence
  chemically synthesized
ataggcagaaattaaaaactca

SEQ ID NO: 708511 - DNA, 22 bp, Artificial Sequence
  chemically synthesized
aagcaaaaacatacttttgagt

SEQ ID NO: 708512 - DNA, 22 bp, Artificial Sequence
  chemically synthesized
ctgaagcaaaaacatacttttg

SEQ ID NO: 708513 - DNA, 22 bp, Artificial Sequence
  chemically synthesized
aaaactcaaaagtatgtttttg

SEQ ID NO: 708514 - DNA, 22 bp, Artificial Sequence
  chemically synthesized
gtatatgggctgctgaagcaaa

SEQ ID NO: 708515 - DNA, 22 bp, Artificial Sequence
  chemically synthesized
aaaagtatgtttttgcttcagc

SEQ ID NO: 708516 - DNA, 22 bp, Artificial Sequence
  chemically synthesized
caatgttagtatatgggctgct

SEQ ID NO: 708517 - DNA, 22 bp, Artificial Sequence
  chemically synthesized
ttccaatgttagtatatgggct

SEQ ID NO: 708518 - DNA, 22 bp, Artificial Sequence
  chemically synthesized
ttgcttcagcagcccatatact

SEQ ID NO: 708519 - DNA, 22 bp, Artificial Sequence
  chemically synthesized
tgcttcagcagcccatatacta

SEQ ID NO: 708520 - DNA, 22 bp, Artificial Sequence
  chemically synthesized
gcttcagcagcccatatactaa

SEQ ID NO: 708521 - DNA, 22 bp, Artificial Sequence
  chemically synthesized
cttcagcagcccatatactaac

SEQ ID NO: 708522 - DNA, 22 bp, Artificial Sequence
  chemically synthesized
cagcagcccatatactaacatt

SEQ ID NO: 708523 - DNA, 22 bp, Artificial Sequence
  chemically synthesized
tatcattattccaatgttagta

SEQ ID NO: 708524 - DNA, 22 bp, Artificial Sequence
  chemically synthesized
agcagcccatatactaacattg

SEQ ID NO: 708525 - DNA, 22 bp, Artificial Sequence
  chemically synthesized
tgtatcattattccaatgttag

SEQ ID NO: 708526 - DNA, 22 bp, Artificial Sequence
  chemically synthesized
tctgtatcattattccaatgtt

SEQ ID NO: 708527 - DNA, 22 bp, Artificial Sequence
  chemically synthesized
gtattctctgtatcattattcc

SEQ ID NO: 708528 - DNA, 22 bp, Artificial Sequence
  chemically synthesized
acattggaataatgatacagag

SEQ ID NO: 708529 - DNA, 22 bp, Artificial Sequence
  chemically synthesized
gaataatgatacagagaatact

SEQ ID NO: 708530 - DNA, 22 bp, Artificial Sequence
  chemically synthesized
aggagccatgctagtattctct

SEQ ID NO: 708531 - DNA, 22 bp, Artificial Sequence
  chemically synthesized
ctcaggagccatgctagtattc

SEQ ID NO: 708532 - DNA, 22 bp, Artificial Sequence
  chemically synthesized
gctcaggagccatgctagtatt

SEQ ID NO: 708533 - DNA, 22 bp, Artificial Sequence
  chemically synthesized
tgctcaggagccatgctagtat

SEQ ID NO: 708534 - DNA, 22 bp, Artificial Sequence
  chemically synthesized
aaaaatgtggaacactttgctc

SEQ ID NO: 708535 - DNA, 22 bp, Artificial Sequence
  chemically synthesized
gcatggctcctgagcaaagtgt

SEQ ID NO: 708536 - DNA, 22 bp, Artificial Sequence
  chemically synthesized
gaaaaatgtggaacactttgct

SEQ ID NO: 708537 - DNA, 22 bp, Artificial Sequence
  chemically synthesized
tgaaaaatgtggaacactttgc

SEQ ID NO: 708538 - DNA, 22 bp, Artificial Sequence
  chemically synthesized
ttgaaaaatgtggaacactttg

SEQ ID NO: 708539 - DNA, 22 bp, Artificial Sequence
  chemically synthesized
tttgaaaaatgtggaacacttt

SEQ ID NO: 708540 - DNA, 22 bp, Artificial Sequence
  chemically synthesized
ctgagcaaagtgttccacattt

SEQ ID NO: 708541 - DNA, 22 bp, Artificial Sequence
  chemically synthesized
agtctttttgaaaaatgtggaa

SEQ ID NO: 708542 - DNA, 22 bp, Artificial Sequence
  chemically synthesized
gagtctttttgaaaaatgtgga

SEQ ID NO: 708543 - DNA, 22 bp, Artificial Sequence
  chemically synthesized
tgagtctttttgaaaaatgtgg

SEQ ID NO: 708544 - DNA, 22 bp, Artificial Sequence
  chemically synthesized
agcaaagtgttccacatttttc

SEQ ID NO: 708545 - DNA, 22 bp, Artificial Sequence
  chemically synthesized
ttgagtctttttgaaaaatgtg

SEQ ID NO: 708546 - DNA, 22 bp, Artificial Sequence
  chemically synthesized
atatttttgagtctttttgaaa

SEQ ID NO: 708547 - DNA, 22 bp, Artificial Sequence
  chemically synthesized
cacatttttcaaaaagactcaa

SEQ ID NO: 708548 - DNA, 22 bp, Artificial Sequence
  chemically synthesized
accatattaatatttttgagtc

SEQ ID NO: 708549 - DNA, 22 bp, Artificial Sequence
  chemically synthesized
ttcaaaaagactcaaaaatatt

SEQ ID NO: 708550 - DNA, 22 bp, Artificial Sequence
  chemically synthesized
tcaaaaagactcaaaaatatta

SEQ ID NO: 708551 - DNA, 22 bp, Artificial Sequence
  chemically synthesized
caaaaagactcaaaaatattaa

SEQ ID NO: 708552 - DNA, 22 bp, Artificial Sequence
  chemically synthesized
aaaaagactcaaaaatattaat

SEQ ID NO: 708553 - DNA, 22 bp, Artificial Sequence
  chemically synthesized
aaatgttaaccatattaatatt

SEQ ID NO: 708554 - DNA, 22 bp, Artificial Sequence
  chemically synthesized
tcaaatgttaaccatattaata

SEQ ID NO: 708555 - DNA, 22 bp, Artificial Sequence
  chemically synthesized
tattctcaaatgttaaccatat

SEQ ID NO: 708556 - DNA, 22 bp, Artificial Sequence
  chemically synthesized
aaaaatattaatatggttaaca

SEQ ID NO: 708557 - DNA, 22 bp, Artificial Sequence
  chemically synthesized
cactatattctcaaatgttaac

SEQ ID NO: 708558 - DNA, 22 bp, Artificial Sequence
  chemically synthesized
ctgcactatattctcaaatgtt

SEQ ID NO: 708559 - DNA, 22 bp, Artificial Sequence
  chemically synthesized
cctgcactatattctcaaatgt

SEQ ID NO: 708560 - DNA, 22 bp, Artificial Sequence
  chemically synthesized
atatggttaacatttgagaata

SEQ ID NO: 708561 - DNA, 22 bp, Artificial Sequence
  chemically synthesized
tttcctgcactatattctcaaa

SEQ ID NO: 708562 - DNA, 22 bp, Artificial Sequence
  chemically synthesized
acatttgagaatatagtgcagg

SEQ ID NO: 708563 - DNA, 22 bp, Artificial Sequence
  chemically synthesized
atgcataattgtttcctgcact

SEQ ID NO: 708564 - DNA, 22 bp, Artificial Sequence
  chemically synthesized
gagaatatagtgcaggaaacaa

SEQ ID NO: 708565 - DNA, 22 bp, Artificial Sequence
  chemically synthesized
agaatatagtgcaggaaacaat

SEQ ID NO: 708566 - DNA, 22 bp, Artificial Sequence
  chemically synthesized
agctaatgcataattgtttcct

SEQ ID NO: 708567 - DNA, 22 bp, Artificial Sequence
  chemically synthesized
cagctaatgcataattgtttcc

SEQ ID NO: 708568 - DNA, 22 bp, Artificial Sequence
  chemically synthesized
tccagtcttcagctaatgcata

SEQ ID NO: 708569 - DNA, 22 bp, Artificial Sequence
  chemically synthesized
gtccagtcttcagctaatgcat

SEQ ID NO: 708570 - DNA, 22 bp, Artificial Sequence
  chemically synthesized
tgtccagtcttcagctaatgca

SEQ ID NO: 708571 - DNA, 22 bp, Artificial Sequence
  chemically synthesized
gatcattttgtccagtcttcag

SEQ ID NO: 708572 - DNA, 22 bp, Artificial Sequence
  chemically synthesized
tgcattagctgaagactggaca

SEQ ID NO: 708573 - DNA, 22 bp, Artificial Sequence
  chemically synthesized
gctgaagactggacaaaatgat

SEQ ID NO: 708574 - DNA, 22 bp, Artificial Sequence
  chemically synthesized
aagactggacaaaatgatccaa

SEQ ID NO: 708575 - DNA, 22 bp, Artificial Sequence
  chemically synthesized
ggaagaggaaggccaattggat

SEQ ID NO: 708576 - DNA, 22 bp, Artificial Sequence
  chemically synthesized
gacaaaatgatccaattggcct

SEQ ID NO: 708577 - DNA, 22 bp, Artificial Sequence
  chemically synthesized
agaaggttaggaagaggaaggc

SEQ ID NO: 708578 - DNA, 22 bp, Artificial Sequence
  chemically synthesized
ataagttgagaaggttaggaag

SEQ ID NO: 708579 - DNA, 22 bp, Artificial Sequence
  chemically synthesized
gccttcctcttcctaaccttct

SEQ ID NO: 708580 - DNA, 22 bp, Artificial Sequence
  chemically synthesized
gttgataagttgagaaggttag

SEQ ID NO: 708581 - DNA, 22 bp, Artificial Sequence
  chemically synthesized
ggttgataagttgagaaggtta

SEQ ID NO: 708582 - DNA, 22 bp, Artificial Sequence
  chemically synthesized
cctcttcctaaccttctcaact

SEQ ID NO: 708583 - DNA, 22 bp, Artificial Sequence
  chemically synthesized
ctcttcctaaccttctcaactt

SEQ ID NO: 708584 - DNA, 22 bp, Artificial Sequence
  chemically synthesized
ttcctaaccttctcaacttatc

SEQ ID NO: 708585 - DNA, 22 bp, Artificial Sequence
  chemically synthesized
cctaaccttctcaacttatcaa

SEQ ID NO: 708586 - DNA, 22 bp, Artificial Sequence
  chemically synthesized
ctaaccttctcaacttatcaac

SEQ ID NO: 708587 - DNA, 22 bp, Artificial Sequence
  chemically synthesized
aaatataacttggttgataagt

SEQ ID NO: 708588 - DNA, 22 bp, Artificial Sequence
  chemically synthesized
accttctcaacttatcaaccaa

SEQ ID NO: 708589 - DNA, 22 bp, Artificial Sequence
  chemically synthesized
ctcaacttatcaaccaagttat

SEQ ID NO: 708590 - DNA, 22 bp, Artificial Sequence
  chemically synthesized
tcaacttatcaaccaagttata

SEQ ID NO: 708591 - DNA, 22 bp, Artificial Sequence
  chemically synthesized
aacttatcaaccaagttatatt

SEQ ID NO: 708592 - DNA, 22 bp, Artificial Sequence
  chemically synthesized
atcaaccaagttatatttcagg

SEQ ID NO: 708593 - DNA, 22 bp, Artificial Sequence
  chemically synthesized
tcaaccaagttatatttcagga

SEQ ID NO: 708594 - DNA, 22 bp, Artificial Sequence
  chemically synthesized
tatttcaggatgatttatgctt

SEQ ID NO: 708595 - DNA, 22 bp, Artificial Sequence
  chemically synthesized
tcagatgcagtagaagcataaa

SEQ ID NO: 708596 - DNA, 22 bp, Artificial Sequence
  chemically synthesized
atcagatgcagtagaagcataa

SEQ ID NO: 708597 - DNA, 22 bp, Artificial Sequence
  chemically synthesized
tatcagatgcagtagaagcata

SEQ ID NO: 708598 - DNA, 22 bp, Artificial Sequence
  chemically synthesized
ttatcagatgcagtagaagcat

SEQ ID NO: 708599 - DNA, 22 bp, Artificial Sequence
  chemically synthesized
caggatgatttatgcttctact

SEQ ID NO: 708600 - DNA, 22 bp, Artificial Sequence
  chemically synthesized
aggatgatttatgcttctactg

SEQ ID NO: 708601 - DNA, 22 bp, Artificial Sequence
  chemically synthesized
tagtaatcttttatcagatgca

SEQ ID NO: 708602 - DNA, 22 bp, Artificial Sequence
  chemically synthesized
atgcttctactgcatctgataa

SEQ ID NO: 708603 - DNA, 22 bp, Artificial Sequence
  chemically synthesized
tgcttctactgcatctgataaa

SEQ ID NO: 708604 - DNA, 22 bp, Artificial Sequence
  chemically synthesized
aattatagtaatcttttatcag

SEQ ID NO: 708605 - DNA, 22 bp, Artificial Sequence
  chemically synthesized
ctactgcatctgataaaagatt

SEQ ID NO: 708606 - DNA, 22 bp, Artificial Sequence
  chemically synthesized
tactgcatctgataaaagatta

SEQ ID NO: 708607 - DNA, 22 bp, Artificial Sequence
  chemically synthesized
ctgcatctgataaaagattact

SEQ ID NO: 708608 - DNA, 22 bp, Artificial Sequence
  chemically synthesized
agagttgaattatagtaatctt

SEQ ID NO: 708609 - DNA, 22 bp, Artificial Sequence
  chemically synthesized
catctgataaaagattactata

SEQ ID NO: 708610 - DNA, 22 bp, Artificial Sequence
  chemically synthesized
ataaaagattactataattcaa

SEQ ID NO: 708611 - DNA, 22 bp, Artificial Sequence
  chemically synthesized
aaaaaacaaaagaattaagagt

SEQ ID NO: 708612 - DNA, 22 bp, Artificial Sequence
  chemically synthesized
ctataattcaactcttaattct

SEQ ID NO: 708613 - DNA, 22 bp, Artificial Sequence
  chemically synthesized
taattcaactcttaattctttt

SEQ ID NO: 708614 - DNA, 22 bp, Artificial Sequence
  chemically synthesized
aactcttaattcttttgttttt

SEQ ID NO: 708615 - DNA, 22 bp, Artificial Sequence
  chemically synthesized
ttaattcttttgttttttcaac

SEQ ID NO: 708616 - DNA, 22 bp, Artificial Sequence
  chemically synthesized
ataagaataacagttgaaaaaa

SEQ ID NO: 708617 - DNA, 22 bp, Artificial Sequence
  chemically synthesized
aattcttttgttttttcaactg

SEQ ID NO: 708618 - DNA, 22 bp, Artificial Sequence
  chemically synthesized
attcttttgttttttcaactgt

SEQ ID NO: 708619 - DNA, 22 bp, Artificial Sequence
  chemically synthesized
attaataagaataacagttgaa

SEQ ID NO: 708620 - DNA, 22 bp, Artificial Sequence
  chemically synthesized
gattaataagaataacagttga

SEQ ID NO: 708621 - DNA, 22 bp, Artificial Sequence
  chemically synthesized
ttttgttttttcaactgttatt

SEQ ID NO: 708622 - DNA, 22 bp, Artificial Sequence
  chemically synthesized
ttgttttttcaactgttattct

SEQ ID NO: 708623 - DNA, 22 bp, Artificial Sequence
  chemically synthesized
tgttttttcaactgttattctt

SEQ ID NO: 708624 - DNA, 22 bp, Artificial Sequence
  chemically synthesized
gttttttcaactgttattctta

SEQ ID NO: 708625 - DNA, 22 bp, Artificial Sequence
  chemically synthesized
catcttgattaataagaataac

SEQ ID NO: 708626 - DNA, 22 bp, Artificial Sequence
  chemically synthesized
ttttttcaactgttattcttat

SEQ ID NO: 708627 - DNA, 22 bp, Artificial Sequence
  chemically synthesized
ttgcatcttgattaataagaat

SEQ ID NO: 708628 - DNA, 22 bp, Artificial Sequence
  chemically synthesized
tttcaactgttattcttattaa

SEQ ID NO: 708629 - DNA, 22 bp, Artificial Sequence
  chemically synthesized
attgcatcttgattaataagaa

SEQ ID NO: 708630 - DNA, 22 bp, Artificial Sequence
  chemically synthesized
ttcaactgttattcttattaat

SEQ ID NO: 708631 - DNA, 22 bp, Artificial Sequence
  chemically synthesized
tattgcatcttgattaataaga

SEQ ID NO: 708632 - DNA, 22 bp, Artificial Sequence
  chemically synthesized
tcaactgttattcttattaatc

SEQ ID NO: 708633 - DNA, 22 bp, Artificial Sequence
  chemically synthesized
caactgttattcttattaatca

SEQ ID NO: 708634 - DNA, 22 bp, Artificial Sequence
  chemically synthesized
aactgttattcttattaatcaa

SEQ ID NO: 708635 - DNA, 22 bp, Artificial Sequence
  chemically synthesized
actttattgcatcttgattaat

SEQ ID NO: 708636 - DNA, 22 bp, Artificial Sequence
  chemically synthesized
aactttattgcatcttgattaa

SEQ ID NO: 708637 - DNA, 22 bp, Artificial Sequence
  chemically synthesized
ttattcttattaatcaagatgc

SEQ ID NO: 708638 - DNA, 22 bp, Artificial Sequence
  chemically synthesized
ttcttattaatcaagatgcaat

SEQ ID NO: 708639 - DNA, 22 bp, Artificial Sequence
  chemically synthesized
tcacttaactttattgcatctt

SEQ ID NO: 708640 - DNA, 22 bp, Artificial Sequence
  chemically synthesized
atcacttaactttattgcatct

SEQ ID NO: 708641 - DNA, 22 bp, Artificial Sequence
  chemically synthesized
tatcacttaactttattgcatc

SEQ ID NO: 708642 - DNA, 22 bp, Artificial Sequence
  chemically synthesized
ttattaatcaagatgcaataaa

SEQ ID NO: 708643 - DNA, 22 bp, Artificial Sequence
  chemically synthesized
ttatcacttaactttattgcat

SEQ ID NO: 708644 - DNA, 22 bp, Artificial Sequence
  chemically synthesized
attaatcaagatgcaataaagt

SEQ ID NO: 708645 - DNA, 22 bp, Artificial Sequence
  chemically synthesized
ttaatcaagatgcaataaagtt

SEQ ID NO: 708646 - DNA, 22 bp, Artificial Sequence
  chemically synthesized
agcttttatcacttaactttat

SEQ ID NO: 708647 - DNA, 22 bp, Artificial Sequence
  chemically synthesized
atcaagatgcaataaagttaag

SEQ ID NO: 708648 - DNA, 22 bp, Artificial Sequence
  chemically synthesized
cagcttttatcacttaacttta

SEQ ID NO: 708649 - DNA, 22 bp, Artificial Sequence
  chemically synthesized
tcagcttttatcacttaacttt

SEQ ID NO: 708650 - DNA, 22 bp, Artificial Sequence
  chemically synthesized
cagtaagtcattttcagctttt

SEQ ID NO: 708651 - DNA, 22 bp, Artificial Sequence
  chemically synthesized
ccagtaagtcattttcagcttt

SEQ ID NO: 708652 - DNA, 22 bp, Artificial Sequence
  chemically synthesized
tccagtaagtcattttcagctt

SEQ ID NO: 708653 - DNA, 22 bp, Artificial Sequence
  chemically synthesized
tttccagtaagtcattttcagc

SEQ ID NO: 708654 - DNA, 22 bp, Artificial Sequence
  chemically synthesized
ctttccagtaagtcattttcag

SEQ ID NO: 708655 - DNA, 22 bp, Artificial Sequence
  chemically synthesized
agtgataaaagctgaaaatgac

SEQ ID NO: 708656 - DNA, 22 bp, Artificial Sequence
  chemically synthesized
tctttccagtaagtcattttca

SEQ ID NO: 708657 - DNA, 22 bp, Artificial Sequence
  chemically synthesized
agcactttctttccagtaagtc

SEQ ID NO: 708658 - DNA, 22 bp, Artificial Sequence
  chemically synthesized
aaaatgacttactggaaagaaa

SEQ ID NO: 708659 - DNA, 22 bp, Artificial Sequence
  chemically synthesized
gtccagcatctcagcactttct

SEQ ID NO: 708660 - DNA, 22 bp, Artificial Sequence
  chemically synthesized
ggtccagcatctcagcactttc

SEQ ID NO: 708661 - DNA, 22 bp, Artificial Sequence
  chemically synthesized
tggtccagcatctcagcacttt

SEQ ID NO: 708662 - DNA, 22 bp, Artificial Sequence
  chemically synthesized
actggaaagaaagtgctgagat

SEQ ID NO: 708663 - DNA, 22 bp, Artificial Sequence
  chemically synthesized
ctggaaagaaagtgctgagatg

SEQ ID NO: 708664 - DNA, 22 bp, Artificial Sequence
  chemically synthesized
gaaagaaagtgctgagatgctg

SEQ ID NO: 708665 - DNA, 22 bp, Artificial Sequence
  chemically synthesized
catgaagcccacagggactttg

SEQ ID NO: 708666 - DNA, 22 bp, Artificial Sequence
  chemically synthesized
agatgctggaccaaagtccctg

SEQ ID NO: 708667 - DNA, 22 bp, Artificial Sequence
  chemically synthesized
gaccaaagtccctgtgggcttc

SEQ ID NO: 708668 - DNA, 22 bp, Artificial Sequence
  chemically synthesized
tgggcttcatgcagctgcctga

SEQ ID NO: 708669 - DNA, 22 bp, Artificial Sequence
  chemically synthesized
catgcagctgcctgactcggtc

SEQ ID NO: 708670 - DNA, 22 bp, Artificial Sequence
  chemically synthesized
atgcagctgcctgactcggtcc

SEQ ID NO: 708671 - DNA, 22 bp, Artificial Sequence
  chemically synthesized
ccaggtggccgtcgaggaccga

SEQ ID NO: 708672 - DNA, 22 bp, Artificial Sequence
  chemically synthesized
ctcccaggtggccgtcgaggac

SEQ ID NO: 708673 - DNA, 22 bp, Artificial Sequence
  chemically synthesized
cctcccaggtggccgtcgagga

SEQ ID NO: 708674 - DNA, 22 bp, Artificial Sequence
  chemically synthesized
tcctcccaggtggccgtcgagg

SEQ ID NO: 708675 - DNA, 22 bp, Artificial Sequence
  chemically synthesized
cctgactcggtcctcgacggcc

SEQ ID NO: 708676 - DNA, 22 bp, Artificial Sequence
  chemically synthesized
ttcctcccaggtggccgtcgag

SEQ ID NO: 708677 - DNA, 22 bp, Artificial Sequence
  chemically synthesized
cttttcctcccaggtggccgtc

SEQ ID NO: 708678 - DNA, 22 bp, Artificial Sequence
  chemically synthesized
actcggtcctcgacggccacct

SEQ ID NO: 708679 - DNA, 22 bp, Artificial Sequence
  chemically synthesized
tccttttcctcccaggtggccg

SEQ ID NO: 708680 - DNA, 22 bp, Artificial Sequence
  chemically synthesized
tctccttttcctcccaggtggc

SEQ ID NO: 708681 - DNA, 22 bp, Artificial Sequence
  chemically synthesized
ggtcctcgacggccacctggga

SEQ ID NO: 708682 - DNA, 22 bp, Artificial Sequence
  chemically synthesized
ctctccttttcctcccaggtgg

SEQ ID NO: 708683 - DNA, 22 bp, Artificial Sequence
  chemically synthesized
gacggccacctgggaggaaaag

SEQ ID NO: 708684 - DNA, 22 bp, Artificial Sequence
  chemically synthesized
ggaggaaaaggagagaaatgat

SEQ ID NO: 708685 - DNA, 22 bp, Artificial Sequence
  chemically synthesized
tatagaatgagagaacatcatt

SEQ ID NO: 708686 - DNA, 22 bp, Artificial Sequence
  chemically synthesized
attatatagaatgagagaacat

SEQ ID NO: 708687 - DNA, 22 bp, Artificial Sequence
  chemically synthesized
ctcattatatagaatgagagaa

SEQ ID NO: 708688 - DNA, 22 bp, Artificial Sequence
  chemically synthesized
ttcctcattatatagaatgaga

SEQ ID NO: 708689 - DNA, 22 bp, Artificial Sequence
  chemically synthesized
attgttcctcattatatagaat

SEQ ID NO: 708690 - DNA, 22 bp, Artificial Sequence
  chemically synthesized
aattgttcctcattatatagaa

SEQ ID NO: 708691 - DNA, 22 bp, Artificial Sequence
  chemically synthesized
taattgttcctcattatataga

SEQ ID NO: 708692 - DNA, 22 bp, Artificial Sequence
  chemically synthesized
ttttaattgttcctcattatat

SEQ ID NO: 708693 - DNA, 22 bp, Artificial Sequence
  chemically synthesized
tctcattctatataatgaggaa

SEQ ID NO: 708694 - DNA, 22 bp, Artificial Sequence
  chemically synthesized
tcattctatataatgaggaaca

SEQ ID NO: 708695 - DNA, 22 bp, Artificial Sequence
  chemically synthesized
attctatataatgaggaacaat

SEQ ID NO: 708696 - DNA, 22 bp, Artificial Sequence
  chemically synthesized
tatataatgaggaacaattaaa

SEQ ID NO: 708697 - DNA, 22 bp, Artificial Sequence
  chemically synthesized
tataatgaggaacaattaaaac

SEQ ID NO: 708698 - DNA, 22 bp, Artificial Sequence
  chemically synthesized
tcagaaaggatacattgtttta

SEQ ID NO: 708699 - DNA, 22 bp, Artificial Sequence
  chemically synthesized
atcagaaaggatacattgtttt

SEQ ID NO: 708700 - DNA, 22 bp, Artificial Sequence
  chemically synthesized
aaagtatcttatcagaaaggat

SEQ ID NO: 708701 - DNA, 22 bp, Artificial Sequence
  chemically synthesized
aaacaatgtatcctttctgata

SEQ ID NO: 708702 - DNA, 22 bp, Artificial Sequence
  chemically synthesized
gagactcaaagtatcttatcag

SEQ ID NO: 708703 - DNA, 22 bp, Artificial Sequence
  chemically synthesized
ggagactcaaagtatcttatca

SEQ ID NO: 708704 - DNA, 22 bp, Artificial Sequence
  chemically synthesized
agtcttggagactcaaagtatc

SEQ ID NO: 708705 - DNA, 22 bp, Artificial Sequence
  chemically synthesized
tcagtcttggagactcaaagta

SEQ ID NO: 708706 - DNA, 22 bp, Artificial Sequence
  chemically synthesized
tctgataagatactttgagtct

SEQ ID NO: 708707 - DNA, 22 bp, Artificial Sequence
  chemically synthesized
ctgataagatactttgagtctc

SEQ ID NO: 708708 - DNA, 22 bp, Artificial Sequence
  chemically synthesized
tgataagatactttgagtctcc

SEQ ID NO: 708709 - DNA, 22 bp, Artificial Sequence
  chemically synthesized
ataagatactttgagtctccaa

SEQ ID NO: 708710 - DNA, 22 bp, Artificial Sequence
  chemically synthesized
gtgttctcagtcttggagactc

SEQ ID NO: 708711 - DNA, 22 bp, Artificial Sequence
  chemically synthesized
agtgttctcagtcttggagact

SEQ ID NO: 708712 - DNA, 22 bp, Artificial Sequence
  chemically synthesized
tagtgttctcagtcttggagac

SEQ ID NO: 708713 - DNA, 22 bp, Artificial Sequence
  chemically synthesized
ctttagtgttctcagtcttgga

SEQ ID NO: 708714 - DNA, 22 bp, Artificial Sequence
  chemically synthesized
tgagtctccaagactgagaaca

SEQ ID NO: 708715 - DNA, 22 bp, Artificial Sequence
  chemically synthesized
gagtctccaagactgagaacac

SEQ ID NO: 708716 - DNA, 22 bp, Artificial Sequence
  chemically synthesized
agtctccaagactgagaacact

SEQ ID NO: 708717 - DNA, 22 bp, Artificial Sequence
  chemically synthesized
tgaaatgttgctttagtgttct

SEQ ID NO: 708718 - DNA, 22 bp, Artificial Sequence
  chemically synthesized
caagactgagaacactaaagca

SEQ ID NO: 708719 - DNA, 22 bp, Artificial Sequence
  chemically synthesized
gagttatgaaatgttgctttag

SEQ ID NO: 708720 - DNA, 22 bp, Artificial Sequence
  chemically synthesized
agaacactaaagcaacatttca

SEQ ID NO: 708721 - DNA, 22 bp, Artificial Sequence
  chemically synthesized
aaactagagttatgaaatgttg

SEQ ID NO: 708722 - DNA, 22 bp, Artificial Sequence
  chemically synthesized
aagcaacatttcataactctag

SEQ ID NO: 708723 - DNA, 22 bp, Artificial Sequence
  chemically synthesized
cataactctagttttaatattc

SEQ ID NO: 708724 - DNA, 22 bp, Artificial Sequence
  chemically synthesized
tatacggtaagtgaatattaaa

SEQ ID NO: 708725 - DNA, 22 bp, Artificial Sequence
  chemically synthesized
ataactctagttttaatattca

SEQ ID NO: 708726 - DNA, 22 bp, Artificial Sequence
  chemically synthesized
tagttttaatattcacttaccg

SEQ ID NO: 708727 - DNA, 22 bp, Artificial Sequence
  chemically synthesized
gaatactatatacggtaagtga

SEQ ID NO: 708728 - DNA, 22 bp, Artificial Sequence
  chemically synthesized
gttttaatattcacttaccgta

SEQ ID NO: 708729 - DNA, 22 bp, Artificial Sequence
  chemically synthesized
taatattcacttaccgtatata

SEQ ID NO: 708730 - DNA, 22 bp, Artificial Sequence
  chemically synthesized
aatattcacttaccgtatatag

SEQ ID NO: 708731 - DNA, 22 bp, Artificial Sequence
  chemically synthesized
atattcacttaccgtatatagt

SEQ ID NO: 708732 - DNA, 22 bp, Artificial Sequence
  chemically synthesized
acttaccgtatatagtattcca

SEQ ID NO: 708733 - DNA, 22 bp, Artificial Sequence
  chemically synthesized
ataaaaacgagtctggaatact

SEQ ID NO: 708734 - DNA, 22 bp, Artificial Sequence
  chemically synthesized
accgtatatagtattccagact

SEQ ID NO: 708735 - DNA, 22 bp, Artificial Sequence
  chemically synthesized
ccgtatatagtattccagactc

SEQ ID NO: 708736 - DNA, 22 bp, Artificial Sequence
  chemically synthesized
gattgataaaaacgagtctgga

SEQ ID NO: 708737 - DNA, 22 bp, Artificial Sequence
  chemically synthesized
ggattgataaaaacgagtctgg

SEQ ID NO: 708738 - DNA, 22 bp, Artificial Sequence
  chemically synthesized
gccttggattgataaaaacgag

SEQ ID NO: 708739 - DNA, 22 bp, Artificial Sequence
  chemically synthesized
ggccttggattgataaaaacga

SEQ ID NO: 708740 - DNA, 22 bp, Artificial Sequence
  chemically synthesized
tgtttggccttggattgataaa

SEQ ID NO: 708741 - DNA, 22 bp, Artificial Sequence
  chemically synthesized
gtgtttggccttggattgataa

SEQ ID NO: 708742 - DNA, 22 bp, Artificial Sequence
  chemically synthesized
cagactcgtttttatcaatcca

SEQ ID NO: 708743 - DNA, 22 bp, Artificial Sequence
  chemically synthesized
tgtgtttggccttggattgata

SEQ ID NO: 708744 - DNA, 22 bp, Artificial Sequence
  chemically synthesized
gtttttatcaatccaaggccaa

SEQ ID NO: 708745 - DNA, 22 bp, Artificial Sequence
  chemically synthesized
ttatcaatccaaggccaaacac

SEQ ID NO: 708746 - DNA, 22 bp, Artificial Sequence
  chemically synthesized
tatcaatccaaggccaaacaca

SEQ ID NO: 708747 - DNA, 22 bp, Artificial Sequence
  chemically synthesized
atcaatccaaggccaaacacaa

SEQ ID NO: 708748 - DNA, 22 bp, Artificial Sequence
  chemically synthesized
tcaatccaaggccaaacacaaa

SEQ ID NO: 708749 - DNA, 22 bp, Artificial Sequence
  chemically synthesized
tcgagagaggaaatcctttgtg

SEQ ID NO: 708750 - DNA, 22 bp, Artificial Sequence
  chemically synthesized
acattgtcgagagaggaaatcc

SEQ ID NO: 708751 - DNA, 22 bp, Artificial Sequence
  chemically synthesized
aacattgtcgagagaggaaatc

SEQ ID NO: 708752 - DNA, 22 bp, Artificial Sequence
  chemically synthesized
taacattgtcgagagaggaaat

SEQ ID NO: 708753 - DNA, 22 bp, Artificial Sequence
  chemically synthesized
attttaacattgtcgagagagg

SEQ ID NO: 708754 - DNA, 22 bp, Artificial Sequence
  chemically synthesized
cctctctcgacaatgttaaaat

SEQ ID NO: 708755 - DNA, 22 bp, Artificial Sequence
  chemically synthesized
ctctctcgacaatgttaaaatg

SEQ ID NO: 708756 - DNA, 22 bp, Artificial Sequence
  chemically synthesized
tctcgacaatgttaaaatgaga

SEQ ID NO: 708757 - DNA, 22 bp, Artificial Sequence
  chemically synthesized
tcgacaatgttaaaatgagatt

SEQ ID NO: 708758 - DNA, 22 bp, Artificial Sequence
  chemically synthesized
gacaatgttaaaatgagatttt

SEQ ID NO: 708759 - DNA, 22 bp, Artificial Sequence
  chemically synthesized
taaaaaaaaaccaaaatctcat

SEQ ID NO: 708760 - DNA, 22 bp, Artificial Sequence
  chemically synthesized
actgtaaaaaaaaaccaaaatc

SEQ ID NO: 708761 - DNA, 22 bp, Artificial Sequence
  chemically synthesized
aaatgagattttggtttttttt

SEQ ID NO: 708762 - DNA, 22 bp, Artificial Sequence
  chemically synthesized
ccaatgagttgactgtaaaaaa

SEQ ID NO: 708763 - DNA, 22 bp, Artificial Sequence
  chemically synthesized
tggtttttttttacagtcaact

SEQ ID NO: 708764 - DNA, 22 bp, Artificial Sequence
  chemically synthesized
tggctgccaatgagttgactgt

SEQ ID NO: 708765 - DNA, 22 bp, Artificial Sequence
  chemically synthesized
ggtttttttttacagtcaactc

SEQ ID NO: 708766 - DNA, 22 bp, Artificial Sequence
  chemically synthesized
gtggctgccaatgagttgactg

SEQ ID NO: 708767 - DNA, 22 bp, Artificial Sequence
  chemically synthesized
gtttttttttacagtcaactca

SEQ ID NO: 708768 - DNA, 22 bp, Artificial Sequence
  chemically synthesized
atttgtggctgccaatgagttg

SEQ ID NO: 708769 - DNA, 22 bp, Artificial Sequence
  chemically synthesized
ttttttacagtcaactcattgg

SEQ ID NO: 708770 - DNA, 22 bp, Artificial Sequence
  chemically synthesized
tttttacagtcaactcattggc

SEQ ID NO: 708771 - DNA, 22 bp, Artificial Sequence
  chemically synthesized
ttttacagtcaactcattggca

SEQ ID NO: 708772 - DNA, 22 bp, Artificial Sequence
  chemically synthesized
tttacagtcaactcattggcag

SEQ ID NO: 708773 - DNA, 22 bp, Artificial Sequence
  chemically synthesized
ttacagtcaactcattggcagc

SEQ ID NO: 708774 - DNA, 22 bp, Artificial Sequence
  chemically synthesized
tacagtcaactcattggcagcc

SEQ ID NO: 708775 - DNA, 22 bp, Artificial Sequence
  chemically synthesized
acagtcaactcattggcagcca

SEQ ID NO: 708776 - DNA, 22 bp, Artificial Sequence
  chemically synthesized
cagtcaactcattggcagccac

SEQ ID NO: 708777 - DNA, 22 bp, Artificial Sequence
  chemically synthesized
aagcagtagttcatttgtggct

SEQ ID NO: 708778 - DNA, 22 bp, Artificial Sequence
  chemically synthesized
attgaagcagtagttcatttgt

SEQ ID NO: 708779 - DNA, 22 bp, Artificial Sequence
  chemically synthesized
attggcagccacaaatgaacta

SEQ ID NO: 708780 - DNA, 22 bp, Artificial Sequence
  chemically synthesized
gcagccacaaatgaactactgc

SEQ ID NO: 708781 - DNA, 22 bp, Artificial Sequence
  chemically synthesized
tggtactaattgaagcagtagt

SEQ ID NO: 708782 - DNA, 22 bp, Artificial Sequence
  chemically synthesized
atggtactaattgaagcagtag

SEQ ID NO: 708783 - DNA, 22 bp, Artificial Sequence
  chemically synthesized
tatggtactaattgaagcagta

SEQ ID NO: 708784 - DNA, 22 bp, Artificial Sequence
  chemically synthesized
ttatggtactaattgaagcagt

SEQ ID NO: 708785 - DNA, 22 bp, Artificial Sequence
  chemically synthesized
tttatggtactaattgaagcag

SEQ ID NO: 708786 - DNA, 22 bp, Artificial Sequence
  chemically synthesized
ttttatggtactaattgaagca

SEQ ID NO: 708787 - DNA, 22 bp, Artificial Sequence
  chemically synthesized
tatttttttatggtactaattg

SEQ ID NO: 708788 - DNA, 22 bp, Artificial Sequence
  chemically synthesized
gtatttttttatggtactaatt

SEQ ID NO: 708789 - DNA, 22 bp, Artificial Sequence
  chemically synthesized
ctgcttcaattagtaccataaa

SEQ ID NO: 708790 - DNA, 22 bp, Artificial Sequence
  chemically synthesized
cttcaattagtaccataaaaaa

SEQ ID NO: 708791 - DNA, 22 bp, Artificial Sequence
  chemically synthesized
caattagtaccataaaaaaata

SEQ ID NO: 708792 - DNA, 22 bp, Artificial Sequence
  chemically synthesized
aattagtaccataaaaaaatac

SEQ ID NO: 708793 - DNA, 22 bp, Artificial Sequence
  chemically synthesized
tgaaagtaaagatttgtatttt

SEQ ID NO: 708794 - DNA, 22 bp, Artificial Sequence
  chemically synthesized
gtgaaagtaaagatttgtattt

SEQ ID NO: 708795 - DNA, 22 bp, Artificial Sequence
  chemically synthesized
gtaccataaaaaaatacaaatc

SEQ ID NO: 708796 - DNA, 22 bp, Artificial Sequence
  chemically synthesized
tgtgaaagtaaagatttgtatt

SEQ ID NO: 708797 - DNA, 22 bp, Artificial Sequence
  chemically synthesized
ttgtgaaagtaaagatttgtat

SEQ ID NO: 708798 - DNA, 22 bp, Artificial Sequence
  chemically synthesized
atgtttttgtgaaagtaaagat

SEQ ID NO: 708799 - DNA, 22 bp, Artificial Sequence
  chemically synthesized
cctaatgtttttgtgaaagtaa

SEQ ID NO: 708800 - DNA, 22 bp, Artificial Sequence
  chemically synthesized
tactttcacaaaaacattaggg

SEQ ID NO: 708801 - DNA, 22 bp, Artificial Sequence
  chemically synthesized
actttcacaaaaacattaggga

SEQ ID NO: 708802 - DNA, 22 bp, Artificial Sequence
  chemically synthesized
ctttcacaaaaacattagggag

SEQ ID NO: 708803 - DNA, 22 bp, Artificial Sequence
  chemically synthesized
taccaaatgtcaccctccctaa

SEQ ID NO: 708804 - DNA, 22 bp, Artificial Sequence
  chemically synthesized
tcacaaaaacattagggagggt

SEQ ID NO: 708805 - DNA, 22 bp, Artificial Sequence
  chemically synthesized
cacaaaaacattagggagggtg

SEQ ID NO: 708806 - DNA, 22 bp, Artificial Sequence
  chemically synthesized
acaaaaacattagggagggtga

SEQ ID NO: 708807 - DNA, 22 bp, Artificial Sequence
  chemically synthesized
tagtcacctataccaaatgtca

SEQ ID NO: 708808 - DNA, 22 bp, Artificial Sequence
  chemically synthesized
tgtagtcacctataccaaatgt

SEQ ID NO: 708809 - DNA, 22 bp, Artificial Sequence
  chemically synthesized
gggagggtgacatttggtatag

SEQ ID NO: 708810 - DNA, 22 bp, Artificial Sequence
  chemically synthesized
agattctgtagtcacctatacc

SEQ ID NO: 708811 - DNA, 22 bp, Artificial Sequence
  chemically synthesized
tgagattctgtagtcacctata

SEQ ID NO: 708812 - DNA, 22 bp, Artificial Sequence
  chemically synthesized
ctgagattctgtagtcacctat

SEQ ID NO: 708813 - DNA, 22 bp, Artificial Sequence
  chemically synthesized
ggtataggtgactacagaatct

SEQ ID NO: 708814 - DNA, 22 bp, Artificial Sequence
  chemically synthesized
gtataggtgactacagaatctc

SEQ ID NO: 708815 - DNA, 22 bp, Artificial Sequence
  chemically synthesized
aagacaagacatgtcatttctg

SEQ ID NO: 708816 - DNA, 22 bp, Artificial Sequence
  chemically synthesized
aaagacaagacatgtcatttct

SEQ ID NO: 708817 - DNA, 22 bp, Artificial Sequence
  chemically synthesized
cagaatctcagaaatgacatgt

SEQ ID NO: 708818 - DNA, 22 bp, Artificial Sequence
  chemically synthesized
agacttaaagacaagacatgtc

SEQ ID NO: 708819 - DNA, 22 bp, Artificial Sequence
  chemically synthesized
agaaatgacatgtcttgtcttt

SEQ ID NO: 708820 - DNA, 22 bp, Artificial Sequence
  chemically synthesized
tcaaaaacaatagcctaagact

SEQ ID NO: 708821 - DNA, 22 bp, Artificial Sequence
  chemically synthesized
gtcaaaaacaatagcctaagac

SEQ ID NO: 708822 - DNA, 22 bp, Artificial Sequence
  chemically synthesized
gtctttaagtcttaggctattg

SEQ ID NO: 708823 - DNA, 22 bp, Artificial Sequence
  chemically synthesized
tctttaagtcttaggctattgt

SEQ ID NO: 708824 - DNA, 22 bp, Artificial Sequence
  chemically synthesized
aaaatttgtcaaaaacaatagc

SEQ ID NO: 708825 - DNA, 22 bp, Artificial Sequence
  chemically synthesized
aaaaatttgtcaaaaacaatag

SEQ ID NO: 708826 - DNA, 22 bp, Artificial Sequence
  chemically synthesized
taagtcttaggctattgttttt

SEQ ID NO: 708827 - DNA, 22 bp, Artificial Sequence
  chemically synthesized
taaaaatttgtcaaaaacaata

SEQ ID NO: 708828 - DNA, 22 bp, Artificial Sequence
  chemically synthesized
aagtcttaggctattgtttttg

SEQ ID NO: 708829 - DNA, 22 bp, Artificial Sequence
  chemically synthesized
agtcttaggctattgtttttga

SEQ ID NO: 708830 - DNA, 22 bp, Artificial Sequence
  chemically synthesized
tttaaaaatttgtcaaaaacaa

SEQ ID NO: 708831 - DNA, 22 bp, Artificial Sequence
  chemically synthesized
ctttaaaaatttgtcaaaaaca

SEQ ID NO: 708832 - DNA, 22 bp, Artificial Sequence
  chemically synthesized
cttctttaaaaatttgtcaaaa

SEQ ID NO: 708833 - DNA, 22 bp, Artificial Sequence
  chemically synthesized
aggctattgtttttgacaaatt

SEQ ID NO: 708834 - DNA, 22 bp, Artificial Sequence
  chemically synthesized
ggctattgtttttgacaaattt

SEQ ID NO: 708835 - DNA, 22 bp, Artificial Sequence
  chemically synthesized
ttgtttttgacaaatttttaaa

SEQ ID NO: 708836 - DNA, 22 bp, Artificial Sequence
  chemically synthesized
atcaatattgcttctttaaaaa

SEQ ID NO: 708837 - DNA, 22 bp, Artificial Sequence
  chemically synthesized
tttttgacaaatttttaaagaa

SEQ ID NO: 708838 - DNA, 22 bp, Artificial Sequence
  chemically synthesized
ttaatcaatattgcttctttaa

SEQ ID NO: 708839 - DNA, 22 bp, Artificial Sequence
  chemically synthesized
ttgacaaatttttaaagaagca

SEQ ID NO: 708840 - DNA, 22 bp, Artificial Sequence
  chemically synthesized
tgacaaatttttaaagaagcaa

SEQ ID NO: 708841 - DNA, 22 bp, Artificial Sequence
  chemically synthesized
gacaaatttttaaagaagcaat

SEQ ID NO: 708842 - DNA, 22 bp, Artificial Sequence
  chemically synthesized
acaaatttttaaagaagcaata

SEQ ID NO: 708843 - DNA, 22 bp, Artificial Sequence
  chemically synthesized
tctattaatcaatattgcttct

SEQ ID NO: 708844 - DNA, 22 bp, Artificial Sequence
  chemically synthesized
ttatctattaatcaatattgct

SEQ ID NO: 708845 - DNA, 22 bp, Artificial Sequence
  chemically synthesized
attatctattaatcaatattgc

SEQ ID NO: 708846 - DNA, 22 bp, Artificial Sequence
  chemically synthesized
ttaaagaagcaatattgattaa

SEQ ID NO: 708847 - DNA, 22 bp, Artificial Sequence
  chemically synthesized
taaagaagcaatattgattaat

SEQ ID NO: 708848 - DNA, 22 bp, Artificial Sequence
  chemically synthesized
aaagaagcaatattgattaata

SEQ ID NO: 708849 - DNA, 22 bp, Artificial Sequence
  chemically synthesized
aagaagcaatattgattaatag

SEQ ID NO: 708850 - DNA, 22 bp, Artificial Sequence
  chemically synthesized
aatgatttattatctattaatc

SEQ ID NO: 708851 - DNA, 22 bp, Artificial Sequence
  chemically synthesized
aatatcactcaatgatttatta

SEQ ID NO: 708852 - DNA, 22 bp, Artificial Sequence
  chemically synthesized
attaatagataataaatcattg

SEQ ID NO: 708853 - DNA, 22 bp, Artificial Sequence
  chemically synthesized
atagataataaatcattgagtg

SEQ ID NO: 708854 - DNA, 22 bp, Artificial Sequence
  chemically synthesized
tcaataattaaatatcactcaa

SEQ ID NO: 708855 - DNA, 22 bp, Artificial Sequence
  chemically synthesized
ataattatcaataattaaatat

SEQ ID NO: 708856 - DNA, 22 bp, Artificial Sequence
  chemically synthesized
attaataattatcaataattaa

SEQ ID NO: 708857 - DNA, 22 bp, Artificial Sequence
  chemically synthesized
agtgatatttaattattgataa

SEQ ID NO: 708858 - DNA, 22 bp, Artificial Sequence
  chemically synthesized
gttaattaataattatcaataa

SEQ ID NO: 708859 - DNA, 22 bp, Artificial Sequence
  chemically synthesized
aattattgataattattaatta

SEQ ID NO: 708860 - DNA, 22 bp, Artificial Sequence
  chemically synthesized
attattgataattattaattaa

SEQ ID NO: 708861 - DNA, 22 bp, Artificial Sequence
  chemically synthesized
atcaaccactggttaattaata

SEQ ID NO: 708862 - DNA, 22 bp, Artificial Sequence
  chemically synthesized
ttgataattattaattaaccag

SEQ ID NO: 708863 - DNA, 22 bp, Artificial Sequence
  chemically synthesized
ataattattaattaaccagtgg

SEQ ID NO: 708864 - DNA, 22 bp, Artificial Sequence
  chemically synthesized
aatattaatcaaccactggtta

SEQ ID NO: 708865 - DNA, 22 bp, Artificial Sequence
  chemically synthesized
ttaattaaccagtggttgatta

SEQ ID NO: 708866 - DNA, 22 bp, Artificial Sequence
  chemically synthesized
attaaccagtggttgattaata

SEQ ID NO: 708867 - DNA, 22 bp, Artificial Sequence
  chemically synthesized
accagtggttgattaatattta

SEQ ID NO: 708868 - DNA, 22 bp, Artificial Sequence
  chemically synthesized
tgcccagcccataattaaatat

SEQ ID NO: 708869 - DNA, 22 bp, Artificial Sequence
  chemically synthesized
attaatatttaattatgggctg

SEQ ID NO: 708870 - DNA, 22 bp, Artificial Sequence
  chemically synthesized
atatttaattatgggctgggca

SEQ ID NO: 708871 - DNA, 22 bp, Artificial Sequence
  chemically synthesized
caggcatgagtcactgtgccca

SEQ ID NO: 708872 - DNA, 22 bp, Artificial Sequence
  chemically synthesized
aattatgggctgggcacagtga

SEQ ID NO: 708873 - DNA, 22 bp, Artificial Sequence
  chemically synthesized
attatgggctgggcacagtgac

SEQ ID NO: 708874 - DNA, 22 bp, Artificial Sequence
  chemically synthesized
ggattacaggcatgagtcactg

SEQ ID NO: 708875 - DNA, 22 bp, Artificial Sequence
  chemically synthesized
tgggctgggcacagtgactcat

SEQ ID NO: 708876 - DNA, 22 bp, Artificial Sequence
  chemically synthesized
ggcacagtgactcatgcctgta

SEQ ID NO: 708877 - DNA, 22 bp, Artificial Sequence
  chemically synthesized
ccaaagtgctgggattacaggc

SEQ ID NO: 708878 - DNA, 22 bp, Artificial Sequence
  chemically synthesized
gcctcccaaagtgctgggatta

SEQ ID NO: 708879 - DNA, 22 bp, Artificial Sequence
  chemically synthesized
ggcctcccaaagtgctgggatt

SEQ ID NO: 708880 - DNA, 22 bp, Artificial Sequence
  chemically synthesized
atgcctgtaatcccagcacttt

SEQ ID NO: 708881 - DNA, 22 bp, Artificial Sequence
  chemically synthesized
taatcccagcactttgggaggc

SEQ ID NO: 708882 - DNA, 22 bp, Artificial Sequence
  chemically synthesized
aagtgatccagccaacttggcc

SEQ ID NO: 708883 - DNA, 22 bp, Artificial Sequence
  chemically synthesized
tgggaggccaagttggctggat

SEQ ID NO: 708884 - DNA, 22 bp, Artificial Sequence
  chemically synthesized
tgacctcaagtgatccagccaa

SEQ ID NO: 708885 - DNA, 22 bp, Artificial Sequence
  chemically synthesized
gggaggccaagttggctggatc

SEQ ID NO: 708886 - DNA, 22 bp, Artificial Sequence
  chemically synthesized
atgacctcaagtgatccagcca

SEQ ID NO: 708887 - DNA, 22 bp, Artificial Sequence
  chemically synthesized
ggaggccaagttggctggatca

SEQ ID NO: 708888 - DNA, 22 bp, Artificial Sequence
  chemically synthesized
gaacttatgacctcaagtgatc

SEQ ID NO: 708889 - DNA, 22 bp, Artificial Sequence
  chemically synthesized
gcctcgaacttatgacctcaag

SEQ ID NO: 708890 - DNA, 22 bp, Artificial Sequence
  chemically synthesized
gctggatcacttgaggtcataa

SEQ ID NO: 708891 - DNA, 22 bp, Artificial Sequence
  chemically synthesized
gatcacttgaggtcataagttc

SEQ ID NO: 708892 - DNA, 22 bp, Artificial Sequence
  chemically synthesized
gccaggctggcctcgaacttat

SEQ ID NO: 708893 - DNA, 22 bp, Artificial Sequence
  chemically synthesized
gaggtcataagttcgaggccag

SEQ ID NO: 708894 - DNA, 22 bp, Artificial Sequence
  chemically synthesized
aggtcataagttcgaggccagc

SEQ ID NO: 708895 - DNA, 22 bp, Artificial Sequence
  chemically synthesized
accatgttggccaggctggcct

SEQ ID NO: 708896 - DNA, 22 bp, Artificial Sequence
  chemically synthesized
caccatgttggccaggctggcc

SEQ ID NO: 708897 - DNA, 22 bp, Artificial Sequence
  chemically synthesized
tcaccatgttggccaggctggc

SEQ ID NO: 708898 - DNA, 22 bp, Artificial Sequence
  chemically synthesized
gaggccagcctggccaacatgg

SEQ ID NO: 708899 - DNA, 22 bp, Artificial Sequence
  chemically synthesized
gtagagacgggttttcaccatg

SEQ ID NO: 708900 - DNA, 22 bp, Artificial Sequence
  chemically synthesized
tagtagagacgggttttcacca

SEQ ID NO: 708901 - DNA, 22 bp, Artificial Sequence
  chemically synthesized
ctagtagagacgggttttcacc

SEQ ID NO: 708902 - DNA, 22 bp, Artificial Sequence
  chemically synthesized
gccaacatggtgaaaacccgtc

SEQ ID NO: 708903 - DNA, 22 bp, Artificial Sequence
  chemically synthesized
tatttctagtagagacgggttt

SEQ ID NO: 708904 - DNA, 22 bp, Artificial Sequence
  chemically synthesized
gtatttctagtagagacgggtt

SEQ ID NO: 708905 - DNA, 22 bp, Artificial Sequence
  chemically synthesized
tgtatttctagtagagacgggt

SEQ ID NO: 708906 - DNA, 22 bp, Artificial Sequence
  chemically synthesized
ttgtatttctagtagagacggg

SEQ ID NO: 708907 - DNA, 22 bp, Artificial Sequence
  chemically synthesized
atttttgtatttctagtagaga

SEQ ID NO: 708908 - DNA, 22 bp, Artificial Sequence
  chemically synthesized
actaatttttgtatttctagta

SEQ ID NO: 708909 - DNA, 22 bp, Artificial Sequence
  chemically synthesized
tactagaaatacaaaaattagt

SEQ ID NO: 708910 - DNA, 22 bp, Artificial Sequence
  chemically synthesized
ctagaaatacaaaaattagtca

SEQ ID NO: 708911 - DNA, 22 bp, Artificial Sequence
  chemically synthesized
gaaatacaaaaattagtcaggt

SEQ ID NO: 708912 - DNA, 22 bp, Artificial Sequence
  chemically synthesized
caggcatgcgccaccacacctg

SEQ ID NO: 708913 - DNA, 22 bp, Artificial Sequence
  chemically synthesized
ggactacaggcatgcgccacca

SEQ ID NO: 708914 - DNA, 22 bp, Artificial Sequence
  chemically synthesized
gtcaggtgtggtggcgcatgcc

SEQ ID NO: 708915 - DNA, 22 bp, Artificial Sequence
  chemically synthesized
ggagctgggactacaggcatgc

SEQ ID NO: 708916 - DNA, 22 bp, Artificial Sequence
  chemically synthesized
cctaggagctgggactacaggc

SEQ ID NO: 708917 - DNA, 22 bp, Artificial Sequence
  chemically synthesized
agcctccctaggagctgggact

SEQ ID NO: 708918 - DNA, 22 bp, Artificial Sequence
  chemically synthesized
cctcagcctccctaggagctgg

SEQ ID NO: 708919 - DNA, 22 bp, Artificial Sequence
  chemically synthesized
ctgcctcagcctccctaggagc

SEQ ID NO: 708920 - DNA, 22 bp, Artificial Sequence
  chemically synthesized
tagtcccagctcctagggaggc

SEQ ID NO: 708921 - DNA, 22 bp, Artificial Sequence
  chemically synthesized
cctcctgcctcagcctccctag

SEQ ID NO: 708922 - DNA, 22 bp, Artificial Sequence
  chemically synthesized
cagcctccctcctgcctcagcc

SEQ ID NO: 708923 - DNA, 22 bp, Artificial Sequence
  chemically synthesized
actgcagcctccctcctgcctc

SEQ ID NO: 708924 - DNA, 22 bp, Artificial Sequence
  chemically synthesized
ctagggaggctgaggcaggagg

SEQ ID NO: 708925 - DNA, 22 bp, Artificial Sequence
  chemically synthesized
ctcactgcagcctccctcctgc

SEQ ID NO: 708926 - DNA, 22 bp, Artificial Sequence
  chemically synthesized
gggaggctgaggcaggagggag

SEQ ID NO: 708927 - DNA, 22 bp, Artificial Sequence
  chemically synthesized
tgctcactgcagcctccctcct

SEQ ID NO: 708928 - DNA, 22 bp, Artificial Sequence
  chemically synthesized
aggcaggagggaggctgcagtg

SEQ ID NO: 708929 - DNA, 22 bp, Artificial Sequence
  chemically synthesized
gagtacagtggcgtgatctctg

SEQ ID NO: 708930 - DNA, 22 bp, Artificial Sequence
  chemically synthesized
cagtgagcagagatcacgccac

SEQ ID NO: 708931 - DNA, 22 bp, Artificial Sequence
  chemically synthesized
tcacccaggctggagtacagtg

SEQ ID NO: 708932 - DNA, 22 bp, Artificial Sequence
  chemically synthesized
tgtcacccaggctggagtacag

SEQ ID NO: 708933 - DNA, 22 bp, Artificial Sequence
  chemically synthesized
actctgtcacccaggctggagt

SEQ ID NO: 708934 - DNA, 22 bp, Artificial Sequence
  chemically synthesized
cactctgtcacccaggctggag

SEQ ID NO: 708935 - DNA, 22 bp, Artificial Sequence
  chemically synthesized
tactccagcctgggtgacagag

SEQ ID NO: 708936 - DNA, 22 bp, Artificial Sequence
  chemically synthesized
aggtggagtttcactctgtcac

SEQ ID NO: 708937 - DNA, 22 bp, Artificial Sequence
  chemically synthesized
gaggtggagtttcactctgtca

SEQ ID NO: 708938 - DNA, 22 bp, Artificial Sequence
  chemically synthesized
tgaggtggagtttcactctgtc

SEQ ID NO: 708939 - DNA, 22 bp, Artificial Sequence
  chemically synthesized
cagcctgggtgacagagtgaaa

SEQ ID NO: 708940 - DNA, 22 bp, Artificial Sequence
  chemically synthesized
tttgaggtggagtttcactctg

SEQ ID NO: 708941 - DNA, 22 bp, Artificial Sequence
  chemically synthesized
ctttgaggtggagtttcactct

SEQ ID NO: 708942 - DNA, 22 bp, Artificial Sequence
  chemically synthesized
tctttgaggtggagtttcactc

SEQ ID NO: 708943 - DNA, 22 bp, Artificial Sequence
  chemically synthesized
ttctttgaggtggagtttcact

SEQ ID NO: 708944 - DNA, 22 bp, Artificial Sequence
  chemically synthesized
tttctttgaggtggagtttcac

SEQ ID NO: 708945 - DNA, 22 bp, Artificial Sequence
  chemically synthesized
ttttctttgaggtggagtttca

SEQ ID NO: 708946 - DNA, 22 bp, Artificial Sequence
  chemically synthesized
ggtgacagagtgaaactccacc

SEQ ID NO: 708947 - DNA, 22 bp, Artificial Sequence
  chemically synthesized
atatttttttctttgaggtgga

SEQ ID NO: 708948 - DNA, 22 bp, Artificial Sequence
  chemically synthesized
aatatttttttctttgaggtgg

SEQ ID NO: 708949 - DNA, 22 bp, Artificial Sequence
  chemically synthesized
atacttaatatttttttctttg

SEQ ID NO: 708950 - DNA, 22 bp, Artificial Sequence
  chemically synthesized
gatacttaatatttttttcttt

SEQ ID NO: 708951 - DNA, 22 bp, Artificial Sequence
  chemically synthesized
tgatacttaatatttttttctt

SEQ ID NO: 708952 - DNA, 22 bp, Artificial Sequence
  chemically synthesized
tttgatacttaatatttttttc

SEQ ID NO: 708953 - DNA, 22 bp, Artificial Sequence
  chemically synthesized
ctttgatacttaatattttttt

SEQ ID NO: 708954 - DNA, 22 bp, Artificial Sequence
  chemically synthesized
cacctcaaagaaaaaaatatta

SEQ ID NO: 708955 - DNA, 22 bp, Artificial Sequence
  chemically synthesized
tacttctttgatacttaatatt

SEQ ID NO: 708956 - DNA, 22 bp, Artificial Sequence
  chemically synthesized
aaagaaaaaaatattaagtatc

SEQ ID NO: 708957 - DNA, 22 bp, Artificial Sequence
  chemically synthesized
cctgtacttctttgatacttaa

SEQ ID NO: 708958 - DNA, 22 bp, Artificial Sequence
  chemically synthesized
gcctgtacttctttgatactta

SEQ ID NO: 708959 - DNA, 22 bp, Artificial Sequence
  chemically synthesized
agccttgcctgtacttctttga

SEQ ID NO: 708960 - DNA, 22 bp, Artificial Sequence
  chemically synthesized
aagccttgcctgtacttctttg

SEQ ID NO: 708961 - DNA, 22 bp, Artificial Sequence
  chemically synthesized
agtatcaaagaagtacaggcaa

SEQ ID NO: 708962 - DNA, 22 bp, Artificial Sequence
  chemically synthesized
tcccaaatttaagccttgcctg

SEQ ID NO: 708963 - DNA, 22 bp, Artificial Sequence
  chemically synthesized
atcccaaatttaagccttgcct

SEQ ID NO: 708964 - DNA, 22 bp, Artificial Sequence
  chemically synthesized
tatcccaaatttaagccttgcc

SEQ ID NO: 708965 - DNA, 22 bp, Artificial Sequence
  chemically synthesized
ttttatcccaaatttaagcctt

SEQ ID NO: 708966 - DNA, 22 bp, Artificial Sequence
  chemically synthesized
cccaccctattttatcccaaat

SEQ ID NO: 708967 - DNA, 22 bp, Artificial Sequence
  chemically synthesized
ctacccaccctattttatccca

SEQ ID NO: 708968 - DNA, 22 bp, Artificial Sequence
  chemically synthesized
actacccaccctattttatccc

SEQ ID NO: 708969 - DNA, 22 bp, Artificial Sequence
  chemically synthesized
tcttactacccaccctatttta

SEQ ID NO: 708970 - DNA, 22 bp, Artificial Sequence
  chemically synthesized
atcttactacccaccctatttt

SEQ ID NO: 708971 - DNA, 22 bp, Artificial Sequence
  chemically synthesized
aaatttgggataaaatagggtg

SEQ ID NO: 708972 - DNA, 22 bp, Artificial Sequence
  chemically synthesized
tatcttactacccaccctattt

SEQ ID NO: 708973 - DNA, 22 bp, Artificial Sequence
  chemically synthesized
aatttgggataaaatagggtgg

SEQ ID NO: 708974 - DNA, 22 bp, Artificial Sequence
  chemically synthesized
gttttatcttactacccaccct

SEQ ID NO: 708975 - DNA, 22 bp, Artificial Sequence
  chemically synthesized
gggataaaatagggtgggtagt

SEQ ID NO: 708976 - DNA, 22 bp, Artificial Sequence
  chemically synthesized
ggataaaatagggtgggtagta

SEQ ID NO: 708977 - DNA, 22 bp, Artificial Sequence
  chemically synthesized
cgaaaattagttttatcttact

SEQ ID NO: 708978 - DNA, 22 bp, Artificial Sequence
  chemically synthesized
aattccgaaaattagttttatc

SEQ ID NO: 708979 - DNA, 22 bp, Artificial Sequence
  chemically synthesized
aaaactgaattccgaaaattag

SEQ ID NO: 708980 - DNA, 22 bp, Artificial Sequence
  chemically synthesized
caagtccactgaaaactgaatt

SEQ ID NO: 708981 - DNA, 22 bp, Artificial Sequence
  chemically synthesized
ccaagtccactgaaaactgaat

SEQ ID NO: 708982 - DNA, 22 bp, Artificial Sequence
  chemically synthesized
attttcggaattcagttttcag

SEQ ID NO: 708983 - DNA, 22 bp, Artificial Sequence
  chemically synthesized
tcggaattcagttttcagtgga

SEQ ID NO: 708984 - DNA, 22 bp, Artificial Sequence
  chemically synthesized
ataatttccaagtccactgaaa

SEQ ID NO: 708985 - DNA, 22 bp, Artificial Sequence
  chemically synthesized
cggaattcagttttcagtggac

SEQ ID NO: 708986 - DNA, 22 bp, Artificial Sequence
  chemically synthesized
aataatttccaagtccactgaa

SEQ ID NO: 708987 - DNA, 22 bp, Artificial Sequence
  chemically synthesized
ggaattcagttttcagtggact

SEQ ID NO: 708988 - DNA, 22 bp, Artificial Sequence
  chemically synthesized
ttaataatttccaagtccactg

SEQ ID NO: 708989 - DNA, 22 bp, Artificial Sequence
  chemically synthesized
cttaataatttccaagtccact

SEQ ID NO: 708990 - DNA, 22 bp, Artificial Sequence
  chemically synthesized
agttttcagtggacttggaaat

SEQ ID NO: 708991 - DNA, 22 bp, Artificial Sequence
  chemically synthesized
tcagtggacttggaaattatta

SEQ ID NO: 708992 - DNA, 22 bp, Artificial Sequence
  chemically synthesized
cagtggacttggaaattattaa

SEQ ID NO: 708993 - DNA, 22 bp, Artificial Sequence
  chemically synthesized
aaggtatatttcttaataattt

SEQ ID NO: 708994 - DNA, 22 bp, Artificial Sequence
  chemically synthesized
agtggacttggaaattattaag

SEQ ID NO: 708995 - DNA, 22 bp, Artificial Sequence
  chemically synthesized
ggaaattattaagaaatatacc

SEQ ID NO: 708996 - DNA, 22 bp, Artificial Sequence
  chemically synthesized
gaaattattaagaaatatacct

SEQ ID NO: 708997 - DNA, 22 bp, Artificial Sequence
  chemically synthesized
catgccccctaaaggtatattt

SEQ ID NO: 708998 - DNA, 22 bp, Artificial Sequence
  chemically synthesized
actgcatgccccctaaaggtat

SEQ ID NO: 708999 - DNA, 22 bp, Artificial Sequence
  chemically synthesized
cactgcatgccccctaaaggta

SEQ ID NO: 709000 - DNA, 22 bp, Artificial Sequence
  chemically synthesized
tcactgcatgccccctaaaggt

SEQ ID NO: 709001 - DNA, 22 bp, Artificial Sequence
  chemically synthesized
ttaagaaatatacctttagggg

SEQ ID NO: 709002 - DNA, 22 bp, Artificial Sequence
  chemically synthesized
agaaatatacctttagggggca

SEQ ID NO: 709003 - DNA, 22 bp, Artificial Sequence
  chemically synthesized
tagggggcatgcagtgaaaact

SEQ ID NO: 709004 - DNA, 22 bp, Artificial Sequence
  chemically synthesized
agggggcatgcagtgaaaactg

SEQ ID NO: 709005 - DNA, 22 bp, Artificial Sequence
  chemically synthesized
gggggcatgcagtgaaaactgc

SEQ ID NO: 709006 - DNA, 22 bp, Artificial Sequence
  chemically synthesized
ataggaagaaaagaatggcagt

SEQ ID NO: 709007 - DNA, 22 bp, Artificial Sequence
  chemically synthesized
tagaaaaacctaataggaagaa

SEQ ID NO: 709008 - DNA, 22 bp, Artificial Sequence
  chemically synthesized
ccattcttttcttcctattagg

SEQ ID NO: 709009 - DNA, 22 bp, Artificial Sequence
  chemically synthesized
ttttcttcctattaggtttttc

SEQ ID NO: 709010 - DNA, 22 bp, Artificial Sequence
  chemically synthesized
ttcttcctattaggtttttcta

SEQ ID NO: 709011 - DNA, 22 bp, Artificial Sequence
  chemically synthesized
tcttcctattaggtttttctat

SEQ ID NO: 709012 - DNA, 22 bp, Artificial Sequence
  chemically synthesized
tgtcaatatattatagaaaaac

SEQ ID NO: 709013 - DNA, 22 bp, Artificial Sequence
  chemically synthesized
cttcctattaggtttttctata

SEQ ID NO: 709014 - DNA, 22 bp, Artificial Sequence
  chemically synthesized
ttcctattaggtttttctataa

SEQ ID NO: 709015 - DNA, 22 bp, Artificial Sequence
  chemically synthesized
cctattaggtttttctataata

SEQ ID NO: 709016 - DNA, 22 bp, Artificial Sequence
  chemically synthesized
ctattaggtttttctataatat

SEQ ID NO: 709017 - DNA, 22 bp, Artificial Sequence
  chemically synthesized
ttaggtttttctataatatatt

SEQ ID NO: 709018 - DNA, 22 bp, Artificial Sequence
  chemically synthesized
ggtttttctataatatattgac

SEQ ID NO: 709019 - DNA, 22 bp, Artificial Sequence
  chemically synthesized
acagcacactgtgtcaatatat

SEQ ID NO: 709020 - DNA, 22 bp, Artificial Sequence
  chemically synthesized
ttctataatatattgacacagt

SEQ ID NO: 709021 - DNA, 22 bp, Artificial Sequence
  chemically synthesized
agttgacagcacactgtgtcaa

SEQ ID NO: 709022 - DNA, 22 bp, Artificial Sequence
  chemically synthesized
tctataatatattgacacagtg

SEQ ID NO: 709023 - DNA, 22 bp, Artificial Sequence
  chemically synthesized
ctataatatattgacacagtgt

SEQ ID NO: 709024 - DNA, 22 bp, Artificial Sequence
  chemically synthesized
tataatatattgacacagtgtg

SEQ ID NO: 709025 - DNA, 22 bp, Artificial Sequence
  chemically synthesized
actaagttgacagcacactgtg

SEQ ID NO: 709026 - DNA, 22 bp, Artificial Sequence
  chemically synthesized
taatatattgacacagtgtgct

SEQ ID NO: 709027 - DNA, 22 bp, Artificial Sequence
  chemically synthesized
acacagtgtgctgtcaacttag

SEQ ID NO: 709028 - DNA, 22 bp, Artificial Sequence
  chemically synthesized
cccaccaagaatagaactcact

SEQ ID NO: 709029 - DNA, 22 bp, Artificial Sequence
  chemically synthesized
ccccaccaagaatagaactcac

SEQ ID NO: 709030 - DNA, 22 bp, Artificial Sequence
  chemically synthesized
ttccccaccaagaatagaactc

SEQ ID NO: 709031 - DNA, 22 bp, Artificial Sequence
  chemically synthesized
cttccccaccaagaatagaact

SEQ ID NO: 709032 - DNA, 22 bp, Artificial Sequence
  chemically synthesized
tcaacttagtgagttctattct

SEQ ID NO: 709033 - DNA, 22 bp, Artificial Sequence
  chemically synthesized
tcttccccaccaagaatagaac

SEQ ID NO: 709034 - DNA, 22 bp, Artificial Sequence
  chemically synthesized
ctttcttccccaccaagaatag

SEQ ID NO: 709035 - DNA, 22 bp, Artificial Sequence
  chemically synthesized
ttcctttcttccccaccaagaa

SEQ ID NO: 709036 - DNA, 22 bp, Artificial Sequence
  chemically synthesized
agtgagttctattcttggtggg

SEQ ID NO: 709037 - DNA, 22 bp, Artificial Sequence
  chemically synthesized
gtgagttctattcttggtgggg

SEQ ID NO: 709038 - DNA, 22 bp, Artificial Sequence
  chemically synthesized
tattcttggtggggaagaaagg

SEQ ID NO: 709039 - DNA, 22 bp, Artificial Sequence
  chemically synthesized
ttcttggtggggaagaaaggaa

SEQ ID NO: 709040 - DNA, 22 bp, Artificial Sequence
  chemically synthesized
ttggtggggaagaaaggaataa

SEQ ID NO: 709041 - DNA, 22 bp, Artificial Sequence
  chemically synthesized
ggtggggaagaaaggaataatt

SEQ ID NO: 709042 - DNA, 22 bp, Artificial Sequence
  chemically synthesized
gtggggaagaaaggaataattt

SEQ ID NO: 709043 - DNA, 22 bp, Artificial Sequence
  chemically synthesized
tacgggtgacatgctatactta

SEQ ID NO: 709044 - DNA, 22 bp, Artificial Sequence
  chemically synthesized
acgggtgacatgctatacttac

SEQ ID NO: 709045 - DNA, 22 bp, Artificial Sequence
  chemically synthesized
cgggtgacatgctatacttact

SEQ ID NO: 709046 - DNA, 22 bp, Artificial Sequence
  chemically synthesized
gcaaaatgccaaataagtaagt

SEQ ID NO: 709047 - DNA, 22 bp, Artificial Sequence
  chemically synthesized
gattggcaaaatgccaaataag

SEQ ID NO: 709048 - DNA, 22 bp, Artificial Sequence
  chemically synthesized
tattggattggcaaaatgccaa

SEQ ID NO: 709049 - DNA, 22 bp, Artificial Sequence
  chemically synthesized
tacttacttatttggcattttg

SEQ ID NO: 709050 - DNA, 22 bp, Artificial Sequence
  chemically synthesized
atattggattggcaaaatgcca

SEQ ID NO: 709051 - DNA, 22 bp, Artificial Sequence
  chemically synthesized
acttatttggcattttgccaat

SEQ ID NO: 709052 - DNA, 22 bp, Artificial Sequence
  chemically synthesized
cttatttggcattttgccaatc

SEQ ID NO: 709053 - DNA, 22 bp, Artificial Sequence
  chemically synthesized
atttggcattttgccaatccaa

SEQ ID NO: 709054 - DNA, 22 bp, Artificial Sequence
  chemically synthesized
tttggcattttgccaatccaat

SEQ ID NO: 709055 - DNA, 22 bp, Artificial Sequence
  chemically synthesized
gagccaccacttatattggatt

SEQ ID NO: 709056 - DNA, 22 bp, Artificial Sequence
  chemically synthesized
ggcattttgccaatccaatata

SEQ ID NO: 709057 - DNA, 22 bp, Artificial Sequence
  chemically synthesized
gcattttgccaatccaatataa

SEQ ID NO: 709058 - DNA, 22 bp, Artificial Sequence
  chemically synthesized
tgccaatccaatataagtggtg

SEQ ID NO: 709059 - DNA, 22 bp, Artificial Sequence
  chemically synthesized
gccaatccaatataagtggtgg

SEQ ID NO: 709060 - DNA, 22 bp, Artificial Sequence
  chemically synthesized
ggatgcctggagccaccactta

SEQ ID NO: 709061 - DNA, 22 bp, Artificial Sequence
  chemically synthesized
ccaatccaatataagtggtggc

SEQ ID NO: 709062 - DNA, 22 bp, Artificial Sequence
  chemically synthesized
gagagctaggatgcctggagcc

SEQ ID NO: 709063 - DNA, 22 bp, Artificial Sequence
  chemically synthesized
caggcatcctagctctctaact

SEQ ID NO: 709064 - DNA, 22 bp, Artificial Sequence
  chemically synthesized
aatcaaaatccagagttagaga

SEQ ID NO: 709065 - DNA, 22 bp, Artificial Sequence
  chemically synthesized
acaactaaatcaaaatccagag

SEQ ID NO: 709066 - DNA, 22 bp, Artificial Sequence
  chemically synthesized
gctctctaactctggattttga

SEQ ID NO: 709067 - DNA, 22 bp, Artificial Sequence
  chemically synthesized
ttcacaactaaatcaaaatcca

SEQ ID NO: 709068 - DNA, 22 bp, Artificial Sequence
  chemically synthesized
tctaactctggattttgattta

SEQ ID NO: 709069 - DNA, 22 bp, Artificial Sequence
  chemically synthesized
taactctggattttgatttagt

SEQ ID NO: 709070 - DNA, 22 bp, Artificial Sequence
  chemically synthesized
actctggattttgatttagttg

SEQ ID NO: 709071 - DNA, 22 bp, Artificial Sequence
  chemically synthesized
gcatggactgttcacaactaaa

SEQ ID NO: 709072 - DNA, 22 bp, Artificial Sequence
  chemically synthesized
agcatggactgttcacaactaa

SEQ ID NO: 709073 - DNA, 22 bp, Artificial Sequence
  chemically synthesized
tggattttgatttagttgtgaa

SEQ ID NO: 709074 - DNA, 22 bp, Artificial Sequence
  chemically synthesized
gattttgatttagttgtgaaca

SEQ ID NO: 709075 - DNA, 22 bp, Artificial Sequence
  chemically synthesized
gtttagcatggactgttcacaa

SEQ ID NO: 709076 - DNA, 22 bp, Artificial Sequence
  chemically synthesized
tgatttagttgtgaacagtcca

SEQ ID NO: 709077 - DNA, 22 bp, Artificial Sequence
  chemically synthesized
gatttagttgtgaacagtccat

SEQ ID NO: 709078 - DNA, 22 bp, Artificial Sequence
  chemically synthesized
atttagttgtgaacagtccatg

SEQ ID NO: 709079 - DNA, 22 bp, Artificial Sequence
  chemically synthesized
agttgtgaacagtccatgctaa

SEQ ID NO: 709080 - DNA, 22 bp, Artificial Sequence
  chemically synthesized
gttgtgaacagtccatgctaaa

SEQ ID NO: 709081 - DNA, 22 bp, Artificial Sequence
  chemically synthesized
atcaacccctagtttagcatgg

SEQ ID NO: 709082 - DNA, 22 bp, Artificial Sequence
  chemically synthesized
tgatcaacccctagtttagcat

SEQ ID NO: 709083 - DNA, 22 bp, Artificial Sequence
  chemically synthesized
tgaacagtccatgctaaactag

SEQ ID NO: 709084 - DNA, 22 bp, Artificial Sequence
  chemically synthesized
tgcaagctctgatcaaccccta

SEQ ID NO: 709085 - DNA, 22 bp, Artificial Sequence
  chemically synthesized
tgtgcaagctctgatcaacccc

SEQ ID NO: 709086 - DNA, 22 bp, Artificial Sequence
  chemically synthesized
ctctgtgcaagctctgatcaac

SEQ ID NO: 709087 - DNA, 22 bp, Artificial Sequence
  chemically synthesized
aactaggggttgatcagagctt

SEQ ID NO: 709088 - DNA, 22 bp, Artificial Sequence
  chemically synthesized
attgctctgtgcaagctctgat

SEQ ID NO: 709089 - DNA, 22 bp, Artificial Sequence
  chemically synthesized
tgattgctctgtgcaagctctg

SEQ ID NO: 709090 - DNA, 22 bp, Artificial Sequence
  chemically synthesized
ggggttgatcagagcttgcaca

SEQ ID NO: 709091 - DNA, 22 bp, Artificial Sequence
  chemically synthesized
agttctgattgctctgtgcaag

SEQ ID NO: 709092 - DNA, 22 bp, Artificial Sequence
  chemically synthesized
atcagagcttgcacagagcaat

SEQ ID NO: 709093 - DNA, 22 bp, Artificial Sequence
  chemically synthesized
ccccctgagttctgattgctct

SEQ ID NO: 709094 - DNA, 22 bp, Artificial Sequence
  chemically synthesized
gcacagagcaatcagaactcag

SEQ ID NO: 709095 - DNA, 22 bp, Artificial Sequence
  chemically synthesized
cacagagcaatcagaactcagg

SEQ ID NO: 709096 - DNA, 22 bp, Artificial Sequence
  chemically synthesized
cacaccacgggaactaccccct

SEQ ID NO: 709097 - DNA, 22 bp, Artificial Sequence
  chemically synthesized
tgcacaccacgggaactacccc

SEQ ID NO: 709098 - DNA, 22 bp, Artificial Sequence
  chemically synthesized
gggaattctgcacaccacggga

SEQ ID NO: 709099 - DNA, 22 bp, Artificial Sequence
  chemically synthesized
agggggtagttcccgtggtgtg

SEQ ID NO: 709100 - DNA, 22 bp, Artificial Sequence
  chemically synthesized
tcgggaattctgcacaccacgg

SEQ ID NO: 709101 - DNA, 22 bp, Artificial Sequence
  chemically synthesized
cctctcgggaattctgcacacc

SEQ ID NO: 709102 - DNA, 22 bp, Artificial Sequence
  chemically synthesized
acctctcgggaattctgcacac

SEQ ID NO: 709103 - DNA, 22 bp, Artificial Sequence
  chemically synthesized
tacctctcgggaattctgcaca

SEQ ID NO: 709104 - DNA, 22 bp, Artificial Sequence
  chemically synthesized
ttacctctcgggaattctgcac

SEQ ID NO: 709105 - DNA, 22 bp, Artificial Sequence
  chemically synthesized
ccgtggtgtgcagaattcccga

SEQ ID NO: 709106 - DNA, 22 bp, Artificial Sequence
  chemically synthesized
acatcgatttttacctctcggg

SEQ ID NO: 709107 - DNA, 22 bp, Artificial Sequence
  chemically synthesized
atgagattaacatcgattttta

SEQ ID NO: 709108 - DNA, 22 bp, Artificial Sequence
  chemically synthesized
tgatgagattaacatcgatttt

SEQ ID NO: 709109 - DNA, 22 bp, Artificial Sequence
  chemically synthesized
ctgatgagattaacatcgattt

SEQ ID NO: 709110 - DNA, 22 bp, Artificial Sequence
  chemically synthesized
ccgagaggtaaaaatcgatgtt

SEQ ID NO: 709111 - DNA, 22 bp, Artificial Sequence
  chemically synthesized
tctgatgagattaacatcgatt

SEQ ID NO: 709112 - DNA, 22 bp, Artificial Sequence
  chemically synthesized
ttctgatgagattaacatcgat

SEQ ID NO: 709113 - DNA, 22 bp, Artificial Sequence
  chemically synthesized
agccacttttctgatgagatta

SEQ ID NO: 709114 - DNA, 22 bp, Artificial Sequence
  chemically synthesized
cctgagccacttttctgatgag

SEQ ID NO: 709115 - DNA, 22 bp, Artificial Sequence
  chemically synthesized
atctcatcagaaaagtggctca

SEQ ID NO: 709116 - DNA, 22 bp, Artificial Sequence
  chemically synthesized
agaccaggctacctgagccact

SEQ ID NO: 709117 - DNA, 22 bp, Artificial Sequence
  chemically synthesized
gagaccaggctacctgagccac

SEQ ID NO: 709118 - DNA, 22 bp, Artificial Sequence
  chemically synthesized
atcagaaaagtggctcaggtag

SEQ ID NO: 709119 - DNA, 22 bp, Artificial Sequence
  chemically synthesized
gtttgagaccaggctacctgag

SEQ ID NO: 709120 - DNA, 22 bp, Artificial Sequence
  chemically synthesized
gaaggccagagttggtttgaga

SEQ ID NO: 709121 - DNA, 22 bp, Artificial Sequence
  chemically synthesized
aggtagcctggtctcaaaccaa

SEQ ID NO: 709122 - DNA, 22 bp, Artificial Sequence
  chemically synthesized
atattggaaggccagagttggt

SEQ ID NO: 709123 - DNA, 22 bp, Artificial Sequence
  chemically synthesized
attgatattggaaggccagagt

SEQ ID NO: 709124 - DNA, 22 bp, Artificial Sequence
  chemically synthesized
gtctcaaaccaactctggcctt

SEQ ID NO: 709125 - DNA, 22 bp, Artificial Sequence
  chemically synthesized
aattgatattggaaggccagag

SEQ ID NO: 709126 - DNA, 22 bp, Artificial Sequence
  chemically synthesized
aaaccaactctggccttccaat

SEQ ID NO: 709127 - DNA, 22 bp, Artificial Sequence
  chemically synthesized
ggcacttaattgatattggaag

SEQ ID NO: 709128 - DNA, 22 bp, Artificial Sequence
  chemically synthesized
tggccttccaatatcaattaag

SEQ ID NO: 709129 - DNA, 22 bp, Artificial Sequence
  chemically synthesized
gccttccaatatcaattaagtg

SEQ ID NO: 709130 - DNA, 22 bp, Artificial Sequence
  chemically synthesized
gatatacactaggcacttaatt

SEQ ID NO: 709131 - DNA, 22 bp, Artificial Sequence
  chemically synthesized
tggatatacactaggcacttaa

SEQ ID NO: 709132 - DNA, 22 bp, Artificial Sequence
  chemically synthesized
ccaatatcaattaagtgcctag

SEQ ID NO: 709133 - DNA, 22 bp, Artificial Sequence
  chemically synthesized
caatatcaattaagtgcctagt

SEQ ID NO: 709134 - DNA, 22 bp, Artificial Sequence
  chemically synthesized
ttctggatatacactaggcact

SEQ ID NO: 709135 - DNA, 22 bp, Artificial Sequence
  chemically synthesized
agtgcctagtgtatatccagaa

SEQ ID NO: 709136 - DNA, 22 bp, Artificial Sequence
  chemically synthesized
gtgtatatccagaacaatctca

SEQ ID NO: 709137 - DNA, 22 bp, Artificial Sequence
  chemically synthesized
gggagagagtgaaaaaatgaga

SEQ ID NO: 709138 - DNA, 22 bp, Artificial Sequence
  chemically synthesized
attttttcactctctccctaga

SEQ ID NO: 709139 - DNA, 22 bp, Artificial Sequence
  chemically synthesized
tttcactctctccctagacttg

SEQ ID NO: 709140 - DNA, 22 bp, Artificial Sequence
  chemically synthesized
ttcactctctccctagacttgc

SEQ ID NO: 709141 - DNA, 22 bp, Artificial Sequence
  chemically synthesized
tcactctctccctagacttgcc

SEQ ID NO: 709142 - DNA, 22 bp, Artificial Sequence
  chemically synthesized
cactctctccctagacttgccc

SEQ ID NO: 709143 - DNA, 22 bp, Artificial Sequence
  chemically synthesized
actctctccctagacttgccca

SEQ ID NO: 709144 - DNA, 22 bp, Artificial Sequence
  chemically synthesized
ggccaagcaaaaatgggcaagt

SEQ ID NO: 709145 - DNA, 22 bp, Artificial Sequence
  chemically synthesized
gggccaagcaaaaatgggcaag

SEQ ID NO: 709146 - DNA, 22 bp, Artificial Sequence
  chemically synthesized
tctccctagacttgcccatttt

SEQ ID NO: 709147 - DNA, 22 bp, Artificial Sequence
  chemically synthesized
tccctagacttgcccatttttg

SEQ ID NO: 709148 - DNA, 22 bp, Artificial Sequence
  chemically synthesized
cctagacttgcccatttttgct

SEQ ID NO: 709149 - DNA, 22 bp, Artificial Sequence
  chemically synthesized
gacttgcccatttttgcttggc

SEQ ID NO: 709150 - DNA, 22 bp, Artificial Sequence
  chemically synthesized
tccacgtatttgggccaagcaa

SEQ ID NO: 709151 - DNA, 22 bp, Artificial Sequence
  chemically synthesized
gcccatttttgcttggcccaaa

SEQ ID NO: 709152 - DNA, 22 bp, Artificial Sequence
  chemically synthesized
gttatccacgtatttgggccaa

SEQ ID NO: 709153 - DNA, 22 bp, Artificial Sequence
  chemically synthesized
cccatttttgcttggcccaaat

SEQ ID NO: 709154 - DNA, 22 bp, Artificial Sequence
  chemically synthesized
ggttatccacgtatttgggcca

SEQ ID NO: 709155 - DNA, 22 bp, Artificial Sequence
  chemically synthesized
ttgcttggcccaaatacgtgga

SEQ ID NO: 709156 - DNA, 22 bp, Artificial Sequence
  chemically synthesized
tgcttggcccaaatacgtggat

SEQ ID NO: 709157 - DNA, 22 bp, Artificial Sequence
  chemically synthesized
gcttggcccaaatacgtggata

SEQ ID NO: 709158 - DNA, 22 bp, Artificial Sequence
  chemically synthesized
cttggcccaaatacgtggataa

SEQ ID NO: 709159 - DNA, 22 bp, Artificial Sequence
  chemically synthesized
ggcccaaatacgtggataacca

SEQ ID NO: 709160 - DNA, 22 bp, Artificial Sequence
  chemically synthesized
gcccaaatacgtggataaccaa

SEQ ID NO: 709161 - DNA, 22 bp, Artificial Sequence
  chemically synthesized
taggggaaccccacttggttat

SEQ ID NO: 709162 - DNA, 22 bp, Artificial Sequence
  chemically synthesized
cattgtaggggaaccccacttg

SEQ ID NO: 709163 - DNA, 22 bp, Artificial Sequence
  chemically synthesized
ccctacaatgcaggatttactt

SEQ ID NO: 709164 - DNA, 22 bp, Artificial Sequence
  chemically synthesized
tgtatataaaataaagtaaatc

SEQ ID NO: 709165 - DNA, 22 bp, Artificial Sequence
  chemically synthesized
gtgtatataaaataaagtaaat

SEQ ID NO: 709166 - DNA, 22 bp, Artificial Sequence
  chemically synthesized
tgtgtatataaaataaagtaaa

SEQ ID NO: 709167 - DNA, 22 bp, Artificial Sequence
  chemically synthesized
ttgtgtatataaaataaagtaa

SEQ ID NO: 709168 - DNA, 22 bp, Artificial Sequence
  chemically synthesized
caatgcaggatttactttattt

SEQ ID NO: 709169 - DNA, 22 bp, Artificial Sequence
  chemically synthesized
atgcttttgtgtatataaaata

SEQ ID NO: 709170 - DNA, 22 bp, Artificial Sequence
  chemically synthesized
actttattttatatacacaaaa

SEQ ID NO: 709171 - DNA, 22 bp, Artificial Sequence
  chemically synthesized
ctttattttatatacacaaaag

SEQ ID NO: 709172 - DNA, 22 bp, Artificial Sequence
  chemically synthesized
atatgtccctcatgcttttgtg

SEQ ID NO: 709173 - DNA, 22 bp, Artificial Sequence
  chemically synthesized
tattttatatacacaaaagcat

SEQ ID NO: 709174 - DNA, 22 bp, Artificial Sequence
  chemically synthesized
gatatgtccctcatgcttttgt

SEQ ID NO: 709175 - DNA, 22 bp, Artificial Sequence
  chemically synthesized
attttatatacacaaaagcatg

SEQ ID NO: 709176 - DNA, 22 bp, Artificial Sequence
  chemically synthesized
ttttatatacacaaaagcatga

SEQ ID NO: 709177 - DNA, 22 bp, Artificial Sequence
  chemically synthesized
tatatacacaaaagcatgaggg

SEQ ID NO: 709178 - DNA, 22 bp, Artificial Sequence
  chemically synthesized
atatacacaaaagcatgaggga

SEQ ID NO: 709179 - DNA, 22 bp, Artificial Sequence
  chemically synthesized
tatacacaaaagcatgagggac

SEQ ID NO: 709180 - DNA, 22 bp, Artificial Sequence
  chemically synthesized
ggaaggtaggtttgatatgtcc

SEQ ID NO: 709181 - DNA, 22 bp, Artificial Sequence
  chemically synthesized
ggagtgcagggtcataaggttg

SEQ ID NO: 709182 - DNA, 22 bp, Artificial Sequence
  chemically synthesized
gggagtgcagggtcataaggtt

SEQ ID NO: 709183 - DNA, 22 bp, Artificial Sequence
  chemically synthesized
ccttcccaaccttatgaccctg

SEQ ID NO: 709184 - DNA, 22 bp, Artificial Sequence
  chemically synthesized
cccaaccttatgaccctgcact

SEQ ID NO: 709185 - DNA, 22 bp, Artificial Sequence
  chemically synthesized
ccaaccttatgaccctgcactc

SEQ ID NO: 709186 - DNA, 22 bp, Artificial Sequence
  chemically synthesized
gcaggtagagtttgggagtgca

SEQ ID NO: 709187 - DNA, 22 bp, Artificial Sequence
  chemically synthesized
agcaggtagagtttgggagtgc

SEQ ID NO: 709188 - DNA, 22 bp, Artificial Sequence
  chemically synthesized
atgaccctgcactcccaaactc

SEQ ID NO: 709189 - DNA, 22 bp, Artificial Sequence
  chemically synthesized
tgaccctgcactcccaaactct

SEQ ID NO: 709190 - DNA, 22 bp, Artificial Sequence
  chemically synthesized
gtgggcttagcaggtagagttt

SEQ ID NO: 709191 - DNA, 22 bp, Artificial Sequence
  chemically synthesized
ggtgggcttagcaggtagagtt

SEQ ID NO: 709192 - DNA, 22 bp, Artificial Sequence
  chemically synthesized
tggtgggcttagcaggtagagt

SEQ ID NO: 709193 - DNA, 22 bp, Artificial Sequence
  chemically synthesized
cactcccaaactctacctgcta

SEQ ID NO: 709194 - DNA, 22 bp, Artificial Sequence
  chemically synthesized
ccaaactctacctgctaagccc

SEQ ID NO: 709195 - DNA, 22 bp, Artificial Sequence
  chemically synthesized
tacctgctaagcccaccaaaac

SEQ ID NO: 709196 - DNA, 22 bp, Artificial Sequence
  chemically synthesized
cctgctaagcccaccaaaacta

SEQ ID NO: 709197 - DNA, 22 bp, Artificial Sequence
  chemically synthesized
ctaagcccaccaaaactacctg

SEQ ID NO: 709198 - DNA, 22 bp, Artificial Sequence
  chemically synthesized
agcccaccaaaactacctgcct

SEQ ID NO: 709199 - DNA, 22 bp, Artificial Sequence
  chemically synthesized
gatggaatagtgcaggacaggc

SEQ ID NO: 709200 - DNA, 22 bp, Artificial Sequence
  chemically synthesized
tattggatggaatagtgcagga

SEQ ID NO: 709201 - DNA, 22 bp, Artificial Sequence
  chemically synthesized
cctgcctgtcctgcactattcc

SEQ ID NO: 709202 - DNA, 22 bp, Artificial Sequence
  chemically synthesized
cctgtcctgcactattccatcc

SEQ ID NO: 709203 - DNA, 22 bp, Artificial Sequence
  chemically synthesized
tcctgcactattccatccaata

SEQ ID NO: 709204 - DNA, 22 bp, Artificial Sequence
  chemically synthesized
cactattccatccaatataact

SEQ ID NO: 709205 - DNA, 22 bp, Artificial Sequence
  chemically synthesized
ttccatccaatataactcttgt

SEQ ID NO: 709206 - DNA, 22 bp, Artificial Sequence
  chemically synthesized
catccaatataactcttgtgcg

SEQ ID NO: 709207 - DNA, 22 bp, Artificial Sequence
  chemically synthesized
ttgtgcgtggcttcttcatgct

SEQ ID NO: 709208 - DNA, 22 bp, Artificial Sequence
  chemically synthesized
gtgcgtggcttcttcatgctgc

SEQ ID NO: 709209 - DNA, 22 bp, Artificial Sequence
  chemically synthesized
ccgagagaaggagcagcatgaa

SEQ ID NO: 709210 - DNA, 22 bp, Artificial Sequence
  chemically synthesized
tgcgtggcttcttcatgctgct

SEQ ID NO: 709211 - DNA, 22 bp, Artificial Sequence
  chemically synthesized
cttcatgctgctccttctctcg

SEQ ID NO: 709212 - DNA, 22 bp, Artificial Sequence
  chemically synthesized
ttcatgctgctccttctctcgg

SEQ ID NO: 709213 - DNA, 22 bp, Artificial Sequence
  chemically synthesized
catgctgctccttctctcggca

SEQ ID NO: 709214 - DNA, 22 bp, Artificial Sequence
  chemically synthesized
atgctgctccttctctcggcaa

SEQ ID NO: 709215 - DNA, 22 bp, Artificial Sequence
  chemically synthesized
ctccttctctcggcaatgctct

SEQ ID NO: 709216 - DNA, 22 bp, Artificial Sequence
  chemically synthesized
cttctctcggcaatgctcttac

SEQ ID NO: 709217 - DNA, 22 bp, Artificial Sequence
  chemically synthesized
ggagagaagtggggtaagagca

SEQ ID NO: 709218 - DNA, 22 bp, Artificial Sequence
  chemically synthesized
ctctcggcaatgctcttacccc

SEQ ID NO: 709219 - DNA, 22 bp, Artificial Sequence
  chemically synthesized
tctcggcaatgctcttacccca

SEQ ID NO: 709220 - DNA, 22 bp, Artificial Sequence
  chemically synthesized
tcggcaatgctcttaccccact

SEQ ID NO: 709221 - DNA, 22 bp, Artificial Sequence
  chemically synthesized
atctgggagagaagtggggtaa

SEQ ID NO: 709222 - DNA, 22 bp, Artificial Sequence
  chemically synthesized
ggcaatgctcttaccccacttc

SEQ ID NO: 709223 - DNA, 22 bp, Artificial Sequence
  chemically synthesized
acagcattgatctgggagagaa

SEQ ID NO: 709224 - DNA, 22 bp, Artificial Sequence
  chemically synthesized
ttaccccacttctctcccagat

SEQ ID NO: 709225 - DNA, 22 bp, Artificial Sequence
  chemically synthesized
accccacttctctcccagatca

SEQ ID NO: 709226 - DNA, 22 bp, Artificial Sequence
  chemically synthesized
ccccacttctctcccagatcaa

SEQ ID NO: 709227 - DNA, 22 bp, Artificial Sequence
  chemically synthesized
ctctcccagatcaatgctgtta

SEQ ID NO: 709228 - DNA, 22 bp, Artificial Sequence
  chemically synthesized
tctcccagatcaatgctgttag

SEQ ID NO: 709229 - DNA, 22 bp, Artificial Sequence
  chemically synthesized
tcccagatcaatgctgttagtg

SEQ ID NO: 709230 - DNA, 22 bp, Artificial Sequence
  chemically synthesized
ccagatcaatgctgttagtgtt

SEQ ID NO: 709231 - DNA, 22 bp, Artificial Sequence
  chemically synthesized
ggagatgaggaagtaaacatat

SEQ ID NO: 709232 - DNA, 22 bp, Artificial Sequence
  chemically synthesized
ttagtgtttatatgtttacttc

SEQ ID NO: 709233 - DNA, 22 bp, Artificial Sequence
  chemically synthesized
acctgggagatgaggaagtaaa

SEQ ID NO: 709234 - DNA, 22 bp, Artificial Sequence
  chemically synthesized
gtgtttatatgtttacttcctc

SEQ ID NO: 709235 - DNA, 22 bp, Artificial Sequence
  chemically synthesized
taacctgggagatgaggaagta

SEQ ID NO: 709236 - DNA, 22 bp, Artificial Sequence
  chemically synthesized
attctaacctgggagatgagga

SEQ ID NO: 709237 - DNA, 22 bp, Artificial Sequence
  chemically synthesized
atatgtttacttcctcatctcc

SEQ ID NO: 709238 - DNA, 22 bp, Artificial Sequence
  chemically synthesized
tatgtttacttcctcatctccc

SEQ ID NO: 709239 - DNA, 22 bp, Artificial Sequence
  chemically synthesized
acttcctcatctcccaggttag

SEQ ID NO: 709240 - DNA, 22 bp, Artificial Sequence
  chemically synthesized
cttcctcatctcccaggttaga

SEQ ID NO: 709241 - DNA, 22 bp, Artificial Sequence
  chemically synthesized
aggaagccattaattctaacct

SEQ ID NO: 709242 - DNA, 22 bp, Artificial Sequence
  chemically synthesized
cctcatctcccaggttagaatt

SEQ ID NO: 709243 - DNA, 22 bp, Artificial Sequence
  chemically synthesized
ctcatctcccaggttagaatta

SEQ ID NO: 709244 - DNA, 22 bp, Artificial Sequence
  chemically synthesized
atctcccaggttagaattaatg

SEQ ID NO: 709245 - DNA, 22 bp, Artificial Sequence
  chemically synthesized
gaatgctgaggaagccattaat

SEQ ID NO: 709246 - DNA, 22 bp, Artificial Sequence
  chemically synthesized
ccaggttagaattaatggcttc

SEQ ID NO: 709247 - DNA, 22 bp, Artificial Sequence
  chemically synthesized
ttagaatgctgaggaagccatt

SEQ ID NO: 709248 - DNA, 22 bp, Artificial Sequence
  chemically synthesized
gaattaatggcttcctcagcat

SEQ ID NO: 709249 - DNA, 22 bp, Artificial Sequence
  chemically synthesized
atggcttcctcagcattctaac

SEQ ID NO: 709250 - DNA, 22 bp, Artificial Sequence
  chemically synthesized
aggtataaaccatatactgtta

SEQ ID NO: 709251 - DNA, 22 bp, Artificial Sequence
  chemically synthesized
cctcagcattctaacagtatat

SEQ ID NO: 709252 - DNA, 22 bp, Artificial Sequence
  chemically synthesized
caggtataaaccatatactgtt

SEQ ID NO: 709253 - DNA, 22 bp, Artificial Sequence
  chemically synthesized
ctcagcattctaacagtatatg

SEQ ID NO: 709254 - DNA, 22 bp, Artificial Sequence
  chemically synthesized
agcattctaacagtatatggtt

SEQ ID NO: 709255 - DNA, 22 bp, Artificial Sequence
  chemically synthesized
taacagtatatggtttatacct

SEQ ID NO: 709256 - DNA, 22 bp, Artificial Sequence
  chemically synthesized
acagtatatggtttatacctga

SEQ ID NO: 709257 - DNA, 22 bp, Artificial Sequence
  chemically synthesized
tatgatagaagtgcttcaggta

SEQ ID NO: 709258 - DNA, 22 bp, Artificial Sequence
  chemically synthesized
aaatgaattatatgatagaagt

SEQ ID NO: 709259 - DNA, 22 bp, Artificial Sequence
  chemically synthesized
atacctgaagcacttctatcat

SEQ ID NO: 709260 - DNA, 22 bp, Artificial Sequence
  chemically synthesized
tacctgaagcacttctatcata

SEQ ID NO: 709261 - DNA, 22 bp, Artificial Sequence
  chemically synthesized
aagcacttctatcatataattc

SEQ ID NO: 709262 - DNA, 22 bp, Artificial Sequence
  chemically synthesized
atgtccatataactaaaatgaa

SEQ ID NO: 709263 - DNA, 22 bp, Artificial Sequence
  chemically synthesized
ctatcatataattcattttagt

SEQ ID NO: 709264 - DNA, 22 bp, Artificial Sequence
  chemically synthesized
tatcatataattcattttagtt

SEQ ID NO: 709265 - DNA, 22 bp, Artificial Sequence
  chemically synthesized
tcatataattcattttagttat

SEQ ID NO: 709266 - DNA, 22 bp, Artificial Sequence
  chemically synthesized
caagacacactcatgtccatat

SEQ ID NO: 709267 - DNA, 22 bp, Artificial Sequence
  chemically synthesized
attttagttatatggacatgag

SEQ ID NO: 709268 - DNA, 22 bp, Artificial Sequence
  chemically synthesized
ttgcaagacacactcatgtcca

SEQ ID NO: 709269 - DNA, 22 bp, Artificial Sequence
  chemically synthesized
tagttatatggacatgagtgtg

SEQ ID NO: 709270 - DNA, 22 bp, Artificial Sequence
  chemically synthesized
agttatatggacatgagtgtgt

SEQ ID NO: 709271 - DNA, 22 bp, Artificial Sequence
  chemically synthesized
gttatatggacatgagtgtgtc

SEQ ID NO: 709272 - DNA, 22 bp, Artificial Sequence
  chemically synthesized
caatctattgcaagacacactc

SEQ ID NO: 709273 - DNA, 22 bp, Artificial Sequence
  chemically synthesized
ccaatctattgcaagacacact

SEQ ID NO: 709274 - DNA, 22 bp, Artificial Sequence
  chemically synthesized
tatggacatgagtgtgtcttgc

SEQ ID NO: 709275 - DNA, 22 bp, Artificial Sequence
  chemically synthesized
tcaagaagtttccaatctattg

SEQ ID NO: 709276 - DNA, 22 bp, Artificial Sequence
  chemically synthesized
ctatcaagaagtttccaatcta

SEQ ID NO: 709277 - DNA, 22 bp, Artificial Sequence
  chemically synthesized
gcaatagattggaaacttcttg

SEQ ID NO: 709278 - DNA, 22 bp, Artificial Sequence
  chemically synthesized
caatagattggaaacttcttga

SEQ ID NO: 709279 - DNA, 22 bp, Artificial Sequence
  chemically synthesized
gaaacttcttgatagcagggac

SEQ ID NO: 709280 - DNA, 22 bp, Artificial Sequence
  chemically synthesized
cttgatagcagggaccattttt

SEQ ID NO: 709281 - DNA, 22 bp, Artificial Sequence
  chemically synthesized
ttgatagcagggaccatttttt

SEQ ID NO: 709282 - DNA, 22 bp, Artificial Sequence
  chemically synthesized
gatagcagggaccattttttgt

SEQ ID NO: 709283 - DNA, 22 bp, Artificial Sequence
  chemically synthesized
atagcagggaccattttttgtt

SEQ ID NO: 709284 - DNA, 22 bp, Artificial Sequence
  chemically synthesized
gaagagaaaggtaaacaaaaaa

SEQ ID NO: 709285 - DNA, 22 bp, Artificial Sequence
  chemically synthesized
gagacattcgaagagaaaggta

SEQ ID NO: 709286 - DNA, 22 bp, Artificial Sequence
  chemically synthesized
tttgtttacctttctcttcgaa

SEQ ID NO: 709287 - DNA, 22 bp, Artificial Sequence
  chemically synthesized
ttgtttacctttctcttcgaat

SEQ ID NO: 709288 - DNA, 22 bp, Artificial Sequence
  chemically synthesized
tgtttacctttctcttcgaatg

SEQ ID NO: 709289 - DNA, 22 bp, Artificial Sequence
  chemically synthesized
gtttacctttctcttcgaatgt

SEQ ID NO: 709290 - DNA, 22 bp, Artificial Sequence
  chemically synthesized
tttacctttctcttcgaatgtc

SEQ ID NO: 709291 - DNA, 22 bp, Artificial Sequence
  chemically synthesized
cagaaagggttggagacattcg

SEQ ID NO: 709292 - DNA, 22 bp, Artificial Sequence
  chemically synthesized
acctttctcttcgaatgtctcc

SEQ ID NO: 709293 - DNA, 22 bp, Artificial Sequence
  chemically synthesized
cctttctcttcgaatgtctcca

SEQ ID NO: 709294 - DNA, 22 bp, Artificial Sequence
  chemically synthesized
ctgcagaaagggttggagacat

SEQ ID NO: 709295 - DNA, 22 bp, Artificial Sequence
  chemically synthesized
tctcttcgaatgtctccaaccc

SEQ ID NO: 709296 - DNA, 22 bp, Artificial Sequence
  chemically synthesized
ctcttcgaatgtctccaaccct

SEQ ID NO: 709297 - DNA, 22 bp, Artificial Sequence
  chemically synthesized
tcttcgaatgtctccaaccctt

SEQ ID NO: 709298 - DNA, 22 bp, Artificial Sequence
  chemically synthesized
ttcgaatgtctccaaccctttc

SEQ ID NO: 709299 - DNA, 22 bp, Artificial Sequence
  chemically synthesized
tgtgcctcctgcagaaagggtt

SEQ ID NO: 709300 - DNA, 22 bp, Artificial Sequence
  chemically synthesized
cgaatgtctccaaccctttctg

SEQ ID NO: 709301 - DNA, 22 bp, Artificial Sequence
  chemically synthesized
gaatgtctccaaccctttctgc

SEQ ID NO: 709302 - DNA, 22 bp, Artificial Sequence
  chemically synthesized
ccatatactatgtgcctcctgc

SEQ ID NO: 709303 - DNA, 22 bp, Artificial Sequence
  chemically synthesized
caaccctttctgcaggaggcac

SEQ ID NO: 709304 - DNA, 22 bp, Artificial Sequence
  chemically synthesized
ctaccatatactatgtgcctcc

SEQ ID NO: 709305 - DNA, 22 bp, Artificial Sequence
  chemically synthesized
gctaccatatactatgtgcctc

SEQ ID NO: 709306 - DNA, 22 bp, Artificial Sequence
  chemically synthesized
tctgcaggaggcacatagtata

SEQ ID NO: 709307 - DNA, 22 bp, Artificial Sequence
  chemically synthesized
ctgcaggaggcacatagtatat

SEQ ID NO: 709308 - DNA, 22 bp, Artificial Sequence
  chemically synthesized
tgcaggaggcacatagtatatg

SEQ ID NO: 709309 - DNA, 22 bp, Artificial Sequence
  chemically synthesized
caggaggcacatagtatatggt

SEQ ID NO: 709310 - DNA, 22 bp, Artificial Sequence
  chemically synthesized
aacaaatatttgctaccatata

SEQ ID NO: 709311 - DNA, 22 bp, Artificial Sequence
  chemically synthesized
gtcattaaacaaatatttgcta

SEQ ID NO: 709312 - DNA, 22 bp, Artificial Sequence
  chemically synthesized
gtcaactagtcattaaacaaat

SEQ ID NO: 709313 - DNA, 22 bp, Artificial Sequence
  chemically synthesized
ggtcaactagtcattaaacaaa

SEQ ID NO: 709314 - DNA, 22 bp, Artificial Sequence
  chemically synthesized
tttggtcaactagtcattaaac

SEQ ID NO: 709315 - DNA, 22 bp, Artificial Sequence
  chemically synthesized
gtttggtcaactagtcattaaa

SEQ ID NO: 709316 - DNA, 22 bp, Artificial Sequence
  chemically synthesized
atccatttgtttggtcaactag

SEQ ID NO: 709317 - DNA, 22 bp, Artificial Sequence
  chemically synthesized
gtttaatgactagttgaccaaa

SEQ ID NO: 709318 - DNA, 22 bp, Artificial Sequence
  chemically synthesized
ctcatccatttgtttggtcaac

SEQ ID NO: 709319 - DNA, 22 bp, Artificial Sequence
  chemically synthesized
tttaatgactagttgaccaaac

SEQ ID NO: 709320 - DNA, 22 bp, Artificial Sequence
  chemically synthesized
actcatccatttgtttggtcaa

SEQ ID NO: 709321 - DNA, 22 bp, Artificial Sequence
  chemically synthesized
aatgactagttgaccaaacaaa

SEQ ID NO: 709322 - DNA, 22 bp, Artificial Sequence
  chemically synthesized
atgactagttgaccaaacaaat

SEQ ID NO: 709323 - DNA, 22 bp, Artificial Sequence
  chemically synthesized
atttactcatccatttgtttgg

SEQ ID NO: 709324 - DNA, 22 bp, Artificial Sequence
  chemically synthesized
ctcatttactcatccatttgtt

SEQ ID NO: 709325 - DNA, 22 bp, Artificial Sequence
  chemically synthesized
actcatttactcatccatttgt

SEQ ID NO: 709326 - DNA, 22 bp, Artificial Sequence
  chemically synthesized
gttgaccaaacaaatggatgag

SEQ ID NO: 709327 - DNA, 22 bp, Artificial Sequence
  chemically synthesized
accaaacaaatggatgagtaaa

SEQ ID NO: 709328 - DNA, 22 bp, Artificial Sequence
  chemically synthesized
acacacacacacacacacacac

SEQ ID NO: 709329 - DNA, 22 bp, Artificial Sequence
  chemically synthesized
tcacacacacacacacacacac

SEQ ID NO: 709330 - DNA, 22 bp, Artificial Sequence
  chemically synthesized
tctcacacacacacacacacac

SEQ ID NO: 709331 - DNA, 22 bp, Artificial Sequence
  chemically synthesized
tctctcacacacacacacacac

SEQ ID NO: 709332 - DNA, 22 bp, Artificial Sequence
  chemically synthesized
tctctctcacacacacacacac

SEQ ID NO: 709333 - DNA, 22 bp, Artificial Sequence
  chemically synthesized
tctctctctcacacacacacac

SEQ ID NO: 709334 - DNA, 22 bp, Artificial Sequence
  chemically synthesized
tctctctctctcacacacacac

SEQ ID NO: 709335 - DNA, 22 bp, Artificial Sequence
  chemically synthesized
tctctctctctctcacacacac

SEQ ID NO: 709336 - DNA, 22 bp, Artificial Sequence
  chemically synthesized
tctctctctctctctcacacac

SEQ ID NO: 709337 - DNA, 22 bp, Artificial Sequence
  chemically synthesized
tctctctctctctctctcacac

SEQ ID NO: 709338 - DNA, 22 bp, Artificial Sequence
  chemically synthesized
tctctctctctctctctctcac

SEQ ID NO: 709339 - DNA, 22 bp, Artificial Sequence
  chemically synthesized
tctctctctctctctctctctc

SEQ ID NO: 709340 - DNA, 22 bp, Artificial Sequence
  chemically synthesized
tctctctctctctctctctctc

SEQ ID NO: 709341 - DNA, 22 bp, Artificial Sequence
  chemically synthesized
tctctctctctctctctctctc

SEQ ID NO: 709342 - DNA, 22 bp, Artificial Sequence
  chemically synthesized
ctctctctctctctctctctct

SEQ ID NO: 709343 - DNA, 22 bp, Artificial Sequence
  chemically synthesized
ttctctctctctctctctctct

SEQ ID NO: 709344 - DNA, 22 bp, Artificial Sequence
  chemically synthesized
tcttctctctctctctctctct

SEQ ID NO: 709345 - DNA, 22 bp, Artificial Sequence
  chemically synthesized
ctcttctctctctctctctctc

SEQ ID NO: 709346 - DNA, 22 bp, Artificial Sequence
  chemically synthesized
ttctcttctctctctctctctc

SEQ ID NO: 709347 - DNA, 22 bp, Artificial Sequence
  chemically synthesized
tcttctcttctctctctctctc

SEQ ID NO: 709348 - DNA, 22 bp, Artificial Sequence
  chemically synthesized
ctcttctcttctctctctctct

SEQ ID NO: 709349 - DNA, 22 bp, Artificial Sequence
  chemically synthesized
cgcatcgcttctcttctcttct

SEQ ID NO: 709350 - DNA, 22 bp, Artificial Sequence
  chemically synthesized
ttccgcatcgcttctcttctct

SEQ ID NO: 709351 - DNA, 22 bp, Artificial Sequence
  chemically synthesized
gttccgcatcgcttctcttctc

SEQ ID NO: 709352 - DNA, 22 bp, Artificial Sequence
  chemically synthesized
tttgttccgcatcgcttctctt

SEQ ID NO: 709353 - DNA, 22 bp, Artificial Sequence
  chemically synthesized
gtttgttccgcatcgcttctct

SEQ ID NO: 709354 - DNA, 22 bp, Artificial Sequence
  chemically synthesized
agtgtcagtaggcatacttgtt

SEQ ID NO: 709355 - DNA, 22 bp, Artificial Sequence
  chemically synthesized
cagtcagtgcactcagtgtcag

SEQ ID NO: 709356 - DNA, 22 bp, Artificial Sequence
  chemically synthesized
cagacctgcagtcagtgcactc

SEQ ID NO: 709357 - DNA, 22 bp, Artificial Sequence
  chemically synthesized
ctgacactgagtgcactgactg

SEQ ID NO: 709358 - DNA, 22 bp, Artificial Sequence
  chemically synthesized
acactgagtgcactgactgcag

SEQ ID NO: 709359 - DNA, 22 bp, Artificial Sequence
  chemically synthesized
accattacagacctgcagtcag

SEQ ID NO: 709360 - DNA, 22 bp, Artificial Sequence
  chemically synthesized
agtgcactgactgcaggtctgt

SEQ ID NO: 709361 - DNA, 22 bp, Artificial Sequence
  chemically synthesized
acacatagaattaaccattaca

SEQ ID NO: 709362 - DNA, 22 bp, Artificial Sequence
  chemically synthesized
gacacatagaattaaccattac

SEQ ID NO: 709363 - DNA, 22 bp, Artificial Sequence
  chemically synthesized
actgcaggtctgtaatggttaa

SEQ ID NO: 709364 - DNA, 22 bp, Artificial Sequence
  chemically synthesized
caggtctgtaatggttaattct

SEQ ID NO: 709365 - DNA, 22 bp, Artificial Sequence
  chemically synthesized
taatggttaattctatgtgtca

SEQ ID NO: 709366 - DNA, 22 bp, Artificial Sequence
  chemically synthesized
attctatgtgtcaagttgactg

SEQ ID NO: 709367 - DNA, 22 bp, Artificial Sequence
  chemically synthesized
ggcaccccatagtccagtcaac

SEQ ID NO: 709368 - DNA, 22 bp, Artificial Sequence
  chemically synthesized
tatgtgtcaagttgactggact

SEQ ID NO: 709369 - DNA, 22 bp, Artificial Sequence
  chemically synthesized
tgtgtcaagttgactggactat

SEQ ID NO: 709370 - DNA, 22 bp, Artificial Sequence
  chemically synthesized
cctgggcaccccatagtccagt

SEQ ID NO: 709371 - DNA, 22 bp, Artificial Sequence
  chemically synthesized
acctgggcaccccatagtccag

SEQ ID NO: 709372 - DNA, 22 bp, Artificial Sequence
  chemically synthesized
actggactatggggtgcccagg

SEQ ID NO: 709373 - DNA, 22 bp, Artificial Sequence
  chemically synthesized
gactatggggtgcccaggtaaa

SEQ ID NO: 709374 - DNA, 22 bp, Artificial Sequence
  chemically synthesized
tggggtgcccaggtaaaccact

SEQ ID NO: 709375 - DNA, 22 bp, Artificial Sequence
  chemically synthesized
acagacacacccagaaatagtg

SEQ ID NO: 709376 - DNA, 22 bp, Artificial Sequence
  chemically synthesized
caaaacaccctcacagacacac

SEQ ID NO: 709377 - DNA, 22 bp, Artificial Sequence
  chemically synthesized
tctgcaaaacaccctcacagac

SEQ ID NO: 709378 - DNA, 22 bp, Artificial Sequence
  chemically synthesized
tttctgggtgtgtctgtgaggg

SEQ ID NO: 709379 - DNA, 22 bp, Artificial Sequence
  chemically synthesized
gtctgcaaaacaccctcacaga

SEQ ID NO: 709380 - DNA, 22 bp, Artificial Sequence
  chemically synthesized
ctgggtgtgtctgtgagggtgt

SEQ ID NO: 709381 - DNA, 22 bp, Artificial Sequence
  chemically synthesized
tgggtgtgtctgtgagggtgtt

SEQ ID NO: 709382 - DNA, 22 bp, Artificial Sequence
  chemically synthesized
atcttgtctgcaaaacaccctc

SEQ ID NO: 709383 - DNA, 22 bp, Artificial Sequence
  chemically synthesized
ggtgtgtctgtgagggtgtttt

SEQ ID NO: 709384 - DNA, 22 bp, Artificial Sequence
  chemically synthesized
tgagggtgttttgcagacaaga

SEQ ID NO: 709385 - DNA, 22 bp, Artificial Sequence
  chemically synthesized
aaccaaatgctaatcttgtctg

SEQ ID NO: 709386 - DNA, 22 bp, Artificial Sequence
  chemically synthesized
aatccactgaaccaaatgctaa

SEQ ID NO: 709387 - DNA, 22 bp, Artificial Sequence
  chemically synthesized
tgcagacaagattagcatttgg

SEQ ID NO: 709388 - DNA, 22 bp, Artificial Sequence
  chemically synthesized
gcagacaagattagcatttggt

SEQ ID NO: 709389 - DNA, 22 bp, Artificial Sequence
  chemically synthesized
cagacaagattagcatttggtt

SEQ ID NO: 709390 - DNA, 22 bp, Artificial Sequence
  chemically synthesized
ctgaatccactgaaccaaatgc

SEQ ID NO: 709391 - DNA, 22 bp, Artificial Sequence
  chemically synthesized
gcatttggttcagtggattcag

SEQ ID NO: 709392 - DNA, 22 bp, Artificial Sequence
  chemically synthesized
gggagggcaatctactgaatcc

SEQ ID NO: 709393 - DNA, 22 bp, Artificial Sequence
  chemically synthesized
ggttcagtggattcagtagatt

SEQ ID NO: 709394 - DNA, 22 bp, Artificial Sequence
  chemically synthesized
gttcagtggattcagtagattg

SEQ ID NO: 709395 - DNA, 22 bp, Artificial Sequence
  chemically synthesized
agtggattcagtagattgccct

SEQ ID NO: 709396 - DNA, 22 bp, Artificial Sequence
  chemically synthesized
agtagattgccctccccaatgt

SEQ ID NO: 709397 - DNA, 22 bp, Artificial Sequence
  chemically synthesized
acaggatgatgcccgcccacat

SEQ ID NO: 709398 - DNA, 22 bp, Artificial Sequence
  chemically synthesized
ccctccccaatgtgggcgggca

SEQ ID NO: 709399 - DNA, 22 bp, Artificial Sequence
  chemically synthesized
aactgacaggatgatgcccgcc

SEQ ID NO: 709400 - DNA, 22 bp, Artificial Sequence
  chemically synthesized
cccaatgtgggcgggcatcatc

SEQ ID NO: 709401 - DNA, 22 bp, Artificial Sequence
  chemically synthesized
ggacctcaactgacaggatgat

SEQ ID NO: 709402 - DNA, 22 bp, Artificial Sequence
  chemically synthesized
aggacctcaactgacaggatga

SEQ ID NO: 709403 - DNA, 22 bp, Artificial Sequence
  chemically synthesized
tttaggacctcaactgacagga

SEQ ID NO: 709404 - DNA, 22 bp, Artificial Sequence
  chemically synthesized
tgtttaggacctcaactgacag

SEQ ID NO: 709405 - DNA, 22 bp, Artificial Sequence
  chemically synthesized
ttctgtttaggacctcaactga

SEQ ID NO: 709406 - DNA, 22 bp, Artificial Sequence
  chemically synthesized
gttctgtttaggacctcaactg

SEQ ID NO: 709407 - DNA, 22 bp, Artificial Sequence
  chemically synthesized
tgttctgtttaggacctcaact

SEQ ID NO: 709408 - DNA, 22 bp, Artificial Sequence
  chemically synthesized
ttgttctgtttaggacctcaac

SEQ ID NO: 709409 - DNA, 22 bp, Artificial Sequence
  chemically synthesized
tttgttctgtttaggacctcaa

SEQ ID NO: 709410 - DNA, 22 bp, Artificial Sequence
  chemically synthesized
tcagttgaggtcctaaacagaa

SEQ ID NO: 709411 - DNA, 22 bp, Artificial Sequence
  chemically synthesized
aggtcctaaacagaacaaaaag

SEQ ID NO: 709412 - DNA, 22 bp, Artificial Sequence
  chemically synthesized
aacagaacaaaaaggcatgttc

SEQ ID NO: 709413 - DNA, 22 bp, Artificial Sequence
  chemically synthesized
cagggaaaaaaggaacatgcct

SEQ ID NO: 709414 - DNA, 22 bp, Artificial Sequence
  chemically synthesized
aagcaggcctgcagggaaaaaa

SEQ ID NO: 709415 - DNA, 22 bp, Artificial Sequence
  chemically synthesized
cttttttccctgcaggcctgct

SEQ ID NO: 709416 - DNA, 22 bp, Artificial Sequence
  chemically synthesized
acatcccagctcaagcaggcct

SEQ ID NO: 709417 - DNA, 22 bp, Artificial Sequence
  chemically synthesized
ttttccctgcaggcctgcttga

SEQ ID NO: 709418 - DNA, 22 bp, Artificial Sequence
  chemically synthesized
tttccctgcaggcctgcttgag

SEQ ID NO: 709419 - DNA, 22 bp, Artificial Sequence
  chemically synthesized
ttccctgcaggcctgcttgagc

SEQ ID NO: 709420 - DNA, 22 bp, Artificial Sequence
  chemically synthesized
tccctgcaggcctgcttgagct

SEQ ID NO: 709421 - DNA, 22 bp, Artificial Sequence
  chemically synthesized
ccctgcaggcctgcttgagctg

SEQ ID NO: 709422 - DNA, 22 bp, Artificial Sequence
  chemically synthesized
cctgcaggcctgcttgagctgg

SEQ ID NO: 709423 - DNA, 22 bp, Artificial Sequence
  chemically synthesized
caggcctgcttgagctgggatg

SEQ ID NO: 709424 - DNA, 22 bp, Artificial Sequence
  chemically synthesized
cttgagctgggatgtcagtctt

SEQ ID NO: 709425 - DNA, 22 bp, Artificial Sequence
  chemically synthesized
gagctgggatgtcagtcttctc

SEQ ID NO: 709426 - DNA, 22 bp, Artificial Sequence
  chemically synthesized
agctgggatgtcagtcttctcc

SEQ ID NO: 709427 - DNA, 22 bp, Artificial Sequence
  chemically synthesized
ggatgtcagtcttctcctgcac

SEQ ID NO: 709428 - DNA, 22 bp, Artificial Sequence
  chemically synthesized
atgatgtaaatcccagtgcaag

SEQ ID NO: 709429 - DNA, 22 bp, Artificial Sequence
  chemically synthesized
ctcctgcacttgcactgggatt

SEQ ID NO: 709430 - DNA, 22 bp, Artificial Sequence
  chemically synthesized
tcctgcacttgcactgggattt

SEQ ID NO: 709431 - DNA, 22 bp, Artificial Sequence
  chemically synthesized
ctgcacttgcactgggatttac

SEQ ID NO: 709432 - DNA, 22 bp, Artificial Sequence
  chemically synthesized
cacttgcactgggatttacatc

SEQ ID NO: 709433 - DNA, 22 bp, Artificial Sequence
  chemically synthesized
gcactgggatttacatcatcaa

SEQ ID NO: 709434 - DNA, 22 bp, Artificial Sequence
  chemically synthesized
cactgggatttacatcatcaac

SEQ ID NO: 709435 - DNA, 22 bp, Artificial Sequence
  chemically synthesized
agaaccaggggagttgatgatg

SEQ ID NO: 709436 - DNA, 22 bp, Artificial Sequence
  chemically synthesized
ggatttacatcatcaactcccc

SEQ ID NO: 709437 - DNA, 22 bp, Artificial Sequence
  chemically synthesized
aaggcctgagaaccaggggagt

SEQ ID NO: 709438 - DNA, 22 bp, Artificial Sequence
  chemically synthesized
acatcatcaactcccctggttc

SEQ ID NO: 709439 - DNA, 22 bp, Artificial Sequence
  chemically synthesized
catcatcaactcccctggttct

SEQ ID NO: 709440 - DNA, 22 bp, Artificial Sequence
  chemically synthesized
agtcccagtctgaaggcctgag

SEQ ID NO: 709441 - DNA, 22 bp, Artificial Sequence
  chemically synthesized
cagtcccagtctgaaggcctga

SEQ ID NO: 709442 - DNA, 22 bp, Artificial Sequence
  chemically synthesized
ccctggttctcaggccttcaga

SEQ ID NO: 709443 - DNA, 22 bp, Artificial Sequence
  chemically synthesized
gttctcaggccttcagactggg

SEQ ID NO: 709444 - DNA, 22 bp, Artificial Sequence
  chemically synthesized
tcaggccttcagactgggactg

SEQ ID NO: 709445 - DNA, 22 bp, Artificial Sequence
  chemically synthesized
gtagtgtgatttcagtcccagt

SEQ ID NO: 709446 - DNA, 22 bp, Artificial Sequence
  chemically synthesized
aggccttcagactgggactgaa

SEQ ID NO: 709447 - DNA, 22 bp, Artificial Sequence
  chemically synthesized
cagactgggactgaaatcacac

SEQ ID NO: 709448 - DNA, 22 bp, Artificial Sequence
  chemically synthesized
agactgggactgaaatcacact

SEQ ID NO: 709449 - DNA, 22 bp, Artificial Sequence
  chemically synthesized
ggactgaaatcacactaccaat

SEQ ID NO: 709450 - DNA, 22 bp, Artificial Sequence
  chemically synthesized
gagagccaggaaaattggtagt

SEQ ID NO: 709451 - DNA, 22 bp, Artificial Sequence
  chemically synthesized
aaatcacactaccaattttcct

SEQ ID NO: 709452 - DNA, 22 bp, Artificial Sequence
  chemically synthesized
caagctagagagccaggaaaat

SEQ ID NO: 709453 - DNA, 22 bp, Artificial Sequence
  chemically synthesized
tctgcaagctagagagccagga

SEQ ID NO: 709454 - DNA, 22 bp, Artificial Sequence
  chemically synthesized
ctatctgcaagctagagagcca

SEQ ID NO: 709455 - DNA, 22 bp, Artificial Sequence
  chemically synthesized
ccaattttcctggctctctagc

SEQ ID NO: 709456 - DNA, 22 bp, Artificial Sequence
  chemically synthesized
tcctggctctctagcttgcaga

SEQ ID NO: 709457 - DNA, 22 bp, Artificial Sequence
  chemically synthesized
cctggctctctagcttgcagat

SEQ ID NO: 709458 - DNA, 22 bp, Artificial Sequence
  chemically synthesized
ctggctctctagcttgcagata

SEQ ID NO: 709459 - DNA, 22 bp, Artificial Sequence
  chemically synthesized
gctctctagcttgcagatagca

SEQ ID NO: 709460 - DNA, 22 bp, Artificial Sequence
  chemically synthesized
agaagtcccatgacctgctatc

SEQ ID NO: 709461 - DNA, 22 bp, Artificial Sequence
  chemically synthesized
tctagcttgcagatagcaggtc

SEQ ID NO: 709462 - DNA, 22 bp, Artificial Sequence
  chemically synthesized
tagcttgcagatagcaggtcat

SEQ ID NO: 709463 - DNA, 22 bp, Artificial Sequence
  chemically synthesized
gcttgcagatagcaggtcatgg

SEQ ID NO: 709464 - DNA, 22 bp, Artificial Sequence
  chemically synthesized
gagactaagaagtcccatgacc

SEQ ID NO: 709465 - DNA, 22 bp, Artificial Sequence
  chemically synthesized
gcagatagcaggtcatgggact

SEQ ID NO: 709466 - DNA, 22 bp, Artificial Sequence
  chemically synthesized
cagatagcaggtcatgggactt

SEQ ID NO: 709467 - DNA, 22 bp, Artificial Sequence
  chemically synthesized
atgcagttggagactaagaagt

SEQ ID NO: 709468 - DNA, 22 bp, Artificial Sequence
  chemically synthesized
tctcatgcagttggagactaag

SEQ ID NO: 709469 - DNA, 22 bp, Artificial Sequence
  chemically synthesized
agtattatctcatgcagttgga

SEQ ID NO: 709470 - DNA, 22 bp, Artificial Sequence
  chemically synthesized
cttagtctccaactgcatgaga

SEQ ID NO: 709471 - DNA, 22 bp, Artificial Sequence
  chemically synthesized
ttagtctccaactgcatgagat

SEQ ID NO: 709472 - DNA, 22 bp, Artificial Sequence
  chemically synthesized
agtctccaactgcatgagataa

SEQ ID NO: 709473 - DNA, 22 bp, Artificial Sequence
  chemically synthesized
gtctccaactgcatgagataat

SEQ ID NO: 709474 - DNA, 22 bp, Artificial Sequence
  chemically synthesized
caactgcatgagataatactta

SEQ ID NO: 709475 - DNA, 22 bp, Artificial Sequence
  chemically synthesized
catgagataatacttaatttta

SEQ ID NO: 709476 - DNA, 22 bp, Artificial Sequence
  chemically synthesized
tgtgtgtgtgaatatataaaat

SEQ ID NO: 709477 - DNA, 22 bp, Artificial Sequence
  chemically synthesized
aattttatatattcacacacac

SEQ ID NO: 709478 - DNA, 22 bp, Artificial Sequence
  chemically synthesized
attttatatattcacacacaca

SEQ ID NO: 709479 - DNA, 22 bp, Artificial Sequence
  chemically synthesized
tatatattcacacacacataga

SEQ ID NO: 709480 - DNA, 22 bp, Artificial Sequence
  chemically synthesized
atatattcacacacacatagac

SEQ ID NO: 709481 - DNA, 22 bp, Artificial Sequence
  chemically synthesized
tatattcacacacacatagaca

SEQ ID NO: 709482 - DNA, 22 bp, Artificial Sequence
  chemically synthesized
acacacacatagacatacatat

SEQ ID NO: 709483 - DNA, 22 bp, Artificial Sequence
  chemically synthesized
cagagaaatagaagcaacaata

SEQ ID NO: 709484 - DNA, 22 bp, Artificial Sequence
  chemically synthesized
tccagagaaatagaagcaacaa

SEQ ID NO: 709485 - DNA, 22 bp, Artificial Sequence
  chemically synthesized
gtcaaggttctccagagaaata

SEQ ID NO: 709486 - DNA, 22 bp, Artificial Sequence
  chemically synthesized
attagtcaaggttctccagaga

SEQ ID NO: 709487 - DNA, 22 bp, Artificial Sequence
  chemically synthesized
ttgcttctatttctctggagaa

SEQ ID NO: 709488 - DNA, 22 bp, Artificial Sequence
  chemically synthesized
cttctatttctctggagaacct

SEQ ID NO: 709489 - DNA, 22 bp, Artificial Sequence
  chemically synthesized
ctatttctctggagaaccttga

SEQ ID NO: 709490 - DNA, 22 bp, Artificial Sequence
  chemically synthesized
tatttctctggagaaccttgac

SEQ ID NO: 709491 - DNA, 22 bp, Artificial Sequence
  chemically synthesized
tttctctggagaaccttgacta

SEQ ID NO: 709492 - DNA, 22 bp, Artificial Sequence
  chemically synthesized
ctctggagaaccttgactaatc

SEQ ID NO: 709493 - DNA, 22 bp, Artificial Sequence
  chemically synthesized
cccagggacattgattagtcaa

SEQ ID NO: 709494 - DNA, 22 bp, Artificial Sequence
  chemically synthesized
tctggagaaccttgactaatca

SEQ ID NO: 709495 - DNA, 22 bp, Artificial Sequence
  chemically synthesized
acccagggacattgattagtca

SEQ ID NO: 709496 - DNA, 22 bp, Artificial Sequence
  chemically synthesized
tggagaaccttgactaatcaat

SEQ ID NO: 709497 - DNA, 22 bp, Artificial Sequence
  chemically synthesized
gagaaccttgactaatcaatgt

SEQ ID NO: 709498 - DNA, 22 bp, Artificial Sequence
  chemically synthesized
agaataatttacccagggacat

SEQ ID NO: 709499 - DNA, 22 bp, Artificial Sequence
  chemically synthesized
gactaatcaatgtccctgggta

SEQ ID NO: 709500 - DNA, 22 bp, Artificial Sequence
  chemically synthesized
actaatcaatgtccctgggtaa

SEQ ID NO: 709501 - DNA, 22 bp, Artificial Sequence
  chemically synthesized
atcaatgtccctgggtaaatta

SEQ ID NO: 709502 - DNA, 22 bp, Artificial Sequence
  chemically synthesized
ataaggaaagttaagaataatt

SEQ ID NO: 709503 - DNA, 22 bp, Artificial Sequence
  chemically synthesized
ctgataaggaaagttaagaata

SEQ ID NO: 709504 - DNA, 22 bp, Artificial Sequence
  chemically synthesized
actgataaggaaagttaagaat

SEQ ID NO: 709505 - DNA, 22 bp, Artificial Sequence
  chemically synthesized
tactgataaggaaagttaagaa

SEQ ID NO: 709506 - DNA, 22 bp, Artificial Sequence
  chemically synthesized
ggtaaattattcttaactttcc

SEQ ID NO: 709507 - DNA, 22 bp, Artificial Sequence
  chemically synthesized
cacattttactgataaggaaag

SEQ ID NO: 709508 - DNA, 22 bp, Artificial Sequence
  chemically synthesized
ccacattttactgataaggaaa

SEQ ID NO: 709509 - DNA, 22 bp, Artificial Sequence
  chemically synthesized
tccacattttactgataaggaa

SEQ ID NO: 709510 - DNA, 22 bp, Artificial Sequence
  chemically synthesized
ttcttaactttccttatcagta

SEQ ID NO: 709511 - DNA, 22 bp, Artificial Sequence
  chemically synthesized
ttttccacattttactgataag

SEQ ID NO: 709512 - DNA, 22 bp, Artificial Sequence
  chemically synthesized
ttaactttccttatcagtaaaa

SEQ ID NO: 709513 - DNA, 22 bp, Artificial Sequence
  chemically synthesized
aactttccttatcagtaaaatg

SEQ ID NO: 709514 - DNA, 22 bp, Artificial Sequence
  chemically synthesized
tattattttccacattttactg

SEQ ID NO: 709515 - DNA, 22 bp, Artificial Sequence
  chemically synthesized
actttccttatcagtaaaatgt

SEQ ID NO: 709516 - DNA, 22 bp, Artificial Sequence
  chemically synthesized
tccttatcagtaaaatgtggaa

SEQ ID NO: 709517 - DNA, 22 bp, Artificial Sequence
  chemically synthesized
ccttatcagtaaaatgtggaaa

SEQ ID NO: 709518 - DNA, 22 bp, Artificial Sequence
  chemically synthesized
cttatcagtaaaatgtggaaaa

SEQ ID NO: 709519 - DNA, 22 bp, Artificial Sequence
  chemically synthesized
taagttatattattttccacat

SEQ ID NO: 709520 - DNA, 22 bp, Artificial Sequence
  chemically synthesized
atcagtaaaatgtggaaaataa

SEQ ID NO: 709521 - DNA, 22 bp, Artificial Sequence
  chemically synthesized
tcagtaaaatgtggaaaataat

SEQ ID NO: 709522 - DNA, 22 bp, Artificial Sequence
  chemically synthesized
ccacaaaaccctataagttata

SEQ ID NO: 709523 - DNA, 22 bp, Artificial Sequence
  chemically synthesized
attcccacaaaaccctataagt

SEQ ID NO: 709524 - DNA, 22 bp, Artificial Sequence
  chemically synthesized
aattcccacaaaaccctataag

SEQ ID NO: 709525 - DNA, 22 bp, Artificial Sequence
  chemically synthesized
tttaattcccacaaaaccctat

SEQ ID NO: 709526 - DNA, 22 bp, Artificial Sequence
  chemically synthesized
atttaattcccacaaaacccta

SEQ ID NO: 709527 - DNA, 22 bp, Artificial Sequence
  chemically synthesized
tatcatcttatttaattcccac

SEQ ID NO: 709528 - DNA, 22 bp, Artificial Sequence
  chemically synthesized
atagggttttgtgggaattaaa

SEQ ID NO: 709529 - DNA, 22 bp, Artificial Sequence
  chemically synthesized
tagggttttgtgggaattaaat

SEQ ID NO: 709530 - DNA, 22 bp, Artificial Sequence
  chemically synthesized
cattgtatcatcttatttaatt

SEQ ID NO: 709531 - DNA, 22 bp, Artificial Sequence
  chemically synthesized
acattgtatcatcttatttaat

SEQ ID NO: 709532 - DNA, 22 bp, Artificial Sequence
  chemically synthesized
tacattgtatcatcttatttaa

SEQ ID NO: 709533 - DNA, 22 bp, Artificial Sequence
  chemically synthesized
tgtgggaattaaataagatgat

SEQ ID NO: 709534 - DNA, 22 bp, Artificial Sequence
  chemically synthesized
gtgggaattaaataagatgata

SEQ ID NO: 709535 - DNA, 22 bp, Artificial Sequence
  chemically synthesized
tgggaattaaataagatgatac

SEQ ID NO: 709536 - DNA, 22 bp, Artificial Sequence
  chemically synthesized
aatgctttacattgtatcatct

SEQ ID NO: 709537 - DNA, 22 bp, Artificial Sequence
  chemically synthesized
ggctaaatgctttacattgtat

SEQ ID NO: 709538 - DNA, 22 bp, Artificial Sequence
  chemically synthesized
aataagatgatacaatgtaaag

SEQ ID NO: 709539 - DNA, 22 bp, Artificial Sequence
  chemically synthesized
ccacgtgacagaaactaggcta

SEQ ID NO: 709540 - DNA, 22 bp, Artificial Sequence
  chemically synthesized
agcaattaccacgtgacagaaa

SEQ ID NO: 709541 - DNA, 22 bp, Artificial Sequence
  chemically synthesized
ttgagcaattaccacgtgacag

SEQ ID NO: 709542 - DNA, 22 bp, Artificial Sequence
  chemically synthesized
attgagcaattaccacgtgaca

SEQ ID NO: 709543 - DNA, 22 bp, Artificial Sequence
  chemically synthesized
agcctagtttctgtcacgtggt

SEQ ID NO: 709544 - DNA, 22 bp, Artificial Sequence
  chemically synthesized
gcctagtttctgtcacgtggta

SEQ ID NO: 709545 - DNA, 22 bp, Artificial Sequence
  chemically synthesized
gtttctgtcacgtggtaattgc

SEQ ID NO: 709546 - DNA, 22 bp, Artificial Sequence
  chemically synthesized
gtaacatttattgagcaattac

SEQ ID NO: 709547 - DNA, 22 bp, Artificial Sequence
  chemically synthesized
ctgtcacgtggtaattgctcaa

SEQ ID NO: 709548 - DNA, 22 bp, Artificial Sequence
  chemically synthesized
tgtcacgtggtaattgctcaat

SEQ ID NO: 709549 - DNA, 22 bp, Artificial Sequence
  chemically synthesized
tcacgtggtaattgctcaataa

SEQ ID NO: 709550 - DNA, 22 bp, Artificial Sequence
  chemically synthesized
ctcaataaatgttaccagctac

SEQ ID NO: 709551 - DNA, 22 bp, Artificial Sequence
  chemically synthesized
aataaatgttaccagctactgt

SEQ ID NO: 709552 - DNA, 22 bp, Artificial Sequence
  chemically synthesized
accataatagtagcaagaacag

SEQ ID NO: 709553 - DNA, 22 bp, Artificial Sequence
  chemically synthesized
ttaaccataatagtagcaagaa

SEQ ID NO: 709554 - DNA, 22 bp, Artificial Sequence
  chemically synthesized
attaaccataatagtagcaaga

SEQ ID NO: 709555 - DNA, 22 bp, Artificial Sequence
  chemically synthesized
ccagctactgttcttgctacta

SEQ ID NO: 709556 - DNA, 22 bp, Artificial Sequence
  chemically synthesized
tattaaccataatagtagcaag

SEQ ID NO: 709557 - DNA, 22 bp, Artificial Sequence
  chemically synthesized
ttattaaccataatagtagcaa

SEQ ID NO: 709558 - DNA, 22 bp, Artificial Sequence
  chemically synthesized
cttttattaaccataatagtag

SEQ ID NO: 709559 - DNA, 22 bp, Artificial Sequence
  chemically synthesized
tccttttattaaccataatagt

SEQ ID NO: 709560 - DNA, 22 bp, Artificial Sequence
  chemically synthesized
ctgttcttgctactattatggt

SEQ ID NO: 709561 - DNA, 22 bp, Artificial Sequence
  chemically synthesized
ctctccttttattaaccataat

SEQ ID NO: 709562 - DNA, 22 bp, Artificial Sequence
  chemically synthesized
ttcttgctactattatggttaa

SEQ ID NO: 709563 - DNA, 22 bp, Artificial Sequence
  chemically synthesized
ttcctctccttttattaaccat

SEQ ID NO: 709564 - DNA, 22 bp, Artificial Sequence
  chemically synthesized
ttgctactattatggttaataa

SEQ ID NO: 709565 - DNA, 22 bp, Artificial Sequence
  chemically synthesized
gctactattatggttaataaaa

SEQ ID NO: 709566 - DNA, 22 bp, Artificial Sequence
  chemically synthesized
ctactattatggttaataaaag

SEQ ID NO: 709567 - DNA, 22 bp, Artificial Sequence
  chemically synthesized
gcctattcctctccttttatta

SEQ ID NO: 709568 - DNA, 22 bp, Artificial Sequence
  chemically synthesized
ctattatggttaataaaaggag

SEQ ID NO: 709569 - DNA, 22 bp, Artificial Sequence
  chemically synthesized
ttatggttaataaaaggagagg

SEQ ID NO: 709570 - DNA, 22 bp, Artificial Sequence
  chemically synthesized
tggttaataaaaggagaggaat

SEQ ID NO: 709571 - DNA, 22 bp, Artificial Sequence
  chemically synthesized
ataaaaggagaggaataggcca

SEQ ID NO: 709572 - DNA, 22 bp, Artificial Sequence
  chemically synthesized
caggtgtgagtcaccatgcctg

SEQ ID NO: 709573 - DNA, 22 bp, Artificial Sequence
  chemically synthesized
ggattacaggtgtgagtcacca

SEQ ID NO: 709574 - DNA, 22 bp, Artificial Sequence
  chemically synthesized
ccaaagtgctgggattacaggt

SEQ ID NO: 709575 - DNA, 22 bp, Artificial Sequence
  chemically synthesized
ggcctcccaaagtgctgggatt

SEQ ID NO: 709576 - DNA, 22 bp, Artificial Sequence
  chemically synthesized
acacctgtaatcccagcacttt

SEQ ID NO: 709577 - DNA, 22 bp, Artificial Sequence
  chemically synthesized
cctcggcctcccaaagtgctgg

SEQ ID NO: 709578 - DNA, 22 bp, Artificial Sequence
  chemically synthesized
taatcccagcactttgggaggc

SEQ ID NO: 709579 - DNA, 22 bp, Artificial Sequence
  chemically synthesized
aagtgatccgcctgcctcggcc

SEQ ID NO: 709580 - DNA, 22 bp, Artificial Sequence
  chemically synthesized
acctcaagtgatccgcctgcct

SEQ ID NO: 709581 - DNA, 22 bp, Artificial Sequence
  chemically synthesized
tgggaggccgaggcaggcggat

SEQ ID NO: 709582 - DNA, 22 bp, Artificial Sequence
  chemically synthesized
gggaggccgaggcaggcggatc

SEQ ID NO: 709583 - DNA, 22 bp, Artificial Sequence
  chemically synthesized
ctgacctcaagtgatccgcctg

SEQ ID NO: 709584 - DNA, 22 bp, Artificial Sequence
  chemically synthesized
ggaggccgaggcaggcggatca

SEQ ID NO: 709585 - DNA, 22 bp, Artificial Sequence
  chemically synthesized
gaactcctgacctcaagtgatc

SEQ ID NO: 709586 - DNA, 22 bp, Artificial Sequence
  chemically synthesized
gccagaccggtctcgaactcct

SEQ ID NO: 709587 - DNA, 22 bp, Artificial Sequence
  chemically synthesized
gaggtcaggagttcgagaccgg

SEQ ID NO: 709588 - DNA, 22 bp, Artificial Sequence
  chemically synthesized
aggtcaggagttcgagaccggt

SEQ ID NO: 709589 - DNA, 22 bp, Artificial Sequence
  chemically synthesized
atcatgttggccagaccggtct

SEQ ID NO: 709590 - DNA, 22 bp, Artificial Sequence
  chemically synthesized
catcatgttggccagaccggtc

SEQ ID NO: 709591 - DNA, 22 bp, Artificial Sequence
  chemically synthesized
cgtttcatcatgttggccagac

SEQ ID NO: 709592 - DNA, 22 bp, Artificial Sequence
  chemically synthesized
gagaccggtctggccaacatga

SEQ ID NO: 709593 - DNA, 22 bp, Artificial Sequence
  chemically synthesized
gtagagactgcgtttcatcatg

SEQ ID NO: 709594 - DNA, 22 bp, Artificial Sequence
  chemically synthesized
agtagagactgcgtttcatcat

SEQ ID NO: 709595 - DNA, 22 bp, Artificial Sequence
  chemically synthesized
tagtagagactgcgtttcatca

SEQ ID NO: 709596 - DNA, 22 bp, Artificial Sequence
  chemically synthesized
ttagtagagactgcgtttcatc

SEQ ID NO: 709597 - DNA, 22 bp, Artificial Sequence
  chemically synthesized
gccaacatgatgaaacgcagtc

SEQ ID NO: 709598 - DNA, 22 bp, Artificial Sequence
  chemically synthesized
tatttttagtagagactgcgtt

SEQ ID NO: 709599 - DNA, 22 bp, Artificial Sequence
  chemically synthesized
gtatttttagtagagactgcgt

SEQ ID NO: 709600 - DNA, 22 bp, Artificial Sequence
  chemically synthesized
tgtatttttagtagagactgcg

SEQ ID NO: 709601 - DNA, 22 bp, Artificial Sequence
  chemically synthesized
ttgtatttttagtagagactgc

SEQ ID NO: 709602 - DNA, 22 bp, Artificial Sequence
  chemically synthesized
atttttgtatttttagtagaga

SEQ ID NO: 709603 - DNA, 22 bp, Artificial Sequence
  chemically synthesized
tactaaaaatacaaaaattagc

SEQ ID NO: 709604 - DNA, 22 bp, Artificial Sequence
  chemically synthesized
ctaaaaatacaaaaattagctt

SEQ ID NO: 709605 - DNA, 22 bp, Artificial Sequence
  chemically synthesized
aaaatacaaaaattagcttggt

SEQ ID NO: 709606 - DNA, 22 bp, Artificial Sequence
  chemically synthesized
cagatgcccaccaccacaccaa

SEQ ID NO: 709607 - DNA, 22 bp, Artificial Sequence
  chemically synthesized
ggattacagatgcccaccacca

SEQ ID NO: 709608 - DNA, 22 bp, Artificial Sequence
  chemically synthesized
gcttggtgtggtggtgggcatc

SEQ ID NO: 709609 - DNA, 22 bp, Artificial Sequence
  chemically synthesized
ggtgtggtggtgggcatctgta

SEQ ID NO: 709610 - DNA, 22 bp, Artificial Sequence
  chemically synthesized
gtgtggtggtgggcatctgtaa

SEQ ID NO: 709611 - DNA, 22 bp, Artificial Sequence
  chemically synthesized
ccgagtagctgggattacagat

SEQ ID NO: 709612 - DNA, 22 bp, Artificial Sequence
  chemically synthesized
cccgagtagctgggattacaga

SEQ ID NO: 709613 - DNA, 22 bp, Artificial Sequence
  chemically synthesized
agcttcccgagtagctgggatt

SEQ ID NO: 709614 - DNA, 22 bp, Artificial Sequence
  chemically synthesized
tctcagcttcccgagtagctgg

SEQ ID NO: 709615 - DNA, 22 bp, Artificial Sequence
  chemically synthesized
ctgtctcagcttcccgagtagc

SEQ ID NO: 709616 - DNA, 22 bp, Artificial Sequence
  chemically synthesized
tcctgtctcagcttcccgagta

SEQ ID NO: 709617 - DNA, 22 bp, Artificial Sequence
  chemically synthesized
taatcccagctactcgggaagc

SEQ ID NO: 709618 - DNA, 22 bp, Artificial Sequence
  chemically synthesized
aagtgattctcctgtctcagct

SEQ ID NO: 709619 - DNA, 22 bp, Artificial Sequence
  chemically synthesized
ctcgggaagctgagacaggaga

SEQ ID NO: 709620 - DNA, 22 bp, Artificial Sequence
  chemically synthesized
agattcaagtgattctcctgtc

SEQ ID NO: 709621 - DNA, 22 bp, Artificial Sequence
  chemically synthesized
gggaagctgagacaggagaatc

SEQ ID NO: 709622 - DNA, 22 bp, Artificial Sequence
  chemically synthesized
tcagattcaagtgattctcctg

SEQ ID NO: 709623 - DNA, 22 bp, Artificial Sequence
  chemically synthesized
cacctctcagattcaagtgatt

SEQ ID NO: 709624 - DNA, 22 bp, Artificial Sequence
  chemically synthesized
agacaggagaatcacttgaatc

SEQ ID NO: 709625 - DNA, 22 bp, Artificial Sequence
  chemically synthesized
caacctccacctctcagattca

SEQ ID NO: 709626 - DNA, 22 bp, Artificial Sequence
  chemically synthesized
ggcgcactgcaacctccacctc

SEQ ID NO: 709627 - DNA, 22 bp, Artificial Sequence
  chemically synthesized
gaatctgagaggtggaggttgc

SEQ ID NO: 709628 - DNA, 22 bp, Artificial Sequence
  chemically synthesized
aatctgagaggtggaggttgca

SEQ ID NO: 709629 - DNA, 22 bp, Artificial Sequence
  chemically synthesized
agaggtggaggttgcagtgcgc

SEQ ID NO: 709630 - DNA, 22 bp, Artificial Sequence
  chemically synthesized
gagtgtagtgacacgatctcgg

SEQ ID NO: 709631 - DNA, 22 bp, Artificial Sequence
  chemically synthesized
cagtgcgccgagatcgtgtcac

SEQ ID NO: 709632 - DNA, 22 bp, Artificial Sequence
  chemically synthesized
ggctggagtgtagtgacacgat

SEQ ID NO: 709633 - DNA, 22 bp, Artificial Sequence
  chemically synthesized
cctaggctggagtgtagtgaca

SEQ ID NO: 709634 - DNA, 22 bp, Artificial Sequence
  chemically synthesized
ttacctaggctggagtgtagtg

SEQ ID NO: 709635 - DNA, 22 bp, Artificial Sequence
  chemically synthesized
tgttacctaggctggagtgtag

SEQ ID NO: 709636 - DNA, 22 bp, Artificial Sequence
  chemically synthesized
ttctgttacctaggctggagtg

SEQ ID NO: 709637 - DNA, 22 bp, Artificial Sequence
  chemically synthesized
gttctgttacctaggctggagt

SEQ ID NO: 709638 - DNA, 22 bp, Artificial Sequence
  chemically synthesized
cactccagcctaggtaacagaa

SEQ ID NO: 709639 - DNA, 22 bp, Artificial Sequence
  chemically synthesized
agatggagtcttgttctgttac

SEQ ID NO: 709640 - DNA, 22 bp, Artificial Sequence
  chemically synthesized
gagatggagtcttgttctgtta

SEQ ID NO: 709641 - DNA, 22 bp, Artificial Sequence
  chemically synthesized
tgagatggagtcttgttctgtt

SEQ ID NO: 709642 - DNA, 22 bp, Artificial Sequence
  chemically synthesized
ttgagatggagtcttgttctgt

SEQ ID NO: 709643 - DNA, 22 bp, Artificial Sequence
  chemically synthesized
cagcctaggtaacagaacaaga

SEQ ID NO: 709644 - DNA, 22 bp, Artificial Sequence
  chemically synthesized
tttgagatggagtcttgttctg

SEQ ID NO: 709645 - DNA, 22 bp, Artificial Sequence
  chemically synthesized
ttttgagatggagtcttgttct

SEQ ID NO: 709646 - DNA, 22 bp, Artificial Sequence
  chemically synthesized
tttttgagatggagtcttgttc

SEQ ID NO: 709647 - DNA, 22 bp, Artificial Sequence
  chemically synthesized
ttttttgagatggagtcttgtt

SEQ ID NO: 709648 - DNA, 22 bp, Artificial Sequence
  chemically synthesized
tttttttgagatggagtcttgt

SEQ ID NO: 709649 - DNA, 22 bp, Artificial Sequence
  chemically synthesized
ttttttttgagatggagtcttg

SEQ ID NO: 709650 - DNA, 22 bp, Artificial Sequence
  chemically synthesized
tttttttttgagatggagtctt

SEQ ID NO: 709651 - DNA, 22 bp, Artificial Sequence
  chemically synthesized
ggtaacagaacaagactccatc

SEQ ID NO: 709652 - DNA, 22 bp, Artificial Sequence
  chemically synthesized
ttttttttttgagatggagtct

SEQ ID NO: 709653 - DNA, 22 bp, Artificial Sequence
  chemically synthesized
tttttttttttgagatggagtc

SEQ ID NO: 709654 - DNA, 22 bp, Artificial Sequence
  chemically synthesized
ttttttttttttgagatggagt

SEQ ID NO: 709655 - DNA, 22 bp, Artificial Sequence
  chemically synthesized
tttttttttttttgagatggag

SEQ ID NO: 709656 - DNA, 22 bp, Artificial Sequence
  chemically synthesized
ttttttttttttttgagatgga

SEQ ID NO: 709657 - DNA, 22 bp, Artificial Sequence
  chemically synthesized
tttttttttttttttgagatgg

SEQ ID NO: 709658 - DNA, 22 bp, Artificial Sequence
  chemically synthesized
ttttttttttttttttgagatg

SEQ ID NO: 709659 - DNA, 22 bp, Artificial Sequence
  chemically synthesized
tttttttttttttttttgagat

SEQ ID NO: 709660 - DNA, 22 bp, Artificial Sequence
  chemically synthesized
ctttttttttttttttttttga

SEQ ID NO: 709661 - DNA, 22 bp, Artificial Sequence
  chemically synthesized
gctttttttttttttttttttg

SEQ ID NO: 709662 - DNA, 22 bp, Artificial Sequence
  chemically synthesized
tgcttttttttttttttttttt

SEQ ID NO: 709663 - DNA, 22 bp, Artificial Sequence
  chemically synthesized
ttgctttttttttttttttttt

SEQ ID NO: 709664 - DNA, 22 bp, Artificial Sequence
  chemically synthesized
tttgcttttttttttttttttt

SEQ ID NO: 709665 - DNA, 22 bp, Artificial Sequence
  chemically synthesized
ttttgctttttttttttttttt

SEQ ID NO: 709666 - DNA, 22 bp, Artificial Sequence
  chemically synthesized
catctcaaaaaaaaaaaaaaaa

SEQ ID NO: 709667 - DNA, 22 bp, Artificial Sequence
  chemically synthesized
cttttttgcttttttttttttt

SEQ ID NO: 709668 - DNA, 22 bp, Artificial Sequence
  chemically synthesized
tccttttttgcttttttttttt

SEQ ID NO: 709669 - DNA, 22 bp, Artificial Sequence
  chemically synthesized
ctctccttttttgctttttttt

SEQ ID NO: 709670 - DNA, 22 bp, Artificial Sequence
  chemically synthesized
aaaaaaaaaaaaaaaaaaagca

SEQ ID NO: 709671 - DNA, 22 bp, Artificial Sequence
  chemically synthesized
ttgctctccttttttgcttttt

SEQ ID NO: 709672 - DNA, 22 bp, Artificial Sequence
  chemically synthesized
tagtctattgctctcctttttt

SEQ ID NO: 709673 - DNA, 22 bp, Artificial Sequence
  chemically synthesized
cacattatagtctattgctctc

SEQ ID NO: 709674 - DNA, 22 bp, Artificial Sequence
  chemically synthesized
tatgtggtgccctgcacattat

SEQ ID NO: 709675 - DNA, 22 bp, Artificial Sequence
  chemically synthesized
tattgtatgtggtgccctgcac

SEQ ID NO: 709676 - DNA, 22 bp, Artificial Sequence
  chemically synthesized
gtattgtatgtggtgccctgca

SEQ ID NO: 709677 - DNA, 22 bp, Artificial Sequence
  chemically synthesized
tgtattgtatgtggtgccctgc

SEQ ID NO: 709678 - DNA, 22 bp, Artificial Sequence
  chemically synthesized
ttgtattgtatgtggtgccctg

SEQ ID NO: 709679 - DNA, 22 bp, Artificial Sequence
  chemically synthesized
taatgtgcagggcaccacatac

SEQ ID NO: 709680 - DNA, 22 bp, Artificial Sequence
  chemically synthesized
gccatttttgtattgtatgtgg

SEQ ID NO: 709681 - DNA, 22 bp, Artificial Sequence
  chemically synthesized
ataaacattagccatttttgta

SEQ ID NO: 709682 - DNA, 22 bp, Artificial Sequence
  chemically synthesized
aataaacattagccatttttgt

SEQ ID NO: 709683 - DNA, 22 bp, Artificial Sequence
  chemically synthesized
cttaataaacattagccatttt

SEQ ID NO: 709684 - DNA, 22 bp, Artificial Sequence
  chemically synthesized
tcatgccacatattgcttaata

SEQ ID NO: 709685 - DNA, 22 bp, Artificial Sequence
  chemically synthesized
atattgtcatgccacatattgc

SEQ ID NO: 709686 - DNA, 22 bp, Artificial Sequence
  chemically synthesized
atgtttattaagcaatatgtgg

SEQ ID NO: 709687 - DNA, 22 bp, Artificial Sequence
  chemically synthesized
attaagcaatatgtggcatgac

SEQ ID NO: 709688 - DNA, 22 bp, Artificial Sequence
  chemically synthesized
ttaagcaatatgtggcatgaca

SEQ ID NO: 709689 - DNA, 22 bp, Artificial Sequence
  chemically synthesized
agcaatatgtggcatgacaata

SEQ ID NO: 709690 - DNA, 22 bp, Artificial Sequence
  chemically synthesized
tgaagatgaaataacataattc

SEQ ID NO: 709691 - DNA, 22 bp, Artificial Sequence
  chemically synthesized
ctgtgaagatgaaataacataa

SEQ ID NO: 709692 - DNA, 22 bp, Artificial Sequence
  chemically synthesized
cagagttactgtgaagatgaaa

SEQ ID NO: 709693 - DNA, 22 bp, Artificial Sequence
  chemically synthesized
ttgcagagttactgtgaagatg

SEQ ID NO: 709694 - DNA, 22 bp, Artificial Sequence
  chemically synthesized
ctattgcagagttactgtgaag

SEQ ID NO: 709695 - DNA, 22 bp, Artificial Sequence
  chemically synthesized
tgttatttcatcttcacagtaa

SEQ ID NO: 709696 - DNA, 22 bp, Artificial Sequence
  chemically synthesized
actcctattgcagagttactgt

SEQ ID NO: 709697 - DNA, 22 bp, Artificial Sequence
  chemically synthesized
tttcatcttcacagtaactctg

SEQ ID NO: 709698 - DNA, 22 bp, Artificial Sequence
  chemically synthesized
catcttcacagtaactctgcaa

SEQ ID NO: 709699 - DNA, 22 bp, Artificial Sequence
  chemically synthesized
atcttcacagtaactctgcaat

SEQ ID NO: 709700 - DNA, 22 bp, Artificial Sequence
  chemically synthesized
cacagtaactctgcaataggag

SEQ ID NO: 709701 - DNA, 22 bp, Artificial Sequence
  chemically synthesized
acagtaactctgcaataggagt

SEQ ID NO: 709702 - DNA, 22 bp, Artificial Sequence
  chemically synthesized
tgcaataggagttaatattatt

SEQ ID NO: 709703 - DNA, 22 bp, Artificial Sequence
  chemically synthesized
caataggagttaatattattcc

SEQ ID NO: 709704 - DNA, 22 bp, Artificial Sequence
  chemically synthesized
tgtcaatgaagtcggggggaat

SEQ ID NO: 709705 - DNA, 22 bp, Artificial Sequence
  chemically synthesized
atgtcaatgaagtcggggggaa

SEQ ID NO: 709706 - DNA, 22 bp, Artificial Sequence
  chemically synthesized
tatgtcaatgaagtcgggggga

SEQ ID NO: 709707 - DNA, 22 bp, Artificial Sequence
  chemically synthesized
ttatgtcaatgaagtcgggggg

SEQ ID NO: 709708 - DNA, 22 bp, Artificial Sequence
  chemically synthesized
atattattccccccgacttcat

SEQ ID NO: 709709 - DNA, 22 bp, Artificial Sequence
  chemically synthesized
agtttttatgtcaatgaagtcg

SEQ ID NO: 709710 - DNA, 22 bp, Artificial Sequence
  chemically synthesized
ttccccccgacttcattgacat

SEQ ID NO: 709711 - DNA, 22 bp, Artificial Sequence
  chemically synthesized
atgcctcagtttttatgtcaat

SEQ ID NO: 709712 - DNA, 22 bp, Artificial Sequence
  chemically synthesized
cccccgacttcattgacataaa

SEQ ID NO: 709713 - DNA, 22 bp, Artificial Sequence
  chemically synthesized
tcatgcctcagtttttatgtca

SEQ ID NO: 709714 - DNA, 22 bp, Artificial Sequence
  chemically synthesized
acctctcatgcctcagttttta

SEQ ID NO: 709715 - DNA, 22 bp, Artificial Sequence
  chemically synthesized
aacctctcatgcctcagttttt

SEQ ID NO: 709716 - DNA, 22 bp, Artificial Sequence
  chemically synthesized
taacctctcatgcctcagtttt

SEQ ID NO: 709717 - DNA, 22 bp, Artificial Sequence
  chemically synthesized
ttaacctctcatgcctcagttt

SEQ ID NO: 709718 - DNA, 22 bp, Artificial Sequence
  chemically synthesized
cattgacataaaaactgaggca

SEQ ID NO: 709719 - DNA, 22 bp, Artificial Sequence
  chemically synthesized
tttaacctctcatgcctcagtt

SEQ ID NO: 709720 - DNA, 22 bp, Artificial Sequence
  chemically synthesized
attgacataaaaactgaggcat

SEQ ID NO: 709721 - DNA, 22 bp, Artificial Sequence
  chemically synthesized
ttttaacctctcatgcctcagt

SEQ ID NO: 709722 - DNA, 22 bp, Artificial Sequence
  chemically synthesized
tttttaacctctcatgcctcag

SEQ ID NO: 709723 - DNA, 22 bp, Artificial Sequence
  chemically synthesized
ttttttaacctctcatgcctca

SEQ ID NO: 709724 - DNA, 22 bp, Artificial Sequence
  chemically synthesized
tttttttaacctctcatgcctc

SEQ ID NO: 709725 - DNA, 22 bp, Artificial Sequence
  chemically synthesized
acataaaaactgaggcatgaga

SEQ ID NO: 709726 - DNA, 22 bp, Artificial Sequence
  chemically synthesized
ttttttttaacctctcatgcct

SEQ ID NO: 709727 - DNA, 22 bp, Artificial Sequence
  chemically synthesized
tttttttttaacctctcatgcc

SEQ ID NO: 709728 - DNA, 22 bp, Artificial Sequence
  chemically synthesized
ggcaagttttttttttttaacc

SEQ ID NO: 709729 - DNA, 22 bp, Artificial Sequence
  chemically synthesized
aggcaagttttttttttttaac

SEQ ID NO: 709730 - DNA, 22 bp, Artificial Sequence
  chemically synthesized
aggcatgagaggttaaaaaaaa

SEQ ID NO: 709731 - DNA, 22 bp, Artificial Sequence
  chemically synthesized
aagcttaggcaagttttttttt

SEQ ID NO: 709732 - DNA, 22 bp, Artificial Sequence
  chemically synthesized
ctgaagcttaggcaagtttttt

SEQ ID NO: 709733 - DNA, 22 bp, Artificial Sequence
  chemically synthesized
actactgaagcttaggcaagtt

SEQ ID NO: 709734 - DNA, 22 bp, Artificial Sequence
  chemically synthesized
aaaaaaaaaaacttgcctaagc

SEQ ID NO: 709735 - DNA, 22 bp, Artificial Sequence
  chemically synthesized
ctaactactgaagcttaggcaa

SEQ ID NO: 709736 - DNA, 22 bp, Artificial Sequence
  chemically synthesized
actaactactgaagcttaggca

SEQ ID NO: 709737 - DNA, 22 bp, Artificial Sequence
  chemically synthesized
ccaatttactaactactgaagc

SEQ ID NO: 709738 - DNA, 22 bp, Artificial Sequence
  chemically synthesized
tgccaatttactaactactgaa

SEQ ID NO: 709739 - DNA, 22 bp, Artificial Sequence
  chemically synthesized
gcctaagcttcagtagttagta

SEQ ID NO: 709740 - DNA, 22 bp, Artificial Sequence
  chemically synthesized
gctctgccaatttactaactac

SEQ ID NO: 709741 - DNA, 22 bp, Artificial Sequence
  chemically synthesized
cctaagcttcagtagttagtaa

SEQ ID NO: 709742 - DNA, 22 bp, Artificial Sequence
  chemically synthesized
agcttcagtagttagtaaattg

SEQ ID NO: 709743 - DNA, 22 bp, Artificial Sequence
  chemically synthesized
aatcctagctctgccaatttac

SEQ ID NO: 709744 - DNA, 22 bp, Artificial Sequence
  chemically synthesized
gaatcctagctctgccaattta

SEQ ID NO: 709745 - DNA, 22 bp, Artificial Sequence
  chemically synthesized
cagtagttagtaaattggcaga

SEQ ID NO: 709746 - DNA, 22 bp, Artificial Sequence
  chemically synthesized
agtagttagtaaattggcagag

SEQ ID NO: 709747 - DNA, 22 bp, Artificial Sequence
  chemically synthesized
aatgagtttgaatcctagctct

SEQ ID NO: 709748 - DNA, 22 bp, Artificial Sequence
  chemically synthesized
gtaaattggcagagctaggatt

SEQ ID NO: 709749 - DNA, 22 bp, Artificial Sequence
  chemically synthesized
gcagagctaggattcaaactca

SEQ ID NO: 709750 - DNA, 22 bp, Artificial Sequence
  chemically synthesized
agagcaagacccagactgaatg

SEQ ID NO: 709751 - DNA, 22 bp, Artificial Sequence
  chemically synthesized
ggattcaaactcattcagtctg

SEQ ID NO: 709752 - DNA, 22 bp, Artificial Sequence
  chemically synthesized
aaactcattcagtctgggtctt

SEQ ID NO: 709753 - DNA, 22 bp, Artificial Sequence
  chemically synthesized
attcagtctgggtcttgctctt

SEQ ID NO: 709754 - DNA, 22 bp, Artificial Sequence
  chemically synthesized
aggatagcagttaagagcaaga

SEQ ID NO: 709755 - DNA, 22 bp, Artificial Sequence
  chemically synthesized
caggatagcagttaagagcaag

SEQ ID NO: 709756 - DNA, 22 bp, Artificial Sequence
  chemically synthesized
agtctgggtcttgctcttaact

SEQ ID NO: 709757 - DNA, 22 bp, Artificial Sequence
  chemically synthesized
atcttcaggatagcagttaaga

SEQ ID NO: 709758 - DNA, 22 bp, Artificial Sequence
  chemically synthesized
aatcttcaggatagcagttaag

SEQ ID NO: 709759 - DNA, 22 bp, Artificial Sequence
  chemically synthesized
taatcttcaggatagcagttaa

SEQ ID NO: 709760 - DNA, 22 bp, Artificial Sequence
  chemically synthesized
ggtcttgctcttaactgctatc

SEQ ID NO: 709761 - DNA, 22 bp, Artificial Sequence
  chemically synthesized
aactttaatcttcaggatagca

SEQ ID NO: 709762 - DNA, 22 bp, Artificial Sequence
  chemically synthesized
caactttaatcttcaggatagc

SEQ ID NO: 709763 - DNA, 22 bp, Artificial Sequence
  chemically synthesized
tcaactttaatcttcaggatag

SEQ ID NO: 709764 - DNA, 22 bp, Artificial Sequence
  chemically synthesized
gctcttaactgctatcctgaag

SEQ ID NO: 709765 - DNA, 22 bp, Artificial Sequence
  chemically synthesized
ttcaactttaatcttcaggata

SEQ ID NO: 709766 - DNA, 22 bp, Artificial Sequence
  chemically synthesized
ctcttaactgctatcctgaaga

SEQ ID NO: 709767 - DNA, 22 bp, Artificial Sequence
  chemically synthesized
tttcaactttaatcttcaggat

SEQ ID NO: 709768 - DNA, 22 bp, Artificial Sequence
  chemically synthesized
ttttcaactttaatcttcagga

SEQ ID NO: 709769 - DNA, 22 bp, Artificial Sequence
  chemically synthesized
tttttcaactttaatcttcagg

SEQ ID NO: 709770 - DNA, 22 bp, Artificial Sequence
  chemically synthesized
ttaactgctatcctgaagatta

SEQ ID NO: 709771 - DNA, 22 bp, Artificial Sequence
  chemically synthesized
aactgctatcctgaagattaaa

SEQ ID NO: 709772 - DNA, 22 bp, Artificial Sequence
  chemically synthesized
actgctatcctgaagattaaag

SEQ ID NO: 709773 - DNA, 22 bp, Artificial Sequence
  chemically synthesized
ctatcctgaagattaaagttga

SEQ ID NO: 709774 - DNA, 22 bp, Artificial Sequence
  chemically synthesized
taaaatactttttttcaacttt

SEQ ID NO: 709775 - DNA, 22 bp, Artificial Sequence
  chemically synthesized
tcctgaagattaaagttgaaaa

SEQ ID NO: 709776 - DNA, 22 bp, Artificial Sequence
  chemically synthesized
ataaaatactttttttcaactt

SEQ ID NO: 709777 - DNA, 22 bp, Artificial Sequence
  chemically synthesized
aagattaaagttgaaaaaaagt

SEQ ID NO: 709778 - DNA, 22 bp, Artificial Sequence
  chemically synthesized
aatatttataaaatactttttt

SEQ ID NO: 709779 - DNA, 22 bp, Artificial Sequence
  chemically synthesized
ttaaatatttataaaatacttt

SEQ ID NO: 709780 - DNA, 22 bp, Artificial Sequence
  chemically synthesized
attaaatatttataaaatactt

SEQ ID NO: 709781 - DNA, 22 bp, Artificial Sequence
  chemically synthesized
aagttgaaaaaaagtattttat

SEQ ID NO: 709782 - DNA, 22 bp, Artificial Sequence
  chemically synthesized
cttattaaatatttataaaata

SEQ ID NO: 709783 - DNA, 22 bp, Artificial Sequence
  chemically synthesized
aaaaaaagtattttataaatat

SEQ ID NO: 709784 - DNA, 22 bp, Artificial Sequence
  chemically synthesized
aaaagccaattacttattaaat

SEQ ID NO: 709785 - DNA, 22 bp, Artificial Sequence
  chemically synthesized
tataaatatttaataagtaatt

SEQ ID NO: 709786 - DNA, 22 bp, Artificial Sequence
  chemically synthesized
ataaatatttaataagtaattg

SEQ ID NO: 709787 - DNA, 22 bp, Artificial Sequence
  chemically synthesized
taaatatttaataagtaattgg

SEQ ID NO: 709788 - DNA, 22 bp, Artificial Sequence
  chemically synthesized
aagaaattaaaaagccaattac

SEQ ID NO: 709789 - DNA, 22 bp, Artificial Sequence
  chemically synthesized
attaaagaaattaaaaagccaa

SEQ ID NO: 709790 - DNA, 22 bp, Artificial Sequence
  chemically synthesized
aataagtaattggctttttaat

SEQ ID NO: 709791 - DNA, 22 bp, Artificial Sequence
  chemically synthesized
ataagtaattggctttttaatt

SEQ ID NO: 709792 - DNA, 22 bp, Artificial Sequence
  chemically synthesized
aataaactgattaaagaaatta

SEQ ID NO: 709793 - DNA, 22 bp, Artificial Sequence
  chemically synthesized
cattcaataaactgattaaaga

SEQ ID NO: 709794 - DNA, 22 bp, Artificial Sequence
  chemically synthesized
gctttttaatttctttaatcag

SEQ ID NO: 709795 - DNA, 22 bp, Artificial Sequence
  chemically synthesized
tttaatttctttaatcagttta

SEQ ID NO: 709796 - DNA, 22 bp, Artificial Sequence
  chemically synthesized
gtctgcattcaataaactgatt

SEQ ID NO: 709797 - DNA, 22 bp, Artificial Sequence
  chemically synthesized
ttaatttctttaatcagtttat

SEQ ID NO: 709798 - DNA, 22 bp, Artificial Sequence
  chemically synthesized
taatttctttaatcagtttatt

SEQ ID NO: 709799 - DNA, 22 bp, Artificial Sequence
  chemically synthesized
aatttctttaatcagtttattg

SEQ ID NO: 709800 - DNA, 22 bp, Artificial Sequence
  chemically synthesized
atttctttaatcagtttattga

SEQ ID NO: 709801 - DNA, 22 bp, Artificial Sequence
  chemically synthesized
gaattggtctgcattcaataaa

SEQ ID NO: 709802 - DNA, 22 bp, Artificial Sequence
  chemically synthesized
ctttaatcagtttattgaatgc

SEQ ID NO: 709803 - DNA, 22 bp, Artificial Sequence
  chemically synthesized
tttaatcagtttattgaatgca

SEQ ID NO: 709804 - DNA, 22 bp, Artificial Sequence
  chemically synthesized
taatcagtttattgaatgcaga

SEQ ID NO: 709805 - DNA, 22 bp, Artificial Sequence
  chemically synthesized
aatcagtttattgaatgcagac

SEQ ID NO: 709806 - DNA, 22 bp, Artificial Sequence
  chemically synthesized
atcagtttattgaatgcagacc

SEQ ID NO: 709807 - DNA, 22 bp, Artificial Sequence
  chemically synthesized
attgaatgcagaccaattctag

SEQ ID NO: 709808 - DNA, 22 bp, Artificial Sequence
  chemically synthesized
ttgaatgcagaccaattctagt

SEQ ID NO: 709809 - DNA, 22 bp, Artificial Sequence
  chemically synthesized
atcgatatgcacactagaattg

SEQ ID NO: 709810 - DNA, 22 bp, Artificial Sequence
  chemically synthesized
catcgatatgcacactagaatt

SEQ ID NO: 709811 - DNA, 22 bp, Artificial Sequence
  chemically synthesized
aatgcagaccaattctagtgtg

SEQ ID NO: 709812 - DNA, 22 bp, Artificial Sequence
  chemically synthesized
cagtttcatcgatatgcacact

SEQ ID NO: 709813 - DNA, 22 bp, Artificial Sequence
  chemically synthesized
aacaactgcagtttcatcgata

SEQ ID NO: 709814 - DNA, 22 bp, Artificial Sequence
  chemically synthesized
tagtgtgcatatcgatgaaact

SEQ ID NO: 709815 - DNA, 22 bp, Artificial Sequence
  chemically synthesized
gtgtgcatatcgatgaaactgc

SEQ ID NO: 709816 - DNA, 22 bp, Artificial Sequence
  chemically synthesized
ggccataaaatacgttgaacaa

SEQ ID NO: 709817 - DNA, 22 bp, Artificial Sequence
  chemically synthesized
cattgggccataaaatacgttg

SEQ ID NO: 709818 - DNA, 22 bp, Artificial Sequence
  chemically synthesized
gcattgggccataaaatacgtt

SEQ ID NO: 709819 - DNA, 22 bp, Artificial Sequence
  chemically synthesized
cagttgttcaacgtattttatg

SEQ ID NO: 709820 - DNA, 22 bp, Artificial Sequence
  chemically synthesized
accttgcattgggccataaaat

SEQ ID NO: 709821 - DNA, 22 bp, Artificial Sequence
  chemically synthesized
ttcaacgtattttatggcccaa

SEQ ID NO: 709822 - DNA, 22 bp, Artificial Sequence
  chemically synthesized
aacgtattttatggcccaatgc

SEQ ID NO: 709823 - DNA, 22 bp, Artificial Sequence
  chemically synthesized
aagaccaggaattgaccttgca

SEQ ID NO: 709824 - DNA, 22 bp, Artificial Sequence
  chemically synthesized
caagaccaggaattgaccttgc

SEQ ID NO: 709825 - DNA, 22 bp, Artificial Sequence
  chemically synthesized
tatggcccaatgcaaggtcaat

SEQ ID NO: 709826 - DNA, 22 bp, Artificial Sequence
  chemically synthesized
atggcccaatgcaaggtcaatt

SEQ ID NO: 709827 - DNA, 22 bp, Artificial Sequence
  chemically synthesized
ttcaagaccaggaattgacctt

SEQ ID NO: 709828 - DNA, 22 bp, Artificial Sequence
  chemically synthesized
tggcccaatgcaaggtcaattc

SEQ ID NO: 709829 - DNA, 22 bp, Artificial Sequence
  chemically synthesized
tggtatcacattcttcaagacc

SEQ ID NO: 709830 - DNA, 22 bp, Artificial Sequence
  chemically synthesized
atggtatcacattcttcaagac

SEQ ID NO: 709831 - DNA, 22 bp, Artificial Sequence
  chemically synthesized
taatcttatggtatcacattct

SEQ ID NO: 709832 - DNA, 22 bp, Artificial Sequence
  chemically synthesized
ctggtcttgaagaatgtgatac

SEQ ID NO: 709833 - DNA, 22 bp, Artificial Sequence
  chemically synthesized
tataatcttatggtatcacatt

SEQ ID NO: 709834 - DNA, 22 bp, Artificial Sequence
  chemically synthesized
tctataatcttatggtatcaca

SEQ ID NO: 709835 - DNA, 22 bp, Artificial Sequence
  chemically synthesized
gtcttgaagaatgtgataccat

SEQ ID NO: 709836 - DNA, 22 bp, Artificial Sequence
  chemically synthesized
ctctataatcttatggtatcac

SEQ ID NO: 709837 - DNA, 22 bp, Artificial Sequence
  chemically synthesized
tctctataatcttatggtatca

SEQ ID NO: 709838 - DNA, 22 bp, Artificial Sequence
  chemically synthesized
gaagaatgtgataccataagat

SEQ ID NO: 709839 - DNA, 22 bp, Artificial Sequence
  chemically synthesized
aagaatgtgataccataagatt

SEQ ID NO: 709840 - DNA, 22 bp, Artificial Sequence
  chemically synthesized
ccacaacctttctctataatct

SEQ ID NO: 709841 - DNA, 22 bp, Artificial Sequence
  chemically synthesized
cccacaacctttctctataatc

SEQ ID NO: 709842 - DNA, 22 bp, Artificial Sequence
  chemically synthesized
tcccacaacctttctctataat

SEQ ID NO: 709843 - DNA, 22 bp, Artificial Sequence
  chemically synthesized
cacgcgttttcccacaaccttt

SEQ ID NO: 709844 - DNA, 22 bp, Artificial Sequence
  chemically synthesized
gcacgcgttttcccacaacctt

SEQ ID NO: 709845 - DNA, 22 bp, Artificial Sequence
  chemically synthesized
tttgcacgcgttttcccacaac

SEQ ID NO: 709846 - DNA, 22 bp, Artificial Sequence
  chemically synthesized
atttgcacgcgttttcccacaa

SEQ ID NO: 709847 - DNA, 22 bp, Artificial Sequence
  chemically synthesized
tagagaaaggttgtgggaaaac

SEQ ID NO: 709848 - DNA, 22 bp, Artificial Sequence
  chemically synthesized
tgggaaaacgcgtgcaaataaa

SEQ ID NO: 709849 - DNA, 22 bp, Artificial Sequence
  chemically synthesized
gaaataatgacatatgcccaac

SEQ ID NO: 709850 - DNA, 22 bp, Artificial Sequence
  chemically synthesized
agaaataatgacatatgcccaa

SEQ ID NO: 709851 - DNA, 22 bp, Artificial Sequence
  chemically synthesized
aatttagaaataatgacatatg

SEQ ID NO: 709852 - DNA, 22 bp, Artificial Sequence
  chemically synthesized
taaatttagaaataatgacata

SEQ ID NO: 709853 - DNA, 22 bp, Artificial Sequence
  chemically synthesized
ggcatatgtcattatttctaaa

SEQ ID NO: 709854 - DNA, 22 bp, Artificial Sequence
  chemically synthesized
atgaaatgacccattctaaatt

SEQ ID NO: 709855 - DNA, 22 bp, Artificial Sequence
  chemically synthesized
ttcatgaaatgacccattctaa

SEQ ID NO: 709856 - DNA, 22 bp, Artificial Sequence
  chemically synthesized
attcatgaaatgacccattcta

SEQ ID NO: 709857 - DNA, 22 bp, Artificial Sequence
  chemically synthesized
tttctaaatttagaatgggtca

SEQ ID NO: 709858 - DNA, 22 bp, Artificial Sequence
  chemically synthesized
atttattcatgaaatgacccat

SEQ ID NO: 709859 - DNA, 22 bp, Artificial Sequence
  chemically synthesized
ctaaatttagaatgggtcattt

SEQ ID NO: 709860 - DNA, 22 bp, Artificial Sequence
  chemically synthesized
taaatttagaatgggtcatttc

SEQ ID NO: 709861 - DNA, 22 bp, Artificial Sequence
  chemically synthesized
aatttagaatgggtcatttcat

SEQ ID NO: 709862 - DNA, 22 bp, Artificial Sequence
  chemically synthesized
gattgatttattcatgaaatga

SEQ ID NO: 709863 - DNA, 22 bp, Artificial Sequence
  chemically synthesized
tagattgatttattcatgaaat

SEQ ID NO: 709864 - DNA, 22 bp, Artificial Sequence
  chemically synthesized
agaatgggtcatttcatgaata

SEQ ID NO: 709865 - DNA, 22 bp, Artificial Sequence
  chemically synthesized
gaatgggtcatttcatgaataa

SEQ ID NO: 709866 - DNA, 22 bp, Artificial Sequence
  chemically synthesized
tctctagattgatttattcatg

SEQ ID NO: 709867 - DNA, 22 bp, Artificial Sequence
  chemically synthesized
atctctagattgatttattcat

SEQ ID NO: 709868 - DNA, 22 bp, Artificial Sequence
  chemically synthesized
acatttatctctagattgattt

SEQ ID NO: 709869 - DNA, 22 bp, Artificial Sequence
  chemically synthesized
catgaataaatcaatctagaga

SEQ ID NO: 709870 - DNA, 22 bp, Artificial Sequence
  chemically synthesized
atgaataaatcaatctagagat

SEQ ID NO: 709871 - DNA, 22 bp, Artificial Sequence
  chemically synthesized
cccccaaacactcacatttatc

SEQ ID NO: 709872 - DNA, 22 bp, Artificial Sequence
  chemically synthesized
tacccccaaacactcacattta

SEQ ID NO: 709873 - DNA, 22 bp, Artificial Sequence
  chemically synthesized
tctacccccaaacactcacatt

SEQ ID NO: 709874 - DNA, 22 bp, Artificial Sequence
  chemically synthesized
ctctctacccccaaacactcac

SEQ ID NO: 709875 - DNA, 22 bp, Artificial Sequence
  chemically synthesized
tcctctctacccccaaacactc

SEQ ID NO: 709876 - DNA, 22 bp, Artificial Sequence
  chemically synthesized
gagataaatgtgagtgtttggg

SEQ ID NO: 709877 - DNA, 22 bp, Artificial Sequence
  chemically synthesized
ctcctctctacccccaaacact

SEQ ID NO: 709878 - DNA, 22 bp, Artificial Sequence
  chemically synthesized
atcttctcctctctacccccaa

SEQ ID NO: 709879 - DNA, 22 bp, Artificial Sequence
  chemically synthesized
catcttctcctctctaccccca

SEQ ID NO: 709880 - DNA, 22 bp, Artificial Sequence
  chemically synthesized
gggggtagagaggagaagatga

SEQ ID NO: 709881 - DNA, 22 bp, Artificial Sequence
  chemically synthesized
ggggtagagaggagaagatgaa

SEQ ID NO: 709882 - DNA, 22 bp, Artificial Sequence
  chemically synthesized
ccatatggcatcttcatcttct

SEQ ID NO: 709883 - DNA, 22 bp, Artificial Sequence
  chemically synthesized
atcagtgtccactcccatatgg

SEQ ID NO: 709884 - DNA, 22 bp, Artificial Sequence
  chemically synthesized
tgatcagtgtccactcccatat

SEQ ID NO: 709885 - DNA, 22 bp, Artificial Sequence
  chemically synthesized
ctgatcagtgtccactcccata

SEQ ID NO: 709886 - DNA, 22 bp, Artificial Sequence
  chemically synthesized
agtatgtgcaaagatttctgat

SEQ ID NO: 709887 - DNA, 22 bp, Artificial Sequence
  chemically synthesized
tcagtatgtgcaaagatttctg

SEQ ID NO: 709888 - DNA, 22 bp, Artificial Sequence
  chemically synthesized
ctcagtatgtgcaaagatttct

SEQ ID NO: 709889 - DNA, 22 bp, Artificial Sequence
  chemically synthesized
tctcagtatgtgcaaagatttc

SEQ ID NO: 709890 - DNA, 22 bp, Artificial Sequence
  chemically synthesized
tttctcagtatgtgcaaagatt

SEQ ID NO: 709891 - DNA, 22 bp, Artificial Sequence
  chemically synthesized
ctttctcagtatgtgcaaagat

SEQ ID NO: 709892 - DNA, 22 bp, Artificial Sequence
  chemically synthesized
atcagaaatctttgcacatact

SEQ ID NO: 709893 - DNA, 22 bp, Artificial Sequence
  chemically synthesized
ggatttctttctcagtatgtgc

SEQ ID NO: 709894 - DNA, 22 bp, Artificial Sequence
  chemically synthesized
gggatttctttctcagtatgtg

SEQ ID NO: 709895 - DNA, 22 bp, Artificial Sequence
  chemically synthesized
cccttgggatttctttctcagt

SEQ ID NO: 709896 - DNA, 22 bp, Artificial Sequence
  chemically synthesized
ccccttgggatttctttctcag

SEQ ID NO: 709897 - DNA, 22 bp, Artificial Sequence
  chemically synthesized
tgcacatactgagaaagaaatc

SEQ ID NO: 709898 - DNA, 22 bp, Artificial Sequence
  chemically synthesized
gcacatactgagaaagaaatcc

SEQ ID NO: 709899 - DNA, 22 bp, Artificial Sequence
  chemically synthesized
cacatactgagaaagaaatccc

SEQ ID NO: 709900 - DNA, 22 bp, Artificial Sequence
  chemically synthesized
catcttccccttgggatttctt

SEQ ID NO: 709901 - DNA, 22 bp, Artificial Sequence
  chemically synthesized
ccatctacatcttccccttggg

SEQ ID NO: 709902 - DNA, 22 bp, Artificial Sequence
  chemically synthesized
accatctacatcttccccttgg

SEQ ID NO: 709903 - DNA, 22 bp, Artificial Sequence
  chemically synthesized
agaaagaaatcccaaggggaag

SEQ ID NO: 709904 - DNA, 22 bp, Artificial Sequence
  chemically synthesized
taccatctacatcttccccttg

SEQ ID NO: 709905 - DNA, 22 bp, Artificial Sequence
  chemically synthesized
tggcacagtcataatcctttac

SEQ ID NO: 709906 - DNA, 22 bp, Artificial Sequence
  chemically synthesized
gagaaagtggcctatggcacag

SEQ ID NO: 709907 - DNA, 22 bp, Artificial Sequence
  chemically synthesized
ctagagaaagtggcctatggca

SEQ ID NO: 709908 - DNA, 22 bp, Artificial Sequence
  chemically synthesized
actagagaaagtggcctatggc

SEQ ID NO: 709909 - DNA, 22 bp, Artificial Sequence
  chemically synthesized
ttactagagaaagtggcctatg

SEQ ID NO: 709910 - DNA, 22 bp, Artificial Sequence
  chemically synthesized
tgactgtgccataggccacttt

SEQ ID NO: 709911 - DNA, 22 bp, Artificial Sequence
  chemically synthesized
acattcttactagagaaagtgg

SEQ ID NO: 709912 - DNA, 22 bp, Artificial Sequence
  chemically synthesized
tgccataggccactttctctag

SEQ ID NO: 709913 - DNA, 22 bp, Artificial Sequence
  chemically synthesized
tgaaactaacattcttactaga

SEQ ID NO: 709914 - DNA, 22 bp, Artificial Sequence
  chemically synthesized
agtccctatgaaactaacattc

SEQ ID NO: 709915 - DNA, 22 bp, Artificial Sequence
  chemically synthesized
tctctagtaagaatgttagttt

SEQ ID NO: 709916 - DNA, 22 bp, Artificial Sequence
  chemically synthesized
ctctagtaagaatgttagtttc

SEQ ID NO: 709917 - DNA, 22 bp, Artificial Sequence
  chemically synthesized
tctagtaagaatgttagtttca

SEQ ID NO: 709918 - DNA, 22 bp, Artificial Sequence
  chemically synthesized
tagtaagaatgttagtttcata

SEQ ID NO: 709919 - DNA, 22 bp, Artificial Sequence
  chemically synthesized
gtaagaatgttagtttcatagg

SEQ ID NO: 709920 - DNA, 22 bp, Artificial Sequence
  chemically synthesized
catcggctcagtccctatgaaa

SEQ ID NO: 709921 - DNA, 22 bp, Artificial Sequence
  chemically synthesized
atgctgcatcggctcagtccct

SEQ ID NO: 709922 - DNA, 22 bp, Artificial Sequence
  chemically synthesized
gatgctgcatcggctcagtccc

SEQ ID NO: 709923 - DNA, 22 bp, Artificial Sequence
  chemically synthesized
tgatgctgcatcggctcagtcc

SEQ ID NO: 709924 - DNA, 22 bp, Artificial Sequence
  chemically synthesized
gtttcatagggactgagccgat

SEQ ID NO: 709925 - DNA, 22 bp, Artificial Sequence
  chemically synthesized
catagggactgagccgatgcag

SEQ ID NO: 709926 - DNA, 22 bp, Artificial Sequence
  chemically synthesized
atagggactgagccgatgcagc

SEQ ID NO: 709927 - DNA, 22 bp, Artificial Sequence
  chemically synthesized
gaatgaactttgatgctgcatc

SEQ ID NO: 709928 - DNA, 22 bp, Artificial Sequence
  chemically synthesized
agccgatgcagcatcaaagttc

SEQ ID NO: 709929 - DNA, 22 bp, Artificial Sequence
  chemically synthesized
ggagtctagaatgaactttgat

SEQ ID NO: 709930 - DNA, 22 bp, Artificial Sequence
  chemically synthesized
agagagaagattgggagtctag

SEQ ID NO: 709931 - DNA, 22 bp, Artificial Sequence
  chemically synthesized
cagagagaagattgggagtcta

SEQ ID NO: 709932 - DNA, 22 bp, Artificial Sequence
  chemically synthesized
ttcagagagaagattgggagtc

SEQ ID NO: 709933 - DNA, 22 bp, Artificial Sequence
  chemically synthesized
attctagactcccaatcttctc

SEQ ID NO: 709934 - DNA, 22 bp, Artificial Sequence
  chemically synthesized
tagactcccaatcttctctctg

SEQ ID NO: 709935 - DNA, 22 bp, Artificial Sequence
  chemically synthesized
gactcccaatcttctctctgaa

SEQ ID NO: 709936 - DNA, 22 bp, Artificial Sequence
  chemically synthesized
ccaatcttctctctgaagaatt

SEQ ID NO: 709937 - DNA, 22 bp, Artificial Sequence
  chemically synthesized
tataagaaggcaaaattcttca

SEQ ID NO: 709938 - DNA, 22 bp, Artificial Sequence
  chemically synthesized
gtataagaaggcaaaattcttc

SEQ ID NO: 709939 - DNA, 22 bp, Artificial Sequence
  chemically synthesized
cttgtataagaaggcaaaattc

SEQ ID NO: 709940 - DNA, 22 bp, Artificial Sequence
  chemically synthesized
ctctctgaagaattttgccttc

SEQ ID NO: 709941 - DNA, 22 bp, Artificial Sequence
  chemically synthesized
tctctgaagaattttgccttct

SEQ ID NO: 709942 - DNA, 22 bp, Artificial Sequence
  chemically synthesized
tctgaagaattttgccttctta

SEQ ID NO: 709943 - DNA, 22 bp, Artificial Sequence
  chemically synthesized
tgaagaattttgccttcttata

SEQ ID NO: 709944 - DNA, 22 bp, Artificial Sequence
  chemically synthesized
gagcgctccttgtataagaagg

SEQ ID NO: 709945 - DNA, 22 bp, Artificial Sequence
  chemically synthesized
aagaattttgccttcttataca

SEQ ID NO: 709946 - DNA, 22 bp, Artificial Sequence
  chemically synthesized
ccactggagcgctccttgtata

SEQ ID NO: 709947 - DNA, 22 bp, Artificial Sequence
  chemically synthesized
tgccttcttatacaaggagcgc

SEQ ID NO: 709948 - DNA, 22 bp, Artificial Sequence
  chemically synthesized
gccttcttatacaaggagcgct

SEQ ID NO: 709949 - DNA, 22 bp, Artificial Sequence
  chemically synthesized
ccttcttatacaaggagcgctc

SEQ ID NO: 709950 - DNA, 22 bp, Artificial Sequence
  chemically synthesized
gaaactaccactggagcgctcc

SEQ ID NO: 709951 - DNA, 22 bp, Artificial Sequence
  chemically synthesized
cttatacaaggagcgctccagt

SEQ ID NO: 709952 - DNA, 22 bp, Artificial Sequence
  chemically synthesized
ttatacaaggagcgctccagtg

SEQ ID NO: 709953 - DNA, 22 bp, Artificial Sequence
  chemically synthesized
atacaaggagcgctccagtggt

SEQ ID NO: 709954 - DNA, 22 bp, Artificial Sequence
  chemically synthesized
tacaaggagcgctccagtggta

SEQ ID NO: 709955 - DNA, 22 bp, Artificial Sequence
  chemically synthesized
aatgtacactggaaactaccac

SEQ ID NO: 709956 - DNA, 22 bp, Artificial Sequence
  chemically synthesized
acaatattgaatgtacactgga

SEQ ID NO: 709957 - DNA, 22 bp, Artificial Sequence
  chemically synthesized
cagtggtagtttccagtgtaca

SEQ ID NO: 709958 - DNA, 22 bp, Artificial Sequence
  chemically synthesized
gacaatattgaatgtacactgg

SEQ ID NO: 709959 - DNA, 22 bp, Artificial Sequence
  chemically synthesized
aaatcttgacaatattgaatgt

SEQ ID NO: 709960 - DNA, 22 bp, Artificial Sequence
  chemically synthesized
aaaatcttgacaatattgaatg

SEQ ID NO: 709961 - DNA, 22 bp, Artificial Sequence
  chemically synthesized
taaaatcttgacaatattgaat

SEQ ID NO: 709962 - DNA, 22 bp, Artificial Sequence
  chemically synthesized
ccagtgtacattcaatattgtc

SEQ ID NO: 709963 - DNA, 22 bp, Artificial Sequence
  chemically synthesized
cagtgtacattcaatattgtca

SEQ ID NO: 709964 - DNA, 22 bp, Artificial Sequence
  chemically synthesized
attttaaaatcttgacaatatt

SEQ ID NO: 709965 - DNA, 22 bp, Artificial Sequence
  chemically synthesized
atctcattttaaaatcttgaca

SEQ ID NO: 709966 - DNA, 22 bp, Artificial Sequence
  chemically synthesized
gatctcattttaaaatcttgac

SEQ ID NO: 709967 - DNA, 22 bp, Artificial Sequence
  chemically synthesized
tgatctcattttaaaatcttga

SEQ ID NO: 709968 - DNA, 22 bp, Artificial Sequence
  chemically synthesized
actttgatctcattttaaaatc

SEQ ID NO: 709969 - DNA, 22 bp, Artificial Sequence
  chemically synthesized
aatattgtcaagattttaaaat

SEQ ID NO: 709970 - DNA, 22 bp, Artificial Sequence
  chemically synthesized
tcaagattttaaaatgagatca

SEQ ID NO: 709971 - DNA, 22 bp, Artificial Sequence
  chemically synthesized
tgaagatggaaattcactttga

SEQ ID NO: 709972 - DNA, 22 bp, Artificial Sequence
  chemically synthesized
taaaatgagatcaaagtgaatt

SEQ ID NO: 709973 - DNA, 22 bp, Artificial Sequence
  chemically synthesized
aaaatgagatcaaagtgaattt

SEQ ID NO: 709974 - DNA, 22 bp, Artificial Sequence
  chemically synthesized
aaatgagatcaaagtgaatttc

SEQ ID NO: 709975 - DNA, 22 bp, Artificial Sequence
  chemically synthesized
agttatgaagatggaaattcac

SEQ ID NO: 709976 - DNA, 22 bp, Artificial Sequence
  chemically synthesized
gagttatgaagatggaaattca

SEQ ID NO: 709977 - DNA, 22 bp, Artificial Sequence
  chemically synthesized
agtttgagttatgaagatggaa

SEQ ID NO: 709978 - DNA, 22 bp, Artificial Sequence
  chemically synthesized
aagtttgagttatgaagatgga

SEQ ID NO: 709979 - DNA, 22 bp, Artificial Sequence
  chemically synthesized
ttaagtttgagttatgaagatg

SEQ ID NO: 709980 - DNA, 22 bp, Artificial Sequence
  chemically synthesized
tcttaagtttgagttatgaaga

SEQ ID NO: 709981 - DNA, 22 bp, Artificial Sequence
  chemically synthesized
ctcttaagtttgagttatgaag

SEQ ID NO: 709982 - DNA, 22 bp, Artificial Sequence
  chemically synthesized
ccatcttcataactcaaactta

SEQ ID NO: 709983 - DNA, 22 bp, Artificial Sequence
  chemically synthesized
catcttcataactcaaacttaa

SEQ ID NO: 709984 - DNA, 22 bp, Artificial Sequence
  chemically synthesized
tcataccttctcttaagtttga

SEQ ID NO: 709985 - DNA, 22 bp, Artificial Sequence
  chemically synthesized
gctgtcataccttctcttaagt

SEQ ID NO: 709986 - DNA, 22 bp, Artificial Sequence
  chemically synthesized
cataactcaaacttaagagaag

SEQ ID NO: 709987 - DNA, 22 bp, Artificial Sequence
  chemically synthesized
tcgctgtcataccttctcttaa

SEQ ID NO: 709988 - DNA, 22 bp, Artificial Sequence
  chemically synthesized
ataactcaaacttaagagaagg

SEQ ID NO: 709989 - DNA, 22 bp, Artificial Sequence
  chemically synthesized
ctcgctgtcataccttctctta

SEQ ID NO: 709990 - DNA, 22 bp, Artificial Sequence
  chemically synthesized
ttctcgctgtcataccttctct

SEQ ID NO: 709991 - DNA, 22 bp, Artificial Sequence
  chemically synthesized
attcttctcgctgtcatacctt

SEQ ID NO: 709992 - DNA, 22 bp, Artificial Sequence
  chemically synthesized
aaacttaagagaaggtatgaca

SEQ ID NO: 709993 - DNA, 22 bp, Artificial Sequence
  chemically synthesized
aattcttctcgctgtcatacct

SEQ ID NO: 709994 - DNA, 22 bp, Artificial Sequence
  chemically synthesized
tgcttaattcttctcgctgtca

SEQ ID NO: 709995 - DNA, 22 bp, Artificial Sequence
  chemically synthesized
aagagaaggtatgacagcgaga

SEQ ID NO: 709996 - DNA, 22 bp, Artificial Sequence
  chemically synthesized
atgcttaattcttctcgctgtc

SEQ ID NO: 709997 - DNA, 22 bp, Artificial Sequence
  chemically synthesized
agagaaggtatgacagcgagaa

SEQ ID NO: 709998 - DNA, 22 bp, Artificial Sequence
  chemically synthesized
tatgcttaattcttctcgctgt

SEQ ID NO: 709999 - DNA, 22 bp, Artificial Sequence
  chemically synthesized
tggaaagaaatattttatgctt

SEQ ID NO: 710000 - DNA, 22 bp, Artificial Sequence
  chemically synthesized
gtggaaagaaatattttatgct

SEQ ID NO: 710001 - DNA, 22 bp, Artificial Sequence
  chemically synthesized
agcataaaatatttctttccac

SEQ ID NO: 710002 - DNA, 22 bp, Artificial Sequence
  chemically synthesized
cagtgataatttgtggaaagaa

SEQ ID NO: 710003 - DNA, 22 bp, Artificial Sequence
  chemically synthesized
tccagtgataatttgtggaaag

SEQ ID NO: 710004 - DNA, 22 bp, Artificial Sequence
  chemically synthesized
ctccagtgataatttgtggaaa

SEQ ID NO: 710005 - DNA, 22 bp, Artificial Sequence
  chemically synthesized
tctccagtgataatttgtggaa

SEQ ID NO: 710006 - DNA, 22 bp, Artificial Sequence
  chemically synthesized
ctttccacaaattatcactgga

SEQ ID NO: 710007 - DNA, 22 bp, Artificial Sequence
  chemically synthesized
tttccacaaattatcactggag

SEQ ID NO: 710008 - DNA, 22 bp, Artificial Sequence
  chemically synthesized
tccacaaattatcactggagaa

SEQ ID NO: 710009 - DNA, 22 bp, Artificial Sequence
  chemically synthesized
ccacaaattatcactggagaaa

SEQ ID NO: 710010 - DNA, 22 bp, Artificial Sequence
  chemically synthesized
cacaaattatcactggagaaag

SEQ ID NO: 710011 - DNA, 22 bp, Artificial Sequence
  chemically synthesized
aatccacacaaaacctttctcc

SEQ ID NO: 710012 - DNA, 22 bp, Artificial Sequence
  chemically synthesized
tcactggagaaaggttttgtgt

SEQ ID NO: 710013 - DNA, 22 bp, Artificial Sequence
  chemically synthesized
tgcattcaatccacacaaaacc

SEQ ID NO: 710014 - DNA, 22 bp, Artificial Sequence
  chemically synthesized
gagaaaggttttgtgtggattg

SEQ ID NO: 710015 - DNA, 22 bp, Artificial Sequence
  chemically synthesized
gccagttgtgcattcaatccac

SEQ ID NO: 710016 - DNA, 22 bp, Artificial Sequence
  chemically synthesized
agccagttgtgcattcaatcca

SEQ ID NO: 710017 - DNA, 22 bp, Artificial Sequence
  chemically synthesized
tttagccagttgtgcattcaat

SEQ ID NO: 710018 - DNA, 22 bp, Artificial Sequence
  chemically synthesized
atttagccagttgtgcattcaa

SEQ ID NO: 710019 - DNA, 22 bp, Artificial Sequence
  chemically synthesized
tatttagccagttgtgcattca

SEQ ID NO: 710020 - DNA, 22 bp, Artificial Sequence
  chemically synthesized
tttatttagccagttgtgcatt

SEQ ID NO: 710021 - DNA, 22 bp, Artificial Sequence
  chemically synthesized
tgtgtggattgaatgcacaact

SEQ ID NO: 710022 - DNA, 22 bp, Artificial Sequence
  chemically synthesized
ctttatttagccagttgtgcat

SEQ ID NO: 710023 - DNA, 22 bp, Artificial Sequence
  chemically synthesized
gtgtggattgaatgcacaactg

SEQ ID NO: 710024 - DNA, 22 bp, Artificial Sequence
  chemically synthesized
tgtggattgaatgcacaactgg

SEQ ID NO: 710025 - DNA, 22 bp, Artificial Sequence
  chemically synthesized
tttctttatttagccagttgtg

SEQ ID NO: 710026 - DNA, 22 bp, Artificial Sequence
  chemically synthesized
gtttctttatttagccagttgt

SEQ ID NO: 710027 - DNA, 22 bp, Artificial Sequence
  chemically synthesized
aatgcacaactggctaaataaa

SEQ ID NO: 710028 - DNA, 22 bp, Artificial Sequence
  chemically synthesized
ataaatttgtttctttatttag

SEQ ID NO: 710029 - DNA, 22 bp, Artificial Sequence
  chemically synthesized
attcataaatttgtttctttat

SEQ ID NO: 710030 - DNA, 22 bp, Artificial Sequence
  chemically synthesized
tcattcataaatttgtttcttt

SEQ ID NO: 710031 - DNA, 22 bp, Artificial Sequence
  chemically synthesized
ctcattcataaatttgtttctt

SEQ ID NO: 710032 - DNA, 22 bp, Artificial Sequence
  chemically synthesized
tctcattcataaatttgtttct

SEQ ID NO: 710033 - DNA, 22 bp, Artificial Sequence
  chemically synthesized
ttctcattcataaatttgtttc

SEQ ID NO: 710034 - DNA, 22 bp, Artificial Sequence
  chemically synthesized
gctaaataaagaaacaaattta

SEQ ID NO: 710035 - DNA, 22 bp, Artificial Sequence
  chemically synthesized
aataaagaaacaaatttatgaa

SEQ ID NO: 710036 - DNA, 22 bp, Artificial Sequence
  chemically synthesized
aagtttttctcattcataaatt

SEQ ID NO: 710037 - DNA, 22 bp, Artificial Sequence
  chemically synthesized
caagtttttctcattcataaat

SEQ ID NO: 710038 - DNA, 22 bp, Artificial Sequence
  chemically synthesized
tcaagtttttctcattcataaa

SEQ ID NO: 710039 - DNA, 22 bp, Artificial Sequence
  chemically synthesized
ctttcaagtttttctcattcat

SEQ ID NO: 710040 - DNA, 22 bp, Artificial Sequence
  chemically synthesized
gttgctttcaagtttttctcat

SEQ ID NO: 710041 - DNA, 22 bp, Artificial Sequence
  chemically synthesized
ggttgctttcaagtttttctca

SEQ ID NO: 710042 - DNA, 22 bp, Artificial Sequence
  chemically synthesized
tggttgctttcaagtttttctc

SEQ ID NO: 710043 - DNA, 22 bp, Artificial Sequence
  chemically synthesized
atgaatgagaaaaacttgaaag

SEQ ID NO: 710044 - DNA, 22 bp, Artificial Sequence
  chemically synthesized
tgaatgagaaaaacttgaaagc

SEQ ID NO: 710045 - DNA, 22 bp, Artificial Sequence
  chemically synthesized
gaggactttggttgctttcaag

SEQ ID NO: 710046 - DNA, 22 bp, Artificial Sequence
  chemically synthesized
cgaggactttggttgctttcaa

SEQ ID NO: 710047 - DNA, 22 bp, Artificial Sequence
  chemically synthesized
tcgaggactttggttgctttca

SEQ ID NO: 710048 - DNA, 22 bp, Artificial Sequence
  chemically synthesized
aagctttcgaggactttggttg

SEQ ID NO: 710049 - DNA, 22 bp, Artificial Sequence
  chemically synthesized
gaaagcaaccaaagtcctcgaa

SEQ ID NO: 710050 - DNA, 22 bp, Artificial Sequence
  chemically synthesized
aaagcaaccaaagtcctcgaaa

SEQ ID NO: 710051 - DNA, 22 bp, Artificial Sequence
  chemically synthesized
agtcccaagctaaagctttcga

SEQ ID NO: 710052 - DNA, 22 bp, Artificial Sequence
  chemically synthesized
ctaagtcccaagctaaagcttt

SEQ ID NO: 710053 - DNA, 22 bp, Artificial Sequence
  chemically synthesized
ttcctaagtcccaagctaaagc

SEQ ID NO: 710054 - DNA, 22 bp, Artificial Sequence
  chemically synthesized
gttcctaagtcccaagctaaag

SEQ ID NO: 710055 - DNA, 22 bp, Artificial Sequence
  chemically synthesized
tgttcctaagtcccaagctaaa

SEQ ID NO: 710056 - DNA, 22 bp, Artificial Sequence
  chemically synthesized
gaaagctttagcttgggactta

SEQ ID NO: 710057 - DNA, 22 bp, Artificial Sequence
  chemically synthesized
tagcttgggacttaggaacaaa

SEQ ID NO: 710058 - DNA, 22 bp, Artificial Sequence
  chemically synthesized
agcttgggacttaggaacaaag

SEQ ID NO: 710059 - DNA, 22 bp, Artificial Sequence
  chemically synthesized
gcttgggacttaggaacaaagc

SEQ ID NO: 710060 - DNA, 22 bp, Artificial Sequence
  chemically synthesized
aaagaataaagtgctttgttcc

SEQ ID NO: 710061 - DNA, 22 bp, Artificial Sequence
  chemically synthesized
ctcaaagaataaagtgctttgt

SEQ ID NO: 710062 - DNA, 22 bp, Artificial Sequence
  chemically synthesized
gggacttaggaacaaagcactt

SEQ ID NO: 710063 - DNA, 22 bp, Artificial Sequence
  chemically synthesized
ggacttaggaacaaagcacttt

SEQ ID NO: 710064 - DNA, 22 bp, Artificial Sequence
  chemically synthesized
aggaacaaagcactttattctt

SEQ ID NO: 710065 - DNA, 22 bp, Artificial Sequence
  chemically synthesized
cataattgctcaaagaataaag

SEQ ID NO: 710066 - DNA, 22 bp, Artificial Sequence
  chemically synthesized
ggaacaaagcactttattcttt

SEQ ID NO: 710067 - DNA, 22 bp, Artificial Sequence
  chemically synthesized
gcataattgctcaaagaataaa

SEQ ID NO: 710068 - DNA, 22 bp, Artificial Sequence
  chemically synthesized
cttgcataattgctcaaagaat

SEQ ID NO: 710069 - DNA, 22 bp, Artificial Sequence
  chemically synthesized
ccttgcataattgctcaaagaa

SEQ ID NO: 710070 - DNA, 22 bp, Artificial Sequence
  chemically synthesized
atttccttgcataattgctcaa

SEQ ID NO: 710071 - DNA, 22 bp, Artificial Sequence
  chemically synthesized
catttccttgcataattgctca

SEQ ID NO: 710072 - DNA, 22 bp, Artificial Sequence
  chemically synthesized
tattctttgagcaattatgcaa

SEQ ID NO: 710073 - DNA, 22 bp, Artificial Sequence
  chemically synthesized
attctttgagcaattatgcaag

SEQ ID NO: 710074 - DNA, 22 bp, Artificial Sequence
  chemically synthesized
ttctttgagcaattatgcaagg

SEQ ID NO: 710075 - DNA, 22 bp, Artificial Sequence
  chemically synthesized
tcaaatttcatttccttgcata

SEQ ID NO: 710076 - DNA, 22 bp, Artificial Sequence
  chemically synthesized
tttgagcaattatgcaaggaaa

SEQ ID NO: 710077 - DNA, 22 bp, Artificial Sequence
  chemically synthesized
tgagcaattatgcaaggaaatg

SEQ ID NO: 710078 - DNA, 22 bp, Artificial Sequence
  chemically synthesized
gagcaattatgcaaggaaatga

SEQ ID NO: 710079 - DNA, 22 bp, Artificial Sequence
  chemically synthesized
agcaattatgcaaggaaatgaa

SEQ ID NO: 710080 - DNA, 22 bp, Artificial Sequence
  chemically synthesized
atagattatcaaatttcatttc

SEQ ID NO: 710081 - DNA, 22 bp, Artificial Sequence
  chemically synthesized
aatagattatcaaatttcattt

SEQ ID NO: 710082 - DNA, 22 bp, Artificial Sequence
  chemically synthesized
gtttaatagattatcaaatttc

SEQ ID NO: 710083 - DNA, 22 bp, Artificial Sequence
  chemically synthesized
tgcaaggaaatgaaatttgata

SEQ ID NO: 710084 - DNA, 22 bp, Artificial Sequence
  chemically synthesized
tcgtttaatagattatcaaatt

SEQ ID NO: 710085 - DNA, 22 bp, Artificial Sequence
  chemically synthesized
atgcatggaggctctcgtttaa

SEQ ID NO: 710086 - DNA, 22 bp, Artificial Sequence
  chemically synthesized
gataatctattaaacgagagcc

SEQ ID NO: 710087 - DNA, 22 bp, Artificial Sequence
  chemically synthesized
ataatctattaaacgagagcct

SEQ ID NO: 710088 - DNA, 22 bp, Artificial Sequence
  chemically synthesized
gaaagatctaatgcatggaggc

SEQ ID NO: 710089 - DNA, 22 bp, Artificial Sequence
  chemically synthesized
ttaaacgagagcctccatgcat

SEQ ID NO: 710090 - DNA, 22 bp, Artificial Sequence
  chemically synthesized
aacgagagcctccatgcattag

SEQ ID NO: 710091 - DNA, 22 bp, Artificial Sequence
  chemically synthesized
acatacagccagttagaaagat

SEQ ID NO: 710092 - DNA, 22 bp, Artificial Sequence
  chemically synthesized
aacatacagccagttagaaaga

SEQ ID NO: 710093 - DNA, 22 bp, Artificial Sequence
  chemically synthesized
catgcattagatctttctaact

SEQ ID NO: 710094 - DNA, 22 bp, Artificial Sequence
  chemically synthesized
atttaacatacagccagttaga

SEQ ID NO: 710095 - DNA, 22 bp, Artificial Sequence
  chemically synthesized
gatctttctaactggctgtatg

SEQ ID NO: 710096 - DNA, 22 bp, Artificial Sequence
  chemically synthesized
tctaactggctgtatgttaaat

SEQ ID NO: 710097 - DNA, 22 bp, Artificial Sequence
  chemically synthesized
ctaactggctgtatgttaaatc

SEQ ID NO: 710098 - DNA, 22 bp, Artificial Sequence
  chemically synthesized
taactggctgtatgttaaatca

SEQ ID NO: 710099 - DNA, 22 bp, Artificial Sequence
  chemically synthesized
actggctgtatgttaaatcaat

SEQ ID NO: 710100 - DNA, 22 bp, Artificial Sequence
  chemically synthesized
tatataccacggtatattgatt

SEQ ID NO: 710101 - DNA, 22 bp, Artificial Sequence
  chemically synthesized
gctgtatgttaaatcaatatac

SEQ ID NO: 710102 - DNA, 22 bp, Artificial Sequence
  chemically synthesized
gtatataccacggtatattgat

SEQ ID NO: 710103 - DNA, 22 bp, Artificial Sequence
  chemically synthesized
tgtatataccacggtatattga

SEQ ID NO: 710104 - DNA, 22 bp, Artificial Sequence
  chemically synthesized
tatgttaaatcaatataccgtg

SEQ ID NO: 710105 - DNA, 22 bp, Artificial Sequence
  chemically synthesized
ttttgtatataccacggtatat

SEQ ID NO: 710106 - DNA, 22 bp, Artificial Sequence
  chemically synthesized
ctgttttgtatataccacggta

SEQ ID NO: 710107 - DNA, 22 bp, Artificial Sequence
  chemically synthesized
cctgttttgtatataccacggt

SEQ ID NO: 710108 - DNA, 22 bp, Artificial Sequence
  chemically synthesized
aatcaatataccgtggtatata

SEQ ID NO: 710109 - DNA, 22 bp, Artificial Sequence
  chemically synthesized
cttcctgttttgtatataccac

SEQ ID NO: 710110 - DNA, 22 bp, Artificial Sequence
  chemically synthesized
gcttcctgttttgtatatacca

SEQ ID NO: 710111 - DNA, 22 bp, Artificial Sequence
  chemically synthesized
tgcttcctgttttgtatatacc

SEQ ID NO: 710112 - DNA, 22 bp, Artificial Sequence
  chemically synthesized
ttgcttcctgttttgtatatac

SEQ ID NO: 710113 - DNA, 22 bp, Artificial Sequence
  chemically synthesized
gcttttgcttcctgttttgtat

SEQ ID NO: 710114 - DNA, 22 bp, Artificial Sequence
  chemically synthesized
tggcttttgcttcctgttttgt

SEQ ID NO: 710115 - DNA, 22 bp, Artificial Sequence
  chemically synthesized
ctggcttttgcttcctgttttg

SEQ ID NO: 710116 - DNA, 22 bp, Artificial Sequence
  chemically synthesized
tgccagaacataagacacaggt

SEQ ID NO: 710117 - DNA, 22 bp, Artificial Sequence
  chemically synthesized
attgtgccagaacataagacac

SEQ ID NO: 710118 - DNA, 22 bp, Artificial Sequence
  chemically synthesized
tgtcttatgttctggcacaatc

SEQ ID NO: 710119 - DNA, 22 bp, Artificial Sequence
  chemically synthesized
atgttctggcacaatcagttct

SEQ ID NO: 710120 - DNA, 22 bp, Artificial Sequence
  chemically synthesized
tgttctggcacaatcagttctt

SEQ ID NO: 710121 - DNA, 22 bp, Artificial Sequence
  chemically synthesized
tggcacaatcagttctttcctt

SEQ ID NO: 710122 - DNA, 22 bp, Artificial Sequence
  chemically synthesized
gcacaatcagttctttccttgg

SEQ ID NO: 710123 - DNA, 22 bp, Artificial Sequence
  chemically synthesized
taaaatgaataaaccaccaagg

SEQ ID NO: 710124 - DNA, 22 bp, Artificial Sequence
  chemically synthesized
ataaaatgaataaaccaccaag

SEQ ID NO: 710125 - DNA, 22 bp, Artificial Sequence
  chemically synthesized
tttccttggtggtttattcatt

SEQ ID NO: 710126 - DNA, 22 bp, Artificial Sequence
  chemically synthesized
tccttggtggtttattcatttt

SEQ ID NO: 710127 - DNA, 22 bp, Artificial Sequence
  chemically synthesized
acaaatacttataaaatgaata

SEQ ID NO: 710128 - DNA, 22 bp, Artificial Sequence
  chemically synthesized
ccttggtggtttattcatttta

SEQ ID NO: 710129 - DNA, 22 bp, Artificial Sequence
  chemically synthesized
cttggtggtttattcattttat

SEQ ID NO: 710130 - DNA, 22 bp, Artificial Sequence
  chemically synthesized
ggtggtttattcattttataag

SEQ ID NO: 710131 - DNA, 22 bp, Artificial Sequence
  chemically synthesized
gtggtttattcattttataagt

SEQ ID NO: 710132 - DNA, 22 bp, Artificial Sequence
  chemically synthesized
aatattaacaaatacttataaa

SEQ ID NO: 710133 - DNA, 22 bp, Artificial Sequence
  chemically synthesized
caatattaacaaatacttataa

SEQ ID NO: 710134 - DNA, 22 bp, Artificial Sequence
  chemically synthesized
tcaatattaacaaatacttata

SEQ ID NO: 710135 - DNA, 22 bp, Artificial Sequence
  chemically synthesized
tttcaatattaacaaatactta

SEQ ID NO: 710136 - DNA, 22 bp, Artificial Sequence
  chemically synthesized
attcattttataagtatttgtt

SEQ ID NO: 710137 - DNA, 22 bp, Artificial Sequence
  chemically synthesized
ttcattttataagtatttgtta

SEQ ID NO: 710138 - DNA, 22 bp, Artificial Sequence
  chemically synthesized
tctctttcaatattaacaaata

SEQ ID NO: 710139 - DNA, 22 bp, Artificial Sequence
  chemically synthesized
attttataagtatttgttaata

SEQ ID NO: 710140 - DNA, 22 bp, Artificial Sequence
  chemically synthesized
cctatctctttcaatattaaca

SEQ ID NO: 710141 - DNA, 22 bp, Artificial Sequence
  chemically synthesized
gcctatctctttcaatattaac

SEQ ID NO: 710142 - DNA, 22 bp, Artificial Sequence
  chemically synthesized
tataagtatttgttaatattga

SEQ ID NO: 710143 - DNA, 22 bp, Artificial Sequence
  chemically synthesized
tgcctatctctttcaatattaa

SEQ ID NO: 710144 - DNA, 22 bp, Artificial Sequence
  chemically synthesized
ataagtatttgttaatattgaa

SEQ ID NO: 710145 - DNA, 22 bp, Artificial Sequence
  chemically synthesized
ttgcctatctctttcaatatta

SEQ ID NO: 710146 - DNA, 22 bp, Artificial Sequence
  chemically synthesized
taagtatttgttaatattgaaa

SEQ ID NO: 710147 - DNA, 22 bp, Artificial Sequence
  chemically synthesized
tttgcctatctctttcaatatt

SEQ ID NO: 710148 - DNA, 22 bp, Artificial Sequence
  chemically synthesized
ttttttgcctatctctttcaat

SEQ ID NO: 710149 - DNA, 22 bp, Artificial Sequence
  chemically synthesized
gttttttgcctatctctttcaa

SEQ ID NO: 710150 - DNA, 22 bp, Artificial Sequence
  chemically synthesized
gttaatattgaaagagataggc

SEQ ID NO: 710151 - DNA, 22 bp, Artificial Sequence
  chemically synthesized
ttaatattgaaagagataggca

SEQ ID NO: 710152 - DNA, 22 bp, Artificial Sequence
  chemically synthesized
tagcatttgttttttgcctatc

SEQ ID NO: 710153 - DNA, 22 bp, Artificial Sequence
  chemically synthesized
atattgaaagagataggcaaaa

SEQ ID NO: 710154 - DNA, 22 bp, Artificial Sequence
  chemically synthesized
aaagagataggcaaaaaacaaa

SEQ ID NO: 710155 - DNA, 22 bp, Artificial Sequence
  chemically synthesized
cagagatcagggactatagcat

SEQ ID NO: 710156 - DNA, 22 bp, Artificial Sequence
  chemically synthesized
gcagagatcagggactatagca

SEQ ID NO: 710157 - DNA, 22 bp, Artificial Sequence
  chemically synthesized
cacttgcagagatcagggacta

SEQ ID NO: 710158 - DNA, 22 bp, Artificial Sequence
  chemically synthesized
acacttgcagagatcagggact

SEQ ID NO: 710159 - DNA, 22 bp, Artificial Sequence
  chemically synthesized
tacacttgcagagatcagggac

SEQ ID NO: 710160 - DNA, 22 bp, Artificial Sequence
  chemically synthesized
caaacctttacacttgcagaga

SEQ ID NO: 710161 - DNA, 22 bp, Artificial Sequence
  chemically synthesized
tagtccctgatctctgcaagtg

SEQ ID NO: 710162 - DNA, 22 bp, Artificial Sequence
  chemically synthesized
cctccaaacctttacacttgca

SEQ ID NO: 710163 - DNA, 22 bp, Artificial Sequence
  chemically synthesized
acctccaaacctttacacttgc

SEQ ID NO: 710164 - DNA, 22 bp, Artificial Sequence
  chemically synthesized
ttacctccaaacctttacactt

SEQ ID NO: 710165 - DNA, 22 bp, Artificial Sequence
  chemically synthesized
cttacctccaaacctttacact

SEQ ID NO: 710166 - DNA, 22 bp, Artificial Sequence
  chemically synthesized
atctctgcaagtgtaaaggttt

SEQ ID NO: 710167 - DNA, 22 bp, Artificial Sequence
  chemically synthesized
cttcttacctccaaacctttac

SEQ ID NO: 710168 - DNA, 22 bp, Artificial Sequence
  chemically synthesized
tgcaagtgtaaaggtttggagg

SEQ ID NO: 710169 - DNA, 22 bp, Artificial Sequence
  chemically synthesized
tcactacttcttacctccaaac

SEQ ID NO: 710170 - DNA, 22 bp, Artificial Sequence
  chemically synthesized
caagtgtaaaggtttggaggta

SEQ ID NO: 710171 - DNA, 22 bp, Artificial Sequence
  chemically synthesized
gtcactacttcttacctccaaa

SEQ ID NO: 710172 - DNA, 22 bp, Artificial Sequence
  chemically synthesized
agcttgtcactacttcttacct

SEQ ID NO: 710173 - DNA, 22 bp, Artificial Sequence
  chemically synthesized
cagcttgtcactacttcttacc

SEQ ID NO: 710174 - DNA, 22 bp, Artificial Sequence
  chemically synthesized
ttcagcttgtcactacttctta

SEQ ID NO: 710175 - DNA, 22 bp, Artificial Sequence
  chemically synthesized
cttcagcttgtcactacttctt

SEQ ID NO: 710176 - DNA, 22 bp, Artificial Sequence
  chemically synthesized
tcttcagcttgtcactacttct

SEQ ID NO: 710177 - DNA, 22 bp, Artificial Sequence
  chemically synthesized
ggaggtaagaagtagtgacaag

SEQ ID NO: 710178 - DNA, 22 bp, Artificial Sequence
  chemically synthesized
gaggtaagaagtagtgacaagc

SEQ ID NO: 710179 - DNA, 22 bp, Artificial Sequence
  chemically synthesized
cagccccaagcctttcttcagc

SEQ ID NO: 710180 - DNA, 22 bp, Artificial Sequence
  chemically synthesized
tgcagccccaagcctttcttca

SEQ ID NO: 710181 - DNA, 22 bp, Artificial Sequence
  chemically synthesized
ttctgcagccccaagcctttct

SEQ ID NO: 710182 - DNA, 22 bp, Artificial Sequence
  chemically synthesized
aacaccactgttctgcagcccc

SEQ ID NO: 710183 - DNA, 22 bp, Artificial Sequence
  chemically synthesized
aagaaaggcttggggctgcaga

SEQ ID NO: 710184 - DNA, 22 bp, Artificial Sequence
  chemically synthesized
tcgtcctcaacaccactgttct

SEQ ID NO: 710185 - DNA, 22 bp, Artificial Sequence
  chemically synthesized
ggggctgcagaacagtggtgtt

SEQ ID NO: 710186 - DNA, 22 bp, Artificial Sequence
  chemically synthesized
actgtcgtcctcaacaccactg

SEQ ID NO: 710187 - DNA, 22 bp, Artificial Sequence
  chemically synthesized
gggctgcagaacagtggtgttg

SEQ ID NO: 710188 - DNA, 22 bp, Artificial Sequence
  chemically synthesized
tatctcactgtcgtcctcaaca

SEQ ID NO: 710189 - DNA, 22 bp, Artificial Sequence
  chemically synthesized
cagaacagtggtgttgaggacg

SEQ ID NO: 710190 - DNA, 22 bp, Artificial Sequence
  chemically synthesized
attgtatctcactgtcgtcctc

SEQ ID NO: 710191 - DNA, 22 bp, Artificial Sequence
  chemically synthesized
actaattgtatctcactgtcgt

SEQ ID NO: 710192 - DNA, 22 bp, Artificial Sequence
  chemically synthesized
aggacgacagtgagatacaatt

SEQ ID NO: 710193 - DNA, 22 bp, Artificial Sequence
  chemically synthesized
aacatgactaactaattgtatc

SEQ ID NO: 710194 - DNA, 22 bp, Artificial Sequence
  chemically synthesized
caacatgactaactaattgtat

SEQ ID NO: 710195 - DNA, 22 bp, Artificial Sequence
  chemically synthesized
tcaacatgactaactaattgta

SEQ ID NO: 710196 - DNA, 22 bp, Artificial Sequence
  chemically synthesized
catcatcggctttcaacatgac

SEQ ID NO: 710197 - DNA, 22 bp, Artificial Sequence
  chemically synthesized
gcatcatcggctttcaacatga

SEQ ID NO: 710198 - DNA, 22 bp, Artificial Sequence
  chemically synthesized
tgcatcatcggctttcaacatg

SEQ ID NO: 710199 - DNA, 22 bp, Artificial Sequence
  chemically synthesized
ctttgcatcatcggctttcaac

SEQ ID NO: 710200 - DNA, 22 bp, Artificial Sequence
  chemically synthesized
gctttgcatcatcggctttcaa

SEQ ID NO: 710201 - DNA, 22 bp, Artificial Sequence
  chemically synthesized
gttagtcatgttgaaagccgat

SEQ ID NO: 710202 - DNA, 22 bp, Artificial Sequence
  chemically synthesized
gtcatgttgaaagccgatgatg

SEQ ID NO: 710203 - DNA, 22 bp, Artificial Sequence
  chemically synthesized
ggacgccttgctttgcatcatc

SEQ ID NO: 710204 - DNA, 22 bp, Artificial Sequence
  chemically synthesized
aaagccgatgatgcaaagcaag

SEQ ID NO: 710205 - DNA, 22 bp, Artificial Sequence
  chemically synthesized
agagtctgggacgccttgcttt

SEQ ID NO: 710206 - DNA, 22 bp, Artificial Sequence
  chemically synthesized
agcctcagagtctgggacgcct

SEQ ID NO: 710207 - DNA, 22 bp, Artificial Sequence
  chemically synthesized
gagcctcagagtctgggacgcc

SEQ ID NO: 710208 - DNA, 22 bp, Artificial Sequence
  chemically synthesized
cagggtaaatcttgagcctcag

SEQ ID NO: 710209 - DNA, 22 bp, Artificial Sequence
  chemically synthesized
cctgcagggtaaatcttgagcc

SEQ ID NO: 710210 - DNA, 22 bp, Artificial Sequence
  chemically synthesized
gcctgcagggtaaatcttgagc

SEQ ID NO: 710211 - DNA, 22 bp, Artificial Sequence
  chemically synthesized
tgcctgcagggtaaatcttgag

SEQ ID NO: 710212 - DNA, 22 bp, Artificial Sequence
  chemically synthesized
tttgcctgcagggtaaatcttg

SEQ ID NO: 710213 - DNA, 22 bp, Artificial Sequence
  chemically synthesized
tctttgcctgcagggtaaatct

SEQ ID NO: 710214 - DNA, 22 bp, Artificial Sequence
  chemically synthesized
tgaggctcaagatttaccctgc

SEQ ID NO: 710215 - DNA, 22 bp, Artificial Sequence
  chemically synthesized
aggctcaagatttaccctgcag

SEQ ID NO: 710216 - DNA, 22 bp, Artificial Sequence
  chemically synthesized
agtggttctctttgcctgcagg

SEQ ID NO: 710217 - DNA, 22 bp, Artificial Sequence
  chemically synthesized
cagtggttctctttgcctgcag

SEQ ID NO: 710218 - DNA, 22 bp, Artificial Sequence
  chemically synthesized
tcagtggttctctttgcctgca

SEQ ID NO: 710219 - DNA, 22 bp, Artificial Sequence
  chemically synthesized
aagatttaccctgcaggcaaag

SEQ ID NO: 710220 - DNA, 22 bp, Artificial Sequence
  chemically synthesized
accctgcaggcaaagagaacca

SEQ ID NO: 710221 - DNA, 22 bp, Artificial Sequence
  chemically synthesized
ccctgcaggcaaagagaaccac

SEQ ID NO: 710222 - DNA, 22 bp, Artificial Sequence
  chemically synthesized
caggcaaagagaaccactgaaa

SEQ ID NO: 710223 - DNA, 22 bp, Artificial Sequence
  chemically synthesized
aaatagtgagtcatgtcacaga

SEQ ID NO: 710224 - DNA, 22 bp, Artificial Sequence
  chemically synthesized
taaaatagtgagtcatgtcaca

SEQ ID NO: 710225 - DNA, 22 bp, Artificial Sequence
  chemically synthesized
ctctaaaatagtgagtcatgtc

SEQ ID NO: 710226 - DNA, 22 bp, Artificial Sequence
  chemically synthesized
aaaatttctgtgacatgactca

SEQ ID NO: 710227 - DNA, 22 bp, Artificial Sequence
  chemically synthesized
cctctaaaatagtgagtcatgt

SEQ ID NO: 710228 - DNA, 22 bp, Artificial Sequence
  chemically synthesized
tcctctaaaatagtgagtcatg

SEQ ID NO: 710229 - DNA, 22 bp, Artificial Sequence
  chemically synthesized
actttcctctaaaatagtgagt

SEQ ID NO: 710230 - DNA, 22 bp, Artificial Sequence
  chemically synthesized
ctgtgacatgactcactatttt

SEQ ID NO: 710231 - DNA, 22 bp, Artificial Sequence
  chemically synthesized
tgtgacatgactcactatttta

SEQ ID NO: 710232 - DNA, 22 bp, Artificial Sequence
  chemically synthesized
tgacatgactcactattttaga

SEQ ID NO: 710233 - DNA, 22 bp, Artificial Sequence
  chemically synthesized
ccaaaccctaactttcctctaa

SEQ ID NO: 710234 - DNA, 22 bp, Artificial Sequence
  chemically synthesized
cccaaaccctaactttcctcta

SEQ ID NO: 710235 - DNA, 22 bp, Artificial Sequence
  chemically synthesized
actattttagaggaaagttagg

SEQ ID NO: 710236 - DNA, 22 bp, Artificial Sequence
  chemically synthesized
atcttcccaaaccctaactttc

SEQ ID NO: 710237 - DNA, 22 bp, Artificial Sequence
  chemically synthesized
ttttagaggaaagttagggttt

SEQ ID NO: 710238 - DNA, 22 bp, Artificial Sequence
  chemically synthesized
tactgatcttcccaaaccctaa

SEQ ID NO: 710239 - DNA, 22 bp, Artificial Sequence
  chemically synthesized
tagaggaaagttagggtttggg

SEQ ID NO: 710240 - DNA, 22 bp, Artificial Sequence
  chemically synthesized
agaggaaagttagggtttggga

SEQ ID NO: 710241 - DNA, 22 bp, Artificial Sequence
  chemically synthesized
gaggaaagttagggtttgggaa

SEQ ID NO: 710242 - DNA, 22 bp, Artificial Sequence
  chemically synthesized
cactatactgatcttcccaaac

SEQ ID NO: 710243 - DNA, 22 bp, Artificial Sequence
  chemically synthesized
acactatactgatcttcccaaa

SEQ ID NO: 710244 - DNA, 22 bp, Artificial Sequence
  chemically synthesized
tacactatactgatcttcccaa

SEQ ID NO: 710245 - DNA, 22 bp, Artificial Sequence
  chemically synthesized
ttttacactatactgatcttcc

SEQ ID NO: 710246 - DNA, 22 bp, Artificial Sequence
  chemically synthesized
gggtttgggaagatcagtatag

SEQ ID NO: 710247 - DNA, 22 bp, Artificial Sequence
  chemically synthesized
gaatctgttttacactatactg

SEQ ID NO: 710248 - DNA, 22 bp, Artificial Sequence
  chemically synthesized
cgaatctgttttacactatact

SEQ ID NO: 710249 - DNA, 22 bp, Artificial Sequence
  chemically synthesized
tcgaatctgttttacactatac

SEQ ID NO: 710250 - DNA, 22 bp, Artificial Sequence
  chemically synthesized
gggaagatcagtatagtgtaaa

SEQ ID NO: 710251 - DNA, 22 bp, Artificial Sequence
  chemically synthesized
ggaagatcagtatagtgtaaaa

SEQ ID NO: 710252 - DNA, 22 bp, Artificial Sequence
  chemically synthesized
aggtgccctttcgaatctgttt

SEQ ID NO: 710253 - DNA, 22 bp, Artificial Sequence
  chemically synthesized
agtctcaggtgccctttcgaat

SEQ ID NO: 710254 - DNA, 22 bp, Artificial Sequence
  chemically synthesized
atctcagtctcaggtgcccttt

SEQ ID NO: 710255 - DNA, 22 bp, Artificial Sequence
  chemically synthesized
tgatctcagtctcaggtgccct

SEQ ID NO: 710256 - DNA, 22 bp, Artificial Sequence
  chemically synthesized
ctgatctcagtctcaggtgccc

SEQ ID NO: 710257 - DNA, 22 bp, Artificial Sequence
  chemically synthesized
tctgatctcagtctcaggtgcc

SEQ ID NO: 710258 - DNA, 22 bp, Artificial Sequence
  chemically synthesized
tttctgatctcagtctcaggtg

SEQ ID NO: 710259 - DNA, 22 bp, Artificial Sequence
  chemically synthesized
gaaagggcacctgagactgaga

SEQ ID NO: 710260 - DNA, 22 bp, Artificial Sequence
  chemically synthesized
caacagcctctttctgatctca

SEQ ID NO: 710261 - DNA, 22 bp, Artificial Sequence
  chemically synthesized
agactgagatcagaaagaggct

SEQ ID NO: 710262 - DNA, 22 bp, Artificial Sequence
  chemically synthesized
gtaagttacaacagcctctttc

SEQ ID NO: 710263 - DNA, 22 bp, Artificial Sequence
  chemically synthesized
agatcagaaagaggctgttgta

SEQ ID NO: 710264 - DNA, 22 bp, Artificial Sequence
  chemically synthesized
atgcatatcaacccaagtctag

SEQ ID NO: 710265 - DNA, 22 bp, Artificial Sequence
  chemically synthesized
ttgtaacttactagacttgggt

SEQ ID NO: 710266 - DNA, 22 bp, Artificial Sequence
  chemically synthesized
taatgcatatcaacccaagtct

SEQ ID NO: 710267 - DNA, 22 bp, Artificial Sequence
  chemically synthesized
taacttactagacttgggttga

SEQ ID NO: 710268 - DNA, 22 bp, Artificial Sequence
  chemically synthesized
attctaatgcatatcaacccaa

SEQ ID NO: 710269 - DNA, 22 bp, Artificial Sequence
  chemically synthesized
aattctaatgcatatcaaccca

SEQ ID NO: 710270 - DNA, 22 bp, Artificial Sequence
  chemically synthesized
actagacttgggttgatatgca

SEQ ID NO: 710271 - DNA, 22 bp, Artificial Sequence
  chemically synthesized
ctagacttgggttgatatgcat

SEQ ID NO: 710272 - DNA, 22 bp, Artificial Sequence
  chemically synthesized
gacttgggttgatatgcattag

SEQ ID NO: 710273 - DNA, 22 bp, Artificial Sequence
  chemically synthesized
gggttgatatgcattagaatta

SEQ ID NO: 710274 - DNA, 22 bp, Artificial Sequence
  chemically synthesized
ggttgatatgcattagaattaa

SEQ ID NO: 710275 - DNA, 22 bp, Artificial Sequence
  chemically synthesized
aatacaatacagccttaattct

SEQ ID NO: 710276 - DNA, 22 bp, Artificial Sequence
  chemically synthesized
atatgcattagaattaaggctg

SEQ ID NO: 710277 - DNA, 22 bp, Artificial Sequence
  chemically synthesized
cattgaatacaatacagcctta

SEQ ID NO: 710278 - DNA, 22 bp, Artificial Sequence
  chemically synthesized
acattgaatacaatacagcctt

SEQ ID NO: 710279 - DNA, 22 bp, Artificial Sequence
  chemically synthesized
tacattgaatacaatacagcct

SEQ ID NO: 710280 - DNA, 22 bp, Artificial Sequence
  chemically synthesized
ttacattgaatacaatacagcc

SEQ ID NO: 710281 - DNA, 22 bp, Artificial Sequence
  chemically synthesized
ttttacattgaatacaatacag

SEQ ID NO: 710282 - DNA, 22 bp, Artificial Sequence
  chemically synthesized
cttttacattgaatacaataca

SEQ ID NO: 710283 - DNA, 22 bp, Artificial Sequence
  chemically synthesized
gaattaaggctgtattgtattc

SEQ ID NO: 710284 - DNA, 22 bp, Artificial Sequence
  chemically synthesized
aggctgtattgtattcaatgta

SEQ ID NO: 710285 - DNA, 22 bp, Artificial Sequence
  chemically synthesized
atatgtaccttcttttacattg

SEQ ID NO: 710286 - DNA, 22 bp, Artificial Sequence
  chemically synthesized
tcatatgtaccttcttttacat

SEQ ID NO: 710287 - DNA, 22 bp, Artificial Sequence
  chemically synthesized
tattgtattcaatgtaaaagaa

SEQ ID NO: 710288 - DNA, 22 bp, Artificial Sequence
  chemically synthesized
ctcatatgtaccttcttttaca

SEQ ID NO: 710289 - DNA, 22 bp, Artificial Sequence
  chemically synthesized
tattcaatgtaaaagaaggtac

SEQ ID NO: 710290 - DNA, 22 bp, Artificial Sequence
  chemically synthesized
aatgtaaaagaaggtacatatg

SEQ ID NO: 710291 - DNA, 22 bp, Artificial Sequence
  chemically synthesized
aaaataccttctcatatgtacc

SEQ ID NO: 710292 - DNA, 22 bp, Artificial Sequence
  chemically synthesized
caaaataccttctcatatgtac

SEQ ID NO: 710293 - DNA, 22 bp, Artificial Sequence
  chemically synthesized
tcaaaataccttctcatatgta

SEQ ID NO: 710294 - DNA, 22 bp, Artificial Sequence
  chemically synthesized
ctttcaaaataccttctcatat

SEQ ID NO: 710295 - DNA, 22 bp, Artificial Sequence
  chemically synthesized
ctcctttcaaaataccttctca

SEQ ID NO: 710296 - DNA, 22 bp, Artificial Sequence
  chemically synthesized
cctcctttcaaaataccttctc

SEQ ID NO: 710297 - DNA, 22 bp, Artificial Sequence
  chemically synthesized
ttcctcctttcaaaataccttc

SEQ ID NO: 710298 - DNA, 22 bp, Artificial Sequence
  chemically synthesized
gatagttcttcctcctttcaaa

SEQ ID NO: 710299 - DNA, 22 bp, Artificial Sequence
  chemically synthesized
caacaccaaattggatagttct

SEQ ID NO: 710300 - DNA, 22 bp, Artificial Sequence
  chemically synthesized
tgaaaggaggaagaactatcca

SEQ ID NO: 710301 - DNA, 22 bp, Artificial Sequence
  chemically synthesized
gaaaggaggaagaactatccaa

SEQ ID NO: 710302 - DNA, 22 bp, Artificial Sequence
  chemically synthesized
aaaggaggaagaactatccaat

SEQ ID NO: 710303 - DNA, 22 bp, Artificial Sequence
  chemically synthesized
atctccaacaccaaattggata

SEQ ID NO: 710304 - DNA, 22 bp, Artificial Sequence
  chemically synthesized
agatattaatctccaacaccaa

SEQ ID NO: 710305 - DNA, 22 bp, Artificial Sequence
  chemically synthesized
cagatattaatctccaacacca

SEQ ID NO: 710306 - DNA, 22 bp, Artificial Sequence
  chemically synthesized
ttcagatattaatctccaacac

SEQ ID NO: 710307 - DNA, 22 bp, Artificial Sequence
  chemically synthesized
cttcagatattaatctccaaca

SEQ ID NO: 710308 - DNA, 22 bp, Artificial Sequence
  chemically synthesized
tccaatttggtgttggagatta

SEQ ID NO: 710309 - DNA, 22 bp, Artificial Sequence
  chemically synthesized
cttcttcagatattaatctcca

SEQ ID NO: 710310 - DNA, 22 bp, Artificial Sequence
  chemically synthesized
gcttcttcagatattaatctcc

SEQ ID NO: 710311 - DNA, 22 bp, Artificial Sequence
  chemically synthesized
tttgcttcttcagatattaatc

SEQ ID NO: 710312 - DNA, 22 bp, Artificial Sequence
  chemically synthesized
atttgcttcttcagatattaat

SEQ ID NO: 710313 - DNA, 22 bp, Artificial Sequence
  chemically synthesized
ggtgttggagattaatatctga

SEQ ID NO: 710314 - DNA, 22 bp, Artificial Sequence
  chemically synthesized
gtgttggagattaatatctgaa

SEQ ID NO: 710315 - DNA, 22 bp, Artificial Sequence
  chemically synthesized
gagattaatatctgaagaagca

SEQ ID NO: 710316 - DNA, 22 bp, Artificial Sequence
  chemically synthesized
gaaatccaagagtttatttgct

SEQ ID NO: 710317 - DNA, 22 bp, Artificial Sequence
  chemically synthesized
atatctgaagaagcaaataaac

SEQ ID NO: 710318 - DNA, 22 bp, Artificial Sequence
  chemically synthesized
ctcgaaatccaagagtttattt

SEQ ID NO: 710319 - DNA, 22 bp, Artificial Sequence
  chemically synthesized
actcgaaatccaagagtttatt

SEQ ID NO: 710320 - DNA, 22 bp, Artificial Sequence
  chemically synthesized
cttactcgaaatccaagagttt

SEQ ID NO: 710321 - DNA, 22 bp, Artificial Sequence
  chemically synthesized
aagaagcaaataaactcttgga

SEQ ID NO: 710322 - DNA, 22 bp, Artificial Sequence
  chemically synthesized
ccttactcgaaatccaagagtt

SEQ ID NO: 710323 - DNA, 22 bp, Artificial Sequence
  chemically synthesized
ccagtcttccttactcgaaatc

SEQ ID NO: 710324 - DNA, 22 bp, Artificial Sequence
  chemically synthesized
tcccagtcttccttactcgaaa

SEQ ID NO: 710325 - DNA, 22 bp, Artificial Sequence
  chemically synthesized
attctcccagtcttccttactc

SEQ ID NO: 710326 - DNA, 22 bp, Artificial Sequence
  chemically synthesized
cattctcccagtcttccttact

SEQ ID NO: 710327 - DNA, 22 bp, Artificial Sequence
  chemically synthesized
ttggatttcgagtaaggaagac

SEQ ID NO: 710328 - DNA, 22 bp, Artificial Sequence
  chemically synthesized
ggatttcgagtaaggaagactg

SEQ ID NO: 710329 - DNA, 22 bp, Artificial Sequence
  chemically synthesized
gatttcgagtaaggaagactgg

SEQ ID NO: 710330 - DNA, 22 bp, Artificial Sequence
  chemically synthesized
cgagtaaggaagactgggagaa

SEQ ID NO: 710331 - DNA, 22 bp, Artificial Sequence
  chemically synthesized
gagtaaggaagactgggagaat

SEQ ID NO: 710332 - DNA, 22 bp, Artificial Sequence
  chemically synthesized
ccaccagcaatatcttcattct

SEQ ID NO: 710333 - DNA, 22 bp, Artificial Sequence
  chemically synthesized
atattgccaccagcaatatctt

SEQ ID NO: 710334 - DNA, 22 bp, Artificial Sequence
  chemically synthesized
catattgccaccagcaatatct

SEQ ID NO: 710335 - DNA, 22 bp, Artificial Sequence
  chemically synthesized
tcatattgccaccagcaatatc

SEQ ID NO: 710336 - DNA, 22 bp, Artificial Sequence
  chemically synthesized
ggagaatgaagatattgctggt

SEQ ID NO: 710337 - DNA, 22 bp, Artificial Sequence
  chemically synthesized
attttcatattgccaccagcaa

SEQ ID NO: 710338 - DNA, 22 bp, Artificial Sequence
  chemically synthesized
tgattttcatattgccaccagc

SEQ ID NO: 710339 - DNA, 22 bp, Artificial Sequence
  chemically synthesized
ctgattttcatattgccaccag

SEQ ID NO: 710340 - DNA, 22 bp, Artificial Sequence
  chemically synthesized
tctgattttcatattgccacca

SEQ ID NO: 710341 - DNA, 22 bp, Artificial Sequence
  chemically synthesized
ttctgattttcatattgccacc

SEQ ID NO: 710342 - DNA, 22 bp, Artificial Sequence
  chemically synthesized
cttttctgattttcatattgcc

SEQ ID NO: 710343 - DNA, 22 bp, Artificial Sequence
  chemically synthesized
ccttttctgattttcatattgc

SEQ ID NO: 710344 - DNA, 22 bp, Artificial Sequence
  chemically synthesized
ttccttttctgattttcatatt

SEQ ID NO: 710345 - DNA, 22 bp, Artificial Sequence
  chemically synthesized
cttccttttctgattttcatat

SEQ ID NO: 710346 - DNA, 22 bp, Artificial Sequence
  chemically synthesized
ctggtggcaatatgaaaatcag

SEQ ID NO: 710347 - DNA, 22 bp, Artificial Sequence
  chemically synthesized
tttcttccttttctgattttca

SEQ ID NO: 710348 - DNA, 22 bp, Artificial Sequence
  chemically synthesized
gtggcaatatgaaaatcagaaa

SEQ ID NO: 710349 - DNA, 22 bp, Artificial Sequence
  chemically synthesized
atacatacatatgctatttctt

SEQ ID NO: 710350 - DNA, 22 bp, Artificial Sequence
  chemically synthesized
caaatgaattcatacatacata

SEQ ID NO: 710351 - DNA, 22 bp, Artificial Sequence
  chemically synthesized
tgttccaaatgaattcatacat

SEQ ID NO: 710352 - DNA, 22 bp, Artificial Sequence
  chemically synthesized
attatgttccaaatgaattcat

SEQ ID NO: 710353 - DNA, 22 bp, Artificial Sequence
  chemically synthesized
ggacaaattcattatgttccaa

SEQ ID NO: 710354 - DNA, 22 bp, Artificial Sequence
  chemically synthesized
ttaggacaaattcattatgttc

SEQ ID NO: 710355 - DNA, 22 bp, Artificial Sequence
  chemically synthesized
actgttaggacaaattcattat

SEQ ID NO: 710356 - DNA, 22 bp, Artificial Sequence
  chemically synthesized
cactgttaggacaaattcatta

SEQ ID NO: 710357 - DNA, 22 bp, Artificial Sequence
  chemically synthesized
atttggaacataatgaatttgt

SEQ ID NO: 710358 - DNA, 22 bp, Artificial Sequence
  chemically synthesized
ggaacataatgaatttgtccta

SEQ ID NO: 710359 - DNA, 22 bp, Artificial Sequence
  chemically synthesized
gaacataatgaatttgtcctaa

SEQ ID NO: 710360 - DNA, 22 bp, Artificial Sequence
  chemically synthesized
aatgtttcactgttaggacaaa

SEQ ID NO: 710361 - DNA, 22 bp, Artificial Sequence
  chemically synthesized
cagttaaatgtttcactgttag

SEQ ID NO: 710362 - DNA, 22 bp, Artificial Sequence
  chemically synthesized
gtcctaacagtgaaacatttaa

SEQ ID NO: 710363 - DNA, 22 bp, Artificial Sequence
  chemically synthesized
tcctaacagtgaaacatttaac

SEQ ID NO: 710364 - DNA, 22 bp, Artificial Sequence
  chemically synthesized
tacatgacatctccagttaaat

SEQ ID NO: 710365 - DNA, 22 bp, Artificial Sequence
  chemically synthesized
acagtgaaacatttaactggag

SEQ ID NO: 710366 - DNA, 22 bp, Artificial Sequence
  chemically synthesized
gctatacatgacatctccagtt

SEQ ID NO: 710367 - DNA, 22 bp, Artificial Sequence
  chemically synthesized
actggctatacatgacatctcc

SEQ ID NO: 710368 - DNA, 22 bp, Artificial Sequence
  chemically synthesized
taactggctatacatgacatct

SEQ ID NO: 710369 - DNA, 22 bp, Artificial Sequence
  chemically synthesized
atctctaactggctatacatga

SEQ ID NO: 710370 - DNA, 22 bp, Artificial Sequence
  chemically synthesized
aactggagatgtcatgtatagc

SEQ ID NO: 710371 - DNA, 22 bp, Artificial Sequence
  chemically synthesized
actggagatgtcatgtatagcc

SEQ ID NO: 710372 - DNA, 22 bp, Artificial Sequence
  chemically synthesized
ttcatctctaactggctataca

SEQ ID NO: 710373 - DNA, 22 bp, Artificial Sequence
  chemically synthesized
gagatgtcatgtatagccagtt

SEQ ID NO: 710374 - DNA, 22 bp, Artificial Sequence
  chemically synthesized
agacaaattgttcatctctaac

SEQ ID NO: 710375 - DNA, 22 bp, Artificial Sequence
  chemically synthesized
ctgagacaaattgttcatctct

SEQ ID NO: 710376 - DNA, 22 bp, Artificial Sequence
  chemically synthesized
attgctgagacaaattgttcat

SEQ ID NO: 710377 - DNA, 22 bp, Artificial Sequence
  chemically synthesized
aattgctgagacaaattgttca

SEQ ID NO: 710378 - DNA, 22 bp, Artificial Sequence
  chemically synthesized
taattgctgagacaaattgttc

SEQ ID NO: 710379 - DNA, 22 bp, Artificial Sequence
  chemically synthesized
tttaattgctgagacaaattgt

SEQ ID NO: 710380 - DNA, 22 bp, Artificial Sequence
  chemically synthesized
ctttaattgctgagacaaattg

SEQ ID NO: 710381 - DNA, 22 bp, Artificial Sequence
  chemically synthesized
tctttaattgctgagacaaatt

SEQ ID NO: 710382 - DNA, 22 bp, Artificial Sequence
  chemically synthesized
gagatgaacaatttgtctcagc

SEQ ID NO: 710383 - DNA, 22 bp, Artificial Sequence
  chemically synthesized
ctttctttaattgctgagacaa

SEQ ID NO: 710384 - DNA, 22 bp, Artificial Sequence
  chemically synthesized
cctttctttaattgctgagaca

SEQ ID NO: 710385 - DNA, 22 bp, Artificial Sequence
  chemically synthesized
tcctttctttaattgctgagac

SEQ ID NO: 710386 - DNA, 22 bp, Artificial Sequence
  chemically synthesized
cctttcctttctttaattgctg

SEQ ID NO: 710387 - DNA, 22 bp, Artificial Sequence
  chemically synthesized
ccctttcctttctttaattgct

SEQ ID NO: 710388 - DNA, 22 bp, Artificial Sequence
  chemically synthesized
acttccctttcctttctttaat

SEQ ID NO: 710389 - DNA, 22 bp, Artificial Sequence
  chemically synthesized
gtctcagcaattaaagaaagga

SEQ ID NO: 710390 - DNA, 22 bp, Artificial Sequence
  chemically synthesized
tctcagcaattaaagaaaggaa

SEQ ID NO: 710391 - DNA, 22 bp, Artificial Sequence
  chemically synthesized
gtctcacttccctttcctttct

SEQ ID NO: 710392 - DNA, 22 bp, Artificial Sequence
  chemically synthesized
agtctcacttccctttcctttc

SEQ ID NO: 710393 - DNA, 22 bp, Artificial Sequence
  chemically synthesized
tagtctcacttccctttccttt

SEQ ID NO: 710394 - DNA, 22 bp, Artificial Sequence
  chemically synthesized
agcaattaaagaaaggaaaggg

SEQ ID NO: 710395 - DNA, 22 bp, Artificial Sequence
  chemically synthesized
ttagtctcacttccctttcctt

SEQ ID NO: 710396 - DNA, 22 bp, Artificial Sequence
  chemically synthesized
ccccttttagtctcacttccct

SEQ ID NO: 710397 - DNA, 22 bp, Artificial Sequence
  chemically synthesized
accccttttagtctcacttccc

SEQ ID NO: 710398 - DNA, 22 bp, Artificial Sequence
  chemically synthesized
aagaaaggaaagggaagtgaga

SEQ ID NO: 710399 - DNA, 22 bp, Artificial Sequence
  chemically synthesized
ttaccccttttagtctcacttc

SEQ ID NO: 710400 - DNA, 22 bp, Artificial Sequence
  chemically synthesized
actcttaccccttttagtctca

SEQ ID NO: 710401 - DNA, 22 bp, Artificial Sequence
  chemically synthesized
caaagctcactcttaccccttt

SEQ ID NO: 710402 - DNA, 22 bp, Artificial Sequence
  chemically synthesized
ccaaagctcactcttacccctt

SEQ ID NO: 710403 - DNA, 22 bp, Artificial Sequence
  chemically synthesized
accttccaaagctcactcttac

SEQ ID NO: 710404 - DNA, 22 bp, Artificial Sequence
  chemically synthesized
gctcaccttccaaagctcactc

SEQ ID NO: 710405 - DNA, 22 bp, Artificial Sequence
  chemically synthesized
ggctcaccttccaaagctcact

SEQ ID NO: 710406 - DNA, 22 bp, Artificial Sequence
  chemically synthesized
aaaggggtaagagtgagctttg

SEQ ID NO: 710407 - DNA, 22 bp, Artificial Sequence
  chemically synthesized
ttggctcaccttccaaagctca

SEQ ID NO: 710408 - DNA, 22 bp, Artificial Sequence
  chemically synthesized
cttggctcaccttccaaagctc

SEQ ID NO: 710409 - DNA, 22 bp, Artificial Sequence
  chemically synthesized
tcttggctcaccttccaaagct

SEQ ID NO: 710410 - DNA, 22 bp, Artificial Sequence
  chemically synthesized
tttcttggctcaccttccaaag

SEQ ID NO: 710411 - DNA, 22 bp, Artificial Sequence
  chemically synthesized
ctttcttggctcaccttccaaa

SEQ ID NO: 710412 - DNA, 22 bp, Artificial Sequence
  chemically synthesized
ttctttcttggctcaccttcca

SEQ ID NO: 710413 - DNA, 22 bp, Artificial Sequence
  chemically synthesized
tctcttctttcttggctcacct

SEQ ID NO: 710414 - DNA, 22 bp, Artificial Sequence
  chemically synthesized
atctcttctttcttggctcacc

SEQ ID NO: 710415 - DNA, 22 bp, Artificial Sequence
  chemically synthesized
tatctcttctttcttggctcac

SEQ ID NO: 710416 - DNA, 22 bp, Artificial Sequence
  chemically synthesized
ctttatctcttctttcttggct

SEQ ID NO: 710417 - DNA, 22 bp, Artificial Sequence
  chemically synthesized
tggaaggtgagccaagaaagaa

SEQ ID NO: 710418 - DNA, 22 bp, Artificial Sequence
  chemically synthesized
ggaaggtgagccaagaaagaag

SEQ ID NO: 710419 - DNA, 22 bp, Artificial Sequence
  chemically synthesized
gaaggtgagccaagaaagaaga

SEQ ID NO: 710420 - DNA, 22 bp, Artificial Sequence
  chemically synthesized
aactcctttatctcttctttct

SEQ ID NO: 710421 - DNA, 22 bp, Artificial Sequence
  chemically synthesized
aaactcctttatctcttctttc

SEQ ID NO: 710422 - DNA, 22 bp, Artificial Sequence
  chemically synthesized
tttaaactcctttatctcttct

SEQ ID NO: 710423 - DNA, 22 bp, Artificial Sequence
  chemically synthesized
tatttaaactcctttatctctt

SEQ ID NO: 710424 - DNA, 22 bp, Artificial Sequence
  chemically synthesized
aatcattctatttaaactcctt

SEQ ID NO: 710425 - DNA, 22 bp, Artificial Sequence
  chemically synthesized
aaatcattctatttaaactcct

SEQ ID NO: 710426 - DNA, 22 bp, Artificial Sequence
  chemically synthesized
tttaaatcattctatttaaact

SEQ ID NO: 710427 - DNA, 22 bp, Artificial Sequence
  chemically synthesized
gctgtttaaatcattctattta

SEQ ID NO: 710428 - DNA, 22 bp, Artificial Sequence
  chemically synthesized
ctggctgtttaaatcattctat

SEQ ID NO: 710429 - DNA, 22 bp, Artificial Sequence
  chemically synthesized
ctcctggctgtttaaatcattc

SEQ ID NO: 710430 - DNA, 22 bp, Artificial Sequence
  chemically synthesized
ggttcctcctggctgtttaaat

SEQ ID NO: 710431 - DNA, 22 bp, Artificial Sequence
  chemically synthesized
aaatagaatgatttaaacagcc

SEQ ID NO: 710432 - DNA, 22 bp, Artificial Sequence
  chemically synthesized
aatagaatgatttaaacagcca

SEQ ID NO: 710433 - DNA, 22 bp, Artificial Sequence
  chemically synthesized
agaagagattgggttcctcctg

SEQ ID NO: 710434 - DNA, 22 bp, Artificial Sequence
  chemically synthesized
attcagaagagattgggttcct

SEQ ID NO: 710435 - DNA, 22 bp, Artificial Sequence
  chemically synthesized
aaacagccaggaggaacccaat

SEQ ID NO: 710436 - DNA, 22 bp, Artificial Sequence
  chemically synthesized
aacagccaggaggaacccaatc

SEQ ID NO: 710437 - DNA, 22 bp, Artificial Sequence
  chemically synthesized
ttaattcagaagagattgggtt

SEQ ID NO: 710438 - DNA, 22 bp, Artificial Sequence
  chemically synthesized
ttctgaattaatagggcatgtc

SEQ ID NO: 710439 - DNA, 22 bp, Artificial Sequence
  chemically synthesized
ctgaattaatagggcatgtctc

SEQ ID NO: 710440 - DNA, 22 bp, Artificial Sequence
  chemically synthesized
taaaaggaaacagagacatgcc

SEQ ID NO: 710441 - DNA, 22 bp, Artificial Sequence
  chemically synthesized
tgaattaatagggcatgtctct

SEQ ID NO: 710442 - DNA, 22 bp, Artificial Sequence
  chemically synthesized
ataaaaggaaacagagacatgc

SEQ ID NO: 710443 - DNA, 22 bp, Artificial Sequence
  chemically synthesized
tataaaaggaaacagagacatg

SEQ ID NO: 710444 - DNA, 22 bp, Artificial Sequence
  chemically synthesized
aattaatagggcatgtctctgt

SEQ ID NO: 710445 - DNA, 22 bp, Artificial Sequence
  chemically synthesized
ttataaaaggaaacagagacat

SEQ ID NO: 710446 - DNA, 22 bp, Artificial Sequence
  chemically synthesized
cttttataaaaggaaacagaga

SEQ ID NO: 710447 - DNA, 22 bp, Artificial Sequence
  chemically synthesized
atagggcatgtctctgtttcct

SEQ ID NO: 710448 - DNA, 22 bp, Artificial Sequence
  chemically synthesized
tattacttttataaaaggaaac

SEQ ID NO: 710449 - DNA, 22 bp, Artificial Sequence
  chemically synthesized
gtattacttttataaaaggaaa

SEQ ID NO: 710450 - DNA, 22 bp, Artificial Sequence
  chemically synthesized
tatttgtattacttttataaaa

SEQ ID NO: 710451 - DNA, 22 bp, Artificial Sequence
  chemically synthesized
tgtttccttttataaaagtaat

SEQ ID NO: 710452 - DNA, 22 bp, Artificial Sequence
  chemically synthesized
tttccttttataaaagtaatac

SEQ ID NO: 710453 - DNA, 22 bp, Artificial Sequence
  chemically synthesized
ccttttataaaagtaatacaaa

SEQ ID NO: 710454 - DNA, 22 bp, Artificial Sequence
  chemically synthesized
cttttataaaagtaatacaaat

SEQ ID NO: 710455 - DNA, 22 bp, Artificial Sequence
  chemically synthesized
caaaaagatgttatatttgtat

SEQ ID NO: 710456 - DNA, 22 bp, Artificial Sequence
  chemically synthesized
ttataaaagtaatacaaatata

SEQ ID NO: 710457 - DNA, 22 bp, Artificial Sequence
  chemically synthesized
ccaaaaagatgttatatttgta

SEQ ID NO: 710458 - DNA, 22 bp, Artificial Sequence
  chemically synthesized
tataaaagtaatacaaatataa

SEQ ID NO: 710459 - DNA, 22 bp, Artificial Sequence
  chemically synthesized
ataaaagtaatacaaatataac

SEQ ID NO: 710460 - DNA, 22 bp, Artificial Sequence
  chemically synthesized
taaaagtaatacaaatataaca

SEQ ID NO: 710461 - DNA, 22 bp, Artificial Sequence
  chemically synthesized
aaacaggatgtatgcttccaaa

SEQ ID NO: 710462 - DNA, 22 bp, Artificial Sequence
  chemically synthesized
atagttgaaacaggatgtatgc

SEQ ID NO: 710463 - DNA, 22 bp, Artificial Sequence
  chemically synthesized
tttggaagcatacatcctgttt

SEQ ID NO: 710464 - DNA, 22 bp, Artificial Sequence
  chemically synthesized
ttggaagcatacatcctgtttc

SEQ ID NO: 710465 - DNA, 22 bp, Artificial Sequence
  chemically synthesized
tggaagcatacatcctgtttca

SEQ ID NO: 710466 - DNA, 22 bp, Artificial Sequence
  chemically synthesized
tgatctaatagttgaaacagga

SEQ ID NO: 710467 - DNA, 22 bp, Artificial Sequence
  chemically synthesized
ggaagcatacatcctgtttcaa

SEQ ID NO: 710468 - DNA, 22 bp, Artificial Sequence
  chemically synthesized
gaagcatacatcctgtttcaac

SEQ ID NO: 710469 - DNA, 22 bp, Artificial Sequence
  chemically synthesized
gtgatctatgatctaatagttg

SEQ ID NO: 710470 - DNA, 22 bp, Artificial Sequence
  chemically synthesized
cgtgatctatgatctaatagtt

SEQ ID NO: 710471 - DNA, 22 bp, Artificial Sequence
  chemically synthesized
tcgtgatctatgatctaatagt

SEQ ID NO: 710472 - DNA, 22 bp, Artificial Sequence
  chemically synthesized
agctttcgtgatctatgatcta

SEQ ID NO: 710473 - DNA, 22 bp, Artificial Sequence
  chemically synthesized
tttcaactattagatcatagat

SEQ ID NO: 710474 - DNA, 22 bp, Artificial Sequence
  chemically synthesized
taagctttcgtgatctatgatc

SEQ ID NO: 710475 - DNA, 22 bp, Artificial Sequence
  chemically synthesized
caactattagatcatagatcac

SEQ ID NO: 710476 - DNA, 22 bp, Artificial Sequence
  chemically synthesized
aactattagatcatagatcacg

SEQ ID NO: 710477 - DNA, 22 bp, Artificial Sequence
  chemically synthesized
cagttctaagctttcgtgatct

SEQ ID NO: 710478 - DNA, 22 bp, Artificial Sequence
  chemically synthesized
ccagttctaagctttcgtgatc

SEQ ID NO: 710479 - DNA, 22 bp, Artificial Sequence
  chemically synthesized
ttagatcatagatcacgaaagc

SEQ ID NO: 710480 - DNA, 22 bp, Artificial Sequence
  chemically synthesized
ttccagttctaagctttcgtga

SEQ ID NO: 710481 - DNA, 22 bp, Artificial Sequence
  chemically synthesized
cttccagttctaagctttcgtg

SEQ ID NO: 710482 - DNA, 22 bp, Artificial Sequence
  chemically synthesized
gatcatagatcacgaaagctta

SEQ ID NO: 710483 - DNA, 22 bp, Artificial Sequence
  chemically synthesized
gtgtatcaatcaaggtttcttc

SEQ ID NO: 710484 - DNA, 22 bp, Artificial Sequence
  chemically synthesized
agaactggaagaaaccttgatt

SEQ ID NO: 710485 - DNA, 22 bp, Artificial Sequence
  chemically synthesized
gaactggaagaaaccttgattg

SEQ ID NO: 710486 - DNA, 22 bp, Artificial Sequence
  chemically synthesized
gaagaaaccttgattgatacac

SEQ ID NO: 710487 - DNA, 22 bp, Artificial Sequence
  chemically synthesized
aagaatagaccctcgtgtatca

SEQ ID NO: 710488 - DNA, 22 bp, Artificial Sequence
  chemically synthesized
tgaagaatagaccctcgtgtat

SEQ ID NO: 710489 - DNA, 22 bp, Artificial Sequence
  chemically synthesized
gattgatacacgagggtctatt

SEQ ID NO: 710490 - DNA, 22 bp, Artificial Sequence
  chemically synthesized
attgatacacgagggtctattc

SEQ ID NO: 710491 - DNA, 22 bp, Artificial Sequence
  chemically synthesized
ggatagttctgaagaatagacc

SEQ ID NO: 710492 - DNA, 22 bp, Artificial Sequence
  chemically synthesized
atacacgagggtctattcttca

SEQ ID NO: 710493 - DNA, 22 bp, Artificial Sequence
  chemically synthesized
cccatctgggatagttctgaag

SEQ ID NO: 710494 - DNA, 22 bp, Artificial Sequence
  chemically synthesized
tgcccatctgggatagttctga

SEQ ID NO: 710495 - DNA, 22 bp, Artificial Sequence
  chemically synthesized
ctgcccatctgggatagttctg

SEQ ID NO: 710496 - DNA, 22 bp, Artificial Sequence
  chemically synthesized
tctgcccatctgggatagttct

SEQ ID NO: 710497 - DNA, 22 bp, Artificial Sequence
  chemically synthesized
ttcttcagaactatcccagatg

SEQ ID NO: 710498 - DNA, 22 bp, Artificial Sequence
  chemically synthesized
ttcagaactatcccagatgggc

SEQ ID NO: 710499 - DNA, 22 bp, Artificial Sequence
  chemically synthesized
cagaactatcccagatgggcag

SEQ ID NO: 710500 - DNA, 22 bp, Artificial Sequence
  chemically synthesized
agaactatcccagatgggcaga

SEQ ID NO: 710501 - DNA, 22 bp, Artificial Sequence
  chemically synthesized
tcccagatgggcagaaaactgc

SEQ ID NO: 710502 - DNA, 22 bp, Artificial Sequence
  chemically synthesized
atggaccagatggcagttttct

SEQ ID NO: 710503 - DNA, 22 bp, Artificial Sequence
  chemically synthesized
tcatggaccagatggcagtttt

SEQ ID NO: 710504 - DNA, 22 bp, Artificial Sequence
  chemically synthesized
tgagttctcatggaccagatgg

SEQ ID NO: 710505 - DNA, 22 bp, Artificial Sequence
  chemically synthesized
gattatgagttctcatggacca

SEQ ID NO: 710506 - DNA, 22 bp, Artificial Sequence
  chemically synthesized
ccatctggtccatgagaactca

SEQ ID NO: 710507 - DNA, 22 bp, Artificial Sequence
  chemically synthesized
caacctagattatgagttctca

SEQ ID NO: 710508 - DNA, 22 bp, Artificial Sequence
  chemically synthesized
ctgcaacctagattatgagttc

SEQ ID NO: 710509 - DNA, 22 bp, Artificial Sequence
  chemically synthesized
gtccatgagaactcataatcta

SEQ ID NO: 710510 - DNA, 22 bp, Artificial Sequence
  chemically synthesized
aagaattgctgcaacctagatt

SEQ ID NO: 710511 - DNA, 22 bp, Artificial Sequence
  chemically synthesized
ctgaagaattgctgcaacctag

SEQ ID NO: 710512 - DNA, 22 bp, Artificial Sequence
  chemically synthesized
actgaagaattgctgcaaccta

SEQ ID NO: 710513 - DNA, 22 bp, Artificial Sequence
  chemically synthesized
tactgaagaattgctgcaacct

SEQ ID NO: 710514 - DNA, 22 bp, Artificial Sequence
  chemically synthesized
ttactgaagaattgctgcaacc

SEQ ID NO: 710515 - DNA, 22 bp, Artificial Sequence
  chemically synthesized
ataatctaggttgcagcaattc

SEQ ID NO: 710516 - DNA, 22 bp, Artificial Sequence
  chemically synthesized
agatgcttttactgaagaattg

SEQ ID NO: 710517 - DNA, 22 bp, Artificial Sequence
  chemically synthesized
ctgagatgcttttactgaagaa

SEQ ID NO: 710518 - DNA, 22 bp, Artificial Sequence
  chemically synthesized
ggttgcagcaattcttcagtaa

SEQ ID NO: 710519 - DNA, 22 bp, Artificial Sequence
  chemically synthesized
cctgagatgcttttactgaaga

SEQ ID NO: 710520 - DNA, 22 bp, Artificial Sequence
  chemically synthesized
tcctgagatgcttttactgaag

SEQ ID NO: 710521 - DNA, 22 bp, Artificial Sequence
  chemically synthesized
ttcctgagatgcttttactgaa

SEQ ID NO: 710522 - DNA, 22 bp, Artificial Sequence
  chemically synthesized
tttcctgagatgcttttactga

SEQ ID NO: 710523 - DNA, 22 bp, Artificial Sequence
  chemically synthesized
ttttcctgagatgcttttactg

SEQ ID NO: 710524 - DNA, 22 bp, Artificial Sequence
  chemically synthesized
cagcaattcttcagtaaaagca

SEQ ID NO: 710525 - DNA, 22 bp, Artificial Sequence
  chemically synthesized
tttttcctgagatgcttttact

SEQ ID NO: 710526 - DNA, 22 bp, Artificial Sequence
  chemically synthesized
ttcagtaaaagcatctcaggaa

SEQ ID NO: 710527 - DNA, 22 bp, Artificial Sequence
  chemically synthesized
cagtaaaagcatctcaggaaaa

SEQ ID NO: 710528 - DNA, 22 bp, Artificial Sequence
  chemically synthesized
agtaaaagcatctcaggaaaaa

SEQ ID NO: 710529 - DNA, 22 bp, Artificial Sequence
  chemically synthesized
atggaacatataaaaaaggacc

SEQ ID NO: 710530 - DNA, 22 bp, Artificial Sequence
  chemically synthesized
aggaaaaaaaggtcctttttta

SEQ ID NO: 710531 - DNA, 22 bp, Artificial Sequence
  chemically synthesized
tcctcatggaacatataaaaaa

SEQ ID NO: 710532 - DNA, 22 bp, Artificial Sequence
  chemically synthesized
ttttatatgttccatgaggaca

SEQ ID NO: 710533 - DNA, 22 bp, Artificial Sequence
  chemically synthesized
tttatatgttccatgaggacag

SEQ ID NO: 710534 - DNA, 22 bp, Artificial Sequence
  chemically synthesized
ttatatgttccatgaggacagg

SEQ ID NO: 710535 - DNA, 22 bp, Artificial Sequence
  chemically synthesized
tatatgttccatgaggacaggg

SEQ ID NO: 710536 - DNA, 22 bp, Artificial Sequence
  chemically synthesized
atatgttccatgaggacaggga

SEQ ID NO: 710537 - DNA, 22 bp, Artificial Sequence
  chemically synthesized
tatgttccatgaggacagggac

SEQ ID NO: 710538 - DNA, 22 bp, Artificial Sequence
  chemically synthesized
gcagggaaagatgtgtccctgt

SEQ ID NO: 710539 - DNA, 22 bp, Artificial Sequence
  chemically synthesized
agcagggaaagatgtgtccctg

SEQ ID NO: 710540 - DNA, 22 bp, Artificial Sequence
  chemically synthesized
catgaggacagggacacatctt

SEQ ID NO: 710541 - DNA, 22 bp, Artificial Sequence
  chemically synthesized
aggatttagcagggaaagatgt

SEQ ID NO: 710542 - DNA, 22 bp, Artificial Sequence
  chemically synthesized
actgaggatttagcagggaaag

SEQ ID NO: 710543 - DNA, 22 bp, Artificial Sequence
  chemically synthesized
ctcactgaggatttagcaggga

SEQ ID NO: 710544 - DNA, 22 bp, Artificial Sequence
  chemically synthesized
tgctactcactgaggatttagc

SEQ ID NO: 710545 - DNA, 22 bp, Artificial Sequence
  chemically synthesized
tccctgctaaatcctcagtgag

SEQ ID NO: 710546 - DNA, 22 bp, Artificial Sequence
  chemically synthesized
ccctgctaaatcctcagtgagt

SEQ ID NO: 710547 - DNA, 22 bp, Artificial Sequence
  chemically synthesized
cctgctaaatcctcagtgagta

SEQ ID NO: 710548 - DNA, 22 bp, Artificial Sequence
  chemically synthesized
ctaaatcctcagtgagtagcac

SEQ ID NO: 710549 - DNA, 22 bp, Artificial Sequence
  chemically synthesized
tatgccaggtactgtgctactc

SEQ ID NO: 710550 - DNA, 22 bp, Artificial Sequence
  chemically synthesized
aatcctcagtgagtagcacagt

SEQ ID NO: 710551 - DNA, 22 bp, Artificial Sequence
  chemically synthesized
ttatatgccaggtactgtgcta

SEQ ID NO: 710552 - DNA, 22 bp, Artificial Sequence
  chemically synthesized
agtgagtagcacagtacctggc

SEQ ID NO: 710553 - DNA, 22 bp, Artificial Sequence
  chemically synthesized
gcacctattatatgccaggtac

SEQ ID NO: 710554 - DNA, 22 bp, Artificial Sequence
  chemically synthesized
agcacctattatatgccaggta

SEQ ID NO: 710555 - DNA, 22 bp, Artificial Sequence
  chemically synthesized
atttagcacctattatatgcca

SEQ ID NO: 710556 - DNA, 22 bp, Artificial Sequence
  chemically synthesized
atattaatttagcacctattat

SEQ ID NO: 710557 - DNA, 22 bp, Artificial Sequence
  chemically synthesized
aactaatattaatttagcacct

SEQ ID NO: 710558 - DNA, 22 bp, Artificial Sequence
  chemically synthesized
gcatataataggtgctaaatta

SEQ ID NO: 710559 - DNA, 22 bp, Artificial Sequence
  chemically synthesized
attcaactaatattaatttagc

SEQ ID NO: 710560 - DNA, 22 bp, Artificial Sequence
  chemically synthesized
attcattcaactaatattaatt

SEQ ID NO: 710561 - DNA, 22 bp, Artificial Sequence
  chemically synthesized
aattaatattagttgaatgaat

SEQ ID NO: 710562 - DNA, 22 bp, Artificial Sequence
  chemically synthesized
atattagttgaatgaattaatg

SEQ ID NO: 710563 - DNA, 22 bp, Artificial Sequence
  chemically synthesized
gttgaatgaattaatgtactgt

SEQ ID NO: 710564 - DNA, 22 bp, Artificial Sequence
  chemically synthesized
aatgaattaatgtactgtttat

SEQ ID NO: 710565 - DNA, 22 bp, Artificial Sequence
  chemically synthesized
atagtaaagatccgtgaataaa

SEQ ID NO: 710566 - DNA, 22 bp, Artificial Sequence
  chemically synthesized
ttaatagtaaagatccgtgaat

SEQ ID NO: 710567 - DNA, 22 bp, Artificial Sequence
  chemically synthesized
atgtactgtttattcacggatc

SEQ ID NO: 710568 - DNA, 22 bp, Artificial Sequence
  chemically synthesized
tttattcacggatctttactat

SEQ ID NO: 710569 - DNA, 22 bp, Artificial Sequence
  chemically synthesized
attcacggatctttactattaa

SEQ ID NO: 710570 - DNA, 22 bp, Artificial Sequence
  chemically synthesized
aaaatatagttgttaatagtaa

SEQ ID NO: 710571 - DNA, 22 bp, Artificial Sequence
  chemically synthesized
ttcacggatctttactattaac

SEQ ID NO: 710572 - DNA, 22 bp, Artificial Sequence
  chemically synthesized
acggatctttactattaacaac

SEQ ID NO: 710573 - DNA, 22 bp, Artificial Sequence
  chemically synthesized
attcaaaatatagttgttaata

SEQ ID NO: 710574 - DNA, 22 bp, Artificial Sequence
  chemically synthesized
tactattaacaactatattttg

SEQ ID NO: 710575 - DNA, 22 bp, Artificial Sequence
  chemically synthesized
actattaacaactatattttga

SEQ ID NO: 710576 - DNA, 22 bp, Artificial Sequence
  chemically synthesized
ctattaacaactatattttgaa

SEQ ID NO: 710577 - DNA, 22 bp, Artificial Sequence
  chemically synthesized
ttaacaactatattttgaatga

SEQ ID NO: 710578 - DNA, 22 bp, Artificial Sequence
  chemically synthesized
aaaaagaaatgattcattcaaa

SEQ ID NO: 710579 - DNA, 22 bp, Artificial Sequence
  chemically synthesized
gaaaaagaaatgattcattcaa

SEQ ID NO: 710580 - DNA, 22 bp, Artificial Sequence
  chemically synthesized
acaactatattttgaatgaatc

SEQ ID NO: 710581 - DNA, 22 bp, Artificial Sequence
  chemically synthesized
tattttgaatgaatcatttctt

SEQ ID NO: 710582 - DNA, 22 bp, Artificial Sequence
  chemically synthesized
tgaatgaatcatttctttttca

SEQ ID NO: 710583 - DNA, 22 bp, Artificial Sequence
  chemically synthesized
tgtcagggatcttgaaaaagaa

SEQ ID NO: 710584 - DNA, 22 bp, Artificial Sequence
  chemically synthesized
gaatgaatcatttctttttcaa

SEQ ID NO: 710585 - DNA, 22 bp, Artificial Sequence
  chemically synthesized
gtgtcagggatcttgaaaaaga

SEQ ID NO: 710586 - DNA, 22 bp, Artificial Sequence
  chemically synthesized
aatgaatcatttctttttcaag

SEQ ID NO: 710587 - DNA, 22 bp, Artificial Sequence
  chemically synthesized
aaaagcttgtgtcagggatctt

SEQ ID NO: 710588 - DNA, 22 bp, Artificial Sequence
  chemically synthesized
caaaagcttgtgtcagggatct

SEQ ID NO: 710589 - DNA, 22 bp, Artificial Sequence
  chemically synthesized
tcaaaagcttgtgtcagggatc

SEQ ID NO: 710590 - DNA, 22 bp, Artificial Sequence
  chemically synthesized
ttcaaaagcttgtgtcagggat

SEQ ID NO: 710591 - DNA, 22 bp, Artificial Sequence
  chemically synthesized
ctttttcaagatccctgacaca

SEQ ID NO: 710592 - DNA, 22 bp, Artificial Sequence
  chemically synthesized
tttttcaagatccctgacacaa

SEQ ID NO: 710593 - DNA, 22 bp, Artificial Sequence
  chemically synthesized
tttcaagatccctgacacaagc

SEQ ID NO: 710594 - DNA, 22 bp, Artificial Sequence
  chemically synthesized
ttcaagatccctgacacaagct

SEQ ID NO: 710595 - DNA, 22 bp, Artificial Sequence
  chemically synthesized
tcaagatccctgacacaagctt

SEQ ID NO: 710596 - DNA, 22 bp, Artificial Sequence
  chemically synthesized
caagatccctgacacaagcttt

SEQ ID NO: 710597 - DNA, 22 bp, Artificial Sequence
  chemically synthesized
aagatccctgacacaagctttt

SEQ ID NO: 710598 - DNA, 22 bp, Artificial Sequence
  chemically synthesized
acacaagcttttgaaaaacttc

SEQ ID NO: 710599 - DNA, 22 bp, Artificial Sequence
  chemically synthesized
ttgaaaaacttccctccctccc

SEQ ID NO: 710600 - DNA, 22 bp, Artificial Sequence
  chemically synthesized
tgaaaaacttccctccctccct

SEQ ID NO: 710601 - DNA, 22 bp, Artificial Sequence
  chemically synthesized
gaaaaacttccctccctccctt

SEQ ID NO: 710602 - DNA, 22 bp, Artificial Sequence
  chemically synthesized
aaaaacttccctccctcccttc

SEQ ID NO: 710603 - DNA, 22 bp, Artificial Sequence
  chemically synthesized
ccctccctcccttcttcctttc

SEQ ID NO: 710604 - DNA, 22 bp, Artificial Sequence
  chemically synthesized
cctccctcccttcttcctttcc

SEQ ID NO: 710605 - DNA, 22 bp, Artificial Sequence
  chemically synthesized
cctcccttcttcctttccttct

SEQ ID NO: 710606 - DNA, 22 bp, Artificial Sequence
  chemically synthesized
ccttcttcctttccttcttttc

SEQ ID NO: 710607 - DNA, 22 bp, Artificial Sequence
  chemically synthesized
cttcctttccttcttttcttcc

SEQ ID NO: 710608 - DNA, 22 bp, Artificial Sequence
  chemically synthesized
ttcctttccttcttttcttcct

SEQ ID NO: 710609 - DNA, 22 bp, Artificial Sequence
  chemically synthesized
cctttccttcttttcttccttc

SEQ ID NO: 710610 - DNA, 22 bp, Artificial Sequence
  chemically synthesized
ctttccttcttttcttccttcc

SEQ ID NO: 710611 - DNA, 22 bp, Artificial Sequence
  chemically synthesized
tccttcttttcttccttcctcc

SEQ ID NO: 710612 - DNA, 22 bp, Artificial Sequence
  chemically synthesized
ccttcttttcttccttcctcct

SEQ ID NO: 710613 - DNA, 22 bp, Artificial Sequence
  chemically synthesized
cttcttttcttccttcctcctt

SEQ ID NO: 710614 - DNA, 22 bp, Artificial Sequence
  chemically synthesized
cttttcttccttcctccttttc

SEQ ID NO: 710615 - DNA, 22 bp, Artificial Sequence
  chemically synthesized
ttttcttccttcctccttttct

SEQ ID NO: 710616 - DNA, 22 bp, Artificial Sequence
  chemically synthesized
ttcttccttcctccttttcttc

SEQ ID NO: 710617 - DNA, 22 bp, Artificial Sequence
  chemically synthesized
tcttccttcctccttttcttcc

SEQ ID NO: 710618 - DNA, 22 bp, Artificial Sequence
  chemically synthesized
cttccttcctccttttcttcct

SEQ ID NO: 710619 - DNA, 22 bp, Artificial Sequence
  chemically synthesized
ttccttcctccttttcttcctt

SEQ ID NO: 710620 - DNA, 22 bp, Artificial Sequence
  chemically synthesized
ccttcctccttttcttcctttc

SEQ ID NO: 710621 - DNA, 22 bp, Artificial Sequence
  chemically synthesized
cttcctccttttcttcctttct

SEQ ID NO: 710622 - DNA, 22 bp, Artificial Sequence
  chemically synthesized
cctccttttcttcctttcttcc

SEQ ID NO: 710623 - DNA, 22 bp, Artificial Sequence
  chemically synthesized
atcatcaaaaatggaagaaagg

SEQ ID NO: 710624 - DNA, 22 bp, Artificial Sequence
  chemically synthesized
ctccttttcttcctttcttcca

SEQ ID NO: 710625 - DNA, 22 bp, Artificial Sequence
  chemically synthesized
catcatcaaaaatggaagaaag

SEQ ID NO: 710626 - DNA, 22 bp, Artificial Sequence
  chemically synthesized
tcatcatcaaaaatggaagaaa

SEQ ID NO: 710627 - DNA, 22 bp, Artificial Sequence
  chemically synthesized
cttttcttcctttcttccattt

SEQ ID NO: 710628 - DNA, 22 bp, Artificial Sequence
  chemically synthesized
ctttcatcatcaaaaatggaag

SEQ ID NO: 710629 - DNA, 22 bp, Artificial Sequence
  chemically synthesized
actttcatcatcaaaaatggaa

SEQ ID NO: 710630 - DNA, 22 bp, Artificial Sequence
  chemically synthesized
ttcttcctttcttccatttttg

SEQ ID NO: 710631 - DNA, 22 bp, Artificial Sequence
  chemically synthesized
tactttcatcatcaaaaatgga

SEQ ID NO: 710632 - DNA, 22 bp, Artificial Sequence
  chemically synthesized
tcttcctttcttccatttttga

SEQ ID NO: 710633 - DNA, 22 bp, Artificial Sequence
  chemically synthesized
ttactttcatcatcaaaaatgg

SEQ ID NO: 710634 - DNA, 22 bp, Artificial Sequence
  chemically synthesized
cttcctttcttccatttttgat

SEQ ID NO: 710635 - DNA, 22 bp, Artificial Sequence
  chemically synthesized
tttactttcatcatcaaaaatg

SEQ ID NO: 710636 - DNA, 22 bp, Artificial Sequence
  chemically synthesized
ttcctttcttccatttttgatg

SEQ ID NO: 710637 - DNA, 22 bp, Artificial Sequence
  chemically synthesized
ttttactttcatcatcaaaaat

SEQ ID NO: 710638 - DNA, 22 bp, Artificial Sequence
  chemically synthesized
tttttactttcatcatcaaaaa

SEQ ID NO: 710639 - DNA, 22 bp, Artificial Sequence
  chemically synthesized
cctttcttccatttttgatgat

SEQ ID NO: 710640 - DNA, 22 bp, Artificial Sequence
  chemically synthesized
ttttttactttcatcatcaaaa

SEQ ID NO: 710641 - DNA, 22 bp, Artificial Sequence
  chemically synthesized
ctttcttccatttttgatgatg

SEQ ID NO: 710642 - DNA, 22 bp, Artificial Sequence
  chemically synthesized
ttttttttactttcatcatcaa

SEQ ID NO: 710643 - DNA, 22 bp, Artificial Sequence
  chemically synthesized
cttttttttactttcatcatca

SEQ ID NO: 710644 - DNA, 22 bp, Artificial Sequence
  chemically synthesized
tcttccatttttgatgatgaaa

SEQ ID NO: 710645 - DNA, 22 bp, Artificial Sequence
  chemically synthesized
tcttttttttactttcatcatc

SEQ ID NO: 710646 - DNA, 22 bp, Artificial Sequence
  chemically synthesized
cttccatttttgatgatgaaag

SEQ ID NO: 710647 - DNA, 22 bp, Artificial Sequence
  chemically synthesized
ttcttttttttactttcatcat

SEQ ID NO: 710648 - DNA, 22 bp, Artificial Sequence
  chemically synthesized
ttccatttttgatgatgaaagt

SEQ ID NO: 710649 - DNA, 22 bp, Artificial Sequence
  chemically synthesized
ttttcttttttttactttcatc

SEQ ID NO: 710650 - DNA, 22 bp, Artificial Sequence
  chemically synthesized
ccatttttgatgatgaaagtaa

SEQ ID NO: 710651 - DNA, 22 bp, Artificial Sequence
  chemically synthesized
cttttcttttttttactttcat

SEQ ID NO: 710652 - DNA, 22 bp, Artificial Sequence
  chemically synthesized
catttttgatgatgaaagtaaa

SEQ ID NO: 710653 - DNA, 22 bp, Artificial Sequence
  chemically synthesized
ttcttttcttttttttactttc

SEQ ID NO: 710654 - DNA, 22 bp, Artificial Sequence
  chemically synthesized
cttcttttcttttttttacttt

SEQ ID NO: 710655 - DNA, 22 bp, Artificial Sequence
  chemically synthesized
tcttcttttcttttttttactt

SEQ ID NO: 710656 - DNA, 22 bp, Artificial Sequence
  chemically synthesized
ttgatgatgaaagtaaaaaaaa

SEQ ID NO: 710657 - DNA, 22 bp, Artificial Sequence
  chemically synthesized
tgatgatgaaagtaaaaaaaag

SEQ ID NO: 710658 - DNA, 22 bp, Artificial Sequence
  chemically synthesized
gatgatgaaagtaaaaaaaaga

SEQ ID NO: 710659 - DNA, 22 bp, Artificial Sequence
  chemically synthesized
atgatgaaagtaaaaaaaagaa

SEQ ID NO: 710660 - DNA, 22 bp, Artificial Sequence
  chemically synthesized
aatggttttcttcttttctttt

SEQ ID NO: 710661 - DNA, 22 bp, Artificial Sequence
  chemically synthesized
aatctaaatggttttcttcttt

SEQ ID NO: 710662 - DNA, 22 bp, Artificial Sequence
  chemically synthesized
taggcaaaattgaatctaaatg

SEQ ID NO: 710663 - DNA, 22 bp, Artificial Sequence
  chemically synthesized
gtattataggcaaaattgaatc

SEQ ID NO: 710664 - DNA, 22 bp, Artificial Sequence
  chemically synthesized
aatctagtattataggcaaaat

SEQ ID NO: 710665 - DNA, 22 bp, Artificial Sequence
  chemically synthesized
aaatctagtattataggcaaaa

SEQ ID NO: 710666 - DNA, 22 bp, Artificial Sequence
  chemically synthesized
taaatctagtattataggcaaa

SEQ ID NO: 710667 - DNA, 22 bp, Artificial Sequence
  chemically synthesized
ttaaatctagtattataggcaa

SEQ ID NO: 710668 - DNA, 22 bp, Artificial Sequence
  chemically synthesized
agattcaattttgcctataata

SEQ ID NO: 710669 - DNA, 22 bp, Artificial Sequence
  chemically synthesized
gattcaattttgcctataatac

SEQ ID NO: 710670 - DNA, 22 bp, Artificial Sequence
  chemically synthesized
catttttaaatctagtattata

SEQ ID NO: 710671 - DNA, 22 bp, Artificial Sequence
  chemically synthesized
acatttttaaatctagtattat

SEQ ID NO: 710672 - DNA, 22 bp, Artificial Sequence
  chemically synthesized
tacatttttaaatctagtatta

SEQ ID NO: 710673 - DNA, 22 bp, Artificial Sequence
  chemically synthesized
aattttgcctataatactagat

SEQ ID NO: 710674 - DNA, 22 bp, Artificial Sequence
  chemically synthesized
tgcctataatactagatttaaa

SEQ ID NO: 710675 - DNA, 22 bp, Artificial Sequence
  chemically synthesized
ccgttttacatttttaaatcta

SEQ ID NO: 710676 - DNA, 22 bp, Artificial Sequence
  chemically synthesized
gcctataatactagatttaaaa

SEQ ID NO: 710677 - DNA, 22 bp, Artificial Sequence
  chemically synthesized
cctataatactagatttaaaaa

SEQ ID NO: 710678 - DNA, 22 bp, Artificial Sequence
  chemically synthesized
taatactagatttaaaaatgta

SEQ ID NO: 710679 - DNA, 22 bp, Artificial Sequence
  chemically synthesized
taaattgccgttttacattttt

SEQ ID NO: 710680 - DNA, 22 bp, Artificial Sequence
  chemically synthesized
ataaattgccgttttacatttt

SEQ ID NO: 710681 - DNA, 22 bp, Artificial Sequence
  chemically synthesized
tataaattgccgttttacattt

SEQ ID NO: 710682 - DNA, 22 bp, Artificial Sequence
  chemically synthesized
ttttataaattgccgttttaca

SEQ ID NO: 710683 - DNA, 22 bp, Artificial Sequence
  chemically synthesized
gatttaaaaatgtaaaacggca

SEQ ID NO: 710684 - DNA, 22 bp, Artificial Sequence
  chemically synthesized
aaaaatgtaaaacggcaattta

SEQ ID NO: 710685 - DNA, 22 bp, Artificial Sequence
  chemically synthesized
agggttgttttataaattgccg

SEQ ID NO: 710686 - DNA, 22 bp, Artificial Sequence
  chemically synthesized
aaaatgtaaaacggcaatttat

SEQ ID NO: 710687 - DNA, 22 bp, Artificial Sequence
  chemically synthesized
cagggttgttttataaattgcc

SEQ ID NO: 710688 - DNA, 22 bp, Artificial Sequence
  chemically synthesized
gacttcagggttgttttataaa

SEQ ID NO: 710689 - DNA, 22 bp, Artificial Sequence
  chemically synthesized
ggacttcagggttgttttataa

SEQ ID NO: 710690 - DNA, 22 bp, Artificial Sequence
  chemically synthesized
ataaaacaaccctgaagtccaa

SEQ ID NO: 710691 - DNA, 22 bp, Artificial Sequence
  chemically synthesized
taaaacaaccctgaagtccaaa

SEQ ID NO: 710692 - DNA, 22 bp, Artificial Sequence
  chemically synthesized
gagtaaaacaaatgtggaggag

SEQ ID NO: 710693 - DNA, 22 bp, Artificial Sequence
  chemically synthesized
aagtccaaatctcctccacatt

SEQ ID NO: 710694 - DNA, 22 bp, Artificial Sequence
  chemically synthesized
aaaactagagtaaaacaaatgt

SEQ ID NO: 710695 - DNA, 22 bp, Artificial Sequence
  chemically synthesized
aaaaactagagtaaaacaaatg

SEQ ID NO: 710696 - DNA, 22 bp, Artificial Sequence
  chemically synthesized
tttaaaaactagagtaaaacaa

SEQ ID NO: 710697 - DNA, 22 bp, Artificial Sequence
  chemically synthesized
ctccacatttgttttactctag

SEQ ID NO: 710698 - DNA, 22 bp, Artificial Sequence
  chemically synthesized
cacatttgttttactctagttt

SEQ ID NO: 710699 - DNA, 22 bp, Artificial Sequence
  chemically synthesized
aatatgattatttaaaaactag

SEQ ID NO: 710700 - DNA, 22 bp, Artificial Sequence
  chemically synthesized
aaatatgattatttaaaaacta

SEQ ID NO: 710701 - DNA, 22 bp, Artificial Sequence
  chemically synthesized
gttttactctagtttttaaata

SEQ ID NO: 710702 - DNA, 22 bp, Artificial Sequence
  chemically synthesized
ttttactctagtttttaaataa

SEQ ID NO: 710703 - DNA, 22 bp, Artificial Sequence
  chemically synthesized
tactctagtttttaaataatca

SEQ ID NO: 710704 - DNA, 22 bp, Artificial Sequence
  chemically synthesized
aaatcttaaatatgattattta

SEQ ID NO: 710705 - DNA, 22 bp, Artificial Sequence
  chemically synthesized
actctagtttttaaataatcat

SEQ ID NO: 710706 - DNA, 22 bp, Artificial Sequence
  chemically synthesized
ctctagtttttaaataatcata

SEQ ID NO: 710707 - DNA, 22 bp, Artificial Sequence
  chemically synthesized
tcaaatcttaaatatgattatt

SEQ ID NO: 710708 - DNA, 22 bp, Artificial Sequence
  chemically synthesized
tagtttttaaataatcatattt

SEQ ID NO: 710709 - DNA, 22 bp, Artificial Sequence
  chemically synthesized
gtttttaaataatcatatttaa

SEQ ID NO: 710710 - DNA, 22 bp, Artificial Sequence
  chemically synthesized
ataactctcaaatcttaaatat

SEQ ID NO: 710711 - DNA, 22 bp, Artificial Sequence
  chemically synthesized
ttaaataatcatatttaagatt

SEQ ID NO: 710712 - DNA, 22 bp, Artificial Sequence
  chemically synthesized
taaataatcatatttaagattt

SEQ ID NO: 710713 - DNA, 22 bp, Artificial Sequence
  chemically synthesized
aaataatcatatttaagatttg

SEQ ID NO: 710714 - DNA, 22 bp, Artificial Sequence
  chemically synthesized
aataatcatatttaagatttga

SEQ ID NO: 710715 - DNA, 22 bp, Artificial Sequence
  chemically synthesized
aagatttgagagttatgagggc

SEQ ID NO: 710716 - DNA, 22 bp, Artificial Sequence
  chemically synthesized
agatttgagagttatgagggct

SEQ ID NO: 710717 - DNA, 22 bp, Artificial Sequence
  chemically synthesized
gagagttatgagggctatatat

SEQ ID NO: 710718 - DNA, 22 bp, Artificial Sequence
  chemically synthesized
agagttatgagggctatatatt

SEQ ID NO: 710719 - DNA, 22 bp, Artificial Sequence
  chemically synthesized
tgagggctatatattattctcc

SEQ ID NO: 710720 - DNA, 22 bp, Artificial Sequence
  chemically synthesized
aaatgagaagaccaaggagaat

SEQ ID NO: 710721 - DNA, 22 bp, Artificial Sequence
  chemically synthesized
atctgaaatgagaagaccaagg

SEQ ID NO: 710722 - DNA, 22 bp, Artificial Sequence
  chemically synthesized
tatattattctccttggtcttc

SEQ ID NO: 710723 - DNA, 22 bp, Artificial Sequence
  chemically synthesized
ttctccttggtcttctcatttc

SEQ ID NO: 710724 - DNA, 22 bp, Artificial Sequence
  chemically synthesized
cagaactcatctgaaatgagaa

SEQ ID NO: 710725 - DNA, 22 bp, Artificial Sequence
  chemically synthesized
tccttggtcttctcatttcaga

SEQ ID NO: 710726 - DNA, 22 bp, Artificial Sequence
  chemically synthesized
tctacagaactcatctgaaatg

SEQ ID NO: 710727 - DNA, 22 bp, Artificial Sequence
  chemically synthesized
cttggtcttctcatttcagatg

SEQ ID NO: 710728 - DNA, 22 bp, Artificial Sequence
  chemically synthesized
ggtcttctcatttcagatgagt

SEQ ID NO: 710729 - DNA, 22 bp, Artificial Sequence
  chemically synthesized
gtcttctcatttcagatgagtt

SEQ ID NO: 710730 - DNA, 22 bp, Artificial Sequence
  chemically synthesized
ctcatttcagatgagttctgta

SEQ ID NO: 710731 - DNA, 22 bp, Artificial Sequence
  chemically synthesized
tcatttcagatgagttctgtag

SEQ ID NO: 710732 - DNA, 22 bp, Artificial Sequence
  chemically synthesized
atttcagatgagttctgtagac

SEQ ID NO: 710733 - DNA, 22 bp, Artificial Sequence
  chemically synthesized
caaacagtatactgtctacaga

SEQ ID NO: 710734 - DNA, 22 bp, Artificial Sequence
  chemically synthesized
tgcaaacagtatactgtctaca

SEQ ID NO: 710735 - DNA, 22 bp, Artificial Sequence
  chemically synthesized
cagatgagttctgtagacagta

SEQ ID NO: 710736 - DNA, 22 bp, Artificial Sequence
  chemically synthesized
agatgagttctgtagacagtat

SEQ ID NO: 710737 - DNA, 22 bp, Artificial Sequence
  chemically synthesized
tgtagacagtatactgtttgca

SEQ ID NO: 710738 - DNA, 22 bp, Artificial Sequence
  chemically synthesized
tagacagtatactgtttgcaga

SEQ ID NO: 710739 - DNA, 22 bp, Artificial Sequence
  chemically synthesized
agaaaggaaggtctctgcaaac

SEQ ID NO: 710740 - DNA, 22 bp, Artificial Sequence
  chemically synthesized
aagctaagaaaggaaggtctct

SEQ ID NO: 710741 - DNA, 22 bp, Artificial Sequence
  chemically synthesized
ctgaagctaagaaaggaaggtc

SEQ ID NO: 710742 - DNA, 22 bp, Artificial Sequence
  chemically synthesized
actgaagctaagaaaggaaggt

SEQ ID NO: 710743 - DNA, 22 bp, Artificial Sequence
  chemically synthesized
ttactgaagctaagaaaggaag

SEQ ID NO: 710744 - DNA, 22 bp, Artificial Sequence
  chemically synthesized
tttgcagagaccttcctttctt

SEQ ID NO: 710745 - DNA, 22 bp, Artificial Sequence
  chemically synthesized
cttactgaagctaagaaaggaa

SEQ ID NO: 710746 - DNA, 22 bp, Artificial Sequence
  chemically synthesized
gcagagaccttcctttcttagc

SEQ ID NO: 710747 - DNA, 22 bp, Artificial Sequence
  chemically synthesized
cagagaccttcctttcttagct

SEQ ID NO: 710748 - DNA, 22 bp, Artificial Sequence
  chemically synthesized
cctttcttagcttcagtaagaa

SEQ ID NO: 710749 - DNA, 22 bp, Artificial Sequence
  chemically synthesized
ctttcttagcttcagtaagaaa

SEQ ID NO: 710750 - DNA, 22 bp, Artificial Sequence
  chemically synthesized
tcttagcttcagtaagaaatat

SEQ ID NO: 710751 - DNA, 22 bp, Artificial Sequence
  chemically synthesized
cttagcttcagtaagaaatatc

SEQ ID NO: 710752 - DNA, 22 bp, Artificial Sequence
  chemically synthesized
aatgaatgtagtgatatttctt

SEQ ID NO: 710753 - DNA, 22 bp, Artificial Sequence
  chemically synthesized
ttagcttcagtaagaaatatca

SEQ ID NO: 710754 - DNA, 22 bp, Artificial Sequence
  chemically synthesized
gaatgaatgtagtgatatttct

SEQ ID NO: 710755 - DNA, 22 bp, Artificial Sequence
  chemically synthesized
tgaatgaatgtagtgatatttc

SEQ ID NO: 710756 - DNA, 22 bp, Artificial Sequence
  chemically synthesized
agcttcagtaagaaatatcact

SEQ ID NO: 710757 - DNA, 22 bp, Artificial Sequence
  chemically synthesized
ttgaatgaatgtagtgatattt

SEQ ID NO: 710758 - DNA, 22 bp, Artificial Sequence
  chemically synthesized
gcttcagtaagaaatatcacta

SEQ ID NO: 710759 - DNA, 22 bp, Artificial Sequence
  chemically synthesized
cagtaagaaatatcactacatt

SEQ ID NO: 710760 - DNA, 22 bp, Artificial Sequence
  chemically synthesized
agtaagaaatatcactacattc

SEQ ID NO: 710761 - DNA, 22 bp, Artificial Sequence
  chemically synthesized
gtcaatatcttttgaatgaatg

SEQ ID NO: 710762 - DNA, 22 bp, Artificial Sequence
  chemically synthesized
tagtcaatatcttttgaatgaa

SEQ ID NO: 710763 - DNA, 22 bp, Artificial Sequence
  chemically synthesized
cattctagtcaatatcttttga

SEQ ID NO: 710764 - DNA, 22 bp, Artificial Sequence
  chemically synthesized
acattctagtcaatatcttttg

SEQ ID NO: 710765 - DNA, 22 bp, Artificial Sequence
  chemically synthesized
cattcattcaaaagatattgac

SEQ ID NO: 710766 - DNA, 22 bp, Artificial Sequence
  chemically synthesized
attcaaaagatattgactagaa

SEQ ID NO: 710767 - DNA, 22 bp, Artificial Sequence
  chemically synthesized
aaaagatattgactagaatgta

SEQ ID NO: 710768 - DNA, 22 bp, Artificial Sequence
  chemically synthesized
tggacaataaacttacattcta

SEQ ID NO: 710769 - DNA, 22 bp, Artificial Sequence
  chemically synthesized
gtggacaataaacttacattct

SEQ ID NO: 710770 - DNA, 22 bp, Artificial Sequence
  chemically synthesized
tgtggacaataaacttacattc

SEQ ID NO: 710771 - DNA, 22 bp, Artificial Sequence
  chemically synthesized
tctttgtggacaataaacttac

SEQ ID NO: 710772 - DNA, 22 bp, Artificial Sequence
  chemically synthesized
tgtctttgtggacaataaactt

SEQ ID NO: 710773 - DNA, 22 bp, Artificial Sequence
  chemically synthesized
actagaatgtaagtttattgtc

SEQ ID NO: 710774 - DNA, 22 bp, Artificial Sequence
  chemically synthesized
gaatgtaagtttattgtccaca

SEQ ID NO: 710775 - DNA, 22 bp, Artificial Sequence
  chemically synthesized
attgtccacaaagacagagatc

SEQ ID NO: 710776 - DNA, 22 bp, Artificial Sequence
  chemically synthesized
ttgtccacaaagacagagatct

SEQ ID NO: 710777 - DNA, 22 bp, Artificial Sequence
  chemically synthesized
acaagacagataagatctctgt

SEQ ID NO: 710778 - DNA, 22 bp, Artificial Sequence
  chemically synthesized
aacaagacagataagatctctg

SEQ ID NO: 710779 - DNA, 22 bp, Artificial Sequence
  chemically synthesized
tccacaaagacagagatcttat

SEQ ID NO: 710780 - DNA, 22 bp, Artificial Sequence
  chemically synthesized
ttaacaagacagataagatctc

SEQ ID NO: 710781 - DNA, 22 bp, Artificial Sequence
  chemically synthesized
tgataaattcttaacaagacag

SEQ ID NO: 710782 - DNA, 22 bp, Artificial Sequence
  chemically synthesized
ggcattgtgataaattcttaac

SEQ ID NO: 710783 - DNA, 22 bp, Artificial Sequence
  chemically synthesized
atctgtcttgttaagaatttat

SEQ ID NO: 710784 - DNA, 22 bp, Artificial Sequence
  chemically synthesized
tctgtcttgttaagaatttatc

SEQ ID NO: 710785 - DNA, 22 bp, Artificial Sequence
  chemically synthesized
tgtactaggcattgtgataaat

SEQ ID NO: 710786 - DNA, 22 bp, Artificial Sequence
  chemically synthesized
tcttgttaagaatttatcacaa

SEQ ID NO: 710787 - DNA, 22 bp, Artificial Sequence
  chemically synthesized
tatgtactaggcattgtgataa

SEQ ID NO: 710788 - DNA, 22 bp, Artificial Sequence
  chemically synthesized
ctatgtactaggcattgtgata

SEQ ID NO: 710789 - DNA, 22 bp, Artificial Sequence
  chemically synthesized
gttaagaatttatcacaatgcc

SEQ ID NO: 710790 - DNA, 22 bp, Artificial Sequence
  chemically synthesized
ttaagaatttatcacaatgcct

SEQ ID NO: 710791 - DNA, 22 bp, Artificial Sequence
  chemically synthesized
agaatttatcacaatgcctagt

SEQ ID NO: 710792 - DNA, 22 bp, Artificial Sequence
  chemically synthesized
atcatcttctatgtactaggca

SEQ ID NO: 710793 - DNA, 22 bp, Artificial Sequence
  chemically synthesized
gatcatcttctatgtactaggc

SEQ ID NO: 710794 - DNA, 22 bp, Artificial Sequence
  chemically synthesized
ttgatcatcttctatgtactag

SEQ ID NO: 710795 - DNA, 22 bp, Artificial Sequence
  chemically synthesized
cttgatcatcttctatgtacta

SEQ ID NO: 710796 - DNA, 22 bp, Artificial Sequence
  chemically synthesized
atcacaatgcctagtacataga

SEQ ID NO: 710797 - DNA, 22 bp, Artificial Sequence
  chemically synthesized
tcacaatgcctagtacatagaa

SEQ ID NO: 710798 - DNA, 22 bp, Artificial Sequence
  chemically synthesized
agtatttcttgatcatcttcta

SEQ ID NO: 710799 - DNA, 22 bp, Artificial Sequence
  chemically synthesized
gtacatagaagatgatcaagaa

SEQ ID NO: 710800 - DNA, 22 bp, Artificial Sequence
  chemically synthesized
atccattcagtatttcttgatc

SEQ ID NO: 710801 - DNA, 22 bp, Artificial Sequence
  chemically synthesized
attcatccattcagtatttctt

SEQ ID NO: 710802 - DNA, 22 bp, Artificial Sequence
  chemically synthesized
attcattcatccattcagtatt

SEQ ID NO: 710803 - DNA, 22 bp, Artificial Sequence
  chemically synthesized
cattcattcatccattcagtat

SEQ ID NO: 710804 - DNA, 22 bp, Artificial Sequence
  chemically synthesized
tcattcattcatccattcagta

SEQ ID NO: 710805 - DNA, 22 bp, Artificial Sequence
  chemically synthesized
aaaaagcctttcattcattcat

SEQ ID NO: 710806 - DNA, 22 bp, Artificial Sequence
  chemically synthesized
aatggatgaatgaatgaaaggc

SEQ ID NO: 710807 - DNA, 22 bp, Artificial Sequence
  chemically synthesized
acaaataagaggaactcaaaaa

SEQ ID NO: 710808 - DNA, 22 bp, Artificial Sequence
  chemically synthesized
agtgcctgacaaataagaggaa

SEQ ID NO: 710809 - DNA, 22 bp, Artificial Sequence
  chemically synthesized
tctcagtgcctgacaaataaga

SEQ ID NO: 710810 - DNA, 22 bp, Artificial Sequence
  chemically synthesized
atctcagtgcctgacaaataag

SEQ ID NO: 710811 - DNA, 22 bp, Artificial Sequence
  chemically synthesized
tttgagttcctcttatttgtca

SEQ ID NO: 710812 - DNA, 22 bp, Artificial Sequence
  chemically synthesized
ttgagttcctcttatttgtcag

SEQ ID NO: 710813 - DNA, 22 bp, Artificial Sequence
  chemically synthesized
tgagttcctcttatttgtcagg

SEQ ID NO: 710814 - DNA, 22 bp, Artificial Sequence
  chemically synthesized
gagttcctcttatttgtcaggc

SEQ ID NO: 710815 - DNA, 22 bp, Artificial Sequence
  chemically synthesized
agttcctcttatttgtcaggca

SEQ ID NO: 710816 - DNA, 22 bp, Artificial Sequence
  chemically synthesized
atacttatctcagtgcctgaca

SEQ ID NO: 710817 - DNA, 22 bp, Artificial Sequence
  chemically synthesized
ctcttatttgtcaggcactgag

SEQ ID NO: 710818 - DNA, 22 bp, Artificial Sequence
  chemically synthesized
ttatttgtcaggcactgagata

SEQ ID NO: 710819 - DNA, 22 bp, Artificial Sequence
  chemically synthesized
ccgtattcatacttatctcagt

SEQ ID NO: 710820 - DNA, 22 bp, Artificial Sequence
  chemically synthesized
atttgtcaggcactgagataag

SEQ ID NO: 710821 - DNA, 22 bp, Artificial Sequence
  chemically synthesized
tttgtcaggcactgagataagt

SEQ ID NO: 710822 - DNA, 22 bp, Artificial Sequence
  chemically synthesized
gtcaggcactgagataagtatg

SEQ ID NO: 710823 - DNA, 22 bp, Artificial Sequence
  chemically synthesized
tcaggcactgagataagtatga

SEQ ID NO: 710824 - DNA, 22 bp, Artificial Sequence
  chemically synthesized
aagtctaccgtattcatactta

SEQ ID NO: 710825 - DNA, 22 bp, Artificial Sequence
  chemically synthesized
caagtctaccgtattcatactt

SEQ ID NO: 710826 - DNA, 22 bp, Artificial Sequence
  chemically synthesized
tcaagtctaccgtattcatact

SEQ ID NO: 710827 - DNA, 22 bp, Artificial Sequence
  chemically synthesized
cgctttcaagtctaccgtattc

SEQ ID NO: 710828 - DNA, 22 bp, Artificial Sequence
  chemically synthesized
agataagtatgaatacggtaga

SEQ ID NO: 710829 - DNA, 22 bp, Artificial Sequence
  chemically synthesized
tacccagaattacgctttcaag

SEQ ID NO: 710830 - DNA, 22 bp, Artificial Sequence
  chemically synthesized
attatacccagaattacgcttt

SEQ ID NO: 710831 - DNA, 22 bp, Artificial Sequence
  chemically synthesized
attcattatacccagaattacg

SEQ ID NO: 710832 - DNA, 22 bp, Artificial Sequence
  chemically synthesized
gtgctcattcattatacccaga

SEQ ID NO: 710833 - DNA, 22 bp, Artificial Sequence
  chemically synthesized
gaaagcgtaattctgggtataa

SEQ ID NO: 710834 - DNA, 22 bp, Artificial Sequence
  chemically synthesized
ggtgctcattcattatacccag

SEQ ID NO: 710835 - DNA, 22 bp, Artificial Sequence
  chemically synthesized
aaagcgtaattctgggtataat

SEQ ID NO: 710836 - DNA, 22 bp, Artificial Sequence
  chemically synthesized
gatgatttggtgctcattcatt

SEQ ID NO: 710837 - DNA, 22 bp, Artificial Sequence
  chemically synthesized
gttggatgatttggtgctcatt

SEQ ID NO: 710838 - DNA, 22 bp, Artificial Sequence
  chemically synthesized
tgggtataatgaatgagcacca

SEQ ID NO: 710839 - DNA, 22 bp, Artificial Sequence
  chemically synthesized
agttggatgatttggtgctcat

SEQ ID NO: 710840 - DNA, 22 bp, Artificial Sequence
  chemically synthesized
ggtataatgaatgagcaccaaa

SEQ ID NO: 710841 - DNA, 22 bp, Artificial Sequence
  chemically synthesized
agagtgtgtgtcgtatcgtaat

SEQ ID NO: 710842 - DNA, 22 bp, Artificial Sequence
  chemically synthesized
gaattaagagtgtgtgtcgtat

SEQ ID NO: 710843 - DNA, 22 bp, Artificial Sequence
  chemically synthesized
ggaattaagagtgtgtgtcgta

SEQ ID NO: 710844 - DNA, 22 bp, Artificial Sequence
  chemically synthesized
aattacgatacgacacacactc

SEQ ID NO: 710845 - DNA, 22 bp, Artificial Sequence
  chemically synthesized
cgatacgacacacactcttaat

SEQ ID NO: 710846 - DNA, 22 bp, Artificial Sequence
  chemically synthesized
ggaaacagtcacagcttggaat

SEQ ID NO: 710847 - DNA, 22 bp, Artificial Sequence
  chemically synthesized
gggaaacagtcacagcttggaa

SEQ ID NO: 710848 - DNA, 22 bp, Artificial Sequence
  chemically synthesized
tgggaaacagtcacagcttgga

SEQ ID NO: 710849 - DNA, 22 bp, Artificial Sequence
  chemically synthesized
agctttgggaaacagtcacagc

SEQ ID NO: 710850 - DNA, 22 bp, Artificial Sequence
  chemically synthesized
ttaattccaagctgtgactgtt

SEQ ID NO: 710851 - DNA, 22 bp, Artificial Sequence
  chemically synthesized
aattccaagctgtgactgtttc

SEQ ID NO: 710852 - DNA, 22 bp, Artificial Sequence
  chemically synthesized
attccaagctgtgactgtttcc

SEQ ID NO: 710853 - DNA, 22 bp, Artificial Sequence
  chemically synthesized
caagctgtgactgtttcccaaa

SEQ ID NO: 710854 - DNA, 22 bp, Artificial Sequence
  chemically synthesized
tgactgtttcccaaagctcagt

SEQ ID NO: 710855 - DNA, 22 bp, Artificial Sequence
  chemically synthesized
tttcccaaagctcagtccattc

SEQ ID NO: 710856 - DNA, 22 bp, Artificial Sequence
  chemically synthesized
acaatacacagaggaatggact

SEQ ID NO: 710857 - DNA, 22 bp, Artificial Sequence
  chemically synthesized
cacaatacacagaggaatggac

SEQ ID NO: 710858 - DNA, 22 bp, Artificial Sequence
  chemically synthesized
cccaaagctcagtccattcctc

SEQ ID NO: 710859 - DNA, 22 bp, Artificial Sequence
  chemically synthesized
tcacaatacacagaggaatgga

SEQ ID NO: 710860 - DNA, 22 bp, Artificial Sequence
  chemically synthesized
ccaaagctcagtccattcctct

SEQ ID NO: 710861 - DNA, 22 bp, Artificial Sequence
  chemically synthesized
tctttcacaatacacagaggaa

SEQ ID NO: 710862 - DNA, 22 bp, Artificial Sequence
  chemically synthesized
atctttcacaatacacagagga

SEQ ID NO: 710863 - DNA, 22 bp, Artificial Sequence
  chemically synthesized
agtccattcctctgtgtattgt

SEQ ID NO: 710864 - DNA, 22 bp, Artificial Sequence
  chemically synthesized
ctctgtgtattgtgaaagataa

SEQ ID NO: 710865 - DNA, 22 bp, Artificial Sequence
  chemically synthesized
tgtgtattgtgaaagataagct

SEQ ID NO: 710866 - DNA, 22 bp, Artificial Sequence
  chemically synthesized
tgtattgtgaaagataagcttt

SEQ ID NO: 710867 - DNA, 22 bp, Artificial Sequence
  chemically synthesized
aagaaaaaatgaaataaagctt

SEQ ID NO: 710868 - DNA, 22 bp, Artificial Sequence
  chemically synthesized
tgaaagataagctttatttcat

SEQ ID NO: 710869 - DNA, 22 bp, Artificial Sequence
  chemically synthesized
aaagcaatgttgaagaaaaaat

SEQ ID NO: 710870 - DNA, 22 bp, Artificial Sequence
  chemically synthesized
aaaagcaatgttgaagaaaaaa

SEQ ID NO: 710871 - DNA, 22 bp, Artificial Sequence
  chemically synthesized
tttaaaagcaatgttgaagaaa

SEQ ID NO: 710872 - DNA, 22 bp, Artificial Sequence
  chemically synthesized
atttaaaagcaatgttgaagaa

SEQ ID NO: 710873 - DNA, 22 bp, Artificial Sequence
  chemically synthesized
tatttcattttttcttcaacat

SEQ ID NO: 710874 - DNA, 22 bp, Artificial Sequence
  chemically synthesized
atttcattttttcttcaacatt

SEQ ID NO: 710875 - DNA, 22 bp, Artificial Sequence
  chemically synthesized
tttcattttttcttcaacattg

SEQ ID NO: 710876 - DNA, 22 bp, Artificial Sequence
  chemically synthesized
gcttatttaaaagcaatgttga

SEQ ID NO: 710877 - DNA, 22 bp, Artificial Sequence
  chemically synthesized
ggcttatttaaaagcaatgttg

SEQ ID NO: 710878 - DNA, 22 bp, Artificial Sequence
  chemically synthesized
cattttttcttcaacattgctt

SEQ ID NO: 710879 - DNA, 22 bp, Artificial Sequence
  chemically synthesized
tggcttatttaaaagcaatgtt

SEQ ID NO: 710880 - DNA, 22 bp, Artificial Sequence
  chemically synthesized
attttttcttcaacattgcttt

SEQ ID NO: 710881 - DNA, 22 bp, Artificial Sequence
  chemically synthesized
ttggcttatttaaaagcaatgt

SEQ ID NO: 710882 - DNA, 22 bp, Artificial Sequence
  chemically synthesized
ttttggcttatttaaaagcaat

SEQ ID NO: 710883 - DNA, 22 bp, Artificial Sequence
  chemically synthesized
tttcttcaacattgcttttaaa

SEQ ID NO: 710884 - DNA, 22 bp, Artificial Sequence
  chemically synthesized
ttcttcaacattgcttttaaat

SEQ ID NO: 710885 - DNA, 22 bp, Artificial Sequence
  chemically synthesized
ttcttttggcttatttaaaagc

SEQ ID NO: 710886 - DNA, 22 bp, Artificial Sequence
  chemically synthesized
tcttcaacattgcttttaaata

SEQ ID NO: 710887 - DNA, 22 bp, Artificial Sequence
  chemically synthesized
attcttttggcttatttaaaag

SEQ ID NO: 710888 - DNA, 22 bp, Artificial Sequence
  chemically synthesized
cttcaacattgcttttaaataa

SEQ ID NO: 710889 - DNA, 22 bp, Artificial Sequence
  chemically synthesized
tattcttttggcttatttaaaa

SEQ ID NO: 710890 - DNA, 22 bp, Artificial Sequence
  chemically synthesized
ttcaacattgcttttaaataag

SEQ ID NO: 710891 - DNA, 22 bp, Artificial Sequence
  chemically synthesized
ttattcttttggcttatttaaa

SEQ ID NO: 710892 - DNA, 22 bp, Artificial Sequence
  chemically synthesized
caacattgcttttaaataagcc

SEQ ID NO: 710893 - DNA, 22 bp, Artificial Sequence
  chemically synthesized
ttttattcttttggcttattta

SEQ ID NO: 710894 - DNA, 22 bp, Artificial Sequence
  chemically synthesized
aacattgcttttaaataagcca

SEQ ID NO: 710895 - DNA, 22 bp, Artificial Sequence
  chemically synthesized
cttttattcttttggcttattt

SEQ ID NO: 710896 - DNA, 22 bp, Artificial Sequence
  chemically synthesized
tcttttattcttttggcttatt

SEQ ID NO: 710897 - DNA, 22 bp, Artificial Sequence
  chemically synthesized
tttcttttattcttttggctta

SEQ ID NO: 710898 - DNA, 22 bp, Artificial Sequence
  chemically synthesized
ctttcttttattcttttggctt

SEQ ID NO: 710899 - DNA, 22 bp, Artificial Sequence
  chemically synthesized
tctttcttttattcttttggct

SEQ ID NO: 710900 - DNA, 22 bp, Artificial Sequence
  chemically synthesized
cttttaaataagccaaaagaat

SEQ ID NO: 710901 - DNA, 22 bp, Artificial Sequence
  chemically synthesized
tttctttcttttattcttttgg

SEQ ID NO: 710902 - DNA, 22 bp, Artificial Sequence
  chemically synthesized
ctttctttcttttattcttttg

SEQ ID NO: 710903 - DNA, 22 bp, Artificial Sequence
  chemically synthesized
tctttctttcttttattctttt

SEQ ID NO: 710904 - DNA, 22 bp, Artificial Sequence
  chemically synthesized
ttaaataagccaaaagaataaa

SEQ ID NO: 710905 - DNA, 22 bp, Artificial Sequence
  chemically synthesized
ttctttctttcttttattcttt

SEQ ID NO: 710906 - DNA, 22 bp, Artificial Sequence
  chemically synthesized
taaataagccaaaagaataaaa

SEQ ID NO: 710907 - DNA, 22 bp, Artificial Sequence
  chemically synthesized
tttctttctttcttttattctt

SEQ ID NO: 710908 - DNA, 22 bp, Artificial Sequence
  chemically synthesized
aaataagccaaaagaataaaag

SEQ ID NO: 710909 - DNA, 22 bp, Artificial Sequence
  chemically synthesized
aataagccaaaagaataaaaga

SEQ ID NO: 710910 - DNA, 22 bp, Artificial Sequence
  chemically synthesized
tcggtcctttttctttctttct

SEQ ID NO: 710911 - DNA, 22 bp, Artificial Sequence
  chemically synthesized
ttatcggtcctttttctttctt

SEQ ID NO: 710912 - DNA, 22 bp, Artificial Sequence
  chemically synthesized
agagccatgatgttgttatcgg

SEQ ID NO: 710913 - DNA, 22 bp, Artificial Sequence
  chemically synthesized
taagagccatgatgttgttatc

SEQ ID NO: 710914 - DNA, 22 bp, Artificial Sequence
  chemically synthesized
ctaagagccatgatgttgttat

SEQ ID NO: 710915 - DNA, 22 bp, Artificial Sequence
  chemically synthesized
aaataatttctaagagccatga

SEQ ID NO: 710916 - DNA, 22 bp, Artificial Sequence
  chemically synthesized
gaaataatttctaagagccatg

SEQ ID NO: 710917 - DNA, 22 bp, Artificial Sequence
  chemically synthesized
tttgaaataatttctaagagcc

SEQ ID NO: 710918 - DNA, 22 bp, Artificial Sequence
  chemically synthesized
atttgaaataatttctaagagc

SEQ ID NO: 710919 - DNA, 22 bp, Artificial Sequence
  chemically synthesized
gataaatttatttgaaataatt

SEQ ID NO: 710920 - DNA, 22 bp, Artificial Sequence
  chemically synthesized
agataaatttatttgaaataat

SEQ ID NO: 710921 - DNA, 22 bp, Artificial Sequence
  chemically synthesized
catttagataaatttatttgaa

SEQ ID NO: 710922 - DNA, 22 bp, Artificial Sequence
  chemically synthesized
ttagaaattatttcaaataaat

SEQ ID NO: 710923 - DNA, 22 bp, Artificial Sequence
  chemically synthesized
acatttagataaatttatttga

SEQ ID NO: 710924 - DNA, 22 bp, Artificial Sequence
  chemically synthesized
agaaattatttcaaataaattt

SEQ ID NO: 710925 - DNA, 22 bp, Artificial Sequence
  chemically synthesized
gaaattatttcaaataaattta

SEQ ID NO: 710926 - DNA, 22 bp, Artificial Sequence
  chemically synthesized
tttcaaataaatttatctaaat

SEQ ID NO: 710927 - DNA, 22 bp, Artificial Sequence
  chemically synthesized
caaataaatttatctaaatgta

SEQ ID NO: 710928 - DNA, 22 bp, Artificial Sequence
  chemically synthesized
aaataaatttatctaaatgtaa

SEQ ID NO: 710929 - DNA, 22 bp, Artificial Sequence
  chemically synthesized
aagaaccaacatttacatttag

SEQ ID NO: 710930 - DNA, 22 bp, Artificial Sequence
  chemically synthesized
atctaaatgtaaatgttggttc

SEQ ID NO: 710931 - DNA, 22 bp, Artificial Sequence
  chemically synthesized
tctaaatgtaaatgttggttct

SEQ ID NO: 710932 - DNA, 22 bp, Artificial Sequence
  chemically synthesized
aaacaaagttaaagaaccaaca

SEQ ID NO: 710933 - DNA, 22 bp, Artificial Sequence
  chemically synthesized
aatgtaaatgttggttctttaa

SEQ ID NO: 710934 - DNA, 22 bp, Artificial Sequence
  chemically synthesized
agaatctaaaacaaagttaaag

SEQ ID NO: 710935 - DNA, 22 bp, Artificial Sequence
  chemically synthesized
gagaatctaaaacaaagttaaa

SEQ ID NO: 710936 - DNA, 22 bp, Artificial Sequence
  chemically synthesized
gttctttaactttgttttagat

SEQ ID NO: 710937 - DNA, 22 bp, Artificial Sequence
  chemically synthesized
tttaactttgttttagattctc

SEQ ID NO: 710938 - DNA, 22 bp, Artificial Sequence
  chemically synthesized
taactttgttttagattctcaa

SEQ ID NO: 710939 - DNA, 22 bp, Artificial Sequence
  chemically synthesized
aactttgttttagattctcaag

SEQ ID NO: 710940 - DNA, 22 bp, Artificial Sequence
  chemically synthesized
actttgttttagattctcaagg

SEQ ID NO: 710941 - DNA, 22 bp, Artificial Sequence
  chemically synthesized
tgttttagattctcaagggctt

SEQ ID NO: 710942 - DNA, 22 bp, Artificial Sequence
  chemically synthesized
gttttagattctcaagggcttc

SEQ ID NO: 710943 - DNA, 22 bp, Artificial Sequence
  chemically synthesized
ttttagattctcaagggcttcc

SEQ ID NO: 710944 - DNA, 22 bp, Artificial Sequence
  chemically synthesized
tagattctcaagggcttccact

SEQ ID NO: 710945 - DNA, 22 bp, Artificial Sequence
  chemically synthesized
agattctcaagggcttccactt

SEQ ID NO: 710946 - DNA, 22 bp, Artificial Sequence
  chemically synthesized
gattctcaagggcttccacttt

SEQ ID NO: 710947 - DNA, 22 bp, Artificial Sequence
  chemically synthesized
tcaagggcttccactttgtctt

SEQ ID NO: 710948 - DNA, 22 bp, Artificial Sequence
  chemically synthesized
acagaaaggtcaaaagacaaag

SEQ ID NO: 710949 - DNA, 22 bp, Artificial Sequence
  chemically synthesized
aagggcttccactttgtctttt

SEQ ID NO: 710950 - DNA, 22 bp, Artificial Sequence
  chemically synthesized
ccactttgtcttttgacctttc

SEQ ID NO: 710951 - DNA, 22 bp, Artificial Sequence
  chemically synthesized
cactttgtcttttgacctttct

SEQ ID NO: 710952 - DNA, 22 bp, Artificial Sequence
  chemically synthesized
tgtcttttgacctttctgttaa

SEQ ID NO: 710953 - DNA, 22 bp, Artificial Sequence
  chemically synthesized
aaagtagagtaattaacagaaa

SEQ ID NO: 710954 - DNA, 22 bp, Artificial Sequence
  chemically synthesized
gtcttttgacctttctgttaat

SEQ ID NO: 710955 - DNA, 22 bp, Artificial Sequence
  chemically synthesized
tcttttgacctttctgttaatt

SEQ ID NO: 710956 - DNA, 22 bp, Artificial Sequence
  chemically synthesized
ttgacctttctgttaattactc

SEQ ID NO: 710957 - DNA, 22 bp, Artificial Sequence
  chemically synthesized
tgacctttctgttaattactct

SEQ ID NO: 710958 - DNA, 22 bp, Artificial Sequence
  chemically synthesized
gacctttctgttaattactcta

SEQ ID NO: 710959 - DNA, 22 bp, Artificial Sequence
  chemically synthesized
acctttctgttaattactctac

SEQ ID NO: 710960 - DNA, 22 bp, Artificial Sequence
  chemically synthesized
tctgttaattactctactttga

SEQ ID NO: 710961 - DNA, 22 bp, Artificial Sequence
  chemically synthesized
ctgttaattactctactttgag

SEQ ID NO: 710962 - DNA, 22 bp, Artificial Sequence
  chemically synthesized
gtgaagataaaactcaaagtag

SEQ ID NO: 710963 - DNA, 22 bp, Artificial Sequence
  chemically synthesized
tgttaattactctactttgagt

SEQ ID NO: 710964 - DNA, 22 bp, Artificial Sequence
  chemically synthesized
tagtgaagataaaactcaaagt

SEQ ID NO: 710965 - DNA, 22 bp, Artificial Sequence
  chemically synthesized
ttaattactctactttgagttt

SEQ ID NO: 710966 - DNA, 22 bp, Artificial Sequence
  chemically synthesized
ctagtgaagataaaactcaaag

SEQ ID NO: 710967 - DNA, 22 bp, Artificial Sequence
  chemically synthesized
attactctactttgagttttat

SEQ ID NO: 710968 - DNA, 22 bp, Artificial Sequence
  chemically synthesized
aacttctagtgaagataaaact

SEQ ID NO: 710969 - DNA, 22 bp, Artificial Sequence
  chemically synthesized
ctctactttgagttttatcttc

SEQ ID NO: 710970 - DNA, 22 bp, Artificial Sequence
  chemically synthesized
ctaaacttctagtgaagataaa

SEQ ID NO: 710971 - DNA, 22 bp, Artificial Sequence
  chemically synthesized
tactttgagttttatcttcact

SEQ ID NO: 710972 - DNA, 22 bp, Artificial Sequence
  chemically synthesized
tcctaaacttctagtgaagata

SEQ ID NO: 710973 - DNA, 22 bp, Artificial Sequence
  chemically synthesized
ctttgagttttatcttcactag

SEQ ID NO: 710974 - DNA, 22 bp, Artificial Sequence
  chemically synthesized
tctctcctaaacttctagtgaa

SEQ ID NO: 710975 - DNA, 22 bp, Artificial Sequence
  chemically synthesized
tgagttttatcttcactagaag

SEQ ID NO: 710976 - DNA, 22 bp, Artificial Sequence
  chemically synthesized
gagttttatcttcactagaagt

SEQ ID NO: 710977 - DNA, 22 bp, Artificial Sequence
  chemically synthesized
agttttatcttcactagaagtt

SEQ ID NO: 710978 - DNA, 22 bp, Artificial Sequence
  chemically synthesized
tatcttcactagaagtttagga

SEQ ID NO: 710979 - DNA, 22 bp, Artificial Sequence
  chemically synthesized
atcttcactagaagtttaggag

SEQ ID NO: 710980 - DNA, 22 bp, Artificial Sequence
  chemically synthesized
tcttcactagaagtttaggaga

SEQ ID NO: 710981 - DNA, 22 bp, Artificial Sequence
  chemically synthesized
cactagaagtttaggagagaca

SEQ ID NO: 710982 - DNA, 22 bp, Artificial Sequence
  chemically synthesized
actagaagtttaggagagacag

SEQ ID NO: 710983 - DNA, 22 bp, Artificial Sequence
  chemically synthesized
gaagtttaggagagacaggcat

SEQ ID NO: 710984 - DNA, 22 bp, Artificial Sequence
  chemically synthesized
cacatggggaggtaatgcctgt

SEQ ID NO: 710985 - DNA, 22 bp, Artificial Sequence
  chemically synthesized
ccacatggggaggtaatgcctg

SEQ ID NO: 710986 - DNA, 22 bp, Artificial Sequence
  chemically synthesized
aggagagacaggcattacctcc

SEQ ID NO: 710987 - DNA, 22 bp, Artificial Sequence
  chemically synthesized
ggagagacaggcattacctccc

SEQ ID NO: 710988 - DNA, 22 bp, Artificial Sequence
  chemically synthesized
gcagtgtatttccacatgggga

SEQ ID NO: 710989 - DNA, 22 bp, Artificial Sequence
  chemically synthesized
cctagcagtgtatttccacatg

SEQ ID NO: 710990 - DNA, 22 bp, Artificial Sequence
  chemically synthesized
cctccccatgtggaaatacact

SEQ ID NO: 710991 - DNA, 22 bp, Artificial Sequence
  chemically synthesized
cccatgtggaaatacactgcta

SEQ ID NO: 710992 - DNA, 22 bp, Artificial Sequence
  chemically synthesized
ggaagaaaccacattgcctagc

SEQ ID NO: 710993 - DNA, 22 bp, Artificial Sequence
  chemically synthesized
gacactaggaagaaaccacatt

SEQ ID NO: 710994 - DNA, 22 bp, Artificial Sequence
  chemically synthesized
ggacactaggaagaaaccacat

SEQ ID NO: 710995 - DNA, 22 bp, Artificial Sequence
  chemically synthesized
ctaggcaatgtggtttcttcct

SEQ ID NO: 710996 - DNA, 22 bp, Artificial Sequence
  chemically synthesized
ggcaatgtggtttcttcctagt

SEQ ID NO: 710997 - DNA, 22 bp, Artificial Sequence
  chemically synthesized
cttcctagtgtccaagctacat

SEQ ID NO: 710998 - DNA, 22 bp, Artificial Sequence
  chemically synthesized
ttcctagtgtccaagctacatc

SEQ ID NO: 710999 - DNA, 22 bp, Artificial Sequence
  chemically synthesized
cctagtgtccaagctacatctt

SEQ ID NO: 711000 - DNA, 22 bp, Artificial Sequence
  chemically synthesized
ctagtgtccaagctacatctta

SEQ ID NO: 711001 - DNA, 22 bp, Artificial Sequence
  chemically synthesized
gtgtccaagctacatcttactg

SEQ ID NO: 711002 - DNA, 22 bp, Artificial Sequence
  chemically synthesized
tgtatgtagtaatcagtaagat

SEQ ID NO: 711003 - DNA, 22 bp, Artificial Sequence
  chemically synthesized
atgtatgtagtaatcagtaaga

SEQ ID NO: 711004 - DNA, 22 bp, Artificial Sequence
  chemically synthesized
catcttactgattactacatac

SEQ ID NO: 711005 - DNA, 22 bp, Artificial Sequence
  chemically synthesized
gagtaaacatgatttatgtatg

SEQ ID NO: 711006 - DNA, 22 bp, Artificial Sequence
  chemically synthesized
actgattactacatacataaat

SEQ ID NO: 711007 - DNA, 22 bp, Artificial Sequence
  chemically synthesized
ctgattactacatacataaatc

SEQ ID NO: 711008 - DNA, 22 bp, Artificial Sequence
  chemically synthesized
attactacatacataaatcatg

SEQ ID NO: 711009 - DNA, 22 bp, Artificial Sequence
  chemically synthesized
gactggagtaaacatgatttat

SEQ ID NO: 711010 - DNA, 22 bp, Artificial Sequence
  chemically synthesized
tagactggagtaaacatgattt

SEQ ID NO: 711011 - DNA, 22 bp, Artificial Sequence
  chemically synthesized
ctacatacataaatcatgttta

SEQ ID NO: 711012 - DNA, 22 bp, Artificial Sequence
  chemically synthesized
tctagactggagtaaacatgat

SEQ ID NO: 711013 - DNA, 22 bp, Artificial Sequence
  chemically synthesized
ctctagactggagtaaacatga

SEQ ID NO: 711014 - DNA, 22 bp, Artificial Sequence
  chemically synthesized
tctctagactggagtaaacatg

SEQ ID NO: 711015 - DNA, 22 bp, Artificial Sequence
  chemically synthesized
catacataaatcatgtttactc

SEQ ID NO: 711016 - DNA, 22 bp, Artificial Sequence
  chemically synthesized
catattttctctagactggagt

SEQ ID NO: 711017 - DNA, 22 bp, Artificial Sequence
  chemically synthesized
gttacatattttctctagactg

SEQ ID NO: 711018 - DNA, 22 bp, Artificial Sequence
  chemically synthesized
ctagttacatattttctctaga

SEQ ID NO: 711019 - DNA, 22 bp, Artificial Sequence
  chemically synthesized
actccagtctagagaaaatatg

SEQ ID NO: 711020 - DNA, 22 bp, Artificial Sequence
  chemically synthesized
ctccagtctagagaaaatatgt

SEQ ID NO: 711021 - DNA, 22 bp, Artificial Sequence
  chemically synthesized
cagtctagagaaaatatgtaac

SEQ ID NO: 711022 - DNA, 22 bp, Artificial Sequence
  chemically synthesized
gagaaaatatgtaactaggaac

SEQ ID NO: 711023 - DNA, 22 bp, Artificial Sequence
  chemically synthesized
agaaccagaaaatcaaaacata

SEQ ID NO: 711024 - DNA, 22 bp, Artificial Sequence
  chemically synthesized
ggaacgtatgttttgattttct

SEQ ID NO: 711025 - DNA, 22 bp, Artificial Sequence
  chemically synthesized
gacaaactgagaaccagaaaat

SEQ ID NO: 711026 - DNA, 22 bp, Artificial Sequence
  chemically synthesized
gggtctagacaaactgagaacc

SEQ ID NO: 711027 - DNA, 22 bp, Artificial Sequence
  chemically synthesized
tgattttctggttctcagtttg

SEQ ID NO: 711028 - DNA, 22 bp, Artificial Sequence
  chemically synthesized
gattttctggttctcagtttgt

SEQ ID NO: 711029 - DNA, 22 bp, Artificial Sequence
  chemically synthesized
tctagggtctagacaaactgag

SEQ ID NO: 711030 - DNA, 22 bp, Artificial Sequence
  chemically synthesized
attttctggttctcagtttgtc

SEQ ID NO: 711031 - DNA, 22 bp, Artificial Sequence
  chemically synthesized
atctagggtctagacaaactga

SEQ ID NO: 711032 - DNA, 22 bp, Artificial Sequence
  chemically synthesized
tctggttctcagtttgtctaga

SEQ ID NO: 711033 - DNA, 22 bp, Artificial Sequence
  chemically synthesized
ctggttctcagtttgtctagac

SEQ ID NO: 711034 - DNA, 22 bp, Artificial Sequence
  chemically synthesized
tggttctcagtttgtctagacc

SEQ ID NO: 711035 - DNA, 22 bp, Artificial Sequence
  chemically synthesized
gttctcagtttgtctagaccct

SEQ ID NO: 711036 - DNA, 22 bp, Artificial Sequence
  chemically synthesized
tcagtttgtctagaccctagat

SEQ ID NO: 711037 - DNA, 22 bp, Artificial Sequence
  chemically synthesized
ccatggatatttatctagggtc

SEQ ID NO: 711038 - DNA, 22 bp, Artificial Sequence
  chemically synthesized
agtttgtctagaccctagataa

SEQ ID NO: 711039 - DNA, 22 bp, Artificial Sequence
  chemically synthesized
cattcccatggatatttatcta

SEQ ID NO: 711040 - DNA, 22 bp, Artificial Sequence
  chemically synthesized
gcattcccatggatatttatct

SEQ ID NO: 711041 - DNA, 22 bp, Artificial Sequence
  chemically synthesized
gtctagaccctagataaatatc

SEQ ID NO: 711042 - DNA, 22 bp, Artificial Sequence
  chemically synthesized
tctagaccctagataaatatcc

SEQ ID NO: 711043 - DNA, 22 bp, Artificial Sequence
  chemically synthesized
ttgcattcccatggatatttat

SEQ ID NO: 711044 - DNA, 22 bp, Artificial Sequence
  chemically synthesized
cttgcattcccatggatattta

SEQ ID NO: 711045 - DNA, 22 bp, Artificial Sequence
  chemically synthesized
gaccctagataaatatccatgg

SEQ ID NO: 711046 - DNA, 22 bp, Artificial Sequence
  chemically synthesized
tttcttgcattcccatggatat

SEQ ID NO: 711047 - DNA, 22 bp, Artificial Sequence
  chemically synthesized
gataaatatccatgggaatgca

SEQ ID NO: 711048 - DNA, 22 bp, Artificial Sequence
  chemically synthesized
tgtaagtgtcatgtctgtttct

SEQ ID NO: 711049 - DNA, 22 bp, Artificial Sequence
  chemically synthesized
gtgtaagtgtcatgtctgtttc

SEQ ID NO: 711050 - DNA, 22 bp, Artificial Sequence
  chemically synthesized
atttgtgtaagtgtcatgtctg

SEQ ID NO: 711051 - DNA, 22 bp, Artificial Sequence
  chemically synthesized
ataggctcatttgtgtaagtgt

SEQ ID NO: 711052 - DNA, 22 bp, Artificial Sequence
  chemically synthesized
aataggctcatttgtgtaagtg

SEQ ID NO: 711053 - DNA, 22 bp, Artificial Sequence
  chemically synthesized
taataggctcatttgtgtaagt

SEQ ID NO: 711054 - DNA, 22 bp, Artificial Sequence
  chemically synthesized
ttttaataggctcatttgtgta

SEQ ID NO: 711055 - DNA, 22 bp, Artificial Sequence
  chemically synthesized
gttttaataggctcatttgtgt

SEQ ID NO: 711056 - DNA, 22 bp, Artificial Sequence
  chemically synthesized
tgttttaataggctcatttgtg

SEQ ID NO: 711057 - DNA, 22 bp, Artificial Sequence
  chemically synthesized
ttgttttaataggctcatttgt

SEQ ID NO: 711058 - DNA, 22 bp, Artificial Sequence
  chemically synthesized
tttttgttttaataggctcatt

SEQ ID NO: 711059 - DNA, 22 bp, Artificial Sequence
  chemically synthesized
gtttttgttttaataggctcat

SEQ ID NO: 711060 - DNA, 22 bp, Artificial Sequence
  chemically synthesized
tgtttttgttttaataggctca

SEQ ID NO: 711061 - DNA, 22 bp, Artificial Sequence
  chemically synthesized
ttgtttttgttttaataggctc

SEQ ID NO: 711062 - DNA, 22 bp, Artificial Sequence
  chemically synthesized
cttttgtttttgttttaatagg

SEQ ID NO: 711063 - DNA, 22 bp, Artificial Sequence
  chemically synthesized
acacaaatgagcctattaaaac

SEQ ID NO: 711064 - DNA, 22 bp, Artificial Sequence
  chemically synthesized
gcttttgtttttgttttaatag

SEQ ID NO: 711065 - DNA, 22 bp, Artificial Sequence
  chemically synthesized
cacaaatgagcctattaaaaca

SEQ ID NO: 711066 - DNA, 22 bp, Artificial Sequence
  chemically synthesized
tgcttttgtttttgttttaata

SEQ ID NO: 711067 - DNA, 22 bp, Artificial Sequence
  chemically synthesized
ttgcttttgtttttgttttaat

SEQ ID NO: 711068 - DNA, 22 bp, Artificial Sequence
  chemically synthesized
tcttttgcttttgtttttgttt

SEQ ID NO: 711069 - DNA, 22 bp, Artificial Sequence
  chemically synthesized
tgtcttttgcttttgtttttgt

SEQ ID NO: 711070 - DNA, 22 bp, Artificial Sequence
  chemically synthesized
ctgtcttttgcttttgtttttg

SEQ ID NO: 711071 - DNA, 22 bp, Artificial Sequence
  chemically synthesized
ttaaaacaaaaacaaaagcaaa

SEQ ID NO: 711072 - DNA, 22 bp, Artificial Sequence
  chemically synthesized
aaacaaaaacaaaagcaaaaga

SEQ ID NO: 711073 - DNA, 22 bp, Artificial Sequence
  chemically synthesized
gcatcacagcacaagagtttct

SEQ ID NO: 711074 - DNA, 22 bp, Artificial Sequence
  chemically synthesized
ctagcatcacagcacaagagtt

SEQ ID NO: 711075 - DNA, 22 bp, Artificial Sequence
  chemically synthesized
actagcatcacagcacaagagt

SEQ ID NO: 711076 - DNA, 22 bp, Artificial Sequence
  chemically synthesized
tttactagcatcacagcacaag

SEQ ID NO: 711077 - DNA, 22 bp, Artificial Sequence
  chemically synthesized
atttactagcatcacagcacaa

SEQ ID NO: 711078 - DNA, 22 bp, Artificial Sequence
  chemically synthesized
ttgtgctgtgatgctagtaaat

SEQ ID NO: 711079 - DNA, 22 bp, Artificial Sequence
  chemically synthesized
gtgctgtgatgctagtaaataa

SEQ ID NO: 711080 - DNA, 22 bp, Artificial Sequence
  chemically synthesized
tgctgtgatgctagtaaataaa

SEQ ID NO: 711081 - DNA, 22 bp, Artificial Sequence
  chemically synthesized
tgtgcatatgtgtggtttattt

SEQ ID NO: 711082 - DNA, 22 bp, Artificial Sequence
  chemically synthesized
gtgtgcatatgtgtggtttatt

SEQ ID NO: 711083 - DNA, 22 bp, Artificial Sequence
  chemically synthesized
tgatgctagtaaataaaccaca

SEQ ID NO: 711084 - DNA, 22 bp, Artificial Sequence
  chemically synthesized
gtaaataaaccacacatatgca

SEQ ID NO: 711085 - DNA, 22 bp, Artificial Sequence
  chemically synthesized
gagagtcatttgtgtgcatatg

SEQ ID NO: 711086 - DNA, 22 bp, Artificial Sequence
  chemically synthesized
gtgaatagactggagagtcatt

SEQ ID NO: 711087 - DNA, 22 bp, Artificial Sequence
  chemically synthesized
aggacaaaaactcgtgaataga

SEQ ID NO: 711088 - DNA, 22 bp, Artificial Sequence
  chemically synthesized
caggacaaaaactcgtgaatag

SEQ ID NO: 711089 - DNA, 22 bp, Artificial Sequence
  chemically synthesized
tccagtctattcacgagttttt

SEQ ID NO: 711090 - DNA, 22 bp, Artificial Sequence
  chemically synthesized
cagtctattcacgagtttttgt

SEQ ID NO: 711091 - DNA, 22 bp, Artificial Sequence
  chemically synthesized
aaaaacttcaggacaaaaactc

SEQ ID NO: 711092 - DNA, 22 bp, Artificial Sequence
  chemically synthesized
ttcacgagtttttgtcctgaag

SEQ ID NO: 711093 - DNA, 22 bp, Artificial Sequence
  chemically synthesized
tacaaactgaaaaacttcagga

SEQ ID NO: 711094 - DNA, 22 bp, Artificial Sequence
  chemically synthesized
acgagtttttgtcctgaagttt

SEQ ID NO: 711095 - DNA, 22 bp, Artificial Sequence
  chemically synthesized
ttgtcctgaagtttttcagttt

SEQ ID NO: 711096 - DNA, 22 bp, Artificial Sequence
  chemically synthesized
tgtcctgaagtttttcagtttg

SEQ ID NO: 711097 - DNA, 22 bp, Artificial Sequence
  chemically synthesized
gtcctgaagtttttcagtttgt

SEQ ID NO: 711098 - DNA, 22 bp, Artificial Sequence
  chemically synthesized
tcctgaagtttttcagtttgta

SEQ ID NO: 711099 - DNA, 22 bp, Artificial Sequence
  chemically synthesized
aagtttttcagtttgtacagtt

SEQ ID NO: 711100 - DNA, 22 bp, Artificial Sequence
  chemically synthesized
ttcagtttgtacagtttctgtg

SEQ ID NO: 711101 - DNA, 22 bp, Artificial Sequence
  chemically synthesized
tcagtttgtacagtttctgtgt

SEQ ID NO: 711102 - DNA, 22 bp, Artificial Sequence
  chemically synthesized
cagtttgtacagtttctgtgtg

SEQ ID NO: 711103 - DNA, 22 bp, Artificial Sequence
  chemically synthesized
agtttgtacagtttctgtgtgc

SEQ ID NO: 711104 - DNA, 22 bp, Artificial Sequence
  chemically synthesized
gtacagtttctgtgtgcatgtg

SEQ ID NO: 711105 - DNA, 22 bp, Artificial Sequence
  chemically synthesized
ccccaacacagacacatgcaca

SEQ ID NO: 711106 - DNA, 22 bp, Artificial Sequence
  chemically synthesized
tacagtttctgtgtgcatgtgt

SEQ ID NO: 711107 - DNA, 22 bp, Artificial Sequence
  chemically synthesized
ctcccccaacacagacacatgc

SEQ ID NO: 711108 - DNA, 22 bp, Artificial Sequence
  chemically synthesized
ctgtgtgcatgtgtctgtgttg

SEQ ID NO: 711109 - DNA, 22 bp, Artificial Sequence
  chemically synthesized
tgtgtgcatgtgtctgtgttgg

SEQ ID NO: 711110 - DNA, 22 bp, Artificial Sequence
  chemically synthesized
tgtgcatgtgtctgtgttgggg

SEQ ID NO: 711111 - DNA, 22 bp, Artificial Sequence
  chemically synthesized
tgttgggggaggaacttcctcg

SEQ ID NO: 711112 - DNA, 22 bp, Artificial Sequence
  chemically synthesized
ggagtaagaatgaacgaggaag

SEQ ID NO: 711113 - DNA, 22 bp, Artificial Sequence
  chemically synthesized
gggagtaagaatgaacgaggaa

SEQ ID NO: 711114 - DNA, 22 bp, Artificial Sequence
  chemically synthesized
ggggaggaacttcctcgttcat

SEQ ID NO: 711115 - DNA, 22 bp, Artificial Sequence
  chemically synthesized
tgaggatttgggagtaagaatg

SEQ ID NO: 711116 - DNA, 22 bp, Artificial Sequence
  chemically synthesized
gtgaggatttgggagtaagaat

SEQ ID NO: 711117 - DNA, 22 bp, Artificial Sequence
  chemically synthesized
cttgtgaggatttgggagtaag

SEQ ID NO: 711118 - DNA, 22 bp, Artificial Sequence
  chemically synthesized
cctcgttcattcttactcccaa

SEQ ID NO: 711119 - DNA, 22 bp, Artificial Sequence
  chemically synthesized
ctcgttcattcttactcccaaa

SEQ ID NO: 711120 - DNA, 22 bp, Artificial Sequence
  chemically synthesized
gttcattcttactcccaaatcc

SEQ ID NO: 711121 - DNA, 22 bp, Artificial Sequence
  chemically synthesized
attcttactcccaaatcctcac

SEQ ID NO: 711122 - DNA, 22 bp, Artificial Sequence
  chemically synthesized
tgagtgttacttgtgaggattt

SEQ ID NO: 711123 - DNA, 22 bp, Artificial Sequence
  chemically synthesized
atgagtgttacttgtgaggatt

SEQ ID NO: 711124 - DNA, 22 bp, Artificial Sequence
  chemically synthesized
ttactcccaaatcctcacaagt

SEQ ID NO: 711125 - DNA, 22 bp, Artificial Sequence
  chemically synthesized
actcccaaatcctcacaagtaa

SEQ ID NO: 711126 - DNA, 22 bp, Artificial Sequence
  chemically synthesized
ctcccaaatcctcacaagtaac

SEQ ID NO: 711127 - DNA, 22 bp, Artificial Sequence
  chemically synthesized
ccaaatcctcacaagtaacact

SEQ ID NO: 711128 - DNA, 22 bp, Artificial Sequence
  chemically synthesized
ggcacgtatttatgagtgttac

SEQ ID NO: 711129 - DNA, 22 bp, Artificial Sequence
  chemically synthesized
gggcacgtatttatgagtgtta

SEQ ID NO: 711130 - DNA, 22 bp, Artificial Sequence
  chemically synthesized
acaagtaacactcataaatacg

SEQ ID NO: 711131 - DNA, 22 bp, Artificial Sequence
  chemically synthesized
ccggataatgtttgggcacgta

SEQ ID NO: 711132 - DNA, 22 bp, Artificial Sequence
  chemically synthesized
cccggataatgtttgggcacgt

SEQ ID NO: 711133 - DNA, 22 bp, Artificial Sequence
  chemically synthesized
ataaatacgtgcccaaacatta

SEQ ID NO: 711134 - DNA, 22 bp, Artificial Sequence
  chemically synthesized
aggagcgtttcccggataatgt

SEQ ID NO: 711135 - DNA, 22 bp, Artificial Sequence
  chemically synthesized
taatcagtctcaggagcgtttc

SEQ ID NO: 711136 - DNA, 22 bp, Artificial Sequence
  chemically synthesized
aaactgtaatcagtctcaggag

SEQ ID NO: 711137 - DNA, 22 bp, Artificial Sequence
  chemically synthesized
tccgggaaacgctcctgagact

SEQ ID NO: 711138 - DNA, 22 bp, Artificial Sequence
  chemically synthesized
actgaaactgtaatcagtctca

SEQ ID NO: 711139 - DNA, 22 bp, Artificial Sequence
  chemically synthesized
aactgaaactgtaatcagtctc

SEQ ID NO: 711140 - DNA, 22 bp, Artificial Sequence
  chemically synthesized
taactgaaactgtaatcagtct

SEQ ID NO: 711141 - DNA, 22 bp, Artificial Sequence
  chemically synthesized
ctgagactgattacagtttcag

SEQ ID NO: 711142 - DNA, 22 bp, Artificial Sequence
  chemically synthesized
aaaggattttaactgaaactgt

SEQ ID NO: 711143 - DNA, 22 bp, Artificial Sequence
  chemically synthesized
agactgattacagtttcagtta

SEQ ID NO: 711144 - DNA, 22 bp, Artificial Sequence
  chemically synthesized
gttaaaaggattttaactgaaa

SEQ ID NO: 711145 - DNA, 22 bp, Artificial Sequence
  chemically synthesized
attacagtttcagttaaaatcc

SEQ ID NO: 711146 - DNA, 22 bp, Artificial Sequence
  chemically synthesized
ccattagttaaaaggattttaa

SEQ ID NO: 711147 - DNA, 22 bp, Artificial Sequence
  chemically synthesized
cagtttcagttaaaatcctttt

SEQ ID NO: 711148 - DNA, 22 bp, Artificial Sequence
  chemically synthesized
cagttaaaatccttttaactaa

SEQ ID NO: 711149 - DNA, 22 bp, Artificial Sequence
  chemically synthesized
agttaaaatccttttaactaat

SEQ ID NO: 711150 - DNA, 22 bp, Artificial Sequence
  chemically synthesized
aaagggattaccattagttaaa

SEQ ID NO: 711151 - DNA, 22 bp, Artificial Sequence
  chemically synthesized
actgaaagggattaccattagt

SEQ ID NO: 711152 - DNA, 22 bp, Artificial Sequence
  chemically synthesized
aaatccttttaactaatggtaa

SEQ ID NO: 711153 - DNA, 22 bp, Artificial Sequence
  chemically synthesized
aactgaaagggattaccattag

SEQ ID NO: 711154 - DNA, 22 bp, Artificial Sequence
  chemically synthesized
taactgaaagggattaccatta

SEQ ID NO: 711155 - DNA, 22 bp, Artificial Sequence
  chemically synthesized
ttaactaatggtaatccctttc

SEQ ID NO: 711156 - DNA, 22 bp, Artificial Sequence
  chemically synthesized
taactaatggtaatccctttca

SEQ ID NO: 711157 - DNA, 22 bp, Artificial Sequence
  chemically synthesized
aactaatggtaatccctttcag

SEQ ID NO: 711158 - DNA, 22 bp, Artificial Sequence
  chemically synthesized
actaatggtaatccctttcagt

SEQ ID NO: 711159 - DNA, 22 bp, Artificial Sequence
  chemically synthesized
atggtaatccctttcagttaaa

SEQ ID NO: 711160 - DNA, 22 bp, Artificial Sequence
  chemically synthesized
gaataataatggattttaactg

SEQ ID NO: 711161 - DNA, 22 bp, Artificial Sequence
  chemically synthesized
tcagttaaaatccattattatt

SEQ ID NO: 711162 - DNA, 22 bp, Artificial Sequence
  chemically synthesized
cagttaaaatccattattattc

SEQ ID NO: 711163 - DNA, 22 bp, Artificial Sequence
  chemically synthesized
agttaaaatccattattattct

SEQ ID NO: 711164 - DNA, 22 bp, Artificial Sequence
  chemically synthesized
aaaagaatcagaattagaataa

SEQ ID NO: 711165 - DNA, 22 bp, Artificial Sequence
  chemically synthesized
aaatccattattattctaattc

SEQ ID NO: 711166 - DNA, 22 bp, Artificial Sequence
  chemically synthesized
caactcaaaagaatcagaatta

SEQ ID NO: 711167 - DNA, 22 bp, Artificial Sequence
  chemically synthesized
agttacaactcaaaagaatcag

SEQ ID NO: 711168 - DNA, 22 bp, Artificial Sequence
  chemically synthesized
ttattctaattctgattctttt

SEQ ID NO: 711169 - DNA, 22 bp, Artificial Sequence
  chemically synthesized
cagttacaactcaaaagaatca

SEQ ID NO: 711170 - DNA, 22 bp, Artificial Sequence
  chemically synthesized
tcagttacaactcaaaagaatc

SEQ ID NO: 711171 - DNA, 22 bp, Artificial Sequence
  chemically synthesized
ttcagttacaactcaaaagaat

SEQ ID NO: 711172 - DNA, 22 bp, Artificial Sequence
  chemically synthesized
ttctaattctgattcttttgag

SEQ ID NO: 711173 - DNA, 22 bp, Artificial Sequence
  chemically synthesized
tttcagttacaactcaaaagaa

SEQ ID NO: 711174 - DNA, 22 bp, Artificial Sequence
  chemically synthesized
taattctgattcttttgagttg

SEQ ID NO: 711175 - DNA, 22 bp, Artificial Sequence
  chemically synthesized
ttttttcagttacaactcaaaa

SEQ ID NO: 711176 - DNA, 22 bp, Artificial Sequence
  chemically synthesized
attctgattcttttgagttgta

SEQ ID NO: 711177 - DNA, 22 bp, Artificial Sequence
  chemically synthesized
ttattttttcagttacaactca

SEQ ID NO: 711178 - DNA, 22 bp, Artificial Sequence
  chemically synthesized
attattttttcagttacaactc

SEQ ID NO: 711179 - DNA, 22 bp, Artificial Sequence
  chemically synthesized
tattattttttcagttacaact

SEQ ID NO: 711180 - DNA, 22 bp, Artificial Sequence
  chemically synthesized
tgattcttttgagttgtaactg

SEQ ID NO: 711181 - DNA, 22 bp, Artificial Sequence
  chemically synthesized
ttattattttttcagttacaac

SEQ ID NO: 711182 - DNA, 22 bp, Artificial Sequence
  chemically synthesized
tttattattttttcagttacaa

SEQ ID NO: 711183 - DNA, 22 bp, Artificial Sequence
  chemically synthesized
attcttttgagttgtaactgaa

SEQ ID NO: 711184 - DNA, 22 bp, Artificial Sequence
  chemically synthesized
ttttattattttttcagttaca

SEQ ID NO: 711185 - DNA, 22 bp, Artificial Sequence
  chemically synthesized
tttttattattttttcagttac

SEQ ID NO: 711186 - DNA, 22 bp, Artificial Sequence
  chemically synthesized
ttttttattattttttcagtta

SEQ ID NO: 711187 - DNA, 22 bp, Artificial Sequence
  chemically synthesized
tttttttattattttttcagtt

SEQ ID NO: 711188 - DNA, 22 bp, Artificial Sequence
  chemically synthesized
ttttgagttgtaactgaaaaaa

SEQ ID NO: 711189 - DNA, 22 bp, Artificial Sequence
  chemically synthesized
ttttttttattattttttcagt

SEQ ID NO: 711190 - DNA, 22 bp, Artificial Sequence
  chemically synthesized
tttttttttattattttttcag

SEQ ID NO: 711191 - DNA, 22 bp, Artificial Sequence
  chemically synthesized
ttgagttgtaactgaaaaaata

SEQ ID NO: 711192 - DNA, 22 bp, Artificial Sequence
  chemically synthesized
ttttttttttattattttttca

SEQ ID NO: 711193 - DNA, 22 bp, Artificial Sequence
  chemically synthesized
tgagttgtaactgaaaaaataa

SEQ ID NO: 711194 - DNA, 22 bp, Artificial Sequence
  chemically synthesized
tttttttttttattattttttc

SEQ ID NO: 711195 - DNA, 22 bp, Artificial Sequence
  chemically synthesized
gagttgtaactgaaaaaataat

SEQ ID NO: 711196 - DNA, 22 bp, Artificial Sequence
  chemically synthesized
agttgtaactgaaaaaataata

SEQ ID NO: 711197 - DNA, 22 bp, Artificial Sequence
  chemically synthesized
agactttttttttttttattat

SEQ ID NO: 711198 - DNA, 22 bp, Artificial Sequence
  chemically synthesized
taactgaaaaaataataaaaaa

SEQ ID NO: 711199 - DNA, 22 bp, Artificial Sequence
  chemically synthesized
tctcagacttttttttttttta

SEQ ID NO: 711200 - DNA, 22 bp, Artificial Sequence
  chemically synthesized
atctcagacttttttttttttt

SEQ ID NO: 711201 - DNA, 22 bp, Artificial Sequence
  chemically synthesized
aaaaaataataaaaaaaaaaaa

SEQ ID NO: 711202 - DNA, 22 bp, Artificial Sequence
  chemically synthesized
aaatcaagaccagaacttatct

SEQ ID NO: 711203 - DNA, 22 bp, Artificial Sequence
  chemically synthesized
gaaatcaagaccagaacttatc

SEQ ID NO: 711204 - DNA, 22 bp, Artificial Sequence
  chemically synthesized
agataagttctggtcttgattt

SEQ ID NO: 711205 - DNA, 22 bp, Artificial Sequence
  chemically synthesized
ggaggcccaggagagtttgaaa

SEQ ID NO: 711206 - DNA, 22 bp, Artificial Sequence
  chemically synthesized
tgggaggcccaggagagtttga

SEQ ID NO: 711207 - DNA, 22 bp, Artificial Sequence
  chemically synthesized
tggtcttgatttcaaactctcc

SEQ ID NO: 711208 - DNA, 22 bp, Artificial Sequence
  chemically synthesized
gtcttgatttcaaactctcctg

SEQ ID NO: 711209 - DNA, 22 bp, Artificial Sequence
  chemically synthesized
gatttcaaactctcctgggcct

SEQ ID NO: 711210 - DNA, 22 bp, Artificial Sequence
  chemically synthesized
atttcaaactctcctgggcctc

SEQ ID NO: 711211 - DNA, 22 bp, Artificial Sequence
  chemically synthesized
caaactctcctgggcctcccag

SEQ ID NO: 711212 - DNA, 22 bp, Artificial Sequence
  chemically synthesized
aaactctcctgggcctcccaga

SEQ ID NO: 711213 - DNA, 22 bp, Artificial Sequence
  chemically synthesized
taatcccagcactctgggaggc

SEQ ID NO: 711214 - DNA, 22 bp, Artificial Sequence
  chemically synthesized
tcctgggcctcccagagtgctg

SEQ ID NO: 711215 - DNA, 22 bp, Artificial Sequence
  chemically synthesized
atgcctgtaatcccagcactct

SEQ ID NO: 711216 - DNA, 22 bp, Artificial Sequence
  chemically synthesized
ctgggcctcccagagtgctggg

SEQ ID NO: 711217 - DNA, 22 bp, Artificial Sequence
  chemically synthesized
ggcctcccagagtgctgggatt

SEQ ID NO: 711218 - DNA, 22 bp, Artificial Sequence
  chemically synthesized
ccagagtgctgggattacaggc

SEQ ID NO: 711219 - DNA, 22 bp, Artificial Sequence
  chemically synthesized
ggattacaggcatgagccacct

SEQ ID NO: 711220 - DNA, 22 bp, Artificial Sequence
  chemically synthesized
cagaagatggccggtagaggtg

SEQ ID NO: 711221 - DNA, 22 bp, Artificial Sequence
  chemically synthesized
caggcatgagccacctctaccg

SEQ ID NO: 711222 - DNA, 22 bp, Artificial Sequence
  chemically synthesized
attccagaagatggccggtaga

SEQ ID NO: 711223 - DNA, 22 bp, Artificial Sequence
  chemically synthesized
cattccagaagatggccggtag

SEQ ID NO: 711224 - DNA, 22 bp, Artificial Sequence
  chemically synthesized
tcacaaaacttcattccagaag

SEQ ID NO: 711225 - DNA, 22 bp, Artificial Sequence
  chemically synthesized
taccggccatcttctggaatga

SEQ ID NO: 711226 - DNA, 22 bp, Artificial Sequence
  chemically synthesized
ccggccatcttctggaatgaag

SEQ ID NO: 711227 - DNA, 22 bp, Artificial Sequence
  chemically synthesized
tacctatcacaaaacttcattc

SEQ ID NO: 711228 - DNA, 22 bp, Artificial Sequence
  chemically synthesized
ctggaatgaagttttgtgatag

SEQ ID NO: 711229 - DNA, 22 bp, Artificial Sequence
  chemically synthesized
tggaatgaagttttgtgatagg

SEQ ID NO: 711230 - DNA, 22 bp, Artificial Sequence
  chemically synthesized
ccgcagagctatacctatcaca

SEQ ID NO: 711231 - DNA, 22 bp, Artificial Sequence
  chemically synthesized
gaatgaagttttgtgataggta

SEQ ID NO: 711232 - DNA, 22 bp, Artificial Sequence
  chemically synthesized
gccgcagagctatacctatcac

SEQ ID NO: 711233 - DNA, 22 bp, Artificial Sequence
  chemically synthesized
tgccgcagagctatacctatca

SEQ ID NO: 711234 - DNA, 22 bp, Artificial Sequence
  chemically synthesized
ttttgccgcagagctataccta

SEQ ID NO: 711235 - DNA, 22 bp, Artificial Sequence
  chemically synthesized
tgtgataggtatagctctgcgg

SEQ ID NO: 711236 - DNA, 22 bp, Artificial Sequence
  chemically synthesized
gtgataggtatagctctgcggc

SEQ ID NO: 711237 - DNA, 22 bp, Artificial Sequence
  chemically synthesized
tgataggtatagctctgcggca

SEQ ID NO: 711238 - DNA, 22 bp, Artificial Sequence
  chemically synthesized
aacaagcccaggttgttttgcc

SEQ ID NO: 711239 - DNA, 22 bp, Artificial Sequence
  chemically synthesized
cattcaacaagcccaggttgtt

SEQ ID NO: 711240 - DNA, 22 bp, Artificial Sequence
  chemically synthesized
gcattcaacaagcccaggttgt

SEQ ID NO: 711241 - DNA, 22 bp, Artificial Sequence
  chemically synthesized
tgcattcaacaagcccaggttg

SEQ ID NO: 711242 - DNA, 22 bp, Artificial Sequence
  chemically synthesized
tgcggcaaaacaacctgggctt

SEQ ID NO: 711243 - DNA, 22 bp, Artificial Sequence
  chemically synthesized
cggcaaaacaacctgggcttgt

SEQ ID NO: 711244 - DNA, 22 bp, Artificial Sequence
  chemically synthesized
atctttgcattcaacaagccca

SEQ ID NO: 711245 - DNA, 22 bp, Artificial Sequence
  chemically synthesized
agttaatctttgcattcaacaa

SEQ ID NO: 711246 - DNA, 22 bp, Artificial Sequence
  chemically synthesized
ggcttgttgaatgcaaagatta

SEQ ID NO: 711247 - DNA, 22 bp, Artificial Sequence
  chemically synthesized
gttgaatgcaaagattaactga

SEQ ID NO: 711248 - DNA, 22 bp, Artificial Sequence
  chemically synthesized
ttgaatgcaaagattaactgaa

SEQ ID NO: 711249 - DNA, 22 bp, Artificial Sequence
  chemically synthesized
aaaggaaagacaattcagttaa

SEQ ID NO: 711250 - DNA, 22 bp, Artificial Sequence
  chemically synthesized
aatgcaaagattaactgaattg

SEQ ID NO: 711251 - DNA, 22 bp, Artificial Sequence
  chemically synthesized
actgaattgtctttcctttgag

SEQ ID NO: 711252 - DNA, 22 bp, Artificial Sequence
  chemically synthesized
aattgtctttcctttgagttta

SEQ ID NO: 711253 - DNA, 22 bp, Artificial Sequence
  chemically synthesized
tctttcctttgagtttatttct

SEQ ID NO: 711254 - DNA, 22 bp, Artificial Sequence
  chemically synthesized
atgtcaggaaaacacagaaata

SEQ ID NO: 711255 - DNA, 22 bp, Artificial Sequence
  chemically synthesized
tcctttgagtttatttctgtgt

SEQ ID NO: 711256 - DNA, 22 bp, Artificial Sequence
  chemically synthesized
cctttgagtttatttctgtgtt

SEQ ID NO: 711257 - DNA, 22 bp, Artificial Sequence
  chemically synthesized
ctttgagtttatttctgtgttt

SEQ ID NO: 711258 - DNA, 22 bp, Artificial Sequence
  chemically synthesized
tgagtttatttctgtgttttcc

SEQ ID NO: 711259 - DNA, 22 bp, Artificial Sequence
  chemically synthesized
gagtttatttctgtgttttcct

SEQ ID NO: 711260 - DNA, 22 bp, Artificial Sequence
  chemically synthesized
agtttatttctgtgttttcctg

SEQ ID NO: 711261 - DNA, 22 bp, Artificial Sequence
  chemically synthesized
agtgccctaatgtcaggaaaac

SEQ ID NO: 711262 - DNA, 22 bp, Artificial Sequence
  chemically synthesized
ctaagtgccctaatgtcaggaa

SEQ ID NO: 711263 - DNA, 22 bp, Artificial Sequence
  chemically synthesized
atttctgtgttttcctgacatt

SEQ ID NO: 711264 - DNA, 22 bp, Artificial Sequence
  chemically synthesized
tttctgtgttttcctgacatta

SEQ ID NO: 711265 - DNA, 22 bp, Artificial Sequence
  chemically synthesized
actcctaagtgccctaatgtca

SEQ ID NO: 711266 - DNA, 22 bp, Artificial Sequence
  chemically synthesized
ctgtgttttcctgacattaggg

SEQ ID NO: 711267 - DNA, 22 bp, Artificial Sequence
  chemically synthesized
aactcctaagtgccctaatgtc

SEQ ID NO: 711268 - DNA, 22 bp, Artificial Sequence
  chemically synthesized
tgtgttttcctgacattagggc

SEQ ID NO: 711269 - DNA, 22 bp, Artificial Sequence
  chemically synthesized
tgttttcctgacattagggcac

SEQ ID NO: 711270 - DNA, 22 bp, Artificial Sequence
  chemically synthesized
tttaactcctaagtgccctaat

SEQ ID NO: 711271 - DNA, 22 bp, Artificial Sequence
  chemically synthesized
tcctgacattagggcacttagg

SEQ ID NO: 711272 - DNA, 22 bp, Artificial Sequence
  chemically synthesized
cctgacattagggcacttagga

SEQ ID NO: 711273 - DNA, 22 bp, Artificial Sequence
  chemically synthesized
ctgacattagggcacttaggag

SEQ ID NO: 711274 - DNA, 22 bp, Artificial Sequence
  chemically synthesized
acattagggcacttaggagtta

SEQ ID NO: 711275 - DNA, 22 bp, Artificial Sequence
  chemically synthesized
gggcacttaggagttaaacagt

SEQ ID NO: 711276 - DNA, 22 bp, Artificial Sequence
  chemically synthesized
aagtcaaacgcaagaaacactg

SEQ ID NO: 711277 - DNA, 22 bp, Artificial Sequence
  chemically synthesized
aggagttaaacagtgtttcttg

SEQ ID NO: 711278 - DNA, 22 bp, Artificial Sequence
  chemically synthesized
ggagttaaacagtgtttcttgc

SEQ ID NO: 711279 - DNA, 22 bp, Artificial Sequence
  chemically synthesized
tcctgaagtcaaacgcaagaaa

SEQ ID NO: 711280 - DNA, 22 bp, Artificial Sequence
  chemically synthesized
aacagtgtttcttgcgtttgac

SEQ ID NO: 711281 - DNA, 22 bp, Artificial Sequence
  chemically synthesized
ccgtgatctatcctgaagtcaa

SEQ ID NO: 711282 - DNA, 22 bp, Artificial Sequence
  chemically synthesized
cccgtgatctatcctgaagtca

SEQ ID NO: 711283 - DNA, 22 bp, Artificial Sequence
  chemically synthesized
tttcccgtgatctatcctgaag

SEQ ID NO: 711284 - DNA, 22 bp, Artificial Sequence
  chemically synthesized
cttgcgtttgacttcaggatag

SEQ ID NO: 711285 - DNA, 22 bp, Artificial Sequence
  chemically synthesized
ttgcgtttgacttcaggataga

SEQ ID NO: 711286 - DNA, 22 bp, Artificial Sequence
  chemically synthesized
gcgtttgacttcaggatagatc

SEQ ID NO: 711287 - DNA, 22 bp, Artificial Sequence
  chemically synthesized
gttgtttcccgtgatctatcct

SEQ ID NO: 711288 - DNA, 22 bp, Artificial Sequence
  chemically synthesized
cgtttgacttcaggatagatca

SEQ ID NO: 711289 - DNA, 22 bp, Artificial Sequence
  chemically synthesized
gacttcaggatagatcacggga

SEQ ID NO: 711290 - DNA, 22 bp, Artificial Sequence
  chemically synthesized
gcactagttgtttcccgtgatc

SEQ ID NO: 711291 - DNA, 22 bp, Artificial Sequence
  chemically synthesized
acttcaggatagatcacgggaa

SEQ ID NO: 711292 - DNA, 22 bp, Artificial Sequence
  chemically synthesized
caggatagatcacgggaaacaa

SEQ ID NO: 711293 - DNA, 22 bp, Artificial Sequence
  chemically synthesized
aggatagatcacgggaaacaac

SEQ ID NO: 711294 - DNA, 22 bp, Artificial Sequence
  chemically synthesized
agagtgagtgccatgttagcac

SEQ ID NO: 711295 - DNA, 22 bp, Artificial Sequence
  chemically synthesized
ctcagagtgagtgccatgttag

SEQ ID NO: 711296 - DNA, 22 bp, Artificial Sequence
  chemically synthesized
ctactcagagtgagtgccatgt

SEQ ID NO: 711297 - DNA, 22 bp, Artificial Sequence
  chemically synthesized
tgctcctactcagagtgagtgc

SEQ ID NO: 711298 - DNA, 22 bp, Artificial Sequence
  chemically synthesized
gtgctaacatggcactcactct

SEQ ID NO: 711299 - DNA, 22 bp, Artificial Sequence
  chemically synthesized
acatggcactcactctgagtag

SEQ ID NO: 711300 - DNA, 22 bp, Artificial Sequence
  chemically synthesized
agaattatgctcctactcagag

SEQ ID NO: 711301 - DNA, 22 bp, Artificial Sequence
  chemically synthesized
ttaagaattatgctcctactca

SEQ ID NO: 711302 - DNA, 22 bp, Artificial Sequence
  chemically synthesized
actctgagtaggagcataattc

SEQ ID NO: 711303 - DNA, 22 bp, Artificial Sequence
  chemically synthesized
tgagtaggagcataattcttaa

SEQ ID NO: 711304 - DNA, 22 bp, Artificial Sequence
  chemically synthesized
agtaggagcataattcttaata

SEQ ID NO: 711305 - DNA, 22 bp, Artificial Sequence
  chemically synthesized
ttaatagattttgtgtgactta

SEQ ID NO: 711306 - DNA, 22 bp, Artificial Sequence
  chemically synthesized
gtatcaatgccataagtcacac

SEQ ID NO: 711307 - DNA, 22 bp, Artificial Sequence
  chemically synthesized
aatagattttgtgtgacttatg

SEQ ID NO: 711308 - DNA, 22 bp, Artificial Sequence
  chemically synthesized
atagattttgtgtgacttatgg

SEQ ID NO: 711309 - DNA, 22 bp, Artificial Sequence
  chemically synthesized
tgtgtgacttatggcattgata

SEQ ID NO: 711310 - DNA, 22 bp, Artificial Sequence
  chemically synthesized
gtgtgacttatggcattgatac

SEQ ID NO: 711311 - DNA, 22 bp, Artificial Sequence
  chemically synthesized
tgtgacttatggcattgatact

SEQ ID NO: 711312 - DNA, 22 bp, Artificial Sequence
  chemically synthesized
agatggcacggcattagtatca

SEQ ID NO: 711313 - DNA, 22 bp, Artificial Sequence
  chemically synthesized
atggcattgatactaatgccgt

SEQ ID NO: 711314 - DNA, 22 bp, Artificial Sequence
  chemically synthesized
tggcattgatactaatgccgtg

SEQ ID NO: 711315 - DNA, 22 bp, Artificial Sequence
  chemically synthesized
aggatggtctcagatggcacgg

SEQ ID NO: 711316 - DNA, 22 bp, Artificial Sequence
  chemically synthesized
atactaatgccgtgccatctga

SEQ ID NO: 711317 - DNA, 22 bp, Artificial Sequence
  chemically synthesized
atgccgtgccatctgagaccat

SEQ ID NO: 711318 - DNA, 22 bp, Artificial Sequence
  chemically synthesized
aaaggtagattaaggatggtct

SEQ ID NO: 711319 - DNA, 22 bp, Artificial Sequence
  chemically synthesized
aaaaggtagattaaggatggtc

SEQ ID NO: 711320 - DNA, 22 bp, Artificial Sequence
  chemically synthesized
agaccatccttaatctaccttt

SEQ ID NO: 711321 - DNA, 22 bp, Artificial Sequence
  chemically synthesized
tgatgcaggaaccttaaaaggt

SEQ ID NO: 711322 - DNA, 22 bp, Artificial Sequence
  chemically synthesized
aatctaccttttaaggttcctg

SEQ ID NO: 711323 - DNA, 22 bp, Artificial Sequence
  chemically synthesized
atctaccttttaaggttcctgc

SEQ ID NO: 711324 - DNA, 22 bp, Artificial Sequence
  chemically synthesized
ccttttaaggttcctgcatcac

SEQ ID NO: 711325 - DNA, 22 bp, Artificial Sequence
  chemically synthesized
ttaaggttcctgcatcacagct

SEQ ID NO: 711326 - DNA, 22 bp, Artificial Sequence
  chemically synthesized
taaggttcctgcatcacagctt

SEQ ID NO: 711327 - DNA, 22 bp, Artificial Sequence
  chemically synthesized
aaggttcctgcatcacagcttt

SEQ ID NO: 711328 - DNA, 22 bp, Artificial Sequence
  chemically synthesized
aggttcctgcatcacagctttt

SEQ ID NO: 711329 - DNA, 22 bp, Artificial Sequence
  chemically synthesized
ctgcatcacagctttttttcct

SEQ ID NO: 711330 - DNA, 22 bp, Artificial Sequence
  chemically synthesized
catcacagctttttttccttcc

SEQ ID NO: 711331 - DNA, 22 bp, Artificial Sequence
  chemically synthesized
tttttccttccattttatattt

SEQ ID NO: 711332 - DNA, 22 bp, Artificial Sequence
  chemically synthesized
ttttccttccattttatatttc

SEQ ID NO: 711333 - DNA, 22 bp, Artificial Sequence
  chemically synthesized
tttccttccattttatatttct

SEQ ID NO: 711334 - DNA, 22 bp, Artificial Sequence
  chemically synthesized
ttccttccattttatatttctg

SEQ ID NO: 711335 - DNA, 22 bp, Artificial Sequence
  chemically synthesized
tccttccattttatatttctgt

SEQ ID NO: 711336 - DNA, 22 bp, Artificial Sequence
  chemically synthesized
ccttccattttatatttctgtg

SEQ ID NO: 711337 - DNA, 22 bp, Artificial Sequence
  chemically synthesized
cttccattttatatttctgtgc

SEQ ID NO: 711338 - DNA, 22 bp, Artificial Sequence
  chemically synthesized
agaaagaagtcagcacagaaat

SEQ ID NO: 711339 - DNA, 22 bp, Artificial Sequence
  chemically synthesized
ccattttatatttctgtgctga

SEQ ID NO: 711340 - DNA, 22 bp, Artificial Sequence
  chemically synthesized
cattttatatttctgtgctgac

SEQ ID NO: 711341 - DNA, 22 bp, Artificial Sequence
  chemically synthesized
tatatttctgtgctgacttctt

SEQ ID NO: 711342 - DNA, 22 bp, Artificial Sequence
  chemically synthesized
atatttctgtgctgacttcttt

SEQ ID NO: 711343 - DNA, 22 bp, Artificial Sequence
  chemically synthesized
tatttctgtgctgacttctttc

SEQ ID NO: 711344 - DNA, 22 bp, Artificial Sequence
  chemically synthesized
ctgtgctgacttctttcttaat

SEQ ID NO: 711345 - DNA, 22 bp, Artificial Sequence
  chemically synthesized
tgtgctgacttctttcttaatc

SEQ ID NO: 711346 - DNA, 22 bp, Artificial Sequence
  chemically synthesized
tgctgacttctttcttaatctg

SEQ ID NO: 711347 - DNA, 22 bp, Artificial Sequence
  chemically synthesized
acttctttcttaatctgactcc

SEQ ID NO: 711348 - DNA, 22 bp, Artificial Sequence
  chemically synthesized
ctttcttaatctgactcctttt

SEQ ID NO: 711349 - DNA, 22 bp, Artificial Sequence
  chemically synthesized
tttcttaatctgactccttttt

SEQ ID NO: 711350 - DNA, 22 bp, Artificial Sequence
  chemically synthesized
tcttaatctgactccttttttt

SEQ ID NO: 711351 - DNA, 22 bp, Artificial Sequence
  chemically synthesized
cttaatctgactccttttttta

SEQ ID NO: 711352 - DNA, 22 bp, Artificial Sequence
  chemically synthesized
ttaatctgactcctttttttat

SEQ ID NO: 711353 - DNA, 22 bp, Artificial Sequence
  chemically synthesized
aatctgactcctttttttattc

SEQ ID NO: 711354 - DNA, 22 bp, Artificial Sequence
  chemically synthesized
atctgactcctttttttattcc

SEQ ID NO: 711355 - DNA, 22 bp, Artificial Sequence
  chemically synthesized
actcctttttttattccctcct

SEQ ID NO: 711356 - DNA, 22 bp, Artificial Sequence
  chemically synthesized
ctttttttattccctccttttt

SEQ ID NO: 711357 - DNA, 22 bp, Artificial Sequence
  chemically synthesized
tttttattccctcctttttctg

SEQ ID NO: 711358 - DNA, 22 bp, Artificial Sequence
  chemically synthesized
gaggagaaaggacagaaaaagg

SEQ ID NO: 711359 - DNA, 22 bp, Artificial Sequence
  chemically synthesized
ttttattccctcctttttctgt

SEQ ID NO: 711360 - DNA, 22 bp, Artificial Sequence
  chemically synthesized
tttattccctcctttttctgtc

SEQ ID NO: 711361 - DNA, 22 bp, Artificial Sequence
  chemically synthesized
ttattccctcctttttctgtcc

SEQ ID NO: 711362 - DNA, 22 bp, Artificial Sequence
  chemically synthesized
tattccctcctttttctgtcct

SEQ ID NO: 711363 - DNA, 22 bp, Artificial Sequence
  chemically synthesized
attccctcctttttctgtcctt

SEQ ID NO: 711364 - DNA, 22 bp, Artificial Sequence
  chemically synthesized
ttccctcctttttctgtccttt

SEQ ID NO: 711365 - DNA, 22 bp, Artificial Sequence
  chemically synthesized
cctcctttttctgtcctttctc

SEQ ID NO: 711366 - DNA, 22 bp, Artificial Sequence
  chemically synthesized
ctttttctgtcctttctcctcc

SEQ ID NO: 711367 - DNA, 22 bp, Artificial Sequence
  chemically synthesized
tttctgtcctttctcctccagc

SEQ ID NO: 711368 - DNA, 22 bp, Artificial Sequence
  chemically synthesized
ttctgtcctttctcctccagcc

SEQ ID NO: 711369 - DNA, 22 bp, Artificial Sequence
  chemically synthesized
tctgtcctttctcctccagccc

SEQ ID NO: 711370 - DNA, 22 bp, Artificial Sequence
  chemically synthesized
ctgtcctttctcctccagccct

SEQ ID NO: 711371 - DNA, 22 bp, Artificial Sequence
  chemically synthesized
tgtcctttctcctccagccctc

SEQ ID NO: 711372 - DNA, 22 bp, Artificial Sequence
  chemically synthesized
tcctttctcctccagccctccc

SEQ ID NO: 711373 - DNA, 22 bp, Artificial Sequence
  chemically synthesized
tctcctccagccctcccccttt

SEQ ID NO: 711374 - DNA, 22 bp, Artificial Sequence
  chemically synthesized
ctcctccagccctcccccttta

SEQ ID NO: 711375 - DNA, 22 bp, Artificial Sequence
  chemically synthesized
tatagaacataataaaggggga

SEQ ID NO: 711376 - DNA, 22 bp, Artificial Sequence
  chemically synthesized
tcctccagccctccccctttat

SEQ ID NO: 711377 - DNA, 22 bp, Artificial Sequence
  chemically synthesized
ctccagccctccccctttatta

SEQ ID NO: 711378 - DNA, 22 bp, Artificial Sequence
  chemically synthesized
cagccctccccctttattatgt

SEQ ID NO: 711379 - DNA, 22 bp, Artificial Sequence
  chemically synthesized
gtaggttgtatagaacataata

SEQ ID NO: 711380 - DNA, 22 bp, Artificial Sequence
  chemically synthesized
tggtaggttgtatagaacataa

SEQ ID NO: 711381 - DNA, 22 bp, Artificial Sequence
  chemically synthesized
ctggtaggttgtatagaacata

SEQ ID NO: 711382 - DNA, 22 bp, Artificial Sequence
  chemically synthesized
ttctggtaggttgtatagaaca

SEQ ID NO: 711383 - DNA, 22 bp, Artificial Sequence
  chemically synthesized
cccctttattatgttctataca

SEQ ID NO: 711384 - DNA, 22 bp, Artificial Sequence
  chemically synthesized
tattatgttctatacaacctac

SEQ ID NO: 711385 - DNA, 22 bp, Artificial Sequence
  chemically synthesized
tgtactcttctggtaggttgta

SEQ ID NO: 711386 - DNA, 22 bp, Artificial Sequence
  chemically synthesized
attatgttctatacaacctacc

SEQ ID NO: 711387 - DNA, 22 bp, Artificial Sequence
  chemically synthesized
ttatgttctatacaacctacca

SEQ ID NO: 711388 - DNA, 22 bp, Artificial Sequence
  chemically synthesized
tgttctatacaacctaccagaa

SEQ ID NO: 711389 - DNA, 22 bp, Artificial Sequence
  chemically synthesized
tatacaacctaccagaagagta

SEQ ID NO: 711390 - DNA, 22 bp, Artificial Sequence
  chemically synthesized
agcagagtctgtgtactcttct

SEQ ID NO: 711391 - DNA, 22 bp, Artificial Sequence
  chemically synthesized
tacaacctaccagaagagtaca

SEQ ID NO: 711392 - DNA, 22 bp, Artificial Sequence
  chemically synthesized
cctcagcagagtctgtgtactc

SEQ ID NO: 711393 - DNA, 22 bp, Artificial Sequence
  chemically synthesized
gcctcagcagagtctgtgtact

SEQ ID NO: 711394 - DNA, 22 bp, Artificial Sequence
  chemically synthesized
tttgcctcagcagagtctgtgt

SEQ ID NO: 711395 - DNA, 22 bp, Artificial Sequence
  chemically synthesized
ccagaagagtacacagactctg

SEQ ID NO: 711396 - DNA, 22 bp, Artificial Sequence
  chemically synthesized
aggcactgtttgcctcagcaga

SEQ ID NO: 711397 - DNA, 22 bp, Artificial Sequence
  chemically synthesized
gaggcactgtttgcctcagcag

SEQ ID NO: 711398 - DNA, 22 bp, Artificial Sequence
  chemically synthesized
atttgaggcactgtttgcctca

SEQ ID NO: 711399 - DNA, 22 bp, Artificial Sequence
  chemically synthesized
catttgaggcactgtttgcctc

SEQ ID NO: 711400 - DNA, 22 bp, Artificial Sequence
  chemically synthesized
tgctgaggcaaacagtgcctca

SEQ ID NO: 711401 - DNA, 22 bp, Artificial Sequence
  chemically synthesized
ctgaggcaaacagtgcctcaaa

SEQ ID NO: 711402 - DNA, 22 bp, Artificial Sequence
  chemically synthesized
aggcaaacagtgcctcaaatga

SEQ ID NO: 711403 - DNA, 22 bp, Artificial Sequence
  chemically synthesized
caagcatgcacagccccttcat

SEQ ID NO: 711404 - DNA, 22 bp, Artificial Sequence
  chemically synthesized
gcaagcatgcacagccccttca

SEQ ID NO: 711405 - DNA, 22 bp, Artificial Sequence
  chemically synthesized
tcttgcaagcatgcacagcccc

SEQ ID NO: 711406 - DNA, 22 bp, Artificial Sequence
  chemically synthesized
gtcttgcaagcatgcacagccc

SEQ ID NO: 711407 - DNA, 22 bp, Artificial Sequence
  chemically synthesized
aaatgaaggggctgtgcatgct

SEQ ID NO: 711408 - DNA, 22 bp, Artificial Sequence
  chemically synthesized
gcttgtcttgcaagcatgcaca

SEQ ID NO: 711409 - DNA, 22 bp, Artificial Sequence
  chemically synthesized
cctcgcttgtcttgcaagcatg

SEQ ID NO: 711410 - DNA, 22 bp, Artificial Sequence
  chemically synthesized
atatcctgcctcgcttgtcttg

SEQ ID NO: 711411 - DNA, 22 bp, Artificial Sequence
  chemically synthesized
tgcatgcttgcaagacaagcga

SEQ ID NO: 711412 - DNA, 22 bp, Artificial Sequence
  chemically synthesized
ttcatatcctgcctcgcttgtc

SEQ ID NO: 711413 - DNA, 22 bp, Artificial Sequence
  chemically synthesized
gcaagacaagcgaggcaggata

SEQ ID NO: 711414 - DNA, 22 bp, Artificial Sequence
  chemically synthesized
caagacaagcgaggcaggatat

SEQ ID NO: 711415 - DNA, 22 bp, Artificial Sequence
  chemically synthesized
ggagtcctattcatatcctgcc

SEQ ID NO: 711416 - DNA, 22 bp, Artificial Sequence
  chemically synthesized
ggctaggagtcctattcatatc

SEQ ID NO: 711417 - DNA, 22 bp, Artificial Sequence
  chemically synthesized
gcactaggctaggagtcctatt

SEQ ID NO: 711418 - DNA, 22 bp, Artificial Sequence
  chemically synthesized
ggctggcactaggctaggagtc

SEQ ID NO: 711419 - DNA, 22 bp, Artificial Sequence
  chemically synthesized
gagaagcgttgggctggcacta

SEQ ID NO: 711420 - DNA, 22 bp, Artificial Sequence
  chemically synthesized
ggagaagcgttgggctggcact

SEQ ID NO: 711421 - DNA, 22 bp, Artificial Sequence
  chemically synthesized
ttggagaagcgttgggctggca

SEQ ID NO: 711422 - DNA, 22 bp, Artificial Sequence
  chemically synthesized
ctagcctagtgccagcccaacg

SEQ ID NO: 711423 - DNA, 22 bp, Artificial Sequence
  chemically synthesized
gcctagtgccagcccaacgctt

SEQ ID NO: 711424 - DNA, 22 bp, Artificial Sequence
  chemically synthesized
gtgccagcccaacgcttctcca

SEQ ID NO: 711425 - DNA, 22 bp, Artificial Sequence
  chemically synthesized
gaggaagaatgttcttggagaa

SEQ ID NO: 711426 - DNA, 22 bp, Artificial Sequence
  chemically synthesized
atcagaattagaggaagaatgt

SEQ ID NO: 711427 - DNA, 22 bp, Artificial Sequence
  chemically synthesized
ctccaagaacattcttcctcta

SEQ ID NO: 711428 - DNA, 22 bp, Artificial Sequence
  chemically synthesized
tccaagaacattcttcctctaa

SEQ ID NO: 711429 - DNA, 22 bp, Artificial Sequence
  chemically synthesized
caagaacattcttcctctaatt

SEQ ID NO: 711430 - DNA, 22 bp, Artificial Sequence
  chemically synthesized
atggcagagttcatcagaatta

SEQ ID NO: 711431 - DNA, 22 bp, Artificial Sequence
  chemically synthesized
gatggcagagttcatcagaatt

SEQ ID NO: 711432 - DNA, 22 bp, Artificial Sequence
  chemically synthesized
ttcctctaattctgatgaactc

SEQ ID NO: 711433 - DNA, 22 bp, Artificial Sequence
  chemically synthesized
cagtttgatggcagagttcatc

SEQ ID NO: 711434 - DNA, 22 bp, Artificial Sequence
  chemically synthesized
cctctaattctgatgaactctg

SEQ ID NO: 711435 - DNA, 22 bp, Artificial Sequence
  chemically synthesized
ccagtttgatggcagagttcat

SEQ ID NO: 711436 - DNA, 22 bp, Artificial Sequence
  chemically synthesized
ctctaattctgatgaactctgc

SEQ ID NO: 711437 - DNA, 22 bp, Artificial Sequence
  chemically synthesized
taattctgatgaactctgccat

SEQ ID NO: 711438 - DNA, 22 bp, Artificial Sequence
  chemically synthesized
ccttccagtttgatggcagagt

SEQ ID NO: 711439 - DNA, 22 bp, Artificial Sequence
  chemically synthesized
gccttccagtttgatggcagag

SEQ ID NO: 711440 - DNA, 22 bp, Artificial Sequence
  chemically synthesized
attctgatgaactctgccatca

SEQ ID NO: 711441 - DNA, 22 bp, Artificial Sequence
  chemically synthesized
ttgccttccagtttgatggcag

SEQ ID NO: 711442 - DNA, 22 bp, Artificial Sequence
  chemically synthesized
tcttgccttccagtttgatggc

SEQ ID NO: 711443 - DNA, 22 bp, Artificial Sequence
  chemically synthesized
tgatgaactctgccatcaaact

SEQ ID NO: 711444 - DNA, 22 bp, Artificial Sequence
  chemically synthesized
tctcttgccttccagtttgatg

SEQ ID NO: 711445 - DNA, 22 bp, Artificial Sequence
  chemically synthesized
atgaactctgccatcaaactgg

SEQ ID NO: 711446 - DNA, 22 bp, Artificial Sequence
  chemically synthesized
ttctctcttgccttccagtttg

SEQ ID NO: 711447 - DNA, 22 bp, Artificial Sequence
  chemically synthesized
gttctctcttgccttccagttt

SEQ ID NO: 711448 - DNA, 22 bp, Artificial Sequence
  chemically synthesized
tgttctctcttgccttccagtt

SEQ ID NO: 711449 - DNA, 22 bp, Artificial Sequence
  chemically synthesized
ttttgttctctcttgccttcca

SEQ ID NO: 711450 - DNA, 22 bp, Artificial Sequence
  chemically synthesized
tgccatcaaactggaaggcaag

SEQ ID NO: 711451 - DNA, 22 bp, Artificial Sequence
  chemically synthesized
ccatcaaactggaaggcaagag

SEQ ID NO: 711452 - DNA, 22 bp, Artificial Sequence
  chemically synthesized
ctgttttgttctctcttgcctt

SEQ ID NO: 711453 - DNA, 22 bp, Artificial Sequence
  chemically synthesized
gctgttttgttctctcttgcct

SEQ ID NO: 711454 - DNA, 22 bp, Artificial Sequence
  chemically synthesized
gaaggcaagagagaacaaaaca

SEQ ID NO: 711455 - DNA, 22 bp, Artificial Sequence
  chemically synthesized
acaacggacaaagagcttgctg

SEQ ID NO: 711456 - DNA, 22 bp, Artificial Sequence
  chemically synthesized
aacaacggacaaagagcttgct

SEQ ID NO: 711457 - DNA, 22 bp, Artificial Sequence
  chemically synthesized
aaggcttaacaacggacaaaga

SEQ ID NO: 711458 - DNA, 22 bp, Artificial Sequence
  chemically synthesized
tttgtccgttgttaagccttta

SEQ ID NO: 711459 - DNA, 22 bp, Artificial Sequence
  chemically synthesized
tgtccgttgttaagcctttaat

SEQ ID NO: 711460 - DNA, 22 bp, Artificial Sequence
  chemically synthesized
gtccgttgttaagcctttaatc

SEQ ID NO: 711461 - DNA, 22 bp, Artificial Sequence
  chemically synthesized
tccgttgttaagcctttaatct

SEQ ID NO: 711462 - DNA, 22 bp, Artificial Sequence
  chemically synthesized
gaaatcggtgaggtgaaagatt

SEQ ID NO: 711463 - DNA, 22 bp, Artificial Sequence
  chemically synthesized
agaaatcggtgaggtgaaagat

SEQ ID NO: 711464 - DNA, 22 bp, Artificial Sequence
  chemically synthesized
ttaagcctttaatctttcacct

SEQ ID NO: 711465 - DNA, 22 bp, Artificial Sequence
  chemically synthesized
tagaaatcggtgaggtgaaaga

SEQ ID NO: 711466 - DNA, 22 bp, Artificial Sequence
  chemically synthesized
agcctttaatctttcacctcac

SEQ ID NO: 711467 - DNA, 22 bp, Artificial Sequence
  chemically synthesized
taatctttcacctcaccgattt

SEQ ID NO: 711468 - DNA, 22 bp, Artificial Sequence
  chemically synthesized
aatctttcacctcaccgatttc

SEQ ID NO: 711469 - DNA, 22 bp, Artificial Sequence
  chemically synthesized
atctttcacctcaccgatttct

SEQ ID NO: 711470 - DNA, 22 bp, Artificial Sequence
  chemically synthesized
tcacctcaccgatttctaaaat

SEQ ID NO: 711471 - DNA, 22 bp, Artificial Sequence
  chemically synthesized
cacctcaccgatttctaaaatg

SEQ ID NO: 711472 - DNA, 22 bp, Artificial Sequence
  chemically synthesized
acctcaccgatttctaaaatgc

SEQ ID NO: 711473 - DNA, 22 bp, Artificial Sequence
  chemically synthesized
accgatttctaaaatgcacttt

SEQ ID NO: 711474 - DNA, 22 bp, Artificial Sequence
  chemically synthesized
ctaaaatgcactttggatgttt

SEQ ID NO: 711475 - DNA, 22 bp, Artificial Sequence
  chemically synthesized
taaaatgcactttggatgtttg

SEQ ID NO: 711476 - DNA, 22 bp, Artificial Sequence
  chemically synthesized
aaatgcactttggatgtttgtt

SEQ ID NO: 711477 - DNA, 22 bp, Artificial Sequence
  chemically synthesized
cataagcaagaaaaccaataaa

SEQ ID NO: 711478 - DNA, 22 bp, Artificial Sequence
  chemically synthesized
tggatgtttgtttattggtttt

SEQ ID NO: 711479 - DNA, 22 bp, Artificial Sequence
  chemically synthesized
ggatgtttgtttattggttttc

SEQ ID NO: 711480 - DNA, 22 bp, Artificial Sequence
  chemically synthesized
gatgtttgtttattggttttct

SEQ ID NO: 711481 - DNA, 22 bp, Artificial Sequence
  chemically synthesized
gtttattggttttcttgcttat

SEQ ID NO: 711482 - DNA, 22 bp, Artificial Sequence
  chemically synthesized
tttattggttttcttgcttatg

SEQ ID NO: 711483 - DNA, 22 bp, Artificial Sequence
  chemically synthesized
attggttttcttgcttatgcaa

SEQ ID NO: 711484 - DNA, 22 bp, Artificial Sequence
  chemically synthesized
ttggttttcttgcttatgcaac

SEQ ID NO: 711485 - DNA, 22 bp, Artificial Sequence
  chemically synthesized
gttttcttgcttatgcaactgc

SEQ ID NO: 711486 - DNA, 22 bp, Artificial Sequence
  chemically synthesized
tcacagaatgaggcagttgcat

SEQ ID NO: 711487 - DNA, 22 bp, Artificial Sequence
  chemically synthesized
tcttgcttatgcaactgcctca

SEQ ID NO: 711488 - DNA, 22 bp, Artificial Sequence
  chemically synthesized
cttgcttatgcaactgcctcat

SEQ ID NO: 711489 - DNA, 22 bp, Artificial Sequence
  chemically synthesized
cattatcacagaatgaggcagt

SEQ ID NO: 711490 - DNA, 22 bp, Artificial Sequence
  chemically synthesized
ttgcttatgcaactgcctcatt

SEQ ID NO: 711491 - DNA, 22 bp, Artificial Sequence
  chemically synthesized
gcttatgcaactgcctcattct

SEQ ID NO: 711492 - DNA, 22 bp, Artificial Sequence
  chemically synthesized
cttatgcaactgcctcattctg

SEQ ID NO: 711493 - DNA, 22 bp, Artificial Sequence
  chemically synthesized
actccattatcacagaatgagg

SEQ ID NO: 711494 - DNA, 22 bp, Artificial Sequence
  chemically synthesized
atgcaactgcctcattctgtga

SEQ ID NO: 711495 - DNA, 22 bp, Artificial Sequence
  chemically synthesized
tgcaactgcctcattctgtgat

SEQ ID NO: 711496 - DNA, 22 bp, Artificial Sequence
  chemically synthesized
atataacctgactccattatca

SEQ ID NO: 711497 - DNA, 22 bp, Artificial Sequence
  chemically synthesized
cctcattctgtgataatggagt

SEQ ID NO: 711498 - DNA, 22 bp, Artificial Sequence
  chemically synthesized
attctgtgataatggagtcagg

SEQ ID NO: 711499 - DNA, 22 bp, Artificial Sequence
  chemically synthesized
atgttgatataacctgactcca

SEQ ID NO: 711500 - DNA, 22 bp, Artificial Sequence
  chemically synthesized
aatgttgatataacctgactcc

SEQ ID NO: 711501 - DNA, 22 bp, Artificial Sequence
  chemically synthesized
tgtgataatggagtcaggttat

SEQ ID NO: 711502 - DNA, 22 bp, Artificial Sequence
  chemically synthesized
tgataatggagtcaggttatat

SEQ ID NO: 711503 - DNA, 22 bp, Artificial Sequence
  chemically synthesized
tgaagtcaatttaatgttgata

SEQ ID NO: 711504 - DNA, 22 bp, Artificial Sequence
  chemically synthesized
ggtctatgaagtcaatttaatg

SEQ ID NO: 711505 - DNA, 22 bp, Artificial Sequence
  chemically synthesized
gggtctatgaagtcaatttaat

SEQ ID NO: 711506 - DNA, 22 bp, Artificial Sequence
  chemically synthesized
tatcaacattaaattgacttca

SEQ ID NO: 711507 - DNA, 22 bp, Artificial Sequence
  chemically synthesized
aggtacttgggtctatgaagtc

SEQ ID NO: 711508 - DNA, 22 bp, Artificial Sequence
  chemically synthesized
aaggtacttgggtctatgaagt

SEQ ID NO: 711509 - DNA, 22 bp, Artificial Sequence
  chemically synthesized
aattgacttcatagacccaagt

SEQ ID NO: 711510 - DNA, 22 bp, Artificial Sequence
  chemically synthesized
acttcatagacccaagtacctt

SEQ ID NO: 711511 - DNA, 22 bp, Artificial Sequence
  chemically synthesized
catagacccaagtaccttaagg

SEQ ID NO: 711512 - DNA, 22 bp, Artificial Sequence
  chemically synthesized
atagacccaagtaccttaaggg

SEQ ID NO: 711513 - DNA, 22 bp, Artificial Sequence
  chemically synthesized
aaatgaatgatacccttaaggt

SEQ ID NO: 711514 - DNA, 22 bp, Artificial Sequence
  chemically synthesized
aattaaaatgaatgataccctt

SEQ ID NO: 711515 - DNA, 22 bp, Artificial Sequence
  chemically synthesized
taaattaaaatgaatgataccc

SEQ ID NO: 711516 - DNA, 22 bp, Artificial Sequence
  chemically synthesized
ctaaattaaaatgaatgatacc

SEQ ID NO: 711517 - DNA, 22 bp, Artificial Sequence
  chemically synthesized
tctaaattaaaatgaatgatac

SEQ ID NO: 711518 - DNA, 22 bp, Artificial Sequence
  chemically synthesized
ttctaaattaaaatgaatgata

SEQ ID NO: 711519 - DNA, 22 bp, Artificial Sequence
  chemically synthesized
cttttctaaattaaaatgaatg

SEQ ID NO: 711520 - DNA, 22 bp, Artificial Sequence
  chemically synthesized
ctgcttttctaaattaaaatga

SEQ ID NO: 711521 - DNA, 22 bp, Artificial Sequence
  chemically synthesized
aagggtatcattcattttaatt

SEQ ID NO: 711522 - DNA, 22 bp, Artificial Sequence
  chemically synthesized
agggtatcattcattttaattt

SEQ ID NO: 711523 - DNA, 22 bp, Artificial Sequence
  chemically synthesized
attgctgcttttctaaattaaa

SEQ ID NO: 711524 - DNA, 22 bp, Artificial Sequence
  chemically synthesized
attttaatttagaaaagcagca

SEQ ID NO: 711525 - DNA, 22 bp, Artificial Sequence
  chemically synthesized
taatttagaaaagcagcaatca

SEQ ID NO: 711526 - DNA, 22 bp, Artificial Sequence
  chemically synthesized
aatttagaaaagcagcaatcaa

SEQ ID NO: 711527 - DNA, 22 bp, Artificial Sequence
  chemically synthesized
atttagaaaagcagcaatcaac

SEQ ID NO: 711528 - DNA, 22 bp, Artificial Sequence
  chemically synthesized
agaaaagcagcaatcaacctcc

SEQ ID NO: 711529 - DNA, 22 bp, Artificial Sequence
  chemically synthesized
gaaaagcagcaatcaacctcct

SEQ ID NO: 711530 - DNA, 22 bp, Artificial Sequence
  chemically synthesized
acaaatgaaacaggataggagg

SEQ ID NO: 711531 - DNA, 22 bp, Artificial Sequence
  chemically synthesized
gacaaatgaaacaggataggag

SEQ ID NO: 711532 - DNA, 22 bp, Artificial Sequence
  chemically synthesized
tgacaaatgaaacaggatagga

SEQ ID NO: 711533 - DNA, 22 bp, Artificial Sequence
  chemically synthesized
aagattttgacaaatgaaacag

SEQ ID NO: 711534 - DNA, 22 bp, Artificial Sequence
  chemically synthesized
aaactaaagattttgacaaatg

SEQ ID NO: 711535 - DNA, 22 bp, Artificial Sequence
  chemically synthesized
ctatcctgtttcatttgtcaaa

SEQ ID NO: 711536 - DNA, 22 bp, Artificial Sequence
  chemically synthesized
tcctgtttcatttgtcaaaatc

SEQ ID NO: 711537 - DNA, 22 bp, Artificial Sequence
  chemically synthesized
tttcatttgtcaaaatctttag

SEQ ID NO: 711538 - DNA, 22 bp, Artificial Sequence
  chemically synthesized
catttgtcaaaatctttagttt

SEQ ID NO: 711539 - DNA, 22 bp, Artificial Sequence
  chemically synthesized
tagatgtaattaaaactaaaga

SEQ ID NO: 711540 - DNA, 22 bp, Artificial Sequence
  chemically synthesized
atttgtcaaaatctttagtttt

SEQ ID NO: 711541 - DNA, 22 bp, Artificial Sequence
  chemically synthesized
gtcaaaatctttagttttaatt

SEQ ID NO: 711542 - DNA, 22 bp, Artificial Sequence
  chemically synthesized
tcaaaatctttagttttaatta

SEQ ID NO: 711543 - DNA, 22 bp, Artificial Sequence
  chemically synthesized
ataagtctgtagatgtaattaa

SEQ ID NO: 711544 - DNA, 22 bp, Artificial Sequence
  chemically synthesized
cataagtctgtagatgtaatta

SEQ ID NO: 711545 - DNA, 22 bp, Artificial Sequence
  chemically synthesized
tcataagtctgtagatgtaatt

SEQ ID NO: 711546 - DNA, 22 bp, Artificial Sequence
  chemically synthesized
tagttttaattacatctacaga

SEQ ID NO: 711547 - DNA, 22 bp, Artificial Sequence
  chemically synthesized
agttttaattacatctacagac

SEQ ID NO: 711548 - DNA, 22 bp, Artificial Sequence
  chemically synthesized
gttttaattacatctacagact

SEQ ID NO: 711549 - DNA, 22 bp, Artificial Sequence
  chemically synthesized
tcacaattttcataagtctgta

SEQ ID NO: 711550 - DNA, 22 bp, Artificial Sequence
  chemically synthesized
taattacatctacagacttatg

SEQ ID NO: 711551 - DNA, 22 bp, Artificial Sequence
  chemically synthesized
aattacatctacagacttatga

SEQ ID NO: 711552 - DNA, 22 bp, Artificial Sequence
  chemically synthesized
ctgtcacaattttcataagtct

SEQ ID NO: 711553 - DNA, 22 bp, Artificial Sequence
  chemically synthesized
attacatctacagacttatgaa

SEQ ID NO: 711554 - DNA, 22 bp, Artificial Sequence
  chemically synthesized
cctgtcacaattttcataagtc

SEQ ID NO: 711555 - DNA, 22 bp, Artificial Sequence
  chemically synthesized
ttcctgtcacaattttcataag

SEQ ID NO: 711556 - DNA, 22 bp, Artificial Sequence
  chemically synthesized
catctacagacttatgaaaatt

SEQ ID NO: 711557 - DNA, 22 bp, Artificial Sequence
  chemically synthesized
tcttcctgtcacaattttcata

SEQ ID NO: 711558 - DNA, 22 bp, Artificial Sequence
  chemically synthesized
ctcttcctgtcacaattttcat

SEQ ID NO: 711559 - DNA, 22 bp, Artificial Sequence
  chemically synthesized
ttctcttcctgtcacaattttc

SEQ ID NO: 711560 - DNA, 22 bp, Artificial Sequence
  chemically synthesized
cagacttatgaaaattgtgaca

SEQ ID NO: 711561 - DNA, 22 bp, Artificial Sequence
  chemically synthesized
tgatctcttctcttcctgtcac

SEQ ID NO: 711562 - DNA, 22 bp, Artificial Sequence
  chemically synthesized
atgaaaattgtgacaggaagag

SEQ ID NO: 711563 - DNA, 22 bp, Artificial Sequence
  chemically synthesized
ctatgatctcttctcttcctgt

SEQ ID NO: 711564 - DNA, 22 bp, Artificial Sequence
  chemically synthesized
tgaaaattgtgacaggaagaga

SEQ ID NO: 711565 - DNA, 22 bp, Artificial Sequence
  chemically synthesized
cctatgatctcttctcttcctg

SEQ ID NO: 711566 - DNA, 22 bp, Artificial Sequence
  chemically synthesized
tgacaggaagagaagagatcat

SEQ ID NO: 711567 - DNA, 22 bp, Artificial Sequence
  chemically synthesized
cttctgcctttttttttttttt

SEQ ID NO: 711568 - DNA, 22 bp, Artificial Sequence
  chemically synthesized
agaccaaaaaaaaaaaaaaaaa

SEQ ID NO: 711569 - DNA, 22 bp, Artificial Sequence
  chemically synthesized
ttctgccttttttttttttttt

SEQ ID NO: 711570 - DNA, 22 bp, Artificial Sequence
  chemically synthesized
tgagaccaaaaaaaaaaaaaaa

SEQ ID NO: 711571 - DNA, 22 bp, Artificial Sequence
  chemically synthesized
ctgccttttttttttttttttt

SEQ ID NO: 711572 - DNA, 22 bp, Artificial Sequence
  chemically synthesized
tgcctttttttttttttttttt

SEQ ID NO: 711573 - DNA, 22 bp, Artificial Sequence
  chemically synthesized
tctgagaccaaaaaaaaaaaaa

SEQ ID NO: 711574 - DNA, 22 bp, Artificial Sequence
  chemically synthesized
cctttttttttttttttttttt

SEQ ID NO: 711575 - DNA, 22 bp, Artificial Sequence
  chemically synthesized
tctctgagaccaaaaaaaaaaa

SEQ ID NO: 711576 - DNA, 22 bp, Artificial Sequence
  chemically synthesized
ctctctgagaccaaaaaaaaaa

SEQ ID NO: 711577 - DNA, 22 bp, Artificial Sequence
  chemically synthesized
tctctctgagaccaaaaaaaaa

SEQ ID NO: 711578 - DNA, 22 bp, Artificial Sequence
  chemically synthesized
ttctctctgagaccaaaaaaaa

SEQ ID NO: 711579 - DNA, 22 bp, Artificial Sequence
  chemically synthesized
tttttttttttttttttttggt

SEQ ID NO: 711580 - DNA, 22 bp, Artificial Sequence
  chemically synthesized
ttttttttttttttttttggtc

SEQ ID NO: 711581 - DNA, 22 bp, Artificial Sequence
  chemically synthesized
ttttctctctgagaccaaaaaa

SEQ ID NO: 711582 - DNA, 22 bp, Artificial Sequence
  chemically synthesized
tttttttttttttttttggtct

SEQ ID NO: 711583 - DNA, 22 bp, Artificial Sequence
  chemically synthesized
ttttttttttttttttggtctc

SEQ ID NO: 711584 - DNA, 22 bp, Artificial Sequence
  chemically synthesized
tttttttttttttttggtctca

SEQ ID NO: 711585 - DNA, 22 bp, Artificial Sequence
  chemically synthesized
ctcttttctctctgagaccaaa

SEQ ID NO: 711586 - DNA, 22 bp, Artificial Sequence
  chemically synthesized
ttttttttttttttggtctcag

SEQ ID NO: 711587 - DNA, 22 bp, Artificial Sequence
  chemically synthesized
cctcttttctctctgagaccaa

SEQ ID NO: 711588 - DNA, 22 bp, Artificial Sequence
  chemically synthesized
tttttttttttttggtctcaga

SEQ ID NO: 711589 - DNA, 22 bp, Artificial Sequence
  chemically synthesized
tcctcttttctctctgagacca

SEQ ID NO: 711590 - DNA, 22 bp, Artificial Sequence
  chemically synthesized
ttttttttttttggtctcagag

SEQ ID NO: 711591 - DNA, 22 bp, Artificial Sequence
  chemically synthesized
tttttttttttggtctcagaga

SEQ ID NO: 711592 - DNA, 22 bp, Artificial Sequence
  chemically synthesized
ttttttttttggtctcagagag

SEQ ID NO: 711593 - DNA, 22 bp, Artificial Sequence
  chemically synthesized
tttttttttggtctcagagaga

SEQ ID NO: 711594 - DNA, 22 bp, Artificial Sequence
  chemically synthesized
ttttttttggtctcagagagaa

SEQ ID NO: 711595 - DNA, 22 bp, Artificial Sequence
  chemically synthesized
aactttcctcttttctctctga

SEQ ID NO: 711596 - DNA, 22 bp, Artificial Sequence
  chemically synthesized
tttttttggtctcagagagaaa

SEQ ID NO: 711597 - DNA, 22 bp, Artificial Sequence
  chemically synthesized
ttttttggtctcagagagaaaa

SEQ ID NO: 711598 - DNA, 22 bp, Artificial Sequence
  chemically synthesized
tttttggtctcagagagaaaag

SEQ ID NO: 711599 - DNA, 22 bp, Artificial Sequence
  chemically synthesized
ttttggtctcagagagaaaaga

SEQ ID NO: 711600 - DNA, 22 bp, Artificial Sequence
  chemically synthesized
tttggtctcagagagaaaagag

SEQ ID NO: 711601 - DNA, 22 bp, Artificial Sequence
  chemically synthesized
ttggtctcagagagaaaagagg

SEQ ID NO: 711602 - DNA, 22 bp, Artificial Sequence
  chemically synthesized
tggtctcagagagaaaagagga

SEQ ID NO: 711603 - DNA, 22 bp, Artificial Sequence
  chemically synthesized
ggtctcagagagaaaagaggaa

SEQ ID NO: 711604 - DNA, 22 bp, Artificial Sequence
  chemically synthesized
gtctcagagagaaaagaggaaa

SEQ ID NO: 711605 - DNA, 22 bp, Artificial Sequence
  chemically synthesized
agagagaaaagaggaaagttga

SEQ ID NO: 711606 - DNA, 22 bp, Artificial Sequence
  chemically synthesized
caggcaaagtaattcaactttc

SEQ ID NO: 711607 - DNA, 22 bp, Artificial Sequence
  chemically synthesized
ccaggcaaagtaattcaacttt

SEQ ID NO: 711608 - DNA, 22 bp, Artificial Sequence
  chemically synthesized
catcaccttccaggcaaagtaa

SEQ ID NO: 711609 - DNA, 22 bp, Artificial Sequence
  chemically synthesized
aattactttgcctggaaggtga

SEQ ID NO: 711610 - DNA, 22 bp, Artificial Sequence
  chemically synthesized
tatcaagttacatcaccttcca

SEQ ID NO: 711611 - DNA, 22 bp, Artificial Sequence
  chemically synthesized
ctttgcctggaaggtgatgtaa

SEQ ID NO: 711612 - DNA, 22 bp, Artificial Sequence
  chemically synthesized
tgcctggaaggtgatgtaactt

SEQ ID NO: 711613 - DNA, 22 bp, Artificial Sequence
  chemically synthesized
gcctggaaggtgatgtaacttg

SEQ ID NO: 711614 - DNA, 22 bp, Artificial Sequence
  chemically synthesized
cctggaaggtgatgtaacttga

SEQ ID NO: 711615 - DNA, 22 bp, Artificial Sequence
  chemically synthesized
agataaaatctgtatcaagtta

SEQ ID NO: 711616 - DNA, 22 bp, Artificial Sequence
  chemically synthesized
aagataaaatctgtatcaagtt

SEQ ID NO: 711617 - DNA, 22 bp, Artificial Sequence
  chemically synthesized
gaaggtgatgtaacttgataca

SEQ ID NO: 711618 - DNA, 22 bp, Artificial Sequence
  chemically synthesized
taagataaaatctgtatcaagt

SEQ ID NO: 711619 - DNA, 22 bp, Artificial Sequence
  chemically synthesized
ttaagataaaatctgtatcaag

SEQ ID NO: 711620 - DNA, 22 bp, Artificial Sequence
  chemically synthesized
tttaagataaaatctgtatcaa

SEQ ID NO: 711621 - DNA, 22 bp, Artificial Sequence
  chemically synthesized
ttttttaagataaaatctgtat

SEQ ID NO: 711622 - DNA, 22 bp, Artificial Sequence
  chemically synthesized
gatacagattttatcttaaaaa

SEQ ID NO: 711623 - DNA, 22 bp, Artificial Sequence
  chemically synthesized
atacagattttatcttaaaaaa

SEQ ID NO: 711624 - DNA, 22 bp, Artificial Sequence
  chemically synthesized
aaagggaacctattttttaaga

SEQ ID NO: 711625 - DNA, 22 bp, Artificial Sequence
  chemically synthesized
aaaagggaacctattttttaag

SEQ ID NO: 711626 - DNA, 22 bp, Artificial Sequence
  chemically synthesized
taaaagggaacctattttttaa

SEQ ID NO: 711627 - DNA, 22 bp, Artificial Sequence
  chemically synthesized
ttaaaagggaacctatttttta

SEQ ID NO: 711628 - DNA, 22 bp, Artificial Sequence
  chemically synthesized
tatcttaaaaaataggttccct

SEQ ID NO: 711629 - DNA, 22 bp, Artificial Sequence
  chemically synthesized
atcttaaaaaataggttccctt

SEQ ID NO: 711630 - DNA, 22 bp, Artificial Sequence
  chemically synthesized
tcttaaaaaataggttcccttt

SEQ ID NO: 711631 - DNA, 22 bp, Artificial Sequence
  chemically synthesized
ggaaaacttttaaaagggaacc

SEQ ID NO: 711632 - DNA, 22 bp, Artificial Sequence
  chemically synthesized
aaaaaataggttcccttttaaa

SEQ ID NO: 711633 - DNA, 22 bp, Artificial Sequence
  chemically synthesized
aaaaataggttcccttttaaaa

SEQ ID NO: 711634 - DNA, 22 bp, Artificial Sequence
  chemically synthesized
ccttttaaaagttttcctaatg

SEQ ID NO: 711635 - DNA, 22 bp, Artificial Sequence
  chemically synthesized
caaatcatgagatacattagga

SEQ ID NO: 711636 - DNA, 22 bp, Artificial Sequence
  chemically synthesized
ttaaaagttttcctaatgtatc

SEQ ID NO: 711637 - DNA, 22 bp, Artificial Sequence
  chemically synthesized
taaaagttttcctaatgtatct

SEQ ID NO: 711638 - DNA, 22 bp, Artificial Sequence
  chemically synthesized
ttgcaaatcatgagatacatta

SEQ ID NO: 711639 - DNA, 22 bp, Artificial Sequence
  chemically synthesized
aaaagttttcctaatgtatctc

SEQ ID NO: 711640 - DNA, 22 bp, Artificial Sequence
  chemically synthesized
aaagttttcctaatgtatctca

SEQ ID NO: 711641 - DNA, 22 bp, Artificial Sequence
  chemically synthesized
ctgttgcaaatcatgagataca

SEQ ID NO: 711642 - DNA, 22 bp, Artificial Sequence
  chemically synthesized
gttcctgttgcaaatcatgaga

SEQ ID NO: 711643 - DNA, 22 bp, Artificial Sequence
  chemically synthesized
agttcctgttgcaaatcatgag

SEQ ID NO: 711644 - DNA, 22 bp, Artificial Sequence
  chemically synthesized
tcctaatgtatctcatgatttg

SEQ ID NO: 711645 - DNA, 22 bp, Artificial Sequence
  chemically synthesized
tagttcctgttgcaaatcatga

SEQ ID NO: 711646 - DNA, 22 bp, Artificial Sequence
  chemically synthesized
cctaatgtatctcatgatttgc

SEQ ID NO: 711647 - DNA, 22 bp, Artificial Sequence
  chemically synthesized
ctaatgtatctcatgatttgca

SEQ ID NO: 711648 - DNA, 22 bp, Artificial Sequence
  chemically synthesized
actttagttcctgttgcaaatc

SEQ ID NO: 711649 - DNA, 22 bp, Artificial Sequence
  chemically synthesized
atgtatctcatgatttgcaaca

SEQ ID NO: 711650 - DNA, 22 bp, Artificial Sequence
  chemically synthesized
gactttagttcctgttgcaaat

SEQ ID NO: 711651 - DNA, 22 bp, Artificial Sequence
  chemically synthesized
atgatttgcaacaggaactaaa

SEQ ID NO: 711652 - DNA, 22 bp, Artificial Sequence
  chemically synthesized
gcaacaggaactaaagtcaagt

SEQ ID NO: 711653 - DNA, 22 bp, Artificial Sequence
  chemically synthesized
caacaggaactaaagtcaagtg

SEQ ID NO: 711654 - DNA, 22 bp, Artificial Sequence
  chemically synthesized
taaggtgagagccacttgactt

SEQ ID NO: 711655 - DNA, 22 bp, Artificial Sequence
  chemically synthesized
aagtcaagtggctctcacctta

SEQ ID NO: 711656 - DNA, 22 bp, Artificial Sequence
  chemically synthesized
atgtaatgatgttgtaaggtga

SEQ ID NO: 711657 - DNA, 22 bp, Artificial Sequence
  chemically synthesized
aatgtaatgatgttgtaaggtg

SEQ ID NO: 711658 - DNA, 22 bp, Artificial Sequence
  chemically synthesized
tcaccttacaacatcattacat

SEQ ID NO: 711659 - DNA, 22 bp, Artificial Sequence
  chemically synthesized
accttacaacatcattacatta

SEQ ID NO: 711660 - DNA, 22 bp, Artificial Sequence
  chemically synthesized
gaatgtaaatgatttaatgtaa

SEQ ID NO: 711661 - DNA, 22 bp, Artificial Sequence
  chemically synthesized
acaacatcattacattaaatca

SEQ ID NO: 711662 - DNA, 22 bp, Artificial Sequence
  chemically synthesized
caacatcattacattaaatcat

SEQ ID NO: 711663 - DNA, 22 bp, Artificial Sequence
  chemically synthesized
aggctggaatgtaaatgattta

SEQ ID NO: 711664 - DNA, 22 bp, Artificial Sequence
  chemically synthesized
cattaaatcatttacattccag

SEQ ID NO: 711665 - DNA, 22 bp, Artificial Sequence
  chemically synthesized
aatcatttacattccagcctta

SEQ ID NO: 711666 - DNA, 22 bp, Artificial Sequence
  chemically synthesized
aagaataaatagctaaggctgg

SEQ ID NO: 711667 - DNA, 22 bp, Artificial Sequence
  chemically synthesized
acattccagccttagctattta

SEQ ID NO: 711668 - DNA, 22 bp, Artificial Sequence
  chemically synthesized
cattccagccttagctatttat

SEQ ID NO: 711669 - DNA, 22 bp, Artificial Sequence
  chemically synthesized
cagccttagctatttattcttg

SEQ ID NO: 711670 - DNA, 22 bp, Artificial Sequence
  chemically synthesized
agctatttattcttgagcttta

SEQ ID NO: 711671 - DNA, 22 bp, Artificial Sequence
  chemically synthesized
gctatttattcttgagctttat

SEQ ID NO: 711672 - DNA, 22 bp, Artificial Sequence
  chemically synthesized
caaatgtggtataaataaagct

SEQ ID NO: 711673 - DNA, 22 bp, Artificial Sequence
  chemically synthesized
ccaaatgtggtataaataaagc

SEQ ID NO: 711674 - DNA, 22 bp, Artificial Sequence
  chemically synthesized
tttattcttgagctttatttat

SEQ ID NO: 711675 - DNA, 22 bp, Artificial Sequence
  chemically synthesized
attcttgagctttatttatacc

SEQ ID NO: 711676 - DNA, 22 bp, Artificial Sequence
  chemically synthesized
ttcttgagctttatttatacca

SEQ ID NO: 711677 - DNA, 22 bp, Artificial Sequence
  chemically synthesized
ttgagctttatttataccacat

SEQ ID NO: 711678 - DNA, 22 bp, Artificial Sequence
  chemically synthesized
gagctttatttataccacattt

SEQ ID NO: 711679 - DNA, 22 bp, Artificial Sequence
  chemically synthesized
agctttatttataccacatttg

SEQ ID NO: 711680 - DNA, 22 bp, Artificial Sequence
  chemically synthesized
tgagaacgatatcttccaaatg

SEQ ID NO: 711681 - DNA, 22 bp, Artificial Sequence
  chemically synthesized
tatttataccacatttggaaga

SEQ ID NO: 711682 - DNA, 22 bp, Artificial Sequence
  chemically synthesized
atttataccacatttggaagat

SEQ ID NO: 711683 - DNA, 22 bp, Artificial Sequence
  chemically synthesized
tgtgagaacgatatcttccaaa

SEQ ID NO: 711684 - DNA, 22 bp, Artificial Sequence
  chemically synthesized
tttataccacatttggaagata

SEQ ID NO: 711685 - DNA, 22 bp, Artificial Sequence
  chemically synthesized
ctgtgagaacgatatcttccaa

SEQ ID NO: 711686 - DNA, 22 bp, Artificial Sequence
  chemically synthesized
ataccacatttggaagatatcg

SEQ ID NO: 711687 - DNA, 22 bp, Artificial Sequence
  chemically synthesized
taccacatttggaagatatcgt

SEQ ID NO: 711688 - DNA, 22 bp, Artificial Sequence
  chemically synthesized
agaaaatttctgtgagaacgat

SEQ ID NO: 711689 - DNA, 22 bp, Artificial Sequence
  chemically synthesized
ggaagatatcgttctcacagaa

SEQ ID NO: 711690 - DNA, 22 bp, Artificial Sequence
  chemically synthesized
gaagatatcgttctcacagaaa

SEQ ID NO: 711691 - DNA, 22 bp, Artificial Sequence
  chemically synthesized
caatggcctcagaaaatttctg

SEQ ID NO: 711692 - DNA, 22 bp, Artificial Sequence
  chemically synthesized
tcacagaaattttctgaggcca

SEQ ID NO: 711693 - DNA, 22 bp, Artificial Sequence
  chemically synthesized
acagaaattttctgaggccatt

SEQ ID NO: 711694 - DNA, 22 bp, Artificial Sequence
  chemically synthesized
gaaaggaatgctccaatggcct

SEQ ID NO: 711695 - DNA, 22 bp, Artificial Sequence
  chemically synthesized
tctgaggccattggagcattcc

SEQ ID NO: 711696 - DNA, 22 bp, Artificial Sequence
  chemically synthesized
ctgaggccattggagcattcct

SEQ ID NO: 711697 - DNA, 22 bp, Artificial Sequence
  chemically synthesized
tgaggccattggagcattcctt

SEQ ID NO: 711698 - DNA, 22 bp, Artificial Sequence
  chemically synthesized
aggccattggagcattcctttc

SEQ ID NO: 711699 - DNA, 22 bp, Artificial Sequence
  chemically synthesized
tgggccaaaatgcccctagaaa

SEQ ID NO: 711700 - DNA, 22 bp, Artificial Sequence
  chemically synthesized
atgggccaaaatgcccctagaa

SEQ ID NO: 711701 - DNA, 22 bp, Artificial Sequence
  chemically synthesized
gagcattcctttctaggggcat

SEQ ID NO: 711702 - DNA, 22 bp, Artificial Sequence
  chemically synthesized
cttatgggccaaaatgccccta

SEQ ID NO: 711703 - DNA, 22 bp, Artificial Sequence
  chemically synthesized
tgctacttatgggccaaaatgc

SEQ ID NO: 711704 - DNA, 22 bp, Artificial Sequence
  chemically synthesized
ctttctaggggcattttggccc

SEQ ID NO: 711705 - DNA, 22 bp, Artificial Sequence
  chemically synthesized
tctaggggcattttggcccata

SEQ ID NO: 711706 - DNA, 22 bp, Artificial Sequence
  chemically synthesized
ctaggggcattttggcccataa

SEQ ID NO: 711707 - DNA, 22 bp, Artificial Sequence
  chemically synthesized
taggggcattttggcccataag

SEQ ID NO: 711708 - DNA, 22 bp, Artificial Sequence
  chemically synthesized
ggggcattttggcccataagta

SEQ ID NO: 711709 - DNA, 22 bp, Artificial Sequence
  chemically synthesized
ccatgtgaacattatgctactt

SEQ ID NO: 711710 - DNA, 22 bp, Artificial Sequence
  chemically synthesized
tggcccataagtagcataatgt

SEQ ID NO: 711711 - DNA, 22 bp, Artificial Sequence
  chemically synthesized
ggcccataagtagcataatgtt

SEQ ID NO: 711712 - DNA, 22 bp, Artificial Sequence
  chemically synthesized
gcccataagtagcataatgttc

SEQ ID NO: 711713 - DNA, 22 bp, Artificial Sequence
  chemically synthesized
tgtaattaccatgtgaacatta

SEQ ID NO: 711714 - DNA, 22 bp, Artificial Sequence
  chemically synthesized
acatggtaattacataattatg

SEQ ID NO: 711715 - DNA, 22 bp, Artificial Sequence
  chemically synthesized
aaataccaggaggcataattat

SEQ ID NO: 711716 - DNA, 22 bp, Artificial Sequence
  chemically synthesized
tgttcaaataccaggaggcata

SEQ ID NO: 711717 - DNA, 22 bp, Artificial Sequence
  chemically synthesized
ctgtgttcaaataccaggaggc

SEQ ID NO: 711718 - DNA, 22 bp, Artificial Sequence
  chemically synthesized
cataattatgcctcctggtatt

SEQ ID NO: 711719 - DNA, 22 bp, Artificial Sequence
  chemically synthesized
gaaatactcctgtgttcaaata

SEQ ID NO: 711720 - DNA, 22 bp, Artificial Sequence
  chemically synthesized
ggaaatactcctgtgttcaaat

SEQ ID NO: 711721 - DNA, 22 bp, Artificial Sequence
  chemically synthesized
tgcctcctggtatttgaacaca

SEQ ID NO: 711722 - DNA, 22 bp, Artificial Sequence
  chemically synthesized
cttggaaatactcctgtgttca

SEQ ID NO: 711723 - DNA, 22 bp, Artificial Sequence
  chemically synthesized
ttccttggaaatactcctgtgt

SEQ ID NO: 711724 - DNA, 22 bp, Artificial Sequence
  chemically synthesized
ctggtatttgaacacaggagta

SEQ ID NO: 711725 - DNA, 22 bp, Artificial Sequence
  chemically synthesized
gttccttggaaatactcctgtg

SEQ ID NO: 711726 - DNA, 22 bp, Artificial Sequence
  chemically synthesized
tgttccttggaaatactcctgt

SEQ ID NO: 711727 - DNA, 22 bp, Artificial Sequence
  chemically synthesized
ttgttccttggaaatactcctg

SEQ ID NO: 711728 - DNA, 22 bp, Artificial Sequence
  chemically synthesized
gtatttgaacacaggagtattt

SEQ ID NO: 711729 - DNA, 22 bp, Artificial Sequence
  chemically synthesized
ccacttttgttccttggaaata

SEQ ID NO: 711730 - DNA, 22 bp, Artificial Sequence
  chemically synthesized
gaacacaggagtatttccaagg

SEQ ID NO: 711731 - DNA, 22 bp, Artificial Sequence
  chemically synthesized
aacacaggagtatttccaagga

SEQ ID NO: 711732 - DNA, 22 bp, Artificial Sequence
  chemically synthesized
aaattgccacttttgttccttg

SEQ ID NO: 711733 - DNA, 22 bp, Artificial Sequence
  chemically synthesized
caaattgccacttttgttcctt

SEQ ID NO: 711734 - DNA, 22 bp, Artificial Sequence
  chemically synthesized
tttcaaattgccacttttgttc

SEQ ID NO: 711735 - DNA, 22 bp, Artificial Sequence
  chemically synthesized
ccaaggaacaaaagtggcaatt

SEQ ID NO: 711736 - DNA, 22 bp, Artificial Sequence
  chemically synthesized
atgattatttcaaattgccact

SEQ ID NO: 711737 - DNA, 22 bp, Artificial Sequence
  chemically synthesized
caaggaacaaaagtggcaattt

SEQ ID NO: 711738 - DNA, 22 bp, Artificial Sequence
  chemically synthesized
actgatgattatttcaaattgc

SEQ ID NO: 711739 - DNA, 22 bp, Artificial Sequence
  chemically synthesized
tggtatctcactgatgattatt

SEQ ID NO: 711740 - DNA, 22 bp, Artificial Sequence
  chemically synthesized
tatggtatctcactgatgatta

SEQ ID NO: 711741 - DNA, 22 bp, Artificial Sequence
  chemically synthesized
gaaataatcatcagtgagatac

SEQ ID NO: 711742 - DNA, 22 bp, Artificial Sequence
  chemically synthesized
aaataatcatcagtgagatacc

SEQ ID NO: 711743 - DNA, 22 bp, Artificial Sequence
  chemically synthesized
ggacaataccagttctatggta

SEQ ID NO: 711744 - DNA, 22 bp, Artificial Sequence
  chemically synthesized
cggacaataccagttctatggt

SEQ ID NO: 711745 - DNA, 22 bp, Artificial Sequence
  chemically synthesized
tcggacaataccagttctatgg

SEQ ID NO: 711746 - DNA, 22 bp, Artificial Sequence
  chemically synthesized
ttcggacaataccagttctatg

SEQ ID NO: 711747 - DNA, 22 bp, Artificial Sequence
  chemically synthesized
tttcggacaataccagttctat

SEQ ID NO: 711748 - DNA, 22 bp, Artificial Sequence
  chemically synthesized
ttttcggacaataccagttcta

SEQ ID NO: 711749 - DNA, 22 bp, Artificial Sequence
  chemically synthesized
tttttcggacaataccagttct

SEQ ID NO: 711750 - DNA, 22 bp, Artificial Sequence
  chemically synthesized
ttttttcggacaataccagttc

SEQ ID NO: 711751 - DNA, 22 bp, Artificial Sequence
  chemically synthesized
tttttttcggacaataccagtt

SEQ ID NO: 711752 - DNA, 22 bp, Artificial Sequence
  chemically synthesized
ttttttttcggacaataccagt

SEQ ID NO: 711753 - DNA, 22 bp, Artificial Sequence
  chemically synthesized
tttttttttcggacaataccag

SEQ ID NO: 711754 - DNA, 22 bp, Artificial Sequence
  chemically synthesized
ttttttttttcggacaatacca

SEQ ID NO: 711755 - DNA, 22 bp, Artificial Sequence
  chemically synthesized
tttttttttttcggacaatacc

SEQ ID NO: 711756 - DNA, 22 bp, Artificial Sequence
  chemically synthesized
ttttttttttttcggacaatac

SEQ ID NO: 711757 - DNA, 22 bp, Artificial Sequence
  chemically synthesized
gtattgtccgaaaaaaaaaaaa

SEQ ID NO: 711758 - DNA, 22 bp, Artificial Sequence
  chemically synthesized
atatatgccgtctttttttttt

SEQ ID NO: 711759 - DNA, 22 bp, Artificial Sequence
  chemically synthesized
ctaatatatgccgtcttttttt

SEQ ID NO: 711760 - DNA, 22 bp, Artificial Sequence
  chemically synthesized
tccgaaaaaaaaaaaaaagacg

SEQ ID NO: 711761 - DNA, 22 bp, Artificial Sequence
  chemically synthesized
cctaatatatgccgtctttttt

SEQ ID NO: 711762 - DNA, 22 bp, Artificial Sequence
  chemically synthesized
atatgaatttcctaatatatgc

SEQ ID NO: 711763 - DNA, 22 bp, Artificial Sequence
  chemically synthesized
gttaatatgaatttcctaatat

SEQ ID NO: 711764 - DNA, 22 bp, Artificial Sequence
  chemically synthesized
agtcattcgttaatatgaattt

SEQ ID NO: 711765 - DNA, 22 bp, Artificial Sequence
  chemically synthesized
cagtcattcgttaatatgaatt

SEQ ID NO: 711766 - DNA, 22 bp, Artificial Sequence
  chemically synthesized
tttcagtcattcgttaatatga

SEQ ID NO: 711767 - DNA, 22 bp, Artificial Sequence
  chemically synthesized
cctgtttcagtcattcgttaat

SEQ ID NO: 711768 - DNA, 22 bp, Artificial Sequence
  chemically synthesized
ggaaattcatattaacgaatga

SEQ ID NO: 711769 - DNA, 22 bp, Artificial Sequence
  chemically synthesized
tctacctgtttcagtcattcgt

SEQ ID NO: 711770 - DNA, 22 bp, Artificial Sequence
  chemically synthesized
atctacctgtttcagtcattcg

SEQ ID NO: 711771 - DNA, 22 bp, Artificial Sequence
  chemically synthesized
atattaacgaatgactgaaaca

SEQ ID NO: 711772 - DNA, 22 bp, Artificial Sequence
  chemically synthesized
catttatctacctgtttcagtc

SEQ ID NO: 711773 - DNA, 22 bp, Artificial Sequence
  chemically synthesized
gcatttatctacctgtttcagt

SEQ ID NO: 711774 - DNA, 22 bp, Artificial Sequence
  chemically synthesized
tgcatttatctacctgtttcag

SEQ ID NO: 711775 - DNA, 22 bp, Artificial Sequence
  chemically synthesized
ttgcatttatctacctgtttca

SEQ ID NO: 711776 - DNA, 22 bp, Artificial Sequence
  chemically synthesized
tttgcatttatctacctgtttc

SEQ ID NO: 711777 - DNA, 22 bp, Artificial Sequence
  chemically synthesized
acgaatgactgaaacaggtaga

SEQ ID NO: 711778 - DNA, 22 bp, Artificial Sequence
  chemically synthesized
tctttttgcatttatctacctg

SEQ ID NO: 711779 - DNA, 22 bp, Artificial Sequence
  chemically synthesized
atctttttgcatttatctacct

SEQ ID NO: 711780 - DNA, 22 bp, Artificial Sequence
  chemically synthesized
tatctttttgcatttatctacc

SEQ ID NO: 711781 - DNA, 22 bp, Artificial Sequence
  chemically synthesized
aaacaggtagataaatgcaaaa

SEQ ID NO: 711782 - DNA, 22 bp, Artificial Sequence
  chemically synthesized
cagtgctttatctttttgcatt

SEQ ID NO: 711783 - DNA, 22 bp, Artificial Sequence
  chemically synthesized
ccagtgctttatctttttgcat

SEQ ID NO: 711784 - DNA, 22 bp, Artificial Sequence
  chemically synthesized
atttccagtgctttatcttttt

SEQ ID NO: 711785 - DNA, 22 bp, Artificial Sequence
  chemically synthesized
gatttccagtgctttatctttt

SEQ ID NO: 711786 - DNA, 22 bp, Artificial Sequence
  chemically synthesized
agatgaaaatgtttgatttcca

SEQ ID NO: 711787 - DNA, 22 bp, Artificial Sequence
  chemically synthesized
ccactgagatgaaaatgtttga

SEQ ID NO: 711788 - DNA, 22 bp, Artificial Sequence
  chemically synthesized
tgccactgagatgaaaatgttt

SEQ ID NO: 711789 - DNA, 22 bp, Artificial Sequence
  chemically synthesized
ctgccactgagatgaaaatgtt

SEQ ID NO: 711790 - DNA, 22 bp, Artificial Sequence
  chemically synthesized
gaaatcaaacattttcatctca

SEQ ID NO: 711791 - DNA, 22 bp, Artificial Sequence
  chemically synthesized
cccaaaatataaaagcttctgc

SEQ ID NO: 711792 - DNA, 22 bp, Artificial Sequence
  chemically synthesized
tcatctcagtggcagaagcttt

SEQ ID NO: 711793 - DNA, 22 bp, Artificial Sequence
  chemically synthesized
catctcagtggcagaagctttt

SEQ ID NO: 711794 - DNA, 22 bp, Artificial Sequence
  chemically synthesized
atctcagtggcagaagctttta

SEQ ID NO: 711795 - DNA, 22 bp, Artificial Sequence
  chemically synthesized
ttacccaaaatataaaagcttc

SEQ ID NO: 711796 - DNA, 22 bp, Artificial Sequence
  chemically synthesized
agtggcagaagcttttatattt

SEQ ID NO: 711797 - DNA, 22 bp, Artificial Sequence
  chemically synthesized
caagtatattgttacccaaaat

SEQ ID NO: 711798 - DNA, 22 bp, Artificial Sequence
  chemically synthesized
ttatattttgggtaacaatata

SEQ ID NO: 711799 - DNA, 22 bp, Artificial Sequence
  chemically synthesized
aaaatctacaagtatattgtta

SEQ ID NO: 711800 - DNA, 22 bp, Artificial Sequence
  chemically synthesized
tatattttgggtaacaatatac

SEQ ID NO: 711801 - DNA, 22 bp, Artificial Sequence
  chemically synthesized
atattttgggtaacaatatact

SEQ ID NO: 711802 - DNA, 22 bp, Artificial Sequence
  chemically synthesized
tattttgggtaacaatatactt

SEQ ID NO: 711803 - DNA, 22 bp, Artificial Sequence
  chemically synthesized
tgggtaacaatatacttgtaga

SEQ ID NO: 711804 - DNA, 22 bp, Artificial Sequence
  chemically synthesized
gggtaacaatatacttgtagat

SEQ ID NO: 711805 - DNA, 22 bp, Artificial Sequence
  chemically synthesized
ggtaacaatatacttgtagatt

SEQ ID NO: 711806 - DNA, 22 bp, Artificial Sequence
  chemically synthesized
gtagaacaaactgaaaatctac

SEQ ID NO: 711807 - DNA, 22 bp, Artificial Sequence
  chemically synthesized
agtagaacaaactgaaaatcta

SEQ ID NO: 711808 - DNA, 22 bp, Artificial Sequence
  chemically synthesized
gtagattttcagtttgttctac

SEQ ID NO: 711809 - DNA, 22 bp, Artificial Sequence
  chemically synthesized
aagaagtgtttagtagaacaaa

SEQ ID NO: 711810 - DNA, 22 bp, Artificial Sequence
  chemically synthesized
tagattttcagtttgttctact

SEQ ID NO: 711811 - DNA, 22 bp, Artificial Sequence
  chemically synthesized
ttaaagaagtgtttagtagaac

SEQ ID NO: 711812 - DNA, 22 bp, Artificial Sequence
  chemically synthesized
attaaagaagtgtttagtagaa

SEQ ID NO: 711813 - DNA, 22 bp, Artificial Sequence
  chemically synthesized
tattaaagaagtgtttagtaga

SEQ ID NO: 711814 - DNA, 22 bp, Artificial Sequence
  chemically synthesized
tcagtttgttctactaaacact

SEQ ID NO: 711815 - DNA, 22 bp, Artificial Sequence
  chemically synthesized
cagtttgttctactaaacactt

SEQ ID NO: 711816 - DNA, 22 bp, Artificial Sequence
  chemically synthesized
agtttgttctactaaacacttc

SEQ ID NO: 711817 - DNA, 22 bp, Artificial Sequence
  chemically synthesized
cagcctttattaaagaagtgtt

SEQ ID NO: 711818 - DNA, 22 bp, Artificial Sequence
  chemically synthesized
ccagcctttattaaagaagtgt

SEQ ID NO: 711819 - DNA, 22 bp, Artificial Sequence
  chemically synthesized
gttctactaaacacttctttaa

SEQ ID NO: 711820 - DNA, 22 bp, Artificial Sequence
  chemically synthesized
ttctactaaacacttctttaat

SEQ ID NO: 711821 - DNA, 22 bp, Artificial Sequence
  chemically synthesized
tactaaacacttctttaataaa

SEQ ID NO: 711822 - DNA, 22 bp, Artificial Sequence
  chemically synthesized
ccccttccagcctttattaaag

SEQ ID NO: 711823 - DNA, 22 bp, Artificial Sequence
  chemically synthesized
ctaaacacttctttaataaagg

SEQ ID NO: 711824 - DNA, 22 bp, Artificial Sequence
  chemically synthesized
aacacttctttaataaaggctg

SEQ ID NO: 711825 - DNA, 22 bp, Artificial Sequence
  chemically synthesized
agcaaattcccccttccagcct

SEQ ID NO: 711826 - DNA, 22 bp, Artificial Sequence
  chemically synthesized
cagcaaattcccccttccagcc

SEQ ID NO: 711827 - DNA, 22 bp, Artificial Sequence
  chemically synthesized
ctttaataaaggctggaagggg

SEQ ID NO: 711828 - DNA, 22 bp, Artificial Sequence
  chemically synthesized
tttaataaaggctggaaggggg

SEQ ID NO: 711829 - DNA, 22 bp, Artificial Sequence
  chemically synthesized
taataaaggctggaagggggaa

SEQ ID NO: 711830 - DNA, 22 bp, Artificial Sequence
  chemically synthesized
aataaaggctggaagggggaat

SEQ ID NO: 711831 - DNA, 22 bp, Artificial Sequence
  chemically synthesized
ataaaggctggaagggggaatt

SEQ ID NO: 711832 - DNA, 22 bp, Artificial Sequence
  chemically synthesized
cagacttcagcaaattccccct

SEQ ID NO: 711833 - DNA, 22 bp, Artificial Sequence
  chemically synthesized
ttgcagacttcagcaaattccc

SEQ ID NO: 711834 - DNA, 22 bp, Artificial Sequence
  chemically synthesized
gaagggggaatttgctgaagtc

SEQ ID NO: 711835 - DNA, 22 bp, Artificial Sequence
  chemically synthesized
agggttgttgcagacttcagca

SEQ ID NO: 711836 - DNA, 22 bp, Artificial Sequence
  chemically synthesized
ggttaagggttgttgcagactt

SEQ ID NO: 711837 - DNA, 22 bp, Artificial Sequence
  chemically synthesized
ctcggttaagggttgttgcaga

SEQ ID NO: 711838 - DNA, 22 bp, Artificial Sequence
  chemically synthesized
cctcggttaagggttgttgcag

SEQ ID NO: 711839 - DNA, 22 bp, Artificial Sequence
  chemically synthesized
gctgaagtctgcaacaaccctt

SEQ ID NO: 711840 - DNA, 22 bp, Artificial Sequence
  chemically synthesized
atttcctcggttaagggttgtt

SEQ ID NO: 711841 - DNA, 22 bp, Artificial Sequence
  chemically synthesized
ctgaagtctgcaacaaccctta

SEQ ID NO: 711842 - DNA, 22 bp, Artificial Sequence
  chemically synthesized
aagtctgcaacaacccttaacc

SEQ ID NO: 711843 - DNA, 22 bp, Artificial Sequence
  chemically synthesized
aggagggttgatttcctcggtt

SEQ ID NO: 711844 - DNA, 22 bp, Artificial Sequence
  chemically synthesized
caacaacccttaaccgaggaaa

SEQ ID NO: 711845 - DNA, 22 bp, Artificial Sequence
  chemically synthesized
aaggagggttgatttcctcggt

SEQ ID NO: 711846 - DNA, 22 bp, Artificial Sequence
  chemically synthesized
aaccgaggaaatcaaccctcct

SEQ ID NO: 711847 - DNA, 22 bp, Artificial Sequence
  chemically synthesized
accgaggaaatcaaccctcctt

SEQ ID NO: 711848 - DNA, 22 bp, Artificial Sequence
  chemically synthesized
caaggatggtacgggatttaag

SEQ ID NO: 711849 - DNA, 22 bp, Artificial Sequence
  chemically synthesized
gaaatgctgcaaggatggtacg

SEQ ID NO: 711850 - DNA, 22 bp, Artificial Sequence
  chemically synthesized
ggaaatgctgcaaggatggtac

SEQ ID NO: 711851 - DNA, 22 bp, Artificial Sequence
  chemically synthesized
tggaaatgctgcaaggatggta

SEQ ID NO: 711852 - DNA, 22 bp, Artificial Sequence
  chemically synthesized
cttaaatcccgtaccatccttg

SEQ ID NO: 711853 - DNA, 22 bp, Artificial Sequence
  chemically synthesized
aaatcccgtaccatccttgcag

SEQ ID NO: 711854 - DNA, 22 bp, Artificial Sequence
  chemically synthesized
aatcccgtaccatccttgcagc

SEQ ID NO: 711855 - DNA, 22 bp, Artificial Sequence
  chemically synthesized
gcagcatttccaaagcttcctg

SEQ ID NO: 711856 - DNA, 22 bp, Artificial Sequence
  chemically synthesized
cagcatttccaaagcttcctga

SEQ ID NO: 711857 - DNA, 22 bp, Artificial Sequence
  chemically synthesized
tgaagggagtcaaggtcaggaa

SEQ ID NO: 711858 - DNA, 22 bp, Artificial Sequence
  chemically synthesized
actgtgaagggagtcaaggtca

SEQ ID NO: 711859 - DNA, 22 bp, Artificial Sequence
  chemically synthesized
ccaaagcttcctgaccttgact

SEQ ID NO: 711860 - DNA, 22 bp, Artificial Sequence
  chemically synthesized
caaagcttcctgaccttgactc

SEQ ID NO: 711861 - DNA, 22 bp, Artificial Sequence
  chemically synthesized
cctgaccttgactcccttcaca

SEQ ID NO: 711862 - DNA, 22 bp, Artificial Sequence
  chemically synthesized
ctgaccttgactcccttcacag

SEQ ID NO: 711863 - DNA, 22 bp, Artificial Sequence
  chemically synthesized
accttgactcccttcacagtca

SEQ ID NO: 711864 - DNA, 22 bp, Artificial Sequence
  chemically synthesized
agtggtggtcaaattgactgtg

SEQ ID NO: 711865 - DNA, 22 bp, Artificial Sequence
  chemically synthesized
gagtggtggtcaaattgactgt

SEQ ID NO: 711866 - DNA, 22 bp, Artificial Sequence
  chemically synthesized
gactcccttcacagtcaatttg

SEQ ID NO: 711867 - DNA, 22 bp, Artificial Sequence
  chemically synthesized
actcccttcacagtcaatttga

SEQ ID NO: 711868 - DNA, 22 bp, Artificial Sequence
  chemically synthesized
cttgagtggtggtcaaattgac

SEQ ID NO: 711869 - DNA, 22 bp, Artificial Sequence
  chemically synthesized
ccttgagtggtggtcaaattga

SEQ ID NO: 711870 - DNA, 22 bp, Artificial Sequence
  chemically synthesized
ccttcacagtcaatttgaccac

SEQ ID NO: 711871 - DNA, 22 bp, Artificial Sequence
  chemically synthesized
cacagtcaatttgaccaccact

SEQ ID NO: 711872 - DNA, 22 bp, Artificial Sequence
  chemically synthesized
acagtcaatttgaccaccactc

SEQ ID NO: 711873 - DNA, 22 bp, Artificial Sequence
  chemically synthesized
gcggacaagcttccttgagtgg

SEQ ID NO: 711874 - DNA, 22 bp, Artificial Sequence
  chemically synthesized
tggcggacaagcttccttgagt

SEQ ID NO: 711875 - DNA, 22 bp, Artificial Sequence
  chemically synthesized
ctggcggacaagcttccttgag

SEQ ID NO: 711876 - DNA, 22 bp, Artificial Sequence
  chemically synthesized
gaccaccactcaaggaagcttg

SEQ ID NO: 711877 - DNA, 22 bp, Artificial Sequence
  chemically synthesized
accaccactcaaggaagcttgt

SEQ ID NO: 711878 - DNA, 22 bp, Artificial Sequence
  chemically synthesized
aaggaagcttgtccgccagaag

SEQ ID NO: 711879 - DNA, 22 bp, Artificial Sequence
  chemically synthesized
gtccgccagaagaccctgtttc

SEQ ID NO: 711880 - DNA, 22 bp, Artificial Sequence
  chemically synthesized
tccgccagaagaccctgtttcc

SEQ ID NO: 711881 - DNA, 22 bp, Artificial Sequence
  chemically synthesized
ccagaggaggagagccgggaag

SEQ ID NO: 711882 - DNA, 22 bp, Artificial Sequence
  chemically synthesized
gccagaggaggagagccgggaa

SEQ ID NO: 711883 - DNA, 22 bp, Artificial Sequence
  chemically synthesized
tttccacttcccggctctcctc

SEQ ID NO: 711884 - DNA, 22 bp, Artificial Sequence
  chemically synthesized
ccacttcccggctctcctcctc

SEQ ID NO: 711885 - DNA, 22 bp, Artificial Sequence
  chemically synthesized
agtcacttgccagaggaggaga

SEQ ID NO: 711886 - DNA, 22 bp, Artificial Sequence
  chemically synthesized
cacttcccggctctcctcctct

SEQ ID NO: 711887 - DNA, 22 bp, Artificial Sequence
  chemically synthesized
cagtcacttgccagaggaggag

SEQ ID NO: 711888 - DNA, 22 bp, Artificial Sequence
  chemically synthesized
tcagtcacttgccagaggagga

SEQ ID NO: 711889 - DNA, 22 bp, Artificial Sequence
  chemically synthesized
ttcagtcacttgccagaggagg

SEQ ID NO: 711890 - DNA, 22 bp, Artificial Sequence
  chemically synthesized
cccggctctcctcctctggcaa

SEQ ID NO: 711891 - DNA, 22 bp, Artificial Sequence
  chemically synthesized
ccggctctcctcctctggcaag

SEQ ID NO: 711892 - DNA, 22 bp, Artificial Sequence
  chemically synthesized
tcctcctctggcaagtgactga

SEQ ID NO: 711893 - DNA, 22 bp, Artificial Sequence
  chemically synthesized
ctcctctggcaagtgactgaaa

SEQ ID NO: 711894 - DNA, 22 bp, Artificial Sequence
  chemically synthesized
ctctggcaagtgactgaaaagc

SEQ ID NO: 711895 - DNA, 22 bp, Artificial Sequence
  chemically synthesized
tggcaagtgactgaaaagcgcc

SEQ ID NO: 711896 - DNA, 22 bp, Artificial Sequence
  chemically synthesized
gcaagtgactgaaaagcgcctt

SEQ ID NO: 711897 - DNA, 22 bp, Artificial Sequence
  chemically synthesized
catcagtgagagaaaagaaagg

SEQ ID NO: 711898 - DNA, 22 bp, Artificial Sequence
  chemically synthesized
tgcatcagtgagagaaaagaaa

SEQ ID NO: 711899 - DNA, 22 bp, Artificial Sequence
  chemically synthesized
aaaagcgcctttcttttctctc

SEQ ID NO: 711900 - DNA, 22 bp, Artificial Sequence
  chemically synthesized
tcagttctgcatcagtgagaga

SEQ ID NO: 711901 - DNA, 22 bp, Artificial Sequence
  chemically synthesized
gtcagttctgcatcagtgagag

SEQ ID NO: 711902 - DNA, 22 bp, Artificial Sequence
  chemically synthesized
gtttgtcagttctgcatcagtg

SEQ ID NO: 711903 - DNA, 22 bp, Artificial Sequence
  chemically synthesized
tcttttctctcactgatgcaga

SEQ ID NO: 711904 - DNA, 22 bp, Artificial Sequence
  chemically synthesized
cttttctctcactgatgcagaa

SEQ ID NO: 711905 - DNA, 22 bp, Artificial Sequence
  chemically synthesized
ttttctctcactgatgcagaac

SEQ ID NO: 711906 - DNA, 22 bp, Artificial Sequence
  chemically synthesized
ttctctcactgatgcagaactg

SEQ ID NO: 711907 - DNA, 22 bp, Artificial Sequence
  chemically synthesized
atactggtttgtcagttctgca

SEQ ID NO: 711908 - DNA, 22 bp, Artificial Sequence
  chemically synthesized
tctctcactgatgcagaactga

SEQ ID NO: 711909 - DNA, 22 bp, Artificial Sequence
  chemically synthesized
gatactggtttgtcagttctgc

SEQ ID NO: 711910 - DNA, 22 bp, Artificial Sequence
  chemically synthesized
ctctcactgatgcagaactgac

SEQ ID NO: 711911 - DNA, 22 bp, Artificial Sequence
  chemically synthesized
tctcactgatgcagaactgaca

SEQ ID NO: 711912 - DNA, 22 bp, Artificial Sequence
  chemically synthesized
tcactgatgcagaactgacaaa

SEQ ID NO: 711913 - DNA, 22 bp, Artificial Sequence
  chemically synthesized
actgatgcagaactgacaaacc

SEQ ID NO: 711914 - DNA, 22 bp, Artificial Sequence
  chemically synthesized
atgcagaactgacaaaccagta

SEQ ID NO: 711915 - DNA, 22 bp, Artificial Sequence
  chemically synthesized
taaagaacggcttgatactggt

SEQ ID NO: 711916 - DNA, 22 bp, Artificial Sequence
  chemically synthesized
gtaaagaacggcttgatactgg

SEQ ID NO: 711917 - DNA, 22 bp, Artificial Sequence
  chemically synthesized
atttgtaaagaacggcttgata

SEQ ID NO: 711918 - DNA, 22 bp, Artificial Sequence
  chemically synthesized
acaaaccagtatcaagccgttc

SEQ ID NO: 711919 - DNA, 22 bp, Artificial Sequence
  chemically synthesized
ttgatttgtaaagaacggcttg

SEQ ID NO: 711920 - DNA, 22 bp, Artificial Sequence
  chemically synthesized
attgatttgtaaagaacggctt

SEQ ID NO: 711921 - DNA, 22 bp, Artificial Sequence
  chemically synthesized
cggtttattgatttgtaaagaa

SEQ ID NO: 711922 - DNA, 22 bp, Artificial Sequence
  chemically synthesized
ccggtttattgatttgtaaaga

SEQ ID NO: 711923 - DNA, 22 bp, Artificial Sequence
  chemically synthesized
tttacaaatcaataaaccggaa

SEQ ID NO: 711924 - DNA, 22 bp, Artificial Sequence
  chemically synthesized
tacaaatcaataaaccggaaga

SEQ ID NO: 711925 - DNA, 22 bp, Artificial Sequence
  chemically synthesized
acaaatcaataaaccggaagat

SEQ ID NO: 711926 - DNA, 22 bp, Artificial Sequence
  chemically synthesized
caaatcaataaaccggaagatc

SEQ ID NO: 711927 - DNA, 22 bp, Artificial Sequence
  chemically synthesized
gaagtacagtagatgagatctt

SEQ ID NO: 711928 - DNA, 22 bp, Artificial Sequence
  chemically synthesized
ggaagtacagtagatgagatct

SEQ ID NO: 711929 - DNA, 22 bp, Artificial Sequence
  chemically synthesized
taggatttggaagtacagtaga

SEQ ID NO: 711930 - DNA, 22 bp, Artificial Sequence
  chemically synthesized
atctactgtacttccaaatcct

SEQ ID NO: 711931 - DNA, 22 bp, Artificial Sequence
  chemically synthesized
ctgtacttccaaatcctacaac

SEQ ID NO: 711932 - DNA, 22 bp, Artificial Sequence
  chemically synthesized
tacttccaaatcctacaacatt

SEQ ID NO: 711933 - DNA, 22 bp, Artificial Sequence
  chemically synthesized
ccaaatcctacaacattctgtc

SEQ ID NO: 711934 - DNA, 22 bp, Artificial Sequence
  chemically synthesized
caaatcctacaacattctgtct

SEQ ID NO: 711935 - DNA, 22 bp, Artificial Sequence
  chemically synthesized
tgatatgcgaagaagagagaag

SEQ ID NO: 711936 - DNA, 22 bp, Artificial Sequence
  chemically synthesized
caacattctgtcttctctcttc

SEQ ID NO: 711937 - DNA, 22 bp, Artificial Sequence
  chemically synthesized
atgatatgcgaagaagagagaa

SEQ ID NO: 711938 - DNA, 22 bp, Artificial Sequence
  chemically synthesized
tggcttatgatatgcgaagaag

SEQ ID NO: 711939 - DNA, 22 bp, Artificial Sequence
  chemically synthesized
gtggcttatgatatgcgaagaa

SEQ ID NO: 711940 - DNA, 22 bp, Artificial Sequence
  chemically synthesized
tgtcttctctcttcttcgcata

SEQ ID NO: 711941 - DNA, 22 bp, Artificial Sequence
  chemically synthesized
tcttctctcttcttcgcatatc

SEQ ID NO: 711942 - DNA, 22 bp, Artificial Sequence
  chemically synthesized
ctctcttcttcgcatatcataa

SEQ ID NO: 711943 - DNA, 22 bp, Artificial Sequence
  chemically synthesized
tctcttcttcgcatatcataag

SEQ ID NO: 711944 - DNA, 22 bp, Artificial Sequence
  chemically synthesized
tcttcttcgcatatcataagcc

SEQ ID NO: 711945 - DNA, 22 bp, Artificial Sequence
  chemically synthesized
ttcttcgcatatcataagccac

SEQ ID NO: 711946 - DNA, 22 bp, Artificial Sequence
  chemically synthesized
cttcgcatatcataagccacaa

SEQ ID NO: 711947 - DNA, 22 bp, Artificial Sequence
  chemically synthesized
ttcgcatatcataagccacaag

SEQ ID NO: 711948 - DNA, 22 bp, Artificial Sequence
  chemically synthesized
cgcatatcataagccacaagtt

SEQ ID NO: 711949 - DNA, 22 bp, Artificial Sequence
  chemically synthesized
gcatatcataagccacaagtta

SEQ ID NO: 711950 - DNA, 22 bp, Artificial Sequence
  chemically synthesized
agaagcgtgaagtaaataactt

SEQ ID NO: 711951 - DNA, 22 bp, Artificial Sequence
  chemically synthesized
ctaagaagcgtgaagtaaataa

SEQ ID NO: 711952 - DNA, 22 bp, Artificial Sequence
  chemically synthesized
actaagaagcgtgaagtaaata

SEQ ID NO: 711953 - DNA, 22 bp, Artificial Sequence
  chemically synthesized
tactaagaagcgtgaagtaaat

SEQ ID NO: 711954 - DNA, 22 bp, Artificial Sequence
  chemically synthesized
tcctttactaagaagcgtgaag

SEQ ID NO: 711955 - DNA, 22 bp, Artificial Sequence
  chemically synthesized
tttacttcacgcttcttagtaa

SEQ ID NO: 711956 - DNA, 22 bp, Artificial Sequence
  chemically synthesized
catcccctgtcctttactaaga

SEQ ID NO: 711957 - DNA, 22 bp, Artificial Sequence
  chemically synthesized
acttcacgcttcttagtaaagg

SEQ ID NO: 711958 - DNA, 22 bp, Artificial Sequence
  chemically synthesized
cttcacgcttcttagtaaagga

SEQ ID NO: 711959 - DNA, 22 bp, Artificial Sequence
  chemically synthesized
ctccatcccctgtcctttacta

SEQ ID NO: 711960 - DNA, 22 bp, Artificial Sequence
  chemically synthesized
cacgcttcttagtaaaggacag

SEQ ID NO: 711961 - DNA, 22 bp, Artificial Sequence
  chemically synthesized
acgcttcttagtaaaggacagg

SEQ ID NO: 711962 - DNA, 22 bp, Artificial Sequence
  chemically synthesized
cttagtaaaggacaggggatgg

SEQ ID NO: 711963 - DNA, 22 bp, Artificial Sequence
  chemically synthesized
ttagtaaaggacaggggatgga

SEQ ID NO: 711964 - DNA, 22 bp, Artificial Sequence
  chemically synthesized
agtaaaggacaggggatggagc

SEQ ID NO: 711965 - DNA, 22 bp, Artificial Sequence
  chemically synthesized
gtaaaggacaggggatggagca

SEQ ID NO: 711966 - DNA, 22 bp, Artificial Sequence
  chemically synthesized
cacagagaaacaatggaagcac

SEQ ID NO: 711967 - DNA, 22 bp, Artificial Sequence
  chemically synthesized
acacatctacacagagaaacaa

SEQ ID NO: 711968 - DNA, 22 bp, Artificial Sequence
  chemically synthesized
tcacacatctacacagagaaac

SEQ ID NO: 711969 - DNA, 22 bp, Artificial Sequence
  chemically synthesized
gttctcacacatctacacagag

SEQ ID NO: 711970 - DNA, 22 bp, Artificial Sequence
  chemically synthesized
tggttctcacacatctacacag

SEQ ID NO: 711971 - DNA, 22 bp, Artificial Sequence
  chemically synthesized
ccattgtttctctgtgtagatg

SEQ ID NO: 711972 - DNA, 22 bp, Artificial Sequence
  chemically synthesized
cattgtttctctgtgtagatgt

SEQ ID NO: 711973 - DNA, 22 bp, Artificial Sequence
  chemically synthesized
attctggttctcacacatctac

SEQ ID NO: 711974 - DNA, 22 bp, Artificial Sequence
  chemically synthesized
aattctggttctcacacatcta

SEQ ID NO: 711975 - DNA, 22 bp, Artificial Sequence
  chemically synthesized
taattctggttctcacacatct

SEQ ID NO: 711976 - DNA, 22 bp, Artificial Sequence
  chemically synthesized
tttctctgtgtagatgtgtgag

SEQ ID NO: 711977 - DNA, 22 bp, Artificial Sequence
  chemically synthesized
ctctgtgtagatgtgtgagaac

SEQ ID NO: 711978 - DNA, 22 bp, Artificial Sequence
  chemically synthesized
tctgtgtagatgtgtgagaacc

SEQ ID NO: 711979 - DNA, 22 bp, Artificial Sequence
  chemically synthesized
tgtgtagatgtgtgagaaccag

SEQ ID NO: 711980 - DNA, 22 bp, Artificial Sequence
  chemically synthesized
tgtagatgtgtgagaaccagaa

SEQ ID NO: 711981 - DNA, 22 bp, Artificial Sequence
  chemically synthesized
tgagtccatggcagagttttaa

SEQ ID NO: 711982 - DNA, 22 bp, Artificial Sequence
  chemically synthesized
aaactctgccatggactcacag

SEQ ID NO: 711983 - DNA, 22 bp, Artificial Sequence
  chemically synthesized
tgccatggactcacagtctcta

SEQ ID NO: 711984 - DNA, 22 bp, Artificial Sequence
  chemically synthesized
ccatggactcacagtctctacg

SEQ ID NO: 711985 - DNA, 22 bp, Artificial Sequence
  chemically synthesized
acagtctctacggtctctctcc

SEQ ID NO: 711986 - DNA, 22 bp, Artificial Sequence
  chemically synthesized
tacggtctctctccctctgtct

SEQ ID NO: 711987 - DNA, 22 bp, Artificial Sequence
  chemically synthesized
cggtctctctccctctgtcttc

SEQ ID NO: 711988 - DNA, 22 bp, Artificial Sequence
  chemically synthesized
ggtcagaagtgtgcaaagaaga

SEQ ID NO: 711989 - DNA, 22 bp, Artificial Sequence
  chemically synthesized
tctccctctgtcttctttgcac

SEQ ID NO: 711990 - DNA, 22 bp, Artificial Sequence
  chemically synthesized
tccctctgtcttctttgcacac

SEQ ID NO: 711991 - DNA, 22 bp, Artificial Sequence
  chemically synthesized
cctctgtcttctttgcacactt

SEQ ID NO: 711992 - DNA, 22 bp, Artificial Sequence
  chemically synthesized
tgtcttctttgcacacttctga

SEQ ID NO: 711993 - DNA, 22 bp, Artificial Sequence
  chemically synthesized
tcttctttgcacacttctgacc

SEQ ID NO: 711994 - DNA, 22 bp, Artificial Sequence
  chemically synthesized
ctttgcacacttctgacctagc

SEQ ID NO: 711995 - DNA, 22 bp, Artificial Sequence
  chemically synthesized
tttgcacacttctgacctagcc

SEQ ID NO: 711996 - DNA, 22 bp, Artificial Sequence
  chemically synthesized
tgcacacttctgacctagccct

SEQ ID NO: 711997 - DNA, 22 bp, Artificial Sequence
  chemically synthesized
gcacacttctgacctagccctc

SEQ ID NO: 711998 - DNA, 22 bp, Artificial Sequence
  chemically synthesized
cacacttctgacctagccctcc

SEQ ID NO: 711999 - DNA, 22 bp, Artificial Sequence
  chemically synthesized
ctgacctagccctcctcttctc

SEQ ID NO: 712000 - DNA, 22 bp, Artificial Sequence
  chemically synthesized
tgacctagccctcctcttctct

SEQ ID NO: 712001 - DNA, 22 bp, Artificial Sequence
  chemically synthesized
acctagccctcctcttctctcc

SEQ ID NO: 712002 - DNA, 22 bp, Artificial Sequence
  chemically synthesized
gccctcctcttctctccccctg

SEQ ID NO: 712003 - DNA, 22 bp, Artificial Sequence
  chemically synthesized
ctcttctctccccctgcctccc

SEQ ID NO: 712004 - DNA, 22 bp, Artificial Sequence
  chemically synthesized
ttctctccccctgcctccctct

SEQ ID NO: 712005 - DNA, 22 bp, Artificial Sequence
  chemically synthesized
ctctccccctgcctccctcttc

SEQ ID NO: 712006 - DNA, 22 bp, Artificial Sequence
  chemically synthesized
tctccccctgcctccctcttcc

SEQ ID NO: 712007 - DNA, 22 bp, Artificial Sequence
  chemically synthesized
tccccctgcctccctcttccct

SEQ ID NO: 712008 - DNA, 22 bp, Artificial Sequence
  chemically synthesized
cccctgcctccctcttccctca

SEQ ID NO: 712009 - DNA, 22 bp, Artificial Sequence
  chemically synthesized
cctccctcttccctcattcccc

SEQ ID NO: 712010 - DNA, 22 bp, Artificial Sequence
  chemically synthesized
ggggtggggtgagggggaatga

SEQ ID NO: 712011 - DNA, 22 bp, Artificial Sequence
  chemically synthesized
gggggtggggtgagggggaatg

SEQ ID NO: 712012 - DNA, 22 bp, Artificial Sequence
  chemically synthesized
cctcttccctcattccccctca

SEQ ID NO: 712013 - DNA, 22 bp, Artificial Sequence
  chemically synthesized
ttccctcattccccctcacccc

SEQ ID NO: 712014 - DNA, 22 bp, Artificial Sequence
  chemically synthesized
ccctcattccccctcaccccac

SEQ ID NO: 712015 - DNA, 22 bp, Artificial Sequence
  chemically synthesized
cctcattccccctcaccccacc

SEQ ID NO: 712016 - DNA, 22 bp, Artificial Sequence
  chemically synthesized
caaacagccttgggggtggggt

SEQ ID NO: 712017 - DNA, 22 bp, Artificial Sequence
  chemically synthesized
acaaacagccttgggggtgggg

SEQ ID NO: 712018 - DNA, 22 bp, Artificial Sequence
  chemically synthesized
attccccctcaccccaccccca

SEQ ID NO: 712019 - DNA, 22 bp, Artificial Sequence
  chemically synthesized
cccctcaccccacccccaaggc

SEQ ID NO: 712020 - DNA, 22 bp, Artificial Sequence
  chemically synthesized
gggagcttacaaacagccttgg

SEQ ID NO: 712021 - DNA, 22 bp, Artificial Sequence
  chemically synthesized
ggggagcttacaaacagccttg

SEQ ID NO: 712022 - DNA, 22 bp, Artificial Sequence
  chemically synthesized
accccacccccaaggctgtttg

SEQ ID NO: 712023 - DNA, 22 bp, Artificial Sequence
  chemically synthesized
tgagcatttggggagcttacaa

SEQ ID NO: 712024 - DNA, 22 bp, Artificial Sequence
  chemically synthesized
atgagcatttggggagcttaca

SEQ ID NO: 712025 - DNA, 22 bp, Artificial Sequence
  chemically synthesized
tttgtaagctccccaaatgctc

SEQ ID NO: 712026 - DNA, 22 bp, Artificial Sequence
  chemically synthesized
aggaaagtcttatgagcatttg

SEQ ID NO: 712027 - DNA, 22 bp, Artificial Sequence
  chemically synthesized
gtaagctccccaaatgctcata

SEQ ID NO: 712028 - DNA, 22 bp, Artificial Sequence
  chemically synthesized
taagctccccaaatgctcataa

SEQ ID NO: 712029 - DNA, 22 bp, Artificial Sequence
  chemically synthesized
aaatagttcaggaaagtcttat

SEQ ID NO: 712030 - DNA, 22 bp, Artificial Sequence
  chemically synthesized
cccaaatgctcataagactttc

SEQ ID NO: 712031 - DNA, 22 bp, Artificial Sequence
  chemically synthesized
ataagactttcctgaactattt

SEQ ID NO: 712032 - DNA, 22 bp, Artificial Sequence
  chemically synthesized
aagtgaaaatatctgaaatagt

SEQ ID NO: 712033 - DNA, 22 bp, Artificial Sequence
  chemically synthesized
tcctgaactatttcagatattt

SEQ ID NO: 712034 - DNA, 22 bp, Artificial Sequence
  chemically synthesized
gagttgaagtgaaaatatctga

SEQ ID NO: 712035 - DNA, 22 bp, Artificial Sequence
  chemically synthesized
cctgaactatttcagatatttt

SEQ ID NO: 712036 - DNA, 22 bp, Artificial Sequence
  chemically synthesized
agagttgaagtgaaaatatctg

SEQ ID NO: 712037 - DNA, 22 bp, Artificial Sequence
  chemically synthesized
ctgaactatttcagatattttc

SEQ ID NO: 712038 - DNA, 22 bp, Artificial Sequence
  chemically synthesized
aactatttcagatattttcact

SEQ ID NO: 712039 - DNA, 22 bp, Artificial Sequence
  chemically synthesized
gtttagagttgaagtgaaaata

SEQ ID NO: 712040 - DNA, 22 bp, Artificial Sequence
  chemically synthesized
agtttagagttgaagtgaaaat

SEQ ID NO: 712041 - DNA, 22 bp, Artificial Sequence
  chemically synthesized
tagtttagagttgaagtgaaaa

SEQ ID NO: 712042 - DNA, 22 bp, Artificial Sequence
  chemically synthesized
tttcagatattttcacttcaac

SEQ ID NO: 712043 - DNA, 22 bp, Artificial Sequence
  chemically synthesized
cagatattttcacttcaactct

SEQ ID NO: 712044 - DNA, 22 bp, Artificial Sequence
  chemically synthesized
agatattttcacttcaactcta

SEQ ID NO: 712045 - DNA, 22 bp, Artificial Sequence
  chemically synthesized
tcacttcaactctaaactaaaa

SEQ ID NO: 712046 - DNA, 22 bp, Artificial Sequence
  chemically synthesized
cacttcaactctaaactaaaac

SEQ ID NO: 712047 - DNA, 22 bp, Artificial Sequence
  chemically synthesized
acttcaactctaaactaaaact

SEQ ID NO: 712048 - DNA, 22 bp, Artificial Sequence
  chemically synthesized
gaaaaacaaaatagttttagtt

SEQ ID NO: 712049 - DNA, 22 bp, Artificial Sequence
  chemically synthesized
ggaaaaacaaaatagttttagt

SEQ ID NO: 712050 - DNA, 22 bp, Artificial Sequence
  chemically synthesized
caactctaaactaaaactattt

SEQ ID NO: 712051 - DNA, 22 bp, Artificial Sequence
  chemically synthesized
aactctaaactaaaactatttt

SEQ ID NO: 712052 - DNA, 22 bp, Artificial Sequence
  chemically synthesized
taaactaaaactattttgtttt

SEQ ID NO: 712053 - DNA, 22 bp, Artificial Sequence
  chemically synthesized
aactaaaactattttgtttttc

SEQ ID NO: 712054 - DNA, 22 bp, Artificial Sequence
  chemically synthesized
tgtaaagccacatttggaaaaa

SEQ ID NO: 712055 - DNA, 22 bp, Artificial Sequence
  chemically synthesized
aaactattttgtttttccaaat

SEQ ID NO: 712056 - DNA, 22 bp, Artificial Sequence
  chemically synthesized
cactatgtaaagccacatttgg

SEQ ID NO: 712057 - DNA, 22 bp, Artificial Sequence
  chemically synthesized
ttttgtttttccaaatgtggct

SEQ ID NO: 712058 - DNA, 22 bp, Artificial Sequence
  chemically synthesized
tgcactatgtaaagccacattt

SEQ ID NO: 712059 - DNA, 22 bp, Artificial Sequence
  chemically synthesized
ctgcactatgtaaagccacatt

SEQ ID NO: 712060 - DNA, 22 bp, Artificial Sequence
  chemically synthesized
tctgcactatgtaaagccacat

SEQ ID NO: 712061 - DNA, 22 bp, Artificial Sequence
  chemically synthesized
tgtttttccaaatgtggcttta

SEQ ID NO: 712062 - DNA, 22 bp, Artificial Sequence
  chemically synthesized
gtttttccaaatgtggctttac

SEQ ID NO: 712063 - DNA, 22 bp, Artificial Sequence
  chemically synthesized
tttttccaaatgtggctttaca

SEQ ID NO: 712064 - DNA, 22 bp, Artificial Sequence
  chemically synthesized
ttccaaatgtggctttacatag

SEQ ID NO: 712065 - DNA, 22 bp, Artificial Sequence
  chemically synthesized
tagttttctgcactatgtaaag

SEQ ID NO: 712066 - DNA, 22 bp, Artificial Sequence
  chemically synthesized
tccaaatgtggctttacatagt

SEQ ID NO: 712067 - DNA, 22 bp, Artificial Sequence
  chemically synthesized
ccaaatgtggctttacatagtg

SEQ ID NO: 712068 - DNA, 22 bp, Artificial Sequence
  chemically synthesized
caaatgtggctttacatagtgc

SEQ ID NO: 712069 - DNA, 22 bp, Artificial Sequence
  chemically synthesized
cctgtagttttctgcactatgt

SEQ ID NO: 712070 - DNA, 22 bp, Artificial Sequence
  chemically synthesized
ccctgtagttttctgcactatg

SEQ ID NO: 712071 - DNA, 22 bp, Artificial Sequence
  chemically synthesized
tccctgtagttttctgcactat

SEQ ID NO: 712072 - DNA, 22 bp, Artificial Sequence
  chemically synthesized
gatgttttccctgtagttttct

SEQ ID NO: 712073 - DNA, 22 bp, Artificial Sequence
  chemically synthesized
ggatgttttccctgtagttttc

SEQ ID NO: 712074 - DNA, 22 bp, Artificial Sequence
  chemically synthesized
tacatagtgcagaaaactacag

SEQ ID NO: 712075 - DNA, 22 bp, Artificial Sequence
  chemically synthesized
tggatgttttccctgtagtttt

SEQ ID NO: 712076 - DNA, 22 bp, Artificial Sequence
  chemically synthesized
acatagtgcagaaaactacagg

SEQ ID NO: 712077 - DNA, 22 bp, Artificial Sequence
  chemically synthesized
catagtgcagaaaactacaggg

SEQ ID NO: 712078 - DNA, 22 bp, Artificial Sequence
  chemically synthesized
tactttggatgttttccctgta

SEQ ID NO: 712079 - DNA, 22 bp, Artificial Sequence
  chemically synthesized
cagggaaaacatccaaagtaca

SEQ ID NO: 712080 - DNA, 22 bp, Artificial Sequence
  chemically synthesized
taaaagatcacattgtactttg

SEQ ID NO: 712081 - DNA, 22 bp, Artificial Sequence
  chemically synthesized
ctataaaagatcacattgtact

SEQ ID NO: 712082 - DNA, 22 bp, Artificial Sequence
  chemically synthesized
tcctataaaagatcacattgta

SEQ ID NO: 712083 - DNA, 22 bp, Artificial Sequence
  chemically synthesized
ctcctataaaagatcacattgt

SEQ ID NO: 712084 - DNA, 22 bp, Artificial Sequence
  chemically synthesized
tttctcctataaaagatcacat

SEQ ID NO: 712085 - DNA, 22 bp, Artificial Sequence
  chemically synthesized
gtttctcctataaaagatcaca

SEQ ID NO: 712086 - DNA, 22 bp, Artificial Sequence
  chemically synthesized
tgtttctcctataaaagatcac

SEQ ID NO: 712087 - DNA, 22 bp, Artificial Sequence
  chemically synthesized
ttgtttctcctataaaagatca

SEQ ID NO: 712088 - DNA, 22 bp, Artificial Sequence
  chemically synthesized
aatcttttgtttctcctataaa

SEQ ID NO: 712089 - DNA, 22 bp, Artificial Sequence
  chemically synthesized
gaaattcaatcttttgtttctc

SEQ ID NO: 712090 - DNA, 22 bp, Artificial Sequence
  chemically synthesized
ttataggagaaacaaaagattg

SEQ ID NO: 712091 - DNA, 22 bp, Artificial Sequence
  chemically synthesized
tataggagaaacaaaagattga

SEQ ID NO: 712092 - DNA, 22 bp, Artificial Sequence
  chemically synthesized
ataggagaaacaaaagattgaa

SEQ ID NO: 712093 - DNA, 22 bp, Artificial Sequence
  chemically synthesized
taggagaaacaaaagattgaat

SEQ ID NO: 712094 - DNA, 22 bp, Artificial Sequence
  chemically synthesized
catgatgacctagaaattcaat

SEQ ID NO: 712095 - DNA, 22 bp, Artificial Sequence
  chemically synthesized
ccatgatgacctagaaattcaa

SEQ ID NO: 712096 - DNA, 22 bp, Artificial Sequence
  chemically synthesized
cttccatgatgacctagaaatt

SEQ ID NO: 712097 - DNA, 22 bp, Artificial Sequence
  chemically synthesized
aatttctaggtcatcatggaag

SEQ ID NO: 712098 - DNA, 22 bp, Artificial Sequence
  chemically synthesized
ctaggtcatcatggaagtaggt

SEQ ID NO: 712099 - DNA, 22 bp, Artificial Sequence
  chemically synthesized
taggtcatcatggaagtaggta

SEQ ID NO: 712100 - DNA, 22 bp, Artificial Sequence
  chemically synthesized
ggtcatcatggaagtaggtaca

SEQ ID NO: 712101 - DNA, 22 bp, Artificial Sequence
  chemically synthesized
tcgcccagggaagtgtacctac

SEQ ID NO: 712102 - DNA, 22 bp, Artificial Sequence
  chemically synthesized
agattatcgcccagggaagtgt

SEQ ID NO: 712103 - DNA, 22 bp, Artificial Sequence
  chemically synthesized
taaagtacctcagattatcgcc

SEQ ID NO: 712104 - DNA, 22 bp, Artificial Sequence
  chemically synthesized
ataaagtacctcagattatcgc

SEQ ID NO: 712105 - DNA, 22 bp, Artificial Sequence
  chemically synthesized
ccctgggcgataatctgaggta

SEQ ID NO: 712106 - DNA, 22 bp, Artificial Sequence
  chemically synthesized
cctgggcgataatctgaggtac

SEQ ID NO: 712107 - DNA, 22 bp, Artificial Sequence
  chemically synthesized
ggcgataatctgaggtacttta

SEQ ID NO: 712108 - DNA, 22 bp, Artificial Sequence
  chemically synthesized
gtgaaagaaagaagcttataaa

SEQ ID NO: 712109 - DNA, 22 bp, Artificial Sequence
  chemically synthesized
cgtgaaagaaagaagcttataa

SEQ ID NO: 712110 - DNA, 22 bp, Artificial Sequence
  chemically synthesized
tcgtgaaagaaagaagcttata

SEQ ID NO: 712111 - DNA, 22 bp, Artificial Sequence
  chemically synthesized
ctttcgtgaaagaaagaagctt

SEQ ID NO: 712112 - DNA, 22 bp, Artificial Sequence
  chemically synthesized
aggtactttataagcttctttc

SEQ ID NO: 712113 - DNA, 22 bp, Artificial Sequence
  chemically synthesized
gctttcgtgaaagaaagaagct

SEQ ID NO: 712114 - DNA, 22 bp, Artificial Sequence
  chemically synthesized
ttgctttcgtgaaagaaagaag

SEQ ID NO: 712115 - DNA, 22 bp, Artificial Sequence
  chemically synthesized
cttgctttcgtgaaagaaagaa

SEQ ID NO: 712116 - DNA, 22 bp, Artificial Sequence
  chemically synthesized
tataagcttctttctttcacga

SEQ ID NO: 712117 - DNA, 22 bp, Artificial Sequence
  chemically synthesized
ataagcttctttctttcacgaa

SEQ ID NO: 712118 - DNA, 22 bp, Artificial Sequence
  chemically synthesized
ggatttcttgctttcgtgaaag

SEQ ID NO: 712119 - DNA, 22 bp, Artificial Sequence
  chemically synthesized
taagcttctttctttcacgaaa

SEQ ID NO: 712120 - DNA, 22 bp, Artificial Sequence
  chemically synthesized
aggatttcttgctttcgtgaaa

SEQ ID NO: 712121 - DNA, 22 bp, Artificial Sequence
  chemically synthesized
taggatttcttgctttcgtgaa

SEQ ID NO: 712122 - DNA, 22 bp, Artificial Sequence
  chemically synthesized
ctttctttcacgaaagcaagaa

SEQ ID NO: 712123 - DNA, 22 bp, Artificial Sequence
  chemically synthesized
tttctttcacgaaagcaagaaa

SEQ ID NO: 712124 - DNA, 22 bp, Artificial Sequence
  chemically synthesized
atggattttaggatttcttgct

SEQ ID NO: 712125 - DNA, 22 bp, Artificial Sequence
  chemically synthesized
tctttcacgaaagcaagaaatc

SEQ ID NO: 712126 - DNA, 22 bp, Artificial Sequence
  chemically synthesized
gatggattttaggatttcttgc

SEQ ID NO: 712127 - DNA, 22 bp, Artificial Sequence
  chemically synthesized
ctttcacgaaagcaagaaatcc

SEQ ID NO: 712128 - DNA, 22 bp, Artificial Sequence
  chemically synthesized
tttcacgaaagcaagaaatcct

SEQ ID NO: 712129 - DNA, 22 bp, Artificial Sequence
  chemically synthesized
tcacgaaagcaagaaatcctaa

SEQ ID NO: 712130 - DNA, 22 bp, Artificial Sequence
  chemically synthesized
cacgaaagcaagaaatcctaaa

SEQ ID NO: 712131 - DNA, 22 bp, Artificial Sequence
  chemically synthesized
acgaaagcaagaaatcctaaaa

SEQ ID NO: 712132 - DNA, 22 bp, Artificial Sequence
  chemically synthesized
aggcacagtgcacgtatcttga

SEQ ID NO: 712133 - DNA, 22 bp, Artificial Sequence
  chemically synthesized
aaatccatcaagatacgtgcac

SEQ ID NO: 712134 - DNA, 22 bp, Artificial Sequence
  chemically synthesized
aaaagagagttgaggcacagtg

SEQ ID NO: 712135 - DNA, 22 bp, Artificial Sequence
  chemically synthesized
aggattaaaaagagagttgagg

SEQ ID NO: 712136 - DNA, 22 bp, Artificial Sequence
  chemically synthesized
gaggattaaaaagagagttgag

SEQ ID NO: 712137 - DNA, 22 bp, Artificial Sequence
  chemically synthesized
acttgaggattaaaaagagagt

SEQ ID NO: 712138 - DNA, 22 bp, Artificial Sequence
  chemically synthesized
cacttgaggattaaaaagagag

SEQ ID NO: 712139 - DNA, 22 bp, Artificial Sequence
  chemically synthesized
tgcctcaactctctttttaatc

SEQ ID NO: 712140 - DNA, 22 bp, Artificial Sequence
  chemically synthesized
atttcacttgaggattaaaaag

SEQ ID NO: 712141 - DNA, 22 bp, Artificial Sequence
  chemically synthesized
tgttgatttcacttgaggatta

SEQ ID NO: 712142 - DNA, 22 bp, Artificial Sequence
  chemically synthesized
aactctctttttaatcctcaag

SEQ ID NO: 712143 - DNA, 22 bp, Artificial Sequence
  chemically synthesized
tactgtgttgatttcacttgag

SEQ ID NO: 712144 - DNA, 22 bp, Artificial Sequence
  chemically synthesized
tctttttaatcctcaagtgaaa

SEQ ID NO: 712145 - DNA, 22 bp, Artificial Sequence
  chemically synthesized
tttttaatcctcaagtgaaatc

SEQ ID NO: 712146 - DNA, 22 bp, Artificial Sequence
  chemically synthesized
tttaatcctcaagtgaaatcaa

SEQ ID NO: 712147 - DNA, 22 bp, Artificial Sequence
  chemically synthesized
cactgtactgtgttgatttcac

SEQ ID NO: 712148 - DNA, 22 bp, Artificial Sequence
  chemically synthesized
ttaatcctcaagtgaaatcaac

SEQ ID NO: 712149 - DNA, 22 bp, Artificial Sequence
  chemically synthesized
taatcctcaagtgaaatcaaca

SEQ ID NO: 712150 - DNA, 22 bp, Artificial Sequence
  chemically synthesized
aatcctcaagtgaaatcaacac

SEQ ID NO: 712151 - DNA, 22 bp, Artificial Sequence
  chemically synthesized
ttacactgtactgtgttgattt

SEQ ID NO: 712152 - DNA, 22 bp, Artificial Sequence
  chemically synthesized
atcctcaagtgaaatcaacaca

SEQ ID NO: 712153 - DNA, 22 bp, Artificial Sequence
  chemically synthesized
attacactgtactgtgttgatt

SEQ ID NO: 712154 - DNA, 22 bp, Artificial Sequence
  chemically synthesized
tattacactgtactgtgttgat

SEQ ID NO: 712155 - DNA, 22 bp, Artificial Sequence
  chemically synthesized
ttattacactgtactgtgttga

SEQ ID NO: 712156 - DNA, 22 bp, Artificial Sequence
  chemically synthesized
aagtgaaatcaacacagtacag

SEQ ID NO: 712157 - DNA, 22 bp, Artificial Sequence
  chemically synthesized
tatgcatttttattacactgta

SEQ ID NO: 712158 - DNA, 22 bp, Artificial Sequence
  chemically synthesized
gggctatatgcatttttattac

SEQ ID NO: 712159 - DNA, 22 bp, Artificial Sequence
  chemically synthesized
aggcacaaagcctggggctata

SEQ ID NO: 712160 - DNA, 22 bp, Artificial Sequence
  chemically synthesized
ctaaggcacaaagcctggggct

SEQ ID NO: 712161 - DNA, 22 bp, Artificial Sequence
  chemically synthesized
gctaaggcacaaagcctggggc

SEQ ID NO: 712162 - DNA, 22 bp, Artificial Sequence
  chemically synthesized
tgctaaggcacaaagcctgggg

SEQ ID NO: 712163 - DNA, 22 bp, Artificial Sequence
  chemically synthesized
tttgctaaggcacaaagcctgg

SEQ ID NO: 712164 - DNA, 22 bp, Artificial Sequence
  chemically synthesized
tctttgctaaggcacaaagcct

SEQ ID NO: 712165 - DNA, 22 bp, Artificial Sequence
  chemically synthesized
tctctttgctaaggcacaaagc

SEQ ID NO: 712166 - DNA, 22 bp, Artificial Sequence
  chemically synthesized
ctctctttgctaaggcacaaag

SEQ ID NO: 712167 - DNA, 22 bp, Artificial Sequence
  chemically synthesized
tctctctttgctaaggcacaaa

SEQ ID NO: 712168 - DNA, 22 bp, Artificial Sequence
  chemically synthesized
ttctctctttgctaaggcacaa

SEQ ID NO: 712169 - DNA, 22 bp, Artificial Sequence
  chemically synthesized
tttctctctttgctaaggcaca

SEQ ID NO: 712170 - DNA, 22 bp, Artificial Sequence
  chemically synthesized
ttttttctctctttgctaaggc

SEQ ID NO: 712171 - DNA, 22 bp, Artificial Sequence
  chemically synthesized
attttttctctctttgctaagg

SEQ ID NO: 712172 - DNA, 22 bp, Artificial Sequence
  chemically synthesized
tgtgccttagcaaagagagaaa

SEQ ID NO: 712173 - DNA, 22 bp, Artificial Sequence
  chemically synthesized
gtgccttagcaaagagagaaaa

SEQ ID NO: 712174 - DNA, 22 bp, Artificial Sequence
  chemically synthesized
tgccttagcaaagagagaaaaa

SEQ ID NO: 712175 - DNA, 22 bp, Artificial Sequence
  chemically synthesized
agcaaagagagaaaaaataagc

SEQ ID NO: 712176 - DNA, 22 bp, Artificial Sequence
  chemically synthesized
gcaaagagagaaaaaataagct

SEQ ID NO: 712177 - DNA, 22 bp, Artificial Sequence
  chemically synthesized
acagtagacatatgaagtcagg

SEQ ID NO: 712178 - DNA, 22 bp, Artificial Sequence
  chemically synthesized
ttcacagtagacatatgaagtc

SEQ ID NO: 712179 - DNA, 22 bp, Artificial Sequence
  chemically synthesized
attattcacagtagacatatga

SEQ ID NO: 712180 - DNA, 22 bp, Artificial Sequence
  chemically synthesized
cctgacttcatatgtctactgt

SEQ ID NO: 712181 - DNA, 22 bp, Artificial Sequence
  chemically synthesized
ctgacttcatatgtctactgtg

SEQ ID NO: 712182 - DNA, 22 bp, Artificial Sequence
  chemically synthesized
acttcatatgtctactgtgaat

SEQ ID NO: 712183 - DNA, 22 bp, Artificial Sequence
  chemically synthesized
catatgtctactgtgaataatc

SEQ ID NO: 712184 - DNA, 22 bp, Artificial Sequence
  chemically synthesized
atatgtctactgtgaataatca

SEQ ID NO: 712185 - DNA, 22 bp, Artificial Sequence
  chemically synthesized
ctgtgaataatcagtcactgcg

SEQ ID NO: 712186 - DNA, 22 bp, Artificial Sequence
  chemically synthesized
tgaataatcagtcactgcgttt

SEQ ID NO: 712187 - DNA, 22 bp, Artificial Sequence
  chemically synthesized
taaagcaaaatcccaaaaacgc

SEQ ID NO: 712188 - DNA, 22 bp, Artificial Sequence
  chemically synthesized
agattataaagcaaaatcccaa

SEQ ID NO: 712189 - DNA, 22 bp, Artificial Sequence
  chemically synthesized
cgtttttgggattttgctttat

SEQ ID NO: 712190 - DNA, 22 bp, Artificial Sequence
  chemically synthesized
tacgttaagattataaagcaaa

SEQ ID NO: 712191 - DNA, 22 bp, Artificial Sequence
  chemically synthesized
ctatacgttaagattataaagc

SEQ ID NO: 712192 - DNA, 22 bp, Artificial Sequence
  chemically synthesized
ttgggattttgctttataatct

SEQ ID NO: 712193 - DNA, 22 bp, Artificial Sequence
  chemically synthesized
tgggattttgctttataatctt

SEQ ID NO: 712194 - DNA, 22 bp, Artificial Sequence
  chemically synthesized
gggattttgctttataatctta

SEQ ID NO: 712195 - DNA, 22 bp, Artificial Sequence
  chemically synthesized
actgctatacgttaagattata

SEQ ID NO: 712196 - DNA, 22 bp, Artificial Sequence
  chemically synthesized
ggattttgctttataatcttaa

SEQ ID NO: 712197 - DNA, 22 bp, Artificial Sequence
  chemically synthesized
tgctttataatcttaacgtata

SEQ ID NO: 712198 - DNA, 22 bp, Artificial Sequence
  chemically synthesized
gctttataatcttaacgtatag

SEQ ID NO: 712199 - DNA, 22 bp, Artificial Sequence
  chemically synthesized
ctttataatcttaacgtatagc

SEQ ID NO: 712200 - DNA, 22 bp, Artificial Sequence
  chemically synthesized
tataatcttaacgtatagcagt

SEQ ID NO: 712201 - DNA, 22 bp, Artificial Sequence
  chemically synthesized
ataatcttaacgtatagcagtg

SEQ ID NO: 712202 - DNA, 22 bp, Artificial Sequence
  chemically synthesized
taatcttaacgtatagcagtga

SEQ ID NO: 712203 - DNA, 22 bp, Artificial Sequence
  chemically synthesized
aacgtatagcagtgaactccat

SEQ ID NO: 712204 - DNA, 22 bp, Artificial Sequence
  chemically synthesized
acgtatagcagtgaactccatg

SEQ ID NO: 712205 - DNA, 22 bp, Artificial Sequence
  chemically synthesized
tcacaccacaaacatggagttc

SEQ ID NO: 712206 - DNA, 22 bp, Artificial Sequence
  chemically synthesized
gtcacaccacaaacatggagtt

SEQ ID NO: 712207 - DNA, 22 bp, Artificial Sequence
  chemically synthesized
ttgtcacaccacaaacatggag

SEQ ID NO: 712208 - DNA, 22 bp, Artificial Sequence
  chemically synthesized
ttcttgtcacaccacaaacatg

SEQ ID NO: 712209 - DNA, 22 bp, Artificial Sequence
  chemically synthesized
attcttgtcacaccacaaacat

SEQ ID NO: 712210 - DNA, 22 bp, Artificial Sequence
  chemically synthesized
tattcttgtcacaccacaaaca

SEQ ID NO: 712211 - DNA, 22 bp, Artificial Sequence
  chemically synthesized
catgtttgtggtgtgacaagaa

SEQ ID NO: 712212 - DNA, 22 bp, Artificial Sequence
  chemically synthesized
gtggtgtgacaagaataaagga

SEQ ID NO: 712213 - DNA, 22 bp, Artificial Sequence
  chemically synthesized
tggtgtgacaagaataaaggat

SEQ ID NO: 712214 - DNA, 22 bp, Artificial Sequence
  chemically synthesized
aagaaagaaaaagaatccttta

SEQ ID NO: 712215 - DNA, 22 bp, Artificial Sequence
  chemically synthesized
aaagaaagaaaaagaatccttt

SEQ ID NO: 712216 - DNA, 22 bp, Artificial Sequence
  chemically synthesized
taaagaaagaaaaagaatcctt

SEQ ID NO: 712217 - DNA, 22 bp, Artificial Sequence
  chemically synthesized
ttttaaagaaagaaaaagaatc

SEQ ID NO: 712218 - DNA, 22 bp, Artificial Sequence
  chemically synthesized
tttttctttctttaaaacaggt

SEQ ID NO: 712219 - DNA, 22 bp, Artificial Sequence
  chemically synthesized
tttctttctttaaaacaggttg

SEQ ID NO: 712220 - DNA, 22 bp, Artificial Sequence
  chemically synthesized
ttctttctttaaaacaggttgt

SEQ ID NO: 712221 - DNA, 22 bp, Artificial Sequence
  chemically synthesized
tctttctttaaaacaggttgtt

SEQ ID NO: 712222 - DNA, 22 bp, Artificial Sequence
  chemically synthesized
ctttctttaaaacaggttgttc

SEQ ID NO: 712223 - DNA, 22 bp, Artificial Sequence
  chemically synthesized
tggaaaatatgggaacaacctg

SEQ ID NO: 712224 - DNA, 22 bp, Artificial Sequence
  chemically synthesized
tttctttaaaacaggttgttcc

SEQ ID NO: 712225 - DNA, 22 bp, Artificial Sequence
  chemically synthesized
atggaaaatatgggaacaacct

SEQ ID NO: 712226 - DNA, 22 bp, Artificial Sequence
  chemically synthesized
tctttaaaacaggttgttccca

SEQ ID NO: 712227 - DNA, 22 bp, Artificial Sequence
  chemically synthesized
ttatggaaaatatgggaacaac

SEQ ID NO: 712228 - DNA, 22 bp, Artificial Sequence
  chemically synthesized
ctttaaaacaggttgttcccat

SEQ ID NO: 712229 - DNA, 22 bp, Artificial Sequence
  chemically synthesized
tttaaaacaggttgttcccata

SEQ ID NO: 712230 - DNA, 22 bp, Artificial Sequence
  chemically synthesized
tcttatggaaaatatgggaaca

SEQ ID NO: 712231 - DNA, 22 bp, Artificial Sequence
  chemically synthesized
taaaacaggttgttcccatatt

SEQ ID NO: 712232 - DNA, 22 bp, Artificial Sequence
  chemically synthesized
aaaacaggttgttcccatattt

SEQ ID NO: 712233 - DNA, 22 bp, Artificial Sequence
  chemically synthesized
aaacaggttgttcccatatttt

SEQ ID NO: 712234 - DNA, 22 bp, Artificial Sequence
  chemically synthesized
ttcccatattttccataagaga

SEQ ID NO: 712235 - DNA, 22 bp, Artificial Sequence
  chemically synthesized
agccgacacatgtctctcttat

SEQ ID NO: 712236 - DNA, 22 bp, Artificial Sequence
  chemically synthesized
ccatattttccataagagagac

SEQ ID NO: 712237 - DNA, 22 bp, Artificial Sequence
  chemically synthesized
aagccgacacatgtctctctta

SEQ ID NO: 712238 - DNA, 22 bp, Artificial Sequence
  chemically synthesized
taagccgacacatgtctctctt

SEQ ID NO: 712239 - DNA, 22 bp, Artificial Sequence
  chemically synthesized
ttaagccgacacatgtctctct

SEQ ID NO: 712240 - DNA, 22 bp, Artificial Sequence
  chemically synthesized
ttttaagccgacacatgtctct

SEQ ID NO: 712241 - DNA, 22 bp, Artificial Sequence
  chemically synthesized
cttttaagccgacacatgtctc

SEQ ID NO: 712242 - DNA, 22 bp, Artificial Sequence
  chemically synthesized
tccataagagagacatgtgtcg

SEQ ID NO: 712243 - DNA, 22 bp, Artificial Sequence
  chemically synthesized
ccataagagagacatgtgtcgg

SEQ ID NO: 712244 - DNA, 22 bp, Artificial Sequence
  chemically synthesized
atttcttttaagccgacacatg

SEQ ID NO: 712245 - DNA, 22 bp, Artificial Sequence
  chemically synthesized
cataagagagacatgtgtcggc

SEQ ID NO: 712246 - DNA, 22 bp, Artificial Sequence
  chemically synthesized
catttcttttaagccgacacat

SEQ ID NO: 712247 - DNA, 22 bp, Artificial Sequence
  chemically synthesized
tagtttcatttcttttaagccg

SEQ ID NO: 712248 - DNA, 22 bp, Artificial Sequence
  chemically synthesized
acaccattgtagtttcatttct

SEQ ID NO: 712249 - DNA, 22 bp, Artificial Sequence
  chemically synthesized
cctcacaccattgtagtttcat

SEQ ID NO: 712250 - DNA, 22 bp, Artificial Sequence
  chemically synthesized
ctccctcacaccattgtagttt

SEQ ID NO: 712251 - DNA, 22 bp, Artificial Sequence
  chemically synthesized
aaaagaaatgaaactacaatgg

SEQ ID NO: 712252 - DNA, 22 bp, Artificial Sequence
  chemically synthesized
aaagaaatgaaactacaatggt

SEQ ID NO: 712253 - DNA, 22 bp, Artificial Sequence
  chemically synthesized
acaatcaggagattcctccctc

SEQ ID NO: 712254 - DNA, 22 bp, Artificial Sequence
  chemically synthesized
caatggtgtgagggaggaatct

SEQ ID NO: 712255 - DNA, 22 bp, Artificial Sequence
  chemically synthesized
ctgattgttagcgtatattttc

SEQ ID NO: 712256 - DNA, 22 bp, Artificial Sequence
  chemically synthesized
aggtaaaatgcagaaaatatac

SEQ ID NO: 712257 - DNA, 22 bp, Artificial Sequence
  chemically synthesized
caggtaaaatgcagaaaatata

SEQ ID NO: 712258 - DNA, 22 bp, Artificial Sequence
  chemically synthesized
attgttagcgtatattttctgc

SEQ ID NO: 712259 - DNA, 22 bp, Artificial Sequence
  chemically synthesized
ttagcgtatattttctgcattt

SEQ ID NO: 712260 - DNA, 22 bp, Artificial Sequence
  chemically synthesized
acaatttcaggtaaaatgcaga

SEQ ID NO: 712261 - DNA, 22 bp, Artificial Sequence
  chemically synthesized
gcgtatattttctgcattttac

SEQ ID NO: 712262 - DNA, 22 bp, Artificial Sequence
  chemically synthesized
gttgacaatttcaggtaaaatg

SEQ ID NO: 712263 - DNA, 22 bp, Artificial Sequence
  chemically synthesized
cgttgacaatttcaggtaaaat

SEQ ID NO: 712264 - DNA, 22 bp, Artificial Sequence
  chemically synthesized
cacttcgttgacaatttcaggt

SEQ ID NO: 712265 - DNA, 22 bp, Artificial Sequence
  chemically synthesized
tctgcattttacctgaaattgt

SEQ ID NO: 712266 - DNA, 22 bp, Artificial Sequence
  chemically synthesized
ctgcattttacctgaaattgtc

SEQ ID NO: 712267 - DNA, 22 bp, Artificial Sequence
  chemically synthesized
tgcattttacctgaaattgtca

SEQ ID NO: 712268 - DNA, 22 bp, Artificial Sequence
  chemically synthesized
cctacacttcgttgacaatttc

SEQ ID NO: 712269 - DNA, 22 bp, Artificial Sequence
  chemically synthesized
acctacacttcgttgacaattt

SEQ ID NO: 712270 - DNA, 22 bp, Artificial Sequence
  chemically synthesized
cattttacctgaaattgtcaac

SEQ ID NO: 712271 - DNA, 22 bp, Artificial Sequence
  chemically synthesized
tacctacacttcgttgacaatt

SEQ ID NO: 712272 - DNA, 22 bp, Artificial Sequence
  chemically synthesized
actttacctacacttcgttgac

SEQ ID NO: 712273 - DNA, 22 bp, Artificial Sequence
  chemically synthesized
tacctgaaattgtcaacgaagt

SEQ ID NO: 712274 - DNA, 22 bp, Artificial Sequence
  chemically synthesized
aactttacctacacttcgttga

SEQ ID NO: 712275 - DNA, 22 bp, Artificial Sequence
  chemically synthesized
acctgaaattgtcaacgaagtg

SEQ ID NO: 712276 - DNA, 22 bp, Artificial Sequence
  chemically synthesized
cctgaaattgtcaacgaagtgt

SEQ ID NO: 712277 - DNA, 22 bp, Artificial Sequence
  chemically synthesized
aaattgtcaacgaagtgtaggt

SEQ ID NO: 712278 - DNA, 22 bp, Artificial Sequence
  chemically synthesized
tcaacgaagtgtaggtaaagtt

SEQ ID NO: 712279 - DNA, 22 bp, Artificial Sequence
  chemically synthesized
gggccccgccttaactttacct

SEQ ID NO: 712280 - DNA, 22 bp, Artificial Sequence
  chemically synthesized
aacagcctagggccccgcctta

SEQ ID NO: 712281 - DNA, 22 bp, Artificial Sequence
  chemically synthesized
ttgaacagcctagggccccgcc

SEQ ID NO: 712282 - DNA, 22 bp, Artificial Sequence
  chemically synthesized
gccacgttattgaacagcctag

SEQ ID NO: 712283 - DNA, 22 bp, Artificial Sequence
  chemically synthesized
aggcggggccctaggctgttca

SEQ ID NO: 712284 - DNA, 22 bp, Artificial Sequence
  chemically synthesized
aaaccaaatgttagccacgtta

SEQ ID NO: 712285 - DNA, 22 bp, Artificial Sequence
  chemically synthesized
ggctgttcaataacgtggctaa

SEQ ID NO: 712286 - DNA, 22 bp, Artificial Sequence
  chemically synthesized
ttcaataacgtggctaacattt

SEQ ID NO: 712287 - DNA, 22 bp, Artificial Sequence
  chemically synthesized
aataacgtggctaacatttggt

SEQ ID NO: 712288 - DNA, 22 bp, Artificial Sequence
  chemically synthesized
agaaggccctcaaaccaaatgt

SEQ ID NO: 712289 - DNA, 22 bp, Artificial Sequence
  chemically synthesized
acatttggtttgagggccttct

SEQ ID NO: 712290 - DNA, 22 bp, Artificial Sequence
  chemically synthesized
ggaacagaactgagaaggccct

SEQ ID NO: 712291 - DNA, 22 bp, Artificial Sequence
  chemically synthesized
gggaacagaactgagaaggccc

SEQ ID NO: 712292 - DNA, 22 bp, Artificial Sequence
  chemically synthesized
tttgggaacagaactgagaagg

SEQ ID NO: 712293 - DNA, 22 bp, Artificial Sequence
  chemically synthesized
ggtttgagggccttctcagttc

SEQ ID NO: 712294 - DNA, 22 bp, Artificial Sequence
  chemically synthesized
gtttgagggccttctcagttct

SEQ ID NO: 712295 - DNA, 22 bp, Artificial Sequence
  chemically synthesized
actatttgggaacagaactgag

SEQ ID NO: 712296 - DNA, 22 bp, Artificial Sequence
  chemically synthesized
gagggccttctcagttctgttc

SEQ ID NO: 712297 - DNA, 22 bp, Artificial Sequence
  chemically synthesized
agggccttctcagttctgttcc

SEQ ID NO: 712298 - DNA, 22 bp, Artificial Sequence
  chemically synthesized
ctcagttctgttcccaaatagt

SEQ ID NO: 712299 - DNA, 22 bp, Artificial Sequence
  chemically synthesized
tcagttctgttcccaaatagtc

SEQ ID NO: 712300 - DNA, 22 bp, Artificial Sequence
  chemically synthesized
ggaaagaaaggctgactatttg

SEQ ID NO: 712301 - DNA, 22 bp, Artificial Sequence
  chemically synthesized
agttctgttcccaaatagtcag

SEQ ID NO: 712302 - DNA, 22 bp, Artificial Sequence
  chemically synthesized
tgttcccaaatagtcagccttt

SEQ ID NO: 712303 - DNA, 22 bp, Artificial Sequence
  chemically synthesized
ttcccaaatagtcagcctttct

SEQ ID NO: 712304 - DNA, 22 bp, Artificial Sequence
  chemically synthesized
ccaaatagtcagcctttctttc

SEQ ID NO: 712305 - DNA, 22 bp, Artificial Sequence
  chemically synthesized
aggacaagcagttgggaaagaa

SEQ ID NO: 712306 - DNA, 22 bp, Artificial Sequence
  chemically synthesized
atcagctaaggacaagcagttg

SEQ ID NO: 712307 - DNA, 22 bp, Artificial Sequence
  chemically synthesized
ctaatcagctaaggacaagcag

SEQ ID NO: 712308 - DNA, 22 bp, Artificial Sequence
  chemically synthesized
actaatcagctaaggacaagca

SEQ ID NO: 712309 - DNA, 22 bp, Artificial Sequence
  chemically synthesized
tctttcccaactgcttgtcctt

SEQ ID NO: 712310 - DNA, 22 bp, Artificial Sequence
  chemically synthesized
ctttcccaactgcttgtcctta

SEQ ID NO: 712311 - DNA, 22 bp, Artificial Sequence
  chemically synthesized
tttcccaactgcttgtccttag

SEQ ID NO: 712312 - DNA, 22 bp, Artificial Sequence
  chemically synthesized
tttactaatcagctaaggacaa

SEQ ID NO: 712313 - DNA, 22 bp, Artificial Sequence
  chemically synthesized
tcccaactgcttgtccttagct

SEQ ID NO: 712314 - DNA, 22 bp, Artificial Sequence
  chemically synthesized
cccaactgcttgtccttagctg

SEQ ID NO: 712315 - DNA, 22 bp, Artificial Sequence
  chemically synthesized
ccaactgcttgtccttagctga

SEQ ID NO: 712316 - DNA, 22 bp, Artificial Sequence
  chemically synthesized
gggttatttactaatcagctaa

SEQ ID NO: 712317 - DNA, 22 bp, Artificial Sequence
  chemically synthesized
ctagggttatttactaatcagc

SEQ ID NO: 712318 - DNA, 22 bp, Artificial Sequence
  chemically synthesized
cctagggttatttactaatcag

SEQ ID NO: 712319 - DNA, 22 bp, Artificial Sequence
  chemically synthesized
cttgtccttagctgattagtaa

SEQ ID NO: 712320 - DNA, 22 bp, Artificial Sequence
  chemically synthesized
gtccttagctgattagtaaata

SEQ ID NO: 712321 - DNA, 22 bp, Artificial Sequence
  chemically synthesized
tcttcctagggttatttactaa

SEQ ID NO: 712322 - DNA, 22 bp, Artificial Sequence
  chemically synthesized
tccttagctgattagtaaataa

SEQ ID NO: 712323 - DNA, 22 bp, Artificial Sequence
  chemically synthesized
atcttcctagggttatttacta

SEQ ID NO: 712324 - DNA, 22 bp, Artificial Sequence
  chemically synthesized
agctgattagtaaataacccta

SEQ ID NO: 712325 - DNA, 22 bp, Artificial Sequence
  chemically synthesized
gctgattagtaaataaccctag

SEQ ID NO: 712326 - DNA, 22 bp, Artificial Sequence
  chemically synthesized
attagtaaataaccctaggaag

SEQ ID NO: 712327 - DNA, 22 bp, Artificial Sequence
  chemically synthesized
tgaacaatcatttatcttccta

SEQ ID NO: 712328 - DNA, 22 bp, Artificial Sequence
  chemically synthesized
gtaaataaccctaggaagataa

SEQ ID NO: 712329 - DNA, 22 bp, Artificial Sequence
  chemically synthesized
ttatgaacaatcatttatcttc

SEQ ID NO: 712330 - DNA, 22 bp, Artificial Sequence
  chemically synthesized
gaagcctgttatgaacaatcat

SEQ ID NO: 712331 - DNA, 22 bp, Artificial Sequence
  chemically synthesized
ggaagataaatgattgttcata

SEQ ID NO: 712332 - DNA, 22 bp, Artificial Sequence
  chemically synthesized
tggtactggaagcctgttatga

SEQ ID NO: 712333 - DNA, 22 bp, Artificial Sequence
  chemically synthesized
acagctgtggtactggaagcct

SEQ ID NO: 712334 - DNA, 22 bp, Artificial Sequence
  chemically synthesized
ttcataacaggcttccagtacc

SEQ ID NO: 712335 - DNA, 22 bp, Artificial Sequence
  chemically synthesized
ataacaggcttccagtaccaca

SEQ ID NO: 712336 - DNA, 22 bp, Artificial Sequence
  chemically synthesized
aaatgcaaatactcacagctgt

SEQ ID NO: 712337 - DNA, 22 bp, Artificial Sequence
  chemically synthesized
aaaatgcaaatactcacagctg

SEQ ID NO: 712338 - DNA, 22 bp, Artificial Sequence
  chemically synthesized
ccagtaccacagctgtgagtat

SEQ ID NO: 712339 - DNA, 22 bp, Artificial Sequence
  chemically synthesized
cagtaccacagctgtgagtatt

SEQ ID NO: 712340 - DNA, 22 bp, Artificial Sequence
  chemically synthesized
cacttaaaatgcaaatactcac

SEQ ID NO: 712341 - DNA, 22 bp, Artificial Sequence
  chemically synthesized
aagttgcacttaaaatgcaaat

SEQ ID NO: 712342 - DNA, 22 bp, Artificial Sequence
  chemically synthesized
aaagttgcacttaaaatgcaaa

SEQ ID NO: 712343 - DNA, 22 bp, Artificial Sequence
  chemically synthesized
tttaaagttgcacttaaaatgc

SEQ ID NO: 712344 - DNA, 22 bp, Artificial Sequence
  chemically synthesized
tgagtatttgcattttaagtgc

SEQ ID NO: 712345 - DNA, 22 bp, Artificial Sequence
  chemically synthesized
attatttaaagttgcacttaaa

SEQ ID NO: 712346 - DNA, 22 bp, Artificial Sequence
  chemically synthesized
aattatttaaagttgcacttaa

SEQ ID NO: 712347 - DNA, 22 bp, Artificial Sequence
  chemically synthesized
gcattttaagtgcaactttaaa

SEQ ID NO: 712348 - DNA, 22 bp, Artificial Sequence
  chemically synthesized
atggcttaattatttaaagttg

SEQ ID NO: 712349 - DNA, 22 bp, Artificial Sequence
  chemically synthesized
cattttaagtgcaactttaaat

SEQ ID NO: 712350 - DNA, 22 bp, Artificial Sequence
  chemically synthesized
taagtgcaactttaaataatta

SEQ ID NO: 712351 - DNA, 22 bp, Artificial Sequence
  chemically synthesized
aagtgcaactttaaataattaa

SEQ ID NO: 712352 - DNA, 22 bp, Artificial Sequence
  chemically synthesized
agtgcaactttaaataattaag

SEQ ID NO: 712353 - DNA, 22 bp, Artificial Sequence
  chemically synthesized
agtaattaatggcttaattatt

SEQ ID NO: 712354 - DNA, 22 bp, Artificial Sequence
  chemically synthesized
gagtaattaatggcttaattat

SEQ ID NO: 712355 - DNA, 22 bp, Artificial Sequence
  chemically synthesized
taaataattaagccattaatta

SEQ ID NO: 712356 - DNA, 22 bp, Artificial Sequence
  chemically synthesized
aaataattaagccattaattac

SEQ ID NO: 712357 - DNA, 22 bp, Artificial Sequence
  chemically synthesized
aataattaagccattaattact

SEQ ID NO: 712358 - DNA, 22 bp, Artificial Sequence
  chemically synthesized
aataagtatttgagtaattaat

SEQ ID NO: 712359 - DNA, 22 bp, Artificial Sequence
  chemically synthesized
agccattaattactcaaatact

SEQ ID NO: 712360 - DNA, 22 bp, Artificial Sequence
  chemically synthesized
taaacactcaataagtatttga

SEQ ID NO: 712361 - DNA, 22 bp, Artificial Sequence
  chemically synthesized
ataaacactcaataagtatttg

SEQ ID NO: 712362 - DNA, 22 bp, Artificial Sequence
  chemically synthesized
attactcaaatacttattgagt

SEQ ID NO: 712363 - DNA, 22 bp, Artificial Sequence
  chemically synthesized
ctcaaatacttattgagtgttt

SEQ ID NO: 712364 - DNA, 22 bp, Artificial Sequence
  chemically synthesized
gcaaagtgccttataaacactc

SEQ ID NO: 712365 - DNA, 22 bp, Artificial Sequence
  chemically synthesized
aaatacttattgagtgtttata

SEQ ID NO: 712366 - DNA, 22 bp, Artificial Sequence
  chemically synthesized
ctagcaaagtgccttataaaca

SEQ ID NO: 712367 - DNA, 22 bp, Artificial Sequence
  chemically synthesized
tcctagcaaagtgccttataaa

SEQ ID NO: 712368 - DNA, 22 bp, Artificial Sequence
  chemically synthesized
ctctcctagcaaagtgccttat

SEQ ID NO: 712369 - DNA, 22 bp, Artificial Sequence
  chemically synthesized
attgagtgtttataaggcactt

SEQ ID NO: 712370 - DNA, 22 bp, Artificial Sequence
  chemically synthesized
cctctcctagcaaagtgcctta

SEQ ID NO: 712371 - DNA, 22 bp, Artificial Sequence
  chemically synthesized
ttgagtgtttataaggcacttt

SEQ ID NO: 712372 - DNA, 22 bp, Artificial Sequence
  chemically synthesized
cttcctctcctagcaaagtgcc

SEQ ID NO: 712373 - DNA, 22 bp, Artificial Sequence
  chemically synthesized
agtgtttataaggcactttgct

SEQ ID NO: 712374 - DNA, 22 bp, Artificial Sequence
  chemically synthesized
tgcttcctctcctagcaaagtg

SEQ ID NO: 712375 - DNA, 22 bp, Artificial Sequence
  chemically synthesized
ctgcttcctctcctagcaaagt

SEQ ID NO: 712376 - DNA, 22 bp, Artificial Sequence
  chemically synthesized
tctgcttcctctcctagcaaag

SEQ ID NO: 712377 - DNA, 22 bp, Artificial Sequence
  chemically synthesized
ttctgcttcctctcctagcaaa

SEQ ID NO: 712378 - DNA, 22 bp, Artificial Sequence
  chemically synthesized
tttctgcttcctctcctagcaa

SEQ ID NO: 712379 - DNA, 22 bp, Artificial Sequence
  chemically synthesized
ataaggcactttgctaggagag

SEQ ID NO: 712380 - DNA, 22 bp, Artificial Sequence
  chemically synthesized
taaggcactttgctaggagagg

SEQ ID NO: 712381 - DNA, 22 bp, Artificial Sequence
  chemically synthesized
ttttttctgcttcctctcctag

SEQ ID NO: 712382 - DNA, 22 bp, Artificial Sequence
  chemically synthesized
attttttctgcttcctctccta

SEQ ID NO: 712383 - DNA, 22 bp, Artificial Sequence
  chemically synthesized
tattttttctgcttcctctcct

SEQ ID NO: 712384 - DNA, 22 bp, Artificial Sequence
  chemically synthesized
ttattttttctgcttcctctcc

SEQ ID NO: 712385 - DNA, 22 bp, Artificial Sequence
  chemically synthesized
tttttattttttctgcttcctc

SEQ ID NO: 712386 - DNA, 22 bp, Artificial Sequence
  chemically synthesized
atttttattttttctgcttcct

SEQ ID NO: 712387 - DNA, 22 bp, Artificial Sequence
  chemically synthesized
tgctaggagaggaagcagaaaa

SEQ ID NO: 712388 - DNA, 22 bp, Artificial Sequence
  chemically synthesized
tttatttttattttttctgctt

SEQ ID NO: 712389 - DNA, 22 bp, Artificial Sequence
  chemically synthesized
gctaggagaggaagcagaaaaa

SEQ ID NO: 712390 - DNA, 22 bp, Artificial Sequence
  chemically synthesized
atttatttttattttttctgct

SEQ ID NO: 712391 - DNA, 22 bp, Artificial Sequence
  chemically synthesized
ctaggagaggaagcagaaaaaa

SEQ ID NO: 712392 - DNA, 22 bp, Artificial Sequence
  chemically synthesized
ttatttatttttattttttctg

SEQ ID NO: 712393 - DNA, 22 bp, Artificial Sequence
  chemically synthesized
cttatttatttttattttttct

SEQ ID NO: 712394 - DNA, 22 bp, Artificial Sequence
  chemically synthesized
ggagaggaagcagaaaaaataa

SEQ ID NO: 712395 - DNA, 22 bp, Artificial Sequence
  chemically synthesized
tcttatttatttttattttttc

SEQ ID NO: 712396 - DNA, 22 bp, Artificial Sequence
  chemically synthesized
ttttcttatttatttttatttt

SEQ ID NO: 712397 - DNA, 22 bp, Artificial Sequence
  chemically synthesized
gttttcttatttatttttattt

SEQ ID NO: 712398 - DNA, 22 bp, Artificial Sequence
  chemically synthesized
aagaccatccccttgttttctt

SEQ ID NO: 712399 - DNA, 22 bp, Artificial Sequence
  chemically synthesized
actaaagaccatccccttgttt

SEQ ID NO: 712400 - DNA, 22 bp, Artificial Sequence
  chemically synthesized
caaattcactaaagaccatccc

SEQ ID NO: 712401 - DNA, 22 bp, Artificial Sequence
  chemically synthesized
taaatatcaaatctacaaattc

SEQ ID NO: 712402 - DNA, 22 bp, Artificial Sequence
  chemically synthesized
gtaaatatcaaatctacaaatt

SEQ ID NO: 712403 - DNA, 22 bp, Artificial Sequence
  chemically synthesized
tttgtaaatatcaaatctacaa

SEQ ID NO: 712404 - DNA, 22 bp, Artificial Sequence
  chemically synthesized
atttgtaaatatcaaatctaca

SEQ ID NO: 712405 - DNA, 22 bp, Artificial Sequence
  chemically synthesized
tagtgaatttgtagatttgata

SEQ ID NO: 712406 - DNA, 22 bp, Artificial Sequence
  chemically synthesized
agtgaatttgtagatttgatat

SEQ ID NO: 712407 - DNA, 22 bp, Artificial Sequence
  chemically synthesized
gtgaatttgtagatttgatatt

SEQ ID NO: 712408 - DNA, 22 bp, Artificial Sequence
  chemically synthesized
tgcttatttgtaaatatcaaat

SEQ ID NO: 712409 - DNA, 22 bp, Artificial Sequence
  chemically synthesized
ttatgcttatttgtaaatatca

SEQ ID NO: 712410 - DNA, 22 bp, Artificial Sequence
  chemically synthesized
attatgcttatttgtaaatatc

SEQ ID NO: 712411 - DNA, 22 bp, Artificial Sequence
  chemically synthesized
tattatgcttatttgtaaatat

SEQ ID NO: 712412 - DNA, 22 bp, Artificial Sequence
  chemically synthesized
gtagatttgatatttacaaata

SEQ ID NO: 712413 - DNA, 22 bp, Artificial Sequence
  chemically synthesized
tagatttgatatttacaaataa

SEQ ID NO: 712414 - DNA, 22 bp, Artificial Sequence
  chemically synthesized
gatatttacaaataagcataat

SEQ ID NO: 712415 - DNA, 22 bp, Artificial Sequence
  chemically synthesized
ccataatactttattatgctta

SEQ ID NO: 712416 - DNA, 22 bp, Artificial Sequence
  chemically synthesized
atatttacaaataagcataata

SEQ ID NO: 712417 - DNA, 22 bp, Artificial Sequence
  chemically synthesized
cccataatactttattatgctt

SEQ ID NO: 712418 - DNA, 22 bp, Artificial Sequence
  chemically synthesized
tcccataatactttattatgct

SEQ ID NO: 712419 - DNA, 22 bp, Artificial Sequence
  chemically synthesized
acaaataagcataataaagtat

SEQ ID NO: 712420 - DNA, 22 bp, Artificial Sequence
  chemically synthesized
caaataagcataataaagtatt

SEQ ID NO: 712421 - DNA, 22 bp, Artificial Sequence
  chemically synthesized
aaatctttcccataatacttta

SEQ ID NO: 712422 - DNA, 22 bp, Artificial Sequence
  chemically synthesized
cattaaaatctttcccataata

SEQ ID NO: 712423 - DNA, 22 bp, Artificial Sequence
  chemically synthesized
cactacattaaaatctttccca

SEQ ID NO: 712424 - DNA, 22 bp, Artificial Sequence
  chemically synthesized
gggaatgactgcactacattaa

SEQ ID NO: 712425 - DNA, 22 bp, Artificial Sequence
  chemically synthesized
tgggaaagattttaatgtagtg

SEQ ID NO: 712426 - DNA, 22 bp, Artificial Sequence
  chemically synthesized
tcaaattggggaatgactgcac

SEQ ID NO: 712427 - DNA, 22 bp, Artificial Sequence
  chemically synthesized
taatgtagtgcagtcattcccc

SEQ ID NO: 712428 - DNA, 22 bp, Artificial Sequence
  chemically synthesized
aatgtagtgcagtcattcccca

SEQ ID NO: 712429 - DNA, 22 bp, Artificial Sequence
  chemically synthesized
atgtagtgcagtcattccccaa

SEQ ID NO: 712430 - DNA, 22 bp, Artificial Sequence
  chemically synthesized
tgatacactgtcaaattgggga

SEQ ID NO: 712431 - DNA, 22 bp, Artificial Sequence
  chemically synthesized
aaatagttgtgatacactgtca

SEQ ID NO: 712432 - DNA, 22 bp, Artificial Sequence
  chemically synthesized
tcaaatagttgtgatacactgt

SEQ ID NO: 712433 - DNA, 22 bp, Artificial Sequence
  chemically synthesized
cccaatttgacagtgtatcaca

SEQ ID NO: 712434 - DNA, 22 bp, Artificial Sequence
  chemically synthesized
aaaagttctcaaatagttgtga

SEQ ID NO: 712435 - DNA, 22 bp, Artificial Sequence
  chemically synthesized
gaaaagttctcaaatagttgtg

SEQ ID NO: 712436 - DNA, 22 bp, Artificial Sequence
  chemically synthesized
tgaaaagttctcaaatagttgt

SEQ ID NO: 712437 - DNA, 22 bp, Artificial Sequence
  chemically synthesized
gacagtgtatcacaactatttg

SEQ ID NO: 712438 - DNA, 22 bp, Artificial Sequence
  chemically synthesized
ttgaaaagttctcaaatagttg

SEQ ID NO: 712439 - DNA, 22 bp, Artificial Sequence
  chemically synthesized
acagtgtatcacaactatttga

SEQ ID NO: 712440 - DNA, 22 bp, Artificial Sequence
  chemically synthesized
tttgaaaagttctcaaatagtt

SEQ ID NO: 712441 - DNA, 22 bp, Artificial Sequence
  chemically synthesized
ttttgaaaagttctcaaatagt

SEQ ID NO: 712442 - DNA, 22 bp, Artificial Sequence
  chemically synthesized
tatttttttgaaaagttctcaa

SEQ ID NO: 712443 - DNA, 22 bp, Artificial Sequence
  chemically synthesized
agaatctgtatttttttgaaaa

SEQ ID NO: 712444 - DNA, 22 bp, Artificial Sequence
  chemically synthesized
tttgagaacttttcaaaaaaat

SEQ ID NO: 712445 - DNA, 22 bp, Artificial Sequence
  chemically synthesized
gagaacttttcaaaaaaataca

SEQ ID NO: 712446 - DNA, 22 bp, Artificial Sequence
  chemically synthesized
agaacttttcaaaaaaatacag

SEQ ID NO: 712447 - DNA, 22 bp, Artificial Sequence
  chemically synthesized
gacgagctaagaatctgtattt

SEQ ID NO: 712448 - DNA, 22 bp, Artificial Sequence
  chemically synthesized
agacgagctaagaatctgtatt

SEQ ID NO: 712449 - DNA, 22 bp, Artificial Sequence
  chemically synthesized
tttagacgagctaagaatctgt

SEQ ID NO: 712450 - DNA, 22 bp, Artificial Sequence
  chemically synthesized
ttcaaaaaaatacagattctta

SEQ ID NO: 712451 - DNA, 22 bp, Artificial Sequence
  chemically synthesized
tcaaaaaaatacagattcttag

SEQ ID NO: 712452 - DNA, 22 bp, Artificial Sequence
  chemically synthesized
caaaaaaatacagattcttagc

SEQ ID NO: 712453 - DNA, 22 bp, Artificial Sequence
  chemically synthesized
aaaaaaatacagattcttagct

SEQ ID NO: 712454 - DNA, 22 bp, Artificial Sequence
  chemically synthesized
aatcagaaattatttagacgag

SEQ ID NO: 712455 - DNA, 22 bp, Artificial Sequence
  chemically synthesized
actaaatcagaaattatttaga

SEQ ID NO: 712456 - DNA, 22 bp, Artificial Sequence
  chemically synthesized
ttagctcgtctaaataatttct

SEQ ID NO: 712457 - DNA, 22 bp, Artificial Sequence
  chemically synthesized
agctcgtctaaataatttctga

SEQ ID NO: 712458 - DNA, 22 bp, Artificial Sequence
  chemically synthesized
aaattaactaaatcagaaatta

SEQ ID NO: 712459 - DNA, 22 bp, Artificial Sequence
  chemically synthesized
gctcgtctaaataatttctgat

SEQ ID NO: 712460 - DNA, 22 bp, Artificial Sequence
  chemically synthesized
gtctaaataatttctgatttag

SEQ ID NO: 712461 - DNA, 22 bp, Artificial Sequence
  chemically synthesized
agcctcaaattaactaaatcag

SEQ ID NO: 712462 - DNA, 22 bp, Artificial Sequence
  chemically synthesized
aataatttctgatttagttaat

SEQ ID NO: 712463 - DNA, 22 bp, Artificial Sequence
  chemically synthesized
aagcctcagcctcaaattaact

SEQ ID NO: 712464 - DNA, 22 bp, Artificial Sequence
  chemically synthesized
tcaagcctcagcctcaaattaa

SEQ ID NO: 712465 - DNA, 22 bp, Artificial Sequence
  chemically synthesized
ctgatttagttaatttgaggct

SEQ ID NO: 712466 - DNA, 22 bp, Artificial Sequence
  chemically synthesized
tgatttagttaatttgaggctg

SEQ ID NO: 712467 - DNA, 22 bp, Artificial Sequence
  chemically synthesized
atttagttaatttgaggctgag

SEQ ID NO: 712468 - DNA, 22 bp, Artificial Sequence
  chemically synthesized
agttaatttgaggctgaggctt

SEQ ID NO: 712469 - DNA, 22 bp, Artificial Sequence
  chemically synthesized
gttaatttgaggctgaggcttg

SEQ ID NO: 712470 - DNA, 22 bp, Artificial Sequence
  chemically synthesized
atttgaggctgaggcttgagaa

SEQ ID NO: 712471 - DNA, 22 bp, Artificial Sequence
  chemically synthesized
aagaaagtaaagattctcaagc

SEQ ID NO: 712472 - DNA, 22 bp, Artificial Sequence
  chemically synthesized
aaagaaagtaaagattctcaag

SEQ ID NO: 712473 - DNA, 22 bp, Artificial Sequence
  chemically synthesized
gaggctgaggcttgagaatctt

SEQ ID NO: 712474 - DNA, 22 bp, Artificial Sequence
  chemically synthesized
aggctgaggcttgagaatcttt

SEQ ID NO: 712475 - DNA, 22 bp, Artificial Sequence
  chemically synthesized
aggcttgagaatctttactttc

SEQ ID NO: 712476 - DNA, 22 bp, Artificial Sequence
  chemically synthesized
tggagacttaaagaaagtaaag

SEQ ID NO: 712477 - DNA, 22 bp, Artificial Sequence
  chemically synthesized
tctgtggagacttaaagaaagt

SEQ ID NO: 712478 - DNA, 22 bp, Artificial Sequence
  chemically synthesized
gagaatctttactttctttaag

SEQ ID NO: 712479 - DNA, 22 bp, Artificial Sequence
  chemically synthesized
agaatctttactttctttaagt

SEQ ID NO: 712480 - DNA, 22 bp, Artificial Sequence
  chemically synthesized
tactttctttaagtctccacag

SEQ ID NO: 712481 - DNA, 22 bp, Artificial Sequence
  chemically synthesized
actttctttaagtctccacaga

SEQ ID NO: 712482 - DNA, 22 bp, Artificial Sequence
  chemically synthesized
ctttctttaagtctccacagat

SEQ ID NO: 712483 - DNA, 22 bp, Artificial Sequence
  chemically synthesized
tacatcagaactatctgtggag

SEQ ID NO: 712484 - DNA, 22 bp, Artificial Sequence
  chemically synthesized
tctttaagtctccacagatagt

SEQ ID NO: 712485 - DNA, 22 bp, Artificial Sequence
  chemically synthesized
ctttaagtctccacagatagtt

SEQ ID NO: 712486 - DNA, 22 bp, Artificial Sequence
  chemically synthesized
tttaagtctccacagatagttc

SEQ ID NO: 712487 - DNA, 22 bp, Artificial Sequence
  chemically synthesized
taagtctccacagatagttctg

SEQ ID NO: 712488 - DNA, 22 bp, Artificial Sequence
  chemically synthesized
aagtctccacagatagttctga

SEQ ID NO: 712489 - DNA, 22 bp, Artificial Sequence
  chemically synthesized
agtctccacagatagttctgat

SEQ ID NO: 712490 - DNA, 22 bp, Artificial Sequence
  chemically synthesized
cacagatagttctgatgtacag

SEQ ID NO: 712491 - DNA, 22 bp, Artificial Sequence
  chemically synthesized
atggatgtataccaggctgtac

SEQ ID NO: 712492 - DNA, 22 bp, Artificial Sequence
  chemically synthesized
cactgatggatgtataccaggc

SEQ ID NO: 712493 - DNA, 22 bp, Artificial Sequence
  chemically synthesized
tgatgtacagcctggtatacat

SEQ ID NO: 712494 - DNA, 22 bp, Artificial Sequence
  chemically synthesized
atgtacagcctggtatacatcc

SEQ ID NO: 712495 - DNA, 22 bp, Artificial Sequence
  chemically synthesized
cactacactgatggatgtatac

SEQ ID NO: 712496 - DNA, 22 bp, Artificial Sequence
  chemically synthesized
ccactacactgatggatgtata

SEQ ID NO: 712497 - DNA, 22 bp, Artificial Sequence
  chemically synthesized
gtggcatttccactacactgat

SEQ ID NO: 712498 - DNA, 22 bp, Artificial Sequence
  chemically synthesized
gtatacatccatcagtgtagtg

SEQ ID NO: 712499 - DNA, 22 bp, Artificial Sequence
  chemically synthesized
agtcataaaattcgtggcattt

SEQ ID NO: 712500 - DNA, 22 bp, Artificial Sequence
  chemically synthesized
ctgagtcataaaattcgtggca

SEQ ID NO: 712501 - DNA, 22 bp, Artificial Sequence
  chemically synthesized
cctgagtcataaaattcgtggc

SEQ ID NO: 712502 - DNA, 22 bp, Artificial Sequence
  chemically synthesized
aggtcttcctgagtcataaaat

SEQ ID NO: 712503 - DNA, 22 bp, Artificial Sequence
  chemically synthesized
caactcaggtcttcctgagtca

SEQ ID NO: 712504 - DNA, 22 bp, Artificial Sequence
  chemically synthesized
tatgactcaggaagacctgagt

SEQ ID NO: 712505 - DNA, 22 bp, Artificial Sequence
  chemically synthesized
atgactcaggaagacctgagtt

SEQ ID NO: 712506 - DNA, 22 bp, Artificial Sequence
  chemically synthesized
gtaagggactccaactcaggtc

SEQ ID NO: 712507 - DNA, 22 bp, Artificial Sequence
  chemically synthesized
tgactcaggaagacctgagttg

SEQ ID NO: 712508 - DNA, 22 bp, Artificial Sequence
  chemically synthesized
aggaagacctgagttggagtcc

SEQ ID NO: 712509 - DNA, 22 bp, Artificial Sequence
  chemically synthesized
aatagctagtaagggactccaa

SEQ ID NO: 712510 - DNA, 22 bp, Artificial Sequence
  chemically synthesized
gttaaatagctagtaagggact

SEQ ID NO: 712511 - DNA, 22 bp, Artificial Sequence
  chemically synthesized
agttggagtcccttactagcta

SEQ ID NO: 712512 - DNA, 22 bp, Artificial Sequence
  chemically synthesized
gagtcccttactagctatttaa

SEQ ID NO: 712513 - DNA, 22 bp, Artificial Sequence
  chemically synthesized
gataagatgctggttaaatagc

SEQ ID NO: 712514 - DNA, 22 bp, Artificial Sequence
  chemically synthesized
ttagataagatgctggttaaat

SEQ ID NO: 712515 - DNA, 22 bp, Artificial Sequence
  chemically synthesized
actagctatttaaccagcatct

SEQ ID NO: 712516 - DNA, 22 bp, Artificial Sequence
  chemically synthesized
ctagctatttaaccagcatctt

SEQ ID NO: 712517 - DNA, 22 bp, Artificial Sequence
  chemically synthesized
acaggctgttagataagatgct

SEQ ID NO: 712518 - DNA, 22 bp, Artificial Sequence
  chemically synthesized
gctatttaaccagcatcttatc

SEQ ID NO: 712519 - DNA, 22 bp, Artificial Sequence
  chemically synthesized
tttaaccagcatcttatctaac

SEQ ID NO: 712520 - DNA, 22 bp, Artificial Sequence
  chemically synthesized
aggttcacaggctgttagataa

SEQ ID NO: 712521 - DNA, 22 bp, Artificial Sequence
  chemically synthesized
aaccagcatcttatctaacagc

SEQ ID NO: 712522 - DNA, 22 bp, Artificial Sequence
  chemically synthesized
accagcatcttatctaacagcc

SEQ ID NO: 712523 - DNA, 22 bp, Artificial Sequence
  chemically synthesized
atctaacagcctgtgaacctta

SEQ ID NO: 712524 - DNA, 22 bp, Artificial Sequence
  chemically synthesized
tctaacagcctgtgaaccttag

SEQ ID NO: 712525 - DNA, 22 bp, Artificial Sequence
  chemically synthesized
acacataaagaaactaaggttc

SEQ ID NO: 712526 - DNA, 22 bp, Artificial Sequence
  chemically synthesized
acagcctgtgaaccttagtttc

SEQ ID NO: 712527 - DNA, 22 bp, Artificial Sequence
  chemically synthesized
ttaacacataaagaaactaagg

SEQ ID NO: 712528 - DNA, 22 bp, Artificial Sequence
  chemically synthesized
tattaacacataaagaaactaa

SEQ ID NO: 712529 - DNA, 22 bp, Artificial Sequence
  chemically synthesized
ctattaacacataaagaaacta

SEQ ID NO: 712530 - DNA, 22 bp, Artificial Sequence
  chemically synthesized
tgaaccttagtttctttatgtg

SEQ ID NO: 712531 - DNA, 22 bp, Artificial Sequence
  chemically synthesized
tgtggtatttctattaacacat

SEQ ID NO: 712532 - DNA, 22 bp, Artificial Sequence
  chemically synthesized
agtttctttatgtgttaataga

SEQ ID NO: 712533 - DNA, 22 bp, Artificial Sequence
  chemically synthesized
ttatgtggtatttctattaaca

SEQ ID NO: 712534 - DNA, 22 bp, Artificial Sequence
  chemically synthesized
gtttctttatgtgttaatagaa

SEQ ID NO: 712535 - DNA, 22 bp, Artificial Sequence
  chemically synthesized
ctttatgtgttaatagaaatac

SEQ ID NO: 712536 - DNA, 22 bp, Artificial Sequence
  chemically synthesized
tttatgtgttaatagaaatacc

SEQ ID NO: 712537 - DNA, 22 bp, Artificial Sequence
  chemically synthesized
tatgtgttaatagaaataccac

SEQ ID NO: 712538 - DNA, 22 bp, Artificial Sequence
  chemically synthesized
atgtgttaatagaaataccaca

SEQ ID NO: 712539 - DNA, 22 bp, Artificial Sequence
  chemically synthesized
gtagtgttgttatgtggtattt

SEQ ID NO: 712540 - DNA, 22 bp, Artificial Sequence
  chemically synthesized
tgtgttaatagaaataccacat

SEQ ID NO: 712541 - DNA, 22 bp, Artificial Sequence
  chemically synthesized
ttggtagtgttgttatgtggta

SEQ ID NO: 712542 - DNA, 22 bp, Artificial Sequence
  chemically synthesized
atagaaataccacataacaaca

SEQ ID NO: 712543 - DNA, 22 bp, Artificial Sequence
  chemically synthesized
tcattgttggtagtgttgttat

SEQ ID NO: 712544 - DNA, 22 bp, Artificial Sequence
  chemically synthesized
ctgtcattgttggtagtgttgt

SEQ ID NO: 712545 - DNA, 22 bp, Artificial Sequence
  chemically synthesized
ttactgtcattgttggtagtgt

SEQ ID NO: 712546 - DNA, 22 bp, Artificial Sequence
  chemically synthesized
ttattactgtcattgttggtag

SEQ ID NO: 712547 - DNA, 22 bp, Artificial Sequence
  chemically synthesized
ctattattactgtcattgttgg

SEQ ID NO: 712548 - DNA, 22 bp, Artificial Sequence
  chemically synthesized
gctattattactgtcattgttg

SEQ ID NO: 712549 - DNA, 22 bp, Artificial Sequence
  chemically synthesized
taaatgtttgctattattactg

SEQ ID NO: 712550 - DNA, 22 bp, Artificial Sequence
  chemically synthesized
ccaacaatgacagtaataatag

SEQ ID NO: 712551 - DNA, 22 bp, Artificial Sequence
  chemically synthesized
tataaatgtttgctattattac

SEQ ID NO: 712552 - DNA, 22 bp, Artificial Sequence
  chemically synthesized
ggatatagtaaatgctctataa

SEQ ID NO: 712553 - DNA, 22 bp, Artificial Sequence
  chemically synthesized
gggatatagtaaatgctctata

SEQ ID NO: 712554 - DNA, 22 bp, Artificial Sequence
  chemically synthesized
aaatagcacttgggatatagta

SEQ ID NO: 712555 - DNA, 22 bp, Artificial Sequence
  chemically synthesized
gaaatagcacttgggatatagt

SEQ ID NO: 712556 - DNA, 22 bp, Artificial Sequence
  chemically synthesized
atagagcatttactatatccca

SEQ ID NO: 712557 - DNA, 22 bp, Artificial Sequence
  chemically synthesized
tagagcatttactatatcccaa

SEQ ID NO: 712558 - DNA, 22 bp, Artificial Sequence
  chemically synthesized
ttgaaatagcacttgggatata

SEQ ID NO: 712559 - DNA, 22 bp, Artificial Sequence
  chemically synthesized
taatgctcttgaaatagcactt

SEQ ID NO: 712560 - DNA, 22 bp, Artificial Sequence
  chemically synthesized
actatatcccaagtgctatttc

SEQ ID NO: 712561 - DNA, 22 bp, Artificial Sequence
  chemically synthesized
ctatatcccaagtgctatttca

SEQ ID NO: 712562 - DNA, 22 bp, Artificial Sequence
  chemically synthesized
tatcccaagtgctatttcaaga

SEQ ID NO: 712563 - DNA, 22 bp, Artificial Sequence
  chemically synthesized
tttcaagagcattataggtata

SEQ ID NO: 712564 - DNA, 22 bp, Artificial Sequence
  chemically synthesized
caagagcattataggtatattt

SEQ ID NO: 712565 - DNA, 22 bp, Artificial Sequence
  chemically synthesized
aagagcattataggtatatttc

SEQ ID NO: 712566 - DNA, 22 bp, Artificial Sequence
  chemically synthesized
ataagaaagacataaatgaaat

SEQ ID NO: 712567 - DNA, 22 bp, Artificial Sequence
  chemically synthesized
tgataagaaagacataaatgaa

SEQ ID NO: 712568 - DNA, 22 bp, Artificial Sequence
  chemically synthesized
ctgataagaaagacataaatga

SEQ ID NO: 712569 - DNA, 22 bp, Artificial Sequence
  chemically synthesized
taggtatatttcatttatgtct

SEQ ID NO: 712570 - DNA, 22 bp, Artificial Sequence
  chemically synthesized
ccttctgataagaaagacataa

SEQ ID NO: 712571 - DNA, 22 bp, Artificial Sequence
  chemically synthesized
accttctgataagaaagacata

SEQ ID NO: 712572 - DNA, 22 bp, Artificial Sequence
  chemically synthesized
catttatgtctttcttatcaga

SEQ ID NO: 712573 - DNA, 22 bp, Artificial Sequence
  chemically synthesized
atttatgtctttcttatcagaa

SEQ ID NO: 712574 - DNA, 22 bp, Artificial Sequence
  chemically synthesized
atcaaatttaccttctgataag

SEQ ID NO: 712575 - DNA, 22 bp, Artificial Sequence
  chemically synthesized
atgtctttcttatcagaaggta

SEQ ID NO: 712576 - DNA, 22 bp, Artificial Sequence
  chemically synthesized
tgtctttcttatcagaaggtaa

SEQ ID NO: 712577 - DNA, 22 bp, Artificial Sequence
  chemically synthesized
ccctcatcaaatttaccttctg

SEQ ID NO: 712578 - DNA, 22 bp, Artificial Sequence
  chemically synthesized
tcttatcagaaggtaaatttga

SEQ ID NO: 712579 - DNA, 22 bp, Artificial Sequence
  chemically synthesized
cttatcagaaggtaaatttgat

SEQ ID NO: 712580 - DNA, 22 bp, Artificial Sequence
  chemically synthesized
agtcctgccctcatcaaattta

SEQ ID NO: 712581 - DNA, 22 bp, Artificial Sequence
  chemically synthesized
ttatcagaaggtaaatttgatg

SEQ ID NO: 712582 - DNA, 22 bp, Artificial Sequence
  chemically synthesized
atcagaaggtaaatttgatgag

SEQ ID NO: 712583 - DNA, 22 bp, Artificial Sequence
  chemically synthesized
tcagaaggtaaatttgatgagg

SEQ ID NO: 712584 - DNA, 22 bp, Artificial Sequence
  chemically synthesized
gatgagggcaggactcaatcta

SEQ ID NO: 712585 - DNA, 22 bp, Artificial Sequence
  chemically synthesized
atgagggcaggactcaatctat

SEQ ID NO: 712586 - DNA, 22 bp, Artificial Sequence
  chemically synthesized
ggggtacagtaatgaataaaat

SEQ ID NO: 712587 - DNA, 22 bp, Artificial Sequence
  chemically synthesized
aatctattttattcattactgt

SEQ ID NO: 712588 - DNA, 22 bp, Artificial Sequence
  chemically synthesized
ggtcctgggggtacagtaatga

SEQ ID NO: 712589 - DNA, 22 bp, Artificial Sequence
  chemically synthesized
acctgggtcctgggggtacagt

SEQ ID NO: 712590 - DNA, 22 bp, Artificial Sequence
  chemically synthesized
ttttattcattactgtaccccc

SEQ ID NO: 712591 - DNA, 22 bp, Artificial Sequence
  chemically synthesized
tattcattactgtacccccagg

SEQ ID NO: 712592 - DNA, 22 bp, Artificial Sequence
  chemically synthesized
attcattactgtacccccagga

SEQ ID NO: 712593 - DNA, 22 bp, Artificial Sequence
  chemically synthesized
ttcattactgtacccccaggac

SEQ ID NO: 712594 - DNA, 22 bp, Artificial Sequence
  chemically synthesized
attactgtacccccaggaccca

SEQ ID NO: 712595 - DNA, 22 bp, Artificial Sequence
  chemically synthesized
ctgtacccccaggacccaggtc

SEQ ID NO: 712596 - DNA, 22 bp, Artificial Sequence
  chemically synthesized
tgagacaggcactgacctgggt

SEQ ID NO: 712597 - DNA, 22 bp, Artificial Sequence
  chemically synthesized
tacccccaggacccaggtcagt

SEQ ID NO: 712598 - DNA, 22 bp, Artificial Sequence
  chemically synthesized
ctatgagacaggcactgacctg

SEQ ID NO: 712599 - DNA, 22 bp, Artificial Sequence
  chemically synthesized
ggtacctactatgagacaggca

SEQ ID NO: 712600 - DNA, 22 bp, Artificial Sequence
  chemically synthesized
gttaggtacctactatgagaca

SEQ ID NO: 712601 - DNA, 22 bp, Artificial Sequence
  chemically synthesized
aagtagttagttaggtacctac

SEQ ID NO: 712602 - DNA, 22 bp, Artificial Sequence
  chemically synthesized
caagtagttagttaggtaccta

SEQ ID NO: 712603 - DNA, 22 bp, Artificial Sequence
  chemically synthesized
tcaagtagttagttaggtacct

SEQ ID NO: 712604 - DNA, 22 bp, Artificial Sequence
  chemically synthesized
tttcaagtagttagttaggtac

SEQ ID NO: 712605 - DNA, 22 bp, Artificial Sequence
  chemically synthesized
tctcatagtaggtacctaacta

SEQ ID NO: 712606 - DNA, 22 bp, Artificial Sequence
  chemically synthesized
attctttcaagtagttagttag

SEQ ID NO: 712607 - DNA, 22 bp, Artificial Sequence
  chemically synthesized
atagtaggtacctaactaacta

SEQ ID NO: 712608 - DNA, 22 bp, Artificial Sequence
  chemically synthesized
atagtgatgttcattctttcaa

SEQ ID NO: 712609 - DNA, 22 bp, Artificial Sequence
  chemically synthesized
actaactacttgaaagaatgaa

SEQ ID NO: 712610 - DNA, 22 bp, Artificial Sequence
  chemically synthesized
ctcatagtgatgttcattcttt

SEQ ID NO: 712611 - DNA, 22 bp, Artificial Sequence
  chemically synthesized
cctcatagtgatgttcattctt

SEQ ID NO: 712612 - DNA, 22 bp, Artificial Sequence
  chemically synthesized
tcctcatagtgatgttcattct

SEQ ID NO: 712613 - DNA, 22 bp, Artificial Sequence
  chemically synthesized
actacttgaaagaatgaacatc

SEQ ID NO: 712614 - DNA, 22 bp, Artificial Sequence
  chemically synthesized
cttgaaagaatgaacatcacta

SEQ ID NO: 712615 - DNA, 22 bp, Artificial Sequence
  chemically synthesized
gaaagaatgaacatcactatga

SEQ ID NO: 712616 - DNA, 22 bp, Artificial Sequence
  chemically synthesized
aaagaatgaacatcactatgag

SEQ ID NO: 712617 - DNA, 22 bp, Artificial Sequence
  chemically synthesized
tggtgtactttcctcatagtga

SEQ ID NO: 712618 - DNA, 22 bp, Artificial Sequence
  chemically synthesized
taaaatggtcactatggtgtac

SEQ ID NO: 712619 - DNA, 22 bp, Artificial Sequence
  chemically synthesized
tgaggaaagtacaccatagtga

SEQ ID NO: 712620 - DNA, 22 bp, Artificial Sequence
  chemically synthesized
atctgtaaaatggtcactatgg

SEQ ID NO: 712621 - DNA, 22 bp, Artificial Sequence
  chemically synthesized
ctcatctgtaaaatggtcacta

SEQ ID NO: 712622 - DNA, 22 bp, Artificial Sequence
  chemically synthesized
cctcatctgtaaaatggtcact

SEQ ID NO: 712623 - DNA, 22 bp, Artificial Sequence
  chemically synthesized
catttcctcatctgtaaaatgg

SEQ ID NO: 712624 - DNA, 22 bp, Artificial Sequence
  chemically synthesized
tgcctccatttcctcatctgta

SEQ ID NO: 712625 - DNA, 22 bp, Artificial Sequence
  chemically synthesized
tgtgcctccatttcctcatctg

SEQ ID NO: 712626 - DNA, 22 bp, Artificial Sequence
  chemically synthesized
tctgtgcctccatttcctcatc

SEQ ID NO: 712627 - DNA, 22 bp, Artificial Sequence
  chemically synthesized
attctctgtgcctccatttcct

SEQ ID NO: 712628 - DNA, 22 bp, Artificial Sequence
  chemically synthesized
tacagatgaggaaatggaggca

SEQ ID NO: 712629 - DNA, 22 bp, Artificial Sequence
  chemically synthesized
acagatgaggaaatggaggcac

SEQ ID NO: 712630 - DNA, 22 bp, Artificial Sequence
  chemically synthesized
cagatgaggaaatggaggcaca

SEQ ID NO: 712631 - DNA, 22 bp, Artificial Sequence
  chemically synthesized
caacatctcattctctgtgcct

SEQ ID NO: 712632 - DNA, 22 bp, Artificial Sequence
  chemically synthesized
tgcacattacaacatctcattc

SEQ ID NO: 712633 - DNA, 22 bp, Artificial Sequence
  chemically synthesized
caactgtgcacattacaacatc

SEQ ID NO: 712634 - DNA, 22 bp, Artificial Sequence
  chemically synthesized
tccaactgtgcacattacaaca

SEQ ID NO: 712635 - DNA, 22 bp, Artificial Sequence
  chemically synthesized
taatgtgcacagttggagagac

SEQ ID NO: 712636 - DNA, 22 bp, Artificial Sequence
  chemically synthesized
gagagaccactttctggcactc

SEQ ID NO: 712637 - DNA, 22 bp, Artificial Sequence
  chemically synthesized
tcagaaaaatgagtacataccg

SEQ ID NO: 712638 - DNA, 22 bp, Artificial Sequence
  chemically synthesized
tctggcactcggtatgtactca

SEQ ID NO: 712639 - DNA, 22 bp, Artificial Sequence
  chemically synthesized
ctggcactcggtatgtactcat

SEQ ID NO: 712640 - DNA, 22 bp, Artificial Sequence
  chemically synthesized
tggcactcggtatgtactcatt

SEQ ID NO: 712641 - DNA, 22 bp, Artificial Sequence
  chemically synthesized
cagttatcagaaaaatgagtac

SEQ ID NO: 712642 - DNA, 22 bp, Artificial Sequence
  chemically synthesized
gcactcggtatgtactcatttt

SEQ ID NO: 712643 - DNA, 22 bp, Artificial Sequence
  chemically synthesized
gcagttatcagaaaaatgagta

SEQ ID NO: 712644 - DNA, 22 bp, Artificial Sequence
  chemically synthesized
ggtatgtactcatttttctgat

SEQ ID NO: 712645 - DNA, 22 bp, Artificial Sequence
  chemically synthesized
gcaatttgcagttatcagaaaa

SEQ ID NO: 712646 - DNA, 22 bp, Artificial Sequence
  chemically synthesized
tagcaatttgcagttatcagaa

SEQ ID NO: 712647 - DNA, 22 bp, Artificial Sequence
  chemically synthesized
ttctagcaatttgcagttatca

SEQ ID NO: 712648 - DNA, 22 bp, Artificial Sequence
  chemically synthesized
gttctagcaatttgcagttatc

SEQ ID NO: 712649 - DNA, 22 bp, Artificial Sequence
  chemically synthesized
atttttctgataactgcaaatt

SEQ ID NO: 712650 - DNA, 22 bp, Artificial Sequence
  chemically synthesized
ggcttgttctagcaatttgcag

SEQ ID NO: 712651 - DNA, 22 bp, Artificial Sequence
  chemically synthesized
aggcttgttctagcaatttgca

SEQ ID NO: 712652 - DNA, 22 bp, Artificial Sequence
  chemically synthesized
ttctgataactgcaaattgcta

SEQ ID NO: 712653 - DNA, 22 bp, Artificial Sequence
  chemically synthesized
tctgataactgcaaattgctag

SEQ ID NO: 712654 - DNA, 22 bp, Artificial Sequence
  chemically synthesized
tttaggcttgttctagcaattt

SEQ ID NO: 712655 - DNA, 22 bp, Artificial Sequence
  chemically synthesized
ctgataactgcaaattgctaga

SEQ ID NO: 712656 - DNA, 22 bp, Artificial Sequence
  chemically synthesized
tgataactgcaaattgctagaa

SEQ ID NO: 712657 - DNA, 22 bp, Artificial Sequence
  chemically synthesized
ataactgcaaattgctagaaca

SEQ ID NO: 712658 - DNA, 22 bp, Artificial Sequence
  chemically synthesized
caaattgctagaacaagcctaa

SEQ ID NO: 712659 - DNA, 22 bp, Artificial Sequence
  chemically synthesized
taacccccatagctgtttaggc

SEQ ID NO: 712660 - DNA, 22 bp, Artificial Sequence
  chemically synthesized
tgtaacccccatagctgtttag

SEQ ID NO: 712661 - DNA, 22 bp, Artificial Sequence
  chemically synthesized
ctagaacaagcctaaacagcta

SEQ ID NO: 712662 - DNA, 22 bp, Artificial Sequence
  chemically synthesized
gaacaagcctaaacagctatgg

SEQ ID NO: 712663 - DNA, 22 bp, Artificial Sequence
  chemically synthesized
atccagatactctgtaaccccc

SEQ ID NO: 712664 - DNA, 22 bp, Artificial Sequence
  chemically synthesized
catccagatactctgtaacccc

SEQ ID NO: 712665 - DNA, 22 bp, Artificial Sequence
  chemically synthesized
aacagctatgggggttacagag

SEQ ID NO: 712666 - DNA, 22 bp, Artificial Sequence
  chemically synthesized
atttcatccagatactctgtaa

SEQ ID NO: 712667 - DNA, 22 bp, Artificial Sequence
  chemically synthesized
attaatttcatccagatactct

SEQ ID NO: 712668 - DNA, 22 bp, Artificial Sequence
  chemically synthesized
cattaatttcatccagatactc

SEQ ID NO: 712669 - DNA, 22 bp, Artificial Sequence
  chemically synthesized
tgggggttacagagtatctgga

SEQ ID NO: 712670 - DNA, 22 bp, Artificial Sequence
  chemically synthesized
cttcattaatttcatccagata

SEQ ID NO: 712671 - DNA, 22 bp, Artificial Sequence
  chemically synthesized
cagagtatctggatgaaattaa

SEQ ID NO: 712672 - DNA, 22 bp, Artificial Sequence
  chemically synthesized
aaagcaacctccttcattaatt

SEQ ID NO: 712673 - DNA, 22 bp, Artificial Sequence
  chemically synthesized
caaagcaacctccttcattaat

SEQ ID NO: 712674 - DNA, 22 bp, Artificial Sequence
  chemically synthesized
gatgaaattaatgaaggaggtt

SEQ ID NO: 712675 - DNA, 22 bp, Artificial Sequence
  chemically synthesized
tgaaggcccagtttcaaagcaa

SEQ ID NO: 712676 - DNA, 22 bp, Artificial Sequence
  chemically synthesized
atgaaggaggttgctttgaaac

SEQ ID NO: 712677 - DNA, 22 bp, Artificial Sequence
  chemically synthesized
cccaattgtgaaggcccagttt

SEQ ID NO: 712678 - DNA, 22 bp, Artificial Sequence
  chemically synthesized
acccaattgtgaaggcccagtt

SEQ ID NO: 712679 - DNA, 22 bp, Artificial Sequence
  chemically synthesized
ctttgaaactgggccttcacaa

SEQ ID NO: 712680 - DNA, 22 bp, Artificial Sequence
  chemically synthesized
tgaaactgggccttcacaattg

SEQ ID NO: 712681 - DNA, 22 bp, Artificial Sequence
  chemically synthesized
gaaactgggccttcacaattgg

SEQ ID NO: 712682 - DNA, 22 bp, Artificial Sequence
  chemically synthesized
aaactgggccttcacaattggg

SEQ ID NO: 712683 - DNA, 22 bp, Artificial Sequence
  chemically synthesized
cccatcaaaagcttacccaatt

SEQ ID NO: 712684 - DNA, 22 bp, Artificial Sequence
  chemically synthesized
gcccatcaaaagcttacccaat

SEQ ID NO: 712685 - DNA, 22 bp, Artificial Sequence
  chemically synthesized
tgcccatcaaaagcttacccaa

SEQ ID NO: 712686 - DNA, 22 bp, Artificial Sequence
  chemically synthesized
ggccttcacaattgggtaagct

SEQ ID NO: 712687 - DNA, 22 bp, Artificial Sequence
  chemically synthesized
ttgcccatcaaaagcttaccca

SEQ ID NO: 712688 - DNA, 22 bp, Artificial Sequence
  chemically synthesized
tttttgcccatcaaaagcttac

SEQ ID NO: 712689 - DNA, 22 bp, Artificial Sequence
  chemically synthesized
tgtttttgcccatcaaaagctt

SEQ ID NO: 712690 - DNA, 22 bp, Artificial Sequence
  chemically synthesized
cacaattgggtaagcttttgat

SEQ ID NO: 712691 - DNA, 22 bp, Artificial Sequence
  chemically synthesized
ctgtttttgcccatcaaaagct

SEQ ID NO: 712692 - DNA, 22 bp, Artificial Sequence
  chemically synthesized
acaattgggtaagcttttgatg

SEQ ID NO: 712693 - DNA, 22 bp, Artificial Sequence
  chemically synthesized
ttctgtttttgcccatcaaaag

SEQ ID NO: 712694 - DNA, 22 bp, Artificial Sequence
  chemically synthesized
cttctgtttttgcccatcaaaa

SEQ ID NO: 712695 - DNA, 22 bp, Artificial Sequence
  chemically synthesized
ggtaagcttttgatgggcaaaa

SEQ ID NO: 712696 - DNA, 22 bp, Artificial Sequence
  chemically synthesized
ttgatgggcaaaaacagaagaa

SEQ ID NO: 712697 - DNA, 22 bp, Artificial Sequence
  chemically synthesized
tgatgggcaaaaacagaagaaa

SEQ ID NO: 712698 - DNA, 22 bp, Artificial Sequence
  chemically synthesized
tcacccagagtgtttcttctgt

SEQ ID NO: 712699 - DNA, 22 bp, Artificial Sequence
  chemically synthesized
gatgggcaaaaacagaagaaac

SEQ ID NO: 712700 - DNA, 22 bp, Artificial Sequence
  chemically synthesized
gtcacccagagtgtttcttctg

SEQ ID NO: 712701 - DNA, 22 bp, Artificial Sequence
  chemically synthesized
atgggcaaaaacagaagaaaca

SEQ ID NO: 712702 - DNA, 22 bp, Artificial Sequence
  chemically synthesized
ttgtcacccagagtgtttcttc

SEQ ID NO: 712703 - DNA, 22 bp, Artificial Sequence
  chemically synthesized
ctcttgtcacccagagtgtttc

SEQ ID NO: 712704 - DNA, 22 bp, Artificial Sequence
  chemically synthesized
tactcttgtcacccagagtgtt

SEQ ID NO: 712705 - DNA, 22 bp, Artificial Sequence
  chemically synthesized
attctactcttgtcacccagag

SEQ ID NO: 712706 - DNA, 22 bp, Artificial Sequence
  chemically synthesized
ctcattctactcttgtcaccca

SEQ ID NO: 712707 - DNA, 22 bp, Artificial Sequence
  chemically synthesized
tgggtgacaagagtagaatgag

SEQ ID NO: 712708 - DNA, 22 bp, Artificial Sequence
  chemically synthesized
ggtgacaagagtagaatgagca

SEQ ID NO: 712709 - DNA, 22 bp, Artificial Sequence
  chemically synthesized
gtgccaaaaaaaaaaaaattgc

SEQ ID NO: 712710 - DNA, 22 bp, Artificial Sequence
  chemically synthesized
ctagtgccaaaaaaaaaaaaat

SEQ ID NO: 712711 - DNA, 22 bp, Artificial Sequence
  chemically synthesized
actagtgccaaaaaaaaaaaaa

SEQ ID NO: 712712 - DNA, 22 bp, Artificial Sequence
  chemically synthesized
tactagtgccaaaaaaaaaaaa

SEQ ID NO: 712713 - DNA, 22 bp, Artificial Sequence
  chemically synthesized
atatccgggcctttactagtgc

SEQ ID NO: 712714 - DNA, 22 bp, Artificial Sequence
  chemically synthesized
ttttttttttggcactagtaaa

SEQ ID NO: 712715 - DNA, 22 bp, Artificial Sequence
  chemically synthesized
catatccgggcctttactagtg

SEQ ID NO: 712716 - DNA, 22 bp, Artificial Sequence
  chemically synthesized
tttttttttggcactagtaaag

SEQ ID NO: 712717 - DNA, 22 bp, Artificial Sequence
  chemically synthesized
ttttttttggcactagtaaagg

SEQ ID NO: 712718 - DNA, 22 bp, Artificial Sequence
  chemically synthesized
tttttttggcactagtaaaggc

SEQ ID NO: 712719 - DNA, 22 bp, Artificial Sequence
  chemically synthesized
ttttttggcactagtaaaggcc

SEQ ID NO: 712720 - DNA, 22 bp, Artificial Sequence
  chemically synthesized
tttttggcactagtaaaggccc

SEQ ID NO: 712721 - DNA, 22 bp, Artificial Sequence
  chemically synthesized
tccttcatatccgggcctttac

SEQ ID NO: 712722 - DNA, 22 bp, Artificial Sequence
  chemically synthesized
ttttggcactagtaaaggcccg

SEQ ID NO: 712723 - DNA, 22 bp, Artificial Sequence
  chemically synthesized
atccttcatatccgggccttta

SEQ ID NO: 712724 - DNA, 22 bp, Artificial Sequence
  chemically synthesized
tttggcactagtaaaggcccgg

SEQ ID NO: 712725 - DNA, 22 bp, Artificial Sequence
  chemically synthesized
ttggcactagtaaaggcccgga

SEQ ID NO: 712726 - DNA, 22 bp, Artificial Sequence
  chemically synthesized
tggcactagtaaaggcccggat

SEQ ID NO: 712727 - DNA, 22 bp, Artificial Sequence
  chemically synthesized
tttatccttcatatccgggcct

SEQ ID NO: 712728 - DNA, 22 bp, Artificial Sequence
  chemically synthesized
ggcactagtaaaggcccggata

SEQ ID NO: 712729 - DNA, 22 bp, Artificial Sequence
  chemically synthesized
gcactagtaaaggcccggatat

SEQ ID NO: 712730 - DNA, 22 bp, Artificial Sequence
  chemically synthesized
tgtttatccttcatatccgggc

SEQ ID NO: 712731 - DNA, 22 bp, Artificial Sequence
  chemically synthesized
ctgtttatccttcatatccggg

SEQ ID NO: 712732 - DNA, 22 bp, Artificial Sequence
  chemically synthesized
tctgtttatccttcatatccgg

SEQ ID NO: 712733 - DNA, 22 bp, Artificial Sequence
  chemically synthesized
ttctgtttatccttcatatccg

SEQ ID NO: 712734 - DNA, 22 bp, Artificial Sequence
  chemically synthesized
tttctgtttatccttcatatcc

SEQ ID NO: 712735 - DNA, 22 bp, Artificial Sequence
  chemically synthesized
gtaaaggcccggatatgaagga

SEQ ID NO: 712736 - DNA, 22 bp, Artificial Sequence
  chemically synthesized
tttttctgtttatccttcatat

SEQ ID NO: 712737 - DNA, 22 bp, Artificial Sequence
  chemically synthesized
aactctttttctgtttatcctt

SEQ ID NO: 712738 - DNA, 22 bp, Artificial Sequence
  chemically synthesized
ttcaactctttttctgtttatc

SEQ ID NO: 712739 - DNA, 22 bp, Artificial Sequence
  chemically synthesized
tattattcaactctttttctgt

SEQ ID NO: 712740 - DNA, 22 bp, Artificial Sequence
  chemically synthesized
gtattattcaactctttttctg

SEQ ID NO: 712741 - DNA, 22 bp, Artificial Sequence
  chemically synthesized
gccttgtattattcaactcttt

SEQ ID NO: 712742 - DNA, 22 bp, Artificial Sequence
  chemically synthesized
tagccttgtattattcaactct

SEQ ID NO: 712743 - DNA, 22 bp, Artificial Sequence
  chemically synthesized
ctagccttgtattattcaactc

SEQ ID NO: 712744 - DNA, 22 bp, Artificial Sequence
  chemically synthesized
catttctagccttgtattattc

SEQ ID NO: 712745 - DNA, 22 bp, Artificial Sequence
  chemically synthesized
caagctacatttctagccttgt

SEQ ID NO: 712746 - DNA, 22 bp, Artificial Sequence
  chemically synthesized
actccaagctacatttctagcc

SEQ ID NO: 712747 - DNA, 22 bp, Artificial Sequence
  chemically synthesized
gactccaagctacatttctagc

SEQ ID NO: 712748 - DNA, 22 bp, Artificial Sequence
  chemically synthesized
aataatacaaggctagaaatgt

SEQ ID NO: 712749 - DNA, 22 bp, Artificial Sequence
  chemically synthesized
gtttgactccaagctacatttc

SEQ ID NO: 712750 - DNA, 22 bp, Artificial Sequence
  chemically synthesized
tggtttgactccaagctacatt

SEQ ID NO: 712751 - DNA, 22 bp, Artificial Sequence
  chemically synthesized
gaaatgtagcttggagtcaaac

SEQ ID NO: 712752 - DNA, 22 bp, Artificial Sequence
  chemically synthesized
acagtcaagtacagctctggtt

SEQ ID NO: 712753 - DNA, 22 bp, Artificial Sequence
  chemically synthesized
ggagtcaaaccagagctgtact

SEQ ID NO: 712754 - DNA, 22 bp, Artificial Sequence
  chemically synthesized
gagtcaaaccagagctgtactt

SEQ ID NO: 712755 - DNA, 22 bp, Artificial Sequence
  chemically synthesized
aacctgacagtcaagtacagct

SEQ ID NO: 712756 - DNA, 22 bp, Artificial Sequence
  chemically synthesized
aaacctgacagtcaagtacagc

SEQ ID NO: 712757 - DNA, 22 bp, Artificial Sequence
  chemically synthesized
ttaaacctgacagtcaagtaca

SEQ ID NO: 712758 - DNA, 22 bp, Artificial Sequence
  chemically synthesized
ttcttaaacctgacagtcaagt

SEQ ID NO: 712759 - DNA, 22 bp, Artificial Sequence
  chemically synthesized
tattcttaaacctgacagtcaa

SEQ ID NO: 712760 - DNA, 22 bp, Artificial Sequence
  chemically synthesized
tacttgactgtcaggtttaaga

SEQ ID NO: 712761 - DNA, 22 bp, Artificial Sequence
  chemically synthesized
aatgaagtctctattcttaaac

SEQ ID NO: 712762 - DNA, 22 bp, Artificial Sequence
  chemically synthesized
gactgtcaggtttaagaataga

SEQ ID NO: 712763 - DNA, 22 bp, Artificial Sequence
  chemically synthesized
actgtcaggtttaagaatagag

SEQ ID NO: 712764 - DNA, 22 bp, Artificial Sequence
  chemically synthesized
tcaggtttaagaatagagactt

SEQ ID NO: 712765 - DNA, 22 bp, Artificial Sequence
  chemically synthesized
ccatgaacaactaaatgaagtc

SEQ ID NO: 712766 - DNA, 22 bp, Artificial Sequence
  chemically synthesized
cccatgaacaactaaatgaagt

SEQ ID NO: 712767 - DNA, 22 bp, Artificial Sequence
  chemically synthesized
aagaatagagacttcatttagt

SEQ ID NO: 712768 - DNA, 22 bp, Artificial Sequence
  chemically synthesized
agaatagagacttcatttagtt

SEQ ID NO: 712769 - DNA, 22 bp, Artificial Sequence
  chemically synthesized
aatgccttcccatgaacaacta

SEQ ID NO: 712770 - DNA, 22 bp, Artificial Sequence
  chemically synthesized
gaatgccttcccatgaacaact

SEQ ID NO: 712771 - DNA, 22 bp, Artificial Sequence
  chemically synthesized
catttagttgttcatgggaagg

SEQ ID NO: 712772 - DNA, 22 bp, Artificial Sequence
  chemically synthesized
atttagttgttcatgggaaggc

SEQ ID NO: 712773 - DNA, 22 bp, Artificial Sequence
  chemically synthesized
aaaaaatatttgaatgccttcc

SEQ ID NO: 712774 - DNA, 22 bp, Artificial Sequence
  chemically synthesized
agttgttcatgggaaggcattc

SEQ ID NO: 712775 - DNA, 22 bp, Artificial Sequence
  chemically synthesized
gttgttcatgggaaggcattca

SEQ ID NO: 712776 - DNA, 22 bp, Artificial Sequence
  chemically synthesized
ttaaaaaaatatttgaatgcct

SEQ ID NO: 712777 - DNA, 22 bp, Artificial Sequence
  chemically synthesized
ttcatgggaaggcattcaaata

SEQ ID NO: 712778 - DNA, 22 bp, Artificial Sequence
  chemically synthesized
atgggaaggcattcaaatattt

SEQ ID NO: 712779 - DNA, 22 bp, Artificial Sequence
  chemically synthesized
aaataattattaaaaaaatatt

SEQ ID NO: 712780 - DNA, 22 bp, Artificial Sequence
  chemically synthesized
aaaataattattaaaaaaatat

SEQ ID NO: 712781 - DNA, 22 bp, Artificial Sequence
  chemically synthesized
taaaataattattaaaaaaata

SEQ ID NO: 712782 - DNA, 22 bp, Artificial Sequence
  chemically synthesized
aaatatttttttaataattatt

SEQ ID NO: 712783 - DNA, 22 bp, Artificial Sequence
  chemically synthesized
aaagaaatacaattttaaaata

SEQ ID NO: 712784 - DNA, 22 bp, Artificial Sequence
  chemically synthesized
gaaagaaatacaattttaaaat

SEQ ID NO: 712785 - DNA, 22 bp, Artificial Sequence
  chemically synthesized
ttttaataattattttaaaatt

SEQ ID NO: 712786 - DNA, 22 bp, Artificial Sequence
  chemically synthesized
tttaataattattttaaaattg

SEQ ID NO: 712787 - DNA, 22 bp, Artificial Sequence
  chemically synthesized
ttaataattattttaaaattgt

SEQ ID NO: 712788 - DNA, 22 bp, Artificial Sequence
  chemically synthesized
taataattattttaaaattgta

SEQ ID NO: 712789 - DNA, 22 bp, Artificial Sequence
  chemically synthesized
aataattattttaaaattgtat

SEQ ID NO: 712790 - DNA, 22 bp, Artificial Sequence
  chemically synthesized
ataattattttaaaattgtatt

SEQ ID NO: 712791 - DNA, 22 bp, Artificial Sequence
  chemically synthesized
ttttaaaattgtatttctttca

SEQ ID NO: 712792 - DNA, 22 bp, Artificial Sequence
  chemically synthesized
taaaattgtatttctttcaaat

SEQ ID NO: 712793 - DNA, 22 bp, Artificial Sequence
  chemically synthesized
tcatgtgaatgcatttgaaaga

SEQ ID NO: 712794 - DNA, 22 bp, Artificial Sequence
  chemically synthesized
aaaattgtatttctttcaaatg

SEQ ID NO: 712795 - DNA, 22 bp, Artificial Sequence
  chemically synthesized
aaattgtatttctttcaaatgc

SEQ ID NO: 712796 - DNA, 22 bp, Artificial Sequence
  chemically synthesized
ttatcatgtgaatgcatttgaa

SEQ ID NO: 712797 - DNA, 22 bp, Artificial Sequence
  chemically synthesized
attatcatgtgaatgcatttga

SEQ ID NO: 712798 - DNA, 22 bp, Artificial Sequence
  chemically synthesized
tattatcatgtgaatgcatttg

SEQ ID NO: 712799 - DNA, 22 bp, Artificial Sequence
  chemically synthesized
tatttctttcaaatgcattcac

SEQ ID NO: 712800 - DNA, 22 bp, Artificial Sequence
  chemically synthesized
aattttattatcatgtgaatgc

SEQ ID NO: 712801 - DNA, 22 bp, Artificial Sequence
  chemically synthesized
gaattttattatcatgtgaatg

SEQ ID NO: 712802 - DNA, 22 bp, Artificial Sequence
  chemically synthesized
ctttcaaatgcattcacatgat

SEQ ID NO: 712803 - DNA, 22 bp, Artificial Sequence
  chemically synthesized
ttgaattttattatcatgtgaa

SEQ ID NO: 712804 - DNA, 22 bp, Artificial Sequence
  chemically synthesized
tttcaaatgcattcacatgata

SEQ ID NO: 712805 - DNA, 22 bp, Artificial Sequence
  chemically synthesized
cttgaattttattatcatgtga

SEQ ID NO: 712806 - DNA, 22 bp, Artificial Sequence
  chemically synthesized
tcttgaattttattatcatgtg

SEQ ID NO: 712807 - DNA, 22 bp, Artificial Sequence
  chemically synthesized
tcaaatgcattcacatgataat

SEQ ID NO: 712808 - DNA, 22 bp, Artificial Sequence
  chemically synthesized
ttcttgaattttattatcatgt

SEQ ID NO: 712809 - DNA, 22 bp, Artificial Sequence
  chemically synthesized
caaatgcattcacatgataata

SEQ ID NO: 712810 - DNA, 22 bp, Artificial Sequence
  chemically synthesized
aaatgcattcacatgataataa

SEQ ID NO: 712811 - DNA, 22 bp, Artificial Sequence
  chemically synthesized
tttttcttgaattttattatca

SEQ ID NO: 712812 - DNA, 22 bp, Artificial Sequence
  chemically synthesized
gtttttcttgaattttattatc

SEQ ID NO: 712813 - DNA, 22 bp, Artificial Sequence
  chemically synthesized
tgtttttcttgaattttattat

SEQ ID NO: 712814 - DNA, 22 bp, Artificial Sequence
  chemically synthesized
ttgtttttcttgaattttatta

SEQ ID NO: 712815 - DNA, 22 bp, Artificial Sequence
  chemically synthesized
tttgtttttcttgaattttatt

SEQ ID NO: 712816 - DNA, 22 bp, Artificial Sequence
  chemically synthesized
ttttgtttttcttgaattttat

SEQ ID NO: 712817 - DNA, 22 bp, Artificial Sequence
  chemically synthesized
tttttgtttttcttgaatttta

SEQ ID NO: 712818 - DNA, 22 bp, Artificial Sequence
  chemically synthesized
acatgataataaaattcaagaa

SEQ ID NO: 712819 - DNA, 22 bp, Artificial Sequence
  chemically synthesized
aataactttttttgtttttctt

SEQ ID NO: 712820 - DNA, 22 bp, Artificial Sequence
  chemically synthesized
aaataactttttttgtttttct

SEQ ID NO: 712821 - DNA, 22 bp, Artificial Sequence
  chemically synthesized
taaataactttttttgtttttc

SEQ ID NO: 712822 - DNA, 22 bp, Artificial Sequence
  chemically synthesized
ttaaataactttttttgttttt

SEQ ID NO: 712823 - DNA, 22 bp, Artificial Sequence
  chemically synthesized
atttttaaataactttttttgt

SEQ ID NO: 712824 - DNA, 22 bp, Artificial Sequence
  chemically synthesized
gatttttaaataactttttttg

SEQ ID NO: 712825 - DNA, 22 bp, Artificial Sequence
  chemically synthesized
aagaaaaacaaaaaaagttatt

SEQ ID NO: 712826 - DNA, 22 bp, Artificial Sequence
  chemically synthesized
tttaaaaatcaagtctctcttt

SEQ ID NO: 712827 - DNA, 22 bp, Artificial Sequence
  chemically synthesized
gagagacatggtgaaagagaga

SEQ ID NO: 712828 - DNA, 22 bp, Artificial Sequence
  chemically synthesized
aaaaatcaagtctctctttcac

SEQ ID NO: 712829 - DNA, 22 bp, Artificial Sequence
  chemically synthesized
aaaatcaagtctctctttcacc

SEQ ID NO: 712830 - DNA, 22 bp, Artificial Sequence
  chemically synthesized
tctttcaccatgtctctctagc

SEQ ID NO: 712831 - DNA, 22 bp, Artificial Sequence
  chemically synthesized
tttcaccatgtctctctagcca

SEQ ID NO: 712832 - DNA, 22 bp, Artificial Sequence
  chemically synthesized
tcaccatgtctctctagccatt

SEQ ID NO: 712833 - DNA, 22 bp, Artificial Sequence
  chemically synthesized
caccatgtctctctagccattt

SEQ ID NO: 712834 - DNA, 22 bp, Artificial Sequence
  chemically synthesized
accatgtctctctagccatttt

SEQ ID NO: 712835 - DNA, 22 bp, Artificial Sequence
  chemically synthesized
ccatcagggaatggggaagaaa

SEQ ID NO: 712836 - DNA, 22 bp, Artificial Sequence
  chemically synthesized
gccatcagggaatggggaagaa

SEQ ID NO: 712837 - DNA, 22 bp, Artificial Sequence
  chemically synthesized
tctagccattttcttccccatt

SEQ ID NO: 712838 - DNA, 22 bp, Artificial Sequence
  chemically synthesized
tagccattttcttccccattcc

SEQ ID NO: 712839 - DNA, 22 bp, Artificial Sequence
  chemically synthesized
gccattttcttccccattccct

SEQ ID NO: 712840 - DNA, 22 bp, Artificial Sequence
  chemically synthesized
tcttccccattccctgatggca

SEQ ID NO: 712841 - DNA, 22 bp, Artificial Sequence
  chemically synthesized
cttccccattccctgatggcaa

SEQ ID NO: 712842 - DNA, 22 bp, Artificial Sequence
  chemically synthesized
ttccccattccctgatggcaag

SEQ ID NO: 712843 - DNA, 22 bp, Artificial Sequence
  chemically synthesized
ccccattccctgatggcaagta

SEQ ID NO: 712844 - DNA, 22 bp, Artificial Sequence
  chemically synthesized
cccattccctgatggcaagtat

SEQ ID NO: 712845 - DNA, 22 bp, Artificial Sequence
  chemically synthesized
atgtagagtatggaaatacttg

SEQ ID NO: 712846 - DNA, 22 bp, Artificial Sequence
  chemically synthesized
cctgatggcaagtatttccata

SEQ ID NO: 712847 - DNA, 22 bp, Artificial Sequence
  chemically synthesized
atggcaagtatttccatactct

SEQ ID NO: 712848 - DNA, 22 bp, Artificial Sequence
  chemically synthesized
aaaaattaatgtagagtatgga

SEQ ID NO: 712849 - DNA, 22 bp, Artificial Sequence
  chemically synthesized
aaaaaattaatgtagagtatgg

SEQ ID NO: 712850 - DNA, 22 bp, Artificial Sequence
  chemically synthesized
cttaaaaaattaatgtagagta

SEQ ID NO: 712851 - DNA, 22 bp, Artificial Sequence
  chemically synthesized
acttaaaaaattaatgtagagt

SEQ ID NO: 712852 - DNA, 22 bp, Artificial Sequence
  chemically synthesized
ttacttaaaaaattaatgtaga

SEQ ID NO: 712853 - DNA, 22 bp, Artificial Sequence
  chemically synthesized
cttacttaaaaaattaatgtag

SEQ ID NO: 712854 - DNA, 22 bp, Artificial Sequence
  chemically synthesized
tcttacttaaaaaattaatgta

SEQ ID NO: 712855 - DNA, 22 bp, Artificial Sequence
  chemically synthesized
ttcttacttaaaaaattaatgt

SEQ ID NO: 712856 - DNA, 22 bp, Artificial Sequence
  chemically synthesized
ccatactctacattaatttttt

SEQ ID NO: 712857 - DNA, 22 bp, Artificial Sequence
  chemically synthesized
catactctacattaatttttta

SEQ ID NO: 712858 - DNA, 22 bp, Artificial Sequence
  chemically synthesized
tacattaattttttaagtaaga

SEQ ID NO: 712859 - DNA, 22 bp, Artificial Sequence
  chemically synthesized
cattaattttttaagtaagaaa

SEQ ID NO: 712860 - DNA, 22 bp, Artificial Sequence
  chemically synthesized
caccaacgtaatatttttctta

SEQ ID NO: 712861 - DNA, 22 bp, Artificial Sequence
  chemically synthesized
gcaccaacgtaatatttttctt

SEQ ID NO: 712862 - DNA, 22 bp, Artificial Sequence
  chemically synthesized
attttttaagtaagaaaaatat

SEQ ID NO: 712863 - DNA, 22 bp, Artificial Sequence
  chemically synthesized
tttaagtaagaaaaatattacg

SEQ ID NO: 712864 - DNA, 22 bp, Artificial Sequence
  chemically synthesized
ttaagtaagaaaaatattacgt

SEQ ID NO: 712865 - DNA, 22 bp, Artificial Sequence
  chemically synthesized
taagtaagaaaaatattacgtt

SEQ ID NO: 712866 - DNA, 22 bp, Artificial Sequence
  chemically synthesized
aagtaagaaaaatattacgttg

SEQ ID NO: 712867 - DNA, 22 bp, Artificial Sequence
  chemically synthesized
agtaagaaaaatattacgttgg

SEQ ID NO: 712868 - DNA, 22 bp, Artificial Sequence
  chemically synthesized
cgatcacatttgcaccaacgta

SEQ ID NO: 712869 - DNA, 22 bp, Artificial Sequence
  chemically synthesized
cgttggtgcaaatgtgatcgca

SEQ ID NO: 712870 - DNA, 22 bp, Artificial Sequence
  chemically synthesized
aatggcaaaaactgcgatcaca

SEQ ID NO: 712871 - DNA, 22 bp, Artificial Sequence
  chemically synthesized
caatggcaaaaactgcgatcac

SEQ ID NO: 712872 - DNA, 22 bp, Artificial Sequence
  chemically synthesized
gtgcaaatgtgatcgcagtttt

SEQ ID NO: 712873 - DNA, 22 bp, Artificial Sequence
  chemically synthesized
ccttcaatggcaaaaactgcga

SEQ ID NO: 712874 - DNA, 22 bp, Artificial Sequence
  chemically synthesized
ccattaccttcaatggcaaaaa

SEQ ID NO: 712875 - DNA, 22 bp, Artificial Sequence
  chemically synthesized
accattaccttcaatggcaaaa

SEQ ID NO: 712876 - DNA, 22 bp, Artificial Sequence
  chemically synthesized
taccattaccttcaatggcaaa

SEQ ID NO: 712877 - DNA, 22 bp, Artificial Sequence
  chemically synthesized
tggttttaccattaccttcaat

SEQ ID NO: 712878 - DNA, 22 bp, Artificial Sequence
  chemically synthesized
ttgccattgaaggtaatggtaa

SEQ ID NO: 712879 - DNA, 22 bp, Artificial Sequence
  chemically synthesized
tgccattgaaggtaatggtaaa

SEQ ID NO: 712880 - DNA, 22 bp, Artificial Sequence
  chemically synthesized
gccattgaaggtaatggtaaaa

SEQ ID NO: 712881 - DNA, 22 bp, Artificial Sequence
  chemically synthesized
ccattgaaggtaatggtaaaac

SEQ ID NO: 712882 - DNA, 22 bp, Artificial Sequence
  chemically synthesized
gtacataagtaattgtggtttt

SEQ ID NO: 712883 - DNA, 22 bp, Artificial Sequence
  chemically synthesized
aaggtaatggtaaaaccacaat

SEQ ID NO: 712884 - DNA, 22 bp, Artificial Sequence
  chemically synthesized
ggttggtacataagtaattgtg

SEQ ID NO: 712885 - DNA, 22 bp, Artificial Sequence
  chemically synthesized
aggttggtacataagtaattgt

SEQ ID NO: 712886 - DNA, 22 bp, Artificial Sequence
  chemically synthesized
acaatgatatttaggttggtac

SEQ ID NO: 712887 - DNA, 22 bp, Artificial Sequence
  chemically synthesized
tgacaatgatatttaggttggt

SEQ ID NO: 712888 - DNA, 22 bp, Artificial Sequence
  chemically synthesized
cttatgtaccaacctaaatatc

SEQ ID NO: 712889 - DNA, 22 bp, Artificial Sequence
  chemically synthesized
atgtaccaacctaaatatcatt

SEQ ID NO: 712890 - DNA, 22 bp, Artificial Sequence
  chemically synthesized
tgtaccaacctaaatatcattg

SEQ ID NO: 712891 - DNA, 22 bp, Artificial Sequence
  chemically synthesized
aaacaccattctgacaatgata

SEQ ID NO: 712892 - DNA, 22 bp, Artificial Sequence
  chemically synthesized
atcctaaaacaccattctgaca

SEQ ID NO: 712893 - DNA, 22 bp, Artificial Sequence
  chemically synthesized
aatatcattgtcagaatggtgt

SEQ ID NO: 712894 - DNA, 22 bp, Artificial Sequence
  chemically synthesized
attcatcctaaaacaccattct

SEQ ID NO: 712895 - DNA, 22 bp, Artificial Sequence
  chemically synthesized
cattcatcctaaaacaccattc

SEQ ID NO: 712896 - DNA, 22 bp, Artificial Sequence
  chemically synthesized
tcattcatcctaaaacaccatt

SEQ ID NO: 712897 - DNA, 22 bp, Artificial Sequence
  chemically synthesized
catgctttcattcatcctaaaa

SEQ ID NO: 712898 - DNA, 22 bp, Artificial Sequence
  chemically synthesized
tcagaatggtgttttaggatga

SEQ ID NO: 712899 - DNA, 22 bp, Artificial Sequence
  chemically synthesized
tccatgctttcattcatcctaa

SEQ ID NO: 712900 - DNA, 22 bp, Artificial Sequence
  chemically synthesized
ctccatgctttcattcatccta

SEQ ID NO: 712901 - DNA, 22 bp, Artificial Sequence
  chemically synthesized
tctccatgctttcattcatcct

SEQ ID NO: 712902 - DNA, 22 bp, Artificial Sequence
  chemically synthesized
gctttctccatgctttcattca

SEQ ID NO: 712903 - DNA, 22 bp, Artificial Sequence
  chemically synthesized
cgctttctccatgctttcattc

SEQ ID NO: 712904 - DNA, 22 bp, Artificial Sequence
  chemically synthesized
ttcgctttctccatgctttcat

SEQ ID NO: 712905 - DNA, 22 bp, Artificial Sequence
  chemically synthesized
tcttcgctttctccatgctttc

SEQ ID NO: 712906 - DNA, 22 bp, Artificial Sequence
  chemically synthesized
taggatgaatgaaagcatggag

SEQ ID NO: 712907 - DNA, 22 bp, Artificial Sequence
  chemically synthesized
aggatgaatgaaagcatggaga

SEQ ID NO: 712908 - DNA, 22 bp, Artificial Sequence
  chemically synthesized
ggatgaatgaaagcatggagaa

SEQ ID NO: 712909 - DNA, 22 bp, Artificial Sequence
  chemically synthesized
tcctctcttcgctttctccatg

SEQ ID NO: 712910 - DNA, 22 bp, Artificial Sequence
  chemically synthesized
atcctctcttcgctttctccat

SEQ ID NO: 712911 - DNA, 22 bp, Artificial Sequence
  chemically synthesized
gcagcttatcctctcttcgctt

SEQ ID NO: 712912 - DNA, 22 bp, Artificial Sequence
  chemically synthesized
tggcagcttatcctctcttcgc

SEQ ID NO: 712913 - DNA, 22 bp, Artificial Sequence
  chemically synthesized
ctggcagcttatcctctcttcg

SEQ ID NO: 712914 - DNA, 22 bp, Artificial Sequence
  chemically synthesized
gtttctggcagcttatcctctc

SEQ ID NO: 712915 - DNA, 22 bp, Artificial Sequence
  chemically synthesized
cgtttctggcagcttatcctct

SEQ ID NO: 712916 - DNA, 22 bp, Artificial Sequence
  chemically synthesized
tcgtttctggcagcttatcctc

SEQ ID NO: 712917 - DNA, 22 bp, Artificial Sequence
  chemically synthesized
ttttcgtttctggcagcttatc

SEQ ID NO: 712918 - DNA, 22 bp, Artificial Sequence
  chemically synthesized
gttttcgtttctggcagcttat

SEQ ID NO: 712919 - DNA, 22 bp, Artificial Sequence
  chemically synthesized
ttgttttcgtttctggcagctt

SEQ ID NO: 712920 - DNA, 22 bp, Artificial Sequence
  chemically synthesized
acacagaacatctcttgttttc

SEQ ID NO: 712921 - DNA, 22 bp, Artificial Sequence
  chemically synthesized
aacacagaacatctcttgtttt

SEQ ID NO: 712922 - DNA, 22 bp, Artificial Sequence
  chemically synthesized
ccagaaacgaaaacaagagatg

SEQ ID NO: 712923 - DNA, 22 bp, Artificial Sequence
  chemically synthesized
catttaacacagaacatctctt

SEQ ID NO: 712924 - DNA, 22 bp, Artificial Sequence
  chemically synthesized
ttacatttaacacagaacatct

SEQ ID NO: 712925 - DNA, 22 bp, Artificial Sequence
  chemically synthesized
atattgttacatttaacacaga

SEQ ID NO: 712926 - DNA, 22 bp, Artificial Sequence
  chemically synthesized
tgatattgttacatttaacaca

SEQ ID NO: 712927 - DNA, 22 bp, Artificial Sequence
  chemically synthesized
ctgatattgttacatttaacac

SEQ ID NO: 712928 - DNA, 22 bp, Artificial Sequence
  chemically synthesized
tctgatattgttacatttaaca

SEQ ID NO: 712929 - DNA, 22 bp, Artificial Sequence
  chemically synthesized
ctttctgatattgttacattta

SEQ ID NO: 712930 - DNA, 22 bp, Artificial Sequence
  chemically synthesized
agtctactttctgatattgtta

SEQ ID NO: 712931 - DNA, 22 bp, Artificial Sequence
  chemically synthesized
tgtgttaaatgtaacaatatca

SEQ ID NO: 712932 - DNA, 22 bp, Artificial Sequence
  chemically synthesized
gagtctactttctgatattgtt

SEQ ID NO: 712933 - DNA, 22 bp, Artificial Sequence
  chemically synthesized
tgttaaatgtaacaatatcaga

SEQ ID NO: 712934 - DNA, 22 bp, Artificial Sequence
  chemically synthesized
cttgagtctactttctgatatt

SEQ ID NO: 712935 - DNA, 22 bp, Artificial Sequence
  chemically synthesized
ccttgagtctactttctgatat

SEQ ID NO: 712936 - DNA, 22 bp, Artificial Sequence
  chemically synthesized
aatgtaacaatatcagaaagta

SEQ ID NO: 712937 - DNA, 22 bp, Artificial Sequence
  chemically synthesized
aggcttccttgagtctactttc

SEQ ID NO: 712938 - DNA, 22 bp, Artificial Sequence
  chemically synthesized
gggtgagagtctgaggcttcct

SEQ ID NO: 712939 - DNA, 22 bp, Artificial Sequence
  chemically synthesized
acctagggtgagagtctgaggc

SEQ ID NO: 712940 - DNA, 22 bp, Artificial Sequence
  chemically synthesized
ctcacctagggtgagagtctga

SEQ ID NO: 712941 - DNA, 22 bp, Artificial Sequence
  chemically synthesized
aaggaagcctcagactctcacc

SEQ ID NO: 712942 - DNA, 22 bp, Artificial Sequence
  chemically synthesized
ctcctcacctagggtgagagtc

SEQ ID NO: 712943 - DNA, 22 bp, Artificial Sequence
  chemically synthesized
tccatctcctcctcacctaggg

SEQ ID NO: 712944 - DNA, 22 bp, Artificial Sequence
  chemically synthesized
atccatctcctcctcacctagg

SEQ ID NO: 712945 - DNA, 22 bp, Artificial Sequence
  chemically synthesized
tatccatctcctcctcacctag

SEQ ID NO: 712946 - DNA, 22 bp, Artificial Sequence
  chemically synthesized
agactctcaccctaggtgagga

SEQ ID NO: 712947 - DNA, 22 bp, Artificial Sequence
  chemically synthesized
ttatccatctcctcctcaccta

SEQ ID NO: 712948 - DNA, 22 bp, Artificial Sequence
  chemically synthesized
atttttatccatctcctcctca

SEQ ID NO: 712949 - DNA, 22 bp, Artificial Sequence
  chemically synthesized
tcaccctaggtgaggaggagat

SEQ ID NO: 712950 - DNA, 22 bp, Artificial Sequence
  chemically synthesized
tgatttttatccatctcctcct

SEQ ID NO: 712951 - DNA, 22 bp, Artificial Sequence
  chemically synthesized
ctgatttttatccatctcctcc

SEQ ID NO: 712952 - DNA, 22 bp, Artificial Sequence
  chemically synthesized
accctaggtgaggaggagatgg

SEQ ID NO: 712953 - DNA, 22 bp, Artificial Sequence
  chemically synthesized
cttctgatttttatccatctcc

SEQ ID NO: 712954 - DNA, 22 bp, Artificial Sequence
  chemically synthesized
ggtgaggaggagatggataaaa

SEQ ID NO: 712955 - DNA, 22 bp, Artificial Sequence
  chemically synthesized
caacaaaccagtggttccttct

SEQ ID NO: 712956 - DNA, 22 bp, Artificial Sequence
  chemically synthesized
tgctgcaacaaaccagtggttc

SEQ ID NO: 712957 - DNA, 22 bp, Artificial Sequence
  chemically synthesized
catcaaactatgctgcaacaaa

SEQ ID NO: 712958 - DNA, 22 bp, Artificial Sequence
  chemically synthesized
ttacatcaaactatgctgcaac

SEQ ID NO: 712959 - DNA, 22 bp, Artificial Sequence
  chemically synthesized
ctattacatcaaactatgctgc

SEQ ID NO: 712960 - DNA, 22 bp, Artificial Sequence
  chemically synthesized
gctattacatcaaactatgctg

SEQ ID NO: 712961 - DNA, 22 bp, Artificial Sequence
  chemically synthesized
gtttgttgcagcatagtttgat

SEQ ID NO: 712962 - DNA, 22 bp, Artificial Sequence
  chemically synthesized
atttgctattacatcaaactat

SEQ ID NO: 712963 - DNA, 22 bp, Artificial Sequence
  chemically synthesized
ctgatttgctattacatcaaac

SEQ ID NO: 712964 - DNA, 22 bp, Artificial Sequence
  chemically synthesized
gttgcagcatagtttgatgtaa

SEQ ID NO: 712965 - DNA, 22 bp, Artificial Sequence
  chemically synthesized
actgatttgctattacatcaaa

SEQ ID NO: 712966 - DNA, 22 bp, Artificial Sequence
  chemically synthesized
ttgcagcatagtttgatgtaat

SEQ ID NO: 712967 - DNA, 22 bp, Artificial Sequence
  chemically synthesized
cagcatagtttgatgtaatagc

SEQ ID NO: 712968 - DNA, 22 bp, Artificial Sequence
  chemically synthesized
gatgtaatagcaaatcagtaaa

SEQ ID NO: 712969 - DNA, 22 bp, Artificial Sequence
  chemically synthesized
aaccgtccatgatttactgatt

SEQ ID NO: 712970 - DNA, 22 bp, Artificial Sequence
  chemically synthesized
atgtaatagcaaatcagtaaat

SEQ ID NO: 712971 - DNA, 22 bp, Artificial Sequence
  chemically synthesized
ttcaaccgtccatgatttactg

SEQ ID NO: 712972 - DNA, 22 bp, Artificial Sequence
  chemically synthesized
gttcaaccgtccatgatttact

SEQ ID NO: 712973 - DNA, 22 bp, Artificial Sequence
  chemically synthesized
tgttcaaccgtccatgatttac

SEQ ID NO: 712974 - DNA, 22 bp, Artificial Sequence
  chemically synthesized
cagtctttgttcaaccgtccat

SEQ ID NO: 712975 - DNA, 22 bp, Artificial Sequence
  chemically synthesized
ctccagtctttgttcaaccgtc

SEQ ID NO: 712976 - DNA, 22 bp, Artificial Sequence
  chemically synthesized
ccatcattcctccagtctttgt

SEQ ID NO: 712977 - DNA, 22 bp, Artificial Sequence
  chemically synthesized
cccatcattcctccagtctttg

SEQ ID NO: 712978 - DNA, 22 bp, Artificial Sequence
  chemically synthesized
tcccatcattcctccagtcttt

SEQ ID NO: 712979 - DNA, 22 bp, Artificial Sequence
  chemically synthesized
ataattttcccatcattcctcc

SEQ ID NO: 712980 - DNA, 22 bp, Artificial Sequence
  chemically synthesized
cataattttcccatcattcctc

SEQ ID NO: 712981 - DNA, 22 bp, Artificial Sequence
  chemically synthesized
aacaaagactggaggaatgatg

SEQ ID NO: 712982 - DNA, 22 bp, Artificial Sequence
  chemically synthesized
tcataattttcccatcattcct

SEQ ID NO: 712983 - DNA, 22 bp, Artificial Sequence
  chemically synthesized
ccacacctttcataattttccc

SEQ ID NO: 712984 - DNA, 22 bp, Artificial Sequence
  chemically synthesized
gaggaatgatgggaaaattatg

SEQ ID NO: 712985 - DNA, 22 bp, Artificial Sequence
  chemically synthesized
actgccacacctttcataattt

SEQ ID NO: 712986 - DNA, 22 bp, Artificial Sequence
  chemically synthesized
aggagaattcactgccacacct

SEQ ID NO: 712987 - DNA, 22 bp, Artificial Sequence
  chemically synthesized
aaggagaattcactgccacacc

SEQ ID NO: 712988 - DNA, 22 bp, Artificial Sequence
  chemically synthesized
taaggagaattcactgccacac

SEQ ID NO: 712989 - DNA, 22 bp, Artificial Sequence
  chemically synthesized
tgaaaggtgtggcagtgaattc

SEQ ID NO: 712990 - DNA, 22 bp, Artificial Sequence
  chemically synthesized
tccttaaagcccctcttatcat

SEQ ID NO: 712991 - DNA, 22 bp, Artificial Sequence
  chemically synthesized
acaatgagaatgaatgataaga

SEQ ID NO: 712992 - DNA, 22 bp, Artificial Sequence
  chemically synthesized
cttaaagcccctcttatcattc

SEQ ID NO: 712993 - DNA, 22 bp, Artificial Sequence
  chemically synthesized
ctaacaatgagaatgaatgata

SEQ ID NO: 712994 - DNA, 22 bp, Artificial Sequence
  chemically synthesized
aaagcccctcttatcattcatt

SEQ ID NO: 712995 - DNA, 22 bp, Artificial Sequence
  chemically synthesized
gctaacaatgagaatgaatgat

SEQ ID NO: 712996 - DNA, 22 bp, Artificial Sequence
  chemically synthesized
aagcccctcttatcattcattc

SEQ ID NO: 712997 - DNA, 22 bp, Artificial Sequence
  chemically synthesized
ttatcattcattctcattgtta

SEQ ID NO: 712998 - DNA, 22 bp, Artificial Sequence
  chemically synthesized
atcattcattctcattgttagc

SEQ ID NO: 712999 - DNA, 22 bp, Artificial Sequence
  chemically synthesized
tcattcattctcattgttagca

SEQ ID NO: 713000 - DNA, 22 bp, Artificial Sequence
  chemically synthesized
tggtagggatcttgctaacaat

SEQ ID NO: 713001 - DNA, 22 bp, Artificial Sequence
  chemically synthesized
attctcattgttagcaagatcc

SEQ ID NO: 713002 - DNA, 22 bp, Artificial Sequence
  chemically synthesized
ccccagctatggtagggatctt

SEQ ID NO: 713003 - DNA, 22 bp, Artificial Sequence
  chemically synthesized
tcattgttagcaagatccctac

SEQ ID NO: 713004 - DNA, 22 bp, Artificial Sequence
  chemically synthesized
gccccagctatggtagggatct

SEQ ID NO: 713005 - DNA, 22 bp, Artificial Sequence
  chemically synthesized
tgccccagctatggtagggatc

SEQ ID NO: 713006 - DNA, 22 bp, Artificial Sequence
  chemically synthesized
attgttagcaagatccctacca

SEQ ID NO: 713007 - DNA, 22 bp, Artificial Sequence
  chemically synthesized
ttgccccagctatggtagggat

SEQ ID NO: 713008 - DNA, 22 bp, Artificial Sequence
  chemically synthesized
tttttgccccagctatggtagg

SEQ ID NO: 713009 - DNA, 22 bp, Artificial Sequence
  chemically synthesized
ttagcaagatccctaccatagc

SEQ ID NO: 713010 - DNA, 22 bp, Artificial Sequence
  chemically synthesized
gcaagatccctaccatagctgg

SEQ ID NO: 713011 - DNA, 22 bp, Artificial Sequence
  chemically synthesized
aatacattgtttttgccccagc

SEQ ID NO: 713012 - DNA, 22 bp, Artificial Sequence
  chemically synthesized
gttaaatacattgtttttgccc

SEQ ID NO: 713013 - DNA, 22 bp, Artificial Sequence
  chemically synthesized
agttaaatacattgtttttgcc

SEQ ID NO: 713014 - DNA, 22 bp, Artificial Sequence
  chemically synthesized
tagttaaatacattgtttttgc

SEQ ID NO: 713015 - DNA, 22 bp, Artificial Sequence
  chemically synthesized
ccatagctggggcaaaaacaat

SEQ ID NO: 713016 - DNA, 22 bp, Artificial Sequence
  chemically synthesized
ttagttaaatacattgtttttg

SEQ ID NO: 713017 - DNA, 22 bp, Artificial Sequence
  chemically synthesized
atttttagttaaatacattgtt

SEQ ID NO: 713018 - DNA, 22 bp, Artificial Sequence
  chemically synthesized
gctcatttttagttaaatacat

SEQ ID NO: 713019 - DNA, 22 bp, Artificial Sequence
  chemically synthesized
gggcaaaaacaatgtatttaac

SEQ ID NO: 713020 - DNA, 22 bp, Artificial Sequence
  chemically synthesized
agctcatttttagttaaataca

SEQ ID NO: 713021 - DNA, 22 bp, Artificial Sequence
  chemically synthesized
cacgccttagctcatttttagt

SEQ ID NO: 713022 - DNA, 22 bp, Artificial Sequence
  chemically synthesized
acacgccttagctcatttttag

SEQ ID NO: 713023 - DNA, 22 bp, Artificial Sequence
  chemically synthesized
tacacgccttagctcattttta

SEQ ID NO: 713024 - DNA, 22 bp, Artificial Sequence
  chemically synthesized
aacgctttacacgccttagctc

SEQ ID NO: 713025 - DNA, 22 bp, Artificial Sequence
  chemically synthesized
aactaaaaatgagctaaggcgt

SEQ ID NO: 713026 - DNA, 22 bp, Artificial Sequence
  chemically synthesized
actaaaaatgagctaaggcgtg

SEQ ID NO: 713027 - DNA, 22 bp, Artificial Sequence
  chemically synthesized
ttaaacgctttacacgccttag

SEQ ID NO: 713028 - DNA, 22 bp, Artificial Sequence
  chemically synthesized
aaaatgagctaaggcgtgtaaa

SEQ ID NO: 713029 - DNA, 22 bp, Artificial Sequence
  chemically synthesized
taacagatgctgttaaacgctt

SEQ ID NO: 713030 - DNA, 22 bp, Artificial Sequence
  chemically synthesized
ataacagatgctgttaaacgct

SEQ ID NO: 713031 - DNA, 22 bp, Artificial Sequence
  chemically synthesized
aggcgtgtaaagcgtttaacag

SEQ ID NO: 713032 - DNA, 22 bp, Artificial Sequence
  chemically synthesized
accttataacagatgctgttaa

SEQ ID NO: 713033 - DNA, 22 bp, Artificial Sequence
  chemically synthesized
agtgctcaccttataacagatg

SEQ ID NO: 713034 - DNA, 22 bp, Artificial Sequence
  chemically synthesized
ctcagtgctcaccttataacag

SEQ ID NO: 713035 - DNA, 22 bp, Artificial Sequence
  chemically synthesized
actcagtgctcaccttataaca

SEQ ID NO: 713036 - DNA, 22 bp, Artificial Sequence
  chemically synthesized
aacagcatctgttataaggtga

SEQ ID NO: 713037 - DNA, 22 bp, Artificial Sequence
  chemically synthesized
acagcatctgttataaggtgag

SEQ ID NO: 713038 - DNA, 22 bp, Artificial Sequence
  chemically synthesized
ccatttactcagtgctcacctt

SEQ ID NO: 713039 - DNA, 22 bp, Artificial Sequence
  chemically synthesized
ttataaggtgagcactgagtaa

SEQ ID NO: 713040 - DNA, 22 bp, Artificial Sequence
  chemically synthesized
taaggtgagcactgagtaaatg

SEQ ID NO: 713041 - DNA, 22 bp, Artificial Sequence
  chemically synthesized
atacaaataagtaacagttacc

SEQ ID NO: 713042 - DNA, 22 bp, Artificial Sequence
  chemically synthesized
aatacaaataagtaacagttac

SEQ ID NO: 713043 - DNA, 22 bp, Artificial Sequence
  chemically synthesized
taatacaaataagtaacagtta

SEQ ID NO: 713044 - DNA, 22 bp, Artificial Sequence
  chemically synthesized
ttaatacaaataagtaacagtt

SEQ ID NO: 713045 - DNA, 22 bp, Artificial Sequence
  chemically synthesized
agtaaatggtaactgttactta

SEQ ID NO: 713046 - DNA, 22 bp, Artificial Sequence
  chemically synthesized
ttacttatttgtattaaaaggt

SEQ ID NO: 713047 - DNA, 22 bp, Artificial Sequence
  chemically synthesized
cttatttgtattaaaaggtggg

SEQ ID NO: 713048 - DNA, 22 bp, Artificial Sequence
  chemically synthesized
atttgtattaaaaggtggggct

SEQ ID NO: 713049 - DNA, 22 bp, Artificial Sequence
  chemically synthesized
tttgtattaaaaggtggggctg

SEQ ID NO: 713050 - DNA, 22 bp, Artificial Sequence
  chemically synthesized
caccaccatgcccagccccacc

SEQ ID NO: 713051 - DNA, 22 bp, Artificial Sequence
  chemically synthesized
gcaccaccatgcccagccccac

SEQ ID NO: 713052 - DNA, 22 bp, Artificial Sequence
  chemically synthesized
gtattaaaaggtggggctgggc

SEQ ID NO: 713053 - DNA, 22 bp, Artificial Sequence
  chemically synthesized
tattaaaaggtggggctgggca

SEQ ID NO: 713054 - DNA, 22 bp, Artificial Sequence
  chemically synthesized
caggcttgcaccaccatgccca

SEQ ID NO: 713055 - DNA, 22 bp, Artificial Sequence
  chemically synthesized
aaaggtggggctgggcatggtg

SEQ ID NO: 713056 - DNA, 22 bp, Artificial Sequence
  chemically synthesized
tgagagattacaggcttgcacc

SEQ ID NO: 713057 - DNA, 22 bp, Artificial Sequence
  chemically synthesized
ggcatggtggtgcaagcctgta

SEQ ID NO: 713058 - DNA, 22 bp, Artificial Sequence
  chemically synthesized
ccaggtcactgtgagagattac

SEQ ID NO: 713059 - DNA, 22 bp, Artificial Sequence
  chemically synthesized
agcctcccaggtcactgtgaga

SEQ ID NO: 713060 - DNA, 22 bp, Artificial Sequence
  chemically synthesized
cagcctcccaggtcactgtgag

SEQ ID NO: 713061 - DNA, 22 bp, Artificial Sequence
  chemically synthesized
taatctctcacagtgacctggg

SEQ ID NO: 713062 - DNA, 22 bp, Artificial Sequence
  chemically synthesized
ccacttcagcctcccaggtcac

SEQ ID NO: 713063 - DNA, 22 bp, Artificial Sequence
  chemically synthesized
tcacagtgacctgggaggctga

SEQ ID NO: 713064 - DNA, 22 bp, Artificial Sequence
  chemically synthesized
acagtgacctgggaggctgaag

SEQ ID NO: 713065 - DNA, 22 bp, Artificial Sequence
  chemically synthesized
aagtgatcctcccacttcagcc

SEQ ID NO: 713066 - DNA, 22 bp, Artificial Sequence
  chemically synthesized
ggttcaagtgatcctcccactt

SEQ ID NO: 713067 - DNA, 22 bp, Artificial Sequence
  chemically synthesized
ctgggttcaagtgatcctccca

SEQ ID NO: 713068 - DNA, 22 bp, Artificial Sequence
  chemically synthesized
ggaggctgaagtgggaggatca

SEQ ID NO: 713069 - DNA, 22 bp, Artificial Sequence
  chemically synthesized
aactcctgggttcaagtgatcc

SEQ ID NO: 713070 - DNA, 22 bp, Artificial Sequence
  chemically synthesized
gaactcctgggttcaagtgatc

SEQ ID NO: 713071 - DNA, 22 bp, Artificial Sequence
  chemically synthesized
aagtgggaggatcacttgaacc

SEQ ID NO: 713072 - DNA, 22 bp, Artificial Sequence
  chemically synthesized
gtcttgaactcctgggttcaag

SEQ ID NO: 713073 - DNA, 22 bp, Artificial Sequence
  chemically synthesized
cccaggctggtcttgaactcct

SEQ ID NO: 713074 - DNA, 22 bp, Artificial Sequence
  chemically synthesized
tgttgcccaggctggtcttgaa

SEQ ID NO: 713075 - DNA, 22 bp, Artificial Sequence
  chemically synthesized
gaacccaggagttcaagaccag

SEQ ID NO: 713076 - DNA, 22 bp, Artificial Sequence
  chemically synthesized
aacccaggagttcaagaccagc

SEQ ID NO: 713077 - DNA, 22 bp, Artificial Sequence
  chemically synthesized
actatgttgcccaggctggtct

SEQ ID NO: 713078 - DNA, 22 bp, Artificial Sequence
  chemically synthesized
aagaccagcctgggcaacatag

SEQ ID NO: 713079 - DNA, 22 bp, Artificial Sequence
  chemically synthesized
agagacagggtctcactatgtt

SEQ ID NO: 713080 - DNA, 22 bp, Artificial Sequence
  chemically synthesized
aagagacagggtctcactatgt

SEQ ID NO: 713081 - DNA, 22 bp, Artificial Sequence
  chemically synthesized
taagagacagggtctcactatg

SEQ ID NO: 713082 - DNA, 22 bp, Artificial Sequence
  chemically synthesized
ttaagagacagggtctcactat

SEQ ID NO: 713083 - DNA, 22 bp, Artificial Sequence
  chemically synthesized
tttaagagacagggtctcacta

SEQ ID NO: 713084 - DNA, 22 bp, Artificial Sequence
  chemically synthesized
ttttaagagacagggtctcact

SEQ ID NO: 713085 - DNA, 22 bp, Artificial Sequence
  chemically synthesized
tttttaagagacagggtctcac

SEQ ID NO: 713086 - DNA, 22 bp, Artificial Sequence
  chemically synthesized
ttttttaagagacagggtctca

SEQ ID NO: 713087 - DNA, 22 bp, Artificial Sequence
  chemically synthesized
ggcaacatagtgagaccctgtc

SEQ ID NO: 713088 - DNA, 22 bp, Artificial Sequence
  chemically synthesized
tttttttttaagagacagggtc

SEQ ID NO: 713089 - DNA, 22 bp, Artificial Sequence
  chemically synthesized
tgttatttttttttaagagaca

SEQ ID NO: 713090 - DNA, 22 bp, Artificial Sequence
  chemically synthesized
gtgttatttttttttaagagac

SEQ ID NO: 713091 - DNA, 22 bp, Artificial Sequence
  chemically synthesized
tttgtgttatttttttttaaga

SEQ ID NO: 713092 - DNA, 22 bp, Artificial Sequence
  chemically synthesized
gtttgtgttatttttttttaag

SEQ ID NO: 713093 - DNA, 22 bp, Artificial Sequence
  chemically synthesized
tgtttgtgttatttttttttaa

SEQ ID NO: 713094 - DNA, 22 bp, Artificial Sequence
  chemically synthesized
ttgtttgtgttattttttttta

SEQ ID NO: 713095 - DNA, 22 bp, Artificial Sequence
  chemically synthesized
tttgtttgtgttattttttttt

SEQ ID NO: 713096 - DNA, 22 bp, Artificial Sequence
  chemically synthesized
tctcttaaaaaaaaataacaca

SEQ ID NO: 713097 - DNA, 22 bp, Artificial Sequence
  chemically synthesized
ttaaaaaaaaataacacaaaca

SEQ ID NO: 713098 - DNA, 22 bp, Artificial Sequence
  chemically synthesized
acaccatgttttttgtttgtgt

SEQ ID NO: 713099 - DNA, 22 bp, Artificial Sequence
  chemically synthesized
aaaaaaaaataacacaaacaaa

SEQ ID NO: 713100 - DNA, 22 bp, Artificial Sequence
  chemically synthesized
aaaaaaaataacacaaacaaaa

SEQ ID NO: 713101 - DNA, 22 bp, Artificial Sequence
  chemically synthesized
tgacaccatgttttttgtttgt

SEQ ID NO: 713102 - DNA, 22 bp, Artificial Sequence
  chemically synthesized
ctctgacaccatgttttttgtt

SEQ ID NO: 713103 - DNA, 22 bp, Artificial Sequence
  chemically synthesized
tgctctgacaccatgttttttg

SEQ ID NO: 713104 - DNA, 22 bp, Artificial Sequence
  chemically synthesized
tattctgctctgacaccatgtt

SEQ ID NO: 713105 - DNA, 22 bp, Artificial Sequence
  chemically synthesized
accccattgtattctgctctga

SEQ ID NO: 713106 - DNA, 22 bp, Artificial Sequence
  chemically synthesized
tcaaactcaccccattgtattc

SEQ ID NO: 713107 - DNA, 22 bp, Artificial Sequence
  chemically synthesized
aagatgggtctgtcaaactcac

SEQ ID NO: 713108 - DNA, 22 bp, Artificial Sequence
  chemically synthesized
ccctaaagatgggtctgtcaaa

SEQ ID NO: 713109 - DNA, 22 bp, Artificial Sequence
  chemically synthesized
cccctaaagatgggtctgtcaa

SEQ ID NO: 713110 - DNA, 22 bp, Artificial Sequence
  chemically synthesized
gatatggaacttcccctaaaga

SEQ ID NO: 713111 - DNA, 22 bp, Artificial Sequence
  chemically synthesized
gacagacccatctttaggggaa

SEQ ID NO: 713112 - DNA, 22 bp, Artificial Sequence
  chemically synthesized
acagacccatctttaggggaag

SEQ ID NO: 713113 - DNA, 22 bp, Artificial Sequence
  chemically synthesized
taggggaagttccatatctagc

SEQ ID NO: 713114 - DNA, 22 bp, Artificial Sequence
  chemically synthesized
taaaaaagggaagctagatatg

SEQ ID NO: 713115 - DNA, 22 bp, Artificial Sequence
  chemically synthesized
aggggaagttccatatctagct

SEQ ID NO: 713116 - DNA, 22 bp, Artificial Sequence
  chemically synthesized
ggggaagttccatatctagctt

SEQ ID NO: 713117 - DNA, 22 bp, Artificial Sequence
  chemically synthesized
ctataaaaaagggaagctagat

SEQ ID NO: 713118 - DNA, 22 bp, Artificial Sequence
  chemically synthesized
actataaaaaagggaagctaga

SEQ ID NO: 713119 - DNA, 22 bp, Artificial Sequence
  chemically synthesized
catatctagcttccctttttta

SEQ ID NO: 713120 - DNA, 22 bp, Artificial Sequence
  chemically synthesized
aagtatttactataaaaaaggg

SEQ ID NO: 713121 - DNA, 22 bp, Artificial Sequence
  chemically synthesized
gcttcccttttttatagtaaat

SEQ ID NO: 713122 - DNA, 22 bp, Artificial Sequence
  chemically synthesized
cccttttttatagtaaatactt

SEQ ID NO: 713123 - DNA, 22 bp, Artificial Sequence
  chemically synthesized
ccttttttatagtaaatacttg

SEQ ID NO: 713124 - DNA, 22 bp, Artificial Sequence
  chemically synthesized
aacaaaccagctcaagtattta

SEQ ID NO: 713125 - DNA, 22 bp, Artificial Sequence
  chemically synthesized
ttttatagtaaatacttgagct

SEQ ID NO: 713126 - DNA, 22 bp, Artificial Sequence
  chemically synthesized
tttatagtaaatacttgagctg

SEQ ID NO: 713127 - DNA, 22 bp, Artificial Sequence
  chemically synthesized
ccctcaacaaaccagctcaagt

SEQ ID NO: 713128 - DNA, 22 bp, Artificial Sequence
  chemically synthesized
ttatagtaaatacttgagctgg

SEQ ID NO: 713129 - DNA, 22 bp, Artificial Sequence
  chemically synthesized
tatagtaaatacttgagctggt

SEQ ID NO: 713130 - DNA, 22 bp, Artificial Sequence
  chemically synthesized
atagtaaatacttgagctggtt

SEQ ID NO: 713131 - DNA, 22 bp, Artificial Sequence
  chemically synthesized
tagtaaatacttgagctggttt

SEQ ID NO: 713132 - DNA, 22 bp, Artificial Sequence
  chemically synthesized
aaatcgtatgggttaccctcaa

SEQ ID NO: 713133 - DNA, 22 bp, Artificial Sequence
  chemically synthesized
gagctggtttgttgagggtaac

SEQ ID NO: 713134 - DNA, 22 bp, Artificial Sequence
  chemically synthesized
agctggtttgttgagggtaacc

SEQ ID NO: 713135 - DNA, 22 bp, Artificial Sequence
  chemically synthesized
gtttgttgagggtaacccatac

SEQ ID NO: 713136 - DNA, 22 bp, Artificial Sequence
  chemically synthesized
gttgagggtaacccatacgatt

SEQ ID NO: 713137 - DNA, 22 bp, Artificial Sequence
  chemically synthesized
gtaaatgattaaaatcgtatgg

SEQ ID NO: 713138 - DNA, 22 bp, Artificial Sequence
  chemically synthesized
ttgagggtaacccatacgattt

SEQ ID NO: 713139 - DNA, 22 bp, Artificial Sequence
  chemically synthesized
agggtaacccatacgattttaa

SEQ ID NO: 713140 - DNA, 22 bp, Artificial Sequence
  chemically synthesized
agtcctggtaaatgattaaaat

SEQ ID NO: 713141 - DNA, 22 bp, Artificial Sequence
  chemically synthesized
aagtcctggtaaatgattaaaa

SEQ ID NO: 713142 - DNA, 22 bp, Artificial Sequence
  chemically synthesized
cagatttaagtcctggtaaatg

SEQ ID NO: 713143 - DNA, 22 bp, Artificial Sequence
  chemically synthesized
ccagatttaagtcctggtaaat

SEQ ID NO: 713144 - DNA, 22 bp, Artificial Sequence
  chemically synthesized
tccagatttaagtcctggtaaa

SEQ ID NO: 713145 - DNA, 22 bp, Artificial Sequence
  chemically synthesized
taatcatttaccaggacttaaa

SEQ ID NO: 713146 - DNA, 22 bp, Artificial Sequence
  chemically synthesized
aatcatttaccaggacttaaat

SEQ ID NO: 713147 - DNA, 22 bp, Artificial Sequence
  chemically synthesized
atcatttaccaggacttaaatc

SEQ ID NO: 713148 - DNA, 22 bp, Artificial Sequence
  chemically synthesized
tcatactttccagatttaagtc

SEQ ID NO: 713149 - DNA, 22 bp, Artificial Sequence
  chemically synthesized
accaggacttaaatctggaaag

SEQ ID NO: 713150 - DNA, 22 bp, Artificial Sequence
  chemically synthesized
ccaggacttaaatctggaaagt

SEQ ID NO: 713151 - DNA, 22 bp, Artificial Sequence
  chemically synthesized
aacccaactgtcatactttcca

SEQ ID NO: 713152 - DNA, 22 bp, Artificial Sequence
  chemically synthesized
gaacccaactgtcatactttcc

SEQ ID NO: 713153 - DNA, 22 bp, Artificial Sequence
  chemically synthesized
ttgaacccaactgtcatacttt

SEQ ID NO: 713154 - DNA, 22 bp, Artificial Sequence
  chemically synthesized
aaatctggaaagtatgacagtt

SEQ ID NO: 713155 - DNA, 22 bp, Artificial Sequence
  chemically synthesized
attcttgaacccaactgtcata

SEQ ID NO: 713156 - DNA, 22 bp, Artificial Sequence
  chemically synthesized
aatctggaaagtatgacagttg

SEQ ID NO: 713157 - DNA, 22 bp, Artificial Sequence
  chemically synthesized
gaaagtatgacagttgggttca

SEQ ID NO: 713158 - DNA, 22 bp, Artificial Sequence
  chemically synthesized
gtggaatcattgattcttgaac

SEQ ID NO: 713159 - DNA, 22 bp, Artificial Sequence
  chemically synthesized
aaaatgctggtggaatcattga

SEQ ID NO: 713160 - DNA, 22 bp, Artificial Sequence
  chemically synthesized
gaaaatgctggtggaatcattg

SEQ ID NO: 713161 - DNA, 22 bp, Artificial Sequence
  chemically synthesized
ggttcaagaatcaatgattcca

SEQ ID NO: 713162 - DNA, 22 bp, Artificial Sequence
  chemically synthesized
aagaatcaatgattccaccagc

SEQ ID NO: 713163 - DNA, 22 bp, Artificial Sequence
  chemically synthesized
caccagcattttcaagggctgc

SEQ ID NO: 713164 - DNA, 22 bp, Artificial Sequence
  chemically synthesized
tcaagggctgctatgtacactg

SEQ ID NO: 713165 - DNA, 22 bp, Artificial Sequence
  chemically synthesized
caagggctgctatgtacactgt

SEQ ID NO: 713166 - DNA, 22 bp, Artificial Sequence
  chemically synthesized
aagggctgctatgtacactgta

SEQ ID NO: 713167 - DNA, 22 bp, Artificial Sequence
  chemically synthesized
ctatgtacactgtactgtatgt

SEQ ID NO: 713168 - DNA, 22 bp, Artificial Sequence
  chemically synthesized
tgtacactgtactgtatgttca

SEQ ID NO: 713169 - DNA, 22 bp, Artificial Sequence
  chemically synthesized
ccatccaccacacgatgaacat

SEQ ID NO: 713170 - DNA, 22 bp, Artificial Sequence
  chemically synthesized
gccatccaccacacgatgaaca

SEQ ID NO: 713171 - DNA, 22 bp, Artificial Sequence
  chemically synthesized
tgccatccaccacacgatgaac

SEQ ID NO: 713172 - DNA, 22 bp, Artificial Sequence
  chemically synthesized
tactgtatgttcatcgtgtggt

SEQ ID NO: 713173 - DNA, 22 bp, Artificial Sequence
  chemically synthesized
tatgttcatcgtgtggtggatg

SEQ ID NO: 713174 - DNA, 22 bp, Artificial Sequence
  chemically synthesized
atgtcccatctttgccatccac

SEQ ID NO: 713175 - DNA, 22 bp, Artificial Sequence
  chemically synthesized
catgtcccatctttgccatcca

SEQ ID NO: 713176 - DNA, 22 bp, Artificial Sequence
  chemically synthesized
tcatgtcccatctttgccatcc

SEQ ID NO: 713177 - DNA, 22 bp, Artificial Sequence
  chemically synthesized
ttcatgtcccatctttgccatc

SEQ ID NO: 713178 - DNA, 22 bp, Artificial Sequence
  chemically synthesized
atcgtgtggtggatggcaaaga

SEQ ID NO: 713179 - DNA, 22 bp, Artificial Sequence
  chemically synthesized
agaaaagaaatttttcatgtcc

SEQ ID NO: 713180 - DNA, 22 bp, Artificial Sequence
  chemically synthesized
gagaaaagaaatttttcatgtc

SEQ ID NO: 713181 - DNA, 22 bp, Artificial Sequence
  chemically synthesized
ttgagaaaagaaatttttcatg

SEQ ID NO: 713182 - DNA, 22 bp, Artificial Sequence
  chemically synthesized
ccagcaagacacaaggttcttg

SEQ ID NO: 713183 - DNA, 22 bp, Artificial Sequence
  chemically synthesized
cttttctcaagaaccttgtgtc

SEQ ID NO: 713184 - DNA, 22 bp, Artificial Sequence
  chemically synthesized
ttttctcaagaaccttgtgtct

SEQ ID NO: 713185 - DNA, 22 bp, Artificial Sequence
  chemically synthesized
ttctcaagaaccttgtgtcttg

SEQ ID NO: 713186 - DNA, 22 bp, Artificial Sequence
  chemically synthesized
tctcaagaaccttgtgtcttgc

SEQ ID NO: 713187 - DNA, 22 bp, Artificial Sequence
  chemically synthesized
ctcaagaaccttgtgtcttgct

SEQ ID NO: 713188 - DNA, 22 bp, Artificial Sequence
  chemically synthesized
cagtcatctcccagcaagacac

SEQ ID NO: 713189 - DNA, 22 bp, Artificial Sequence
  chemically synthesized
tcaagaaccttgtgtcttgctg

SEQ ID NO: 713190 - DNA, 22 bp, Artificial Sequence
  chemically synthesized
aagaaccttgtgtcttgctggg

SEQ ID NO: 713191 - DNA, 22 bp, Artificial Sequence
  chemically synthesized
agctgcagtcatctcccagcaa

SEQ ID NO: 713192 - DNA, 22 bp, Artificial Sequence
  chemically synthesized
gtctcagctgcagtcatctccc

SEQ ID NO: 713193 - DNA, 22 bp, Artificial Sequence
  chemically synthesized
gtgtcttgctgggagatgactg

SEQ ID NO: 713194 - DNA, 22 bp, Artificial Sequence
  chemically synthesized
tgtcttgctgggagatgactgc

SEQ ID NO: 713195 - DNA, 22 bp, Artificial Sequence
  chemically synthesized
attcgtctcagctgcagtcatc

SEQ ID NO: 713196 - DNA, 22 bp, Artificial Sequence
  chemically synthesized
taattcgtctcagctgcagtca

SEQ ID NO: 713197 - DNA, 22 bp, Artificial Sequence
  chemically synthesized
gctgggagatgactgcagctga

SEQ ID NO: 713198 - DNA, 22 bp, Artificial Sequence
  chemically synthesized
ctgggagatgactgcagctgag

SEQ ID NO: 713199 - DNA, 22 bp, Artificial Sequence
  chemically synthesized
ggagatgactgcagctgagacg

SEQ ID NO: 713200 - DNA, 22 bp, Artificial Sequence
  chemically synthesized
aaaagtctctaattcgtctcag

SEQ ID NO: 713201 - DNA, 22 bp, Artificial Sequence
  chemically synthesized
tcagttcaaaagtctctaattc

SEQ ID NO: 713202 - DNA, 22 bp, Artificial Sequence
  chemically synthesized
cagctgagacgaattagagact

SEQ ID NO: 713203 - DNA, 22 bp, Artificial Sequence
  chemically synthesized
agacgaattagagacttttgaa

SEQ ID NO: 713204 - DNA, 22 bp, Artificial Sequence
  chemically synthesized
gagacttttgaactgatagtct

SEQ ID NO: 713205 - DNA, 22 bp, Artificial Sequence
  chemically synthesized
gtcataacacagagactatcag

SEQ ID NO: 713206 - DNA, 22 bp, Artificial Sequence
  chemically synthesized
ttggtcataacacagagactat

SEQ ID NO: 713207 - DNA, 22 bp, Artificial Sequence
  chemically synthesized
attggtcataacacagagacta

SEQ ID NO: 713208 - DNA, 22 bp, Artificial Sequence
  chemically synthesized
ttgaactgatagtctctgtgtt

SEQ ID NO: 713209 - DNA, 22 bp, Artificial Sequence
  chemically synthesized
tgaactgatagtctctgtgtta

SEQ ID NO: 713210 - DNA, 22 bp, Artificial Sequence
  chemically synthesized
gaactgatagtctctgtgttat

SEQ ID NO: 713211 - DNA, 22 bp, Artificial Sequence
  chemically synthesized
cccttattggtcataacacaga

SEQ ID NO: 713212 - DNA, 22 bp, Artificial Sequence
  chemically synthesized
aactgatagtctctgtgttatg

SEQ ID NO: 713213 - DNA, 22 bp, Artificial Sequence
  chemically synthesized
atagtctctgtgttatgaccaa

SEQ ID NO: 713214 - DNA, 22 bp, Artificial Sequence
  chemically synthesized
tgtgttatgaccaataagggca

SEQ ID NO: 713215 - DNA, 22 bp, Artificial Sequence
  chemically synthesized
caaaaatacatattgcccttat

SEQ ID NO: 713216 - DNA, 22 bp, Artificial Sequence
  chemically synthesized
tgttatgaccaataagggcaat

SEQ ID NO: 713217 - DNA, 22 bp, Artificial Sequence
  chemically synthesized
ccaaaaatacatattgccctta

SEQ ID NO: 713218 - DNA, 22 bp, Artificial Sequence
  chemically synthesized
acttccaaaaatacatattgcc

SEQ ID NO: 713219 - DNA, 22 bp, Artificial Sequence
  chemically synthesized
tgaccaataagggcaatatgta

SEQ ID NO: 713220 - DNA, 22 bp, Artificial Sequence
  chemically synthesized
tctcacttccaaaaatacatat

SEQ ID NO: 713221 - DNA, 22 bp, Artificial Sequence
  chemically synthesized
ctgtctcacttccaaaaataca

SEQ ID NO: 713222 - DNA, 22 bp, Artificial Sequence
  chemically synthesized
actgctgtctcacttccaaaaa

SEQ ID NO: 713223 - DNA, 22 bp, Artificial Sequence
  chemically synthesized
gcctcactgctgtctcacttcc

SEQ ID NO: 713224 - DNA, 22 bp, Artificial Sequence
  chemically synthesized
ctggcctcactgctgtctcact

SEQ ID NO: 713225 - DNA, 22 bp, Artificial Sequence
  chemically synthesized
ctcctggcctcactgctgtctc

SEQ ID NO: 713226 - DNA, 22 bp, Artificial Sequence
  chemically synthesized
ttggaagtgagacagcagtgag

SEQ ID NO: 713227 - DNA, 22 bp, Artificial Sequence
  chemically synthesized
tggaagtgagacagcagtgagg

SEQ ID NO: 713228 - DNA, 22 bp, Artificial Sequence
  chemically synthesized
ggaagtgagacagcagtgaggc

SEQ ID NO: 713229 - DNA, 22 bp, Artificial Sequence
  chemically synthesized
gaagtgagacagcagtgaggcc

SEQ ID NO: 713230 - DNA, 22 bp, Artificial Sequence
  chemically synthesized
ccagattgctcctggcctcact

SEQ ID NO: 713231 - DNA, 22 bp, Artificial Sequence
  chemically synthesized
atgcctcccagattgctcctgg

SEQ ID NO: 713232 - DNA, 22 bp, Artificial Sequence
  chemically synthesized
tgatgcctcccagattgctcct

SEQ ID NO: 713233 - DNA, 22 bp, Artificial Sequence
  chemically synthesized
ctgatgcctcccagattgctcc

SEQ ID NO: 713234 - DNA, 22 bp, Artificial Sequence
  chemically synthesized
tctgatgcctcccagattgctc

SEQ ID NO: 713235 - DNA, 22 bp, Artificial Sequence
  chemically synthesized
ttctgatgcctcccagattgct

SEQ ID NO: 713236 - DNA, 22 bp, Artificial Sequence
  chemically synthesized
ttttctgatgcctcccagattg

SEQ ID NO: 713237 - DNA, 22 bp, Artificial Sequence
  chemically synthesized
tgtcacctcttttctgatgcct

SEQ ID NO: 713238 - DNA, 22 bp, Artificial Sequence
  chemically synthesized
tgtgtcacctcttttctgatgc

SEQ ID NO: 713239 - DNA, 22 bp, Artificial Sequence
  chemically synthesized
ggaggcatcagaaaagaggtga

SEQ ID NO: 713240 - DNA, 22 bp, Artificial Sequence
  chemically synthesized
ggacaatgatgttctgtgtcac

SEQ ID NO: 713241 - DNA, 22 bp, Artificial Sequence
  chemically synthesized
acctaggacaatgatgttctgt

SEQ ID NO: 713242 - DNA, 22 bp, Artificial Sequence
  chemically synthesized
agtctgacctaggacaatgatg

SEQ ID NO: 713243 - DNA, 22 bp, Artificial Sequence
  chemically synthesized
atactgagtctgacctaggaca

SEQ ID NO: 713244 - DNA, 22 bp, Artificial Sequence
  chemically synthesized
ctgatactgagtctgacctagg

SEQ ID NO: 713245 - DNA, 22 bp, Artificial Sequence
  chemically synthesized
agctgctgatactgagtctgac

SEQ ID NO: 713246 - DNA, 22 bp, Artificial Sequence
  chemically synthesized
tcctaggtcagactcagtatca

SEQ ID NO: 713247 - DNA, 22 bp, Artificial Sequence
  chemically synthesized
ggtcagactcagtatcagcagc

SEQ ID NO: 713248 - DNA, 22 bp, Artificial Sequence
  chemically synthesized
atggacatgagatgctaagctg

SEQ ID NO: 713249 - DNA, 22 bp, Artificial Sequence
  chemically synthesized
ctcatggacatgagatgctaag

SEQ ID NO: 713250 - DNA, 22 bp, Artificial Sequence
  chemically synthesized
agtatcagcagcttagcatctc

SEQ ID NO: 713251 - DNA, 22 bp, Artificial Sequence
  chemically synthesized
aaaaaatactcctcatggacat

SEQ ID NO: 713252 - DNA, 22 bp, Artificial Sequence
  chemically synthesized
ttcaaaaaatactcctcatgga

SEQ ID NO: 713253 - DNA, 22 bp, Artificial Sequence
  chemically synthesized
agcatctcatgtccatgaggag

SEQ ID NO: 713254 - DNA, 22 bp, Artificial Sequence
  chemically synthesized
gcatctcatgtccatgaggagt

SEQ ID NO: 713255 - DNA, 22 bp, Artificial Sequence
  chemically synthesized
atgtccatgaggagtatttttt

SEQ ID NO: 713256 - DNA, 22 bp, Artificial Sequence
  chemically synthesized
tatcacaaatggcatgcaaaat

SEQ ID NO: 713257 - DNA, 22 bp, Artificial Sequence
  chemically synthesized
tttgaacaggtattttgcatgc

SEQ ID NO: 713258 - DNA, 22 bp, Artificial Sequence
  chemically synthesized
ttgaacaggtattttgcatgcc

SEQ ID NO: 713259 - DNA, 22 bp, Artificial Sequence
  chemically synthesized
tgaacaggtattttgcatgcca

SEQ ID NO: 713260 - DNA, 22 bp, Artificial Sequence
  chemically synthesized
gaacaggtattttgcatgccat

SEQ ID NO: 713261 - DNA, 22 bp, Artificial Sequence
  chemically synthesized
aacaggtattttgcatgccatt

SEQ ID NO: 713262 - DNA, 22 bp, Artificial Sequence
  chemically synthesized
agattatatcacaaatggcatg

SEQ ID NO: 713263 - DNA, 22 bp, Artificial Sequence
  chemically synthesized
aatcattaagattatatcacaa

SEQ ID NO: 713264 - DNA, 22 bp, Artificial Sequence
  chemically synthesized
tgcatgccatttgtgatataat

SEQ ID NO: 713265 - DNA, 22 bp, Artificial Sequence
  chemically synthesized
tgaatcattaagattatatcac

SEQ ID NO: 713266 - DNA, 22 bp, Artificial Sequence
  chemically synthesized
gcatgccatttgtgatataatc

SEQ ID NO: 713267 - DNA, 22 bp, Artificial Sequence
  chemically synthesized
catgccatttgtgatataatct

SEQ ID NO: 713268 - DNA, 22 bp, Artificial Sequence
  chemically synthesized
aggaatctctgaatcattaaga

SEQ ID NO: 713269 - DNA, 22 bp, Artificial Sequence
  chemically synthesized
gtgatataatcttaatgattca

SEQ ID NO: 713270 - DNA, 22 bp, Artificial Sequence
  chemically synthesized
tgatataatcttaatgattcag

SEQ ID NO: 713271 - DNA, 22 bp, Artificial Sequence
  chemically synthesized
aaatctcaggaatctctgaatc

SEQ ID NO: 713272 - DNA, 22 bp, Artificial Sequence
  chemically synthesized
gaaatctcaggaatctctgaat

SEQ ID NO: 713273 - DNA, 22 bp, Artificial Sequence
  chemically synthesized
tttgaaatctcaggaatctctg

SEQ ID NO: 713274 - DNA, 22 bp, Artificial Sequence
  chemically synthesized
aatgattcagagattcctgaga

SEQ ID NO: 713275 - DNA, 22 bp, Artificial Sequence
  chemically synthesized
atgattcagagattcctgagat

SEQ ID NO: 713276 - DNA, 22 bp, Artificial Sequence
  chemically synthesized
taagtgatactgtttgaaatct

SEQ ID NO: 713277 - DNA, 22 bp, Artificial Sequence
  chemically synthesized
agagattcctgagatttcaaac

SEQ ID NO: 713278 - DNA, 22 bp, Artificial Sequence
  chemically synthesized
acactataagtgatactgtttg

SEQ ID NO: 713279 - DNA, 22 bp, Artificial Sequence
  chemically synthesized
ctgagatttcaaacagtatcac

SEQ ID NO: 713280 - DNA, 22 bp, Artificial Sequence
  chemically synthesized
agatttcaaacagtatcactta

SEQ ID NO: 713281 - DNA, 22 bp, Artificial Sequence
  chemically synthesized
caaacagtatcacttatagtgt

SEQ ID NO: 713282 - DNA, 22 bp, Artificial Sequence
  chemically synthesized
aaacagtatcacttatagtgtc

SEQ ID NO: 713283 - DNA, 22 bp, Artificial Sequence
  chemically synthesized
aaataaaggaaagattgacact

SEQ ID NO: 713284 - DNA, 22 bp, Artificial Sequence
  chemically synthesized
ctaaaataaaggaaagattgac

SEQ ID NO: 713285 - DNA, 22 bp, Artificial Sequence
  chemically synthesized
actaaaataaaggaaagattga

SEQ ID NO: 713286 - DNA, 22 bp, Artificial Sequence
  chemically synthesized
cttactaaaataaaggaaagat

SEQ ID NO: 713287 - DNA, 22 bp, Artificial Sequence
  chemically synthesized
atagtgtcaatctttcctttat

SEQ ID NO: 713288 - DNA, 22 bp, Artificial Sequence
  chemically synthesized
ttgcttactaaaataaaggaaa

SEQ ID NO: 713289 - DNA, 22 bp, Artificial Sequence
  chemically synthesized
tagtgtcaatctttcctttatt

SEQ ID NO: 713290 - DNA, 22 bp, Artificial Sequence
  chemically synthesized
gttgcttactaaaataaaggaa

SEQ ID NO: 713291 - DNA, 22 bp, Artificial Sequence
  chemically synthesized
tcctttattttagtaagcaaca

SEQ ID NO: 713292 - DNA, 22 bp, Artificial Sequence
  chemically synthesized
cctttattttagtaagcaacaa

SEQ ID NO: 713293 - DNA, 22 bp, Artificial Sequence
  chemically synthesized
ctttattttagtaagcaacaag

SEQ ID NO: 713294 - DNA, 22 bp, Artificial Sequence
  chemically synthesized
tattttagtaagcaacaagtca

SEQ ID NO: 713295 - DNA, 22 bp, Artificial Sequence
  chemically synthesized
attttagtaagcaacaagtcat

SEQ ID NO: 713296 - DNA, 22 bp, Artificial Sequence
  chemically synthesized
ttttagtaagcaacaagtcatc

SEQ ID NO: 713297 - DNA, 22 bp, Artificial Sequence
  chemically synthesized
tagtaagcaacaagtcatcatt

SEQ ID NO: 713298 - DNA, 22 bp, Artificial Sequence
  chemically synthesized
agtaagcaacaagtcatcattc

SEQ ID NO: 713299 - DNA, 22 bp, Artificial Sequence
  chemically synthesized
gtaagcaacaagtcatcattct

SEQ ID NO: 713300 - DNA, 22 bp, Artificial Sequence
  chemically synthesized
aaaaaaaaaaaaaaaaaaaaga

SEQ ID NO: 713301 - DNA, 22 bp, Artificial Sequence
  chemically synthesized
tcttaccatctttttttttttt

SEQ ID NO: 713302 - DNA, 22 bp, Artificial Sequence
  chemically synthesized
ttaccatctttttttttttttt

SEQ ID NO: 713303 - DNA, 22 bp, Artificial Sequence
  chemically synthesized
accatctttttttttttttttt

SEQ ID NO: 713304 - DNA, 22 bp, Artificial Sequence
  chemically synthesized
ccatcttttttttttttttttt

SEQ ID NO: 713305 - DNA, 22 bp, Artificial Sequence
  chemically synthesized
ttttttttttttttttttgaga

SEQ ID NO: 713306 - DNA, 22 bp, Artificial Sequence
  chemically synthesized
tttttttttttttttttgagac

SEQ ID NO: 713307 - DNA, 22 bp, Artificial Sequence
  chemically synthesized
ttttttttttttttttgagacg

SEQ ID NO: 713308 - DNA, 22 bp, Artificial Sequence
  chemically synthesized
tttttttttttttttgagacgt

SEQ ID NO: 713309 - DNA, 22 bp, Artificial Sequence
  chemically synthesized
ttttttttttttttgagacgtc

SEQ ID NO: 713310 - DNA, 22 bp, Artificial Sequence
  chemically synthesized
tttttttttttttgagacgtcc

SEQ ID NO: 713311 - DNA, 22 bp, Artificial Sequence
  chemically synthesized
ggcaacagagcaggacgtctca

SEQ ID NO: 713312 - DNA, 22 bp, Artificial Sequence
  chemically synthesized
ttttttttttttgagacgtcct

SEQ ID NO: 713313 - DNA, 22 bp, Artificial Sequence
  chemically synthesized
tttttttttttgagacgtcctg

SEQ ID NO: 713314 - DNA, 22 bp, Artificial Sequence
  chemically synthesized
ttttttttttgagacgtcctgc

SEQ ID NO: 713315 - DNA, 22 bp, Artificial Sequence
  chemically synthesized
tttttttttgagacgtcctgct

SEQ ID NO: 713316 - DNA, 22 bp, Artificial Sequence
  chemically synthesized
ttttttttgagacgtcctgctc

SEQ ID NO: 713317 - DNA, 22 bp, Artificial Sequence
  chemically synthesized
tttttttgagacgtcctgctct

SEQ ID NO: 713318 - DNA, 22 bp, Artificial Sequence
  chemically synthesized
ttttttgagacgtcctgctctg

SEQ ID NO: 713319 - DNA, 22 bp, Artificial Sequence
  chemically synthesized
cagactgggcaacagagcagga

SEQ ID NO: 713320 - DNA, 22 bp, Artificial Sequence
  chemically synthesized
tttttgagacgtcctgctctgt

SEQ ID NO: 713321 - DNA, 22 bp, Artificial Sequence
  chemically synthesized
ttttgagacgtcctgctctgtt

SEQ ID NO: 713322 - DNA, 22 bp, Artificial Sequence
  chemically synthesized
tttgagacgtcctgctctgttg

SEQ ID NO: 713323 - DNA, 22 bp, Artificial Sequence
  chemically synthesized
ttgagacgtcctgctctgttgc

SEQ ID NO: 713324 - DNA, 22 bp, Artificial Sequence
  chemically synthesized
tgagacgtcctgctctgttgcc

SEQ ID NO: 713325 - DNA, 22 bp, Artificial Sequence
  chemically synthesized
cactccagactgggcaacagag

SEQ ID NO: 713326 - DNA, 22 bp, Artificial Sequence
  chemically synthesized
gagacgtcctgctctgttgccc

SEQ ID NO: 713327 - DNA, 22 bp, Artificial Sequence
  chemically synthesized
agacgtcctgctctgttgccca

SEQ ID NO: 713328 - DNA, 22 bp, Artificial Sequence
  chemically synthesized
ctctgttgcccagtctggagtg

SEQ ID NO: 713329 - DNA, 22 bp, Artificial Sequence
  chemically synthesized
agatcatgccactgcactccag

SEQ ID NO: 713330 - DNA, 22 bp, Artificial Sequence
  chemically synthesized
tgttgcccagtctggagtgcag

SEQ ID NO: 713331 - DNA, 22 bp, Artificial Sequence
  chemically synthesized
ttgcccagtctggagtgcagtg

SEQ ID NO: 713332 - DNA, 22 bp, Artificial Sequence
  chemically synthesized
cccagtctggagtgcagtggca

SEQ ID NO: 713333 - DNA, 22 bp, Artificial Sequence
  chemically synthesized
caatgagctgagatcatgccac

SEQ ID NO: 713334 - DNA, 22 bp, Artificial Sequence
  chemically synthesized
gagtgcagtggcatgatctcag

SEQ ID NO: 713335 - DNA, 22 bp, Artificial Sequence
  chemically synthesized
ggaggcaggggttgcaatgagc

SEQ ID NO: 713336 - DNA, 22 bp, Artificial Sequence
  chemically synthesized
aacctgggaggcaggggttgca

SEQ ID NO: 713337 - DNA, 22 bp, Artificial Sequence
  chemically synthesized
gaacctgggaggcaggggttgc

SEQ ID NO: 713338 - DNA, 22 bp, Artificial Sequence
  chemically synthesized
cttgaacctgggaggcaggggt

SEQ ID NO: 713339 - DNA, 22 bp, Artificial Sequence
  chemically synthesized
agctcattgcaacccctgcctc

SEQ ID NO: 713340 - DNA, 22 bp, Artificial Sequence
  chemically synthesized
attgcaacccctgcctcccagg

SEQ ID NO: 713341 - DNA, 22 bp, Artificial Sequence
  chemically synthesized
caacccctgcctcccaggttca

SEQ ID NO: 713342 - DNA, 22 bp, Artificial Sequence
  chemically synthesized
aggcaggagaattgcttgaacc

SEQ ID NO: 713343 - DNA, 22 bp, Artificial Sequence
  chemically synthesized
cctcccaggttcaagcaattct

SEQ ID NO: 713344 - DNA, 22 bp, Artificial Sequence
  chemically synthesized
ccaggttcaagcaattctcctg

SEQ ID NO: 713345 - DNA, 22 bp, Artificial Sequence
  chemically synthesized
gggaggctgaggcaggagaatt

SEQ ID NO: 713346 - DNA, 22 bp, Artificial Sequence
  chemically synthesized
aagcaattctcctgcctcagcc

SEQ ID NO: 713347 - DNA, 22 bp, Artificial Sequence
  chemically synthesized
taatcccgggtactcgggaggc

SEQ ID NO: 713348 - DNA, 22 bp, Artificial Sequence
  chemically synthesized
tcctgcctcagcctcccgagta

SEQ ID NO: 713349 - DNA, 22 bp, Artificial Sequence
  chemically synthesized
ctgcctcagcctcccgagtacc

SEQ ID NO: 713350 - DNA, 22 bp, Artificial Sequence
  chemically synthesized
cctcagcctcccgagtacccgg

SEQ ID NO: 713351 - DNA, 22 bp, Artificial Sequence
  chemically synthesized
agcctcccgagtacccgggatt

SEQ ID NO: 713352 - DNA, 22 bp, Artificial Sequence
  chemically synthesized
gcgcatgcctgtaatcccgggt

SEQ ID NO: 713353 - DNA, 22 bp, Artificial Sequence
  chemically synthesized
ccgagtacccgggattacaggc

SEQ ID NO: 713354 - DNA, 22 bp, Artificial Sequence
  chemically synthesized
gccgggtgggttggcgcatgcc

SEQ ID NO: 713355 - DNA, 22 bp, Artificial Sequence
  chemically synthesized
caggcatgcgccaacccacccg

SEQ ID NO: 713356 - DNA, 22 bp, Artificial Sequence
  chemically synthesized
aaaaatacaaaaattagccggg

SEQ ID NO: 713357 - DNA, 22 bp, Artificial Sequence
  chemically synthesized
taaaaaatacaaaaattagccg

SEQ ID NO: 713358 - DNA, 22 bp, Artificial Sequence
  chemically synthesized
ctaaaaaatacaaaaattagcc

SEQ ID NO: 713359 - DNA, 22 bp, Artificial Sequence
  chemically synthesized
ttctaaaaaatacaaaaattag

SEQ ID NO: 713360 - DNA, 22 bp, Artificial Sequence
  chemically synthesized
atttttgtattttttagaagag

SEQ ID NO: 713361 - DNA, 22 bp, Artificial Sequence
  chemically synthesized
ttgtattttttagaagagatgg

SEQ ID NO: 713362 - DNA, 22 bp, Artificial Sequence
  chemically synthesized
tgtattttttagaagagatggg

SEQ ID NO: 713363 - DNA, 22 bp, Artificial Sequence
  chemically synthesized
gtattttttagaagagatgggg

SEQ ID NO: 713364 - DNA, 22 bp, Artificial Sequence
  chemically synthesized
tattttttagaagagatggggt

SEQ ID NO: 713365 - DNA, 22 bp, Artificial Sequence
  chemically synthesized
gccaacagggtgaaaccccatc

SEQ ID NO: 713366 - DNA, 22 bp, Artificial Sequence
  chemically synthesized
tttagaagagatggggtttcac

SEQ ID NO: 713367 - DNA, 22 bp, Artificial Sequence
  chemically synthesized
ttagaagagatggggtttcacc

SEQ ID NO: 713368 - DNA, 22 bp, Artificial Sequence
  chemically synthesized
tagaagagatggggtttcaccc

SEQ ID NO: 713369 - DNA, 22 bp, Artificial Sequence
  chemically synthesized
agaagagatggggtttcaccct

SEQ ID NO: 713370 - DNA, 22 bp, Artificial Sequence
  chemically synthesized
gaagagatggggtttcaccctg

SEQ ID NO: 713371 - DNA, 22 bp, Artificial Sequence
  chemically synthesized
caccctgttggccaggctggtc

SEQ ID NO: 713372 - DNA, 22 bp, Artificial Sequence
  chemically synthesized
accctgttggccaggctggtct

SEQ ID NO: 713373 - DNA, 22 bp, Artificial Sequence
  chemically synthesized
aaagataggaggatggagacca

SEQ ID NO: 713374 - DNA, 22 bp, Artificial Sequence
  chemically synthesized
ttggccaggctggtctccatcc

SEQ ID NO: 713375 - DNA, 22 bp, Artificial Sequence
  chemically synthesized
gccaggctggtctccatcctcc

SEQ ID NO: 713376 - DNA, 22 bp, Artificial Sequence
  chemically synthesized
gtctccatcctcctatctttta

SEQ ID NO: 713377 - DNA, 22 bp, Artificial Sequence
  chemically synthesized
catcctcctatcttttaaccat

SEQ ID NO: 713378 - DNA, 22 bp, Artificial Sequence
  chemically synthesized
caaacaaccgtgaaatggttaa

SEQ ID NO: 713379 - DNA, 22 bp, Artificial Sequence
  chemically synthesized
gcaaacaaccgtgaaatggtta

SEQ ID NO: 713380 - DNA, 22 bp, Artificial Sequence
  chemically synthesized
tgcaaacaaccgtgaaatggtt

SEQ ID NO: 713381 - DNA, 22 bp, Artificial Sequence
  chemically synthesized
tttgcaaacaaccgtgaaatgg

SEQ ID NO: 713382 - DNA, 22 bp, Artificial Sequence
  chemically synthesized
ctatcttttaaccatttcacgg

SEQ ID NO: 713383 - DNA, 22 bp, Artificial Sequence
  chemically synthesized
tcttttaaccatttcacggttg

SEQ ID NO: 713384 - DNA, 22 bp, Artificial Sequence
  chemically synthesized
aaagttctttgcaaacaaccgt

SEQ ID NO: 713385 - DNA, 22 bp, Artificial Sequence
  chemically synthesized
ttaaccatttcacggttgtttg

SEQ ID NO: 713386 - DNA, 22 bp, Artificial Sequence
  chemically synthesized
gaaagttctttgcaaacaaccg

SEQ ID NO: 713387 - DNA, 22 bp, Artificial Sequence
  chemically synthesized
taaccatttcacggttgtttgc

SEQ ID NO: 713388 - DNA, 22 bp, Artificial Sequence
  chemically synthesized
tgaaagttctttgcaaacaacc

SEQ ID NO: 713389 - DNA, 22 bp, Artificial Sequence
  chemically synthesized
aaccatttcacggttgtttgca

SEQ ID NO: 713390 - DNA, 22 bp, Artificial Sequence
  chemically synthesized
accatttcacggttgtttgcaa

SEQ ID NO: 713391 - DNA, 22 bp, Artificial Sequence
  chemically synthesized
tattttgaaagttctttgcaaa

SEQ ID NO: 713392 - DNA, 22 bp, Artificial Sequence
  chemically synthesized
cacggttgtttgcaaagaactt

SEQ ID NO: 713393 - DNA, 22 bp, Artificial Sequence
  chemically synthesized
acggttgtttgcaaagaacttt

SEQ ID NO: 713394 - DNA, 22 bp, Artificial Sequence
  chemically synthesized
atcactgtattttgaaagttct

SEQ ID NO: 713395 - DNA, 22 bp, Artificial Sequence
  chemically synthesized
taatcactgtattttgaaagtt

SEQ ID NO: 713396 - DNA, 22 bp, Artificial Sequence
  chemically synthesized
tttgcaaagaactttcaaaata

SEQ ID NO: 713397 - DNA, 22 bp, Artificial Sequence
  chemically synthesized
gcaaagaactttcaaaatacag

SEQ ID NO: 713398 - DNA, 22 bp, Artificial Sequence
  chemically synthesized
caaagaactttcaaaatacagt

SEQ ID NO: 713399 - DNA, 22 bp, Artificial Sequence
  chemically synthesized
tcaaaatacagtgattagaatg

SEQ ID NO: 713400 - DNA, 22 bp, Artificial Sequence
  chemically synthesized
caaaatacagtgattagaatga

SEQ ID NO: 713401 - DNA, 22 bp, Artificial Sequence
  chemically synthesized
aaaatacagtgattagaatgat

SEQ ID NO: 713402 - DNA, 22 bp, Artificial Sequence
  chemically synthesized
gaatgattcgttttcttgtctt

SEQ ID NO: 713403 - DNA, 22 bp, Artificial Sequence
  chemically synthesized
aatacagtaaggaaaagacaag

SEQ ID NO: 713404 - DNA, 22 bp, Artificial Sequence
  chemically synthesized
caatacagtaaggaaaagacaa

SEQ ID NO: 713405 - DNA, 22 bp, Artificial Sequence
  chemically synthesized
gttttcttgtcttttccttact

SEQ ID NO: 713406 - DNA, 22 bp, Artificial Sequence
  chemically synthesized
tcttgtcttttccttactgtat

SEQ ID NO: 713407 - DNA, 22 bp, Artificial Sequence
  chemically synthesized
cttgtcttttccttactgtatt

SEQ ID NO: 713408 - DNA, 22 bp, Artificial Sequence
  chemically synthesized
ttgtcttttccttactgtattg

SEQ ID NO: 713409 - DNA, 22 bp, Artificial Sequence
  chemically synthesized
gtcttttccttactgtattgaa

SEQ ID NO: 713410 - DNA, 22 bp, Artificial Sequence
  chemically synthesized
tcttttccttactgtattgaaa

SEQ ID NO: 713411 - DNA, 22 bp, Artificial Sequence
  chemically synthesized
accataaaaaatcaatttcaat

SEQ ID NO: 713412 - DNA, 22 bp, Artificial Sequence
  chemically synthesized
ttccttactgtattgaaattga

SEQ ID NO: 713413 - DNA, 22 bp, Artificial Sequence
  chemically synthesized
tccttactgtattgaaattgat

SEQ ID NO: 713414 - DNA, 22 bp, Artificial Sequence
  chemically synthesized
ccttactgtattgaaattgatt

SEQ ID NO: 713415 - DNA, 22 bp, Artificial Sequence
  chemically synthesized
cttactgtattgaaattgattt

SEQ ID NO: 713416 - DNA, 22 bp, Artificial Sequence
  chemically synthesized
acctaaccataaaaaatcaatt

SEQ ID NO: 713417 - DNA, 22 bp, Artificial Sequence
  chemically synthesized
actgtattgaaattgatttttt

SEQ ID NO: 713418 - DNA, 22 bp, Artificial Sequence
  chemically synthesized
ctgtattgaaattgatttttta

SEQ ID NO: 713419 - DNA, 22 bp, Artificial Sequence
  chemically synthesized
tattcacctaaccataaaaaat

SEQ ID NO: 713420 - DNA, 22 bp, Artificial Sequence
  chemically synthesized
tattgaaattgattttttatgg

SEQ ID NO: 713421 - DNA, 22 bp, Artificial Sequence
  chemically synthesized
aaattgattttttatggttagg

SEQ ID NO: 713422 - DNA, 22 bp, Artificial Sequence
  chemically synthesized
atcatctatattcacctaacca

SEQ ID NO: 713423 - DNA, 22 bp, Artificial Sequence
  chemically synthesized
aatcatctatattcacctaacc

SEQ ID NO: 713424 - DNA, 22 bp, Artificial Sequence
  chemically synthesized
attttttatggttaggtgaata

SEQ ID NO: 713425 - DNA, 22 bp, Artificial Sequence
  chemically synthesized
tatttaatcatctatattcacc

SEQ ID NO: 713426 - DNA, 22 bp, Artificial Sequence
  chemically synthesized
atatttaatcatctatattcac

SEQ ID NO: 713427 - DNA, 22 bp, Artificial Sequence
  chemically synthesized
tttatggttaggtgaatataga

SEQ ID NO: 713428 - DNA, 22 bp, Artificial Sequence
  chemically synthesized
tatatttaatcatctatattca

SEQ ID NO: 713429 - DNA, 22 bp, Artificial Sequence
  chemically synthesized
ttatggttaggtgaatatagat

SEQ ID NO: 713430 - DNA, 22 bp, Artificial Sequence
  chemically synthesized
ttatatttaatcatctatattc

SEQ ID NO: 713431 - DNA, 22 bp, Artificial Sequence
  chemically synthesized
tatggttaggtgaatatagatg

SEQ ID NO: 713432 - DNA, 22 bp, Artificial Sequence
  chemically synthesized
atggttaggtgaatatagatga

SEQ ID NO: 713433 - DNA, 22 bp, Artificial Sequence
  chemically synthesized
tggttaggtgaatatagatgat

SEQ ID NO: 713434 - DNA, 22 bp, Artificial Sequence
  chemically synthesized
aatgcttttatatttaatcatc

SEQ ID NO: 713435 - DNA, 22 bp, Artificial Sequence
  chemically synthesized
ggtgaatatagatgattaaata

SEQ ID NO: 713436 - DNA, 22 bp, Artificial Sequence
  chemically synthesized
aacaacacaaaatcattcaatg

SEQ ID NO: 713437 - DNA, 22 bp, Artificial Sequence
  chemically synthesized
aatataaaagcattgaatgatt

SEQ ID NO: 713438 - DNA, 22 bp, Artificial Sequence
  chemically synthesized
tctaaacaacacaaaatcattc

SEQ ID NO: 713439 - DNA, 22 bp, Artificial Sequence
  chemically synthesized
atctaaacaacacaaaatcatt

SEQ ID NO: 713440 - DNA, 22 bp, Artificial Sequence
  chemically synthesized
tatctaaacaacacaaaatcat

SEQ ID NO: 713441 - DNA, 22 bp, Artificial Sequence
  chemically synthesized
ttatctaaacaacacaaaatca

SEQ ID NO: 713442 - DNA, 22 bp, Artificial Sequence
  chemically synthesized
acagtttttatctaaacaacac

SEQ ID NO: 713443 - DNA, 22 bp, Artificial Sequence
  chemically synthesized
aatgattttgtgttgtttagat

SEQ ID NO: 713444 - DNA, 22 bp, Artificial Sequence
  chemically synthesized
tgtgttgtttagataaaaactg

SEQ ID NO: 713445 - DNA, 22 bp, Artificial Sequence
  chemically synthesized
atgcaaaattcacagtttttat

SEQ ID NO: 713446 - DNA, 22 bp, Artificial Sequence
  chemically synthesized
gtgttgtttagataaaaactgt

SEQ ID NO: 713447 - DNA, 22 bp, Artificial Sequence
  chemically synthesized
tgttgtttagataaaaactgtg

SEQ ID NO: 713448 - DNA, 22 bp, Artificial Sequence
  chemically synthesized
ctcatgcaaaattcacagtttt

SEQ ID NO: 713449 - DNA, 22 bp, Artificial Sequence
  chemically synthesized
actcatgcaaaattcacagttt

SEQ ID NO: 713450 - DNA, 22 bp, Artificial Sequence
  chemically synthesized
tactcatgcaaaattcacagtt

SEQ ID NO: 713451 - DNA, 22 bp, Artificial Sequence
  chemically synthesized
tttagataaaaactgtgaattt

SEQ ID NO: 713452 - DNA, 22 bp, Artificial Sequence
  chemically synthesized
agataaaaactgtgaattttgc

SEQ ID NO: 713453 - DNA, 22 bp, Artificial Sequence
  chemically synthesized
gataaaaactgtgaattttgca

SEQ ID NO: 713454 - DNA, 22 bp, Artificial Sequence
  chemically synthesized
gccctttactcatgcaaaattc

SEQ ID NO: 713455 - DNA, 22 bp, Artificial Sequence
  chemically synthesized
tgaattttgcatgagtaaaggg

SEQ ID NO: 713456 - DNA, 22 bp, Artificial Sequence
  chemically synthesized
tgcatgagtaaagggctagtat

SEQ ID NO: 713457 - DNA, 22 bp, Artificial Sequence
  chemically synthesized
gcatgagtaaagggctagtatc

SEQ ID NO: 713458 - DNA, 22 bp, Artificial Sequence
  chemically synthesized
catgagtaaagggctagtatcg

SEQ ID NO: 713459 - DNA, 22 bp, Artificial Sequence
  chemically synthesized
aagtaggaacaatagcgatact

SEQ ID NO: 713460 - DNA, 22 bp, Artificial Sequence
  chemically synthesized
caagtaggaacaatagcgatac

SEQ ID NO: 713461 - DNA, 22 bp, Artificial Sequence
  chemically synthesized
tcaagtaggaacaatagcgata

SEQ ID NO: 713462 - DNA, 22 bp, Artificial Sequence
  chemically synthesized
aaatcattttcaagtaggaaca

SEQ ID NO: 713463 - DNA, 22 bp, Artificial Sequence
  chemically synthesized
gtatcgctattgttcctacttg

SEQ ID NO: 713464 - DNA, 22 bp, Artificial Sequence
  chemically synthesized
ttgttcctacttgaaaatgatt

SEQ ID NO: 713465 - DNA, 22 bp, Artificial Sequence
  chemically synthesized
ttcctacttgaaaatgatttca

SEQ ID NO: 713466 - DNA, 22 bp, Artificial Sequence
  chemically synthesized
atatcagtgcactgaaatcatt

SEQ ID NO: 713467 - DNA, 22 bp, Artificial Sequence
  chemically synthesized
gatatcagtgcactgaaatcat

SEQ ID NO: 713468 - DNA, 22 bp, Artificial Sequence
  chemically synthesized
ctacttgaaaatgatttcagtg

SEQ ID NO: 713469 - DNA, 22 bp, Artificial Sequence
  chemically synthesized
cttgaaaatgatttcagtgcac

SEQ ID NO: 713470 - DNA, 22 bp, Artificial Sequence
  chemically synthesized
gaaaatgatttcagtgcactga

SEQ ID NO: 713471 - DNA, 22 bp, Artificial Sequence
  chemically synthesized
aaaatgatttcagtgcactgat

SEQ ID NO: 713472 - DNA, 22 bp, Artificial Sequence
  chemically synthesized
gaaaaagtttgatatcagtgca

SEQ ID NO: 713473 - DNA, 22 bp, Artificial Sequence
  chemically synthesized
cagtgcactgatatcaaacttt

SEQ ID NO: 713474 - DNA, 22 bp, Artificial Sequence
  chemically synthesized
agtgcactgatatcaaactttt

SEQ ID NO: 713475 - DNA, 22 bp, Artificial Sequence
  chemically synthesized
gaaaagtctagaaaaagtttga

SEQ ID NO: 713476 - DNA, 22 bp, Artificial Sequence
  chemically synthesized
ggaaaagtctagaaaaagtttg

SEQ ID NO: 713477 - DNA, 22 bp, Artificial Sequence
  chemically synthesized
tggaaaagtctagaaaaagttt

SEQ ID NO: 713478 - DNA, 22 bp, Artificial Sequence
  chemically synthesized
ctttggaaaagtctagaaaaag

SEQ ID NO: 713479 - DNA, 22 bp, Artificial Sequence
  chemically synthesized
atatcaaactttttctagactt

SEQ ID NO: 713480 - DNA, 22 bp, Artificial Sequence
  chemically synthesized
cgattactttggaaaagtctag

SEQ ID NO: 713481 - DNA, 22 bp, Artificial Sequence
  chemically synthesized
ccgattactttggaaaagtcta

SEQ ID NO: 713482 - DNA, 22 bp, Artificial Sequence
  chemically synthesized
tttctagacttttccaaagtaa

SEQ ID NO: 713483 - DNA, 22 bp, Artificial Sequence
  chemically synthesized
gagcatttccgattactttgga

SEQ ID NO: 713484 - DNA, 22 bp, Artificial Sequence
  chemically synthesized
ttctagacttttccaaagtaat

SEQ ID NO: 713485 - DNA, 22 bp, Artificial Sequence
  chemically synthesized
ggagcatttccgattactttgg

SEQ ID NO: 713486 - DNA, 22 bp, Artificial Sequence
  chemically synthesized
tctagacttttccaaagtaatc

SEQ ID NO: 713487 - DNA, 22 bp, Artificial Sequence
  chemically synthesized
ctagacttttccaaagtaatcg

SEQ ID NO: 713488 - DNA, 22 bp, Artificial Sequence
  chemically synthesized
tagacttttccaaagtaatcgg

SEQ ID NO: 713489 - DNA, 22 bp, Artificial Sequence
  chemically synthesized
gacttttccaaagtaatcggaa

SEQ ID NO: 713490 - DNA, 22 bp, Artificial Sequence
  chemically synthesized
aaaatttggagcatttccgatt

SEQ ID NO: 713491 - DNA, 22 bp, Artificial Sequence
  chemically synthesized
caaaatttggagcatttccgat

SEQ ID NO: 713492 - DNA, 22 bp, Artificial Sequence
  chemically synthesized
ttccaaagtaatcggaaatgct

SEQ ID NO: 713493 - DNA, 22 bp, Artificial Sequence
  chemically synthesized
tccaaagtaatcggaaatgctc

SEQ ID NO: 713494 - DNA, 22 bp, Artificial Sequence
  chemically synthesized
ccaaagtaatcggaaatgctcc

SEQ ID NO: 713495 - DNA, 22 bp, Artificial Sequence
  chemically synthesized
caaagtaatcggaaatgctcca

SEQ ID NO: 713496 - DNA, 22 bp, Artificial Sequence
  chemically synthesized
aaaaagtttcaaaatttggagc

SEQ ID NO: 713497 - DNA, 22 bp, Artificial Sequence
  chemically synthesized
caaattttgaaactttttgagt

SEQ ID NO: 713498 - DNA, 22 bp, Artificial Sequence
  chemically synthesized
tgacgtcatgtcagtactcaaa

SEQ ID NO: 713499 - DNA, 22 bp, Artificial Sequence
  chemically synthesized
gtgacgtcatgtcagtactcaa

SEQ ID NO: 713500 - DNA, 22 bp, Artificial Sequence
  chemically synthesized
tgaaactttttgagtactgaca

SEQ ID NO: 713501 - DNA, 22 bp, Artificial Sequence
  chemically synthesized
gaaactttttgagtactgacat

SEQ ID NO: 713502 - DNA, 22 bp, Artificial Sequence
  chemically synthesized
aaactttttgagtactgacatg

SEQ ID NO: 713503 - DNA, 22 bp, Artificial Sequence
  chemically synthesized
cacttgtgacgtcatgtcagta

SEQ ID NO: 713504 - DNA, 22 bp, Artificial Sequence
  chemically synthesized
ccacttgtgacgtcatgtcagt

SEQ ID NO: 713505 - DNA, 22 bp, Artificial Sequence
  chemically synthesized
tccacttgtgacgtcatgtcag

SEQ ID NO: 713506 - DNA, 22 bp, Artificial Sequence
  chemically synthesized
tttgagtactgacatgacgtca

SEQ ID NO: 713507 - DNA, 22 bp, Artificial Sequence
  chemically synthesized
ttgagtactgacatgacgtcac

SEQ ID NO: 713508 - DNA, 22 bp, Artificial Sequence
  chemically synthesized
tgagtactgacatgacgtcaca

SEQ ID NO: 713509 - DNA, 22 bp, Artificial Sequence
  chemically synthesized
gagtactgacatgacgtcacaa

SEQ ID NO: 713510 - DNA, 22 bp, Artificial Sequence
  chemically synthesized
agtactgacatgacgtcacaag

SEQ ID NO: 713511 - DNA, 22 bp, Artificial Sequence
  chemically synthesized
acatgacgtcacaagtggaaaa

SEQ ID NO: 713512 - DNA, 22 bp, Artificial Sequence
  chemically synthesized
tcacatgaggtcaggtgtgaaa

SEQ ID NO: 713513 - DNA, 22 bp, Artificial Sequence
  chemically synthesized
tgacctgtcacatgaggtcagg

SEQ ID NO: 713514 - DNA, 22 bp, Artificial Sequence
  chemically synthesized
actgtgacctgtcacatgaggt

SEQ ID NO: 713515 - DNA, 22 bp, Artificial Sequence
  chemically synthesized
gactgtgacctgtcacatgagg

SEQ ID NO: 713516 - DNA, 22 bp, Artificial Sequence
  chemically synthesized
tgactgtgacctgtcacatgag

SEQ ID NO: 713517 - DNA, 22 bp, Artificial Sequence
  chemically synthesized
cacacctgacctcatgtgacag

SEQ ID NO: 713518 - DNA, 22 bp, Artificial Sequence
  chemically synthesized
acacctgacctcatgtgacagg

SEQ ID NO: 713519 - DNA, 22 bp, Artificial Sequence
  chemically synthesized
acctcatgtgacaggtcacagt

SEQ ID NO: 713520 - DNA, 22 bp, Artificial Sequence
  chemically synthesized
atgtgacaggtcacagtcaaaa

SEQ ID NO: 713521 - DNA, 22 bp, Artificial Sequence
  chemically synthesized
tgcgtgaaacacaaaagttttg

SEQ ID NO: 713522 - DNA, 22 bp, Artificial Sequence
  chemically synthesized
gtgcgtgaaacacaaaagtttt

SEQ ID NO: 713523 - DNA, 22 bp, Artificial Sequence
  chemically synthesized
tgtgcgtgaaacacaaaagttt

SEQ ID NO: 713524 - DNA, 22 bp, Artificial Sequence
  chemically synthesized
ttgtgcgtgaaacacaaaagtt

SEQ ID NO: 713525 - DNA, 22 bp, Artificial Sequence
  chemically synthesized
aatacttttgtgcgtgaaacac

SEQ ID NO: 713526 - DNA, 22 bp, Artificial Sequence
  chemically synthesized
aaatacttttgtgcgtgaaaca

SEQ ID NO: 713527 - DNA, 22 bp, Artificial Sequence
  chemically synthesized
taaatacttttgtgcgtgaaac

SEQ ID NO: 713528 - DNA, 22 bp, Artificial Sequence
  chemically synthesized
ttgtgtttcacgcacaaaagta

SEQ ID NO: 713529 - DNA, 22 bp, Artificial Sequence
  chemically synthesized
tgtgtttcacgcacaaaagtat

SEQ ID NO: 713530 - DNA, 22 bp, Artificial Sequence
  chemically synthesized
gtgtttcacgcacaaaagtatt

SEQ ID NO: 713531 - DNA, 22 bp, Artificial Sequence
  chemically synthesized
tacaatattttaaatacttttg

SEQ ID NO: 713532 - DNA, 22 bp, Artificial Sequence
  chemically synthesized
tgtttcacgcacaaaagtattt

SEQ ID NO: 713533 - DNA, 22 bp, Artificial Sequence
  chemically synthesized
atacaatattttaaatactttt

SEQ ID NO: 713534 - DNA, 22 bp, Artificial Sequence
  chemically synthesized
tatacaatattttaaatacttt

SEQ ID NO: 713535 - DNA, 22 bp, Artificial Sequence
  chemically synthesized
cacgcacaaaagtatttaaaat

SEQ ID NO: 713536 - DNA, 22 bp, Artificial Sequence
  chemically synthesized
acgcacaaaagtatttaaaata

SEQ ID NO: 713537 - DNA, 22 bp, Artificial Sequence
  chemically synthesized
aaggaaattttatacaatattt

SEQ ID NO: 713538 - DNA, 22 bp, Artificial Sequence
  chemically synthesized
aaaatattgtataaaatttcct

SEQ ID NO: 713539 - DNA, 22 bp, Artificial Sequence
  chemically synthesized
aaatattgtataaaatttcctt

SEQ ID NO: 713540 - DNA, 22 bp, Artificial Sequence
  chemically synthesized
tacacataccctgaaggaaatt

SEQ ID NO: 713541 - DNA, 22 bp, Artificial Sequence
  chemically synthesized
atacacataccctgaaggaaat

SEQ ID NO: 713542 - DNA, 22 bp, Artificial Sequence
  chemically synthesized
tataaaatttccttcagggtat

SEQ ID NO: 713543 - DNA, 22 bp, Artificial Sequence
  chemically synthesized
gtatataccttatacacatacc

SEQ ID NO: 713544 - DNA, 22 bp, Artificial Sequence
  chemically synthesized
cgtatataccttatacacatac

SEQ ID NO: 713545 - DNA, 22 bp, Artificial Sequence
  chemically synthesized
ccttcagggtatgtgtataagg

SEQ ID NO: 713546 - DNA, 22 bp, Artificial Sequence
  chemically synthesized
cttcagggtatgtgtataaggt

SEQ ID NO: 713547 - DNA, 22 bp, Artificial Sequence
  chemically synthesized
tatttcgtatataccttataca

SEQ ID NO: 713548 - DNA, 22 bp, Artificial Sequence
  chemically synthesized
atatttcgtatataccttatac

SEQ ID NO: 713549 - DNA, 22 bp, Artificial Sequence
  chemically synthesized
cagggtatgtgtataaggtata

SEQ ID NO: 713550 - DNA, 22 bp, Artificial Sequence
  chemically synthesized
agggtatgtgtataaggtatat

SEQ ID NO: 713551 - DNA, 22 bp, Artificial Sequence
  chemically synthesized
atttatatttcgtatatacctt

SEQ ID NO: 713552 - DNA, 22 bp, Artificial Sequence
  chemically synthesized
aacatgaaattcatttatattt

SEQ ID NO: 713553 - DNA, 22 bp, Artificial Sequence
  chemically synthesized
ggatgggacccaagcctaaaca

SEQ ID NO: 713554 - DNA, 22 bp, Artificial Sequence
  chemically synthesized
gggatgggacccaagcctaaac

SEQ ID NO: 713555 - DNA, 22 bp, Artificial Sequence
  chemically synthesized
catgtttaggcttgggtcccat

SEQ ID NO: 713556 - DNA, 22 bp, Artificial Sequence
  chemically synthesized
atgtttaggcttgggtcccatc

SEQ ID NO: 713557 - DNA, 22 bp, Artificial Sequence
  chemically synthesized
atgagatatcttgggatgggac

SEQ ID NO: 713558 - DNA, 22 bp, Artificial Sequence
  chemically synthesized
ctcatgagatatcttgggatgg

SEQ ID NO: 713559 - DNA, 22 bp, Artificial Sequence
  chemically synthesized
aggcttgggtcccatcccaaga

SEQ ID NO: 713560 - DNA, 22 bp, Artificial Sequence
  chemically synthesized
ggcttgggtcccatcccaagat

SEQ ID NO: 713561 - DNA, 22 bp, Artificial Sequence
  chemically synthesized
gggtcccatcccaagatatctc

SEQ ID NO: 713562 - DNA, 22 bp, Artificial Sequence
  chemically synthesized
catattcctcatgagatatctt

SEQ ID NO: 713563 - DNA, 22 bp, Artificial Sequence
  chemically synthesized
ggtcccatcccaagatatctca

SEQ ID NO: 713564 - DNA, 22 bp, Artificial Sequence
  chemically synthesized
gcatattcctcatgagatatct

SEQ ID NO: 713565 - DNA, 22 bp, Artificial Sequence
  chemically synthesized
gaatatttgcatattcctcatg

SEQ ID NO: 713566 - DNA, 22 bp, Artificial Sequence
  chemically synthesized
ggaatatttgcatattcctcat

SEQ ID NO: 713567 - DNA, 22 bp, Artificial Sequence
  chemically synthesized
tggaatatttgcatattcctca

SEQ ID NO: 713568 - DNA, 22 bp, Artificial Sequence
  chemically synthesized
tggattttggaatatttgcata

SEQ ID NO: 713569 - DNA, 22 bp, Artificial Sequence
  chemically synthesized
gtggattttggaatatttgcat

SEQ ID NO: 713570 - DNA, 22 bp, Artificial Sequence
  chemically synthesized
tgtggattttggaatatttgca

SEQ ID NO: 713571 - DNA, 22 bp, Artificial Sequence
  chemically synthesized
ttgtggattttggaatatttgc

SEQ ID NO: 713572 - DNA, 22 bp, Artificial Sequence
  chemically synthesized
atgaggaatatgcaaatattcc

SEQ ID NO: 713573 - DNA, 22 bp, Artificial Sequence
  chemically synthesized
tttttgtggattttggaatatt

SEQ ID NO: 713574 - DNA, 22 bp, Artificial Sequence
  chemically synthesized
atttttgtggattttggaatat

SEQ ID NO: 713575 - DNA, 22 bp, Artificial Sequence
  chemically synthesized
tatttttgtggattttggaata

SEQ ID NO: 713576 - DNA, 22 bp, Artificial Sequence
  chemically synthesized
ttatttttgtggattttggaat

SEQ ID NO: 713577 - DNA, 22 bp, Artificial Sequence
  chemically synthesized
tttatttttgtggattttggaa

SEQ ID NO: 713578 - DNA, 22 bp, Artificial Sequence
  chemically synthesized
gattttttatttttgtggattt

SEQ ID NO: 713579 - DNA, 22 bp, Artificial Sequence
  chemically synthesized
ggattttttatttttgtggatt

SEQ ID NO: 713580 - DNA, 22 bp, Artificial Sequence
  chemically synthesized
tggattttttatttttgtggat

SEQ ID NO: 713581 - DNA, 22 bp, Artificial Sequence
  chemically synthesized
caaaatccacaaaaataaaaaa

SEQ ID NO: 713582 - DNA, 22 bp, Artificial Sequence
  chemically synthesized
ggaccagaagtgttttggattt

SEQ ID NO: 713583 - DNA, 22 bp, Artificial Sequence
  chemically synthesized
gggaccagaagtgttttggatt

SEQ ID NO: 713584 - DNA, 22 bp, Artificial Sequence
  chemically synthesized
tccaaaatgcttgggaccagaa

SEQ ID NO: 713585 - DNA, 22 bp, Artificial Sequence
  chemically synthesized
atccaaaatgcttgggaccaga

SEQ ID NO: 713586 - DNA, 22 bp, Artificial Sequence
  chemically synthesized
cttatccaaaatgcttgggacc

SEQ ID NO: 713587 - DNA, 22 bp, Artificial Sequence
  chemically synthesized
agtattccttatccaaaatgct

SEQ ID NO: 713588 - DNA, 22 bp, Artificial Sequence
  chemically synthesized
ctggtcccaagcattttggata

SEQ ID NO: 713589 - DNA, 22 bp, Artificial Sequence
  chemically synthesized
tggtcccaagcattttggataa

SEQ ID NO: 713590 - DNA, 22 bp, Artificial Sequence
  chemically synthesized
gtcccaagcattttggataagg

SEQ ID NO: 713591 - DNA, 22 bp, Artificial Sequence
  chemically synthesized
gatcggaaaacaagttaagtat

SEQ ID NO: 713592 - DNA, 22 bp, Artificial Sequence
  chemically synthesized
tggataaggaatacttaacttg

SEQ ID NO: 713593 - DNA, 22 bp, Artificial Sequence
  chemically synthesized
ggataaggaatacttaacttgt

SEQ ID NO: 713594 - DNA, 22 bp, Artificial Sequence
  chemically synthesized
gataaggaatacttaacttgtt

SEQ ID NO: 713595 - DNA, 22 bp, Artificial Sequence
  chemically synthesized
gggccaggttagatcggaaaac

SEQ ID NO: 713596 - DNA, 22 bp, Artificial Sequence
  chemically synthesized
aacttgttttccgatctaacct

SEQ ID NO: 713597 - DNA, 22 bp, Artificial Sequence
  chemically synthesized
aatgttagggccaggttagatc

SEQ ID NO: 713598 - DNA, 22 bp, Artificial Sequence
  chemically synthesized
acttgttttccgatctaacctg

SEQ ID NO: 713599 - DNA, 22 bp, Artificial Sequence
  chemically synthesized
gttttccgatctaacctggccc

SEQ ID NO: 713600 - DNA, 22 bp, Artificial Sequence
  chemically synthesized
ttttccgatctaacctggccct

SEQ ID NO: 713601 - DNA, 22 bp, Artificial Sequence
  chemically synthesized
caaagttgaatgttagggccag

SEQ ID NO: 713602 - DNA, 22 bp, Artificial Sequence
  chemically synthesized
tccgatctaacctggccctaac

SEQ ID NO: 713603 - DNA, 22 bp, Artificial Sequence
  chemically synthesized
ccgatctaacctggccctaaca

SEQ ID NO: 713604 - DNA, 22 bp, Artificial Sequence
  chemically synthesized
cgatctaacctggccctaacat

SEQ ID NO: 713605 - DNA, 22 bp, Artificial Sequence
  chemically synthesized
tatattacaaagttgaatgtta

SEQ ID NO: 713606 - DNA, 22 bp, Artificial Sequence
  chemically synthesized
acctggccctaacattcaactt

SEQ ID NO: 713607 - DNA, 22 bp, Artificial Sequence
  chemically synthesized
attatatattacaaagttgaat

SEQ ID NO: 713608 - DNA, 22 bp, Artificial Sequence
  chemically synthesized
cattatatattacaaagttgaa

SEQ ID NO: 713609 - DNA, 22 bp, Artificial Sequence
  chemically synthesized
ttcattatatattacaaagttg

SEQ ID NO: 713610 - DNA, 22 bp, Artificial Sequence
  chemically synthesized
gccctaacattcaactttgtaa

SEQ ID NO: 713611 - DNA, 22 bp, Artificial Sequence
  chemically synthesized
cttcattatatattacaaagtt

SEQ ID NO: 713612 - DNA, 22 bp, Artificial Sequence
  chemically synthesized
tttcttcattatatattacaaa

SEQ ID NO: 713613 - DNA, 22 bp, Artificial Sequence
  chemically synthesized
atttcttcattatatattacaa

SEQ ID NO: 713614 - DNA, 22 bp, Artificial Sequence
  chemically synthesized
tatttcttcattatatattaca

SEQ ID NO: 713615 - DNA, 22 bp, Artificial Sequence
  chemically synthesized
acattcaactttgtaatatata

SEQ ID NO: 713616 - DNA, 22 bp, Artificial Sequence
  chemically synthesized
ttttatttcttcattatatatt

SEQ ID NO: 713617 - DNA, 22 bp, Artificial Sequence
  chemically synthesized
ttgttttatttcttcattatat

SEQ ID NO: 713618 - DNA, 22 bp, Artificial Sequence
  chemically synthesized
aactttgtaatatataatgaag

SEQ ID NO: 713619 - DNA, 22 bp, Artificial Sequence
  chemically synthesized
tgttgttttatttcttcattat

SEQ ID NO: 713620 - DNA, 22 bp, Artificial Sequence
  chemically synthesized
ctctgttgttttatttcttcat

SEQ ID NO: 713621 - DNA, 22 bp, Artificial Sequence
  chemically synthesized
tgtaatatataatgaagaaata

SEQ ID NO: 713622 - DNA, 22 bp, Artificial Sequence
  chemically synthesized
actctgttgttttatttcttca

SEQ ID NO: 713623 - DNA, 22 bp, Artificial Sequence
  chemically synthesized
gtaatatataatgaagaaataa

SEQ ID NO: 713624 - DNA, 22 bp, Artificial Sequence
  chemically synthesized
taatatataatgaagaaataaa

SEQ ID NO: 713625 - DNA, 22 bp, Artificial Sequence
  chemically synthesized
agccaccgcacccggccttact

SEQ ID NO: 713626 - DNA, 22 bp, Artificial Sequence
  chemically synthesized
caggcctgagccaccgcacccg

SEQ ID NO: 713627 - DNA, 22 bp, Artificial Sequence
  chemically synthesized
ggattacaggcctgagccaccg

SEQ ID NO: 713628 - DNA, 22 bp, Artificial Sequence
  chemically synthesized
ccgaagtgctgggattacaggc

SEQ ID NO: 713629 - DNA, 22 bp, Artificial Sequence
  chemically synthesized
ggcctcccgaagtgctgggatt

SEQ ID NO: 713630 - DNA, 22 bp, Artificial Sequence
  chemically synthesized
aggcctgtaatcccagcacttc

SEQ ID NO: 713631 - DNA, 22 bp, Artificial Sequence
  chemically synthesized
taatcccagcacttcgggaggc

SEQ ID NO: 713632 - DNA, 22 bp, Artificial Sequence
  chemically synthesized
gtgatccaccagcctcggcctc

SEQ ID NO: 713633 - DNA, 22 bp, Artificial Sequence
  chemically synthesized
acctcgtgatccaccagcctcg

SEQ ID NO: 713634 - DNA, 22 bp, Artificial Sequence
  chemically synthesized
ctgacctcgtgatccaccagcc

SEQ ID NO: 713635 - DNA, 22 bp, Artificial Sequence
  chemically synthesized
cgggaggccgaggctggtggat

SEQ ID NO: 713636 - DNA, 22 bp, Artificial Sequence
  chemically synthesized
gggaggccgaggctggtggatc

SEQ ID NO: 713637 - DNA, 22 bp, Artificial Sequence
  chemically synthesized
gatctcctgacctcgtgatcca

SEQ ID NO: 713638 - DNA, 22 bp, Artificial Sequence
  chemically synthesized
gtggatcacgaggtcaggagat

SEQ ID NO: 713639 - DNA, 22 bp, Artificial Sequence
  chemically synthesized
gccaggatggtctcgatctcct

SEQ ID NO: 713640 - DNA, 22 bp, Artificial Sequence
  chemically synthesized
accgtgttagccaggatggtct

SEQ ID NO: 713641 - DNA, 22 bp, Artificial Sequence
  chemically synthesized
caccgtgttagccaggatggtc

SEQ ID NO: 713642 - DNA, 22 bp, Artificial Sequence
  chemically synthesized
gagacggggtttcaccgtgtta

SEQ ID NO: 713643 - DNA, 22 bp, Artificial Sequence
  chemically synthesized
ctagagacggggtttcaccgtg

SEQ ID NO: 713644 - DNA, 22 bp, Artificial Sequence
  chemically synthesized
actagagacggggtttcaccgt

SEQ ID NO: 713645 - DNA, 22 bp, Artificial Sequence
  chemically synthesized
tactagagacggggtttcaccg

SEQ ID NO: 713646 - DNA, 22 bp, Artificial Sequence
  chemically synthesized
ttactagagacggggtttcacc

SEQ ID NO: 713647 - DNA, 22 bp, Artificial Sequence
  chemically synthesized
gctaacacggtgaaaccccgtc

SEQ ID NO: 713648 - DNA, 22 bp, Artificial Sequence
  chemically synthesized
tgtttttactagagacggggtt

SEQ ID NO: 713649 - DNA, 22 bp, Artificial Sequence
  chemically synthesized
gtgtttttactagagacggggt

SEQ ID NO: 713650 - DNA, 22 bp, Artificial Sequence
  chemically synthesized
tgtgtttttactagagacgggg

SEQ ID NO: 713651 - DNA, 22 bp, Artificial Sequence
  chemically synthesized
acacggtgaaaccccgtctcta

SEQ ID NO: 713652 - DNA, 22 bp, Artificial Sequence
  chemically synthesized
ttgtgtttttactagagacggg

SEQ ID NO: 713653 - DNA, 22 bp, Artificial Sequence
  chemically synthesized
tttgtgtttttactagagacgg

SEQ ID NO: 713654 - DNA, 22 bp, Artificial Sequence
  chemically synthesized
ttttgtgtttttactagagacg

SEQ ID NO: 713655 - DNA, 22 bp, Artificial Sequence
  chemically synthesized
atttttttgtgtttttactaga

SEQ ID NO: 713656 - DNA, 22 bp, Artificial Sequence
  chemically synthesized
aatttttttgtgtttttactag

SEQ ID NO: 713657 - DNA, 22 bp, Artificial Sequence
  chemically synthesized
atttaatttttttgtgttttta

SEQ ID NO: 713658 - DNA, 22 bp, Artificial Sequence
  chemically synthesized
tagtaaaaacacaaaaaaatta

SEQ ID NO: 713659 - DNA, 22 bp, Artificial Sequence
  chemically synthesized
gtaaaaacacaaaaaaattaaa

SEQ ID NO: 713660 - DNA, 22 bp, Artificial Sequence
  chemically synthesized
caggtgcccgccaccatgcccg

SEQ ID NO: 713661 - DNA, 22 bp, Artificial Sequence
  chemically synthesized
aattagccgggcatggtggcgg

SEQ ID NO: 713662 - DNA, 22 bp, Artificial Sequence
  chemically synthesized
ggactacaggtgcccgccacca

SEQ ID NO: 713663 - DNA, 22 bp, Artificial Sequence
  chemically synthesized
gccgggcatggtggcgggcacc

SEQ ID NO: 713664 - DNA, 22 bp, Artificial Sequence
  chemically synthesized
ccgagcagctgggactacaggt

SEQ ID NO: 713665 - DNA, 22 bp, Artificial Sequence
  chemically synthesized
aacctcccgagcagctgggact

SEQ ID NO: 713666 - DNA, 22 bp, Artificial Sequence
  chemically synthesized
cctcaacctcccgagcagctgg

SEQ ID NO: 713667 - DNA, 22 bp, Artificial Sequence
  chemically synthesized
ctgcctcaacctcccgagcagc

SEQ ID NO: 713668 - DNA, 22 bp, Artificial Sequence
  chemically synthesized
tcctgcctcaacctcccgagca

SEQ ID NO: 713669 - DNA, 22 bp, Artificial Sequence
  chemically synthesized
tagtcccagctgctcgggaggt

SEQ ID NO: 713670 - DNA, 22 bp, Artificial Sequence
  chemically synthesized
acgccattctcctgcctcaacc

SEQ ID NO: 713671 - DNA, 22 bp, Artificial Sequence
  chemically synthesized
ctcgggaggttgaggcaggaga

SEQ ID NO: 713672 - DNA, 22 bp, Artificial Sequence
  chemically synthesized
gggaggttgaggcaggagaatg

SEQ ID NO: 713673 - DNA, 22 bp, Artificial Sequence
  chemically synthesized
cggggttcacgccattctcctg

SEQ ID NO: 713674 - DNA, 22 bp, Artificial Sequence
  chemically synthesized
cgcctccggggttcacgccatt

SEQ ID NO: 713675 - DNA, 22 bp, Artificial Sequence
  chemically synthesized
aggcaggagaatggcgtgaacc

SEQ ID NO: 713676 - DNA, 22 bp, Artificial Sequence
  chemically synthesized
caagctccgcctccggggttca

SEQ ID NO: 713677 - DNA, 22 bp, Artificial Sequence
  chemically synthesized
actgcaagctccgcctccgggg

SEQ ID NO: 713678 - DNA, 22 bp, Artificial Sequence
  chemically synthesized
ggctcactgcaagctccgcctc

SEQ ID NO: 713679 - DNA, 22 bp, Artificial Sequence
  chemically synthesized
gagtgcagtggcacgatctcgg

SEQ ID NO: 713680 - DNA, 22 bp, Artificial Sequence
  chemically synthesized
gcagtgagccgagatcgtgcca

SEQ ID NO: 713681 - DNA, 22 bp, Artificial Sequence
  chemically synthesized
cagtgagccgagatcgtgccac

SEQ ID NO: 713682 - DNA, 22 bp, Artificial Sequence
  chemically synthesized
tcacccaggctggagtgcagtg

SEQ ID NO: 713683 - DNA, 22 bp, Artificial Sequence
  chemically synthesized
tgtcacccaggctggagtgcag

SEQ ID NO: 713684 - DNA, 22 bp, Artificial Sequence
  chemically synthesized
actctgtcacccaggctggagt

SEQ ID NO: 713685 - DNA, 22 bp, Artificial Sequence
  chemically synthesized
cactccagcctgggtgacagag

SEQ ID NO: 713686 - DNA, 22 bp, Artificial Sequence
  chemically synthesized
agacggtgtctcactctgtcac

SEQ ID NO: 713687 - DNA, 22 bp, Artificial Sequence
  chemically synthesized
gagacggtgtctcactctgtca

SEQ ID NO: 713688 - DNA, 22 bp, Artificial Sequence
  chemically synthesized
tgagacggtgtctcactctgtc

SEQ ID NO: 713689 - DNA, 22 bp, Artificial Sequence
  chemically synthesized
ttgagacggtgtctcactctgt

SEQ ID NO: 713690 - DNA, 22 bp, Artificial Sequence
  chemically synthesized
cagcctgggtgacagagtgaga

SEQ ID NO: 713691 - DNA, 22 bp, Artificial Sequence
  chemically synthesized
tttgagacggtgtctcactctg

SEQ ID NO: 713692 - DNA, 22 bp, Artificial Sequence
  chemically synthesized
ttttttgagacggtgtctcact

SEQ ID NO: 713693 - DNA, 22 bp, Artificial Sequence
  chemically synthesized
gttttttgagacggtgtctcac

SEQ ID NO: 713694 - DNA, 22 bp, Artificial Sequence
  chemically synthesized
tgttttttgagacggtgtctca

SEQ ID NO: 713695 - DNA, 22 bp, Artificial Sequence
  chemically synthesized
ttgttttttgagacggtgtctc

SEQ ID NO: 713696 - DNA, 22 bp, Artificial Sequence
  chemically synthesized
ggtgacagagtgagacaccgtc

SEQ ID NO: 713697 - DNA, 22 bp, Artificial Sequence
  chemically synthesized
tttttgttttttgagacggtgt

SEQ ID NO: 713698 - DNA, 22 bp, Artificial Sequence
  chemically synthesized
gtttttgttttttgagacggtg

SEQ ID NO: 713699 - DNA, 22 bp, Artificial Sequence
  chemically synthesized
tgtttttgttttttgagacggt

SEQ ID NO: 713700 - DNA, 22 bp, Artificial Sequence
  chemically synthesized
ttgtttttgttttttgagacgg

SEQ ID NO: 713701 - DNA, 22 bp, Artificial Sequence
  chemically synthesized
tttttgtttttgttttttgaga

SEQ ID NO: 713702 - DNA, 22 bp, Artificial Sequence
  chemically synthesized
gtttttgtttttgttttttgag

SEQ ID NO: 713703 - DNA, 22 bp, Artificial Sequence
  chemically synthesized
tttgtttttgtttttgtttttt

SEQ ID NO: 713704 - DNA, 22 bp, Artificial Sequence
  chemically synthesized
gtttgtttttgtttttgttttt

SEQ ID NO: 713705 - DNA, 22 bp, Artificial Sequence
  chemically synthesized
tttgtttgtttttgtttttgtt

SEQ ID NO: 713706 - DNA, 22 bp, Artificial Sequence
  chemically synthesized
gtttgtttgtttttgtttttgt

SEQ ID NO: 713707 - DNA, 22 bp, Artificial Sequence
  chemically synthesized
tttgtttgtttgtttttgtttt

SEQ ID NO: 713708 - DNA, 22 bp, Artificial Sequence
  chemically synthesized
ttgtttgtttgtttgtttttgt

SEQ ID NO: 713709 - DNA, 22 bp, Artificial Sequence
  chemically synthesized
aaaaaacaaaaacaaaaacaaa

SEQ ID NO: 713710 - DNA, 22 bp, Artificial Sequence
  chemically synthesized
tgttgtttgtttgtttgttttt

SEQ ID NO: 713711 - DNA, 22 bp, Artificial Sequence
  chemically synthesized
ctctgttgtttgtttgtttgtt

SEQ ID NO: 713712 - DNA, 22 bp, Artificial Sequence
  chemically synthesized
actctgttgtttgtttgtttgt

SEQ ID NO: 713713 - DNA, 22 bp, Artificial Sequence
  chemically synthesized
gaagtttactctgttgtttgtt

SEQ ID NO: 713714 - DNA, 22 bp, Artificial Sequence
  chemically synthesized
tggaagtttactctgttgtttg

SEQ ID NO: 713715 - DNA, 22 bp, Artificial Sequence
  chemically synthesized
ctctggaagtttactctgttgt

SEQ ID NO: 713716 - DNA, 22 bp, Artificial Sequence
  chemically synthesized
actctggaagtttactctgttg

SEQ ID NO: 713717 - DNA, 22 bp, Artificial Sequence
  chemically synthesized
tttactctggaagtttactctg

SEQ ID NO: 713718 - DNA, 22 bp, Artificial Sequence
  chemically synthesized
gtttactctggaagtttactct

SEQ ID NO: 713719 - DNA, 22 bp, Artificial Sequence
  chemically synthesized
aggtatagatttgtttactctg

SEQ ID NO: 713720 - DNA, 22 bp, Artificial Sequence
  chemically synthesized
aatatccctgaggtatagattt

SEQ ID NO: 713721 - DNA, 22 bp, Artificial Sequence
  chemically synthesized
ccagagtaaacaaatctatacc

SEQ ID NO: 713722 - DNA, 22 bp, Artificial Sequence
  chemically synthesized
aaatatccctgaggtatagatt

SEQ ID NO: 713723 - DNA, 22 bp, Artificial Sequence
  chemically synthesized
cagagtaaacaaatctatacct

SEQ ID NO: 713724 - DNA, 22 bp, Artificial Sequence
  chemically synthesized
atatttaaatatccctgaggta

SEQ ID NO: 713725 - DNA, 22 bp, Artificial Sequence
  chemically synthesized
tgatatttaaatatccctgagg

SEQ ID NO: 713726 - DNA, 22 bp, Artificial Sequence
  chemically synthesized
ctgatatttaaatatccctgag

SEQ ID NO: 713727 - DNA, 22 bp, Artificial Sequence
  chemically synthesized
tttctgatatttaaatatccct

SEQ ID NO: 713728 - DNA, 22 bp, Artificial Sequence
  chemically synthesized
atttctgatatttaaatatccc

SEQ ID NO: 713729 - DNA, 22 bp, Artificial Sequence
  chemically synthesized
tacctcagggatatttaaatat

SEQ ID NO: 713730 - DNA, 22 bp, Artificial Sequence
  chemically synthesized
agggatatttaaatatcagaaa

SEQ ID NO: 713731 - DNA, 22 bp, Artificial Sequence
  chemically synthesized
aaatatcagaaataaactcata

SEQ ID NO: 713732 - DNA, 22 bp, Artificial Sequence
  chemically synthesized
aatatcagaaataaactcatac

SEQ ID NO: 713733 - DNA, 22 bp, Artificial Sequence
  chemically synthesized
tgaagatggtaagtcaaaagta

SEQ ID NO: 713734 - DNA, 22 bp, Artificial Sequence
  chemically synthesized
atgaagatggtaagtcaaaagt

SEQ ID NO: 713735 - DNA, 22 bp, Artificial Sequence
  chemically synthesized
ccttatgaagatggtaagtcaa

SEQ ID NO: 713736 - DNA, 22 bp, Artificial Sequence
  chemically synthesized
atacttttgacttaccatcttc

SEQ ID NO: 713737 - DNA, 22 bp, Artificial Sequence
  chemically synthesized
ttgacttaccatcttcataagg

SEQ ID NO: 713738 - DNA, 22 bp, Artificial Sequence
  chemically synthesized
tgacttaccatcttcataaggc

SEQ ID NO: 713739 - DNA, 22 bp, Artificial Sequence
  chemically synthesized
agcatatgcattgccttatgaa

SEQ ID NO: 713740 - DNA, 22 bp, Artificial Sequence
  chemically synthesized
gacttaccatcttcataaggca

SEQ ID NO: 713741 - DNA, 22 bp, Artificial Sequence
  chemically synthesized
acttaccatcttcataaggcaa

SEQ ID NO: 713742 - DNA, 22 bp, Artificial Sequence
  chemically synthesized
tgttcagcatatgcattgcctt

SEQ ID NO: 713743 - DNA, 22 bp, Artificial Sequence
  chemically synthesized
accatcttcataaggcaatgca

SEQ ID NO: 713744 - DNA, 22 bp, Artificial Sequence
  chemically synthesized
ccatcttcataaggcaatgcat

SEQ ID NO: 713745 - DNA, 22 bp, Artificial Sequence
  chemically synthesized
cataaggcaatgcatatgctga

SEQ ID NO: 713746 - DNA, 22 bp, Artificial Sequence
  chemically synthesized
ataaggcaatgcatatgctgaa

SEQ ID NO: 713747 - DNA, 22 bp, Artificial Sequence
  chemically synthesized
gtgaacagataagaatcatctg

SEQ ID NO: 713748 - DNA, 22 bp, Artificial Sequence
  chemically synthesized
ggtgaacagataagaatcatct

SEQ ID NO: 713749 - DNA, 22 bp, Artificial Sequence
  chemically synthesized
gtttggtgaacagataagaatc

SEQ ID NO: 713750 - DNA, 22 bp, Artificial Sequence
  chemically synthesized
agtttggtgaacagataagaat

SEQ ID NO: 713751 - DNA, 22 bp, Artificial Sequence
  chemically synthesized
aacacagatgattcttatctgt

SEQ ID NO: 713752 - DNA, 22 bp, Artificial Sequence
  chemically synthesized
aagaccttagtttggtgaacag

SEQ ID NO: 713753 - DNA, 22 bp, Artificial Sequence
  chemically synthesized
aaagaccttagtttggtgaaca

SEQ ID NO: 713754 - DNA, 22 bp, Artificial Sequence
  chemically synthesized
ttatctgttcaccaaactaagg

SEQ ID NO: 713755 - DNA, 22 bp, Artificial Sequence
  chemically synthesized
aagtccttaaagaccttagttt

SEQ ID NO: 713756 - DNA, 22 bp, Artificial Sequence
  chemically synthesized
atctgttcaccaaactaaggtc

SEQ ID NO: 713757 - DNA, 22 bp, Artificial Sequence
  chemically synthesized
tctgttcaccaaactaaggtct

SEQ ID NO: 713758 - DNA, 22 bp, Artificial Sequence
  chemically synthesized
ttcaccaaactaaggtctttaa

SEQ ID NO: 713759 - DNA, 22 bp, Artificial Sequence
  chemically synthesized
gtagttaaagtccttaaagacc

SEQ ID NO: 713760 - DNA, 22 bp, Artificial Sequence
  chemically synthesized
agtagttaaagtccttaaagac

SEQ ID NO: 713761 - DNA, 22 bp, Artificial Sequence
  chemically synthesized
accaaactaaggtctttaagga

SEQ ID NO: 713762 - DNA, 22 bp, Artificial Sequence
  chemically synthesized
ttagtagttaaagtccttaaag

SEQ ID NO: 713763 - DNA, 22 bp, Artificial Sequence
  chemically synthesized
aggtctttaaggactttaacta

SEQ ID NO: 713764 - DNA, 22 bp, Artificial Sequence
  chemically synthesized
acgtaaatattcttagtagtta

SEQ ID NO: 713765 - DNA, 22 bp, Artificial Sequence
  chemically synthesized
taaggactttaactactaagaa

SEQ ID NO: 713766 - DNA, 22 bp, Artificial Sequence
  chemically synthesized
aaggactttaactactaagaat

SEQ ID NO: 713767 - DNA, 22 bp, Artificial Sequence
  chemically synthesized
aggactttaactactaagaata

SEQ ID NO: 713768 - DNA, 22 bp, Artificial Sequence
  chemically synthesized
aattaacgtaaatattcttagt

SEQ ID NO: 713769 - DNA, 22 bp, Artificial Sequence
  chemically synthesized
gaattaacgtaaatattcttag

SEQ ID NO: 713770 - DNA, 22 bp, Artificial Sequence
  chemically synthesized
acttgaattaacgtaaatattc

SEQ ID NO: 713771 - DNA, 22 bp, Artificial Sequence
  chemically synthesized
taactactaagaatatttacgt

SEQ ID NO: 713772 - DNA, 22 bp, Artificial Sequence
  chemically synthesized
aactactaagaatatttacgtt

SEQ ID NO: 713773 - DNA, 22 bp, Artificial Sequence
  chemically synthesized
actactaagaatatttacgtta

SEQ ID NO: 713774 - DNA, 22 bp, Artificial Sequence
  chemically synthesized
ctaagaatatttacgttaattc

SEQ ID NO: 713775 - DNA, 22 bp, Artificial Sequence
  chemically synthesized
agaatatttacgttaattcaag

SEQ ID NO: 713776 - DNA, 22 bp, Artificial Sequence
  chemically synthesized
aaacaaatattaacttgaatta

SEQ ID NO: 713777 - DNA, 22 bp, Artificial Sequence
  chemically synthesized
aaaacaaatattaacttgaatt

SEQ ID NO: 713778 - DNA, 22 bp, Artificial Sequence
  chemically synthesized
taaaacaaatattaacttgaat

SEQ ID NO: 713779 - DNA, 22 bp, Artificial Sequence
  chemically synthesized
ttaaaacaaatattaacttgaa

SEQ ID NO: 713780 - DNA, 22 bp, Artificial Sequence
  chemically synthesized
tttaaaacaaatattaacttga

SEQ ID NO: 713781 - DNA, 22 bp, Artificial Sequence
  chemically synthesized
ttttttaaaacaaatattaact

SEQ ID NO: 713782 - DNA, 22 bp, Artificial Sequence
  chemically synthesized
acgttaattcaagttaatattt

SEQ ID NO: 713783 - DNA, 22 bp, Artificial Sequence
  chemically synthesized
cgttaattcaagttaatatttg

SEQ ID NO: 713784 - DNA, 22 bp, Artificial Sequence
  chemically synthesized
tgttttttaaaacaaatattaa

SEQ ID NO: 713785 - DNA, 22 bp, Artificial Sequence
  chemically synthesized
attcaagttaatatttgtttta

SEQ ID NO: 713786 - DNA, 22 bp, Artificial Sequence
  chemically synthesized
aaagattctgttttttaaaaca

SEQ ID NO: 713787 - DNA, 22 bp, Artificial Sequence
  chemically synthesized
aagttaatatttgttttaaaaa

SEQ ID NO: 713788 - DNA, 22 bp, Artificial Sequence
  chemically synthesized
aaaagattctgttttttaaaac

SEQ ID NO: 713789 - DNA, 22 bp, Artificial Sequence
  chemically synthesized
atatttgttttaaaaaacagaa

SEQ ID NO: 713790 - DNA, 22 bp, Artificial Sequence
  chemically synthesized
aatatttaaaagattctgtttt

SEQ ID NO: 713791 - DNA, 22 bp, Artificial Sequence
  chemically synthesized
gttttaaaaaacagaatctttt

SEQ ID NO: 713792 - DNA, 22 bp, Artificial Sequence
  chemically synthesized
ttttaaaaaacagaatctttta

SEQ ID NO: 713793 - DNA, 22 bp, Artificial Sequence
  chemically synthesized
tatcctgaatatttaaaagatt

SEQ ID NO: 713794 - DNA, 22 bp, Artificial Sequence
  chemically synthesized
taaaaaacagaatcttttaaat

SEQ ID NO: 713795 - DNA, 22 bp, Artificial Sequence
  chemically synthesized
aaaaaacagaatcttttaaata

SEQ ID NO: 713796 - DNA, 22 bp, Artificial Sequence
  chemically synthesized
aaaaacagaatcttttaaatat

SEQ ID NO: 713797 - DNA, 22 bp, Artificial Sequence
  chemically synthesized
gtgaaacatctatatcctgaat

SEQ ID NO: 713798 - DNA, 22 bp, Artificial Sequence
  chemically synthesized
aattggtgaaacatctatatcc

SEQ ID NO: 713799 - DNA, 22 bp, Artificial Sequence
  chemically synthesized
ttaaatattcaggatatagatg

SEQ ID NO: 713800 - DNA, 22 bp, Artificial Sequence
  chemically synthesized
taaatattcaggatatagatgt

SEQ ID NO: 713801 - DNA, 22 bp, Artificial Sequence
  chemically synthesized
aaatattcaggatatagatgtt

SEQ ID NO: 713802 - DNA, 22 bp, Artificial Sequence
  chemically synthesized
aatattcaggatatagatgttt

SEQ ID NO: 713803 - DNA, 22 bp, Artificial Sequence
  chemically synthesized
aggatatagatgtttcaccaat

SEQ ID NO: 713804 - DNA, 22 bp, Artificial Sequence
  chemically synthesized
accagaaagggtagattgaatt

SEQ ID NO: 713805 - DNA, 22 bp, Artificial Sequence
  chemically synthesized
gaccagaaagggtagattgaat

SEQ ID NO: 713806 - DNA, 22 bp, Artificial Sequence
  chemically synthesized
tgaccagaaagggtagattgaa

SEQ ID NO: 713807 - DNA, 22 bp, Artificial Sequence
  chemically synthesized
ttgaccagaaagggtagattga

SEQ ID NO: 713808 - DNA, 22 bp, Artificial Sequence
  chemically synthesized
acttttgaccagaaagggtaga

SEQ ID NO: 713809 - DNA, 22 bp, Artificial Sequence
  chemically synthesized
caccaattcaatctaccctttc

SEQ ID NO: 713810 - DNA, 22 bp, Artificial Sequence
  chemically synthesized
aacttttgaccagaaagggtag

SEQ ID NO: 713811 - DNA, 22 bp, Artificial Sequence
  chemically synthesized
accaattcaatctaccctttct

SEQ ID NO: 713812 - DNA, 22 bp, Artificial Sequence
  chemically synthesized
tttaacttttgaccagaaaggg

SEQ ID NO: 713813 - DNA, 22 bp, Artificial Sequence
  chemically synthesized
atttaacttttgaccagaaagg

SEQ ID NO: 713814 - DNA, 22 bp, Artificial Sequence
  chemically synthesized
aatctaccctttctggtcaaaa

SEQ ID NO: 713815 - DNA, 22 bp, Artificial Sequence
  chemically synthesized
catccaatttatttaacttttg

SEQ ID NO: 713816 - DNA, 22 bp, Artificial Sequence
  chemically synthesized
ccctttctggtcaaaagttaaa

SEQ ID NO: 713817 - DNA, 22 bp, Artificial Sequence
  chemically synthesized
tctggtcaaaagttaaataaat

SEQ ID NO: 713818 - DNA, 22 bp, Artificial Sequence
  chemically synthesized
agattccatccaatttatttaa

SEQ ID NO: 713819 - DNA, 22 bp, Artificial Sequence
  chemically synthesized
ctggtcaaaagttaaataaatt

SEQ ID NO: 713820 - DNA, 22 bp, Artificial Sequence
  chemically synthesized
gagattccatccaatttattta

SEQ ID NO: 713821 - DNA, 22 bp, Artificial Sequence
  chemically synthesized
tggtcaaaagttaaataaattg

SEQ ID NO: 713822 - DNA, 22 bp, Artificial Sequence
  chemically synthesized
gtcaaaagttaaataaattgga

SEQ ID NO: 713823 - DNA, 22 bp, Artificial Sequence
  chemically synthesized
tgaatacttgagattccatcca

SEQ ID NO: 713824 - DNA, 22 bp, Artificial Sequence
  chemically synthesized
aataaattggatggaatctcaa

SEQ ID NO: 713825 - DNA, 22 bp, Artificial Sequence
  chemically synthesized
tatgtagttatgaatacttgag

SEQ ID NO: 713826 - DNA, 22 bp, Artificial Sequence
  chemically synthesized
atatgtagttatgaatacttga

SEQ ID NO: 713827 - DNA, 22 bp, Artificial Sequence
  chemically synthesized
ttatatgtagttatgaatactt

SEQ ID NO: 713828 - DNA, 22 bp, Artificial Sequence
  chemically synthesized
gatggaatctcaagtattcata

SEQ ID NO: 713829 - DNA, 22 bp, Artificial Sequence
  chemically synthesized
ttcttatatgtagttatgaata

SEQ ID NO: 713830 - DNA, 22 bp, Artificial Sequence
  chemically synthesized
gttcttatatgtagttatgaat

SEQ ID NO: 713831 - DNA, 22 bp, Artificial Sequence
  chemically synthesized
tgttcttatatgtagttatgaa

SEQ ID NO: 713832 - DNA, 22 bp, Artificial Sequence
  chemically synthesized
ttgttcttatatgtagttatga

SEQ ID NO: 713833 - DNA, 22 bp, Artificial Sequence
  chemically synthesized
aagtattcataactacatataa

SEQ ID NO: 713834 - DNA, 22 bp, Artificial Sequence
  chemically synthesized
atagtttttgttcttatatgta

SEQ ID NO: 713835 - DNA, 22 bp, Artificial Sequence
  chemically synthesized
gatagtttttgttcttatatgt

SEQ ID NO: 713836 - DNA, 22 bp, Artificial Sequence
  chemically synthesized
ttgatagtttttgttcttatat

SEQ ID NO: 713837 - DNA, 22 bp, Artificial Sequence
  chemically synthesized
ataactacatataagaacaaaa

SEQ ID NO: 713838 - DNA, 22 bp, Artificial Sequence
  chemically synthesized
atacattcttgatagtttttgt

SEQ ID NO: 713839 - DNA, 22 bp, Artificial Sequence
  chemically synthesized
catataagaacaaaaactatca

SEQ ID NO: 713840 - DNA, 22 bp, Artificial Sequence
  chemically synthesized
ttgatacattcttgatagtttt

SEQ ID NO: 713841 - DNA, 22 bp, Artificial Sequence
  chemically synthesized
gttgatacattcttgatagttt

SEQ ID NO: 713842 - DNA, 22 bp, Artificial Sequence
  chemically synthesized
tgttgatacattcttgatagtt

SEQ ID NO: 713843 - DNA, 22 bp, Artificial Sequence
  chemically synthesized
ttgttgatacattcttgatagt

SEQ ID NO: 713844 - DNA, 22 bp, Artificial Sequence
  chemically synthesized
tcaagaatgtatcaacaaaagg

SEQ ID NO: 713845 - DNA, 22 bp, Artificial Sequence
  chemically synthesized
aaagaggccacggaaacctttt

SEQ ID NO: 713846 - DNA, 22 bp, Artificial Sequence
  chemically synthesized
tgtgtactgaaagaggccacgg

SEQ ID NO: 713847 - DNA, 22 bp, Artificial Sequence
  chemically synthesized
atgtgtactgaaagaggccacg

SEQ ID NO: 713848 - DNA, 22 bp, Artificial Sequence
  chemically synthesized
ccgtggcctctttcagtacaca

SEQ ID NO: 713849 - DNA, 22 bp, Artificial Sequence
  chemically synthesized
cgtggcctctttcagtacacat

SEQ ID NO: 713850 - DNA, 22 bp, Artificial Sequence
  chemically synthesized
tttcagtacacataagacatgt

SEQ ID NO: 713851 - DNA, 22 bp, Artificial Sequence
  chemically synthesized
tcagtacacataagacatgtat

SEQ ID NO: 713852 - DNA, 22 bp, Artificial Sequence
  chemically synthesized
cagtacacataagacatgtatc

SEQ ID NO: 713853 - DNA, 22 bp, Artificial Sequence
  chemically synthesized
agtacacataagacatgtatct

SEQ ID NO: 713854 - DNA, 22 bp, Artificial Sequence
  chemically synthesized
aaaaaaaaaaaaaaaaaaaaaa

SEQ ID NO: 713855 - DNA, 22 bp, Artificial Sequence
  chemically synthesized
tctcaaaaaaaaaaaaaaaaaa

SEQ ID NO: 713856 - DNA, 22 bp, Artificial Sequence
  chemically synthesized
tgtctcaaaaaaaaaaaaaaaa

SEQ ID NO: 713857 - DNA, 22 bp, Artificial Sequence
  chemically synthesized
tttttttttttttttttttttt

SEQ ID NO: 713858 - DNA, 22 bp, Artificial Sequence
  chemically synthesized
tttttttttttttttttttttt

SEQ ID NO: 713859 - DNA, 22 bp, Artificial Sequence
  chemically synthesized
tttttttttttttttttttttt

SEQ ID NO: 713860 - DNA, 22 bp, Artificial Sequence
  chemically synthesized
tttttttttttttttttttttt

SEQ ID NO: 713861 - DNA, 22 bp, Artificial Sequence
  chemically synthesized
tttttttttttttttttttttg

SEQ ID NO: 713862 - DNA, 22 bp, Artificial Sequence
  chemically synthesized
ttttttttttttttttttttga

SEQ ID NO: 713863 - DNA, 22 bp, Artificial Sequence
  chemically synthesized
tttttttttttttttttttgag

SEQ ID NO: 713864 - DNA, 22 bp, Artificial Sequence
  chemically synthesized
ttttttttttttttttttgaga

SEQ ID NO: 713865 - DNA, 22 bp, Artificial Sequence
  chemically synthesized
tttttttttttttttttgagac

SEQ ID NO: 713866 - DNA, 22 bp, Artificial Sequence
  chemically synthesized
ttttttttttttttttgagaca

SEQ ID NO: 713867 - DNA, 22 bp, Artificial Sequence
  chemically synthesized
tttttttttttttttgagacag

SEQ ID NO: 713868 - DNA, 22 bp, Artificial Sequence
  chemically synthesized
ttttttttttttttgagacaga

SEQ ID NO: 713869 - DNA, 22 bp, Artificial Sequence
  chemically synthesized
tttttttttttttgagacagag

SEQ ID NO: 713870 - DNA, 22 bp, Artificial Sequence
  chemically synthesized
ttttttttttttgagacagagt

SEQ ID NO: 713871 - DNA, 22 bp, Artificial Sequence
  chemically synthesized
tttttttttttgagacagagtc

SEQ ID NO: 713872 - DNA, 22 bp, Artificial Sequence
  chemically synthesized
gtgacagagcaagactctgtct

SEQ ID NO: 713873 - DNA, 22 bp, Artificial Sequence
  chemically synthesized
ttttttttttgagacagagtct

SEQ ID NO: 713874 - DNA, 22 bp, Artificial Sequence
  chemically synthesized
tttttttttgagacagagtctt

SEQ ID NO: 713875 - DNA, 22 bp, Artificial Sequence
  chemically synthesized
ttttttttgagacagagtcttg

SEQ ID NO: 713876 - DNA, 22 bp, Artificial Sequence
  chemically synthesized
tttttttgagacagagtcttgc

SEQ ID NO: 713877 - DNA, 22 bp, Artificial Sequence
  chemically synthesized
ttttttgagacagagtcttgct

SEQ ID NO: 713878 - DNA, 22 bp, Artificial Sequence
  chemically synthesized
tttttgagacagagtcttgctc

SEQ ID NO: 713879 - DNA, 22 bp, Artificial Sequence
  chemically synthesized
ttttgagacagagtcttgctct

SEQ ID NO: 713880 - DNA, 22 bp, Artificial Sequence
  chemically synthesized
cagcctggtgacagagcaagac

SEQ ID NO: 713881 - DNA, 22 bp, Artificial Sequence
  chemically synthesized
tttgagacagagtcttgctctg

SEQ ID NO: 713882 - DNA, 22 bp, Artificial Sequence
  chemically synthesized
ttgagacagagtcttgctctgt

SEQ ID NO: 713883 - DNA, 22 bp, Artificial Sequence
  chemically synthesized
tgagacagagtcttgctctgtc

SEQ ID NO: 713884 - DNA, 22 bp, Artificial Sequence
  chemically synthesized
gagacagagtcttgctctgtca

SEQ ID NO: 713885 - DNA, 22 bp, Artificial Sequence
  chemically synthesized
agacagagtcttgctctgtcac

SEQ ID NO: 713886 - DNA, 22 bp, Artificial Sequence
  chemically synthesized
cactccagcctggtgacagagc

SEQ ID NO: 713887 - DNA, 22 bp, Artificial Sequence
  chemically synthesized
gctctgtcaccaggctggagtg

SEQ ID NO: 713888 - DNA, 22 bp, Artificial Sequence
  chemically synthesized
ctctgtcaccaggctggagtgc

SEQ ID NO: 713889 - DNA, 22 bp, Artificial Sequence
  chemically synthesized
tgtcaccaggctggagtgcagt

SEQ ID NO: 713890 - DNA, 22 bp, Artificial Sequence
  chemically synthesized
tcaccaggctggagtgcagtgg

SEQ ID NO: 713891 - DNA, 22 bp, Artificial Sequence
  chemically synthesized
cagtgagccgagatggcgccac

SEQ ID NO: 713892 - DNA, 22 bp, Artificial Sequence
  chemically synthesized
gagtgcagtggcgccatctcgg

SEQ ID NO: 713893 - DNA, 22 bp, Artificial Sequence
  chemically synthesized
aacccgggaagcggaagttgca

SEQ ID NO: 713894 - DNA, 22 bp, Artificial Sequence
  chemically synthesized
gaacccgggaagcggaagttgc

SEQ ID NO: 713895 - DNA, 22 bp, Artificial Sequence
  chemically synthesized
ggctcactgcaacttccgcttc

SEQ ID NO: 713896 - DNA, 22 bp, Artificial Sequence
  chemically synthesized
actgcaacttccgcttcccggg

SEQ ID NO: 713897 - DNA, 22 bp, Artificial Sequence
  chemically synthesized
caacttccgcttcccgggttca

SEQ ID NO: 713898 - DNA, 22 bp, Artificial Sequence
  chemically synthesized
ccgcttcccgggttcaagcgat

SEQ ID NO: 713899 - DNA, 22 bp, Artificial Sequence
  chemically synthesized
cgcttcccgggttcaagcgatt

SEQ ID NO: 713900 - DNA, 22 bp, Artificial Sequence
  chemically synthesized
cccgggttcaagcgattctcct

SEQ ID NO: 713901 - DNA, 22 bp, Artificial Sequence
  chemically synthesized
ccgggttcaagcgattctcctg

SEQ ID NO: 713902 - DNA, 22 bp, Artificial Sequence
  chemically synthesized
gggaggccgaggcaggagaatc

SEQ ID NO: 713903 - DNA, 22 bp, Artificial Sequence
  chemically synthesized
ctggggaggccgaggcaggaga

SEQ ID NO: 713904 - DNA, 22 bp, Artificial Sequence
  chemically synthesized
aagcgattctcctgcctcggcc

SEQ ID NO: 713905 - DNA, 22 bp, Artificial Sequence
  chemically synthesized
tagtcccagctactggggaggc

SEQ ID NO: 713906 - DNA, 22 bp, Artificial Sequence
  chemically synthesized
tcctgcctcggcctccccagta

SEQ ID NO: 713907 - DNA, 22 bp, Artificial Sequence
  chemically synthesized
ctgcctcggcctccccagtagc

SEQ ID NO: 713908 - DNA, 22 bp, Artificial Sequence
  chemically synthesized
cctcggcctccccagtagctgg

SEQ ID NO: 713909 - DNA, 22 bp, Artificial Sequence
  chemically synthesized
ggcctccccagtagctgggact

SEQ ID NO: 713910 - DNA, 22 bp, Artificial Sequence
  chemically synthesized
cccagtagctgggactacaggc

SEQ ID NO: 713911 - DNA, 22 bp, Artificial Sequence
  chemically synthesized
gccaggcgtggtggtgcatgcc

SEQ ID NO: 713912 - DNA, 22 bp, Artificial Sequence
  chemically synthesized
ggactacaggcatgcaccacca

SEQ ID NO: 713913 - DNA, 22 bp, Artificial Sequence
  chemically synthesized
caggcatgcaccaccacgcctg

SEQ ID NO: 713914 - DNA, 22 bp, Artificial Sequence
  chemically synthesized
aaaatacaaaaattagccaggc

SEQ ID NO: 713915 - DNA, 22 bp, Artificial Sequence
  chemically synthesized
ctaaaaatacaaaaattagcca

SEQ ID NO: 713916 - DNA, 22 bp, Artificial Sequence
  chemically synthesized
tactaaaaatacaaaaattagc

SEQ ID NO: 713917 - DNA, 22 bp, Artificial Sequence
  chemically synthesized
atctctactaaaaatacaaaaa

SEQ ID NO: 713918 - DNA, 22 bp, Artificial Sequence
  chemically synthesized
gctaatttttgtatttttagta

SEQ ID NO: 713919 - DNA, 22 bp, Artificial Sequence
  chemically synthesized
atttttgtatttttagtagaga

SEQ ID NO: 713920 - DNA, 22 bp, Artificial Sequence
  chemically synthesized
ttgtatttttagtagagatgag

SEQ ID NO: 713921 - DNA, 22 bp, Artificial Sequence
  chemically synthesized
tgtatttttagtagagatgagt

SEQ ID NO: 713922 - DNA, 22 bp, Artificial Sequence
  chemically synthesized
gtatttttagtagagatgagtt

SEQ ID NO: 713923 - DNA, 22 bp, Artificial Sequence
  chemically synthesized
tatttttagtagagatgagttt

SEQ ID NO: 713924 - DNA, 22 bp, Artificial Sequence
  chemically synthesized
ggcaacatggtgaaactcatct

SEQ ID NO: 713925 - DNA, 22 bp, Artificial Sequence
  chemically synthesized
ttagtagagatgagtttcacca

SEQ ID NO: 713926 - DNA, 22 bp, Artificial Sequence
  chemically synthesized
tagtagagatgagtttcaccat

SEQ ID NO: 713927 - DNA, 22 bp, Artificial Sequence
  chemically synthesized
agtagagatgagtttcaccatg

SEQ ID NO: 713928 - DNA, 22 bp, Artificial Sequence
  chemically synthesized
gtagagatgagtttcaccatgt

SEQ ID NO: 713929 - DNA, 22 bp, Artificial Sequence
  chemically synthesized
caccatgttgcccaggatggtc

SEQ ID NO: 713930 - DNA, 22 bp, Artificial Sequence
  chemically synthesized
accatgttgcccaggatggtct

SEQ ID NO: 713931 - DNA, 22 bp, Artificial Sequence
  chemically synthesized
cccaggatggtcttgatctcct

SEQ ID NO: 713932 - DNA, 22 bp, Artificial Sequence
  chemically synthesized
gatctcctgatctcgtgatccg

SEQ ID NO: 713933 - DNA, 22 bp, Artificial Sequence
  chemically synthesized
atctcctgatctcgtgatccgc

SEQ ID NO: 713934 - DNA, 22 bp, Artificial Sequence
  chemically synthesized
ggaggccgaggtgggcggatca

SEQ ID NO: 713935 - DNA, 22 bp, Artificial Sequence
  chemically synthesized
gggaggccgaggtgggcggatc

SEQ ID NO: 713936 - DNA, 22 bp, Artificial Sequence
  chemically synthesized
tgggaggccgaggtgggcggat

SEQ ID NO: 713937 - DNA, 22 bp, Artificial Sequence
  chemically synthesized
ctgatctcgtgatccgcccacc

SEQ ID NO: 713938 - DNA, 22 bp, Artificial Sequence
  chemically synthesized
atctcgtgatccgcccacctcg

SEQ ID NO: 713939 - DNA, 22 bp, Artificial Sequence
  chemically synthesized
gtgatccgcccacctcggcctc

SEQ ID NO: 713940 - DNA, 22 bp, Artificial Sequence
  chemically synthesized
taatcccagtactttgggaggc

SEQ ID NO: 713941 - DNA, 22 bp, Artificial Sequence
  chemically synthesized
acgcctgtaatcccagtacttt

SEQ ID NO: 713942 - DNA, 22 bp, Artificial Sequence
  chemically synthesized
ggcctcccaaagtactgggatt

SEQ ID NO: 713943 - DNA, 22 bp, Artificial Sequence
  chemically synthesized
ccaaagtactgggattacaggc

SEQ ID NO: 713944 - DNA, 22 bp, Artificial Sequence
  chemically synthesized
gccgggcacggtggctcacgcc

SEQ ID NO: 713945 - DNA, 22 bp, Artificial Sequence
  chemically synthesized
ggccgggcacggtggctcacgc

SEQ ID NO: 713946 - DNA, 22 bp, Artificial Sequence
  chemically synthesized
ggattacaggcgtgagccaccg

SEQ ID NO: 713947 - DNA, 22 bp, Artificial Sequence
  chemically synthesized
caggcgtgagccaccgtgcccg

SEQ ID NO: 713948 - DNA, 22 bp, Artificial Sequence
  chemically synthesized
taaagatacatgtcttggccgg

SEQ ID NO: 713949 - DNA, 22 bp, Artificial Sequence
  chemically synthesized
tataaagatacatgtcttggcc

SEQ ID NO: 713950 - DNA, 22 bp, Artificial Sequence
  chemically synthesized
ctctataaagatacatgtcttg

SEQ ID NO: 713951 - DNA, 22 bp, Artificial Sequence
  chemically synthesized
gctctataaagatacatgtctt

SEQ ID NO: 713952 - DNA, 22 bp, Artificial Sequence
  chemically synthesized
agaaaccttgctctataaagat

SEQ ID NO: 713953 - DNA, 22 bp, Artificial Sequence
  chemically synthesized
aagttgagaaaccttgctctat

SEQ ID NO: 713954 - DNA, 22 bp, Artificial Sequence
  chemically synthesized
tatagagcaaggtttctcaact

SEQ ID NO: 713955 - DNA, 22 bp, Artificial Sequence
  chemically synthesized
atagagcaaggtttctcaactt

SEQ ID NO: 713956 - DNA, 22 bp, Artificial Sequence
  chemically synthesized
tagagcaaggtttctcaacttc

SEQ ID NO: 713957 - DNA, 22 bp, Artificial Sequence
  chemically synthesized
ctcaacttcagcattattgaca

SEQ ID NO: 713958 - DNA, 22 bp, Artificial Sequence
  chemically synthesized
cccaggccaaaatgtcaataat

SEQ ID NO: 713959 - DNA, 22 bp, Artificial Sequence
  chemically synthesized
tcaacttcagcattattgacat

SEQ ID NO: 713960 - DNA, 22 bp, Artificial Sequence
  chemically synthesized
aacttcagcattattgacattt

SEQ ID NO: 713961 - DNA, 22 bp, Artificial Sequence
  chemically synthesized
cagcattattgacattttggcc

SEQ ID NO: 713962 - DNA, 22 bp, Artificial Sequence
  chemically synthesized
agcattattgacattttggcct

SEQ ID NO: 713963 - DNA, 22 bp, Artificial Sequence
  chemically synthesized
ttgacattttggcctgggcaat

SEQ ID NO: 713964 - DNA, 22 bp, Artificial Sequence
  chemically synthesized
acattttggcctgggcaatttt

SEQ ID NO: 713965 - DNA, 22 bp, Artificial Sequence
  chemically synthesized
tggcctgggcaattttttgttg

SEQ ID NO: 713966 - DNA, 22 bp, Artificial Sequence
  chemically synthesized
ggcctgggcaattttttgttgt

SEQ ID NO: 713967 - DNA, 22 bp, Artificial Sequence
  chemically synthesized
gcctgggcaattttttgttgtg

SEQ ID NO: 713968 - DNA, 22 bp, Artificial Sequence
  chemically synthesized
gtgggatagatagcacaacaaa

SEQ ID NO: 713969 - DNA, 22 bp, Artificial Sequence
  chemically synthesized
ggcaattttttgttgtgctatc

SEQ ID NO: 713970 - DNA, 22 bp, Artificial Sequence
  chemically synthesized
taattcgtgggatagatagcac

SEQ ID NO: 713971 - DNA, 22 bp, Artificial Sequence
  chemically synthesized
tataattcgtgggatagatagc

SEQ ID NO: 713972 - DNA, 22 bp, Artificial Sequence
  chemically synthesized
tctataattcgtgggatagata

SEQ ID NO: 713973 - DNA, 22 bp, Artificial Sequence
  chemically synthesized
tttgttgtgctatctatcccac

SEQ ID NO: 713974 - DNA, 22 bp, Artificial Sequence
  chemically synthesized
ttgttgtgctatctatcccacg

SEQ ID NO: 713975 - DNA, 22 bp, Artificial Sequence
  chemically synthesized
tgttgtgctatctatcccacga

SEQ ID NO: 713976 - DNA, 22 bp, Artificial Sequence
  chemically synthesized
gttgtgctatctatcccacgaa

SEQ ID NO: 713977 - DNA, 22 bp, Artificial Sequence
  chemically synthesized
ttgtgctatctatcccacgaat

SEQ ID NO: 713978 - DNA, 22 bp, Artificial Sequence
  chemically synthesized
ggcattctctataattcgtggg

SEQ ID NO: 713979 - DNA, 22 bp, Artificial Sequence
  chemically synthesized
tgctatctatcccacgaattat

SEQ ID NO: 713980 - DNA, 22 bp, Artificial Sequence
  chemically synthesized
ctaggcattctctataattcgt

SEQ ID NO: 713981 - DNA, 22 bp, Artificial Sequence
  chemically synthesized
tctatcccacgaattatagaga

SEQ ID NO: 713982 - DNA, 22 bp, Artificial Sequence
  chemically synthesized
tcccacgaattatagagaatgc

SEQ ID NO: 713983 - DNA, 22 bp, Artificial Sequence
  chemically synthesized
tggatgctgctaggcattctct

SEQ ID NO: 713984 - DNA, 22 bp, Artificial Sequence
  chemically synthesized
tagagaatgcctagcagcatcc

SEQ ID NO: 713985 - DNA, 22 bp, Artificial Sequence
  chemically synthesized
gtgggtagaagttgtggatgct

SEQ ID NO: 713986 - DNA, 22 bp, Artificial Sequence
  chemically synthesized
gcatctagtgggtagaagttgt

SEQ ID NO: 713987 - DNA, 22 bp, Artificial Sequence
  chemically synthesized
gcagcatccacaacttctaccc

SEQ ID NO: 713988 - DNA, 22 bp, Artificial Sequence
  chemically synthesized
ctggcatctagtgggtagaagt

SEQ ID NO: 713989 - DNA, 22 bp, Artificial Sequence
  chemically synthesized
gtgaggaggtgctactggcatc

SEQ ID NO: 713990 - DNA, 22 bp, Artificial Sequence
  chemically synthesized
ctacccactagatgccagtagc

SEQ ID NO: 713991 - DNA, 22 bp, Artificial Sequence
  chemically synthesized
tacccactagatgccagtagca

SEQ ID NO: 713992 - DNA, 22 bp, Artificial Sequence
  chemically synthesized
cccactagatgccagtagcacc

SEQ ID NO: 713993 - DNA, 22 bp, Artificial Sequence
  chemically synthesized
tcccaactggtgaggaggtgct

SEQ ID NO: 713994 - DNA, 22 bp, Artificial Sequence
  chemically synthesized
gatgccagtagcacctcctcac

SEQ ID NO: 713995 - DNA, 22 bp, Artificial Sequence
  chemically synthesized
agttgtcccaactggtgaggag

SEQ ID NO: 713996 - DNA, 22 bp, Artificial Sequence
  chemically synthesized
cagttgtcccaactggtgagga

SEQ ID NO: 713997 - DNA, 22 bp, Artificial Sequence
  chemically synthesized
tcagttgtcccaactggtgagg

SEQ ID NO: 713998 - DNA, 22 bp, Artificial Sequence
  chemically synthesized
gagacattttcagttgtcccaa

SEQ ID NO: 713999 - DNA, 22 bp, Artificial Sequence
  chemically synthesized
tggagacattttcagttgtccc

SEQ ID NO: 714000 - DNA, 22 bp, Artificial Sequence
  chemically synthesized
ctggagacattttcagttgtcc

SEQ ID NO: 714001 - DNA, 22 bp, Artificial Sequence
  chemically synthesized
ctcaccagttgggacaactgaa

SEQ ID NO: 714002 - DNA, 22 bp, Artificial Sequence
  chemically synthesized
accagttgggacaactgaaaat

SEQ ID NO: 714003 - DNA, 22 bp, Artificial Sequence
  chemically synthesized
ggacaactgaaaatgtctccag

SEQ ID NO: 714004 - DNA, 22 bp, Artificial Sequence
  chemically synthesized
aaaatgtctccagaaattgcca

SEQ ID NO: 714005 - DNA, 22 bp, Artificial Sequence
  chemically synthesized
tcccccaggggacatggcaatt

SEQ ID NO: 714006 - DNA, 22 bp, Artificial Sequence
  chemically synthesized
cagaaattgccatgtcccctgg

SEQ ID NO: 714007 - DNA, 22 bp, Artificial Sequence
  chemically synthesized
ccatgtcccctgggggacagac

SEQ ID NO: 714008 - DNA, 22 bp, Artificial Sequence
  chemically synthesized
aaccaagagcaagtctgtcccc

SEQ ID NO: 714009 - DNA, 22 bp, Artificial Sequence
  chemically synthesized
tcaaccaagagcaagtctgtcc

SEQ ID NO: 714010 - DNA, 22 bp, Artificial Sequence
  chemically synthesized
gtggttctcaaccaagagcaag

SEQ ID NO: 714011 - DNA, 22 bp, Artificial Sequence
  chemically synthesized
ggggacagacttgctcttggtt

SEQ ID NO: 714012 - DNA, 22 bp, Artificial Sequence
  chemically synthesized
tacactagtggttctcaaccaa

SEQ ID NO: 714013 - DNA, 22 bp, Artificial Sequence
  chemically synthesized
ctgtacactagtggttctcaac

SEQ ID NO: 714014 - DNA, 22 bp, Artificial Sequence
  chemically synthesized
actgtacactagtggttctcaa

SEQ ID NO: 714015 - DNA, 22 bp, Artificial Sequence
  chemically synthesized
gctcttggttgagaaccactag

SEQ ID NO: 714016 - DNA, 22 bp, Artificial Sequence
  chemically synthesized
ctcttggttgagaaccactagt

SEQ ID NO: 714017 - DNA, 22 bp, Artificial Sequence
  chemically synthesized
ttggttgagaaccactagtgta

SEQ ID NO: 714018 - DNA, 22 bp, Artificial Sequence
  chemically synthesized
ggttgagaaccactagtgtaca

SEQ ID NO: 714019 - DNA, 22 bp, Artificial Sequence
  chemically synthesized
gttgagaaccactagtgtacag

SEQ ID NO: 714020 - DNA, 22 bp, Artificial Sequence
  chemically synthesized
agaaccactagtgtacagtaaa

SEQ ID NO: 714021 - DNA, 22 bp, Artificial Sequence
  chemically synthesized
gtgtacagtaaactttcaccct

SEQ ID NO: 714022 - DNA, 22 bp, Artificial Sequence
  chemically synthesized
tgtatatgaagtagagggtgaa

SEQ ID NO: 714023 - DNA, 22 bp, Artificial Sequence
  chemically synthesized
tcaccctctacttcatatacac

SEQ ID NO: 714024 - DNA, 22 bp, Artificial Sequence
  chemically synthesized
caccctctacttcatatacaca

SEQ ID NO: 714025 - DNA, 22 bp, Artificial Sequence
  chemically synthesized
accctctacttcatatacacag

SEQ ID NO: 714026 - DNA, 22 bp, Artificial Sequence
  chemically synthesized
aaacatcaatatctgtgtatat

SEQ ID NO: 714027 - DNA, 22 bp, Artificial Sequence
  chemically synthesized
tctcaaacatcaatatctgtgt

SEQ ID NO: 714028 - DNA, 22 bp, Artificial Sequence
  chemically synthesized
atctcaaacatcaatatctgtg

SEQ ID NO: 714029 - DNA, 22 bp, Artificial Sequence
  chemically synthesized
tacttcatatacacagatattg

SEQ ID NO: 714030 - DNA, 22 bp, Artificial Sequence
  chemically synthesized
ttatctcaaacatcaatatctg

SEQ ID NO: 714031 - DNA, 22 bp, Artificial Sequence
  chemically synthesized
cttcatatacacagatattgat

SEQ ID NO: 714032 - DNA, 22 bp, Artificial Sequence
  chemically synthesized
tcttatctcaaacatcaatatc

SEQ ID NO: 714033 - DNA, 22 bp, Artificial Sequence
  chemically synthesized
catatacacagatattgatgtt

SEQ ID NO: 714034 - DNA, 22 bp, Artificial Sequence
  chemically synthesized
atatacacagatattgatgttt

SEQ ID NO: 714035 - DNA, 22 bp, Artificial Sequence
  chemically synthesized
atgtttgagataagagagtcct

SEQ ID NO: 714036 - DNA, 22 bp, Artificial Sequence
  chemically synthesized
tagacatagaataggactctct

SEQ ID NO: 714037 - DNA, 22 bp, Artificial Sequence
  chemically synthesized
gagataagagagtcctattcta

SEQ ID NO: 714038 - DNA, 22 bp, Artificial Sequence
  chemically synthesized
agataagagagtcctattctat

SEQ ID NO: 714039 - DNA, 22 bp, Artificial Sequence
  chemically synthesized
aaccagttatagacatagaata

SEQ ID NO: 714040 - DNA, 22 bp, Artificial Sequence
  chemically synthesized
ctcaaccagttatagacataga

SEQ ID NO: 714041 - DNA, 22 bp, Artificial Sequence
  chemically synthesized
cctcaaccagttatagacatag

SEQ ID NO: 714042 - DNA, 22 bp, Artificial Sequence
  chemically synthesized
cttcctcaaccagttatagaca

SEQ ID NO: 714043 - DNA, 22 bp, Artificial Sequence
  chemically synthesized
tccttcctcaaccagttataga

SEQ ID NO: 714044 - DNA, 22 bp, Artificial Sequence
  chemically synthesized
ctccttcctcaaccagttatag

SEQ ID NO: 714045 - DNA, 22 bp, Artificial Sequence
  chemically synthesized
ttctatgtctataactggttga

SEQ ID NO: 714046 - DNA, 22 bp, Artificial Sequence
  chemically synthesized
acttctccttcctcaaccagtt

SEQ ID NO: 714047 - DNA, 22 bp, Artificial Sequence
  chemically synthesized
tatgtctataactggttgagga

SEQ ID NO: 714048 - DNA, 22 bp, Artificial Sequence
  chemically synthesized
ttaacttctccttcctcaacca

SEQ ID NO: 714049 - DNA, 22 bp, Artificial Sequence
  chemically synthesized
tgtctataactggttgaggaag

SEQ ID NO: 714050 - DNA, 22 bp, Artificial Sequence
  chemically synthesized
gggactgttaacttctccttcc

SEQ ID NO: 714051 - DNA, 22 bp, Artificial Sequence
  chemically synthesized
taactggttgaggaaggagaag

SEQ ID NO: 714052 - DNA, 22 bp, Artificial Sequence
  chemically synthesized
gttgaggaaggagaagttaaca

SEQ ID NO: 714053 - DNA, 22 bp, Artificial Sequence
  chemically synthesized
tatataactcgggactgttaac

SEQ ID NO: 714054 - DNA, 22 bp, Artificial Sequence
  chemically synthesized
aggaaggagaagttaacagtcc

SEQ ID NO: 714055 - DNA, 22 bp, Artificial Sequence
  chemically synthesized
acaatagtctgtatataactcg

SEQ ID NO: 714056 - DNA, 22 bp, Artificial Sequence
  chemically synthesized
acagtcccgagttatatacaga

SEQ ID NO: 714057 - DNA, 22 bp, Artificial Sequence
  chemically synthesized
ggcagatctgacaatagtctgt

SEQ ID NO: 714058 - DNA, 22 bp, Artificial Sequence
  chemically synthesized
aattgggcagatctgacaatag

SEQ ID NO: 714059 - DNA, 22 bp, Artificial Sequence
  chemically synthesized
tatacagactattgtcagatct

SEQ ID NO: 714060 - DNA, 22 bp, Artificial Sequence
  chemically synthesized
gaggaatactgaattgggcaga

SEQ ID NO: 714061 - DNA, 22 bp, Artificial Sequence
  chemically synthesized
ttgtcagatctgcccaattcag

SEQ ID NO: 714062 - DNA, 22 bp, Artificial Sequence
  chemically synthesized
tcagatctgcccaattcagtat

SEQ ID NO: 714063 - DNA, 22 bp, Artificial Sequence
  chemically synthesized
ccaattagaggaatactgaatt

SEQ ID NO: 714064 - DNA, 22 bp, Artificial Sequence
  chemically synthesized
cccaattcagtattcctctaat

SEQ ID NO: 714065 - DNA, 22 bp, Artificial Sequence
  chemically synthesized
agtattcctctaattggcagtc

SEQ ID NO: 714066 - DNA, 22 bp, Artificial Sequence
  chemically synthesized
ctctaattggcagtctttgctc

SEQ ID NO: 714067 - DNA, 22 bp, Artificial Sequence
  chemically synthesized
taattggcagtctttgctctgg

SEQ ID NO: 714068 - DNA, 22 bp, Artificial Sequence
  chemically synthesized
attggcagtctttgctctggca

SEQ ID NO: 714069 - DNA, 22 bp, Artificial Sequence
  chemically synthesized
gcagtctttgctctggcattcc

SEQ ID NO: 714070 - DNA, 22 bp, Artificial Sequence
  chemically synthesized
tgtcagcacaacaaggaatgcc

SEQ ID NO: 714071 - DNA, 22 bp, Artificial Sequence
  chemically synthesized
tgtgtcagcacaacaaggaatg

SEQ ID NO: 714072 - DNA, 22 bp, Artificial Sequence
  chemically synthesized
tgctctggcattccttgttgtg

SEQ ID NO: 714073 - DNA, 22 bp, Artificial Sequence
  chemically synthesized
gctctggcattccttgttgtgc

SEQ ID NO: 714074 - DNA, 22 bp, Artificial Sequence
  chemically synthesized
gactctgtgtcagcacaacaag

SEQ ID NO: 714075 - DNA, 22 bp, Artificial Sequence
  chemically synthesized
ctctggcattccttgttgtgct

SEQ ID NO: 714076 - DNA, 22 bp, Artificial Sequence
  chemically synthesized
tagactctgtgtcagcacaaca

SEQ ID NO: 714077 - DNA, 22 bp, Artificial Sequence
  chemically synthesized
ctagactctgtgtcagcacaac

SEQ ID NO: 714078 - DNA, 22 bp, Artificial Sequence
  chemically synthesized
tggcattccttgttgtgctgac

SEQ ID NO: 714079 - DNA, 22 bp, Artificial Sequence
  chemically synthesized
gcattccttgttgtgctgacac

SEQ ID NO: 714080 - DNA, 22 bp, Artificial Sequence
  chemically synthesized
cttgttgtgctgacacagagtc

SEQ ID NO: 714081 - DNA, 22 bp, Artificial Sequence
  chemically synthesized
gttgtgctgacacagagtctag

SEQ ID NO: 714082 - DNA, 22 bp, Artificial Sequence
  chemically synthesized
ttgtgctgacacagagtctaga

SEQ ID NO: 714083 - DNA, 22 bp, Artificial Sequence
  chemically synthesized
tgctgacacagagtctagaaga

SEQ ID NO: 714084 - DNA, 22 bp, Artificial Sequence
  chemically synthesized
acacagagtctagaagatctgc

SEQ ID NO: 714085 - DNA, 22 bp, Artificial Sequence
  chemically synthesized
gaagatctgcattgtgatctga

SEQ ID NO: 714086 - DNA, 22 bp, Artificial Sequence
  chemically synthesized
aacaagggaagccatcagatca

SEQ ID NO: 714087 - DNA, 22 bp, Artificial Sequence
  chemically synthesized
cattgtgatctgatggcttccc

SEQ ID NO: 714088 - DNA, 22 bp, Artificial Sequence
  chemically synthesized
tgatctgatggcttcccttgtt

SEQ ID NO: 714089 - DNA, 22 bp, Artificial Sequence
  chemically synthesized
atggcttcccttgttcaattct

SEQ ID NO: 714090 - DNA, 22 bp, Artificial Sequence
  chemically synthesized
cccttgttcaattctgcttcca

SEQ ID NO: 714091 - DNA, 22 bp, Artificial Sequence
  chemically synthesized
ccttgttcaattctgcttccac

SEQ ID NO: 714092 - DNA, 22 bp, Artificial Sequence
  chemically synthesized
tgaagaaataggggtggaagca

SEQ ID NO: 714093 - DNA, 22 bp, Artificial Sequence
  chemically synthesized
gttcaattctgcttccacccct

SEQ ID NO: 714094 - DNA, 22 bp, Artificial Sequence
  chemically synthesized
ttcaattctgcttccaccccta

SEQ ID NO: 714095 - DNA, 22 bp, Artificial Sequence
  chemically synthesized
aattctgcttccacccctattt

SEQ ID NO: 714096 - DNA, 22 bp, Artificial Sequence
  chemically synthesized
tgcttccacccctatttcttca

SEQ ID NO: 714097 - DNA, 22 bp, Artificial Sequence
  chemically synthesized
cttccacccctatttcttcaca

SEQ ID NO: 714098 - DNA, 22 bp, Artificial Sequence
  chemically synthesized
cagaataacacctgtgaagaaa

SEQ ID NO: 714099 - DNA, 22 bp, Artificial Sequence
  chemically synthesized
ccacccctatttcttcacaggt

SEQ ID NO: 714100 - DNA, 22 bp, Artificial Sequence
  chemically synthesized
ttgcagaataacacctgtgaag

SEQ ID NO: 714101 - DNA, 22 bp, Artificial Sequence
  chemically synthesized
cacccctatttcttcacaggtg

SEQ ID NO: 714102 - DNA, 22 bp, Artificial Sequence
  chemically synthesized
attgcagaataacacctgtgaa

SEQ ID NO: 714103 - DNA, 22 bp, Artificial Sequence
  chemically synthesized
tttcttcacaggtgttattctg

SEQ ID NO: 714104 - DNA, 22 bp, Artificial Sequence
  chemically synthesized
cttcacaggtgttattctgcaa

SEQ ID NO: 714105 - DNA, 22 bp, Artificial Sequence
  chemically synthesized
ttcacaggtgttattctgcaat

SEQ ID NO: 714106 - DNA, 22 bp, Artificial Sequence
  chemically synthesized
cacaggtgttattctgcaataa

SEQ ID NO: 714107 - DNA, 22 bp, Artificial Sequence
  chemically synthesized
acaggtgttattctgcaataaa

SEQ ID NO: 714108 - DNA, 22 bp, Artificial Sequence
  chemically synthesized
ttctgcaataaatctgccctgg

SEQ ID NO: 714109 - DNA, 22 bp, Artificial Sequence
  chemically synthesized
caagaagcagatgccagggcag

SEQ ID NO: 714110 - DNA, 22 bp, Artificial Sequence
  chemically synthesized
tgcaataaatctgccctggcat

SEQ ID NO: 714111 - DNA, 22 bp, Artificial Sequence
  chemically synthesized
caataaatctgccctggcatct

SEQ ID NO: 714112 - DNA, 22 bp, Artificial Sequence
  chemically synthesized
agtcctccaagaagcagatgcc

SEQ ID NO: 714113 - DNA, 22 bp, Artificial Sequence
  chemically synthesized
caggttgagtcctccaagaagc

SEQ ID NO: 714114 - DNA, 22 bp, Artificial Sequence
  chemically synthesized
ccctggcatctgcttcttggag

SEQ ID NO: 714115 - DNA, 22 bp, Artificial Sequence
  chemically synthesized
ttgcaggttgagtcctccaaga

SEQ ID NO: 714116 - DNA, 22 bp, Artificial Sequence
  chemically synthesized
gcatctgcttcttggaggactc

SEQ ID NO: 714117 - DNA, 22 bp, Artificial Sequence
  chemically synthesized
ttgttgcaggttgagtcctcca

SEQ ID NO: 714118 - DNA, 22 bp, Artificial Sequence
  chemically synthesized
attattgttgcaggttgagtcc

SEQ ID NO: 714119 - DNA, 22 bp, Artificial Sequence
  chemically synthesized
cttcttggaggactcaacctgc

SEQ ID NO: 714120 - DNA, 22 bp, Artificial Sequence
  chemically synthesized
attgattattgttgcaggttga

SEQ ID NO: 714121 - DNA, 22 bp, Artificial Sequence
  chemically synthesized
cttggaggactcaacctgcaac

SEQ ID NO: 714122 - DNA, 22 bp, Artificial Sequence
  chemically synthesized
ttggaggactcaacctgcaaca

SEQ ID NO: 714123 - DNA, 22 bp, Artificial Sequence
  chemically synthesized
attgattgattattgttgcagg

SEQ ID NO: 714124 - DNA, 22 bp, Artificial Sequence
  chemically synthesized
ggaggactcaacctgcaacaat

SEQ ID NO: 714125 - DNA, 22 bp, Artificial Sequence
  chemically synthesized
gaggactcaacctgcaacaata

SEQ ID NO: 714126 - DNA, 22 bp, Artificial Sequence
  chemically synthesized
aacctgcaacaataatcaatca

SEQ ID NO: 714127 - DNA, 22 bp, Artificial Sequence
  chemically synthesized
caacaataatcaatcaatcaat

SEQ ID NO: 714128 - DNA, 22 bp, Artificial Sequence
  chemically synthesized
ggggaatggaatcgtggaattg

SEQ ID NO: 714129 - DNA, 22 bp, Artificial Sequence
  chemically synthesized
ggctaggggaatggaatcgtgg

SEQ ID NO: 714130 - DNA, 22 bp, Artificial Sequence
  chemically synthesized
cacgattccattcccctagcct

SEQ ID NO: 714131 - DNA, 22 bp, Artificial Sequence
  chemically synthesized
ggtcacatgcccacctaggcta

SEQ ID NO: 714132 - DNA, 22 bp, Artificial Sequence
  chemically synthesized
cattcccctagcctaggtgggc

SEQ ID NO: 714133 - DNA, 22 bp, Artificial Sequence
  chemically synthesized
ccctagcctaggtgggcatgtg

SEQ ID NO: 714134 - DNA, 22 bp, Artificial Sequence
  chemically synthesized
tggcccaaattgggtcacatgc

SEQ ID NO: 714135 - DNA, 22 bp, Artificial Sequence
  chemically synthesized
atggcccaaattgggtcacatg

SEQ ID NO: 714136 - DNA, 22 bp, Artificial Sequence
  chemically synthesized
gcctaggtgggcatgtgaccca

SEQ ID NO: 714137 - DNA, 22 bp, Artificial Sequence
  chemically synthesized
tatggcccaaattgggtcacat

SEQ ID NO: 714138 - DNA, 22 bp, Artificial Sequence
  chemically synthesized
tttatggcccaaattgggtcac

SEQ ID NO: 714139 - DNA, 22 bp, Artificial Sequence
  chemically synthesized
ggtgggcatgtgacccaatttg

SEQ ID NO: 714140 - DNA, 22 bp, Artificial Sequence
  chemically synthesized
actctttatggcccaaattggg

SEQ ID NO: 714141 - DNA, 22 bp, Artificial Sequence
  chemically synthesized
gactctttatggcccaaattgg

SEQ ID NO: 714142 - DNA, 22 bp, Artificial Sequence
  chemically synthesized
gtcaagtatgggcttgactctt

SEQ ID NO: 714143 - DNA, 22 bp, Artificial Sequence
  chemically synthesized
gggccataaagagtcaagccca

SEQ ID NO: 714144 - DNA, 22 bp, Artificial Sequence
  chemically synthesized
ggccataaagagtcaagcccat

SEQ ID NO: 714145 - DNA, 22 bp, Artificial Sequence
  chemically synthesized
aagactggtcaagtatgggctt

SEQ ID NO: 714146 - DNA, 22 bp, Artificial Sequence
  chemically synthesized
aaagactggtcaagtatgggct

SEQ ID NO: 714147 - DNA, 22 bp, Artificial Sequence
  chemically synthesized
acccgagagcttaaagactggt

SEQ ID NO: 714148 - DNA, 22 bp, Artificial Sequence
  chemically synthesized
tgacccgagagcttaaagactg

SEQ ID NO: 714149 - DNA, 22 bp, Artificial Sequence
  chemically synthesized
ctctgacccgagagcttaaaga

SEQ ID NO: 714150 - DNA, 22 bp, Artificial Sequence
  chemically synthesized
gaccagtctttaagctctcggg

SEQ ID NO: 714151 - DNA, 22 bp, Artificial Sequence
  chemically synthesized
accagtctttaagctctcgggt

SEQ ID NO: 714152 - DNA, 22 bp, Artificial Sequence
  chemically synthesized
taagctctcgggtcagagtagc

SEQ ID NO: 714153 - DNA, 22 bp, Artificial Sequence
  chemically synthesized
aagctctcgggtcagagtagct

SEQ ID NO: 714154 - DNA, 22 bp, Artificial Sequence
  chemically synthesized
cagaaaagagagagctactctg

SEQ ID NO: 714155 - DNA, 22 bp, Artificial Sequence
  chemically synthesized
agctctcgggtcagagtagctc

SEQ ID NO: 714156 - DNA, 22 bp, Artificial Sequence
  chemically synthesized
tcgggtcagagtagctctctct

SEQ ID NO: 714157 - DNA, 22 bp, Artificial Sequence
  chemically synthesized
gggtcagagtagctctctcttt

SEQ ID NO: 714158 - DNA, 22 bp, Artificial Sequence
  chemically synthesized
aacataccctgcagaaaagaga

SEQ ID NO: 714159 - DNA, 22 bp, Artificial Sequence
  chemically synthesized
acaccctcaacataccctgcag

SEQ ID NO: 714160 - DNA, 22 bp, Artificial Sequence
  chemically synthesized
aacaccctcaacataccctgca

SEQ ID NO: 714161 - DNA, 22 bp, Artificial Sequence
  chemically synthesized
ttaacaccctcaacataccctg

SEQ ID NO: 714162 - DNA, 22 bp, Artificial Sequence
  chemically synthesized
tctcttttctgcagggtatgtt

SEQ ID NO: 714163 - DNA, 22 bp, Artificial Sequence
  chemically synthesized
tcttttctgcagggtatgttga

SEQ ID NO: 714164 - DNA, 22 bp, Artificial Sequence
  chemically synthesized
ttttctgcagggtatgttgagg

SEQ ID NO: 714165 - DNA, 22 bp, Artificial Sequence
  chemically synthesized
ttctgcagggtatgttgagggt

SEQ ID NO: 714166 - DNA, 22 bp, Artificial Sequence
  chemically synthesized
tctgcagggtatgttgagggtg

SEQ ID NO: 714167 - DNA, 22 bp, Artificial Sequence
  chemically synthesized
ccatcctcttaacaccctcaac

SEQ ID NO: 714168 - DNA, 22 bp, Artificial Sequence
  chemically synthesized
ctgcagggtatgttgagggtgt

SEQ ID NO: 714169 - DNA, 22 bp, Artificial Sequence
  chemically synthesized
tgcagggtatgttgagggtgtt

SEQ ID NO: 714170 - DNA, 22 bp, Artificial Sequence
  chemically synthesized
cagggtatgttgagggtgttaa

SEQ ID NO: 714171 - DNA, 22 bp, Artificial Sequence
  chemically synthesized
caggcccacctgccatcctctt

SEQ ID NO: 714172 - DNA, 22 bp, Artificial Sequence
  chemically synthesized
ctgcaggcccacctgccatcct

SEQ ID NO: 714173 - DNA, 22 bp, Artificial Sequence
  chemically synthesized
agggtgttaagaggatggcagg

SEQ ID NO: 714174 - DNA, 22 bp, Artificial Sequence
  chemically synthesized
ttgctgcaggcccacctgccat

SEQ ID NO: 714175 - DNA, 22 bp, Artificial Sequence
  chemically synthesized
agactattgctgcaggcccacc

SEQ ID NO: 714176 - DNA, 22 bp, Artificial Sequence
  chemically synthesized
agaggatggcaggtgggcctgc

SEQ ID NO: 714177 - DNA, 22 bp, Artificial Sequence
  chemically synthesized
cagactattgctgcaggcccac

SEQ ID NO: 714178 - DNA, 22 bp, Artificial Sequence
  chemically synthesized
tcagactattgctgcaggccca

SEQ ID NO: 714179 - DNA, 22 bp, Artificial Sequence
  chemically synthesized
gtgacagtggtggctttcagac

SEQ ID NO: 714180 - DNA, 22 bp, Artificial Sequence
  chemically synthesized
cagcaatagtctgaaagccacc

SEQ ID NO: 714181 - DNA, 22 bp, Artificial Sequence
  chemically synthesized
aaagccaccactgtcaccaaca

SEQ ID NO: 714182 - DNA, 22 bp, Artificial Sequence
  chemically synthesized
agaaacaaaagggtgttggtga

SEQ ID NO: 714183 - DNA, 22 bp, Artificial Sequence
  chemically synthesized
gttaagaaacaaaagggtgttg

SEQ ID NO: 714184 - DNA, 22 bp, Artificial Sequence
  chemically synthesized
agattagttaagaaacaaaagg

SEQ ID NO: 714185 - DNA, 22 bp, Artificial Sequence
  chemically synthesized
tcaccaacacccttttgtttct

SEQ ID NO: 714186 - DNA, 22 bp, Artificial Sequence
  chemically synthesized
aactcagattagttaagaaaca

SEQ ID NO: 714187 - DNA, 22 bp, Artificial Sequence
  chemically synthesized
ttgtttcttaactaatctgagt

SEQ ID NO: 714188 - DNA, 22 bp, Artificial Sequence
  chemically synthesized
tgtttcttaactaatctgagtt

SEQ ID NO: 714189 - DNA, 22 bp, Artificial Sequence
  chemically synthesized
gtttcttaactaatctgagttg

SEQ ID NO: 714190 - DNA, 22 bp, Artificial Sequence
  chemically synthesized
tttcttaactaatctgagttga

SEQ ID NO: 714191 - DNA, 22 bp, Artificial Sequence
  chemically synthesized
cttaactaatctgagttgagtt

SEQ ID NO: 714192 - DNA, 22 bp, Artificial Sequence
  chemically synthesized
taagtgacagaaaactcaactc

SEQ ID NO: 714193 - DNA, 22 bp, Artificial Sequence
  chemically synthesized
ttaactaatctgagttgagttt

SEQ ID NO: 714194 - DNA, 22 bp, Artificial Sequence
  chemically synthesized
aactaatctgagttgagttttc

SEQ ID NO: 714195 - DNA, 22 bp, Artificial Sequence
  chemically synthesized
actaatctgagttgagttttct

SEQ ID NO: 714196 - DNA, 22 bp, Artificial Sequence
  chemically synthesized
gctgtaagtgacagaaaactca

SEQ ID NO: 714197 - DNA, 22 bp, Artificial Sequence
  chemically synthesized
ggctgtaagtgacagaaaactc

SEQ ID NO: 714198 - DNA, 22 bp, Artificial Sequence
  chemically synthesized
ttggctgtaagtgacagaaaac

SEQ ID NO: 714199 - DNA, 22 bp, Artificial Sequence
  chemically synthesized
atctgagttgagttttctgtca

SEQ ID NO: 714200 - DNA, 22 bp, Artificial Sequence
  chemically synthesized
gactcttggctgtaagtgacag

SEQ ID NO: 714201 - DNA, 22 bp, Artificial Sequence
  chemically synthesized
agttgagttttctgtcacttac

SEQ ID NO: 714202 - DNA, 22 bp, Artificial Sequence
  chemically synthesized
ggctggactcttggctgtaagt

SEQ ID NO: 714203 - DNA, 22 bp, Artificial Sequence
  chemically synthesized
agttttctgtcacttacagcca

SEQ ID NO: 714204 - DNA, 22 bp, Artificial Sequence
  chemically synthesized
tctgtcacttacagccaagagt

SEQ ID NO: 714205 - DNA, 22 bp, Artificial Sequence
  chemically synthesized
ctgtcacttacagccaagagtc

SEQ ID NO: 714206 - DNA, 22 bp, Artificial Sequence
  chemically synthesized
tgtcacttacagccaagagtcc

SEQ ID NO: 714207 - DNA, 22 bp, Artificial Sequence
  chemically synthesized
tcacttacagccaagagtccag

SEQ ID NO: 714208 - DNA, 22 bp, Artificial Sequence
  chemically synthesized
taaagtatattaggctggactc

SEQ ID NO: 714209 - DNA, 22 bp, Artificial Sequence
  chemically synthesized
ttataaagtatattaggctgga

SEQ ID NO: 714210 - DNA, 22 bp, Artificial Sequence
  chemically synthesized
acagccaagagtccagcctaat

SEQ ID NO: 714211 - DNA, 22 bp, Artificial Sequence
  chemically synthesized
attataaagtatattaggctgg

SEQ ID NO: 714212 - DNA, 22 bp, Artificial Sequence
  chemically synthesized
cagccaagagtccagcctaata

SEQ ID NO: 714213 - DNA, 22 bp, Artificial Sequence
  chemically synthesized
tattataaagtatattaggctg

SEQ ID NO: 714214 - DNA, 22 bp, Artificial Sequence
  chemically synthesized
ccctttattataaagtatatta

SEQ ID NO: 714215 - DNA, 22 bp, Artificial Sequence
  chemically synthesized
cccctttattataaagtatatt

SEQ ID NO: 714216 - DNA, 22 bp, Artificial Sequence
  chemically synthesized
tagtttcccctttattataaag

SEQ ID NO: 714217 - DNA, 22 bp, Artificial Sequence
  chemically synthesized
tgtagtttcccctttattataa

SEQ ID NO: 714218 - DNA, 22 bp, Artificial Sequence
  chemically synthesized
ctgtagtttcccctttattata

SEQ ID NO: 714219 - DNA, 22 bp, Artificial Sequence
  chemically synthesized
atatactttataataaagggga

SEQ ID NO: 714220 - DNA, 22 bp, Artificial Sequence
  chemically synthesized
aatgtttctgtagtttcccctt

SEQ ID NO: 714221 - DNA, 22 bp, Artificial Sequence
  chemically synthesized
aaatgtttctgtagtttcccct

SEQ ID NO: 714222 - DNA, 22 bp, Artificial Sequence
  chemically synthesized
ttaaatgtttctgtagtttccc

SEQ ID NO: 714223 - DNA, 22 bp, Artificial Sequence
  chemically synthesized
cttaaatgtttctgtagtttcc

SEQ ID NO: 714224 - DNA, 22 bp, Artificial Sequence
  chemically synthesized
tataataaaggggaaactacag

SEQ ID NO: 714225 - DNA, 22 bp, Artificial Sequence
  chemically synthesized
tcttaaatgtttctgtagtttc

SEQ ID NO: 714226 - DNA, 22 bp, Artificial Sequence
  chemically synthesized
ataataaaggggaaactacaga

SEQ ID NO: 714227 - DNA, 22 bp, Artificial Sequence
  chemically synthesized
taataaaggggaaactacagaa

SEQ ID NO: 714228 - DNA, 22 bp, Artificial Sequence
  chemically synthesized
attttcttaaatgtttctgtag

SEQ ID NO: 714229 - DNA, 22 bp, Artificial Sequence
  chemically synthesized
ggatcaatgctaattttcttaa

SEQ ID NO: 714230 - DNA, 22 bp, Artificial Sequence
  chemically synthesized
aggatcaatgctaattttctta

SEQ ID NO: 714231 - DNA, 22 bp, Artificial Sequence
  chemically synthesized
taggatcaatgctaattttctt

SEQ ID NO: 714232 - DNA, 22 bp, Artificial Sequence
  chemically synthesized
cagaaacatttaagaaaattag

SEQ ID NO: 714233 - DNA, 22 bp, Artificial Sequence
  chemically synthesized
ttaggatcaatgctaattttct

SEQ ID NO: 714234 - DNA, 22 bp, Artificial Sequence
  chemically synthesized
taacaacttttaggatcaatgc

SEQ ID NO: 714235 - DNA, 22 bp, Artificial Sequence
  chemically synthesized
gtaacaacttttaggatcaatg

SEQ ID NO: 714236 - DNA, 22 bp, Artificial Sequence
  chemically synthesized
aagaaaattagcattgatccta

SEQ ID NO: 714237 - DNA, 22 bp, Artificial Sequence
  chemically synthesized
agaaaattagcattgatcctaa

SEQ ID NO: 714238 - DNA, 22 bp, Artificial Sequence
  chemically synthesized
gcattgatcctaaaagttgtta

SEQ ID NO: 714239 - DNA, 22 bp, Artificial Sequence
  chemically synthesized
tgatgaggtaatttgtaacaac

SEQ ID NO: 714240 - DNA, 22 bp, Artificial Sequence
  chemically synthesized
atcctaaaagttgttacaaatt

SEQ ID NO: 714241 - DNA, 22 bp, Artificial Sequence
  chemically synthesized
ttgtgatgaggtaatttgtaac

SEQ ID NO: 714242 - DNA, 22 bp, Artificial Sequence
  chemically synthesized
aaagttgttacaaattacctca

SEQ ID NO: 714243 - DNA, 22 bp, Artificial Sequence
  chemically synthesized
aatagttattgtgatgaggtaa

SEQ ID NO: 714244 - DNA, 22 bp, Artificial Sequence
  chemically synthesized
tgaatagttattgtgatgaggt

SEQ ID NO: 714245 - DNA, 22 bp, Artificial Sequence
  chemically synthesized
ttacaaattacctcatcacaat

SEQ ID NO: 714246 - DNA, 22 bp, Artificial Sequence
  chemically synthesized
ctctgaatagttattgtgatga

SEQ ID NO: 714247 - DNA, 22 bp, Artificial Sequence
  chemically synthesized
caaattacctcatcacaataac

SEQ ID NO: 714248 - DNA, 22 bp, Artificial Sequence
  chemically synthesized
aatacgttgctctgaatagtta

SEQ ID NO: 714249 - DNA, 22 bp, Artificial Sequence
  chemically synthesized
cctcatcacaataactattcag

SEQ ID NO: 714250 - DNA, 22 bp, Artificial Sequence
  chemically synthesized
aaatacgttgctctgaatagtt

SEQ ID NO: 714251 - DNA, 22 bp, Artificial Sequence
  chemically synthesized
atcacaataactattcagagca

SEQ ID NO: 714252 - DNA, 22 bp, Artificial Sequence
  chemically synthesized
agcaacttaaatacgttgctct

SEQ ID NO: 714253 - DNA, 22 bp, Artificial Sequence
  chemically synthesized
gagcaacttaaatacgttgctc

SEQ ID NO: 714254 - DNA, 22 bp, Artificial Sequence
  chemically synthesized
ttgagcaacttaaatacgttgc

SEQ ID NO: 714255 - DNA, 22 bp, Artificial Sequence
  chemically synthesized
ttcagagcaacgtatttaagtt

SEQ ID NO: 714256 - DNA, 22 bp, Artificial Sequence
  chemically synthesized
tggttcttgagcaacttaaata

SEQ ID NO: 714257 - DNA, 22 bp, Artificial Sequence
  chemically synthesized
gtggttcttgagcaacttaaat

SEQ ID NO: 714258 - DNA, 22 bp, Artificial Sequence
  chemically synthesized
tgtggttcttgagcaacttaaa

SEQ ID NO: 714259 - DNA, 22 bp, Artificial Sequence
  chemically synthesized
agagcaacgtatttaagttgct

SEQ ID NO: 714260 - DNA, 22 bp, Artificial Sequence
  chemically synthesized
aagttgctcaagaaccacaaag

SEQ ID NO: 714261 - DNA, 22 bp, Artificial Sequence
  chemically synthesized
agttgctcaagaaccacaaagc

SEQ ID NO: 714262 - DNA, 22 bp, Artificial Sequence
  chemically synthesized
aaaaggcaatgtgctttgtggt

SEQ ID NO: 714263 - DNA, 22 bp, Artificial Sequence
  chemically synthesized
aaaaaggcaatgtgctttgtgg

SEQ ID NO: 714264 - DNA, 22 bp, Artificial Sequence
  chemically synthesized
ctcaagaaccacaaagcacatt

SEQ ID NO: 714265 - DNA, 22 bp, Artificial Sequence
  chemically synthesized
aatttaaaaaggcaatgtgctt

SEQ ID NO: 714266 - DNA, 22 bp, Artificial Sequence
  chemically synthesized
aaatttaaaaaggcaatgtgct

SEQ ID NO: 714267 - DNA, 22 bp, Artificial Sequence
  chemically synthesized
aagaaccacaaagcacattgcc

SEQ ID NO: 714268 - DNA, 22 bp, Artificial Sequence
  chemically synthesized
taaatttaaaaaggcaatgtgc

SEQ ID NO: 714269 - DNA, 22 bp, Artificial Sequence
  chemically synthesized
tttaaatttaaaaaggcaatgt

SEQ ID NO: 714270 - DNA, 22 bp, Artificial Sequence
  chemically synthesized
tgaagtctctttaaatttaaaa

SEQ ID NO: 714271 - DNA, 22 bp, Artificial Sequence
  chemically synthesized
atgaagtctctttaaatttaaa

SEQ ID NO: 714272 - DNA, 22 bp, Artificial Sequence
  chemically synthesized
tatgaagtctctttaaatttaa

SEQ ID NO: 714273 - DNA, 22 bp, Artificial Sequence
  chemically synthesized
ttatgaagtctctttaaattta

SEQ ID NO: 714274 - DNA, 22 bp, Artificial Sequence
  chemically synthesized
cctttttaaatttaaagagact

SEQ ID NO: 714275 - DNA, 22 bp, Artificial Sequence
  chemically synthesized
tttaaatttaaagagacttcat

SEQ ID NO: 714276 - DNA, 22 bp, Artificial Sequence
  chemically synthesized
tcccacatttttatgaagtctc

SEQ ID NO: 714277 - DNA, 22 bp, Artificial Sequence
  chemically synthesized
ttaaatttaaagagacttcata

SEQ ID NO: 714278 - DNA, 22 bp, Artificial Sequence
  chemically synthesized
taaatttaaagagacttcataa

SEQ ID NO: 714279 - DNA, 22 bp, Artificial Sequence
  chemically synthesized
tgtcccacatttttatgaagtc

SEQ ID NO: 714280 - DNA, 22 bp, Artificial Sequence
  chemically synthesized
aaatttaaagagacttcataaa

SEQ ID NO: 714281 - DNA, 22 bp, Artificial Sequence
  chemically synthesized
aatttaaagagacttcataaaa

SEQ ID NO: 714282 - DNA, 22 bp, Artificial Sequence
  chemically synthesized
ctctgtcccacatttttatgaa

SEQ ID NO: 714283 - DNA, 22 bp, Artificial Sequence
  chemically synthesized
tgctctgtcccacatttttatg

SEQ ID NO: 714284 - DNA, 22 bp, Artificial Sequence
  chemically synthesized
aaagagacttcataaaaatgtg

SEQ ID NO: 714285 - DNA, 22 bp, Artificial Sequence
  chemically synthesized
aagagacttcataaaaatgtgg

SEQ ID NO: 714286 - DNA, 22 bp, Artificial Sequence
  chemically synthesized
cataaaaatgtgggacagagca

SEQ ID NO: 714287 - DNA, 22 bp, Artificial Sequence
  chemically synthesized
ataaaaatgtgggacagagcag

SEQ ID NO: 714288 - DNA, 22 bp, Artificial Sequence
  chemically synthesized
taataatgggtaccattctgct

SEQ ID NO: 714289 - DNA, 22 bp, Artificial Sequence
  chemically synthesized
tataataatgggtaccattctg

SEQ ID NO: 714290 - DNA, 22 bp, Artificial Sequence
  chemically synthesized
gtaaaatcattctataataatg

SEQ ID NO: 714291 - DNA, 22 bp, Artificial Sequence
  chemically synthesized
atgccgcagttggtaaaatcat

SEQ ID NO: 714292 - DNA, 22 bp, Artificial Sequence
  chemically synthesized
ttatagaatgattttaccaact

SEQ ID NO: 714293 - DNA, 22 bp, Artificial Sequence
  chemically synthesized
tagaatgattttaccaactgcg

SEQ ID NO: 714294 - DNA, 22 bp, Artificial Sequence
  chemically synthesized
gagaattaatgccgcagttggt

SEQ ID NO: 714295 - DNA, 22 bp, Artificial Sequence
  chemically synthesized
ggagaattaatgccgcagttgg

SEQ ID NO: 714296 - DNA, 22 bp, Artificial Sequence
  chemically synthesized
tggagaattaatgccgcagttg

SEQ ID NO: 714297 - DNA, 22 bp, Artificial Sequence
  chemically synthesized
taccaactgcggcattaattct

SEQ ID NO: 714298 - DNA, 22 bp, Artificial Sequence
  chemically synthesized
accaactgcggcattaattctc

SEQ ID NO: 714299 - DNA, 22 bp, Artificial Sequence
  chemically synthesized
ccaactgcggcattaattctcc

SEQ ID NO: 714300 - DNA, 22 bp, Artificial Sequence
  chemically synthesized
ggggaaatctttggagaattaa

SEQ ID NO: 714301 - DNA, 22 bp, Artificial Sequence
  chemically synthesized
cggcattaattctccaaagatt

SEQ ID NO: 714302 - DNA, 22 bp, Artificial Sequence
  chemically synthesized
ataatgagactgggggaaatct

SEQ ID NO: 714303 - DNA, 22 bp, Artificial Sequence
  chemically synthesized
cataatgagactgggggaaatc

SEQ ID NO: 714304 - DNA, 22 bp, Artificial Sequence
  chemically synthesized
attctccaaagatttcccccag

SEQ ID NO: 714305 - DNA, 22 bp, Artificial Sequence
  chemically synthesized
ttcataatgagactgggggaaa

SEQ ID NO: 714306 - DNA, 22 bp, Artificial Sequence
  chemically synthesized
cttcataatgagactgggggaa

SEQ ID NO: 714307 - DNA, 22 bp, Artificial Sequence
  chemically synthesized
tccaaagatttcccccagtctc

SEQ ID NO: 714308 - DNA, 22 bp, Artificial Sequence
  chemically synthesized
tttcttcataatgagactgggg

SEQ ID NO: 714309 - DNA, 22 bp, Artificial Sequence
  chemically synthesized
caaagatttcccccagtctcat

SEQ ID NO: 714310 - DNA, 22 bp, Artificial Sequence
  chemically synthesized
ttatttcttcataatgagactg

SEQ ID NO: 714311 - DNA, 22 bp, Artificial Sequence
  chemically synthesized
tgtctattatttcttcataatg

SEQ ID NO: 714312 - DNA, 22 bp, Artificial Sequence
  chemically synthesized
cccccagtctcattatgaagaa

SEQ ID NO: 714313 - DNA, 22 bp, Artificial Sequence
  chemically synthesized
tatgtctattatttcttcataa

SEQ ID NO: 714314 - DNA, 22 bp, Artificial Sequence
  chemically synthesized
ccccagtctcattatgaagaaa

SEQ ID NO: 714315 - DNA, 22 bp, Artificial Sequence
  chemically synthesized
gtattctatgtctattatttct

SEQ ID NO: 714316 - DNA, 22 bp, Artificial Sequence
  chemically synthesized
attatgaagaaataatagacat

SEQ ID NO: 714317 - DNA, 22 bp, Artificial Sequence
  chemically synthesized
tgaagaaataatagacatagaa

SEQ ID NO: 714318 - DNA, 22 bp, Artificial Sequence
  chemically synthesized
catgcgtgagccaccgcaccca

SEQ ID NO: 714319 - DNA, 22 bp, Artificial Sequence
  chemically synthesized
ggattacatgcgtgagccaccg

SEQ ID NO: 714320 - DNA, 22 bp, Artificial Sequence
  chemically synthesized
ggctgggtgcggtggctcacgc

SEQ ID NO: 714321 - DNA, 22 bp, Artificial Sequence
  chemically synthesized
ggtgcggtggctcacgcatgta

SEQ ID NO: 714322 - DNA, 22 bp, Artificial Sequence
  chemically synthesized
ccaaagtgctgggattacatgc

SEQ ID NO: 714323 - DNA, 22 bp, Artificial Sequence
  chemically synthesized
ggcctcccaaagtgctgggatt

SEQ ID NO: 714324 - DNA, 22 bp, Artificial Sequence
  chemically synthesized
acgcatgtaatcccagcacttt

SEQ ID NO: 714325 - DNA, 22 bp, Artificial Sequence
  chemically synthesized
cccgcctcggcctcccaaagtg

SEQ ID NO: 714326 - DNA, 22 bp, Artificial Sequence
  chemically synthesized
gtgatctgcccgcctcggcctc

SEQ ID NO: 714327 - DNA, 22 bp, Artificial Sequence
  chemically synthesized
atctcgtgatctgcccgcctcg

SEQ ID NO: 714328 - DNA, 22 bp, Artificial Sequence
  chemically synthesized
ctaatctcgtgatctgcccgcc

SEQ ID NO: 714329 - DNA, 22 bp, Artificial Sequence
  chemically synthesized
tgggaggccgaggcgggcagat

SEQ ID NO: 714330 - DNA, 22 bp, Artificial Sequence
  chemically synthesized
gggaggccgaggcgggcagatc

SEQ ID NO: 714331 - DNA, 22 bp, Artificial Sequence
  chemically synthesized
ggaggccgaggcgggcagatca

SEQ ID NO: 714332 - DNA, 22 bp, Artificial Sequence
  chemically synthesized
gatctcctaatctcgtgatctg

SEQ ID NO: 714333 - DNA, 22 bp, Artificial Sequence
  chemically synthesized
gccaggatggcctcgatctcct

SEQ ID NO: 714334 - DNA, 22 bp, Artificial Sequence
  chemically synthesized
accgttagccaggatggcctcg

SEQ ID NO: 714335 - DNA, 22 bp, Artificial Sequence
  chemically synthesized
caccgttagccaggatggcctc

SEQ ID NO: 714336 - DNA, 22 bp, Artificial Sequence
  chemically synthesized
ggagatcgaggccatcctggct

SEQ ID NO: 714337 - DNA, 22 bp, Artificial Sequence
  chemically synthesized
gtacagacggggtttcaccgtt

SEQ ID NO: 714338 - DNA, 22 bp, Artificial Sequence
  chemically synthesized
agtacagacggggtttcaccgt

SEQ ID NO: 714339 - DNA, 22 bp, Artificial Sequence
  chemically synthesized
tagtacagacggggtttcaccg

SEQ ID NO: 714340 - DNA, 22 bp, Artificial Sequence
  chemically synthesized
ttagtacagacggggtttcacc

SEQ ID NO: 714341 - DNA, 22 bp, Artificial Sequence
  chemically synthesized
tatttttagtacagacggggtt

SEQ ID NO: 714342 - DNA, 22 bp, Artificial Sequence
  chemically synthesized
gctaacggtgaaaccccgtctg

SEQ ID NO: 714343 - DNA, 22 bp, Artificial Sequence
  chemically synthesized
gtatttttagtacagacggggt

SEQ ID NO: 714344 - DNA, 22 bp, Artificial Sequence
  chemically synthesized
tgtatttttagtacagacgggg

SEQ ID NO: 714345 - DNA, 22 bp, Artificial Sequence
  chemically synthesized
ttgtatttttagtacagacggg

SEQ ID NO: 714346 - DNA, 22 bp, Artificial Sequence
  chemically synthesized
tttgtatttttagtacagacgg

SEQ ID NO: 714347 - DNA, 22 bp, Artificial Sequence
  chemically synthesized
acggtgaaaccccgtctgtact

SEQ ID NO: 714348 - DNA, 22 bp, Artificial Sequence
  chemically synthesized
attttttgtatttttagtacag

SEQ ID NO: 714349 - DNA, 22 bp, Artificial Sequence
  chemically synthesized
gctaattttttgtatttttagt

SEQ ID NO: 714350 - DNA, 22 bp, Artificial Sequence
  chemically synthesized
tactaaaaatacaaaaaattag

SEQ ID NO: 714351 - DNA, 22 bp, Artificial Sequence
  chemically synthesized
aaaatacaaaaaattagccagg

SEQ ID NO: 714352 - DNA, 22 bp, Artificial Sequence
  chemically synthesized
caggcgcccgccaccacgcctg

SEQ ID NO: 714353 - DNA, 22 bp, Artificial Sequence
  chemically synthesized
ggattacaggcgcccgccacca

SEQ ID NO: 714354 - DNA, 22 bp, Artificial Sequence
  chemically synthesized
gccaggcgtggtggcgggcgcc

SEQ ID NO: 714355 - DNA, 22 bp, Artificial Sequence
  chemically synthesized
agtagctgggattacaggcgcc

SEQ ID NO: 714356 - DNA, 22 bp, Artificial Sequence
  chemically synthesized
ctgagtagctgggattacaggc

SEQ ID NO: 714357 - DNA, 22 bp, Artificial Sequence
  chemically synthesized
agcctcctgagtagctgggatt

SEQ ID NO: 714358 - DNA, 22 bp, Artificial Sequence
  chemically synthesized
cctcagcctcctgagtagctgg

SEQ ID NO: 714359 - DNA, 22 bp, Artificial Sequence
  chemically synthesized
ctgcctcagcctcctgagtagc

SEQ ID NO: 714360 - DNA, 22 bp, Artificial Sequence
  chemically synthesized
tcctgcctcagcctcctgagta

SEQ ID NO: 714361 - DNA, 22 bp, Artificial Sequence
  chemically synthesized
taatcccagctactcaggaggc

SEQ ID NO: 714362 - DNA, 22 bp, Artificial Sequence
  chemically synthesized
aagtgattctcctgcctcagcc

SEQ ID NO: 714363 - DNA, 22 bp, Artificial Sequence
  chemically synthesized
ctcaggaggctgaggcaggaga

SEQ ID NO: 714364 - DNA, 22 bp, Artificial Sequence
  chemically synthesized
aggaggctgaggcaggagaatc

SEQ ID NO: 714365 - DNA, 22 bp, Artificial Sequence
  chemically synthesized
ccgggttcaagtgattctcctg

SEQ ID NO: 714366 - DNA, 22 bp, Artificial Sequence
  chemically synthesized
cacctcccgggttcaagtgatt

SEQ ID NO: 714367 - DNA, 22 bp, Artificial Sequence
  chemically synthesized
aggcaggagaatcacttgaacc

SEQ ID NO: 714368 - DNA, 22 bp, Artificial Sequence
  chemically synthesized
caacctccacctcccgggttca

SEQ ID NO: 714369 - DNA, 22 bp, Artificial Sequence
  chemically synthesized
actgcaacctccacctcccggg

SEQ ID NO: 714370 - DNA, 22 bp, Artificial Sequence
  chemically synthesized
ggctcactgcaacctccacctc

SEQ ID NO: 714371 - DNA, 22 bp, Artificial Sequence
  chemically synthesized
gaacccgggaggtggaggttgc

SEQ ID NO: 714372 - DNA, 22 bp, Artificial Sequence
  chemically synthesized
aacccgggaggtggaggttgca

SEQ ID NO: 714373 - DNA, 22 bp, Artificial Sequence
  chemically synthesized
gagtgcagtggtgtgatctcgg

SEQ ID NO: 714374 - DNA, 22 bp, Artificial Sequence
  chemically synthesized
cagtgagccgagatcacaccac

SEQ ID NO: 714375 - DNA, 22 bp, Artificial Sequence
  chemically synthesized
tcgcccaggctggagtgcagtg

SEQ ID NO: 714376 - DNA, 22 bp, Artificial Sequence
  chemically synthesized
tgtcgcccaggctggagtgcag

SEQ ID NO: 714377 - DNA, 22 bp, Artificial Sequence
  chemically synthesized
gctctgtcgcccaggctggagt

SEQ ID NO: 714378 - DNA, 22 bp, Artificial Sequence
  chemically synthesized
cactccagcctgggcgacagag

SEQ ID NO: 714379 - DNA, 22 bp, Artificial Sequence
  chemically synthesized
agatggggtctcgctctgtcgc

SEQ ID NO: 714380 - DNA, 22 bp, Artificial Sequence
  chemically synthesized
gagatggggtctcgctctgtcg

SEQ ID NO: 714381 - DNA, 22 bp, Artificial Sequence
  chemically synthesized
tgagatggggtctcgctctgtc

SEQ ID NO: 714382 - DNA, 22 bp, Artificial Sequence
  chemically synthesized
ttgagatggggtctcgctctgt

SEQ ID NO: 714383 - DNA, 22 bp, Artificial Sequence
  chemically synthesized
cagcctgggcgacagagcgaga

SEQ ID NO: 714384 - DNA, 22 bp, Artificial Sequence
  chemically synthesized
tttgagatggggtctcgctctg

SEQ ID NO: 714385 - DNA, 22 bp, Artificial Sequence
  chemically synthesized
ttttgagatggggtctcgctct

SEQ ID NO: 714386 - DNA, 22 bp, Artificial Sequence
  chemically synthesized
tttttgagatggggtctcgctc

SEQ ID NO: 714387 - DNA, 22 bp, Artificial Sequence
  chemically synthesized
ttttttgagatggggtctcgct

SEQ ID NO: 714388 - DNA, 22 bp, Artificial Sequence
  chemically synthesized
tttttttgagatggggtctcgc

SEQ ID NO: 714389 - DNA, 22 bp, Artificial Sequence
  chemically synthesized
ttttttttgagatggggtctcg

SEQ ID NO: 714390 - DNA, 22 bp, Artificial Sequence
  chemically synthesized
tttttttttgagatggggtctc

SEQ ID NO: 714391 - DNA, 22 bp, Artificial Sequence
  chemically synthesized
ggcgacagagcgagaccccatc

SEQ ID NO: 714392 - DNA, 22 bp, Artificial Sequence
  chemically synthesized
ttttttttttgagatggggtct

SEQ ID NO: 714393 - DNA, 22 bp, Artificial Sequence
  chemically synthesized
tttttttttttgagatggggtc

SEQ ID NO: 714394 - DNA, 22 bp, Artificial Sequence
  chemically synthesized
ttttttttttttgagatggggt

SEQ ID NO: 714395 - DNA, 22 bp, Artificial Sequence
  chemically synthesized
tttttttttttttgagatgggg

SEQ ID NO: 714396 - DNA, 22 bp, Artificial Sequence
  chemically synthesized
ttttttttttttttgagatggg

SEQ ID NO: 714397 - DNA, 22 bp, Artificial Sequence
  chemically synthesized
tttttttttttttttgagatgg

SEQ ID NO: 714398 - DNA, 22 bp, Artificial Sequence
  chemically synthesized
ttttttttttttttttgagatg

SEQ ID NO: 714399 - DNA, 22 bp, Artificial Sequence
  chemically synthesized
tttttttttttttttttgagat

SEQ ID NO: 714400 - DNA, 22 bp, Artificial Sequence
  chemically synthesized
tttttttttttttttttttgag

SEQ ID NO: 714401 - DNA, 22 bp, Artificial Sequence
  chemically synthesized
gtattctttttttttttttttt

SEQ ID NO: 714402 - DNA, 22 bp, Artificial Sequence
  chemically synthesized
atatctagtattcttttttttt

SEQ ID NO: 714403 - DNA, 22 bp, Artificial Sequence
  chemically synthesized
aaaaaaaaaaaaaaaaaaagaa

SEQ ID NO: 714404 - DNA, 22 bp, Artificial Sequence
  chemically synthesized
tggcatctaatatctagtattc

SEQ ID NO: 714405 - DNA, 22 bp, Artificial Sequence
  chemically synthesized
gtggcatctaatatctagtatt

SEQ ID NO: 714406 - DNA, 22 bp, Artificial Sequence
  chemically synthesized
ataaccttgtggcatctaatat

SEQ ID NO: 714407 - DNA, 22 bp, Artificial Sequence
  chemically synthesized
gtgtatattgataaccttgtgg

SEQ ID NO: 714408 - DNA, 22 bp, Artificial Sequence
  chemically synthesized
gatattagatgccacaaggtta

SEQ ID NO: 714409 - DNA, 22 bp, Artificial Sequence
  chemically synthesized
gaaactagtgtatattgataac

SEQ ID NO: 714410 - DNA, 22 bp, Artificial Sequence
  chemically synthesized
gatgccacaaggttatcaatat

SEQ ID NO: 714411 - DNA, 22 bp, Artificial Sequence
  chemically synthesized
aaaaagcctcgaaactagtgta

SEQ ID NO: 714412 - DNA, 22 bp, Artificial Sequence
  chemically synthesized
caaaaagcctcgaaactagtgt

SEQ ID NO: 714413 - DNA, 22 bp, Artificial Sequence
  chemically synthesized
tcaaaaagcctcgaaactagtg

SEQ ID NO: 714414 - DNA, 22 bp, Artificial Sequence
  chemically synthesized
tcaatatacactagtttcgagg

SEQ ID NO: 714415 - DNA, 22 bp, Artificial Sequence
  chemically synthesized
gtttcgaggctttttgaaaatt

SEQ ID NO: 714416 - DNA, 22 bp, Artificial Sequence
  chemically synthesized
cgaggctttttgaaaattttgg

SEQ ID NO: 714417 - DNA, 22 bp, Artificial Sequence
  chemically synthesized
gataggggtgcaccaaaatttt

SEQ ID NO: 714418 - DNA, 22 bp, Artificial Sequence
  chemically synthesized
gaggctttttgaaaattttggt

SEQ ID NO: 714419 - DNA, 22 bp, Artificial Sequence
  chemically synthesized
tttgaaaattttggtgcacccc

SEQ ID NO: 714420 - DNA, 22 bp, Artificial Sequence
  chemically synthesized
ttgaaaattttggtgcacccct

SEQ ID NO: 714421 - DNA, 22 bp, Artificial Sequence
  chemically synthesized
tgaaaattttggtgcaccccta

SEQ ID NO: 714422 - DNA, 22 bp, Artificial Sequence
  chemically synthesized
gaaaattttggtgcacccctat

SEQ ID NO: 714423 - DNA, 22 bp, Artificial Sequence
  chemically synthesized
aaaattttggtgcacccctatc

SEQ ID NO: 714424 - DNA, 22 bp, Artificial Sequence
  chemically synthesized
tggtgcacccctatccagcata

SEQ ID NO: 714425 - DNA, 22 bp, Artificial Sequence
  chemically synthesized
ggtgcacccctatccagcatat

SEQ ID NO: 714426 - DNA, 22 bp, Artificial Sequence
  chemically synthesized
gtgcacccctatccagcatatc

SEQ ID NO: 714427 - DNA, 22 bp, Artificial Sequence
  chemically synthesized
tccagcatatcccgcccctctc

SEQ ID NO: 714428 - DNA, 22 bp, Artificial Sequence
  chemically synthesized
gcaacagggaatgtgaaataga

SEQ ID NO: 714429 - DNA, 22 bp, Artificial Sequence
  chemically synthesized
atattagcaacagggaatgtga

SEQ ID NO: 714430 - DNA, 22 bp, Artificial Sequence
  chemically synthesized
ctaatattagcaacagggaatg

SEQ ID NO: 714431 - DNA, 22 bp, Artificial Sequence
  chemically synthesized
cctaatattagcaacagggaat

SEQ ID NO: 714432 - DNA, 22 bp, Artificial Sequence
  chemically synthesized
tcctaatattagcaacagggaa

SEQ ID NO: 714433 - DNA, 22 bp, Artificial Sequence
  chemically synthesized
tctatttcacattccctgttgc

SEQ ID NO: 714434 - DNA, 22 bp, Artificial Sequence
  chemically synthesized
ttcctaatattagcaacaggga

SEQ ID NO: 714435 - DNA, 22 bp, Artificial Sequence
  chemically synthesized
tatttcacattccctgttgcta

SEQ ID NO: 714436 - DNA, 22 bp, Artificial Sequence
  chemically synthesized
ttttcctaatattagcaacagg

SEQ ID NO: 714437 - DNA, 22 bp, Artificial Sequence
  chemically synthesized
tttcacattccctgttgctaat

SEQ ID NO: 714438 - DNA, 22 bp, Artificial Sequence
  chemically synthesized
tcttttcctaatattagcaaca

SEQ ID NO: 714439 - DNA, 22 bp, Artificial Sequence
  chemically synthesized
cacattccctgttgctaatatt

SEQ ID NO: 714440 - DNA, 22 bp, Artificial Sequence
  chemically synthesized
acattccctgttgctaatatta

SEQ ID NO: 714441 - DNA, 22 bp, Artificial Sequence
  chemically synthesized
cctgttgctaatattaggaaaa

SEQ ID NO: 714442 - DNA, 22 bp, Artificial Sequence
  chemically synthesized
acgtaaacgttctcttttccta

SEQ ID NO: 714443 - DNA, 22 bp, Artificial Sequence
  chemically synthesized
ttgctaatattaggaaaagaga

SEQ ID NO: 714444 - DNA, 22 bp, Artificial Sequence
  chemically synthesized
ctaatattaggaaaagagaacg

SEQ ID NO: 714445 - DNA, 22 bp, Artificial Sequence
  chemically synthesized
atattaggaaaagagaacgttt

SEQ ID NO: 714446 - DNA, 22 bp, Artificial Sequence
  chemically synthesized
ggaaaagagaacgtttacgtga

SEQ ID NO: 714447 - DNA, 22 bp, Artificial Sequence
  chemically synthesized
aaatcaaatagcatactcacgt

SEQ ID NO: 714448 - DNA, 22 bp, Artificial Sequence
  chemically synthesized
gttcaaatcaaatagcatactc

SEQ ID NO: 714449 - DNA, 22 bp, Artificial Sequence
  chemically synthesized
acgtgagtatgctatttgattt

SEQ ID NO: 714450 - DNA, 22 bp, Artificial Sequence
  chemically synthesized
agaggttggttcaaatcaaata

SEQ ID NO: 714451 - DNA, 22 bp, Artificial Sequence
  chemically synthesized
cgtgagtatgctatttgatttg

SEQ ID NO: 714452 - DNA, 22 bp, Artificial Sequence
  chemically synthesized
accctgagaggttggttcaaat

SEQ ID NO: 714453 - DNA, 22 bp, Artificial Sequence
  chemically synthesized
ttgaccctgagaggttggttca

SEQ ID NO: 714454 - DNA, 22 bp, Artificial Sequence
  chemically synthesized
tttgatttgaaccaacctctca

SEQ ID NO: 714455 - DNA, 22 bp, Artificial Sequence
  chemically synthesized
gatttgaaccaacctctcaggg

SEQ ID NO: 714456 - DNA, 22 bp, Artificial Sequence
  chemically synthesized
aaatattattgaccctgagagg

SEQ ID NO: 714457 - DNA, 22 bp, Artificial Sequence
  chemically synthesized
atttgaaccaacctctcagggt

SEQ ID NO: 714458 - DNA, 22 bp, Artificial Sequence
  chemically synthesized
gaaccaacctctcagggtcaat

SEQ ID NO: 714459 - DNA, 22 bp, Artificial Sequence
  chemically synthesized
aaccaacctctcagggtcaata

SEQ ID NO: 714460 - DNA, 22 bp, Artificial Sequence
  chemically synthesized
cacacaaaatactgaaatatta

SEQ ID NO: 714461 - DNA, 22 bp, Artificial Sequence
  chemically synthesized
tcagggtcaataatatttcagt

SEQ ID NO: 714462 - DNA, 22 bp, Artificial Sequence
  chemically synthesized
agggtcaataatatttcagtat

SEQ ID NO: 714463 - DNA, 22 bp, Artificial Sequence
  chemically synthesized
aatgctgcacacaaaatactga

SEQ ID NO: 714464 - DNA, 22 bp, Artificial Sequence
  chemically synthesized
aaatgctgcacacaaaatactg

SEQ ID NO: 714465 - DNA, 22 bp, Artificial Sequence
  chemically synthesized
taatcttaaatgctgcacacaa

SEQ ID NO: 714466 - DNA, 22 bp, Artificial Sequence
  chemically synthesized
ataatcttaaatgctgcacaca

SEQ ID NO: 714467 - DNA, 22 bp, Artificial Sequence
  chemically synthesized
tataatcttaaatgctgcacac

SEQ ID NO: 714468 - DNA, 22 bp, Artificial Sequence
  chemically synthesized
cagtattttgtgtgcagcattt

SEQ ID NO: 714469 - DNA, 22 bp, Artificial Sequence
  chemically synthesized
agtattttgtgtgcagcattta

SEQ ID NO: 714470 - DNA, 22 bp, Artificial Sequence
  chemically synthesized
tgtgtgcagcatttaagattat

SEQ ID NO: 714471 - DNA, 22 bp, Artificial Sequence
  chemically synthesized
gtgtgcagcatttaagattata

SEQ ID NO: 714472 - DNA, 22 bp, Artificial Sequence
  chemically synthesized
tgtgcagcatttaagattataa

SEQ ID NO: 714473 - DNA, 22 bp, Artificial Sequence
  chemically synthesized
aaatgggcatactttataatct

SEQ ID NO: 714474 - DNA, 22 bp, Artificial Sequence
  chemically synthesized
aagattataaagtatgcccatt

SEQ ID NO: 714475 - DNA, 22 bp, Artificial Sequence
  chemically synthesized
agattataaagtatgcccattt

SEQ ID NO: 714476 - DNA, 22 bp, Artificial Sequence
  chemically synthesized
aaaggagtgctgaaatgggcat

SEQ ID NO: 714477 - DNA, 22 bp, Artificial Sequence
  chemically synthesized
aaaaggagtgctgaaatgggca

SEQ ID NO: 714478 - DNA, 22 bp, Artificial Sequence
  chemically synthesized
tttaaaaggagtgctgaaatgg

SEQ ID NO: 714479 - DNA, 22 bp, Artificial Sequence
  chemically synthesized
taaagtatgcccatttcagcac

SEQ ID NO: 714480 - DNA, 22 bp, Artificial Sequence
  chemically synthesized
tgtttaaaaggagtgctgaaat

SEQ ID NO: 714481 - DNA, 22 bp, Artificial Sequence
  chemically synthesized
ctgtttaaaaggagtgctgaaa

SEQ ID NO: 714482 - DNA, 22 bp, Artificial Sequence
  chemically synthesized
tctgtttaaaaggagtgctgaa

SEQ ID NO: 714483 - DNA, 22 bp, Artificial Sequence
  chemically synthesized
aatctttctgtttaaaaggagt

SEQ ID NO: 714484 - DNA, 22 bp, Artificial Sequence
  chemically synthesized
aactaaatctttctgtttaaaa

SEQ ID NO: 714485 - DNA, 22 bp, Artificial Sequence
  chemically synthesized
caactaaatctttctgtttaaa

SEQ ID NO: 714486 - DNA, 22 bp, Artificial Sequence
  chemically synthesized
tcaactaaatctttctgtttaa

SEQ ID NO: 714487 - DNA, 22 bp, Artificial Sequence
  chemically synthesized
cagcactccttttaaacagaaa

SEQ ID NO: 714488 - DNA, 22 bp, Artificial Sequence
  chemically synthesized
agcactccttttaaacagaaag

SEQ ID NO: 714489 - DNA, 22 bp, Artificial Sequence
  chemically synthesized
agttttcaactaaatctttctg

SEQ ID NO: 714490 - DNA, 22 bp, Artificial Sequence
  chemically synthesized
gagttttcaactaaatctttct

SEQ ID NO: 714491 - DNA, 22 bp, Artificial Sequence
  chemically synthesized
tgagttttcaactaaatctttc

SEQ ID NO: 714492 - DNA, 22 bp, Artificial Sequence
  chemically synthesized
cttttaaacagaaagatttagt

SEQ ID NO: 714493 - DNA, 22 bp, Artificial Sequence
  chemically synthesized
ttaaacagaaagatttagttga

SEQ ID NO: 714494 - DNA, 22 bp, Artificial Sequence
  chemically synthesized
taaacagaaagatttagttgaa

SEQ ID NO: 714495 - DNA, 22 bp, Artificial Sequence
  chemically synthesized
aaacagaaagatttagttgaaa

SEQ ID NO: 714496 - DNA, 22 bp, Artificial Sequence
  chemically synthesized
aacagaaagatttagttgaaaa

SEQ ID NO: 714497 - DNA, 22 bp, Artificial Sequence
  chemically synthesized
agtggacaaatgtggctttgag

SEQ ID NO: 714498 - DNA, 22 bp, Artificial Sequence
  chemically synthesized
cagtggacaaatgtggctttga

SEQ ID NO: 714499 - DNA, 22 bp, Artificial Sequence
  chemically synthesized
tcagtggacaaatgtggctttg

SEQ ID NO: 714500 - DNA, 22 bp, Artificial Sequence
  chemically synthesized
agttgaaaactcaaagccacat

SEQ ID NO: 714501 - DNA, 22 bp, Artificial Sequence
  chemically synthesized
gttgaaaactcaaagccacatt

SEQ ID NO: 714502 - DNA, 22 bp, Artificial Sequence
  chemically synthesized
aaaactcaaagccacatttgtc

SEQ ID NO: 714503 - DNA, 22 bp, Artificial Sequence
  chemically synthesized
aaagctttcagtggacaaatgt

SEQ ID NO: 714504 - DNA, 22 bp, Artificial Sequence
  chemically synthesized
aaaagctttcagtggacaaatg

SEQ ID NO: 714505 - DNA, 22 bp, Artificial Sequence
  chemically synthesized
taaaagctttcagtggacaaat

SEQ ID NO: 714506 - DNA, 22 bp, Artificial Sequence
  chemically synthesized
ttaaaagctttcagtggacaaa

SEQ ID NO: 714507 - DNA, 22 bp, Artificial Sequence
  chemically synthesized
tttaaaagctttcagtggacaa

SEQ ID NO: 714508 - DNA, 22 bp, Artificial Sequence
  chemically synthesized
aaagccacatttgtccactgaa

SEQ ID NO: 714509 - DNA, 22 bp, Artificial Sequence
  chemically synthesized
acaaatgaagctttttaaaagc

SEQ ID NO: 714510 - DNA, 22 bp, Artificial Sequence
  chemically synthesized
gtccactgaaagcttttaaaaa

SEQ ID NO: 714511 - DNA, 22 bp, Artificial Sequence
  chemically synthesized
cacaaatgaagctttttaaaag

SEQ ID NO: 714512 - DNA, 22 bp, Artificial Sequence
  chemically synthesized
tccactgaaagcttttaaaaag

SEQ ID NO: 714513 - DNA, 22 bp, Artificial Sequence
  chemically synthesized
tcacaaatgaagctttttaaaa

SEQ ID NO: 714514 - DNA, 22 bp, Artificial Sequence
  chemically synthesized
ttcacaaatgaagctttttaaa

SEQ ID NO: 714515 - DNA, 22 bp, Artificial Sequence
  chemically synthesized
aaagcttttaaaaagcttcatt

SEQ ID NO: 714516 - DNA, 22 bp, Artificial Sequence
  chemically synthesized
ttaaaaagcttcatttgtgaaa

SEQ ID NO: 714517 - DNA, 22 bp, Artificial Sequence
  chemically synthesized
gtcaatgtgtcttttcacaaat

SEQ ID NO: 714518 - DNA, 22 bp, Artificial Sequence
  chemically synthesized
taaaaagcttcatttgtgaaaa

SEQ ID NO: 714519 - DNA, 22 bp, Artificial Sequence
  chemically synthesized
aaaaagcttcatttgtgaaaag

SEQ ID NO: 714520 - DNA, 22 bp, Artificial Sequence
  chemically synthesized
tggtcaatgtgtcttttcacaa

SEQ ID NO: 714521 - DNA, 22 bp, Artificial Sequence
  chemically synthesized
aaaagcttcatttgtgaaaaga

SEQ ID NO: 714522 - DNA, 22 bp, Artificial Sequence
  chemically synthesized
catttgtgaaaagacacattga

SEQ ID NO: 714523 - DNA, 22 bp, Artificial Sequence
  chemically synthesized
atttgtgaaaagacacattgac

SEQ ID NO: 714524 - DNA, 22 bp, Artificial Sequence
  chemically synthesized
gtgaaaagacacattgaccaga

SEQ ID NO: 714525 - DNA, 22 bp, Artificial Sequence
  chemically synthesized
tgaaaagacacattgaccagag

SEQ ID NO: 714526 - DNA, 22 bp, Artificial Sequence
  chemically synthesized
atgatccccagcagctctggtc

SEQ ID NO: 714527 - DNA, 22 bp, Artificial Sequence
  chemically synthesized
attaatgatccccagcagctct

SEQ ID NO: 714528 - DNA, 22 bp, Artificial Sequence
  chemically synthesized
cattaatgatccccagcagctc

SEQ ID NO: 714529 - DNA, 22 bp, Artificial Sequence
  chemically synthesized
tcattaatgatccccagcagct

SEQ ID NO: 714530 - DNA, 22 bp, Artificial Sequence
  chemically synthesized
accagagctgctggggatcatt

SEQ ID NO: 714531 - DNA, 22 bp, Artificial Sequence
  chemically synthesized
aagatccagctttcattaatga

SEQ ID NO: 714532 - DNA, 22 bp, Artificial Sequence
  chemically synthesized
gaagatccagctttcattaatg

SEQ ID NO: 714533 - DNA, 22 bp, Artificial Sequence
  chemically synthesized
tgaagatccagctttcattaat

SEQ ID NO: 714534 - DNA, 22 bp, Artificial Sequence
  chemically synthesized
ctggggatcattaatgaaagct

SEQ ID NO: 714535 - DNA, 22 bp, Artificial Sequence
  chemically synthesized
ctttgaagatccagctttcatt

SEQ ID NO: 714536 - DNA, 22 bp, Artificial Sequence
  chemically synthesized
gggatcattaatgaaagctgga

SEQ ID NO: 714537 - DNA, 22 bp, Artificial Sequence
  chemically synthesized
atgaaagctggatcttcaaagg

SEQ ID NO: 714538 - DNA, 22 bp, Artificial Sequence
  chemically synthesized
taacacagaatctcctttgaag

SEQ ID NO: 714539 - DNA, 22 bp, Artificial Sequence
  chemically synthesized
gtaacacagaatctcctttgaa

SEQ ID NO: 714540 - DNA, 22 bp, Artificial Sequence
  chemically synthesized
tgtaacacagaatctcctttga

SEQ ID NO: 714541 - DNA, 22 bp, Artificial Sequence
  chemically synthesized
ttgtaacacagaatctcctttg

SEQ ID NO: 714542 - DNA, 22 bp, Artificial Sequence
  chemically synthesized
tttgtaacacagaatctccttt

SEQ ID NO: 714543 - DNA, 22 bp, Artificial Sequence
  chemically synthesized
gatcttcaaaggagattctgtg

SEQ ID NO: 714544 - DNA, 22 bp, Artificial Sequence
  chemically synthesized
caaaggagattctgtgttacaa

SEQ ID NO: 714545 - DNA, 22 bp, Artificial Sequence
  chemically synthesized
aaaggagattctgtgttacaaa

SEQ ID NO: 714546 - DNA, 22 bp, Artificial Sequence
  chemically synthesized
gccaaaatgtccaagtaccttt

SEQ ID NO: 714547 - DNA, 22 bp, Artificial Sequence
  chemically synthesized
agccaaaatgtccaagtacctt

SEQ ID NO: 714548 - DNA, 22 bp, Artificial Sequence
  chemically synthesized
tgtgttacaaaaaggtacttgg

SEQ ID NO: 714549 - DNA, 22 bp, Artificial Sequence
  chemically synthesized
tgttacaaaaaggtacttggac

SEQ ID NO: 714550 - DNA, 22 bp, Artificial Sequence
  chemically synthesized
cagcttagccaaaatgtccaag

SEQ ID NO: 714551 - DNA, 22 bp, Artificial Sequence
  chemically synthesized
caaaaaggtacttggacatttt

SEQ ID NO: 714552 - DNA, 22 bp, Artificial Sequence
  chemically synthesized
ggacattttggctaagctgcag

SEQ ID NO: 714553 - DNA, 22 bp, Artificial Sequence
  chemically synthesized
gacattttggctaagctgcaga

SEQ ID NO: 714554 - DNA, 22 bp, Artificial Sequence
  chemically synthesized
tggctaagctgcagaccacctg

SEQ ID NO: 714555 - DNA, 22 bp, Artificial Sequence
  chemically synthesized
ggctaagctgcagaccacctgt

SEQ ID NO: 714556 - DNA, 22 bp, Artificial Sequence
  chemically synthesized
gctaagctgcagaccacctgtg

SEQ ID NO: 714557 - DNA, 22 bp, Artificial Sequence
  chemically synthesized
tcaaatggccaaatcacaggtg

SEQ ID NO: 714558 - DNA, 22 bp, Artificial Sequence
  chemically synthesized
agctgcagaccacctgtgattt

SEQ ID NO: 714559 - DNA, 22 bp, Artificial Sequence
  chemically synthesized
tatcaaatggccaaatcacagg

SEQ ID NO: 714560 - DNA, 22 bp, Artificial Sequence
  chemically synthesized
cagaccacctgtgatttggcca

SEQ ID NO: 714561 - DNA, 22 bp, Artificial Sequence
  chemically synthesized
tgatttggccatttgatagagg

SEQ ID NO: 714562 - DNA, 22 bp, Artificial Sequence
  chemically synthesized
tcaacaaccaaccctctatcaa

SEQ ID NO: 714563 - DNA, 22 bp, Artificial Sequence
  chemically synthesized
ggccatttgatagagggttggt

SEQ ID NO: 714564 - DNA, 22 bp, Artificial Sequence
  chemically synthesized
gccatttgatagagggttggtt

SEQ ID NO: 714565 - DNA, 22 bp, Artificial Sequence
  chemically synthesized
ggacctgtcaacaaccaaccct

SEQ ID NO: 714566 - DNA, 22 bp, Artificial Sequence
  chemically synthesized
aggacctgtcaacaaccaaccc

SEQ ID NO: 714567 - DNA, 22 bp, Artificial Sequence
  chemically synthesized
ttaggacctgtcaacaaccaac

SEQ ID NO: 714568 - DNA, 22 bp, Artificial Sequence
  chemically synthesized
gatagagggttggttgttgaca

SEQ ID NO: 714569 - DNA, 22 bp, Artificial Sequence
  chemically synthesized
atagagggttggttgttgacag

SEQ ID NO: 714570 - DNA, 22 bp, Artificial Sequence
  chemically synthesized
gttgttgacaggtcctaagaga

SEQ ID NO: 714571 - DNA, 22 bp, Artificial Sequence
  chemically synthesized
ttgacaggtcctaagagatacc

SEQ ID NO: 714572 - DNA, 22 bp, Artificial Sequence
  chemically synthesized
acaggtcctaagagataccccc

SEQ ID NO: 714573 - DNA, 22 bp, Artificial Sequence
  chemically synthesized
aaaagaagagacatagggggta

SEQ ID NO: 714574 - DNA, 22 bp, Artificial Sequence
  chemically synthesized
aaaaagaagagacatagggggt

SEQ ID NO: 714575 - DNA, 22 bp, Artificial Sequence
  chemically synthesized
taaaaagaagagacataggggg

SEQ ID NO: 714576 - DNA, 22 bp, Artificial Sequence
  chemically synthesized
agagataccccctatgtctctt

SEQ ID NO: 714577 - DNA, 22 bp, Artificial Sequence
  chemically synthesized
atacaattttaaaaagaagaga

SEQ ID NO: 714578 - DNA, 22 bp, Artificial Sequence
  chemically synthesized
aatacaattttaaaaagaagag

SEQ ID NO: 714579 - DNA, 22 bp, Artificial Sequence
  chemically synthesized
taatacaattttaaaaagaaga

SEQ ID NO: 714580 - DNA, 22 bp, Artificial Sequence
  chemically synthesized
ttaatacaattttaaaaagaag

SEQ ID NO: 714581 - DNA, 22 bp, Artificial Sequence
  chemically synthesized
tgtctcttctttttaaaattgt

SEQ ID NO: 714582 - DNA, 22 bp, Artificial Sequence
  chemically synthesized
ttctttttaaaattgtattaaa

SEQ ID NO: 714583 - DNA, 22 bp, Artificial Sequence
  chemically synthesized
ctttttaaaattgtattaaaag

SEQ ID NO: 714584 - DNA, 22 bp, Artificial Sequence
  chemically synthesized
tttttaaaattgtattaaaaga

SEQ ID NO: 714585 - DNA, 22 bp, Artificial Sequence
  chemically synthesized
tttaaaattgtattaaaagatt

SEQ ID NO: 714586 - DNA, 22 bp, Artificial Sequence
  chemically synthesized
ttaaaattgtattaaaagattt

SEQ ID NO: 714587 - DNA, 22 bp, Artificial Sequence
  chemically synthesized
taaaattgtattaaaagatttg

SEQ ID NO: 714588 - DNA, 22 bp, Artificial Sequence
  chemically synthesized
aaaattgtattaaaagatttgt

SEQ ID NO: 714589 - DNA, 22 bp, Artificial Sequence
  chemically synthesized
aaattgtattaaaagatttgta

SEQ ID NO: 714590 - DNA, 22 bp, Artificial Sequence
  chemically synthesized
aatagggagcccatgatacaaa

SEQ ID NO: 714591 - DNA, 22 bp, Artificial Sequence
  chemically synthesized
aaatagggagcccatgatacaa

SEQ ID NO: 714592 - DNA, 22 bp, Artificial Sequence
  chemically synthesized
tattaaaagatttgtatcatgg

SEQ ID NO: 714593 - DNA, 22 bp, Artificial Sequence
  chemically synthesized
taaatagggagcccatgataca

SEQ ID NO: 714594 - DNA, 22 bp, Artificial Sequence
  chemically synthesized
attttaaatagggagcccatga

SEQ ID NO: 714595 - DNA, 22 bp, Artificial Sequence
  chemically synthesized
aaagatttgtatcatgggctcc

SEQ ID NO: 714596 - DNA, 22 bp, Artificial Sequence
  chemically synthesized
cattttaaatagggagcccatg

SEQ ID NO: 714597 - DNA, 22 bp, Artificial Sequence
  chemically synthesized
tcattttaaatagggagcccat

SEQ ID NO: 714598 - DNA, 22 bp, Artificial Sequence
  chemically synthesized
gtatcatgggctccctatttaa

SEQ ID NO: 714599 - DNA, 22 bp, Artificial Sequence
  chemically synthesized
tatcatgggctccctatttaaa

SEQ ID NO: 714600 - DNA, 22 bp, Artificial Sequence
  chemically synthesized
cccagactttcattttaaatag

SEQ ID NO: 714601 - DNA, 22 bp, Artificial Sequence
  chemically synthesized
cctatttaaaatgaaagtctgg

SEQ ID NO: 714602 - DNA, 22 bp, Artificial Sequence
  chemically synthesized
tttaaaatgaaagtctgggcag

SEQ ID NO: 714603 - DNA, 22 bp, Artificial Sequence
  chemically synthesized
aaaatgaaagtctgggcagctg

SEQ ID NO: 714604 - DNA, 22 bp, Artificial Sequence
  chemically synthesized
aaatgaaagtctgggcagctgc

SEQ ID NO: 714605 - DNA, 22 bp, Artificial Sequence
  chemically synthesized
gacggagtaaaaggggcagctg

SEQ ID NO: 714606 - DNA, 22 bp, Artificial Sequence
  chemically synthesized
tagacggagtaaaaggggcagc

SEQ ID NO: 714607 - DNA, 22 bp, Artificial Sequence
  chemically synthesized
ctagacggagtaaaaggggcag

SEQ ID NO: 714608 - DNA, 22 bp, Artificial Sequence
  chemically synthesized
ttctagacggagtaaaaggggc

SEQ ID NO: 714609 - DNA, 22 bp, Artificial Sequence
  chemically synthesized
cttctagacggagtaaaagggg

SEQ ID NO: 714610 - DNA, 22 bp, Artificial Sequence
  chemically synthesized
ggcagctgccccttttactccg

SEQ ID NO: 714611 - DNA, 22 bp, Artificial Sequence
  chemically synthesized
ccccttttactccgtctagaag

SEQ ID NO: 714612 - DNA, 22 bp, Artificial Sequence
  chemically synthesized
ttactccgtctagaagaaggta

SEQ ID NO: 714613 - DNA, 22 bp, Artificial Sequence
  chemically synthesized
gaaaatgtaaggtaccttcttc

SEQ ID NO: 714614 - DNA, 22 bp, Artificial Sequence
  chemically synthesized
tactccgtctagaagaaggtac

SEQ ID NO: 714615 - DNA, 22 bp, Artificial Sequence
  chemically synthesized
actccgtctagaagaaggtacc

SEQ ID NO: 714616 - DNA, 22 bp, Artificial Sequence
  chemically synthesized
ctccgtctagaagaaggtacct

SEQ ID NO: 714617 - DNA, 22 bp, Artificial Sequence
  chemically synthesized
cgtctagaagaaggtaccttac

SEQ ID NO: 714618 - DNA, 22 bp, Artificial Sequence
  chemically synthesized
atgttagaaaatgtaaggtacc

SEQ ID NO: 714619 - DNA, 22 bp, Artificial Sequence
  chemically synthesized
gaagaaggtaccttacattttc

SEQ ID NO: 714620 - DNA, 22 bp, Artificial Sequence
  chemically synthesized
atggaaaactcatgttagaaaa

SEQ ID NO: 714621 - DNA, 22 bp, Artificial Sequence
  chemically synthesized
ttgatggaaaactcatgttaga

SEQ ID NO: 714622 - DNA, 22 bp, Artificial Sequence
  chemically synthesized
acattttctaacatgagttttc

SEQ ID NO: 714623 - DNA, 22 bp, Artificial Sequence
  chemically synthesized
cattttctaacatgagttttcc

SEQ ID NO: 714624 - DNA, 22 bp, Artificial Sequence
  chemically synthesized
tctaacatgagttttccatcaa

SEQ ID NO: 714625 - DNA, 22 bp, Artificial Sequence
  chemically synthesized
ctaacatgagttttccatcaat

SEQ ID NO: 714626 - DNA, 22 bp, Artificial Sequence
  chemically synthesized
taacatgagttttccatcaata

SEQ ID NO: 714627 - DNA, 22 bp, Artificial Sequence
  chemically synthesized
acatgagttttccatcaataat

SEQ ID NO: 714628 - DNA, 22 bp, Artificial Sequence
  chemically synthesized
gtgtcatagcagacaattattg

SEQ ID NO: 714629 - DNA, 22 bp, Artificial Sequence
  chemically synthesized
ggtgtcatagcagacaattatt

SEQ ID NO: 714630 - DNA, 22 bp, Artificial Sequence
  chemically synthesized
tggtgtcatagcagacaattat

SEQ ID NO: 714631 - DNA, 22 bp, Artificial Sequence
  chemically synthesized
tccatcaataattgtctgctat

SEQ ID NO: 714632 - DNA, 22 bp, Artificial Sequence
  chemically synthesized
ccatcaataattgtctgctatg

SEQ ID NO: 714633 - DNA, 22 bp, Artificial Sequence
  chemically synthesized
catcaataattgtctgctatga

SEQ ID NO: 714634 - DNA, 22 bp, Artificial Sequence
  chemically synthesized
tctgctatgacaccaaagtatt

SEQ ID NO: 714635 - DNA, 22 bp, Artificial Sequence
  chemically synthesized
ctatgacaccaaagtattcccc

SEQ ID NO: 714636 - DNA, 22 bp, Artificial Sequence
  chemically synthesized
cagccaggaggtggggaatact

SEQ ID NO: 714637 - DNA, 22 bp, Artificial Sequence
  chemically synthesized
tccagccaggaggtggggaata

SEQ ID NO: 714638 - DNA, 22 bp, Artificial Sequence
  chemically synthesized
tgacaccaaagtattccccacc

SEQ ID NO: 714639 - DNA, 22 bp, Artificial Sequence
  chemically synthesized
cccacctcctggctggagagca

SEQ ID NO: 714640 - DNA, 22 bp, Artificial Sequence
  chemically synthesized
ctggctggagagcatgttgtct

SEQ ID NO: 714641 - DNA, 22 bp, Artificial Sequence
  chemically synthesized
gctggagagcatgttgtcttgg

SEQ ID NO: 714642 - DNA, 22 bp, Artificial Sequence
  chemically synthesized
gagagcatgttgtcttggtcat

SEQ ID NO: 714643 - DNA, 22 bp, Artificial Sequence
  chemically synthesized
caacataacagaggagatgacc

SEQ ID NO: 714644 - DNA, 22 bp, Artificial Sequence
  chemically synthesized
tctccaacataacagaggagat

SEQ ID NO: 714645 - DNA, 22 bp, Artificial Sequence
  chemically synthesized
tgtctccaacataacagaggag

SEQ ID NO: 714646 - DNA, 22 bp, Artificial Sequence
  chemically synthesized
tcttggtcatctcctctgttat

SEQ ID NO: 714647 - DNA, 22 bp, Artificial Sequence
  chemically synthesized
ggtcatctcctctgttatgttg

SEQ ID NO: 714648 - DNA, 22 bp, Artificial Sequence
  chemically synthesized
gtcatctcctctgttatgttgg

SEQ ID NO: 714649 - DNA, 22 bp, Artificial Sequence
  chemically synthesized
cgtgtgtcactctgtctccaac

SEQ ID NO: 714650 - DNA, 22 bp, Artificial Sequence
  chemically synthesized
ctctgttatgttggagacagag

SEQ ID NO: 714651 - DNA, 22 bp, Artificial Sequence
  chemically synthesized
acctacgtgtgtcactctgtct

SEQ ID NO: 714652 - DNA, 22 bp, Artificial Sequence
  chemically synthesized
tgttatgttggagacagagtga

SEQ ID NO: 714653 - DNA, 22 bp, Artificial Sequence
  chemically synthesized
ttatgttggagacagagtgaca

SEQ ID NO: 714654 - DNA, 22 bp, Artificial Sequence
  chemically synthesized
tgttggagacagagtgacacac

SEQ ID NO: 714655 - DNA, 22 bp, Artificial Sequence
  chemically synthesized
gaccccattcacctacgtgtgt

SEQ ID NO: 714656 - DNA, 22 bp, Artificial Sequence
  chemically synthesized
gagacagagtgacacacgtagg

SEQ ID NO: 714657 - DNA, 22 bp, Artificial Sequence
  chemically synthesized
agaccccattcacctacgtgtg

SEQ ID NO: 714658 - DNA, 22 bp, Artificial Sequence
  chemically synthesized
gtttagaccccattcacctacg

SEQ ID NO: 714659 - DNA, 22 bp, Artificial Sequence
  chemically synthesized
attggtttagaccccattcacc

SEQ ID NO: 714660 - DNA, 22 bp, Artificial Sequence
  chemically synthesized
aattggtttagaccccattcac

SEQ ID NO: 714661 - DNA, 22 bp, Artificial Sequence
  chemically synthesized
gacccagacaaggatttaattg

SEQ ID NO: 714662 - DNA, 22 bp, Artificial Sequence
  chemically synthesized
agacccagacaaggatttaatt

SEQ ID NO: 714663 - DNA, 22 bp, Artificial Sequence
  chemically synthesized
aaccaattaaatccttgtctgg

SEQ ID NO: 714664 - DNA, 22 bp, Artificial Sequence
  chemically synthesized
atcggtttagacccagacaagg

SEQ ID NO: 714665 - DNA, 22 bp, Artificial Sequence
  chemically synthesized
aatcggtttagacccagacaag

SEQ ID NO: 714666 - DNA, 22 bp, Artificial Sequence
  chemically synthesized
taatcggtttagacccagacaa

SEQ ID NO: 714667 - DNA, 22 bp, Artificial Sequence
  chemically synthesized
ttaatcggtttagacccagaca

SEQ ID NO: 714668 - DNA, 22 bp, Artificial Sequence
  chemically synthesized
tttaatcggtttagacccagac

SEQ ID NO: 714669 - DNA, 22 bp, Artificial Sequence
  chemically synthesized
ctttttaatcggtttagaccca

SEQ ID NO: 714670 - DNA, 22 bp, Artificial Sequence
  chemically synthesized
aatccttgtctgggtctaaacc

SEQ ID NO: 714671 - DNA, 22 bp, Artificial Sequence
  chemically synthesized
agttcctttttaatcggtttag

SEQ ID NO: 714672 - DNA, 22 bp, Artificial Sequence
  chemically synthesized
gagttcctttttaatcggttta

SEQ ID NO: 714673 - DNA, 22 bp, Artificial Sequence
  chemically synthesized
gtctgggtctaaaccgattaaa

SEQ ID NO: 714674 - DNA, 22 bp, Artificial Sequence
  chemically synthesized
tctgggtctaaaccgattaaaa

SEQ ID NO: 714675 - DNA, 22 bp, Artificial Sequence
  chemically synthesized
ggtctaaaccgattaaaaagga

SEQ ID NO: 714676 - DNA, 22 bp, Artificial Sequence
  chemically synthesized
aaccgattaaaaaggaactcaa

SEQ ID NO: 714677 - DNA, 22 bp, Artificial Sequence
  chemically synthesized
agagaaaatagatttgagttcc

SEQ ID NO: 714678 - DNA, 22 bp, Artificial Sequence
  chemically synthesized
aaaaggaactcaaatctatttt

SEQ ID NO: 714679 - DNA, 22 bp, Artificial Sequence
  chemically synthesized
ccaatctgagagaaaatagatt

SEQ ID NO: 714680 - DNA, 22 bp, Artificial Sequence
  chemically synthesized
tcccaatctgagagaaaataga

SEQ ID NO: 714681 - DNA, 22 bp, Artificial Sequence
  chemically synthesized
gtggactctcccaatctgagag

SEQ ID NO: 714682 - DNA, 22 bp, Artificial Sequence
  chemically synthesized
aaatctattttctctcagattg

SEQ ID NO: 714683 - DNA, 22 bp, Artificial Sequence
  chemically synthesized
cgtggactctcccaatctgaga

SEQ ID NO: 714684 - DNA, 22 bp, Artificial Sequence
  chemically synthesized
tcgtggactctcccaatctgag

SEQ ID NO: 714685 - DNA, 22 bp, Artificial Sequence
  chemically synthesized
ttttcgtggactctcccaatct

SEQ ID NO: 714686 - DNA, 22 bp, Artificial Sequence
  chemically synthesized
attttcgtggactctcccaatc

SEQ ID NO: 714687 - DNA, 22 bp, Artificial Sequence
  chemically synthesized
tattttcgtggactctcccaat

SEQ ID NO: 714688 - DNA, 22 bp, Artificial Sequence
  chemically synthesized
ttttctctcagattgggagagt

SEQ ID NO: 714689 - DNA, 22 bp, Artificial Sequence
  chemically synthesized
ttattttcgtggactctcccaa

SEQ ID NO: 714690 - DNA, 22 bp, Artificial Sequence
  chemically synthesized
tttattttcgtggactctccca

SEQ ID NO: 714691 - DNA, 22 bp, Artificial Sequence
  chemically synthesized
ttttattttcgtggactctccc

SEQ ID NO: 714692 - DNA, 22 bp, Artificial Sequence
  chemically synthesized
tctctcagattgggagagtcca

SEQ ID NO: 714693 - DNA, 22 bp, Artificial Sequence
  chemically synthesized
ctctcagattgggagagtccac

SEQ ID NO: 714694 - DNA, 22 bp, Artificial Sequence
  chemically synthesized
tctcagattgggagagtccacg

SEQ ID NO: 714695 - DNA, 22 bp, Artificial Sequence
  chemically synthesized
gcttttttattttcgtggactc

SEQ ID NO: 714696 - DNA, 22 bp, Artificial Sequence
  chemically synthesized
tcagattgggagagtccacgaa

SEQ ID NO: 714697 - DNA, 22 bp, Artificial Sequence
  chemically synthesized
ggcttttttattttcgtggact

SEQ ID NO: 714698 - DNA, 22 bp, Artificial Sequence
  chemically synthesized
agattgggagagtccacgaaaa

SEQ ID NO: 714699 - DNA, 22 bp, Artificial Sequence
  chemically synthesized
tttggcttttttattttcgtgg

SEQ ID NO: 714700 - DNA, 22 bp, Artificial Sequence
  chemically synthesized
ttgtttggcttttttattttcg

SEQ ID NO: 714701 - DNA, 22 bp, Artificial Sequence
  chemically synthesized
ggagagtccacgaaaataaaaa

SEQ ID NO: 714702 - DNA, 22 bp, Artificial Sequence
  chemically synthesized
tgttgtttggcttttttatttt

SEQ ID NO: 714703 - DNA, 22 bp, Artificial Sequence
  chemically synthesized
ctgttgtttggcttttttattt

SEQ ID NO: 714704 - DNA, 22 bp, Artificial Sequence
  chemically synthesized
ggcagcatttctgttgtttggc

SEQ ID NO: 714705 - DNA, 22 bp, Artificial Sequence
  chemically synthesized
tgcaactgggcagcatttctgt

SEQ ID NO: 714706 - DNA, 22 bp, Artificial Sequence
  chemically synthesized
gataatagcaacatcctgtgca

SEQ ID NO: 714707 - DNA, 22 bp, Artificial Sequence
  chemically synthesized
cccagttgcacaggatgttgct

SEQ ID NO: 714708 - DNA, 22 bp, Artificial Sequence
  chemically synthesized
cacaggatgttgctattatcta

SEQ ID NO: 714709 - DNA, 22 bp, Artificial Sequence
  chemically synthesized
atgtgcaaatgctagataatag

SEQ ID NO: 714710 - DNA, 22 bp, Artificial Sequence
  chemically synthesized
ctattatctagcatttgcacat

SEQ ID NO: 714711 - DNA, 22 bp, Artificial Sequence
  chemically synthesized
aaaacataaattgatgtgcaaa

SEQ ID NO: 714712 - DNA, 22 bp, Artificial Sequence
  chemically synthesized
gaaaacataaattgatgtgcaa

SEQ ID NO: 714713 - DNA, 22 bp, Artificial Sequence
  chemically synthesized
ttatctagcatttgcacatcaa

SEQ ID NO: 714714 - DNA, 22 bp, Artificial Sequence
  chemically synthesized
tctagcatttgcacatcaattt

SEQ ID NO: 714715 - DNA, 22 bp, Artificial Sequence
  chemically synthesized
gcatttgcacatcaatttatgt

SEQ ID NO: 714716 - DNA, 22 bp, Artificial Sequence
  chemically synthesized
tcaatgagtttgaaaacataaa

SEQ ID NO: 714717 - DNA, 22 bp, Artificial Sequence
  chemically synthesized
gcacatcaatttatgttttcaa

SEQ ID NO: 714718 - DNA, 22 bp, Artificial Sequence
  chemically synthesized
cacatcaatttatgttttcaaa

SEQ ID NO: 714719 - DNA, 22 bp, Artificial Sequence
  chemically synthesized
gtgactgtcaatgagtttgaaa

SEQ ID NO: 714720 - DNA, 22 bp, Artificial Sequence
  chemically synthesized
atgttttcaaactcattgacag

SEQ ID NO: 714721 - DNA, 22 bp, Artificial Sequence
  chemically synthesized
tgttttcaaactcattgacagt

SEQ ID NO: 714722 - DNA, 22 bp, Artificial Sequence
  chemically synthesized
ccggtaactagtgactgtcaat

SEQ ID NO: 714723 - DNA, 22 bp, Artificial Sequence
  chemically synthesized
tcaaactcattgacagtcacta

SEQ ID NO: 714724 - DNA, 22 bp, Artificial Sequence
  chemically synthesized
caaactcattgacagtcactag

SEQ ID NO: 714725 - DNA, 22 bp, Artificial Sequence
  chemically synthesized
aaactcattgacagtcactagt

SEQ ID NO: 714726 - DNA, 22 bp, Artificial Sequence
  chemically synthesized
attgacagtcactagttaccgg

SEQ ID NO: 714727 - DNA, 22 bp, Artificial Sequence
  chemically synthesized
acagagtgcctgccggtaacta

SEQ ID NO: 714728 - DNA, 22 bp, Artificial Sequence
  chemically synthesized
aacagagtgcctgccggtaact

SEQ ID NO: 714729 - DNA, 22 bp, Artificial Sequence
  chemically synthesized
ttaacagagtgcctgccggtaa

SEQ ID NO: 714730 - DNA, 22 bp, Artificial Sequence
  chemically synthesized
acagtcactagttaccggcagg

SEQ ID NO: 714731 - DNA, 22 bp, Artificial Sequence
  chemically synthesized
cttaacagagtgcctgccggta

SEQ ID NO: 714732 - DNA, 22 bp, Artificial Sequence
  chemically synthesized
cttcttaacagagtgcctgccg

SEQ ID NO: 714733 - DNA, 22 bp, Artificial Sequence
  chemically synthesized
tacttcttaacagagtgcctgc

SEQ ID NO: 714734 - DNA, 22 bp, Artificial Sequence
  chemically synthesized
tctacttcttaacagagtgcct

SEQ ID NO: 714735 - DNA, 22 bp, Artificial Sequence
  chemically synthesized
gttaccggcaggcactctgtta

SEQ ID NO: 714736 - DNA, 22 bp, Artificial Sequence
  chemically synthesized
gagttctctacttcttaacaga

SEQ ID NO: 714737 - DNA, 22 bp, Artificial Sequence
  chemically synthesized
ccggcaggcactctgttaagaa

SEQ ID NO: 714738 - DNA, 22 bp, Artificial Sequence
  chemically synthesized
agagttctctacttcttaacag

SEQ ID NO: 714739 - DNA, 22 bp, Artificial Sequence
  chemically synthesized
agcttagagttctctacttctt

SEQ ID NO: 714740 - DNA, 22 bp, Artificial Sequence
  chemically synthesized
tgttaagaagtagagaactcta

SEQ ID NO: 714741 - DNA, 22 bp, Artificial Sequence
  chemically synthesized
ttaagaagtagagaactctaag

SEQ ID NO: 714742 - DNA, 22 bp, Artificial Sequence
  chemically synthesized
tggtcaaaactcagcttagagt

SEQ ID NO: 714743 - DNA, 22 bp, Artificial Sequence
  chemically synthesized
agaagtagagaactctaagctg

SEQ ID NO: 714744 - DNA, 22 bp, Artificial Sequence
  chemically synthesized
cgggaatctatggtcaaaactc

SEQ ID NO: 714745 - DNA, 22 bp, Artificial Sequence
  chemically synthesized
ccgggaatctatggtcaaaact

SEQ ID NO: 714746 - DNA, 22 bp, Artificial Sequence
  chemically synthesized
taagctgagttttgaccataga

SEQ ID NO: 714747 - DNA, 22 bp, Artificial Sequence
  chemically synthesized
agctgagttttgaccatagatt

SEQ ID NO: 714748 - DNA, 22 bp, Artificial Sequence
  chemically synthesized
taaatcacttccgggaatctat

SEQ ID NO: 714749 - DNA, 22 bp, Artificial Sequence
  chemically synthesized
gtaaatcacttccgggaatcta

SEQ ID NO: 714750 - DNA, 22 bp, Artificial Sequence
  chemically synthesized
agttttgaccatagattcccgg

SEQ ID NO: 714751 - DNA, 22 bp, Artificial Sequence
  chemically synthesized
tgaccatagattcccggaagtg

SEQ ID NO: 714752 - DNA, 22 bp, Artificial Sequence
  chemically synthesized
gaccatagattcccggaagtga

SEQ ID NO: 714753 - DNA, 22 bp, Artificial Sequence
  chemically synthesized
accatagattcccggaagtgat

SEQ ID NO: 714754 - DNA, 22 bp, Artificial Sequence
  chemically synthesized
aaaatgatcttgtaaatcactt

SEQ ID NO: 714755 - DNA, 22 bp, Artificial Sequence
  chemically synthesized
gaaaatgatcttgtaaatcact

SEQ ID NO: 714756 - DNA, 22 bp, Artificial Sequence
  chemically synthesized
ccggaagtgatttacaagatca

SEQ ID NO: 714757 - DNA, 22 bp, Artificial Sequence
  chemically synthesized
gtcatacaaatttgaaaatgat

SEQ ID NO: 714758 - DNA, 22 bp, Artificial Sequence
  chemically synthesized
ggtcatacaaatttgaaaatga

SEQ ID NO: 714759 - DNA, 22 bp, Artificial Sequence
  chemically synthesized
tggtcatacaaatttgaaaatg

SEQ ID NO: 714760 - DNA, 22 bp, Artificial Sequence
  chemically synthesized
ttggtcatacaaatttgaaaat

SEQ ID NO: 714761 - DNA, 22 bp, Artificial Sequence
  chemically synthesized
acaagatcattttcaaatttgt

SEQ ID NO: 714762 - DNA, 22 bp, Artificial Sequence
  chemically synthesized
caagatcattttcaaatttgta

SEQ ID NO: 714763 - DNA, 22 bp, Artificial Sequence
  chemically synthesized
aaatgccttttggtcatacaaa

SEQ ID NO: 714764 - DNA, 22 bp, Artificial Sequence
  chemically synthesized
aaaatgccttttggtcatacaa

SEQ ID NO: 714765 - DNA, 22 bp, Artificial Sequence
  chemically synthesized
tcaaatttgtatgaccaaaagg

SEQ ID NO: 714766 - DNA, 22 bp, Artificial Sequence
  chemically synthesized
caaatttgtatgaccaaaaggc

SEQ ID NO: 714767 - DNA, 22 bp, Artificial Sequence
  chemically synthesized
aaatttgtatgaccaaaaggca

SEQ ID NO: 714768 - DNA, 22 bp, Artificial Sequence
  chemically synthesized
aaatcatatttaaaatgccttt

SEQ ID NO: 714769 - DNA, 22 bp, Artificial Sequence
  chemically synthesized
aaaatcatatttaaaatgcctt

SEQ ID NO: 714770 - DNA, 22 bp, Artificial Sequence
  chemically synthesized
gtatgaccaaaaggcattttaa

SEQ ID NO: 714771 - DNA, 22 bp, Artificial Sequence
  chemically synthesized
tatgaccaaaaggcattttaaa

SEQ ID NO: 714772 - DNA, 22 bp, Artificial Sequence
  chemically synthesized
caatttaaaatcatatttaaaa

SEQ ID NO: 714773 - DNA, 22 bp, Artificial Sequence
  chemically synthesized
gcaatttaaaatcatatttaaa

SEQ ID NO: 714774 - DNA, 22 bp, Artificial Sequence
  chemically synthesized
tgcaatttaaaatcatatttaa

SEQ ID NO: 714775 - DNA, 22 bp, Artificial Sequence
  chemically synthesized
gtccctttgcaatttaaaatca

SEQ ID NO: 714776 - DNA, 22 bp, Artificial Sequence
  chemically synthesized
cgtccctttgcaatttaaaatc

SEQ ID NO: 714777 - DNA, 22 bp, Artificial Sequence
  chemically synthesized
taaatatgattttaaattgcaa

SEQ ID NO: 714778 - DNA, 22 bp, Artificial Sequence
  chemically synthesized
aaatatgattttaaattgcaaa

SEQ ID NO: 714779 - DNA, 22 bp, Artificial Sequence
  chemically synthesized
aatatgattttaaattgcaaag

SEQ ID NO: 714780 - DNA, 22 bp, Artificial Sequence
  chemically synthesized
taaattgcaaagggacgaaatc

SEQ ID NO: 714781 - DNA, 22 bp, Artificial Sequence
  chemically synthesized
aaattgcaaagggacgaaatca

SEQ ID NO: 714782 - DNA, 22 bp, Artificial Sequence
  chemically synthesized
aattgcaaagggacgaaatcat

SEQ ID NO: 714783 - DNA, 22 bp, Artificial Sequence
  chemically synthesized
caaagggacgaaatcatgggct

SEQ ID NO: 714784 - DNA, 22 bp, Artificial Sequence
  chemically synthesized
gcatccaaagaaacacaagaag

SEQ ID NO: 714785 - DNA, 22 bp, Artificial Sequence
  chemically synthesized
cttgtgtttctttggatgccaa

SEQ ID NO: 714786 - DNA, 22 bp, Artificial Sequence
  chemically synthesized
gaagtaatgtgattggcatcca

SEQ ID NO: 714787 - DNA, 22 bp, Artificial Sequence
  chemically synthesized
ttgtgtttctttggatgccaat

SEQ ID NO: 714788 - DNA, 22 bp, Artificial Sequence
  chemically synthesized
tcgaagtaatgtgattggcatc

SEQ ID NO: 714789 - DNA, 22 bp, Artificial Sequence
  chemically synthesized
gtgtttctttggatgccaatca

SEQ ID NO: 714790 - DNA, 22 bp, Artificial Sequence
  chemically synthesized
tgtttctttggatgccaatcac

SEQ ID NO: 714791 - DNA, 22 bp, Artificial Sequence
  chemically synthesized
ctttggatgccaatcacattac

SEQ ID NO: 714792 - DNA, 22 bp, Artificial Sequence
  chemically synthesized
tttggatgccaatcacattact

SEQ ID NO: 714793 - DNA, 22 bp, Artificial Sequence
  chemically synthesized
tgccagctctcgaagtaatgtg

SEQ ID NO: 714794 - DNA, 22 bp, Artificial Sequence
  chemically synthesized
tggatgccaatcacattacttc

SEQ ID NO: 714795 - DNA, 22 bp, Artificial Sequence
  chemically synthesized
ggatgccaatcacattacttcg

SEQ ID NO: 714796 - DNA, 22 bp, Artificial Sequence
  chemically synthesized
gatgccaatcacattacttcga

SEQ ID NO: 714797 - DNA, 22 bp, Artificial Sequence
  chemically synthesized
agacatccacgacctatgccag

SEQ ID NO: 714798 - DNA, 22 bp, Artificial Sequence
  chemically synthesized
cttcgagagctggcataggtcg

SEQ ID NO: 714799 - DNA, 22 bp, Artificial Sequence
  chemically synthesized
cgagagctggcataggtcgtgg

SEQ ID NO: 714800 - DNA, 22 bp, Artificial Sequence
  chemically synthesized
gagagctggcataggtcgtgga

SEQ ID NO: 714801 - DNA, 22 bp, Artificial Sequence
  chemically synthesized
gcataggtcgtggatgtctcag

SEQ ID NO: 714802 - DNA, 22 bp, Artificial Sequence
  chemically synthesized
tcagtggtgcgtagcctgagac

SEQ ID NO: 714803 - DNA, 22 bp, Artificial Sequence
  chemically synthesized
tgttatcagtggtgcgtagcct

SEQ ID NO: 714804 - DNA, 22 bp, Artificial Sequence
  chemically synthesized
gtgttatcagtggtgcgtagcc

SEQ ID NO: 714805 - DNA, 22 bp, Artificial Sequence
  chemically synthesized
aggctacgcaccactgataaca

SEQ ID NO: 714806 - DNA, 22 bp, Artificial Sequence
  chemically synthesized
cgcaccactgataacacaaact

SEQ ID NO: 714807 - DNA, 22 bp, Artificial Sequence
  chemically synthesized
cagtgcccgcatagtttgtgtt

SEQ ID NO: 714808 - DNA, 22 bp, Artificial Sequence
  chemically synthesized
ctccagtgcccgcatagtttgt

SEQ ID NO: 714809 - DNA, 22 bp, Artificial Sequence
  chemically synthesized
tgctccagtgcccgcatagttt

SEQ ID NO: 714810 - DNA, 22 bp, Artificial Sequence
  chemically synthesized
ctgctccagtgcccgcatagtt

SEQ ID NO: 714811 - DNA, 22 bp, Artificial Sequence
  chemically synthesized
tctgctccagtgcccgcatagt

SEQ ID NO: 714812 - DNA, 22 bp, Artificial Sequence
  chemically synthesized
ataacacaaactatgcgggcac

SEQ ID NO: 714813 - DNA, 22 bp, Artificial Sequence
  chemically synthesized
atatctttctgctccagtgccc

SEQ ID NO: 714814 - DNA, 22 bp, Artificial Sequence
  chemically synthesized
ctcatatctttctgctccagtg

SEQ ID NO: 714815 - DNA, 22 bp, Artificial Sequence
  chemically synthesized
tgctcatatctttctgctccag

SEQ ID NO: 714816 - DNA, 22 bp, Artificial Sequence
  chemically synthesized
ctctgctcatatctttctgctc

SEQ ID NO: 714817 - DNA, 22 bp, Artificial Sequence
  chemically synthesized
tgcgggcactggagcagaaaga

SEQ ID NO: 714818 - DNA, 22 bp, Artificial Sequence
  chemically synthesized
cctctgctcatatctttctgct

SEQ ID NO: 714819 - DNA, 22 bp, Artificial Sequence
  chemically synthesized
ttcctctgctcatatctttctg

SEQ ID NO: 714820 - DNA, 22 bp, Artificial Sequence
  chemically synthesized
tcttcctctgctcatatctttc

SEQ ID NO: 714821 - DNA, 22 bp, Artificial Sequence
  chemically synthesized
tctctcttcctctgctcatatc

SEQ ID NO: 714822 - DNA, 22 bp, Artificial Sequence
  chemically synthesized
atctctcttcctctgctcatat

SEQ ID NO: 714823 - DNA, 22 bp, Artificial Sequence
  chemically synthesized
gagcagaaagatatgagcagag

SEQ ID NO: 714824 - DNA, 22 bp, Artificial Sequence
  chemically synthesized
gaggcaccacttatctctcttc

SEQ ID NO: 714825 - DNA, 22 bp, Artificial Sequence
  chemically synthesized
agaggcaccacttatctctctt

SEQ ID NO: 714826 - DNA, 22 bp, Artificial Sequence
  chemically synthesized
gggtcttagaggcaccacttat

SEQ ID NO: 714827 - DNA, 22 bp, Artificial Sequence
  chemically synthesized
tggggtcttagaggcaccactt

SEQ ID NO: 714828 - DNA, 22 bp, Artificial Sequence
  chemically synthesized
ctggggtcttagaggcaccact

SEQ ID NO: 714829 - DNA, 22 bp, Artificial Sequence
  chemically synthesized
tctggggtcttagaggcaccac

SEQ ID NO: 714830 - DNA, 22 bp, Artificial Sequence
  chemically synthesized
aaaaccactttctggggtctta

SEQ ID NO: 714831 - DNA, 22 bp, Artificial Sequence
  chemically synthesized
taagaccccagaaagtggtttt

SEQ ID NO: 714832 - DNA, 22 bp, Artificial Sequence
  chemically synthesized
agaccccagaaagtggttttga

SEQ ID NO: 714833 - DNA, 22 bp, Artificial Sequence
  chemically synthesized
cagtgagatccacaagggttca

SEQ ID NO: 714834 - DNA, 22 bp, Artificial Sequence
  chemically synthesized
ccagtgagatccacaagggttc

SEQ ID NO: 714835 - DNA, 22 bp, Artificial Sequence
  chemically synthesized
tccagtgagatccacaagggtt

SEQ ID NO: 714836 - DNA, 22 bp, Artificial Sequence
  chemically synthesized
atccctttccagtgagatccac

SEQ ID NO: 714837 - DNA, 22 bp, Artificial Sequence
  chemically synthesized
tgaacccttgtggatctcactg

SEQ ID NO: 714838 - DNA, 22 bp, Artificial Sequence
  chemically synthesized
ctaatccctttccagtgagatc

SEQ ID NO: 714839 - DNA, 22 bp, Artificial Sequence
  chemically synthesized
gaacccttgtggatctcactgg

SEQ ID NO: 714840 - DNA, 22 bp, Artificial Sequence
  chemically synthesized
aacccttgtggatctcactgga

SEQ ID NO: 714841 - DNA, 22 bp, Artificial Sequence
  chemically synthesized
tcctaatccctttccagtgaga

SEQ ID NO: 714842 - DNA, 22 bp, Artificial Sequence
  chemically synthesized
gtggatctcactggaaagggat

SEQ ID NO: 714843 - DNA, 22 bp, Artificial Sequence
  chemically synthesized
tggatctcactggaaagggatt

SEQ ID NO: 714844 - DNA, 22 bp, Artificial Sequence
  chemically synthesized
ccaggtggtattctcctaatcc

SEQ ID NO: 714845 - DNA, 22 bp, Artificial Sequence
  chemically synthesized
tgccaggtggtattctcctaat

SEQ ID NO: 714846 - DNA, 22 bp, Artificial Sequence
  chemically synthesized
actggaaagggattaggagaat

SEQ ID NO: 714847 - DNA, 22 bp, Artificial Sequence
  chemically synthesized
ctgccaggtggtattctcctaa

SEQ ID NO: 714848 - DNA, 22 bp, Artificial Sequence
  chemically synthesized
gaaagggattaggagaatacca

SEQ ID NO: 714849 - DNA, 22 bp, Artificial Sequence
  chemically synthesized
ggagaataccacctggcagaag

SEQ ID NO: 714850 - DNA, 22 bp, Artificial Sequence
  chemically synthesized
ataagagaatggtcttctgcca

SEQ ID NO: 714851 - DNA, 22 bp, Artificial Sequence
  chemically synthesized
aataagagaatggtcttctgcc

SEQ ID NO: 714852 - DNA, 22 bp, Artificial Sequence
  chemically synthesized
gcagaagaccattctcttatta

SEQ ID NO: 714853 - DNA, 22 bp, Artificial Sequence
  chemically synthesized
agagagagagagagtggatcag

SEQ ID NO: 714854 - DNA, 22 bp, Artificial Sequence
  chemically synthesized
tcttattaaggctgatccactc

SEQ ID NO: 714855 - DNA, 22 bp, Artificial Sequence
  chemically synthesized
gagagagagagagagtggatca

SEQ ID NO: 714856 - DNA, 22 bp, Artificial Sequence
  chemically synthesized
tgagagagagagagagtggatc

SEQ ID NO: 714857 - DNA, 22 bp, Artificial Sequence
  chemically synthesized
ttattaaggctgatccactctc

SEQ ID NO: 714858 - DNA, 22 bp, Artificial Sequence
  chemically synthesized
ttgagagagagagagagtggat

SEQ ID NO: 714859 - DNA, 22 bp, Artificial Sequence
  chemically synthesized
tttgagagagagagagagtgga

SEQ ID NO: 714860 - DNA, 22 bp, Artificial Sequence
  chemically synthesized
attaaggctgatccactctctc

SEQ ID NO: 714861 - DNA, 22 bp, Artificial Sequence
  chemically synthesized
ttttgagagagagagagagtgg

SEQ ID NO: 714862 - DNA, 22 bp, Artificial Sequence
  chemically synthesized
ttaaggctgatccactctctct

SEQ ID NO: 714863 - DNA, 22 bp, Artificial Sequence
  chemically synthesized
tttttgagagagagagagagtg

SEQ ID NO: 714864 - DNA, 22 bp, Artificial Sequence
  chemically synthesized
ttttttgagagagagagagagt

SEQ ID NO: 714865 - DNA, 22 bp, Artificial Sequence
  chemically synthesized
tttttttgagagagagagagag

SEQ ID NO: 714866 - DNA, 22 bp, Artificial Sequence
  chemically synthesized
aggctgatccactctctctctc

SEQ ID NO: 714867 - DNA, 22 bp, Artificial Sequence
  chemically synthesized
ttttttttgagagagagagaga

SEQ ID NO: 714868 - DNA, 22 bp, Artificial Sequence
  chemically synthesized
tttttttttgagagagagagag

SEQ ID NO: 714869 - DNA, 22 bp, Artificial Sequence
  chemically synthesized
ttttttttttgagagagagaga

SEQ ID NO: 714870 - DNA, 22 bp, Artificial Sequence
  chemically synthesized
tttttttttttgagagagagag

SEQ ID NO: 714871 - DNA, 22 bp, Artificial Sequence
  chemically synthesized
ttttttttttttgagagagaga

SEQ ID NO: 714872 - DNA, 22 bp, Artificial Sequence
  chemically synthesized
tttttttttttttgagagagag

SEQ ID NO: 714873 - DNA, 22 bp, Artificial Sequence
  chemically synthesized
atccactctctctctctctcaa

SEQ ID NO: 714874 - DNA, 22 bp, Artificial Sequence
  chemically synthesized
ttttttttttttttgagagaga

SEQ ID NO: 714875 - DNA, 22 bp, Artificial Sequence
  chemically synthesized
tttttttttttttttgagagag

SEQ ID NO: 714876 - DNA, 22 bp, Artificial Sequence
  chemically synthesized
ttttttttttttttttgagaga

SEQ ID NO: 714877 - DNA, 22 bp, Artificial Sequence
  chemically synthesized
tttttttttttttttttgagag

SEQ ID NO: 714878 - DNA, 22 bp, Artificial Sequence
  chemically synthesized
ttttttttttttttttttgaga

SEQ ID NO: 714879 - DNA, 22 bp, Artificial Sequence
  chemically synthesized
tttttttttttttttttttgag

SEQ ID NO: 714880 - DNA, 22 bp, Artificial Sequence
  chemically synthesized
ttttttttttttttttttttga

SEQ ID NO: 714881 - DNA, 22 bp, Artificial Sequence
  chemically synthesized
tttttttttttttttttttttg

SEQ ID NO: 714882 - DNA, 22 bp, Artificial Sequence
  chemically synthesized
tctctctctctcaaaaaaaaaa

SEQ ID NO: 714883 - DNA, 22 bp, Artificial Sequence
  chemically synthesized
tttttttttttttttttttttt

SEQ ID NO: 714884 - DNA, 22 bp, Artificial Sequence
  chemically synthesized
tttttttttttttttttttttt

SEQ ID NO: 714885 - DNA, 22 bp, Artificial Sequence
  chemically synthesized
tctctctctcaaaaaaaaaaaa

SEQ ID NO: 714886 - DNA, 22 bp, Artificial Sequence
  chemically synthesized
tctctctcaaaaaaaaaaaaaa

SEQ ID NO: 714887 - DNA, 22 bp, Artificial Sequence
  chemically synthesized
tctctcaaaaaaaaaaaaaaaa

SEQ ID NO: 714888 - DNA, 22 bp, Artificial Sequence
  chemically synthesized
tgtttttttttttttttttttt

SEQ ID NO: 714889 - DNA, 22 bp, Artificial Sequence
  chemically synthesized
atgttttttttttttttttttt

SEQ ID NO: 714890 - DNA, 22 bp, Artificial Sequence
  chemically synthesized
tctcaaaaaaaaaaaaaaaaaa

SEQ ID NO: 714891 - DNA, 22 bp, Artificial Sequence
  chemically synthesized
tatgtttttttttttttttttt

SEQ ID NO: 714892 - DNA, 22 bp, Artificial Sequence
  chemically synthesized
ttatgttttttttttttttttt

SEQ ID NO: 714893 - DNA, 22 bp, Artificial Sequence
  chemically synthesized
tcaaaaaaaaaaaaaaaaaaaa

SEQ ID NO: 714894 - DNA, 22 bp, Artificial Sequence
  chemically synthesized
tttatgtttttttttttttttt

SEQ ID NO: 714895 - DNA, 22 bp, Artificial Sequence
  chemically synthesized
ttttatgttttttttttttttt

SEQ ID NO: 714896 - DNA, 22 bp, Artificial Sequence
  chemically synthesized
aaaaaaaaaaaaaaaaaaaaaa

SEQ ID NO: 714897 - DNA, 22 bp, Artificial Sequence
  chemically synthesized
tttttatgtttttttttttttt

SEQ ID NO: 714898 - DNA, 22 bp, Artificial Sequence
  chemically synthesized
ttttttatgttttttttttttt

SEQ ID NO: 714899 - DNA, 22 bp, Artificial Sequence
  chemically synthesized
tttttttatgtttttttttttt

SEQ ID NO: 714900 - DNA, 22 bp, Artificial Sequence
  chemically synthesized
ttttttttatgttttttttttt

SEQ ID NO: 714901 - DNA, 22 bp, Artificial Sequence
  chemically synthesized
tttttttttttatgtttttttt

SEQ ID NO: 714902 - DNA, 22 bp, Artificial Sequence
  chemically synthesized
atttttttttttatgttttttt

SEQ ID NO: 714903 - DNA, 22 bp, Artificial Sequence
  chemically synthesized
tttatttttttttttatgtttt

SEQ ID NO: 714904 - DNA, 22 bp, Artificial Sequence
  chemically synthesized
atttatttttttttttatgttt

SEQ ID NO: 714905 - DNA, 22 bp, Artificial Sequence
  chemically synthesized
tttatttatttttttttttatg

SEQ ID NO: 714906 - DNA, 22 bp, Artificial Sequence
  chemically synthesized
atttatttatttttttttttat

SEQ ID NO: 714907 - DNA, 22 bp, Artificial Sequence
  chemically synthesized
tatttatttattttttttttta

SEQ ID NO: 714908 - DNA, 22 bp, Artificial Sequence
  chemically synthesized
ttatttatttattttttttttt

SEQ ID NO: 714909 - DNA, 22 bp, Artificial Sequence
  chemically synthesized
tttatttatttatttttttttt

SEQ ID NO: 714910 - DNA, 22 bp, Artificial Sequence
  chemically synthesized
ttttatttatttattttttttt

SEQ ID NO: 714911 - DNA, 22 bp, Artificial Sequence
  chemically synthesized
tcttttttatttatttattttt

SEQ ID NO: 714912 - DNA, 22 bp, Artificial Sequence
  chemically synthesized
atcttttttatttatttatttt

SEQ ID NO: 714913 - DNA, 22 bp, Artificial Sequence
  chemically synthesized
tatcttttttatttatttattt

SEQ ID NO: 714914 - DNA, 22 bp, Artificial Sequence
  chemically synthesized
ttatcttttttatttatttatt

SEQ ID NO: 714915 - DNA, 22 bp, Artificial Sequence
  chemically synthesized
ttttatcttttttatttattta

SEQ ID NO: 714916 - DNA, 22 bp, Artificial Sequence
  chemically synthesized
cttttatcttttttatttattt

SEQ ID NO: 714917 - DNA, 22 bp, Artificial Sequence
  chemically synthesized
tcttttatcttttttatttatt

SEQ ID NO: 714918 - DNA, 22 bp, Artificial Sequence
  chemically synthesized
ttcttttatcttttttatttat

SEQ ID NO: 714919 - DNA, 22 bp, Artificial Sequence
  chemically synthesized
tttcttttatcttttttattta

SEQ ID NO: 714920 - DNA, 22 bp, Artificial Sequence
  chemically synthesized
ttttcttttatcttttttattt

SEQ ID NO: 714921 - DNA, 22 bp, Artificial Sequence
  chemically synthesized
tttttcttttatcttttttatt

SEQ ID NO: 714922 - DNA, 22 bp, Artificial Sequence
  chemically synthesized
ttttttcttttatcttttttat

SEQ ID NO: 714923 - DNA, 22 bp, Artificial Sequence
  chemically synthesized
ttttttttcttttatctttttt

SEQ ID NO: 714924 - DNA, 22 bp, Artificial Sequence
  chemically synthesized
cttttttttcttttatcttttt

SEQ ID NO: 714925 - DNA, 22 bp, Artificial Sequence
  chemically synthesized
tcttttttttcttttatctttt

SEQ ID NO: 714926 - DNA, 22 bp, Artificial Sequence
  chemically synthesized
ttcttttttttcttttatcttt

SEQ ID NO: 714927 - DNA, 22 bp, Artificial Sequence
  chemically synthesized
tttcttttttttcttttatctt

SEQ ID NO: 714928 - DNA, 22 bp, Artificial Sequence
  chemically synthesized
ttttcttttttttcttttatct

SEQ ID NO: 714929 - DNA, 22 bp, Artificial Sequence
  chemically synthesized
tttttcttttttttcttttatc

SEQ ID NO: 714930 - DNA, 22 bp, Artificial Sequence
  chemically synthesized
agttttttttcttttttttctt

SEQ ID NO: 714931 - DNA, 22 bp, Artificial Sequence
  chemically synthesized
aagttttttttcttttttttct

SEQ ID NO: 714932 - DNA, 22 bp, Artificial Sequence
  chemically synthesized
cttaagttttttttcttttttt

SEQ ID NO: 714933 - DNA, 22 bp, Artificial Sequence
  chemically synthesized
ctacttaagttttttttctttt

SEQ ID NO: 714934 - DNA, 22 bp, Artificial Sequence
  chemically synthesized
cctcctacttaagttttttttc

SEQ ID NO: 714935 - DNA, 22 bp, Artificial Sequence
  chemically synthesized
ccctcctacttaagtttttttt

SEQ ID NO: 714936 - DNA, 22 bp, Artificial Sequence
  chemically synthesized
tccctcctacttaagttttttt

SEQ ID NO: 714937 - DNA, 22 bp, Artificial Sequence
  chemically synthesized
gactttccctcctacttaagtt

SEQ ID NO: 714938 - DNA, 22 bp, Artificial Sequence
  chemically synthesized
tagactttccctcctacttaag

SEQ ID NO: 714939 - DNA, 22 bp, Artificial Sequence
  chemically synthesized
tcaactctagactttccctcct

SEQ ID NO: 714940 - DNA, 22 bp, Artificial Sequence
  chemically synthesized
tgtcaactctagactttccctc

SEQ ID NO: 714941 - DNA, 22 bp, Artificial Sequence
  chemically synthesized
agctctgtcaactctagacttt

SEQ ID NO: 714942 - DNA, 22 bp, Artificial Sequence
  chemically synthesized
aagtaggagggaaagtctagag

SEQ ID NO: 714943 - DNA, 22 bp, Artificial Sequence
  chemically synthesized
cagctctgtcaactctagactt

SEQ ID NO: 714944 - DNA, 22 bp, Artificial Sequence
  chemically synthesized
agtaggagggaaagtctagagt

SEQ ID NO: 714945 - DNA, 22 bp, Artificial Sequence
  chemically synthesized
tcagctctgtcaactctagact

SEQ ID NO: 714946 - DNA, 22 bp, Artificial Sequence
  chemically synthesized
agagcctttcagctctgtcaac

SEQ ID NO: 714947 - DNA, 22 bp, Artificial Sequence
  chemically synthesized
gagagcctttcagctctgtcaa

SEQ ID NO: 714948 - DNA, 22 bp, Artificial Sequence
  chemically synthesized
tgagagcctttcagctctgtca

SEQ ID NO: 714949 - DNA, 22 bp, Artificial Sequence
  chemically synthesized
aaattttgagagcctttcagct

SEQ ID NO: 714950 - DNA, 22 bp, Artificial Sequence
  chemically synthesized
aaaattttgagagcctttcagc

SEQ ID NO: 714951 - DNA, 22 bp, Artificial Sequence
  chemically synthesized
gagttgacagagctgaaaggct

SEQ ID NO: 714952 - DNA, 22 bp, Artificial Sequence
  chemically synthesized
acagagctgaaaggctctcaaa

SEQ ID NO: 714953 - DNA, 22 bp, Artificial Sequence
  chemically synthesized
aaaaaaaaagtcttaaaatttt

SEQ ID NO: 714954 - DNA, 22 bp, Artificial Sequence
  chemically synthesized
aaaaaaaaaagtcttaaaattt

SEQ ID NO: 714955 - DNA, 22 bp, Artificial Sequence
  chemically synthesized
aaaggctctcaaaattttaaga

SEQ ID NO: 714956 - DNA, 22 bp, Artificial Sequence
  chemically synthesized
agacacttaaaaaaaaaagtct

SEQ ID NO: 714957 - DNA, 22 bp, Artificial Sequence
  chemically synthesized
tcaaaattttaagacttttttt

SEQ ID NO: 714958 - DNA, 22 bp, Artificial Sequence
  chemically synthesized
aagacacttaaaaaaaaaagtc

SEQ ID NO: 714959 - DNA, 22 bp, Artificial Sequence
  chemically synthesized
taagacacttaaaaaaaaaagt

SEQ ID NO: 714960 - DNA, 22 bp, Artificial Sequence
  chemically synthesized
aaaattttaagacttttttttt

SEQ ID NO: 714961 - DNA, 22 bp, Artificial Sequence
  chemically synthesized
taagacttttttttttaagtgt

SEQ ID NO: 714962 - DNA, 22 bp, Artificial Sequence
  chemically synthesized
aaatattttaagacacttaaaa

SEQ ID NO: 714963 - DNA, 22 bp, Artificial Sequence
  chemically synthesized
aagacttttttttttaagtgtc

SEQ ID NO: 714964 - DNA, 22 bp, Artificial Sequence
  chemically synthesized
agacttttttttttaagtgtct

SEQ ID NO: 714965 - DNA, 22 bp, Artificial Sequence
  chemically synthesized
ttttttttaagtgtcttaaaat

SEQ ID NO: 714966 - DNA, 22 bp, Artificial Sequence
  chemically synthesized
tttttttaagtgtcttaaaata

SEQ ID NO: 714967 - DNA, 22 bp, Artificial Sequence
  chemically synthesized
aagtccctaaaatattttaaga

SEQ ID NO: 714968 - DNA, 22 bp, Artificial Sequence
  chemically synthesized
ttttttaagtgtcttaaaatat

SEQ ID NO: 714969 - DNA, 22 bp, Artificial Sequence
  chemically synthesized
tttttaagtgtcttaaaatatt

SEQ ID NO: 714970 - DNA, 22 bp, Artificial Sequence
  chemically synthesized
ttttaagtgtcttaaaatattt

SEQ ID NO: 714971 - DNA, 22 bp, Artificial Sequence
  chemically synthesized
tttaagtgtcttaaaatatttt

SEQ ID NO: 714972 - DNA, 22 bp, Artificial Sequence
  chemically synthesized
ttaagtgtcttaaaatatttta

SEQ ID NO: 714973 - DNA, 22 bp, Artificial Sequence
  chemically synthesized
taagtgtcttaaaatattttag

SEQ ID NO: 714974 - DNA, 22 bp, Artificial Sequence
  chemically synthesized
aagtgtcttaaaatattttagg

SEQ ID NO: 714975 - DNA, 22 bp, Artificial Sequence
  chemically synthesized
agtgtcttaaaatattttaggg

SEQ ID NO: 714976 - DNA, 22 bp, Artificial Sequence
  chemically synthesized
agacaaagttaaagtccctaaa

SEQ ID NO: 714977 - DNA, 22 bp, Artificial Sequence
  chemically synthesized
ctaagacaaagttaaagtccct

SEQ ID NO: 714978 - DNA, 22 bp, Artificial Sequence
  chemically synthesized
actaagacaaagttaaagtccc

SEQ ID NO: 714979 - DNA, 22 bp, Artificial Sequence
  chemically synthesized
aaaatattttagggactttaac

SEQ ID NO: 714980 - DNA, 22 bp, Artificial Sequence
  chemically synthesized
tactaagacaaagttaaagtcc

SEQ ID NO: 714981 - DNA, 22 bp, Artificial Sequence
  chemically synthesized
aaatattttagggactttaact

SEQ ID NO: 714982 - DNA, 22 bp, Artificial Sequence
  chemically synthesized
tcatctttactaagacaaagtt

SEQ ID NO: 714983 - DNA, 22 bp, Artificial Sequence
  chemically synthesized
atcatctttactaagacaaagt

SEQ ID NO: 714984 - DNA, 22 bp, Artificial Sequence
  chemically synthesized
tagggactttaactttgtctta

SEQ ID NO: 714985 - DNA, 22 bp, Artificial Sequence
  chemically synthesized
tatcatctttactaagacaaag

SEQ ID NO: 714986 - DNA, 22 bp, Artificial Sequence
  chemically synthesized
agggactttaactttgtcttag

SEQ ID NO: 714987 - DNA, 22 bp, Artificial Sequence
  chemically synthesized
gggactttaactttgtcttagt

SEQ ID NO: 714988 - DNA, 22 bp, Artificial Sequence
  chemically synthesized
attttatcatctttactaagac

SEQ ID NO: 714989 - DNA, 22 bp, Artificial Sequence
  chemically synthesized
aattttatcatctttactaaga

SEQ ID NO: 714990 - DNA, 22 bp, Artificial Sequence
  chemically synthesized
taactttgtcttagtaaagatg

SEQ ID NO: 714991 - DNA, 22 bp, Artificial Sequence
  chemically synthesized
aactttgtcttagtaaagatga

SEQ ID NO: 714992 - DNA, 22 bp, Artificial Sequence
  chemically synthesized
actttgtcttagtaaagatgat

SEQ ID NO: 714993 - DNA, 22 bp, Artificial Sequence
  chemically synthesized
tgtcttagtaaagatgataaaa

SEQ ID NO: 714994 - DNA, 22 bp, Artificial Sequence
  chemically synthesized
gtcttagtaaagatgataaaat

SEQ ID NO: 714995 - DNA, 22 bp, Artificial Sequence
  chemically synthesized
tcttagtaaagatgataaaatt

SEQ ID NO: 714996 - DNA, 22 bp, Artificial Sequence
  chemically synthesized
agtaaagatgataaaattaagt

SEQ ID NO: 714997 - DNA, 22 bp, Artificial Sequence
  chemically synthesized
gtaaagatgataaaattaagtt

SEQ ID NO: 714998 - DNA, 22 bp, Artificial Sequence
  chemically synthesized
aaaagaatgagtgtgtagtgaa

SEQ ID NO: 714999 - DNA, 22 bp, Artificial Sequence
  chemically synthesized
taaaaagaatgagtgtgtagtg

SEQ ID NO: 715000 - DNA, 22 bp, Artificial Sequence
  chemically synthesized
ctaaaaagaatgagtgtgtagt

SEQ ID NO: 715001 - DNA, 22 bp, Artificial Sequence
  chemically synthesized
agttcactacacactcattctt

SEQ ID NO: 715002 - DNA, 22 bp, Artificial Sequence
  chemically synthesized
actacacactcattctttttag

SEQ ID NO: 715003 - DNA, 22 bp, Artificial Sequence
  chemically synthesized
cacactcattctttttagaagc

SEQ ID NO: 715004 - DNA, 22 bp, Artificial Sequence
  chemically synthesized
aaagggaggtgaaaagcttcta

SEQ ID NO: 715005 - DNA, 22 bp, Artificial Sequence
  chemically synthesized
attctttttagaagcttttcac

SEQ ID NO: 715006 - DNA, 22 bp, Artificial Sequence
  chemically synthesized
tttttagaagcttttcacctcc

SEQ ID NO: 715007 - DNA, 22 bp, Artificial Sequence
  chemically synthesized
tttagaagcttttcacctccct

SEQ ID NO: 715008 - DNA, 22 bp, Artificial Sequence
  chemically synthesized
ttagaagcttttcacctccctt

SEQ ID NO: 715009 - DNA, 22 bp, Artificial Sequence
  chemically synthesized
tagaagcttttcacctcccttt

SEQ ID NO: 715010 - DNA, 22 bp, Artificial Sequence
  chemically synthesized
agaagcttttcacctccctttt

SEQ ID NO: 715011 - DNA, 22 bp, Artificial Sequence
  chemically synthesized
gaagcttttcacctccctttta

SEQ ID NO: 715012 - DNA, 22 bp, Artificial Sequence
  chemically synthesized
aatgcacacagttaaaagggag

SEQ ID NO: 715013 - DNA, 22 bp, Artificial Sequence
  chemically synthesized
ttcacctcccttttaactgtgt

SEQ ID NO: 715014 - DNA, 22 bp, Artificial Sequence
  chemically synthesized
tcacctcccttttaactgtgtg

SEQ ID NO: 715015 - DNA, 22 bp, Artificial Sequence
  chemically synthesized
cacctcccttttaactgtgtgc

SEQ ID NO: 715016 - DNA, 22 bp, Artificial Sequence
  chemically synthesized
cacaaattaaatgcacacagtt

SEQ ID NO: 715017 - DNA, 22 bp, Artificial Sequence
  chemically synthesized
acctcccttttaactgtgtgca

SEQ ID NO: 715018 - DNA, 22 bp, Artificial Sequence
  chemically synthesized
ttacacaaattaaatgcacaca

SEQ ID NO: 715019 - DNA, 22 bp, Artificial Sequence
  chemically synthesized
ccttttaactgtgtgcatttaa

SEQ ID NO: 715020 - DNA, 22 bp, Artificial Sequence
  chemically synthesized
ttaactgtgtgcatttaatttg

SEQ ID NO: 715021 - DNA, 22 bp, Artificial Sequence
  chemically synthesized
taactgtgtgcatttaatttgt

SEQ ID NO: 715022 - DNA, 22 bp, Artificial Sequence
  chemically synthesized
aactgtgtgcatttaatttgtg

SEQ ID NO: 715023 - DNA, 22 bp, Artificial Sequence
  chemically synthesized
actgtgtgcatttaatttgtgt

SEQ ID NO: 715024 - DNA, 22 bp, Artificial Sequence
  chemically synthesized
tgtgcatttaatttgtgtaata

SEQ ID NO: 715025 - DNA, 22 bp, Artificial Sequence
  chemically synthesized
aaggggacatacagtgattatt

SEQ ID NO: 715026 - DNA, 22 bp, Artificial Sequence
  chemically synthesized
aatttgtgtaataatcactgta

SEQ ID NO: 715027 - DNA, 22 bp, Artificial Sequence
  chemically synthesized
atttgtgtaataatcactgtat

SEQ ID NO: 715028 - DNA, 22 bp, Artificial Sequence
  chemically synthesized
gtgtaataatcactgtatgtcc

SEQ ID NO: 715029 - DNA, 22 bp, Artificial Sequence
  chemically synthesized
tgtaataatcactgtatgtccc

SEQ ID NO: 715030 - DNA, 22 bp, Artificial Sequence
  chemically synthesized
tatgtccccttcaatgtccttt

SEQ ID NO: 715031 - DNA, 22 bp, Artificial Sequence
  chemically synthesized
aaaaaaaagatacaaaaggaca

SEQ ID NO: 715032 - DNA, 22 bp, Artificial Sequence
  chemically synthesized
aaatgctaaaaaaaaagataca

SEQ ID NO: 715033 - DNA, 22 bp, Artificial Sequence
  chemically synthesized
caatgtccttttgtatcttttt

SEQ ID NO: 715034 - DNA, 22 bp, Artificial Sequence
  chemically synthesized
aatgtccttttgtatctttttt

SEQ ID NO: 715035 - DNA, 22 bp, Artificial Sequence
  chemically synthesized
ttgtatctttttttttagcatt

SEQ ID NO: 715036 - DNA, 22 bp, Artificial Sequence
  chemically synthesized
tgtatctttttttttagcattt

SEQ ID NO: 715037 - DNA, 22 bp, Artificial Sequence
  chemically synthesized
gtatctttttttttagcatttt

SEQ ID NO: 715038 - DNA, 22 bp, Artificial Sequence
  chemically synthesized
tatctttttttttagcatttta

SEQ ID NO: 715039 - DNA, 22 bp, Artificial Sequence
  chemically synthesized
tttttttagcattttagtctat

SEQ ID NO: 715040 - DNA, 22 bp, Artificial Sequence
  chemically synthesized
ttttttagcattttagtctatt

SEQ ID NO: 715041 - DNA, 22 bp, Artificial Sequence
  chemically synthesized
tttttagcattttagtctattt

SEQ ID NO: 715042 - DNA, 22 bp, Artificial Sequence
  chemically synthesized
ttttagcattttagtctatttc

SEQ ID NO: 715043 - DNA, 22 bp, Artificial Sequence
  chemically synthesized
tttagcattttagtctatttct

SEQ ID NO: 715044 - DNA, 22 bp, Artificial Sequence
  chemically synthesized
ttagcattttagtctatttctg

SEQ ID NO: 715045 - DNA, 22 bp, Artificial Sequence
  chemically synthesized
tagcattttagtctatttctgt

SEQ ID NO: 715046 - DNA, 22 bp, Artificial Sequence
  chemically synthesized
agcattttagtctatttctgtc

SEQ ID NO: 715047 - DNA, 22 bp, Artificial Sequence
  chemically synthesized
gcattttagtctatttctgtct

SEQ ID NO: 715048 - DNA, 22 bp, Artificial Sequence
  chemically synthesized
tagtctatttctgtctgtctga

SEQ ID NO: 715049 - DNA, 22 bp, Artificial Sequence
  chemically synthesized
agtctatttctgtctgtctgat

SEQ ID NO: 715050 - DNA, 22 bp, Artificial Sequence
  chemically synthesized
gtctatttctgtctgtctgatt

SEQ ID NO: 715051 - DNA, 22 bp, Artificial Sequence
  chemically synthesized
aatagaagaaaaaaatcagaca

SEQ ID NO: 715052 - DNA, 22 bp, Artificial Sequence
  chemically synthesized
gaatagaagaaaaaaatcagac

SEQ ID NO: 715053 - DNA, 22 bp, Artificial Sequence
  chemically synthesized
tgaatagaagaaaaaaatcaga

SEQ ID NO: 715054 - DNA, 22 bp, Artificial Sequence
  chemically synthesized
tttctgtctgtctgattttttt

SEQ ID NO: 715055 - DNA, 22 bp, Artificial Sequence
  chemically synthesized
ctgtctgtctgatttttttctt

SEQ ID NO: 715056 - DNA, 22 bp, Artificial Sequence
  chemically synthesized
tgtctgtctgatttttttcttc

SEQ ID NO: 715057 - DNA, 22 bp, Artificial Sequence
  chemically synthesized
tctgtctgatttttttcttcta

SEQ ID NO: 715058 - DNA, 22 bp, Artificial Sequence
  chemically synthesized
tctgatttttttcttctattca

SEQ ID NO: 715059 - DNA, 22 bp, Artificial Sequence
  chemically synthesized
atttttttcttctattcaaaga

SEQ ID NO: 715060 - DNA, 22 bp, Artificial Sequence
  chemically synthesized
ttttcttctattcaaagacatt

SEQ ID NO: 715061 - DNA, 22 bp, Artificial Sequence
  chemically synthesized
tttcttctattcaaagacattt

SEQ ID NO: 715062 - DNA, 22 bp, Artificial Sequence
  chemically synthesized
taatagaggagaaaatgtcttt

SEQ ID NO: 715063 - DNA, 22 bp, Artificial Sequence
  chemically synthesized
ttcttctattcaaagacatttt

SEQ ID NO: 715064 - DNA, 22 bp, Artificial Sequence
  chemically synthesized
tcttctattcaaagacattttc

SEQ ID NO: 715065 - DNA, 22 bp, Artificial Sequence
  chemically synthesized
cttctattcaaagacattttct

SEQ ID NO: 715066 - DNA, 22 bp, Artificial Sequence
  chemically synthesized
ttctattcaaagacattttctc

SEQ ID NO: 715067 - DNA, 22 bp, Artificial Sequence
  chemically synthesized
ctattcaaagacattttctcct

SEQ ID NO: 715068 - DNA, 22 bp, Artificial Sequence
  chemically synthesized
tattcaaagacattttctcctc

SEQ ID NO: 715069 - DNA, 22 bp, Artificial Sequence
  chemically synthesized
ttcaaagacattttctcctcta

SEQ ID NO: 715070 - DNA, 22 bp, Artificial Sequence
  chemically synthesized
aataaagctataatagaggaga

SEQ ID NO: 715071 - DNA, 22 bp, Artificial Sequence
  chemically synthesized
aaagacattttctcctctatta

SEQ ID NO: 715072 - DNA, 22 bp, Artificial Sequence
  chemically synthesized
tctcctctattatagctttatt

SEQ ID NO: 715073 - DNA, 22 bp, Artificial Sequence
  chemically synthesized
ctcctctattatagctttattt

SEQ ID NO: 715074 - DNA, 22 bp, Artificial Sequence
  chemically synthesized
tcctctattatagctttattta

SEQ ID NO: 715075 - DNA, 22 bp, Artificial Sequence
  chemically synthesized
ctctattatagctttatttaat

SEQ ID NO: 715076 - DNA, 22 bp, Artificial Sequence
  chemically synthesized
tattatagctttatttaatgtt

SEQ ID NO: 715077 - DNA, 22 bp, Artificial Sequence
  chemically synthesized
tagcataagggaaacattaaat

SEQ ID NO: 715078 - DNA, 22 bp, Artificial Sequence
  chemically synthesized
ttatagctttatttaatgtttc

SEQ ID NO: 715079 - DNA, 22 bp, Artificial Sequence
  chemically synthesized
tagctttatttaatgtttccct

SEQ ID NO: 715080 - DNA, 22 bp, Artificial Sequence
  chemically synthesized
tgctgtagcataagggaaacat

SEQ ID NO: 715081 - DNA, 22 bp, Artificial Sequence
  chemically synthesized
atgctgtagcataagggaaaca

SEQ ID NO: 715082 - DNA, 22 bp, Artificial Sequence
  chemically synthesized
tatttaatgtttcccttatgct

SEQ ID NO: 715083 - DNA, 22 bp, Artificial Sequence
  chemically synthesized
atttaatgtttcccttatgcta

SEQ ID NO: 715084 - DNA, 22 bp, Artificial Sequence
  chemically synthesized
tttaatgtttcccttatgctac

SEQ ID NO: 715085 - DNA, 22 bp, Artificial Sequence
  chemically synthesized
aatgtttcccttatgctacagc

SEQ ID NO: 715086 - DNA, 22 bp, Artificial Sequence
  chemically synthesized
atgtttcccttatgctacagca

SEQ ID NO: 715087 - DNA, 22 bp, Artificial Sequence
  chemically synthesized
cccttatgctacagcataagtg

SEQ ID NO: 715088 - DNA, 22 bp, Artificial Sequence
  chemically synthesized
ccttatgctacagcataagtgc

SEQ ID NO: 715089 - DNA, 22 bp, Artificial Sequence
  chemically synthesized
atgctacagcataagtgccttt

SEQ ID NO: 715090 - DNA, 22 bp, Artificial Sequence
  chemically synthesized
tgctacagcataagtgcctttt

SEQ ID NO: 715091 - DNA, 22 bp, Artificial Sequence
  chemically synthesized
cagcataagtgcctttttttct

SEQ ID NO: 715092 - DNA, 22 bp, Artificial Sequence
  chemically synthesized
gagatatggatggagaaaaaaa

SEQ ID NO: 715093 - DNA, 22 bp, Artificial Sequence
  chemically synthesized
agagatatggatggagaaaaaa

SEQ ID NO: 715094 - DNA, 22 bp, Artificial Sequence
  chemically synthesized
atttagagatatggatggagaa

SEQ ID NO: 715095 - DNA, 22 bp, Artificial Sequence
  chemically synthesized
tttttctccatccatatctcta

SEQ ID NO: 715096 - DNA, 22 bp, Artificial Sequence
  chemically synthesized
ttttctccatccatatctctaa

SEQ ID NO: 715097 - DNA, 22 bp, Artificial Sequence
  chemically synthesized
tttctccatccatatctctaaa

SEQ ID NO: 715098 - DNA, 22 bp, Artificial Sequence
  chemically synthesized
ttctccatccatatctctaaat

SEQ ID NO: 715099 - DNA, 22 bp, Artificial Sequence
  chemically synthesized
tctccatccatatctctaaatt

SEQ ID NO: 715100 - DNA, 22 bp, Artificial Sequence
  chemically synthesized
ctccatccatatctctaaatta

SEQ ID NO: 715101 - DNA, 22 bp, Artificial Sequence
  chemically synthesized
tccatccatatctctaaattag

SEQ ID NO: 715102 - DNA, 22 bp, Artificial Sequence
  chemically synthesized
catccatatctctaaattaggg

SEQ ID NO: 715103 - DNA, 22 bp, Artificial Sequence
  chemically synthesized
catagaaaaggaagagggaccc

SEQ ID NO: 715104 - DNA, 22 bp, Artificial Sequence
  chemically synthesized
taaattagggggtccctcttcc

SEQ ID NO: 715105 - DNA, 22 bp, Artificial Sequence
  chemically synthesized
ctgcatagaaaaggaagaggga

SEQ ID NO: 715106 - DNA, 22 bp, Artificial Sequence
  chemically synthesized
aattagggggtccctcttcctt

SEQ ID NO: 715107 - DNA, 22 bp, Artificial Sequence
  chemically synthesized
gggggtccctcttccttttcta

SEQ ID NO: 715108 - DNA, 22 bp, Artificial Sequence
  chemically synthesized
aagacagactgctgcatagaaa

SEQ ID NO: 715109 - DNA, 22 bp, Artificial Sequence
  chemically synthesized
ttccttttctatgcagcagtct

SEQ ID NO: 715110 - DNA, 22 bp, Artificial Sequence
  chemically synthesized
ccttttctatgcagcagtctgt

SEQ ID NO: 715111 - DNA, 22 bp, Artificial Sequence
  chemically synthesized
cttttctatgcagcagtctgtc

SEQ ID NO: 715112 - DNA, 22 bp, Artificial Sequence
  chemically synthesized
ttctatgcagcagtctgtcttc

SEQ ID NO: 715113 - DNA, 22 bp, Artificial Sequence
  chemically synthesized
tctatgcagcagtctgtcttca

SEQ ID NO: 715114 - DNA, 22 bp, Artificial Sequence
  chemically synthesized
ctatgcagcagtctgtcttcag

SEQ ID NO: 715115 - DNA, 22 bp, Artificial Sequence
  chemically synthesized
tatgcagcagtctgtcttcagc

SEQ ID NO: 715116 - DNA, 22 bp, Artificial Sequence
  chemically synthesized
tgcagcagtctgtcttcagcat

SEQ ID NO: 715117 - DNA, 22 bp, Artificial Sequence
  chemically synthesized
caatagagaaaagtgaagacat

SEQ ID NO: 715118 - DNA, 22 bp, Artificial Sequence
  chemically synthesized
tcttcagcatgatgtcttcact

SEQ ID NO: 715119 - DNA, 22 bp, Artificial Sequence
  chemically synthesized
cagcatgatgtcttcacttttc

SEQ ID NO: 715120 - DNA, 22 bp, Artificial Sequence
  chemically synthesized
agcatgatgtcttcacttttct

SEQ ID NO: 715121 - DNA, 22 bp, Artificial Sequence
  chemically synthesized
cacttttctctattgtagtctc

SEQ ID NO: 715122 - DNA, 22 bp, Artificial Sequence
  chemically synthesized
acttttctctattgtagtctct

SEQ ID NO: 715123 - DNA, 22 bp, Artificial Sequence
  chemically synthesized
gccaatcacaaaagagactaca

SEQ ID NO: 715124 - DNA, 22 bp, Artificial Sequence
  chemically synthesized
ttggccaatcacaaaagagact

SEQ ID NO: 715125 - DNA, 22 bp, Artificial Sequence
  chemically synthesized
ttctctattgtagtctcttttg

SEQ ID NO: 715126 - DNA, 22 bp, Artificial Sequence
  chemically synthesized
tctctattgtagtctcttttgt

SEQ ID NO: 715127 - DNA, 22 bp, Artificial Sequence
  chemically synthesized
ctctattgtagtctcttttgtg

SEQ ID NO: 715128 - DNA, 22 bp, Artificial Sequence
  chemically synthesized
ctattggccaatcacaaaagag

SEQ ID NO: 715129 - DNA, 22 bp, Artificial Sequence
  chemically synthesized
tctattgtagtctcttttgtga

SEQ ID NO: 715130 - DNA, 22 bp, Artificial Sequence
  chemically synthesized
gctattggccaatcacaaaaga

SEQ ID NO: 715131 - DNA, 22 bp, Artificial Sequence
  chemically synthesized
tgctattggccaatcacaaaag

SEQ ID NO: 715132 - DNA, 22 bp, Artificial Sequence
  chemically synthesized
tattgtagtctcttttgtgatt

SEQ ID NO: 715133 - DNA, 22 bp, Artificial Sequence
  chemically synthesized
ttgtagtctcttttgtgattgg

SEQ ID NO: 715134 - DNA, 22 bp, Artificial Sequence
  chemically synthesized
attttgctattggccaatcaca

SEQ ID NO: 715135 - DNA, 22 bp, Artificial Sequence
  chemically synthesized
cattttgctattggccaatcac

SEQ ID NO: 715136 - DNA, 22 bp, Artificial Sequence
  chemically synthesized
tagtctcttttgtgattggcca

SEQ ID NO: 715137 - DNA, 22 bp, Artificial Sequence
  chemically synthesized
ttttgtgattggccaatagcaa

SEQ ID NO: 715138 - DNA, 22 bp, Artificial Sequence
  chemically synthesized
gtaagtttcattttgctattgg

SEQ ID NO: 715139 - DNA, 22 bp, Artificial Sequence
  chemically synthesized
ttgtgattggccaatagcaaaa

SEQ ID NO: 715140 - DNA, 22 bp, Artificial Sequence
  chemically synthesized
tagtaagtttcattttgctatt

SEQ ID NO: 715141 - DNA, 22 bp, Artificial Sequence
  chemically synthesized
tgtgattggccaatagcaaaat

SEQ ID NO: 715142 - DNA, 22 bp, Artificial Sequence
  chemically synthesized
gtgattggccaatagcaaaatg

SEQ ID NO: 715143 - DNA, 22 bp, Artificial Sequence
  chemically synthesized
tgattggccaatagcaaaatga

SEQ ID NO: 715144 - DNA, 22 bp, Artificial Sequence
  chemically synthesized
gattctagtaagtttcattttg

SEQ ID NO: 715145 - DNA, 22 bp, Artificial Sequence
  chemically synthesized
gccaatagcaaaatgaaactta

SEQ ID NO: 715146 - DNA, 22 bp, Artificial Sequence
  chemically synthesized
ggattggattctagtaagtttc

SEQ ID NO: 715147 - DNA, 22 bp, Artificial Sequence
  chemically synthesized
gggattggattctagtaagttt

SEQ ID NO: 715148 - DNA, 22 bp, Artificial Sequence
  chemically synthesized
tgggattggattctagtaagtt

SEQ ID NO: 715149 - DNA, 22 bp, Artificial Sequence
  chemically synthesized
ttgggattggattctagtaagt

SEQ ID NO: 715150 - DNA, 22 bp, Artificial Sequence
  chemically synthesized
aagtgcttttgggattggattc

SEQ ID NO: 715151 - DNA, 22 bp, Artificial Sequence
  chemically synthesized
taaagtgcttttgggattggat

SEQ ID NO: 715152 - DNA, 22 bp, Artificial Sequence
  chemically synthesized
ctaaagtgcttttgggattgga

SEQ ID NO: 715153 - DNA, 22 bp, Artificial Sequence
  chemically synthesized
actagaatccaatcccaaaagc

SEQ ID NO: 715154 - DNA, 22 bp, Artificial Sequence
  chemically synthesized
ctagaatccaatcccaaaagca

SEQ ID NO: 715155 - DNA, 22 bp, Artificial Sequence
  chemically synthesized
catccttctaaagtgcttttgg

SEQ ID NO: 715156 - DNA, 22 bp, Artificial Sequence
  chemically synthesized
gaatccaatcccaaaagcactt

SEQ ID NO: 715157 - DNA, 22 bp, Artificial Sequence
  chemically synthesized
agggagtaaatgataagattcc

SEQ ID NO: 715158 - DNA, 22 bp, Artificial Sequence
  chemically synthesized
tagaaggatggaatcttatcat

SEQ ID NO: 715159 - DNA, 22 bp, Artificial Sequence
  chemically synthesized
agaaggatggaatcttatcatt

SEQ ID NO: 715160 - DNA, 22 bp, Artificial Sequence
  chemically synthesized
gaaggatggaatcttatcattt

SEQ ID NO: 715161 - DNA, 22 bp, Artificial Sequence
  chemically synthesized
atgatagtgattcagggagtaa

SEQ ID NO: 715162 - DNA, 22 bp, Artificial Sequence
  chemically synthesized
tactgatgatagtgattcaggg

SEQ ID NO: 715163 - DNA, 22 bp, Artificial Sequence
  chemically synthesized
atcatttactccctgaatcact

SEQ ID NO: 715164 - DNA, 22 bp, Artificial Sequence
  chemically synthesized
tcatttactccctgaatcacta

SEQ ID NO: 715165 - DNA, 22 bp, Artificial Sequence
  chemically synthesized
actccctgaatcactatcatca

SEQ ID NO: 715166 - DNA, 22 bp, Artificial Sequence
  chemically synthesized
caccaactgtactgatgatagt

SEQ ID NO: 715167 - DNA, 22 bp, Artificial Sequence
  chemically synthesized
ctccctgaatcactatcatcag

SEQ ID NO: 715168 - DNA, 22 bp, Artificial Sequence
  chemically synthesized
tacaccaactgtactgatgata

SEQ ID NO: 715169 - DNA, 22 bp, Artificial Sequence
  chemically synthesized
cctgaatcactatcatcagtac

SEQ ID NO: 715170 - DNA, 22 bp, Artificial Sequence
  chemically synthesized
aatcactatcatcagtacagtt

SEQ ID NO: 715171 - DNA, 22 bp, Artificial Sequence
  chemically synthesized
tcatcagtacagttggtgtaga

SEQ ID NO: 715172 - DNA, 22 bp, Artificial Sequence
  chemically synthesized
gtgtagaacggtattccattct

SEQ ID NO: 715173 - DNA, 22 bp, Artificial Sequence
  chemically synthesized
tccaatgagccccagaatggaa

SEQ ID NO: 715174 - DNA, 22 bp, Artificial Sequence
  chemically synthesized
atccaatgagccccagaatgga

SEQ ID NO: 715175 - DNA, 22 bp, Artificial Sequence
  chemically synthesized
atacttatccaatgagccccag

SEQ ID NO: 715176 - DNA, 22 bp, Artificial Sequence
  chemically synthesized
aactcatacttatccaatgagc

SEQ ID NO: 715177 - DNA, 22 bp, Artificial Sequence
  chemically synthesized
cattctggggctcattggataa

SEQ ID NO: 715178 - DNA, 22 bp, Artificial Sequence
  chemically synthesized
tggggctcattggataagtatg

SEQ ID NO: 715179 - DNA, 22 bp, Artificial Sequence
  chemically synthesized
ccaggttgaactcatacttatc

SEQ ID NO: 715180 - DNA, 22 bp, Artificial Sequence
  chemically synthesized
gggctcattggataagtatgag

SEQ ID NO: 715181 - DNA, 22 bp, Artificial Sequence
  chemically synthesized
tagctgccaggttgaactcata

SEQ ID NO: 715182 - DNA, 22 bp, Artificial Sequence
  chemically synthesized
atagctgccaggttgaactcat

SEQ ID NO: 715183 - DNA, 22 bp, Artificial Sequence
  chemically synthesized
attggataagtatgagttcaac

SEQ ID NO: 715184 - DNA, 22 bp, Artificial Sequence
  chemically synthesized
tatagctgccaggttgaactca

SEQ ID NO: 715185 - DNA, 22 bp, Artificial Sequence
  chemically synthesized
ttttatagctgccaggttgaac

SEQ ID NO: 715186 - DNA, 22 bp, Artificial Sequence
  chemically synthesized
gataagtatgagttcaacctgg

SEQ ID NO: 715187 - DNA, 22 bp, Artificial Sequence
  chemically synthesized
ccccggttattttatagctgcc

SEQ ID NO: 715188 - DNA, 22 bp, Artificial Sequence
  chemically synthesized
cccccggttattttatagctgc

SEQ ID NO: 715189 - DNA, 22 bp, Artificial Sequence
  chemically synthesized
tcccccggttattttatagctg

SEQ ID NO: 715190 - DNA, 22 bp, Artificial Sequence
  chemically synthesized
aacctggcagctataaaataac

SEQ ID NO: 715191 - DNA, 22 bp, Artificial Sequence
  chemically synthesized
gcagctataaaataaccggggg

SEQ ID NO: 715192 - DNA, 22 bp, Artificial Sequence
  chemically synthesized
taaaataaccgggggaaaatct

SEQ ID NO: 715193 - DNA, 22 bp, Artificial Sequence
  chemically synthesized
taaaggaggaaaggaacaagat

SEQ ID NO: 715194 - DNA, 22 bp, Artificial Sequence
  chemically synthesized
cgagctataaaggaggaaagga

SEQ ID NO: 715195 - DNA, 22 bp, Artificial Sequence
  chemically synthesized
ccgagctataaaggaggaaagg

SEQ ID NO: 715196 - DNA, 22 bp, Artificial Sequence
  chemically synthesized
acaaatttccgagctataaagg

SEQ ID NO: 715197 - DNA, 22 bp, Artificial Sequence
  chemically synthesized
gttcctttcctcctttatagct

SEQ ID NO: 715198 - DNA, 22 bp, Artificial Sequence
  chemically synthesized
ttcctttcctcctttatagctc

SEQ ID NO: 715199 - DNA, 22 bp, Artificial Sequence
  chemically synthesized
ctttcctcctttatagctcgga

SEQ ID NO: 715200 - DNA, 22 bp, Artificial Sequence
  chemically synthesized
tcctcctttatagctcggaaat

SEQ ID NO: 715201 - DNA, 22 bp, Artificial Sequence
  chemically synthesized
cctcctttatagctcggaaatt

SEQ ID NO: 715202 - DNA, 22 bp, Artificial Sequence
  chemically synthesized
ctcctttatagctcggaaattt

SEQ ID NO: 715203 - DNA, 22 bp, Artificial Sequence
  chemically synthesized
ctttatagctcggaaatttgtg

SEQ ID NO: 715204 - DNA, 22 bp, Artificial Sequence
  chemically synthesized
tatagctcggaaatttgtgagt

SEQ ID NO: 715205 - DNA, 22 bp, Artificial Sequence
  chemically synthesized
atagctcggaaatttgtgagtg

SEQ ID NO: 715206 - DNA, 22 bp, Artificial Sequence
  chemically synthesized
tagctcggaaatttgtgagtga

SEQ ID NO: 715207 - DNA, 22 bp, Artificial Sequence
  chemically synthesized
gaaataaagaagcaaggtcact

SEQ ID NO: 715208 - DNA, 22 bp, Artificial Sequence
  chemically synthesized
ggaaatttgtgagtgaccttgc

SEQ ID NO: 715209 - DNA, 22 bp, Artificial Sequence
  chemically synthesized
gtgagtgaccttgcttctttat

SEQ ID NO: 715210 - DNA, 22 bp, Artificial Sequence
  chemically synthesized
tgagtgaccttgcttctttatt

SEQ ID NO: 715211 - DNA, 22 bp, Artificial Sequence
  chemically synthesized
catagggcataattagaaataa

SEQ ID NO: 715212 - DNA, 22 bp, Artificial Sequence
  chemically synthesized
ccatagggcataattagaaata

SEQ ID NO: 715213 - DNA, 22 bp, Artificial Sequence
  chemically synthesized
tccatagggcataattagaaat

SEQ ID NO: 715214 - DNA, 22 bp, Artificial Sequence
  chemically synthesized
ttccatagggcataattagaaa

SEQ ID NO: 715215 - DNA, 22 bp, Artificial Sequence
  chemically synthesized
gcttctttatttctaattatgc

SEQ ID NO: 715216 - DNA, 22 bp, Artificial Sequence
  chemically synthesized
tttttccatagggcataattag

SEQ ID NO: 715217 - DNA, 22 bp, Artificial Sequence
  chemically synthesized
cttctttatttctaattatgcc

SEQ ID NO: 715218 - DNA, 22 bp, Artificial Sequence
  chemically synthesized
ctttatttctaattatgcccta

SEQ ID NO: 715219 - DNA, 22 bp, Artificial Sequence
  chemically synthesized
tttatttctaattatgccctat

SEQ ID NO: 715220 - DNA, 22 bp, Artificial Sequence
  chemically synthesized
tatttctaattatgccctatgg

SEQ ID NO: 715221 - DNA, 22 bp, Artificial Sequence
  chemically synthesized
atttctaattatgccctatgga

SEQ ID NO: 715222 - DNA, 22 bp, Artificial Sequence
  chemically synthesized
tttctaattatgccctatggaa

SEQ ID NO: 715223 - DNA, 22 bp, Artificial Sequence
  chemically synthesized
ctaattatgccctatggaaaaa

SEQ ID NO: 715224 - DNA, 22 bp, Artificial Sequence
  chemically synthesized
taattatgccctatggaaaaat

SEQ ID NO: 715225 - DNA, 22 bp, Artificial Sequence
  chemically synthesized
attatgccctatggaaaaataa

SEQ ID NO: 715226 - DNA, 22 bp, Artificial Sequence
  chemically synthesized
tgccctatggaaaaataacgcc

SEQ ID NO: 715227 - DNA, 22 bp, Artificial Sequence
  chemically synthesized
tggaaaaataacgccttttttt

SEQ ID NO: 715228 - DNA, 22 bp, Artificial Sequence
  chemically synthesized
tacaatataaatgaaaaaaaag

SEQ ID NO: 715229 - DNA, 22 bp, Artificial Sequence
  chemically synthesized
ggcactatacaatataaatgaa

SEQ ID NO: 715230 - DNA, 22 bp, Artificial Sequence
  chemically synthesized
aggcactatacaatataaatga

SEQ ID NO: 715231 - DNA, 22 bp, Artificial Sequence
  chemically synthesized
ttttttcatttatattgtatag

SEQ ID NO: 715232 - DNA, 22 bp, Artificial Sequence
  chemically synthesized
tttttcatttatattgtatagt

SEQ ID NO: 715233 - DNA, 22 bp, Artificial Sequence
  chemically synthesized
ttttcatttatattgtatagtg

SEQ ID NO: 715234 - DNA, 22 bp, Artificial Sequence
  chemically synthesized
tttcatttatattgtatagtgc

SEQ ID NO: 715235 - DNA, 22 bp, Artificial Sequence
  chemically synthesized
ttcatttatattgtatagtgcc

SEQ ID NO: 715236 - DNA, 22 bp, Artificial Sequence
  chemically synthesized
tcatttatattgtatagtgcct

SEQ ID NO: 715237 - DNA, 22 bp, Artificial Sequence
  chemically synthesized
catttatattgtatagtgccta

SEQ ID NO: 715238 - DNA, 22 bp, Artificial Sequence
  chemically synthesized
atttatattgtatagtgcctaa

SEQ ID NO: 715239 - DNA, 22 bp, Artificial Sequence
  chemically synthesized
atattgtatagtgcctaagatt

SEQ ID NO: 715240 - DNA, 22 bp, Artificial Sequence
  chemically synthesized
aaggcccccaaaaatcttaggc

SEQ ID NO: 715241 - DNA, 22 bp, Artificial Sequence
  chemically synthesized
tattgtatagtgcctaagattt

SEQ ID NO: 715242 - DNA, 22 bp, Artificial Sequence
  chemically synthesized
attaaaggcccccaaaaatctt

SEQ ID NO: 715243 - DNA, 22 bp, Artificial Sequence
  chemically synthesized
tatagtgcctaagatttttggg

SEQ ID NO: 715244 - DNA, 22 bp, Artificial Sequence
  chemically synthesized
ttcattaaaggcccccaaaaat

SEQ ID NO: 715245 - DNA, 22 bp, Artificial Sequence
  chemically synthesized
ctgttcattaaaggcccccaaa

SEQ ID NO: 715246 - DNA, 22 bp, Artificial Sequence
  chemically synthesized
tactgctgttcattaaaggccc

SEQ ID NO: 715247 - DNA, 22 bp, Artificial Sequence
  chemically synthesized
agatttttgggggcctttaatg

SEQ ID NO: 715248 - DNA, 22 bp, Artificial Sequence
  chemically synthesized
ttgggggcctttaatgaacagc

SEQ ID NO: 715249 - DNA, 22 bp, Artificial Sequence
  chemically synthesized
tgggggcctttaatgaacagca

SEQ ID NO: 715250 - DNA, 22 bp, Artificial Sequence
  chemically synthesized
gggggcctttaatgaacagcag

SEQ ID NO: 715251 - DNA, 22 bp, Artificial Sequence
  chemically synthesized
ggggcctttaatgaacagcagt

SEQ ID NO: 715252 - DNA, 22 bp, Artificial Sequence
  chemically synthesized
taatgaacagcagtacaatttc

SEQ ID NO: 715253 - DNA, 22 bp, Artificial Sequence
  chemically synthesized
taaaatgaaaatgaaattgtac

SEQ ID NO: 715254 - DNA, 22 bp, Artificial Sequence
  chemically synthesized
aatgaacagcagtacaatttca

SEQ ID NO: 715255 - DNA, 22 bp, Artificial Sequence
  chemically synthesized
atgaacagcagtacaatttcat

SEQ ID NO: 715256 - DNA, 22 bp, Artificial Sequence
  chemically synthesized
catatcctgtaaaatgaaaatg

SEQ ID NO: 715257 - DNA, 22 bp, Artificial Sequence
  chemically synthesized
tattgcatatcctgtaaaatga

SEQ ID NO: 715258 - DNA, 22 bp, Artificial Sequence
  chemically synthesized
cattttcattttacaggatatg

SEQ ID NO: 715259 - DNA, 22 bp, Artificial Sequence
  chemically synthesized
aaaattatattgcatatcctgt

SEQ ID NO: 715260 - DNA, 22 bp, Artificial Sequence
  chemically synthesized
attttcattttacaggatatgc

SEQ ID NO: 715261 - DNA, 22 bp, Artificial Sequence
  chemically synthesized
caaaattatattgcatatcctg

SEQ ID NO: 715262 - DNA, 22 bp, Artificial Sequence
  chemically synthesized
tcaaaattatattgcatatcct

SEQ ID NO: 715263 - DNA, 22 bp, Artificial Sequence
  chemically synthesized
ttcaaaattatattgcatatcc

SEQ ID NO: 715264 - DNA, 22 bp, Artificial Sequence
  chemically synthesized
tcattttacaggatatgcaata

SEQ ID NO: 715265 - DNA, 22 bp, Artificial Sequence
  chemically synthesized
cattttacaggatatgcaatat

SEQ ID NO: 715266 - DNA, 22 bp, Artificial Sequence
  chemically synthesized
attttacaggatatgcaatata

SEQ ID NO: 715267 - DNA, 22 bp, Artificial Sequence
  chemically synthesized
atttttcaaaattatattgcat

SEQ ID NO: 715268 - DNA, 22 bp, Artificial Sequence
  chemically synthesized
aatttttcaaaattatattgca

SEQ ID NO: 715269 - DNA, 22 bp, Artificial Sequence
  chemically synthesized
tacaggatatgcaatataattt

SEQ ID NO: 715270 - DNA, 22 bp, Artificial Sequence
  chemically synthesized
acaggatatgcaatataatttt

SEQ ID NO: 715271 - DNA, 22 bp, Artificial Sequence
  chemically synthesized
caggatatgcaatataattttg

SEQ ID NO: 715272 - DNA, 22 bp, Artificial Sequence
  chemically synthesized
gagcatgtagtttaatttttca

SEQ ID NO: 715273 - DNA, 22 bp, Artificial Sequence
  chemically synthesized
ctcgagcatgtagtttaatttt

SEQ ID NO: 715274 - DNA, 22 bp, Artificial Sequence
  chemically synthesized
cctcgagcatgtagtttaattt

SEQ ID NO: 715275 - DNA, 22 bp, Artificial Sequence
  chemically synthesized
aatccttcctcgagcatgtagt

SEQ ID NO: 715276 - DNA, 22 bp, Artificial Sequence
  chemically synthesized
tgaaaaattaaactacatgctc

SEQ ID NO: 715277 - DNA, 22 bp, Artificial Sequence
  chemically synthesized
gaaaaattaaactacatgctcg

SEQ ID NO: 715278 - DNA, 22 bp, Artificial Sequence
  chemically synthesized
aaaaattaaactacatgctcga

SEQ ID NO: 715279 - DNA, 22 bp, Artificial Sequence
  chemically synthesized
aactacatgctcgaggaaggat

SEQ ID NO: 715280 - DNA, 22 bp, Artificial Sequence
  chemically synthesized
cggaaatgttgaatccttcctc

SEQ ID NO: 715281 - DNA, 22 bp, Artificial Sequence
  chemically synthesized
tccggaaatgttgaatccttcc

SEQ ID NO: 715282 - DNA, 22 bp, Artificial Sequence
  chemically synthesized
catgctcgaggaaggattcaac

SEQ ID NO: 715283 - DNA, 22 bp, Artificial Sequence
  chemically synthesized
ggttctccggaaatgttgaatc

SEQ ID NO: 715284 - DNA, 22 bp, Artificial Sequence
  chemically synthesized
gaggaaggattcaacatttccg

SEQ ID NO: 715285 - DNA, 22 bp, Artificial Sequence
  chemically synthesized
agggaaaatgctaggttctccg

SEQ ID NO: 715286 - DNA, 22 bp, Artificial Sequence
  chemically synthesized
tgagggaaaatgctaggttctc

SEQ ID NO: 715287 - DNA, 22 bp, Artificial Sequence
  chemically synthesized
ctgagggaaaatgctaggttct

SEQ ID NO: 715288 - DNA, 22 bp, Artificial Sequence
  chemically synthesized
aacatttccggagaacctagca

SEQ ID NO: 715289 - DNA, 22 bp, Artificial Sequence
  chemically synthesized
gtcttctgagggaaaatgctag

SEQ ID NO: 715290 - DNA, 22 bp, Artificial Sequence
  chemically synthesized
agtcttctgagggaaaatgcta

SEQ ID NO: 715291 - DNA, 22 bp, Artificial Sequence
  chemically synthesized
tagtcttctgagggaaaatgct

SEQ ID NO: 715292 - DNA, 22 bp, Artificial Sequence
  chemically synthesized
ccggagaacctagcattttccc

SEQ ID NO: 715293 - DNA, 22 bp, Artificial Sequence
  chemically synthesized
cggagaacctagcattttccct

SEQ ID NO: 715294 - DNA, 22 bp, Artificial Sequence
  chemically synthesized
attttagtcttctgagggaaaa

SEQ ID NO: 715295 - DNA, 22 bp, Artificial Sequence
  chemically synthesized
gcattttccctcagaagactaa

SEQ ID NO: 715296 - DNA, 22 bp, Artificial Sequence
  chemically synthesized
aaacaggatctaattttagtct

SEQ ID NO: 715297 - DNA, 22 bp, Artificial Sequence
  chemically synthesized
tccctcagaagactaaaattag

SEQ ID NO: 715298 - DNA, 22 bp, Artificial Sequence
  chemically synthesized
ccctcagaagactaaaattaga

SEQ ID NO: 715299 - DNA, 22 bp, Artificial Sequence
  chemically synthesized
cctcagaagactaaaattagat

SEQ ID NO: 715300 - DNA, 22 bp, Artificial Sequence
  chemically synthesized
agaagactaaaattagatcctg

SEQ ID NO: 715301 - DNA, 22 bp, Artificial Sequence
  chemically synthesized
cagggacagtcattaaaacagg

SEQ ID NO: 715302 - DNA, 22 bp, Artificial Sequence
  chemically synthesized
aaattagatcctgttttaatga

SEQ ID NO: 715303 - DNA, 22 bp, Artificial Sequence
  chemically synthesized
gatcctgttttaatgactgtcc

SEQ ID NO: 715304 - DNA, 22 bp, Artificial Sequence
  chemically synthesized
ttttaatgactgtccctgcaac

SEQ ID NO: 715305 - DNA, 22 bp, Artificial Sequence
  chemically synthesized
catagaagtcagtgttgcaggg

SEQ ID NO: 715306 - DNA, 22 bp, Artificial Sequence
  chemically synthesized
taatgactgtccctgcaacact

SEQ ID NO: 715307 - DNA, 22 bp, Artificial Sequence
  chemically synthesized
aatgactgtccctgcaacactg

SEQ ID NO: 715308 - DNA, 22 bp, Artificial Sequence
  chemically synthesized
atgactgtccctgcaacactga

SEQ ID NO: 715309 - DNA, 22 bp, Artificial Sequence
  chemically synthesized
attacatagaagtcagtgttgc

SEQ ID NO: 715310 - DNA, 22 bp, Artificial Sequence
  chemically synthesized
tcattacatagaagtcagtgtt

SEQ ID NO: 715311 - DNA, 22 bp, Artificial Sequence
  chemically synthesized
tccctgcaacactgacttctat

SEQ ID NO: 715312 - DNA, 22 bp, Artificial Sequence
  chemically synthesized
caacactgacttctatgtaatg

SEQ ID NO: 715313 - DNA, 22 bp, Artificial Sequence
  chemically synthesized
acttctatgtaatgagaatgtt

SEQ ID NO: 715314 - DNA, 22 bp, Artificial Sequence
  chemically synthesized
ctatgtaatgagaatgtttcca

SEQ ID NO: 715315 - DNA, 22 bp, Artificial Sequence
  chemically synthesized
tcagcaggaacatggaaacatt

SEQ ID NO: 715316 - DNA, 22 bp, Artificial Sequence
  chemically synthesized
tatgtaatgagaatgtttccat

SEQ ID NO: 715317 - DNA, 22 bp, Artificial Sequence
  chemically synthesized
tgtaatgagaatgtttccatgt

SEQ ID NO: 715318 - DNA, 22 bp, Artificial Sequence
  chemically synthesized
ccatgttcctgctgacagacca

SEQ ID NO: 715319 - DNA, 22 bp, Artificial Sequence
  chemically synthesized
catgttcctgctgacagaccac

SEQ ID NO: 715320 - DNA, 22 bp, Artificial Sequence
  chemically synthesized
ctgctgacagaccacctactat

SEQ ID NO: 715321 - DNA, 22 bp, Artificial Sequence
  chemically synthesized
ctgacagaccacctactattct

SEQ ID NO: 715322 - DNA, 22 bp, Artificial Sequence
  chemically synthesized
acagaccacctactattctttg

SEQ ID NO: 715323 - DNA, 22 bp, Artificial Sequence
  chemically synthesized
tcagccccacatcagcaaagaa

SEQ ID NO: 715324 - DNA, 22 bp, Artificial Sequence
  chemically synthesized
ctattctttgctgatgtggggc

SEQ ID NO: 715325 - DNA, 22 bp, Artificial Sequence
  chemically synthesized
tcagaattatcagccccacatc

SEQ ID NO: 715326 - DNA, 22 bp, Artificial Sequence
  chemically synthesized
ttctttgctgatgtggggctga

SEQ ID NO: 715327 - DNA, 22 bp, Artificial Sequence
  chemically synthesized
attgtcagaattatcagcccca

SEQ ID NO: 715328 - DNA, 22 bp, Artificial Sequence
  chemically synthesized
tttgctgatgtggggctgataa

SEQ ID NO: 715329 - DNA, 22 bp, Artificial Sequence
  chemically synthesized
ttgattgtcagaattatcagcc

SEQ ID NO: 715330 - DNA, 22 bp, Artificial Sequence
  chemically synthesized
tgctgatgtggggctgataatt

SEQ ID NO: 715331 - DNA, 22 bp, Artificial Sequence
  chemically synthesized
gctgatgtggggctgataattc

SEQ ID NO: 715332 - DNA, 22 bp, Artificial Sequence
  chemically synthesized
ctgatgtggggctgataattct

SEQ ID NO: 715333 - DNA, 22 bp, Artificial Sequence
  chemically synthesized
ttattgattgtcagaattatca

SEQ ID NO: 715334 - DNA, 22 bp, Artificial Sequence
  chemically synthesized
atgtggggctgataattctgac

SEQ ID NO: 715335 - DNA, 22 bp, Artificial Sequence
  chemically synthesized
ttattattgattgtcagaatta

SEQ ID NO: 715336 - DNA, 22 bp, Artificial Sequence
  chemically synthesized
tacaattattattattgattgt

SEQ ID NO: 715337 - DNA, 22 bp, Artificial Sequence
  chemically synthesized
atacaattattattattgattg

SEQ ID NO: 715338 - DNA, 22 bp, Artificial Sequence
  chemically synthesized
ataattctgacaatcaataata

SEQ ID NO: 715339 - DNA, 22 bp, Artificial Sequence
  chemically synthesized
atgtttatacaattattattat

SEQ ID NO: 715340 - DNA, 22 bp, Artificial Sequence
  chemically synthesized
tgacaatcaataataataattg

SEQ ID NO: 715341 - DNA, 22 bp, Artificial Sequence
  chemically synthesized
acaatcaataataataattgta

SEQ ID NO: 715342 - DNA, 22 bp, Artificial Sequence
  chemically synthesized
aatacatgttaatgtttataca

SEQ ID NO: 715343 - DNA, 22 bp, Artificial Sequence
  chemically synthesized
tataaacattaacatgtattga

SEQ ID NO: 715344 - DNA, 22 bp, Artificial Sequence
  chemically synthesized
gcacaaagcacgcactcaatac

SEQ ID NO: 715345 - DNA, 22 bp, Artificial Sequence
  chemically synthesized
acatgtattgagtgcgtgcttt

SEQ ID NO: 715346 - DNA, 22 bp, Artificial Sequence
  chemically synthesized
tgcagtgcctggcacaaagcac

SEQ ID NO: 715347 - DNA, 22 bp, Artificial Sequence
  chemically synthesized
gtgcagtgcctggcacaaagca

SEQ ID NO: 715348 - DNA, 22 bp, Artificial Sequence
  chemically synthesized
tgtgcagtgcctggcacaaagc

SEQ ID NO: 715349 - DNA, 22 bp, Artificial Sequence
  chemically synthesized
agtgcgtgctttgtgccaggca

SEQ ID NO: 715350 - DNA, 22 bp, Artificial Sequence
  chemically synthesized
taaagcactttgtgcagtgcct

SEQ ID NO: 715351 - DNA, 22 bp, Artificial Sequence
  chemically synthesized
tgtgccaggcactgcacaaagt

SEQ ID NO: 715352 - DNA, 22 bp, Artificial Sequence
  chemically synthesized
gtgccaggcactgcacaaagtg

SEQ ID NO: 715353 - DNA, 22 bp, Artificial Sequence
  chemically synthesized
tgccaggcactgcacaaagtgc

SEQ ID NO: 715354 - DNA, 22 bp, Artificial Sequence
  chemically synthesized
cacaaagtgctttataatgatt

SEQ ID NO: 715355 - DNA, 22 bp, Artificial Sequence
  chemically synthesized
caaagatcaaatgaaataatca

SEQ ID NO: 715356 - DNA, 22 bp, Artificial Sequence
  chemically synthesized
ttacaaagatcaaatgaaataa

SEQ ID NO: 715357 - DNA, 22 bp, Artificial Sequence
  chemically synthesized
tataatgattatttcatttgat

SEQ ID NO: 715358 - DNA, 22 bp, Artificial Sequence
  chemically synthesized
ataatgattatttcatttgatc

SEQ ID NO: 715359 - DNA, 22 bp, Artificial Sequence
  chemically synthesized
taatgattatttcatttgatct

SEQ ID NO: 715360 - DNA, 22 bp, Artificial Sequence
  chemically synthesized
atggggttattacaaagatcaa

SEQ ID NO: 715361 - DNA, 22 bp, Artificial Sequence
  chemically synthesized
actcatggggttattacaaaga

SEQ ID NO: 715362 - DNA, 22 bp, Artificial Sequence
  chemically synthesized
aactcatggggttattacaaag

SEQ ID NO: 715363 - DNA, 22 bp, Artificial Sequence
  chemically synthesized
tttcatttgatctttgtaataa

SEQ ID NO: 715364 - DNA, 22 bp, Artificial Sequence
  chemically synthesized
ttaactcatggggttattacaa

SEQ ID NO: 715365 - DNA, 22 bp, Artificial Sequence
  chemically synthesized
catttgatctttgtaataaccc

SEQ ID NO: 715366 - DNA, 22 bp, Artificial Sequence
  chemically synthesized
atttgatctttgtaataacccc

SEQ ID NO: 715367 - DNA, 22 bp, Artificial Sequence
  chemically synthesized
tattcttaactcatggggttat

SEQ ID NO: 715368 - DNA, 22 bp, Artificial Sequence
  chemically synthesized
gtattcttaactcatggggtta

SEQ ID NO: 715369 - DNA, 22 bp, Artificial Sequence
  chemically synthesized
gatctttgtaataaccccatga

SEQ ID NO: 715370 - DNA, 22 bp, Artificial Sequence
  chemically synthesized
atctttgtaataaccccatgag

SEQ ID NO: 715371 - DNA, 22 bp, Artificial Sequence
  chemically synthesized
tgtaataaccccatgagttaag

SEQ ID NO: 715372 - DNA, 22 bp, Artificial Sequence
  chemically synthesized
gtaataaccccatgagttaaga

SEQ ID NO: 715373 - DNA, 22 bp, Artificial Sequence
  chemically synthesized
taataaccccatgagttaagaa

SEQ ID NO: 715374 - DNA, 22 bp, Artificial Sequence
  chemically synthesized
atatgccagagcatttgtattc

SEQ ID NO: 715375 - DNA, 22 bp, Artificial Sequence
  chemically synthesized
tgatatgccagagcatttgtat

SEQ ID NO: 715376 - DNA, 22 bp, Artificial Sequence
  chemically synthesized
agaatacaaatgctctggcata

SEQ ID NO: 715377 - DNA, 22 bp, Artificial Sequence
  chemically synthesized
tggcatatcagaattgttcaca

SEQ ID NO: 715378 - DNA, 22 bp, Artificial Sequence
  chemically synthesized
gcatatcagaattgttcacatt

SEQ ID NO: 715379 - DNA, 22 bp, Artificial Sequence
  chemically synthesized
agtcaaccatcaaatgtgaaca

SEQ ID NO: 715380 - DNA, 22 bp, Artificial Sequence
  chemically synthesized
aaagtcgatattgagtcaacca

SEQ ID NO: 715381 - DNA, 22 bp, Artificial Sequence
  chemically synthesized
ttcacatttgatggttgactca

SEQ ID NO: 715382 - DNA, 22 bp, Artificial Sequence
  chemically synthesized
aaaagtcgatattgagtcaacc

SEQ ID NO: 715383 - DNA, 22 bp, Artificial Sequence
  chemically synthesized
taaaagtcgatattgagtcaac

SEQ ID NO: 715384 - DNA, 22 bp, Artificial Sequence
  chemically synthesized
ttaaaagtcgatattgagtcaa

SEQ ID NO: 715385 - DNA, 22 bp, Artificial Sequence
  chemically synthesized
acatttgatggttgactcaata

SEQ ID NO: 715386 - DNA, 22 bp, Artificial Sequence
  chemically synthesized
gatggttgactcaatatcgact

SEQ ID NO: 715387 - DNA, 22 bp, Artificial Sequence
  chemically synthesized
atggttgactcaatatcgactt

SEQ ID NO: 715388 - DNA, 22 bp, Artificial Sequence
  chemically synthesized
gacagtttttaaaagtcgatat

SEQ ID NO: 715389 - DNA, 22 bp, Artificial Sequence
  chemically synthesized
tagacagtttttaaaagtcgat

SEQ ID NO: 715390 - DNA, 22 bp, Artificial Sequence
  chemically synthesized
ctagacagtttttaaaagtcga

SEQ ID NO: 715391 - DNA, 22 bp, Artificial Sequence
  chemically synthesized
actcaatatcgacttttaaaaa

SEQ ID NO: 715392 - DNA, 22 bp, Artificial Sequence
  chemically synthesized
aatatcgacttttaaaaactgt

SEQ ID NO: 715393 - DNA, 22 bp, Artificial Sequence
  chemically synthesized
ttaaaaactgtctagaaacctc

SEQ ID NO: 715394 - DNA, 22 bp, Artificial Sequence
  chemically synthesized
taaaaactgtctagaaacctcc

SEQ ID NO: 715395 - DNA, 22 bp, Artificial Sequence
  chemically synthesized
aaaaactgtctagaaacctccc

SEQ ID NO: 715396 - DNA, 22 bp, Artificial Sequence
  chemically synthesized
aaaactgtctagaaacctccca

SEQ ID NO: 715397 - DNA, 22 bp, Artificial Sequence
  chemically synthesized
tctagaaacctcccacgacact

SEQ ID NO: 715398 - DNA, 22 bp, Artificial Sequence
  chemically synthesized
gaaacctcccacgacacttact

SEQ ID NO: 715399 - DNA, 22 bp, Artificial Sequence
  chemically synthesized
ccacgacacttactgcactgat

SEQ ID NO: 715400 - DNA, 22 bp, Artificial Sequence
  chemically synthesized
gaggagtatggagaaccatcag

SEQ ID NO: 715401 - DNA, 22 bp, Artificial Sequence
  chemically synthesized
actgcactgatggttctccata

SEQ ID NO: 715402 - DNA, 22 bp, Artificial Sequence
  chemically synthesized
ctgcactgatggttctccatac

SEQ ID NO: 715403 - DNA, 22 bp, Artificial Sequence
  chemically synthesized
tgtcattggaggagtatggaga

SEQ ID NO: 715404 - DNA, 22 bp, Artificial Sequence
  chemically synthesized
gtgtcattggaggagtatggag

SEQ ID NO: 715405 - DNA, 22 bp, Artificial Sequence
  chemically synthesized
cactgatggttctccatactcc

SEQ ID NO: 715406 - DNA, 22 bp, Artificial Sequence
  chemically synthesized
tgtgtcattggaggagtatgga

SEQ ID NO: 715407 - DNA, 22 bp, Artificial Sequence
  chemically synthesized
atggttctccatactcctccaa

SEQ ID NO: 715408 - DNA, 22 bp, Artificial Sequence
  chemically synthesized
tccatactcctccaatgacaca

SEQ ID NO: 715409 - DNA, 22 bp, Artificial Sequence
  chemically synthesized
catactcctccaatgacacaaa

SEQ ID NO: 715410 - DNA, 22 bp, Artificial Sequence
  chemically synthesized
aaagcaggataggctttgtgtc

SEQ ID NO: 715411 - DNA, 22 bp, Artificial Sequence
  chemically synthesized
ctccaatgacacaaagcctatc

SEQ ID NO: 715412 - DNA, 22 bp, Artificial Sequence
  chemically synthesized
caatgacacaaagcctatcctg

SEQ ID NO: 715413 - DNA, 22 bp, Artificial Sequence
  chemically synthesized
tcctgctttgaattcttgtatt

SEQ ID NO: 715414 - DNA, 22 bp, Artificial Sequence
  chemically synthesized
tatgaataataataatacaaga

SEQ ID NO: 715415 - DNA, 22 bp, Artificial Sequence
  chemically synthesized
ctttgaattcttgtattattat

SEQ ID NO: 715416 - DNA, 22 bp, Artificial Sequence
  chemically synthesized
cctatatgaataataataatac

SEQ ID NO: 715417 - DNA, 22 bp, Artificial Sequence
  chemically synthesized
tccctatatgaataataataat

SEQ ID NO: 715418 - DNA, 22 bp, Artificial Sequence
  chemically synthesized
tgaattcttgtattattattat

SEQ ID NO: 715419 - DNA, 22 bp, Artificial Sequence
  chemically synthesized
gaattcttgtattattattatt

SEQ ID NO: 715420 - DNA, 22 bp, Artificial Sequence
  chemically synthesized
aattcttgtattattattattc

SEQ ID NO: 715421 - DNA, 22 bp, Artificial Sequence
  chemically synthesized
aattctccctatatgaataata

SEQ ID NO: 715422 - DNA, 22 bp, Artificial Sequence
  chemically synthesized
ttgtattattattattcatata

SEQ ID NO: 715423 - DNA, 22 bp, Artificial Sequence
  chemically synthesized
ttgaattctccctatatgaata

SEQ ID NO: 715424 - DNA, 22 bp, Artificial Sequence
  chemically synthesized
gttgaattctccctatatgaat

SEQ ID NO: 715425 - DNA, 22 bp, Artificial Sequence
  chemically synthesized
gtattattattattcatatagg

SEQ ID NO: 715426 - DNA, 22 bp, Artificial Sequence
  chemically synthesized
tattattattattcatataggg

SEQ ID NO: 715427 - DNA, 22 bp, Artificial Sequence
  chemically synthesized
tttgttgaattctccctatatg

SEQ ID NO: 715428 - DNA, 22 bp, Artificial Sequence
  chemically synthesized
atttgttgaattctccctatat

SEQ ID NO: 715429 - DNA, 22 bp, Artificial Sequence
  chemically synthesized
ttattattcatatagggagaat

SEQ ID NO: 715430 - DNA, 22 bp, Artificial Sequence
  chemically synthesized
tttatttgttgaattctcccta

SEQ ID NO: 715431 - DNA, 22 bp, Artificial Sequence
  chemically synthesized
ttattcatatagggagaattca

SEQ ID NO: 715432 - DNA, 22 bp, Artificial Sequence
  chemically synthesized
ttcatatagggagaattcaaca

SEQ ID NO: 715433 - DNA, 22 bp, Artificial Sequence
  chemically synthesized
atatagggagaattcaacaaat

SEQ ID NO: 715434 - DNA, 22 bp, Artificial Sequence
  chemically synthesized
gtgtcaatagaatacctgttta

SEQ ID NO: 715435 - DNA, 22 bp, Artificial Sequence
  chemically synthesized
ggtgtcaatagaatacctgttt

SEQ ID NO: 715436 - DNA, 22 bp, Artificial Sequence
  chemically synthesized
ttggtgtcaatagaatacctgt

SEQ ID NO: 715437 - DNA, 22 bp, Artificial Sequence
  chemically synthesized
cttggtgtcaatagaatacctg

SEQ ID NO: 715438 - DNA, 22 bp, Artificial Sequence
  chemically synthesized
aacaaataaacaggtattctat

SEQ ID NO: 715439 - DNA, 22 bp, Artificial Sequence
  chemically synthesized
tattgacaccaagaagactgac

SEQ ID NO: 715440 - DNA, 22 bp, Artificial Sequence
  chemically synthesized
ttgacaccaagaagactgacac

SEQ ID NO: 715441 - DNA, 22 bp, Artificial Sequence
  chemically synthesized
acaccaagaagactgacactgc

SEQ ID NO: 715442 - DNA, 22 bp, Artificial Sequence
  chemically synthesized
aaagtggagcagagcagcggca

SEQ ID NO: 715443 - DNA, 22 bp, Artificial Sequence
  chemically synthesized
acactgccgctgctctgctcca

SEQ ID NO: 715444 - DNA, 22 bp, Artificial Sequence
  chemically synthesized
caaacctcaaagtggagcagag

SEQ ID NO: 715445 - DNA, 22 bp, Artificial Sequence
  chemically synthesized
ctacaaacctcaaagtggagca

SEQ ID NO: 715446 - DNA, 22 bp, Artificial Sequence
  chemically synthesized
gctacaaacctcaaagtggagc

SEQ ID NO: 715447 - DNA, 22 bp, Artificial Sequence
  chemically synthesized
ccgctgctctgctccactttga

SEQ ID NO: 715448 - DNA, 22 bp, Artificial Sequence
  chemically synthesized
ctctgctccactttgaggtttg

SEQ ID NO: 715449 - DNA, 22 bp, Artificial Sequence
  chemically synthesized
tgctccactttgaggtttgtag

SEQ ID NO: 715450 - DNA, 22 bp, Artificial Sequence
  chemically synthesized
ctccactttgaggtttgtagca

SEQ ID NO: 715451 - DNA, 22 bp, Artificial Sequence
  chemically synthesized
cactttgaggtttgtagcaaat

SEQ ID NO: 715452 - DNA, 22 bp, Artificial Sequence
  chemically synthesized
tgaggtttgtagcaaatatgtc

SEQ ID NO: 715453 - DNA, 22 bp, Artificial Sequence
  chemically synthesized
gaggtttgtagcaaatatgtct

SEQ ID NO: 715454 - DNA, 22 bp, Artificial Sequence
  chemically synthesized
aggtttgtagcaaatatgtctg

SEQ ID NO: 715455 - DNA, 22 bp, Artificial Sequence
  chemically synthesized
gtagcaaatatgtctggtgctt

SEQ ID NO: 715456 - DNA, 22 bp, Artificial Sequence
  chemically synthesized
tagcaaatatgtctggtgcttg

SEQ ID NO: 715457 - DNA, 22 bp, Artificial Sequence
  chemically synthesized
acaagatgtgatgcaagcacca

SEQ ID NO: 715458 - DNA, 22 bp, Artificial Sequence
  chemically synthesized
gtgcttgcatcacatcttgtca

SEQ ID NO: 715459 - DNA, 22 bp, Artificial Sequence
  chemically synthesized
gaatcacaggtgggctgacaag

SEQ ID NO: 715460 - DNA, 22 bp, Artificial Sequence
  chemically synthesized
gcatcacatcttgtcagcccac

SEQ ID NO: 715461 - DNA, 22 bp, Artificial Sequence
  chemically synthesized
catcacatcttgtcagcccacc

SEQ ID NO: 715462 - DNA, 22 bp, Artificial Sequence
  chemically synthesized
acactggaatcacaggtgggct

SEQ ID NO: 715463 - DNA, 22 bp, Artificial Sequence
  chemically synthesized
ctgacactggaatcacaggtgg

SEQ ID NO: 715464 - DNA, 22 bp, Artificial Sequence
  chemically synthesized
ctgctgacactggaatcacagg

SEQ ID NO: 715465 - DNA, 22 bp, Artificial Sequence
  chemically synthesized
gtcagcccacctgtgattccag

SEQ ID NO: 715466 - DNA, 22 bp, Artificial Sequence
  chemically synthesized
tcagcccacctgtgattccagt

SEQ ID NO: 715467 - DNA, 22 bp, Artificial Sequence
  chemically synthesized
tgattccagtgtcagcagtagt

SEQ ID NO: 715468 - DNA, 22 bp, Artificial Sequence
  chemically synthesized
cacagaaccgtccactactgct

SEQ ID NO: 715469 - DNA, 22 bp, Artificial Sequence
  chemically synthesized
gcacagaaccgtccactactgc

SEQ ID NO: 715470 - DNA, 22 bp, Artificial Sequence
  chemically synthesized
cagtgtcagcagtagtggacgg

SEQ ID NO: 715471 - DNA, 22 bp, Artificial Sequence
  chemically synthesized
gaacttgcacagaaccgtccac

SEQ ID NO: 715472 - DNA, 22 bp, Artificial Sequence
  chemically synthesized
tacagcacgagttagaacttgc

SEQ ID NO: 715473 - DNA, 22 bp, Artificial Sequence
  chemically synthesized
gctatacagcacgagttagaac

SEQ ID NO: 715474 - DNA, 22 bp, Artificial Sequence
  chemically synthesized
tgtgcaagttctaactcgtgct

SEQ ID NO: 715475 - DNA, 22 bp, Artificial Sequence
  chemically synthesized
tgcaagttctaactcgtgctgt

SEQ ID NO: 715476 - DNA, 22 bp, Artificial Sequence
  chemically synthesized
agaagggatgctggctatacag

SEQ ID NO: 715477 - DNA, 22 bp, Artificial Sequence
  chemically synthesized
gagaagggatgctggctataca

SEQ ID NO: 715478 - DNA, 22 bp, Artificial Sequence
  chemically synthesized
tgagaagggatgctggctatac

SEQ ID NO: 715479 - DNA, 22 bp, Artificial Sequence
  chemically synthesized
taactcgtgctgtatagccagc

SEQ ID NO: 715480 - DNA, 22 bp, Artificial Sequence
  chemically synthesized
ttgagaagggatgctggctata

SEQ ID NO: 715481 - DNA, 22 bp, Artificial Sequence
  chemically synthesized
actcgtgctgtatagccagcat

SEQ ID NO: 715482 - DNA, 22 bp, Artificial Sequence
  chemically synthesized
gtgctgtatagccagcatccct

SEQ ID NO: 715483 - DNA, 22 bp, Artificial Sequence
  chemically synthesized
agggatcccttttgagaaggga

SEQ ID NO: 715484 - DNA, 22 bp, Artificial Sequence
  chemically synthesized
tatagccagcatcccttctcaa

SEQ ID NO: 715485 - DNA, 22 bp, Artificial Sequence
  chemically synthesized
aaaggctcagggatcccttttg

SEQ ID NO: 715486 - DNA, 22 bp, Artificial Sequence
  chemically synthesized
ctcaaaagggatccctgagcct

SEQ ID NO: 715487 - DNA, 22 bp, Artificial Sequence
  chemically synthesized
tcaaaagggatccctgagcctt

SEQ ID NO: 715488 - DNA, 22 bp, Artificial Sequence
  chemically synthesized
aaaagggatccctgagcctttc

SEQ ID NO: 715489 - DNA, 22 bp, Artificial Sequence
  chemically synthesized
gaacagaaagctgaaaggctca

SEQ ID NO: 715490 - DNA, 22 bp, Artificial Sequence
  chemically synthesized
agcctttcagctttctgttcta

SEQ ID NO: 715491 - DNA, 22 bp, Artificial Sequence
  chemically synthesized
tcagctttctgttctaggttcc

SEQ ID NO: 715492 - DNA, 22 bp, Artificial Sequence
  chemically synthesized
cagctttctgttctaggttccc

SEQ ID NO: 715493 - DNA, 22 bp, Artificial Sequence
  chemically synthesized
agctttctgttctaggttcccc

SEQ ID NO: 715494 - DNA, 22 bp, Artificial Sequence
  chemically synthesized
tctgttctaggttcccctgacc

SEQ ID NO: 715495 - DNA, 22 bp, Artificial Sequence
  chemically synthesized
ccatgtcatgggggtcagggga

SEQ ID NO: 715496 - DNA, 22 bp, Artificial Sequence
  chemically synthesized
ctgttctaggttcccctgaccc

SEQ ID NO: 715497 - DNA, 22 bp, Artificial Sequence
  chemically synthesized
tgttctaggttcccctgacccc

SEQ ID NO: 715498 - DNA, 22 bp, Artificial Sequence
  chemically synthesized
ttctaggttcccctgaccccca

SEQ ID NO: 715499 - DNA, 22 bp, Artificial Sequence
  chemically synthesized
taggttcccctgacccccatga

SEQ ID NO: 715500 - DNA, 22 bp, Artificial Sequence
  chemically synthesized
ggttcccctgacccccatgaca

SEQ ID NO: 715501 - DNA, 22 bp, Artificial Sequence
  chemically synthesized
ccctgacccccatgacatggga

SEQ ID NO: 715502 - DNA, 22 bp, Artificial Sequence
  chemically synthesized
cccacccaggaagctcccatgt

SEQ ID NO: 715503 - DNA, 22 bp, Artificial Sequence
  chemically synthesized
gcccacccaggaagctcccatg

SEQ ID NO: 715504 - DNA, 22 bp, Artificial Sequence
  chemically synthesized
acccccatgacatgggagcttc

SEQ ID NO: 715505 - DNA, 22 bp, Artificial Sequence
  chemically synthesized
tgcttgcccacccaggaagctc

SEQ ID NO: 715506 - DNA, 22 bp, Artificial Sequence
  chemically synthesized
gctatgcttgcccacccaggaa

SEQ ID NO: 715507 - DNA, 22 bp, Artificial Sequence
  chemically synthesized
tggctggctatgcttgcccacc

SEQ ID NO: 715508 - DNA, 22 bp, Artificial Sequence
  chemically synthesized
acccctgtggctggctatgctt

SEQ ID NO: 715509 - DNA, 22 bp, Artificial Sequence
  chemically synthesized
cctgggtgggcaagcatagcca

SEQ ID NO: 715510 - DNA, 22 bp, Artificial Sequence
  chemically synthesized
ctgggtgggcaagcatagccag

SEQ ID NO: 715511 - DNA, 22 bp, Artificial Sequence
  chemically synthesized
ggtgggcaagcatagccagcca

SEQ ID NO: 715512 - DNA, 22 bp, Artificial Sequence
  chemically synthesized
ccaaagcactaacccctgtggc

SEQ ID NO: 715513 - DNA, 22 bp, Artificial Sequence
  chemically synthesized
ctgccaaagcactaacccctgt

SEQ ID NO: 715514 - DNA, 22 bp, Artificial Sequence
  chemically synthesized
ggaggggaaaaagagaattgct

SEQ ID NO: 715515 - DNA, 22 bp, Artificial Sequence
  chemically synthesized
gtgctttggcagcaattctctt

SEQ ID NO: 715516 - DNA, 22 bp, Artificial Sequence
  chemically synthesized
tggcagcaattctctttttccc

SEQ ID NO: 715517 - DNA, 22 bp, Artificial Sequence
  chemically synthesized
ggcagcaattctctttttcccc

SEQ ID NO: 715518 - DNA, 22 bp, Artificial Sequence
  chemically synthesized
gcagcaattctctttttcccct

SEQ ID NO: 715519 - DNA, 22 bp, Artificial Sequence
  chemically synthesized
tgcagaagttgggaggggaaaa

SEQ ID NO: 715520 - DNA, 22 bp, Artificial Sequence
  chemically synthesized
tctttttcccctcccaacttct

SEQ ID NO: 715521 - DNA, 22 bp, Artificial Sequence
  chemically synthesized
tttttcccctcccaacttctgc

SEQ ID NO: 715522 - DNA, 22 bp, Artificial Sequence
  chemically synthesized
aataaacactgtgcagaagttg

SEQ ID NO: 715523 - DNA, 22 bp, Artificial Sequence
  chemically synthesized
tttcccctcccaacttctgcac

SEQ ID NO: 715524 - DNA, 22 bp, Artificial Sequence
  chemically synthesized
ttcccctcccaacttctgcaca

SEQ ID NO: 715525 - DNA, 22 bp, Artificial Sequence
  chemically synthesized
tcccctcccaacttctgcacag

SEQ ID NO: 715526 - DNA, 22 bp, Artificial Sequence
  chemically synthesized
cccctcccaacttctgcacagt

SEQ ID NO: 715527 - DNA, 22 bp, Artificial Sequence
  chemically synthesized
ccctcccaacttctgcacagtg

SEQ ID NO: 715528 - DNA, 22 bp, Artificial Sequence
  chemically synthesized
ccaacttctgcacagtgtttat

SEQ ID NO: 715529 - DNA, 22 bp, Artificial Sequence
  chemically synthesized
ctgcacagtgtttattgagctt

SEQ ID NO: 715530 - DNA, 22 bp, Artificial Sequence
  chemically synthesized
tatgatatgagtaagctcaata

SEQ ID NO: 715531 - DNA, 22 bp, Artificial Sequence
  chemically synthesized
tgcacagtgtttattgagctta

SEQ ID NO: 715532 - DNA, 22 bp, Artificial Sequence
  chemically synthesized
cacagtgtttattgagcttact

SEQ ID NO: 715533 - DNA, 22 bp, Artificial Sequence
  chemically synthesized
tgaactatatgatatgagtaag

SEQ ID NO: 715534 - DNA, 22 bp, Artificial Sequence
  chemically synthesized
attgagcttactcatatcatat

SEQ ID NO: 715535 - DNA, 22 bp, Artificial Sequence
  chemically synthesized
ttgagcttactcatatcatata

SEQ ID NO: 715536 - DNA, 22 bp, Artificial Sequence
  chemically synthesized
tcaaagctgtgaactatatgat

SEQ ID NO: 715537 - DNA, 22 bp, Artificial Sequence
  chemically synthesized
agcttactcatatcatatagtt

SEQ ID NO: 715538 - DNA, 22 bp, Artificial Sequence
  chemically synthesized
tatcaaagctgtgaactatatg

SEQ ID NO: 715539 - DNA, 22 bp, Artificial Sequence
  chemically synthesized
ctatcaaagctgtgaactatat

SEQ ID NO: 715540 - DNA, 22 bp, Artificial Sequence
  chemically synthesized
tctatcaaagctgtgaactata

SEQ ID NO: 715541 - DNA, 22 bp, Artificial Sequence
  chemically synthesized
ttctatcaaagctgtgaactat

SEQ ID NO: 715542 - DNA, 22 bp, Artificial Sequence
  chemically synthesized
actcatatcatatagttcacag

SEQ ID NO: 715543 - DNA, 22 bp, Artificial Sequence
  chemically synthesized
ctcatatcatatagttcacagc

SEQ ID NO: 715544 - DNA, 22 bp, Artificial Sequence
  chemically synthesized
atatcatatagttcacagcttt

SEQ ID NO: 715545 - DNA, 22 bp, Artificial Sequence
  chemically synthesized
acagctttgatagaaaaacttc

SEQ ID NO: 715546 - DNA, 22 bp, Artificial Sequence
  chemically synthesized
tgatagaaaaacttcttgtttc

SEQ ID NO: 715547 - DNA, 22 bp, Artificial Sequence
  chemically synthesized
gatagaaaaacttcttgtttcc

SEQ ID NO: 715548 - DNA, 22 bp, Artificial Sequence
  chemically synthesized
atagaaaaacttcttgtttcct

SEQ ID NO: 715549 - DNA, 22 bp, Artificial Sequence
  chemically synthesized
agtataaatacaaaaaggaaac

SEQ ID NO: 715550 - DNA, 22 bp, Artificial Sequence
  chemically synthesized
cttgtttcctttttgtatttat

SEQ ID NO: 715551 - DNA, 22 bp, Artificial Sequence
  chemically synthesized
ttgtttcctttttgtatttata

SEQ ID NO: 715552 - DNA, 22 bp, Artificial Sequence
  chemically synthesized
gtttcctttttgtatttatact

SEQ ID NO: 715553 - DNA, 22 bp, Artificial Sequence
  chemically synthesized
tttcctttttgtatttatactt

SEQ ID NO: 715554 - DNA, 22 bp, Artificial Sequence
  chemically synthesized
cctttttgtatttatacttaga

SEQ ID NO: 715555 - DNA, 22 bp, Artificial Sequence
  chemically synthesized
ctttttgtatttatacttagat

SEQ ID NO: 715556 - DNA, 22 bp, Artificial Sequence
  chemically synthesized
tttgtatttatacttagatttt

SEQ ID NO: 715557 - DNA, 22 bp, Artificial Sequence
  chemically synthesized
aaaacaatgtagaaaatctaag

SEQ ID NO: 715558 - DNA, 22 bp, Artificial Sequence
  chemically synthesized
ttgtatttatacttagattttc

SEQ ID NO: 715559 - DNA, 22 bp, Artificial Sequence
  chemically synthesized
tgtatttatacttagattttct

SEQ ID NO: 715560 - DNA, 22 bp, Artificial Sequence
  chemically synthesized
gtatttatacttagattttcta

SEQ ID NO: 715561 - DNA, 22 bp, Artificial Sequence
  chemically synthesized
tatttatacttagattttctac

SEQ ID NO: 715562 - DNA, 22 bp, Artificial Sequence
  chemically synthesized
atacttagattttctacattgt

SEQ ID NO: 715563 - DNA, 22 bp, Artificial Sequence
  chemically synthesized
tacttagattttctacattgtt

SEQ ID NO: 715564 - DNA, 22 bp, Artificial Sequence
  chemically synthesized
agattttctacattgttttgaa

SEQ ID NO: 715565 - DNA, 22 bp, Artificial Sequence
  chemically synthesized
gattttctacattgttttgaat

SEQ ID NO: 715566 - DNA, 22 bp, Artificial Sequence
  chemically synthesized
acacaacgtcggaaagattcaa

SEQ ID NO: 715567 - DNA, 22 bp, Artificial Sequence
  chemically synthesized
tctacattgttttgaatctttc

SEQ ID NO: 715568 - DNA, 22 bp, Artificial Sequence
  chemically synthesized
cacacaacgtcggaaagattca

SEQ ID NO: 715569 - DNA, 22 bp, Artificial Sequence
  chemically synthesized
ctacattgttttgaatctttcc

SEQ ID NO: 715570 - DNA, 22 bp, Artificial Sequence
  chemically synthesized
tacattgttttgaatctttccg

SEQ ID NO: 715571 - DNA, 22 bp, Artificial Sequence
  chemically synthesized
cattgttttgaatctttccgac

SEQ ID NO: 715572 - DNA, 22 bp, Artificial Sequence
  chemically synthesized
aacttcacacaacgtcggaaag

SEQ ID NO: 715573 - DNA, 22 bp, Artificial Sequence
  chemically synthesized
tgaacttcacacaacgtcggaa

SEQ ID NO: 715574 - DNA, 22 bp, Artificial Sequence
  chemically synthesized
ttttgaatctttccgacgttgt

SEQ ID NO: 715575 - DNA, 22 bp, Artificial Sequence
  chemically synthesized
ctctgaacttcacacaacgtcg

SEQ ID NO: 715576 - DNA, 22 bp, Artificial Sequence
  chemically synthesized
tgaatctttccgacgttgtgtg

SEQ ID NO: 715577 - DNA, 22 bp, Artificial Sequence
  chemically synthesized
gaatctttccgacgttgtgtga

SEQ ID NO: 715578 - DNA, 22 bp, Artificial Sequence
  chemically synthesized
aatctttccgacgttgtgtgaa

SEQ ID NO: 715579 - DNA, 22 bp, Artificial Sequence
  chemically synthesized
cgctgctctgaacttcacacaa

SEQ ID NO: 715580 - DNA, 22 bp, Artificial Sequence
  chemically synthesized
ccgctgctctgaacttcacaca

SEQ ID NO: 715581 - DNA, 22 bp, Artificial Sequence
  chemically synthesized
tccgctgctctgaacttcacac

SEQ ID NO: 715582 - DNA, 22 bp, Artificial Sequence
  chemically synthesized
ttccgctgctctgaacttcaca

SEQ ID NO: 715583 - DNA, 22 bp, Artificial Sequence
  chemically synthesized
tccgacgttgtgtgaagttcag

SEQ ID NO: 715584 - DNA, 22 bp, Artificial Sequence
  chemically synthesized
ccgacgttgtgtgaagttcaga

SEQ ID NO: 715585 - DNA, 22 bp, Artificial Sequence
  chemically synthesized
cgacgttgtgtgaagttcagag

SEQ ID NO: 715586 - DNA, 22 bp, Artificial Sequence
  chemically synthesized
ccttttccgctgctctgaactt

SEQ ID NO: 715587 - DNA, 22 bp, Artificial Sequence
  chemically synthesized
tgtgaagttcagagcagcggaa

SEQ ID NO: 715588 - DNA, 22 bp, Artificial Sequence
  chemically synthesized
cagtgcacccctgccttttccg

SEQ ID NO: 715589 - DNA, 22 bp, Artificial Sequence
  chemically synthesized
tccagtgcacccctgccttttc

SEQ ID NO: 715590 - DNA, 22 bp, Artificial Sequence
  chemically synthesized
agagcagcggaaaaggcagggg

SEQ ID NO: 715591 - DNA, 22 bp, Artificial Sequence
  chemically synthesized
agtgggacacatcctctccagt

SEQ ID NO: 715592 - DNA, 22 bp, Artificial Sequence
  chemically synthesized
gatctgagtgggacacatcctc

SEQ ID NO: 715593 - DNA, 22 bp, Artificial Sequence
  chemically synthesized
gagaggatgtgtcccactcaga

SEQ ID NO: 715594 - DNA, 22 bp, Artificial Sequence
  chemically synthesized
atatgggcaagcattggatctg

SEQ ID NO: 715595 - DNA, 22 bp, Artificial Sequence
  chemically synthesized
atctgatatgggcaagcattgg

SEQ ID NO: 715596 - DNA, 22 bp, Artificial Sequence
  chemically synthesized
catctgatatgggcaagcattg

SEQ ID NO: 715597 - DNA, 22 bp, Artificial Sequence
  chemically synthesized
tcatctgatatgggcaagcatt

SEQ ID NO: 715598 - DNA, 22 bp, Artificial Sequence
  chemically synthesized
ttcatctgatatgggcaagcat

SEQ ID NO: 715599 - DNA, 22 bp, Artificial Sequence
  chemically synthesized
tttcatctgatatgggcaagca

SEQ ID NO: 715600 - DNA, 22 bp, Artificial Sequence
  chemically synthesized
ctttttcatctgatatgggcaa

SEQ ID NO: 715601 - DNA, 22 bp, Artificial Sequence
  chemically synthesized
agatccaatgcttgcccatatc

SEQ ID NO: 715602 - DNA, 22 bp, Artificial Sequence
  chemically synthesized
attcctttttcatctgatatgg

SEQ ID NO: 715603 - DNA, 22 bp, Artificial Sequence
  chemically synthesized
agaattgattcctttttcatct

SEQ ID NO: 715604 - DNA, 22 bp, Artificial Sequence
  chemically synthesized
gcccatatcagatgaaaaagga

SEQ ID NO: 715605 - DNA, 22 bp, Artificial Sequence
  chemically synthesized
cccatatcagatgaaaaaggaa

SEQ ID NO: 715606 - DNA, 22 bp, Artificial Sequence
  chemically synthesized
gttgagaattgattcctttttc

SEQ ID NO: 715607 - DNA, 22 bp, Artificial Sequence
  chemically synthesized
ccactggttgagaattgattcc

SEQ ID NO: 715608 - DNA, 22 bp, Artificial Sequence
  chemically synthesized
ctcccactggttgagaattgat

SEQ ID NO: 715609 - DNA, 22 bp, Artificial Sequence
  chemically synthesized
ctgctcccactggttgagaatt

SEQ ID NO: 715610 - DNA, 22 bp, Artificial Sequence
  chemically synthesized
ctcctgctcccactggttgaga

SEQ ID NO: 715611 - DNA, 22 bp, Artificial Sequence
  chemically synthesized
tcaaccagtgggagcaggagca

SEQ ID NO: 715612 - DNA, 22 bp, Artificial Sequence
  chemically synthesized
aaccagtgggagcaggagcagg

SEQ ID NO: 715613 - DNA, 22 bp, Artificial Sequence
  chemically synthesized
aaatatggaaagccagagcatg

SEQ ID NO: 715614 - DNA, 22 bp, Artificial Sequence
  chemically synthesized
cagcctgaaatatggaaagcca

SEQ ID NO: 715615 - DNA, 22 bp, Artificial Sequence
  chemically synthesized
tggctttccatatttcaggctg

SEQ ID NO: 715616 - DNA, 22 bp, Artificial Sequence
  chemically synthesized
gctttccatatttcaggctgta

SEQ ID NO: 715617 - DNA, 22 bp, Artificial Sequence
  chemically synthesized
gatataggtagctacagcctga

SEQ ID NO: 715618 - DNA, 22 bp, Artificial Sequence
  chemically synthesized
tccatatttcaggctgtagcta

SEQ ID NO: 715619 - DNA, 22 bp, Artificial Sequence
  chemically synthesized
ccatatttcaggctgtagctac

SEQ ID NO: 715620 - DNA, 22 bp, Artificial Sequence
  chemically synthesized
catatttcaggctgtagctacc

SEQ ID NO: 715621 - DNA, 22 bp, Artificial Sequence
  chemically synthesized
caggctgtagctacctatatcc

SEQ ID NO: 715622 - DNA, 22 bp, Artificial Sequence
  chemically synthesized
aggctgtagctacctatatcca

SEQ ID NO: 715623 - DNA, 22 bp, Artificial Sequence
  chemically synthesized
tagctacctatatccagatttg

SEQ ID NO: 715624 - DNA, 22 bp, Artificial Sequence
  chemically synthesized
cctatatccagatttgttttct

SEQ ID NO: 715625 - DNA, 22 bp, Artificial Sequence
  chemically synthesized
agaagtgtacagaagaaaacaa

SEQ ID NO: 715626 - DNA, 22 bp, Artificial Sequence
  chemically synthesized
tatccagatttgttttcttctg

SEQ ID NO: 715627 - DNA, 22 bp, Artificial Sequence
  chemically synthesized
ttgagaagtgtacagaagaaaa

SEQ ID NO: 715628 - DNA, 22 bp, Artificial Sequence
  chemically synthesized
gaactgttgagaagtgtacaga

SEQ ID NO: 715629 - DNA, 22 bp, Artificial Sequence
  chemically synthesized
tggaactgttgagaagtgtaca

SEQ ID NO: 715630 - DNA, 22 bp, Artificial Sequence
  chemically synthesized
tctggaactgttgagaagtgta

SEQ ID NO: 715631 - DNA, 22 bp, Artificial Sequence
  chemically synthesized
gttttcttctgtacacttctca

SEQ ID NO: 715632 - DNA, 22 bp, Artificial Sequence
  chemically synthesized
ttttcttctgtacacttctcaa

SEQ ID NO: 715633 - DNA, 22 bp, Artificial Sequence
  chemically synthesized
tcttctgtacacttctcaacag

SEQ ID NO: 715634 - DNA, 22 bp, Artificial Sequence
  chemically synthesized
cttctgtacacttctcaacagt

SEQ ID NO: 715635 - DNA, 22 bp, Artificial Sequence
  chemically synthesized
ttctgtacacttctcaacagtt

SEQ ID NO: 715636 - DNA, 22 bp, Artificial Sequence
  chemically synthesized
ctgtacacttctcaacagttcc

SEQ ID NO: 715637 - DNA, 22 bp, Artificial Sequence
  chemically synthesized
tgtacacttctcaacagttcca

SEQ ID NO: 715638 - DNA, 22 bp, Artificial Sequence
  chemically synthesized
tacacttctcaacagttccaga

SEQ ID NO: 715639 - DNA, 22 bp, Artificial Sequence
  chemically synthesized
ctcaacagttccagagaattgc

SEQ ID NO: 715640 - DNA, 22 bp, Artificial Sequence
  chemically synthesized
tcaacagttccagagaattgct

SEQ ID NO: 715641 - DNA, 22 bp, Artificial Sequence
  chemically synthesized
aacagttccagagaattgctca

SEQ ID NO: 715642 - DNA, 22 bp, Artificial Sequence
  chemically synthesized
cagagaattgctcatctttctt

SEQ ID NO: 715643 - DNA, 22 bp, Artificial Sequence
  chemically synthesized
ctcatctttctttgtcgcttca

SEQ ID NO: 715644 - DNA, 22 bp, Artificial Sequence
  chemically synthesized
atctttctttgtcgcttcattc

SEQ ID NO: 715645 - DNA, 22 bp, Artificial Sequence
  chemically synthesized
tctttgtcgcttcattcttctt

SEQ ID NO: 715646 - DNA, 22 bp, Artificial Sequence
  chemically synthesized
ctttgtcgcttcattcttcttg

SEQ ID NO: 715647 - DNA, 22 bp, Artificial Sequence
  chemically synthesized
tttgtcgcttcattcttcttgt

SEQ ID NO: 715648 - DNA, 22 bp, Artificial Sequence
  chemically synthesized
tgtcgcttcattcttcttgttc

SEQ ID NO: 715649 - DNA, 22 bp, Artificial Sequence
  chemically synthesized
gtcgcttcattcttcttgttct

SEQ ID NO: 715650 - DNA, 22 bp, Artificial Sequence
  chemically synthesized
tcgcttcattcttcttgttctc

SEQ ID NO: 715651 - DNA, 22 bp, Artificial Sequence
  chemically synthesized
agaagcaggaataagagaacaa

SEQ ID NO: 715652 - DNA, 22 bp, Artificial Sequence
  chemically synthesized
taagaagcaggaataagagaac

SEQ ID NO: 715653 - DNA, 22 bp, Artificial Sequence
  chemically synthesized
cattcttcttgttctcttattc

SEQ ID NO: 715654 - DNA, 22 bp, Artificial Sequence
  chemically synthesized
attcttcttgttctcttattcc

SEQ ID NO: 715655 - DNA, 22 bp, Artificial Sequence
  chemically synthesized
ttcttgttctcttattcctgct

SEQ ID NO: 715656 - DNA, 22 bp, Artificial Sequence
  chemically synthesized
cttgttctcttattcctgcttc

SEQ ID NO: 715657 - DNA, 22 bp, Artificial Sequence
  chemically synthesized
ttgttctcttattcctgcttct

SEQ ID NO: 715658 - DNA, 22 bp, Artificial Sequence
  chemically synthesized
gttctcttattcctgcttctta

SEQ ID NO: 715659 - DNA, 22 bp, Artificial Sequence
  chemically synthesized
ttctcttattcctgcttcttag

SEQ ID NO: 715660 - DNA, 22 bp, Artificial Sequence
  chemically synthesized
ggtgcaagtaattctaagaagc

SEQ ID NO: 715661 - DNA, 22 bp, Artificial Sequence
  chemically synthesized
tcttattcctgcttcttagaat

SEQ ID NO: 715662 - DNA, 22 bp, Artificial Sequence
  chemically synthesized
ttattcctgcttcttagaatta

SEQ ID NO: 715663 - DNA, 22 bp, Artificial Sequence
  chemically synthesized
attcctgcttcttagaattact

SEQ ID NO: 715664 - DNA, 22 bp, Artificial Sequence
  chemically synthesized
ttcctgcttcttagaattactt

SEQ ID NO: 715665 - DNA, 22 bp, Artificial Sequence
  chemically synthesized
ctgcttcttagaattacttgca

SEQ ID NO: 715666 - DNA, 22 bp, Artificial Sequence
  chemically synthesized
cttcttagaattacttgcaccc

SEQ ID NO: 715667 - DNA, 22 bp, Artificial Sequence
  chemically synthesized
cttagaattacttgcacccagg

SEQ ID NO: 715668 - DNA, 22 bp, Artificial Sequence
  chemically synthesized
ttagaattacttgcacccaggt

SEQ ID NO: 715669 - DNA, 22 bp, Artificial Sequence
  chemically synthesized
agaattacttgcacccaggtcc

SEQ ID NO: 715670 - DNA, 22 bp, Artificial Sequence
  chemically synthesized
gaattacttgcacccaggtccc

SEQ ID NO: 715671 - DNA, 22 bp, Artificial Sequence
  chemically synthesized
aaaaaaaaaagggcggggggac

SEQ ID NO: 715672 - DNA, 22 bp, Artificial Sequence
  chemically synthesized
cttgcacccaggtccccccgcc

SEQ ID NO: 715673 - DNA, 22 bp, Artificial Sequence
  chemically synthesized
gcacccaggtccccccgccctt

SEQ ID NO: 715674 - DNA, 22 bp, Artificial Sequence
  chemically synthesized
tctcaaaaaaaaaagggcgggg

SEQ ID NO: 715675 - DNA, 22 bp, Artificial Sequence
  chemically synthesized
cacccaggtccccccgcccttt

SEQ ID NO: 715676 - DNA, 22 bp, Artificial Sequence
  chemically synthesized
tgtctcaaaaaaaaaagggcgg

SEQ ID NO: 715677 - DNA, 22 bp, Artificial Sequence
  chemically synthesized
ggcgacagagcaagactctgtc

SEQ ID NO: 715678 - DNA, 22 bp, Artificial Sequence
  chemically synthesized
ttttttttgagacagagtcttg

SEQ ID NO: 715679 - DNA, 22 bp, Artificial Sequence
  chemically synthesized
tttttttgagacagagtcttgc

SEQ ID NO: 715680 - DNA, 22 bp, Artificial Sequence
  chemically synthesized
ttttttgagacagagtcttgct

SEQ ID NO: 715681 - DNA, 22 bp, Artificial Sequence
  chemically synthesized
tttttgagacagagtcttgctc

SEQ ID NO: 715682 - DNA, 22 bp, Artificial Sequence
  chemically synthesized
ttttgagacagagtcttgctct

SEQ ID NO: 715683 - DNA, 22 bp, Artificial Sequence
  chemically synthesized
tttgagacagagtcttgctctg

SEQ ID NO: 715684 - DNA, 22 bp, Artificial Sequence
  chemically synthesized
cagcctgggcgacagagcaaga

SEQ ID NO: 715685 - DNA, 22 bp, Artificial Sequence
  chemically synthesized
ttgagacagagtcttgctctgt

SEQ ID NO: 715686 - DNA, 22 bp, Artificial Sequence
  chemically synthesized
tgagacagagtcttgctctgtc

SEQ ID NO: 715687 - DNA, 22 bp, Artificial Sequence
  chemically synthesized
gagacagagtcttgctctgtcg

SEQ ID NO: 715688 - DNA, 22 bp, Artificial Sequence
  chemically synthesized
agacagagtcttgctctgtcgc

SEQ ID NO: 715689 - DNA, 22 bp, Artificial Sequence
  chemically synthesized
cactccagcctgggcgacagag

SEQ ID NO: 715690 - DNA, 22 bp, Artificial Sequence
  chemically synthesized
caccactgcactccagcctggg

SEQ ID NO: 715691 - DNA, 22 bp, Artificial Sequence
  chemically synthesized
gctctgtcgcccaggctggagt

SEQ ID NO: 715692 - DNA, 22 bp, Artificial Sequence
  chemically synthesized
ctctgtcgcccaggctggagtg

SEQ ID NO: 715693 - DNA, 22 bp, Artificial Sequence
  chemically synthesized
tgtcgcccaggctggagtgcag

SEQ ID NO: 715694 - DNA, 22 bp, Artificial Sequence
  chemically synthesized
tcgcccaggctggagtgcagtg

SEQ ID NO: 715695 - DNA, 22 bp, Artificial Sequence
  chemically synthesized
agccgagattgcaccactgcac

SEQ ID NO: 715696 - DNA, 22 bp, Artificial Sequence
  chemically synthesized
cactgagccgagattgcaccac

SEQ ID NO: 715697 - DNA, 22 bp, Artificial Sequence
  chemically synthesized
gagtgcagtggtgcaatctcgg

SEQ ID NO: 715698 - DNA, 22 bp, Artificial Sequence
  chemically synthesized
aacccgggaggcagaggctgca

SEQ ID NO: 715699 - DNA, 22 bp, Artificial Sequence
  chemically synthesized
gaacccgggaggcagaggctgc

SEQ ID NO: 715700 - DNA, 22 bp, Artificial Sequence
  chemically synthesized
ttgaacccgggaggcagaggct

SEQ ID NO: 715701 - DNA, 22 bp, Artificial Sequence
  chemically synthesized
ggctcagtgcagcctctgcctc

SEQ ID NO: 715702 - DNA, 22 bp, Artificial Sequence
  chemically synthesized
agtgcagcctctgcctcccggg

SEQ ID NO: 715703 - DNA, 22 bp, Artificial Sequence
  chemically synthesized
agacaggagaatctcttgaacc

SEQ ID NO: 715704 - DNA, 22 bp, Artificial Sequence
  chemically synthesized
tgcctcccgggttcaagagatt

SEQ ID NO: 715705 - DNA, 22 bp, Artificial Sequence
  chemically synthesized
cctcccgggttcaagagattct

SEQ ID NO: 715706 - DNA, 22 bp, Artificial Sequence
  chemically synthesized
ggaggctgagacaggagaatct

SEQ ID NO: 715707 - DNA, 22 bp, Artificial Sequence
  chemically synthesized
ccgggttcaagagattctcctg

SEQ ID NO: 715708 - DNA, 22 bp, Artificial Sequence
  chemically synthesized
gggaggctgagacaggagaatc

SEQ ID NO: 715709 - DNA, 22 bp, Artificial Sequence
  chemically synthesized
cttgggaggctgagacaggaga

SEQ ID NO: 715710 - DNA, 22 bp, Artificial Sequence
  chemically synthesized
aagagattctcctgtctcagcc

SEQ ID NO: 715711 - DNA, 22 bp, Artificial Sequence
  chemically synthesized
taatcccagctacttgggaggc

SEQ ID NO: 715712 - DNA, 22 bp, Artificial Sequence
  chemically synthesized
tcctgtctcagcctcccaagta

SEQ ID NO: 715713 - DNA, 22 bp, Artificial Sequence
  chemically synthesized
ctgtctcagcctcccaagtagc

SEQ ID NO: 715714 - DNA, 22 bp, Artificial Sequence
  chemically synthesized
tctcagcctcccaagtagctgg

SEQ ID NO: 715715 - DNA, 22 bp, Artificial Sequence
  chemically synthesized
agcctcccaagtagctgggatt

SEQ ID NO: 715716 - DNA, 22 bp, Artificial Sequence
  chemically synthesized
gtggcacacacctgtaatccca

SEQ ID NO: 715717 - DNA, 22 bp, Artificial Sequence
  chemically synthesized
ggtggcacacacctgtaatccc

SEQ ID NO: 715718 - DNA, 22 bp, Artificial Sequence
  chemically synthesized
ccaagtagctgggattacaggt

SEQ ID NO: 715719 - DNA, 22 bp, Artificial Sequence
  chemically synthesized
ggcttggtggcacacacctgta

SEQ ID NO: 715720 - DNA, 22 bp, Artificial Sequence
  chemically synthesized
gctgggcttggtggcacacacc

SEQ ID NO: 715721 - DNA, 22 bp, Artificial Sequence
  chemically synthesized
ggattacaggtgtgtgccacca

SEQ ID NO: 715722 - DNA, 22 bp, Artificial Sequence
  chemically synthesized
caggtgtgtgccaccaagccca

SEQ ID NO: 715723 - DNA, 22 bp, Artificial Sequence
  chemically synthesized
aaaatacaaaaattagctgggc

SEQ ID NO: 715724 - DNA, 22 bp, Artificial Sequence
  chemically synthesized
ctaaaaatacaaaaattagctg

SEQ ID NO: 715725 - DNA, 22 bp, Artificial Sequence
  chemically synthesized
tactaaaaatacaaaaattagc

SEQ ID NO: 715726 - DNA, 22 bp, Artificial Sequence
  chemically synthesized
tctctactaaaaatacaaaaat

SEQ ID NO: 715727 - DNA, 22 bp, Artificial Sequence
  chemically synthesized
atttttgtatttttagtagaga

SEQ ID NO: 715728 - DNA, 22 bp, Artificial Sequence
  chemically synthesized
ttgtatttttagtagagacagg

SEQ ID NO: 715729 - DNA, 22 bp, Artificial Sequence
  chemically synthesized
tgtatttttagtagagacaggg

SEQ ID NO: 715730 - DNA, 22 bp, Artificial Sequence
  chemically synthesized
gtatttttagtagagacagggt

SEQ ID NO: 715731 - DNA, 22 bp, Artificial Sequence
  chemically synthesized
tatttttagtagagacagggtt

SEQ ID NO: 715732 - DNA, 22 bp, Artificial Sequence
  chemically synthesized
gccaacatggtgaaaccctgtc

SEQ ID NO: 715733 - DNA, 22 bp, Artificial Sequence
  chemically synthesized
ttagtagagacagggtttcacc

SEQ ID NO: 715734 - DNA, 22 bp, Artificial Sequence
  chemically synthesized
tagtagagacagggtttcacca

SEQ ID NO: 715735 - DNA, 22 bp, Artificial Sequence
  chemically synthesized
agtagagacagggtttcaccat

SEQ ID NO: 715736 - DNA, 22 bp, Artificial Sequence
  chemically synthesized
gtagagacagggtttcaccatg

SEQ ID NO: 715737 - DNA, 22 bp, Artificial Sequence
  chemically synthesized
cagaccagcctggccaacatgg

SEQ ID NO: 715738 - DNA, 22 bp, Artificial Sequence
  chemically synthesized
caccatgttggccaggctggtc

SEQ ID NO: 715739 - DNA, 22 bp, Artificial Sequence
  chemically synthesized
accatgttggccaggctggtct

SEQ ID NO: 715740 - DNA, 22 bp, Artificial Sequence
  chemically synthesized
aggtcaggagttccagaccagc

SEQ ID NO: 715741 - DNA, 22 bp, Artificial Sequence
  chemically synthesized
gccaggctggtctggaactcct

SEQ ID NO: 715742 - DNA, 22 bp, Artificial Sequence
  chemically synthesized
gtctggaactcctgacctcagg

SEQ ID NO: 715743 - DNA, 22 bp, Artificial Sequence
  chemically synthesized
aggtgggcagatcacctgaggt

SEQ ID NO: 715744 - DNA, 22 bp, Artificial Sequence
  chemically synthesized
gaactcctgacctcaggtgatc

SEQ ID NO: 715745 - DNA, 22 bp, Artificial Sequence
  chemically synthesized
ggaggttgaggtgggcagatca

SEQ ID NO: 715746 - DNA, 22 bp, Artificial Sequence
  chemically synthesized
ctgacctcaggtgatctgccca

SEQ ID NO: 715747 - DNA, 22 bp, Artificial Sequence
  chemically synthesized
gggaggttgaggtgggcagatc

SEQ ID NO: 715748 - DNA, 22 bp, Artificial Sequence
  chemically synthesized
tgggaggttgaggtgggcagat

SEQ ID NO: 715749 - DNA, 22 bp, Artificial Sequence
  chemically synthesized
acctcaggtgatctgcccacct

SEQ ID NO: 715750 - DNA, 22 bp, Artificial Sequence
  chemically synthesized
aggtgatctgcccacctcaacc

SEQ ID NO: 715751 - DNA, 22 bp, Artificial Sequence
  chemically synthesized
taataccagtactttgggaggt

SEQ ID NO: 715752 - DNA, 22 bp, Artificial Sequence
  chemically synthesized
cccacctcaacctcccaaagta

SEQ ID NO: 715753 - DNA, 22 bp, Artificial Sequence
  chemically synthesized
atgcctgtaataccagtacttt

SEQ ID NO: 715754 - DNA, 22 bp, Artificial Sequence
  chemically synthesized
aacctcccaaagtactggtatt

SEQ ID NO: 715755 - DNA, 22 bp, Artificial Sequence
  chemically synthesized
ccaaagtactggtattacaggc

SEQ ID NO: 715756 - DNA, 22 bp, Artificial Sequence
  chemically synthesized
gggccgggcatggtggctcatg

SEQ ID NO: 715757 - DNA, 22 bp, Artificial Sequence
  chemically synthesized
gtattacaggcatgagccacca

SEQ ID NO: 715758 - DNA, 22 bp, Artificial Sequence
  chemically synthesized
caggcatgagccaccatgcccg

SEQ ID NO: 715759 - DNA, 22 bp, Artificial Sequence
  chemically synthesized
atcacagaatcaagaagggacc

SEQ ID NO: 715760 - DNA, 22 bp, Artificial Sequence
  chemically synthesized
cctcatcacagaatcaagaagg

SEQ ID NO: 715761 - DNA, 22 bp, Artificial Sequence
  chemically synthesized
tagtgaggggttacctcatcac

SEQ ID NO: 715762 - DNA, 22 bp, Artificial Sequence
  chemically synthesized
gtagtgaggggttacctcatca

SEQ ID NO: 715763 - DNA, 22 bp, Artificial Sequence
  chemically synthesized
tgtagtgaggggttacctcatc

SEQ ID NO: 715764 - DNA, 22 bp, Artificial Sequence
  chemically synthesized
cttgattctgtgatgaggtaac

SEQ ID NO: 715765 - DNA, 22 bp, Artificial Sequence
  chemically synthesized
ttgattctgtgatgaggtaacc

SEQ ID NO: 715766 - DNA, 22 bp, Artificial Sequence
  chemically synthesized
gattctgtgatgaggtaacccc

SEQ ID NO: 715767 - DNA, 22 bp, Artificial Sequence
  chemically synthesized
gctttgtagtgaggggttacct

SEQ ID NO: 715768 - DNA, 22 bp, Artificial Sequence
  chemically synthesized
attctgtgatgaggtaacccct

SEQ ID NO: 715769 - DNA, 22 bp, Artificial Sequence
  chemically synthesized
tgtgatgaggtaacccctcact

SEQ ID NO: 715770 - DNA, 22 bp, Artificial Sequence
  chemically synthesized
tgatgaggtaacccctcactac

SEQ ID NO: 715771 - DNA, 22 bp, Artificial Sequence
  chemically synthesized
agacctggctttgtagtgaggg

SEQ ID NO: 715772 - DNA, 22 bp, Artificial Sequence
  chemically synthesized
tcctaagacctggctttgtagt

SEQ ID NO: 715773 - DNA, 22 bp, Artificial Sequence
  chemically synthesized
actacaaagccaggtcttagga

SEQ ID NO: 715774 - DNA, 22 bp, Artificial Sequence
  chemically synthesized
caaagccaggtcttaggatagg

SEQ ID NO: 715775 - DNA, 22 bp, Artificial Sequence
  chemically synthesized
atgatggtgagacctatcctaa

SEQ ID NO: 715776 - DNA, 22 bp, Artificial Sequence
  chemically synthesized
aatgatggtgagacctatccta

SEQ ID NO: 715777 - DNA, 22 bp, Artificial Sequence
  chemically synthesized
aggataggtctcaccatcatta

SEQ ID NO: 715778 - DNA, 22 bp, Artificial Sequence
  chemically synthesized
ggataggtctcaccatcattaa

SEQ ID NO: 715779 - DNA, 22 bp, Artificial Sequence
  chemically synthesized
caagagtccaggtttaatgatg

SEQ ID NO: 715780 - DNA, 22 bp, Artificial Sequence
  chemically synthesized
tccaagagtccaggtttaatga

SEQ ID NO: 715781 - DNA, 22 bp, Artificial Sequence
  chemically synthesized
ctccaagagtccaggtttaatg

SEQ ID NO: 715782 - DNA, 22 bp, Artificial Sequence
  chemically synthesized
ccttctccaagagtccaggttt

SEQ ID NO: 715783 - DNA, 22 bp, Artificial Sequence
  chemically synthesized
gccttctccaagagtccaggtt

SEQ ID NO: 715784 - DNA, 22 bp, Artificial Sequence
  chemically synthesized
accatcattaaacctggactct

SEQ ID NO: 715785 - DNA, 22 bp, Artificial Sequence
  chemically synthesized
acatttgccttctccaagagtc

SEQ ID NO: 715786 - DNA, 22 bp, Artificial Sequence
  chemically synthesized
aacctggactcttggagaaggc

SEQ ID NO: 715787 - DNA, 22 bp, Artificial Sequence
  chemically synthesized
atggtattcacatttgccttct

SEQ ID NO: 715788 - DNA, 22 bp, Artificial Sequence
  chemically synthesized
aatggtattcacatttgccttc

SEQ ID NO: 715789 - DNA, 22 bp, Artificial Sequence
  chemically synthesized
taatggtattcacatttgcctt

SEQ ID NO: 715790 - DNA, 22 bp, Artificial Sequence
  chemically synthesized
gactcttggagaaggcaaatgt

SEQ ID NO: 715791 - DNA, 22 bp, Artificial Sequence
  chemically synthesized
ttaatggtattcacatttgcct

SEQ ID NO: 715792 - DNA, 22 bp, Artificial Sequence
  chemically synthesized
gtttttaatggtattcacattt

SEQ ID NO: 715793 - DNA, 22 bp, Artificial Sequence
  chemically synthesized
ttggagaaggcaaatgtgaata

SEQ ID NO: 715794 - DNA, 22 bp, Artificial Sequence
  chemically synthesized
tggtttttaatggtattcacat

SEQ ID NO: 715795 - DNA, 22 bp, Artificial Sequence
  chemically synthesized
ggagaaggcaaatgtgaatacc

SEQ ID NO: 715796 - DNA, 22 bp, Artificial Sequence
  chemically synthesized
gagaaggcaaatgtgaatacca

SEQ ID NO: 715797 - DNA, 22 bp, Artificial Sequence
  chemically synthesized
tcaacatcacagattctggttt

SEQ ID NO: 715798 - DNA, 22 bp, Artificial Sequence
  chemically synthesized
cactgtcaacatcacagattct

SEQ ID NO: 715799 - DNA, 22 bp, Artificial Sequence
  chemically synthesized
ccactgtcaacatcacagattc

SEQ ID NO: 715800 - DNA, 22 bp, Artificial Sequence
  chemically synthesized
tccactgtcaacatcacagatt

SEQ ID NO: 715801 - DNA, 22 bp, Artificial Sequence
  chemically synthesized
aaaaccagaatctgtgatgttg

SEQ ID NO: 715802 - DNA, 22 bp, Artificial Sequence
  chemically synthesized
tgatgttgacagtggaaagtct

SEQ ID NO: 715803 - DNA, 22 bp, Artificial Sequence
  chemically synthesized
aataatgagtgatgtagacttt

SEQ ID NO: 715804 - DNA, 22 bp, Artificial Sequence
  chemically synthesized
aaataatgagtgatgtagactt

SEQ ID NO: 715805 - DNA, 22 bp, Artificial Sequence
  chemically synthesized
acagtggaaagtctacatcact

SEQ ID NO: 715806 - DNA, 22 bp, Artificial Sequence
  chemically synthesized
atgacaaagagggtcttaaata

SEQ ID NO: 715807 - DNA, 22 bp, Artificial Sequence
  chemically synthesized
catcactcattatttaagaccc

SEQ ID NO: 715808 - DNA, 22 bp, Artificial Sequence
  chemically synthesized
ttgatgacaaagagggtcttaa

SEQ ID NO: 715809 - DNA, 22 bp, Artificial Sequence
  chemically synthesized
attgatgacaaagagggtctta

SEQ ID NO: 715810 - DNA, 22 bp, Artificial Sequence
  chemically synthesized
attatttaagaccctctttgtc

SEQ ID NO: 715811 - DNA, 22 bp, Artificial Sequence
  chemically synthesized
tttaagaccctctttgtcatca

SEQ ID NO: 715812 - DNA, 22 bp, Artificial Sequence
  chemically synthesized
catgaacatttattgatgacaa

SEQ ID NO: 715813 - DNA, 22 bp, Artificial Sequence
  chemically synthesized
ccatgaacatttattgatgaca

SEQ ID NO: 715814 - DNA, 22 bp, Artificial Sequence
  chemically synthesized
aagaccctctttgtcatcaata

SEQ ID NO: 715815 - DNA, 22 bp, Artificial Sequence
  chemically synthesized
agaccctctttgtcatcaataa

SEQ ID NO: 715816 - DNA, 22 bp, Artificial Sequence
  chemically synthesized
aatttccatgaacatttattga

SEQ ID NO: 715817 - DNA, 22 bp, Artificial Sequence
  chemically synthesized
tttgtcatcaataaatgttcat

SEQ ID NO: 715818 - DNA, 22 bp, Artificial Sequence
  chemically synthesized
tgtcatcaataaatgttcatgg

SEQ ID NO: 715819 - DNA, 22 bp, Artificial Sequence
  chemically synthesized
gtcatcaataaatgttcatgga

SEQ ID NO: 715820 - DNA, 22 bp, Artificial Sequence
  chemically synthesized
tcatcaataaatgttcatggaa

SEQ ID NO: 715821 - DNA, 22 bp, Artificial Sequence
  chemically synthesized
agatagtgcctgaatttccatg

SEQ ID NO: 715822 - DNA, 22 bp, Artificial Sequence
  chemically synthesized
atggaaattcaggcactatctt

SEQ ID NO: 715823 - DNA, 22 bp, Artificial Sequence
  chemically synthesized
agcagtgggacctaagatagtg

SEQ ID NO: 715824 - DNA, 22 bp, Artificial Sequence
  chemically synthesized
aggcactatcttaggtcccact

SEQ ID NO: 715825 - DNA, 22 bp, Artificial Sequence
  chemically synthesized
aatcccggcctcagcagtggga

SEQ ID NO: 715826 - DNA, 22 bp, Artificial Sequence
  chemically synthesized
tcttaggtcccactgctgaggc

SEQ ID NO: 715827 - DNA, 22 bp, Artificial Sequence
  chemically synthesized
gattaaatcccggcctcagcag

SEQ ID NO: 715828 - DNA, 22 bp, Artificial Sequence
  chemically synthesized
tggattaaatcccggcctcagc

SEQ ID NO: 715829 - DNA, 22 bp, Artificial Sequence
  chemically synthesized
aggtcccactgctgaggccggg

SEQ ID NO: 715830 - DNA, 22 bp, Artificial Sequence
  chemically synthesized
ggtcccactgctgaggccggga

SEQ ID NO: 715831 - DNA, 22 bp, Artificial Sequence
  chemically synthesized
tcagattctggattaaatcccg

SEQ ID NO: 715832 - DNA, 22 bp, Artificial Sequence
  chemically synthesized
ttatcagattctggattaaatc

SEQ ID NO: 715833 - DNA, 22 bp, Artificial Sequence
  chemically synthesized
gttatcagattctggattaaat

SEQ ID NO: 715834 - DNA, 22 bp, Artificial Sequence
  chemically synthesized
ctgaggccgggatttaatccag

SEQ ID NO: 715835 - DNA, 22 bp, Artificial Sequence
  chemically synthesized
aggccgggatttaatccagaat

SEQ ID NO: 715836 - DNA, 22 bp, Artificial Sequence
  chemically synthesized
caacaaatcttgttatcagatt

SEQ ID NO: 715837 - DNA, 22 bp, Artificial Sequence
  chemically synthesized
aatccagaatctgataacaaga

SEQ ID NO: 715838 - DNA, 22 bp, Artificial Sequence
  chemically synthesized
atccagaatctgataacaagat

SEQ ID NO: 715839 - DNA, 22 bp, Artificial Sequence
  chemically synthesized
aggcagaagttccaacaaatct

SEQ ID NO: 715840 - DNA, 22 bp, Artificial Sequence
  chemically synthesized
ccctaaggcagaagttccaaca

SEQ ID NO: 715841 - DNA, 22 bp, Artificial Sequence
  chemically synthesized
ataacaagatttgttggaactt

SEQ ID NO: 715842 - DNA, 22 bp, Artificial Sequence
  chemically synthesized
ctgccctaaggcagaagttcca

SEQ ID NO: 715843 - DNA, 22 bp, Artificial Sequence
  chemically synthesized
tcctgccctaaggcagaagttc

SEQ ID NO: 715844 - DNA, 22 bp, Artificial Sequence
  chemically synthesized
ctcctgccctaaggcagaagtt

SEQ ID NO: 715845 - DNA, 22 bp, Artificial Sequence
  chemically synthesized
tctcctgccctaaggcagaagt

SEQ ID NO: 715846 - DNA, 22 bp, Artificial Sequence
  chemically synthesized
ttttctcctgccctaaggcaga

SEQ ID NO: 715847 - DNA, 22 bp, Artificial Sequence
  chemically synthesized
gttggaacttctgccttagggc

SEQ ID NO: 715848 - DNA, 22 bp, Artificial Sequence
  chemically synthesized
ttgttttctcctgccctaaggc

SEQ ID NO: 715849 - DNA, 22 bp, Artificial Sequence
  chemically synthesized
ttggaacttctgccttagggca

SEQ ID NO: 715850 - DNA, 22 bp, Artificial Sequence
  chemically synthesized
attgttttctcctgccctaagg

SEQ ID NO: 715851 - DNA, 22 bp, Artificial Sequence
  chemically synthesized
ttattgttttctcctgccctaa

SEQ ID NO: 715852 - DNA, 22 bp, Artificial Sequence
  chemically synthesized
gaacttctgccttagggcagga

SEQ ID NO: 715853 - DNA, 22 bp, Artificial Sequence
  chemically synthesized
cttattgttttctcctgcccta

SEQ ID NO: 715854 - DNA, 22 bp, Artificial Sequence
  chemically synthesized
tcttattgttttctcctgccct

SEQ ID NO: 715855 - DNA, 22 bp, Artificial Sequence
  chemically synthesized
ctgccttagggcaggagaaaac

SEQ ID NO: 715856 - DNA, 22 bp, Artificial Sequence
  chemically synthesized
tgccttagggcaggagaaaaca

SEQ ID NO: 715857 - DNA, 22 bp, Artificial Sequence
  chemically synthesized
aagtctttcttattgttttctc

SEQ ID NO: 715858 - DNA, 22 bp, Artificial Sequence
  chemically synthesized
ccttagggcaggagaaaacaat

SEQ ID NO: 715859 - DNA, 22 bp, Artificial Sequence
  chemically synthesized
aaagtctttcttattgttttct

SEQ ID NO: 715860 - DNA, 22 bp, Artificial Sequence
  chemically synthesized
taaagtctttcttattgttttc

SEQ ID NO: 715861 - DNA, 22 bp, Artificial Sequence
  chemically synthesized
agggcaggagaaaacaataaga

SEQ ID NO: 715862 - DNA, 22 bp, Artificial Sequence
  chemically synthesized
ttttaaagtctttcttattgtt

SEQ ID NO: 715863 - DNA, 22 bp, Artificial Sequence
  chemically synthesized
gggcaggagaaaacaataagaa

SEQ ID NO: 715864 - DNA, 22 bp, Artificial Sequence
  chemically synthesized
attttaaagtctttcttattgt

SEQ ID NO: 715865 - DNA, 22 bp, Artificial Sequence
  chemically synthesized
cttattttaaagtctttcttat

SEQ ID NO: 715866 - DNA, 22 bp, Artificial Sequence
  chemically synthesized
tccttattttaaagtctttctt

SEQ ID NO: 715867 - DNA, 22 bp, Artificial Sequence
  chemically synthesized
ggtgactctccttattttaaag

SEQ ID NO: 715868 - DNA, 22 bp, Artificial Sequence
  chemically synthesized
attaggtgactctccttatttt

SEQ ID NO: 715869 - DNA, 22 bp, Artificial Sequence
  chemically synthesized
taaaataaggagagtcacctaa

SEQ ID NO: 715870 - DNA, 22 bp, Artificial Sequence
  chemically synthesized
aaaataaggagagtcacctaat

SEQ ID NO: 715871 - DNA, 22 bp, Artificial Sequence
  chemically synthesized
aaataaggagagtcacctaatc

SEQ ID NO: 715872 - DNA, 22 bp, Artificial Sequence
  chemically synthesized
aaatgcagatctgattaggtga

SEQ ID NO: 715873 - DNA, 22 bp, Artificial Sequence
  chemically synthesized
ctaaaatgcagatctgattagg

SEQ ID NO: 715874 - DNA, 22 bp, Artificial Sequence
  chemically synthesized
tagtaatcctcctaaaatgcag

SEQ ID NO: 715875 - DNA, 22 bp, Artificial Sequence
  chemically synthesized
atcagatctgcattttaggagg

SEQ ID NO: 715876 - DNA, 22 bp, Artificial Sequence
  chemically synthesized
cacaatgcgcctatagtaatcc

SEQ ID NO: 715877 - DNA, 22 bp, Artificial Sequence
  chemically synthesized
ccacaatgcgcctatagtaatc

SEQ ID NO: 715878 - DNA, 22 bp, Artificial Sequence
  chemically synthesized
cattttaggaggattactatag

SEQ ID NO: 715879 - DNA, 22 bp, Artificial Sequence
  chemically synthesized
tccacaatgcgcctatagtaat

SEQ ID NO: 715880 - DNA, 22 bp, Artificial Sequence
  chemically synthesized
ttccacaatgcgcctatagtaa

SEQ ID NO: 715881 - DNA, 22 bp, Artificial Sequence
  chemically synthesized
taggaggattactataggcgca

SEQ ID NO: 715882 - DNA, 22 bp, Artificial Sequence
  chemically synthesized
aggaggattactataggcgcat

SEQ ID NO: 715883 - DNA, 22 bp, Artificial Sequence
  chemically synthesized
ggaggattactataggcgcatt

SEQ ID NO: 715884 - DNA, 22 bp, Artificial Sequence
  chemically synthesized
cgaatcccttttccacaatgcg

SEQ ID NO: 715885 - DNA, 22 bp, Artificial Sequence
  chemically synthesized
ccgaatcccttttccacaatgc

SEQ ID NO: 715886 - DNA, 22 bp, Artificial Sequence
  chemically synthesized
cttccgaatcccttttccacaa

SEQ ID NO: 715887 - DNA, 22 bp, Artificial Sequence
  chemically synthesized
ctataggcgcattgtggaaaag

SEQ ID NO: 715888 - DNA, 22 bp, Artificial Sequence
  chemically synthesized
gcttccgaatcccttttccaca

SEQ ID NO: 715889 - DNA, 22 bp, Artificial Sequence
  chemically synthesized
ttgcttccgaatcccttttcca

SEQ ID NO: 715890 - DNA, 22 bp, Artificial Sequence
  chemically synthesized
taggcgcattgtggaaaaggga

SEQ ID NO: 715891 - DNA, 22 bp, Artificial Sequence
  chemically synthesized
ttcttgcttccgaatccctttt

SEQ ID NO: 715892 - DNA, 22 bp, Artificial Sequence
  chemically synthesized
atattgttcttgcttccgaatc

SEQ ID NO: 715893 - DNA, 22 bp, Artificial Sequence
  chemically synthesized
tggaaaagggattcggaagcaa

SEQ ID NO: 715894 - DNA, 22 bp, Artificial Sequence
  chemically synthesized
cctgatattgttcttgcttccg

SEQ ID NO: 715895 - DNA, 22 bp, Artificial Sequence
  chemically synthesized
tctccctgatattgttcttgct

SEQ ID NO: 715896 - DNA, 22 bp, Artificial Sequence
  chemically synthesized
atctccctgatattgttcttgc

SEQ ID NO: 715897 - DNA, 22 bp, Artificial Sequence
  chemically synthesized
atttatctccctgatattgttc

SEQ ID NO: 715898 - DNA, 22 bp, Artificial Sequence
  chemically synthesized
taatttatctccctgatattgt

SEQ ID NO: 715899 - DNA, 22 bp, Artificial Sequence
  chemically synthesized
ggaagcaagaacaatatcaggg

SEQ ID NO: 715900 - DNA, 22 bp, Artificial Sequence
  chemically synthesized
catagcctctaatttatctccc

SEQ ID NO: 715901 - DNA, 22 bp, Artificial Sequence
  chemically synthesized
aaatgctacatagcctctaatt

SEQ ID NO: 715902 - DNA, 22 bp, Artificial Sequence
  chemically synthesized
actcaaatgctacatagcctct

SEQ ID NO: 715903 - DNA, 22 bp, Artificial Sequence
  chemically synthesized
gactcaaatgctacatagcctc

SEQ ID NO: 715904 - DNA, 22 bp, Artificial Sequence
  chemically synthesized
tgactcaaatgctacatagcct

SEQ ID NO: 715905 - DNA, 22 bp, Artificial Sequence
  chemically synthesized
ttgactcaaatgctacatagcc

SEQ ID NO: 715906 - DNA, 22 bp, Artificial Sequence
  chemically synthesized
caatatcttttgactcaaatgc

SEQ ID NO: 715907 - DNA, 22 bp, Artificial Sequence
  chemically synthesized
gaggctatgtagcatttgagtc

SEQ ID NO: 715908 - DNA, 22 bp, Artificial Sequence
  chemically synthesized
actccaatatcttttgactcaa

SEQ ID NO: 715909 - DNA, 22 bp, Artificial Sequence
  chemically synthesized
gactccaatatcttttgactca

SEQ ID NO: 715910 - DNA, 22 bp, Artificial Sequence
  chemically synthesized
tgtagcatttgagtcaaaagat

SEQ ID NO: 715911 - DNA, 22 bp, Artificial Sequence
  chemically synthesized
ccttgactccaatatcttttga

SEQ ID NO: 715912 - DNA, 22 bp, Artificial Sequence
  chemically synthesized
cacctcccttgactccaatatc

SEQ ID NO: 715913 - DNA, 22 bp, Artificial Sequence
  chemically synthesized
acacctcccttgactccaatat

SEQ ID NO: 715914 - DNA, 22 bp, Artificial Sequence
  chemically synthesized
gagtcaaaagatattggagtca

SEQ ID NO: 715915 - DNA, 22 bp, Artificial Sequence
  chemically synthesized
agtcaaaagatattggagtcaa

SEQ ID NO: 715916 - DNA, 22 bp, Artificial Sequence
  chemically synthesized
tttacacctcccttgactccaa

SEQ ID NO: 715917 - DNA, 22 bp, Artificial Sequence
  chemically synthesized
atttacacctcccttgactcca

SEQ ID NO: 715918 - DNA, 22 bp, Artificial Sequence
  chemically synthesized
ccttatttacacctcccttgac

SEQ ID NO: 715919 - DNA, 22 bp, Artificial Sequence
  chemically synthesized
attcccttatttacacctccct

SEQ ID NO: 715920 - DNA, 22 bp, Artificial Sequence
  chemically synthesized
attcattcccttatttacacct

SEQ ID NO: 715921 - DNA, 22 bp, Artificial Sequence
  chemically synthesized
aattcattcccttatttacacc

SEQ ID NO: 715922 - DNA, 22 bp, Artificial Sequence
  chemically synthesized
gagtcaagggaggtgtaaataa

SEQ ID NO: 715923 - DNA, 22 bp, Artificial Sequence
  chemically synthesized
ttaattcattcccttatttaca

SEQ ID NO: 715924 - DNA, 22 bp, Artificial Sequence
  chemically synthesized
tccccaagccatctcttaattc

SEQ ID NO: 715925 - DNA, 22 bp, Artificial Sequence
  chemically synthesized
tatccccaagccatctcttaat

SEQ ID NO: 715926 - DNA, 22 bp, Artificial Sequence
  chemically synthesized
tcagctctatccccaagccatc

SEQ ID NO: 715927 - DNA, 22 bp, Artificial Sequence
  chemically synthesized
tgtcagctctatccccaagcca

SEQ ID NO: 715928 - DNA, 22 bp, Artificial Sequence
  chemically synthesized
agagatggcttggggatagagc

SEQ ID NO: 715929 - DNA, 22 bp, Artificial Sequence
  chemically synthesized
ccaaattctgtcagctctatcc

SEQ ID NO: 715930 - DNA, 22 bp, Artificial Sequence
  chemically synthesized
ggggatagagctgacagaattt

SEQ ID NO: 715931 - DNA, 22 bp, Artificial Sequence
  chemically synthesized
gggatagagctgacagaatttg

SEQ ID NO: 715932 - DNA, 22 bp, Artificial Sequence
  chemically synthesized
acatgatgcattgccaaattct

SEQ ID NO: 715933 - DNA, 22 bp, Artificial Sequence
  chemically synthesized
aatctaacatgatgcattgcca

SEQ ID NO: 715934 - DNA, 22 bp, Artificial Sequence
  chemically synthesized
aaatctaacatgatgcattgcc

SEQ ID NO: 715935 - DNA, 22 bp, Artificial Sequence
  chemically synthesized
taaatctaacatgatgcattgc

SEQ ID NO: 715936 - DNA, 22 bp, Artificial Sequence
  chemically synthesized
acagaatttggcaatgcatcat

SEQ ID NO: 715937 - DNA, 22 bp, Artificial Sequence
  chemically synthesized
tctttaaatctaacatgatgca

SEQ ID NO: 715938 - DNA, 22 bp, Artificial Sequence
  chemically synthesized
atctttaaatctaacatgatgc

SEQ ID NO: 715939 - DNA, 22 bp, Artificial Sequence
  chemically synthesized
tatctttaaatctaacatgatg

SEQ ID NO: 715940 - DNA, 22 bp, Artificial Sequence
  chemically synthesized
ttatctttaaatctaacatgat

SEQ ID NO: 715941 - DNA, 22 bp, Artificial Sequence
  chemically synthesized
cttttatctttaaatctaacat

SEQ ID NO: 715942 - DNA, 22 bp, Artificial Sequence
  chemically synthesized
ggcaatgcatcatgttagattt

SEQ ID NO: 715943 - DNA, 22 bp, Artificial Sequence
  chemically synthesized
gcaatgcatcatgttagattta

SEQ ID NO: 715944 - DNA, 22 bp, Artificial Sequence
  chemically synthesized
aatctacttttatctttaaatc

SEQ ID NO: 715945 - DNA, 22 bp, Artificial Sequence
  chemically synthesized
tgaatctacttttatctttaaa

SEQ ID NO: 715946 - DNA, 22 bp, Artificial Sequence
  chemically synthesized
ctgaatctacttttatctttaa

SEQ ID NO: 715947 - DNA, 22 bp, Artificial Sequence
  chemically synthesized
tttctgaatctacttttatctt

SEQ ID NO: 715948 - DNA, 22 bp, Artificial Sequence
  chemically synthesized
gatttaaagataaaagtagatt

SEQ ID NO: 715949 - DNA, 22 bp, Artificial Sequence
  chemically synthesized
gggtattatttctgaatctact

SEQ ID NO: 715950 - DNA, 22 bp, Artificial Sequence
  chemically synthesized
aaagataaaagtagattcagaa

SEQ ID NO: 715951 - DNA, 22 bp, Artificial Sequence
  chemically synthesized
aagataaaagtagattcagaaa

SEQ ID NO: 715952 - DNA, 22 bp, Artificial Sequence
  chemically synthesized
cccaagtcaaaaattagggtat

SEQ ID NO: 715953 - DNA, 22 bp, Artificial Sequence
  chemically synthesized
agaaataataccctaatttttg

SEQ ID NO: 715954 - DNA, 22 bp, Artificial Sequence
  chemically synthesized
acccaattgcccaagtcaaaaa

SEQ ID NO: 715955 - DNA, 22 bp, Artificial Sequence
  chemically synthesized
cacccaattgcccaagtcaaaa

SEQ ID NO: 715956 - DNA, 22 bp, Artificial Sequence
  chemically synthesized
cgcttcacccaattgcccaagt

SEQ ID NO: 715957 - DNA, 22 bp, Artificial Sequence
  chemically synthesized
atttttgacttgggcaattggg

SEQ ID NO: 715958 - DNA, 22 bp, Artificial Sequence
  chemically synthesized
ttgacttgggcaattgggtgaa

SEQ ID NO: 715959 - DNA, 22 bp, Artificial Sequence
  chemically synthesized
tgaacgctacgcttcacccaat

SEQ ID NO: 715960 - DNA, 22 bp, Artificial Sequence
  chemically synthesized
tgacttgggcaattgggtgaag

SEQ ID NO: 715961 - DNA, 22 bp, Artificial Sequence
  chemically synthesized
atgaacgctacgcttcacccaa

SEQ ID NO: 715962 - DNA, 22 bp, Artificial Sequence
  chemically synthesized
gacttgggcaattgggtgaagc

SEQ ID NO: 715963 - DNA, 22 bp, Artificial Sequence
  chemically synthesized
acttgggcaattgggtgaagcg

SEQ ID NO: 715964 - DNA, 22 bp, Artificial Sequence
  chemically synthesized
ttatgaacgctacgcttcaccc

SEQ ID NO: 715965 - DNA, 22 bp, Artificial Sequence
  chemically synthesized
ttcttatgaacgctacgcttca

SEQ ID NO: 715966 - DNA, 22 bp, Artificial Sequence
  chemically synthesized
gggcaattgggtgaagcgtagc

SEQ ID NO: 715967 - DNA, 22 bp, Artificial Sequence
  chemically synthesized
ggcaattgggtgaagcgtagcg

SEQ ID NO: 715968 - DNA, 22 bp, Artificial Sequence
  chemically synthesized
tgctgttcttatgaacgctacg

SEQ ID NO: 715969 - DNA, 22 bp, Artificial Sequence
  chemically synthesized
attgtgctgttcttatgaacgc

SEQ ID NO: 715970 - DNA, 22 bp, Artificial Sequence
  chemically synthesized
ggtgaagcgtagcgttcataag

SEQ ID NO: 715971 - DNA, 22 bp, Artificial Sequence
  chemically synthesized
cctaattgtgctgttcttatga

SEQ ID NO: 715972 - DNA, 22 bp, Artificial Sequence
  chemically synthesized
cctccctaattgtgctgttctt

SEQ ID NO: 715973 - DNA, 22 bp, Artificial Sequence
  chemically synthesized
ccctccctaattgtgctgttct

SEQ ID NO: 715974 - DNA, 22 bp, Artificial Sequence
  chemically synthesized
tccctccctaattgtgctgttc

SEQ ID NO: 715975 - DNA, 22 bp, Artificial Sequence
  chemically synthesized
ttccctccctaattgtgctgtt

SEQ ID NO: 715976 - DNA, 22 bp, Artificial Sequence
  chemically synthesized
ataagaacagcacaattaggga

SEQ ID NO: 715977 - DNA, 22 bp, Artificial Sequence
  chemically synthesized
aacatttttccctccctaattg

SEQ ID NO: 715978 - DNA, 22 bp, Artificial Sequence
  chemically synthesized
tcccaatccaccctcaacattt

SEQ ID NO: 715979 - DNA, 22 bp, Artificial Sequence
  chemically synthesized
gtcccaatccaccctcaacatt

SEQ ID NO: 715980 - DNA, 22 bp, Artificial Sequence
  chemically synthesized
tgtcccaatccaccctcaacat

SEQ ID NO: 715981 - DNA, 22 bp, Artificial Sequence
  chemically synthesized
gggagggaaaaatgttgagggt

SEQ ID NO: 715982 - DNA, 22 bp, Artificial Sequence
  chemically synthesized
ttgtcccaatccaccctcaaca

SEQ ID NO: 715983 - DNA, 22 bp, Artificial Sequence
  chemically synthesized
cttttgtcccaatccaccctca

SEQ ID NO: 715984 - DNA, 22 bp, Artificial Sequence
  chemically synthesized
tcctccttttgtcccaatccac

SEQ ID NO: 715985 - DNA, 22 bp, Artificial Sequence
  chemically synthesized
ttatcctccttttgtcccaatc

SEQ ID NO: 715986 - DNA, 22 bp, Artificial Sequence
  chemically synthesized
attattatcctccttttgtccc

SEQ ID NO: 715987 - DNA, 22 bp, Artificial Sequence
  chemically synthesized
agggtggattgggacaaaagga

SEQ ID NO: 715988 - DNA, 22 bp, Artificial Sequence
  chemically synthesized
ggacaaaaggaggataataatg

SEQ ID NO: 715989 - DNA, 22 bp, Artificial Sequence
  chemically synthesized
acatgtccccagcagctcatta

SEQ ID NO: 715990 - DNA, 22 bp, Artificial Sequence
  chemically synthesized
aacatgtccccagcagctcatt

SEQ ID NO: 715991 - DNA, 22 bp, Artificial Sequence
  chemically synthesized
agacttaacatgtccccagcag

SEQ ID NO: 715992 - DNA, 22 bp, Artificial Sequence
  chemically synthesized
ctggggacatgttaagtctgag

SEQ ID NO: 715993 - DNA, 22 bp, Artificial Sequence
  chemically synthesized
gggacatgttaagtctgaggtg

SEQ ID NO: 715994 - DNA, 22 bp, Artificial Sequence
  chemically synthesized
aatgtcccacagacacctcaga

SEQ ID NO: 715995 - DNA, 22 bp, Artificial Sequence
  chemically synthesized
agtctgaggtgtctgtgggaca

SEQ ID NO: 715996 - DNA, 22 bp, Artificial Sequence
  chemically synthesized
tccaccacaacctgaatgtccc

SEQ ID NO: 715997 - DNA, 22 bp, Artificial Sequence
  chemically synthesized
gtccaccacaacctgaatgtcc

SEQ ID NO: 715998 - DNA, 22 bp, Artificial Sequence
  chemically synthesized
aggtgtctgtgggacattcagg

SEQ ID NO: 715999 - DNA, 22 bp, Artificial Sequence
  chemically synthesized
ttgtccaccacaacctgaatgt

SEQ ID NO: 716000 - DNA, 22 bp, Artificial Sequence
  chemically synthesized
cttgtccaccacaacctgaatg

SEQ ID NO: 716001 - DNA, 22 bp, Artificial Sequence
  chemically synthesized
tgtttcttgtccaccacaacct

SEQ ID NO: 716002 - DNA, 22 bp, Artificial Sequence
  chemically synthesized
tgggacattcaggttgtggtgg

SEQ ID NO: 716003 - DNA, 22 bp, Artificial Sequence
  chemically synthesized
tatgtttcttgtccaccacaac

SEQ ID NO: 716004 - DNA, 22 bp, Artificial Sequence
  chemically synthesized
ctatgtttcttgtccaccacaa

SEQ ID NO: 716005 - DNA, 22 bp, Artificial Sequence
  chemically synthesized
aggttgtggtggacaagaaaca

SEQ ID NO: 716006 - DNA, 22 bp, Artificial Sequence
  chemically synthesized
tggtggacaagaaacatagaag

SEQ ID NO: 716007 - DNA, 22 bp, Artificial Sequence
  chemically synthesized
agacccagccaccttctatgtt

SEQ ID NO: 716008 - DNA, 22 bp, Artificial Sequence
  chemically synthesized
cagacccagccaccttctatgt

SEQ ID NO: 716009 - DNA, 22 bp, Artificial Sequence
  chemically synthesized
ggcttcagacccagccaccttc

SEQ ID NO: 716010 - DNA, 22 bp, Artificial Sequence
  chemically synthesized
ctgggcttcagacccagccacc

SEQ ID NO: 716011 - DNA, 22 bp, Artificial Sequence
  chemically synthesized
tcctgggcttcagacccagcca

SEQ ID NO: 716012 - DNA, 22 bp, Artificial Sequence
  chemically synthesized
tctcctgggcttcagacccagc

SEQ ID NO: 716013 - DNA, 22 bp, Artificial Sequence
  chemically synthesized
ctctcctgggcttcagacccag

SEQ ID NO: 716014 - DNA, 22 bp, Artificial Sequence
  chemically synthesized
tttctctcctgggcttcagacc

SEQ ID NO: 716015 - DNA, 22 bp, Artificial Sequence
  chemically synthesized
atttctctcctgggcttcagac

SEQ ID NO: 716016 - DNA, 22 bp, Artificial Sequence
  chemically synthesized
ggtctgaagcccaggagagaaa

SEQ ID NO: 716017 - DNA, 22 bp, Artificial Sequence
  chemically synthesized
aagtaaggtcagacttatttct

SEQ ID NO: 716018 - DNA, 22 bp, Artificial Sequence
  chemically synthesized
aagcccaggagagaaataagtc

SEQ ID NO: 716019 - DNA, 22 bp, Artificial Sequence
  chemically synthesized
ttgaagtaaggtcagacttatt

SEQ ID NO: 716020 - DNA, 22 bp, Artificial Sequence
  chemically synthesized
attattgaagtaaggtcagact

SEQ ID NO: 716021 - DNA, 22 bp, Artificial Sequence
  chemically synthesized
gattattgaagtaaggtcagac

SEQ ID NO: 716022 - DNA, 22 bp, Artificial Sequence
  chemically synthesized
gcttgattattgaagtaaggtc

SEQ ID NO: 716023 - DNA, 22 bp, Artificial Sequence
  chemically synthesized
aaatggctggcttgattattga

SEQ ID NO: 716024 - DNA, 22 bp, Artificial Sequence
  chemically synthesized
gaaatggctggcttgattattg

SEQ ID NO: 716025 - DNA, 22 bp, Artificial Sequence
  chemically synthesized
accttacttcaataatcaagcc

SEQ ID NO: 716026 - DNA, 22 bp, Artificial Sequence
  chemically synthesized
tttgaaatggctggcttgatta

SEQ ID NO: 716027 - DNA, 22 bp, Artificial Sequence
  chemically synthesized
acttcaataatcaagccagcca

SEQ ID NO: 716028 - DNA, 22 bp, Artificial Sequence
  chemically synthesized
cttcaataatcaagccagccat

SEQ ID NO: 716029 - DNA, 22 bp, Artificial Sequence
  chemically synthesized
caataatcaagccagccatttc

SEQ ID NO: 716030 - DNA, 22 bp, Artificial Sequence
  chemically synthesized
gcataattatttgaaatggctg

SEQ ID NO: 716031 - DNA, 22 bp, Artificial Sequence
  chemically synthesized
aataatcaagccagccatttca

SEQ ID NO: 716032 - DNA, 22 bp, Artificial Sequence
  chemically synthesized
tagcataattatttgaaatggc

SEQ ID NO: 716033 - DNA, 22 bp, Artificial Sequence
  chemically synthesized
ctctagcataattatttgaaat

SEQ ID NO: 716034 - DNA, 22 bp, Artificial Sequence
  chemically synthesized
aattgctctagcataattattt

SEQ ID NO: 716035 - DNA, 22 bp, Artificial Sequence
  chemically synthesized
caaataattatgctagagcaat

SEQ ID NO: 716036 - DNA, 22 bp, Artificial Sequence
  chemically synthesized
aaataattatgctagagcaatt

SEQ ID NO: 716037 - DNA, 22 bp, Artificial Sequence
  chemically synthesized
catatggatgttcaattgctct

SEQ ID NO: 716038 - DNA, 22 bp, Artificial Sequence
  chemically synthesized
gcatatggatgttcaattgctc

SEQ ID NO: 716039 - DNA, 22 bp, Artificial Sequence
  chemically synthesized
tgcatatggatgttcaattgct

SEQ ID NO: 716040 - DNA, 22 bp, Artificial Sequence
  chemically synthesized
ttgcatatggatgttcaattgc

SEQ ID NO: 716041 - DNA, 22 bp, Artificial Sequence
  chemically synthesized
tttgcatatggatgttcaattg

SEQ ID NO: 716042 - DNA, 22 bp, Artificial Sequence
  chemically synthesized
ttttttgcatatggatgttcaa

SEQ ID NO: 716043 - DNA, 22 bp, Artificial Sequence
  chemically synthesized
tgctagagcaattgaacatcca

SEQ ID NO: 716044 - DNA, 22 bp, Artificial Sequence
  chemically synthesized
attttttgcatatggatgttca

SEQ ID NO: 716045 - DNA, 22 bp, Artificial Sequence
  chemically synthesized
gagcaattgaacatccatatgc

SEQ ID NO: 716046 - DNA, 22 bp, Artificial Sequence
  chemically synthesized
aggtttattttttgcatatgga

SEQ ID NO: 716047 - DNA, 22 bp, Artificial Sequence
  chemically synthesized
agttgaggtttattttttgcat

SEQ ID NO: 716048 - DNA, 22 bp, Artificial Sequence
  chemically synthesized
aagttgaggtttattttttgca

SEQ ID NO: 716049 - DNA, 22 bp, Artificial Sequence
  chemically synthesized
aacatccatatgcaaaaaataa

SEQ ID NO: 716050 - DNA, 22 bp, Artificial Sequence
  chemically synthesized
tataaagtatgaggtttaagtt

SEQ ID NO: 716051 - DNA, 22 bp, Artificial Sequence
  chemically synthesized
atataaagtatgaggtttaagt

SEQ ID NO: 716052 - DNA, 22 bp, Artificial Sequence
  chemically synthesized
tatataaagtatgaggtttaag

SEQ ID NO: 716053 - DNA, 22 bp, Artificial Sequence
  chemically synthesized
ttatataaagtatgaggtttaa

SEQ ID NO: 716054 - DNA, 22 bp, Artificial Sequence
  chemically synthesized
atttttatataaagtatgaggt

SEQ ID NO: 716055 - DNA, 22 bp, Artificial Sequence
  chemically synthesized
gatttttatataaagtatgagg

SEQ ID NO: 716056 - DNA, 22 bp, Artificial Sequence
  chemically synthesized
aacttaaacctcatactttata

SEQ ID NO: 716057 - DNA, 22 bp, Artificial Sequence
  chemically synthesized
aaacctcatactttatataaaa

SEQ ID NO: 716058 - DNA, 22 bp, Artificial Sequence
  chemically synthesized
aacctcatactttatataaaaa

SEQ ID NO: 716059 - DNA, 22 bp, Artificial Sequence
  chemically synthesized
tgatccatttgatttttatata

SEQ ID NO: 716060 - DNA, 22 bp, Artificial Sequence
  chemically synthesized
atactttatataaaaatcaaat

SEQ ID NO: 716061 - DNA, 22 bp, Artificial Sequence
  chemically synthesized
agtctgtgatccatttgatttt

SEQ ID NO: 716062 - DNA, 22 bp, Artificial Sequence
  chemically synthesized
aagtctgtgatccatttgattt

SEQ ID NO: 716063 - DNA, 22 bp, Artificial Sequence
  chemically synthesized
tatataaaaatcaaatggatca

SEQ ID NO: 716064 - DNA, 22 bp, Artificial Sequence
  chemically synthesized
tgtttaagtctgtgatccattt

SEQ ID NO: 716065 - DNA, 22 bp, Artificial Sequence
  chemically synthesized
atataaaaatcaaatggatcac

SEQ ID NO: 716066 - DNA, 22 bp, Artificial Sequence
  chemically synthesized
atgtttaagtctgtgatccatt

SEQ ID NO: 716067 - DNA, 22 bp, Artificial Sequence
  chemically synthesized
tataaaaatcaaatggatcaca

SEQ ID NO: 716068 - DNA, 22 bp, Artificial Sequence
  chemically synthesized
tatgtttaagtctgtgatccat

SEQ ID NO: 716069 - DNA, 22 bp, Artificial Sequence
  chemically synthesized
cattttatgtttaagtctgtga

SEQ ID NO: 716070 - DNA, 22 bp, Artificial Sequence
  chemically synthesized
acattttatgtttaagtctgtg

SEQ ID NO: 716071 - DNA, 22 bp, Artificial Sequence
  chemically synthesized
tacattttatgtttaagtctgt

SEQ ID NO: 716072 - DNA, 22 bp, Artificial Sequence
  chemically synthesized
tagttttacattttatgtttaa

SEQ ID NO: 716073 - DNA, 22 bp, Artificial Sequence
  chemically synthesized
atagttttacattttatgttta

SEQ ID NO: 716074 - DNA, 22 bp, Artificial Sequence
  chemically synthesized
tatgtcttatagttttacattt

SEQ ID NO: 716075 - DNA, 22 bp, Artificial Sequence
  chemically synthesized
atatgtcttatagttttacatt

SEQ ID NO: 716076 - DNA, 22 bp, Artificial Sequence
  chemically synthesized
tatatgtcttatagttttacat

SEQ ID NO: 716077 - DNA, 22 bp, Artificial Sequence
  chemically synthesized
aaacataaaatgtaaaactata

SEQ ID NO: 716078 - DNA, 22 bp, Artificial Sequence
  chemically synthesized
ttttatatgtcttatagtttta

SEQ ID NO: 716079 - DNA, 22 bp, Artificial Sequence
  chemically synthesized
aacataaaatgtaaaactataa

SEQ ID NO: 716080 - DNA, 22 bp, Artificial Sequence
  chemically synthesized
ctgttttatatgtcttatagtt

SEQ ID NO: 716081 - DNA, 22 bp, Artificial Sequence
  chemically synthesized
tcctgttttatatgtcttatag

SEQ ID NO: 716082 - DNA, 22 bp, Artificial Sequence
  chemically synthesized
gctctcctgttttatatgtctt

SEQ ID NO: 716083 - DNA, 22 bp, Artificial Sequence
  chemically synthesized
ggctctcctgttttatatgtct

SEQ ID NO: 716084 - DNA, 22 bp, Artificial Sequence
  chemically synthesized
tggctctcctgttttatatgtc

SEQ ID NO: 716085 - DNA, 22 bp, Artificial Sequence
  chemically synthesized
accattttggctctcctgtttt

SEQ ID NO: 716086 - DNA, 22 bp, Artificial Sequence
  chemically synthesized
caccattttggctctcctgttt

SEQ ID NO: 716087 - DNA, 22 bp, Artificial Sequence
  chemically synthesized
taagacatataaaacaggagag

SEQ ID NO: 716088 - DNA, 22 bp, Artificial Sequence
  chemically synthesized
gtagagacggggtttcaccatt

SEQ ID NO: 716089 - DNA, 22 bp, Artificial Sequence
  chemically synthesized
agtagagacggggtttcaccat

SEQ ID NO: 716090 - DNA, 22 bp, Artificial Sequence
  chemically synthesized
tagtagagacggggtttcacca

SEQ ID NO: 716091 - DNA, 22 bp, Artificial Sequence
  chemically synthesized
ttagtagagacggggtttcacc

SEQ ID NO: 716092 - DNA, 22 bp, Artificial Sequence
  chemically synthesized
tatttttagtagagacggggtt

SEQ ID NO: 716093 - DNA, 22 bp, Artificial Sequence
  chemically synthesized
gtatttttagtagagacggggt

SEQ ID NO: 716094 - DNA, 22 bp, Artificial Sequence
  chemically synthesized
tgtatttttagtagagacgggg

SEQ ID NO: 716095 - DNA, 22 bp, Artificial Sequence
  chemically synthesized
ttgtatttttagtagagacggg

SEQ ID NO: 716096 - DNA, 22 bp, Artificial Sequence
  chemically synthesized
tttgtatttttagtagagacgg

SEQ ID NO: 716097 - DNA, 22 bp, Artificial Sequence
  chemically synthesized
attttttgtatttttagtagag

SEQ ID NO: 716098 - DNA, 22 bp, Artificial Sequence
  chemically synthesized
tactaaaaatacaaaaaattag

SEQ ID NO: 716099 - DNA, 22 bp, Artificial Sequence
  chemically synthesized
ctaaaaatacaaaaaattagct

SEQ ID NO: 716100 - DNA, 22 bp, Artificial Sequence
  chemically synthesized
caccaccacacccagctaattt

SEQ ID NO: 716101 - DNA, 22 bp, Artificial Sequence
  chemically synthesized
aaaatacaaaaaattagctggg

SEQ ID NO: 716102 - DNA, 22 bp, Artificial Sequence
  chemically synthesized
caggcctccaccaccacaccca

SEQ ID NO: 716103 - DNA, 22 bp, Artificial Sequence
  chemically synthesized
ggactacaggcctccaccacca

SEQ ID NO: 716104 - DNA, 22 bp, Artificial Sequence
  chemically synthesized
gctgggtgtggtggtggaggcc

SEQ ID NO: 716105 - DNA, 22 bp, Artificial Sequence
  chemically synthesized
ggtgtggtggtggaggcctgta

SEQ ID NO: 716106 - DNA, 22 bp, Artificial Sequence
  chemically synthesized
ccgagtagctgggactacaggc

SEQ ID NO: 716107 - DNA, 22 bp, Artificial Sequence
  chemically synthesized
agcctcccgagtagctgggact

SEQ ID NO: 716108 - DNA, 22 bp, Artificial Sequence
  chemically synthesized
cctcagcctcccgagtagctgg

SEQ ID NO: 716109 - DNA, 22 bp, Artificial Sequence
  chemically synthesized
ctgcctcagcctcccgagtagc

SEQ ID NO: 716110 - DNA, 22 bp, Artificial Sequence
  chemically synthesized
tcctgcctcagcctcccgagta

SEQ ID NO: 716111 - DNA, 22 bp, Artificial Sequence
  chemically synthesized
tagtcccagctactcgggaggc

SEQ ID NO: 716112 - DNA, 22 bp, Artificial Sequence
  chemically synthesized
acgccattctcctgcctcagcc

SEQ ID NO: 716113 - DNA, 22 bp, Artificial Sequence
  chemically synthesized
ctcgggaggctgaggcaggaga

SEQ ID NO: 716114 - DNA, 22 bp, Artificial Sequence
  chemically synthesized
gggaggctgaggcaggagaatg

SEQ ID NO: 716115 - DNA, 22 bp, Artificial Sequence
  chemically synthesized
ccgggttcacgccattctcctg

SEQ ID NO: 716116 - DNA, 22 bp, Artificial Sequence
  chemically synthesized
cgcctcccgggttcacgccatt

SEQ ID NO: 716117 - DNA, 22 bp, Artificial Sequence
  chemically synthesized
aggcaggagaatggcgtgaacc

SEQ ID NO: 716118 - DNA, 22 bp, Artificial Sequence
  chemically synthesized
caagttccgcctcccgggttca

SEQ ID NO: 716119 - DNA, 22 bp, Artificial Sequence
  chemically synthesized
actgcaagttccgcctcccggg

SEQ ID NO: 716120 - DNA, 22 bp, Artificial Sequence
  chemically synthesized
gctcactgcaagttccgcctcc

SEQ ID NO: 716121 - DNA, 22 bp, Artificial Sequence
  chemically synthesized
ggctcactgcaagttccgcctc

SEQ ID NO: 716122 - DNA, 22 bp, Artificial Sequence
  chemically synthesized
gagtgcagtggcccgatcttgg

SEQ ID NO: 716123 - DNA, 22 bp, Artificial Sequence
  chemically synthesized
ggagtgcagtggcccgatcttg

SEQ ID NO: 716124 - DNA, 22 bp, Artificial Sequence
  chemically synthesized
gcagtgagccaagatcgggcca

SEQ ID NO: 716125 - DNA, 22 bp, Artificial Sequence
  chemically synthesized
cagtgagccaagatcgggccac

SEQ ID NO: 716126 - DNA, 22 bp, Artificial Sequence
  chemically synthesized
tcgcccagcttggagtgcagtg

SEQ ID NO: 716127 - DNA, 22 bp, Artificial Sequence
  chemically synthesized
tgtcgcccagcttggagtgcag

SEQ ID NO: 716128 - DNA, 22 bp, Artificial Sequence
  chemically synthesized
gctctgtcgcccagcttggagt

SEQ ID NO: 716129 - DNA, 22 bp, Artificial Sequence
  chemically synthesized
cactccaagctgggcgacagag

SEQ ID NO: 716130 - DNA, 22 bp, Artificial Sequence
  chemically synthesized
agacggagcctcgctctgtcgc

SEQ ID NO: 716131 - DNA, 22 bp, Artificial Sequence
  chemically synthesized
gagacggagcctcgctctgtcg

SEQ ID NO: 716132 - DNA, 22 bp, Artificial Sequence
  chemically synthesized
tgagacggagcctcgctctgtc

SEQ ID NO: 716133 - DNA, 22 bp, Artificial Sequence
  chemically synthesized
ttgagacggagcctcgctctgt

SEQ ID NO: 716134 - DNA, 22 bp, Artificial Sequence
  chemically synthesized
caagctgggcgacagagcgagg

SEQ ID NO: 716135 - DNA, 22 bp, Artificial Sequence
  chemically synthesized
tttgagacggagcctcgctctg

SEQ ID NO: 716136 - DNA, 22 bp, Artificial Sequence
  chemically synthesized
ttttgagacggagcctcgctct

SEQ ID NO: 716137 - DNA, 22 bp, Artificial Sequence
  chemically synthesized
tttttgagacggagcctcgctc

SEQ ID NO: 716138 - DNA, 22 bp, Artificial Sequence
  chemically synthesized
ttttttgagacggagcctcgct

SEQ ID NO: 716139 - DNA, 22 bp, Artificial Sequence
  chemically synthesized
tttttttgagacggagcctcgc

SEQ ID NO: 716140 - DNA, 22 bp, Artificial Sequence
  chemically synthesized
ttttttttgagacggagcctcg

SEQ ID NO: 716141 - DNA, 22 bp, Artificial Sequence
  chemically synthesized
tttttttttgagacggagcctc

SEQ ID NO: 716142 - DNA, 22 bp, Artificial Sequence
  chemically synthesized
ggcgacagagcgaggctccgtc

SEQ ID NO: 716143 - DNA, 22 bp, Artificial Sequence
  chemically synthesized
ttttttttttgagacggagcct

SEQ ID NO: 716144 - DNA, 22 bp, Artificial Sequence
  chemically synthesized
tttttttttttgagacggagcc

SEQ ID NO: 716145 - DNA, 22 bp, Artificial Sequence
  chemically synthesized
ttttttttttttgagacggagc

SEQ ID NO: 716146 - DNA, 22 bp, Artificial Sequence
  chemically synthesized
tttttttttttttgagacggag

SEQ ID NO: 716147 - DNA, 22 bp, Artificial Sequence
  chemically synthesized
ttttttttttttttgagacgga

SEQ ID NO: 716148 - DNA, 22 bp, Artificial Sequence
  chemically synthesized
tttttttttttttttgagacgg

SEQ ID NO: 716149 - DNA, 22 bp, Artificial Sequence
  chemically synthesized
ttttttttttttttttgagacg

SEQ ID NO: 716150 - DNA, 22 bp, Artificial Sequence
  chemically synthesized
ttttttttttttttttttgaga

SEQ ID NO: 716151 - DNA, 22 bp, Artificial Sequence
  chemically synthesized
ttcttttttttttttttttttg

SEQ ID NO: 716152 - DNA, 22 bp, Artificial Sequence
  chemically synthesized
ctgttctttttttttttttttt

SEQ ID NO: 716153 - DNA, 22 bp, Artificial Sequence
  chemically synthesized
tcctgttctttttttttttttt

SEQ ID NO: 716154 - DNA, 22 bp, Artificial Sequence
  chemically synthesized
ctcctgttcttttttttttttt

SEQ ID NO: 716155 - DNA, 22 bp, Artificial Sequence
  chemically synthesized
cgtctcaaaaaaaaaaaaaaaa

SEQ ID NO: 716156 - DNA, 22 bp, Artificial Sequence
  chemically synthesized
tctcctgttctttttttttttt

SEQ ID NO: 716157 - DNA, 22 bp, Artificial Sequence
  chemically synthesized
aaaaaaaaaaaaaaaaaagaac

SEQ ID NO: 716158 - DNA, 22 bp, Artificial Sequence
  chemically synthesized
gatcccaaagattttctcctgt

SEQ ID NO: 716159 - DNA, 22 bp, Artificial Sequence
  chemically synthesized
gccctggatcccaaagattttc

SEQ ID NO: 716160 - DNA, 22 bp, Artificial Sequence
  chemically synthesized
cctagccctggatcccaaagat

SEQ ID NO: 716161 - DNA, 22 bp, Artificial Sequence
  chemically synthesized
gcctagccctggatcccaaaga

SEQ ID NO: 716162 - DNA, 22 bp, Artificial Sequence
  chemically synthesized
tgcctagccctggatcccaaag

SEQ ID NO: 716163 - DNA, 22 bp, Artificial Sequence
  chemically synthesized
agaatactttgcctagccctgg

SEQ ID NO: 716164 - DNA, 22 bp, Artificial Sequence
  chemically synthesized
tgggatccagggctaggcaaag

SEQ ID NO: 716165 - DNA, 22 bp, Artificial Sequence
  chemically synthesized
agtctaagaatactttgcctag

SEQ ID NO: 716166 - DNA, 22 bp, Artificial Sequence
  chemically synthesized
gggatccagggctaggcaaagt

SEQ ID NO: 716167 - DNA, 22 bp, Artificial Sequence
  chemically synthesized
ggatccagggctaggcaaagta

SEQ ID NO: 716168 - DNA, 22 bp, Artificial Sequence
  chemically synthesized
tgttgagtctaagaatactttg

SEQ ID NO: 716169 - DNA, 22 bp, Artificial Sequence
  chemically synthesized
gtgttgagtctaagaatacttt

SEQ ID NO: 716170 - DNA, 22 bp, Artificial Sequence
  chemically synthesized
tgtgttgagtctaagaatactt

SEQ ID NO: 716171 - DNA, 22 bp, Artificial Sequence
  chemically synthesized
ttgtgttgagtctaagaatact

SEQ ID NO: 716172 - DNA, 22 bp, Artificial Sequence
  chemically synthesized
ggcaaagtattcttagactcaa

SEQ ID NO: 716173 - DNA, 22 bp, Artificial Sequence
  chemically synthesized
tggatcatgcttttgtgttgag

SEQ ID NO: 716174 - DNA, 22 bp, Artificial Sequence
  chemically synthesized
atggatcatgcttttgtgttga

SEQ ID NO: 716175 - DNA, 22 bp, Artificial Sequence
  chemically synthesized
tatggatcatgcttttgtgttg

SEQ ID NO: 716176 - DNA, 22 bp, Artificial Sequence
  chemically synthesized
ttatggatcatgcttttgtgtt

SEQ ID NO: 716177 - DNA, 22 bp, Artificial Sequence
  chemically synthesized
cttttatggatcatgcttttgt

SEQ ID NO: 716178 - DNA, 22 bp, Artificial Sequence
  chemically synthesized
ttagactcaacacaaaagcatg

SEQ ID NO: 716179 - DNA, 22 bp, Artificial Sequence
  chemically synthesized
ccttttatggatcatgcttttg

SEQ ID NO: 716180 - DNA, 22 bp, Artificial Sequence
  chemically synthesized
tccttttatggatcatgctttt

SEQ ID NO: 716181 - DNA, 22 bp, Artificial Sequence
  chemically synthesized
agactcaacacaaaagcatgat

SEQ ID NO: 716182 - DNA, 22 bp, Artificial Sequence
  chemically synthesized
ttccttttatggatcatgcttt

SEQ ID NO: 716183 - DNA, 22 bp, Artificial Sequence
  chemically synthesized
gactcaacacaaaagcatgatc

SEQ ID NO: 716184 - DNA, 22 bp, Artificial Sequence
  chemically synthesized
tttccttttatggatcatgctt

SEQ ID NO: 716185 - DNA, 22 bp, Artificial Sequence
  chemically synthesized
aacacaaaagcatgatccataa

SEQ ID NO: 716186 - DNA, 22 bp, Artificial Sequence
  chemically synthesized
tcgctttttccttttatggatc

SEQ ID NO: 716187 - DNA, 22 bp, Artificial Sequence
  chemically synthesized
atcgctttttccttttatggat

SEQ ID NO: 716188 - DNA, 22 bp, Artificial Sequence
  chemically synthesized
aatttatcgctttttcctttta

SEQ ID NO: 716189 - DNA, 22 bp, Artificial Sequence
  chemically synthesized
gcgaggttgaatttatcgcttt

SEQ ID NO: 716190 - DNA, 22 bp, Artificial Sequence
  chemically synthesized
ggcgaggttgaatttatcgctt

SEQ ID NO: 716191 - DNA, 22 bp, Artificial Sequence
  chemically synthesized
tggcgaggttgaatttatcgct

SEQ ID NO: 716192 - DNA, 22 bp, Artificial Sequence
  chemically synthesized
attttggcgaggttgaatttat

SEQ ID NO: 716193 - DNA, 22 bp, Artificial Sequence
  chemically synthesized
aattttggcgaggttgaattta

SEQ ID NO: 716194 - DNA, 22 bp, Artificial Sequence
  chemically synthesized
taattttggcgaggttgaattt

SEQ ID NO: 716195 - DNA, 22 bp, Artificial Sequence
  chemically synthesized
aacctcgccaaaattaaaattc

SEQ ID NO: 716196 - DNA, 22 bp, Artificial Sequence
  chemically synthesized
acaggggatgaaaaagaatttt

SEQ ID NO: 716197 - DNA, 22 bp, Artificial Sequence
  chemically synthesized
aacaggggatgaaaaagaattt

SEQ ID NO: 716198 - DNA, 22 bp, Artificial Sequence
  chemically synthesized
gccaaaattaaaattctttttc

SEQ ID NO: 716199 - DNA, 22 bp, Artificial Sequence
  chemically synthesized
ttaacaggggatgaaaaagaat

SEQ ID NO: 716200 - DNA, 22 bp, Artificial Sequence
  chemically synthesized
cttaacaggggatgaaaaagaa

SEQ ID NO: 716201 - DNA, 22 bp, Artificial Sequence
  chemically synthesized
atcttcttaacaggggatgaaa

SEQ ID NO: 716202 - DNA, 22 bp, Artificial Sequence
  chemically synthesized
catcttcttaacaggggatgaa

SEQ ID NO: 716203 - DNA, 22 bp, Artificial Sequence
  chemically synthesized
tcatcttcttaacaggggatga

SEQ ID NO: 716204 - DNA, 22 bp, Artificial Sequence
  chemically synthesized
ttcatcttcttaacaggggatg

SEQ ID NO: 716205 - DNA, 22 bp, Artificial Sequence
  chemically synthesized
aaattctttttcatcccctgtt

SEQ ID NO: 716206 - DNA, 22 bp, Artificial Sequence
  chemically synthesized
atcttttcatcttcttaacagg

SEQ ID NO: 716207 - DNA, 22 bp, Artificial Sequence
  chemically synthesized
tttttcatcccctgttaagaag

SEQ ID NO: 716208 - DNA, 22 bp, Artificial Sequence
  chemically synthesized
tcatcttttcatcttcttaaca

SEQ ID NO: 716209 - DNA, 22 bp, Artificial Sequence
  chemically synthesized
tttcatcccctgttaagaagat

SEQ ID NO: 716210 - DNA, 22 bp, Artificial Sequence
  chemically synthesized
tctcatcttttcatcttcttaa

SEQ ID NO: 716211 - DNA, 22 bp, Artificial Sequence
  chemically synthesized
ttcatcccctgttaagaagatg

SEQ ID NO: 716212 - DNA, 22 bp, Artificial Sequence
  chemically synthesized
tcatcccctgttaagaagatga

SEQ ID NO: 716213 - DNA, 22 bp, Artificial Sequence
  chemically synthesized
tctctcatcttttcatcttctt

SEQ ID NO: 716214 - DNA, 22 bp, Artificial Sequence
  chemically synthesized
catcccctgttaagaagatgaa

SEQ ID NO: 716215 - DNA, 22 bp, Artificial Sequence
  chemically synthesized
ctctctcatcttttcatcttct

SEQ ID NO: 716216 - DNA, 22 bp, Artificial Sequence
  chemically synthesized
atcccctgttaagaagatgaaa

SEQ ID NO: 716217 - DNA, 22 bp, Artificial Sequence
  chemically synthesized
tctctctcatcttttcatcttc

SEQ ID NO: 716218 - DNA, 22 bp, Artificial Sequence
  chemically synthesized
ttaagaagatgaaaagatgaga

SEQ ID NO: 716219 - DNA, 22 bp, Artificial Sequence
  chemically synthesized
aaatgttttctctctcatcttt

SEQ ID NO: 716220 - DNA, 22 bp, Artificial Sequence
  chemically synthesized
caaatgttttctctctcatctt

SEQ ID NO: 716221 - DNA, 22 bp, Artificial Sequence
  chemically synthesized
tcaaatgttttctctctcatct

SEQ ID NO: 716222 - DNA, 22 bp, Artificial Sequence
  chemically synthesized
agaagatgaaaagatgagagag

SEQ ID NO: 716223 - DNA, 22 bp, Artificial Sequence
  chemically synthesized
tgtatagggttttcaaatgttt

SEQ ID NO: 716224 - DNA, 22 bp, Artificial Sequence
  chemically synthesized
gtgtatagggttttcaaatgtt

SEQ ID NO: 716225 - DNA, 22 bp, Artificial Sequence
  chemically synthesized
ttgtgtatagggttttcaaatg

SEQ ID NO: 716226 - DNA, 22 bp, Artificial Sequence
  chemically synthesized
cttgtgtatagggttttcaaat

SEQ ID NO: 716227 - DNA, 22 bp, Artificial Sequence
  chemically synthesized
tcttgtgtatagggttttcaaa

SEQ ID NO: 716228 - DNA, 22 bp, Artificial Sequence
  chemically synthesized
gtcctttcttgtgtatagggtt

SEQ ID NO: 716229 - DNA, 22 bp, Artificial Sequence
  chemically synthesized
gaaaaccctatacacaagaaag

SEQ ID NO: 716230 - DNA, 22 bp, Artificial Sequence
  chemically synthesized
aaaaccctatacacaagaaagg

SEQ ID NO: 716231 - DNA, 22 bp, Artificial Sequence
  chemically synthesized
tatcagatactagtcctttctt

SEQ ID NO: 716232 - DNA, 22 bp, Artificial Sequence
  chemically synthesized
tgtatcagatactagtcctttc

SEQ ID NO: 716233 - DNA, 22 bp, Artificial Sequence
  chemically synthesized
ctgtatcagatactagtccttt

SEQ ID NO: 716234 - DNA, 22 bp, Artificial Sequence
  chemically synthesized
tctgtatcagatactagtcctt

SEQ ID NO: 716235 - DNA, 22 bp, Artificial Sequence
  chemically synthesized
tttctgtatcagatactagtcc

SEQ ID NO: 716236 - DNA, 22 bp, Artificial Sequence
  chemically synthesized
tacacaagaaaggactagtatc

SEQ ID NO: 716237 - DNA, 22 bp, Artificial Sequence
  chemically synthesized
agagttctttctgtatcagata

SEQ ID NO: 716238 - DNA, 22 bp, Artificial Sequence
  chemically synthesized
gagagttctttctgtatcagat

SEQ ID NO: 716239 - DNA, 22 bp, Artificial Sequence
  chemically synthesized
tgagagttctttctgtatcaga

SEQ ID NO: 716240 - DNA, 22 bp, Artificial Sequence
  chemically synthesized
ggttttgagagttctttctgta

SEQ ID NO: 716241 - DNA, 22 bp, Artificial Sequence
  chemically synthesized
gtatctgatacagaaagaactc

SEQ ID NO: 716242 - DNA, 22 bp, Artificial Sequence
  chemically synthesized
tagttcggttttgagagttctt

SEQ ID NO: 716243 - DNA, 22 bp, Artificial Sequence
  chemically synthesized
atagttcggttttgagagttct

SEQ ID NO: 716244 - DNA, 22 bp, Artificial Sequence
  chemically synthesized
tatagttcggttttgagagttc

SEQ ID NO: 716245 - DNA, 22 bp, Artificial Sequence
  chemically synthesized
ttatagttcggttttgagagtt

SEQ ID NO: 716246 - DNA, 22 bp, Artificial Sequence
  chemically synthesized
tttatagttcggttttgagagt

SEQ ID NO: 716247 - DNA, 22 bp, Artificial Sequence
  chemically synthesized
atacagaaagaactctcaaaac

SEQ ID NO: 716248 - DNA, 22 bp, Artificial Sequence
  chemically synthesized
ttttatagttcggttttgagag

SEQ ID NO: 716249 - DNA, 22 bp, Artificial Sequence
  chemically synthesized
aaaagtttttttatagttcggt

SEQ ID NO: 716250 - DNA, 22 bp, Artificial Sequence
  chemically synthesized
attcaaaagtttttttatagtt

SEQ ID NO: 716251 - DNA, 22 bp, Artificial Sequence
  chemically synthesized
taattcaaaagtttttttatag

SEQ ID NO: 716252 - DNA, 22 bp, Artificial Sequence
  chemically synthesized
tcaaaaccgaactataaaaaaa

SEQ ID NO: 716253 - DNA, 22 bp, Artificial Sequence
  chemically synthesized
ctaattcaaaagtttttttata

SEQ ID NO: 716254 - DNA, 22 bp, Artificial Sequence
  chemically synthesized
tctaattcaaaagtttttttat

SEQ ID NO: 716255 - DNA, 22 bp, Artificial Sequence
  chemically synthesized
aaaaccgaactataaaaaaact

SEQ ID NO: 716256 - DNA, 22 bp, Artificial Sequence
  chemically synthesized
ttttctaattcaaaagtttttt

SEQ ID NO: 716257 - DNA, 22 bp, Artificial Sequence
  chemically synthesized
tctattttctaattcaaaagtt

SEQ ID NO: 716258 - DNA, 22 bp, Artificial Sequence
  chemically synthesized
gtctattttctaattcaaaagt

SEQ ID NO: 716259 - DNA, 22 bp, Artificial Sequence
  chemically synthesized
tgtctattttctaattcaaaag

SEQ ID NO: 716260 - DNA, 22 bp, Artificial Sequence
  chemically synthesized
ttgtctattttctaattcaaaa

SEQ ID NO: 716261 - DNA, 22 bp, Artificial Sequence
  chemically synthesized
taaaaaaacttttgaattagaa

SEQ ID NO: 716262 - DNA, 22 bp, Artificial Sequence
  chemically synthesized
atgtcttttgtctattttctaa

SEQ ID NO: 716263 - DNA, 22 bp, Artificial Sequence
  chemically synthesized
ttcatgtcttttgtctattttc

SEQ ID NO: 716264 - DNA, 22 bp, Artificial Sequence
  chemically synthesized
ttgaattagaaaatagacaaaa

SEQ ID NO: 716265 - DNA, 22 bp, Artificial Sequence
  chemically synthesized
tgaattagaaaatagacaaaag

SEQ ID NO: 716266 - DNA, 22 bp, Artificial Sequence
  chemically synthesized
gaattagaaaatagacaaaaga

SEQ ID NO: 716267 - DNA, 22 bp, Artificial Sequence
  chemically synthesized
aattagaaaatagacaaaagac

SEQ ID NO: 716268 - DNA, 22 bp, Artificial Sequence
  chemically synthesized
aaatgtctgttcatgtcttttg

SEQ ID NO: 716269 - DNA, 22 bp, Artificial Sequence
  chemically synthesized
gaaaatagacaaaagacatgaa

SEQ ID NO: 716270 - DNA, 22 bp, Artificial Sequence
  chemically synthesized
attgaaatgtctgttcatgtct

SEQ ID NO: 716271 - DNA, 22 bp, Artificial Sequence
  chemically synthesized
ctcattgaaatgtctgttcatg

SEQ ID NO: 716272 - DNA, 22 bp, Artificial Sequence
  chemically synthesized
ccatatgtatatcctcctcatt

SEQ ID NO: 716273 - DNA, 22 bp, Artificial Sequence
  chemically synthesized
gccatatgtatatcctcctcat

SEQ ID NO: 716274 - DNA, 22 bp, Artificial Sequence
  chemically synthesized
tttgccatatgtatatcctcct

SEQ ID NO: 716275 - DNA, 22 bp, Artificial Sequence
  chemically synthesized
gtttgccatatgtatatcctcc

SEQ ID NO: 716276 - DNA, 22 bp, Artificial Sequence
  chemically synthesized
tacttgtttgccatatgtatat

SEQ ID NO: 716277 - DNA, 22 bp, Artificial Sequence
  chemically synthesized
caatgaggaggatatacatatg

SEQ ID NO: 716278 - DNA, 22 bp, Artificial Sequence
  chemically synthesized
aatgaggaggatatacatatgg

SEQ ID NO: 716279 - DNA, 22 bp, Artificial Sequence
  chemically synthesized
ctgtacttgtttgccatatgta

SEQ ID NO: 716280 - DNA, 22 bp, Artificial Sequence
  chemically synthesized
cctgtacttgtttgccatatgt

SEQ ID NO: 716281 - DNA, 22 bp, Artificial Sequence
  chemically synthesized
tcctgtacttgtttgccatatg

SEQ ID NO: 716282 - DNA, 22 bp, Artificial Sequence
  chemically synthesized
ttcctgtacttgtttgccatat

SEQ ID NO: 716283 - DNA, 22 bp, Artificial Sequence
  chemically synthesized
aacaacttttcctgtacttgtt

SEQ ID NO: 716284 - DNA, 22 bp, Artificial Sequence
  chemically synthesized
ttgaacaacttttcctgtactt

SEQ ID NO: 716285 - DNA, 22 bp, Artificial Sequence
  chemically synthesized
gtggcaaatgctgttgaacaac

SEQ ID NO: 716286 - DNA, 22 bp, Artificial Sequence
  chemically synthesized
cctcgtggcaaatgctgttgaa

SEQ ID NO: 716287 - DNA, 22 bp, Artificial Sequence
  chemically synthesized
ccctcgtggcaaatgctgttga

SEQ ID NO: 716288 - DNA, 22 bp, Artificial Sequence
  chemically synthesized
cgtttccctcgtggcaaatgct

SEQ ID NO: 716289 - DNA, 22 bp, Artificial Sequence
  chemically synthesized
acgtttccctcgtggcaaatgc

SEQ ID NO: 716290 - DNA, 22 bp, Artificial Sequence
  chemically synthesized
atttacgtttccctcgtggcaa

SEQ ID NO: 716291 - DNA, 22 bp, Artificial Sequence
  chemically synthesized
ttcaacagcatttgccacgagg

SEQ ID NO: 716292 - DNA, 22 bp, Artificial Sequence
  chemically synthesized
aatttacgtttccctcgtggca

SEQ ID NO: 716293 - DNA, 22 bp, Artificial Sequence
  chemically synthesized
taatttacgtttccctcgtggc

SEQ ID NO: 716294 - DNA, 22 bp, Artificial Sequence
  chemically synthesized
ttaatttacgtttccctcgtgg

SEQ ID NO: 716295 - DNA, 22 bp, Artificial Sequence
  chemically synthesized
aacagcatttgccacgagggaa

SEQ ID NO: 716296 - DNA, 22 bp, Artificial Sequence
  chemically synthesized
tgcttttaatttacgtttccct

SEQ ID NO: 716297 - DNA, 22 bp, Artificial Sequence
  chemically synthesized
attgtgcttttaatttacgttt

SEQ ID NO: 716298 - DNA, 22 bp, Artificial Sequence
  chemically synthesized
gccacgagggaaacgtaaatta

SEQ ID NO: 716299 - DNA, 22 bp, Artificial Sequence
  chemically synthesized
ccacgagggaaacgtaaattaa

SEQ ID NO: 716300 - DNA, 22 bp, Artificial Sequence
  chemically synthesized
atatgtgtgtaggaatatctca

SEQ ID NO: 716301 - DNA, 22 bp, Artificial Sequence
  chemically synthesized
tgatatgtgtgtaggaatatct

SEQ ID NO: 716302 - DNA, 22 bp, Artificial Sequence
  chemically synthesized
aaagcacaatgagatattccta

SEQ ID NO: 716303 - DNA, 22 bp, Artificial Sequence
  chemically synthesized
gccattctgatatgtgtgtagg

SEQ ID NO: 716304 - DNA, 22 bp, Artificial Sequence
  chemically synthesized
agccattctgatatgtgtgtag

SEQ ID NO: 716305 - DNA, 22 bp, Artificial Sequence
  chemically synthesized
tagccattctgatatgtgtgta

SEQ ID NO: 716306 - DNA, 22 bp, Artificial Sequence
  chemically synthesized
ttagccattctgatatgtgtgt

SEQ ID NO: 716307 - DNA, 22 bp, Artificial Sequence
  chemically synthesized
tttttagccattctgatatgtg

SEQ ID NO: 716308 - DNA, 22 bp, Artificial Sequence
  chemically synthesized
atttttagccattctgatatgt

SEQ ID NO: 716309 - DNA, 22 bp, Artificial Sequence
  chemically synthesized
tatttttagccattctgatatg

SEQ ID NO: 716310 - DNA, 22 bp, Artificial Sequence
  chemically synthesized
ttatttttagccattctgatat

SEQ ID NO: 716311 - DNA, 22 bp, Artificial Sequence
  chemically synthesized
tttatttttagccattctgata

SEQ ID NO: 716312 - DNA, 22 bp, Artificial Sequence
  chemically synthesized
ctacacacatatcagaatggct

SEQ ID NO: 716313 - DNA, 22 bp, Artificial Sequence
  chemically synthesized
ttttttatttttagccattctg

SEQ ID NO: 716314 - DNA, 22 bp, Artificial Sequence
  chemically synthesized
cacacatatcagaatggctaaa

SEQ ID NO: 716315 - DNA, 22 bp, Artificial Sequence
  chemically synthesized
tcattattttttatttttagcc

SEQ ID NO: 716316 - DNA, 22 bp, Artificial Sequence
  chemically synthesized
gtgttgtcattattttttattt

SEQ ID NO: 716317 - DNA, 22 bp, Artificial Sequence
  chemically synthesized
ggtgttgtcattattttttatt

SEQ ID NO: 716318 - DNA, 22 bp, Artificial Sequence
  chemically synthesized
aaaataaaaaataatgacaaca

SEQ ID NO: 716319 - DNA, 22 bp, Artificial Sequence
  chemically synthesized
accaacatttggtgttgtcatt

SEQ ID NO: 716320 - DNA, 22 bp, Artificial Sequence
  chemically synthesized
caccaacatttggtgttgtcat

SEQ ID NO: 716321 - DNA, 22 bp, Artificial Sequence
  chemically synthesized
catcttcaccaacatttggtgt

SEQ ID NO: 716322 - DNA, 22 bp, Artificial Sequence
  chemically synthesized
tgcatcttcaccaacatttggt

SEQ ID NO: 716323 - DNA, 22 bp, Artificial Sequence
  chemically synthesized
tctgcatcttcaccaacatttg

SEQ ID NO: 716324 - DNA, 22 bp, Artificial Sequence
  chemically synthesized
ctctgcatcttcaccaacattt

SEQ ID NO: 716325 - DNA, 22 bp, Artificial Sequence
  chemically synthesized
gtgaagatgcagagaaactgga

SEQ ID NO: 716326 - DNA, 22 bp, Artificial Sequence
  chemically synthesized
caccagcaatgtatgagtgatc

SEQ ID NO: 716327 - DNA, 22 bp, Artificial Sequence
  chemically synthesized
tattccaccagcaatgtatgag

SEQ ID NO: 716328 - DNA, 22 bp, Artificial Sequence
  chemically synthesized
atattccaccagcaatgtatga

SEQ ID NO: 716329 - DNA, 22 bp, Artificial Sequence
  chemically synthesized
tatattccaccagcaatgtatg

SEQ ID NO: 716330 - DNA, 22 bp, Artificial Sequence
  chemically synthesized
ttttatattccaccagcaatgt

SEQ ID NO: 716331 - DNA, 22 bp, Artificial Sequence
  chemically synthesized
gatcactcatacattgctggtg

SEQ ID NO: 716332 - DNA, 22 bp, Artificial Sequence
  chemically synthesized
tactattttatattccaccagc

SEQ ID NO: 716333 - DNA, 22 bp, Artificial Sequence
  chemically synthesized
atacattgctggtggaatataa

SEQ ID NO: 716334 - DNA, 22 bp, Artificial Sequence
  chemically synthesized
cgaagcgtctgtactattttat

SEQ ID NO: 716335 - DNA, 22 bp, Artificial Sequence
  chemically synthesized
ccgaagcgtctgtactatttta

SEQ ID NO: 716336 - DNA, 22 bp, Artificial Sequence
  chemically synthesized
ctggtggaatataaaatagtac

SEQ ID NO: 716337 - DNA, 22 bp, Artificial Sequence
  chemically synthesized
tccgaagcgtctgtactatttt

SEQ ID NO: 716338 - DNA, 22 bp, Artificial Sequence
  chemically synthesized
ttccgaagcgtctgtactattt

SEQ ID NO: 716339 - DNA, 22 bp, Artificial Sequence
  chemically synthesized
gtggaatataaaatagtacaga

SEQ ID NO: 716340 - DNA, 22 bp, Artificial Sequence
  chemically synthesized
ccaaacttttccgaagcgtctg

SEQ ID NO: 716341 - DNA, 22 bp, Artificial Sequence
  chemically synthesized
aaactgccaaacttttccgaag

SEQ ID NO: 716342 - DNA, 22 bp, Artificial Sequence
  chemically synthesized
aaaactgccaaacttttccgaa

SEQ ID NO: 716343 - DNA, 22 bp, Artificial Sequence
  chemically synthesized
taaaactgccaaacttttccga

SEQ ID NO: 716344 - DNA, 22 bp, Artificial Sequence
  chemically synthesized
gttttaaaactgccaaactttt

SEQ ID NO: 716345 - DNA, 22 bp, Artificial Sequence
  chemically synthesized
agttttaaaactgccaaacttt

SEQ ID NO: 716346 - DNA, 22 bp, Artificial Sequence
  chemically synthesized
aatgtttagttttaaaactgcc

SEQ ID NO: 716347 - DNA, 22 bp, Artificial Sequence
  chemically synthesized
cggaaaagtttggcagttttaa

SEQ ID NO: 716348 - DNA, 22 bp, Artificial Sequence
  chemically synthesized
ggaaaagtttggcagttttaaa

SEQ ID NO: 716349 - DNA, 22 bp, Artificial Sequence
  chemically synthesized
ggcagttttaaaactaaacatt

SEQ ID NO: 716350 - DNA, 22 bp, Artificial Sequence
  chemically synthesized
gcagttttaaaactaaacattc

SEQ ID NO: 716351 - DNA, 22 bp, Artificial Sequence
  chemically synthesized
ggtcatatggtagttgaatgtt

SEQ ID NO: 716352 - DNA, 22 bp, Artificial Sequence
  chemically synthesized
ttaggtcatatggtagttgaat

SEQ ID NO: 716353 - DNA, 22 bp, Artificial Sequence
  chemically synthesized
taaaactaaacattcaactacc

SEQ ID NO: 716354 - DNA, 22 bp, Artificial Sequence
  chemically synthesized
aaaactaaacattcaactacca

SEQ ID NO: 716355 - DNA, 22 bp, Artificial Sequence
  chemically synthesized
aaactaaacattcaactaccat

SEQ ID NO: 716356 - DNA, 22 bp, Artificial Sequence
  chemically synthesized
aacattcaactaccatatgacc

SEQ ID NO: 716357 - DNA, 22 bp, Artificial Sequence
  chemically synthesized
aagagtgcaattgttaggtcat

SEQ ID NO: 716358 - DNA, 22 bp, Artificial Sequence
  chemically synthesized
aactaccatatgacctaacaat

SEQ ID NO: 716359 - DNA, 22 bp, Artificial Sequence
  chemically synthesized
ccatatgacctaacaattgcac

SEQ ID NO: 716360 - DNA, 22 bp, Artificial Sequence
  chemically synthesized
agataaatgctgaagagtgcaa

SEQ ID NO: 716361 - DNA, 22 bp, Artificial Sequence
  chemically synthesized
cctgagataaatgctgaagagt

SEQ ID NO: 716362 - DNA, 22 bp, Artificial Sequence
  chemically synthesized
ccctgagataaatgctgaagag

SEQ ID NO: 716363 - DNA, 22 bp, Artificial Sequence
  chemically synthesized
acaattgcactcttcagcattt

SEQ ID NO: 716364 - DNA, 22 bp, Artificial Sequence
  chemically synthesized
tttccctgagataaatgctgaa

SEQ ID NO: 716365 - DNA, 22 bp, Artificial Sequence
  chemically synthesized
atttccctgagataaatgctga

SEQ ID NO: 716366 - DNA, 22 bp, Artificial Sequence
  chemically synthesized
tatttccctgagataaatgctg

SEQ ID NO: 716367 - DNA, 22 bp, Artificial Sequence
  chemically synthesized
ttatttccctgagataaatgct

SEQ ID NO: 716368 - DNA, 22 bp, Artificial Sequence
  chemically synthesized
cactcttcagcatttatctcag

SEQ ID NO: 716369 - DNA, 22 bp, Artificial Sequence
  chemically synthesized
ttcagcatttatctcagggaaa

SEQ ID NO: 716370 - DNA, 22 bp, Artificial Sequence
  chemically synthesized
cagcatttatctcagggaaata

SEQ ID NO: 716371 - DNA, 22 bp, Artificial Sequence
  chemically synthesized
agcatttatctcagggaaataa

SEQ ID NO: 716372 - DNA, 22 bp, Artificial Sequence
  chemically synthesized
tgtgaacataagtttttatttc

SEQ ID NO: 716373 - DNA, 22 bp, Artificial Sequence
  chemically synthesized
gtgtgaacataagtttttattt

SEQ ID NO: 716374 - DNA, 22 bp, Artificial Sequence
  chemically synthesized
tgtgtgaacataagtttttatt

SEQ ID NO: 716375 - DNA, 22 bp, Artificial Sequence
  chemically synthesized
ttgtgtgaacataagtttttat

SEQ ID NO: 716376 - DNA, 22 bp, Artificial Sequence
  chemically synthesized
atctcagggaaataaaaactta

SEQ ID NO: 716377 - DNA, 22 bp, Artificial Sequence
  chemically synthesized
tctcagggaaataaaaacttat

SEQ ID NO: 716378 - DNA, 22 bp, Artificial Sequence
  chemically synthesized
agggaaataaaaacttatgttc

SEQ ID NO: 716379 - DNA, 22 bp, Artificial Sequence
  chemically synthesized
atgtacaggtttttgtgtgaac

SEQ ID NO: 716380 - DNA, 22 bp, Artificial Sequence
  chemically synthesized
ccaacattaatgtacaggtttt

SEQ ID NO: 716381 - DNA, 22 bp, Artificial Sequence
  chemically synthesized
atgttcacacaaaaacctgtac

SEQ ID NO: 716382 - DNA, 22 bp, Artificial Sequence
  chemically synthesized
tgttcacacaaaaacctgtaca

SEQ ID NO: 716383 - DNA, 22 bp, Artificial Sequence
  chemically synthesized
acacaaaaacctgtacattaat

SEQ ID NO: 716384 - DNA, 22 bp, Artificial Sequence
  chemically synthesized
tgaataaagctaccaacattaa

SEQ ID NO: 716385 - DNA, 22 bp, Artificial Sequence
  chemically synthesized
ttgtgaataaagctaccaacat

SEQ ID NO: 716386 - DNA, 22 bp, Artificial Sequence
  chemically synthesized
tacattaatgttggtagcttta

SEQ ID NO: 716387 - DNA, 22 bp, Artificial Sequence
  chemically synthesized
gactattgtgaataaagctacc

SEQ ID NO: 716388 - DNA, 22 bp, Artificial Sequence
  chemically synthesized
ggactattgtgaataaagctac

SEQ ID NO: 716389 - DNA, 22 bp, Artificial Sequence
  chemically synthesized
tggactattgtgaataaagcta

SEQ ID NO: 716390 - DNA, 22 bp, Artificial Sequence
  chemically synthesized
atgttggtagctttattcacaa

SEQ ID NO: 716391 - DNA, 22 bp, Artificial Sequence
  chemically synthesized
tagttttggactattgtgaata

SEQ ID NO: 716392 - DNA, 22 bp, Artificial Sequence
  chemically synthesized
tctgtagttttggactattgtg

SEQ ID NO: 716393 - DNA, 22 bp, Artificial Sequence
  chemically synthesized
gtagctttattcacaatagtcc

SEQ ID NO: 716394 - DNA, 22 bp, Artificial Sequence
  chemically synthesized
agttatctgtagttttggacta

SEQ ID NO: 716395 - DNA, 22 bp, Artificial Sequence
  chemically synthesized
tattcacaatagtccaaaacta

SEQ ID NO: 716396 - DNA, 22 bp, Artificial Sequence
  chemically synthesized
attcacaatagtccaaaactac

SEQ ID NO: 716397 - DNA, 22 bp, Artificial Sequence
  chemically synthesized
ttcacaatagtccaaaactaca

SEQ ID NO: 716398 - DNA, 22 bp, Artificial Sequence
  chemically synthesized
acaatagtccaaaactacagat

SEQ ID NO: 716399 - DNA, 22 bp, Artificial Sequence
  chemically synthesized
aagacatctgagttatctgtag

SEQ ID NO: 716400 - DNA, 22 bp, Artificial Sequence
  chemically synthesized
gaagacatctgagttatctgta

SEQ ID NO: 716401 - DNA, 22 bp, Artificial Sequence
  chemically synthesized
accccttgaagacatctgagtt

SEQ ID NO: 716402 - DNA, 22 bp, Artificial Sequence
  chemically synthesized
cagataactcagatgtcttcaa

SEQ ID NO: 716403 - DNA, 22 bp, Artificial Sequence
  chemically synthesized
atcactcaccccttgaagacat

SEQ ID NO: 716404 - DNA, 22 bp, Artificial Sequence
  chemically synthesized
aatcactcaccccttgaagaca

SEQ ID NO: 716405 - DNA, 22 bp, Artificial Sequence
  chemically synthesized
tttaatcactcaccccttgaag

SEQ ID NO: 716406 - DNA, 22 bp, Artificial Sequence
  chemically synthesized
atttaatcactcaccccttgaa

SEQ ID NO: 716407 - DNA, 22 bp, Artificial Sequence
  chemically synthesized
gtttatttaatcactcacccct

SEQ ID NO: 716408 - DNA, 22 bp, Artificial Sequence
  chemically synthesized
agatgtcttcaaggggtgagtg

SEQ ID NO: 716409 - DNA, 22 bp, Artificial Sequence
  chemically synthesized
caaggggtgagtgattaaataa

SEQ ID NO: 716410 - DNA, 22 bp, Artificial Sequence
  chemically synthesized
aaggggtgagtgattaaataaa

SEQ ID NO: 716411 - DNA, 22 bp, Artificial Sequence
  chemically synthesized
gatataccctagtttatttaat

SEQ ID NO: 716412 - DNA, 22 bp, Artificial Sequence
  chemically synthesized
ggatataccctagtttatttaa

SEQ ID NO: 716413 - DNA, 22 bp, Artificial Sequence
  chemically synthesized
tggtttggatataccctagttt

SEQ ID NO: 716414 - DNA, 22 bp, Artificial Sequence
  chemically synthesized
tatgctatggtttggatatacc

SEQ ID NO: 716415 - DNA, 22 bp, Artificial Sequence
  chemically synthesized
aataaactagggtatatccaaa

SEQ ID NO: 716416 - DNA, 22 bp, Artificial Sequence
  chemically synthesized
tcgtgagttgtatgctatggtt

SEQ ID NO: 716417 - DNA, 22 bp, Artificial Sequence
  chemically synthesized
gggtatatccaaaccatagcat

SEQ ID NO: 716418 - DNA, 22 bp, Artificial Sequence
  chemically synthesized
atcgtgagttgtatgctatggt

SEQ ID NO: 716419 - DNA, 22 bp, Artificial Sequence
  chemically synthesized
tatcgtgagttgtatgctatgg

SEQ ID NO: 716420 - DNA, 22 bp, Artificial Sequence
  chemically synthesized
ttatcgtgagttgtatgctatg

SEQ ID NO: 716421 - DNA, 22 bp, Artificial Sequence
  chemically synthesized
tttatcgtgagttgtatgctat

SEQ ID NO: 716422 - DNA, 22 bp, Artificial Sequence
  chemically synthesized
ctttttatcgtgagttgtatgc

SEQ ID NO: 716423 - DNA, 22 bp, Artificial Sequence
  chemically synthesized
cctttttatcgtgagttgtatg

SEQ ID NO: 716424 - DNA, 22 bp, Artificial Sequence
  chemically synthesized
tttcctttttatcgtgagttgt

SEQ ID NO: 716425 - DNA, 22 bp, Artificial Sequence
  chemically synthesized
gtttcctttttatcgtgagttg

SEQ ID NO: 716426 - DNA, 22 bp, Artificial Sequence
  chemically synthesized
tatgcagcaagacttgtttcct

SEQ ID NO: 716427 - DNA, 22 bp, Artificial Sequence
  chemically synthesized
atatgcagcaagacttgtttcc

SEQ ID NO: 716428 - DNA, 22 bp, Artificial Sequence
  chemically synthesized
tatatgcagcaagacttgtttc

SEQ ID NO: 716429 - DNA, 22 bp, Artificial Sequence
  chemically synthesized
acgataaaaaggaaacaagtct

SEQ ID NO: 716430 - DNA, 22 bp, Artificial Sequence
  chemically synthesized
ttatatgcagcaagacttgttt

SEQ ID NO: 716431 - DNA, 22 bp, Artificial Sequence
  chemically synthesized
tttatatgcagcaagacttgtt

SEQ ID NO: 716432 - DNA, 22 bp, Artificial Sequence
  chemically synthesized
tttttatatgcagcaagacttg

SEQ ID NO: 716433 - DNA, 22 bp, Artificial Sequence
  chemically synthesized
tctttttatatgcagcaagact

SEQ ID NO: 716434 - DNA, 22 bp, Artificial Sequence
  chemically synthesized
ctctttttatatgcagcaagac

SEQ ID NO: 716435 - DNA, 22 bp, Artificial Sequence
  chemically synthesized
gagatttctctttttatatgca

SEQ ID NO: 716436 - DNA, 22 bp, Artificial Sequence
  chemically synthesized
cctagagatttctctttttata

SEQ ID NO: 716437 - DNA, 22 bp, Artificial Sequence
  chemically synthesized
gctgcatataaaaagagaaatc

SEQ ID NO: 716438 - DNA, 22 bp, Artificial Sequence
  chemically synthesized
ctgcatataaaaagagaaatct

SEQ ID NO: 716439 - DNA, 22 bp, Artificial Sequence
  chemically synthesized
catataaaaagagaaatctcta

SEQ ID NO: 716440 - DNA, 22 bp, Artificial Sequence
  chemically synthesized
aacataattccctagagatttc

SEQ ID NO: 716441 - DNA, 22 bp, Artificial Sequence
  chemically synthesized
actcaacataattccctagaga

SEQ ID NO: 716442 - DNA, 22 bp, Artificial Sequence
  chemically synthesized
actcactcaacataattcccta

SEQ ID NO: 716443 - DNA, 22 bp, Artificial Sequence
  chemically synthesized
gactcactcaacataattccct

SEQ ID NO: 716444 - DNA, 22 bp, Artificial Sequence
  chemically synthesized
ggatggacttgactcactcaac

SEQ ID NO: 716445 - DNA, 22 bp, Artificial Sequence
  chemically synthesized
tagggaattatgttgagtgagt

SEQ ID NO: 716446 - DNA, 22 bp, Artificial Sequence
  chemically synthesized
gggatggacttgactcactcaa

SEQ ID NO: 716447 - DNA, 22 bp, Artificial Sequence
  chemically synthesized
tgggatggacttgactcactca

SEQ ID NO: 716448 - DNA, 22 bp, Artificial Sequence
  chemically synthesized
gggaattatgttgagtgagtca

SEQ ID NO: 716449 - DNA, 22 bp, Artificial Sequence
  chemically synthesized
tgttgagtgagtcaagtccatc

SEQ ID NO: 716450 - DNA, 22 bp, Artificial Sequence
  chemically synthesized
agtgagtcaagtccatcccaaa

SEQ ID NO: 716451 - DNA, 22 bp, Artificial Sequence
  chemically synthesized
tatgaatggaaccatacagtat

SEQ ID NO: 716452 - DNA, 22 bp, Artificial Sequence
  chemically synthesized
aataatgttatatgaatggaac

SEQ ID NO: 716453 - DNA, 22 bp, Artificial Sequence
  chemically synthesized
catactgtatggttccattcat

SEQ ID NO: 716454 - DNA, 22 bp, Artificial Sequence
  chemically synthesized
caataatgttatatgaatggaa

SEQ ID NO: 716455 - DNA, 22 bp, Artificial Sequence
  chemically synthesized
tttcaataatgttatatgaatg

SEQ ID NO: 716456 - DNA, 22 bp, Artificial Sequence
  chemically synthesized
ttatttcaataatgttatatga

SEQ ID NO: 716457 - DNA, 22 bp, Artificial Sequence
  chemically synthesized
tatggttccattcatataacat

SEQ ID NO: 716458 - DNA, 22 bp, Artificial Sequence
  chemically synthesized
gttatttcaataatgttatatg

SEQ ID NO: 716459 - DNA, 22 bp, Artificial Sequence
  chemically synthesized
tgttatttcaataatgttatat

SEQ ID NO: 716460 - DNA, 22 bp, Artificial Sequence
  chemically synthesized
attttgttatttcaataatgtt

SEQ ID NO: 716461 - DNA, 22 bp, Artificial Sequence
  chemically synthesized
aattttgttatttcaataatgt

SEQ ID NO: 716462 - DNA, 22 bp, Artificial Sequence
  chemically synthesized
taattttgttatttcaataatg

SEQ ID NO: 716463 - DNA, 22 bp, Artificial Sequence
  chemically synthesized
cattcatataacattattgaaa

SEQ ID NO: 716464 - DNA, 22 bp, Artificial Sequence
  chemically synthesized
tttaattttgttatttcaataa

SEQ ID NO: 716465 - DNA, 22 bp, Artificial Sequence
  chemically synthesized
ctttaattttgttatttcaata

SEQ ID NO: 716466 - DNA, 22 bp, Artificial Sequence
  chemically synthesized
atataacattattgaaataaca

SEQ ID NO: 716467 - DNA, 22 bp, Artificial Sequence
  chemically synthesized
catttctttaattttgttattt

SEQ ID NO: 716468 - DNA, 22 bp, Artificial Sequence
  chemically synthesized
ccatttctttaattttgttatt

SEQ ID NO: 716469 - DNA, 22 bp, Artificial Sequence
  chemically synthesized
tccatttctttaattttgttat

SEQ ID NO: 716470 - DNA, 22 bp, Artificial Sequence
  chemically synthesized
ttttccatttctttaattttgt

SEQ ID NO: 716471 - DNA, 22 bp, Artificial Sequence
  chemically synthesized
ttgaaataacaaaattaaagaa

SEQ ID NO: 716472 - DNA, 22 bp, Artificial Sequence
  chemically synthesized
gtctgttttccatttctttaat

SEQ ID NO: 716473 - DNA, 22 bp, Artificial Sequence
  chemically synthesized
aaataacaaaattaaagaaatg

SEQ ID NO: 716474 - DNA, 22 bp, Artificial Sequence
  chemically synthesized
ctagtctgttttccatttcttt

SEQ ID NO: 716475 - DNA, 22 bp, Artificial Sequence
  chemically synthesized
cagcaactactagtctgttttc

SEQ ID NO: 716476 - DNA, 22 bp, Artificial Sequence
  chemically synthesized
ccagcaactactagtctgtttt

SEQ ID NO: 716477 - DNA, 22 bp, Artificial Sequence
  chemically synthesized
aagaaatggaaaacagactagt

SEQ ID NO: 716478 - DNA, 22 bp, Artificial Sequence
  chemically synthesized
cttccagcaactactagtctgt

SEQ ID NO: 716479 - DNA, 22 bp, Artificial Sequence
  chemically synthesized
ctacttccagcaactactagtc

SEQ ID NO: 716480 - DNA, 22 bp, Artificial Sequence
  chemically synthesized
cctcctacttccagcaactact

SEQ ID NO: 716481 - DNA, 22 bp, Artificial Sequence
  chemically synthesized
ccccccctacctcctacttcca

SEQ ID NO: 716482 - DNA, 22 bp, Artificial Sequence
  chemically synthesized
gtagttgctggaagtaggaggt

SEQ ID NO: 716483 - DNA, 22 bp, Artificial Sequence
  chemically synthesized
cctgccccccctacctcctact

SEQ ID NO: 716484 - DNA, 22 bp, Artificial Sequence
  chemically synthesized
ccctgccccccctacctcctac

SEQ ID NO: 716485 - DNA, 22 bp, Artificial Sequence
  chemically synthesized
ctggaagtaggaggtagggggg

SEQ ID NO: 716486 - DNA, 22 bp, Artificial Sequence
  chemically synthesized
gaagtaggaggtagggggggca

SEQ ID NO: 716487 - DNA, 22 bp, Artificial Sequence
  chemically synthesized
tagccacacccacttccctgcc

SEQ ID NO: 716488 - DNA, 22 bp, Artificial Sequence
  chemically synthesized
atagccacacccacttccctgc

SEQ ID NO: 716489 - DNA, 22 bp, Artificial Sequence
  chemically synthesized
tatagccacacccacttccctg

SEQ ID NO: 716490 - DNA, 22 bp, Artificial Sequence
  chemically synthesized
ttatagccacacccacttccct

SEQ ID NO: 716491 - DNA, 22 bp, Artificial Sequence
  chemically synthesized
gccttttatagccacacccact

SEQ ID NO: 716492 - DNA, 22 bp, Artificial Sequence
  chemically synthesized
ttggccttttatagccacaccc

SEQ ID NO: 716493 - DNA, 22 bp, Artificial Sequence
  chemically synthesized
ctattggccttttatagccaca

SEQ ID NO: 716494 - DNA, 22 bp, Artificial Sequence
  chemically synthesized
caaagatccctcctattggcct

SEQ ID NO: 716495 - DNA, 22 bp, Artificial Sequence
  chemically synthesized
atcactacaaagatccctccta

SEQ ID NO: 716496 - DNA, 22 bp, Artificial Sequence
  chemically synthesized
taaaaggccaataggagggatc

SEQ ID NO: 716497 - DNA, 22 bp, Artificial Sequence
  chemically synthesized
catcactacaaagatccctcct

SEQ ID NO: 716498 - DNA, 22 bp, Artificial Sequence
  chemically synthesized
tcatcactacaaagatccctcc

SEQ ID NO: 716499 - DNA, 22 bp, Artificial Sequence
  chemically synthesized
tcagtatacagaacattttcat

SEQ ID NO: 716500 - DNA, 22 bp, Artificial Sequence
  chemically synthesized
tgtagtgatgaaaatgttctgt

SEQ ID NO: 716501 - DNA, 22 bp, Artificial Sequence
  chemically synthesized
gtagtgatgaaaatgttctgta

SEQ ID NO: 716502 - DNA, 22 bp, Artificial Sequence
  chemically synthesized
tagtgatgaaaatgttctgtat

SEQ ID NO: 716503 - DNA, 22 bp, Artificial Sequence
  chemically synthesized
acgtcaatattgtcagtataca

SEQ ID NO: 716504 - DNA, 22 bp, Artificial Sequence
  chemically synthesized
gacgtcaatattgtcagtatac

SEQ ID NO: 716505 - DNA, 22 bp, Artificial Sequence
  chemically synthesized
tgacgtcaatattgtcagtata

SEQ ID NO: 716506 - DNA, 22 bp, Artificial Sequence
  chemically synthesized
tgtatactgacaatattgacgt

SEQ ID NO: 716507 - DNA, 22 bp, Artificial Sequence
  chemically synthesized
tatactgacaatattgacgtca

SEQ ID NO: 716508 - DNA, 22 bp, Artificial Sequence
  chemically synthesized
acaatattgacgtcaaaatcct

SEQ ID NO: 716509 - DNA, 22 bp, Artificial Sequence
  chemically synthesized
aatgtcacaaccaggattttga

SEQ ID NO: 716510 - DNA, 22 bp, Artificial Sequence
  chemically synthesized
gttcaatgtcacaaccaggatt

SEQ ID NO: 716511 - DNA, 22 bp, Artificial Sequence
  chemically synthesized
tagttcaatgtcacaaccagga

SEQ ID NO: 716512 - DNA, 22 bp, Artificial Sequence
  chemically synthesized
acgtcaaaatcctggttgtgac

SEQ ID NO: 716513 - DNA, 22 bp, Artificial Sequence
  chemically synthesized
caaaactctagttcaatgtcac

SEQ ID NO: 716514 - DNA, 22 bp, Artificial Sequence
  chemically synthesized
gttgtgacattgaactagagtt

SEQ ID NO: 716515 - DNA, 22 bp, Artificial Sequence
  chemically synthesized
atggtacacctgcaaaactcta

SEQ ID NO: 716516 - DNA, 22 bp, Artificial Sequence
  chemically synthesized
tgacattgaactagagttttgc

SEQ ID NO: 716517 - DNA, 22 bp, Artificial Sequence
  chemically synthesized
taatggtacacctgcaaaactc

SEQ ID NO: 716518 - DNA, 22 bp, Artificial Sequence
  chemically synthesized
ctctaatggtacacctgcaaaa

SEQ ID NO: 716519 - DNA, 22 bp, Artificial Sequence
  chemically synthesized
cctctaatggtacacctgcaaa

SEQ ID NO: 716520 - DNA, 22 bp, Artificial Sequence
  chemically synthesized
aactagagttttgcaggtgtac

SEQ ID NO: 716521 - DNA, 22 bp, Artificial Sequence
  chemically synthesized
gagttttgcaggtgtaccatta

SEQ ID NO: 716522 - DNA, 22 bp, Artificial Sequence
  chemically synthesized
ccgagtttcctctaatggtaca

SEQ ID NO: 716523 - DNA, 22 bp, Artificial Sequence
  chemically synthesized
accgagtttcctctaatggtac

SEQ ID NO: 716524 - DNA, 22 bp, Artificial Sequence
  chemically synthesized
taccgagtttcctctaatggta

SEQ ID NO: 716525 - DNA, 22 bp, Artificial Sequence
  chemically synthesized
ttaccgagtttcctctaatggt

SEQ ID NO: 716526 - DNA, 22 bp, Artificial Sequence
  chemically synthesized
tttaccgagtttcctctaatgg

SEQ ID NO: 716527 - DNA, 22 bp, Artificial Sequence
  chemically synthesized
tgcaggtgtaccattagaggaa

SEQ ID NO: 716528 - DNA, 22 bp, Artificial Sequence
  chemically synthesized
gcaggtgtaccattagaggaaa

SEQ ID NO: 716529 - DNA, 22 bp, Artificial Sequence
  chemically synthesized
caggtgtaccattagaggaaac

SEQ ID NO: 716530 - DNA, 22 bp, Artificial Sequence
  chemically synthesized
cacatacctttttaccgagttt

SEQ ID NO: 716531 - DNA, 22 bp, Artificial Sequence
  chemically synthesized
gaggaaactcggtaaaaaggta

SEQ ID NO: 716532 - DNA, 22 bp, Artificial Sequence
  chemically synthesized
tacacggactccacataccttt

SEQ ID NO: 716533 - DNA, 22 bp, Artificial Sequence
  chemically synthesized
ggtaaaaaggtatgtggagtcc

SEQ ID NO: 716534 - DNA, 22 bp, Artificial Sequence
  chemically synthesized
taagaaattatacacggactcc

SEQ ID NO: 716535 - DNA, 22 bp, Artificial Sequence
  chemically synthesized
acatggagttgtaagaaattat

SEQ ID NO: 716536 - DNA, 22 bp, Artificial Sequence
  chemically synthesized
tagattcacatggagttgtaag

SEQ ID NO: 716537 - DNA, 22 bp, Artificial Sequence
  chemically synthesized
attgtagattcacatggagttg

SEQ ID NO: 716538 - DNA, 22 bp, Artificial Sequence
  chemically synthesized
aattgtagattcacatggagtt

SEQ ID NO: 716539 - DNA, 22 bp, Artificial Sequence
  chemically synthesized
taattgtagattcacatggagt

SEQ ID NO: 716540 - DNA, 22 bp, Artificial Sequence
  chemically synthesized
ttaattgtagattcacatggag

SEQ ID NO: 716541 - DNA, 22 bp, Artificial Sequence
  chemically synthesized
cttacaactccatgtgaatcta

SEQ ID NO: 716542 - DNA, 22 bp, Artificial Sequence
  chemically synthesized
ttacaactccatgtgaatctac

SEQ ID NO: 716543 - DNA, 22 bp, Artificial Sequence
  chemically synthesized
agcatttttaattgtagattca

SEQ ID NO: 716544 - DNA, 22 bp, Artificial Sequence
  chemically synthesized
acaactccatgtgaatctacaa

SEQ ID NO: 716545 - DNA, 22 bp, Artificial Sequence
  chemically synthesized
caactccatgtgaatctacaat

SEQ ID NO: 716546 - DNA, 22 bp, Artificial Sequence
  chemically synthesized
gatctcagcatttttaattgta

SEQ ID NO: 716547 - DNA, 22 bp, Artificial Sequence
  chemically synthesized
catgtgaatctacaattaaaaa

SEQ ID NO: 716548 - DNA, 22 bp, Artificial Sequence
  chemically synthesized
ctagatctcagcatttttaatt

SEQ ID NO: 716549 - DNA, 22 bp, Artificial Sequence
  chemically synthesized
agaactactagatctcagcatt

SEQ ID NO: 716550 - DNA, 22 bp, Artificial Sequence
  chemically synthesized
ctgagaactactagatctcagc

SEQ ID NO: 716551 - DNA, 22 bp, Artificial Sequence
  chemically synthesized
caattaaaaatgctgagatcta

SEQ ID NO: 716552 - DNA, 22 bp, Artificial Sequence
  chemically synthesized
aaaatgctgagatctagtagtt

SEQ ID NO: 716553 - DNA, 22 bp, Artificial Sequence
  chemically synthesized
atacattactgagaactactag

SEQ ID NO: 716554 - DNA, 22 bp, Artificial Sequence
  chemically synthesized
agatctagtagttctcagtaat

SEQ ID NO: 716555 - DNA, 22 bp, Artificial Sequence
  chemically synthesized
agtcattgatacattactgaga

SEQ ID NO: 716556 - DNA, 22 bp, Artificial Sequence
  chemically synthesized
gtagttctcagtaatgtatcaa

SEQ ID NO: 716557 - DNA, 22 bp, Artificial Sequence
  chemically synthesized
atgaaaattcagtcattgatac

SEQ ID NO: 716558 - DNA, 22 bp, Artificial Sequence
  chemically synthesized
tcagtaatgtatcaatgactga

SEQ ID NO: 716559 - DNA, 22 bp, Artificial Sequence
  chemically synthesized
atctgatgaaaattcagtcatt

SEQ ID NO: 716560 - DNA, 22 bp, Artificial Sequence
  chemically synthesized
agtaatgtatcaatgactgaat

SEQ ID NO: 716561 - DNA, 22 bp, Artificial Sequence
  chemically synthesized
aatataactaatctgatgaaaa

SEQ ID NO: 716562 - DNA, 22 bp, Artificial Sequence
  chemically synthesized
atattcaatataactaatctga

SEQ ID NO: 716563 - DNA, 22 bp, Artificial Sequence
  chemically synthesized
aattttcatcagattagttata

SEQ ID NO: 716564 - DNA, 22 bp, Artificial Sequence
  chemically synthesized
gaattaatattcaatataacta

SEQ ID NO: 716565 - DNA, 22 bp, Artificial Sequence
  chemically synthesized
agaattaatattcaatataact

SEQ ID NO: 716566 - DNA, 22 bp, Artificial Sequence
  chemically synthesized
tcatcagattagttatattgaa

SEQ ID NO: 716567 - DNA, 22 bp, Artificial Sequence
  chemically synthesized
catcagattagttatattgaat

SEQ ID NO: 716568 - DNA, 22 bp, Artificial Sequence
  chemically synthesized
atcagattagttatattgaata

SEQ ID NO: 716569 - DNA, 22 bp, Artificial Sequence
  chemically synthesized
gttatattgaatattaattcta

SEQ ID NO: 716570 - DNA, 22 bp, Artificial Sequence
  chemically synthesized
tattgaatattaattctaaggt

SEQ ID NO: 716571 - DNA, 22 bp, Artificial Sequence
  chemically synthesized
aatattaattctaaggttctgt

SEQ ID NO: 716572 - DNA, 22 bp, Artificial Sequence
  chemically synthesized
aaaagggatagtgacagaacct

SEQ ID NO: 716573 - DNA, 22 bp, Artificial Sequence
  chemically synthesized
gaaaagggatagtgacagaacc

SEQ ID NO: 716574 - DNA, 22 bp, Artificial Sequence
  chemically synthesized
ttgaaaagggatagtgacagaa

SEQ ID NO: 716575 - DNA, 22 bp, Artificial Sequence
  chemically synthesized
attctaaggttctgtcactatc

SEQ ID NO: 716576 - DNA, 22 bp, Artificial Sequence
  chemically synthesized
gattcttgaaaagggatagtga

SEQ ID NO: 716577 - DNA, 22 bp, Artificial Sequence
  chemically synthesized
taaggttctgtcactatccctt

SEQ ID NO: 716578 - DNA, 22 bp, Artificial Sequence
  chemically synthesized
tagattcttgaaaagggatagt

SEQ ID NO: 716579 - DNA, 22 bp, Artificial Sequence
  chemically synthesized
ctagattcttgaaaagggatag

SEQ ID NO: 716580 - DNA, 22 bp, Artificial Sequence
  chemically synthesized
aggttctgtcactatccctttt

SEQ ID NO: 716581 - DNA, 22 bp, Artificial Sequence
  chemically synthesized
agcttctagattcttgaaaagg

SEQ ID NO: 716582 - DNA, 22 bp, Artificial Sequence
  chemically synthesized
tgtcactatcccttttcaagaa

SEQ ID NO: 716583 - DNA, 22 bp, Artificial Sequence
  chemically synthesized
tcactatcccttttcaagaatc

SEQ ID NO: 716584 - DNA, 22 bp, Artificial Sequence
  chemically synthesized
tcccttttcaagaatctagaag

SEQ ID NO: 716585 - DNA, 22 bp, Artificial Sequence
  chemically synthesized
aaaaagaaatctaagcttctag

SEQ ID NO: 716586 - DNA, 22 bp, Artificial Sequence
  chemically synthesized
caaaaagaaatctaagcttcta

SEQ ID NO: 716587 - DNA, 22 bp, Artificial Sequence
  chemically synthesized
ttcaagaatctagaagcttaga

SEQ ID NO: 716588 - DNA, 22 bp, Artificial Sequence
  chemically synthesized
tcaagaatctagaagcttagat

SEQ ID NO: 716589 - DNA, 22 bp, Artificial Sequence
  chemically synthesized
cttcaaaaagaaatctaagctt

SEQ ID NO: 716590 - DNA, 22 bp, Artificial Sequence
  chemically synthesized
caagaatctagaagcttagatt

SEQ ID NO: 716591 - DNA, 22 bp, Artificial Sequence
  chemically synthesized
aagaatctagaagcttagattt

SEQ ID NO: 716592 - DNA, 22 bp, Artificial Sequence
  chemically synthesized
gtatattgcttcaaaaagaaat

SEQ ID NO: 716593 - DNA, 22 bp, Artificial Sequence
  chemically synthesized
gaagcttagatttctttttgaa

SEQ ID NO: 716594 - DNA, 22 bp, Artificial Sequence
  chemically synthesized
ttggtatattgcttcaaaaaga

SEQ ID NO: 716595 - DNA, 22 bp, Artificial Sequence
  chemically synthesized
agatttctttttgaagcaatat

SEQ ID NO: 716596 - DNA, 22 bp, Artificial Sequence
  chemically synthesized
gatttctttttgaagcaatata

SEQ ID NO: 716597 - DNA, 22 bp, Artificial Sequence
  chemically synthesized
ataagaaaactattggtatatt

SEQ ID NO: 716598 - DNA, 22 bp, Artificial Sequence
  chemically synthesized
ctttttgaagcaatataccaat

SEQ ID NO: 716599 - DNA, 22 bp, Artificial Sequence
  chemically synthesized
aataagaaaactattggtatat

SEQ ID NO: 716600 - DNA, 22 bp, Artificial Sequence
  chemically synthesized
tttttgaagcaatataccaata

SEQ ID NO: 716601 - DNA, 22 bp, Artificial Sequence
  chemically synthesized
taataagaaaactattggtata

SEQ ID NO: 716602 - DNA, 22 bp, Artificial Sequence
  chemically synthesized
ttaataagaaaactattggtat

SEQ ID NO: 716603 - DNA, 22 bp, Artificial Sequence
  chemically synthesized
tttgaagcaatataccaatagt

SEQ ID NO: 716604 - DNA, 22 bp, Artificial Sequence
  chemically synthesized
ttgaagcaatataccaatagtt

SEQ ID NO: 716605 - DNA, 22 bp, Artificial Sequence
  chemically synthesized
tgaagcaatataccaatagttt

SEQ ID NO: 716606 - DNA, 22 bp, Artificial Sequence
  chemically synthesized
gaagcaatataccaatagtttt

SEQ ID NO: 716607 - DNA, 22 bp, Artificial Sequence
  chemically synthesized
aagcaatataccaatagttttc

SEQ ID NO: 716608 - DNA, 22 bp, Artificial Sequence
  chemically synthesized
aatttttaataagaaaactatt

SEQ ID NO: 716609 - DNA, 22 bp, Artificial Sequence
  chemically synthesized
tgaatttttaataagaaaacta

SEQ ID NO: 716610 - DNA, 22 bp, Artificial Sequence
  chemically synthesized
ctgaatttttaataagaaaact

SEQ ID NO: 716611 - DNA, 22 bp, Artificial Sequence
  chemically synthesized
aagccttctgaatttttaataa

SEQ ID NO: 716612 - DNA, 22 bp, Artificial Sequence
  chemically synthesized
gccattgaagccttctgaattt

SEQ ID NO: 716613 - DNA, 22 bp, Artificial Sequence
  chemically synthesized
tcttattaaaaattcagaaggc

SEQ ID NO: 716614 - DNA, 22 bp, Artificial Sequence
  chemically synthesized
ttcgccattgaagccttctgaa

SEQ ID NO: 716615 - DNA, 22 bp, Artificial Sequence
  chemically synthesized
cttattaaaaattcagaaggct

SEQ ID NO: 716616 - DNA, 22 bp, Artificial Sequence
  chemically synthesized
ttattaaaaattcagaaggctt

SEQ ID NO: 716617 - DNA, 22 bp, Artificial Sequence
  chemically synthesized
attaaaaattcagaaggcttca

SEQ ID NO: 716618 - DNA, 22 bp, Artificial Sequence
  chemically synthesized
ttaaaaattcagaaggcttcaa

SEQ ID NO: 716619 - DNA, 22 bp, Artificial Sequence
  chemically synthesized
aaaattcagaaggcttcaatgg

SEQ ID NO: 716620 - DNA, 22 bp, Artificial Sequence
  chemically synthesized
ccaaaaaattattcgccattga

SEQ ID NO: 716621 - DNA, 22 bp, Artificial Sequence
  chemically synthesized
ttaccaaaaaattattcgccat

SEQ ID NO: 716622 - DNA, 22 bp, Artificial Sequence
  chemically synthesized
agaaggcttcaatggcgaataa

SEQ ID NO: 716623 - DNA, 22 bp, Artificial Sequence
  chemically synthesized
attaccaaaaaattattcgcca

SEQ ID NO: 716624 - DNA, 22 bp, Artificial Sequence
  chemically synthesized
ttattaccaaaaaattattcgc

SEQ ID NO: 716625 - DNA, 22 bp, Artificial Sequence
  chemically synthesized
cttattaccaaaaaattattcg

SEQ ID NO: 716626 - DNA, 22 bp, Artificial Sequence
  chemically synthesized
tcttattaccaaaaaattattc

SEQ ID NO: 716627 - DNA, 22 bp, Artificial Sequence
  chemically synthesized
ttcttattaccaaaaaattatt

SEQ ID NO: 716628 - DNA, 22 bp, Artificial Sequence
  chemically synthesized
tttcttattaccaaaaaattat

SEQ ID NO: 716629 - DNA, 22 bp, Artificial Sequence
  chemically synthesized
ttttcttattaccaaaaaatta

SEQ ID NO: 716630 - DNA, 22 bp, Artificial Sequence
  chemically synthesized
tttttcttattaccaaaaaatt

SEQ ID NO: 716631 - DNA, 22 bp, Artificial Sequence
  chemically synthesized
caatggcgaataattttttggt

SEQ ID NO: 716632 - DNA, 22 bp, Artificial Sequence
  chemically synthesized
aatggcgaataattttttggta

SEQ ID NO: 716633 - DNA, 22 bp, Artificial Sequence
  chemically synthesized
gttttttttcttattaccaaaa

SEQ ID NO: 716634 - DNA, 22 bp, Artificial Sequence
  chemically synthesized
agttttttttcttattaccaaa

SEQ ID NO: 716635 - DNA, 22 bp, Artificial Sequence
  chemically synthesized
ttagttttttttcttattacca

SEQ ID NO: 716636 - DNA, 22 bp, Artificial Sequence
  chemically synthesized
tttggtaataagaaaaaaaact

SEQ ID NO: 716637 - DNA, 22 bp, Artificial Sequence
  chemically synthesized
ttggtaataagaaaaaaaacta

SEQ ID NO: 716638 - DNA, 22 bp, Artificial Sequence
  chemically synthesized
tggtaataagaaaaaaaactaa

SEQ ID NO: 716639 - DNA, 22 bp, Artificial Sequence
  chemically synthesized
ggtaataagaaaaaaaactaag

SEQ ID NO: 716640 - DNA, 22 bp, Artificial Sequence
  chemically synthesized
gtaataagaaaaaaaactaaga

SEQ ID NO: 716641 - DNA, 22 bp, Artificial Sequence
  chemically synthesized
ataaaaaataattcttagtttt

SEQ ID NO: 716642 - DNA, 22 bp, Artificial Sequence
  chemically synthesized
aataaaaaataattcttagttt

SEQ ID NO: 716643 - DNA, 22 bp, Artificial Sequence
  chemically synthesized
taataaaaaataattcttagtt

SEQ ID NO: 716644 - DNA, 22 bp, Artificial Sequence
  chemically synthesized
ttaataaaaaataattcttagt

SEQ ID NO: 716645 - DNA, 22 bp, Artificial Sequence
  chemically synthesized
tttaataaaaaataattcttag

SEQ ID NO: 716646 - DNA, 22 bp, Artificial Sequence
  chemically synthesized
ttttttaataaaaaataattct

SEQ ID NO: 716647 - DNA, 22 bp, Artificial Sequence
  chemically synthesized
ttgttttttaataaaaaataat

SEQ ID NO: 716648 - DNA, 22 bp, Artificial Sequence
  chemically synthesized
gttgttttttaataaaaaataa

SEQ ID NO: 716649 - DNA, 22 bp, Artificial Sequence
  chemically synthesized
tgttgttttttaataaaaaata

SEQ ID NO: 716650 - DNA, 22 bp, Artificial Sequence
  chemically synthesized
attttgttgttttttaataaaa

SEQ ID NO: 716651 - DNA, 22 bp, Artificial Sequence
  chemically synthesized
agaattattttttattaaaaaa

SEQ ID NO: 716652 - DNA, 22 bp, Artificial Sequence
  chemically synthesized
agagctgattttgttgtttttt

SEQ ID NO: 716653 - DNA, 22 bp, Artificial Sequence
  chemically synthesized
aagagctgattttgttgttttt

SEQ ID NO: 716654 - DNA, 22 bp, Artificial Sequence
  chemically synthesized
ttttttattaaaaaacaacaaa

SEQ ID NO: 716655 - DNA, 22 bp, Artificial Sequence
  chemically synthesized
tttattaaaaaacaacaaaatc

SEQ ID NO: 716656 - DNA, 22 bp, Artificial Sequence
  chemically synthesized
ttattaaaaaacaacaaaatca

SEQ ID NO: 716657 - DNA, 22 bp, Artificial Sequence
  chemically synthesized
tattaaaaaacaacaaaatcag

SEQ ID NO: 716658 - DNA, 22 bp, Artificial Sequence
  chemically synthesized
attaaaaaacaacaaaatcagc

SEQ ID NO: 716659 - DNA, 22 bp, Artificial Sequence
  chemically synthesized
ttaaaaaacaacaaaatcagct

SEQ ID NO: 716660 - DNA, 22 bp, Artificial Sequence
  chemically synthesized
taagtgtcttaagagctgattt

SEQ ID NO: 716661 - DNA, 22 bp, Artificial Sequence
  chemically synthesized
aaaaacaacaaaatcagctctt

SEQ ID NO: 716662 - DNA, 22 bp, Artificial Sequence
  chemically synthesized
aactgtaagtgtcttaagagct

SEQ ID NO: 716663 - DNA, 22 bp, Artificial Sequence
  chemically synthesized
cccatctgaactgtaagtgtct

SEQ ID NO: 716664 - DNA, 22 bp, Artificial Sequence
  chemically synthesized
ccccatctgaactgtaagtgtc

SEQ ID NO: 716665 - DNA, 22 bp, Artificial Sequence
  chemically synthesized
tttccccatctgaactgtaagt

SEQ ID NO: 716666 - DNA, 22 bp, Artificial Sequence
  chemically synthesized
atttccccatctgaactgtaag

SEQ ID NO: 716667 - DNA, 22 bp, Artificial Sequence
  chemically synthesized
ttaagacacttacagttcagat

SEQ ID NO: 716668 - DNA, 22 bp, Artificial Sequence
  chemically synthesized
aagacacttacagttcagatgg

SEQ ID NO: 716669 - DNA, 22 bp, Artificial Sequence
  chemically synthesized
gatcttatttccccatctgaac

SEQ ID NO: 716670 - DNA, 22 bp, Artificial Sequence
  chemically synthesized
agacacttacagttcagatggg

SEQ ID NO: 716671 - DNA, 22 bp, Artificial Sequence
  chemically synthesized
acagttcagatggggaaataag

SEQ ID NO: 716672 - DNA, 22 bp, Artificial Sequence
  chemically synthesized
acatatctagatcttatttccc

SEQ ID NO: 716673 - DNA, 22 bp, Artificial Sequence
  chemically synthesized
cagttcagatggggaaataaga

SEQ ID NO: 716674 - DNA, 22 bp, Artificial Sequence
  chemically synthesized
cacatatctagatcttatttcc

SEQ ID NO: 716675 - DNA, 22 bp, Artificial Sequence
  chemically synthesized
tcacatatctagatcttatttc

SEQ ID NO: 716676 - DNA, 22 bp, Artificial Sequence
  chemically synthesized
attttcacatatctagatctta

SEQ ID NO: 716677 - DNA, 22 bp, Artificial Sequence
  chemically synthesized
agatggggaaataagatctaga

SEQ ID NO: 716678 - DNA, 22 bp, Artificial Sequence
  chemically synthesized
ctcattttcacatatctagatc

SEQ ID NO: 716679 - DNA, 22 bp, Artificial Sequence
  chemically synthesized
accggacactactcattttcac

SEQ ID NO: 716680 - DNA, 22 bp, Artificial Sequence
  chemically synthesized
caccggacactactcattttca

SEQ ID NO: 716681 - DNA, 22 bp, Artificial Sequence
  chemically synthesized
tcaccggacactactcattttc

SEQ ID NO: 716682 - DNA, 22 bp, Artificial Sequence
  chemically synthesized
gatatgtgaaaatgagtagtgt

SEQ ID NO: 716683 - DNA, 22 bp, Artificial Sequence
  chemically synthesized
accacccagaaacgagcctttc

SEQ ID NO: 716684 - DNA, 22 bp, Artificial Sequence
  chemically synthesized
aactaaccacccagaaacgagc

SEQ ID NO: 716685 - DNA, 22 bp, Artificial Sequence
  chemically synthesized
gaactaaccacccagaaacgag

SEQ ID NO: 716686 - DNA, 22 bp, Artificial Sequence
  chemically synthesized
tgaactaaccacccagaaacga

SEQ ID NO: 716687 - DNA, 22 bp, Artificial Sequence
  chemically synthesized
cagggaacctttgaactaacca

SEQ ID NO: 716688 - DNA, 22 bp, Artificial Sequence
  chemically synthesized
gtttctgggtggttagttcaaa

SEQ ID NO: 716689 - DNA, 22 bp, Artificial Sequence
  chemically synthesized
ctgggtggttagttcaaaggtt

SEQ ID NO: 716690 - DNA, 22 bp, Artificial Sequence
  chemically synthesized
tgggtggttagttcaaaggttc

SEQ ID NO: 716691 - DNA, 22 bp, Artificial Sequence
  chemically synthesized
agcgtcctccagggaacctttg

SEQ ID NO: 716692 - DNA, 22 bp, Artificial Sequence
  chemically synthesized
ggtggttagttcaaaggttccc

SEQ ID NO: 716693 - DNA, 22 bp, Artificial Sequence
  chemically synthesized
aagctcagcgtcctccagggaa

SEQ ID NO: 716694 - DNA, 22 bp, Artificial Sequence
  chemically synthesized
gttcaaaggttccctggaggac

SEQ ID NO: 716695 - DNA, 22 bp, Artificial Sequence
  chemically synthesized
aaaggttccctggaggacgctg

SEQ ID NO: 716696 - DNA, 22 bp, Artificial Sequence
  chemically synthesized
cagatccagctcaagctcagcg

SEQ ID NO: 716697 - DNA, 22 bp, Artificial Sequence
  chemically synthesized
cctggaggacgctgagcttgag

SEQ ID NO: 716698 - DNA, 22 bp, Artificial Sequence
  chemically synthesized
gaggacgctgagcttgagctgg

SEQ ID NO: 716699 - DNA, 22 bp, Artificial Sequence
  chemically synthesized
aatccagatgtgattgcagatc

SEQ ID NO: 716700 - DNA, 22 bp, Artificial Sequence
  chemically synthesized
agcttgagctggatctgcaatc

SEQ ID NO: 716701 - DNA, 22 bp, Artificial Sequence
  chemically synthesized
cctcaatccagatgtgattgca

SEQ ID NO: 716702 - DNA, 22 bp, Artificial Sequence
  chemically synthesized
gagctggatctgcaatcacatc

SEQ ID NO: 716703 - DNA, 22 bp, Artificial Sequence
  chemically synthesized
agctggatctgcaatcacatct

SEQ ID NO: 716704 - DNA, 22 bp, Artificial Sequence
  chemically synthesized
gatctgcaatcacatctggatt

SEQ ID NO: 716705 - DNA, 22 bp, Artificial Sequence
  chemically synthesized
gaaggattccctcaatccagat

SEQ ID NO: 716706 - DNA, 22 bp, Artificial Sequence
  chemically synthesized
caatcacatctggattgaggga

SEQ ID NO: 716707 - DNA, 22 bp, Artificial Sequence
  chemically synthesized
agtgctggaaggattccctcaa

SEQ ID NO: 716708 - DNA, 22 bp, Artificial Sequence
  chemically synthesized
ctgagtgctggaaggattccct

SEQ ID NO: 716709 - DNA, 22 bp, Artificial Sequence
  chemically synthesized
gctgagtgctggaaggattccc

SEQ ID NO: 716710 - DNA, 22 bp, Artificial Sequence
  chemically synthesized
tttgctgagtgctggaaggatt

SEQ ID NO: 716711 - DNA, 22 bp, Artificial Sequence
  chemically synthesized
gattgagggaatccttccagca

SEQ ID NO: 716712 - DNA, 22 bp, Artificial Sequence
  chemically synthesized
ctatttgctgagtgctggaagg

SEQ ID NO: 716713 - DNA, 22 bp, Artificial Sequence
  chemically synthesized
ctgctatttgctgagtgctgga

SEQ ID NO: 716714 - DNA, 22 bp, Artificial Sequence
  chemically synthesized
cctgctatttgctgagtgctgg

SEQ ID NO: 716715 - DNA, 22 bp, Artificial Sequence
  chemically synthesized
agggaatccttccagcactcag

SEQ ID NO: 716716 - DNA, 22 bp, Artificial Sequence
  chemically synthesized
tcctgctatttgctgagtgctg

SEQ ID NO: 716717 - DNA, 22 bp, Artificial Sequence
  chemically synthesized
ttcctgctatttgctgagtgct

SEQ ID NO: 716718 - DNA, 22 bp, Artificial Sequence
  chemically synthesized
gacagtttttcctgctatttgc

SEQ ID NO: 716719 - DNA, 22 bp, Artificial Sequence
  chemically synthesized
ccagcactcagcaaatagcagg

SEQ ID NO: 716720 - DNA, 22 bp, Artificial Sequence
  chemically synthesized
cagcactcagcaaatagcagga

SEQ ID NO: 716721 - DNA, 22 bp, Artificial Sequence
  chemically synthesized
tgtctggacagtttttcctgct

SEQ ID NO: 716722 - DNA, 22 bp, Artificial Sequence
  chemically synthesized
ctgtgtctggacagtttttcct

SEQ ID NO: 716723 - DNA, 22 bp, Artificial Sequence
  chemically synthesized
agcaaatagcaggaaaaactgt

SEQ ID NO: 716724 - DNA, 22 bp, Artificial Sequence
  chemically synthesized
atacctgctgtgtctggacagt

SEQ ID NO: 716725 - DNA, 22 bp, Artificial Sequence
  chemically synthesized
gatacctgctgtgtctggacag

SEQ ID NO: 716726 - DNA, 22 bp, Artificial Sequence
  chemically synthesized
caaatcttgatacctgctgtgt

SEQ ID NO: 716727 - DNA, 22 bp, Artificial Sequence
  chemically synthesized
tccagacacagcaggtatcaag

SEQ ID NO: 716728 - DNA, 22 bp, Artificial Sequence
  chemically synthesized
atgaggaaagtctccaaatctt

SEQ ID NO: 716729 - DNA, 22 bp, Artificial Sequence
  chemically synthesized
ctgatgaggaaagtctccaaat

SEQ ID NO: 716730 - DNA, 22 bp, Artificial Sequence
  chemically synthesized
cctcctgatgaggaaagtctcc

SEQ ID NO: 716731 - DNA, 22 bp, Artificial Sequence
  chemically synthesized
ccctcctgatgaggaaagtctc

SEQ ID NO: 716732 - DNA, 22 bp, Artificial Sequence
  chemically synthesized
ggagactttcctcatcaggagg

SEQ ID NO: 716733 - DNA, 22 bp, Artificial Sequence
  chemically synthesized
gagactttcctcatcaggaggg

SEQ ID NO: 716734 - DNA, 22 bp, Artificial Sequence
  chemically synthesized
tcctcatcaggagggaagcatt

SEQ ID NO: 716735 - DNA, 22 bp, Artificial Sequence
  chemically synthesized
cctcatcaggagggaagcattt

SEQ ID NO: 716736 - DNA, 22 bp, Artificial Sequence
  chemically synthesized
ctcatcaggagggaagcatttg

SEQ ID NO: 716737 - DNA, 22 bp, Artificial Sequence
  chemically synthesized
atcaggagggaagcatttgttt

SEQ ID NO: 716738 - DNA, 22 bp, Artificial Sequence
  chemically synthesized
tatgtccaaacaaacaaaacaa

SEQ ID NO: 716739 - DNA, 22 bp, Artificial Sequence
  chemically synthesized
gtatgtccaaacaaacaaaaca

SEQ ID NO: 716740 - DNA, 22 bp, Artificial Sequence
  chemically synthesized
cttgtatgtccaaacaaacaaa

SEQ ID NO: 716741 - DNA, 22 bp, Artificial Sequence
  chemically synthesized
tctccttgtatgtccaaacaaa

SEQ ID NO: 716742 - DNA, 22 bp, Artificial Sequence
  chemically synthesized
tgtctccttgtatgtccaaaca

SEQ ID NO: 716743 - DNA, 22 bp, Artificial Sequence
  chemically synthesized
ctgtctccttgtatgtccaaac

SEQ ID NO: 716744 - DNA, 22 bp, Artificial Sequence
  chemically synthesized
tctgtctccttgtatgtccaaa

SEQ ID NO: 716745 - DNA, 22 bp, Artificial Sequence
  chemically synthesized
gttttgtttgtttggacataca

SEQ ID NO: 716746 - DNA, 22 bp, Artificial Sequence
  chemically synthesized
tttctgtctccttgtatgtcca

SEQ ID NO: 716747 - DNA, 22 bp, Artificial Sequence
  chemically synthesized
ttttgtttgtttggacatacaa

SEQ ID NO: 716748 - DNA, 22 bp, Artificial Sequence
  chemically synthesized
tgtttgtttggacatacaagga

SEQ ID NO: 716749 - DNA, 22 bp, Artificial Sequence
  chemically synthesized
gtttgtttggacatacaaggag

SEQ ID NO: 716750 - DNA, 22 bp, Artificial Sequence
  chemically synthesized
tttgtttggacatacaaggaga

SEQ ID NO: 716751 - DNA, 22 bp, Artificial Sequence
  chemically synthesized
gtttggacatacaaggagacag

SEQ ID NO: 716752 - DNA, 22 bp, Artificial Sequence
  chemically synthesized
tcaatattctttctgtctcctt

SEQ ID NO: 716753 - DNA, 22 bp, Artificial Sequence
  chemically synthesized
tttggacatacaaggagacaga

SEQ ID NO: 716754 - DNA, 22 bp, Artificial Sequence
  chemically synthesized
ggacatacaaggagacagaaag

SEQ ID NO: 716755 - DNA, 22 bp, Artificial Sequence
  chemically synthesized
gacatacaaggagacagaaaga

SEQ ID NO: 716756 - DNA, 22 bp, Artificial Sequence
  chemically synthesized
aaatacatccattatcaatatt

SEQ ID NO: 716757 - DNA, 22 bp, Artificial Sequence
  chemically synthesized
tcaccaagatcgggttcaaata

SEQ ID NO: 716758 - DNA, 22 bp, Artificial Sequence
  chemically synthesized
ataatggatgtatttgaacccg

SEQ ID NO: 716759 - DNA, 22 bp, Artificial Sequence
  chemically synthesized
aacattgtcaccaagatcgggt

SEQ ID NO: 716760 - DNA, 22 bp, Artificial Sequence
  chemically synthesized
gctcaacattgtcaccaagatc

SEQ ID NO: 716761 - DNA, 22 bp, Artificial Sequence
  chemically synthesized
ggctcaacattgtcaccaagat

SEQ ID NO: 716762 - DNA, 22 bp, Artificial Sequence
  chemically synthesized
tggctcaacattgtcaccaaga

SEQ ID NO: 716763 - DNA, 22 bp, Artificial Sequence
  chemically synthesized
gaacccgatcttggtgacaatg

SEQ ID NO: 716764 - DNA, 22 bp, Artificial Sequence
  chemically synthesized
aacccgatcttggtgacaatgt

SEQ ID NO: 716765 - DNA, 22 bp, Artificial Sequence
  chemically synthesized
caactttggctcaacattgtca

SEQ ID NO: 716766 - DNA, 22 bp, Artificial Sequence
  chemically synthesized
acaactttggctcaacattgtc

SEQ ID NO: 716767 - DNA, 22 bp, Artificial Sequence
  chemically synthesized
ggtgacaatgttgagccaaagt

SEQ ID NO: 716768 - DNA, 22 bp, Artificial Sequence
  chemically synthesized
gtgacaatgttgagccaaagtt

SEQ ID NO: 716769 - DNA, 22 bp, Artificial Sequence
  chemically synthesized
atcatcatgtttacaactttgg

SEQ ID NO: 716770 - DNA, 22 bp, Artificial Sequence
  chemically synthesized
aatcatcatgtttacaactttg

SEQ ID NO: 716771 - DNA, 22 bp, Artificial Sequence
  chemically synthesized
ttaatcatcatgtttacaactt

SEQ ID NO: 716772 - DNA, 22 bp, Artificial Sequence
  chemically synthesized
agttcttaatcatcatgtttac

SEQ ID NO: 716773 - DNA, 22 bp, Artificial Sequence
  chemically synthesized
agccaaagttgtaaacatgatg

SEQ ID NO: 716774 - DNA, 22 bp, Artificial Sequence
  chemically synthesized
agtacctgagttcttaatcatc

SEQ ID NO: 716775 - DNA, 22 bp, Artificial Sequence
  chemically synthesized
cagtacctgagttcttaatcat

SEQ ID NO: 716776 - DNA, 22 bp, Artificial Sequence
  chemically synthesized
taaacatgatgattaagaactc

SEQ ID NO: 716777 - DNA, 22 bp, Artificial Sequence
  chemically synthesized
agaactcaggtactgaagttgg

SEQ ID NO: 716778 - DNA, 22 bp, Artificial Sequence
  chemically synthesized
aggtactgaagttggactgcct

SEQ ID NO: 716779 - DNA, 22 bp, Artificial Sequence
  chemically synthesized
aagttggactgcctggtgtgac

SEQ ID NO: 716780 - DNA, 22 bp, Artificial Sequence
  chemically synthesized
agaaacgaggtagtcacaccag

SEQ ID NO: 716781 - DNA, 22 bp, Artificial Sequence
  chemically synthesized
agttgagaaacgaggtagtcac

SEQ ID NO: 716782 - DNA, 22 bp, Artificial Sequence
  chemically synthesized
gactgcctggtgtgactacctc

SEQ ID NO: 716783 - DNA, 22 bp, Artificial Sequence
  chemically synthesized
tcagttgagaaacgaggtagtc

SEQ ID NO: 716784 - DNA, 22 bp, Artificial Sequence
  chemically synthesized
cctggtgtgactacctcgtttc

SEQ ID NO: 716785 - DNA, 22 bp, Artificial Sequence
  chemically synthesized
gtgtgactacctcgtttctcaa

SEQ ID NO: 716786 - DNA, 22 bp, Artificial Sequence
  chemically synthesized
cccagtggctctcagttgagaa

SEQ ID NO: 716787 - DNA, 22 bp, Artificial Sequence
  chemically synthesized
gcccagtggctctcagttgaga

SEQ ID NO: 716788 - DNA, 22 bp, Artificial Sequence
  chemically synthesized
tgcccagtggctctcagttgag

SEQ ID NO: 716789 - DNA, 22 bp, Artificial Sequence
  chemically synthesized
cctcgtttctcaactgagagcc

SEQ ID NO: 716790 - DNA, 22 bp, Artificial Sequence
  chemically synthesized
agtgctttgcccagtggctctc

SEQ ID NO: 716791 - DNA, 22 bp, Artificial Sequence
  chemically synthesized
gtttctcaactgagagccactg

SEQ ID NO: 716792 - DNA, 22 bp, Artificial Sequence
  chemically synthesized
ctcaactgagagccactgggca

SEQ ID NO: 716793 - DNA, 22 bp, Artificial Sequence
  chemically synthesized
tcaactgagagccactgggcaa

SEQ ID NO: 716794 - DNA, 22 bp, Artificial Sequence
  chemically synthesized
aactgagagccactgggcaaag

SEQ ID NO: 716795 - DNA, 22 bp, Artificial Sequence
  chemically synthesized
gcgagttaagtgctttgcccag

SEQ ID NO: 716796 - DNA, 22 bp, Artificial Sequence
  chemically synthesized
agcgagttaagtgctttgccca

SEQ ID NO: 716797 - DNA, 22 bp, Artificial Sequence
  chemically synthesized
agagccactgggcaaagcactt

SEQ ID NO: 716798 - DNA, 22 bp, Artificial Sequence
  chemically synthesized
ggcaaagcacttaactcgctaa

SEQ ID NO: 716799 - DNA, 22 bp, Artificial Sequence
  chemically synthesized
gatacaaaagcagaaacttagc

SEQ ID NO: 716800 - DNA, 22 bp, Artificial Sequence
  chemically synthesized
agatacaaaagcagaaacttag

SEQ ID NO: 716801 - DNA, 22 bp, Artificial Sequence
  chemically synthesized
tagatacaaaagcagaaactta

SEQ ID NO: 716802 - DNA, 22 bp, Artificial Sequence
  chemically synthesized
ttagatacaaaagcagaaactt

SEQ ID NO: 716803 - DNA, 22 bp, Artificial Sequence
  chemically synthesized
aactcgctaagtttctgctttt

SEQ ID NO: 716804 - DNA, 22 bp, Artificial Sequence
  chemically synthesized
actcgctaagtttctgcttttg

SEQ ID NO: 716805 - DNA, 22 bp, Artificial Sequence
  chemically synthesized
gctaagtttctgcttttgtatc

SEQ ID NO: 716806 - DNA, 22 bp, Artificial Sequence
  chemically synthesized
agtttctgcttttgtatctaaa

SEQ ID NO: 716807 - DNA, 22 bp, Artificial Sequence
  chemically synthesized
atgagtagtatcatttttagat

SEQ ID NO: 716808 - DNA, 22 bp, Artificial Sequence
  chemically synthesized
ctgcttttgtatctaaaaatga

SEQ ID NO: 716809 - DNA, 22 bp, Artificial Sequence
  chemically synthesized
tgatgagtagtatcatttttag

SEQ ID NO: 716810 - DNA, 22 bp, Artificial Sequence
  chemically synthesized
tgcttttgtatctaaaaatgat

SEQ ID NO: 716811 - DNA, 22 bp, Artificial Sequence
  chemically synthesized
cttttgtatctaaaaatgatac

SEQ ID NO: 716812 - DNA, 22 bp, Artificial Sequence
  chemically synthesized
ttgtatctaaaaatgatactac

SEQ ID NO: 716813 - DNA, 22 bp, Artificial Sequence
  chemically synthesized
tgtatctaaaaatgatactact

SEQ ID NO: 716814 - DNA, 22 bp, Artificial Sequence
  chemically synthesized
gtatctaaaaatgatactactc

SEQ ID NO: 716815 - DNA, 22 bp, Artificial Sequence
  chemically synthesized
tatctaaaaatgatactactca

SEQ ID NO: 716816 - DNA, 22 bp, Artificial Sequence
  chemically synthesized
aggtacctctgatgagtagtat

SEQ ID NO: 716817 - DNA, 22 bp, Artificial Sequence
  chemically synthesized
tgaggtacctctgatgagtagt

SEQ ID NO: 716818 - DNA, 22 bp, Artificial Sequence
  chemically synthesized
ctgaggtacctctgatgagtag

SEQ ID NO: 716819 - DNA, 22 bp, Artificial Sequence
  chemically synthesized
tctgaggtacctctgatgagta

SEQ ID NO: 716820 - DNA, 22 bp, Artificial Sequence
  chemically synthesized
aaaatgatactactcatcagag

SEQ ID NO: 716821 - DNA, 22 bp, Artificial Sequence
  chemically synthesized
ctttctgaggtacctctgatga

SEQ ID NO: 716822 - DNA, 22 bp, Artificial Sequence
  chemically synthesized
acaactactttctgaggtacct

SEQ ID NO: 716823 - DNA, 22 bp, Artificial Sequence
  chemically synthesized
taacaactactttctgaggtac

SEQ ID NO: 716824 - DNA, 22 bp, Artificial Sequence
  chemically synthesized
ctcatcagaggtacctcagaaa

SEQ ID NO: 716825 - DNA, 22 bp, Artificial Sequence
  chemically synthesized
attctaacaactactttctgag

SEQ ID NO: 716826 - DNA, 22 bp, Artificial Sequence
  chemically synthesized
atcagaggtacctcagaaagta

SEQ ID NO: 716827 - DNA, 22 bp, Artificial Sequence
  chemically synthesized
aattctaacaactactttctga

SEQ ID NO: 716828 - DNA, 22 bp, Artificial Sequence
  chemically synthesized
ccttaattctaacaactacttt

SEQ ID NO: 716829 - DNA, 22 bp, Artificial Sequence
  chemically synthesized
tctcccttaattctaacaacta

SEQ ID NO: 716830 - DNA, 22 bp, Artificial Sequence
  chemically synthesized
agaaagtagttgttagaattaa

SEQ ID NO: 716831 - DNA, 22 bp, Artificial Sequence
  chemically synthesized
acatacgttatctcccttaatt

SEQ ID NO: 716832 - DNA, 22 bp, Artificial Sequence
  chemically synthesized
gacatacgttatctcccttaat

SEQ ID NO: 716833 - DNA, 22 bp, Artificial Sequence
  chemically synthesized
ttagaattaagggagataacgt

SEQ ID NO: 716834 - DNA, 22 bp, Artificial Sequence
  chemically synthesized
aggacttgacatacgttatctc

SEQ ID NO: 716835 - DNA, 22 bp, Artificial Sequence
  chemically synthesized
gaattaagggagataacgtatg

SEQ ID NO: 716836 - DNA, 22 bp, Artificial Sequence
  chemically synthesized
tgctaaggacttgacatacgtt

SEQ ID NO: 716837 - DNA, 22 bp, Artificial Sequence
  chemically synthesized
agggagataacgtatgtcaagt

SEQ ID NO: 716838 - DNA, 22 bp, Artificial Sequence
  chemically synthesized
ccagtcactgtgctaaggactt

SEQ ID NO: 716839 - DNA, 22 bp, Artificial Sequence
  chemically synthesized
tgccagtcactgtgctaaggac

SEQ ID NO: 716840 - DNA, 22 bp, Artificial Sequence
  chemically synthesized
agcacagtgactggcagagtct

SEQ ID NO: 716841 - DNA, 22 bp, Artificial Sequence
  chemically synthesized
gcacagtgactggcagagtctc

SEQ ID NO: 716842 - DNA, 22 bp, Artificial Sequence
  chemically synthesized
atatatgccagatgagactctg

SEQ ID NO: 716843 - DNA, 22 bp, Artificial Sequence
  chemically synthesized
agagctaatatatgccagatga

SEQ ID NO: 716844 - DNA, 22 bp, Artificial Sequence
  chemically synthesized
gcagagtctcatctggcatata

SEQ ID NO: 716845 - DNA, 22 bp, Artificial Sequence
  chemically synthesized
agctcagagctaatatatgcca

SEQ ID NO: 716846 - DNA, 22 bp, Artificial Sequence
  chemically synthesized
atctggcatatattagctctga

SEQ ID NO: 716847 - DNA, 22 bp, Artificial Sequence
  chemically synthesized
gcatatattagctctgagctta

SEQ ID NO: 716848 - DNA, 22 bp, Artificial Sequence
  chemically synthesized
tcaccaccagcacccccattaa

SEQ ID NO: 716849 - DNA, 22 bp, Artificial Sequence
  chemically synthesized
gctctgagcttaatgggggtgc

SEQ ID NO: 716850 - DNA, 22 bp, Artificial Sequence
  chemically synthesized
tgagcttaatgggggtgctggt

SEQ ID NO: 716851 - DNA, 22 bp, Artificial Sequence
  chemically synthesized
agcttaatgggggtgctggtgg

SEQ ID NO: 716852 - DNA, 22 bp, Artificial Sequence
  chemically synthesized
aatgggggtgctggtggtgata

SEQ ID NO: 716853 - DNA, 22 bp, Artificial Sequence
  chemically synthesized
atgggggtgctggtggtgataa

SEQ ID NO: 716854 - DNA, 22 bp, Artificial Sequence
  chemically synthesized
gagagacaacgtcattatcacc

SEQ ID NO: 716855 - DNA, 22 bp, Artificial Sequence
  chemically synthesized
ggagagacaacgtcattatcac

SEQ ID NO: 716856 - DNA, 22 bp, Artificial Sequence
  chemically synthesized
tggagagacaacgtcattatca

SEQ ID NO: 716857 - DNA, 22 bp, Artificial Sequence
  chemically synthesized
caacctttggagagacaacgtc

SEQ ID NO: 716858 - DNA, 22 bp, Artificial Sequence
  chemically synthesized
gtggtgataatgacgttgtctc

SEQ ID NO: 716859 - DNA, 22 bp, Artificial Sequence
  chemically synthesized
gcaacctttggagagacaacgt

SEQ ID NO: 716860 - DNA, 22 bp, Artificial Sequence
  chemically synthesized
agccgtttgcaacctttggaga

SEQ ID NO: 716861 - DNA, 22 bp, Artificial Sequence
  chemically synthesized
cccctaagccgtttgcaacctt

SEQ ID NO: 716862 - DNA, 22 bp, Artificial Sequence
  chemically synthesized
tgcccctaagccgtttgcaacc

SEQ ID NO: 716863 - DNA, 22 bp, Artificial Sequence
  chemically synthesized
tctctccaaaggttgcaaacgg

SEQ ID NO: 716864 - DNA, 22 bp, Artificial Sequence
  chemically synthesized
tccaaaggttgcaaacggctta

SEQ ID NO: 716865 - DNA, 22 bp, Artificial Sequence
  chemically synthesized
caaaggttgcaaacggcttagg

SEQ ID NO: 716866 - DNA, 22 bp, Artificial Sequence
  chemically synthesized
caaacggcttaggggcagagac

SEQ ID NO: 716867 - DNA, 22 bp, Artificial Sequence
  chemically synthesized
agataagcgatagtctctgccc

SEQ ID NO: 716868 - DNA, 22 bp, Artificial Sequence
  chemically synthesized
aggggcagagactatcgcttat

SEQ ID NO: 716869 - DNA, 22 bp, Artificial Sequence
  chemically synthesized
ggggcagagactatcgcttatc

SEQ ID NO: 716870 - DNA, 22 bp, Artificial Sequence
  chemically synthesized
tcgcttatcttagactacctga

SEQ ID NO: 716871 - DNA, 22 bp, Artificial Sequence
  chemically synthesized
atcttagactacctgatgtctg

SEQ ID NO: 716872 - DNA, 22 bp, Artificial Sequence
  chemically synthesized
tcttagactacctgatgtctgg

SEQ ID NO: 716873 - DNA, 22 bp, Artificial Sequence
  chemically synthesized
tgtgccaggagtgtcccagaca

SEQ ID NO: 716874 - DNA, 22 bp, Artificial Sequence
  chemically synthesized
agactacctgatgtctgggaca

SEQ ID NO: 716875 - DNA, 22 bp, Artificial Sequence
  chemically synthesized
gactacctgatgtctgggacac

SEQ ID NO: 716876 - DNA, 22 bp, Artificial Sequence
  chemically synthesized
ctgtgtgccaggagtgtcccag

SEQ ID NO: 716877 - DNA, 22 bp, Artificial Sequence
  chemically synthesized
ctgctgtgtgccaggagtgtcc

SEQ ID NO: 716878 - DNA, 22 bp, Artificial Sequence
  chemically synthesized
cctgatgtctgggacactcctg

SEQ ID NO: 716879 - DNA, 22 bp, Artificial Sequence
  chemically synthesized
atgtctgggacactcctggcac

SEQ ID NO: 716880 - DNA, 22 bp, Artificial Sequence
  chemically synthesized
gcaaaactcctgctgtgtgcca

SEQ ID NO: 716881 - DNA, 22 bp, Artificial Sequence
  chemically synthesized
cgcaaaactcctgctgtgtgcc

SEQ ID NO: 716882 - DNA, 22 bp, Artificial Sequence
  chemically synthesized
ggacactcctggcacacagcag

SEQ ID NO: 716883 - DNA, 22 bp, Artificial Sequence
  chemically synthesized
atttcgcaaaactcctgctgtg

SEQ ID NO: 716884 - DNA, 22 bp, Artificial Sequence
  chemically synthesized
aatttcgcaaaactcctgctgt

SEQ ID NO: 716885 - DNA, 22 bp, Artificial Sequence
  chemically synthesized
ctggcacacagcaggagttttg

SEQ ID NO: 716886 - DNA, 22 bp, Artificial Sequence
  chemically synthesized
ccagtttaatttcgcaaaactc

SEQ ID NO: 716887 - DNA, 22 bp, Artificial Sequence
  chemically synthesized
gcacacagcaggagttttgcga

SEQ ID NO: 716888 - DNA, 22 bp, Artificial Sequence
  chemically synthesized
gccagtttaatttcgcaaaact

SEQ ID NO: 716889 - DNA, 22 bp, Artificial Sequence
  chemically synthesized
tgccagtttaatttcgcaaaac

SEQ ID NO: 716890 - DNA, 22 bp, Artificial Sequence
  chemically synthesized
ttgccagtttaatttcgcaaaa

SEQ ID NO: 716891 - DNA, 22 bp, Artificial Sequence
  chemically synthesized
cttttgccagtttaatttcgca

SEQ ID NO: 716892 - DNA, 22 bp, Artificial Sequence
  chemically synthesized
caagaacactacttttgccagt

SEQ ID NO: 716893 - DNA, 22 bp, Artificial Sequence
  chemically synthesized
tgcgaaattaaactggcaaaag

SEQ ID NO: 716894 - DNA, 22 bp, Artificial Sequence
  chemically synthesized
gcaagaacactacttttgccag

SEQ ID NO: 716895 - DNA, 22 bp, Artificial Sequence
  chemically synthesized
gcgaaattaaactggcaaaagt

SEQ ID NO: 716896 - DNA, 22 bp, Artificial Sequence
  chemically synthesized
cgaaattaaactggcaaaagta

SEQ ID NO: 716897 - DNA, 22 bp, Artificial Sequence
  chemically synthesized
atcttgcaagaacactactttt

SEQ ID NO: 716898 - DNA, 22 bp, Artificial Sequence
  chemically synthesized
aactggcaaaagtagtgttctt

SEQ ID NO: 716899 - DNA, 22 bp, Artificial Sequence
  chemically synthesized
tcaagttaatcttgcaagaaca

SEQ ID NO: 716900 - DNA, 22 bp, Artificial Sequence
  chemically synthesized
gcaaaagtagtgttcttgcaag

SEQ ID NO: 716901 - DNA, 22 bp, Artificial Sequence
  chemically synthesized
ctgtcaagttaatcttgcaaga

SEQ ID NO: 716902 - DNA, 22 bp, Artificial Sequence
  chemically synthesized
gtcagccaattgctgtcaagtt

SEQ ID NO: 716903 - DNA, 22 bp, Artificial Sequence
  chemically synthesized
ttgcaagattaacttgacagca

SEQ ID NO: 716904 - DNA, 22 bp, Artificial Sequence
  chemically synthesized
gcaagattaacttgacagcaat

SEQ ID NO: 716905 - DNA, 22 bp, Artificial Sequence
  chemically synthesized
caagattaacttgacagcaatt

SEQ ID NO: 716906 - DNA, 22 bp, Artificial Sequence
  chemically synthesized
catctggtcagccaattgctgt

SEQ ID NO: 716907 - DNA, 22 bp, Artificial Sequence
  chemically synthesized
ctccatctggtcagccaattgc

SEQ ID NO: 716908 - DNA, 22 bp, Artificial Sequence
  chemically synthesized
cctccatctggtcagccaattg

SEQ ID NO: 716909 - DNA, 22 bp, Artificial Sequence
  chemically synthesized
acttgacagcaattggctgacc

SEQ ID NO: 716910 - DNA, 22 bp, Artificial Sequence
  chemically synthesized
cttcctccatctggtcagccaa

SEQ ID NO: 716911 - DNA, 22 bp, Artificial Sequence
  chemically synthesized
tccttcctccatctggtcagcc

SEQ ID NO: 716912 - DNA, 22 bp, Artificial Sequence
  chemically synthesized
gacagcaattggctgaccagat

SEQ ID NO: 716913 - DNA, 22 bp, Artificial Sequence
  chemically synthesized
acagcaattggctgaccagatg

SEQ ID NO: 716914 - DNA, 22 bp, Artificial Sequence
  chemically synthesized
aaatctctccttcctccatctg

SEQ ID NO: 716915 - DNA, 22 bp, Artificial Sequence
  chemically synthesized
gctgaccagatggaggaaggag

SEQ ID NO: 716916 - DNA, 22 bp, Artificial Sequence
  chemically synthesized
tgcctaaaatctctccttcctc

SEQ ID NO: 716917 - DNA, 22 bp, Artificial Sequence
  chemically synthesized
tatgcctaaaatctctccttcc

SEQ ID NO: 716918 - DNA, 22 bp, Artificial Sequence
  chemically synthesized
accagatggaggaaggagagat

SEQ ID NO: 716919 - DNA, 22 bp, Artificial Sequence
  chemically synthesized
tactctatgcctaaaatctctc

SEQ ID NO: 716920 - DNA, 22 bp, Artificial Sequence
  chemically synthesized
gtactctatgcctaaaatctct

SEQ ID NO: 716921 - DNA, 22 bp, Artificial Sequence
  chemically synthesized
cttgtactctatgcctaaaatc

SEQ ID NO: 716922 - DNA, 22 bp, Artificial Sequence
  chemically synthesized
tacttgtactctatgcctaaaa

SEQ ID NO: 716923 - DNA, 22 bp, Artificial Sequence
  chemically synthesized
ctacttgtactctatgcctaaa

SEQ ID NO: 716924 - DNA, 22 bp, Artificial Sequence
  chemically synthesized
tctacttgtactctatgcctaa

SEQ ID NO: 716925 - DNA, 22 bp, Artificial Sequence
  chemically synthesized
cagcagctttctacttgtactc

SEQ ID NO: 716926 - DNA, 22 bp, Artificial Sequence
  chemically synthesized
taggcatagagtacaagtagaa

SEQ ID NO: 716927 - DNA, 22 bp, Artificial Sequence
  chemically synthesized
aggcatagagtacaagtagaaa

SEQ ID NO: 716928 - DNA, 22 bp, Artificial Sequence
  chemically synthesized
ggcatagagtacaagtagaaag

SEQ ID NO: 716929 - DNA, 22 bp, Artificial Sequence
  chemically synthesized
tatcattgcagcagctttctac

SEQ ID NO: 716930 - DNA, 22 bp, Artificial Sequence
  chemically synthesized
tcatgaggagtgaagttgtatc

SEQ ID NO: 716931 - DNA, 22 bp, Artificial Sequence
  chemically synthesized
gtcatgaggagtgaagttgtat

SEQ ID NO: 716932 - DNA, 22 bp, Artificial Sequence
  chemically synthesized
ctgcaatgatacaacttcactc

SEQ ID NO: 716933 - DNA, 22 bp, Artificial Sequence
  chemically synthesized
acccttgtcatgaggagtgaag

SEQ ID NO: 716934 - DNA, 22 bp, Artificial Sequence
  chemically synthesized
caatgatacaacttcactcctc

SEQ ID NO: 716935 - DNA, 22 bp, Artificial Sequence
  chemically synthesized
tgacccttgtcatgaggagtga

SEQ ID NO: 716936 - DNA, 22 bp, Artificial Sequence
  chemically synthesized
ctgacccttgtcatgaggagtg

SEQ ID NO: 716937 - DNA, 22 bp, Artificial Sequence
  chemically synthesized
tctgacccttgtcatgaggagt

SEQ ID NO: 716938 - DNA, 22 bp, Artificial Sequence
  chemically synthesized
ttctgacccttgtcatgaggag

SEQ ID NO: 716939 - DNA, 22 bp, Artificial Sequence
  chemically synthesized
tttctgacccttgtcatgagga

SEQ ID NO: 716940 - DNA, 22 bp, Artificial Sequence
  chemically synthesized
cactcctcatgacaagggtcag

SEQ ID NO: 716941 - DNA, 22 bp, Artificial Sequence
  chemically synthesized
actcctcatgacaagggtcaga

SEQ ID NO: 716942 - DNA, 22 bp, Artificial Sequence
  chemically synthesized
acaccaaccattttttctgacc

SEQ ID NO: 716943 - DNA, 22 bp, Artificial Sequence
  chemically synthesized
ctcatgacaagggtcagaaaaa

SEQ ID NO: 716944 - DNA, 22 bp, Artificial Sequence
  chemically synthesized
atgacaagggtcagaaaaaatg

SEQ ID NO: 716945 - DNA, 22 bp, Artificial Sequence
  chemically synthesized
ccgctgacaccaaccatttttt

SEQ ID NO: 716946 - DNA, 22 bp, Artificial Sequence
  chemically synthesized
tcattcccgctgacaccaacca

SEQ ID NO: 716947 - DNA, 22 bp, Artificial Sequence
  chemically synthesized
atcattcccgctgacaccaacc

SEQ ID NO: 716948 - DNA, 22 bp, Artificial Sequence
  chemically synthesized
cttatcattcccgctgacacca

SEQ ID NO: 716949 - DNA, 22 bp, Artificial Sequence
  chemically synthesized
ttccttatcattcccgctgaca

SEQ ID NO: 716950 - DNA, 22 bp, Artificial Sequence
  chemically synthesized
cctattccttatcattcccgct

SEQ ID NO: 716951 - DNA, 22 bp, Artificial Sequence
  chemically synthesized
acctattccttatcattcccgc

SEQ ID NO: 716952 - DNA, 22 bp, Artificial Sequence
  chemically synthesized
cttacctattccttatcattcc

SEQ ID NO: 716953 - DNA, 22 bp, Artificial Sequence
  chemically synthesized
gtgtcagcgggaatgataagga

SEQ ID NO: 716954 - DNA, 22 bp, Artificial Sequence
  chemically synthesized
attacttacctattccttatca

SEQ ID NO: 716955 - DNA, 22 bp, Artificial Sequence
  chemically synthesized
cattacttacctattccttatc

SEQ ID NO: 716956 - DNA, 22 bp, Artificial Sequence
  chemically synthesized
tcattacttacctattccttat

SEQ ID NO: 716957 - DNA, 22 bp, Artificial Sequence
  chemically synthesized
atctttcattacttacctattc

SEQ ID NO: 716958 - DNA, 22 bp, Artificial Sequence
  chemically synthesized
aattcatctttcattacttacc

SEQ ID NO: 716959 - DNA, 22 bp, Artificial Sequence
  chemically synthesized
caattcatctttcattacttac

SEQ ID NO: 716960 - DNA, 22 bp, Artificial Sequence
  chemically synthesized
tgtccttcaattcatctttcat

SEQ ID NO: 716961 - DNA, 22 bp, Artificial Sequence
  chemically synthesized
aaggacatagttcctgggcttt

SEQ ID NO: 716962 - DNA, 22 bp, Artificial Sequence
  chemically synthesized
aaatgtggagtcaaagcccagg

SEQ ID NO: 716963 - DNA, 22 bp, Artificial Sequence
  chemically synthesized
atagttaaaatgtggagtcaaa

SEQ ID NO: 716964 - DNA, 22 bp, Artificial Sequence
  chemically synthesized
ttcatagttaaaatgtggagtc

SEQ ID NO: 716965 - DNA, 22 bp, Artificial Sequence
  chemically synthesized
ctgggctttgactccacatttt

SEQ ID NO: 716966 - DNA, 22 bp, Artificial Sequence
  chemically synthesized
ggctttgactccacattttaac

SEQ ID NO: 716967 - DNA, 22 bp, Artificial Sequence
  chemically synthesized
gaatctattcatagttaaaatg

SEQ ID NO: 716968 - DNA, 22 bp, Artificial Sequence
  chemically synthesized
agaatctattcatagttaaaat

SEQ ID NO: 716969 - DNA, 22 bp, Artificial Sequence
  chemically synthesized
tgactccacattttaactatga

SEQ ID NO: 716970 - DNA, 22 bp, Artificial Sequence
  chemically synthesized
gactccacattttaactatgaa

SEQ ID NO: 716971 - DNA, 22 bp, Artificial Sequence
  chemically synthesized
actccacattttaactatgaat

SEQ ID NO: 716972 - DNA, 22 bp, Artificial Sequence
  chemically synthesized
cacattttaactatgaatagat

SEQ ID NO: 716973 - DNA, 22 bp, Artificial Sequence
  chemically synthesized
cagtcaagcttagaatctattc

SEQ ID NO: 716974 - DNA, 22 bp, Artificial Sequence
  chemically synthesized
taactatgaatagattctaagc

SEQ ID NO: 716975 - DNA, 22 bp, Artificial Sequence
  chemically synthesized
aactatgaatagattctaagct

SEQ ID NO: 716976 - DNA, 22 bp, Artificial Sequence
  chemically synthesized
actatgaatagattctaagctt

SEQ ID NO: 716977 - DNA, 22 bp, Artificial Sequence
  chemically synthesized
cacactacagtcaagcttagaa

SEQ ID NO: 716978 - DNA, 22 bp, Artificial Sequence
  chemically synthesized
gcacactacagtcaagcttaga

SEQ ID NO: 716979 - DNA, 22 bp, Artificial Sequence
  chemically synthesized
tgaatagattctaagcttgact

SEQ ID NO: 716980 - DNA, 22 bp, Artificial Sequence
  chemically synthesized
atttgcacactacagtcaagct

SEQ ID NO: 716981 - DNA, 22 bp, Artificial Sequence
  chemically synthesized
taagcttgactgtagtgtgcaa

SEQ ID NO: 716982 - DNA, 22 bp, Artificial Sequence
  chemically synthesized
agcttgactgtagtgtgcaaat

SEQ ID NO: 716983 - DNA, 22 bp, Artificial Sequence
  chemically synthesized
cgaaagaggcctaatttgcaca

SEQ ID NO: 716984 - DNA, 22 bp, Artificial Sequence
  chemically synthesized
tccgaaagaggcctaatttgca

SEQ ID NO: 716985 - DNA, 22 bp, Artificial Sequence
  chemically synthesized
gactgtagtgtgcaaattaggc

SEQ ID NO: 716986 - DNA, 22 bp, Artificial Sequence
  chemically synthesized
tctccgaaagaggcctaatttg

SEQ ID NO: 716987 - DNA, 22 bp, Artificial Sequence
  chemically synthesized
actgtagtgtgcaaattaggcc

SEQ ID NO: 716988 - DNA, 22 bp, Artificial Sequence
  chemically synthesized
ctctccgaaagaggcctaattt

SEQ ID NO: 716989 - DNA, 22 bp, Artificial Sequence
  chemically synthesized
tagtgtgcaaattaggcctctt

SEQ ID NO: 716990 - DNA, 22 bp, Artificial Sequence
  chemically synthesized
ggccttctctccgaaagaggcc

SEQ ID NO: 716991 - DNA, 22 bp, Artificial Sequence
  chemically synthesized
tactgggccttctctccgaaag

SEQ ID NO: 716992 - DNA, 22 bp, Artificial Sequence
  chemically synthesized
ctatactgggccttctctccga

SEQ ID NO: 716993 - DNA, 22 bp, Artificial Sequence
  chemically synthesized
tgctatactgggccttctctcc

SEQ ID NO: 716994 - DNA, 22 bp, Artificial Sequence
  chemically synthesized
ctgctatactgggccttctctc

SEQ ID NO: 716995 - DNA, 22 bp, Artificial Sequence
  chemically synthesized
ggcctctttcggagagaaggcc

SEQ ID NO: 716996 - DNA, 22 bp, Artificial Sequence
  chemically synthesized
tctgctatactgggccttctct

SEQ ID NO: 716997 - DNA, 22 bp, Artificial Sequence
  chemically synthesized
tttctgctatactgggccttct

SEQ ID NO: 716998 - DNA, 22 bp, Artificial Sequence
  chemically synthesized
tttcggagagaaggcccagtat

SEQ ID NO: 716999 - DNA, 22 bp, Artificial Sequence
  chemically synthesized
tcggagagaaggcccagtatag

SEQ ID NO: 717000 - DNA, 22 bp, Artificial Sequence
  chemically synthesized
atgttctttctgctatactggg

SEQ ID NO: 717001 - DNA, 22 bp, Artificial Sequence
  chemically synthesized
cggagagaaggcccagtatagc

SEQ ID NO: 717002 - DNA, 22 bp, Artificial Sequence
  chemically synthesized
ggagagaaggcccagtatagca

SEQ ID NO: 717003 - DNA, 22 bp, Artificial Sequence
  chemically synthesized
aaaactcatgttctttctgcta

SEQ ID NO: 717004 - DNA, 22 bp, Artificial Sequence
  chemically synthesized
caaaactcatgttctttctgct

SEQ ID NO: 717005 - DNA, 22 bp, Artificial Sequence
  chemically synthesized
acttcaaaactcatgttctttc

SEQ ID NO: 717006 - DNA, 22 bp, Artificial Sequence
  chemically synthesized
aacttcaaaactcatgttcttt

SEQ ID NO: 717007 - DNA, 22 bp, Artificial Sequence
  chemically synthesized
tgaagttaaacactgttctgtc

SEQ ID NO: 717008 - DNA, 22 bp, Artificial Sequence
  chemically synthesized
gaagttaaacactgttctgtcc

SEQ ID NO: 717009 - DNA, 22 bp, Artificial Sequence
  chemically synthesized
aagttaaacactgttctgtccc

SEQ ID NO: 717010 - DNA, 22 bp, Artificial Sequence
  chemically synthesized
aacactgttctgtcccatatgt

SEQ ID NO: 717011 - DNA, 22 bp, Artificial Sequence
  chemically synthesized
aggtcacacaaatgacatatgg

SEQ ID NO: 717012 - DNA, 22 bp, Artificial Sequence
  chemically synthesized
aaggtcacacaaatgacatatg

SEQ ID NO: 717013 - DNA, 22 bp, Artificial Sequence
  chemically synthesized
taaggtcacacaaatgacatat

SEQ ID NO: 717014 - DNA, 22 bp, Artificial Sequence
  chemically synthesized
ttaaggtcacacaaatgacata

SEQ ID NO: 717015 - DNA, 22 bp, Artificial Sequence
  chemically synthesized
tttaaggtcacacaaatgacat

SEQ ID NO: 717016 - DNA, 22 bp, Artificial Sequence
  chemically synthesized
ttctgtcccatatgtcatttgt

SEQ ID NO: 717017 - DNA, 22 bp, Artificial Sequence
  chemically synthesized
tgtcccatatgtcatttgtgtg

SEQ ID NO: 717018 - DNA, 22 bp, Artificial Sequence
  chemically synthesized
tcccatatgtcatttgtgtgac

SEQ ID NO: 717019 - DNA, 22 bp, Artificial Sequence
  chemically synthesized
taaatacattttttaaggtcac

SEQ ID NO: 717020 - DNA, 22 bp, Artificial Sequence
  chemically synthesized
gtaaatacattttttaaggtca

SEQ ID NO: 717021 - DNA, 22 bp, Artificial Sequence
  chemically synthesized
tgtaaatacattttttaaggtc

SEQ ID NO: 717022 - DNA, 22 bp, Artificial Sequence
  chemically synthesized
ttgtaaatacattttttaaggt

SEQ ID NO: 717023 - DNA, 22 bp, Artificial Sequence
  chemically synthesized
gtgtgaccttaaaaaatgtatt

SEQ ID NO: 717024 - DNA, 22 bp, Artificial Sequence
  chemically synthesized
tgtgaccttaaaaaatgtattt

SEQ ID NO: 717025 - DNA, 22 bp, Artificial Sequence
  chemically synthesized
tcaaaggccttttgtaaataca

SEQ ID NO: 717026 - DNA, 22 bp, Artificial Sequence
  chemically synthesized
gtcaaaggccttttgtaaatac

SEQ ID NO: 717027 - DNA, 22 bp, Artificial Sequence
  chemically synthesized
tgtcaaaggccttttgtaaata

SEQ ID NO: 717028 - DNA, 22 bp, Artificial Sequence
  chemically synthesized
aaaaaatgtatttacaaaaggc

SEQ ID NO: 717029 - DNA, 22 bp, Artificial Sequence
  chemically synthesized
aaaaatgtatttacaaaaggcc

SEQ ID NO: 717030 - DNA, 22 bp, Artificial Sequence
  chemically synthesized
aattttgtcaaaggccttttgt

SEQ ID NO: 717031 - DNA, 22 bp, Artificial Sequence
  chemically synthesized
ttgaattttgtcaaaggccttt

SEQ ID NO: 717032 - DNA, 22 bp, Artificial Sequence
  chemically synthesized
acaaaaggcctttgacaaaatt

SEQ ID NO: 717033 - DNA, 22 bp, Artificial Sequence
  chemically synthesized
caaaaggcctttgacaaaattc

SEQ ID NO: 717034 - DNA, 22 bp, Artificial Sequence
  chemically synthesized
gcatgaagggttgttgaatttt

SEQ ID NO: 717035 - DNA, 22 bp, Artificial Sequence
  chemically synthesized
agcatgaagggttgttgaattt

SEQ ID NO: 717036 - DNA, 22 bp, Artificial Sequence
  chemically synthesized
tagcatgaagggttgttgaatt

SEQ ID NO: 717037 - DNA, 22 bp, Artificial Sequence
  chemically synthesized
ttagcatgaagggttgttgaat

SEQ ID NO: 717038 - DNA, 22 bp, Artificial Sequence
  chemically synthesized
tgacaaaattcaacaacccttc

SEQ ID NO: 717039 - DNA, 22 bp, Artificial Sequence
  chemically synthesized
gacaaaattcaacaacccttca

SEQ ID NO: 717040 - DNA, 22 bp, Artificial Sequence
  chemically synthesized
acaaaattcaacaacccttcat

SEQ ID NO: 717041 - DNA, 22 bp, Artificial Sequence
  chemically synthesized
agagtttttagcatgaagggtt

SEQ ID NO: 717042 - DNA, 22 bp, Artificial Sequence
  chemically synthesized
ttgagagtttttagcatgaagg

SEQ ID NO: 717043 - DNA, 22 bp, Artificial Sequence
  chemically synthesized
attgagagtttttagcatgaag

SEQ ID NO: 717044 - DNA, 22 bp, Artificial Sequence
  chemically synthesized
atttattgagagtttttagcat

SEQ ID NO: 717045 - DNA, 22 bp, Artificial Sequence
  chemically synthesized
aacaacccttcatgctaaaaac

SEQ ID NO: 717046 - DNA, 22 bp, Artificial Sequence
  chemically synthesized
catgctaaaaactctcaataaa

SEQ ID NO: 717047 - DNA, 22 bp, Artificial Sequence
  chemically synthesized
atgctaaaaactctcaataaat

SEQ ID NO: 717048 - DNA, 22 bp, Artificial Sequence
  chemically synthesized
aaaactctcaataaattaggta

SEQ ID NO: 717049 - DNA, 22 bp, Artificial Sequence
  chemically synthesized
agatatgtcccatcaataccta

SEQ ID NO: 717050 - DNA, 22 bp, Artificial Sequence
  chemically synthesized
gagatatgtcccatcaatacct

SEQ ID NO: 717051 - DNA, 22 bp, Artificial Sequence
  chemically synthesized
tgagatatgtcccatcaatacc

SEQ ID NO: 717052 - DNA, 22 bp, Artificial Sequence
  chemically synthesized
tcaataaattaggtattgatgg

SEQ ID NO: 717053 - DNA, 22 bp, Artificial Sequence
  chemically synthesized
aataaattaggtattgatggga

SEQ ID NO: 717054 - DNA, 22 bp, Artificial Sequence
  chemically synthesized
ttttgagatatgtcccatcaat

SEQ ID NO: 717055 - DNA, 22 bp, Artificial Sequence
  chemically synthesized
ttattttgagatatgtcccatc

SEQ ID NO: 717056 - DNA, 22 bp, Artificial Sequence
  chemically synthesized
attattttgagatatgtcccat

SEQ ID NO: 717057 - DNA, 22 bp, Artificial Sequence
  chemically synthesized
ttattattttgagatatgtccc

SEQ ID NO: 717058 - DNA, 22 bp, Artificial Sequence
  chemically synthesized
ggtattgatgggacatatctca

SEQ ID NO: 717059 - DNA, 22 bp, Artificial Sequence
  chemically synthesized
atgggacatatctcaaaataat

SEQ ID NO: 717060 - DNA, 22 bp, Artificial Sequence
  chemically synthesized
tcatagatagctcttattattt

SEQ ID NO: 717061 - DNA, 22 bp, Artificial Sequence
  chemically synthesized
gtcatagatagctcttattatt

SEQ ID NO: 717062 - DNA, 22 bp, Artificial Sequence
  chemically synthesized
tgggtttgtcatagatagctct

SEQ ID NO: 717063 - DNA, 22 bp, Artificial Sequence
  chemically synthesized
aaaataataagagctatctatg

SEQ ID NO: 717064 - DNA, 22 bp, Artificial Sequence
  chemically synthesized
gctgtgggtttgtcatagatag

SEQ ID NO: 717065 - DNA, 22 bp, Artificial Sequence
  chemically synthesized
agtatgatattggctgtgggtt

SEQ ID NO: 717066 - DNA, 22 bp, Artificial Sequence
  chemically synthesized
tctatgacaaacccacagccaa

SEQ ID NO: 717067 - DNA, 22 bp, Artificial Sequence
  chemically synthesized
tgacaaacccacagccaatatc

SEQ ID NO: 717068 - DNA, 22 bp, Artificial Sequence
  chemically synthesized
cccattcagtatgatattggct

SEQ ID NO: 717069 - DNA, 22 bp, Artificial Sequence
  chemically synthesized
gcccattcagtatgatattggc

SEQ ID NO: 717070 - DNA, 22 bp, Artificial Sequence
  chemically synthesized
tgcccattcagtatgatattgg

SEQ ID NO: 717071 - DNA, 22 bp, Artificial Sequence
  chemically synthesized
ttgcccattcagtatgatattg

SEQ ID NO: 717072 - DNA, 22 bp, Artificial Sequence
  chemically synthesized
cagtttttgcccattcagtatg

SEQ ID NO: 717073 - DNA, 22 bp, Artificial Sequence
  chemically synthesized
ccagtttttgcccattcagtat

SEQ ID NO: 717074 - DNA, 22 bp, Artificial Sequence
  chemically synthesized
agagggaatgcttccagttttt

SEQ ID NO: 717075 - DNA, 22 bp, Artificial Sequence
  chemically synthesized
cagagggaatgcttccagtttt

SEQ ID NO: 717076 - DNA, 22 bp, Artificial Sequence
  chemically synthesized
tcagagggaatgcttccagttt

SEQ ID NO: 717077 - DNA, 22 bp, Artificial Sequence
  chemically synthesized
aatgggcaaaaactggaagcat

SEQ ID NO: 717078 - DNA, 22 bp, Artificial Sequence
  chemically synthesized
tgccagttttcagagggaatgc

SEQ ID NO: 717079 - DNA, 22 bp, Artificial Sequence
  chemically synthesized
gtgccagttttcagagggaatg

SEQ ID NO: 717080 - DNA, 22 bp, Artificial Sequence
  chemically synthesized
tcttgtgccagttttcagaggg

SEQ ID NO: 717081 - DNA, 22 bp, Artificial Sequence
  chemically synthesized
gaagcattccctctgaaaactg

SEQ ID NO: 717082 - DNA, 22 bp, Artificial Sequence
  chemically synthesized
cctctgaaaactggcacaagac

SEQ ID NO: 717083 - DNA, 22 bp, Artificial Sequence
  chemically synthesized
tgaaaactggcacaagacaggg

SEQ ID NO: 717084 - DNA, 22 bp, Artificial Sequence
  chemically synthesized
aaaactggcacaagacagggat

SEQ ID NO: 717085 - DNA, 22 bp, Artificial Sequence
  chemically synthesized
gcacaagacagggatgccctct

SEQ ID NO: 717086 - DNA, 22 bp, Artificial Sequence
  chemically synthesized
aataggagtggtaagagagggc

SEQ ID NO: 717087 - DNA, 22 bp, Artificial Sequence
  chemically synthesized
tgttgaataggagtggtaagag

SEQ ID NO: 717088 - DNA, 22 bp, Artificial Sequence
  chemically synthesized
caacactatgttgaataggagt

SEQ ID NO: 717089 - DNA, 22 bp, Artificial Sequence
  chemically synthesized
ccaacactatgttgaataggag

SEQ ID NO: 717090 - DNA, 22 bp, Artificial Sequence
  chemically synthesized
tcttaccactcctattcaacat

SEQ ID NO: 717091 - DNA, 22 bp, Artificial Sequence
  chemically synthesized
ttaccactcctattcaacatag

SEQ ID NO: 717092 - DNA, 22 bp, Artificial Sequence
  chemically synthesized
accactcctattcaacatagtg

SEQ ID NO: 717093 - DNA, 22 bp, Artificial Sequence
  chemically synthesized
ccactcctattcaacatagtgt

SEQ ID NO: 717094 - DNA, 22 bp, Artificial Sequence
  chemically synthesized
gccagaacttccaacactatgt

SEQ ID NO: 717095 - DNA, 22 bp, Artificial Sequence
  chemically synthesized
ctattcaacatagtgttggaag

SEQ ID NO: 717096 - DNA, 22 bp, Artificial Sequence
  chemically synthesized
ccctggccagaacttccaacac

SEQ ID NO: 717097 - DNA, 22 bp, Artificial Sequence
  chemically synthesized
ttcaacatagtgttggaagttc

SEQ ID NO: 717098 - DNA, 22 bp, Artificial Sequence
  chemically synthesized
attgccctggccagaacttcca

SEQ ID NO: 717099 - DNA, 22 bp, Artificial Sequence
  chemically synthesized
aacatagtgttggaagttctgg

SEQ ID NO: 717100 - DNA, 22 bp, Artificial Sequence
  chemically synthesized
cctgattgccctggccagaact

SEQ ID NO: 717101 - DNA, 22 bp, Artificial Sequence
  chemically synthesized
ctgcctgattgccctggccaga

SEQ ID NO: 717102 - DNA, 22 bp, Artificial Sequence
  chemically synthesized
tcctgcctgattgccctggcca

SEQ ID NO: 717103 - DNA, 22 bp, Artificial Sequence
  chemically synthesized
ctcctgcctgattgccctggcc

SEQ ID NO: 717104 - DNA, 22 bp, Artificial Sequence
  chemically synthesized
cttctcctgcctgattgccctg

SEQ ID NO: 717105 - DNA, 22 bp, Artificial Sequence
  chemically synthesized
gaagttctggccagggcaatca

SEQ ID NO: 717106 - DNA, 22 bp, Artificial Sequence
  chemically synthesized
ccttctcctgcctgattgccct

SEQ ID NO: 717107 - DNA, 22 bp, Artificial Sequence
  chemically synthesized
tttccttctcctgcctgattgc

SEQ ID NO: 717108 - DNA, 22 bp, Artificial Sequence
  chemically synthesized
atttccttctcctgcctgattg

SEQ ID NO: 717109 - DNA, 22 bp, Artificial Sequence
  chemically synthesized
tatttccttctcctgcctgatt

SEQ ID NO: 717110 - DNA, 22 bp, Artificial Sequence
  chemically synthesized
tggccagggcaatcaggcagga

SEQ ID NO: 717111 - DNA, 22 bp, Artificial Sequence
  chemically synthesized
gccagggcaatcaggcaggaga

SEQ ID NO: 717112 - DNA, 22 bp, Artificial Sequence
  chemically synthesized
aataccctttatttccttctcc

SEQ ID NO: 717113 - DNA, 22 bp, Artificial Sequence
  chemically synthesized
attgaataccctttatttcctt

SEQ ID NO: 717114 - DNA, 22 bp, Artificial Sequence
  chemically synthesized
ctaattgaataccctttatttc

SEQ ID NO: 717115 - DNA, 22 bp, Artificial Sequence
  chemically synthesized
cctaattgaataccctttattt

SEQ ID NO: 717116 - DNA, 22 bp, Artificial Sequence
  chemically synthesized
tcctaattgaataccctttatt

SEQ ID NO: 717117 - DNA, 22 bp, Artificial Sequence
  chemically synthesized
ttcctaattgaataccctttat

SEQ ID NO: 717118 - DNA, 22 bp, Artificial Sequence
  chemically synthesized
ttttcctaattgaatacccttt

SEQ ID NO: 717119 - DNA, 22 bp, Artificial Sequence
  chemically synthesized
ctcttttcctaattgaataccc

SEQ ID NO: 717120 - DNA, 22 bp, Artificial Sequence
  chemically synthesized
cctcttttcctaattgaatacc

SEQ ID NO: 717121 - DNA, 22 bp, Artificial Sequence
  chemically synthesized
acttcctcttttcctaattgaa

SEQ ID NO: 717122 - DNA, 22 bp, Artificial Sequence
  chemically synthesized
gacttcctcttttcctaattga

SEQ ID NO: 717123 - DNA, 22 bp, Artificial Sequence
  chemically synthesized
aattaggaaaagaggaagtcaa

SEQ ID NO: 717124 - DNA, 22 bp, Artificial Sequence
  chemically synthesized
caaacagggacaatttgacttc

SEQ ID NO: 717125 - DNA, 22 bp, Artificial Sequence
  chemically synthesized
ggaaaagaggaagtcaaattgt

SEQ ID NO: 717126 - DNA, 22 bp, Artificial Sequence
  chemically synthesized
gatatacaatcatgtcatctgc

SEQ ID NO: 717127 - DNA, 22 bp, Artificial Sequence
  chemically synthesized
tagatatacaatcatgtcatct

SEQ ID NO: 717128 - DNA, 22 bp, Artificial Sequence
  chemically synthesized
tccctgtttgcagatgacatga

SEQ ID NO: 717129 - DNA, 22 bp, Artificial Sequence
  chemically synthesized
ctagatatacaatcatgtcatc

SEQ ID NO: 717130 - DNA, 22 bp, Artificial Sequence
  chemically synthesized
tctagatatacaatcatgtcat

SEQ ID NO: 717131 - DNA, 22 bp, Artificial Sequence
  chemically synthesized
tttgcagatgacatgattgtat

SEQ ID NO: 717132 - DNA, 22 bp, Artificial Sequence
  chemically synthesized
gcagatgacatgattgtatatc

SEQ ID NO: 717133 - DNA, 22 bp, Artificial Sequence
  chemically synthesized
cagatgacatgattgtatatct

SEQ ID NO: 717134 - DNA, 22 bp, Artificial Sequence
  chemically synthesized
agacgatggggttttctagata

SEQ ID NO: 717135 - DNA, 22 bp, Artificial Sequence
  chemically synthesized
gggttgagacgatggggttttc

SEQ ID NO: 717136 - DNA, 22 bp, Artificial Sequence
  chemically synthesized
ggggttgagacgatggggtttt

SEQ ID NO: 717137 - DNA, 22 bp, Artificial Sequence
  chemically synthesized
tatatctagaaaaccccatcgt

SEQ ID NO: 717138 - DNA, 22 bp, Artificial Sequence
  chemically synthesized
aggagatttggggttgagacga

SEQ ID NO: 717139 - DNA, 22 bp, Artificial Sequence
  chemically synthesized
aaggagatttggggttgagacg

SEQ ID NO: 717140 - DNA, 22 bp, Artificial Sequence
  chemically synthesized
gaaaaccccatcgtctcaaccc

SEQ ID NO: 717141 - DNA, 22 bp, Artificial Sequence
  chemically synthesized
tcagcttaaggagatttggggt

SEQ ID NO: 717142 - DNA, 22 bp, Artificial Sequence
  chemically synthesized
atcagcttaaggagatttgggg

SEQ ID NO: 717143 - DNA, 22 bp, Artificial Sequence
  chemically synthesized
cttatcagcttaaggagatttg

SEQ ID NO: 717144 - DNA, 22 bp, Artificial Sequence
  chemically synthesized
aagttgcttatcagcttaagga

SEQ ID NO: 717145 - DNA, 22 bp, Artificial Sequence
  chemically synthesized
aaccccaaatctccttaagctg

SEQ ID NO: 717146 - DNA, 22 bp, Artificial Sequence
  chemically synthesized
ctgaagttgcttatcagcttaa

SEQ ID NO: 717147 - DNA, 22 bp, Artificial Sequence
  chemically synthesized
gctgaagttgcttatcagctta

SEQ ID NO: 717148 - DNA, 22 bp, Artificial Sequence
  chemically synthesized
tgctgaagttgcttatcagctt

SEQ ID NO: 717149 - DNA, 22 bp, Artificial Sequence
  chemically synthesized
agactttgctgaagttgcttat

SEQ ID NO: 717150 - DNA, 22 bp, Artificial Sequence
  chemically synthesized
cttaagctgataagcaacttca

SEQ ID NO: 717151 - DNA, 22 bp, Artificial Sequence
  chemically synthesized
aagctgataagcaacttcagca

SEQ ID NO: 717152 - DNA, 22 bp, Artificial Sequence
  chemically synthesized
agctgataagcaacttcagcaa

SEQ ID NO: 717153 - DNA, 22 bp, Artificial Sequence
  chemically synthesized
tatcctgagactttgctgaagt

SEQ ID NO: 717154 - DNA, 22 bp, Artificial Sequence
  chemically synthesized
gtatcctgagactttgctgaag

SEQ ID NO: 717155 - DNA, 22 bp, Artificial Sequence
  chemically synthesized
tgtatcctgagactttgctgaa

SEQ ID NO: 717156 - DNA, 22 bp, Artificial Sequence
  chemically synthesized
ttgtatcctgagactttgctga

SEQ ID NO: 717157 - DNA, 22 bp, Artificial Sequence
  chemically synthesized
ataagcaacttcagcaaagtct

SEQ ID NO: 717158 - DNA, 22 bp, Artificial Sequence
  chemically synthesized
cttttgtatcctgagactttgc

SEQ ID NO: 717159 - DNA, 22 bp, Artificial Sequence
  chemically synthesized
cacattgcttttgtatcctgag

SEQ ID NO: 717160 - DNA, 22 bp, Artificial Sequence
  chemically synthesized
gcacattgcttttgtatcctga

SEQ ID NO: 717161 - DNA, 22 bp, Artificial Sequence
  chemically synthesized
tgcacattgcttttgtatcctg

SEQ ID NO: 717162 - DNA, 22 bp, Artificial Sequence
  chemically synthesized
cagcaaagtctcaggatacaaa

SEQ ID NO: 717163 - DNA, 22 bp, Artificial Sequence
  chemically synthesized
ttgcacattgcttttgtatcct

SEQ ID NO: 717164 - DNA, 22 bp, Artificial Sequence
  chemically synthesized
agcaaagtctcaggatacaaaa

SEQ ID NO: 717165 - DNA, 22 bp, Artificial Sequence
  chemically synthesized
tgatttttgcacattgcttttg

SEQ ID NO: 717166 - DNA, 22 bp, Artificial Sequence
  chemically synthesized
gtgatttttgcacattgctttt

SEQ ID NO: 717167 - DNA, 22 bp, Artificial Sequence
  chemically synthesized
aggatacaaaagcaatgtgcaa

SEQ ID NO: 717168 - DNA, 22 bp, Artificial Sequence
  chemically synthesized
gtgtataagaatgcttgtgatt

SEQ ID NO: 717169 - DNA, 22 bp, Artificial Sequence
  chemically synthesized
ttggtgtataagaatgcttgtg

SEQ ID NO: 717170 - DNA, 22 bp, Artificial Sequence
  chemically synthesized
ttattggtgtataagaatgctt

SEQ ID NO: 717171 - DNA, 22 bp, Artificial Sequence
  chemically synthesized
tctgttattggtgtataagaat

SEQ ID NO: 717172 - DNA, 22 bp, Artificial Sequence
  chemically synthesized
tgtctgttattggtgtataaga

SEQ ID NO: 717173 - DNA, 22 bp, Artificial Sequence
  chemically synthesized
tctgtctgttattggtgtataa

SEQ ID NO: 717174 - DNA, 22 bp, Artificial Sequence
  chemically synthesized
gctctctgtctgttattggtgt

SEQ ID NO: 717175 - DNA, 22 bp, Artificial Sequence
  chemically synthesized
ggctctctgtctgttattggtg

SEQ ID NO: 717176 - DNA, 22 bp, Artificial Sequence
  chemically synthesized
ttatacaccaataacagacaga

SEQ ID NO: 717177 - DNA, 22 bp, Artificial Sequence
  chemically synthesized
atgatttggctctctgtctgtt

SEQ ID NO: 717178 - DNA, 22 bp, Artificial Sequence
  chemically synthesized
atacaccaataacagacagaga

SEQ ID NO: 717179 - DNA, 22 bp, Artificial Sequence
  chemically synthesized
tacaccaataacagacagagag

SEQ ID NO: 717180 - DNA, 22 bp, Artificial Sequence
  chemically synthesized
actcatgatttggctctctgtc

SEQ ID NO: 717181 - DNA, 22 bp, Artificial Sequence
  chemically synthesized
tgaatgggagttcactcatgat

SEQ ID NO: 717182 - DNA, 22 bp, Artificial Sequence
  chemically synthesized
aagcaattgtgaatgggagttc

SEQ ID NO: 717183 - DNA, 22 bp, Artificial Sequence
  chemically synthesized
gaagcaattgtgaatgggagtt

SEQ ID NO: 717184 - DNA, 22 bp, Artificial Sequence
  chemically synthesized
tgaagcaattgtgaatgggagt

SEQ ID NO: 717185 - DNA, 22 bp, Artificial Sequence
  chemically synthesized
tttgaagcaattgtgaatggga

SEQ ID NO: 717186 - DNA, 22 bp, Artificial Sequence
  chemically synthesized
tctttgaagcaattgtgaatgg

SEQ ID NO: 717187 - DNA, 22 bp, Artificial Sequence
  chemically synthesized
ttctctttgaagcaattgtgaa

SEQ ID NO: 717188 - DNA, 22 bp, Artificial Sequence
  chemically synthesized
attctctttgaagcaattgtga

SEQ ID NO: 717189 - DNA, 22 bp, Artificial Sequence
  chemically synthesized
tattctctttgaagcaattgtg

SEQ ID NO: 717190 - DNA, 22 bp, Artificial Sequence
  chemically synthesized
ccattcacaattgcttcaaaga

SEQ ID NO: 717191 - DNA, 22 bp, Artificial Sequence
  chemically synthesized
ggtattttattctctttgaagc

SEQ ID NO: 717192 - DNA, 22 bp, Artificial Sequence
  chemically synthesized
ctaggtattttattctctttga

SEQ ID NO: 717193 - DNA, 22 bp, Artificial Sequence
  chemically synthesized
acaattgcttcaaagagaataa

SEQ ID NO: 717194 - DNA, 22 bp, Artificial Sequence
  chemically synthesized
gattcctaggtattttattctc

SEQ ID NO: 717195 - DNA, 22 bp, Artificial Sequence
  chemically synthesized
cttcaaagagaataaaatacct

SEQ ID NO: 717196 - DNA, 22 bp, Artificial Sequence
  chemically synthesized
taagttggattcctaggtattt

SEQ ID NO: 717197 - DNA, 22 bp, Artificial Sequence
  chemically synthesized
caaagagaataaaatacctagg

SEQ ID NO: 717198 - DNA, 22 bp, Artificial Sequence
  chemically synthesized
gtaagttggattcctaggtatt

SEQ ID NO: 717199 - DNA, 22 bp, Artificial Sequence
  chemically synthesized
aaagagaataaaatacctagga

SEQ ID NO: 717200 - DNA, 22 bp, Artificial Sequence
  chemically synthesized
acatcccttgtaagttggattc

SEQ ID NO: 717201 - DNA, 22 bp, Artificial Sequence
  chemically synthesized
cacatcccttgtaagttggatt

SEQ ID NO: 717202 - DNA, 22 bp, Artificial Sequence
  chemically synthesized
ggaatccaacttacaagggatg

SEQ ID NO: 717203 - DNA, 22 bp, Artificial Sequence
  chemically synthesized
aagaggtccttcacatcccttg

SEQ ID NO: 717204 - DNA, 22 bp, Artificial Sequence
  chemically synthesized
gaagaggtccttcacatccctt

SEQ ID NO: 717205 - DNA, 22 bp, Artificial Sequence
  chemically synthesized
cttgaagaggtccttcacatcc

SEQ ID NO: 717206 - DNA, 22 bp, Artificial Sequence
  chemically synthesized
tccttgaagaggtccttcacat

SEQ ID NO: 717207 - DNA, 22 bp, Artificial Sequence
  chemically synthesized
acaagggatgtgaaggacctct

SEQ ID NO: 717208 - DNA, 22 bp, Artificial Sequence
  chemically synthesized
caagggatgtgaaggacctctt

SEQ ID NO: 717209 - DNA, 22 bp, Artificial Sequence
  chemically synthesized
tagttctccttgaagaggtcct

SEQ ID NO: 717210 - DNA, 22 bp, Artificial Sequence
  chemically synthesized
gtagttctccttgaagaggtcc

SEQ ID NO: 717211 - DNA, 22 bp, Artificial Sequence
  chemically synthesized
agcagtggtttgtagttctcct

SEQ ID NO: 717212 - DNA, 22 bp, Artificial Sequence
  chemically synthesized
gagcagtggtttgtagttctcc

SEQ ID NO: 717213 - DNA, 22 bp, Artificial Sequence
  chemically synthesized
cttgagcagtggtttgtagttc

SEQ ID NO: 717214 - DNA, 22 bp, Artificial Sequence
  chemically synthesized
ccttgagcagtggtttgtagtt

SEQ ID NO: 717215 - DNA, 22 bp, Artificial Sequence
  chemically synthesized
ttcaaggagaactacaaaccac

SEQ ID NO: 717216 - DNA, 22 bp, Artificial Sequence
  chemically synthesized
tttccttgagcagtggtttgta

SEQ ID NO: 717217 - DNA, 22 bp, Artificial Sequence
  chemically synthesized
atttccttgagcagtggtttgt

SEQ ID NO: 717218 - DNA, 22 bp, Artificial Sequence
  chemically synthesized
caaggagaactacaaaccactg

SEQ ID NO: 717219 - DNA, 22 bp, Artificial Sequence
  chemically synthesized
tatttccttgagcagtggtttg

SEQ ID NO: 717220 - DNA, 22 bp, Artificial Sequence
  chemically synthesized
aaggagaactacaaaccactgc

SEQ ID NO: 717221 - DNA, 22 bp, Artificial Sequence
  chemically synthesized
ttatttccttgagcagtggttt

SEQ ID NO: 717222 - DNA, 22 bp, Artificial Sequence
  chemically synthesized
ttttatttccttgagcagtggt

SEQ ID NO: 717223 - DNA, 22 bp, Artificial Sequence
  chemically synthesized
tatcctcttttatttccttgag

SEQ ID NO: 717224 - DNA, 22 bp, Artificial Sequence
  chemically synthesized
gtatcctcttttatttccttga

SEQ ID NO: 717225 - DNA, 22 bp, Artificial Sequence
  chemically synthesized
caaaccactgctcaaggaaata

SEQ ID NO: 717226 - DNA, 22 bp, Artificial Sequence
  chemically synthesized
tgtatcctcttttatttccttg

SEQ ID NO: 717227 - DNA, 22 bp, Artificial Sequence
  chemically synthesized
tttgtatcctcttttatttcct

SEQ ID NO: 717228 - DNA, 22 bp, Artificial Sequence
  chemically synthesized
ctttgtatcctcttttatttcc

SEQ ID NO: 717229 - DNA, 22 bp, Artificial Sequence
  chemically synthesized
catttctttgtatcctctttta

SEQ ID NO: 717230 - DNA, 22 bp, Artificial Sequence
  chemically synthesized
ccatttctttgtatcctctttt

SEQ ID NO: 717231 - DNA, 22 bp, Artificial Sequence
  chemically synthesized
ctcaaggaaataaaagaggata

SEQ ID NO: 717232 - DNA, 22 bp, Artificial Sequence
  chemically synthesized
ttccatttctttgtatcctctt

SEQ ID NO: 717233 - DNA, 22 bp, Artificial Sequence
  chemically synthesized
aaggaaataaaagaggatacaa

SEQ ID NO: 717234 - DNA, 22 bp, Artificial Sequence
  chemically synthesized
cccatgagcatggaatgttctt

SEQ ID NO: 717235 - DNA, 22 bp, Artificial Sequence
  chemically synthesized
ctacccatgagcatggaatgtt

SEQ ID NO: 717236 - DNA, 22 bp, Artificial Sequence
  chemically synthesized
cctacccatgagcatggaatgt

SEQ ID NO: 717237 - DNA, 22 bp, Artificial Sequence
  chemically synthesized
ttcctacccatgagcatggaat

SEQ ID NO: 717238 - DNA, 22 bp, Artificial Sequence
  chemically synthesized
attcttcctacccatgagcatg

SEQ ID NO: 717239 - DNA, 22 bp, Artificial Sequence
  chemically synthesized
acgatattgattcttcctaccc

SEQ ID NO: 717240 - DNA, 22 bp, Artificial Sequence
  chemically synthesized
cacgatattgattcttcctacc

SEQ ID NO: 717241 - DNA, 22 bp, Artificial Sequence
  chemically synthesized
tcacgatattgattcttcctac

SEQ ID NO: 717242 - DNA, 22 bp, Artificial Sequence
  chemically synthesized
catgctcatgggtaggaagaat

SEQ ID NO: 717243 - DNA, 22 bp, Artificial Sequence
  chemically synthesized
atgggtaggaagaatcaatatc

SEQ ID NO: 717244 - DNA, 22 bp, Artificial Sequence
  chemically synthesized
ggcagtatggccattttcacga

SEQ ID NO: 717245 - DNA, 22 bp, Artificial Sequence
  chemically synthesized
gggcagtatggccattttcacg

SEQ ID NO: 717246 - DNA, 22 bp, Artificial Sequence
  chemically synthesized
cttgggcagtatggccattttc

SEQ ID NO: 717247 - DNA, 22 bp, Artificial Sequence
  chemically synthesized
ccttgggcagtatggccatttt

SEQ ID NO: 717248 - DNA, 22 bp, Artificial Sequence
  chemically synthesized
taaatttccttgggcagtatgg

SEQ ID NO: 717249 - DNA, 22 bp, Artificial Sequence
  chemically synthesized
aatctataaatttccttgggca

SEQ ID NO: 717250 - DNA, 22 bp, Artificial Sequence
  chemically synthesized
cccaaggaaatttatagattca

SEQ ID NO: 717251 - DNA, 22 bp, Artificial Sequence
  chemically synthesized
atggggatggcattgaatctat

SEQ ID NO: 717252 - DNA, 22 bp, Artificial Sequence
  chemically synthesized
gatggggatggcattgaatcta

SEQ ID NO: 717253 - DNA, 22 bp, Artificial Sequence
  chemically synthesized
gtagcttgatggggatggcatt

SEQ ID NO: 717254 - DNA, 22 bp, Artificial Sequence
  chemically synthesized
atagattcaatgccatccccat

SEQ ID NO: 717255 - DNA, 22 bp, Artificial Sequence
  chemically synthesized
tagattcaatgccatccccatc

SEQ ID NO: 717256 - DNA, 22 bp, Artificial Sequence
  chemically synthesized
aatgccatccccatcaagctac

SEQ ID NO: 717257 - DNA, 22 bp, Artificial Sequence
  chemically synthesized
tgaagaaagtcattggtagctt

SEQ ID NO: 717258 - DNA, 22 bp, Artificial Sequence
  chemically synthesized
tgtgaagaaagtcattggtagc

SEQ ID NO: 717259 - DNA, 22 bp, Artificial Sequence
  chemically synthesized
caattctgtgaagaaagtcatt

SEQ ID NO: 717260 - DNA, 22 bp, Artificial Sequence
  chemically synthesized
ccaattctgtgaagaaagtcat

SEQ ID NO: 717261 - DNA, 22 bp, Artificial Sequence
  chemically synthesized
tccaattctgtgaagaaagtca

SEQ ID NO: 717262 - DNA, 22 bp, Artificial Sequence
  chemically synthesized
ttccaattctgtgaagaaagtc

SEQ ID NO: 717263 - DNA, 22 bp, Artificial Sequence
  chemically synthesized
tttccaattctgtgaagaaagt

SEQ ID NO: 717264 - DNA, 22 bp, Artificial Sequence
  chemically synthesized
ccaatgactttcttcacagaat

SEQ ID NO: 717265 - DNA, 22 bp, Artificial Sequence
  chemically synthesized
aagtagttttttccaattctgt

SEQ ID NO: 717266 - DNA, 22 bp, Artificial Sequence
  chemically synthesized
aaagtagttttttccaattctg

SEQ ID NO: 717267 - DNA, 22 bp, Artificial Sequence
  chemically synthesized
taaagtagttttttccaattct

SEQ ID NO: 717268 - DNA, 22 bp, Artificial Sequence
  chemically synthesized
tcttcacagaattggaaaaaac

SEQ ID NO: 717269 - DNA, 22 bp, Artificial Sequence
  chemically synthesized
cttcacagaattggaaaaaact

SEQ ID NO: 717270 - DNA, 22 bp, Artificial Sequence
  chemically synthesized
ttcacagaattggaaaaaacta

SEQ ID NO: 717271 - DNA, 22 bp, Artificial Sequence
  chemically synthesized
cacagaattggaaaaaactact

SEQ ID NO: 717272 - DNA, 22 bp, Artificial Sequence
  chemically synthesized
acagaattggaaaaaactactt

SEQ ID NO: 717273 - DNA, 22 bp, Artificial Sequence
  chemically synthesized
catatgaactttaaagtagttt

SEQ ID NO: 717274 - DNA, 22 bp, Artificial Sequence
  chemically synthesized
gttccatatgaactttaaagta

SEQ ID NO: 717275 - DNA, 22 bp, Artificial Sequence
  chemically synthesized
ggttccatatgaactttaaagt

SEQ ID NO: 717276 - DNA, 22 bp, Artificial Sequence
  chemically synthesized
tggttccatatgaactttaaag

SEQ ID NO: 717277 - DNA, 22 bp, Artificial Sequence
  chemically synthesized
ttggttccatatgaactttaaa

SEQ ID NO: 717278 - DNA, 22 bp, Artificial Sequence
  chemically synthesized
gaaaaaactactttaaagttca

SEQ ID NO: 717279 - DNA, 22 bp, Artificial Sequence
  chemically synthesized
tttggttccatatgaactttaa

SEQ ID NO: 717280 - DNA, 22 bp, Artificial Sequence
  chemically synthesized
ttttggttccatatgaacttta

SEQ ID NO: 717281 - DNA, 22 bp, Artificial Sequence
  chemically synthesized
ttttttggttccatatgaactt

SEQ ID NO: 717282 - DNA, 22 bp, Artificial Sequence
  chemically synthesized
ctttaaagttcatatggaacca

SEQ ID NO: 717283 - DNA, 22 bp, Artificial Sequence
  chemically synthesized
taaagttcatatggaaccaaaa

SEQ ID NO: 717284 - DNA, 22 bp, Artificial Sequence
  chemically synthesized
aaagttcatatggaaccaaaaa

SEQ ID NO: 717285 - DNA, 22 bp, Artificial Sequence
  chemically synthesized
aagttcatatggaaccaaaaaa

SEQ ID NO: 717286 - DNA, 22 bp, Artificial Sequence
  chemically synthesized
gcgatgcgggctcttttttggt

SEQ ID NO: 717287 - DNA, 22 bp, Artificial Sequence
  chemically synthesized
ggcgatgcgggctcttttttgg

SEQ ID NO: 717288 - DNA, 22 bp, Artificial Sequence
  chemically synthesized
atatggaaccaaaaaagagccc

SEQ ID NO: 717289 - DNA, 22 bp, Artificial Sequence
  chemically synthesized
acttggcgatgcgggctctttt

SEQ ID NO: 717290 - DNA, 22 bp, Artificial Sequence
  chemically synthesized
ggattgacttggcgatgcgggc

SEQ ID NO: 717291 - DNA, 22 bp, Artificial Sequence
  chemically synthesized
aggattgacttggcgatgcggg

SEQ ID NO: 717292 - DNA, 22 bp, Artificial Sequence
  chemically synthesized
gcttaggattgacttggcgatg

SEQ ID NO: 717293 - DNA, 22 bp, Artificial Sequence
  chemically synthesized
ggcttaggattgacttggcgat

SEQ ID NO: 717294 - DNA, 22 bp, Artificial Sequence
  chemically synthesized
tggcttaggattgacttggcga

SEQ ID NO: 717295 - DNA, 22 bp, Artificial Sequence
  chemically synthesized
ttggcttaggattgacttggcg

SEQ ID NO: 717296 - DNA, 22 bp, Artificial Sequence
  chemically synthesized
ttttggcttaggattgacttgg

SEQ ID NO: 717297 - DNA, 22 bp, Artificial Sequence
  chemically synthesized
ttcttttggcttaggattgact

SEQ ID NO: 717298 - DNA, 22 bp, Artificial Sequence
  chemically synthesized
gttcttttggcttaggattgac

SEQ ID NO: 717299 - DNA, 22 bp, Artificial Sequence
  chemically synthesized
tgttcttttggcttaggattga

SEQ ID NO: 717300 - DNA, 22 bp, Artificial Sequence
  chemically synthesized
cagctttgttcttttggcttag

SEQ ID NO: 717301 - DNA, 22 bp, Artificial Sequence
  chemically synthesized
agccaaaagaacaaagctggag

SEQ ID NO: 717302 - DNA, 22 bp, Artificial Sequence
  chemically synthesized
aagtcaggtagcgtgatgcctc

SEQ ID NO: 717303 - DNA, 22 bp, Artificial Sequence
  chemically synthesized
gaagtcaggtagcgtgatgcct

SEQ ID NO: 717304 - DNA, 22 bp, Artificial Sequence
  chemically synthesized
gaggcatcacgctacctgactt

SEQ ID NO: 717305 - DNA, 22 bp, Artificial Sequence
  chemically synthesized
tagtatagtttgaagtcaggta

SEQ ID NO: 717306 - DNA, 22 bp, Artificial Sequence
  chemically synthesized
gtagtatagtttgaagtcaggt

SEQ ID NO: 717307 - DNA, 22 bp, Artificial Sequence
  chemically synthesized
tagccttgtagtatagtttgaa

SEQ ID NO: 717308 - DNA, 22 bp, Artificial Sequence
  chemically synthesized
ctgtagccttgtagtatagttt

SEQ ID NO: 717309 - DNA, 22 bp, Artificial Sequence
  chemically synthesized
cctgtagccttgtagtatagtt

SEQ ID NO: 717310 - DNA, 22 bp, Artificial Sequence
  chemically synthesized
cctgacttcaaactatactaca

SEQ ID NO: 717311 - DNA, 22 bp, Artificial Sequence
  chemically synthesized
cttcctgtagccttgtagtata

SEQ ID NO: 717312 - DNA, 22 bp, Artificial Sequence
  chemically synthesized
gcttcctgtagccttgtagtat

SEQ ID NO: 717313 - DNA, 22 bp, Artificial Sequence
  chemically synthesized
tgcttcctgtagccttgtagta

SEQ ID NO: 717314 - DNA, 22 bp, Artificial Sequence
  chemically synthesized
acttcaaactatactacaaggc

SEQ ID NO: 717315 - DNA, 22 bp, Artificial Sequence
  chemically synthesized
ttttgcttcctgtagccttgta

SEQ ID NO: 717316 - DNA, 22 bp, Artificial Sequence
  chemically synthesized
caaactatactacaaggctaca

SEQ ID NO: 717317 - DNA, 22 bp, Artificial Sequence
  chemically synthesized
aaactatactacaaggctacag

SEQ ID NO: 717318 - DNA, 22 bp, Artificial Sequence
  chemically synthesized
tactacaaggctacaggaagca

SEQ ID NO: 717319 - DNA, 22 bp, Artificial Sequence
  chemically synthesized
caaggctacaggaagcaaaaca

SEQ ID NO: 717320 - DNA, 22 bp, Artificial Sequence
  chemically synthesized
gtaccagtaccatgctgttttg

SEQ ID NO: 717321 - DNA, 22 bp, Artificial Sequence
  chemically synthesized
ggtaccagtaccatgctgtttt

SEQ ID NO: 717322 - DNA, 22 bp, Artificial Sequence
  chemically synthesized
tggtaccagtaccatgctgttt

SEQ ID NO: 717323 - DNA, 22 bp, Artificial Sequence
  chemically synthesized
caggaagcaaaacagcatggta

SEQ ID NO: 717324 - DNA, 22 bp, Artificial Sequence
  chemically synthesized
ttttggtaccagtaccatgctg

SEQ ID NO: 717325 - DNA, 22 bp, Artificial Sequence
  chemically synthesized
tgttttggtaccagtaccatgc

SEQ ID NO: 717326 - DNA, 22 bp, Artificial Sequence
  chemically synthesized
tgtctctgttttggtaccagta

SEQ ID NO: 717327 - DNA, 22 bp, Artificial Sequence
  chemically synthesized
atctatgtctctgttttggtac

SEQ ID NO: 717328 - DNA, 22 bp, Artificial Sequence
  chemically synthesized
cattgatctatgtctctgtttt

SEQ ID NO: 717329 - DNA, 22 bp, Artificial Sequence
  chemically synthesized
ttccattgatctatgtctctgt

SEQ ID NO: 717330 - DNA, 22 bp, Artificial Sequence
  chemically synthesized
tgttccattgatctatgtctct

SEQ ID NO: 717331 - DNA, 22 bp, Artificial Sequence
  chemically synthesized
gtaccaaaacagagacatagat

SEQ ID NO: 717332 - DNA, 22 bp, Artificial Sequence
  chemically synthesized
ttctgttccattgatctatgtc

SEQ ID NO: 717333 - DNA, 22 bp, Artificial Sequence
  chemically synthesized
tgttctgttccattgatctatg

SEQ ID NO: 717334 - DNA, 22 bp, Artificial Sequence
  chemically synthesized
agggctctgttctgttccattg

SEQ ID NO: 717335 - DNA, 22 bp, Artificial Sequence
  chemically synthesized
tgagggctctgttctgttccat

SEQ ID NO: 717336 - DNA, 22 bp, Artificial Sequence
  chemically synthesized
ctgagggctctgttctgttcca

SEQ ID NO: 717337 - DNA, 22 bp, Artificial Sequence
  chemically synthesized
tttctgagggctctgttctgtt

SEQ ID NO: 717338 - DNA, 22 bp, Artificial Sequence
  chemically synthesized
tagatatgcggcattatttctg

SEQ ID NO: 717339 - DNA, 22 bp, Artificial Sequence
  chemically synthesized
agaaataatgccgcatatctac

SEQ ID NO: 717340 - DNA, 22 bp, Artificial Sequence
  chemically synthesized
tcaaagatcagatggttgtaga

SEQ ID NO: 717341 - DNA, 22 bp, Artificial Sequence
  chemically synthesized
gtcaaagatcagatggttgtag

SEQ ID NO: 717342 - DNA, 22 bp, Artificial Sequence
  chemically synthesized
aggtttgtcaaagatcagatgg

SEQ ID NO: 717343 - DNA, 22 bp, Artificial Sequence
  chemically synthesized
tcaggtttgtcaaagatcagat

SEQ ID NO: 717344 - DNA, 22 bp, Artificial Sequence
  chemically synthesized
ctcaggtttgtcaaagatcaga

SEQ ID NO: 717345 - DNA, 22 bp, Artificial Sequence
  chemically synthesized
tctcaggtttgtcaaagatcag

SEQ ID NO: 717346 - DNA, 22 bp, Artificial Sequence
  chemically synthesized
ttctcaggtttgtcaaagatca

SEQ ID NO: 717347 - DNA, 22 bp, Artificial Sequence
  chemically synthesized
tttttctcaggtttgtcaaaga

SEQ ID NO: 717348 - DNA, 22 bp, Artificial Sequence
  chemically synthesized
caaccatctgatctttgacaaa

SEQ ID NO: 717349 - DNA, 22 bp, Artificial Sequence
  chemically synthesized
gtttttctcaggtttgtcaaag

SEQ ID NO: 717350 - DNA, 22 bp, Artificial Sequence
  chemically synthesized
cttgtttttctcaggtttgtca

SEQ ID NO: 717351 - DNA, 22 bp, Artificial Sequence
  chemically synthesized
atctttgacaaacctgagaaaa

SEQ ID NO: 717352 - DNA, 22 bp, Artificial Sequence
  chemically synthesized
cccattgcttgtttttctcagg

SEQ ID NO: 717353 - DNA, 22 bp, Artificial Sequence
  chemically synthesized
ccccattgcttgtttttctcag

SEQ ID NO: 717354 - DNA, 22 bp, Artificial Sequence
  chemically synthesized
tccccattgcttgtttttctca

SEQ ID NO: 717355 - DNA, 22 bp, Artificial Sequence
  chemically synthesized
tgacaaacctgagaaaaacaag

SEQ ID NO: 717356 - DNA, 22 bp, Artificial Sequence
  chemically synthesized
gacaaacctgagaaaaacaagc

SEQ ID NO: 717357 - DNA, 22 bp, Artificial Sequence
  chemically synthesized
acaaacctgagaaaaacaagca

SEQ ID NO: 717358 - DNA, 22 bp, Artificial Sequence
  chemically synthesized
agaaaaacaagcaatggggaaa

SEQ ID NO: 717359 - DNA, 22 bp, Artificial Sequence
  chemically synthesized
aatagggaatcctttccccatt

SEQ ID NO: 717360 - DNA, 22 bp, Artificial Sequence
  chemically synthesized
ttaaatagggaatcctttcccc

SEQ ID NO: 717361 - DNA, 22 bp, Artificial Sequence
  chemically synthesized
attaaatagggaatcctttccc

SEQ ID NO: 717362 - DNA, 22 bp, Artificial Sequence
  chemically synthesized
ccagcaccatttattaaatagg

SEQ ID NO: 717363 - DNA, 22 bp, Artificial Sequence
  chemically synthesized
cccagcaccatttattaaatag

SEQ ID NO: 717364 - DNA, 22 bp, Artificial Sequence
  chemically synthesized
tcccagcaccatttattaaata

SEQ ID NO: 717365 - DNA, 22 bp, Artificial Sequence
  chemically synthesized
gccagttttcccagcaccattt

SEQ ID NO: 717366 - DNA, 22 bp, Artificial Sequence
  chemically synthesized
cctatttaataaatggtgctgg

SEQ ID NO: 717367 - DNA, 22 bp, Artificial Sequence
  chemically synthesized
tttaataaatggtgctgggaaa

SEQ ID NO: 717368 - DNA, 22 bp, Artificial Sequence
  chemically synthesized
aataaatggtgctgggaaaact

SEQ ID NO: 717369 - DNA, 22 bp, Artificial Sequence
  chemically synthesized
ataaatggtgctgggaaaactg

SEQ ID NO: 717370 - DNA, 22 bp, Artificial Sequence
  chemically synthesized
catatggctagccagttttccc

SEQ ID NO: 717371 - DNA, 22 bp, Artificial Sequence
  chemically synthesized
tacatatggctagccagttttc

SEQ ID NO: 717372 - DNA, 22 bp, Artificial Sequence
  chemically synthesized
ctacatatggctagccagtttt

SEQ ID NO: 717373 - DNA, 22 bp, Artificial Sequence
  chemically synthesized
tctacatatggctagccagttt

SEQ ID NO: 717374 - DNA, 22 bp, Artificial Sequence
  chemically synthesized
agctttctacatatggctagcc

SEQ ID NO: 717375 - DNA, 22 bp, Artificial Sequence
  chemically synthesized
cagctttctacatatggctagc

SEQ ID NO: 717376 - DNA, 22 bp, Artificial Sequence
  chemically synthesized
ggaaaactggctagccatatgt

SEQ ID NO: 717377 - DNA, 22 bp, Artificial Sequence
  chemically synthesized
gctagccatatgtagaaagctg

SEQ ID NO: 717378 - DNA, 22 bp, Artificial Sequence
  chemically synthesized
gccatatgtagaaagctgaaac

SEQ ID NO: 717379 - DNA, 22 bp, Artificial Sequence
  chemically synthesized
gtataaggtgtaaggaagggat

SEQ ID NO: 717380 - DNA, 22 bp, Artificial Sequence
  chemically synthesized
cgtataaggtgtaaggaaggga

SEQ ID NO: 717381 - DNA, 22 bp, Artificial Sequence
  chemically synthesized
tcgtataaggtgtaaggaaggg

SEQ ID NO: 717382 - DNA, 22 bp, Artificial Sequence
  chemically synthesized
aaactggatcccttccttacac

SEQ ID NO: 717383 - DNA, 22 bp, Artificial Sequence
  chemically synthesized
attttcgtataaggtgtaagga

SEQ ID NO: 717384 - DNA, 22 bp, Artificial Sequence
  chemically synthesized
gatcccttccttacaccttata

SEQ ID NO: 717385 - DNA, 22 bp, Artificial Sequence
  chemically synthesized
aattaattttcgtataaggtgt

SEQ ID NO: 717386 - DNA, 22 bp, Artificial Sequence
  chemically synthesized
gaattaattttcgtataaggtg

SEQ ID NO: 717387 - DNA, 22 bp, Artificial Sequence
  chemically synthesized
ccttacaccttatacgaaaatt

SEQ ID NO: 717388 - DNA, 22 bp, Artificial Sequence
  chemically synthesized
cttacaccttatacgaaaatta

SEQ ID NO: 717389 - DNA, 22 bp, Artificial Sequence
  chemically synthesized
atccatcttgaattaattttcg

SEQ ID NO: 717390 - DNA, 22 bp, Artificial Sequence
  chemically synthesized
aatccatcttgaattaattttc

SEQ ID NO: 717391 - DNA, 22 bp, Artificial Sequence
  chemically synthesized
acaccttatacgaaaattaatt

SEQ ID NO: 717392 - DNA, 22 bp, Artificial Sequence
  chemically synthesized
taatccatcttgaattaatttt

SEQ ID NO: 717393 - DNA, 22 bp, Artificial Sequence
  chemically synthesized
caccttatacgaaaattaattc

SEQ ID NO: 717394 - DNA, 22 bp, Artificial Sequence
  chemically synthesized
agtctttaatccatcttgaatt

SEQ ID NO: 717395 - DNA, 22 bp, Artificial Sequence
  chemically synthesized
atacgaaaattaattcaagatg

SEQ ID NO: 717396 - DNA, 22 bp, Artificial Sequence
  chemically synthesized
aagtctttaatccatcttgaat

SEQ ID NO: 717397 - DNA, 22 bp, Artificial Sequence
  chemically synthesized
tacgaaaattaattcaagatgg

SEQ ID NO: 717398 - DNA, 22 bp, Artificial Sequence
  chemically synthesized
acatttaagtctttaatccatc

SEQ ID NO: 717399 - DNA, 22 bp, Artificial Sequence
  chemically synthesized
attcaagatggattaaagactt

SEQ ID NO: 717400 - DNA, 22 bp, Artificial Sequence
  chemically synthesized
ggtctaacatttaagtctttaa

SEQ ID NO: 717401 - DNA, 22 bp, Artificial Sequence
  chemically synthesized
aggtctaacatttaagtcttta

SEQ ID NO: 717402 - DNA, 22 bp, Artificial Sequence
  chemically synthesized
taggtctaacatttaagtcttt

SEQ ID NO: 717403 - DNA, 22 bp, Artificial Sequence
  chemically synthesized
aagatggattaaagacttaaat

SEQ ID NO: 717404 - DNA, 22 bp, Artificial Sequence
  chemically synthesized
tggttttaggtctaacatttaa

SEQ ID NO: 717405 - DNA, 22 bp, Artificial Sequence
  chemically synthesized
gtggttttaggtctaacattta

SEQ ID NO: 717406 - DNA, 22 bp, Artificial Sequence
  chemically synthesized
tgtggttttaggtctaacattt

SEQ ID NO: 717407 - DNA, 22 bp, Artificial Sequence
  chemically synthesized
ttgtggttttaggtctaacatt

SEQ ID NO: 717408 - DNA, 22 bp, Artificial Sequence
  chemically synthesized
aagacttaaatgttagacctaa

SEQ ID NO: 717409 - DNA, 22 bp, Artificial Sequence
  chemically synthesized
gagtttttgtggttttaggtct

SEQ ID NO: 717410 - DNA, 22 bp, Artificial Sequence
  chemically synthesized
tagagtttttgtggttttaggt

SEQ ID NO: 717411 - DNA, 22 bp, Artificial Sequence
  chemically synthesized
ctagagtttttgtggttttagg

SEQ ID NO: 717412 - DNA, 22 bp, Artificial Sequence
  chemically synthesized
aaatgttagacctaaaaccaca

SEQ ID NO: 717413 - DNA, 22 bp, Artificial Sequence
  chemically synthesized
ttctagagtttttgtggtttta

SEQ ID NO: 717414 - DNA, 22 bp, Artificial Sequence
  chemically synthesized
aatgttagacctaaaaccacaa

SEQ ID NO: 717415 - DNA, 22 bp, Artificial Sequence
  chemically synthesized
cttctagagtttttgtggtttt

SEQ ID NO: 717416 - DNA, 22 bp, Artificial Sequence
  chemically synthesized
tcttctagagtttttgtggttt

SEQ ID NO: 717417 - DNA, 22 bp, Artificial Sequence
  chemically synthesized
ggttttcttctagagtttttgt

SEQ ID NO: 717418 - DNA, 22 bp, Artificial Sequence
  chemically synthesized
gacctaaaaccacaaaaactct

SEQ ID NO: 717419 - DNA, 22 bp, Artificial Sequence
  chemically synthesized
aaaccacaaaaactctagaaga

SEQ ID NO: 717420 - DNA, 22 bp, Artificial Sequence
  chemically synthesized
aatggtaatgcctaggttttct

SEQ ID NO: 717421 - DNA, 22 bp, Artificial Sequence
  chemically synthesized
tgtcctgaatggtaatgcctag

SEQ ID NO: 717422 - DNA, 22 bp, Artificial Sequence
  chemically synthesized
tagaagaaaacctaggcattac

SEQ ID NO: 717423 - DNA, 22 bp, Artificial Sequence
  chemically synthesized
gaagaaaacctaggcattacca

SEQ ID NO: 717424 - DNA, 22 bp, Artificial Sequence
  chemically synthesized
cccatgcctatgtcctgaatgg

SEQ ID NO: 717425 - DNA, 22 bp, Artificial Sequence
  chemically synthesized
gcccatgcctatgtcctgaatg

SEQ ID NO: 717426 - DNA, 22 bp, Artificial Sequence
  chemically synthesized
ggcattaccattcaggacatag

SEQ ID NO: 717427 - DNA, 22 bp, Artificial Sequence
  chemically synthesized
ccattcaggacataggcatggg

SEQ ID NO: 717428 - DNA, 22 bp, Artificial Sequence
  chemically synthesized
tagacatgaagtccttgcccat

SEQ ID NO: 717429 - DNA, 22 bp, Artificial Sequence
  chemically synthesized
aggacataggcatgggcaagga

SEQ ID NO: 717430 - DNA, 22 bp, Artificial Sequence
  chemically synthesized
gtgttgtagacatgaagtcctt

SEQ ID NO: 717431 - DNA, 22 bp, Artificial Sequence
  chemically synthesized
ggtgttgtagacatgaagtcct

SEQ ID NO: 717432 - DNA, 22 bp, Artificial Sequence
  chemically synthesized
tggtgttgtagacatgaagtcc

SEQ ID NO: 717433 - DNA, 22 bp, Artificial Sequence
  chemically synthesized
ttggtgttgtagacatgaagtc

SEQ ID NO: 717434 - DNA, 22 bp, Artificial Sequence
  chemically synthesized
cttttggtgttgtagacatgaa

SEQ ID NO: 717435 - DNA, 22 bp, Artificial Sequence
  chemically synthesized
ccattgcttttggtgttgtaga

SEQ ID NO: 717436 - DNA, 22 bp, Artificial Sequence
  chemically synthesized
ttgccattgcttttggtgttgt

SEQ ID NO: 717437 - DNA, 22 bp, Artificial Sequence
  chemically synthesized
gttgccattgcttttggtgttg

SEQ ID NO: 717438 - DNA, 22 bp, Artificial Sequence
  chemically synthesized
tgttgccattgcttttggtgtt

SEQ ID NO: 717439 - DNA, 22 bp, Artificial Sequence
  chemically synthesized
ttgttgccattgcttttggtgt

SEQ ID NO: 717440 - DNA, 22 bp, Artificial Sequence
  chemically synthesized
catgtctacaacaccaaaagca

SEQ ID NO: 717441 - DNA, 22 bp, Artificial Sequence
  chemically synthesized
atgtctacaacaccaaaagcaa

SEQ ID NO: 717442 - DNA, 22 bp, Artificial Sequence
  chemically synthesized
gcttttgttgccattgcttttg

SEQ ID NO: 717443 - DNA, 22 bp, Artificial Sequence
  chemically synthesized
ggcttttgttgccattgctttt

SEQ ID NO: 717444 - DNA, 22 bp, Artificial Sequence
  chemically synthesized
tggcttttgttgccattgcttt

SEQ ID NO: 717445 - DNA, 22 bp, Artificial Sequence
  chemically synthesized
caacaccaaaagcaatggcaac

SEQ ID NO: 717446 - DNA, 22 bp, Artificial Sequence
  chemically synthesized
tcaattttggcttttgttgcca

SEQ ID NO: 717447 - DNA, 22 bp, Artificial Sequence
  chemically synthesized
gtcaattttggcttttgttgcc

SEQ ID NO: 717448 - DNA, 22 bp, Artificial Sequence
  chemically synthesized
gatcccatttgtcaattttggc

SEQ ID NO: 717449 - DNA, 22 bp, Artificial Sequence
  chemically synthesized
attagatcccatttgtcaattt

SEQ ID NO: 717450 - DNA, 22 bp, Artificial Sequence
  chemically synthesized
aattagatcccatttgtcaatt

SEQ ID NO: 717451 - DNA, 22 bp, Artificial Sequence
  chemically synthesized
gtttaattagatcccatttgtc

SEQ ID NO: 717452 - DNA, 22 bp, Artificial Sequence
  chemically synthesized
agtttaattagatcccatttgt

SEQ ID NO: 717453 - DNA, 22 bp, Artificial Sequence
  chemically synthesized
tagtttaattagatcccatttg

SEQ ID NO: 717454 - DNA, 22 bp, Artificial Sequence
  chemically synthesized
tttagtttaattagatcccatt

SEQ ID NO: 717455 - DNA, 22 bp, Artificial Sequence
  chemically synthesized
acaaatgggatctaattaaact

SEQ ID NO: 717456 - DNA, 22 bp, Artificial Sequence
  chemically synthesized
tgcagaagctctttagtttaat

SEQ ID NO: 717457 - DNA, 22 bp, Artificial Sequence
  chemically synthesized
ctgtgcagaagctctttagttt

SEQ ID NO: 717458 - DNA, 22 bp, Artificial Sequence
  chemically synthesized
gctgtgcagaagctctttagtt

SEQ ID NO: 717459 - DNA, 22 bp, Artificial Sequence
  chemically synthesized
tgctgtgcagaagctctttagt

SEQ ID NO: 717460 - DNA, 22 bp, Artificial Sequence
  chemically synthesized
ttgctgtgcagaagctctttag

SEQ ID NO: 717461 - DNA, 22 bp, Artificial Sequence
  chemically synthesized
ttttgctgtgcagaagctcttt

SEQ ID NO: 717462 - DNA, 22 bp, Artificial Sequence
  chemically synthesized
cttttgctgtgcagaagctctt

SEQ ID NO: 717463 - DNA, 22 bp, Artificial Sequence
  chemically synthesized
attaaactaaagagcttctgca

SEQ ID NO: 717464 - DNA, 22 bp, Artificial Sequence
  chemically synthesized
aactaaagagcttctgcacagc

SEQ ID NO: 717465 - DNA, 22 bp, Artificial Sequence
  chemically synthesized
atggtagtttcttttgctgtgc

SEQ ID NO: 717466 - DNA, 22 bp, Artificial Sequence
  chemically synthesized
aagagcttctgcacagcaaaag

SEQ ID NO: 717467 - DNA, 22 bp, Artificial Sequence
  chemically synthesized
tgatggtagtttcttttgctgt

SEQ ID NO: 717468 - DNA, 22 bp, Artificial Sequence
  chemically synthesized
actctgatggtagtttcttttg

SEQ ID NO: 717469 - DNA, 22 bp, Artificial Sequence
  chemically synthesized
ttcactctgatggtagtttctt

SEQ ID NO: 717470 - DNA, 22 bp, Artificial Sequence
  chemically synthesized
ctgcacagcaaaagaaactacc

SEQ ID NO: 717471 - DNA, 22 bp, Artificial Sequence
  chemically synthesized
tgcacagcaaaagaaactacca

SEQ ID NO: 717472 - DNA, 22 bp, Artificial Sequence
  chemically synthesized
cacagcaaaagaaactaccatc

SEQ ID NO: 717473 - DNA, 22 bp, Artificial Sequence
  chemically synthesized
cctgttcactctgatggtagtt

SEQ ID NO: 717474 - DNA, 22 bp, Artificial Sequence
  chemically synthesized
taggttgcctgttcactctgat

SEQ ID NO: 717475 - DNA, 22 bp, Artificial Sequence
  chemically synthesized
gtaggttgcctgttcactctga

SEQ ID NO: 717476 - DNA, 22 bp, Artificial Sequence
  chemically synthesized
tgtaggttgcctgttcactctg

SEQ ID NO: 717477 - DNA, 22 bp, Artificial Sequence
  chemically synthesized
ccattttgtaggttgcctgttc

SEQ ID NO: 717478 - DNA, 22 bp, Artificial Sequence
  chemically synthesized
ccatcagagtgaacaggcaacc

SEQ ID NO: 717479 - DNA, 22 bp, Artificial Sequence
  chemically synthesized
tcccattttgtaggttgcctgt

SEQ ID NO: 717480 - DNA, 22 bp, Artificial Sequence
  chemically synthesized
ctcccattttgtaggttgcctg

SEQ ID NO: 717481 - DNA, 22 bp, Artificial Sequence
  chemically synthesized
tctcccattttgtaggttgcct

SEQ ID NO: 717482 - DNA, 22 bp, Artificial Sequence
  chemically synthesized
ttctcccattttgtaggttgcc

SEQ ID NO: 717483 - DNA, 22 bp, Artificial Sequence
  chemically synthesized
cgaaaatttttctcccattttg

SEQ ID NO: 717484 - DNA, 22 bp, Artificial Sequence
  chemically synthesized
caaaatgggagaaaaattttcg

SEQ ID NO: 717485 - DNA, 22 bp, Artificial Sequence
  chemically synthesized
tcagatgagcaggttgcgaaaa

SEQ ID NO: 717486 - DNA, 22 bp, Artificial Sequence
  chemically synthesized
gtcagatgagcaggttgcgaaa

SEQ ID NO: 717487 - DNA, 22 bp, Artificial Sequence
  chemically synthesized
tgtcagatgagcaggttgcgaa

SEQ ID NO: 717488 - DNA, 22 bp, Artificial Sequence
  chemically synthesized
gccctttgtcagatgagcaggt

SEQ ID NO: 717489 - DNA, 22 bp, Artificial Sequence
  chemically synthesized
tcgcaacctgctcatctgacaa

SEQ ID NO: 717490 - DNA, 22 bp, Artificial Sequence
  chemically synthesized
gatattagccctttgtcagatg

SEQ ID NO: 717491 - DNA, 22 bp, Artificial Sequence
  chemically synthesized
cgcaacctgctcatctgacaaa

SEQ ID NO: 717492 - DNA, 22 bp, Artificial Sequence
  chemically synthesized
gcaacctgctcatctgacaaag

SEQ ID NO: 717493 - DNA, 22 bp, Artificial Sequence
  chemically synthesized
tggatattagccctttgtcaga

SEQ ID NO: 717494 - DNA, 22 bp, Artificial Sequence
  chemically synthesized
tagattctggatattagccctt

SEQ ID NO: 717495 - DNA, 22 bp, Artificial Sequence
  chemically synthesized
ctcatctgacaaagggctaata

SEQ ID NO: 717496 - DNA, 22 bp, Artificial Sequence
  chemically synthesized
atctgacaaagggctaatatcc

SEQ ID NO: 717497 - DNA, 22 bp, Artificial Sequence
  chemically synthesized
attgtagattctggatattagc

SEQ ID NO: 717498 - DNA, 22 bp, Artificial Sequence
  chemically synthesized
acaaagggctaatatccagaat

SEQ ID NO: 717499 - DNA, 22 bp, Artificial Sequence
  chemically synthesized
agttcattgtagattctggata

SEQ ID NO: 717500 - DNA, 22 bp, Artificial Sequence
  chemically synthesized
gagttcattgtagattctggat

SEQ ID NO: 717501 - DNA, 22 bp, Artificial Sequence
  chemically synthesized
tttgagttcattgtagattctg

SEQ ID NO: 717502 - DNA, 22 bp, Artificial Sequence
  chemically synthesized
gtttgagttcattgtagattct

SEQ ID NO: 717503 - DNA, 22 bp, Artificial Sequence
  chemically synthesized
atatccagaatctacaatgaac

SEQ ID NO: 717504 - DNA, 22 bp, Artificial Sequence
  chemically synthesized
tacatttgtttgagttcattgt

SEQ ID NO: 717505 - DNA, 22 bp, Artificial Sequence
  chemically synthesized
gtacatttgtttgagttcattg

SEQ ID NO: 717506 - DNA, 22 bp, Artificial Sequence
  chemically synthesized
ttgtacatttgtttgagttcat

SEQ ID NO: 717507 - DNA, 22 bp, Artificial Sequence
  chemically synthesized
cttgtacatttgtttgagttca

SEQ ID NO: 717508 - DNA, 22 bp, Artificial Sequence
  chemically synthesized
tcttgtacatttgtttgagttc

SEQ ID NO: 717509 - DNA, 22 bp, Artificial Sequence
  chemically synthesized
ttcttgtacatttgtttgagtt

SEQ ID NO: 717510 - DNA, 22 bp, Artificial Sequence
  chemically synthesized
tttcttgtacatttgtttgagt

SEQ ID NO: 717511 - DNA, 22 bp, Artificial Sequence
  chemically synthesized
ttttcttgtacatttgtttgag

SEQ ID NO: 717512 - DNA, 22 bp, Artificial Sequence
  chemically synthesized
tttttttcttgtacatttgttt

SEQ ID NO: 717513 - DNA, 22 bp, Artificial Sequence
  chemically synthesized
gtttttttcttgtacatttgtt

SEQ ID NO: 717514 - DNA, 22 bp, Artificial Sequence
  chemically synthesized
caatgaactcaaacaaatgtac

SEQ ID NO: 717515 - DNA, 22 bp, Artificial Sequence
  chemically synthesized
tttgtttttttcttgtacattt

SEQ ID NO: 717516 - DNA, 22 bp, Artificial Sequence
  chemically synthesized
aaacaaatgtacaagaaaaaaa

SEQ ID NO: 717517 - DNA, 22 bp, Artificial Sequence
  chemically synthesized
atggggttgtttgtttttttct

SEQ ID NO: 717518 - DNA, 22 bp, Artificial Sequence
  chemically synthesized
gatggggttgtttgtttttttc

SEQ ID NO: 717519 - DNA, 22 bp, Artificial Sequence
  chemically synthesized
tgatggggttgtttgttttttt

SEQ ID NO: 717520 - DNA, 22 bp, Artificial Sequence
  chemically synthesized
ttgatggggttgtttgtttttt

SEQ ID NO: 717521 - DNA, 22 bp, Artificial Sequence
  chemically synthesized
tttgatggggttgtttgttttt

SEQ ID NO: 717522 - DNA, 22 bp, Artificial Sequence
  chemically synthesized
gcccactttttgatggggttgt

SEQ ID NO: 717523 - DNA, 22 bp, Artificial Sequence
  chemically synthesized
cgcccactttttgatggggttg

SEQ ID NO: 717524 - DNA, 22 bp, Artificial Sequence
  chemically synthesized
atgtccttcgcccactttttga

SEQ ID NO: 717525 - DNA, 22 bp, Artificial Sequence
  chemically synthesized
ttcatgtccttcgcccactttt

SEQ ID NO: 717526 - DNA, 22 bp, Artificial Sequence
  chemically synthesized
agaagtgtctgttcatgtcctt

SEQ ID NO: 717527 - DNA, 22 bp, Artificial Sequence
  chemically synthesized
gagaagtgtctgttcatgtcct

SEQ ID NO: 717528 - DNA, 22 bp, Artificial Sequence
  chemically synthesized
tgagaagtgtctgttcatgtcc

SEQ ID NO: 717529 - DNA, 22 bp, Artificial Sequence
  chemically synthesized
ttgagaagtgtctgttcatgtc

SEQ ID NO: 717530 - DNA, 22 bp, Artificial Sequence
  chemically synthesized
ttttgagaagtgtctgttcatg

SEQ ID NO: 717531 - DNA, 22 bp, Artificial Sequence
  chemically synthesized
cttttgagaagtgtctgttcat

SEQ ID NO: 717532 - DNA, 22 bp, Artificial Sequence
  chemically synthesized
cataaatgtcttcttttgagaa

SEQ ID NO: 717533 - DNA, 22 bp, Artificial Sequence
  chemically synthesized
gctgcataaatgtcttcttttg

SEQ ID NO: 717534 - DNA, 22 bp, Artificial Sequence
  chemically synthesized
ggctgcataaatgtcttctttt

SEQ ID NO: 717535 - DNA, 22 bp, Artificial Sequence
  chemically synthesized
tggctgcataaatgtcttcttt

SEQ ID NO: 717536 - DNA, 22 bp, Artificial Sequence
  chemically synthesized
ttggctgcataaatgtcttctt

SEQ ID NO: 717537 - DNA, 22 bp, Artificial Sequence
  chemically synthesized
ctcaaaagaagacatttatgca

SEQ ID NO: 717538 - DNA, 22 bp, Artificial Sequence
  chemically synthesized
tcaaaagaagacatttatgcag

SEQ ID NO: 717539 - DNA, 22 bp, Artificial Sequence
  chemically synthesized
atgtgtcttttggctgcataaa

SEQ ID NO: 717540 - DNA, 22 bp, Artificial Sequence
  chemically synthesized
aaaagaagacatttatgcagcc

SEQ ID NO: 717541 - DNA, 22 bp, Artificial Sequence
  chemically synthesized
catgtgtcttttggctgcataa

SEQ ID NO: 717542 - DNA, 22 bp, Artificial Sequence
  chemically synthesized
tcatgtgtcttttggctgcata

SEQ ID NO: 717543 - DNA, 22 bp, Artificial Sequence
  chemically synthesized
ttcatgtgtcttttggctgcat

SEQ ID NO: 717544 - DNA, 22 bp, Artificial Sequence
  chemically synthesized
tttcatgtgtcttttggctgca

SEQ ID NO: 717545 - DNA, 22 bp, Artificial Sequence
  chemically synthesized
atgcagccaaaagacacatgaa

SEQ ID NO: 717546 - DNA, 22 bp, Artificial Sequence
  chemically synthesized
tgcagccaaaagacacatgaaa

SEQ ID NO: 717547 - DNA, 22 bp, Artificial Sequence
  chemically synthesized
atggccagtgatggtgagcatt

SEQ ID NO: 717548 - DNA, 22 bp, Artificial Sequence
  chemically synthesized
tgatggccagtgatggtgagca

SEQ ID NO: 717549 - DNA, 22 bp, Artificial Sequence
  chemically synthesized
tctgatggccagtgatggtgag

SEQ ID NO: 717550 - DNA, 22 bp, Artificial Sequence
  chemically synthesized
ctctgatggccagtgatggtga

SEQ ID NO: 717551 - DNA, 22 bp, Artificial Sequence
  chemically synthesized
catttctctgatggccagtgat

SEQ ID NO: 717552 - DNA, 22 bp, Artificial Sequence
  chemically synthesized
gcatttctctgatggccagtga

SEQ ID NO: 717553 - DNA, 22 bp, Artificial Sequence
  chemically synthesized
atttgcatttctctgatggcca

SEQ ID NO: 717554 - DNA, 22 bp, Artificial Sequence
  chemically synthesized
gatttgcatttctctgatggcc

SEQ ID NO: 717555 - DNA, 22 bp, Artificial Sequence
  chemically synthesized
tgatttgcatttctctgatggc

SEQ ID NO: 717556 - DNA, 22 bp, Artificial Sequence
  chemically synthesized
accatcactggccatcagagaa

SEQ ID NO: 717557 - DNA, 22 bp, Artificial Sequence
  chemically synthesized
tggttttgatttgcatttctct

SEQ ID NO: 717558 - DNA, 22 bp, Artificial Sequence
  chemically synthesized
attgtggttttgatttgcattt

SEQ ID NO: 717559 - DNA, 22 bp, Artificial Sequence
  chemically synthesized
gccatcagagaaatgcaaatca

SEQ ID NO: 717560 - DNA, 22 bp, Artificial Sequence
  chemically synthesized
gtgtgagatggtatctcattgt

SEQ ID NO: 717561 - DNA, 22 bp, Artificial Sequence
  chemically synthesized
actggtgtgagatggtatctca

SEQ ID NO: 717562 - DNA, 22 bp, Artificial Sequence
  chemically synthesized
taactggtgtgagatggtatct

SEQ ID NO: 717563 - DNA, 22 bp, Artificial Sequence
  chemically synthesized
atgaccgccattctaactggtg

SEQ ID NO: 717564 - DNA, 22 bp, Artificial Sequence
  chemically synthesized
aatgaccgccattctaactggt

SEQ ID NO: 717565 - DNA, 22 bp, Artificial Sequence
  chemically synthesized
taatgaccgccattctaactgg

SEQ ID NO: 717566 - DNA, 22 bp, Artificial Sequence
  chemically synthesized
ttaatgaccgccattctaactg

SEQ ID NO: 717567 - DNA, 22 bp, Artificial Sequence
  chemically synthesized
tttaatgaccgccattctaact

SEQ ID NO: 717568 - DNA, 22 bp, Artificial Sequence
  chemically synthesized
actttttaatgaccgccattct

SEQ ID NO: 717569 - DNA, 22 bp, Artificial Sequence
  chemically synthesized
acaccagttagaatggcggtca

SEQ ID NO: 717570 - DNA, 22 bp, Artificial Sequence
  chemically synthesized
ctgactttttaatgaccgccat

SEQ ID NO: 717571 - DNA, 22 bp, Artificial Sequence
  chemically synthesized
cctgactttttaatgaccgcca

SEQ ID NO: 717572 - DNA, 22 bp, Artificial Sequence
  chemically synthesized
tttcctgactttttaatgaccg

SEQ ID NO: 717573 - DNA, 22 bp, Artificial Sequence
  chemically synthesized
ttgtttcctgactttttaatga

SEQ ID NO: 717574 - DNA, 22 bp, Artificial Sequence
  chemically synthesized
gaatggcggtcattaaaaagtc

SEQ ID NO: 717575 - DNA, 22 bp, Artificial Sequence
  chemically synthesized
cagcacctgttgtttcctgact

SEQ ID NO: 717576 - DNA, 22 bp, Artificial Sequence
  chemically synthesized
tccagcacctgttgtttcctga

SEQ ID NO: 717577 - DNA, 22 bp, Artificial Sequence
  chemically synthesized
aaaagtcaggaaacaacaggtg

SEQ ID NO: 717578 - DNA, 22 bp, Artificial Sequence
  chemically synthesized
cacatcctctccagcacctgtt

SEQ ID NO: 717579 - DNA, 22 bp, Artificial Sequence
  chemically synthesized
tccacatcctctccagcacctg

SEQ ID NO: 717580 - DNA, 22 bp, Artificial Sequence
  chemically synthesized
ctccacatcctctccagcacct

SEQ ID NO: 717581 - DNA, 22 bp, Artificial Sequence
  chemically synthesized
tttctccacatcctctccagca

SEQ ID NO: 717582 - DNA, 22 bp, Artificial Sequence
  chemically synthesized
ctatttctccacatcctctcca

SEQ ID NO: 717583 - DNA, 22 bp, Artificial Sequence
  chemically synthesized
gagaggatgtggagaaatagga

SEQ ID NO: 717584 - DNA, 22 bp, Artificial Sequence
  chemically synthesized
cagtcccaccaacagtgtaaaa

SEQ ID NO: 717585 - DNA, 22 bp, Artificial Sequence
  chemically synthesized
acagtcccaccaacagtgtaaa

SEQ ID NO: 717586 - DNA, 22 bp, Artificial Sequence
  chemically synthesized
gtttacagtcccaccaacagtg

SEQ ID NO: 717587 - DNA, 22 bp, Artificial Sequence
  chemically synthesized
aactagtttacagtcccaccaa

SEQ ID NO: 717588 - DNA, 22 bp, Artificial Sequence
  chemically synthesized
ttacactgttggtgggactgta

SEQ ID NO: 717589 - DNA, 22 bp, Artificial Sequence
  chemically synthesized
tacactgttggtgggactgtaa

SEQ ID NO: 717590 - DNA, 22 bp, Artificial Sequence
  chemically synthesized
acactgttggtgggactgtaaa

SEQ ID NO: 717591 - DNA, 22 bp, Artificial Sequence
  chemically synthesized
cactgttggtgggactgtaaac

SEQ ID NO: 717592 - DNA, 22 bp, Artificial Sequence
  chemically synthesized
cacaatggttgaactagtttac

SEQ ID NO: 717593 - DNA, 22 bp, Artificial Sequence
  chemically synthesized
ttggtgggactgtaaactagtt

SEQ ID NO: 717594 - DNA, 22 bp, Artificial Sequence
  chemically synthesized
ccacaatggttgaactagttta

SEQ ID NO: 717595 - DNA, 22 bp, Artificial Sequence
  chemically synthesized
gtgggactgtaaactagttcaa

SEQ ID NO: 717596 - DNA, 22 bp, Artificial Sequence
  chemically synthesized
acttccacaatggttgaactag

SEQ ID NO: 717597 - DNA, 22 bp, Artificial Sequence
  chemically synthesized
taaactagttcaaccattgtgg

SEQ ID NO: 717598 - DNA, 22 bp, Artificial Sequence
  chemically synthesized
gttcaaccattgtggaagtcag

SEQ ID NO: 717599 - DNA, 22 bp, Artificial Sequence
  chemically synthesized
aggaatcgccacactgacttcc

SEQ ID NO: 717600 - DNA, 22 bp, Artificial Sequence
  chemically synthesized
aaccattgtggaagtcagtgtg

SEQ ID NO: 717601 - DNA, 22 bp, Artificial Sequence
  chemically synthesized
gatccctgaggaatcgccacac

SEQ ID NO: 717602 - DNA, 22 bp, Artificial Sequence
  chemically synthesized
tagatccctgaggaatcgccac

SEQ ID NO: 717603 - DNA, 22 bp, Artificial Sequence
  chemically synthesized
tggaagtcagtgtggcgattcc

SEQ ID NO: 717604 - DNA, 22 bp, Artificial Sequence
  chemically synthesized
gttctagatccctgaggaatcg

SEQ ID NO: 717605 - DNA, 22 bp, Artificial Sequence
  chemically synthesized
tagttctagatccctgaggaat

SEQ ID NO: 717606 - DNA, 22 bp, Artificial Sequence
  chemically synthesized
ctagttctagatccctgaggaa

SEQ ID NO: 717607 - DNA, 22 bp, Artificial Sequence
  chemically synthesized
ctcagggatctagaactagaaa

SEQ ID NO: 717608 - DNA, 22 bp, Artificial Sequence
  chemically synthesized
ggtcaaatggtatttctagttc

SEQ ID NO: 717609 - DNA, 22 bp, Artificial Sequence
  chemically synthesized
agggatctagaactagaaatac

SEQ ID NO: 717610 - DNA, 22 bp, Artificial Sequence
  chemically synthesized
gaactagaaataccatttgacc

SEQ ID NO: 717611 - DNA, 22 bp, Artificial Sequence
  chemically synthesized
gaaataccatttgacccagcca

SEQ ID NO: 717612 - DNA, 22 bp, Artificial Sequence
  chemically synthesized
ggtatatacccagtaatgggat

SEQ ID NO: 717613 - DNA, 22 bp, Artificial Sequence
  chemically synthesized
gggtatatacccagtaatggga

SEQ ID NO: 717614 - DNA, 22 bp, Artificial Sequence
  chemically synthesized
tgggtatatacccagtaatggg

SEQ ID NO: 717615 - DNA, 22 bp, Artificial Sequence
  chemically synthesized
gacccagccatcccattactgg

SEQ ID NO: 717616 - DNA, 22 bp, Artificial Sequence
  chemically synthesized
acccagccatcccattactggg

SEQ ID NO: 717617 - DNA, 22 bp, Artificial Sequence
  chemically synthesized
tagtcctttgggtatataccca

SEQ ID NO: 717618 - DNA, 22 bp, Artificial Sequence
  chemically synthesized
atagtcctttgggtatataccc

SEQ ID NO: 717619 - DNA, 22 bp, Artificial Sequence
  chemically synthesized
ctgggtatatacccaaaggact

SEQ ID NO: 717620 - DNA, 22 bp, Artificial Sequence
  chemically synthesized
ggtatatacccaaaggactata

SEQ ID NO: 717621 - DNA, 22 bp, Artificial Sequence
  chemically synthesized
tagcagcatgatttatagtcct

SEQ ID NO: 717622 - DNA, 22 bp, Artificial Sequence
  chemically synthesized
atagcagcatgatttatagtcc

SEQ ID NO: 717623 - DNA, 22 bp, Artificial Sequence
  chemically synthesized
tatagcagcatgatttatagtc

SEQ ID NO: 717624 - DNA, 22 bp, Artificial Sequence
  chemically synthesized
taaatcatgctgctataaagac

SEQ ID NO: 717625 - DNA, 22 bp, Artificial Sequence
  chemically synthesized
ctataaagacacatgcacacgt

SEQ ID NO: 717626 - DNA, 22 bp, Artificial Sequence
  chemically synthesized
taaagacacatgcacacgtacg

SEQ ID NO: 717627 - DNA, 22 bp, Artificial Sequence
  chemically synthesized
tgaatagtgccacaataaacgt

SEQ ID NO: 717628 - DNA, 22 bp, Artificial Sequence
  chemically synthesized
ttgtgaatagtgccacaataaa

SEQ ID NO: 717629 - DNA, 22 bp, Artificial Sequence
  chemically synthesized
ctgttgtgaatagtgccacaat

SEQ ID NO: 717630 - DNA, 22 bp, Artificial Sequence
  chemically synthesized
gctgttgtgaatagtgccacaa

SEQ ID NO: 717631 - DNA, 22 bp, Artificial Sequence
  chemically synthesized
tgctgttgtgaatagtgccaca

SEQ ID NO: 717632 - DNA, 22 bp, Artificial Sequence
  chemically synthesized
caagtctttgctgttgtgaata

SEQ ID NO: 717633 - DNA, 22 bp, Artificial Sequence
  chemically synthesized
attgtggcactattcacaacag

SEQ ID NO: 717634 - DNA, 22 bp, Artificial Sequence
  chemically synthesized
ttgtggcactattcacaacagc

SEQ ID NO: 717635 - DNA, 22 bp, Artificial Sequence
  chemically synthesized
gttccaagtctttgctgttgtg

SEQ ID NO: 717636 - DNA, 22 bp, Artificial Sequence
  chemically synthesized
tggcactattcacaacagcaaa

SEQ ID NO: 717637 - DNA, 22 bp, Artificial Sequence
  chemically synthesized
ggttggttccaagtctttgctg

SEQ ID NO: 717638 - DNA, 22 bp, Artificial Sequence
  chemically synthesized
gggttggttccaagtctttgct

SEQ ID NO: 717639 - DNA, 22 bp, Artificial Sequence
  chemically synthesized
ttcacaacagcaaagacttgga

SEQ ID NO: 717640 - DNA, 22 bp, Artificial Sequence
  chemically synthesized
acaacagcaaagacttggaacc

SEQ ID NO: 717641 - DNA, 22 bp, Artificial Sequence
  chemically synthesized
gacatttgggttggttccaagt

SEQ ID NO: 717642 - DNA, 22 bp, Artificial Sequence
  chemically synthesized
ttggacatttgggttggttcca

SEQ ID NO: 717643 - DNA, 22 bp, Artificial Sequence
  chemically synthesized
tcattgttggacatttgggttg

SEQ ID NO: 717644 - DNA, 22 bp, Artificial Sequence
  chemically synthesized
ggaaccaacccaaatgtccaac

SEQ ID NO: 717645 - DNA, 22 bp, Artificial Sequence
  chemically synthesized
gaaccaacccaaatgtccaaca

SEQ ID NO: 717646 - DNA, 22 bp, Artificial Sequence
  chemically synthesized
atccagcctatcattgttggac

SEQ ID NO: 717647 - DNA, 22 bp, Artificial Sequence
  chemically synthesized
aatccagcctatcattgttgga

SEQ ID NO: 717648 - DNA, 22 bp, Artificial Sequence
  chemically synthesized
ttaatccagcctatcattgttg

SEQ ID NO: 717649 - DNA, 22 bp, Artificial Sequence
  chemically synthesized
cttaatccagcctatcattgtt

SEQ ID NO: 717650 - DNA, 22 bp, Artificial Sequence
  chemically synthesized
tcttaatccagcctatcattgt

SEQ ID NO: 717651 - DNA, 22 bp, Artificial Sequence
  chemically synthesized
catggtgcgtatgtgccacatt

SEQ ID NO: 717652 - DNA, 22 bp, Artificial Sequence
  chemically synthesized
gattaagaaaatgtggcacata

SEQ ID NO: 717653 - DNA, 22 bp, Artificial Sequence
  chemically synthesized
agaaaatgtggcacatacgcac

SEQ ID NO: 717654 - DNA, 22 bp, Artificial Sequence
  chemically synthesized
catagtattccatggtgcgtat

SEQ ID NO: 717655 - DNA, 22 bp, Artificial Sequence
  chemically synthesized
tggctgcatagtattccatggt

SEQ ID NO: 717656 - DNA, 22 bp, Artificial Sequence
  chemically synthesized
atggctgcatagtattccatgg

SEQ ID NO: 717657 - DNA, 22 bp, Artificial Sequence
  chemically synthesized
tatggctgcatagtattccatg

SEQ ID NO: 717658 - DNA, 22 bp, Artificial Sequence
  chemically synthesized
ttatggctgcatagtattccat

SEQ ID NO: 717659 - DNA, 22 bp, Artificial Sequence
  chemically synthesized
tttatggctgcatagtattcca

SEQ ID NO: 717660 - DNA, 22 bp, Artificial Sequence
  chemically synthesized
atcattttttatggctgcatag

SEQ ID NO: 717661 - DNA, 22 bp, Artificial Sequence
  chemically synthesized
tgcagccataaaaaatgatgag

SEQ ID NO: 717662 - DNA, 22 bp, Artificial Sequence
  chemically synthesized
caaaggacatgaactcatcatt

SEQ ID NO: 717663 - DNA, 22 bp, Artificial Sequence
  chemically synthesized
atccatgtccctacaaaggaca

SEQ ID NO: 717664 - DNA, 22 bp, Artificial Sequence
  chemically synthesized
catccatgtccctacaaaggac

SEQ ID NO: 717665 - DNA, 22 bp, Artificial Sequence
  chemically synthesized
caatttcatccatgtccctaca

SEQ ID NO: 717666 - DNA, 22 bp, Artificial Sequence
  chemically synthesized
ccaatttcatccatgtccctac

SEQ ID NO: 717667 - DNA, 22 bp, Artificial Sequence
  chemically synthesized
atgtcctttgtagggacatgga

SEQ ID NO: 717668 - DNA, 22 bp, Artificial Sequence
  chemically synthesized
tgtagggacatggatgaaattg

SEQ ID NO: 717669 - DNA, 22 bp, Artificial Sequence
  chemically synthesized
gtagggacatggatgaaattgg

SEQ ID NO: 717670 - DNA, 22 bp, Artificial Sequence
  chemically synthesized
tagggacatggatgaaattgga

SEQ ID NO: 717671 - DNA, 22 bp, Artificial Sequence
  chemically synthesized
agaatgatgatttccaatttca

SEQ ID NO: 717672 - DNA, 22 bp, Artificial Sequence
  chemically synthesized
ctgagaatgatgatttccaatt

SEQ ID NO: 717673 - DNA, 22 bp, Artificial Sequence
  chemically synthesized
actgagaatgatgatttccaat

SEQ ID NO: 717674 - DNA, 22 bp, Artificial Sequence
  chemically synthesized
tccatgtgatagtttactgaga

SEQ ID NO: 717675 - DNA, 22 bp, Artificial Sequence
  chemically synthesized
gaaatcatcattctcagtaaac

SEQ ID NO: 717676 - DNA, 22 bp, Artificial Sequence
  chemically synthesized
gtccatgtgatagtttactgag

SEQ ID NO: 717677 - DNA, 22 bp, Artificial Sequence
  chemically synthesized
tgtccatgtgatagtttactga

SEQ ID NO: 717678 - DNA, 22 bp, Artificial Sequence
  chemically synthesized
ttgtccatgtgatagtttactg

SEQ ID NO: 717679 - DNA, 22 bp, Artificial Sequence
  chemically synthesized
gtcttttgtccatgtgatagtt

SEQ ID NO: 717680 - DNA, 22 bp, Artificial Sequence
  chemically synthesized
ggtcttttgtccatgtgatagt

SEQ ID NO: 717681 - DNA, 22 bp, Artificial Sequence
  chemically synthesized
tcagtaaactatcacatggaca

SEQ ID NO: 717682 - DNA, 22 bp, Artificial Sequence
  chemically synthesized
agtaaactatcacatggacaaa

SEQ ID NO: 717683 - DNA, 22 bp, Artificial Sequence
  chemically synthesized
tcacatggacaaaagaccaaac

SEQ ID NO: 717684 - DNA, 22 bp, Artificial Sequence
  chemically synthesized
tgagtgagaacatgcggtgttt

SEQ ID NO: 717685 - DNA, 22 bp, Artificial Sequence
  chemically synthesized
ccacctatgagtgagaacatgc

SEQ ID NO: 717686 - DNA, 22 bp, Artificial Sequence
  chemically synthesized
aattcccacctatgagtgagaa

SEQ ID NO: 717687 - DNA, 22 bp, Artificial Sequence
  chemically synthesized
ttcaattcccacctatgagtga

SEQ ID NO: 717688 - DNA, 22 bp, Artificial Sequence
  chemically synthesized
attgttcaattcccacctatga

SEQ ID NO: 717689 - DNA, 22 bp, Artificial Sequence
  chemically synthesized
tcattgttcaattcccacctat

SEQ ID NO: 717690 - DNA, 22 bp, Artificial Sequence
  chemically synthesized
tcactcataggtgggaattgaa

SEQ ID NO: 717691 - DNA, 22 bp, Artificial Sequence
  chemically synthesized
actcataggtgggaattgaaca

SEQ ID NO: 717692 - DNA, 22 bp, Artificial Sequence
  chemically synthesized
ataggtgggaattgaacaatga

SEQ ID NO: 717693 - DNA, 22 bp, Artificial Sequence
  chemically synthesized
tgtccatgtgttctcattgttc

SEQ ID NO: 717694 - DNA, 22 bp, Artificial Sequence
  chemically synthesized
ctgtgtccatgtgttctcattg

SEQ ID NO: 717695 - DNA, 22 bp, Artificial Sequence
  chemically synthesized
cctgtgtccatgtgttctcatt

SEQ ID NO: 717696 - DNA, 22 bp, Artificial Sequence
  chemically synthesized
cccttcctgtgtccatgtgttc

SEQ ID NO: 717697 - DNA, 22 bp, Artificial Sequence
  chemically synthesized
aacaatgagaacacatggacac

SEQ ID NO: 717698 - DNA, 22 bp, Artificial Sequence
  chemically synthesized
cccccaccccacaacagtcccc

SEQ ID NO: 717699 - DNA, 22 bp, Artificial Sequence
  chemically synthesized
ccccctccccccaccccacaac

SEQ ID NO: 717700 - DNA, 22 bp, Artificial Sequence
  chemically synthesized
tggggactgttgtggggtgggg

SEQ ID NO: 717701 - DNA, 22 bp, Artificial Sequence
  chemically synthesized
gggactgttgtggggtgggggg

SEQ ID NO: 717702 - DNA, 22 bp, Artificial Sequence
  chemically synthesized
tccctcccccctccccccaccc

SEQ ID NO: 717703 - DNA, 22 bp, Artificial Sequence
  chemically synthesized
atgctatccctcccccctcccc

SEQ ID NO: 717704 - DNA, 22 bp, Artificial Sequence
  chemically synthesized
ttgtggggtggggggagggggg

SEQ ID NO: 717705 - DNA, 22 bp, Artificial Sequence
  chemically synthesized
ctaatgctatccctcccccctc

SEQ ID NO: 717706 - DNA, 22 bp, Artificial Sequence
  chemically synthesized
tggggtggggggaggggggagg

SEQ ID NO: 717707 - DNA, 22 bp, Artificial Sequence
  chemically synthesized
ggtatatctcctaatgctatcc

SEQ ID NO: 717708 - DNA, 22 bp, Artificial Sequence
  chemically synthesized
gcattaggtatatctcctaatg

SEQ ID NO: 717709 - DNA, 22 bp, Artificial Sequence
  chemically synthesized
agcattaggtatatctcctaat

SEQ ID NO: 717710 - DNA, 22 bp, Artificial Sequence
  chemically synthesized
gtcatttagcattaggtatatc

SEQ ID NO: 717711 - DNA, 22 bp, Artificial Sequence
  chemically synthesized
actcgtcatttagcattaggta

SEQ ID NO: 717712 - DNA, 22 bp, Artificial Sequence
  chemically synthesized
ggagatatacctaatgctaaat

SEQ ID NO: 717713 - DNA, 22 bp, Artificial Sequence
  chemically synthesized
cacccattaactcgtcatttag

SEQ ID NO: 717714 - DNA, 22 bp, Artificial Sequence
  chemically synthesized
gtgtgctgcacccattaactcg

SEQ ID NO: 717715 - DNA, 22 bp, Artificial Sequence
  chemically synthesized
atgctaaatgacgagttaatgg

SEQ ID NO: 717716 - DNA, 22 bp, Artificial Sequence
  chemically synthesized
aatgacgagttaatgggtgcag

SEQ ID NO: 717717 - DNA, 22 bp, Artificial Sequence
  chemically synthesized
atgggtgcagcacaccagcatg

SEQ ID NO: 717718 - DNA, 22 bp, Artificial Sequence
  chemically synthesized
catgtgtatacatgtgccatgc

SEQ ID NO: 717719 - DNA, 22 bp, Artificial Sequence
  chemically synthesized
gttacatgtgtatacatgtgcc

SEQ ID NO: 717720 - DNA, 22 bp, Artificial Sequence
  chemically synthesized
gggtacatgtgcacaatgtgca

SEQ ID NO: 717721 - DNA, 22 bp, Artificial Sequence
  chemically synthesized
agggtacatgtgcacaatgtgc

SEQ ID NO: 717722 - DNA, 22 bp, Artificial Sequence
  chemically synthesized
tagggtacatgtgcacaatgtg

SEQ ID NO: 717723 - DNA, 22 bp, Artificial Sequence
  chemically synthesized
agttttagggtacatgtgcaca

SEQ ID NO: 717724 - DNA, 22 bp, Artificial Sequence
  chemically synthesized
aagttttagggtacatgtgcac

SEQ ID NO: 717725 - DNA, 22 bp, Artificial Sequence
  chemically synthesized
acctgcacattgtgcacatgta

SEQ ID NO: 717726 - DNA, 22 bp, Artificial Sequence
  chemically synthesized
taagttttagggtacatgtgca

SEQ ID NO: 717727 - DNA, 22 bp, Artificial Sequence
  chemically synthesized
cacattgtgcacatgtacccta

SEQ ID NO: 717728 - DNA, 22 bp, Artificial Sequence
  chemically synthesized
tactttaagttttagggtacat

SEQ ID NO: 717729 - DNA, 22 bp, Artificial Sequence
  chemically synthesized
ttatactttaagttttagggta

SEQ ID NO: 717730 - DNA, 22 bp, Artificial Sequence
  chemically synthesized
attatactttaagttttagggt

SEQ ID NO: 717731 - DNA, 22 bp, Artificial Sequence
  chemically synthesized
tattatactttaagttttaggg

SEQ ID NO: 717732 - DNA, 22 bp, Artificial Sequence
  chemically synthesized
tgcacatgtaccctaaaactta

SEQ ID NO: 717733 - DNA, 22 bp, Artificial Sequence
  chemically synthesized
ttttattatactttaagtttta

SEQ ID NO: 717734 - DNA, 22 bp, Artificial Sequence
  chemically synthesized
attttattatactttaagtttt

SEQ ID NO: 717735 - DNA, 22 bp, Artificial Sequence
  chemically synthesized
tttattttattatactttaagt

SEQ ID NO: 717736 - DNA, 22 bp, Artificial Sequence
  chemically synthesized
atttattttattatactttaag

SEQ ID NO: 717737 - DNA, 22 bp, Artificial Sequence
  chemically synthesized
tttatttattttattatacttt

SEQ ID NO: 717738 - DNA, 22 bp, Artificial Sequence
  chemically synthesized
atttatttattttattatactt

SEQ ID NO: 717739 - DNA, 22 bp, Artificial Sequence
  chemically synthesized
tttatttatttattttattata

SEQ ID NO: 717740 - DNA, 22 bp, Artificial Sequence
  chemically synthesized
atttatttatttattttattat

SEQ ID NO: 717741 - DNA, 22 bp, Artificial Sequence
  chemically synthesized
aaacttaaagtataataaaata

SEQ ID NO: 717742 - DNA, 22 bp, Artificial Sequence
  chemically synthesized
tttatttatttatttattttat

SEQ ID NO: 717743 - DNA, 22 bp, Artificial Sequence
  chemically synthesized
atttatttatttatttatttta

SEQ ID NO: 717744 - DNA, 22 bp, Artificial Sequence
  chemically synthesized
tatttatttatttatttatttt

SEQ ID NO: 717745 - DNA, 22 bp, Artificial Sequence
  chemically synthesized
aaagtataataaaataaataaa

SEQ ID NO: 717746 - DNA, 22 bp, Artificial Sequence
  chemically synthesized
aagtataataaaataaataaat

SEQ ID NO: 717747 - DNA, 22 bp, Artificial Sequence
  chemically synthesized
aaagagtaaatacattttattt

SEQ ID NO: 717748 - DNA, 22 bp, Artificial Sequence
  chemically synthesized
cagatgctgaaagagtaaatac

SEQ ID NO: 717749 - DNA, 22 bp, Artificial Sequence
  chemically synthesized
ctacagatgctgaaagagtaaa

SEQ ID NO: 717750 - DNA, 22 bp, Artificial Sequence
  chemically synthesized
actctttcagcatctgtagtag

SEQ ID NO: 717751 - DNA, 22 bp, Artificial Sequence
  chemically synthesized
ctctttcagcatctgtagtaga

SEQ ID NO: 717752 - DNA, 22 bp, Artificial Sequence
  chemically synthesized
tttcagcatctgtagtagacac

SEQ ID NO: 717753 - DNA, 22 bp, Artificial Sequence
  chemically synthesized
tcagcatctgtagtagacaccg

SEQ ID NO: 717754 - DNA, 22 bp, Artificial Sequence
  chemically synthesized
cagcatctgtagtagacaccgt

SEQ ID NO: 717755 - DNA, 22 bp, Artificial Sequence
  chemically synthesized
agcatctgtagtagacaccgtg

SEQ ID NO: 717756 - DNA, 22 bp, Artificial Sequence
  chemically synthesized
tagtagacaccgtggcgctcca

SEQ ID NO: 717757 - DNA, 22 bp, Artificial Sequence
  chemically synthesized
aagaggaggtccagggtggagc

SEQ ID NO: 717758 - DNA, 22 bp, Artificial Sequence
  chemically synthesized
caccctggacctcctctttagg

SEQ ID NO: 717759 - DNA, 22 bp, Artificial Sequence
  chemically synthesized
gacctcctctttagggcctttg

SEQ ID NO: 717760 - DNA, 22 bp, Artificial Sequence
  chemically synthesized
ctctttagggcctttgcatgca

SEQ ID NO: 717761 - DNA, 22 bp, Artificial Sequence
  chemically synthesized
tttagggcctttgcatgcatgg

SEQ ID NO: 717762 - DNA, 22 bp, Artificial Sequence
  chemically synthesized
tagggcctttgcatgcatgggc

SEQ ID NO: 717763 - DNA, 22 bp, Artificial Sequence
  chemically synthesized
agggcctttgcatgcatgggcc

SEQ ID NO: 717764 - DNA, 22 bp, Artificial Sequence
  chemically synthesized
gggcctttgcatgcatgggcca

SEQ ID NO: 717765 - DNA, 22 bp, Artificial Sequence
  chemically synthesized
tgcatgcatgggccacctgctg

SEQ ID NO: 717766 - DNA, 22 bp, Artificial Sequence
  chemically synthesized
gcatgcatgggccacctgctgc

SEQ ID NO: 717767 - DNA, 22 bp, Artificial Sequence
  chemically synthesized
catgcatgggccacctgctgcc

SEQ ID NO: 717768 - DNA, 22 bp, Artificial Sequence
  chemically synthesized
tgagccagcagccaataaggca

SEQ ID NO: 717769 - DNA, 22 bp, Artificial Sequence
  chemically synthesized
ctgccttattggctgctggctc

SEQ ID NO: 717770 - DNA, 22 bp, Artificial Sequence
  chemically synthesized
ccttattggctgctggctcaca

SEQ ID NO: 717771 - DNA, 22 bp, Artificial Sequence
  chemically synthesized
attggctgctggctcacagctg

SEQ ID NO: 717772 - DNA, 22 bp, Artificial Sequence
  chemically synthesized
caatgaaggccccagctgtgag

SEQ ID NO: 717773 - DNA, 22 bp, Artificial Sequence
  chemically synthesized
ttggctgctggctcacagctgg

SEQ ID NO: 717774 - DNA, 22 bp, Artificial Sequence
  chemically synthesized
gctgctggctcacagctggggc

SEQ ID NO: 717775 - DNA, 22 bp, Artificial Sequence
  chemically synthesized
ctggctcacagctggggccttc

SEQ ID NO: 717776 - DNA, 22 bp, Artificial Sequence
  chemically synthesized
gctcacagctggggccttcatt

SEQ ID NO: 717777 - DNA, 22 bp, Artificial Sequence
  chemically synthesized
agggcacattccaatgaaggcc

SEQ ID NO: 717778 - DNA, 22 bp, Artificial Sequence
  chemically synthesized
acagctggggccttcattggaa

SEQ ID NO: 717779 - DNA, 22 bp, Artificial Sequence
  chemically synthesized
cctgagggcacattccaatgaa

SEQ ID NO: 717780 - DNA, 22 bp, Artificial Sequence
  chemically synthesized
gggccttcattggaatgtgccc

SEQ ID NO: 717781 - DNA, 22 bp, Artificial Sequence
  chemically synthesized
tgtgaggcagttccctgagggc

SEQ ID NO: 717782 - DNA, 22 bp, Artificial Sequence
  chemically synthesized
cattggaatgtgccctcaggga

SEQ ID NO: 717783 - DNA, 22 bp, Artificial Sequence
  chemically synthesized
attggaatgtgccctcagggaa

SEQ ID NO: 717784 - DNA, 22 bp, Artificial Sequence
  chemically synthesized
gaatgtgccctcagggaactgc

SEQ ID NO: 717785 - DNA, 22 bp, Artificial Sequence
  chemically synthesized
agggaactgcctcacacagcta

SEQ ID NO: 717786 - DNA, 22 bp, Artificial Sequence
  chemically synthesized
agggaggggatgtagctgtgtg

SEQ ID NO: 717787 - DNA, 22 bp, Artificial Sequence
  chemically synthesized
cctgagggaggggatgtagctg

SEQ ID NO: 717788 - DNA, 22 bp, Artificial Sequence
  chemically synthesized
tccctgagggaggggatgtagc

SEQ ID NO: 717789 - DNA, 22 bp, Artificial Sequence
  chemically synthesized
cctcacacagctacatcccctc

SEQ ID NO: 717790 - DNA, 22 bp, Artificial Sequence
  chemically synthesized
ggtctctccctgagggagggga

SEQ ID NO: 717791 - DNA, 22 bp, Artificial Sequence
  chemically synthesized
acacagctacatcccctccctc

SEQ ID NO: 717792 - DNA, 22 bp, Artificial Sequence
  chemically synthesized
gccctaggtctctccctgaggg

SEQ ID NO: 717793 - DNA, 22 bp, Artificial Sequence
  chemically synthesized
catcccctccctcagggagaga

SEQ ID NO: 717794 - DNA, 22 bp, Artificial Sequence
  chemically synthesized
cctcagggagagacctagggcc

SEQ ID NO: 717795 - DNA, 22 bp, Artificial Sequence
  chemically synthesized
catcagccagtcattggcccta

SEQ ID NO: 717796 - DNA, 22 bp, Artificial Sequence
  chemically synthesized
agggagagacctagggccaatg

SEQ ID NO: 717797 - DNA, 22 bp, Artificial Sequence
  chemically synthesized
atccctgcatcagccagtcatt

SEQ ID NO: 717798 - DNA, 22 bp, Artificial Sequence
  chemically synthesized
gggccaatgactggctgatgca

SEQ ID NO: 717799 - DNA, 22 bp, Artificial Sequence
  chemically synthesized
ggcataaatgagttaatccctg

SEQ ID NO: 717800 - DNA, 22 bp, Artificial Sequence
  chemically synthesized
gctgatgcagggattaactcat

SEQ ID NO: 717801 - DNA, 22 bp, Artificial Sequence
  chemically synthesized
atgcagggattaactcatttat

SEQ ID NO: 717802 - DNA, 22 bp, Artificial Sequence
  chemically synthesized
actcatttatgcctagtgttcc

SEQ ID NO: 717803 - DNA, 22 bp, Artificial Sequence
  chemically synthesized
gcgtcccaataatggaacacta

SEQ ID NO: 717804 - DNA, 22 bp, Artificial Sequence
  chemically synthesized
agcgtcccaataatggaacact

SEQ ID NO: 717805 - DNA, 22 bp, Artificial Sequence
  chemically synthesized
atttatgcctagtgttccatta

SEQ ID NO: 717806 - DNA, 22 bp, Artificial Sequence
  chemically synthesized
atgcctagtgttccattattgg

SEQ ID NO: 717807 - DNA, 22 bp, Artificial Sequence
  chemically synthesized
tgcctagtgttccattattggg

SEQ ID NO: 717808 - DNA, 22 bp, Artificial Sequence
  chemically synthesized
ccacaagcttagcgtcccaata

SEQ ID NO: 717809 - DNA, 22 bp, Artificial Sequence
  chemically synthesized
gtgttccattattgggacgcta

SEQ ID NO: 717810 - DNA, 22 bp, Artificial Sequence
  chemically synthesized
cattattgggacgctaagcttg

SEQ ID NO: 717811 - DNA, 22 bp, Artificial Sequence
  chemically synthesized
ttgggacgctaagcttgtggga

SEQ ID NO: 717812 - DNA, 22 bp, Artificial Sequence
  chemically synthesized
ggacgctaagcttgtgggagtt

SEQ ID NO: 717813 - DNA, 22 bp, Artificial Sequence
  chemically synthesized
agcagtaggatataaaaaactc

SEQ ID NO: 717814 - DNA, 22 bp, Artificial Sequence
  chemically synthesized
gagcagtaggatataaaaaact

SEQ ID NO: 717815 - DNA, 22 bp, Artificial Sequence
  chemically synthesized
agcttgtgggagttttttatat

SEQ ID NO: 717816 - DNA, 22 bp, Artificial Sequence
  chemically synthesized
gtgggagttttttatatcctac

SEQ ID NO: 717817 - DNA, 22 bp, Artificial Sequence
  chemically synthesized
tgggagttttttatatcctact

SEQ ID NO: 717818 - DNA, 22 bp, Artificial Sequence
  chemically synthesized
gcgatgaccttgagcagtagga

SEQ ID NO: 717819 - DNA, 22 bp, Artificial Sequence
  chemically synthesized
ggcgatgaccttgagcagtagg

SEQ ID NO: 717820 - DNA, 22 bp, Artificial Sequence
  chemically synthesized
tttatatcctactgctcaaggt

SEQ ID NO: 717821 - DNA, 22 bp, Artificial Sequence
  chemically synthesized
ttatatcctactgctcaaggtc

SEQ ID NO: 717822 - DNA, 22 bp, Artificial Sequence
  chemically synthesized
tatatcctactgctcaaggtca

SEQ ID NO: 717823 - DNA, 22 bp, Artificial Sequence
  chemically synthesized
atatcctactgctcaaggtcat

SEQ ID NO: 717824 - DNA, 22 bp, Artificial Sequence
  chemically synthesized
tatcctactgctcaaggtcatc

SEQ ID NO: 717825 - DNA, 22 bp, Artificial Sequence
  chemically synthesized
ctgctcaaggtcatcgccaagg

SEQ ID NO: 717826 - DNA, 22 bp, Artificial Sequence
  chemically synthesized
tgaaaagtcagaccttggcgat

SEQ ID NO: 717827 - DNA, 22 bp, Artificial Sequence
  chemically synthesized
gtgaaaagtcagaccttggcga

SEQ ID NO: 717828 - DNA, 22 bp, Artificial Sequence
  chemically synthesized
tgtgaaaagtcagaccttggcg

SEQ ID NO: 717829 - DNA, 22 bp, Artificial Sequence
  chemically synthesized
ctcaaggtcatcgccaaggtct

SEQ ID NO: 717830 - DNA, 22 bp, Artificial Sequence
  chemically synthesized
aaggtcatcgccaaggtctgac

SEQ ID NO: 717831 - DNA, 22 bp, Artificial Sequence
  chemically synthesized
caaaaatgttttgtgaaaagtc

SEQ ID NO: 717832 - DNA, 22 bp, Artificial Sequence
  chemically synthesized
gaggttgcaaaaatgttttgtg

SEQ ID NO: 717833 - DNA, 22 bp, Artificial Sequence
  chemically synthesized
tgctggaggttgcaaaaatgtt

SEQ ID NO: 717834 - DNA, 22 bp, Artificial Sequence
  chemically synthesized
acttttcacaaaacatttttgc

SEQ ID NO: 717835 - DNA, 22 bp, Artificial Sequence
  chemically synthesized
atgctggaggttgcaaaaatgt

SEQ ID NO: 717836 - DNA, 22 bp, Artificial Sequence
  chemically synthesized
ttcacaaaacatttttgcaacc

SEQ ID NO: 717837 - DNA, 22 bp, Artificial Sequence
  chemically synthesized
tcacaaaacatttttgcaacct

SEQ ID NO: 717838 - DNA, 22 bp, Artificial Sequence
  chemically synthesized
cacaaaacatttttgcaacctc

SEQ ID NO: 717839 - DNA, 22 bp, Artificial Sequence
  chemically synthesized
acaaaacatttttgcaacctcc

SEQ ID NO: 717840 - DNA, 22 bp, Artificial Sequence
  chemically synthesized
acccatttatgctggaggttgc

SEQ ID NO: 717841 - DNA, 22 bp, Artificial Sequence
  chemically synthesized
aacccatttatgctggaggttg

SEQ ID NO: 717842 - DNA, 22 bp, Artificial Sequence
  chemically synthesized
taacccatttatgctggaggtt

SEQ ID NO: 717843 - DNA, 22 bp, Artificial Sequence
  chemically synthesized
ttgcaacctccagcataaatgg

SEQ ID NO: 717844 - DNA, 22 bp, Artificial Sequence
  chemically synthesized
tgcaacctccagcataaatggg

SEQ ID NO: 717845 - DNA, 22 bp, Artificial Sequence
  chemically synthesized
gcaacctccagcataaatgggt

SEQ ID NO: 717846 - DNA, 22 bp, Artificial Sequence
  chemically synthesized
caacctccagcataaatgggtt

SEQ ID NO: 717847 - DNA, 22 bp, Artificial Sequence
  chemically synthesized
cagcataaatgggttaaagtct

SEQ ID NO: 717848 - DNA, 22 bp, Artificial Sequence
  chemically synthesized
tccccagtaaatcaaatgggtg

SEQ ID NO: 717849 - DNA, 22 bp, Artificial Sequence
  chemically synthesized
aagtcttcacccatttgattta

SEQ ID NO: 717850 - DNA, 22 bp, Artificial Sequence
  chemically synthesized
agagttgtccccagtaaatcaa

SEQ ID NO: 717851 - DNA, 22 bp, Artificial Sequence
  chemically synthesized
cagagttgtccccagtaaatca

SEQ ID NO: 717852 - DNA, 22 bp, Artificial Sequence
  chemically synthesized
tcagagttgtccccagtaaatc

SEQ ID NO: 717853 - DNA, 22 bp, Artificial Sequence
  chemically synthesized
cacccatttgatttactgggga

SEQ ID NO: 717854 - DNA, 22 bp, Artificial Sequence
  chemically synthesized
acccatttgatttactggggac

SEQ ID NO: 717855 - DNA, 22 bp, Artificial Sequence
  chemically synthesized
gcctttcagagttgtccccagt

SEQ ID NO: 717856 - DNA, 22 bp, Artificial Sequence
  chemically synthesized
ggcctttcagagttgtccccag

SEQ ID NO: 717857 - DNA, 22 bp, Artificial Sequence
  chemically synthesized
gatttactggggacaactctga

SEQ ID NO: 717858 - DNA, 22 bp, Artificial Sequence
  chemically synthesized
atttactggggacaactctgaa

SEQ ID NO: 717859 - DNA, 22 bp, Artificial Sequence
  chemically synthesized
gagtaggtttggcctttcagag

SEQ ID NO: 717860 - DNA, 22 bp, Artificial Sequence
  chemically synthesized
actggggacaactctgaaaggc

SEQ ID NO: 717861 - DNA, 22 bp, Artificial Sequence
  chemically synthesized
ctggggacaactctgaaaggcc

SEQ ID NO: 717862 - DNA, 22 bp, Artificial Sequence
  chemically synthesized
tggagtaggtttggcctttcag

SEQ ID NO: 717863 - DNA, 22 bp, Artificial Sequence
  chemically synthesized
gggacaactctgaaaggccaaa

SEQ ID NO: 717864 - DNA, 22 bp, Artificial Sequence
  chemically synthesized
tgaaaggccaaacctactccag

SEQ ID NO: 717865 - DNA, 22 bp, Artificial Sequence
  chemically synthesized
aaaggccaaacctactccagag

SEQ ID NO: 717866 - DNA, 22 bp, Artificial Sequence
  chemically synthesized
cagcaggagcatgcagggaagc

SEQ ID NO: 717867 - DNA, 22 bp, Artificial Sequence
  chemically synthesized
ctccagagcttccctgcatgct

SEQ ID NO: 717868 - DNA, 22 bp, Artificial Sequence
  chemically synthesized
tggctgcagcaggagcatgcag

SEQ ID NO: 717869 - DNA, 22 bp, Artificial Sequence
  chemically synthesized
cagagcttccctgcatgctcct

SEQ ID NO: 717870 - DNA, 22 bp, Artificial Sequence
  chemically synthesized
caattatggctgcagcaggagc

SEQ ID NO: 717871 - DNA, 22 bp, Artificial Sequence
  chemically synthesized
ccctgcatgctcctgctgcagc

SEQ ID NO: 717872 - DNA, 22 bp, Artificial Sequence
  chemically synthesized
cctgcatgctcctgctgcagcc

SEQ ID NO: 717873 - DNA, 22 bp, Artificial Sequence
  chemically synthesized
catgctcctgctgcagccataa

SEQ ID NO: 717874 - DNA, 22 bp, Artificial Sequence
  chemically synthesized
accatgcagttgcaattatggc

SEQ ID NO: 717875 - DNA, 22 bp, Artificial Sequence
  chemically synthesized
ctgctgcagccataattgcaac

SEQ ID NO: 717876 - DNA, 22 bp, Artificial Sequence
  chemically synthesized
gttcaccatgcagttgcaatta

SEQ ID NO: 717877 - DNA, 22 bp, Artificial Sequence
  chemically synthesized
ctgcagccataattgcaactgc

SEQ ID NO: 717878 - DNA, 22 bp, Artificial Sequence
  chemically synthesized
cagccataattgcaactgcatg

SEQ ID NO: 717879 - DNA, 22 bp, Artificial Sequence
  chemically synthesized
cgcagaggaaaagctggttcac

SEQ ID NO: 717880 - DNA, 22 bp, Artificial Sequence
  chemically synthesized
caactgcatggtgaaccagctt

SEQ ID NO: 717881 - DNA, 22 bp, Artificial Sequence
  chemically synthesized
catggtgaaccagcttttcctc

SEQ ID NO: 717882 - DNA, 22 bp, Artificial Sequence
  chemically synthesized
aaaggggcatgactgcgcagag

SEQ ID NO: 717883 - DNA, 22 bp, Artificial Sequence
  chemically synthesized
agaaactgaaaggggcatgact

SEQ ID NO: 717884 - DNA, 22 bp, Artificial Sequence
  chemically synthesized
ttcctctgcgcagtcatgcccc

SEQ ID NO: 717885 - DNA, 22 bp, Artificial Sequence
  chemically synthesized
tcctctgcgcagtcatgcccct

SEQ ID NO: 717886 - DNA, 22 bp, Artificial Sequence
  chemically synthesized
taagaaactgaaaggggcatga

SEQ ID NO: 717887 - DNA, 22 bp, Artificial Sequence
  chemically synthesized
cctctgcgcagtcatgcccctt

SEQ ID NO: 717888 - DNA, 22 bp, Artificial Sequence
  chemically synthesized
ctctgcgcagtcatgccccttt

SEQ ID NO: 717889 - DNA, 22 bp, Artificial Sequence
  chemically synthesized
tgcgcagtcatgcccctttcag

SEQ ID NO: 717890 - DNA, 22 bp, Artificial Sequence
  chemically synthesized
cacctctaagaaactgaaaggg

SEQ ID NO: 717891 - DNA, 22 bp, Artificial Sequence
  chemically synthesized
cgcagtcatgcccctttcagtt

SEQ ID NO: 717892 - DNA, 22 bp, Artificial Sequence
  chemically synthesized
acacctctaagaaactgaaagg

SEQ ID NO: 717893 - DNA, 22 bp, Artificial Sequence
  chemically synthesized
aggatttacacctctaagaaac

SEQ ID NO: 717894 - DNA, 22 bp, Artificial Sequence
  chemically synthesized
tcaggatttacacctctaagaa

SEQ ID NO: 717895 - DNA, 22 bp, Artificial Sequence
  chemically synthesized
tcagtttcttagaggtgtaaat

SEQ ID NO: 717896 - DNA, 22 bp, Artificial Sequence
  chemically synthesized
cagtttcttagaggtgtaaatc

SEQ ID NO: 717897 - DNA, 22 bp, Artificial Sequence
  chemically synthesized
agtttcttagaggtgtaaatcc

SEQ ID NO: 717898 - DNA, 22 bp, Artificial Sequence
  chemically synthesized
ggaagtgctctcaggatttaca

SEQ ID NO: 717899 - DNA, 22 bp, Artificial Sequence
  chemically synthesized
cttagaggtgtaaatcctgaga

SEQ ID NO: 717900 - DNA, 22 bp, Artificial Sequence
  chemically synthesized
ttagaggtgtaaatcctgagag

SEQ ID NO: 717901 - DNA, 22 bp, Artificial Sequence
  chemically synthesized
agaggtgtaaatcctgagagca

SEQ ID NO: 717902 - DNA, 22 bp, Artificial Sequence
  chemically synthesized
gaggtgtaaatcctgagagcac

SEQ ID NO: 717903 - DNA, 22 bp, Artificial Sequence
  chemically synthesized
tcatactgggaagtgctctcag

SEQ ID NO: 717904 - DNA, 22 bp, Artificial Sequence
  chemically synthesized
ttgtcatactgggaagtgctct

SEQ ID NO: 717905 - DNA, 22 bp, Artificial Sequence
  chemically synthesized
cagaaggattattgtcatactg

SEQ ID NO: 717906 - DNA, 22 bp, Artificial Sequence
  chemically synthesized
agagcacttcccagtatgacaa

SEQ ID NO: 717907 - DNA, 22 bp, Artificial Sequence
  chemically synthesized
gcagaaggattattgtcatact

SEQ ID NO: 717908 - DNA, 22 bp, Artificial Sequence
  chemically synthesized
cttgcagaaggattattgtcat

SEQ ID NO: 717909 - DNA, 22 bp, Artificial Sequence
  chemically synthesized
cccagtatgacaataatccttc

SEQ ID NO: 717910 - DNA, 22 bp, Artificial Sequence
  chemically synthesized
ccagtatgacaataatccttct

SEQ ID NO: 717911 - DNA, 22 bp, Artificial Sequence
  chemically synthesized
gagagttgcttgcagaaggatt

SEQ ID NO: 717912 - DNA, 22 bp, Artificial Sequence
  chemically synthesized
agaagcagaagcagttggagag

SEQ ID NO: 717913 - DNA, 22 bp, Artificial Sequence
  chemically synthesized
ctgcaagcaactctccaactgc

SEQ ID NO: 717914 - DNA, 22 bp, Artificial Sequence
  chemically synthesized
tgcaagcaactctccaactgct

SEQ ID NO: 717915 - DNA, 22 bp, Artificial Sequence
  chemically synthesized
caagcaactctccaactgcttc

SEQ ID NO: 717916 - DNA, 22 bp, Artificial Sequence
  chemically synthesized
ggctcagaagcagaagcagttg

SEQ ID NO: 717917 - DNA, 22 bp, Artificial Sequence
  chemically synthesized
caagactaggctcagaagcaga

SEQ ID NO: 717918 - DNA, 22 bp, Artificial Sequence
  chemically synthesized
tccaactgcttctgcttctgag

SEQ ID NO: 717919 - DNA, 22 bp, Artificial Sequence
  chemically synthesized
tccaagactaggctcagaagca

SEQ ID NO: 717920 - DNA, 22 bp, Artificial Sequence
  chemically synthesized
caactgcttctgcttctgagcc

SEQ ID NO: 717921 - DNA, 22 bp, Artificial Sequence
  chemically synthesized
cttctgcttctgagcctagtct

SEQ ID NO: 717922 - DNA, 22 bp, Artificial Sequence
  chemically synthesized
ctgcttctgagcctagtcttgg

SEQ ID NO: 717923 - DNA, 22 bp, Artificial Sequence
  chemically synthesized
tgcttctgagcctagtcttgga

SEQ ID NO: 717924 - DNA, 22 bp, Artificial Sequence
  chemically synthesized
cttctgagcctagtcttggaga

SEQ ID NO: 717925 - DNA, 22 bp, Artificial Sequence
  chemically synthesized
ggaataaaaggctctccaagac

SEQ ID NO: 717926 - DNA, 22 bp, Artificial Sequence
  chemically synthesized
ctgagcctagtcttggagagcc

SEQ ID NO: 717927 - DNA, 22 bp, Artificial Sequence
  chemically synthesized
tgagcctagtcttggagagcct

SEQ ID NO: 717928 - DNA, 22 bp, Artificial Sequence
  chemically synthesized
agcctagtcttggagagccttt

SEQ ID NO: 717929 - DNA, 22 bp, Artificial Sequence
  chemically synthesized
acagattaggaataaaaggctc

SEQ ID NO: 717930 - DNA, 22 bp, Artificial Sequence
  chemically synthesized
cacagattaggaataaaaggct

SEQ ID NO: 717931 - DNA, 22 bp, Artificial Sequence
  chemically synthesized
tcacagattaggaataaaaggc

SEQ ID NO: 717932 - DNA, 22 bp, Artificial Sequence
  chemically synthesized
gtcttggagagccttttattcc

SEQ ID NO: 717933 - DNA, 22 bp, Artificial Sequence
  chemically synthesized
cctttcacagattaggaataaa

SEQ ID NO: 717934 - DNA, 22 bp, Artificial Sequence
  chemically synthesized
ccctttcacagattaggaataa

SEQ ID NO: 717935 - DNA, 22 bp, Artificial Sequence
  chemically synthesized
tccctttcacagattaggaata

SEQ ID NO: 717936 - DNA, 22 bp, Artificial Sequence
  chemically synthesized
ggagagccttttattcctaatc

SEQ ID NO: 717937 - DNA, 22 bp, Artificial Sequence
  chemically synthesized
ttccctttcacagattaggaat

SEQ ID NO: 717938 - DNA, 22 bp, Artificial Sequence
  chemically synthesized
gagagccttttattcctaatct

SEQ ID NO: 717939 - DNA, 22 bp, Artificial Sequence
  chemically synthesized
tttccctttcacagattaggaa

SEQ ID NO: 717940 - DNA, 22 bp, Artificial Sequence
  chemically synthesized
ttttccctttcacagattagga

SEQ ID NO: 717941 - DNA, 22 bp, Artificial Sequence
  chemically synthesized
ttattcctaatctgtgaaaggg

SEQ ID NO: 717942 - DNA, 22 bp, Artificial Sequence
  chemically synthesized
tgtaccttttttccctttcaca

SEQ ID NO: 717943 - DNA, 22 bp, Artificial Sequence
  chemically synthesized
tattcctaatctgtgaaaggga

SEQ ID NO: 717944 - DNA, 22 bp, Artificial Sequence
  chemically synthesized
attcctaatctgtgaaagggaa

SEQ ID NO: 717945 - DNA, 22 bp, Artificial Sequence
  chemically synthesized
ttcctaatctgtgaaagggaaa

SEQ ID NO: 717946 - DNA, 22 bp, Artificial Sequence
  chemically synthesized
ctaatctgtgaaagggaaaaaa

SEQ ID NO: 717947 - DNA, 22 bp, Artificial Sequence
  chemically synthesized
atctgtgaaagggaaaaaaggt

SEQ ID NO: 717948 - DNA, 22 bp, Artificial Sequence
  chemically synthesized
aataacaactgtgtaccttttt

SEQ ID NO: 717949 - DNA, 22 bp, Artificial Sequence
  chemically synthesized
tcaataacaactgtgtaccttt

SEQ ID NO: 717950 - DNA, 22 bp, Artificial Sequence
  chemically synthesized
tgaaagggaaaaaaggtacaca

SEQ ID NO: 717951 - DNA, 22 bp, Artificial Sequence
  chemically synthesized
ccagcacaactctcaataacaa

SEQ ID NO: 717952 - DNA, 22 bp, Artificial Sequence
  chemically synthesized
ttcccagcacaactctcaataa

SEQ ID NO: 717953 - DNA, 22 bp, Artificial Sequence
  chemically synthesized
attcccagcacaactctcaata

SEQ ID NO: 717954 - DNA, 22 bp, Artificial Sequence
  chemically synthesized
tattcccagcacaactctcaat

SEQ ID NO: 717955 - DNA, 22 bp, Artificial Sequence
  chemically synthesized
gttttattcccagcacaactct

SEQ ID NO: 717956 - DNA, 22 bp, Artificial Sequence
  chemically synthesized
ttattgagagttgtgctgggaa

SEQ ID NO: 717957 - DNA, 22 bp, Artificial Sequence
  chemically synthesized
ttgagagttgtgctgggaataa

SEQ ID NO: 717958 - DNA, 22 bp, Artificial Sequence
  chemically synthesized
agagttgtgctgggaataaaac

SEQ ID NO: 717959 - DNA, 22 bp, Artificial Sequence
  chemically synthesized
ccaagcacatgatctcgtttta

SEQ ID NO: 717960 - DNA, 22 bp, Artificial Sequence
  chemically synthesized
tgccaagcacatgatctcgttt

SEQ ID NO: 717961 - DNA, 22 bp, Artificial Sequence
  chemically synthesized
tgctgggaataaaacgagatca

SEQ ID NO: 717962 - DNA, 22 bp, Artificial Sequence
  chemically synthesized
ctgccaagcacatgatctcgtt

SEQ ID NO: 717963 - DNA, 22 bp, Artificial Sequence
  chemically synthesized
tctgccaagcacatgatctcgt

SEQ ID NO: 717964 - DNA, 22 bp, Artificial Sequence
  chemically synthesized
ggaataaaacgagatcatgtgc

SEQ ID NO: 717965 - DNA, 22 bp, Artificial Sequence
  chemically synthesized
aacacggttttctgccaagcac

SEQ ID NO: 717966 - DNA, 22 bp, Artificial Sequence
  chemically synthesized
gaacacggttttctgccaagca

SEQ ID NO: 717967 - DNA, 22 bp, Artificial Sequence
  chemically synthesized
cttgaacacggttttctgccaa

SEQ ID NO: 717968 - DNA, 22 bp, Artificial Sequence
  chemically synthesized
tcattgcttgaacacggttttc

SEQ ID NO: 717969 - DNA, 22 bp, Artificial Sequence
  chemically synthesized
gctgtcattgcttgaacacggt

SEQ ID NO: 717970 - DNA, 22 bp, Artificial Sequence
  chemically synthesized
ttagctgtcattgcttgaacac

SEQ ID NO: 717971 - DNA, 22 bp, Artificial Sequence
  chemically synthesized
ggcagaaaaccgtgttcaagca

SEQ ID NO: 717972 - DNA, 22 bp, Artificial Sequence
  chemically synthesized
gcagaaaaccgtgttcaagcaa

SEQ ID NO: 717973 - DNA, 22 bp, Artificial Sequence
  chemically synthesized
aagtatcacctattagctgtca

SEQ ID NO: 717974 - DNA, 22 bp, Artificial Sequence
  chemically synthesized
aagcaatgacagctaataggtg

SEQ ID NO: 717975 - DNA, 22 bp, Artificial Sequence
  chemically synthesized
acgtagcataatgtcctcaagt

SEQ ID NO: 717976 - DNA, 22 bp, Artificial Sequence
  chemically synthesized
cacgtagcataatgtcctcaag

SEQ ID NO: 717977 - DNA, 22 bp, Artificial Sequence
  chemically synthesized
ataggtgatacttgaggacatt

SEQ ID NO: 717978 - DNA, 22 bp, Artificial Sequence
  chemically synthesized
tttcacgtagcataatgtcctc

SEQ ID NO: 717979 - DNA, 22 bp, Artificial Sequence
  chemically synthesized
atttcacgtagcataatgtcct

SEQ ID NO: 717980 - DNA, 22 bp, Artificial Sequence
  chemically synthesized
gcttatttcacgtagcataatg

SEQ ID NO: 717981 - DNA, 22 bp, Artificial Sequence
  chemically synthesized
gactggcttatttcacgtagca

SEQ ID NO: 717982 - DNA, 22 bp, Artificial Sequence
  chemically synthesized
ggactggcttatttcacgtagc

SEQ ID NO: 717983 - DNA, 22 bp, Artificial Sequence
  chemically synthesized
gaggacattatgctacgtgaaa

SEQ ID NO: 717984 - DNA, 22 bp, Artificial Sequence
  chemically synthesized
tggactggcttatttcacgtag

SEQ ID NO: 717985 - DNA, 22 bp, Artificial Sequence
  chemically synthesized
aggacattatgctacgtgaaat

SEQ ID NO: 717986 - DNA, 22 bp, Artificial Sequence
  chemically synthesized
ttggactggcttatttcacgta

SEQ ID NO: 717987 - DNA, 22 bp, Artificial Sequence
  chemically synthesized
tttggactggcttatttcacgt

SEQ ID NO: 717988 - DNA, 22 bp, Artificial Sequence
  chemically synthesized
ctttttggactggcttatttca

SEQ ID NO: 717989 - DNA, 22 bp, Artificial Sequence
  chemically synthesized
ttcctttttggactggcttatt

SEQ ID NO: 717990 - DNA, 22 bp, Artificial Sequence
  chemically synthesized
gttcctttttggactggcttat

SEQ ID NO: 717991 - DNA, 22 bp, Artificial Sequence
  chemically synthesized
tgctacgtgaaataagccagtc

SEQ ID NO: 717992 - DNA, 22 bp, Artificial Sequence
  chemically synthesized
cgtgaaataagccagtccaaaa

SEQ ID NO: 717993 - DNA, 22 bp, Artificial Sequence
  chemically synthesized
tacagtatttgttcctttttgg

SEQ ID NO: 717994 - DNA, 22 bp, Artificial Sequence
  chemically synthesized
ggaacatcatgtaagcggaatt

SEQ ID NO: 717995 - DNA, 22 bp, Artificial Sequence
  chemically synthesized
taggaacatcatgtaagcggaa

SEQ ID NO: 717996 - DNA, 22 bp, Artificial Sequence
  chemically synthesized
ttctaggaacatcatgtaagcg

SEQ ID NO: 717997 - DNA, 22 bp, Artificial Sequence
  chemically synthesized
tataattccgcttacatgatgt

SEQ ID NO: 717998 - DNA, 22 bp, Artificial Sequence
  chemically synthesized
actattctaggaacatcatgta

SEQ ID NO: 717999 - DNA, 22 bp, Artificial Sequence
  chemically synthesized
gactattctaggaacatcatgt

SEQ ID NO: 718000 - DNA, 22 bp, Artificial Sequence
  chemically synthesized
cgcttacatgatgttcctagaa

SEQ ID NO: 718001 - DNA, 22 bp, Artificial Sequence
  chemically synthesized
tgcatttgactattctaggaac

SEQ ID NO: 718002 - DNA, 22 bp, Artificial Sequence
  chemically synthesized
tatgcatttgactattctagga

SEQ ID NO: 718003 - DNA, 22 bp, Artificial Sequence
  chemically synthesized
acatgatgttcctagaatagtc

SEQ ID NO: 718004 - DNA, 22 bp, Artificial Sequence
  chemically synthesized
catgatgttcctagaatagtca

SEQ ID NO: 718005 - DNA, 22 bp, Artificial Sequence
  chemically synthesized
cgtctctatgcatttgactatt

SEQ ID NO: 718006 - DNA, 22 bp, Artificial Sequence
  chemically synthesized
ccgtctctatgcatttgactat

SEQ ID NO: 718007 - DNA, 22 bp, Artificial Sequence
  chemically synthesized
tccgtctctatgcatttgacta

SEQ ID NO: 718008 - DNA, 22 bp, Artificial Sequence
  chemically synthesized
ctttccgtctctatgcatttga

SEQ ID NO: 718009 - DNA, 22 bp, Artificial Sequence
  chemically synthesized
tactttccgtctctatgcattt

SEQ ID NO: 718010 - DNA, 22 bp, Artificial Sequence
  chemically synthesized
ctagaatagtcaaatgcataga

SEQ ID NO: 718011 - DNA, 22 bp, Artificial Sequence
  chemically synthesized
ctactttccgtctctatgcatt

SEQ ID NO: 718012 - DNA, 22 bp, Artificial Sequence
  chemically synthesized
tctactttccgtctctatgcat

SEQ ID NO: 718013 - DNA, 22 bp, Artificial Sequence
  chemically synthesized
gaatagtcaaatgcatagagac

SEQ ID NO: 718014 - DNA, 22 bp, Artificial Sequence
  chemically synthesized
gcagccatctttctactttccg

SEQ ID NO: 718015 - DNA, 22 bp, Artificial Sequence
  chemically synthesized
ccccagcccctggcagccatct

SEQ ID NO: 718016 - DNA, 22 bp, Artificial Sequence
  chemically synthesized
cccccagcccctggcagccatc

SEQ ID NO: 718017 - DNA, 22 bp, Artificial Sequence
  chemically synthesized
tcccccagcccctggcagccat

SEQ ID NO: 718018 - DNA, 22 bp, Artificial Sequence
  chemically synthesized
ctttcccccagcccctggcagc

SEQ ID NO: 718019 - DNA, 22 bp, Artificial Sequence
  chemically synthesized
ctcctttcccccagcccctggc

SEQ ID NO: 718020 - DNA, 22 bp, Artificial Sequence
  chemically synthesized
cctcctttcccccagcccctgg

SEQ ID NO: 718021 - DNA, 22 bp, Artificial Sequence
  chemically synthesized
atttcctcctttcccccagccc

SEQ ID NO: 718022 - DNA, 22 bp, Artificial Sequence
  chemically synthesized
tcatttcctcctttcccccagc

SEQ ID NO: 718023 - DNA, 22 bp, Artificial Sequence
  chemically synthesized
ctcatttcctcctttcccccag

SEQ ID NO: 718024 - DNA, 22 bp, Artificial Sequence
  chemically synthesized
ccaggggctgggggaaaggagg

SEQ ID NO: 718025 - DNA, 22 bp, Artificial Sequence
  chemically synthesized
aaccacttctcatttcctcctt

SEQ ID NO: 718026 - DNA, 22 bp, Artificial Sequence
  chemically synthesized
ggggaaaggaggaaatgagaag

SEQ ID NO: 718027 - DNA, 22 bp, Artificial Sequence
  chemically synthesized
tacccattaaaccacttctcat

SEQ ID NO: 718028 - DNA, 22 bp, Artificial Sequence
  chemically synthesized
aaactgtacccattaaaccact

SEQ ID NO: 718029 - DNA, 22 bp, Artificial Sequence
  chemically synthesized
caaatctgaaactgtacccatt

SEQ ID NO: 718030 - DNA, 22 bp, Artificial Sequence
  chemically synthesized
gcaaatctgaaactgtacccat

SEQ ID NO: 718031 - DNA, 22 bp, Artificial Sequence
  chemically synthesized
accttgcaaatctgaaactgta

SEQ ID NO: 718032 - DNA, 22 bp, Artificial Sequence
  chemically synthesized
caccttgcaaatctgaaactgt

SEQ ID NO: 718033 - DNA, 22 bp, Artificial Sequence
  chemically synthesized
tcaccttgcaaatctgaaactg

SEQ ID NO: 718034 - DNA, 22 bp, Artificial Sequence
  chemically synthesized
ttcaccttgcaaatctgaaact

SEQ ID NO: 718035 - DNA, 22 bp, Artificial Sequence
  chemically synthesized
tttcaccttgcaaatctgaaac

SEQ ID NO: 718036 - DNA, 22 bp, Artificial Sequence
  chemically synthesized
aatgggtacagtttcagatttg

SEQ ID NO: 718037 - DNA, 22 bp, Artificial Sequence
  chemically synthesized
atgggtacagtttcagatttgc

SEQ ID NO: 718038 - DNA, 22 bp, Artificial Sequence
  chemically synthesized
cagaactttttcaccttgcaaa

SEQ ID NO: 718039 - DNA, 22 bp, Artificial Sequence
  chemically synthesized
gcagaactttttcaccttgcaa

SEQ ID NO: 718040 - DNA, 22 bp, Artificial Sequence
  chemically synthesized
cagatttgcaaggtgaaaaagt

SEQ ID NO: 718041 - DNA, 22 bp, Artificial Sequence
  chemically synthesized
agatttgcaaggtgaaaaagtt

SEQ ID NO: 718042 - DNA, 22 bp, Artificial Sequence
  chemically synthesized
gcaaggtgaaaaagttctgcaa

SEQ ID NO: 718043 - DNA, 22 bp, Artificial Sequence
  chemically synthesized
caaggtgaaaaagttctgcaag

SEQ ID NO: 718044 - DNA, 22 bp, Artificial Sequence
  chemically synthesized
tcatgtagtggacttgcagaac

SEQ ID NO: 718045 - DNA, 22 bp, Artificial Sequence
  chemically synthesized
atgttgtcatgtagtggacttg

SEQ ID NO: 718046 - DNA, 22 bp, Artificial Sequence
  chemically synthesized
agtatattcatgttgtcatgta

SEQ ID NO: 718047 - DNA, 22 bp, Artificial Sequence
  chemically synthesized
tgcaagtccactacatgacaac

SEQ ID NO: 718048 - DNA, 22 bp, Artificial Sequence
  chemically synthesized
caagtccactacatgacaacat

SEQ ID NO: 718049 - DNA, 22 bp, Artificial Sequence
  chemically synthesized
agtaatgttaagtatattcatg

SEQ ID NO: 718050 - DNA, 22 bp, Artificial Sequence
  chemically synthesized
catgacaacatgaatatactta

SEQ ID NO: 718051 - DNA, 22 bp, Artificial Sequence
  chemically synthesized
gagtatagttcagtaatgttaa

SEQ ID NO: 718052 - DNA, 22 bp, Artificial Sequence
  chemically synthesized
agagtatagttcagtaatgtta

SEQ ID NO: 718053 - DNA, 22 bp, Artificial Sequence
  chemically synthesized
tagagtatagttcagtaatgtt

SEQ ID NO: 718054 - DNA, 22 bp, Artificial Sequence
  chemically synthesized
ttagagtatagttcagtaatgt

SEQ ID NO: 718055 - DNA, 22 bp, Artificial Sequence
  chemically synthesized
tttagagtatagttcagtaatg

SEQ ID NO: 718056 - DNA, 22 bp, Artificial Sequence
  chemically synthesized
accattttttagagtatagttc

SEQ ID NO: 718057 - DNA, 22 bp, Artificial Sequence
  chemically synthesized
aaccattttttagagtatagtt

SEQ ID NO: 718058 - DNA, 22 bp, Artificial Sequence
  chemically synthesized
taaccattttttagagtatagt

SEQ ID NO: 718059 - DNA, 22 bp, Artificial Sequence
  chemically synthesized
aacattactgaactatactcta

SEQ ID NO: 718060 - DNA, 22 bp, Artificial Sequence
  chemically synthesized
acattactgaactatactctaa

SEQ ID NO: 718061 - DNA, 22 bp, Artificial Sequence
  chemically synthesized
ccattttaaccattttttagag

SEQ ID NO: 718062 - DNA, 22 bp, Artificial Sequence
  chemically synthesized
accattttaaccattttttaga

SEQ ID NO: 718063 - DNA, 22 bp, Artificial Sequence
  chemically synthesized
ctgaactatactctaaaaaatg

SEQ ID NO: 718064 - DNA, 22 bp, Artificial Sequence
  chemically synthesized
aactatactctaaaaaatggtt

SEQ ID NO: 718065 - DNA, 22 bp, Artificial Sequence
  chemically synthesized
tactctaaaaaatggttaaaat

SEQ ID NO: 718066 - DNA, 22 bp, Artificial Sequence
  chemically synthesized
taaaaaatggttaaaatggtaa

SEQ ID NO: 718067 - DNA, 22 bp, Artificial Sequence
  chemically synthesized
aaaaatggttaaaatggtaaat

SEQ ID NO: 718068 - DNA, 22 bp, Artificial Sequence
  chemically synthesized
tggtaaaaacacataatgtaaa

SEQ ID NO: 718069 - DNA, 22 bp, Artificial Sequence
  chemically synthesized
aaatggtaaattttacattatg

SEQ ID NO: 718070 - DNA, 22 bp, Artificial Sequence
  chemically synthesized
aaattgtggtaaaaacacataa

SEQ ID NO: 718071 - DNA, 22 bp, Artificial Sequence
  chemically synthesized
caaattgtggtaaaaacacata

SEQ ID NO: 718072 - DNA, 22 bp, Artificial Sequence
  chemically synthesized
tcaaattgtggtaaaaacacat

SEQ ID NO: 718073 - DNA, 22 bp, Artificial Sequence
  chemically synthesized
ttcaaattgtggtaaaaacaca

SEQ ID NO: 718074 - DNA, 22 bp, Artificial Sequence
  chemically synthesized
ttttcaaattgtggtaaaaaca

SEQ ID NO: 718075 - DNA, 22 bp, Artificial Sequence
  chemically synthesized
cttttcaaattgtggtaaaaac

SEQ ID NO: 718076 - DNA, 22 bp, Artificial Sequence
  chemically synthesized
tcttttcaaattgtggtaaaaa

SEQ ID NO: 718077 - DNA, 22 bp, Artificial Sequence
  chemically synthesized
tacattatgtgtttttaccaca

SEQ ID NO: 718078 - DNA, 22 bp, Artificial Sequence
  chemically synthesized
acattatgtgtttttaccacaa

SEQ ID NO: 718079 - DNA, 22 bp, Artificial Sequence
  chemically synthesized
tttcttttcaaattgtggtaaa

SEQ ID NO: 718080 - DNA, 22 bp, Artificial Sequence
  chemically synthesized
cattatgtgtttttaccacaat

SEQ ID NO: 718081 - DNA, 22 bp, Artificial Sequence
  chemically synthesized
ctttcttttcaaattgtggtaa

SEQ ID NO: 718082 - DNA, 22 bp, Artificial Sequence
  chemically synthesized
tgtgtttttaccacaatttgaa

SEQ ID NO: 718083 - DNA, 22 bp, Artificial Sequence
  chemically synthesized
ttaccacaatttgaaaagaaag

SEQ ID NO: 718084 - DNA, 22 bp, Artificial Sequence
  chemically synthesized
taccacaatttgaaaagaaaga

SEQ ID NO: 718085 - DNA, 22 bp, Artificial Sequence
  chemically synthesized
accacaatttgaaaagaaagaa

SEQ ID NO: 718086 - DNA, 22 bp, Artificial Sequence
  chemically synthesized
ccacaatttgaaaagaaagaaa

SEQ ID NO: 718087 - DNA, 22 bp, Artificial Sequence
  chemically synthesized
gaaaagaaagaaatgatggcta

SEQ ID NO: 718088 - DNA, 22 bp, Artificial Sequence
  chemically synthesized
aaaagaaagaaatgatggctac

SEQ ID NO: 718089 - DNA, 22 bp, Artificial Sequence
  chemically synthesized
aatggaatcaatggtatggtag

SEQ ID NO: 718090 - DNA, 22 bp, Artificial Sequence
  chemically synthesized
ccataccattgattccatttaa

SEQ ID NO: 718091 - DNA, 22 bp, Artificial Sequence
  chemically synthesized
tgggtaaaatcaattaaatgga

SEQ ID NO: 718092 - DNA, 22 bp, Artificial Sequence
  chemically synthesized
gtgggtaaaatcaattaaatgg

SEQ ID NO: 718093 - DNA, 22 bp, Artificial Sequence
  chemically synthesized
cttgtgggtaaaatcaattaaa

SEQ ID NO: 718094 - DNA, 22 bp, Artificial Sequence
  chemically synthesized
attccatttaattgattttacc

SEQ ID NO: 718095 - DNA, 22 bp, Artificial Sequence
  chemically synthesized
catttaattgattttacccaca

SEQ ID NO: 718096 - DNA, 22 bp, Artificial Sequence
  chemically synthesized
aattgattttacccacaagcag

SEQ ID NO: 718097 - DNA, 22 bp, Artificial Sequence
  chemically synthesized
attgattttacccacaagcagg

SEQ ID NO: 718098 - DNA, 22 bp, Artificial Sequence
  chemically synthesized
attttacccacaagcaggtacc

SEQ ID NO: 718099 - DNA, 22 bp, Artificial Sequence
  chemically synthesized
tacccacaagcaggtacctttt

SEQ ID NO: 718100 - DNA, 22 bp, Artificial Sequence
  chemically synthesized
acccacaagcaggtaccttttc

SEQ ID NO: 718101 - DNA, 22 bp, Artificial Sequence
  chemically synthesized
cccacaagcaggtaccttttct

SEQ ID NO: 718102 - DNA, 22 bp, Artificial Sequence
  chemically synthesized
ttctggcttctcctgtattttc

SEQ ID NO: 718103 - DNA, 22 bp, Artificial Sequence
  chemically synthesized
tctggcttctcctgtattttct

SEQ ID NO: 718104 - DNA, 22 bp, Artificial Sequence
  chemically synthesized
ctggcttctcctgtattttctc

SEQ ID NO: 718105 - DNA, 22 bp, Artificial Sequence
  chemically synthesized
tggcttctcctgtattttctca

SEQ ID NO: 718106 - DNA, 22 bp, Artificial Sequence
  chemically synthesized
gcttctcctgtattttctcatc

SEQ ID NO: 718107 - DNA, 22 bp, Artificial Sequence
  chemically synthesized
ctcctgtattttctcatcctgt

SEQ ID NO: 718108 - DNA, 22 bp, Artificial Sequence
  chemically synthesized
tcctgtattttctcatcctgtt

SEQ ID NO: 718109 - DNA, 22 bp, Artificial Sequence
  chemically synthesized
taggtcccacccaacaggatga

SEQ ID NO: 718110 - DNA, 22 bp, Artificial Sequence
  chemically synthesized
ctgtattttctcatcctgttgg

SEQ ID NO: 718111 - DNA, 22 bp, Artificial Sequence
  chemically synthesized
tattttctcatcctgttgggtg

SEQ ID NO: 718112 - DNA, 22 bp, Artificial Sequence
  chemically synthesized
aaactataggtcccacccaaca

SEQ ID NO: 718113 - DNA, 22 bp, Artificial Sequence
  chemically synthesized
gaaactataggtcccacccaac

SEQ ID NO: 718114 - DNA, 22 bp, Artificial Sequence
  chemically synthesized
tctcatcctgttgggtgggacc

SEQ ID NO: 718115 - DNA, 22 bp, Artificial Sequence
  chemically synthesized
ctcatcctgttgggtgggacct

SEQ ID NO: 718116 - DNA, 22 bp, Artificial Sequence
  chemically synthesized
tcatcctgttgggtgggaccta

SEQ ID NO: 718117 - DNA, 22 bp, Artificial Sequence
  chemically synthesized
atcctgttgggtgggacctata

SEQ ID NO: 718118 - DNA, 22 bp, Artificial Sequence
  chemically synthesized
aatcatgtttgaaactataggt

SEQ ID NO: 718119 - DNA, 22 bp, Artificial Sequence
  chemically synthesized
caatcatgtttgaaactatagg

SEQ ID NO: 718120 - DNA, 22 bp, Artificial Sequence
  chemically synthesized
ttgggtgggacctatagtttca

SEQ ID NO: 718121 - DNA, 22 bp, Artificial Sequence
  chemically synthesized
ggtgggacctatagtttcaaac

SEQ ID NO: 718122 - DNA, 22 bp, Artificial Sequence
  chemically synthesized
tagtttcaaacatgattgaagc

SEQ ID NO: 718123 - DNA, 22 bp, Artificial Sequence
  chemically synthesized
caaacatgattgaagctccctg

SEQ ID NO: 718124 - DNA, 22 bp, Artificial Sequence
  chemically synthesized
aaacatgattgaagctccctgc

SEQ ID NO: 718125 - DNA, 22 bp, Artificial Sequence
  chemically synthesized
aagctccctgcctcctctgaca

SEQ ID NO: 718126 - DNA, 22 bp, Artificial Sequence
  chemically synthesized
cctgcctcctctgacaccctgg

SEQ ID NO: 718127 - DNA, 22 bp, Artificial Sequence
  chemically synthesized
cggagacgtaatatccagggtg

SEQ ID NO: 718128 - DNA, 22 bp, Artificial Sequence
  chemically synthesized
cctcctctgacaccctggatat

SEQ ID NO: 718129 - DNA, 22 bp, Artificial Sequence
  chemically synthesized
ctctgacaccctggatattacg

SEQ ID NO: 718130 - DNA, 22 bp, Artificial Sequence
  chemically synthesized
tgacaccctggatattacgtct

SEQ ID NO: 718131 - DNA, 22 bp, Artificial Sequence
  chemically synthesized
acaccctggatattacgtctcc

SEQ ID NO: 718132 - DNA, 22 bp, Artificial Sequence
  chemically synthesized
gtgtaaaaaatcagattacgga

SEQ ID NO: 718133 - DNA, 22 bp, Artificial Sequence
  chemically synthesized
gatattacgtctccgtaatctg

SEQ ID NO: 718134 - DNA, 22 bp, Artificial Sequence
  chemically synthesized
cgtctccgtaatctgatttttt

SEQ ID NO: 718135 - DNA, 22 bp, Artificial Sequence
  chemically synthesized
gaaacattggtgtaaaaaatca

SEQ ID NO: 718136 - DNA, 22 bp, Artificial Sequence
  chemically synthesized
cgtaatctgattttttacacca

SEQ ID NO: 718137 - DNA, 22 bp, Artificial Sequence
  chemically synthesized
attttttacaccaatgtttcta

SEQ ID NO: 718138 - DNA, 22 bp, Artificial Sequence
  chemically synthesized
tttacaccaatgtttctaatct

SEQ ID NO: 718139 - DNA, 22 bp, Artificial Sequence
  chemically synthesized
ttacaccaatgtttctaatctc

SEQ ID NO: 718140 - DNA, 22 bp, Artificial Sequence
  chemically synthesized
aagagatgtgtggagattagaa

SEQ ID NO: 718141 - DNA, 22 bp, Artificial Sequence
  chemically synthesized
tacaccaatgtttctaatctcc

SEQ ID NO: 718142 - DNA, 22 bp, Artificial Sequence
  chemically synthesized
acaccaatgtttctaatctcca

SEQ ID NO: 718143 - DNA, 22 bp, Artificial Sequence
  chemically synthesized
caccaatgtttctaatctccac

SEQ ID NO: 718144 - DNA, 22 bp, Artificial Sequence
  chemically synthesized
aagtctaaagagatgtgtggag

SEQ ID NO: 718145 - DNA, 22 bp, Artificial Sequence
  chemically synthesized
ctaatctccacacatctcttta

SEQ ID NO: 718146 - DNA, 22 bp, Artificial Sequence
  chemically synthesized
taatctccacacatctctttag

SEQ ID NO: 718147 - DNA, 22 bp, Artificial Sequence
  chemically synthesized
atctccacacatctctttagac

SEQ ID NO: 718148 - DNA, 22 bp, Artificial Sequence
  chemically synthesized
atgagagaatctaaagtctaaa

SEQ ID NO: 718149 - DNA, 22 bp, Artificial Sequence
  chemically synthesized
cacacatctctttagactttag

SEQ ID NO: 718150 - DNA, 22 bp, Artificial Sequence
  chemically synthesized
agctcatgagagaatctaaagt

SEQ ID NO: 718151 - DNA, 22 bp, Artificial Sequence
  chemically synthesized
cagctcatgagagaatctaaag

SEQ ID NO: 718152 - DNA, 22 bp, Artificial Sequence
  chemically synthesized
tttagactttagattctctcat

SEQ ID NO: 718153 - DNA, 22 bp, Artificial Sequence
  chemically synthesized
tagactttagattctctcatga

SEQ ID NO: 718154 - DNA, 22 bp, Artificial Sequence
  chemically synthesized
agactttagattctctcatgag

SEQ ID NO: 718155 - DNA, 22 bp, Artificial Sequence
  chemically synthesized
gactttagattctctcatgagc

SEQ ID NO: 718156 - DNA, 22 bp, Artificial Sequence
  chemically synthesized
tgccagggtgatttcagctcat

SEQ ID NO: 718157 - DNA, 22 bp, Artificial Sequence
  chemically synthesized
tagattctctcatgagctgaaa

SEQ ID NO: 718158 - DNA, 22 bp, Artificial Sequence
  chemically synthesized
agattctctcatgagctgaaat

SEQ ID NO: 718159 - DNA, 22 bp, Artificial Sequence
  chemically synthesized
gattctctcatgagctgaaatc

SEQ ID NO: 718160 - DNA, 22 bp, Artificial Sequence
  chemically synthesized
tctcatgagctgaaatcaccct

SEQ ID NO: 718161 - DNA, 22 bp, Artificial Sequence
  chemically synthesized
agagcctatgccagggtgattt

SEQ ID NO: 718162 - DNA, 22 bp, Artificial Sequence
  chemically synthesized
tcatgagctgaaatcaccctgg

SEQ ID NO: 718163 - DNA, 22 bp, Artificial Sequence
  chemically synthesized
ctcagagcctatgccagggtga

SEQ ID NO: 718164 - DNA, 22 bp, Artificial Sequence
  chemically synthesized
atgagctgaaatcaccctggca

SEQ ID NO: 718165 - DNA, 22 bp, Artificial Sequence
  chemically synthesized
aaatcaccctggcataggctct

SEQ ID NO: 718166 - DNA, 22 bp, Artificial Sequence
  chemically synthesized
catgcagttcctcagagcctat

SEQ ID NO: 718167 - DNA, 22 bp, Artificial Sequence
  chemically synthesized
ccatgcagttcctcagagccta

SEQ ID NO: 718168 - DNA, 22 bp, Artificial Sequence
  chemically synthesized
cttccatgcagttcctcagagc

SEQ ID NO: 718169 - DNA, 22 bp, Artificial Sequence
  chemically synthesized
gcttccatgcagttcctcagag

SEQ ID NO: 718170 - DNA, 22 bp, Artificial Sequence
  chemically synthesized
tttgcttccatgcagttcctca

SEQ ID NO: 718171 - DNA, 22 bp, Artificial Sequence
  chemically synthesized
gcataggctctgaggaactgca

SEQ ID NO: 718172 - DNA, 22 bp, Artificial Sequence
  chemically synthesized
tgaggaactgcatggaagcaaa

SEQ ID NO: 718173 - DNA, 22 bp, Artificial Sequence
  chemically synthesized
aggaactgcatggaagcaaaca

SEQ ID NO: 718174 - DNA, 22 bp, Artificial Sequence
  chemically synthesized
catggaagcaaacagcactatt

SEQ ID NO: 718175 - DNA, 22 bp, Artificial Sequence
  chemically synthesized
gaggaaggaaggaaaatagtgc

SEQ ID NO: 718176 - DNA, 22 bp, Artificial Sequence
  chemically synthesized
ttagaggaaggaaggaaaatag

SEQ ID NO: 718177 - DNA, 22 bp, Artificial Sequence
  chemically synthesized
gttagaggaaggaaggaaaata

SEQ ID NO: 718178 - DNA, 22 bp, Artificial Sequence
  chemically synthesized
tgttagaggaaggaaggaaaat

SEQ ID NO: 718179 - DNA, 22 bp, Artificial Sequence
  chemically synthesized
ttttgttagaggaaggaaggaa

SEQ ID NO: 718180 - DNA, 22 bp, Artificial Sequence
  chemically synthesized
ttttccttccttcctctaacaa

SEQ ID NO: 718181 - DNA, 22 bp, Artificial Sequence
  chemically synthesized
aagagatctgttttgttagagg

SEQ ID NO: 718182 - DNA, 22 bp, Artificial Sequence
  chemically synthesized
aaagagatctgttttgttagag

SEQ ID NO: 718183 - DNA, 22 bp, Artificial Sequence
  chemically synthesized
taaagagatctgttttgttaga

SEQ ID NO: 718184 - DNA, 22 bp, Artificial Sequence
  chemically synthesized
tccttccttcctctaacaaaac

SEQ ID NO: 718185 - DNA, 22 bp, Artificial Sequence
  chemically synthesized
ccttccttcctctaacaaaaca

SEQ ID NO: 718186 - DNA, 22 bp, Artificial Sequence
  chemically synthesized
cttccttcctctaacaaaacag

SEQ ID NO: 718187 - DNA, 22 bp, Artificial Sequence
  chemically synthesized
ccttcctctaacaaaacagatc

SEQ ID NO: 718188 - DNA, 22 bp, Artificial Sequence
  chemically synthesized
cttcctctaacaaaacagatct

SEQ ID NO: 718189 - DNA, 22 bp, Artificial Sequence
  chemically synthesized
cctctaacaaaacagatctctt

SEQ ID NO: 718190 - DNA, 22 bp, Artificial Sequence
  chemically synthesized
ctctaacaaaacagatctcttt

SEQ ID NO: 718191 - DNA, 22 bp, Artificial Sequence
  chemically synthesized
tggtggtgattttaaagagatc

SEQ ID NO: 718192 - DNA, 22 bp, Artificial Sequence
  chemically synthesized
taacaaaacagatctctttaaa

SEQ ID NO: 718193 - DNA, 22 bp, Artificial Sequence
  chemically synthesized
acaaaacagatctctttaaaat

SEQ ID NO: 718194 - DNA, 22 bp, Artificial Sequence
  chemically synthesized
gaaaggttatggtggtgatttt

SEQ ID NO: 718195 - DNA, 22 bp, Artificial Sequence
  chemically synthesized
cgaaaggttatggtggtgattt

SEQ ID NO: 718196 - DNA, 22 bp, Artificial Sequence
  chemically synthesized
tcgaaaggttatggtggtgatt

SEQ ID NO: 718197 - DNA, 22 bp, Artificial Sequence
  chemically synthesized
ttcgaaaggttatggtggtgat

SEQ ID NO: 718198 - DNA, 22 bp, Artificial Sequence
  chemically synthesized
tttaaaatcaccaccataacct

SEQ ID NO: 718199 - DNA, 22 bp, Artificial Sequence
  chemically synthesized
taaaatcaccaccataaccttt

SEQ ID NO: 718200 - DNA, 22 bp, Artificial Sequence
  chemically synthesized
atgtgcttttcgaaaggttatg

SEQ ID NO: 718201 - DNA, 22 bp, Artificial Sequence
  chemically synthesized
aaaatcaccaccataacctttc

SEQ ID NO: 718202 - DNA, 22 bp, Artificial Sequence
  chemically synthesized
gatgtgcttttcgaaaggttat

SEQ ID NO: 718203 - DNA, 22 bp, Artificial Sequence
  chemically synthesized
aaatcaccaccataacctttcg

SEQ ID NO: 718204 - DNA, 22 bp, Artificial Sequence
  chemically synthesized
tatcatgatgcagtttgatgtg

SEQ ID NO: 718205 - DNA, 22 bp, Artificial Sequence
  chemically synthesized
gtatcatgatgcagtttgatgt

SEQ ID NO: 718206 - DNA, 22 bp, Artificial Sequence
  chemically synthesized
tgtatcatgatgcagtttgatg

SEQ ID NO: 718207 - DNA, 22 bp, Artificial Sequence
  chemically synthesized
ttgtatcatgatgcagtttgat

SEQ ID NO: 718208 - DNA, 22 bp, Artificial Sequence
  chemically synthesized
tcgaaaagcacatcaaactgca

SEQ ID NO: 718209 - DNA, 22 bp, Artificial Sequence
  chemically synthesized
cgaaaagcacatcaaactgcat

SEQ ID NO: 718210 - DNA, 22 bp, Artificial Sequence
  chemically synthesized
ttttgtatcatgatgcagtttg

SEQ ID NO: 718211 - DNA, 22 bp, Artificial Sequence
  chemically synthesized
gaaaagcacatcaaactgcatc

SEQ ID NO: 718212 - DNA, 22 bp, Artificial Sequence
  chemically synthesized
cttttgtatcatgatgcagttt

SEQ ID NO: 718213 - DNA, 22 bp, Artificial Sequence
  chemically synthesized
catcatgatacaaaagaaatta

SEQ ID NO: 718214 - DNA, 22 bp, Artificial Sequence
  chemically synthesized
gcaccgacagagtataatttct

SEQ ID NO: 718215 - DNA, 22 bp, Artificial Sequence
  chemically synthesized
aacaacctggcaccgacagagt

SEQ ID NO: 718216 - DNA, 22 bp, Artificial Sequence
  chemically synthesized
caacaacctggcaccgacagag

SEQ ID NO: 718217 - DNA, 22 bp, Artificial Sequence
  chemically synthesized
tcaacaacctggcaccgacaga

SEQ ID NO: 718218 - DNA, 22 bp, Artificial Sequence
  chemically synthesized
ttttcaacaacctggcaccgac

SEQ ID NO: 718219 - DNA, 22 bp, Artificial Sequence
  chemically synthesized
attttcaacaacctggcaccga

SEQ ID NO: 718220 - DNA, 22 bp, Artificial Sequence
  chemically synthesized
tactctgtcggtgccaggttgt

SEQ ID NO: 718221 - DNA, 22 bp, Artificial Sequence
  chemically synthesized
aatcccttattttcaacaacct

SEQ ID NO: 718222 - DNA, 22 bp, Artificial Sequence
  chemically synthesized
tgtcggtgccaggttgttgaaa

SEQ ID NO: 718223 - DNA, 22 bp, Artificial Sequence
  chemically synthesized
tcggtgccaggttgttgaaaat

SEQ ID NO: 718224 - DNA, 22 bp, Artificial Sequence
  chemically synthesized
atctcaatcccttattttcaac

SEQ ID NO: 718225 - DNA, 22 bp, Artificial Sequence
  chemically synthesized
ctgatctcaatcccttattttc

SEQ ID NO: 718226 - DNA, 22 bp, Artificial Sequence
  chemically synthesized
cccagactcctgatctcaatcc

SEQ ID NO: 718227 - DNA, 22 bp, Artificial Sequence
  chemically synthesized
ttgaaaataagggattgagatc

SEQ ID NO: 718228 - DNA, 22 bp, Artificial Sequence
  chemically synthesized
ccccagactcctgatctcaatc

SEQ ID NO: 718229 - DNA, 22 bp, Artificial Sequence
  chemically synthesized
aaaataagggattgagatcagg

SEQ ID NO: 718230 - DNA, 22 bp, Artificial Sequence
  chemically synthesized
tcaacttccccagactcctgat

SEQ ID NO: 718231 - DNA, 22 bp, Artificial Sequence
  chemically synthesized
tatctgtcaacttccccagact

SEQ ID NO: 718232 - DNA, 22 bp, Artificial Sequence
  chemically synthesized
agatcaggagtctggggaagtt

SEQ ID NO: 718233 - DNA, 22 bp, Artificial Sequence
  chemically synthesized
agcacatcattatatctgtcaa

SEQ ID NO: 718234 - DNA, 22 bp, Artificial Sequence
  chemically synthesized
gggaagttgacagatataatga

SEQ ID NO: 718235 - DNA, 22 bp, Artificial Sequence
  chemically synthesized
acagatataatgatgtgcttag

SEQ ID NO: 718236 - DNA, 22 bp, Artificial Sequence
  chemically synthesized
tgtcaaaatccatcaggatatc

SEQ ID NO: 718237 - DNA, 22 bp, Artificial Sequence
  chemically synthesized
agatatcctgatggattttgac

SEQ ID NO: 718238 - DNA, 22 bp, Artificial Sequence
  chemically synthesized
gatatcctgatggattttgaca

SEQ ID NO: 718239 - DNA, 22 bp, Artificial Sequence
  chemically synthesized
acccccaagcagagaatctgtg

SEQ ID NO: 718240 - DNA, 22 bp, Artificial Sequence
  chemically synthesized
atggattttgacacagattctc

SEQ ID NO: 718241 - DNA, 22 bp, Artificial Sequence
  chemically synthesized
cactcacccccaagcagagaat

SEQ ID NO: 718242 - DNA, 22 bp, Artificial Sequence
  chemically synthesized
tgacacagattctctgcttggg

SEQ ID NO: 718243 - DNA, 22 bp, Artificial Sequence
  chemically synthesized
gacacagattctctgcttgggg

SEQ ID NO: 718244 - DNA, 22 bp, Artificial Sequence
  chemically synthesized
acacagattctctgcttggggg

SEQ ID NO: 718245 - DNA, 22 bp, Artificial Sequence
  chemically synthesized
tacaaatagtaattacactcac

SEQ ID NO: 718246 - DNA, 22 bp, Artificial Sequence
  chemically synthesized
tctgcttgggggtgagtgtaat

SEQ ID NO: 718247 - DNA, 22 bp, Artificial Sequence
  chemically synthesized
tgtacaaatagtaattacactc

SEQ ID NO: 718248 - DNA, 22 bp, Artificial Sequence
  chemically synthesized
tgcttgggggtgagtgtaatta

SEQ ID NO: 718249 - DNA, 22 bp, Artificial Sequence
  chemically synthesized
tctgtacaaatagtaattacac

SEQ ID NO: 718250 - DNA, 22 bp, Artificial Sequence
  chemically synthesized
cttgggggtgagtgtaattact

SEQ ID NO: 718251 - DNA, 22 bp, Artificial Sequence
  chemically synthesized
ctctctgtacaaatagtaatta

SEQ ID NO: 718252 - DNA, 22 bp, Artificial Sequence
  chemically synthesized
gggggtgagtgtaattactatt

SEQ ID NO: 718253 - DNA, 22 bp, Artificial Sequence
  chemically synthesized
ggggtgagtgtaattactattt

SEQ ID NO: 718254 - DNA, 22 bp, Artificial Sequence
  chemically synthesized
tgctctctgtacaaatagtaat

SEQ ID NO: 718255 - DNA, 22 bp, Artificial Sequence
  chemically synthesized
actctgctctctgtacaaatag

SEQ ID NO: 718256 - DNA, 22 bp, Artificial Sequence
  chemically synthesized
gactctgctctctgtacaaata

SEQ ID NO: 718257 - DNA, 22 bp, Artificial Sequence
  chemically synthesized
accttgactctgctctctgtac

SEQ ID NO: 718258 - DNA, 22 bp, Artificial Sequence
  chemically synthesized
tgaccttgactctgctctctgt

SEQ ID NO: 718259 - DNA, 22 bp, Artificial Sequence
  chemically synthesized
ctgaccttgactctgctctctg

SEQ ID NO: 718260 - DNA, 22 bp, Artificial Sequence
  chemically synthesized
tctgaccttgactctgctctct

SEQ ID NO: 718261 - DNA, 22 bp, Artificial Sequence
  chemically synthesized
ctatttgtacagagagcagagt

SEQ ID NO: 718262 - DNA, 22 bp, Artificial Sequence
  chemically synthesized
tttgtacagagagcagagtcaa

SEQ ID NO: 718263 - DNA, 22 bp, Artificial Sequence
  chemically synthesized
tattttctgaccttgactctgc

SEQ ID NO: 718264 - DNA, 22 bp, Artificial Sequence
  chemically synthesized
gtacagagagcagagtcaaggt

SEQ ID NO: 718265 - DNA, 22 bp, Artificial Sequence
  chemically synthesized
ctgtattttctgaccttgactc

SEQ ID NO: 718266 - DNA, 22 bp, Artificial Sequence
  chemically synthesized
tacagagagcagagtcaaggtc

SEQ ID NO: 718267 - DNA, 22 bp, Artificial Sequence
  chemically synthesized
tcctgtattttctgaccttgac

SEQ ID NO: 718268 - DNA, 22 bp, Artificial Sequence
  chemically synthesized
atgggtccctctcctgtatttt

SEQ ID NO: 718269 - DNA, 22 bp, Artificial Sequence
  chemically synthesized
gatgggtccctctcctgtattt

SEQ ID NO: 718270 - DNA, 22 bp, Artificial Sequence
  chemically synthesized
gcttgatgggtccctctcctgt

SEQ ID NO: 718271 - DNA, 22 bp, Artificial Sequence
  chemically synthesized
agcttgatgggtccctctcctg

SEQ ID NO: 718272 - DNA, 22 bp, Artificial Sequence
  chemically synthesized
tagcttgatgggtccctctcct

SEQ ID NO: 718273 - DNA, 22 bp, Artificial Sequence
  chemically synthesized
ctttagcttgatgggtccctct

SEQ ID NO: 718274 - DNA, 22 bp, Artificial Sequence
  chemically synthesized
tactttagcttgatgggtccct

SEQ ID NO: 718275 - DNA, 22 bp, Artificial Sequence
  chemically synthesized
aagtcctctactttagcttgat

SEQ ID NO: 718276 - DNA, 22 bp, Artificial Sequence
  chemically synthesized
aaagtcctctactttagcttga

SEQ ID NO: 718277 - DNA, 22 bp, Artificial Sequence
  chemically synthesized
taaagtcctctactttagcttg

SEQ ID NO: 718278 - DNA, 22 bp, Artificial Sequence
  chemically synthesized
cccaaccactttaaagtcctct

SEQ ID NO: 718279 - DNA, 22 bp, Artificial Sequence
  chemically synthesized
aagtagaggactttaaagtggt

SEQ ID NO: 718280 - DNA, 22 bp, Artificial Sequence
  chemically synthesized
aataacaaaaactccccaacca

SEQ ID NO: 718281 - DNA, 22 bp, Artificial Sequence
  chemically synthesized
tgaataacaaaaactccccaac

SEQ ID NO: 718282 - DNA, 22 bp, Artificial Sequence
  chemically synthesized
ctgaataacaaaaactccccaa

SEQ ID NO: 718283 - DNA, 22 bp, Artificial Sequence
  chemically synthesized
taaagtggttggggagtttttg

SEQ ID NO: 718284 - DNA, 22 bp, Artificial Sequence
  chemically synthesized
aaagtggttggggagtttttgt

SEQ ID NO: 718285 - DNA, 22 bp, Artificial Sequence
  chemically synthesized
agcttctgaataacaaaaactc

SEQ ID NO: 718286 - DNA, 22 bp, Artificial Sequence
  chemically synthesized
aagtggttggggagtttttgtt

SEQ ID NO: 718287 - DNA, 22 bp, Artificial Sequence
  chemically synthesized
gagcttctgaataacaaaaact

SEQ ID NO: 718288 - DNA, 22 bp, Artificial Sequence
  chemically synthesized
accagtttgagcttctgaataa

SEQ ID NO: 718289 - DNA, 22 bp, Artificial Sequence
  chemically synthesized
gggagtttttgttattcagaag

SEQ ID NO: 718290 - DNA, 22 bp, Artificial Sequence
  chemically synthesized
ctgaccagtttgagcttctgaa

SEQ ID NO: 718291 - DNA, 22 bp, Artificial Sequence
  chemically synthesized
tcctgctgaccagtttgagctt

SEQ ID NO: 718292 - DNA, 22 bp, Artificial Sequence
  chemically synthesized
ttgttattcagaagctcaaact

SEQ ID NO: 718293 - DNA, 22 bp, Artificial Sequence
  chemically synthesized
gtcctgctgaccagtttgagct

SEQ ID NO: 718294 - DNA, 22 bp, Artificial Sequence
  chemically synthesized
tgttattcagaagctcaaactg

SEQ ID NO: 718295 - DNA, 22 bp, Artificial Sequence
  chemically synthesized
tgtcctgctgaccagtttgagc

SEQ ID NO: 718296 - DNA, 22 bp, Artificial Sequence
  chemically synthesized
gttattcagaagctcaaactgg

SEQ ID NO: 718297 - DNA, 22 bp, Artificial Sequence
  chemically synthesized
ttgtcctgctgaccagtttgag

SEQ ID NO: 718298 - DNA, 22 bp, Artificial Sequence
  chemically synthesized
ttattcagaagctcaaactggt

SEQ ID NO: 718299 - DNA, 22 bp, Artificial Sequence
  chemically synthesized
ttttgtcctgctgaccagtttg

SEQ ID NO: 718300 - DNA, 22 bp, Artificial Sequence
  chemically synthesized
ttcagaagctcaaactggtcag

SEQ ID NO: 718301 - DNA, 22 bp, Artificial Sequence
  chemically synthesized
agaagctcaaactggtcagcag

SEQ ID NO: 718302 - DNA, 22 bp, Artificial Sequence
  chemically synthesized
tatattcttttgtcctgctgac

SEQ ID NO: 718303 - DNA, 22 bp, Artificial Sequence
  chemically synthesized
tgtatattcttttgtcctgctg

SEQ ID NO: 718304 - DNA, 22 bp, Artificial Sequence
  chemically synthesized
aaactggtcagcaggacaaaag

SEQ ID NO: 718305 - DNA, 22 bp, Artificial Sequence
  chemically synthesized
actctgtatattcttttgtcct

SEQ ID NO: 718306 - DNA, 22 bp, Artificial Sequence
  chemically synthesized
gtcagcaggacaaaagaatata

SEQ ID NO: 718307 - DNA, 22 bp, Artificial Sequence
  chemically synthesized
cccataccctgactctgtatat

SEQ ID NO: 718308 - DNA, 22 bp, Artificial Sequence
  chemically synthesized
gcccctgcccataccctgactc

SEQ ID NO: 718309 - DNA, 22 bp, Artificial Sequence
  chemically synthesized
gatattggcccctgcccatacc

SEQ ID NO: 718310 - DNA, 22 bp, Artificial Sequence
  chemically synthesized
gatattggatattggcccctgc

SEQ ID NO: 718311 - DNA, 22 bp, Artificial Sequence
  chemically synthesized
tggatattggatattggcccct

SEQ ID NO: 718312 - DNA, 22 bp, Artificial Sequence
  chemically synthesized
ctggatattggatattggcccc

SEQ ID NO: 718313 - DNA, 22 bp, Artificial Sequence
  chemically synthesized
gacaggaatttctggatattgg

SEQ ID NO: 718314 - DNA, 22 bp, Artificial Sequence
  chemically synthesized
ctagacaggaatttctggatat

SEQ ID NO: 718315 - DNA, 22 bp, Artificial Sequence
  chemically synthesized
gctagacaggaatttctggata

SEQ ID NO: 718316 - DNA, 22 bp, Artificial Sequence
  chemically synthesized
ttgctagacaggaatttctgga

SEQ ID NO: 718317 - DNA, 22 bp, Artificial Sequence
  chemically synthesized
cattcttgctagacaggaattt

SEQ ID NO: 718318 - DNA, 22 bp, Artificial Sequence
  chemically synthesized
tccattcttgctagacaggaat

SEQ ID NO: 718319 - DNA, 22 bp, Artificial Sequence
  chemically synthesized
ctctccattcttgctagacagg

SEQ ID NO: 718320 - DNA, 22 bp, Artificial Sequence
  chemically synthesized
cctctccattcttgctagacag

SEQ ID NO: 718321 - DNA, 22 bp, Artificial Sequence
  chemically synthesized
acatttcctctccattcttgct

SEQ ID NO: 718322 - DNA, 22 bp, Artificial Sequence
  chemically synthesized
tgacatttcctctccattcttg

SEQ ID NO: 718323 - DNA, 22 bp, Artificial Sequence
  chemically synthesized
ctgtctagcaagaatggagagg

SEQ ID NO: 718324 - DNA, 22 bp, Artificial Sequence
  chemically synthesized
tctagcaagaatggagaggaaa

SEQ ID NO: 718325 - DNA, 22 bp, Artificial Sequence
  chemically synthesized
gcaagaatggagaggaaatgtc

SEQ ID NO: 718326 - DNA, 22 bp, Artificial Sequence
  chemically synthesized
caacccatgctctgacatttcc

SEQ ID NO: 718327 - DNA, 22 bp, Artificial Sequence
  chemically synthesized
caaattccaacccatgctctga

SEQ ID NO: 718328 - DNA, 22 bp, Artificial Sequence
  chemically synthesized
attccaaattccaacccatgct

SEQ ID NO: 718329 - DNA, 22 bp, Artificial Sequence
  chemically synthesized
cattccaaattccaacccatgc

SEQ ID NO: 718330 - DNA, 22 bp, Artificial Sequence
  chemically synthesized
atataacttcattccaaattcc

SEQ ID NO: 718331 - DNA, 22 bp, Artificial Sequence
  chemically synthesized
ctcatataacttcattccaaat

SEQ ID NO: 718332 - DNA, 22 bp, Artificial Sequence
  chemically synthesized
cctcatataacttcattccaaa

SEQ ID NO: 718333 - DNA, 22 bp, Artificial Sequence
  chemically synthesized
tttcctcatataacttcattcc

SEQ ID NO: 718334 - DNA, 22 bp, Artificial Sequence
  chemically synthesized
tctgtttcctcatataacttca

SEQ ID NO: 718335 - DNA, 22 bp, Artificial Sequence
  chemically synthesized
gtctgtttcctcatataacttc

SEQ ID NO: 718336 - DNA, 22 bp, Artificial Sequence
  chemically synthesized
gaatttggaatgaagttatatg

SEQ ID NO: 718337 - DNA, 22 bp, Artificial Sequence
  chemically synthesized
taccttgtctgtttcctcatat

SEQ ID NO: 718338 - DNA, 22 bp, Artificial Sequence
  chemically synthesized
ggaatgaagttatatgaggaaa

SEQ ID NO: 718339 - DNA, 22 bp, Artificial Sequence
  chemically synthesized
gtaccttgtctgtttcctcata

SEQ ID NO: 718340 - DNA, 22 bp, Artificial Sequence
  chemically synthesized
gaatgaagttatatgaggaaac

SEQ ID NO: 718341 - DNA, 22 bp, Artificial Sequence
  chemically synthesized
tgtaccttgtctgtttcctcat

SEQ ID NO: 718342 - DNA, 22 bp, Artificial Sequence
  chemically synthesized
gtcacgttttgtaccttgtctg

SEQ ID NO: 718343 - DNA, 22 bp, Artificial Sequence
  chemically synthesized
ggtcacgttttgtaccttgtct

SEQ ID NO: 718344 - DNA, 22 bp, Artificial Sequence
  chemically synthesized
tatgaggaaacagacaaggtac

SEQ ID NO: 718345 - DNA, 22 bp, Artificial Sequence
  chemically synthesized
ttggtcacgttttgtaccttgt

SEQ ID NO: 718346 - DNA, 22 bp, Artificial Sequence
  chemically synthesized
cttggtcacgttttgtaccttg

SEQ ID NO: 718347 - DNA, 22 bp, Artificial Sequence
  chemically synthesized
caacttcttggtcacgttttgt

SEQ ID NO: 718348 - DNA, 22 bp, Artificial Sequence
  chemically synthesized
cagtggcacctccaacttcttg

SEQ ID NO: 718349 - DNA, 22 bp, Artificial Sequence
  chemically synthesized
gcagtggcacctccaacttctt

SEQ ID NO: 718350 - DNA, 22 bp, Artificial Sequence
  chemically synthesized
tgcagtggcacctccaacttct

SEQ ID NO: 718351 - DNA, 22 bp, Artificial Sequence
  chemically synthesized
caaattttgcagtggcacctcc

SEQ ID NO: 718352 - DNA, 22 bp, Artificial Sequence
  chemically synthesized
ttccaaattttgcagtggcacc

SEQ ID NO: 718353 - DNA, 22 bp, Artificial Sequence
  chemically synthesized
attccaaattttgcagtggcac

SEQ ID NO: 718354 - DNA, 22 bp, Artificial Sequence
  chemically synthesized
tattccaaattttgcagtggca

SEQ ID NO: 718355 - DNA, 22 bp, Artificial Sequence
  chemically synthesized
ttattccaaattttgcagtggc

SEQ ID NO: 718356 - DNA, 22 bp, Artificial Sequence
  chemically synthesized
ccccttttattccaaattttgc

SEQ ID NO: 718357 - DNA, 22 bp, Artificial Sequence
  chemically synthesized
gaggtgccactgcaaaatttgg

SEQ ID NO: 718358 - DNA, 22 bp, Artificial Sequence
  chemically synthesized
gcactaccccttttattccaaa

SEQ ID NO: 718359 - DNA, 22 bp, Artificial Sequence
  chemically synthesized
ggcactaccccttttattccaa

SEQ ID NO: 718360 - DNA, 22 bp, Artificial Sequence
  chemically synthesized
ccttggcactaccccttttatt

SEQ ID NO: 718361 - DNA, 22 bp, Artificial Sequence
  chemically synthesized
caaaatttggaataaaaggggt

SEQ ID NO: 718362 - DNA, 22 bp, Artificial Sequence
  chemically synthesized
agacctgccttggcactacccc

SEQ ID NO: 718363 - DNA, 22 bp, Artificial Sequence
  chemically synthesized
ggaataaaaggggtagtgccaa

SEQ ID NO: 718364 - DNA, 22 bp, Artificial Sequence
  chemically synthesized
gaataaaaggggtagtgccaag

SEQ ID NO: 718365 - DNA, 22 bp, Artificial Sequence
  chemically synthesized
ggatcagtcctcagacctgcct

SEQ ID NO: 718366 - DNA, 22 bp, Artificial Sequence
  chemically synthesized
aggatcagtcctcagacctgcc

SEQ ID NO: 718367 - DNA, 22 bp, Artificial Sequence
  chemically synthesized
gcttaggatcagtcctcagacc

SEQ ID NO: 718368 - DNA, 22 bp, Artificial Sequence
  chemically synthesized
aggactgatcctaagccagtgg

SEQ ID NO: 718369 - DNA, 22 bp, Artificial Sequence
  chemically synthesized
ggacagaagaaacaaccactgg

SEQ ID NO: 718370 - DNA, 22 bp, Artificial Sequence
  chemically synthesized
atcctaagccagtggttgtttc

SEQ ID NO: 718371 - DNA, 22 bp, Artificial Sequence
  chemically synthesized
aaactaggacagaagaaacaac

SEQ ID NO: 718372 - DNA, 22 bp, Artificial Sequence
  chemically synthesized
aaaactaggacagaagaaacaa

SEQ ID NO: 718373 - DNA, 22 bp, Artificial Sequence
  chemically synthesized
agccagtggttgtttcttctgt

SEQ ID NO: 718374 - DNA, 22 bp, Artificial Sequence
  chemically synthesized
cttaaaactaggacagaagaaa

SEQ ID NO: 718375 - DNA, 22 bp, Artificial Sequence
  chemically synthesized
ggaaagctgcttaaaactagga

SEQ ID NO: 718376 - DNA, 22 bp, Artificial Sequence
  chemically synthesized
tttcttctgtcctagttttaag

SEQ ID NO: 718377 - DNA, 22 bp, Artificial Sequence
  chemically synthesized
actaggaaagctgcttaaaact

SEQ ID NO: 718378 - DNA, 22 bp, Artificial Sequence
  chemically synthesized
cttctgtcctagttttaagcag

SEQ ID NO: 718379 - DNA, 22 bp, Artificial Sequence
  chemically synthesized
ttctgtcctagttttaagcagc

SEQ ID NO: 718380 - DNA, 22 bp, Artificial Sequence
  chemically synthesized
ctgtcctagttttaagcagctt

SEQ ID NO: 718381 - DNA, 22 bp, Artificial Sequence
  chemically synthesized
tgtcctagttttaagcagcttt

SEQ ID NO: 718382 - DNA, 22 bp, Artificial Sequence
  chemically synthesized
tcctagttttaagcagctttcc

SEQ ID NO: 718383 - DNA, 22 bp, Artificial Sequence
  chemically synthesized
atccaccctcactaggaaagct

SEQ ID NO: 718384 - DNA, 22 bp, Artificial Sequence
  chemically synthesized
gttttaagcagctttcctagtg

SEQ ID NO: 718385 - DNA, 22 bp, Artificial Sequence
  chemically synthesized
gccctcatccaccctcactagg

SEQ ID NO: 718386 - DNA, 22 bp, Artificial Sequence
  chemically synthesized
taagcagctttcctagtgaggg

SEQ ID NO: 718387 - DNA, 22 bp, Artificial Sequence
  chemically synthesized
ggccctcatccaccctcactag

SEQ ID NO: 718388 - DNA, 22 bp, Artificial Sequence
  chemically synthesized
aagcagctttcctagtgagggt

SEQ ID NO: 718389 - DNA, 22 bp, Artificial Sequence
  chemically synthesized
agcagctttcctagtgagggtg

SEQ ID NO: 718390 - DNA, 22 bp, Artificial Sequence
  chemically synthesized
ttggccctcatccaccctcact

SEQ ID NO: 718391 - DNA, 22 bp, Artificial Sequence
  chemically synthesized
tcctagtgagggtggatgaggg

SEQ ID NO: 718392 - DNA, 22 bp, Artificial Sequence
  chemically synthesized
cctagtgagggtggatgagggc

SEQ ID NO: 718393 - DNA, 22 bp, Artificial Sequence
  chemically synthesized
ctagtgagggtggatgagggcc

SEQ ID NO: 718394 - DNA, 22 bp, Artificial Sequence
  chemically synthesized
gtgagggtggatgagggccaag

SEQ ID NO: 718395 - DNA, 22 bp, Artificial Sequence
  chemically synthesized
gggagaagcccagtgctcttgg

SEQ ID NO: 718396 - DNA, 22 bp, Artificial Sequence
  chemically synthesized
tggggagaagcccagtgctctt

SEQ ID NO: 718397 - DNA, 22 bp, Artificial Sequence
  chemically synthesized
tgtgactctggggagaagccca

SEQ ID NO: 718398 - DNA, 22 bp, Artificial Sequence
  chemically synthesized
cagaatcctgtgtgactctggg

SEQ ID NO: 718399 - DNA, 22 bp, Artificial Sequence
  chemically synthesized
ggcttctccccagagtcacaca

SEQ ID NO: 718400 - DNA, 22 bp, Artificial Sequence
  chemically synthesized
aaacctgcagaatcctgtgtga

SEQ ID NO: 718401 - DNA, 22 bp, Artificial Sequence
  chemically synthesized
ctccccagagtcacacaggatt

SEQ ID NO: 718402 - DNA, 22 bp, Artificial Sequence
  chemically synthesized
tccccagagtcacacaggattc

SEQ ID NO: 718403 - DNA, 22 bp, Artificial Sequence
  chemically synthesized
cccagagtcacacaggattctg

SEQ ID NO: 718404 - DNA, 22 bp, Artificial Sequence
  chemically synthesized
taatcattaaaacctgcagaat

SEQ ID NO: 718405 - DNA, 22 bp, Artificial Sequence
  chemically synthesized
ctgtaatcattaaaacctgcag

SEQ ID NO: 718406 - DNA, 22 bp, Artificial Sequence
  chemically synthesized
tgctgtaatcattaaaacctgc

SEQ ID NO: 718407 - DNA, 22 bp, Artificial Sequence
  chemically synthesized
tctgctgtaatcattaaaacct

SEQ ID NO: 718408 - DNA, 22 bp, Artificial Sequence
  chemically synthesized
tctctgctgtaatcattaaaac

SEQ ID NO: 718409 - DNA, 22 bp, Artificial Sequence
  chemically synthesized
tgcaggttttaatgattacagc

SEQ ID NO: 718410 - DNA, 22 bp, Artificial Sequence
  chemically synthesized
caggttttaatgattacagcag

SEQ ID NO: 718411 - DNA, 22 bp, Artificial Sequence
  chemically synthesized
caggggaccaagctctctctgc

SEQ ID NO: 718412 - DNA, 22 bp, Artificial Sequence
  chemically synthesized
taatgattacagcagagagagc

SEQ ID NO: 718413 - DNA, 22 bp, Artificial Sequence
  chemically synthesized
ccaggggaccaagctctctctg

SEQ ID NO: 718414 - DNA, 22 bp, Artificial Sequence
  chemically synthesized
aatgattacagcagagagagct

SEQ ID NO: 718415 - DNA, 22 bp, Artificial Sequence
  chemically synthesized
tccaggggaccaagctctctct

SEQ ID NO: 718416 - DNA, 22 bp, Artificial Sequence
  chemically synthesized
atgattacagcagagagagctt

SEQ ID NO: 718417 - DNA, 22 bp, Artificial Sequence
  chemically synthesized
cagcagagagagcttggtcccc

SEQ ID NO: 718418 - DNA, 22 bp, Artificial Sequence
  chemically synthesized
gaaccgcaagggctttccaggg

SEQ ID NO: 718419 - DNA, 22 bp, Artificial Sequence
  chemically synthesized
ggttagaaccgcaagggctttc

SEQ ID NO: 718420 - DNA, 22 bp, Artificial Sequence
  chemically synthesized
ggtcccctggaaagcccttgcg

SEQ ID NO: 718421 - DNA, 22 bp, Artificial Sequence
  chemically synthesized
ctgggttagaaccgcaagggct

SEQ ID NO: 718422 - DNA, 22 bp, Artificial Sequence
  chemically synthesized
gtcccctggaaagcccttgcgg

SEQ ID NO: 718423 - DNA, 22 bp, Artificial Sequence
  chemically synthesized
gctgggttagaaccgcaagggc

SEQ ID NO: 718424 - DNA, 22 bp, Artificial Sequence
  chemically synthesized
tgctgggttagaaccgcaaggg

SEQ ID NO: 718425 - DNA, 22 bp, Artificial Sequence
  chemically synthesized
gaaagcccttgcggttctaacc

SEQ ID NO: 718426 - DNA, 22 bp, Artificial Sequence
  chemically synthesized
aatgcattttgctgggttagaa

SEQ ID NO: 718427 - DNA, 22 bp, Artificial Sequence
  chemically synthesized
gcggttctaacccagcaaaatg

SEQ ID NO: 718428 - DNA, 22 bp, Artificial Sequence
  chemically synthesized
tcagattcaatgcattttgctg

SEQ ID NO: 718429 - DNA, 22 bp, Artificial Sequence
  chemically synthesized
cggttctaacccagcaaaatgc

SEQ ID NO: 718430 - DNA, 22 bp, Artificial Sequence
  chemically synthesized
gcctgtcagattcaatgcattt

SEQ ID NO: 718431 - DNA, 22 bp, Artificial Sequence
  chemically synthesized
taacccagcaaaatgcattgaa

SEQ ID NO: 718432 - DNA, 22 bp, Artificial Sequence
  chemically synthesized
acccagcaaaatgcattgaatc

SEQ ID NO: 718433 - DNA, 22 bp, Artificial Sequence
  chemically synthesized
aatctgacaggccagcatttac

SEQ ID NO: 718434 - DNA, 22 bp, Artificial Sequence
  chemically synthesized
gcatcagaggtggtaaatgctg

SEQ ID NO: 718435 - DNA, 22 bp, Artificial Sequence
  chemically synthesized
acaggccagcatttaccacctc

SEQ ID NO: 718436 - DNA, 22 bp, Artificial Sequence
  chemically synthesized
cccatgcactggcatcagaggt

SEQ ID NO: 718437 - DNA, 22 bp, Artificial Sequence
  chemically synthesized
ccccatgcactggcatcagagg

SEQ ID NO: 718438 - DNA, 22 bp, Artificial Sequence
  chemically synthesized
tccccatgcactggcatcagag

SEQ ID NO: 718439 - DNA, 22 bp, Artificial Sequence
  chemically synthesized
ttccccatgcactggcatcaga

SEQ ID NO: 718440 - DNA, 22 bp, Artificial Sequence
  chemically synthesized
tttttccccatgcactggcatc

SEQ ID NO: 718441 - DNA, 22 bp, Artificial Sequence
  chemically synthesized
gtttttccccatgcactggcat

SEQ ID NO: 718442 - DNA, 22 bp, Artificial Sequence
  chemically synthesized
accacctctgatgccagtgcat

SEQ ID NO: 718443 - DNA, 22 bp, Artificial Sequence
  chemically synthesized
ccacctctgatgccagtgcatg

SEQ ID NO: 718444 - DNA, 22 bp, Artificial Sequence
  chemically synthesized
tgatgccagtgcatggggaaaa

SEQ ID NO: 718445 - DNA, 22 bp, Artificial Sequence
  chemically synthesized
atgccagtgcatggggaaaaac

SEQ ID NO: 718446 - DNA, 22 bp, Artificial Sequence
  chemically synthesized
caaatggggcaatttgtttttc

SEQ ID NO: 718447 - DNA, 22 bp, Artificial Sequence
  chemically synthesized
gcaaatggggcaatttgttttt

SEQ ID NO: 718448 - DNA, 22 bp, Artificial Sequence
  chemically synthesized
agtttgcaaatggggcaatttg

SEQ ID NO: 718449 - DNA, 22 bp, Artificial Sequence
  chemically synthesized
catatatgtactaagtttgcaa

SEQ ID NO: 718450 - DNA, 22 bp, Artificial Sequence
  chemically synthesized
actgcatatatgtactaagttt

SEQ ID NO: 718451 - DNA, 22 bp, Artificial Sequence
  chemically synthesized
ccccatttgcaaacttagtaca

SEQ ID NO: 718452 - DNA, 22 bp, Artificial Sequence
  chemically synthesized
ctaactgcatatatgtactaag

SEQ ID NO: 718453 - DNA, 22 bp, Artificial Sequence
  chemically synthesized
gcaaacttagtacatatatgca

SEQ ID NO: 718454 - DNA, 22 bp, Artificial Sequence
  chemically synthesized
caaacttagtacatatatgcag

SEQ ID NO: 718455 - DNA, 22 bp, Artificial Sequence
  chemically synthesized
agtacatatatgcagttaggag

SEQ ID NO: 718456 - DNA, 22 bp, Artificial Sequence
  chemically synthesized
gtacatatatgcagttaggagt

SEQ ID NO: 718457 - DNA, 22 bp, Artificial Sequence
  chemically synthesized
tgtaacgagtagagcaactcct

SEQ ID NO: 718458 - DNA, 22 bp, Artificial Sequence
  chemically synthesized
gtgtaacgagtagagcaactcc

SEQ ID NO: 718459 - DNA, 22 bp, Artificial Sequence
  chemically synthesized
tgtgtaacgagtagagcaactc

SEQ ID NO: 718460 - DNA, 22 bp, Artificial Sequence
  chemically synthesized
ttgtgtaacgagtagagcaact

SEQ ID NO: 718461 - DNA, 22 bp, Artificial Sequence
  chemically synthesized
tttgtgtaacgagtagagcaac

SEQ ID NO: 718462 - DNA, 22 bp, Artificial Sequence
  chemically synthesized
ggagttgctctactcgttacac

SEQ ID NO: 718463 - DNA, 22 bp, Artificial Sequence
  chemically synthesized
taaaatctttttgtgtaacgag

SEQ ID NO: 718464 - DNA, 22 bp, Artificial Sequence
  chemically synthesized
ataaaatctttttgtgtaacga

SEQ ID NO: 718465 - DNA, 22 bp, Artificial Sequence
  chemically synthesized
cttataaaatctttttgtgtaa

SEQ ID NO: 718466 - DNA, 22 bp, Artificial Sequence
  chemically synthesized
acttataaaatctttttgtgta

SEQ ID NO: 718467 - DNA, 22 bp, Artificial Sequence
  chemically synthesized
tacttataaaatctttttgtgt

SEQ ID NO: 718468 - DNA, 22 bp, Artificial Sequence
  chemically synthesized
ctctactcgttacacaaaaaga

SEQ ID NO: 718469 - DNA, 22 bp, Artificial Sequence
  chemically synthesized
ttacttataaaatctttttgtg

SEQ ID NO: 718470 - DNA, 22 bp, Artificial Sequence
  chemically synthesized
tttacttataaaatctttttgt

SEQ ID NO: 718471 - DNA, 22 bp, Artificial Sequence
  chemically synthesized
tactcgttacacaaaaagattt

SEQ ID NO: 718472 - DNA, 22 bp, Artificial Sequence
  chemically synthesized
ctcgttacacaaaaagatttta

SEQ ID NO: 718473 - DNA, 22 bp, Artificial Sequence
  chemically synthesized
gttacacaaaaagattttataa

SEQ ID NO: 718474 - DNA, 22 bp, Artificial Sequence
  chemically synthesized
agtattttttacttataaaatc

SEQ ID NO: 718475 - DNA, 22 bp, Artificial Sequence
  chemically synthesized
aagtattttttacttataaaat

SEQ ID NO: 718476 - DNA, 22 bp, Artificial Sequence
  chemically synthesized
taagtattttttacttataaaa

SEQ ID NO: 718477 - DNA, 22 bp, Artificial Sequence
  chemically synthesized
cacaaaaagattttataagtaa

SEQ ID NO: 718478 - DNA, 22 bp, Artificial Sequence
  chemically synthesized
gtgccagactttaagtattttt

SEQ ID NO: 718479 - DNA, 22 bp, Artificial Sequence
  chemically synthesized
agtgccagactttaagtatttt

SEQ ID NO: 718480 - DNA, 22 bp, Artificial Sequence
  chemically synthesized
tataagtaaaaaatacttaaag

SEQ ID NO: 718481 - DNA, 22 bp, Artificial Sequence
  chemically synthesized
ataagtaaaaaatacttaaagt

SEQ ID NO: 718482 - DNA, 22 bp, Artificial Sequence
  chemically synthesized
taagtaaaaaatacttaaagtc

SEQ ID NO: 718483 - DNA, 22 bp, Artificial Sequence
  chemically synthesized
aaagtctggcactaagtttcta

SEQ ID NO: 718484 - DNA, 22 bp, Artificial Sequence
  chemically synthesized
aagtctggcactaagtttctac

SEQ ID NO: 718485 - DNA, 22 bp, Artificial Sequence
  chemically synthesized
gcactaagtttctactccctgt

SEQ ID NO: 718486 - DNA, 22 bp, Artificial Sequence
  chemically synthesized
agtttctactccctgtttgttt

SEQ ID NO: 718487 - DNA, 22 bp, Artificial Sequence
  chemically synthesized
ctactccctgtttgttttgatt

SEQ ID NO: 718488 - DNA, 22 bp, Artificial Sequence
  chemically synthesized
tactccctgtttgttttgattt

SEQ ID NO: 718489 - DNA, 22 bp, Artificial Sequence
  chemically synthesized
ctccctgtttgttttgattttg

SEQ ID NO: 718490 - DNA, 22 bp, Artificial Sequence
  chemically synthesized
cctgtttgttttgattttgata

SEQ ID NO: 718491 - DNA, 22 bp, Artificial Sequence
  chemically synthesized
gaatagagtacaggtatcaaaa

SEQ ID NO: 718492 - DNA, 22 bp, Artificial Sequence
  chemically synthesized
agaatagagtacaggtatcaaa

SEQ ID NO: 718493 - DNA, 22 bp, Artificial Sequence
  chemically synthesized
tttgttttgattttgatacctg

SEQ ID NO: 718494 - DNA, 22 bp, Artificial Sequence
  chemically synthesized
tagaatagagtacaggtatcaa

SEQ ID NO: 718495 - DNA, 22 bp, Artificial Sequence
  chemically synthesized
gttttgattttgatacctgtac

SEQ ID NO: 718496 - DNA, 22 bp, Artificial Sequence
  chemically synthesized
ttttgattttgatacctgtact

SEQ ID NO: 718497 - DNA, 22 bp, Artificial Sequence
  chemically synthesized
tgattttgatacctgtactcta

SEQ ID NO: 718498 - DNA, 22 bp, Artificial Sequence
  chemically synthesized
gattttgatacctgtactctat

SEQ ID NO: 718499 - DNA, 22 bp, Artificial Sequence
  chemically synthesized
attttgatacctgtactctatt

SEQ ID NO: 718500 - DNA, 22 bp, Artificial Sequence
  chemically synthesized
ccaagtctttagaatagagtac

SEQ ID NO: 718501 - DNA, 22 bp, Artificial Sequence
  chemically synthesized
tgatacctgtactctattctaa

SEQ ID NO: 718502 - DNA, 22 bp, Artificial Sequence
  chemically synthesized
actaccaagtctttagaataga

SEQ ID NO: 718503 - DNA, 22 bp, Artificial Sequence
  chemically synthesized
gatacctgtactctattctaaa

SEQ ID NO: 718504 - DNA, 22 bp, Artificial Sequence
  chemically synthesized
atacctgtactctattctaaag

SEQ ID NO: 718505 - DNA, 22 bp, Artificial Sequence
  chemically synthesized
tcactaccaagtctttagaata

SEQ ID NO: 718506 - DNA, 22 bp, Artificial Sequence
  chemically synthesized
ctctcactaccaagtctttaga

SEQ ID NO: 718507 - DNA, 22 bp, Artificial Sequence
  chemically synthesized
tactctcactaccaagtcttta

SEQ ID NO: 718508 - DNA, 22 bp, Artificial Sequence
  chemically synthesized
tactctattctaaagacttggt

SEQ ID NO: 718509 - DNA, 22 bp, Artificial Sequence
  chemically synthesized
ccgctctactctcactaccaag

SEQ ID NO: 718510 - DNA, 22 bp, Artificial Sequence
  chemically synthesized
tattctaaagacttggtagtga

SEQ ID NO: 718511 - DNA, 22 bp, Artificial Sequence
  chemically synthesized
ttctaaagacttggtagtgaga

SEQ ID NO: 718512 - DNA, 22 bp, Artificial Sequence
  chemically synthesized
taaagacttggtagtgagagta

SEQ ID NO: 718513 - DNA, 22 bp, Artificial Sequence
  chemically synthesized
aagacttggtagtgagagtaga

SEQ ID NO: 718514 - DNA, 22 bp, Artificial Sequence
  chemically synthesized
cccccgccacctcccgctctac

SEQ ID NO: 718515 - DNA, 22 bp, Artificial Sequence
  chemically synthesized
ggtagtgagagtagagcgggag

SEQ ID NO: 718516 - DNA, 22 bp, Artificial Sequence
  chemically synthesized
gtagtgagagtagagcgggagg

SEQ ID NO: 718517 - DNA, 22 bp, Artificial Sequence
  chemically synthesized
aattccccccgccacctcccgc

SEQ ID NO: 718518 - DNA, 22 bp, Artificial Sequence
  chemically synthesized
ggaggcattcaattccccccgc

SEQ ID NO: 718519 - DNA, 22 bp, Artificial Sequence
  chemically synthesized
gggaggcattcaattccccccg

SEQ ID NO: 718520 - DNA, 22 bp, Artificial Sequence
  chemically synthesized
aaatacttgggaggcattcaat

SEQ ID NO: 718521 - DNA, 22 bp, Artificial Sequence
  chemically synthesized
caaatacttgggaggcattcaa

SEQ ID NO: 718522 - DNA, 22 bp, Artificial Sequence
  chemically synthesized
aatgcctcccaagtatttgaag

SEQ ID NO: 718523 - DNA, 22 bp, Artificial Sequence
  chemically synthesized
gcaaagacagcccttcaaatac

SEQ ID NO: 718524 - DNA, 22 bp, Artificial Sequence
  chemically synthesized
ggcaaagacagcccttcaaata

SEQ ID NO: 718525 - DNA, 22 bp, Artificial Sequence
  chemically synthesized
ttggcaaagacagcccttcaaa

SEQ ID NO: 718526 - DNA, 22 bp, Artificial Sequence
  chemically synthesized
ccaagtatttgaagggctgtct

SEQ ID NO: 718527 - DNA, 22 bp, Artificial Sequence
  chemically synthesized
gaagggctgtctttgccaagag

SEQ ID NO: 718528 - DNA, 22 bp, Artificial Sequence
  chemically synthesized
aagggctgtctttgccaagagg

SEQ ID NO: 718529 - DNA, 22 bp, Artificial Sequence
  chemically synthesized
tctttgccaagagggtttacac

SEQ ID NO: 718530 - DNA, 22 bp, Artificial Sequence
  chemically synthesized
tgccaagagggtttacacttac

SEQ ID NO: 718531 - DNA, 22 bp, Artificial Sequence
  chemically synthesized
gaaatatacacagtaagtgtaa

SEQ ID NO: 718532 - DNA, 22 bp, Artificial Sequence
  chemically synthesized
gccaagagggtttacacttact

SEQ ID NO: 718533 - DNA, 22 bp, Artificial Sequence
  chemically synthesized
ggaaatatacacagtaagtgta

SEQ ID NO: 718534 - DNA, 22 bp, Artificial Sequence
  chemically synthesized
ccaagagggtttacacttactg

SEQ ID NO: 718535 - DNA, 22 bp, Artificial Sequence
  chemically synthesized
tggaaatatacacagtaagtgt

SEQ ID NO: 718536 - DNA, 22 bp, Artificial Sequence
  chemically synthesized
tatgtatgctttggaaatatac

SEQ ID NO: 718537 - DNA, 22 bp, Artificial Sequence
  chemically synthesized
acacttactgtgtatatttcca

SEQ ID NO: 718538 - DNA, 22 bp, Artificial Sequence
  chemically synthesized
cacttactgtgtatatttccaa

SEQ ID NO: 718539 - DNA, 22 bp, Artificial Sequence
  chemically synthesized
tctatatgtatgctttggaaat

SEQ ID NO: 718540 - DNA, 22 bp, Artificial Sequence
  chemically synthesized
tgtctatatgtatgctttggaa

SEQ ID NO: 718541 - DNA, 22 bp, Artificial Sequence
  chemically synthesized
actgtgtatatttccaaagcat

SEQ ID NO: 718542 - DNA, 22 bp, Artificial Sequence
  chemically synthesized
ctgtctatatgtatgctttgga

SEQ ID NO: 718543 - DNA, 22 bp, Artificial Sequence
  chemically synthesized
ctgtgtatatttccaaagcata

SEQ ID NO: 718544 - DNA, 22 bp, Artificial Sequence
  chemically synthesized
tctgtctatatgtatgctttgg

SEQ ID NO: 718545 - DNA, 22 bp, Artificial Sequence
  chemically synthesized
tgtatatttccaaagcatacat

SEQ ID NO: 718546 - DNA, 22 bp, Artificial Sequence
  chemically synthesized
cctttctgtctatatgtatgct

SEQ ID NO: 718547 - DNA, 22 bp, Artificial Sequence
  chemically synthesized
tgcctttctgtctatatgtatg

SEQ ID NO: 718548 - DNA, 22 bp, Artificial Sequence
  chemically synthesized
ccaaagcatacatatagacaga

SEQ ID NO: 718549 - DNA, 22 bp, Artificial Sequence
  chemically synthesized
caaagcatacatatagacagaa

SEQ ID NO: 718550 - DNA, 22 bp, Artificial Sequence
  chemically synthesized
ccataacctctgcctttctgtc

SEQ ID NO: 718551 - DNA, 22 bp, Artificial Sequence
  chemically synthesized
cccataacctctgcctttctgt

SEQ ID NO: 718552 - DNA, 22 bp, Artificial Sequence
  chemically synthesized
atcttcccataacctctgcctt

SEQ ID NO: 718553 - DNA, 22 bp, Artificial Sequence
  chemically synthesized
aagttgatcttcccataacctc

SEQ ID NO: 718554 - DNA, 22 bp, Artificial Sequence
  chemically synthesized
agctgaagttgatcttcccata

SEQ ID NO: 718555 - DNA, 22 bp, Artificial Sequence
  chemically synthesized
cattgagctgaagttgatcttc

SEQ ID NO: 718556 - DNA, 22 bp, Artificial Sequence
  chemically synthesized
gcattgagctgaagttgatctt

SEQ ID NO: 718557 - DNA, 22 bp, Artificial Sequence
  chemically synthesized
ttgcattgagctgaagttgatc

SEQ ID NO: 718558 - DNA, 22 bp, Artificial Sequence
  chemically synthesized
tctcttgcattgagctgaagtt

SEQ ID NO: 718559 - DNA, 22 bp, Artificial Sequence
  chemically synthesized
tgggaagatcaacttcagctca

SEQ ID NO: 718560 - DNA, 22 bp, Artificial Sequence
  chemically synthesized
ttatctcttgcattgagctgaa

SEQ ID NO: 718561 - DNA, 22 bp, Artificial Sequence
  chemically synthesized
ggctgttatctcttgcattgag

SEQ ID NO: 718562 - DNA, 22 bp, Artificial Sequence
  chemically synthesized
ataattaggctgttatctcttg

SEQ ID NO: 718563 - DNA, 22 bp, Artificial Sequence
  chemically synthesized
cagctcaatgcaagagataaca

SEQ ID NO: 718564 - DNA, 22 bp, Artificial Sequence
  chemically synthesized
agctcaatgcaagagataacag

SEQ ID NO: 718565 - DNA, 22 bp, Artificial Sequence
  chemically synthesized
aatgcaagagataacagcctaa

SEQ ID NO: 718566 - DNA, 22 bp, Artificial Sequence
  chemically synthesized
acaaacaccctaataattaggc

SEQ ID NO: 718567 - DNA, 22 bp, Artificial Sequence
  chemically synthesized
agttcacaaacaccctaataat

SEQ ID NO: 718568 - DNA, 22 bp, Artificial Sequence
  chemically synthesized
ttcagttcacaaacaccctaat

SEQ ID NO: 718569 - DNA, 22 bp, Artificial Sequence
  chemically synthesized
attattagggtgtttgtgaact

SEQ ID NO: 718570 - DNA, 22 bp, Artificial Sequence
  chemically synthesized
taaagcagcctgttcagttcac

SEQ ID NO: 718571 - DNA, 22 bp, Artificial Sequence
  chemically synthesized
ttagggtgtttgtgaactgaac

SEQ ID NO: 718572 - DNA, 22 bp, Artificial Sequence
  chemically synthesized
gtaaagcagcctgttcagttca

SEQ ID NO: 718573 - DNA, 22 bp, Artificial Sequence
  chemically synthesized
tgtaaagcagcctgttcagttc

SEQ ID NO: 718574 - DNA, 22 bp, Artificial Sequence
  chemically synthesized
gggtgtttgtgaactgaacagg

SEQ ID NO: 718575 - DNA, 22 bp, Artificial Sequence
  chemically synthesized
actttgtaaagcagcctgttca

SEQ ID NO: 718576 - DNA, 22 bp, Artificial Sequence
  chemically synthesized
ctcactttgtaaagcagcctgt

SEQ ID NO: 718577 - DNA, 22 bp, Artificial Sequence
  chemically synthesized
gtgaactgaacaggctgcttta

SEQ ID NO: 718578 - DNA, 22 bp, Artificial Sequence
  chemically synthesized
tgaactgaacaggctgctttac

SEQ ID NO: 718579 - DNA, 22 bp, Artificial Sequence
  chemically synthesized
aacaggctgctttacaaagtga

SEQ ID NO: 718580 - DNA, 22 bp, Artificial Sequence
  chemically synthesized
gtgatggggaactcctcacttt

SEQ ID NO: 718581 - DNA, 22 bp, Artificial Sequence
  chemically synthesized
agtgatggggaactcctcactt

SEQ ID NO: 718582 - DNA, 22 bp, Artificial Sequence
  chemically synthesized
ctttacaaagtgaggagttccc

SEQ ID NO: 718583 - DNA, 22 bp, Artificial Sequence
  chemically synthesized
aaacttagtgatggggaactcc

SEQ ID NO: 718584 - DNA, 22 bp, Artificial Sequence
  chemically synthesized
aaaacttagtgatggggaactc

SEQ ID NO: 718585 - DNA, 22 bp, Artificial Sequence
  chemically synthesized
tacaaagtgaggagttccccat

SEQ ID NO: 718586 - DNA, 22 bp, Artificial Sequence
  chemically synthesized
acaaagtgaggagttccccatc

SEQ ID NO: 718587 - DNA, 22 bp, Artificial Sequence
  chemically synthesized
caaagtgaggagttccccatca

SEQ ID NO: 718588 - DNA, 22 bp, Artificial Sequence
  chemically synthesized
ggcttaaaacttagtgatgggg

SEQ ID NO: 718589 - DNA, 22 bp, Artificial Sequence
  chemically synthesized
gcctaggcttaaaacttagtga

SEQ ID NO: 718590 - DNA, 22 bp, Artificial Sequence
  chemically synthesized
ggcctaggcttaaaacttagtg

SEQ ID NO: 718591 - DNA, 22 bp, Artificial Sequence
  chemically synthesized
tggcctaggcttaaaacttagt

SEQ ID NO: 718592 - DNA, 22 bp, Artificial Sequence
  chemically synthesized
cccatcactaagttttaagcct

SEQ ID NO: 718593 - DNA, 22 bp, Artificial Sequence
  chemically synthesized
gaaaacactttggcctaggctt

SEQ ID NO: 718594 - DNA, 22 bp, Artificial Sequence
  chemically synthesized
ctagaaaacactttggcctagg

SEQ ID NO: 718595 - DNA, 22 bp, Artificial Sequence
  chemically synthesized
tgctagaaaacactttggccta

SEQ ID NO: 718596 - DNA, 22 bp, Artificial Sequence
  chemically synthesized
agttttaagcctaggccaaagt

SEQ ID NO: 718597 - DNA, 22 bp, Artificial Sequence
  chemically synthesized
ctgctagaaaacactttggcct

SEQ ID NO: 718598 - DNA, 22 bp, Artificial Sequence
  chemically synthesized
taagcctaggccaaagtgtttt

SEQ ID NO: 718599 - DNA, 22 bp, Artificial Sequence
  chemically synthesized
aagcctaggccaaagtgttttc

SEQ ID NO: 718600 - DNA, 22 bp, Artificial Sequence
  chemically synthesized
agcctaggccaaagtgttttct

SEQ ID NO: 718601 - DNA, 22 bp, Artificial Sequence
  chemically synthesized
cacatttctgctagaaaacact

SEQ ID NO: 718602 - DNA, 22 bp, Artificial Sequence
  chemically synthesized
ccacatttctgctagaaaacac

SEQ ID NO: 718603 - DNA, 22 bp, Artificial Sequence
  chemically synthesized
ttccacatttctgctagaaaac

SEQ ID NO: 718604 - DNA, 22 bp, Artificial Sequence
  chemically synthesized
ggccaaagtgttttctagcaga

SEQ ID NO: 718605 - DNA, 22 bp, Artificial Sequence
  chemically synthesized
aggagttcttccacatttctgc

SEQ ID NO: 718606 - DNA, 22 bp, Artificial Sequence
  chemically synthesized
caggagttcttccacatttctg

SEQ ID NO: 718607 - DNA, 22 bp, Artificial Sequence
  chemically synthesized
tcaggagttcttccacatttct

SEQ ID NO: 718608 - DNA, 22 bp, Artificial Sequence
  chemically synthesized
tctagcagaaatgtggaagaac

SEQ ID NO: 718609 - DNA, 22 bp, Artificial Sequence
  chemically synthesized
ctagcagaaatgtggaagaact

SEQ ID NO: 718610 - DNA, 22 bp, Artificial Sequence
  chemically synthesized
aatcctttcaggagttcttcca

SEQ ID NO: 718611 - DNA, 22 bp, Artificial Sequence
  chemically synthesized
tagcagaaatgtggaagaactc

SEQ ID NO: 718612 - DNA, 22 bp, Artificial Sequence
  chemically synthesized
gcagaaatgtggaagaactcct

SEQ ID NO: 718613 - DNA, 22 bp, Artificial Sequence
  chemically synthesized
gtctaaatcctttcaggagttc

SEQ ID NO: 718614 - DNA, 22 bp, Artificial Sequence
  chemically synthesized
aagatctagtctaaatcctttc

SEQ ID NO: 718615 - DNA, 22 bp, Artificial Sequence
  chemically synthesized
caagatctagtctaaatccttt

SEQ ID NO: 718616 - DNA, 22 bp, Artificial Sequence
  chemically synthesized
ctgaaaggatttagactagatc

SEQ ID NO: 718617 - DNA, 22 bp, Artificial Sequence
  chemically synthesized
aaaggggccttcaagatctagt

SEQ ID NO: 718618 - DNA, 22 bp, Artificial Sequence
  chemically synthesized
aaaggatttagactagatcttg

SEQ ID NO: 718619 - DNA, 22 bp, Artificial Sequence
  chemically synthesized
ggttgaaaggggccttcaagat

SEQ ID NO: 718620 - DNA, 22 bp, Artificial Sequence
  chemically synthesized
aggttgaaaggggccttcaaga

SEQ ID NO: 718621 - DNA, 22 bp, Artificial Sequence
  chemically synthesized
agactagatcttgaaggcccct

SEQ ID NO: 718622 - DNA, 22 bp, Artificial Sequence
  chemically synthesized
gactagatcttgaaggcccctt

SEQ ID NO: 718623 - DNA, 22 bp, Artificial Sequence
  chemically synthesized
gatcttgaaggcccctttcaac

SEQ ID NO: 718624 - DNA, 22 bp, Artificial Sequence
  chemically synthesized
agtaataaaatcttaggttgaa

SEQ ID NO: 718625 - DNA, 22 bp, Artificial Sequence
  chemically synthesized
gagtaataaaatcttaggttga

SEQ ID NO: 718626 - DNA, 22 bp, Artificial Sequence
  chemically synthesized
gaaggcccctttcaacctaaga

SEQ ID NO: 718627 - DNA, 22 bp, Artificial Sequence
  chemically synthesized
aaggcccctttcaacctaagat

SEQ ID NO: 718628 - DNA, 22 bp, Artificial Sequence
  chemically synthesized
acaagtttgagtaataaaatct

SEQ ID NO: 718629 - DNA, 22 bp, Artificial Sequence
  chemically synthesized
aacaagtttgagtaataaaatc

SEQ ID NO: 718630 - DNA, 22 bp, Artificial Sequence
  chemically synthesized
tcaacctaagattttattactc

SEQ ID NO: 718631 - DNA, 22 bp, Artificial Sequence
  chemically synthesized
caacctaagattttattactca

SEQ ID NO: 718632 - DNA, 22 bp, Artificial Sequence
  chemically synthesized
aacctaagattttattactcaa

SEQ ID NO: 718633 - DNA, 22 bp, Artificial Sequence
  chemically synthesized
atcacatcttaacaagtttgag

SEQ ID NO: 718634 - DNA, 22 bp, Artificial Sequence
  chemically synthesized
agattttattactcaaacttgt

SEQ ID NO: 718635 - DNA, 22 bp, Artificial Sequence
  chemically synthesized
gtgttaatcacatcttaacaag

SEQ ID NO: 718636 - DNA, 22 bp, Artificial Sequence
  chemically synthesized
tattactcaaacttgttaagat

SEQ ID NO: 718637 - DNA, 22 bp, Artificial Sequence
  chemically synthesized
attactcaaacttgttaagatg

SEQ ID NO: 718638 - DNA, 22 bp, Artificial Sequence
  chemically synthesized
ttactcaaacttgttaagatgt

SEQ ID NO: 718639 - DNA, 22 bp, Artificial Sequence
  chemically synthesized
agctagtgttaatcacatctta

SEQ ID NO: 718640 - DNA, 22 bp, Artificial Sequence
  chemically synthesized
ctcaaacttgttaagatgtgat

SEQ ID NO: 718641 - DNA, 22 bp, Artificial Sequence
  chemically synthesized
aagctagtgttaatcacatctt

SEQ ID NO: 718642 - DNA, 22 bp, Artificial Sequence
  chemically synthesized
aaacttgttaagatgtgattaa

SEQ ID NO: 718643 - DNA, 22 bp, Artificial Sequence
  chemically synthesized
tttaagctagtgttaatcacat

SEQ ID NO: 718644 - DNA, 22 bp, Artificial Sequence
  chemically synthesized
atttaagctagtgttaatcaca

SEQ ID NO: 718645 - DNA, 22 bp, Artificial Sequence
  chemically synthesized
acttatttaagctagtgttaat

SEQ ID NO: 718646 - DNA, 22 bp, Artificial Sequence
  chemically synthesized
gttaagatgtgattaacactag

SEQ ID NO: 718647 - DNA, 22 bp, Artificial Sequence
  chemically synthesized
ttaagatgtgattaacactagc

SEQ ID NO: 718648 - DNA, 22 bp, Artificial Sequence
  chemically synthesized
agatgtgattaacactagctta

SEQ ID NO: 718649 - DNA, 22 bp, Artificial Sequence
  chemically synthesized
gatagttaacttatttaagcta

SEQ ID NO: 718650 - DNA, 22 bp, Artificial Sequence
  chemically synthesized
tcgatagttaacttatttaagc

SEQ ID NO: 718651 - DNA, 22 bp, Artificial Sequence
  chemically synthesized
actctcgatagttaacttattt

SEQ ID NO: 718652 - DNA, 22 bp, Artificial Sequence
  chemically synthesized
acactagcttaaataagttaac

SEQ ID NO: 718653 - DNA, 22 bp, Artificial Sequence
  chemically synthesized
ggctgactctcgatagttaact

SEQ ID NO: 718654 - DNA, 22 bp, Artificial Sequence
  chemically synthesized
gcttaaataagttaactatcga

SEQ ID NO: 718655 - DNA, 22 bp, Artificial Sequence
  chemically synthesized
cattaggctgactctcgatagt

SEQ ID NO: 718656 - DNA, 22 bp, Artificial Sequence
  chemically synthesized
aaataagttaactatcgagagt

SEQ ID NO: 718657 - DNA, 22 bp, Artificial Sequence
  chemically synthesized
aataagttaactatcgagagtc

SEQ ID NO: 718658 - DNA, 22 bp, Artificial Sequence
  chemically synthesized
accattacattaggctgactct

SEQ ID NO: 718659 - DNA, 22 bp, Artificial Sequence
  chemically synthesized
actatcgagagtcagcctaatg

SEQ ID NO: 718660 - DNA, 22 bp, Artificial Sequence
  chemically synthesized
tcgagagtcagcctaatgtaat

SEQ ID NO: 718661 - DNA, 22 bp, Artificial Sequence
  chemically synthesized
gtaatcctaaccattacattag

SEQ ID NO: 718662 - DNA, 22 bp, Artificial Sequence
  chemically synthesized
cagacctggtaatcctaaccat

SEQ ID NO: 718663 - DNA, 22 bp, Artificial Sequence
  chemically synthesized
atgtaatggttaggattaccag

SEQ ID NO: 718664 - DNA, 22 bp, Artificial Sequence
  chemically synthesized
ggattaccaggtctgcagccat

SEQ ID NO: 718665 - DNA, 22 bp, Artificial Sequence
  chemically synthesized
aaacccaggtaatatggctgca

SEQ ID NO: 718666 - DNA, 22 bp, Artificial Sequence
  chemically synthesized
ccaggtctgcagccatattacc

SEQ ID NO: 718667 - DNA, 22 bp, Artificial Sequence
  chemically synthesized
cagccatattacctgggtttga

SEQ ID NO: 718668 - DNA, 22 bp, Artificial Sequence
  chemically synthesized
gtaagaagccaagattcaaacc

SEQ ID NO: 718669 - DNA, 22 bp, Artificial Sequence
  chemically synthesized
cctgggtttgaatcttggcttc

SEQ ID NO: 718670 - DNA, 22 bp, Artificial Sequence
  chemically synthesized
ggtttgaatcttggcttcttac

SEQ ID NO: 718671 - DNA, 22 bp, Artificial Sequence
  chemically synthesized
gaatcttggcttcttactagct

SEQ ID NO: 718672 - DNA, 22 bp, Artificial Sequence
  chemically synthesized
cccaaagcccacagctagtaag

SEQ ID NO: 718673 - DNA, 22 bp, Artificial Sequence
  chemically synthesized
aatcttggcttcttactagctg

SEQ ID NO: 718674 - DNA, 22 bp, Artificial Sequence
  chemically synthesized
gcccaaagcccacagctagtaa

SEQ ID NO: 718675 - DNA, 22 bp, Artificial Sequence
  chemically synthesized
ggcttcttactagctgtgggct

SEQ ID NO: 718676 - DNA, 22 bp, Artificial Sequence
  chemically synthesized
gcttcttactagctgtgggctt

SEQ ID NO: 718677 - DNA, 22 bp, Artificial Sequence
  chemically synthesized
agtaatttgcccaaagcccaca

SEQ ID NO: 718678 - DNA, 22 bp, Artificial Sequence
  chemically synthesized
cttactagctgtgggctttggg

SEQ ID NO: 718679 - DNA, 22 bp, Artificial Sequence
  chemically synthesized
ttactagctgtgggctttgggc

SEQ ID NO: 718680 - DNA, 22 bp, Artificial Sequence
  chemically synthesized
actagctgtgggctttgggcaa

SEQ ID NO: 718681 - DNA, 22 bp, Artificial Sequence
  chemically synthesized
ctagctgtgggctttgggcaaa

SEQ ID NO: 718682 - DNA, 22 bp, Artificial Sequence
  chemically synthesized
gctgtgggctttgggcaaatta

SEQ ID NO: 718683 - DNA, 22 bp, Artificial Sequence
  chemically synthesized
tgggctttgggcaaattactca

SEQ ID NO: 718684 - DNA, 22 bp, Artificial Sequence
  chemically synthesized
aggtatagagagattgagtaat

SEQ ID NO: 718685 - DNA, 22 bp, Artificial Sequence
  chemically synthesized
tgggcaaattactcaatctctc

SEQ ID NO: 718686 - DNA, 22 bp, Artificial Sequence
  chemically synthesized
gggcaaattactcaatctctct

SEQ ID NO: 718687 - DNA, 22 bp, Artificial Sequence
  chemically synthesized
ggcaaattactcaatctctcta

SEQ ID NO: 718688 - DNA, 22 bp, Artificial Sequence
  chemically synthesized
caaataagaagactaaggtata

SEQ ID NO: 718689 - DNA, 22 bp, Artificial Sequence
  chemically synthesized
ctcaatctctctataccttagt

SEQ ID NO: 718690 - DNA, 22 bp, Artificial Sequence
  chemically synthesized
acaaataagaagactaaggtat

SEQ ID NO: 718691 - DNA, 22 bp, Artificial Sequence
  chemically synthesized
aatctctctataccttagtctt

SEQ ID NO: 718692 - DNA, 22 bp, Artificial Sequence
  chemically synthesized
ccagtttacaaataagaagact

SEQ ID NO: 718693 - DNA, 22 bp, Artificial Sequence
  chemically synthesized
tctataccttagtcttcttatt

SEQ ID NO: 718694 - DNA, 22 bp, Artificial Sequence
  chemically synthesized
tataccttagtcttcttatttg

SEQ ID NO: 718695 - DNA, 22 bp, Artificial Sequence
  chemically synthesized
taccttagtcttcttatttgta

SEQ ID NO: 718696 - DNA, 22 bp, Artificial Sequence
  chemically synthesized
taattcccagtttacaaataag

SEQ ID NO: 718697 - DNA, 22 bp, Artificial Sequence
  chemically synthesized
ttgtaattcccagtttacaaat

SEQ ID NO: 718698 - DNA, 22 bp, Artificial Sequence
  chemically synthesized
agtcttcttatttgtaaactgg

SEQ ID NO: 718699 - DNA, 22 bp, Artificial Sequence
  chemically synthesized
gtcttcttatttgtaaactggg

SEQ ID NO: 718700 - DNA, 22 bp, Artificial Sequence
  chemically synthesized
cttatttgtaaactgggaatta

SEQ ID NO: 718701 - DNA, 22 bp, Artificial Sequence
  chemically synthesized
ttatttgtaaactgggaattac

SEQ ID NO: 718702 - DNA, 22 bp, Artificial Sequence
  chemically synthesized
atttgtaaactgggaattacaa

SEQ ID NO: 718703 - DNA, 22 bp, Artificial Sequence
  chemically synthesized
tttgtaaactgggaattacaac

SEQ ID NO: 718704 - DNA, 22 bp, Artificial Sequence
  chemically synthesized
tagataggtactgttgtaattc

SEQ ID NO: 718705 - DNA, 22 bp, Artificial Sequence
  chemically synthesized
gtagataggtactgttgtaatt

SEQ ID NO: 718706 - DNA, 22 bp, Artificial Sequence
  chemically synthesized
gtaaactgggaattacaacagt

SEQ ID NO: 718707 - DNA, 22 bp, Artificial Sequence
  chemically synthesized
taaactgggaattacaacagta

SEQ ID NO: 718708 - DNA, 22 bp, Artificial Sequence
  chemically synthesized
ggaattacaacagtacctatct

SEQ ID NO: 718709 - DNA, 22 bp, Artificial Sequence
  chemically synthesized
acaacaacgatcttgtagatag

SEQ ID NO: 718710 - DNA, 22 bp, Artificial Sequence
  chemically synthesized
caacagtacctatctacaagat

SEQ ID NO: 718711 - DNA, 22 bp, Artificial Sequence
  chemically synthesized
agaggcctgacaacaacgatct

SEQ ID NO: 718712 - DNA, 22 bp, Artificial Sequence
  chemically synthesized
ggctcagaggcctgacaacaac

SEQ ID NO: 718713 - DNA, 22 bp, Artificial Sequence
  chemically synthesized
tctacaagatcgttgttgtcag

SEQ ID NO: 718714 - DNA, 22 bp, Artificial Sequence
  chemically synthesized
gggctcagaggcctgacaacaa

SEQ ID NO: 718715 - DNA, 22 bp, Artificial Sequence
  chemically synthesized
caagatcgttgttgtcaggcct

SEQ ID NO: 718716 - DNA, 22 bp, Artificial Sequence
  chemically synthesized
gcttgggctcagaggcctgaca

SEQ ID NO: 718717 - DNA, 22 bp, Artificial Sequence
  chemically synthesized
agcttgggctcagaggcctgac

SEQ ID NO: 718718 - DNA, 22 bp, Artificial Sequence
  chemically synthesized
ttgtcaggcctctgagcccaag

SEQ ID NO: 718719 - DNA, 22 bp, Artificial Sequence
  chemically synthesized
tcaggcctctgagcccaagcta

SEQ ID NO: 718720 - DNA, 22 bp, Artificial Sequence
  chemically synthesized
tgagcccaagctaagccatcat

SEQ ID NO: 718721 - DNA, 22 bp, Artificial Sequence
  chemically synthesized
agcccaagctaagccatcatat

SEQ ID NO: 718722 - DNA, 22 bp, Artificial Sequence
  chemically synthesized
agccatcatatcccctgtgacc

SEQ ID NO: 718723 - DNA, 22 bp, Artificial Sequence
  chemically synthesized
gatgtatacgtgcaggtcacag

SEQ ID NO: 718724 - DNA, 22 bp, Artificial Sequence
  chemically synthesized
tggatgtatacgtgcaggtcac

SEQ ID NO: 718725 - DNA, 22 bp, Artificial Sequence
  chemically synthesized
ctggatgtatacgtgcaggtca

SEQ ID NO: 718726 - DNA, 22 bp, Artificial Sequence
  chemically synthesized
aggccttctggatgtatacgtg

SEQ ID NO: 718727 - DNA, 22 bp, Artificial Sequence
  chemically synthesized
caggccttctggatgtatacgt

SEQ ID NO: 718728 - DNA, 22 bp, Artificial Sequence
  chemically synthesized
cttcaggccttctggatgtata

SEQ ID NO: 718729 - DNA, 22 bp, Artificial Sequence
  chemically synthesized
tgacctgcacgtatacatccag

SEQ ID NO: 718730 - DNA, 22 bp, Artificial Sequence
  chemically synthesized
agttacttcaggccttctggat

SEQ ID NO: 718731 - DNA, 22 bp, Artificial Sequence
  chemically synthesized
cagttacttcaggccttctgga

SEQ ID NO: 718732 - DNA, 22 bp, Artificial Sequence
  chemically synthesized
tcagttacttcaggccttctgg

SEQ ID NO: 718733 - DNA, 22 bp, Artificial Sequence
  chemically synthesized
cacgtatacatccagaaggcct

SEQ ID NO: 718734 - DNA, 22 bp, Artificial Sequence
  chemically synthesized
ttcagttacttcaggccttctg

SEQ ID NO: 718735 - DNA, 22 bp, Artificial Sequence
  chemically synthesized
tgatttttcagttacttcaggc

SEQ ID NO: 718736 - DNA, 22 bp, Artificial Sequence
  chemically synthesized
gtgatttttcagttacttcagg

SEQ ID NO: 718737 - DNA, 22 bp, Artificial Sequence
  chemically synthesized
tgtgatttttcagttacttcag

SEQ ID NO: 718738 - DNA, 22 bp, Artificial Sequence
  chemically synthesized
ttgtgatttttcagttacttca

SEQ ID NO: 718739 - DNA, 22 bp, Artificial Sequence
  chemically synthesized
ttttgtgatttttcagttactt

SEQ ID NO: 718740 - DNA, 22 bp, Artificial Sequence
  chemically synthesized
cttttgtgatttttcagttact

SEQ ID NO: 718741 - DNA, 22 bp, Artificial Sequence
  chemically synthesized
acttcttttgtgatttttcagt

SEQ ID NO: 718742 - DNA, 22 bp, Artificial Sequence
  chemically synthesized
cacttcttttgtgatttttcag

SEQ ID NO: 718743 - DNA, 22 bp, Artificial Sequence
  chemically synthesized
tcacttcttttgtgatttttca

SEQ ID NO: 718744 - DNA, 22 bp, Artificial Sequence
  chemically synthesized
aagtaactgaaaaatcacaaaa

SEQ ID NO: 718745 - DNA, 22 bp, Artificial Sequence
  chemically synthesized
aaaaatcacaaaagaagtgaaa

SEQ ID NO: 718746 - DNA, 22 bp, Artificial Sequence
  chemically synthesized
aggcaggaacaggccattttca

SEQ ID NO: 718747 - DNA, 22 bp, Artificial Sequence
  chemically synthesized
tggtggaatgtcatcagttaag

SEQ ID NO: 718748 - DNA, 22 bp, Artificial Sequence
  chemically synthesized
gtggtggaatgtcatcagttaa

SEQ ID NO: 718749 - DNA, 22 bp, Artificial Sequence
  chemically synthesized
tgtggtggaatgtcatcagtta

SEQ ID NO: 718750 - DNA, 22 bp, Artificial Sequence
  chemically synthesized
ttgtggtggaatgtcatcagtt

SEQ ID NO: 718751 - DNA, 22 bp, Artificial Sequence
  chemically synthesized
ttcctgccttaactgatgacat

SEQ ID NO: 718752 - DNA, 22 bp, Artificial Sequence
  chemically synthesized
ttttgtggtggaatgtcatcag

SEQ ID NO: 718753 - DNA, 22 bp, Artificial Sequence
  chemically synthesized
cttttgtggtggaatgtcatca

SEQ ID NO: 718754 - DNA, 22 bp, Artificial Sequence
  chemically synthesized
ctgccttaactgatgacattcc

SEQ ID NO: 718755 - DNA, 22 bp, Artificial Sequence
  chemically synthesized
acttcttttgtggtggaatgtc

SEQ ID NO: 718756 - DNA, 22 bp, Artificial Sequence
  chemically synthesized
ccttaactgatgacattccacc

SEQ ID NO: 718757 - DNA, 22 bp, Artificial Sequence
  chemically synthesized
cacttcttttgtggtggaatgt

SEQ ID NO: 718758 - DNA, 22 bp, Artificial Sequence
  chemically synthesized
tcacttcttttgtggtggaatg

SEQ ID NO: 718759 - DNA, 22 bp, Artificial Sequence
  chemically synthesized
aactgatgacattccaccacaa

SEQ ID NO: 718760 - DNA, 22 bp, Artificial Sequence
  chemically synthesized
actgatgacattccaccacaaa

SEQ ID NO: 718761 - DNA, 22 bp, Artificial Sequence
  chemically synthesized
atgacattccaccacaaaagaa

SEQ ID NO: 718762 - DNA, 22 bp, Artificial Sequence
  chemically synthesized
caccacaaaagaagtgaaaatg

SEQ ID NO: 718763 - DNA, 22 bp, Artificial Sequence
  chemically synthesized
aggcaaggaccggccattttca

SEQ ID NO: 718764 - DNA, 22 bp, Artificial Sequence
  chemically synthesized
acaaggtaatgtcatcagttaa

SEQ ID NO: 718765 - DNA, 22 bp, Artificial Sequence
  chemically synthesized
cacaaggtaatgtcatcagtta

SEQ ID NO: 718766 - DNA, 22 bp, Artificial Sequence
  chemically synthesized
gccttaactgatgacattacct

SEQ ID NO: 718767 - DNA, 22 bp, Artificial Sequence
  chemically synthesized
ccttaactgatgacattacctt

SEQ ID NO: 718768 - DNA, 22 bp, Artificial Sequence
  chemically synthesized
aactgatgacattaccttgtga

SEQ ID NO: 718769 - DNA, 22 bp, Artificial Sequence
  chemically synthesized
actgatgacattaccttgtgaa

SEQ ID NO: 718770 - DNA, 22 bp, Artificial Sequence
  chemically synthesized
atgacattaccttgtgaaattc

SEQ ID NO: 718771 - DNA, 22 bp, Artificial Sequence
  chemically synthesized
ccttgtgaaattcctttccctg

SEQ ID NO: 718772 - DNA, 22 bp, Artificial Sequence
  chemically synthesized
agccaggatgagccagggaaag

SEQ ID NO: 718773 - DNA, 22 bp, Artificial Sequence
  chemically synthesized
gagccaggatgagccagggaaa

SEQ ID NO: 718774 - DNA, 22 bp, Artificial Sequence
  chemically synthesized
tgagccaggatgagccagggaa

SEQ ID NO: 718775 - DNA, 22 bp, Artificial Sequence
  chemically synthesized
gtgaaattcctttccctggctc

SEQ ID NO: 718776 - DNA, 22 bp, Artificial Sequence
  chemically synthesized
ttgagccaggatgagccaggga

SEQ ID NO: 718777 - DNA, 22 bp, Artificial Sequence
  chemically synthesized
tgaaattcctttccctggctca

SEQ ID NO: 718778 - DNA, 22 bp, Artificial Sequence
  chemically synthesized
tttgagccaggatgagccaggg

SEQ ID NO: 718779 - DNA, 22 bp, Artificial Sequence
  chemically synthesized
ctttccctggctcatcctggct

SEQ ID NO: 718780 - DNA, 22 bp, Artificial Sequence
  chemically synthesized
tccctggctcatcctggctcaa

SEQ ID NO: 718781 - DNA, 22 bp, Artificial Sequence
  chemically synthesized
ccctggctcatcctggctcaaa

SEQ ID NO: 718782 - DNA, 22 bp, Artificial Sequence
  chemically synthesized
cctggctcatcctggctcaaaa

SEQ ID NO: 718783 - DNA, 22 bp, Artificial Sequence
  chemically synthesized
agtggggaagctttttgagcca

SEQ ID NO: 718784 - DNA, 22 bp, Artificial Sequence
  chemically synthesized
gctcatcctggctcaaaaagct

SEQ ID NO: 718785 - DNA, 22 bp, Artificial Sequence
  chemically synthesized
atcctggctcaaaaagcttccc

SEQ ID NO: 718786 - DNA, 22 bp, Artificial Sequence
  chemically synthesized
gctcaaaaagcttccccactga

SEQ ID NO: 718787 - DNA, 22 bp, Artificial Sequence
  chemically synthesized
aaaaagcttccccactgagcac

SEQ ID NO: 718788 - DNA, 22 bp, Artificial Sequence
  chemically synthesized
ccccactgagcaccttgtgact

SEQ ID NO: 718789 - DNA, 22 bp, Artificial Sequence
  chemically synthesized
cccactgagcaccttgtgactc

SEQ ID NO: 718790 - DNA, 22 bp, Artificial Sequence
  chemically synthesized
gcgggcaggagtgggagtcaca

SEQ ID NO: 718791 - DNA, 22 bp, Artificial Sequence
  chemically synthesized
tggcgggcaggagtgggagtca

SEQ ID NO: 718792 - DNA, 22 bp, Artificial Sequence
  chemically synthesized
ctggcgggcaggagtgggagtc

SEQ ID NO: 718793 - DNA, 22 bp, Artificial Sequence
  chemically synthesized
tctggcgggcaggagtgggagt

SEQ ID NO: 718794 - DNA, 22 bp, Artificial Sequence
  chemically synthesized
agcaccttgtgactcccactcc

SEQ ID NO: 718795 - DNA, 22 bp, Artificial Sequence
  chemically synthesized
gtgactcccactcctgcccgcc

SEQ ID NO: 718796 - DNA, 22 bp, Artificial Sequence
  chemically synthesized
tgactcccactcctgcccgcca

SEQ ID NO: 718797 - DNA, 22 bp, Artificial Sequence
  chemically synthesized
ccactcctgcccgccagaaaac

SEQ ID NO: 718798 - DNA, 22 bp, Artificial Sequence
  chemically synthesized
cagtcaaatggggggtggtttt

SEQ ID NO: 718799 - DNA, 22 bp, Artificial Sequence
  chemically synthesized
ctgcccgccagaaaaccacccc

SEQ ID NO: 718800 - DNA, 22 bp, Artificial Sequence
  chemically synthesized
cccgccagaaaaccacccccca

SEQ ID NO: 718801 - DNA, 22 bp, Artificial Sequence
  chemically synthesized
ggtaggtaaaggaaaattacag

SEQ ID NO: 718802 - DNA, 22 bp, Artificial Sequence
  chemically synthesized
gggtaggtaaaggaaaattaca

SEQ ID NO: 718803 - DNA, 22 bp, Artificial Sequence
  chemically synthesized
taagatttgggtaggtaaagga

SEQ ID NO: 718804 - DNA, 22 bp, Artificial Sequence
  chemically synthesized
gactgtaattttcctttaccta

SEQ ID NO: 718805 - DNA, 22 bp, Artificial Sequence
  chemically synthesized
ataagatttgggtaggtaaagg

SEQ ID NO: 718806 - DNA, 22 bp, Artificial Sequence
  chemically synthesized
actgtaattttcctttacctac

SEQ ID NO: 718807 - DNA, 22 bp, Artificial Sequence
  chemically synthesized
tataagatttgggtaggtaaag

SEQ ID NO: 718808 - DNA, 22 bp, Artificial Sequence
  chemically synthesized
taattttcctttacctacccaa

SEQ ID NO: 718809 - DNA, 22 bp, Artificial Sequence
  chemically synthesized
tcctttacctacccaaatctta

SEQ ID NO: 718810 - DNA, 22 bp, Artificial Sequence
  chemically synthesized
cctttacctacccaaatcttat

SEQ ID NO: 718811 - DNA, 22 bp, Artificial Sequence
  chemically synthesized
ctttacctacccaaatcttata

SEQ ID NO: 718812 - DNA, 22 bp, Artificial Sequence
  chemically synthesized
tacctacccaaatcttataaaa

SEQ ID NO: 718813 - DNA, 22 bp, Artificial Sequence
  chemically synthesized
acctacccaaatcttataaaac

SEQ ID NO: 718814 - DNA, 22 bp, Artificial Sequence
  chemically synthesized
cctacccaaatcttataaaacg

SEQ ID NO: 718815 - DNA, 22 bp, Artificial Sequence
  chemically synthesized
cccaaatcttataaaacggccc

SEQ ID NO: 718816 - DNA, 22 bp, Artificial Sequence
  chemically synthesized
ataaaacggccccacccctgtc

SEQ ID NO: 718817 - DNA, 22 bp, Artificial Sequence
  chemically synthesized
taaaacggccccacccctgtct

SEQ ID NO: 718818 - DNA, 22 bp, Artificial Sequence
  chemically synthesized
agtccaaaaagagtcagcaaag

SEQ ID NO: 718819 - DNA, 22 bp, Artificial Sequence
  chemically synthesized
tctccctttgctgactcttttt

SEQ ID NO: 718820 - DNA, 22 bp, Artificial Sequence
  chemically synthesized
cctttgctgactctttttggac

SEQ ID NO: 718821 - DNA, 22 bp, Artificial Sequence
  chemically synthesized
tgctgactctttttggactcag

SEQ ID NO: 718822 - DNA, 22 bp, Artificial Sequence
  chemically synthesized
gatgcaggcgggctgagtccaa

SEQ ID NO: 718823 - DNA, 22 bp, Artificial Sequence
  chemically synthesized
gctgactctttttggactcagc

SEQ ID NO: 718824 - DNA, 22 bp, Artificial Sequence
  chemically synthesized
ctgactctttttggactcagcc

SEQ ID NO: 718825 - DNA, 22 bp, Artificial Sequence
  chemically synthesized
actctttttggactcagcccgc

SEQ ID NO: 718826 - DNA, 22 bp, Artificial Sequence
  chemically synthesized
atcacctggatgcaggcgggct

SEQ ID NO: 718827 - DNA, 22 bp, Artificial Sequence
  chemically synthesized
tttttggactcagcccgcctgc

SEQ ID NO: 718828 - DNA, 22 bp, Artificial Sequence
  chemically synthesized
aatcacctggatgcaggcgggc

SEQ ID NO: 718829 - DNA, 22 bp, Artificial Sequence
  chemically synthesized
taatcacctggatgcaggcggg

SEQ ID NO: 718830 - DNA, 22 bp, Artificial Sequence
  chemically synthesized
tttggactcagcccgcctgcat

SEQ ID NO: 718831 - DNA, 22 bp, Artificial Sequence
  chemically synthesized
ttaatcacctggatgcaggcgg

SEQ ID NO: 718832 - DNA, 22 bp, Artificial Sequence
  chemically synthesized
ttggactcagcccgcctgcatc

SEQ ID NO: 718833 - DNA, 22 bp, Artificial Sequence
  chemically synthesized
tttaatcacctggatgcaggcg

SEQ ID NO: 718834 - DNA, 22 bp, Artificial Sequence
  chemically synthesized
tggactcagcccgcctgcatcc

SEQ ID NO: 718835 - DNA, 22 bp, Artificial Sequence
  chemically synthesized
ggactcagcccgcctgcatcca

SEQ ID NO: 718836 - DNA, 22 bp, Artificial Sequence
  chemically synthesized
gactcagcccgcctgcatccag

SEQ ID NO: 718837 - DNA, 22 bp, Artificial Sequence
  chemically synthesized
agcccgcctgcatccaggtgat

SEQ ID NO: 718838 - DNA, 22 bp, Artificial Sequence
  chemically synthesized
tgtgagcaataaaactttttaa

SEQ ID NO: 718839 - DNA, 22 bp, Artificial Sequence
  chemically synthesized
catccaggtgattaaaaagttt

SEQ ID NO: 718840 - DNA, 22 bp, Artificial Sequence
  chemically synthesized
gtgtgagcaataaaacttttta

SEQ ID NO: 718841 - DNA, 22 bp, Artificial Sequence
  chemically synthesized
tgtgtgagcaataaaacttttt

SEQ ID NO: 718842 - DNA, 22 bp, Artificial Sequence
  chemically synthesized
aaaagttttattgctcacacaa

SEQ ID NO: 718843 - DNA, 22 bp, Artificial Sequence
  chemically synthesized
tattgctcacacaaagcctgtt

SEQ ID NO: 718844 - DNA, 22 bp, Artificial Sequence
  chemically synthesized
attgctcacacaaagcctgttt

SEQ ID NO: 718845 - DNA, 22 bp, Artificial Sequence
  chemically synthesized
ttgctcacacaaagcctgtttg

SEQ ID NO: 718846 - DNA, 22 bp, Artificial Sequence
  chemically synthesized
ctcacacaaagcctgtttggtg

SEQ ID NO: 718847 - DNA, 22 bp, Artificial Sequence
  chemically synthesized
acacaaagcctgtttggtggtc

SEQ ID NO: 718848 - DNA, 22 bp, Artificial Sequence
  chemically synthesized
atgcgcgtccgtgtgaagagac

SEQ ID NO: 718849 - DNA, 22 bp, Artificial Sequence
  chemically synthesized
catgcgcgtccgtgtgaagaga

SEQ ID NO: 718850 - DNA, 22 bp, Artificial Sequence
  chemically synthesized
tttggtggtctcttcacacgga

SEQ ID NO: 718851 - DNA, 22 bp, Artificial Sequence
  chemically synthesized
ggtggtctcttcacacggacgc

SEQ ID NO: 718852 - DNA, 22 bp, Artificial Sequence
  chemically synthesized
gtggtctcttcacacggacgcg

SEQ ID NO: 718853 - DNA, 22 bp, Artificial Sequence
  chemically synthesized
ttcacacggacgcgcatgaaat

SEQ ID NO: 718854 - DNA, 22 bp, Artificial Sequence
  chemically synthesized
cacacggacgcgcatgaaattt

SEQ ID NO: 718855 - DNA, 22 bp, Artificial Sequence
  chemically synthesized
acacggacgcgcatgaaatttg

SEQ ID NO: 718856 - DNA, 22 bp, Artificial Sequence
  chemically synthesized
atccgagtgatggcaccaaatt

SEQ ID NO: 718857 - DNA, 22 bp, Artificial Sequence
  chemically synthesized
ggtgccatcactcggatcaggg

SEQ ID NO: 718858 - DNA, 22 bp, Artificial Sequence
  chemically synthesized
ccaagggaggtcccctgatccg

SEQ ID NO: 718859 - DNA, 22 bp, Artificial Sequence
  chemically synthesized
gtgccatcactcggatcagggg

SEQ ID NO: 718860 - DNA, 22 bp, Artificial Sequence
  chemically synthesized
ggatcaggggacctcccttggg

SEQ ID NO: 718861 - DNA, 22 bp, Artificial Sequence
  chemically synthesized
ccttgggagatctatcccctgt

SEQ ID NO: 718862 - DNA, 22 bp, Artificial Sequence
  chemically synthesized
gggagatctatcccctgtcctc

SEQ ID NO: 718863 - DNA, 22 bp, Artificial Sequence
  chemically synthesized
ggagatctatcccctgtcctcc

SEQ ID NO: 718864 - DNA, 22 bp, Artificial Sequence
  chemically synthesized
acagagcaaggagcaggaggac

SEQ ID NO: 718865 - DNA, 22 bp, Artificial Sequence
  chemically synthesized
tcacagagcaaggagcaggagg

SEQ ID NO: 718866 - DNA, 22 bp, Artificial Sequence
  chemically synthesized
ctcacagagcaaggagcaggag

SEQ ID NO: 718867 - DNA, 22 bp, Artificial Sequence
  chemically synthesized
tctcacagagcaaggagcagga

SEQ ID NO: 718868 - DNA, 22 bp, Artificial Sequence
  chemically synthesized
tcccctgtcctcctgctccttg

SEQ ID NO: 718869 - DNA, 22 bp, Artificial Sequence
  chemically synthesized
tcctcctgctccttgctctgtg

SEQ ID NO: 718870 - DNA, 22 bp, Artificial Sequence
  chemically synthesized
ctgctccttgctctgtgagaaa

SEQ ID NO: 718871 - DNA, 22 bp, Artificial Sequence
  chemically synthesized
ctccttgctctgtgagaaagat

SEQ ID NO: 718872 - DNA, 22 bp, Artificial Sequence
  chemically synthesized
cttgctctgtgagaaagatcca

SEQ ID NO: 718873 - DNA, 22 bp, Artificial Sequence
  chemically synthesized
gctctgtgagaaagatccacct

SEQ ID NO: 718874 - DNA, 22 bp, Artificial Sequence
  chemically synthesized
ctctgtgagaaagatccaccta

SEQ ID NO: 718875 - DNA, 22 bp, Artificial Sequence
  chemically synthesized
aggaccagaggtcgtaggtgga

SEQ ID NO: 718876 - DNA, 22 bp, Artificial Sequence
  chemically synthesized
tgtgagaaagatccacctacga

SEQ ID NO: 718877 - DNA, 22 bp, Artificial Sequence
  chemically synthesized
tgagaaagatccacctacgacc

SEQ ID NO: 718878 - DNA, 22 bp, Artificial Sequence
  chemically synthesized
gtctgaggaccagaggtcgtag

SEQ ID NO: 718879 - DNA, 22 bp, Artificial Sequence
  chemically synthesized
gttagtctgaggaccagaggtc

SEQ ID NO: 718880 - DNA, 22 bp, Artificial Sequence
  chemically synthesized
ggctggttagtctgaggaccag

SEQ ID NO: 718881 - DNA, 22 bp, Artificial Sequence
  chemically synthesized
gggctggttagtctgaggacca

SEQ ID NO: 718882 - DNA, 22 bp, Artificial Sequence
  chemically synthesized
cttgggctggttagtctgagga

SEQ ID NO: 718883 - DNA, 22 bp, Artificial Sequence
  chemically synthesized
cgacctctggtcctcagactaa

SEQ ID NO: 718884 - DNA, 22 bp, Artificial Sequence
  chemically synthesized
tggtcctcagactaaccagccc

SEQ ID NO: 718885 - DNA, 22 bp, Artificial Sequence
  chemically synthesized
gtcctcagactaaccagcccaa

SEQ ID NO: 718886 - DNA, 22 bp, Artificial Sequence
  chemically synthesized
gtgtgatgttccttgggctggt

SEQ ID NO: 718887 - DNA, 22 bp, Artificial Sequence
  chemically synthesized
agactaaccagcccaaggaaca

SEQ ID NO: 718888 - DNA, 22 bp, Artificial Sequence
  chemically synthesized
aaattggtgtgatgttccttgg

SEQ ID NO: 718889 - DNA, 22 bp, Artificial Sequence
  chemically synthesized
aaaattggtgtgatgttccttg

SEQ ID NO: 718890 - DNA, 22 bp, Artificial Sequence
  chemically synthesized
atttaaaattggtgtgatgttc

SEQ ID NO: 718891 - DNA, 22 bp, Artificial Sequence
  chemically synthesized
accagcccaaggaacatcacac

SEQ ID NO: 718892 - DNA, 22 bp, Artificial Sequence
  chemically synthesized
cctgatttaaaattggtgtgat

SEQ ID NO: 718893 - DNA, 22 bp, Artificial Sequence
  chemically synthesized
acctgatttaaaattggtgtga

SEQ ID NO: 718894 - DNA, 22 bp, Artificial Sequence
  chemically synthesized
taaatcaggtaagcggcctctt

SEQ ID NO: 718895 - DNA, 22 bp, Artificial Sequence
  chemically synthesized
aaatcaggtaagcggcctcttt

SEQ ID NO: 718896 - DNA, 22 bp, Artificial Sequence
  chemically synthesized
aatcaggtaagcggcctctttt

SEQ ID NO: 718897 - DNA, 22 bp, Artificial Sequence
  chemically synthesized
gaggagagagtaaaaagaggcc

SEQ ID NO: 718898 - DNA, 22 bp, Artificial Sequence
  chemically synthesized
tttttactctctcctccaacct

SEQ ID NO: 718899 - DNA, 22 bp, Artificial Sequence
  chemically synthesized
agggatagtgagaggttggagg

SEQ ID NO: 718900 - DNA, 22 bp, Artificial Sequence
  chemically synthesized
tttactctctcctccaacctct

SEQ ID NO: 718901 - DNA, 22 bp, Artificial Sequence
  chemically synthesized
ttactctctcctccaacctctc

SEQ ID NO: 718902 - DNA, 22 bp, Artificial Sequence
  chemically synthesized
tactctctcctccaacctctca

SEQ ID NO: 718903 - DNA, 22 bp, Artificial Sequence
  chemically synthesized
actctctcctccaacctctcac

SEQ ID NO: 718904 - DNA, 22 bp, Artificial Sequence
  chemically synthesized
ctctctcctccaacctctcact

SEQ ID NO: 718905 - DNA, 22 bp, Artificial Sequence
  chemically synthesized
tctcctccaacctctcactatc

SEQ ID NO: 718906 - DNA, 22 bp, Artificial Sequence
  chemically synthesized
tcctccaacctctcactatccc

SEQ ID NO: 718907 - DNA, 22 bp, Artificial Sequence
  chemically synthesized
ctccaacctctcactatccctc

SEQ ID NO: 718908 - DNA, 22 bp, Artificial Sequence
  chemically synthesized
caacctctcactatccctcaac

SEQ ID NO: 718909 - DNA, 22 bp, Artificial Sequence
  chemically synthesized
aaaggagaaagaggttgaggga

SEQ ID NO: 718910 - DNA, 22 bp, Artificial Sequence
  chemically synthesized
tcactatccctcaacctctttc

SEQ ID NO: 718911 - DNA, 22 bp, Artificial Sequence
  chemically synthesized
actatccctcaacctctttctc

SEQ ID NO: 718912 - DNA, 22 bp, Artificial Sequence
  chemically synthesized
tccctcaacctctttctccttt

SEQ ID NO: 718913 - DNA, 22 bp, Artificial Sequence
  chemically synthesized
aacctctttctcctttcaatct

SEQ ID NO: 718914 - DNA, 22 bp, Artificial Sequence
  chemically synthesized
aagtggggcgccaagattgaaa

SEQ ID NO: 718915 - DNA, 22 bp, Artificial Sequence
  chemically synthesized
tttctcctttcaatcttggcgc

SEQ ID NO: 718916 - DNA, 22 bp, Artificial Sequence
  chemically synthesized
tctcctttcaatcttggcgccc

SEQ ID NO: 718917 - DNA, 22 bp, Artificial Sequence
  chemically synthesized
ctcctttcaatcttggcgcccc

SEQ ID NO: 718918 - DNA, 22 bp, Artificial Sequence
  chemically synthesized
tcctttcaatcttggcgcccca

SEQ ID NO: 718919 - DNA, 22 bp, Artificial Sequence
  chemically synthesized
ctttcaatcttggcgccccact

SEQ ID NO: 718920 - DNA, 22 bp, Artificial Sequence
  chemically synthesized
tcaatcttggcgccccacttca

SEQ ID NO: 718921 - DNA, 22 bp, Artificial Sequence
  chemically synthesized
caatcttggcgccccacttcaa

SEQ ID NO: 718922 - DNA, 22 bp, Artificial Sequence
  chemically synthesized
aatcttggcgccccacttcaat

SEQ ID NO: 718923 - DNA, 22 bp, Artificial Sequence
  chemically synthesized
agagaagggagagattgaagtg

SEQ ID NO: 718924 - DNA, 22 bp, Artificial Sequence
  chemically synthesized
ggcgccccacttcaatctctcc

SEQ ID NO: 718925 - DNA, 22 bp, Artificial Sequence
  chemically synthesized
gcgccccacttcaatctctccc

SEQ ID NO: 718926 - DNA, 22 bp, Artificial Sequence
  chemically synthesized
aagttaagagaagggagagatt

SEQ ID NO: 718927 - DNA, 22 bp, Artificial Sequence
  chemically synthesized
caatctctcccttctcttaact

SEQ ID NO: 718928 - DNA, 22 bp, Artificial Sequence
  chemically synthesized
aatctctcccttctcttaactt

SEQ ID NO: 718929 - DNA, 22 bp, Artificial Sequence
  chemically synthesized
tcccttctcttaacttcagttc

SEQ ID NO: 718930 - DNA, 22 bp, Artificial Sequence
  chemically synthesized
ccttctcttaacttcagttcct

SEQ ID NO: 718931 - DNA, 22 bp, Artificial Sequence
  chemically synthesized
ccagaaaaggaaaggaactgaa

SEQ ID NO: 718932 - DNA, 22 bp, Artificial Sequence
  chemically synthesized
taccagaaaaggaaaggaactg

SEQ ID NO: 718933 - DNA, 22 bp, Artificial Sequence
  chemically synthesized
ctcttaacttcagttcctttcc

SEQ ID NO: 718934 - DNA, 22 bp, Artificial Sequence
  chemically synthesized
tcttaacttcagttcctttcct

SEQ ID NO: 718935 - DNA, 22 bp, Artificial Sequence
  chemically synthesized
tctctaccagaaaaggaaagga

SEQ ID NO: 718936 - DNA, 22 bp, Artificial Sequence
  chemically synthesized
ttaacttcagttcctttccttt

SEQ ID NO: 718937 - DNA, 22 bp, Artificial Sequence
  chemically synthesized
aacttcagttcctttccttttc

SEQ ID NO: 718938 - DNA, 22 bp, Artificial Sequence
  chemically synthesized
ctgtctctaccagaaaaggaaa

SEQ ID NO: 718939 - DNA, 22 bp, Artificial Sequence
  chemically synthesized
acttcagttcctttccttttct

SEQ ID NO: 718940 - DNA, 22 bp, Artificial Sequence
  chemically synthesized
cagttcctttccttttctggta

SEQ ID NO: 718941 - DNA, 22 bp, Artificial Sequence
  chemically synthesized
agttcctttccttttctggtag

SEQ ID NO: 718942 - DNA, 22 bp, Artificial Sequence
  chemically synthesized
ctttccttttctggtagagaca

SEQ ID NO: 718943 - DNA, 22 bp, Artificial Sequence
  chemically synthesized
tccttttctggtagagacagga

SEQ ID NO: 718944 - DNA, 22 bp, Artificial Sequence
  chemically synthesized
ccttttctggtagagacaggag

SEQ ID NO: 718945 - DNA, 22 bp, Artificial Sequence
  chemically synthesized
cttttctggtagagacaggaga

SEQ ID NO: 718946 - DNA, 22 bp, Artificial Sequence
  chemically synthesized
ttctggtagagacaggagatgc

SEQ ID NO: 718947 - DNA, 22 bp, Artificial Sequence
  chemically synthesized
tctggtagagacaggagatgcg

SEQ ID NO: 718948 - DNA, 22 bp, Artificial Sequence
  chemically synthesized
ctggtagagacaggagatgcgt

SEQ ID NO: 718949 - DNA, 22 bp, Artificial Sequence
  chemically synthesized
tggtagagacaggagatgcgtt

SEQ ID NO: 718950 - DNA, 22 bp, Artificial Sequence
  chemically synthesized
ggtccacggataaaacgcatct

SEQ ID NO: 718951 - DNA, 22 bp, Artificial Sequence
  chemically synthesized
gtagagacaggagatgcgtttt

SEQ ID NO: 718952 - DNA, 22 bp, Artificial Sequence
  chemically synthesized
gggtccacggataaaacgcatc

SEQ ID NO: 718953 - DNA, 22 bp, Artificial Sequence
  chemically synthesized
tgggtccacggataaaacgcat

SEQ ID NO: 718954 - DNA, 22 bp, Artificial Sequence
  chemically synthesized
tatccgtggacccaaaactccg

SEQ ID NO: 718955 - DNA, 22 bp, Artificial Sequence
  chemically synthesized
atccgtggacccaaaactccgg

SEQ ID NO: 718956 - DNA, 22 bp, Artificial Sequence
  chemically synthesized
tccgtggacccaaaactccggc

SEQ ID NO: 718957 - DNA, 22 bp, Artificial Sequence
  chemically synthesized
cgagtccgtgaccggtgccgga

SEQ ID NO: 718958 - DNA, 22 bp, Artificial Sequence
  chemically synthesized
ccgagtccgtgaccggtgccgg

SEQ ID NO: 718959 - DNA, 22 bp, Artificial Sequence
  chemically synthesized
ttccgagtccgtgaccggtgcc

SEQ ID NO: 718960 - DNA, 22 bp, Artificial Sequence
  chemically synthesized
cggcaccggtcacggactcgga

SEQ ID NO: 718961 - DNA, 22 bp, Artificial Sequence
  chemically synthesized
aataccaagggaagactcttcc

SEQ ID NO: 718962 - DNA, 22 bp, Artificial Sequence
  chemically synthesized
ggaagagtcttcccttggtatt

SEQ ID NO: 718963 - DNA, 22 bp, Artificial Sequence
  chemically synthesized
cccttggtatttaatcacgcgg

SEQ ID NO: 718964 - DNA, 22 bp, Artificial Sequence
  chemically synthesized
ccttggtatttaatcacgcggg

SEQ ID NO: 718965 - DNA, 22 bp, Artificial Sequence
  chemically synthesized
ggtatttaatcacgcggggatg

SEQ ID NO: 718966 - DNA, 22 bp, Artificial Sequence
  chemically synthesized
gtatttaatcacgcggggatgc

SEQ ID NO: 718967 - DNA, 22 bp, Artificial Sequence
  chemically synthesized
aatcacgcggggatgcctgcct

SEQ ID NO: 718968 - DNA, 22 bp, Artificial Sequence
  chemically synthesized
atcacgcggggatgcctgcctg

SEQ ID NO: 718969 - DNA, 22 bp, Artificial Sequence
  chemically synthesized
aaatgtgggtgaataatcaggc

SEQ ID NO: 718970 - DNA, 22 bp, Artificial Sequence
  chemically synthesized
tgaaatgtgggtgaataatcag

SEQ ID NO: 718971 - DNA, 22 bp, Artificial Sequence
  chemically synthesized
cctgattattcacccacatttc

SEQ ID NO: 718972 - DNA, 22 bp, Artificial Sequence
  chemically synthesized
attattcacccacatttcagag

SEQ ID NO: 718973 - DNA, 22 bp, Artificial Sequence
  chemically synthesized
ttcacccacatttcagaggtgt

SEQ ID NO: 718974 - DNA, 22 bp, Artificial Sequence
  chemically synthesized
acccacatttcagaggtgtctg

SEQ ID NO: 718975 - DNA, 22 bp, Artificial Sequence
  chemically synthesized
cagaggtgtctgaccacacggg

SEQ ID NO: 718976 - DNA, 22 bp, Artificial Sequence
  chemically synthesized
agaggtgtctgaccacacgggg

SEQ ID NO: 718977 - DNA, 22 bp, Artificial Sequence
  chemically synthesized
accacacggggacgcctgcctt

SEQ ID NO: 718978 - DNA, 22 bp, Artificial Sequence
  chemically synthesized
aaggtgaaggaccaaggcaggc

SEQ ID NO: 718979 - DNA, 22 bp, Artificial Sequence
  chemically synthesized
ccgctaaaggtgaaggaccaag

SEQ ID NO: 718980 - DNA, 22 bp, Artificial Sequence
  chemically synthesized
gccgctaaaggtgaaggaccaa

SEQ ID NO: 718981 - DNA, 22 bp, Artificial Sequence
  chemically synthesized
ccttggtccttcacctttagcg

SEQ ID NO: 718982 - DNA, 22 bp, Artificial Sequence
  chemically synthesized
ggtccttcacctttagcggcaa

SEQ ID NO: 718983 - DNA, 22 bp, Artificial Sequence
  chemically synthesized
gtccttcacctttagcggcaag

SEQ ID NO: 718984 - DNA, 22 bp, Artificial Sequence
  chemically synthesized
cacctttagcggcaagtaccgc

SEQ ID NO: 718985 - DNA, 22 bp, Artificial Sequence
  chemically synthesized
cccccgagaaaagcggtacttg

SEQ ID NO: 718986 - DNA, 22 bp, Artificial Sequence
  chemically synthesized
acctttagcggcaagtaccgct

SEQ ID NO: 718987 - DNA, 22 bp, Artificial Sequence
  chemically synthesized
gcccccgagaaaagcggtactt

SEQ ID NO: 718988 - DNA, 22 bp, Artificial Sequence
  chemically synthesized
ttgcccccgagaaaagcggtac

SEQ ID NO: 718989 - DNA, 22 bp, Artificial Sequence
  chemically synthesized
tagcggcaagtaccgcttttct

SEQ ID NO: 718990 - DNA, 22 bp, Artificial Sequence
  chemically synthesized
agcggcaagtaccgcttttctc

SEQ ID NO: 718991 - DNA, 22 bp, Artificial Sequence
  chemically synthesized
gcggcaagtaccgcttttctcg

SEQ ID NO: 718992 - DNA, 22 bp, Artificial Sequence
  chemically synthesized
gggggttcttgcccccgagaaa

SEQ ID NO: 718993 - DNA, 22 bp, Artificial Sequence
  chemically synthesized
ttctcgggggcaagaacccccc

SEQ ID NO: 718994 - DNA, 22 bp, Artificial Sequence
  chemically synthesized
tctcgggggcaagaacccccca

SEQ ID NO: 718995 - DNA, 22 bp, Artificial Sequence
  chemically synthesized
ctcgggggcaagaaccccccaa

SEQ ID NO: 718996 - DNA, 22 bp, Artificial Sequence
  chemically synthesized
tcgggggcaagaaccccccaac

SEQ ID NO: 718997 - DNA, 22 bp, Artificial Sequence
  chemically synthesized
gggggcaagaaccccccaaccc

SEQ ID NO: 718998 - DNA, 22 bp, Artificial Sequence
  chemically synthesized
ctctccatgtctctaccccttc

SEQ ID NO: 718999 - DNA, 22 bp, Artificial Sequence
  chemically synthesized
tctccatgtctctaccccttct

SEQ ID NO: 719000 - DNA, 22 bp, Artificial Sequence
  chemically synthesized
tccatgtctctaccccttctcc

SEQ ID NO: 719001 - DNA, 22 bp, Artificial Sequence
  chemically synthesized
catgtctctaccccttctccgc

SEQ ID NO: 719002 - DNA, 22 bp, Artificial Sequence
  chemically synthesized
tcccccagaaaagcggagaagg

SEQ ID NO: 719003 - DNA, 22 bp, Artificial Sequence
  chemically synthesized
gtcccccagaaaagcggagaag

SEQ ID NO: 719004 - DNA, 22 bp, Artificial Sequence
  chemically synthesized
ttgtcccccagaaaagcggaga

SEQ ID NO: 719005 - DNA, 22 bp, Artificial Sequence
  chemically synthesized
taccccttctccgcttttctgg

SEQ ID NO: 719006 - DNA, 22 bp, Artificial Sequence
  chemically synthesized
ccccttctccgcttttctgggg

SEQ ID NO: 719007 - DNA, 22 bp, Artificial Sequence
  chemically synthesized
ctccgcttttctgggggacaag

SEQ ID NO: 719008 - DNA, 22 bp, Artificial Sequence
  chemically synthesized
tccgcttttctgggggacaaga

SEQ ID NO: 719009 - DNA, 22 bp, Artificial Sequence
  chemically synthesized
cgcttttctgggggacaagaac

SEQ ID NO: 719010 - DNA, 22 bp, Artificial Sequence
  chemically synthesized
ttctgggggacaagaacccccc

SEQ ID NO: 719011 - DNA, 22 bp, Artificial Sequence
  chemically synthesized
tctgggggacaagaacccccca

SEQ ID NO: 719012 - DNA, 22 bp, Artificial Sequence
  chemically synthesized
ctgggggacaagaaccccccac

SEQ ID NO: 719013 - DNA, 22 bp, Artificial Sequence
  chemically synthesized
tgggggacaagaaccccccacc

SEQ ID NO: 719014 - DNA, 22 bp, Artificial Sequence
  chemically synthesized
ggggacaagaaccccccacccc

SEQ ID NO: 719015 - DNA, 22 bp, Artificial Sequence
  chemically synthesized
ctctccgtgtctctactccctt

SEQ ID NO: 719016 - DNA, 22 bp, Artificial Sequence
  chemically synthesized
tctccgtgtctctactcccttt

SEQ ID NO: 719017 - DNA, 22 bp, Artificial Sequence
  chemically synthesized
tccgtgtctctactcccttttc

SEQ ID NO: 719018 - DNA, 22 bp, Artificial Sequence
  chemically synthesized
cgtgtctctactcccttttctc

SEQ ID NO: 719019 - DNA, 22 bp, Artificial Sequence
  chemically synthesized
tactcccttttctctgggcttg

SEQ ID NO: 719020 - DNA, 22 bp, Artificial Sequence
  chemically synthesized
ctcccttttctctgggcttgcc

SEQ ID NO: 719021 - DNA, 22 bp, Artificial Sequence
  chemically synthesized
cccatagtgaaggaggcaagcc

SEQ ID NO: 719022 - DNA, 22 bp, Artificial Sequence
  chemically synthesized
ccttttctctgggcttgcctcc

SEQ ID NO: 719023 - DNA, 22 bp, Artificial Sequence
  chemically synthesized
ttctctgggcttgcctccttca

SEQ ID NO: 719024 - DNA, 22 bp, Artificial Sequence
  chemically synthesized
tctctgggcttgcctccttcac

SEQ ID NO: 719025 - DNA, 22 bp, Artificial Sequence
  chemically synthesized
ctctgggcttgcctccttcact

SEQ ID NO: 719026 - DNA, 22 bp, Artificial Sequence
  chemically synthesized
tctgggcttgcctccttcacta

SEQ ID NO: 719027 - DNA, 22 bp, Artificial Sequence
  chemically synthesized
tgggcttgcctccttcactatg

SEQ ID NO: 719028 - DNA, 22 bp, Artificial Sequence
  chemically synthesized
ggcttgcctccttcactatggg

SEQ ID NO: 719029 - DNA, 22 bp, Artificial Sequence
  chemically synthesized
gcctccttcactatgggcaacc

SEQ ID NO: 719030 - DNA, 22 bp, Artificial Sequence
  chemically synthesized
cctccttcactatgggcaacct

SEQ ID NO: 719031 - DNA, 22 bp, Artificial Sequence
  chemically synthesized
cttcactatgggcaaccttcca

SEQ ID NO: 719032 - DNA, 22 bp, Artificial Sequence
  chemically synthesized
cactatgggcaaccttccaccc

SEQ ID NO: 719033 - DNA, 22 bp, Artificial Sequence
  chemically synthesized
actatgggcaaccttccaccct

SEQ ID NO: 719034 - DNA, 22 bp, Artificial Sequence
  chemically synthesized
tgggcaaccttccaccctccat

SEQ ID NO: 719035 - DNA, 22 bp, Artificial Sequence
  chemically synthesized
agggagaaaaaggaggaatgga

SEQ ID NO: 719036 - DNA, 22 bp, Artificial Sequence
  chemically synthesized
ccaccctccattcctccttttt

SEQ ID NO: 719037 - DNA, 22 bp, Artificial Sequence
  chemically synthesized
caccctccattcctcctttttc

SEQ ID NO: 719038 - DNA, 22 bp, Artificial Sequence
  chemically synthesized
agagcacaggctaagggagaaa

SEQ ID NO: 719039 - DNA, 22 bp, Artificial Sequence
  chemically synthesized
cattcctcctttttctccctta

SEQ ID NO: 719040 - DNA, 22 bp, Artificial Sequence
  chemically synthesized
gagagcacaggctaagggagaa

SEQ ID NO: 719041 - DNA, 22 bp, Artificial Sequence
  chemically synthesized
ttgagagcacaggctaagggag

SEQ ID NO: 719042 - DNA, 22 bp, Artificial Sequence
  chemically synthesized
ctcctttttctcccttagcctg

SEQ ID NO: 719043 - DNA, 22 bp, Artificial Sequence
  chemically synthesized
agttcttgagagcacaggctaa

SEQ ID NO: 719044 - DNA, 22 bp, Artificial Sequence
  chemically synthesized
ctttttctcccttagcctgtgc

SEQ ID NO: 719045 - DNA, 22 bp, Artificial Sequence
  chemically synthesized
aagttcttgagagcacaggcta

SEQ ID NO: 719046 - DNA, 22 bp, Artificial Sequence
  chemically synthesized
taagttcttgagagcacaggct

SEQ ID NO: 719047 - DNA, 22 bp, Artificial Sequence
  chemically synthesized
tttctcccttagcctgtgctct

SEQ ID NO: 719048 - DNA, 22 bp, Artificial Sequence
  chemically synthesized
ttctcccttagcctgtgctctc

SEQ ID NO: 719049 - DNA, 22 bp, Artificial Sequence
  chemically synthesized
tctcccttagcctgtgctctca

SEQ ID NO: 719050 - DNA, 22 bp, Artificial Sequence
  chemically synthesized
ctcccttagcctgtgctctcaa

SEQ ID NO: 719051 - DNA, 22 bp, Artificial Sequence
  chemically synthesized
tcccttagcctgtgctctcaag

SEQ ID NO: 719052 - DNA, 22 bp, Artificial Sequence
  chemically synthesized
ccttagcctgtgctctcaagaa

SEQ ID NO: 719053 - DNA, 22 bp, Artificial Sequence
  chemically synthesized
aagaggttttaagttcttgaga

SEQ ID NO: 719054 - DNA, 22 bp, Artificial Sequence
  chemically synthesized
agcctgtgctctcaagaactta

SEQ ID NO: 719055 - DNA, 22 bp, Artificial Sequence
  chemically synthesized
gcctgtgctctcaagaacttaa

SEQ ID NO: 719056 - DNA, 22 bp, Artificial Sequence
  chemically synthesized
tgctctcaagaacttaaaacct

SEQ ID NO: 719057 - DNA, 22 bp, Artificial Sequence
  chemically synthesized
tcaagaacttaaaacctcttca

SEQ ID NO: 719058 - DNA, 22 bp, Artificial Sequence
  chemically synthesized
aagaacttaaaacctcttcaac

SEQ ID NO: 719059 - DNA, 22 bp, Artificial Sequence
  chemically synthesized
ggtcaggtgtgagttgaagagg

SEQ ID NO: 719060 - DNA, 22 bp, Artificial Sequence
  chemically synthesized
aggtcaggtgtgagttgaagag

SEQ ID NO: 719061 - DNA, 22 bp, Artificial Sequence
  chemically synthesized
taggtcaggtgtgagttgaaga

SEQ ID NO: 719062 - DNA, 22 bp, Artificial Sequence
  chemically synthesized
ggttttaggtcaggtgtgagtt

SEQ ID NO: 719063 - DNA, 22 bp, Artificial Sequence
  chemically synthesized
aaaacctcttcaactcacacct

SEQ ID NO: 719064 - DNA, 22 bp, Artificial Sequence
  chemically synthesized
aggttttaggtcaggtgtgagt

SEQ ID NO: 719065 - DNA, 22 bp, Artificial Sequence
  chemically synthesized
aaacctcttcaactcacacctg

SEQ ID NO: 719066 - DNA, 22 bp, Artificial Sequence
  chemically synthesized
ttcaactcacacctgacctaaa

SEQ ID NO: 719067 - DNA, 22 bp, Artificial Sequence
  chemically synthesized
caactcacacctgacctaaaac

SEQ ID NO: 719068 - DNA, 22 bp, Artificial Sequence
  chemically synthesized
aactcacacctgacctaaaacc

SEQ ID NO: 719069 - DNA, 22 bp, Artificial Sequence
  chemically synthesized
acacctgacctaaaacctaaat

SEQ ID NO: 719070 - DNA, 22 bp, Artificial Sequence
  chemically synthesized
acctaaaacctaaatgccttat

SEQ ID NO: 719071 - DNA, 22 bp, Artificial Sequence
  chemically synthesized
aaacctaaatgccttattttct

SEQ ID NO: 719072 - DNA, 22 bp, Artificial Sequence
  chemically synthesized
aatgccttattttcttctgcga

SEQ ID NO: 719073 - DNA, 22 bp, Artificial Sequence
  chemically synthesized
gggtcaagtggcatcgcagaag

SEQ ID NO: 719074 - DNA, 22 bp, Artificial Sequence
  chemically synthesized
tactggggtcaagtggcatcgc

SEQ ID NO: 719075 - DNA, 22 bp, Artificial Sequence
  chemically synthesized
gtactggggtcaagtggcatcg

SEQ ID NO: 719076 - DNA, 22 bp, Artificial Sequence
  chemically synthesized
attttcttctgcgatgccactt

SEQ ID NO: 719077 - DNA, 22 bp, Artificial Sequence
  chemically synthesized
ttttcttctgcgatgccacttg

SEQ ID NO: 719078 - DNA, 22 bp, Artificial Sequence
  chemically synthesized
tcttctgcgatgccacttgacc

SEQ ID NO: 719079 - DNA, 22 bp, Artificial Sequence
  chemically synthesized
cttctgcgatgccacttgaccc

SEQ ID NO: 719080 - DNA, 22 bp, Artificial Sequence
  chemically synthesized
ttctgcgatgccacttgacccc

SEQ ID NO: 719081 - DNA, 22 bp, Artificial Sequence
  chemically synthesized
tcaagtttgtactggggtcaag

SEQ ID NO: 719082 - DNA, 22 bp, Artificial Sequence
  chemically synthesized
ctgcgatgccacttgaccccag

SEQ ID NO: 719083 - DNA, 22 bp, Artificial Sequence
  chemically synthesized
tgcgatgccacttgaccccagt

SEQ ID NO: 719084 - DNA, 22 bp, Artificial Sequence
  chemically synthesized
ctgtcaagtttgtactggggtc

SEQ ID NO: 719085 - DNA, 22 bp, Artificial Sequence
  chemically synthesized
cgatgccacttgaccccagtac

SEQ ID NO: 719086 - DNA, 22 bp, Artificial Sequence
  chemically synthesized
gaactactgtcaagtttgtact

SEQ ID NO: 719087 - DNA, 22 bp, Artificial Sequence
  chemically synthesized
ggaactactgtcaagtttgtac

SEQ ID NO: 719088 - DNA, 22 bp, Artificial Sequence
  chemically synthesized
tttggaactactgtcaagtttg

SEQ ID NO: 719089 - DNA, 22 bp, Artificial Sequence
  chemically synthesized
gaccccagtacaaacttgacag

SEQ ID NO: 719090 - DNA, 22 bp, Artificial Sequence
  chemically synthesized
accccagtacaaacttgacagt

SEQ ID NO: 719091 - DNA, 22 bp, Artificial Sequence
  chemically synthesized
gctatttggaactactgtcaag

SEQ ID NO: 719092 - DNA, 22 bp, Artificial Sequence
  chemically synthesized
tggctatttggaactactgtca

SEQ ID NO: 719093 - DNA, 22 bp, Artificial Sequence
  chemically synthesized
ctggctatttggaactactgtc

SEQ ID NO: 719094 - DNA, 22 bp, Artificial Sequence
  chemically synthesized
tctggctatttggaactactgt

SEQ ID NO: 719095 - DNA, 22 bp, Artificial Sequence
  chemically synthesized
gacagtagttccaaatagccag

SEQ ID NO: 719096 - DNA, 22 bp, Artificial Sequence
  chemically synthesized
acagtagttccaaatagccaga

SEQ ID NO: 719097 - DNA, 22 bp, Artificial Sequence
  chemically synthesized
aaagtgccgttttctggctatt

SEQ ID NO: 719098 - DNA, 22 bp, Artificial Sequence
  chemically synthesized
caaatagccagaaaacggcact

SEQ ID NO: 719099 - DNA, 22 bp, Artificial Sequence
  chemically synthesized
taggatggaaaaattgaaagtg

SEQ ID NO: 719100 - DNA, 22 bp, Artificial Sequence
  chemically synthesized
gtaggatggaaaaattgaaagt

SEQ ID NO: 719101 - DNA, 22 bp, Artificial Sequence
  chemically synthesized
gagcttgtaggatggaaaaatt

SEQ ID NO: 719102 - DNA, 22 bp, Artificial Sequence
  chemically synthesized
agagcttgtaggatggaaaaat

SEQ ID NO: 719103 - DNA, 22 bp, Artificial Sequence
  chemically synthesized
tttagagcttgtaggatggaaa

SEQ ID NO: 719104 - DNA, 22 bp, Artificial Sequence
  chemically synthesized
tcaatttttccatcctacaagc

SEQ ID NO: 719105 - DNA, 22 bp, Artificial Sequence
  chemically synthesized
caatttttccatcctacaagct

SEQ ID NO: 719106 - DNA, 22 bp, Artificial Sequence
  chemically synthesized
aatttttccatcctacaagctc

SEQ ID NO: 719107 - DNA, 22 bp, Artificial Sequence
  chemically synthesized
tgacaagaattatttagagctt

SEQ ID NO: 719108 - DNA, 22 bp, Artificial Sequence
  chemically synthesized
ttccatcctacaagctctaaat

SEQ ID NO: 719109 - DNA, 22 bp, Artificial Sequence
  chemically synthesized
atgacaagaattatttagagct

SEQ ID NO: 719110 - DNA, 22 bp, Artificial Sequence
  chemically synthesized
tccatcctacaagctctaaata

SEQ ID NO: 719111 - DNA, 22 bp, Artificial Sequence
  chemically synthesized
tatgacaagaattatttagagc

SEQ ID NO: 719112 - DNA, 22 bp, Artificial Sequence
  chemically synthesized
ccatcctacaagctctaaataa

SEQ ID NO: 719113 - DNA, 22 bp, Artificial Sequence
  chemically synthesized
catcctacaagctctaaataat

SEQ ID NO: 719114 - DNA, 22 bp, Artificial Sequence
  chemically synthesized
ttttatgacaagaattatttag

SEQ ID NO: 719115 - DNA, 22 bp, Artificial Sequence
  chemically synthesized
cctattttatgacaagaattat

SEQ ID NO: 719116 - DNA, 22 bp, Artificial Sequence
  chemically synthesized
gcctattttatgacaagaatta

SEQ ID NO: 719117 - DNA, 22 bp, Artificial Sequence
  chemically synthesized
caagctctaaataattcttgtc

SEQ ID NO: 719118 - DNA, 22 bp, Artificial Sequence
  chemically synthesized
taaataattcttgtcataaaat

SEQ ID NO: 719119 - DNA, 22 bp, Artificial Sequence
  chemically synthesized
agaccgtttgcctattttatga

SEQ ID NO: 719120 - DNA, 22 bp, Artificial Sequence
  chemically synthesized
aataattcttgtcataaaatag

SEQ ID NO: 719121 - DNA, 22 bp, Artificial Sequence
  chemically synthesized
ttgtcataaaataggcaaacgg

SEQ ID NO: 719122 - DNA, 22 bp, Artificial Sequence
  chemically synthesized
gtcataaaataggcaaacggtc

SEQ ID NO: 719123 - DNA, 22 bp, Artificial Sequence
  chemically synthesized
tcataaaataggcaaacggtct

SEQ ID NO: 719124 - DNA, 22 bp, Artificial Sequence
  chemically synthesized
gacatcaggcacctcagaccgt

SEQ ID NO: 719125 - DNA, 22 bp, Artificial Sequence
  chemically synthesized
aggtgcctgatgtccaggcatt

SEQ ID NO: 719126 - DNA, 22 bp, Artificial Sequence
  chemically synthesized
atgtccaggcattcttttacac

SEQ ID NO: 719127 - DNA, 22 bp, Artificial Sequence
  chemically synthesized
gggaggggcagatgtgtaaaag

SEQ ID NO: 719128 - DNA, 22 bp, Artificial Sequence
  chemically synthesized
ttttacacatctgcccctcccc

SEQ ID NO: 719129 - DNA, 22 bp, Artificial Sequence
  chemically synthesized
ggaacagagactggggaggggc

SEQ ID NO: 719130 - DNA, 22 bp, Artificial Sequence
  chemically synthesized
ttacacatctgcccctccccag

SEQ ID NO: 719131 - DNA, 22 bp, Artificial Sequence
  chemically synthesized
tacacatctgcccctccccagt

SEQ ID NO: 719132 - DNA, 22 bp, Artificial Sequence
  chemically synthesized
acacatctgcccctccccagtc

SEQ ID NO: 719133 - DNA, 22 bp, Artificial Sequence
  chemically synthesized
cacatctgcccctccccagtct

SEQ ID NO: 719134 - DNA, 22 bp, Artificial Sequence
  chemically synthesized
cattgggaacagagactgggga

SEQ ID NO: 719135 - DNA, 22 bp, Artificial Sequence
  chemically synthesized
cccctccccagtctctgttccc

SEQ ID NO: 719136 - DNA, 22 bp, Artificial Sequence
  chemically synthesized
gaaggagttgcattgggaacag

SEQ ID NO: 719137 - DNA, 22 bp, Artificial Sequence
  chemically synthesized
ggaaggagttgcattgggaaca

SEQ ID NO: 719138 - DNA, 22 bp, Artificial Sequence
  chemically synthesized
cccagtctctgttcccaatgca

SEQ ID NO: 719139 - DNA, 22 bp, Artificial Sequence
  chemically synthesized
tgttcccaatgcaactccttcc

SEQ ID NO: 719140 - DNA, 22 bp, Artificial Sequence
  chemically synthesized
ttcccaatgcaactccttccaa

SEQ ID NO: 719141 - DNA, 22 bp, Artificial Sequence
  chemically synthesized
ccaatgcaactccttccaaatc

SEQ ID NO: 719142 - DNA, 22 bp, Artificial Sequence
  chemically synthesized
cttccaaatcttccttctttcc

SEQ ID NO: 719143 - DNA, 22 bp, Artificial Sequence
  chemically synthesized
ccaaatcttccttctttccctc

SEQ ID NO: 719144 - DNA, 22 bp, Artificial Sequence
  chemically synthesized
caaatcttccttctttccctcc

SEQ ID NO: 719145 - DNA, 22 bp, Artificial Sequence
  chemically synthesized
aggggacaggtgggagggaaag

SEQ ID NO: 719146 - DNA, 22 bp, Artificial Sequence
  chemically synthesized
ggactgaggggacaggtgggag

SEQ ID NO: 719147 - DNA, 22 bp, Artificial Sequence
  chemically synthesized
ccttctttccctcccacctgtc

SEQ ID NO: 719148 - DNA, 22 bp, Artificial Sequence
  chemically synthesized
cttctttccctcccacctgtcc

SEQ ID NO: 719149 - DNA, 22 bp, Artificial Sequence
  chemically synthesized
ctttccctcccacctgtcccct

SEQ ID NO: 719150 - DNA, 22 bp, Artificial Sequence
  chemically synthesized
gggttgggactgaggggacagg

SEQ ID NO: 719151 - DNA, 22 bp, Artificial Sequence
  chemically synthesized
tttccctcccacctgtcccctc

SEQ ID NO: 719152 - DNA, 22 bp, Artificial Sequence
  chemically synthesized
ggggttgggactgaggggacag

SEQ ID NO: 719153 - DNA, 22 bp, Artificial Sequence
  chemically synthesized
tccctcccacctgtcccctcag

SEQ ID NO: 719154 - DNA, 22 bp, Artificial Sequence
  chemically synthesized
ccctcccacctgtcccctcagt

SEQ ID NO: 719155 - DNA, 22 bp, Artificial Sequence
  chemically synthesized
cctcccacctgtcccctcagtc

SEQ ID NO: 719156 - DNA, 22 bp, Artificial Sequence
  chemically synthesized
ccacctgtcccctcagtcccaa

SEQ ID NO: 719157 - DNA, 22 bp, Artificial Sequence
  chemically synthesized
agcgatgcttggggttgggact

SEQ ID NO: 719158 - DNA, 22 bp, Artificial Sequence
  chemically synthesized
tcccctcagtcccaaccccaag

SEQ ID NO: 719159 - DNA, 22 bp, Artificial Sequence
  chemically synthesized
gaaagactgagcgatgcttggg

SEQ ID NO: 719160 - DNA, 22 bp, Artificial Sequence
  chemically synthesized
agtcccaaccccaagcatcgct

SEQ ID NO: 719161 - DNA, 22 bp, Artificial Sequence
  chemically synthesized
tagaaaaggaagattagaaaga

SEQ ID NO: 719162 - DNA, 22 bp, Artificial Sequence
  chemically synthesized
agtctttctaatcttccttttc

SEQ ID NO: 719163 - DNA, 22 bp, Artificial Sequence
  chemically synthesized
tctaatcttccttttctacaga

SEQ ID NO: 719164 - DNA, 22 bp, Artificial Sequence
  chemically synthesized
ctaatcttccttttctacagac

SEQ ID NO: 719165 - DNA, 22 bp, Artificial Sequence
  chemically synthesized
taatcttccttttctacagacc

SEQ ID NO: 719166 - DNA, 22 bp, Artificial Sequence
  chemically synthesized
atcttccttttctacagaccca

SEQ ID NO: 719167 - DNA, 22 bp, Artificial Sequence
  chemically synthesized
ccttttctacagacccatctga

SEQ ID NO: 719168 - DNA, 22 bp, Artificial Sequence
  chemically synthesized
cttttctacagacccatctgac

SEQ ID NO: 719169 - DNA, 22 bp, Artificial Sequence
  chemically synthesized
ttctacagacccatctgacctc

SEQ ID NO: 719170 - DNA, 22 bp, Artificial Sequence
  chemically synthesized
gcgaggaggggagaggtcagat

SEQ ID NO: 719171 - DNA, 22 bp, Artificial Sequence
  chemically synthesized
tctacagacccatctgacctct

SEQ ID NO: 719172 - DNA, 22 bp, Artificial Sequence
  chemically synthesized
ctacagacccatctgacctctc

SEQ ID NO: 719173 - DNA, 22 bp, Artificial Sequence
  chemically synthesized
tacagacccatctgacctctcc

SEQ ID NO: 719174 - DNA, 22 bp, Artificial Sequence
  chemically synthesized
cagacccatctgacctctcccc

SEQ ID NO: 719175 - DNA, 22 bp, Artificial Sequence
  chemically synthesized
ggcctggcgaggaggggagagg

SEQ ID NO: 719176 - DNA, 22 bp, Artificial Sequence
  chemically synthesized
acctctcccctcctcgccaggc

SEQ ID NO: 719177 - DNA, 22 bp, Artificial Sequence
  chemically synthesized
aggaataattgggcctggcgag

SEQ ID NO: 719178 - DNA, 22 bp, Artificial Sequence
  chemically synthesized
tcccctcctcgccaggcccaat

SEQ ID NO: 719179 - DNA, 22 bp, Artificial Sequence
  chemically synthesized
ccctcctcgccaggcccaatta

SEQ ID NO: 719180 - DNA, 22 bp, Artificial Sequence
  chemically synthesized
ctcgccaggcccaattattcct

SEQ ID NO: 719181 - DNA, 22 bp, Artificial Sequence
  chemically synthesized
gccaggcccaattattcctcag

SEQ ID NO: 719182 - DNA, 22 bp, Artificial Sequence
  chemically synthesized
tagggtggaggagcagaggctg

SEQ ID NO: 719183 - DNA, 22 bp, Artificial Sequence
  chemically synthesized
ttcctcagcctctgctcctcca

SEQ ID NO: 719184 - DNA, 22 bp, Artificial Sequence
  chemically synthesized
ctcagcctctgctcctccaccc

SEQ ID NO: 719185 - DNA, 22 bp, Artificial Sequence
  chemically synthesized
agcctctgctcctccaccctat

SEQ ID NO: 719186 - DNA, 22 bp, Artificial Sequence
  chemically synthesized
tgctcctccaccctataatcct

SEQ ID NO: 719187 - DNA, 22 bp, Artificial Sequence
  chemically synthesized
ctcctccaccctataatccttt

SEQ ID NO: 719188 - DNA, 22 bp, Artificial Sequence
  chemically synthesized
ctccaccctataatccttttat

SEQ ID NO: 719189 - DNA, 22 bp, Artificial Sequence
  chemically synthesized
caccctataatccttttatcac

SEQ ID NO: 719190 - DNA, 22 bp, Artificial Sequence
  chemically synthesized
taatccttttatcacctccgct

SEQ ID NO: 719191 - DNA, 22 bp, Artificial Sequence
  chemically synthesized
ttatcacctccgctcctcacac

SEQ ID NO: 719192 - DNA, 22 bp, Artificial Sequence
  chemically synthesized
tatcacctccgctcctcacacc

SEQ ID NO: 719193 - DNA, 22 bp, Artificial Sequence
  chemically synthesized
taagccggaccgggtgtgagga

SEQ ID NO: 719194 - DNA, 22 bp, Artificial Sequence
  chemically synthesized
atcacctccgctcctcacaccc

SEQ ID NO: 719195 - DNA, 22 bp, Artificial Sequence
  chemically synthesized
tcacctccgctcctcacacccg

SEQ ID NO: 719196 - DNA, 22 bp, Artificial Sequence
  chemically synthesized
cgctcctcacacccggtccggc

SEQ ID NO: 719197 - DNA, 22 bp, Artificial Sequence
  chemically synthesized
ctcacacccggtccggcttaca

SEQ ID NO: 719198 - DNA, 22 bp, Artificial Sequence
  chemically synthesized
acacccggtccggcttacagtt

SEQ ID NO: 719199 - DNA, 22 bp, Artificial Sequence
  chemically synthesized
gtcatggaaggaaactgtaagc

SEQ ID NO: 719200 - DNA, 22 bp, Artificial Sequence
  chemically synthesized
acagtttccttccatgactagc

SEQ ID NO: 719201 - DNA, 22 bp, Artificial Sequence
  chemically synthesized
cagtttccttccatgactagcc

SEQ ID NO: 719202 - DNA, 22 bp, Artificial Sequence
  chemically synthesized
ggcaggtgggggagggctagtc

SEQ ID NO: 719203 - DNA, 22 bp, Artificial Sequence
  chemically synthesized
ctgggcaggtgggggagggcta

SEQ ID NO: 719204 - DNA, 22 bp, Artificial Sequence
  chemically synthesized
ccttccatgactagccctcccc

SEQ ID NO: 719205 - DNA, 22 bp, Artificial Sequence
  chemically synthesized
cttccatgactagccctccccc

SEQ ID NO: 719206 - DNA, 22 bp, Artificial Sequence
  chemically synthesized
ccatgactagccctcccccacc

SEQ ID NO: 719207 - DNA, 22 bp, Artificial Sequence
  chemically synthesized
catgactagccctcccccacct

SEQ ID NO: 719208 - DNA, 22 bp, Artificial Sequence
  chemically synthesized
agaggaaattgctgggcaggtg

SEQ ID NO: 719209 - DNA, 22 bp, Artificial Sequence
  chemically synthesized
aagaggaaattgctgggcaggt

SEQ ID NO: 719210 - DNA, 22 bp, Artificial Sequence
  chemically synthesized
taagaggaaattgctgggcagg

SEQ ID NO: 719211 - DNA, 22 bp, Artificial Sequence
  chemically synthesized
gccctcccccacctgcccagca

SEQ ID NO: 719212 - DNA, 22 bp, Artificial Sequence
  chemically synthesized
ttaagaggaaattgctgggcag

SEQ ID NO: 719213 - DNA, 22 bp, Artificial Sequence
  chemically synthesized
tttaagaggaaattgctgggca

SEQ ID NO: 719214 - DNA, 22 bp, Artificial Sequence
  chemically synthesized
ccccacctgcccagcaatttcc

SEQ ID NO: 719215 - DNA, 22 bp, Artificial Sequence
  chemically synthesized
cagccacctttttaagaggaaa

SEQ ID NO: 719216 - DNA, 22 bp, Artificial Sequence
  chemically synthesized
cccagcaatttcctcttaaaaa

SEQ ID NO: 719217 - DNA, 22 bp, Artificial Sequence
  chemically synthesized
gctccagccacctttttaagag

SEQ ID NO: 719218 - DNA, 22 bp, Artificial Sequence
  chemically synthesized
agctccagccacctttttaaga

SEQ ID NO: 719219 - DNA, 22 bp, Artificial Sequence
  chemically synthesized
tagctccagccacctttttaag

SEQ ID NO: 719220 - DNA, 22 bp, Artificial Sequence
  chemically synthesized
tgcctttagctccagccacctt

SEQ ID NO: 719221 - DNA, 22 bp, Artificial Sequence
  chemically synthesized
cctcttaaaaaggtggctggag

SEQ ID NO: 719222 - DNA, 22 bp, Artificial Sequence
  chemically synthesized
ctcttaaaaaggtggctggagc

SEQ ID NO: 719223 - DNA, 22 bp, Artificial Sequence
  chemically synthesized
actatgcctttagctccagcca

SEQ ID NO: 719224 - DNA, 22 bp, Artificial Sequence
  chemically synthesized
gactatgcctttagctccagcc

SEQ ID NO: 719225 - DNA, 22 bp, Artificial Sequence
  chemically synthesized
ttaaaaaggtggctggagctaa

SEQ ID NO: 719226 - DNA, 22 bp, Artificial Sequence
  chemically synthesized
aaaaaggtggctggagctaaag

SEQ ID NO: 719227 - DNA, 22 bp, Artificial Sequence
  chemically synthesized
aaaaggtggctggagctaaagg

SEQ ID NO: 719228 - DNA, 22 bp, Artificial Sequence
  chemically synthesized
accttgactatgcctttagctc

SEQ ID NO: 719229 - DNA, 22 bp, Artificial Sequence
  chemically synthesized
gagctaaaggcatagtcaaggt

SEQ ID NO: 719230 - DNA, 22 bp, Artificial Sequence
  chemically synthesized
aaggcatagtcaaggttaatgc

SEQ ID NO: 719231 - DNA, 22 bp, Artificial Sequence
  chemically synthesized
ggataaagaaaaaggagcatta

SEQ ID NO: 719232 - DNA, 22 bp, Artificial Sequence
  chemically synthesized
gggataaagaaaaaggagcatt

SEQ ID NO: 719233 - DNA, 22 bp, Artificial Sequence
  chemically synthesized
atttgggataaagaaaaaggag

SEQ ID NO: 719234 - DNA, 22 bp, Artificial Sequence
  chemically synthesized
tctgatttgggataaagaaaaa

SEQ ID NO: 719235 - DNA, 22 bp, Artificial Sequence
  chemically synthesized
atgctcctttttctttatccca

SEQ ID NO: 719236 - DNA, 22 bp, Artificial Sequence
  chemically synthesized
aacgctatctgatttgggataa

SEQ ID NO: 719237 - DNA, 22 bp, Artificial Sequence
  chemically synthesized
ctttttctttatcccaaatcag

SEQ ID NO: 719238 - DNA, 22 bp, Artificial Sequence
  chemically synthesized
tttctttatcccaaatcagata

SEQ ID NO: 719239 - DNA, 22 bp, Artificial Sequence
  chemically synthesized
ttctttatcccaaatcagatag

SEQ ID NO: 719240 - DNA, 22 bp, Artificial Sequence
  chemically synthesized
tctttatcccaaatcagatagc

SEQ ID NO: 719241 - DNA, 22 bp, Artificial Sequence
  chemically synthesized
ctttatcccaaatcagatagcg

SEQ ID NO: 719242 - DNA, 22 bp, Artificial Sequence
  chemically synthesized
tttatcccaaatcagatagcgt

SEQ ID NO: 719243 - DNA, 22 bp, Artificial Sequence
  chemically synthesized
tatcccaaatcagatagcgttt

SEQ ID NO: 719244 - DNA, 22 bp, Artificial Sequence
  chemically synthesized
atcccaaatcagatagcgttta

SEQ ID NO: 719245 - DNA, 22 bp, Artificial Sequence
  chemically synthesized
tcccaaatcagatagcgtttag

SEQ ID NO: 719246 - DNA, 22 bp, Artificial Sequence
  chemically synthesized
atgaaaaagagcctaaacgcta

SEQ ID NO: 719247 - DNA, 22 bp, Artificial Sequence
  chemically synthesized
gatgaaaaagagcctaaacgct

SEQ ID NO: 719248 - DNA, 22 bp, Artificial Sequence
  chemically synthesized
tttgatgaaaaagagcctaaac

SEQ ID NO: 719249 - DNA, 22 bp, Artificial Sequence
  chemically synthesized
atttgatgaaaaagagcctaaa

SEQ ID NO: 719250 - DNA, 22 bp, Artificial Sequence
  chemically synthesized
tatttgatgaaaaagagcctaa

SEQ ID NO: 719251 - DNA, 22 bp, Artificial Sequence
  chemically synthesized
ttatttgatgaaaaagagccta

SEQ ID NO: 719252 - DNA, 22 bp, Artificial Sequence
  chemically synthesized
tttatttgatgaaaaagagcct

SEQ ID NO: 719253 - DNA, 22 bp, Artificial Sequence
  chemically synthesized
ttttatttgatgaaaaagagcc

SEQ ID NO: 719254 - DNA, 22 bp, Artificial Sequence
  chemically synthesized
tttttttatttgatgaaaaaga

SEQ ID NO: 719255 - DNA, 22 bp, Artificial Sequence
  chemically synthesized
gtttttttatttgatgaaaaag

SEQ ID NO: 719256 - DNA, 22 bp, Artificial Sequence
  chemically synthesized
ggcttgtttttttatttgatga

SEQ ID NO: 719257 - DNA, 22 bp, Artificial Sequence
  chemically synthesized
aggctctttttcatcaaataaa

SEQ ID NO: 719258 - DNA, 22 bp, Artificial Sequence
  chemically synthesized
ggctctttttcatcaaataaaa

SEQ ID NO: 719259 - DNA, 22 bp, Artificial Sequence
  chemically synthesized
tttttcatcaaataaaaaaaca

SEQ ID NO: 719260 - DNA, 22 bp, Artificial Sequence
  chemically synthesized
tttcatcaaataaaaaaacaag

SEQ ID NO: 719261 - DNA, 22 bp, Artificial Sequence
  chemically synthesized
ttcatcaaataaaaaaacaagc

SEQ ID NO: 719262 - DNA, 22 bp, Artificial Sequence
  chemically synthesized
tcatcaaataaaaaaacaagcc

SEQ ID NO: 719263 - DNA, 22 bp, Artificial Sequence
  chemically synthesized
catcaaataaaaaaacaagccc

SEQ ID NO: 719264 - DNA, 22 bp, Artificial Sequence
  chemically synthesized
atcaaataaaaaaacaagccca

SEQ ID NO: 719265 - DNA, 22 bp, Artificial Sequence
  chemically synthesized
ccaaacgagccatgaactgggc

SEQ ID NO: 719266 - DNA, 22 bp, Artificial Sequence
  chemically synthesized
ttgccaaacgagccatgaactg

SEQ ID NO: 719267 - DNA, 22 bp, Artificial Sequence
  chemically synthesized
agggttgttgccaaacgagcca

SEQ ID NO: 719268 - DNA, 22 bp, Artificial Sequence
  chemically synthesized
atggctcgtttggcaacaaccc

SEQ ID NO: 719269 - DNA, 22 bp, Artificial Sequence
  chemically synthesized
taaagcatctcagggttgttgc

SEQ ID NO: 719270 - DNA, 22 bp, Artificial Sequence
  chemically synthesized
gggctgtaaagcatctcagggt

SEQ ID NO: 719271 - DNA, 22 bp, Artificial Sequence
  chemically synthesized
gtttggcaacaaccctgagatg

SEQ ID NO: 719272 - DNA, 22 bp, Artificial Sequence
  chemically synthesized
ggcaacaaccctgagatgcttt

SEQ ID NO: 719273 - DNA, 22 bp, Artificial Sequence
  chemically synthesized
gcaacaaccctgagatgcttta

SEQ ID NO: 719274 - DNA, 22 bp, Artificial Sequence
  chemically synthesized
gggtctagggctgtaaagcatc

SEQ ID NO: 719275 - DNA, 22 bp, Artificial Sequence
  chemically synthesized
agggtctagggctgtaaagcat

SEQ ID NO: 719276 - DNA, 22 bp, Artificial Sequence
  chemically synthesized
tagggtctagggctgtaaagca

SEQ ID NO: 719277 - DNA, 22 bp, Artificial Sequence
  chemically synthesized
ttagggtctagggctgtaaagc

SEQ ID NO: 719278 - DNA, 22 bp, Artificial Sequence
  chemically synthesized
accttttagggtctagggctgt

SEQ ID NO: 719279 - DNA, 22 bp, Artificial Sequence
  chemically synthesized
gaccttttagggtctagggctg

SEQ ID NO: 719280 - DNA, 22 bp, Artificial Sequence
  chemically synthesized
tgaccttttagggtctagggct

SEQ ID NO: 719281 - DNA, 22 bp, Artificial Sequence
  chemically synthesized
agatgctttacagccctagacc

SEQ ID NO: 719282 - DNA, 22 bp, Artificial Sequence
  chemically synthesized
ttgaccttttagggtctagggc

SEQ ID NO: 719283 - DNA, 22 bp, Artificial Sequence
  chemically synthesized
tacagccctagaccctaaaagg

SEQ ID NO: 719284 - DNA, 22 bp, Artificial Sequence
  chemically synthesized
acagccctagaccctaaaaggt

SEQ ID NO: 719285 - DNA, 22 bp, Artificial Sequence
  chemically synthesized
cagccctagaccctaaaaggtc

SEQ ID NO: 719286 - DNA, 22 bp, Artificial Sequence
  chemically synthesized
agaataagacggccttttgacc

SEQ ID NO: 719287 - DNA, 22 bp, Artificial Sequence
  chemically synthesized
gaccctaaaaggtcaaaaggcc

SEQ ID NO: 719288 - DNA, 22 bp, Artificial Sequence
  chemically synthesized
aaaggtcaaaaggccgtcttat

SEQ ID NO: 719289 - DNA, 22 bp, Artificial Sequence
  chemically synthesized
ggtaataaaatatatattgaga

SEQ ID NO: 719290 - DNA, 22 bp, Artificial Sequence
  chemically synthesized
attctcaatatatattttatta

SEQ ID NO: 719291 - DNA, 22 bp, Artificial Sequence
  chemically synthesized
ttctcaatatatattttattac

SEQ ID NO: 719292 - DNA, 22 bp, Artificial Sequence
  chemically synthesized
tcaatatatattttattaccca

SEQ ID NO: 719293 - DNA, 22 bp, Artificial Sequence
  chemically synthesized
aatatatattttattacccaat

SEQ ID NO: 719294 - DNA, 22 bp, Artificial Sequence
  chemically synthesized
atgtcgggagcagattgggtaa

SEQ ID NO: 719295 - DNA, 22 bp, Artificial Sequence
  chemically synthesized
aatgtcgggagcagattgggta

SEQ ID NO: 719296 - DNA, 22 bp, Artificial Sequence
  chemically synthesized
gagtttaatgtcgggagcagat

SEQ ID NO: 719297 - DNA, 22 bp, Artificial Sequence
  chemically synthesized
ggagtttaatgtcgggagcaga

SEQ ID NO: 719298 - DNA, 22 bp, Artificial Sequence
  chemically synthesized
tggagtttaatgtcgggagcag

SEQ ID NO: 719299 - DNA, 22 bp, Artificial Sequence
  chemically synthesized
tattacccaatctgctcccgac

SEQ ID NO: 719300 - DNA, 22 bp, Artificial Sequence
  chemically synthesized
ttggagtttaatgtcgggagca

SEQ ID NO: 719301 - DNA, 22 bp, Artificial Sequence
  chemically synthesized
attacccaatctgctcccgaca

SEQ ID NO: 719302 - DNA, 22 bp, Artificial Sequence
  chemically synthesized
ttacccaatctgctcccgacat

SEQ ID NO: 719303 - DNA, 22 bp, Artificial Sequence
  chemically synthesized
atttttggagtttaatgtcggg

SEQ ID NO: 719304 - DNA, 22 bp, Artificial Sequence
  chemically synthesized
cccaatctgctcccgacattaa

SEQ ID NO: 719305 - DNA, 22 bp, Artificial Sequence
  chemically synthesized
aatttttggagtttaatgtcgg

SEQ ID NO: 719306 - DNA, 22 bp, Artificial Sequence
  chemically synthesized
gaatttaatttttggagtttaa

SEQ ID NO: 719307 - DNA, 22 bp, Artificial Sequence
  chemically synthesized
ctcccgacattaaactccaaaa

SEQ ID NO: 719308 - DNA, 22 bp, Artificial Sequence
  chemically synthesized
ccgacattaaactccaaaaatt

SEQ ID NO: 719309 - DNA, 22 bp, Artificial Sequence
  chemically synthesized
agggctggaatttaatttttgg

SEQ ID NO: 719310 - DNA, 22 bp, Artificial Sequence
  chemically synthesized
gagggctggaatttaatttttg

SEQ ID NO: 719311 - DNA, 22 bp, Artificial Sequence
  chemically synthesized
aactccaaaaattaaattccag

SEQ ID NO: 719312 - DNA, 22 bp, Artificial Sequence
  chemically synthesized
tggggtttgagggctggaattt

SEQ ID NO: 719313 - DNA, 22 bp, Artificial Sequence
  chemically synthesized
gtggggtttgagggctggaatt

SEQ ID NO: 719314 - DNA, 22 bp, Artificial Sequence
  chemically synthesized
caaaaattaaattccagccctc

SEQ ID NO: 719315 - DNA, 22 bp, Artificial Sequence
  chemically synthesized
agtcttgtggggtttgagggct

SEQ ID NO: 719316 - DNA, 22 bp, Artificial Sequence
  chemically synthesized
attaagtcttgtggggtttgag

SEQ ID NO: 719317 - DNA, 22 bp, Artificial Sequence
  chemically synthesized
aattccagccctcaaaccccac

SEQ ID NO: 719318 - DNA, 22 bp, Artificial Sequence
  chemically synthesized
cagccctcaaaccccacaagac

SEQ ID NO: 719319 - DNA, 22 bp, Artificial Sequence
  chemically synthesized
aaggcgaggttaattaagtctt

SEQ ID NO: 719320 - DNA, 22 bp, Artificial Sequence
  chemically synthesized
gaaggcgaggttaattaagtct

SEQ ID NO: 719321 - DNA, 22 bp, Artificial Sequence
  chemically synthesized
aaaccccacaagacttaattaa

SEQ ID NO: 719322 - DNA, 22 bp, Artificial Sequence
  chemically synthesized
tacaccttgaaggcgaggttaa

SEQ ID NO: 719323 - DNA, 22 bp, Artificial Sequence
  chemically synthesized
ttgtacaccttgaaggcgaggt

SEQ ID NO: 719324 - DNA, 22 bp, Artificial Sequence
  chemically synthesized
ttattgtacaccttgaaggcga

SEQ ID NO: 719325 - DNA, 22 bp, Artificial Sequence
  chemically synthesized
attattgtacaccttgaaggcg

SEQ ID NO: 719326 - DNA, 22 bp, Artificial Sequence
  chemically synthesized
tattattgtacaccttgaaggc

SEQ ID NO: 719327 - DNA, 22 bp, Artificial Sequence
  chemically synthesized
aattaacctcgccttcaaggtg

SEQ ID NO: 719328 - DNA, 22 bp, Artificial Sequence
  chemically synthesized
attaacctcgccttcaaggtgt

SEQ ID NO: 719329 - DNA, 22 bp, Artificial Sequence
  chemically synthesized
ctttattattgtacaccttgaa

SEQ ID NO: 719330 - DNA, 22 bp, Artificial Sequence
  chemically synthesized
tactttattattgtacaccttg

SEQ ID NO: 719331 - DNA, 22 bp, Artificial Sequence
  chemically synthesized
acctcgccttcaaggtgtacaa

SEQ ID NO: 719332 - DNA, 22 bp, Artificial Sequence
  chemically synthesized
cctctactttattattgtacac

SEQ ID NO: 719333 - DNA, 22 bp, Artificial Sequence
  chemically synthesized
gccttcaaggtgtacaataata

SEQ ID NO: 719334 - DNA, 22 bp, Artificial Sequence
  chemically synthesized
gctgcctctactttattattgt

SEQ ID NO: 719335 - DNA, 22 bp, Artificial Sequence
  chemically synthesized
ggctgcctctactttattattg

SEQ ID NO: 719336 - DNA, 22 bp, Artificial Sequence
  chemically synthesized
caaggtgtacaataataaagta

SEQ ID NO: 719337 - DNA, 22 bp, Artificial Sequence
  chemically synthesized
cttggctgcctctactttatta

SEQ ID NO: 719338 - DNA, 22 bp, Artificial Sequence
  chemically synthesized
aaggtgtacaataataaagtag

SEQ ID NO: 719339 - DNA, 22 bp, Artificial Sequence
  chemically synthesized
ctacttggctgcctctacttta

SEQ ID NO: 719340 - DNA, 22 bp, Artificial Sequence
  chemically synthesized
agaaatacattgctacttggct

SEQ ID NO: 719341 - DNA, 22 bp, Artificial Sequence
  chemically synthesized
caactcagaaatacattgctac

SEQ ID NO: 719342 - DNA, 22 bp, Artificial Sequence
  chemically synthesized
acagtggagggaaggaattgca

SEQ ID NO: 719343 - DNA, 22 bp, Artificial Sequence
  chemically synthesized
tctcacagtggagggaaggaat

SEQ ID NO: 719344 - DNA, 22 bp, Artificial Sequence
  chemically synthesized
gtctcacagtggagggaaggaa

SEQ ID NO: 719345 - DNA, 22 bp, Artificial Sequence
  chemically synthesized
ctgagttgcaattccttccctc

SEQ ID NO: 719346 - DNA, 22 bp, Artificial Sequence
  chemically synthesized
tgagttgcaattccttccctcc

SEQ ID NO: 719347 - DNA, 22 bp, Artificial Sequence
  chemically synthesized
agttgcaattccttccctccac

SEQ ID NO: 719348 - DNA, 22 bp, Artificial Sequence
  chemically synthesized
gggtttgtctcacagtggaggg

SEQ ID NO: 719349 - DNA, 22 bp, Artificial Sequence
  chemically synthesized
caattccttccctccactgtga

SEQ ID NO: 719350 - DNA, 22 bp, Artificial Sequence
  chemically synthesized
cttccctccactgtgagacaaa

SEQ ID NO: 719351 - DNA, 22 bp, Artificial Sequence
  chemically synthesized
ccctccactgtgagacaaaccc

SEQ ID NO: 719352 - DNA, 22 bp, Artificial Sequence
  chemically synthesized
gagatatggctggggtttgtct

SEQ ID NO: 719353 - DNA, 22 bp, Artificial Sequence
  chemically synthesized
cctccactgtgagacaaacccc

SEQ ID NO: 719354 - DNA, 22 bp, Artificial Sequence
  chemically synthesized
cactgtgagacaaaccccagcc

SEQ ID NO: 719355 - DNA, 22 bp, Artificial Sequence
  chemically synthesized
tgctggagatatggctggggtt

SEQ ID NO: 719356 - DNA, 22 bp, Artificial Sequence
  chemically synthesized
tgtgctggagatatggctgggg

SEQ ID NO: 719357 - DNA, 22 bp, Artificial Sequence
  chemically synthesized
ctgtgctggagatatggctggg

SEQ ID NO: 719358 - DNA, 22 bp, Artificial Sequence
  chemically synthesized
tgagacaaaccccagccatatc

SEQ ID NO: 719359 - DNA, 22 bp, Artificial Sequence
  chemically synthesized
ttctgtgctggagatatggctg

SEQ ID NO: 719360 - DNA, 22 bp, Artificial Sequence
  chemically synthesized
gagttcttctgtgctggagata

SEQ ID NO: 719361 - DNA, 22 bp, Artificial Sequence
  chemically synthesized
ggagttcttctgtgctggagat

SEQ ID NO: 719362 - DNA, 22 bp, Artificial Sequence
  chemically synthesized
aggcatttggagttcttctgtg

SEQ ID NO: 719363 - DNA, 22 bp, Artificial Sequence
  chemically synthesized
cagttcaggcatttggagttct

SEQ ID NO: 719364 - DNA, 22 bp, Artificial Sequence
  chemically synthesized
cagcacagaagaactccaaatg

SEQ ID NO: 719365 - DNA, 22 bp, Artificial Sequence
  chemically synthesized
gcagctgcagttcaggcatttg

SEQ ID NO: 719366 - DNA, 22 bp, Artificial Sequence
  chemically synthesized
caaatgcctgaactgcagctgc

SEQ ID NO: 719367 - DNA, 22 bp, Artificial Sequence
  chemically synthesized
gaggaacccctcgcagctgcag

SEQ ID NO: 719368 - DNA, 22 bp, Artificial Sequence
  chemically synthesized
tggaggaacccctcgcagctgc

SEQ ID NO: 719369 - DNA, 22 bp, Artificial Sequence
  chemically synthesized
aactgcagctgcgaggggttcc

SEQ ID NO: 719370 - DNA, 22 bp, Artificial Sequence
  chemically synthesized
cagctgcgaggggttcctccag

SEQ ID NO: 719371 - DNA, 22 bp, Artificial Sequence
  chemically synthesized
ggggaggccattctggaggaac

SEQ ID NO: 719372 - DNA, 22 bp, Artificial Sequence
  chemically synthesized
ctgggggaggccattctggagg

SEQ ID NO: 719373 - DNA, 22 bp, Artificial Sequence
  chemically synthesized
cgaggggttcctccagaatggc

SEQ ID NO: 719374 - DNA, 22 bp, Artificial Sequence
  chemically synthesized
tagcaagctcctgggggaggcc

SEQ ID NO: 719375 - DNA, 22 bp, Artificial Sequence
  chemically synthesized
gtagcaagctcctgggggaggc

SEQ ID NO: 719376 - DNA, 22 bp, Artificial Sequence
  chemically synthesized
ctccagaatggcctcccccagg

SEQ ID NO: 719377 - DNA, 22 bp, Artificial Sequence
  chemically synthesized
cagaatggcctcccccaggagc

SEQ ID NO: 719378 - DNA, 22 bp, Artificial Sequence
  chemically synthesized
gcacttgtagcaagctcctggg

SEQ ID NO: 719379 - DNA, 22 bp, Artificial Sequence
  chemically synthesized
tggcacttgtagcaagctcctg

SEQ ID NO: 719380 - DNA, 22 bp, Artificial Sequence
  chemically synthesized
ctggcacttgtagcaagctcct

SEQ ID NO: 719381 - DNA, 22 bp, Artificial Sequence
  chemically synthesized
ccccaggagcttgctacaagtg

SEQ ID NO: 719382 - DNA, 22 bp, Artificial Sequence
  chemically synthesized
gcccagtggccagatttctggc

SEQ ID NO: 719383 - DNA, 22 bp, Artificial Sequence
  chemically synthesized
ggcccagtggccagatttctgg

SEQ ID NO: 719384 - DNA, 22 bp, Artificial Sequence
  chemically synthesized
gctacaagtgccagaaatctgg

SEQ ID NO: 719385 - DNA, 22 bp, Artificial Sequence
  chemically synthesized
ctacaagtgccagaaatctggc

SEQ ID NO: 719386 - DNA, 22 bp, Artificial Sequence
  chemically synthesized
cttggcccagtggccagatttc

SEQ ID NO: 719387 - DNA, 22 bp, Artificial Sequence
  chemically synthesized
caagtgccagaaatctggccac

SEQ ID NO: 719388 - DNA, 22 bp, Artificial Sequence
  chemically synthesized
cgggcattccttggcccagtgg

SEQ ID NO: 719389 - DNA, 22 bp, Artificial Sequence
  chemically synthesized
gccactgggccaaggaatgccc

SEQ ID NO: 719390 - DNA, 22 bp, Artificial Sequence
  chemically synthesized
ggaggaatcccgggctgcgggc

SEQ ID NO: 719391 - DNA, 22 bp, Artificial Sequence
  chemically synthesized
ggccaaggaatgcccgcagccc

SEQ ID NO: 719392 - DNA, 22 bp, Artificial Sequence
  chemically synthesized
aggaggaatcccgggctgcggg

SEQ ID NO: 719393 - DNA, 22 bp, Artificial Sequence
  chemically synthesized
cacagatgggacatggcttagg

SEQ ID NO: 719394 - DNA, 22 bp, Artificial Sequence
  chemically synthesized
ctcctaagccatgtcccatctg

SEQ ID NO: 719395 - DNA, 22 bp, Artificial Sequence
  chemically synthesized
agtggggtcctccacagatggg

SEQ ID NO: 719396 - DNA, 22 bp, Artificial Sequence
  chemically synthesized
ctaagccatgtcccatctgtgg

SEQ ID NO: 719397 - DNA, 22 bp, Artificial Sequence
  chemically synthesized
cagtggggtcctccacagatgg

SEQ ID NO: 719398 - DNA, 22 bp, Artificial Sequence
  chemically synthesized
tcagtggggtcctccacagatg

SEQ ID NO: 719399 - DNA, 22 bp, Artificial Sequence
  chemically synthesized
agccatgtcccatctgtggagg

SEQ ID NO: 719400 - DNA, 22 bp, Artificial Sequence
  chemically synthesized
aacagtccgattttcagtgggg

SEQ ID NO: 719401 - DNA, 22 bp, Artificial Sequence
  chemically synthesized
tggaggaccccactgaaaatcg

SEQ ID NO: 719402 - DNA, 22 bp, Artificial Sequence
  chemically synthesized
ccaggtgagttgaacagtccga

SEQ ID NO: 719403 - DNA, 22 bp, Artificial Sequence
  chemically synthesized
aaaatcggactgttcaactcac

SEQ ID NO: 719404 - DNA, 22 bp, Artificial Sequence
  chemically synthesized
ggagtggctgccaggtgagttg

SEQ ID NO: 719405 - DNA, 22 bp, Artificial Sequence
  chemically synthesized
tgggagtggctgccaggtgagt

SEQ ID NO: 719406 - DNA, 22 bp, Artificial Sequence
  chemically synthesized
ttcaactcacctggcagccact

SEQ ID NO: 719407 - DNA, 22 bp, Artificial Sequence
  chemically synthesized
caggggctctgggagtggctgc

SEQ ID NO: 719408 - DNA, 22 bp, Artificial Sequence
  chemically synthesized
aactcacctggcagccactccc

SEQ ID NO: 719409 - DNA, 22 bp, Artificial Sequence
  chemically synthesized
acctggcagccactcccagagc

SEQ ID NO: 719410 - DNA, 22 bp, Artificial Sequence
  chemically synthesized
ggccagagttccaggggctctg

SEQ ID NO: 719411 - DNA, 22 bp, Artificial Sequence
  chemically synthesized
gcagccactcccagagcccctg

SEQ ID NO: 719412 - DNA, 22 bp, Artificial Sequence
  chemically synthesized
gggccagagttccaggggctct

SEQ ID NO: 719413 - DNA, 22 bp, Artificial Sequence
  chemically synthesized
ccagagcccctggaactctggc

SEQ ID NO: 719414 - DNA, 22 bp, Artificial Sequence
  chemically synthesized
ggaaggagtcagagagccttgg

SEQ ID NO: 719415 - DNA, 22 bp, Artificial Sequence
  chemically synthesized
gaactctggcccaaggctctct

SEQ ID NO: 719416 - DNA, 22 bp, Artificial Sequence
  chemically synthesized
tggcccaaggctctctgactcc

SEQ ID NO: 719417 - DNA, 22 bp, Artificial Sequence
  chemically synthesized
gcccaaggctctctgactcctt

SEQ ID NO: 719418 - DNA, 22 bp, Artificial Sequence
  chemically synthesized
aaccgagaagatctgggaagga

SEQ ID NO: 719419 - DNA, 22 bp, Artificial Sequence
  chemically synthesized
tctgactccttcccagatcttc

SEQ ID NO: 719420 - DNA, 22 bp, Artificial Sequence
  chemically synthesized
tgactccttcccagatcttctc

SEQ ID NO: 719421 - DNA, 22 bp, Artificial Sequence
  chemically synthesized
agccactaaaccgagaagatct

SEQ ID NO: 719422 - DNA, 22 bp, Artificial Sequence
  chemically synthesized
cagccactaaaccgagaagatc

SEQ ID NO: 719423 - DNA, 22 bp, Artificial Sequence
  chemically synthesized
actccttcccagatcttctcgg

SEQ ID NO: 719424 - DNA, 22 bp, Artificial Sequence
  chemically synthesized
cttcccagatcttctcggttta

SEQ ID NO: 719425 - DNA, 22 bp, Artificial Sequence
  chemically synthesized
cccagatcttctcggtttagtg

SEQ ID NO: 719426 - DNA, 22 bp, Artificial Sequence
  chemically synthesized
ccagatcttctcggtttagtgg

SEQ ID NO: 719427 - DNA, 22 bp, Artificial Sequence
  chemically synthesized
ctcggtttagtggctgaagact

SEQ ID NO: 719428 - DNA, 22 bp, Artificial Sequence
  chemically synthesized
tcggtttagtggctgaagactg

SEQ ID NO: 719429 - DNA, 22 bp, Artificial Sequence
  chemically synthesized
ggtttagtggctgaagactgac

SEQ ID NO: 719430 - DNA, 22 bp, Artificial Sequence
  chemically synthesized
aggcaatcgggcagcgtcagtc

SEQ ID NO: 719431 - DNA, 22 bp, Artificial Sequence
  chemically synthesized
agtggctgaagactgacgctgc

SEQ ID NO: 719432 - DNA, 22 bp, Artificial Sequence
  chemically synthesized
tgaggcaatcgggcagcgtcag

SEQ ID NO: 719433 - DNA, 22 bp, Artificial Sequence
  chemically synthesized
gtggctgaagactgacgctgcc

SEQ ID NO: 719434 - DNA, 22 bp, Artificial Sequence
  chemically synthesized
ctgaggcaatcgggcagcgtca

SEQ ID NO: 719435 - DNA, 22 bp, Artificial Sequence
  chemically synthesized
aagactgacgctgcccgattgc

SEQ ID NO: 719436 - DNA, 22 bp, Artificial Sequence
  chemically synthesized
gggggcttctgaggcaatcggg

SEQ ID NO: 719437 - DNA, 22 bp, Artificial Sequence
  chemically synthesized
acgctgcccgattgcctcagaa

SEQ ID NO: 719438 - DNA, 22 bp, Artificial Sequence
  chemically synthesized
tgatggtctagggggcttctga

SEQ ID NO: 719439 - DNA, 22 bp, Artificial Sequence
  chemically synthesized
cccgattgcctcagaagccccc

SEQ ID NO: 719440 - DNA, 22 bp, Artificial Sequence
  chemically synthesized
cctcagaagccccctagaccat

SEQ ID NO: 719441 - DNA, 22 bp, Artificial Sequence
  chemically synthesized
agaagccccctagaccatcaca

SEQ ID NO: 719442 - DNA, 22 bp, Artificial Sequence
  chemically synthesized
aagatcggcatctgtgatggtc

SEQ ID NO: 719443 - DNA, 22 bp, Artificial Sequence
  chemically synthesized
cctgaagatcggcatctgtgat

SEQ ID NO: 719444 - DNA, 22 bp, Artificial Sequence
  chemically synthesized
gaccatcacagatgccgatctt

SEQ ID NO: 719445 - DNA, 22 bp, Artificial Sequence
  chemically synthesized
tgagagttacctgaagatcggc

SEQ ID NO: 719446 - DNA, 22 bp, Artificial Sequence
  chemically synthesized
cactgtgagagttacctgaaga

SEQ ID NO: 719447 - DNA, 22 bp, Artificial Sequence
  chemically synthesized
ccctccactgtgagagttacct

SEQ ID NO: 719448 - DNA, 22 bp, Artificial Sequence
  chemically synthesized
accctccactgtgagagttacc

SEQ ID NO: 719449 - DNA, 22 bp, Artificial Sequence
  chemically synthesized
caggtaactctcacagtggagg

SEQ ID NO: 719450 - DNA, 22 bp, Artificial Sequence
  chemically synthesized
aggtaactctcacagtggaggg

SEQ ID NO: 719451 - DNA, 22 bp, Artificial Sequence
  chemically synthesized
agaaggggacggacttaccctc

SEQ ID NO: 719452 - DNA, 22 bp, Artificial Sequence
  chemically synthesized
tcacagtggagggtaagtccgt

SEQ ID NO: 719453 - DNA, 22 bp, Artificial Sequence
  chemically synthesized
attaagaaggggacggacttac

SEQ ID NO: 719454 - DNA, 22 bp, Artificial Sequence
  chemically synthesized
acagtggagggtaagtccgtcc

SEQ ID NO: 719455 - DNA, 22 bp, Artificial Sequence
  chemically synthesized
cgtattgattaagaaggggacg

SEQ ID NO: 719456 - DNA, 22 bp, Artificial Sequence
  chemically synthesized
cttaatcaatacggaggctacc

SEQ ID NO: 719457 - DNA, 22 bp, Artificial Sequence
  chemically synthesized
ttaatcaatacggaggctaccc

SEQ ID NO: 719458 - DNA, 22 bp, Artificial Sequence
  chemically synthesized
aatcaatacggaggctacccac

SEQ ID NO: 719459 - DNA, 22 bp, Artificial Sequence
  chemically synthesized
atcaatacggaggctacccact

SEQ ID NO: 719460 - DNA, 22 bp, Artificial Sequence
  chemically synthesized
aaaagaaggtaatgtggagtgg

SEQ ID NO: 719461 - DNA, 22 bp, Artificial Sequence
  chemically synthesized
gaaaagaaggtaatgtggagtg

SEQ ID NO: 719462 - DNA, 22 bp, Artificial Sequence
  chemically synthesized
cccactccacattaccttcttt

SEQ ID NO: 719463 - DNA, 22 bp, Artificial Sequence
  chemically synthesized
cacattaccttcttttcaaggg

SEQ ID NO: 719464 - DNA, 22 bp, Artificial Sequence
  chemically synthesized
ccttcttttcaagggcctgttt

SEQ ID NO: 719465 - DNA, 22 bp, Artificial Sequence
  chemically synthesized
tggaggtaagggaaacaggccc

SEQ ID NO: 719466 - DNA, 22 bp, Artificial Sequence
  chemically synthesized
cttttcaagggcctgtttccct

SEQ ID NO: 719467 - DNA, 22 bp, Artificial Sequence
  chemically synthesized
ttttcaagggcctgtttccctt

SEQ ID NO: 719468 - DNA, 22 bp, Artificial Sequence
  chemically synthesized
ttcaagggcctgtttcccttac

SEQ ID NO: 719469 - DNA, 22 bp, Artificial Sequence
  chemically synthesized
tcaagggcctgtttcccttacc

SEQ ID NO: 719470 - DNA, 22 bp, Artificial Sequence
  chemically synthesized
caagggcctgtttcccttacct

SEQ ID NO: 719471 - DNA, 22 bp, Artificial Sequence
  chemically synthesized
caacagttatggaggtaaggga

SEQ ID NO: 719472 - DNA, 22 bp, Artificial Sequence
  chemically synthesized
aagggcctgtttcccttacctc

SEQ ID NO: 719473 - DNA, 22 bp, Artificial Sequence
  chemically synthesized
tttcccttacctccataactgt

SEQ ID NO: 719474 - DNA, 22 bp, Artificial Sequence
  chemically synthesized
cccttacctccataactgttgt

SEQ ID NO: 719475 - DNA, 22 bp, Artificial Sequence
  chemically synthesized
ccttacctccataactgttgta

SEQ ID NO: 719476 - DNA, 22 bp, Artificial Sequence
  chemically synthesized
gccgtcaatacctacaacagtt

SEQ ID NO: 719477 - DNA, 22 bp, Artificial Sequence
  chemically synthesized
acctccataactgttgtaggta

SEQ ID NO: 719478 - DNA, 22 bp, Artificial Sequence
  chemically synthesized
cctccataactgttgtaggtat

SEQ ID NO: 719479 - DNA, 22 bp, Artificial Sequence
  chemically synthesized
gaagcctggccgtcaataccta

SEQ ID NO: 719480 - DNA, 22 bp, Artificial Sequence
  chemically synthesized
cataactgttgtaggtattgac

SEQ ID NO: 719481 - DNA, 22 bp, Artificial Sequence
  chemically synthesized
agaagcctggccgtcaatacct

SEQ ID NO: 719482 - DNA, 22 bp, Artificial Sequence
  chemically synthesized
ttgtaggtattgacggccaggc

SEQ ID NO: 719483 - DNA, 22 bp, Artificial Sequence
  chemically synthesized
agaggtttagaagcctggccgt

SEQ ID NO: 719484 - DNA, 22 bp, Artificial Sequence
  chemically synthesized
aagaggtttagaagcctggccg

SEQ ID NO: 719485 - DNA, 22 bp, Artificial Sequence
  chemically synthesized
taagaggtttagaagcctggcc

SEQ ID NO: 719486 - DNA, 22 bp, Artificial Sequence
  chemically synthesized
taggtattgacggccaggcttc

SEQ ID NO: 719487 - DNA, 22 bp, Artificial Sequence
  chemically synthesized
ggagttttaagaggtttagaag

SEQ ID NO: 719488 - DNA, 22 bp, Artificial Sequence
  chemically synthesized
gggagttttaagaggtttagaa

SEQ ID NO: 719489 - DNA, 22 bp, Artificial Sequence
  chemically synthesized
acggccaggcttctaaacctct

SEQ ID NO: 719490 - DNA, 22 bp, Artificial Sequence
  chemically synthesized
gcaccagagtttgggagtttta

SEQ ID NO: 719491 - DNA, 22 bp, Artificial Sequence
  chemically synthesized
ctaaacctcttaaaactcccaa

SEQ ID NO: 719492 - DNA, 22 bp, Artificial Sequence
  chemically synthesized
taaacctcttaaaactcccaaa

SEQ ID NO: 719493 - DNA, 22 bp, Artificial Sequence
  chemically synthesized
aacctcttaaaactcccaaact

SEQ ID NO: 719494 - DNA, 22 bp, Artificial Sequence
  chemically synthesized
agttggcaccagagtttgggag

SEQ ID NO: 719495 - DNA, 22 bp, Artificial Sequence
  chemically synthesized
ttaaaactcccaaactctggtg

SEQ ID NO: 719496 - DNA, 22 bp, Artificial Sequence
  chemically synthesized
aaaactcccaaactctggtgcc

SEQ ID NO: 719497 - DNA, 22 bp, Artificial Sequence
  chemically synthesized
aaactcccaaactctggtgcca

SEQ ID NO: 719498 - DNA, 22 bp, Artificial Sequence
  chemically synthesized
ccaaactctggtgccaacttag

SEQ ID NO: 719499 - DNA, 22 bp, Artificial Sequence
  chemically synthesized
aaagagtatcgtctaagttggc

SEQ ID NO: 719500 - DNA, 22 bp, Artificial Sequence
  chemically synthesized
aaaagagtatcgtctaagttgg

SEQ ID NO: 719501 - DNA, 22 bp, Artificial Sequence
  chemically synthesized
tggtgccaacttagacgatact

SEQ ID NO: 719502 - DNA, 22 bp, Artificial Sequence
  chemically synthesized
gtgccaacttagacgatactct

SEQ ID NO: 719503 - DNA, 22 bp, Artificial Sequence
  chemically synthesized
aaaaggagtgcttaaaagagta

SEQ ID NO: 719504 - DNA, 22 bp, Artificial Sequence
  chemically synthesized
agacgatactcttttaagcact

SEQ ID NO: 719505 - DNA, 22 bp, Artificial Sequence
  chemically synthesized
gacgatactcttttaagcactc

SEQ ID NO: 719506 - DNA, 22 bp, Artificial Sequence
  chemically synthesized
ttttaagcactcctttttagtt

SEQ ID NO: 719507 - DNA, 22 bp, Artificial Sequence
  chemically synthesized
ggcaggtggggataactaaaaa

SEQ ID NO: 719508 - DNA, 22 bp, Artificial Sequence
  chemically synthesized
ttaagcactcctttttagttat

SEQ ID NO: 719509 - DNA, 22 bp, Artificial Sequence
  chemically synthesized
taagcactcctttttagttatc

SEQ ID NO: 719510 - DNA, 22 bp, Artificial Sequence
  chemically synthesized
aagcactcctttttagttatcc

SEQ ID NO: 719511 - DNA, 22 bp, Artificial Sequence
  chemically synthesized
agcactcctttttagttatccc

SEQ ID NO: 719512 - DNA, 22 bp, Artificial Sequence
  chemically synthesized
ctttttagttatccccacctgc

SEQ ID NO: 719513 - DNA, 22 bp, Artificial Sequence
  chemically synthesized
atagggaactgggcaggtgggg

SEQ ID NO: 719514 - DNA, 22 bp, Artificial Sequence
  chemically synthesized
tttagttatccccacctgccca

SEQ ID NO: 719515 - DNA, 22 bp, Artificial Sequence
  chemically synthesized
ttagttatccccacctgcccag

SEQ ID NO: 719516 - DNA, 22 bp, Artificial Sequence
  chemically synthesized
tagttatccccacctgcccagt

SEQ ID NO: 719517 - DNA, 22 bp, Artificial Sequence
  chemically synthesized
agttatccccacctgcccagtt

SEQ ID NO: 719518 - DNA, 22 bp, Artificial Sequence
  chemically synthesized
ggcctaatagggaactgggcag

SEQ ID NO: 719519 - DNA, 22 bp, Artificial Sequence
  chemically synthesized
gttatccccacctgcccagttc

SEQ ID NO: 719520 - DNA, 22 bp, Artificial Sequence
  chemically synthesized
tccccacctgcccagttcccta

SEQ ID NO: 719521 - DNA, 22 bp, Artificial Sequence
  chemically synthesized
aagtgtctcggcctaataggga

SEQ ID NO: 719522 - DNA, 22 bp, Artificial Sequence
  chemically synthesized
gttaaagtgtctcggcctaata

SEQ ID NO: 719523 - DNA, 22 bp, Artificial Sequence
  chemically synthesized
agttaaagtgtctcggcctaat

SEQ ID NO: 719524 - DNA, 22 bp, Artificial Sequence
  chemically synthesized
cccagttccctattaggccgag

SEQ ID NO: 719525 - DNA, 22 bp, Artificial Sequence
  chemically synthesized
cctattaggccgagacacttta

SEQ ID NO: 719526 - DNA, 22 bp, Artificial Sequence
  chemically synthesized
ttaggccgagacactttaacta

SEQ ID NO: 719527 - DNA, 22 bp, Artificial Sequence
  chemically synthesized
ggccgagacactttaactaaat

SEQ ID NO: 719528 - DNA, 22 bp, Artificial Sequence
  chemically synthesized
ggaatagtcagggaagcagatc

SEQ ID NO: 719529 - DNA, 22 bp, Artificial Sequence
  chemically synthesized
taactaaatgatctgcttccct

SEQ ID NO: 719530 - DNA, 22 bp, Artificial Sequence
  chemically synthesized
aactaaatgatctgcttccctg

SEQ ID NO: 719531 - DNA, 22 bp, Artificial Sequence
  chemically synthesized
actaaatgatctgcttccctga

SEQ ID NO: 719532 - DNA, 22 bp, Artificial Sequence
  chemically synthesized
gcctaggaatagtcagggaagc

SEQ ID NO: 719533 - DNA, 22 bp, Artificial Sequence
  chemically synthesized
tagcctaggaatagtcagggaa

SEQ ID NO: 719534 - DNA, 22 bp, Artificial Sequence
  chemically synthesized
aatgatctgcttccctgactat

SEQ ID NO: 719535 - DNA, 22 bp, Artificial Sequence
  chemically synthesized
cttccctgactattcctaggct

SEQ ID NO: 719536 - DNA, 22 bp, Artificial Sequence
  chemically synthesized
ccctgactattcctaggctaga

SEQ ID NO: 719537 - DNA, 22 bp, Artificial Sequence
  chemically synthesized
cctgactattcctaggctagag

SEQ ID NO: 719538 - DNA, 22 bp, Artificial Sequence
  chemically synthesized
actattcctaggctagagccac

SEQ ID NO: 719539 - DNA, 22 bp, Artificial Sequence
  chemically synthesized
ttcctaggctagagccacacct

SEQ ID NO: 719540 - DNA, 22 bp, Artificial Sequence
  chemically synthesized
ctaggctagagccacacctcat

SEQ ID NO: 719541 - DNA, 22 bp, Artificial Sequence
  chemically synthesized
ggctagagccacacctcattgc

SEQ ID NO: 719542 - DNA, 22 bp, Artificial Sequence
  chemically synthesized
ggggaaaaggcggcaatgaggt

SEQ ID NO: 719543 - DNA, 22 bp, Artificial Sequence
  chemically synthesized
gagccacacctcattgccgcct

SEQ ID NO: 719544 - DNA, 22 bp, Artificial Sequence
  chemically synthesized
aactgggggaaaaggcggcaat

SEQ ID NO: 719545 - DNA, 22 bp, Artificial Sequence
  chemically synthesized
gaactgggggaaaaggcggcaa

SEQ ID NO: 719546 - DNA, 22 bp, Artificial Sequence
  chemically synthesized
tgaactgggggaaaaggcggca

SEQ ID NO: 719547 - DNA, 22 bp, Artificial Sequence
  chemically synthesized
attgccgccttttcccccagtt

SEQ ID NO: 719548 - DNA, 22 bp, Artificial Sequence
  chemically synthesized
ccgccttttcccccagttcaaa

SEQ ID NO: 719549 - DNA, 22 bp, Artificial Sequence
  chemically synthesized
ttcccccagttcaaagcctcct

SEQ ID NO: 719550 - DNA, 22 bp, Artificial Sequence
  chemically synthesized
tcccccagttcaaagcctcctt

SEQ ID NO: 719551 - DNA, 22 bp, Artificial Sequence
  chemically synthesized
cccccagttcaaagcctccttc

SEQ ID NO: 719552 - DNA, 22 bp, Artificial Sequence
  chemically synthesized
ccccagttcaaagcctccttca

SEQ ID NO: 719553 - DNA, 22 bp, Artificial Sequence
  chemically synthesized
aaagcctccttcacatctcccc

SEQ ID NO: 719554 - DNA, 22 bp, Artificial Sequence
  chemically synthesized
aggtggggagatacaaggggag

SEQ ID NO: 719555 - DNA, 22 bp, Artificial Sequence
  chemically synthesized
cttcacatctccccttgtatct

SEQ ID NO: 719556 - DNA, 22 bp, Artificial Sequence
  chemically synthesized
cacatctccccttgtatctccc

SEQ ID NO: 719557 - DNA, 22 bp, Artificial Sequence
  chemically synthesized
tgggttaaggtggggagataca

SEQ ID NO: 719558 - DNA, 22 bp, Artificial Sequence
  chemically synthesized
acatctccccttgtatctcccc

SEQ ID NO: 719559 - DNA, 22 bp, Artificial Sequence
  chemically synthesized
gtgggttaaggtggggagatac

SEQ ID NO: 719560 - DNA, 22 bp, Artificial Sequence
  chemically synthesized
tgcttgtgggttaaggtgggga

SEQ ID NO: 719561 - DNA, 22 bp, Artificial Sequence
  chemically synthesized
atgcttgtgggttaaggtgggg

SEQ ID NO: 719562 - DNA, 22 bp, Artificial Sequence
  chemically synthesized
cccttgtatctccccaccttaa

SEQ ID NO: 719563 - DNA, 22 bp, Artificial Sequence
  chemically synthesized
gtatctccccaccttaacccac

SEQ ID NO: 719564 - DNA, 22 bp, Artificial Sequence
  chemically synthesized
tatctccccaccttaacccaca

SEQ ID NO: 719565 - DNA, 22 bp, Artificial Sequence
  chemically synthesized
cccaccttaacccacaagcata

SEQ ID NO: 719566 - DNA, 22 bp, Artificial Sequence
  chemically synthesized
aacccacaagcataagacacct

SEQ ID NO: 719567 - DNA, 22 bp, Artificial Sequence
  chemically synthesized
aggagggagtagaggtgtctta

SEQ ID NO: 719568 - DNA, 22 bp, Artificial Sequence
  chemically synthesized
acccacaagcataagacacctc

SEQ ID NO: 719569 - DNA, 22 bp, Artificial Sequence
  chemically synthesized
gtcgctaaggagggagtagagg

SEQ ID NO: 719570 - DNA, 22 bp, Artificial Sequence
  chemically synthesized
tactccctccttagcgaccaat

SEQ ID NO: 719571 - DNA, 22 bp, Artificial Sequence
  chemically synthesized
ctccctccttagcgaccaatca

SEQ ID NO: 719572 - DNA, 22 bp, Artificial Sequence
  chemically synthesized
cctccttagcgaccaatcatgc

SEQ ID NO: 719573 - DNA, 22 bp, Artificial Sequence
  chemically synthesized
cttagcgaccaatcatgcaccc

SEQ ID NO: 719574 - DNA, 22 bp, Artificial Sequence
  chemically synthesized
atgggatggtaaggggtgcatg

SEQ ID NO: 719575 - DNA, 22 bp, Artificial Sequence
  chemically synthesized
aatgggatggtaaggggtgcat

SEQ ID NO: 719576 - DNA, 22 bp, Artificial Sequence
  chemically synthesized
agcgaccaatcatgcacccctt

SEQ ID NO: 719577 - DNA, 22 bp, Artificial Sequence
  chemically synthesized
taatgggatggtaaggggtgca

SEQ ID NO: 719578 - DNA, 22 bp, Artificial Sequence
  chemically synthesized
gcgaccaatcatgcacccctta

SEQ ID NO: 719579 - DNA, 22 bp, Artificial Sequence
  chemically synthesized
ggttttaatgggatggtaaggg

SEQ ID NO: 719580 - DNA, 22 bp, Artificial Sequence
  chemically synthesized
accatcccattaaaacctaatc

SEQ ID NO: 719581 - DNA, 22 bp, Artificial Sequence
  chemically synthesized
ccatcccattaaaacctaatca

SEQ ID NO: 719582 - DNA, 22 bp, Artificial Sequence
  chemically synthesized
agcggagtaagggtgattaggt

SEQ ID NO: 719583 - DNA, 22 bp, Artificial Sequence
  chemically synthesized
gcattgagcggagtaagggtga

SEQ ID NO: 719584 - DNA, 22 bp, Artificial Sequence
  chemically synthesized
aaacctaatcacccttactccg

SEQ ID NO: 719585 - DNA, 22 bp, Artificial Sequence
  chemically synthesized
atcacccttactccgctcaatg

SEQ ID NO: 719586 - DNA, 22 bp, Artificial Sequence
  chemically synthesized
tgggatgggatgttggcattga

SEQ ID NO: 719587 - DNA, 22 bp, Artificial Sequence
  chemically synthesized
actccgctcaatgccaacatcc

SEQ ID NO: 719588 - DNA, 22 bp, Artificial Sequence
  chemically synthesized
ctccgctcaatgccaacatccc

SEQ ID NO: 719589 - DNA, 22 bp, Artificial Sequence
  chemically synthesized
cgctcaatgccaacatcccatc

SEQ ID NO: 719590 - DNA, 22 bp, Artificial Sequence
  chemically synthesized
aagcgtgctgtgggatgggatg

SEQ ID NO: 719591 - DNA, 22 bp, Artificial Sequence
  chemically synthesized
aaagcgtgctgtgggatgggat

SEQ ID NO: 719592 - DNA, 22 bp, Artificial Sequence
  chemically synthesized
taaagcgtgctgtgggatggga

SEQ ID NO: 719593 - DNA, 22 bp, Artificial Sequence
  chemically synthesized
ttaaagcgtgctgtgggatggg

SEQ ID NO: 719594 - DNA, 22 bp, Artificial Sequence
  chemically synthesized
aatgccaacatcccatcccaca

SEQ ID NO: 719595 - DNA, 22 bp, Artificial Sequence
  chemically synthesized
taatccttttaaagcgtgctgt

SEQ ID NO: 719596 - DNA, 22 bp, Artificial Sequence
  chemically synthesized
taaaaggattacagtctgttat

SEQ ID NO: 719597 - DNA, 22 bp, Artificial Sequence
  chemically synthesized
aaaaggattacagtctgttatc

SEQ ID NO: 719598 - DNA, 22 bp, Artificial Sequence
  chemically synthesized
tagcaggcgagtgataacagac

SEQ ID NO: 719599 - DNA, 22 bp, Artificial Sequence
  chemically synthesized
aaaggattacagtctgttatca

SEQ ID NO: 719600 - DNA, 22 bp, Artificial Sequence
  chemically synthesized
cagtctgttatcactcgcctgc

SEQ ID NO: 719601 - DNA, 22 bp, Artificial Sequence
  chemically synthesized
aaaggccatgctgtagcaggcg

SEQ ID NO: 719602 - DNA, 22 bp, Artificial Sequence
  chemically synthesized
aaaaggccatgctgtagcaggc

SEQ ID NO: 719603 - DNA, 22 bp, Artificial Sequence
  chemically synthesized
taaaaggccatgctgtagcagg

SEQ ID NO: 719604 - DNA, 22 bp, Artificial Sequence
  chemically synthesized
ttatcactcgcctgctacagca

SEQ ID NO: 719605 - DNA, 22 bp, Artificial Sequence
  chemically synthesized
tcactcgcctgctacagcatgg

SEQ ID NO: 719606 - DNA, 22 bp, Artificial Sequence
  chemically synthesized
taggctttaaaaggccatgctg

SEQ ID NO: 719607 - DNA, 22 bp, Artificial Sequence
  chemically synthesized
ataggctttaaaaggccatgct

SEQ ID NO: 719608 - DNA, 22 bp, Artificial Sequence
  chemically synthesized
gcctgctacagcatggcctttt

SEQ ID NO: 719609 - DNA, 22 bp, Artificial Sequence
  chemically synthesized
ctacagcatggccttttaaagc

SEQ ID NO: 719610 - DNA, 22 bp, Artificial Sequence
  chemically synthesized
cagcatggccttttaaagccta

SEQ ID NO: 719611 - DNA, 22 bp, Artificial Sequence
  chemically synthesized
taaggggagtttataggcttta

SEQ ID NO: 719612 - DNA, 22 bp, Artificial Sequence
  chemically synthesized
ttaaagcctataaactcccctt

SEQ ID NO: 719613 - DNA, 22 bp, Artificial Sequence
  chemically synthesized
taaagcctataaactcccctta

SEQ ID NO: 719614 - DNA, 22 bp, Artificial Sequence
  chemically synthesized
aaagcctataaactccccttac

SEQ ID NO: 719615 - DNA, 22 bp, Artificial Sequence
  chemically synthesized
aagcctataaactccccttaca

SEQ ID NO: 719616 - DNA, 22 bp, Artificial Sequence
  chemically synthesized
taaactccccttacaattcccc

SEQ ID NO: 719617 - DNA, 22 bp, Artificial Sequence
  chemically synthesized
ggacaggtaaaatgggggaatt

SEQ ID NO: 719618 - DNA, 22 bp, Artificial Sequence
  chemically synthesized
aggacaggtaaaatgggggaat

SEQ ID NO: 719619 - DNA, 22 bp, Artificial Sequence
  chemically synthesized
taggacaggtaaaatgggggaa

SEQ ID NO: 719620 - DNA, 22 bp, Artificial Sequence
  chemically synthesized
ttaggacaggtaaaatggggga

SEQ ID NO: 719621 - DNA, 22 bp, Artificial Sequence
  chemically synthesized
cccttacaattcccccatttta

SEQ ID NO: 719622 - DNA, 22 bp, Artificial Sequence
  chemically synthesized
cttttaggacaggtaaaatggg

SEQ ID NO: 719623 - DNA, 22 bp, Artificial Sequence
  chemically synthesized
acaattcccccattttacctgt

SEQ ID NO: 719624 - DNA, 22 bp, Artificial Sequence
  chemically synthesized
tctgcttttaggacaggtaaaa

SEQ ID NO: 719625 - DNA, 22 bp, Artificial Sequence
  chemically synthesized
caattcccccattttacctgtc

SEQ ID NO: 719626 - DNA, 22 bp, Artificial Sequence
  chemically synthesized
gtctgcttttaggacaggtaaa

SEQ ID NO: 719627 - DNA, 22 bp, Artificial Sequence
  chemically synthesized
ccccattttacctgtcctaaaa

SEQ ID NO: 719628 - DNA, 22 bp, Artificial Sequence
  chemically synthesized
taaaccttgtctgcttttagga

SEQ ID NO: 719629 - DNA, 22 bp, Artificial Sequence
  chemically synthesized
acctgtaaaccttgtctgcttt

SEQ ID NO: 719630 - DNA, 22 bp, Artificial Sequence
  chemically synthesized
tacctgtcctaaaagcagacaa

SEQ ID NO: 719631 - DNA, 22 bp, Artificial Sequence
  chemically synthesized
acctgtcctaaaagcagacaag

SEQ ID NO: 719632 - DNA, 22 bp, Artificial Sequence
  chemically synthesized
cctgtcctaaaagcagacaagg

SEQ ID NO: 719633 - DNA, 22 bp, Artificial Sequence
  chemically synthesized
aactaacctgtaaaccttgtct

SEQ ID NO: 719634 - DNA, 22 bp, Artificial Sequence
  chemically synthesized
tcctaaaagcagacaaggttta

SEQ ID NO: 719635 - DNA, 22 bp, Artificial Sequence
  chemically synthesized
aaagcagacaaggtttacaggt

SEQ ID NO: 719636 - DNA, 22 bp, Artificial Sequence
  chemically synthesized
ataaggtgcagatcctgaacta

SEQ ID NO: 719637 - DNA, 22 bp, Artificial Sequence
  chemically synthesized
gttgataaggtgcagatcctga

SEQ ID NO: 719638 - DNA, 22 bp, Artificial Sequence
  chemically synthesized
ggttgataaggtgcagatcctg

SEQ ID NO: 719639 - DNA, 22 bp, Artificial Sequence
  chemically synthesized
acaggttagttcaggatctgca

SEQ ID NO: 719640 - DNA, 22 bp, Artificial Sequence
  chemically synthesized
caggttagttcaggatctgcac

SEQ ID NO: 719641 - DNA, 22 bp, Artificial Sequence
  chemically synthesized
gttcaggatctgcaccttatca

SEQ ID NO: 719642 - DNA, 22 bp, Artificial Sequence
  chemically synthesized
aggatctgcaccttatcaacca

SEQ ID NO: 719643 - DNA, 22 bp, Artificial Sequence
  chemically synthesized
ataggcaaaacaatttggttga

SEQ ID NO: 719644 - DNA, 22 bp, Artificial Sequence
  chemically synthesized
caccttatcaaccaaattgttt

SEQ ID NO: 719645 - DNA, 22 bp, Artificial Sequence
  chemically synthesized
atcaaccaaattgttttgccta

SEQ ID NO: 719646 - DNA, 22 bp, Artificial Sequence
  chemically synthesized
tcaaccaaattgttttgcctat

SEQ ID NO: 719647 - DNA, 22 bp, Artificial Sequence
  chemically synthesized
gcaccacagggttgataggcaa

SEQ ID NO: 719648 - DNA, 22 bp, Artificial Sequence
  chemically synthesized
ggcaccacagggttgataggca

SEQ ID NO: 719649 - DNA, 22 bp, Artificial Sequence
  chemically synthesized
ttttgcctatcaaccctgtggt

SEQ ID NO: 719650 - DNA, 22 bp, Artificial Sequence
  chemically synthesized
tgcctatcaaccctgtggtgcc

SEQ ID NO: 719651 - DNA, 22 bp, Artificial Sequence
  chemically synthesized
gcctatcaaccctgtggtgcca

SEQ ID NO: 719652 - DNA, 22 bp, Artificial Sequence
  chemically synthesized
cctatcaaccctgtggtgccaa

SEQ ID NO: 719653 - DNA, 22 bp, Artificial Sequence
  chemically synthesized
tcaaccctgtggtgccaaaccc

SEQ ID NO: 719654 - DNA, 22 bp, Artificial Sequence
  chemically synthesized
aggacaggagagtatatgggtt

SEQ ID NO: 719655 - DNA, 22 bp, Artificial Sequence
  chemically synthesized
tggtgccaaacccatatactct

SEQ ID NO: 719656 - DNA, 22 bp, Artificial Sequence
  chemically synthesized
tggagggaggtattgaggacag

SEQ ID NO: 719657 - DNA, 22 bp, Artificial Sequence
  chemically synthesized
tcctgtcctcaatacctccctc

SEQ ID NO: 719658 - DNA, 22 bp, Artificial Sequence
  chemically synthesized
ctgtcctcaatacctccctcca

SEQ ID NO: 719659 - DNA, 22 bp, Artificial Sequence
  chemically synthesized
tcctcaatacctccctccacaa

SEQ ID NO: 719660 - DNA, 22 bp, Artificial Sequence
  chemically synthesized
aatacctccctccacaacccat

SEQ ID NO: 719661 - DNA, 22 bp, Artificial Sequence
  chemically synthesized
agatccagaacagaataatggg

SEQ ID NO: 719662 - DNA, 22 bp, Artificial Sequence
  chemically synthesized
gagatccagaacagaataatgg

SEQ ID NO: 719663 - DNA, 22 bp, Artificial Sequence
  chemically synthesized
cctccacaacccattattctgt

SEQ ID NO: 719664 - DNA, 22 bp, Artificial Sequence
  chemically synthesized
cacaacccattattctgttctg

SEQ ID NO: 719665 - DNA, 22 bp, Artificial Sequence
  chemically synthesized
ttctgttctggatctcaaacat

SEQ ID NO: 719666 - DNA, 22 bp, Artificial Sequence
  chemically synthesized
tgttctggatctcaaacatgct

SEQ ID NO: 719667 - DNA, 22 bp, Artificial Sequence
  chemically synthesized
ttctggatctcaaacatgcttt

SEQ ID NO: 719668 - DNA, 22 bp, Artificial Sequence
  chemically synthesized
tggatctcaaacatgctttctt

SEQ ID NO: 719669 - DNA, 22 bp, Artificial Sequence
  chemically synthesized
gatctcaaacatgctttcttca

SEQ ID NO: 719670 - DNA, 22 bp, Artificial Sequence
  chemically synthesized
aaacatgctttcttcactattc

SEQ ID NO: 719671 - DNA, 22 bp, Artificial Sequence
  chemically synthesized
gggtgaagggtgcaaaggaata

SEQ ID NO: 719672 - DNA, 22 bp, Artificial Sequence
  chemically synthesized
tcttcactattcctttgcaccc

SEQ ID NO: 719673 - DNA, 22 bp, Artificial Sequence
  chemically synthesized
cttcactattcctttgcaccct

SEQ ID NO: 719674 - DNA, 22 bp, Artificial Sequence
  chemically synthesized
ttcactattcctttgcaccctt

SEQ ID NO: 719675 - DNA, 22 bp, Artificial Sequence
  chemically synthesized
cactattcctttgcacccttca

SEQ ID NO: 719676 - DNA, 22 bp, Artificial Sequence
  chemically synthesized
actattcctttgcacccttcac

SEQ ID NO: 719677 - DNA, 22 bp, Artificial Sequence
  chemically synthesized
ttcctttgcacccttcacccca

SEQ ID NO: 719678 - DNA, 22 bp, Artificial Sequence
  chemically synthesized
ctttgcacccttcaccccagcc

SEQ ID NO: 719679 - DNA, 22 bp, Artificial Sequence
  chemically synthesized
tgcacccttcaccccagcctct

SEQ ID NO: 719680 - DNA, 22 bp, Artificial Sequence
  chemically synthesized
gcacccttcaccccagcctctc

SEQ ID NO: 719681 - DNA, 22 bp, Artificial Sequence
  chemically synthesized
cacccttcaccccagcctctct

SEQ ID NO: 719682 - DNA, 22 bp, Artificial Sequence
  chemically synthesized
caccccagcctctcttcacttt

SEQ ID NO: 719683 - DNA, 22 bp, Artificial Sequence
  chemically synthesized
accccagcctctcttcactttc

SEQ ID NO: 719684 - DNA, 22 bp, Artificial Sequence
  chemically synthesized
tcttcactttcacttggactga

SEQ ID NO: 719685 - DNA, 22 bp, Artificial Sequence
  chemically synthesized
atgggtgtcagggtcagtccaa

SEQ ID NO: 719686 - DNA, 22 bp, Artificial Sequence
  chemically synthesized
ttcactttcacttggactgacc

SEQ ID NO: 719687 - DNA, 22 bp, Artificial Sequence
  chemically synthesized
cactttcacttggactgaccct

SEQ ID NO: 719688 - DNA, 22 bp, Artificial Sequence
  chemically synthesized
actttcacttggactgaccctg

SEQ ID NO: 719689 - DNA, 22 bp, Artificial Sequence
  chemically synthesized
agcctgatgggtgtcagggtca

SEQ ID NO: 719690 - DNA, 22 bp, Artificial Sequence
  chemically synthesized
tcacttggactgaccctgacac

SEQ ID NO: 719691 - DNA, 22 bp, Artificial Sequence
  chemically synthesized
cacttggactgaccctgacacc

SEQ ID NO: 719692 - DNA, 22 bp, Artificial Sequence
  chemically synthesized
ctgagcctgatgggtgtcaggg

SEQ ID NO: 719693 - DNA, 22 bp, Artificial Sequence
  chemically synthesized
acttggactgaccctgacaccc

SEQ ID NO: 719694 - DNA, 22 bp, Artificial Sequence
  chemically synthesized
gctgagcctgatgggtgtcagg

SEQ ID NO: 719695 - DNA, 22 bp, Artificial Sequence
  chemically synthesized
ggactgaccctgacacccatca

SEQ ID NO: 719696 - DNA, 22 bp, Artificial Sequence
  chemically synthesized
gactgaccctgacacccatcag

SEQ ID NO: 719697 - DNA, 22 bp, Artificial Sequence
  chemically synthesized
accctgacacccatcaggctca

SEQ ID NO: 719698 - DNA, 22 bp, Artificial Sequence
  chemically synthesized
acacccatcaggctcagcaaat

SEQ ID NO: 719699 - DNA, 22 bp, Artificial Sequence
  chemically synthesized
aggcagtacagcccaggtaatt

SEQ ID NO: 719700 - DNA, 22 bp, Artificial Sequence
  chemically synthesized
gaggcagtacagcccaggtaat

SEQ ID NO: 719701 - DNA, 22 bp, Artificial Sequence
  chemically synthesized
agcaaattacctgggctgtact

SEQ ID NO: 719702 - DNA, 22 bp, Artificial Sequence
  chemically synthesized
tgaagccttgaggcagtacagc

SEQ ID NO: 719703 - DNA, 22 bp, Artificial Sequence
  chemically synthesized
tctgtgaagccttgaggcagta

SEQ ID NO: 719704 - DNA, 22 bp, Artificial Sequence
  chemically synthesized
cctgggctgtactgcctcaagg

SEQ ID NO: 719705 - DNA, 22 bp, Artificial Sequence
  chemically synthesized
ggctgtactgcctcaaggcttc

SEQ ID NO: 719706 - DNA, 22 bp, Artificial Sequence
  chemically synthesized
tactgcctcaaggcttcacaga

SEQ ID NO: 719707 - DNA, 22 bp, Artificial Sequence
  chemically synthesized
aagtaatgggggctgtctgtga

SEQ ID NO: 719708 - DNA, 22 bp, Artificial Sequence
  chemically synthesized
cctcaaggcttcacagacagcc

SEQ ID NO: 719709 - DNA, 22 bp, Artificial Sequence
  chemically synthesized
actgaagtaatgggggctgtct

SEQ ID NO: 719710 - DNA, 22 bp, Artificial Sequence
  chemically synthesized
gactgaagtaatgggggctgtc

SEQ ID NO: 719711 - DNA, 22 bp, Artificial Sequence
  chemically synthesized
aaggcttcacagacagccccca

SEQ ID NO: 719712 - DNA, 22 bp, Artificial Sequence
  chemically synthesized
ggcttgactgaagtaatggggg

SEQ ID NO: 719713 - DNA, 22 bp, Artificial Sequence
  chemically synthesized
gggcttgactgaagtaatgggg

SEQ ID NO: 719714 - DNA, 22 bp, Artificial Sequence
  chemically synthesized
cacagacagcccccattacttc

SEQ ID NO: 719715 - DNA, 22 bp, Artificial Sequence
  chemically synthesized
acagacagcccccattacttca

SEQ ID NO: 719716 - DNA, 22 bp, Artificial Sequence
  chemically synthesized
cttcagtcaagcccaaatttct

SEQ ID NO: 719717 - DNA, 22 bp, Artificial Sequence
  chemically synthesized
cagtcaagcccaaatttcttcc

SEQ ID NO: 719718 - DNA, 22 bp, Artificial Sequence
  chemically synthesized
agtcaagcccaaatttcttcct

SEQ ID NO: 719719 - DNA, 22 bp, Artificial Sequence
  chemically synthesized
tgccgagataggtaacaggtga

SEQ ID NO: 719720 - DNA, 22 bp, Artificial Sequence
  chemically synthesized
cttcctcacctgttacctatct

SEQ ID NO: 719721 - DNA, 22 bp, Artificial Sequence
  chemically synthesized
ttcctcacctgttacctatctc

SEQ ID NO: 719722 - DNA, 22 bp, Artificial Sequence
  chemically synthesized
tgagaattatgccgagataggt

SEQ ID NO: 719723 - DNA, 22 bp, Artificial Sequence
  chemically synthesized
cctcacctgttacctatctcgg

SEQ ID NO: 719724 - DNA, 22 bp, Artificial Sequence
  chemically synthesized
atgagaattatgccgagatagg

SEQ ID NO: 719725 - DNA, 22 bp, Artificial Sequence
  chemically synthesized
ctcacctgttacctatctcggc

SEQ ID NO: 719726 - DNA, 22 bp, Artificial Sequence
  chemically synthesized
tatgagaattatgccgagatag

SEQ ID NO: 719727 - DNA, 22 bp, Artificial Sequence
  chemically synthesized
ttatgagaattatgccgagata

SEQ ID NO: 719728 - DNA, 22 bp, Artificial Sequence
  chemically synthesized
acctgttacctatctcggcata

SEQ ID NO: 719729 - DNA, 22 bp, Artificial Sequence
  chemically synthesized
ttacctatctcggcataattct

SEQ ID NO: 719730 - DNA, 22 bp, Artificial Sequence
  chemically synthesized
cctatctcggcataattctcat

SEQ ID NO: 719731 - DNA, 22 bp, Artificial Sequence
  chemically synthesized
tctcggcataattctcataaaa

SEQ ID NO: 719732 - DNA, 22 bp, Artificial Sequence
  chemically synthesized
ggcataattctcataaaaacac

SEQ ID NO: 719733 - DNA, 22 bp, Artificial Sequence
  chemically synthesized
tcataaaaacacacgtgctctc

SEQ ID NO: 719734 - DNA, 22 bp, Artificial Sequence
  chemically synthesized
ataaaaacacacgtgctctccc

SEQ ID NO: 719735 - DNA, 22 bp, Artificial Sequence
  chemically synthesized
gtcagacatgatcagcagggag

SEQ ID NO: 719736 - DNA, 22 bp, Artificial Sequence
  chemically synthesized
ggagattagtcagacatgatca

SEQ ID NO: 719737 - DNA, 22 bp, Artificial Sequence
  chemically synthesized
gggagattagtcagacatgatc

SEQ ID NO: 719738 - DNA, 22 bp, Artificial Sequence
  chemically synthesized
tccctgctgatcatgtctgact

SEQ ID NO: 719739 - DNA, 22 bp, Artificial Sequence
  chemically synthesized
cctgctgatcatgtctgactaa

SEQ ID NO: 719740 - DNA, 22 bp, Artificial Sequence
  chemically synthesized
gggtttgggagattagtcagac

SEQ ID NO: 719741 - DNA, 22 bp, Artificial Sequence
  chemically synthesized
ctgatcatgtctgactaatctc

SEQ ID NO: 719742 - DNA, 22 bp, Artificial Sequence
  chemically synthesized
atcatgtctgactaatctccca

SEQ ID NO: 719743 - DNA, 22 bp, Artificial Sequence
  chemically synthesized
gaagggattggggtttgggaga

SEQ ID NO: 719744 - DNA, 22 bp, Artificial Sequence
  chemically synthesized
tagaagggattggggtttggga

SEQ ID NO: 719745 - DNA, 22 bp, Artificial Sequence
  chemically synthesized
ctagaagggattggggtttggg

SEQ ID NO: 719746 - DNA, 22 bp, Artificial Sequence
  chemically synthesized
tctagaagggattggggtttgg

SEQ ID NO: 719747 - DNA, 22 bp, Artificial Sequence
  chemically synthesized
actaatctcccaaaccccaatc

SEQ ID NO: 719748 - DNA, 22 bp, Artificial Sequence
  chemically synthesized
ttttctagaagggattggggtt

SEQ ID NO: 719749 - DNA, 22 bp, Artificial Sequence
  chemically synthesized
ttgttttctagaagggattggg

SEQ ID NO: 719750 - DNA, 22 bp, Artificial Sequence
  chemically synthesized
atctcccaaaccccaatccctt

SEQ ID NO: 719751 - DNA, 22 bp, Artificial Sequence
  chemically synthesized
gttgttttctagaagggattgg

SEQ ID NO: 719752 - DNA, 22 bp, Artificial Sequence
  chemically synthesized
ccaaaccccaatcccttctaga

SEQ ID NO: 719753 - DNA, 22 bp, Artificial Sequence
  chemically synthesized
ggaggaaaaaacttgttgtttt

SEQ ID NO: 719754 - DNA, 22 bp, Artificial Sequence
  chemically synthesized
ctagaaaacaacaagttttttc

SEQ ID NO: 719755 - DNA, 22 bp, Artificial Sequence
  chemically synthesized
tagaaaacaacaagttttttcc

SEQ ID NO: 719756 - DNA, 22 bp, Artificial Sequence
  chemically synthesized
accatgcctaggaggaaaaaac

SEQ ID NO: 719757 - DNA, 22 bp, Artificial Sequence
  chemically synthesized
gaaaacaacaagttttttcctc

SEQ ID NO: 719758 - DNA, 22 bp, Artificial Sequence
  chemically synthesized
tttcctcctaggcatggttaga

SEQ ID NO: 719759 - DNA, 22 bp, Artificial Sequence
  chemically synthesized
aagtcgaaagtatctaaccatg

SEQ ID NO: 719760 - DNA, 22 bp, Artificial Sequence
  chemically synthesized
ttcctcctaggcatggttagat

SEQ ID NO: 719761 - DNA, 22 bp, Artificial Sequence
  chemically synthesized
tcctcctaggcatggttagata

SEQ ID NO: 719762 - DNA, 22 bp, Artificial Sequence
  chemically synthesized
cctcctaggcatggttagatac

SEQ ID NO: 719763 - DNA, 22 bp, Artificial Sequence
  chemically synthesized
ctcctaggcatggttagatact

SEQ ID NO: 719764 - DNA, 22 bp, Artificial Sequence
  chemically synthesized
ctaggcatggttagatactttc

SEQ ID NO: 719765 - DNA, 22 bp, Artificial Sequence
  chemically synthesized
ggcatggttagatactttcgac

SEQ ID NO: 719766 - DNA, 22 bp, Artificial Sequence
  chemically synthesized
gatactttcgactttagatacc

SEQ ID NO: 719767 - DNA, 22 bp, Artificial Sequence
  chemically synthesized
ggatggcaaaaccaggtatcta

SEQ ID NO: 719768 - DNA, 22 bp, Artificial Sequence
  chemically synthesized
ttaggatggcaaaaccaggtat

SEQ ID NO: 719769 - DNA, 22 bp, Artificial Sequence
  chemically synthesized
gttaggatggcaaaaccaggta

SEQ ID NO: 719770 - DNA, 22 bp, Artificial Sequence
  chemically synthesized
tcgactttagatacctggtttt

SEQ ID NO: 719771 - DNA, 22 bp, Artificial Sequence
  chemically synthesized
tgttaggatggcaaaaccaggt

SEQ ID NO: 719772 - DNA, 22 bp, Artificial Sequence
  chemically synthesized
cgactttagatacctggttttg

SEQ ID NO: 719773 - DNA, 22 bp, Artificial Sequence
  chemically synthesized
gactttagatacctggttttgc

SEQ ID NO: 719774 - DNA, 22 bp, Artificial Sequence
  chemically synthesized
tagatacctggttttgccatcc

SEQ ID NO: 719775 - DNA, 22 bp, Artificial Sequence
  chemically synthesized
agatacctggttttgccatcct

SEQ ID NO: 719776 - DNA, 22 bp, Artificial Sequence
  chemically synthesized
gatacctggttttgccatccta

SEQ ID NO: 719777 - DNA, 22 bp, Artificial Sequence
  chemically synthesized
tataatggttttgttaggatgg

SEQ ID NO: 719778 - DNA, 22 bp, Artificial Sequence
  chemically synthesized
atataatggttttgttaggatg

SEQ ID NO: 719779 - DNA, 22 bp, Artificial Sequence
  chemically synthesized
gttttgccatcctaacaaaacc

SEQ ID NO: 719780 - DNA, 22 bp, Artificial Sequence
  chemically synthesized
tgagtttatataatggttttgt

SEQ ID NO: 719781 - DNA, 22 bp, Artificial Sequence
  chemically synthesized
gtgagtttatataatggttttg

SEQ ID NO: 719782 - DNA, 22 bp, Artificial Sequence
  chemically synthesized
tgccatcctaacaaaaccatta

SEQ ID NO: 719783 - DNA, 22 bp, Artificial Sequence
  chemically synthesized
tgtgagtttatataatggtttt

SEQ ID NO: 719784 - DNA, 22 bp, Artificial Sequence
  chemically synthesized
gccatcctaacaaaaccattat

SEQ ID NO: 719785 - DNA, 22 bp, Artificial Sequence
  chemically synthesized
ttgtgagtttatataatggttt

SEQ ID NO: 719786 - DNA, 22 bp, Artificial Sequence
  chemically synthesized
ccatcctaacaaaaccattata

SEQ ID NO: 719787 - DNA, 22 bp, Artificial Sequence
  chemically synthesized
cttttgtgagtttatataatgg

SEQ ID NO: 719788 - DNA, 22 bp, Artificial Sequence
  chemically synthesized
ccttttgtgagtttatataatg

SEQ ID NO: 719789 - DNA, 22 bp, Artificial Sequence
  chemically synthesized
acaaaaccattatataaactca

SEQ ID NO: 719790 - DNA, 22 bp, Artificial Sequence
  chemically synthesized
ggtttccttttgtgagtttata

SEQ ID NO: 719791 - DNA, 22 bp, Artificial Sequence
  chemically synthesized
tataaactcacaaaaggaaacc

SEQ ID NO: 719792 - DNA, 22 bp, Artificial Sequence
  chemically synthesized
tggggtcagctaggtttccttt

SEQ ID NO: 719793 - DNA, 22 bp, Artificial Sequence
  chemically synthesized
ggatctatggggtcagctaggt

SEQ ID NO: 719794 - DNA, 22 bp, Artificial Sequence
  chemically synthesized
aggatctatggggtcagctagg

SEQ ID NO: 719795 - DNA, 22 bp, Artificial Sequence
  chemically synthesized
acaaaaggaaacctagctgacc

SEQ ID NO: 719796 - DNA, 22 bp, Artificial Sequence
  chemically synthesized
gctgaccccatagatcctaaat

SEQ ID NO: 719797 - DNA, 22 bp, Artificial Sequence
  chemically synthesized
accccatagatcctaaatcctt

SEQ ID NO: 719798 - DNA, 22 bp, Artificial Sequence
  chemically synthesized
aaggaatggaaagaggagtggg

SEQ ID NO: 719799 - DNA, 22 bp, Artificial Sequence
  chemically synthesized
caaggaatggaaagaggagtgg

SEQ ID NO: 719800 - DNA, 22 bp, Artificial Sequence
  chemically synthesized
aatcctttccccactcctcttt

SEQ ID NO: 719801 - DNA, 22 bp, Artificial Sequence
  chemically synthesized
tcttcaaggaatggaaagagga

SEQ ID NO: 719802 - DNA, 22 bp, Artificial Sequence
  chemically synthesized
tccccactcctctttccattcc

SEQ ID NO: 719803 - DNA, 22 bp, Artificial Sequence
  chemically synthesized
ccccactcctctttccattcct

SEQ ID NO: 719804 - DNA, 22 bp, Artificial Sequence
  chemically synthesized
aagctgtcttcaaggaatggaa

SEQ ID NO: 719805 - DNA, 22 bp, Artificial Sequence
  chemically synthesized
cccactcctctttccattcctt

SEQ ID NO: 719806 - DNA, 22 bp, Artificial Sequence
  chemically synthesized
taaagctgtcttcaaggaatgg

SEQ ID NO: 719807 - DNA, 22 bp, Artificial Sequence
  chemically synthesized
ctctttccattccttgaagaca

SEQ ID NO: 719808 - DNA, 22 bp, Artificial Sequence
  chemically synthesized
tttccattccttgaagacagct

SEQ ID NO: 719809 - DNA, 22 bp, Artificial Sequence
  chemically synthesized
tccattccttgaagacagcttt

SEQ ID NO: 719810 - DNA, 22 bp, Artificial Sequence
  chemically synthesized
ccattccttgaagacagcttta

SEQ ID NO: 719811 - DNA, 22 bp, Artificial Sequence
  chemically synthesized
cattccttgaagacagctttag

SEQ ID NO: 719812 - DNA, 22 bp, Artificial Sequence
  chemically synthesized
gggtgggagcagtctctaaagc

SEQ ID NO: 719813 - DNA, 22 bp, Artificial Sequence
  chemically synthesized
cttgaagacagctttagagact

SEQ ID NO: 719814 - DNA, 22 bp, Artificial Sequence
  chemically synthesized
gaagacagctttagagactgct

SEQ ID NO: 719815 - DNA, 22 bp, Artificial Sequence
  chemically synthesized
aagacagctttagagactgctc

SEQ ID NO: 719816 - DNA, 22 bp, Artificial Sequence
  chemically synthesized
tagagactgctcccacccgagc

SEQ ID NO: 719817 - DNA, 22 bp, Artificial Sequence
  chemically synthesized
agagactgctcccacccgagct

SEQ ID NO: 719818 - DNA, 22 bp, Artificial Sequence
  chemically synthesized
gagactgctcccacccgagctc

SEQ ID NO: 719819 - DNA, 22 bp, Artificial Sequence
  chemically synthesized
ggatgagtcagggagagctcgg

SEQ ID NO: 719820 - DNA, 22 bp, Artificial Sequence
  chemically synthesized
ctcccacccgagctctccctga

SEQ ID NO: 719821 - DNA, 22 bp, Artificial Sequence
  chemically synthesized
ccacccgagctctccctgactc

SEQ ID NO: 719822 - DNA, 22 bp, Artificial Sequence
  chemically synthesized
tccctgactcatcccaaccctt

SEQ ID NO: 719823 - DNA, 22 bp, Artificial Sequence
  chemically synthesized
cctgactcatcccaaccctttt

SEQ ID NO: 719824 - DNA, 22 bp, Artificial Sequence
  chemically synthesized
agcggtgtgtaatgaaaagggt

SEQ ID NO: 719825 - DNA, 22 bp, Artificial Sequence
  chemically synthesized
cagcggtgtgtaatgaaaaggg

SEQ ID NO: 719826 - DNA, 22 bp, Artificial Sequence
  chemically synthesized
actcatcccaacccttttcatt

SEQ ID NO: 719827 - DNA, 22 bp, Artificial Sequence
  chemically synthesized
atcccaacccttttcattacac

SEQ ID NO: 719828 - DNA, 22 bp, Artificial Sequence
  chemically synthesized
cacttcagcggtgtgtaatgaa

SEQ ID NO: 719829 - DNA, 22 bp, Artificial Sequence
  chemically synthesized
cacagccctgcacttcagcggt

SEQ ID NO: 719830 - DNA, 22 bp, Artificial Sequence
  chemically synthesized
ttcattacacaccgctgaagtg

SEQ ID NO: 719831 - DNA, 22 bp, Artificial Sequence
  chemically synthesized
tcattacacaccgctgaagtgc

SEQ ID NO: 719832 - DNA, 22 bp, Artificial Sequence
  chemically synthesized
cattacacaccgctgaagtgca

SEQ ID NO: 719833 - DNA, 22 bp, Artificial Sequence
  chemically synthesized
actgcacagccctgcacttcag

SEQ ID NO: 719834 - DNA, 22 bp, Artificial Sequence
  chemically synthesized
attacacaccgctgaagtgcag

SEQ ID NO: 719835 - DNA, 22 bp, Artificial Sequence
  chemically synthesized
cacaccgctgaagtgcagggct

SEQ ID NO: 719836 - DNA, 22 bp, Artificial Sequence
  chemically synthesized
tgtaagaatcctgactgcacag

SEQ ID NO: 719837 - DNA, 22 bp, Artificial Sequence
  chemically synthesized
atgtaagaatcctgactgcaca

SEQ ID NO: 719838 - DNA, 22 bp, Artificial Sequence
  chemically synthesized
aagtgcagggctgtgcagtcag

SEQ ID NO: 719839 - DNA, 22 bp, Artificial Sequence
  chemically synthesized
tgcagtcaggattcttacataa

SEQ ID NO: 719840 - DNA, 22 bp, Artificial Sequence
  chemically synthesized
caggacgtgatcccagtcctta

SEQ ID NO: 719841 - DNA, 22 bp, Artificial Sequence
  chemically synthesized
ttacataaggactgggatcacg

SEQ ID NO: 719842 - DNA, 22 bp, Artificial Sequence
  chemically synthesized
acataaggactgggatcacgtc

SEQ ID NO: 719843 - DNA, 22 bp, Artificial Sequence
  chemically synthesized
cataaggactgggatcacgtcc

SEQ ID NO: 719844 - DNA, 22 bp, Artificial Sequence
  chemically synthesized
gataaaaaggctacaggacgtg

SEQ ID NO: 719845 - DNA, 22 bp, Artificial Sequence
  chemically synthesized
ggataaaaaggctacaggacgt

SEQ ID NO: 719846 - DNA, 22 bp, Artificial Sequence
  chemically synthesized
tttggataaaaaggctacagga

SEQ ID NO: 719847 - DNA, 22 bp, Artificial Sequence
  chemically synthesized
ggatcacgtcctgtagcctttt

SEQ ID NO: 719848 - DNA, 22 bp, Artificial Sequence
  chemically synthesized
tagcctttttatccaaacaact

SEQ ID NO: 719849 - DNA, 22 bp, Artificial Sequence
  chemically synthesized
ggcaaaacagtaaggtcaagtt

SEQ ID NO: 719850 - DNA, 22 bp, Artificial Sequence
  chemically synthesized
tttatccaaacaacttgacctt

SEQ ID NO: 719851 - DNA, 22 bp, Artificial Sequence
  chemically synthesized
ttatccaaacaacttgacctta

SEQ ID NO: 719852 - DNA, 22 bp, Artificial Sequence
  chemically synthesized
tatccaaacaacttgaccttac

SEQ ID NO: 719853 - DNA, 22 bp, Artificial Sequence
  chemically synthesized
atccaaacaacttgaccttact

SEQ ID NO: 719854 - DNA, 22 bp, Artificial Sequence
  chemically synthesized
tccaaacaacttgaccttactg

SEQ ID NO: 719855 - DNA, 22 bp, Artificial Sequence
  chemically synthesized
gaccttactgttttgcctagcc

SEQ ID NO: 719856 - DNA, 22 bp, Artificial Sequence
  chemically synthesized
accttactgttttgcctagccc

SEQ ID NO: 719857 - DNA, 22 bp, Artificial Sequence
  chemically synthesized
ccgcacgcagacatgagggcta

SEQ ID NO: 719858 - DNA, 22 bp, Artificial Sequence
  chemically synthesized
actgttttgcctagccctcatg

SEQ ID NO: 719859 - DNA, 22 bp, Artificial Sequence
  chemically synthesized
ctgttttgcctagccctcatgt

SEQ ID NO: 719860 - DNA, 22 bp, Artificial Sequence
  chemically synthesized
ttttgcctagccctcatgtctg

SEQ ID NO: 719861 - DNA, 22 bp, Artificial Sequence
  chemically synthesized
tgcctagccctcatgtctgcgt

SEQ ID NO: 719862 - DNA, 22 bp, Artificial Sequence
  chemically synthesized
gcctagccctcatgtctgcgtg

SEQ ID NO: 719863 - DNA, 22 bp, Artificial Sequence
  chemically synthesized
cctagccctcatgtctgcgtgc

SEQ ID NO: 719864 - DNA, 22 bp, Artificial Sequence
  chemically synthesized
gccctcatgtctgcgtgcggca

SEQ ID NO: 719865 - DNA, 22 bp, Artificial Sequence
  chemically synthesized
gggtggtggcggctgccgcacg

SEQ ID NO: 719866 - DNA, 22 bp, Artificial Sequence
  chemically synthesized
atgtctgcgtgcggcagccgcc

SEQ ID NO: 719867 - DNA, 22 bp, Artificial Sequence
  chemically synthesized
aaagtattagggtggtggcggc

SEQ ID NO: 719868 - DNA, 22 bp, Artificial Sequence
  chemically synthesized
taaaagtattagggtggtggcg

SEQ ID NO: 719869 - DNA, 22 bp, Artificial Sequence
  chemically synthesized
cgtgcggcagccgccaccaccc

SEQ ID NO: 719870 - DNA, 22 bp, Artificial Sequence
  chemically synthesized
agggcctctaaaagtattaggg

SEQ ID NO: 719871 - DNA, 22 bp, Artificial Sequence
  chemically synthesized
gagggcctctaaaagtattagg

SEQ ID NO: 719872 - DNA, 22 bp, Artificial Sequence
  chemically synthesized
tgagggcctctaaaagtattag

SEQ ID NO: 719873 - DNA, 22 bp, Artificial Sequence
  chemically synthesized
tgattttgagggcctctaaaag

SEQ ID NO: 719874 - DNA, 22 bp, Artificial Sequence
  chemically synthesized
gtgattttgagggcctctaaaa

SEQ ID NO: 719875 - DNA, 22 bp, Artificial Sequence
  chemically synthesized
atacttttagaggccctcaaaa

SEQ ID NO: 719876 - DNA, 22 bp, Artificial Sequence
  chemically synthesized
agcatagtttgtgattttgagg

SEQ ID NO: 719877 - DNA, 22 bp, Artificial Sequence
  chemically synthesized
ttagaggccctcaaaatcacaa

SEQ ID NO: 719878 - DNA, 22 bp, Artificial Sequence
  chemically synthesized
tagaggccctcaaaatcacaaa

SEQ ID NO: 719879 - DNA, 22 bp, Artificial Sequence
  chemically synthesized
agaggccctcaaaatcacaaac

SEQ ID NO: 719880 - DNA, 22 bp, Artificial Sequence
  chemically synthesized
gaggccctcaaaatcacaaact

SEQ ID NO: 719881 - DNA, 22 bp, Artificial Sequence
  chemically synthesized
tagagagtgagttgagcatagt

SEQ ID NO: 719882 - DNA, 22 bp, Artificial Sequence
  chemically synthesized
aaaatcacaaactatgctcaac

SEQ ID NO: 719883 - DNA, 22 bp, Artificial Sequence
  chemically synthesized
tgagaactgtagagagtgagtt

SEQ ID NO: 719884 - DNA, 22 bp, Artificial Sequence
  chemically synthesized
tgctcaactcactctctacagt

SEQ ID NO: 719885 - DNA, 22 bp, Artificial Sequence
  chemically synthesized
gaagttatgagaactgtagaga

SEQ ID NO: 719886 - DNA, 22 bp, Artificial Sequence
  chemically synthesized
ggaagttatgagaactgtagag

SEQ ID NO: 719887 - DNA, 22 bp, Artificial Sequence
  chemically synthesized
tggaagttatgagaactgtaga

SEQ ID NO: 719888 - DNA, 22 bp, Artificial Sequence
  chemically synthesized
aactcactctctacagttctca

SEQ ID NO: 719889 - DNA, 22 bp, Artificial Sequence
  chemically synthesized
actctctacagttctcataact

SEQ ID NO: 719890 - DNA, 22 bp, Artificial Sequence
  chemically synthesized
tctacagttctcataacttcca

SEQ ID NO: 719891 - DNA, 22 bp, Artificial Sequence
  chemically synthesized
tacagttctcataacttccaaa

SEQ ID NO: 719892 - DNA, 22 bp, Artificial Sequence
  chemically synthesized
cagttctcataacttccaaaat

SEQ ID NO: 719893 - DNA, 22 bp, Artificial Sequence
  chemically synthesized
tcataacttccaaaatctattt

SEQ ID NO: 719894 - DNA, 22 bp, Artificial Sequence
  chemically synthesized
ataacttccaaaatctattttc

SEQ ID NO: 719895 - DNA, 22 bp, Artificial Sequence
  chemically synthesized
ccaaaatctattttcttcctca

SEQ ID NO: 719896 - DNA, 22 bp, Artificial Sequence
  chemically synthesized
caaaatctattttcttcctcac

SEQ ID NO: 719897 - DNA, 22 bp, Artificial Sequence
  chemically synthesized
ttttcttcctcacacctgacgc

SEQ ID NO: 719898 - DNA, 22 bp, Artificial Sequence
  chemically synthesized
tcttcctcacacctgacgcata

SEQ ID NO: 719899 - DNA, 22 bp, Artificial Sequence
  chemically synthesized
cttcctcacacctgacgcatat

SEQ ID NO: 719900 - DNA, 22 bp, Artificial Sequence
  chemically synthesized
ttcctcacacctgacgcatatg

SEQ ID NO: 719901 - DNA, 22 bp, Artificial Sequence
  chemically synthesized
cctcacacctgacgcatatgct

SEQ ID NO: 719902 - DNA, 22 bp, Artificial Sequence
  chemically synthesized
ctcacacctgacgcatatgctt

SEQ ID NO: 719903 - DNA, 22 bp, Artificial Sequence
  chemically synthesized
acacctgacgcatatgctttct

SEQ ID NO: 719904 - DNA, 22 bp, Artificial Sequence
  chemically synthesized
aaggagccggggagcagaaagc

SEQ ID NO: 719905 - DNA, 22 bp, Artificial Sequence
  chemically synthesized
acgcatatgctttctgctcccc

SEQ ID NO: 719906 - DNA, 22 bp, Artificial Sequence
  chemically synthesized
tctgctccccggctccttcagc

SEQ ID NO: 719907 - DNA, 22 bp, Artificial Sequence
  chemically synthesized
ctgctccccggctccttcagct

SEQ ID NO: 719908 - DNA, 22 bp, Artificial Sequence
  chemically synthesized
tgctccccggctccttcagctg

SEQ ID NO: 719909 - DNA, 22 bp, Artificial Sequence
  chemically synthesized
ctccccggctccttcagctgta

SEQ ID NO: 719910 - DNA, 22 bp, Artificial Sequence
  chemically synthesized
aacaaagagtgagtacagctga

SEQ ID NO: 719911 - DNA, 22 bp, Artificial Sequence
  chemically synthesized
cccggctccttcagctgtactc

SEQ ID NO: 719912 - DNA, 22 bp, Artificial Sequence
  chemically synthesized
cttcagctgtactcactctttg

SEQ ID NO: 719913 - DNA, 22 bp, Artificial Sequence
  chemically synthesized
tgggagactcaacaaagagtga

SEQ ID NO: 719914 - DNA, 22 bp, Artificial Sequence
  chemically synthesized
cagctgtactcactctttgttg

SEQ ID NO: 719915 - DNA, 22 bp, Artificial Sequence
  chemically synthesized
agctgtactcactctttgttga

SEQ ID NO: 719916 - DNA, 22 bp, Artificial Sequence
  chemically synthesized
tactcactctttgttgagtctc

SEQ ID NO: 719917 - DNA, 22 bp, Artificial Sequence
  chemically synthesized
actctttgttgagtctcccaca

SEQ ID NO: 719918 - DNA, 22 bp, Artificial Sequence
  chemically synthesized
tttgttgagtctcccacaatta

SEQ ID NO: 719919 - DNA, 22 bp, Artificial Sequence
  chemically synthesized
tgttgagtctcccacaattacc

SEQ ID NO: 719920 - DNA, 22 bp, Artificial Sequence
  chemically synthesized
gttgagtctcccacaattacca

SEQ ID NO: 719921 - DNA, 22 bp, Artificial Sequence
  chemically synthesized
ggccaggaacaatggtaattgt

SEQ ID NO: 719922 - DNA, 22 bp, Artificial Sequence
  chemically synthesized
ttgagtctcccacaattaccat

SEQ ID NO: 719923 - DNA, 22 bp, Artificial Sequence
  chemically synthesized
agtctcccacaattaccattgt

SEQ ID NO: 719924 - DNA, 22 bp, Artificial Sequence
  chemically synthesized
aagtctgggccaggaacaatgg

SEQ ID NO: 719925 - DNA, 22 bp, Artificial Sequence
  chemically synthesized
ccacaattaccattgttcctgg

SEQ ID NO: 719926 - DNA, 22 bp, Artificial Sequence
  chemically synthesized
ccattgttcctggcccagactt

SEQ ID NO: 719927 - DNA, 22 bp, Artificial Sequence
  chemically synthesized
ttcctggcccagacttcaatcc

SEQ ID NO: 719928 - DNA, 22 bp, Artificial Sequence
  chemically synthesized
ctggcccagacttcaatccggc

SEQ ID NO: 719929 - DNA, 22 bp, Artificial Sequence
  chemically synthesized
gcccagacttcaatccggcctc

SEQ ID NO: 719930 - DNA, 22 bp, Artificial Sequence
  chemically synthesized
caatccggcctcccacattatt

SEQ ID NO: 719931 - DNA, 22 bp, Artificial Sequence
  chemically synthesized
aatccggcctcccacattattc

SEQ ID NO: 719932 - DNA, 22 bp, Artificial Sequence
  chemically synthesized
ccacattattcctgataccacg

SEQ ID NO: 719933 - DNA, 22 bp, Artificial Sequence
  chemically synthesized
ttcctgataccacgcctgaccc

SEQ ID NO: 719934 - DNA, 22 bp, Artificial Sequence
  chemically synthesized
ctgataccacgcctgaccccca

SEQ ID NO: 719935 - DNA, 22 bp, Artificial Sequence
  chemically synthesized
ataccacgcctgacccccatga

SEQ ID NO: 719936 - DNA, 22 bp, Artificial Sequence
  chemically synthesized
gtggatcagagatacagtcatg

SEQ ID NO: 719937 - DNA, 22 bp, Artificial Sequence
  chemically synthesized
acccccatgactgtatctctga

SEQ ID NO: 719938 - DNA, 22 bp, Artificial Sequence
  chemically synthesized
aatgtctggtggatcagagata

SEQ ID NO: 719939 - DNA, 22 bp, Artificial Sequence
  chemically synthesized
tatctctgatccaccagacatt

SEQ ID NO: 719940 - DNA, 22 bp, Artificial Sequence
  chemically synthesized
tgatccaccagacattcaaccc

SEQ ID NO: 719941 - DNA, 22 bp, Artificial Sequence
  chemically synthesized
atccaccagacattcaacccca

SEQ ID NO: 719942 - DNA, 22 bp, Artificial Sequence
  chemically synthesized
aaccccatttccccatatttcc

SEQ ID NO: 719943 - DNA, 22 bp, Artificial Sequence
  chemically synthesized
ccccatatttccttctttcctg

SEQ ID NO: 719944 - DNA, 22 bp, Artificial Sequence
  chemically synthesized
cccatatttccttctttcctgt

SEQ ID NO: 719945 - DNA, 22 bp, Artificial Sequence
  chemically synthesized
ccttctttcctgttcctcaccc

SEQ ID NO: 719946 - DNA, 22 bp, Artificial Sequence
  chemically synthesized
cttctttcctgttcctcaccct

SEQ ID NO: 719947 - DNA, 22 bp, Artificial Sequence
  chemically synthesized
ctttcctgttcctcaccctgat

SEQ ID NO: 719948 - DNA, 22 bp, Artificial Sequence
  chemically synthesized
tttcctgttcctcaccctgatc

SEQ ID NO: 719949 - DNA, 22 bp, Artificial Sequence
  chemically synthesized
tcctgttcctcaccctgatcac

SEQ ID NO: 719950 - DNA, 22 bp, Artificial Sequence
  chemically synthesized
cctgttcctcaccctgatcaca

SEQ ID NO: 719951 - DNA, 22 bp, Artificial Sequence
  chemically synthesized
ctgttcctcaccctgatcacac

SEQ ID NO: 719952 - DNA, 22 bp, Artificial Sequence
  chemically synthesized
ttcctcaccctgatcacacttg

SEQ ID NO: 719953 - DNA, 22 bp, Artificial Sequence
  chemically synthesized
ccatcaataaaccaagtgtgat

SEQ ID NO: 719954 - DNA, 22 bp, Artificial Sequence
  chemically synthesized
ctcaccctgatcacacttggtt

SEQ ID NO: 719955 - DNA, 22 bp, Artificial Sequence
  chemically synthesized
accctgatcacacttggtttat

SEQ ID NO: 719956 - DNA, 22 bp, Artificial Sequence
  chemically synthesized
gtggaactgccatcaataaacc

SEQ ID NO: 719957 - DNA, 22 bp, Artificial Sequence
  chemically synthesized
atcacacttggtttattgatgg

SEQ ID NO: 719958 - DNA, 22 bp, Artificial Sequence
  chemically synthesized
ggcctggtggaactgccatcaa

SEQ ID NO: 719959 - DNA, 22 bp, Artificial Sequence
  chemically synthesized
ggtttattgatggcagttccac

SEQ ID NO: 719960 - DNA, 22 bp, Artificial Sequence
  chemically synthesized
gtttattgatggcagttccacc

SEQ ID NO: 719961 - DNA, 22 bp, Artificial Sequence
  chemically synthesized
attgatggcagttccaccaggc

SEQ ID NO: 719962 - DNA, 22 bp, Artificial Sequence
  chemically synthesized
ttgatggcagttccaccaggcc

SEQ ID NO: 719963 - DNA, 22 bp, Artificial Sequence
  chemically synthesized
gtgtgtggccattaggcctggt

SEQ ID NO: 719964 - DNA, 22 bp, Artificial Sequence
  chemically synthesized
atggcagttccaccaggcctaa

SEQ ID NO: 719965 - DNA, 22 bp, Artificial Sequence
  chemically synthesized
ctggtgtgtggccattaggcct

SEQ ID NO: 719966 - DNA, 22 bp, Artificial Sequence
  chemically synthesized
gctggtgtgtggccattaggcc

SEQ ID NO: 719967 - DNA, 22 bp, Artificial Sequence
  chemically synthesized
tgctggtgtgtggccattaggc

SEQ ID NO: 719968 - DNA, 22 bp, Artificial Sequence
  chemically synthesized
cctttgctggtgtgtggccatt

SEQ ID NO: 719969 - DNA, 22 bp, Artificial Sequence
  chemically synthesized
caccaggcctaatggccacaca

SEQ ID NO: 719970 - DNA, 22 bp, Artificial Sequence
  chemically synthesized
tagcatagcctgcctttgctgg

SEQ ID NO: 719971 - DNA, 22 bp, Artificial Sequence
  chemically synthesized
atggccacacaccagcaaaggc

SEQ ID NO: 719972 - DNA, 22 bp, Artificial Sequence
  chemically synthesized
tactatagcatagcctgccttt

SEQ ID NO: 719973 - DNA, 22 bp, Artificial Sequence
  chemically synthesized
gtactatagcatagcctgcctt

SEQ ID NO: 719974 - DNA, 22 bp, Artificial Sequence
  chemically synthesized
gtggcttgtactatagcatagc

SEQ ID NO: 719975 - DNA, 22 bp, Artificial Sequence
  chemically synthesized
agaggcaggctagtggcttgta

SEQ ID NO: 719976 - DNA, 22 bp, Artificial Sequence
  chemically synthesized
taagaggcaggctagtggcttg

SEQ ID NO: 719977 - DNA, 22 bp, Artificial Sequence
  chemically synthesized
tgctatagtacaagccactagc

SEQ ID NO: 719978 - DNA, 22 bp, Artificial Sequence
  chemically synthesized
tagtacaagccactagcctgcc

SEQ ID NO: 719979 - DNA, 22 bp, Artificial Sequence
  chemically synthesized
gcctgcctcttagaacttctca

SEQ ID NO: 719980 - DNA, 22 bp, Artificial Sequence
  chemically synthesized
cacgatggaaaggaaatgagaa

SEQ ID NO: 719981 - DNA, 22 bp, Artificial Sequence
  chemically synthesized
cctcttagaacttctcatttcc

SEQ ID NO: 719982 - DNA, 22 bp, Artificial Sequence
  chemically synthesized
ccacgatggaaaggaaatgaga

SEQ ID NO: 719983 - DNA, 22 bp, Artificial Sequence
  chemically synthesized
ttagaacttctcatttcctttc

SEQ ID NO: 719984 - DNA, 22 bp, Artificial Sequence
  chemically synthesized
agaacttctcatttcctttcca

SEQ ID NO: 719985 - DNA, 22 bp, Artificial Sequence
  chemically synthesized
gaacttctcatttcctttccat

SEQ ID NO: 719986 - DNA, 22 bp, Artificial Sequence
  chemically synthesized
aggatagatttccacgatggaa

SEQ ID NO: 719987 - DNA, 22 bp, Artificial Sequence
  chemically synthesized
gaggatagatttccacgatgga

SEQ ID NO: 719988 - DNA, 22 bp, Artificial Sequence
  chemically synthesized
ctcatttcctttccatcgtgga

SEQ ID NO: 719989 - DNA, 22 bp, Artificial Sequence
  chemically synthesized
tgaggatagatttccacgatgg

SEQ ID NO: 719990 - DNA, 22 bp, Artificial Sequence
  chemically synthesized
tcatttcctttccatcgtggaa

SEQ ID NO: 719991 - DNA, 22 bp, Artificial Sequence
  chemically synthesized
tttgaggatagatttccacgat

SEQ ID NO: 719992 - DNA, 22 bp, Artificial Sequence
  chemically synthesized
atttcctttccatcgtggaaat

SEQ ID NO: 719993 - DNA, 22 bp, Artificial Sequence
  chemically synthesized
ctttgaggatagatttccacga

SEQ ID NO: 719994 - DNA, 22 bp, Artificial Sequence
  chemically synthesized
tttctttgaggatagatttcca

SEQ ID NO: 719995 - DNA, 22 bp, Artificial Sequence
  chemically synthesized
cctttccatcgtggaaatctat

SEQ ID NO: 719996 - DNA, 22 bp, Artificial Sequence
  chemically synthesized
ctttccatcgtggaaatctatc

SEQ ID NO: 719997 - DNA, 22 bp, Artificial Sequence
  chemically synthesized
tccatcgtggaaatctatcctc

SEQ ID NO: 719998 - DNA, 22 bp, Artificial Sequence
  chemically synthesized
ccatcgtggaaatctatcctca

SEQ ID NO: 719999 - DNA, 22 bp, Artificial Sequence
  chemically synthesized
catcgtggaaatctatcctcaa

SEQ ID NO: 720000 - DNA, 22 bp, Artificial Sequence
  chemically synthesized
agaagttatttctttgaggata

SEQ ID NO: 720001 - DNA, 22 bp, Artificial Sequence
  chemically synthesized
tcctcaaagaaataacttctca

SEQ ID NO: 720002 - DNA, 22 bp, Artificial Sequence
  chemically synthesized
aaagaaataacttctcagtgtt

SEQ ID NO: 720003 - DNA, 22 bp, Artificial Sequence
  chemically synthesized
aggagtagtagaatagcagatg

SEQ ID NO: 720004 - DNA, 22 bp, Artificial Sequence
  chemically synthesized
ctcagtgttccatctgctattc

SEQ ID NO: 720005 - DNA, 22 bp, Artificial Sequence
  chemically synthesized
tcagtgttccatctgctattct

SEQ ID NO: 720006 - DNA, 22 bp, Artificial Sequence
  chemically synthesized
agtgttccatctgctattctac

SEQ ID NO: 720007 - DNA, 22 bp, Artificial Sequence
  chemically synthesized
aataatccctgaggagtagtag

SEQ ID NO: 720008 - DNA, 22 bp, Artificial Sequence
  chemically synthesized
catctgctattctactactcct

SEQ ID NO: 720009 - DNA, 22 bp, Artificial Sequence
  chemically synthesized
ctattctactactcctcaggga

SEQ ID NO: 720010 - DNA, 22 bp, Artificial Sequence
  chemically synthesized
ttctactactcctcagggatta

SEQ ID NO: 720011 - DNA, 22 bp, Artificial Sequence
  chemically synthesized
tactactcctcagggattattc

SEQ ID NO: 720012 - DNA, 22 bp, Artificial Sequence
  chemically synthesized
ctactcctcagggattattcag

SEQ ID NO: 720013 - DNA, 22 bp, Artificial Sequence
  chemically synthesized
ctcctcagggattattcaggcc

SEQ ID NO: 720014 - DNA, 22 bp, Artificial Sequence
  chemically synthesized
ctcagggattattcaggccccc

SEQ ID NO: 720015 - DNA, 22 bp, Artificial Sequence
  chemically synthesized
agggattattcaggccccctcc

SEQ ID NO: 720016 - DNA, 22 bp, Artificial Sequence
  chemically synthesized
atgtgtggggaagggagggggc

SEQ ID NO: 720017 - DNA, 22 bp, Artificial Sequence
  chemically synthesized
gatgtgtggggaagggaggggg

SEQ ID NO: 720018 - DNA, 22 bp, Artificial Sequence
  chemically synthesized
ttcaggccccctcccttcccca

SEQ ID NO: 720019 - DNA, 22 bp, Artificial Sequence
  chemically synthesized
gaacttgatgtgtggggaaggg
